United States Patent 7,901,882 (ANALYSIS OF METHYLATION USING NUCLEIC ACID ARRAYS) - sequence listing, part 10

SEQ ID NO: 355026 - DNA, 25 bp, Mus musculus
cctactgagggtgtacatggagatc

SEQ ID NO: 355027 - DNA, 25 bp, Mus musculus
tacatggagatctccgtggacggca

SEQ ID NO: 355028 - DNA, 25 bp, Mus musculus
gacggcagggtgttgaagcccttca

SEQ ID NO: 355029 - DNA, 25 bp, Mus musculus
tgttgaagcccttcacgcccacggg

SEQ ID NO: 355030 - DNA, 25 bp, Mus musculus
cgcagctgtttgtggcggtcgataa

SEQ ID NO: 355031 - DNA, 25 bp, Mus musculus
tgctgtccttctggatacagttgtg

SEQ ID NO: 355032 - DNA, 25 bp, Mus musculus
cggtcgataaacatgtgcacggcca

SEQ ID NO: 355033 - DNA, 25 bp, Mus musculus
agctgttatccctgtccgagttgta

SEQ ID NO: 355034 - DNA, 25 bp, Mus musculus
cctggagaaagctgttatccctgtc

SEQ ID NO: 355035 - DNA, 25 bp, Mus musculus
atacagttgtggacctggagaaagc

SEQ ID NO: 355036 - DNA, 25 bp, Mus musculus
cgagcagccgcggttattgttgttg

SEQ ID NO: 355037 - DNA, 25 bp, Mus musculus
tcctgttccacagttccggaatgag

SEQ ID NO: 355038 - DNA, 25 bp, Mus musculus
cctgcgctctgtagccggccaggag

SEQ ID NO: 355039 - DNA, 25 bp, Mus musculus
cgtggtgctgaactggacaactccc

SEQ ID NO: 355040 - DNA, 25 bp, Mus musculus
gctggactggacagctctcggagca

SEQ ID NO: 355041 - DNA, 25 bp, Mus musculus
gaccgggcgctctcacctacagcat

SEQ ID NO: 355042 - DNA, 25 bp, Mus musculus
catcgccgtagtgctgaagtggaca

SEQ ID NO: 355043 - DNA, 25 bp, Mus musculus
cgtccacttactgcatcgccgtagt

SEQ ID NO: 355044 - DNA, 25 bp, Mus musculus
ggccgggctcgtccacttactgcat

SEQ ID NO: 355045 - DNA, 25 bp, Mus musculus
tcccagctacagcatcgccgtggtg

SEQ ID NO: 355046 - DNA, 25 bp, Mus musculus
ctagccggcgtcttgcagcaggcag

SEQ ID NO: 355047 - DNA, 25 bp, Mus musculus
agctcctcggaagccagcgagcgag

SEQ ID NO: 355048 - DNA, 25 bp, Mus musculus
cacagttccggaatgagcgctggcc

SEQ ID NO: 355049 - DNA, 25 bp, Mus musculus
gatccgcaaagctcctcggaagcca

SEQ ID NO: 355050 - DNA, 25 bp, Mus musculus
aatggattcgcccacactgagaggg

SEQ ID NO: 355051 - DNA, 25 bp, Mus musculus
agcccaaccaggatgcagccggagg

SEQ ID NO: 355052 - DNA, 25 bp, Mus musculus
gcgggaattaatggggctttctgat

SEQ ID NO: 355053 - DNA, 25 bp, Mus musculus
ggctttctgattggccagagcatgg

SEQ ID NO: 355054 - DNA, 25 bp, Mus musculus
tggccagagcatggctttaaccatc

SEQ ID NO: 355055 - DNA, 25 bp, Mus musculus
tggctttaaccatcgcgaagagttt

SEQ ID NO: 355056 - DNA, 25 bp, Mus musculus
cgaagagtttgggattcgctgcacc

SEQ ID NO: 355057 - DNA, 25 bp, Mus musculus
gagtttgggattcgctgcaccttgc

SEQ ID NO: 355058 - DNA, 25 bp, Mus musculus
tcctgggaatggattcgcccacact

SEQ ID NO: 355059 - DNA, 25 bp, Mus musculus
cccacactgagaggggtgacgccgc

SEQ ID NO: 355060 - DNA, 25 bp, Mus musculus
gcaccgcctagcgtctctggagacg

SEQ ID NO: 355061 - DNA, 25 bp, Mus musculus
ctgcgcagtaaaggaagctgctgtc

SEQ ID NO: 355062 - DNA, 25 bp, Mus musculus
ggagacgcagcccaaccaggatgca

SEQ ID NO: 355063 - DNA, 25 bp, Mus musculus
tgacgccgctgaaatggcgcctgcg

SEQ ID NO: 355064 - DNA, 25 bp, Mus musculus
gctctcaccctaaggctggccatgg

SEQ ID NO: 355065 - DNA, 25 bp, Mus musculus
tcaccctaaggctggccatggtgct

SEQ ID NO: 355066 - DNA, 25 bp, Mus musculus
cctaaggctggccatggtgctgcgt

SEQ ID NO: 355067 - DNA, 25 bp, Mus musculus
tctgcggaatggtcctggcggactt

SEQ ID NO: 355068 - DNA, 25 bp, Mus musculus
ggctccacgggcgagaattttctgg

SEQ ID NO: 355069 - DNA, 25 bp, Mus musculus
ggcgagaattttctggcccgaggca

SEQ ID NO: 355070 - DNA, 25 bp, Mus musculus
cgctctcagggagtcacggtgttgc

SEQ ID NO: 355071 - DNA, 25 bp, Mus musculus
cttccgctgcggtgagccctgcggt

SEQ ID NO: 355072 - DNA, 25 bp, Mus musculus
acgtgttgctggagcccttccgctg

SEQ ID NO: 355073 - DNA, 25 bp, Mus musculus
cgcggacgtgttgctggagcccttc

SEQ ID NO: 355074 - DNA, 25 bp, Mus musculus
agtcacggtgttgcggcgcatgtgc

SEQ ID NO: 355075 - DNA, 25 bp, Mus musculus
tagcgctggacctgaagcgctctca

SEQ ID NO: 355076 - DNA, 25 bp, Mus musculus
tgaagcgctctcagggagtcacggt

SEQ ID NO: 355077 - DNA, 25 bp, Mus musculus
cgctcgctagcgctggacctgaagc

SEQ ID NO: 355078 - DNA, 25 bp, Mus musculus
ggccaccagcagagactggagcgtt

SEQ ID NO: 355079 - DNA, 25 bp, Mus musculus
gcatctcggacaatgtcctctcgcg

SEQ ID NO: 355080 - DNA, 25 bp, Mus musculus
cgatctgggcatctcggacaatgtc

SEQ ID NO: 355081 - DNA, 25 bp, Mus musculus
cagagaggctccgatctgggcatct

SEQ ID NO: 355082 - DNA, 25 bp, Mus musculus
agactggagcgttctgccgctgtca

SEQ ID NO: 355083 - DNA, 25 bp, Mus musculus
tctcctgatctaaagggccaccagc

SEQ ID NO: 355084 - DNA, 25 bp, Mus musculus
ccaggggccatctcctgatctaaag

SEQ ID NO: 355085 - DNA, 25 bp, Mus musculus
gcattcaggaggctcgcccaggacc

SEQ ID NO: 355086 - DNA, 25 bp, Mus musculus
catgcccatggggtccgggcattca

SEQ ID NO: 355087 - DNA, 25 bp, Mus musculus
agctgagcgggccacatgcccatgg

SEQ ID NO: 355088 - DNA, 25 bp, Mus musculus
accgccaagctgagcgggccacatg

SEQ ID NO: 355089 - DNA, 25 bp, Mus musculus
agctcagcagctcagtcccgccgca

SEQ ID NO: 355090 - DNA, 25 bp, Mus musculus
cccggctcagcgcacagctcagcag

SEQ ID NO: 355091 - DNA, 25 bp, Mus musculus
ctgccgctgtcaagggcatacggga

SEQ ID NO: 355092 - DNA, 25 bp, Mus musculus
tatatcaaagaaggacgcgccaggc

SEQ ID NO: 355093 - DNA, 25 bp, Mus musculus
acgcgtccagcacccgaaggctggg

SEQ ID NO: 355094 - DNA, 25 bp, Mus musculus
gtcgtgtcccggcattcctctatat

SEQ ID NO: 355095 - DNA, 25 bp, Mus musculus
gtcccggcattcctctatatcaaag

SEQ ID NO: 355096 - DNA, 25 bp, Mus musculus
cacttggtggataccagcgcccggt

SEQ ID NO: 355097 - DNA, 25 bp, Mus musculus
aatggattccgccagccacttggtg

SEQ ID NO: 355098 - DNA, 25 bp, Mus musculus
caggcggccagaccgaatggattcc

SEQ ID NO: 355099 - DNA, 25 bp, Mus musculus
gcgcccggtagagcacctgatgtac

SEQ ID NO: 355100 - DNA, 25 bp, Mus musculus
tgagtaccaagacgcgtccagcacc

SEQ ID NO: 355101 - DNA, 25 bp, Mus musculus
tcccgggtgagtaccaagacgcgtc

SEQ ID NO: 355102 - DNA, 25 bp, Mus musculus
tactctttgcgtgcctggcgggtcc

SEQ ID NO: 355103 - DNA, 25 bp, Mus musculus
gctcctggtactctttgcgtgcctg

SEQ ID NO: 355104 - DNA, 25 bp, Mus musculus
acgtgtcgctcctggtactctttgc

SEQ ID NO: 355105 - DNA, 25 bp, Mus musculus
cgccaggcacgtgtcgctcctggta

SEQ ID NO: 355106 - DNA, 25 bp, Mus musculus
cgcaaaagtagctgggctggcactc

SEQ ID NO: 355107 - DNA, 25 bp, Mus musculus
cggctcgctgcactcagtcgcaaaa

SEQ ID NO: 355108 - DNA, 25 bp, Mus musculus
tcgcccttgcgctccgaagaagctg

SEQ ID NO: 355109 - DNA, 25 bp, Mus musculus
tccgaagaagctggagggttcaaac

SEQ ID NO: 355110 - DNA, 25 bp, Mus musculus
gggttctcaagtggcccgcaccatt

SEQ ID NO: 355111 - DNA, 25 bp, Mus musculus
ggtgaggagagaaacctctctcgta

SEQ ID NO: 355112 - DNA, 25 bp, Mus musculus
cctctctcgtagacagtcgggattc

SEQ ID NO: 355113 - DNA, 25 bp, Mus musculus
agtcgggattccgaacagcttctgc

SEQ ID NO: 355114 - DNA, 25 bp, Mus musculus
cagcttctgcgtcttcgcacgggag

SEQ ID NO: 355115 - DNA, 25 bp, Mus musculus
cttcgcacgggagtcttgtttgccc

SEQ ID NO: 355116 - DNA, 25 bp, Mus musculus
ccctcctcgtataatacttctcata

SEQ ID NO: 355117 - DNA, 25 bp, Mus musculus
gctatttgaagctcgaggtgacact

SEQ ID NO: 355118 - DNA, 25 bp, Mus musculus
gtgacactggggcagcgcgcaaccc

SEQ ID NO: 355119 - DNA, 25 bp, Mus musculus
cgggaaatggaaggtgcaacgtctc

SEQ ID NO: 355120 - DNA, 25 bp, Mus musculus
gatctacgacgacagtgaccagggc

SEQ ID NO: 355121 - DNA, 25 bp, Mus musculus
ttcatcaagacccacgaggacatcc

SEQ ID NO: 355122 - DNA, 25 bp, Mus musculus
gcagctcgatccctctttcatcaag

SEQ ID NO: 355123 - DNA, 25 bp, Mus musculus
atcagctccggcaaaagccactcgg

SEQ ID NO: 355124 - DNA, 25 bp, Mus musculus
ttcggccaccactctgtgtcattgc

SEQ ID NO: 355125 - DNA, 25 bp, Mus musculus
atcctggagaacttggatgcccggc

SEQ ID NO: 355126 - DNA, 25 bp, Mus musculus
acgcactttgccgactacgcgggca

SEQ ID NO: 355127 - DNA, 25 bp, Mus musculus
gacatcgatcgttgcagtgaccaca

SEQ ID NO: 355128 - DNA, 25 bp, Mus musculus
acgcgagtttgaggagcgccacatc

SEQ ID NO: 355129 - DNA, 25 bp, Mus musculus
tacctacccaagctgggccgcgatg

SEQ ID NO: 355130 - DNA, 25 bp, Mus musculus
tggacgcgtcctggtacctacccaa

SEQ ID NO: 355131 - DNA, 25 bp, Mus musculus
agccgctgaagttactggacgcgtc

SEQ ID NO: 355132 - DNA, 25 bp, Mus musculus
cgcaacttttccgagctctggtgtc

SEQ ID NO: 355133 - DNA, 25 bp, Mus musculus
ttccgccactggctgaatcagaacc

SEQ ID NO: 355134 - DNA, 25 bp, Mus musculus
tgcatcctcatgtcggtcgtctgtt

SEQ ID NO: 355135 - DNA, 25 bp, Mus musculus
cgtctgtttttcatgtcacctggtc

SEQ ID NO: 355136 - DNA, 25 bp, Mus musculus
tgtacccatggcttccgtctgcagt

SEQ ID NO: 355137 - DNA, 25 bp, Mus musculus
gggcgtccgtcactctcctttcagt

SEQ ID NO: 355138 - DNA, 25 bp, Mus musculus
ggccctgctttccacgatctagaca

SEQ ID NO: 355139 - DNA, 25 bp, Mus musculus
tctagacatgctcaccgccatcttg

SEQ ID NO: 355140 - DNA, 25 bp, Mus musculus
ccacctcagggtcggtgcagaacgc

SEQ ID NO: 355141 - DNA, 25 bp, Mus musculus
tttctaacgcggaggcctttgcgca

SEQ ID NO: 355142 - DNA, 25 bp, Mus musculus
cgcaagcacgttgcggcgtcccgaa

SEQ ID NO: 355143 - DNA, 25 bp, Mus musculus
gcgttgccaggaaaccttccgccta

SEQ ID NO: 355144 - DNA, 25 bp, Mus musculus
ctgaccgtgcccttgaccttgcggt

SEQ ID NO: 355145 - DNA, 25 bp, Mus musculus
caccgcagacttctggcggggctta

SEQ ID NO: 355146 - DNA, 25 bp, Mus musculus
ccttttgcagaatggggcgagttcc

SEQ ID NO: 355147 - DNA, 25 bp, Mus musculus
gaccttgcggtccactcgctcattg

SEQ ID NO: 355148 - DNA, 25 bp, Mus musculus
ctgtgtcagggcgaagagcttcaat

SEQ ID NO: 355149 - DNA, 25 bp, Mus musculus
acgctgtgtcgggagcagaagtcct

SEQ ID NO: 355150 - DNA, 25 bp, Mus musculus
gtgcggagggaaggatgcagacaac

SEQ ID NO: 355151 - DNA, 25 bp, Mus musculus
ggatgcagacaacgcggccggcgat

SEQ ID NO: 355152 - DNA, 25 bp, Mus musculus
cgaagagcttcaatcggacagggtg

SEQ ID NO: 355153 - DNA, 25 bp, Mus musculus
acccgccagacgctgtgtcgggagc

SEQ ID NO: 355154 - DNA, 25 bp, Mus musculus
tgtcgggagcagaagtccttcctca

SEQ ID NO: 355155 - DNA, 25 bp, Mus musculus
ggagcagaagtccttcctcagccgc

SEQ ID NO: 355156 - DNA, 25 bp, Mus musculus
agtccttcctcagccgcctgtgtca

SEQ ID NO: 355157 - DNA, 25 bp, Mus musculus
cagggcgaagagcttcaatcggaca

SEQ ID NO: 355158 - DNA, 25 bp, Mus musculus
agcttcaatcggacagggtgagccc

SEQ ID NO: 355159 - DNA, 25 bp, Mus musculus
cttcaatcggacagggtgagccctg

SEQ ID NO: 355160 - DNA, 25 bp, Mus musculus
aatcggacagggtgagccctgagcc

SEQ ID NO: 355161 - DNA, 25 bp, Mus musculus
acggtgttcctgaccacccgccaga

SEQ ID NO: 355162 - DNA, 25 bp, Mus musculus
caccagggttagctcagcgcctggc

SEQ ID NO: 355163 - DNA, 25 bp, Mus musculus
gagaaaggtgcagcccgcccccaag

SEQ ID NO: 355164 - DNA, 25 bp, Mus musculus
ggccaccagggttagctcagcgcct

SEQ ID NO: 355165 - DNA, 25 bp, Mus musculus
tctccctgctggagcagctgccgcc

SEQ ID NO: 355166 - DNA, 25 bp, Mus musculus
cccgccctctccctgctggagcagc

SEQ ID NO: 355167 - DNA, 25 bp, Mus musculus
attgctaatgacagcccgggcctcc

SEQ ID NO: 355168 - DNA, 25 bp, Mus musculus
acgattgctaatgacagcccgggcc

SEQ ID NO: 355169 - DNA, 25 bp, Mus musculus
gcccaggagaaaggtgcagcccgcc

SEQ ID NO: 355170 - DNA, 25 bp, Mus musculus
gatgcccaggagaaaggtgcagccc

SEQ ID NO: 355171 - DNA, 25 bp, Mus musculus
cacagagcacggacgagcagctgga

SEQ ID NO: 355172 - DNA, 25 bp, Mus musculus
gtgcacagagcacggacgagcagct

SEQ ID NO: 355173 - DNA, 25 bp, Mus musculus
agggttagctcagcgcctggcgcct

SEQ ID NO: 355174 - DNA, 25 bp, Mus musculus
cccaagaggacgattgctaatgaca

SEQ ID NO: 355175 - DNA, 25 bp, Mus musculus
agaggacgattgctaatgacagccc

SEQ ID NO: 355176 - DNA, 25 bp, Mus musculus
aagccctgcttgaagcggtaggaga

SEQ ID NO: 355177 - DNA, 25 bp, Mus musculus
ggtgcctgtacccactgacacgagg

SEQ ID NO: 355178 - DNA, 25 bp, Mus musculus
ctggcatgcgggtgcctgtacccac

SEQ ID NO: 355179 - DNA, 25 bp, Mus musculus
tgaccctgcgctcagagcggcgtcg

SEQ ID NO: 355180 - DNA, 25 bp, Mus musculus
accatgcgtgtgaccctgcgctcag

SEQ ID NO: 355181 - DNA, 25 bp, Mus musculus
cagaggacgaagagtgccaccacgg

SEQ ID NO: 355182 - DNA, 25 bp, Mus musculus
tgttgagcagatagaaaggcatcca

SEQ ID NO: 355183 - DNA, 25 bp, Mus musculus
ccacattgacgatgttgagcagata

SEQ ID NO: 355184 - DNA, 25 bp, Mus musculus
tccggcagcgggcacaccacattga

SEQ ID NO: 355185 - DNA, 25 bp, Mus musculus
ttggcgtagggcagcgccaccacca

SEQ ID NO: 355186 - DNA, 25 bp, Mus musculus
gatcctgcgaaagccctgcttgaag

SEQ ID NO: 355187 - DNA, 25 bp, Mus musculus
cgaatgcgacgtgatggtcttagca

SEQ ID NO: 355188 - DNA, 25 bp, Mus musculus
cgtgatggtcttagcaggatcctgc

SEQ ID NO: 355189 - DNA, 25 bp, Mus musculus
ccaccaccaggaagtagaggccgaa

SEQ ID NO: 355190 - DNA, 25 bp, Mus musculus
tcttatgtgtgctctcagacgagta

SEQ ID NO: 355191 - DNA, 25 bp, Mus musculus
ggcagccatgtatacctcctcgcga

SEQ ID NO: 355192 - DNA, 25 bp, Mus musculus
cgaactggaccttcttacgcagggc

SEQ ID NO: 355193 - DNA, 25 bp, Mus musculus
cggaagcgctcccagatcttatgtg

SEQ ID NO: 355194 - DNA, 25 bp, Mus musculus
ggagtaccctgagtagtaatgtctg

SEQ ID NO: 355195 - DNA, 25 bp, Mus musculus
ctgcgaataggtggagtctcgctta

SEQ ID NO: 355196 - DNA, 25 bp, Mus musculus
cttgaggaaggacacacgctggctc

SEQ ID NO: 355197 - DNA, 25 bp, Mus musculus
ggcgccctcctcgtagtagagagcg

SEQ ID NO: 355198 - DNA, 25 bp, Mus musculus
gagtcgctcttagccagtcccgtgg

SEQ ID NO: 355199 - DNA, 25 bp, Mus musculus
tggcacatccagactgaagaccttg

SEQ ID NO: 355200 - DNA, 25 bp, Mus musculus
tcttgatggagccactggacgacac

SEQ ID NO: 355201 - DNA, 25 bp, Mus musculus
tggacgacacgctgcaggtcttacg

SEQ ID NO: 355202 - DNA, 25 bp, Mus musculus
tttctcaatgtacttggagtcgctc

SEQ ID NO: 355203 - DNA, 25 bp, Mus musculus
cctcctcgcgatggtgtttcttgta

SEQ ID NO: 355204 - DNA, 25 bp, Mus musculus
tgacacagaaggtgtactcagtgtg

SEQ ID NO: 355205 - DNA, 25 bp, Mus musculus
gtgtgcgctcgcagcttgtccaacg

SEQ ID NO: 355206 - DNA, 25 bp, Mus musculus
agtgtgcgctcgcagcttgtccaac

SEQ ID NO: 355207 - DNA, 25 bp, Mus musculus
actcagtgtgcgctcgcagcttgtc

SEQ ID NO: 355208 - DNA, 25 bp, Mus musculus
gtgtactcagtgtgcgctcgcagct

SEQ ID NO: 355209 - DNA, 25 bp, Mus musculus
cagaaggtgtactcagtgtgcgctc

SEQ ID NO: 355210 - DNA, 25 bp, Mus musculus
ggtgacacagaaggtgtactcagtg

SEQ ID NO: 355211 - DNA, 25 bp, Mus musculus
cgaggtgacacagaaggtgtactca

SEQ ID NO: 355212 - DNA, 25 bp, Mus musculus
cagcgaggtgacacagaaggtgtac

SEQ ID NO: 355213 - DNA, 25 bp, Mus musculus
ctgttgcgcagcgaggtgacacaga

SEQ ID NO: 355214 - DNA, 25 bp, Mus musculus
aggtgtggttgaagcggcggctgtt

SEQ ID NO: 355215 - DNA, 25 bp, Mus musculus
tgaaggtcaggcaggtgtggttgaa

SEQ ID NO: 355216 - DNA, 25 bp, Mus musculus
atagtcatgatgtagtgcgtggtgg

SEQ ID NO: 355217 - DNA, 25 bp, Mus musculus
aaggtgtactcagtgtgcgctcgca

SEQ ID NO: 355218 - DNA, 25 bp, Mus musculus
tcttcttaacattgacggacttctg

SEQ ID NO: 355219 - DNA, 25 bp, Mus musculus
ttccgcaggcagtagtagacagccc

SEQ ID NO: 355220 - DNA, 25 bp, Mus musculus
gccgcttccgcaggcagtagtagac

SEQ ID NO: 355221 - DNA, 25 bp, Mus musculus
gaccatgccaaacaggcagcccagg

SEQ ID NO: 355222 - DNA, 25 bp, Mus musculus
tgccaaacaggcagcccaggatagt

SEQ ID NO: 355223 - DNA, 25 bp, Mus musculus
ttgcatgcgccgcttccgcaggcag

SEQ ID NO: 355224 - DNA, 25 bp, Mus musculus
cattgacggacttctgcttctcctc

SEQ ID NO: 355225 - DNA, 25 bp, Mus musculus
gcgcatctctaagatagtcttctta

SEQ ID NO: 355226 - DNA, 25 bp, Mus musculus
gcgccatagcgcatctctaagatag

SEQ ID NO: 355227 - DNA, 25 bp, Mus musculus
acgtcagcgccatagcgcatctcta

SEQ ID NO: 355228 - DNA, 25 bp, Mus musculus
atggaaccggcatccacgtcagcgc

SEQ ID NO: 355229 - DNA, 25 bp, Mus musculus
cagcgtgcactatggaaccggcatc

SEQ ID NO: 355230 - DNA, 25 bp, Mus musculus
cggtggctcgcccagcttctgtgca

SEQ ID NO: 355231 - DNA, 25 bp, Mus musculus
cccagcttctgtgcagcgtgcacta

SEQ ID NO: 355232 - DNA, 25 bp, Mus musculus
cgctagatctccgtctgagcagggc

SEQ ID NO: 355233 - DNA, 25 bp, Mus musculus
acccgcagccgcacgatgagactga

SEQ ID NO: 355234 - DNA, 25 bp, Mus musculus
agcacagggaagtaaggcggaaagc

SEQ ID NO: 355235 - DNA, 25 bp, Mus musculus
ggctgcaaattctaagcacagggaa

SEQ ID NO: 355236 - DNA, 25 bp, Mus musculus
gctgcggctgcaaattctaagcaca

SEQ ID NO: 355237 - DNA, 25 bp, Mus musculus
gcggctgcggctgcaaattctaagc

SEQ ID NO: 355238 - DNA, 25 bp, Mus musculus
ccgtgaaattggctgcgagagcgtc

SEQ ID NO: 355239 - DNA, 25 bp, Mus musculus
ccagagcccgtgaaattggctgcga

SEQ ID NO: 355240 - DNA, 25 bp, Mus musculus
agcccagagcccgtgaaattggctg

SEQ ID NO: 355241 - DNA, 25 bp, Mus musculus
gcggctcttcatcctgcgcaccgag

SEQ ID NO: 355242 - DNA, 25 bp, Mus musculus
tccgtctgagcagggcacgctcctg

SEQ ID NO: 355243 - DNA, 25 bp, Mus musculus
atctccgtctgagcagggcacgctc

SEQ ID NO: 355244 - DNA, 25 bp, Mus musculus
cgcagccgcacgatgagactgaggc

SEQ ID NO: 355245 - DNA, 25 bp, Mus musculus
tagatctccgtctgagcagggcacg

SEQ ID NO: 355246 - DNA, 25 bp, Mus musculus
cggggcgccctgcataaggtaaatt

SEQ ID NO: 355247 - DNA, 25 bp, Mus musculus
tctgaggtcccgaggacgtcactga

SEQ ID NO: 355248 - DNA, 25 bp, Mus musculus
tgccttctctcttcttagccggtga

SEQ ID NO: 355249 - DNA, 25 bp, Mus musculus
agatggcggctctcaaactcctgtc

SEQ ID NO: 355250 - DNA, 25 bp, Mus musculus
agcggtcgaggctctgtgtaccaaa

SEQ ID NO: 355251 - DNA, 25 bp, Mus musculus
gctcgtcctagctgtgcagcctttc

SEQ ID NO: 355252 - DNA, 25 bp, Mus musculus
agcaacgccttagagacagactgtc

SEQ ID NO: 355253 - DNA, 25 bp, Mus musculus
gggttaaccgctgctggctcaagtt

SEQ ID NO: 355254 - DNA, 25 bp, Mus musculus
tggctcaagttcaccgccaagtggg

SEQ ID NO: 355255 - DNA, 25 bp, Mus musculus
cccttccctatatggcggtagaaag

SEQ ID NO: 355256 - DNA, 25 bp, Mus musculus
ggaacccggactggagctcttgtca

SEQ ID NO: 355257 - DNA, 25 bp, Mus musculus
tcgcttcttgacaagccagcaggca

SEQ ID NO: 355258 - DNA, 25 bp, Mus musculus
gcagcctttccattcctagccgtga

SEQ ID NO: 355259 - DNA, 25 bp, Mus musculus
gtgtaccaaagccacgcagcaacgc

SEQ ID NO: 355260 - DNA, 25 bp, Mus musculus
gtcaggttcggcagcagcattaagc

SEQ ID NO: 355261 - DNA, 25 bp, Mus musculus
ttcttgagcgccttgcggaactcgc

SEQ ID NO: 355262 - DNA, 25 bp, Mus musculus
aactcgcggcgcactaagcagtaga

SEQ ID NO: 355263 - DNA, 25 bp, Mus musculus
tgggaacgcgtacacttggcactga

SEQ ID NO: 355264 - DNA, 25 bp, Mus musculus
ggcactgaaagtactcctggctgaa

SEQ ID NO: 355265 - DNA, 25 bp, Mus musculus
gcgttgaacttgatgaggatgctcc

SEQ ID NO: 355266 - DNA, 25 bp, Mus musculus
taagcgcctggttgggcagccaaca

SEQ ID NO: 355267 - DNA, 25 bp, Mus musculus
gaggacgacgatggtcaccgacttg

SEQ ID NO: 355268 - DNA, 25 bp, Mus musculus
accgacttggtgaccttggagcgtc

SEQ ID NO: 355269 - DNA, 25 bp, Mus musculus
cgtctcctagcgctggctgtactca

SEQ ID NO: 355270 - DNA, 25 bp, Mus musculus
tgctgctcctactgcatctgttgtc

SEQ ID NO: 355271 - DNA, 25 bp, Mus musculus
tgttgtcccaactacgcgacggtcg

SEQ ID NO: 355272 - DNA, 25 bp, Mus musculus
ggctatccgccacagcaggttcttg

SEQ ID NO: 355273 - DNA, 25 bp, Mus musculus
tgcagcccgtgatcttcaggttctg

SEQ ID NO: 355274 - DNA, 25 bp, Mus musculus
tactgcagctgcagcgccctgtgag

SEQ ID NO: 355275 - DNA, 25 bp, Mus musculus
ctgtgaggtggctgcaccgcggacc

SEQ ID NO: 355276 - DNA, 25 bp, Mus musculus
gctgggctctggcgctactgcagct

SEQ ID NO: 355277 - DNA, 25 bp, Mus musculus
gcgcgctcccagacacacgccacgg

SEQ ID NO: 355278 - DNA, 25 bp, Mus musculus
ccacggccacaagcgcgctcccaga

SEQ ID NO: 355279 - DNA, 25 bp, Mus musculus
tccgccgtctgcttccacggccaca

SEQ ID NO: 355280 - DNA, 25 bp, Mus musculus
ttcacaggcctctctccgctgcaga

SEQ ID NO: 355281 - DNA, 25 bp, Mus musculus
ggctctgtagccagatcccttcaca

SEQ ID NO: 355282 - DNA, 25 bp, Mus musculus
gtccgtccggctctgtagccagatc

SEQ ID NO: 355283 - DNA, 25 bp, Mus musculus
ctgtcggtccgtccggctctgtagc

SEQ ID NO: 355284 - DNA, 25 bp, Mus musculus
ctggcgatcactgcgtctgtcggtc

SEQ ID NO: 355285 - DNA, 25 bp, Mus musculus
gacctcaggggctggcgatcactgc

SEQ ID NO: 355286 - DNA, 25 bp, Mus musculus
ccgcgtagggctgctgcccgcagag

SEQ ID NO: 355287 - DNA, 25 bp, Mus musculus
tctgtagccagatcccttcacaggc

SEQ ID NO: 355288 - DNA, 25 bp, Mus musculus
agctgcaggtctcggctgcgcagca

SEQ ID NO: 355289 - DNA, 25 bp, Mus musculus
cgcagtcgctggcagcgctcctgtg

SEQ ID NO: 355290 - DNA, 25 bp, Mus musculus
tggcagcgctcctgtgcctgctgct

SEQ ID NO: 355291 - DNA, 25 bp, Mus musculus
tcccgaagcctctgctctagccctg

SEQ ID NO: 355292 - DNA, 25 bp, Mus musculus
cctgcagttgctgctctcggtgcaa

SEQ ID NO: 355293 - DNA, 25 bp, Mus musculus
ctgctctcggtgcaattggctcttc

SEQ ID NO: 355294 - DNA, 25 bp, Mus musculus
ggtgcaattggctcttccgagcttc

SEQ ID NO: 355295 - DNA, 25 bp, Mus musculus
ttggctcttccgagcttcccgaagc

SEQ ID NO: 355296 - DNA, 25 bp, Mus musculus
ggcgatcatgtagttctcatccttg

SEQ ID NO: 355297 - DNA, 25 bp, Mus musculus
caggcgcatggcgatcatgtagttc

SEQ ID NO: 355298 - DNA, 25 bp, Mus musculus
ttctcctcgctgagctgagccaggc

SEQ ID NO: 355299 - DNA, 25 bp, Mus musculus
cgaattcttctcctcgctgagctga

SEQ ID NO: 355300 - DNA, 25 bp, Mus musculus
gctgcgcagcacagccgaattcttc

SEQ ID NO: 355301 - DNA, 25 bp, Mus musculus
gtagttctcatccttgaggcgcagc

SEQ ID NO: 355302 - DNA, 25 bp, Mus musculus
agaggacttccgtaagcccgccgcg

SEQ ID NO: 355303 - DNA, 25 bp, Mus musculus
gacgctatgtgcagcctgcctgcct

SEQ ID NO: 355304 - DNA, 25 bp, Mus musculus
ttcggacgctatgtgcagcctgcct

SEQ ID NO: 355305 - DNA, 25 bp, Mus musculus
cgctgcccttcggacgctatgtgca

SEQ ID NO: 355306 - DNA, 25 bp, Mus musculus
acacagcggacttcgacgtggcggt

SEQ ID NO: 355307 - DNA, 25 bp, Mus musculus
ctatgatgcggacacagcggacttc

SEQ ID NO: 355308 - DNA, 25 bp, Mus musculus
caagaagtgtctgatctcgggctgg

SEQ ID NO: 355309 - DNA, 25 bp, Mus musculus
ccgccgggcaagaagtgtctgatct

SEQ ID NO: 355310 - DNA, 25 bp, Mus musculus
tacctgaaagaggacttccgtaagc

SEQ ID NO: 355311 - DNA, 25 bp, Mus musculus
tctcgggctggggttacctgaaaga

SEQ ID NO: 355312 - DNA, 25 bp, Mus musculus
gctgtgcgcacacgcgtgctctgca

SEQ ID NO: 355313 - DNA, 25 bp, Mus musculus
acacgcgtgctctgcatagccaagc

SEQ ID NO: 355314 - DNA, 25 bp, Mus musculus
atcctgcctatgatgcggacacagc

SEQ ID NO: 355315 - DNA, 25 bp, Mus musculus
tctgcatagccaagcatcctgccta

SEQ ID NO: 355316 - DNA, 25 bp, Mus musculus
acagcgcgtcctcttcggcctccga

SEQ ID NO: 355317 - DNA, 25 bp, Mus musculus
ccgcttcctgtttcccgccggctct

SEQ ID NO: 355318 - DNA, 25 bp, Mus musculus
ctcaccggtacggttagcgcggcac

SEQ ID NO: 355319 - DNA, 25 bp, Mus musculus
ggaaacggtaggtgctgagcacctc

SEQ ID NO: 355320 - DNA, 25 bp, Mus musculus
cctgttcgtccaggacgcggcactg

SEQ ID NO: 355321 - DNA, 25 bp, Mus musculus
ccaggacgcggcactggcgcagata

SEQ ID NO: 355322 - DNA, 25 bp, Mus musculus
actggcgcagatacggcgtgagctt

SEQ ID NO: 355323 - DNA, 25 bp, Mus musculus
tacggcgtgagcttggccggattca

SEQ ID NO: 355324 - DNA, 25 bp, Mus musculus
ggacgccctcgatccgctcccacag

SEQ ID NO: 355325 - DNA, 25 bp, Mus musculus
gtcctccgagcctgcgggcgacaag

SEQ ID NO: 355326 - DNA, 25 bp, Mus musculus
ccgggatcccaagctgctctgcctg

SEQ ID NO: 355327 - DNA, 25 bp, Mus musculus
ccgcactcaccacgggcgctgcagc

SEQ ID NO: 355328 - DNA, 25 bp, Mus musculus
ctgtcgggctccgtcttcccgggat

SEQ ID NO: 355329 - DNA, 25 bp, Mus musculus
aacattgcccgcgacccgctgcgct

SEQ ID NO: 355330 - DNA, 25 bp, Mus musculus
cggagggcggcttcctggacatcga

SEQ ID NO: 355331 - DNA, 25 bp, Mus musculus
tcgggctactttgtcagcatcgacg

SEQ ID NO: 355332 - DNA, 25 bp, Mus musculus
cgtcccgcaccatggtgacgctcgc

SEQ ID NO: 355333 - DNA, 25 bp, Mus musculus
gcaccatggtgacgctcgccgagct

SEQ ID NO: 355334 - DNA, 25 bp, Mus musculus
accatggtgacgctcgccgagctgc

SEQ ID NO: 355335 - DNA, 25 bp, Mus musculus
ccatggtgacgctcgccgagctgct

SEQ ID NO: 355336 - DNA, 25 bp, Mus musculus
catggtgacgctcgccgagctgctg

SEQ ID NO: 355337 - DNA, 25 bp, Mus musculus
ttcttcgagcgggtcacctccggca

SEQ ID NO: 355338 - DNA, 25 bp, Mus musculus
gagcgggtcacctccggcaccaaga

SEQ ID NO: 355339 - DNA, 25 bp, Mus musculus
agcgggtcacctccggcaccaagat

SEQ ID NO: 355340 - DNA, 25 bp, Mus musculus
cctcatcttcgaggtggcggagggc

SEQ ID NO: 355341 - DNA, 25 bp, Mus musculus
ccgtcccgcaccatggtgacgctcg

SEQ ID NO: 355342 - DNA, 25 bp, Mus musculus
gagggcggcttcctggacatcgacg

SEQ ID NO: 355343 - DNA, 25 bp, Mus musculus
gcgggtcacctccggcaccaagatg

SEQ ID NO: 355344 - DNA, 25 bp, Mus musculus
aggctggaaagttcagacttctcgg

SEQ ID NO: 355345 - DNA, 25 bp, Mus musculus
ccgggctcgacgacacgaggtaatc

SEQ ID NO: 355346 - DNA, 25 bp, Mus musculus
agagcgaacattcccgaggtcgccc

SEQ ID NO: 355347 - DNA, 25 bp, Mus musculus
agacttctcgggtggttttgtcacg

SEQ ID NO: 355348 - DNA, 25 bp, Mus musculus
gccaatccgtaggaggctggaaagt

SEQ ID NO: 355349 - DNA, 25 bp, Mus musculus
ggcccagcgactctcgggtagcgct

SEQ ID NO: 355350 - DNA, 25 bp, Mus musculus
cgggctcaagacagagcgaacattc

SEQ ID NO: 355351 - DNA, 25 bp, Mus musculus
aaccgaagggtaacgcagtatactg

SEQ ID NO: 355352 - DNA, 25 bp, Mus musculus
aacgcagtatactgggacgcgagca

SEQ ID NO: 355353 - DNA, 25 bp, Mus musculus
ctgcattccaggctggagcagcgga

SEQ ID NO: 355354 - DNA, 25 bp, Mus musculus
ctggagcagcggatgaggtcatccc

SEQ ID NO: 355355 - DNA, 25 bp, Mus musculus
cggatgaggtcatcccgtccggttc

SEQ ID NO: 355356 - DNA, 25 bp, Mus musculus
ttttgtcacgttgcgggacggctca

SEQ ID NO: 355357 - DNA, 25 bp, Mus musculus
gacggctcagggcaccaaaaccgaa

SEQ ID NO: 355358 - DNA, 25 bp, Mus musculus
gtgccacctcgaaggatggcttccc

SEQ ID NO: 355359 - DNA, 25 bp, Mus musculus
ccgcctcccatctcgcccatcatca

SEQ ID NO: 355360 - DNA, 25 bp, Mus musculus
cgcagagtcggggtgccacctcgaa

SEQ ID NO: 355361 - DNA, 25 bp, Mus musculus
ctccaacaggttcgcagagtcgggg

SEQ ID NO: 355362 - DNA, 25 bp, Mus musculus
caggaagctccaacaggttcgcaga

SEQ ID NO: 355363 - DNA, 25 bp, Mus musculus
ctggccaggaagctccaacaggttc

SEQ ID NO: 355364 - DNA, 25 bp, Mus musculus
ccgaagtttcctggccaggaagctc

SEQ ID NO: 355365 - DNA, 25 bp, Mus musculus
tcagcaaccacggaggccgctctgg

SEQ ID NO: 355366 - DNA, 25 bp, Mus musculus
gagatacgtccttcctcagcaacca

SEQ ID NO: 355367 - DNA, 25 bp, Mus musculus
tgtcttcggagatacgtccttcctc

SEQ ID NO: 355368 - DNA, 25 bp, Mus musculus
tggggatgtcttcggagatacgtcc

SEQ ID NO: 355369 - DNA, 25 bp, Mus musculus
acaccatgcacgtaggccgtggtgg

SEQ ID NO: 355370 - DNA, 25 bp, Mus musculus
gccacaccatgcacgtaggccgtgg

SEQ ID NO: 355371 - DNA, 25 bp, Mus musculus
ggccgctctggaaacacccaccgct

SEQ ID NO: 355372 - DNA, 25 bp, Mus musculus
ctaactgagttagagcggtcccgcg

SEQ ID NO: 355373 - DNA, 25 bp, Mus musculus
ccggtggcgcagagttatcccggac

SEQ ID NO: 355374 - DNA, 25 bp, Mus musculus
ctggaggcacgaatcagtgagtgtc

SEQ ID NO: 355375 - DNA, 25 bp, Mus musculus
ccggagactctggaggcacgaatca

SEQ ID NO: 355376 - DNA, 25 bp, Mus musculus
gggtttctatggtgccgcccgccac

SEQ ID NO: 355377 - DNA, 25 bp, Mus musculus
cgggtctctgcgtgacgctaactga

SEQ ID NO: 355378 - DNA, 25 bp, Mus musculus
tcccggaagcggtcacgggtctctg

SEQ ID NO: 355379 - DNA, 25 bp, Mus musculus
cccttcagaaacatggctccggagc

SEQ ID NO: 355380 - DNA, 25 bp, Mus musculus
tgagggctccggaagtgacttcaga

SEQ ID NO: 355381 - DNA, 25 bp, Mus musculus
acatcttcccacgtaagcggaagta

SEQ ID NO: 355382 - DNA, 25 bp, Mus musculus
taagggactttgacatcttcccacg

SEQ ID NO: 355383 - DNA, 25 bp, Mus musculus
gccacagtgcccagttgccctttta

SEQ ID NO: 355384 - DNA, 25 bp, Mus musculus
cgttagcttaacctcatcgcgttgg

SEQ ID NO: 355385 - DNA, 25 bp, Mus musculus
tgccgcgttcctactccgcggggtg

SEQ ID NO: 355386 - DNA, 25 bp, Mus musculus
atgatgaagaggcagttgcaccgca

SEQ ID NO: 355387 - DNA, 25 bp, Mus musculus
acccgccgcggtgacaggacaggct

SEQ ID NO: 355388 - DNA, 25 bp, Mus musculus
ggacggtgagtgtcacccgcttcta

SEQ ID NO: 355389 - DNA, 25 bp, Mus musculus
atcgtttcgcaggacctgagcgagc

SEQ ID NO: 355390 - DNA, 25 bp, Mus musculus
cgtgctatcgtttcgcaggacctga

SEQ ID NO: 355391 - DNA, 25 bp, Mus musculus
ctagccgtgctatcgtttcgcagga

SEQ ID NO: 355392 - DNA, 25 bp, Mus musculus
gtgtcacccgcttctagccgtgcta

SEQ ID NO: 355393 - DNA, 25 bp, Mus musculus
agttgcaccgcatgcggcagctggc

SEQ ID NO: 355394 - DNA, 25 bp, Mus musculus
ctgcccggacccaagatgatgaaga

SEQ ID NO: 355395 - DNA, 25 bp, Mus musculus
caaacttggagaaaggagtgacctg

SEQ ID NO: 355396 - DNA, 25 bp, Mus musculus
acagaccgacggacactcggcaggc

SEQ ID NO: 355397 - DNA, 25 bp, Mus musculus
gacctcagagagacagaccgacgga

SEQ ID NO: 355398 - DNA, 25 bp, Mus musculus
ctcaactgcggacctcagagagaca

SEQ ID NO: 355399 - DNA, 25 bp, Mus musculus
ggaagagcccgcactcaactgcgga

SEQ ID NO: 355400 - DNA, 25 bp, Mus musculus
tcctgttcgactgcgacggagtgct

SEQ ID NO: 355401 - DNA, 25 bp, Mus musculus
ttcgctgcagaccaggctgtctctt

SEQ ID NO: 355402 - DNA, 25 bp, Mus musculus
ctcttcattggtcgcctccttctag

SEQ ID NO: 355403 - DNA, 25 bp, Mus musculus
cgttctgcgcgccaattggtgaagc

SEQ ID NO: 355404 - DNA, 25 bp, Mus musculus
ttctccgagctccttcgggatcggc

SEQ ID NO: 355405 - DNA, 25 bp, Mus musculus
gccggcaagaacacgctgttcgtga

SEQ ID NO: 355406 - DNA, 25 bp, Mus musculus
gttcgtgagcaacaacagccggcgc

SEQ ID NO: 355407 - DNA, 25 bp, Mus musculus
agcagctcttcagctccgcgctgtg

SEQ ID NO: 355408 - DNA, 25 bp, Mus musculus
cgtaggctacgacgagcagttttcc

SEQ ID NO: 355409 - DNA, 25 bp, Mus musculus
tttccttctccaggttgaccgaggc

SEQ ID NO: 355410 - DNA, 25 bp, Mus musculus
ggacctgacgcgcttttcggaattc

SEQ ID NO: 355411 - DNA, 25 bp, Mus musculus
ttttcggaattcctgcagctgccgc

SEQ ID NO: 355412 - DNA, 25 bp, Mus musculus
ggccagcaccttcgactaaattcta

SEQ ID NO: 355413 - DNA, 25 bp, Mus musculus
tctagtcgctattggctgaagcctg

SEQ ID NO: 355414 - DNA, 25 bp, Mus musculus
ggccaggttcgcagatttaggttgc

SEQ ID NO: 355415 - DNA, 25 bp, Mus musculus
cgccaagaggtgagactggagaaaa

SEQ ID NO: 355416 - DNA, 25 bp, Mus musculus
actggagaaaagaatggagcgggca

SEQ ID NO: 355417 - DNA, 25 bp, Mus musculus
ttcgcagatttaggttgcgatgggc

SEQ ID NO: 355418 - DNA, 25 bp, Mus musculus
tggccggccggaaccgctcattccc

SEQ ID NO: 355419 - DNA, 25 bp, Mus musculus
ccagcccgcagctggttaacgggca

SEQ ID NO: 355420 - DNA, 25 bp, Mus musculus
cttcctcgctgggtctagtcgacgt

SEQ ID NO: 355421 - DNA, 25 bp, Mus musculus
tgcagatgctgcgttttctgggtga

SEQ ID NO: 355422 - DNA, 25 bp, Mus musculus
tgctgcgttttctgggtgagtcact

SEQ ID NO: 355423 - DNA, 25 bp, Mus musculus
gtgagtcacttcctcgctgggtcta

SEQ ID NO: 355424 - DNA, 25 bp, Mus musculus
gtcacttcctcgctgggtctagtcg

SEQ ID NO: 355425 - DNA, 25 bp, Mus musculus
tggttaacgggcagctgcagatgct

SEQ ID NO: 355426 - DNA, 25 bp, Mus musculus
cctcggacgccaagaggtgagactg

SEQ ID NO: 355427 - DNA, 25 bp, Mus musculus
tctagtcgacgtcgccgtggtctcc

SEQ ID NO: 355428 - DNA, 25 bp, Mus musculus
caggtgcctgagctttctatgtaga

SEQ ID NO: 355429 - DNA, 25 bp, Mus musculus
actaccgagagtcagcgcttgctcc

SEQ ID NO: 355430 - DNA, 25 bp, Mus musculus
ttctgcaagccgactaccgagagtc

SEQ ID NO: 355431 - DNA, 25 bp, Mus musculus
tgcgccttagtcacgttctgcaagc

SEQ ID NO: 355432 - DNA, 25 bp, Mus musculus
tgcatgctcaggtgcgccttagtca

SEQ ID NO: 355433 - DNA, 25 bp, Mus musculus
aaactggatgctgagccgcgttggc

SEQ ID NO: 355434 - DNA, 25 bp, Mus musculus
agctgctttcctcacggtggccgcg

SEQ ID NO: 355435 - DNA, 25 bp, Mus musculus
tgtagacgctcaaaagggctcctgg

SEQ ID NO: 355436 - DNA, 25 bp, Mus musculus
tctgagagctcatcacccgcagctg

SEQ ID NO: 355437 - DNA, 25 bp, Mus musculus
tctggggtcagagcgaagaattctg

SEQ ID NO: 355438 - DNA, 25 bp, Mus musculus
tcctgaagctgcagcgacgcattgc

SEQ ID NO: 355439 - DNA, 25 bp, Mus musculus
ggcctcagtgtctgtgctctctgcc

SEQ ID NO: 355440 - DNA, 25 bp, Mus musculus
aggatccgtaccctggcctcagtgt

SEQ ID NO: 355441 - DNA, 25 bp, Mus musculus
gttgcagaagccacctgcatgctca

SEQ ID NO: 355442 - DNA, 25 bp, Mus musculus
agtgccgcgccgtctattgtcacag

SEQ ID NO: 355443 - DNA, 25 bp, Mus musculus
ttttaaagtcagaagcggccacgct

SEQ ID NO: 355444 - DNA, 25 bp, Mus musculus
gctgtttacggctctcagcgctgcg

SEQ ID NO: 355445 - DNA, 25 bp, Mus musculus
ctggctcccagtcgttgttgacgaa

SEQ ID NO: 355446 - DNA, 25 bp, Mus musculus
tggaaagagactcccgtcgggctgc

SEQ ID NO: 355447 - DNA, 25 bp, Mus musculus
cctggatgtagctggagctcgcctt

SEQ ID NO: 355448 - DNA, 25 bp, Mus musculus
attgtcacagcccatagctggctcc

SEQ ID NO: 355449 - DNA, 25 bp, Mus musculus
cccggctcgttctcaactttgatga

SEQ ID NO: 355450 - DNA, 25 bp, Mus musculus
agcgctgcgccttggaccaccggag

SEQ ID NO: 355451 - DNA, 25 bp, Mus musculus
agcttcactgcaatgggccgcaaca

SEQ ID NO: 355452 - DNA, 25 bp, Mus musculus
cacgctgccggaagcttcactgcaa

SEQ ID NO: 355453 - DNA, 25 bp, Mus musculus
gaagagcgccctaccggaaatctga

SEQ ID NO: 355454 - DNA, 25 bp, Mus musculus
tctgaaactgctacacccggaagtg

SEQ ID NO: 355455 - DNA, 25 bp, Mus musculus
gcaatgggccgcaacaagaagaaga

SEQ ID NO: 355456 - DNA, 25 bp, Mus musculus
ccgcagtaagggtcctcagtgaaca

SEQ ID NO: 355457 - DNA, 25 bp, Mus musculus
cgttctacaacatctacacactgga

SEQ ID NO: 355458 - DNA, 25 bp, Mus musculus
cagttggagcgcgtggcacgcatct

SEQ ID NO: 355459 - DNA, 25 bp, Mus musculus
gagcgcgtggcacgcatctatcgcc

SEQ ID NO: 355460 - DNA, 25 bp, Mus musculus
cggcagctgcagaaggccgcagtaa

SEQ ID NO: 355461 - DNA, 25 bp, Mus musculus
cctgacggcgctcgatgcgtcatca

SEQ ID NO: 355462 - DNA, 25 bp, Mus musculus
acgcatgcgtcaggcgcagcccagg

SEQ ID NO: 355463 - DNA, 25 bp, Mus musculus
tcctcagtgaacagacatgtcgccg

SEQ ID NO: 355464 - DNA, 25 bp, Mus musculus
agggaggtatacacgcatgcgtcag

SEQ ID NO: 355465 - DNA, 25 bp, Mus musculus
ctcgctgcgcgagggaggtatacac

SEQ ID NO: 355466 - DNA, 25 bp, Mus musculus
gatgcgtcatcaccggctggggctc

SEQ ID NO: 355467 - DNA, 25 bp, Mus musculus
tctacacactggactatgacgtggc

SEQ ID NO: 355468 - DNA, 25 bp, Mus musculus
actggactatgacgtggcactgctg

SEQ ID NO: 355469 - DNA, 25 bp, Mus musculus
ggatcccacaggctccatggcgcgg

SEQ ID NO: 355470 - DNA, 25 bp, Mus musculus
aaatagaggctgtgactctggcacc

SEQ ID NO: 355471 - DNA, 25 bp, Mus musculus
acgtgctgtgcatcccgcgcggcaa

SEQ ID NO: 355472 - DNA, 25 bp, Mus musculus
agtcctcggtgtgtccagtcgcaca

SEQ ID NO: 355473 - DNA, 25 bp, Mus musculus
tgtgtccagtcgcacactgaccatg

SEQ ID NO: 355474 - DNA, 25 bp, Mus musculus
cagtcgcacactgaccatgcaaatg

SEQ ID NO: 355475 - DNA, 25 bp, Mus musculus
accatgcaaatgaagctcttaggga

SEQ ID NO: 355476 - DNA, 25 bp, Mus musculus
ctcttagggagagcctattggagtg

SEQ ID NO: 355477 - DNA, 25 bp, Mus musculus
aggggcgtggtctatcacgcaagtc

SEQ ID NO: 355478 - DNA, 25 bp, Mus musculus
tggtctatcacgcaagtcctgggcc

SEQ ID NO: 355479 - DNA, 25 bp, Mus musculus
tggaaacccgagtccaggtcagaac

SEQ ID NO: 355480 - DNA, 25 bp, Mus musculus
gtcctgggccgcgttttgattcatt

SEQ ID NO: 355481 - DNA, 25 bp, Mus musculus
tgtgactctggcaccagttcctccg

SEQ ID NO: 355482 - DNA, 25 bp, Mus musculus
gggcgaaacgtgctgtgcatcccgc

SEQ ID NO: 355483 - DNA, 25 bp, Mus musculus
tcacgcaagtcctgggccgcgtttt

SEQ ID NO: 355484 - DNA, 25 bp, Mus musculus
gtgtgtattgggcaccgtgatgccc

SEQ ID NO: 355485 - DNA, 25 bp, Mus musculus
caccgggacgcacctcgcgcctctt

SEQ ID NO: 355486 - DNA, 25 bp, Mus musculus
tcgctattttcagtacgaccctttc

SEQ ID NO: 355487 - DNA, 25 bp, Mus musculus
cccgctcgtctgagagtgaatcgcc

SEQ ID NO: 355488 - DNA, 25 bp, Mus musculus
ctacatgccgcctgcagtgtgtatt

SEQ ID NO: 355489 - DNA, 25 bp, Mus musculus
ctgcagtgtgtattgggcaccgtga

SEQ ID NO: 355490 - DNA, 25 bp, Mus musculus
cccgggccacttcgccacctcgtca

SEQ ID NO: 355491 - DNA, 25 bp, Mus musculus
tcgtcacacccagttcgatcccttc

SEQ ID NO: 355492 - DNA, 25 bp, Mus musculus
tcctcccagacacatcagatgctga

SEQ ID NO: 355493 - DNA, 25 bp, Mus musculus
cacatcagatgctgataatgagtcc

SEQ ID NO: 355494 - DNA, 25 bp, Mus musculus
ctgataatgagtccccgcagcacga

SEQ ID NO: 355495 - DNA, 25 bp, Mus musculus
accagtgtgcatcgggtaccgcgac

SEQ ID NO: 355496 - DNA, 25 bp, Mus musculus
gtgcatcgggtaccgcgacgctccg

SEQ ID NO: 355497 - DNA, 25 bp, Mus musculus
ccgcctgcagtgtgtattgggcacc

SEQ ID NO: 355498 - DNA, 25 bp, Mus musculus
ttcgccttgcaacacagtcgccttg

SEQ ID NO: 355499 - DNA, 25 bp, Mus musculus
atgcaaccgtcactctggcagggga

SEQ ID NO: 355500 - DNA, 25 bp, Mus musculus
cgtcactctggcaggggagaactca

SEQ ID NO: 355501 - DNA, 25 bp, Mus musculus
tggcaggggagaactcaggctctcc

SEQ ID NO: 355502 - DNA, 25 bp, Mus musculus
caggctctccgattcggccgtgaga

SEQ ID NO: 355503 - DNA, 25 bp, Mus musculus
acgcagtctccagcggagtcacctg

SEQ ID NO: 355504 - DNA, 25 bp, Mus musculus
tccagcggagtcacctgcacgcagg

SEQ ID NO: 355505 - DNA, 25 bp, Mus musculus
cttccttcctgcgaaccgccggccg

SEQ ID NO: 355506 - DNA, 25 bp, Mus musculus
gccctcgctcccattggtcctcccg

SEQ ID NO: 355507 - DNA, 25 bp, Mus musculus
ccggcttctaagctgtccattggtc

SEQ ID NO: 355508 - DNA, 25 bp, Mus musculus
cttctaagctgtccattggtccgcc

SEQ ID NO: 355509 - DNA, 25 bp, Mus musculus
cggtccagacttgccctcttggtgc

SEQ ID NO: 355510 - DNA, 25 bp, Mus musculus
aacacagtcgccttggccagatgca

SEQ ID NO: 355511 - DNA, 25 bp, Mus musculus
cttggccagatgcaaccgtcactct

SEQ ID NO: 355512 - DNA, 25 bp, Mus musculus
tggtcctcgcaaggcggatggacca

SEQ ID NO: 355513 - DNA, 25 bp, Mus musculus
ttcgagtccacggacggcaggaccc

SEQ ID NO: 355514 - DNA, 25 bp, Mus musculus
aagacgcaagtggttcgagtccacg

SEQ ID NO: 355515 - DNA, 25 bp, Mus musculus
caacgctctgaggaaagacgcaagt

SEQ ID NO: 355516 - DNA, 25 bp, Mus musculus
gacttggcccaacgctctgaggaaa

SEQ ID NO: 355517 - DNA, 25 bp, Mus musculus
gatctggagcgggacttggcccaac

SEQ ID NO: 355518 - DNA, 25 bp, Mus musculus
gcgccccaccaagcaggaggatctg

SEQ ID NO: 355519 - DNA, 25 bp, Mus musculus
tgcgcactctctcccgctccactcc

SEQ ID NO: 355520 - DNA, 25 bp, Mus musculus
gctctctccattagcgccaagctcc

SEQ ID NO: 355521 - DNA, 25 bp, Mus musculus
ggactacgtggagctctctccatta

SEQ ID NO: 355522 - DNA, 25 bp, Mus musculus
cgtcactggactacgtggagctctc

SEQ ID NO: 355523 - DNA, 25 bp, Mus musculus
gaccacggccgtcactggactacgt

SEQ ID NO: 355524 - DNA, 25 bp, Mus musculus
cagagacgcccagtggcgatgggtc

SEQ ID NO: 355525 - DNA, 25 bp, Mus musculus
ctcgcaaggcggatggaccacggcc

SEQ ID NO: 355526 - DNA, 25 bp, Mus musculus
agcgccagacgcagagctgggaaaa

SEQ ID NO: 355527 - DNA, 25 bp, Mus musculus
ctatccaggcagagaagaaccgtgc

SEQ ID NO: 355528 - DNA, 25 bp, Mus musculus
gcttctgagccgctccgccaggttg

SEQ ID NO: 355529 - DNA, 25 bp, Mus musculus
ctcctcggcgccgtttgaggctcgt

SEQ ID NO: 355530 - DNA, 25 bp, Mus musculus
taaatacccggatgcgccgcccgag

SEQ ID NO: 355531 - DNA, 25 bp, Mus musculus
catgatcgtggctgctatccaggca

SEQ ID NO: 355532 - DNA, 25 bp, Mus musculus
agccgcacttgcgtctggcctgcta

SEQ ID NO: 355533 - DNA, 25 bp, Mus musculus
atcgcgagtcaggttctgcacagcc

SEQ ID NO: 355534 - DNA, 25 bp, Mus musculus
ctggcccatcggaaggctccttgaa

SEQ ID NO: 355535 - DNA, 25 bp, Mus musculus
ctccttgaacagtgggagcaggccg

SEQ ID NO: 355536 - DNA, 25 bp, Mus musculus
gcaggccggccaccatgaccgagaa

SEQ ID NO: 355537 - DNA, 25 bp, Mus musculus
cccaagtattcagacatgatcgtgg

SEQ ID NO: 355538 - DNA, 25 bp, Mus musculus
ttgctcggcggaagaaacacagatg

SEQ ID NO: 355539 - DNA, 25 bp, Mus musculus
aggcttccaagaagtccacggacca

SEQ ID NO: 355540 - DNA, 25 bp, Mus musculus
cctggacagcgaactggaagggatc

SEQ ID NO: 355541 - DNA, 25 bp, Mus musculus
cgtgtgatcacgtcccgccagggac

SEQ ID NO: 355542 - DNA, 25 bp, Mus musculus
caaagctttggagtgacagggacgc

SEQ ID NO: 355543 - DNA, 25 bp, Mus musculus
gcgttgaagtcgctttctccgccta

SEQ ID NO: 355544 - DNA, 25 bp, Mus musculus
ctcccgggtgtcgacttacaaatca

SEQ ID NO: 355545 - DNA, 25 bp, Mus musculus
aatcaatcctttcttggcgggccga

SEQ ID NO: 355546 - DNA, 25 bp, Mus musculus
gcgggtggagtctcccatcctttta

SEQ ID NO: 355547 - DNA, 25 bp, Mus musculus
tcacgtgacggggagcactagactt

SEQ ID NO: 355548 - DNA, 25 bp, Mus musculus
ttcaggctggccagcgcactttagc

SEQ ID NO: 355549 - DNA, 25 bp, Mus musculus
gcactttagcctgtgggcgcgatgt

SEQ ID NO: 355550 - DNA, 25 bp, Mus musculus
gcacattcagcgctggctcagttgc

SEQ ID NO: 355551 - DNA, 25 bp, Mus musculus
gctcagttgcgctgcatcctggaca

SEQ ID NO: 355552 - DNA, 25 bp, Mus musculus
tcgcgccagagaatagcaaagcttt

SEQ ID NO: 355553 - DNA, 25 bp, Mus musculus
cacctggaagagtgagcgtgtgatc

SEQ ID NO: 355554 - DNA, 25 bp, Mus musculus
gccgcaggctacctgctgccggtga

SEQ ID NO: 355555 - DNA, 25 bp, Mus musculus
tacctaagctactacggcacggtgc

SEQ ID NO: 355556 - DNA, 25 bp, Mus musculus
aggtacctggcggtgcgacacccgc

SEQ ID NO: 355557 - DNA, 25 bp, Mus musculus
tcgagctctgcgtgcccgcctggga

SEQ ID NO: 355558 - DNA, 25 bp, Mus musculus
tactacggcacggtgcgctacggcg

SEQ ID NO: 355559 - DNA, 25 bp, Mus musculus
tacctgctgccggtgaccgtggtga

SEQ ID NO: 355560 - DNA, 25 bp, Mus musculus
accgtggtgagcctggcctacggac

SEQ ID NO: 355561 - DNA, 25 bp, Mus musculus
acggacgcacgctgtgcttcctgtg

SEQ ID NO: 355562 - DNA, 25 bp, Mus musculus
tacgcctgtcgtctggcttcgcact

SEQ ID NO: 355563 - DNA, 25 bp, Mus musculus
acgcgctcatcctctgcttctggta

SEQ ID NO: 355564 - DNA, 25 bp, Mus musculus
gctacggcgcgctcgagctctgcgt

SEQ ID NO: 355565 - DNA, 25 bp, Mus musculus
atcctctgcttctggtacggccgct

SEQ ID NO: 355566 - DNA, 25 bp, Mus musculus
tggacgtggccaccttcgccgcagg

SEQ ID NO: 355567 - DNA, 25 bp, Mus musculus
ccatgctgacggtggccgcgctcta

SEQ ID NO: 355568 - DNA, 25 bp, Mus musculus
ggctcgacgtcctgctgccacagga

SEQ ID NO: 355569 - DNA, 25 bp, Mus musculus
cgaaccactacgatcactgcgatca

SEQ ID NO: 355570 - DNA, 25 bp, Mus musculus
agagcaacggaccaatcagagttcg

SEQ ID NO: 355571 - DNA, 25 bp, Mus musculus
gtcggaccgcgccagagcaacggac

SEQ ID NO: 355572 - DNA, 25 bp, Mus musculus
caaccacagcaacagagtgcgggcg

SEQ ID NO: 355573 - DNA, 25 bp, Mus musculus
caggagaagcctcgctgtcagcgaa

SEQ ID NO: 355574 - DNA, 25 bp, Mus musculus
ttccctccaggagaagcctcgctgt

SEQ ID NO: 355575 - DNA, 25 bp, Mus musculus
gcgaaacgccgaagtccgcgaaaga

SEQ ID NO: 355576 - DNA, 25 bp, Mus musculus
aacgcagttcgtcgcgaggctcgac

SEQ ID NO: 355577 - DNA, 25 bp, Mus musculus
cggcgggaatcttgcaacgcagttc

SEQ ID NO: 355578 - DNA, 25 bp, Mus musculus
gctgagctcaccgtgtacctccttg

SEQ ID NO: 355579 - DNA, 25 bp, Mus musculus
gttcctggctgagctcaccgtgtac

SEQ ID NO: 355580 - DNA, 25 bp, Mus musculus
gcagctcgaaccactacgatcactg

SEQ ID NO: 355581 - DNA, 25 bp, Mus musculus
gcgaaagacaccaggcctccggctt

SEQ ID NO: 355582 - DNA, 25 bp, Mus musculus
ctacgagtctgaggtaatgaagcgg

SEQ ID NO: 355583 - DNA, 25 bp, Mus musculus
gcacccggttcggtgggatctgtcc

SEQ ID NO: 355584 - DNA, 25 bp, Mus musculus
cggcgtccagatcgggccggaacaa

SEQ ID NO: 355585 - DNA, 25 bp, Mus musculus
cagatcgggccggaacaagcggacc

SEQ ID NO: 355586 - DNA, 25 bp, Mus musculus
acaagcggacctcgatcattccggc

SEQ ID NO: 355587 - DNA, 25 bp, Mus musculus
tggagcgccgtagccatgtcttacc

SEQ ID NO: 355588 - DNA, 25 bp, Mus musculus
cggaacaagcggacctcgatcattc

SEQ ID NO: 355589 - DNA, 25 bp, Mus musculus
tccggccaagcaggcgcggagttct

SEQ ID NO: 355590 - DNA, 25 bp, Mus musculus
aagcaggcgcggagttcttcttccg

SEQ ID NO: 355591 - DNA, 25 bp, Mus musculus
ccggccgtatgtccccgcgtgtagt

SEQ ID NO: 355592 - DNA, 25 bp, Mus musculus
tcccacgggcttctggagcgccgta

SEQ ID NO: 355593 - DNA, 25 bp, Mus musculus
gtagccatgtcttaccccgctgatg

SEQ ID NO: 355594 - DNA, 25 bp, Mus musculus
cccgctgatgactacgagtctgagg

SEQ ID NO: 355595 - DNA, 25 bp, Mus musculus
aggcgcggagttcttcttccgctct

SEQ ID NO: 355596 - DNA, 25 bp, Mus musculus
cacagcgtgtgcctgctagaactcc

SEQ ID NO: 355597 - DNA, 25 bp, Mus musculus
ccagctcgggcacagcgtgtgcctg

SEQ ID NO: 355598 - DNA, 25 bp, Mus musculus
tgacacggcgccagctcgggcacag

SEQ ID NO: 355599 - DNA, 25 bp, Mus musculus
aaggtcttccctgacacggcgccag

SEQ ID NO: 355600 - DNA, 25 bp, Mus musculus
ccggtgtacaaggtcttccctgaca

SEQ ID NO: 355601 - DNA, 25 bp, Mus musculus
tgcttcccggtgtacaaggtcttcc

SEQ ID NO: 355602 - DNA, 25 bp, Mus musculus
ctgaagccacgcttgcttcccggtg

SEQ ID NO: 355603 - DNA, 25 bp, Mus musculus
tattgtctctcgtgcggatgttcac

SEQ ID NO: 355604 - DNA, 25 bp, Mus musculus
gaccttattgtctctcgtgcggatg

SEQ ID NO: 355605 - DNA, 25 bp, Mus musculus
tgtccgctctccgtggaccttattg

SEQ ID NO: 355606 - DNA, 25 bp, Mus musculus
gcaccgtctcctccactgtccgctc

SEQ ID NO: 355607 - DNA, 25 bp, Mus musculus
ctgcctgcttgctgcgcgtctgctt

SEQ ID NO: 355608 - DNA, 25 bp, Mus musculus
tgtgcctgctagaactcctcctctg

SEQ ID NO: 355609 - DNA, 25 bp, Mus musculus
gctcggcctgaagccacgcttgctt

SEQ ID NO: 355610 - DNA, 25 bp, Mus musculus
acacttgtccgtcattctctgtgga

SEQ ID NO: 355611 - DNA, 25 bp, Mus musculus
gcctgagtcaccatggaaacaagtt

SEQ ID NO: 355612 - DNA, 25 bp, Mus musculus
gtgcactctgacctcggaggctcta

SEQ ID NO: 355613 - DNA, 25 bp, Mus musculus
agccgctgtccatggctgctcagtc

SEQ ID NO: 355614 - DNA, 25 bp, Mus musculus
cgtgccgccaaaatccgagccgaag

SEQ ID NO: 355615 - DNA, 25 bp, Mus musculus
tctctgtggacacacgcgaggtctc

SEQ ID NO: 355616 - DNA, 25 bp, Mus musculus
gggcttcccgatgcacttccggaaa

SEQ ID NO: 355617 - DNA, 25 bp, Mus musculus
agaggctgagtcgattcccacaagg

SEQ ID NO: 355618 - DNA, 25 bp, Mus musculus
gagatgtctcacctgctccgagtta

SEQ ID NO: 355619 - DNA, 25 bp, Mus musculus
cgcgcacaacttcctcagtagctaa

SEQ ID NO: 355620 - DNA, 25 bp, Mus musculus
tctaggcacagaagccgggtcctca

SEQ ID NO: 355621 - DNA, 25 bp, Mus musculus
ccgaggatcacccatgaaggctgca

SEQ ID NO: 355622 - DNA, 25 bp, Mus musculus
aggctctatgggaaactgcaaactc

SEQ ID NO: 355623 - DNA, 25 bp, Mus musculus
tattccaggcgtccatgtagcggtc

SEQ ID NO: 355624 - DNA, 25 bp, Mus musculus
cacctcgggccactggtgtcaggct

SEQ ID NO: 355625 - DNA, 25 bp, Mus musculus
cgccagagcggagcgaagacaccga

SEQ ID NO: 355626 - DNA, 25 bp, Mus musculus
cggccggcccacaatgaggacagcg

SEQ ID NO: 355627 - DNA, 25 bp, Mus musculus
agacacagccggaaactggccctgc

SEQ ID NO: 355628 - DNA, 25 bp, Mus musculus
tgtcaggctctgacctctaagaggg

SEQ ID NO: 355629 - DNA, 25 bp, Mus musculus
ttctgaacgcggagcagggccaccc

SEQ ID NO: 355630 - DNA, 25 bp, Mus musculus
ctcaatgacgcggtggcacgcgccg

SEQ ID NO: 355631 - DNA, 25 bp, Mus musculus
ggacggcctggctttctgcgccatc

SEQ ID NO: 355632 - DNA, 25 bp, Mus musculus
tgagcagctccttccgggacggcct

SEQ ID NO: 355633 - DNA, 25 bp, Mus musculus
tggacatccgcgacctgagcagctc

SEQ ID NO: 355634 - DNA, 25 bp, Mus musculus
gctaccgcggcgtggacatccgcga

SEQ ID NO: 355635 - DNA, 25 bp, Mus musculus
gagccacacgaaccggagcccaagt

SEQ ID NO: 355636 - DNA, 25 bp, Mus musculus
gagcgcaagcggcagcccagtgcca

SEQ ID NO: 355637 - DNA, 25 bp, Mus musculus
ctctaagagggaactctgacccgtc

SEQ ID NO: 355638 - DNA, 25 bp, Mus musculus
cctccgcacggagaaactccaagga

SEQ ID NO: 355639 - DNA, 25 bp, Mus musculus
tgcactgacctctgagcagctcaca

SEQ ID NO: 355640 - DNA, 25 bp, Mus musculus
cccggcgtgtaacctgcttgcttac

SEQ ID NO: 355641 - DNA, 25 bp, Mus musculus
gagaagcaatgactcgccctagtta

SEQ ID NO: 355642 - DNA, 25 bp, Mus musculus
ccctagttacgcttcgcaatccgga

SEQ ID NO: 355643 - DNA, 25 bp, Mus musculus
tctcatcacgagcaacctgggagtc

SEQ ID NO: 355644 - DNA, 25 bp, Mus musculus
gacagcgcagtgaccacagtcccta

SEQ ID NO: 355645 - DNA, 25 bp, Mus musculus
tccaaggagctagagtgtcagcgtc

SEQ ID NO: 355646 - DNA, 25 bp, Mus musculus
cgtcctcactaatcgctccttgtta

SEQ ID NO: 355647 - DNA, 25 bp, Mus musculus
cacgcacgcgcattagcgtctggtc

SEQ ID NO: 355648 - DNA, 25 bp, Mus musculus
tgggtcacggcgcaagcgcaaacta

SEQ ID NO: 355649 - DNA, 25 bp, Mus musculus
ggcggagaaggcatcatgtcagaca

SEQ ID NO: 355650 - DNA, 25 bp, Mus musculus
gaggagcgctcaccttaggcgatga

SEQ ID NO: 355651 - DNA, 25 bp, Mus musculus
acagtccctatcgtgacggtccggg

SEQ ID NO: 355652 - DNA, 25 bp, Mus musculus
tagctttctgcgtgccgcctgtgcc

SEQ ID NO: 355653 - DNA, 25 bp, Mus musculus
gcgtgcacatgccagaccctaggtg

SEQ ID NO: 355654 - DNA, 25 bp, Mus musculus
gaagtggcgactctccctgcctgcg

SEQ ID NO: 355655 - DNA, 25 bp, Mus musculus
gtactggtcggctagctttctgcgt

SEQ ID NO: 355656 - DNA, 25 bp, Mus musculus
gcctcttgacgtgcggcttgctctt

SEQ ID NO: 355657 - DNA, 25 bp, Mus musculus
tgctcttgctggcaccgttgacgcg

SEQ ID NO: 355658 - DNA, 25 bp, Mus musculus
agtcgtagccgctgagcacctggct

SEQ ID NO: 355659 - DNA, 25 bp, Mus musculus
gcacacggggaacttgtcatcgtcc

SEQ ID NO: 355660 - DNA, 25 bp, Mus musculus
gttccttcttgaccttgcccagttc

SEQ ID NO: 355661 - DNA, 25 bp, Mus musculus
agcggggttcctccgagcccacagg

SEQ ID NO: 355662 - DNA, 25 bp, Mus musculus
tcagctccacctctgataggtcttg

SEQ ID NO: 355663 - DNA, 25 bp, Mus musculus
ataggtcttgttcctcggccatgtc

SEQ ID NO: 355664 - DNA, 25 bp, Mus musculus
caacgcccacctggacgggaaggag

SEQ ID NO: 355665 - DNA, 25 bp, Mus musculus
gcctagtgtcttgctgagctcagca

SEQ ID NO: 355666 - DNA, 25 bp, Mus musculus
ccctgtaccaagtaagaatcaccta

SEQ ID NO: 355667 - DNA, 25 bp, Mus musculus
cgactgaagcggctcccaaggctct

SEQ ID NO: 355668 - DNA, 25 bp, Mus musculus
cctgcagggattggggcaaagactc

SEQ ID NO: 355669 - DNA, 25 bp, Mus musculus
gggccgccgacatgtctagaccttt

SEQ ID NO: 355670 - DNA, 25 bp, Mus musculus
cgacatgtctagaccttttcttccc

SEQ ID NO: 355671 - DNA, 25 bp, Mus musculus
gcccttctagcctgaggctccgggt

SEQ ID NO: 355672 - DNA, 25 bp, Mus musculus
gcctggcagtgggaccgactctctc

SEQ ID NO: 355673 - DNA, 25 bp, Mus musculus
ccgactctctcggtgagcgactgaa

SEQ ID NO: 355674 - DNA, 25 bp, Mus musculus
ttttcacactaacggcgaacttcca

SEQ ID NO: 355675 - DNA, 25 bp, Mus musculus
ttttcctggttcagagagtcccgga

SEQ ID NO: 355676 - DNA, 25 bp, Mus musculus
gcgcgtgcccttctagcctgaggct

SEQ ID NO: 355677 - DNA, 25 bp, Mus musculus
ggcgggctccagaatccgagcccgt

SEQ ID NO: 355678 - DNA, 25 bp, Mus musculus
ctcccaaggctctggagaccgtggg

SEQ ID NO: 355679 - DNA, 25 bp, Mus musculus
cttgttctttttcctggttcagaga

SEQ ID NO: 355680 - DNA, 25 bp, Mus musculus
tccacgagcagcactaggcccaatg

SEQ ID NO: 355681 - DNA, 25 bp, Mus musculus
tcaccagcaggatggccggcacaaa

SEQ ID NO: 355682 - DNA, 25 bp, Mus musculus
cgtacaccacgaaagcacggtcggt

SEQ ID NO: 355683 - DNA, 25 bp, Mus musculus
agtgcgcccaccatgccgtaggaca

SEQ ID NO: 355684 - DNA, 25 bp, Mus musculus
cgctaatcaggtccgtgagcccatt

SEQ ID NO: 355685 - DNA, 25 bp, Mus musculus
tcgccgctcgaagtagagtcccagc

SEQ ID NO: 355686 - DNA, 25 bp, Mus musculus
cacgatgtccacgaagcccacgatg

SEQ ID NO: 355687 - DNA, 25 bp, Mus musculus
tgcccttcctggtcccagctgttgg

SEQ ID NO: 355688 - DNA, 25 bp, Mus musculus
ccatcaggaacttggtgaccacgta

SEQ ID NO: 355689 - DNA, 25 bp, Mus musculus
acaaagagcccgagtgccatcagga

SEQ ID NO: 355690 - DNA, 25 bp, Mus musculus
agggcggtcctatgagcacagccac

SEQ ID NO: 355691 - DNA, 25 bp, Mus musculus
ccacggttgccatgagcacctcaaa

SEQ ID NO: 355692 - DNA, 25 bp, Mus musculus
tccgacagaaaggatgggcccgatc

SEQ ID NO: 355693 - DNA, 25 bp, Mus musculus
tgcagaaagcaacgagggtcccgta

SEQ ID NO: 355694 - DNA, 25 bp, Mus musculus
ctgagtcaagagtggctcgcagacc

SEQ ID NO: 355695 - DNA, 25 bp, Mus musculus
ctggctccaactgggacgcggacct

SEQ ID NO: 355696 - DNA, 25 bp, Mus musculus
agggcctcaccatgtccagccgggt

SEQ ID NO: 355697 - DNA, 25 bp, Mus musculus
cccaatcccagatgtcggcgtaagg

SEQ ID NO: 355698 - DNA, 25 bp, Mus musculus
ccttccatagcaagacgcggttctg

SEQ ID NO: 355699 - DNA, 25 bp, Mus musculus
ccgagaagcgcagcagcgtgtgatt

SEQ ID NO: 355700 - DNA, 25 bp, Mus musculus
cacccttgggtgctaggtacccaca

SEQ ID NO: 355701 - DNA, 25 bp, Mus musculus
gctcgccgaaggaattggaccgcga

SEQ ID NO: 355702 - DNA, 25 bp, Mus musculus
ttggcaccctccgagtgggagacca

SEQ ID NO: 355703 - DNA, 25 bp, Mus musculus
tgagcttcgggcaccagcacctcaa

SEQ ID NO: 355704 - DNA, 25 bp, Mus musculus
tagagccagccgttctgagcttcgg

SEQ ID NO: 355705 - DNA, 25 bp, Mus musculus
gacgagccctccagtttgccgtaga

SEQ ID NO: 355706 - DNA, 25 bp, Mus musculus
tcaactacgtctccagccgagaagc

SEQ ID NO: 355707 - DNA, 25 bp, Mus musculus
tttgtgagcagtttatccatccttc

SEQ ID NO: 355708 - DNA, 25 bp, Mus musculus
tgcgtcctgcgcagtcgcacaaccg

SEQ ID NO: 355709 - DNA, 25 bp, Mus musculus
gctctcggacacgaaggcctgcatc

SEQ ID NO: 355710 - DNA, 25 bp, Mus musculus
gagggcgtggcttgctctccccagc

SEQ ID NO: 355711 - DNA, 25 bp, Mus musculus
tcacccggcccaagaactgcaggaa

SEQ ID NO: 355712 - DNA, 25 bp, Mus musculus
ccggcccaagaactgcaggaaagtg

SEQ ID NO: 355713 - DNA, 25 bp, Mus musculus
gcccaagaactgcaggaaagtgttg

SEQ ID NO: 355714 - DNA, 25 bp, Mus musculus
aactgcaggaaagtgttggagagca

SEQ ID NO: 355715 - DNA, 25 bp, Mus musculus
tgcttctcagccaggaagcggtagc

SEQ ID NO: 355716 - DNA, 25 bp, Mus musculus
ttctcagccaggaagcggtagcgcc

SEQ ID NO: 355717 - DNA, 25 bp, Mus musculus
cggtagcgccgcttctcttccagct

SEQ ID NO: 355718 - DNA, 25 bp, Mus musculus
cggcgcgcttgctctcggacacgaa

SEQ ID NO: 355719 - DNA, 25 bp, Mus musculus
cgcttgctctcggacacgaaggcct

SEQ ID NO: 355720 - DNA, 25 bp, Mus musculus
ctcggacacgaaggcctgcatctgg

SEQ ID NO: 355721 - DNA, 25 bp, Mus musculus
cgttcctgctcctgcgtcctgcgca

SEQ ID NO: 355722 - DNA, 25 bp, Mus musculus
acgacactacggctctccaccaatc

SEQ ID NO: 355723 - DNA, 25 bp, Mus musculus
tgaagccaattctgcgtggctgatg

SEQ ID NO: 355724 - DNA, 25 bp, Mus musculus
tctgactgaagccaattctgcgtgg

SEQ ID NO: 355725 - DNA, 25 bp, Mus musculus
tcgggcttctgactgaagccaattc

SEQ ID NO: 355726 - DNA, 25 bp, Mus musculus
gcggtcgggcttctgactgaagcca

SEQ ID NO: 355727 - DNA, 25 bp, Mus musculus
atggaagccgcttctgttgccaggg

SEQ ID NO: 355728 - DNA, 25 bp, Mus musculus
tgcccaatggaagccgcttctgttg

SEQ ID NO: 355729 - DNA, 25 bp, Mus musculus
aactgcccaatggaagccgcttctg

SEQ ID NO: 355730 - DNA, 25 bp, Mus musculus
tctataactgcccaatggaagccgc

SEQ ID NO: 355731 - DNA, 25 bp, Mus musculus
cgccatcttctataactgcccaatg

SEQ ID NO: 355732 - DNA, 25 bp, Mus musculus
cgcacgcggtcaggcgccgccatct

SEQ ID NO: 355733 - DNA, 25 bp, Mus musculus
caagcgtggacctcgcacgcggtca

SEQ ID NO: 355734 - DNA, 25 bp, Mus musculus
cgagcccatgccgcaggcaggctgt

SEQ ID NO: 355735 - DNA, 25 bp, Mus musculus
tctccaccaatccaccgagcccatg

SEQ ID NO: 355736 - DNA, 25 bp, Mus musculus
cataacaaaactcggagcggcgctg

SEQ ID NO: 355737 - DNA, 25 bp, Mus musculus
gtgtcacgtgaatgcatccagagga

SEQ ID NO: 355738 - DNA, 25 bp, Mus musculus
ggacacagtcccagcacggagaacc

SEQ ID NO: 355739 - DNA, 25 bp, Mus musculus
acgtcactgcatgactgggttttta

SEQ ID NO: 355740 - DNA, 25 bp, Mus musculus
ttccgggaagctcgccttacaactg

SEQ ID NO: 355741 - DNA, 25 bp, Mus musculus
ttcctagtgaactgcggtcccgatc

SEQ ID NO: 355742 - DNA, 25 bp, Mus musculus
ccttaacatcagctcccggaggggc

SEQ ID NO: 355743 - DNA, 25 bp, Mus musculus
tacgtgactcggtgagaacagtccc

SEQ ID NO: 355744 - DNA, 25 bp, Mus musculus
cccagcaccttgtgtgcgcggtttg

SEQ ID NO: 355745 - DNA, 25 bp, Mus musculus
gcgctccttggagactgacactagc

SEQ ID NO: 355746 - DNA, 25 bp, Mus musculus
actagcccagtgtatcttgaagtgg

SEQ ID NO: 355747 - DNA, 25 bp, Mus musculus
tgtccactggagcaaatgcggaata

SEQ ID NO: 355748 - DNA, 25 bp, Mus musculus
gccgttctccagaggtgtcacgtga

SEQ ID NO: 355749 - DNA, 25 bp, Mus musculus
agccgcgacaagcacgcactgagcg

SEQ ID NO: 355750 - DNA, 25 bp, Mus musculus
catcaccatcgtcaagtcggcgccg

SEQ ID NO: 355751 - DNA, 25 bp, Mus musculus
tgaaccgcaacctgcgcgggctgtc

SEQ ID NO: 355752 - DNA, 25 bp, Mus musculus
cgcacctgtcggatgaagcgctgat

SEQ ID NO: 355753 - DNA, 25 bp, Mus musculus
acacgccgcacctgtcggatgaagc

SEQ ID NO: 355754 - DNA, 25 bp, Mus musculus
ttgagcgagaacacgccgcacctgt

SEQ ID NO: 355755 - DNA, 25 bp, Mus musculus
tcaagcgcgagttgagcgagaacac

SEQ ID NO: 355756 - DNA, 25 bp, Mus musculus
catggccctcaggtcaagcgcgagt

SEQ ID NO: 355757 - DNA, 25 bp, Mus musculus
aagtggggcggcatcctcaagcacg

SEQ ID NO: 355758 - DNA, 25 bp, Mus musculus
aggagctgcagaagcagaagtccga

SEQ ID NO: 355759 - DNA, 25 bp, Mus musculus
cagaagcagaagtccgagctggagc

SEQ ID NO: 355760 - DNA, 25 bp, Mus musculus
agaacgccgccatgcgcctggagct

SEQ ID NO: 355761 - DNA, 25 bp, Mus musculus
caagtgtgaagcgctgcagggcttc

SEQ ID NO: 355762 - DNA, 25 bp, Mus musculus
tacgcggccagctgccgcgtgaagc

SEQ ID NO: 355763 - DNA, 25 bp, Mus musculus
tggcgcccgccagcgtcatcaccat

SEQ ID NO: 355764 - DNA, 25 bp, Mus musculus
tttgtagtctccttggcgcggagca

SEQ ID NO: 355765 - DNA, 25 bp, Mus musculus
tcctccttctcggagatccggagca

SEQ ID NO: 355766 - DNA, 25 bp, Mus musculus
aatgcggcgcgctcattcaatccgc

SEQ ID NO: 355767 - DNA, 25 bp, Mus musculus
atcacctcggttgcccgaatgcggc

SEQ ID NO: 355768 - DNA, 25 bp, Mus musculus
ggcgggagaatcacctcggttgccc

SEQ ID NO: 355769 - DNA, 25 bp, Mus musculus
tctcctgcagccgagacagacgcgt

SEQ ID NO: 355770 - DNA, 25 bp, Mus musculus
gttgagctcacggagctcctccttc

SEQ ID NO: 355771 - DNA, 25 bp, Mus musculus
cagcgcgccggaatttgtagtctcc

SEQ ID NO: 355772 - DNA, 25 bp, Mus musculus
gagtggtcacctcctccttctcgga

SEQ ID NO: 355773 - DNA, 25 bp, Mus musculus
gacccacgtacctcgcgagtggtca

SEQ ID NO: 355774 - DNA, 25 bp, Mus musculus
ttcacctatcaccaggatcaagctc

SEQ ID NO: 355775 - DNA, 25 bp, Mus musculus
ggcaggactccgctcatttcaccta

SEQ ID NO: 355776 - DNA, 25 bp, Mus musculus
gatccggagcagcaacctatcattc

SEQ ID NO: 355777 - DNA, 25 bp, Mus musculus
acacggtcgatgtagtgtgccaggc

SEQ ID NO: 355778 - DNA, 25 bp, Mus musculus
tctcctgcgacatggaaggaccaca

SEQ ID NO: 355779 - DNA, 25 bp, Mus musculus
caaaacccgtgagctgcaccgcaga

SEQ ID NO: 355780 - DNA, 25 bp, Mus musculus
gccctacctggacacgaggccaatg

SEQ ID NO: 355781 - DNA, 25 bp, Mus musculus
agctaaccagctgatgcaacgggac

SEQ ID NO: 355782 - DNA, 25 bp, Mus musculus
ggcggaaccagctaaccagctgatg

SEQ ID NO: 355783 - DNA, 25 bp, Mus musculus
tggccacaggcggaaccagctaacc

SEQ ID NO: 355784 - DNA, 25 bp, Mus musculus
tagacctacaattccgcactgcgcg

SEQ ID NO: 355785 - DNA, 25 bp, Mus musculus
agccggcggtgtagacctacaattc

SEQ ID NO: 355786 - DNA, 25 bp, Mus musculus
cccgtgagctgcaccgcagagaaga

SEQ ID NO: 355787 - DNA, 25 bp, Mus musculus
ggcagtgccggctcccagaacacat

SEQ ID NO: 355788 - DNA, 25 bp, Mus musculus
catggaaggaccacagagagacaaa

SEQ ID NO: 355789 - DNA, 25 bp, Mus musculus
ccgaagggctgctagccttctcctg

SEQ ID NO: 355790 - DNA, 25 bp, Mus musculus
ggctgctagccttctcctgcgacat

SEQ ID NO: 355791 - DNA, 25 bp, Mus musculus
acacgaggccaatgggctacgcgga

SEQ ID NO: 355792 - DNA, 25 bp, Mus musculus
cccatttacgcatgtaccgtctcaa

SEQ ID NO: 355793 - DNA, 25 bp, Mus musculus
tgcgcacagtcccatcggtaagagg

SEQ ID NO: 355794 - DNA, 25 bp, Mus musculus
catgtaccgtctcaagggccgacca

SEQ ID NO: 355795 - DNA, 25 bp, Mus musculus
gtcccatcggtaagaggctgggccc

SEQ ID NO: 355796 - DNA, 25 bp, Mus musculus
ccacgagcaggtccggttacactca

SEQ ID NO: 355797 - DNA, 25 bp, Mus musculus
gcctgcgcactaggaacgccgctgg

SEQ ID NO: 355798 - DNA, 25 bp, Mus musculus
gctgaggtcactcgccgagccttaa

SEQ ID NO: 355799 - DNA, 25 bp, Mus musculus
cactcgccgagccttaaaggggccg

SEQ ID NO: 355800 - DNA, 25 bp, Mus musculus
tgcgaagcaccacgcgcaatctcgg

SEQ ID NO: 355801 - DNA, 25 bp, Mus musculus
cgcaatctcgggtcaggagaatggt

SEQ ID NO: 355802 - DNA, 25 bp, Mus musculus
caggagaatggtgaggtcctcttgc

SEQ ID NO: 355803 - DNA, 25 bp, Mus musculus
gaggtcctcttgcaactcgcaaacg

SEQ ID NO: 355804 - DNA, 25 bp, Mus musculus
gccactgcactgaggaccgacgtct

SEQ ID NO: 355805 - DNA, 25 bp, Mus musculus
cccgttcggtcgtgccaggctgcag

SEQ ID NO: 355806 - DNA, 25 bp, Mus musculus
cccgcgctcgcgcaaaaagaaaaca

SEQ ID NO: 355807 - DNA, 25 bp, Mus musculus
atgagaagccaagcgataaataacc

SEQ ID NO: 355808 - DNA, 25 bp, Mus musculus
ccgcaatgagaagccaagcgataaa

SEQ ID NO: 355809 - DNA, 25 bp, Mus musculus
gcgctcgcgcaaaaagaaaacacaa

SEQ ID NO: 355810 - DNA, 25 bp, Mus musculus
cagccctgcgcggatgcgcgtgtcc

SEQ ID NO: 355811 - DNA, 25 bp, Mus musculus
cccggccgcgcctttgtcctcacgg

SEQ ID NO: 355812 - DNA, 25 bp, Mus musculus
acccggcggcctgcgaagcgcccgt

SEQ ID NO: 355813 - DNA, 25 bp, Mus musculus
gccgcctcggtgcacccggcggcct

SEQ ID NO: 355814 - DNA, 25 bp, Mus musculus
cccaggacacagaggaggggccgag

SEQ ID NO: 355815 - DNA, 25 bp, Mus musculus
cccggagcccaggacacagaggagg

SEQ ID NO: 355816 - DNA, 25 bp, Mus musculus
ccaccctacgcgagaacggcctcgg

SEQ ID NO: 355817 - DNA, 25 bp, Mus musculus
cttcttctcgccacaaaggaaaaca

SEQ ID NO: 355818 - DNA, 25 bp, Mus musculus
cggatgccagaggattcgccgggcc

SEQ ID NO: 355819 - DNA, 25 bp, Mus musculus
ttctcgccacaaaggaaaacaaagc

SEQ ID NO: 355820 - DNA, 25 bp, Mus musculus
tccgtgcatgacctgaggacgtcgt

SEQ ID NO: 355821 - DNA, 25 bp, Mus musculus
caatgcaccagaagaggaggccgaa

SEQ ID NO: 355822 - DNA, 25 bp, Mus musculus
tcaccatggaagaaggcaatgcacc

SEQ ID NO: 355823 - DNA, 25 bp, Mus musculus
ggactggcctccaggtcaccatgga

SEQ ID NO: 355824 - DNA, 25 bp, Mus musculus
aagccgtttacgtgcatgatacagg

SEQ ID NO: 355825 - DNA, 25 bp, Mus musculus
gtcgtctgggtctccactgagaaga

SEQ ID NO: 355826 - DNA, 25 bp, Mus musculus
ggaacccgtagccaatggtcgtctg

SEQ ID NO: 355827 - DNA, 25 bp, Mus musculus
tcatgagcatatagcgccagcgcgt

SEQ ID NO: 355828 - DNA, 25 bp, Mus musculus
tgtctgccatgtagcgctgggactt

SEQ ID NO: 355829 - DNA, 25 bp, Mus musculus
gctcaggttggcgaagtagacgtta

SEQ ID NO: 355830 - DNA, 25 bp, Mus musculus
gtagacgttacactggccgttcttc

SEQ ID NO: 355831 - DNA, 25 bp, Mus musculus
gcccgtttcggttgtgtccgtgcat

SEQ ID NO: 355832 - DNA, 25 bp, Mus musculus
ccgcggagaagatcatgagcatata

SEQ ID NO: 355833 - DNA, 25 bp, Mus musculus
tgacaaagcggttgcggcgtttccg

SEQ ID NO: 355834 - DNA, 25 bp, Mus musculus
cggacagacggacgaagagtactcg

SEQ ID NO: 355835 - DNA, 25 bp, Mus musculus
cgcactcctactggaggatccgttc

SEQ ID NO: 355836 - DNA, 25 bp, Mus musculus
gagtactcgcgatggacgagcccga

SEQ ID NO: 355837 - DNA, 25 bp, Mus musculus
gggcggcgagtgtccgctacatccc

SEQ ID NO: 355838 - DNA, 25 bp, Mus musculus
gacccaggcggcctctgtgggtctc

SEQ ID NO: 355839 - DNA, 25 bp, Mus musculus
gctccctgcgtaactttcagcgttg

SEQ ID NO: 355840 - DNA, 25 bp, Mus musculus
cgaccctctcgttgttcagttctgg

SEQ ID NO: 355841 - DNA, 25 bp, Mus musculus
ttgttcagttctggggtctcctggc

SEQ ID NO: 355842 - DNA, 25 bp, Mus musculus
gggtctcctggctctgtggccacct

SEQ ID NO: 355843 - DNA, 25 bp, Mus musculus
ctggtgcgtctgacccacgcgggca

SEQ ID NO: 355844 - DNA, 25 bp, Mus musculus
tcgcgcggatcctgcccgggttttc

SEQ ID NO: 355845 - DNA, 25 bp, Mus musculus
gatccgttccaaggaggatccactc

SEQ ID NO: 355846 - DNA, 25 bp, Mus musculus
aggaggatccactcccggatttgcg

SEQ ID NO: 355847 - DNA, 25 bp, Mus musculus
tgcgccgtccggttctcgcgcggat

SEQ ID NO: 355848 - DNA, 25 bp, Mus musculus
ggttcgcgcctcgtcactccggaga

SEQ ID NO: 355849 - DNA, 25 bp, Mus musculus
ggaatccgccctcggaggctgcacg

SEQ ID NO: 355850 - DNA, 25 bp, Mus musculus
gaaggcgctactgaaccggaatccg

SEQ ID NO: 355851 - DNA, 25 bp, Mus musculus
taccgcgccaggaaggcgctactga

SEQ ID NO: 355852 - DNA, 25 bp, Mus musculus
cggctgaattctaccgcgccaggaa

SEQ ID NO: 355853 - DNA, 25 bp, Mus musculus
cccgagcacttctagcggctgaatt

SEQ ID NO: 355854 - DNA, 25 bp, Mus musculus
acagtcaatcccgagcacttctagc

SEQ ID NO: 355855 - DNA, 25 bp, Mus musculus
tgatgtgcggaaacccgcgtcaccc

SEQ ID NO: 355856 - DNA, 25 bp, Mus musculus
cctcagaagcacagcgcggtgatgt

SEQ ID NO: 355857 - DNA, 25 bp, Mus musculus
tctccaagagtagcgagcacacacc

SEQ ID NO: 355858 - DNA, 25 bp, Mus musculus
cgcgcggaccacagcgtttagggtt

SEQ ID NO: 355859 - DNA, 25 bp, Mus musculus
tcacgactcagccaccagactagag

SEQ ID NO: 355860 - DNA, 25 bp, Mus musculus
acgacacctgtccttagagtaactc

SEQ ID NO: 355861 - DNA, 25 bp, Mus musculus
ggctccgggtcttggttcgcgcctc

SEQ ID NO: 355862 - DNA, 25 bp, Mus musculus
ctggctatgatcttgctcctggtga

SEQ ID NO: 355863 - DNA, 25 bp, Mus musculus
accatggtgaggacttaggctcaga

SEQ ID NO: 355864 - DNA, 25 bp, Mus musculus
accggaccatggtgaggacttaggc

SEQ ID NO: 355865 - DNA, 25 bp, Mus musculus
gatctggaggtccaagagctgcgcc

SEQ ID NO: 355866 - DNA, 25 bp, Mus musculus
ctcctggtgaagatctggaggtcca

SEQ ID NO: 355867 - DNA, 25 bp, Mus musculus
ctgagccacctcctggctatgatct

SEQ ID NO: 355868 - DNA, 25 bp, Mus musculus
ccatgaacgtgttccgaatcctcgg

SEQ ID NO: 355869 - DNA, 25 bp, Mus musculus
cgggaccatgaacgtgttccgaatc

SEQ ID NO: 355870 - DNA, 25 bp, Mus musculus
ttccctgggaagttctgcgcgacac

SEQ ID NO: 355871 - DNA, 25 bp, Mus musculus
ccgcgcaacagaaagttccctggga

SEQ ID NO: 355872 - DNA, 25 bp, Mus musculus
acttcagcgaagtttttcgacatca

SEQ ID NO: 355873 - DNA, 25 bp, Mus musculus
aagtttttcgacatcagaggatccg

SEQ ID NO: 355874 - DNA, 25 bp, Mus musculus
ccagcagcggctgtgtaagctgccc

SEQ ID NO: 355875 - DNA, 25 bp, Mus musculus
ggcgcgcgcgcttccaaaaacttca

SEQ ID NO: 355876 - DNA, 25 bp, Mus musculus
gcacggcccagacgctacgtaaaca

SEQ ID NO: 355877 - DNA, 25 bp, Mus musculus
tgaggccgctttcttggttccaacg

SEQ ID NO: 355878 - DNA, 25 bp, Mus musculus
ctccacgcatggtcccaaacggata

SEQ ID NO: 355879 - DNA, 25 bp, Mus musculus
cggagaccgctccaacttaacgcta

SEQ ID NO: 355880 - DNA, 25 bp, Mus musculus
cacggacattctcggaaccgcttta

SEQ ID NO: 355881 - DNA, 25 bp, Mus musculus
tggtcggcccaccttaaacaaggca

SEQ ID NO: 355882 - DNA, 25 bp, Mus musculus
tcgcaccgccagctctagaacgttg

SEQ ID NO: 355883 - DNA, 25 bp, Mus musculus
ccgtcggcacgacgtcacagtgttg

SEQ ID NO: 355884 - DNA, 25 bp, Mus musculus
actattgcgggtcagcgcagtcttc

SEQ ID NO: 355885 - DNA, 25 bp, Mus musculus
cgcagtcttcgtagcgcattctgtt

SEQ ID NO: 355886 - DNA, 25 bp, Mus musculus
cgagaatggacttttcccggcattc

SEQ ID NO: 355887 - DNA, 25 bp, Mus musculus
ccggccttgtgcagacataatggta

SEQ ID NO: 355888 - DNA, 25 bp, Mus musculus
ctccacgtagccttagtcagacttc

SEQ ID NO: 355889 - DNA, 25 bp, Mus musculus
ctctctcgtcggagacgggagcaca

SEQ ID NO: 355890 - DNA, 25 bp, Mus musculus
gggcttggcgccaaatgagggccgc

SEQ ID NO: 355891 - DNA, 25 bp, Mus musculus
tttcctcagatttttcccgcgcttc

SEQ ID NO: 355892 - DNA, 25 bp, Mus musculus
cgcggagaggaaagctttctcaacg

SEQ ID NO: 355893 - DNA, 25 bp, Mus musculus
ggaaagctttctcaacgcgtcgagt

SEQ ID NO: 355894 - DNA, 25 bp, Mus musculus
tttctcaacgcgtcgagttttcctc

SEQ ID NO: 355895 - DNA, 25 bp, Mus musculus
ctcaacgcgtcgagttttcctcaga

SEQ ID NO: 355896 - DNA, 25 bp, Mus musculus
cgcgtcgagttttcctcagattttt

SEQ ID NO: 355897 - DNA, 25 bp, Mus musculus
ccgagaattttcaaggcgacacccg

SEQ ID NO: 355898 - DNA, 25 bp, Mus musculus
attttcaaggcgacacccgctccgg

SEQ ID NO: 355899 - DNA, 25 bp, Mus musculus
gtccggtccagaattctaacgccga

SEQ ID NO: 355900 - DNA, 25 bp, Mus musculus
tccagaattctaacgccgacccaga

SEQ ID NO: 355901 - DNA, 25 bp, Mus musculus
ttctaacgccgacccagaacgcgga

SEQ ID NO: 355902 - DNA, 25 bp, Mus musculus
agcccgccctgtcgtcgaacagctc

SEQ ID NO: 355903 - DNA, 25 bp, Mus musculus
taacgccgacccagaacgcggaggc

SEQ ID NO: 355904 - DNA, 25 bp, Mus musculus
cttgcagaaagctgcaggctagctc

SEQ ID NO: 355905 - DNA, 25 bp, Mus musculus
attccggcttcgcagacaggtacct

SEQ ID NO: 355906 - DNA, 25 bp, Mus musculus
cggcctgggcagatccttgcagaaa

SEQ ID NO: 355907 - DNA, 25 bp, Mus musculus
ggctccctctgcattctcagtggta

SEQ ID NO: 355908 - DNA, 25 bp, Mus musculus
tattcgtgaaccttagagagtccgc

SEQ ID NO: 355909 - DNA, 25 bp, Mus musculus
gcccaaggctttcttctattcgtga

SEQ ID NO: 355910 - DNA, 25 bp, Mus musculus
cccaaggcatgtgtgtatctccaga

SEQ ID NO: 355911 - DNA, 25 bp, Mus musculus
ggggtcatgcctctcccagcctatg

SEQ ID NO: 355912 - DNA, 25 bp, Mus musculus
aaaacgattactatgacgacggcgg

SEQ ID NO: 355913 - DNA, 25 bp, Mus musculus
cagctttcggcctgctttgttgcca

SEQ ID NO: 355914 - DNA, 25 bp, Mus musculus
attttgctactgtgagtccagcctg

SEQ ID NO: 355915 - DNA, 25 bp, Mus musculus
tccgtctgtcttacctgaaagcttc

SEQ ID NO: 355916 - DNA, 25 bp, Mus musculus
gccacaaggcatgtgtgtatctcca

SEQ ID NO: 355917 - DNA, 25 bp, Mus musculus
agctgcaggtcggtccattttgcta

SEQ ID NO: 355918 - DNA, 25 bp, Mus musculus
agcaaccctgggtctgcgttcatct

SEQ ID NO: 355919 - DNA, 25 bp, Mus musculus
tcggccctttgtgcatctaccaatg

SEQ ID NO: 355920 - DNA, 25 bp, Mus musculus
ctccagccaatctcagcgcgggata

SEQ ID NO: 355921 - DNA, 25 bp, Mus musculus
tggcttttctagctgtcgccgctgc

SEQ ID NO: 355922 - DNA, 25 bp, Mus musculus
gcgcatgcacatcccttctttcaga

SEQ ID NO: 355923 - DNA, 25 bp, Mus musculus
cttagtaagcctcctggcgcatgca

SEQ ID NO: 355924 - DNA, 25 bp, Mus musculus
ccaactctacaaggccggcagaaca

SEQ ID NO: 355925 - DNA, 25 bp, Mus musculus
gggtgccttggtagttctcactttg

SEQ ID NO: 355926 - DNA, 25 bp, Mus musculus
tgagcgttctcaaagcaccttcgtg

SEQ ID NO: 355927 - DNA, 25 bp, Mus musculus
accacgaccactaggaagcttcctg

SEQ ID NO: 355928 - DNA, 25 bp, Mus musculus
gcgcctcccgtgcacacgtgaaatt

SEQ ID NO: 355929 - DNA, 25 bp, Mus musculus
taccaatgggtggaaagcgcatgcc

SEQ ID NO: 355930 - DNA, 25 bp, Mus musculus
ctgcgttcatctctgtcttcttgga

SEQ ID NO: 355931 - DNA, 25 bp, Mus musculus
gcctccacccgggaagtcatataaa

SEQ ID NO: 355932 - DNA, 25 bp, Mus musculus
cgaggaattactcccgaaagccgag

SEQ ID NO: 355933 - DNA, 25 bp, Mus musculus
tggctcagaagatgtacaggtaaaa

SEQ ID NO: 355934 - DNA, 25 bp, Mus musculus
tggaggagacgccaacgctttctct

SEQ ID NO: 355935 - DNA, 25 bp, Mus musculus
tcgcttccggaagacgctctgtcca

SEQ ID NO: 355936 - DNA, 25 bp, Mus musculus
ggtgggccgcttcgcctgctctctt

SEQ ID NO: 355937 - DNA, 25 bp, Mus musculus
ttccggtgtcctacagccatggccg

SEQ ID NO: 355938 - DNA, 25 bp, Mus musculus
tcccgaaagccgaggcagagaaagc

SEQ ID NO: 355939 - DNA, 25 bp, Mus musculus
cacagctagacgagaccctgtcgga

SEQ ID NO: 355940 - DNA, 25 bp, Mus musculus
accctgtcggagagactctggggtc

SEQ ID NO: 355941 - DNA, 25 bp, Mus musculus
ggtctgacggagatgtttcccgaga

SEQ ID NO: 355942 - DNA, 25 bp, Mus musculus
atgtttcccgagagggtccggtcag

SEQ ID NO: 355943 - DNA, 25 bp, Mus musculus
ggtcagccgccggagccacctttga

SEQ ID NO: 355944 - DNA, 25 bp, Mus musculus
gacctctcgctcttcgtggctcaga

SEQ ID NO: 355945 - DNA, 25 bp, Mus musculus
tgcggtgctgctgccgcttcaccga

SEQ ID NO: 355946 - DNA, 25 bp, Mus musculus
cggcgacgcacttctggtgcttgta

SEQ ID NO: 355947 - DNA, 25 bp, Mus musculus
gcgcgcgactgcaatggacagagta

SEQ ID NO: 355948 - DNA, 25 bp, Mus musculus
tcctctcgagtttgtcgtcgctgta

SEQ ID NO: 355949 - DNA, 25 bp, Mus musculus
tgcgagtattccgtgtccttgtgct

SEQ ID NO: 355950 - DNA, 25 bp, Mus musculus
tctctcccatcttggcgtaggcagg

SEQ ID NO: 355951 - DNA, 25 bp, Mus musculus
cagcatcggcaggtcccagtgagac

SEQ ID NO: 355952 - DNA, 25 bp, Mus musculus
cctgaattcagacacggcgacgcac

SEQ ID NO: 355953 - DNA, 25 bp, Mus musculus
tggcgaaacagagcgagcatcatct

SEQ ID NO: 355954 - DNA, 25 bp, Mus musculus
agccacacctgtcatacctgggatg

SEQ ID NO: 355955 - DNA, 25 bp, Mus musculus
ccaagtctttggtctcgtcgaaatt

SEQ ID NO: 355956 - DNA, 25 bp, Mus musculus
gcgcactatgtcgtccaggtccaag

SEQ ID NO: 355957 - DNA, 25 bp, Mus musculus
gctgccttggatgtagcgcactatg

SEQ ID NO: 355958 - DNA, 25 bp, Mus musculus
ccctggatcaggcagctcacacttg

SEQ ID NO: 355959 - DNA, 25 bp, Mus musculus
agacgttccctcgactggccagatc

SEQ ID NO: 355960 - DNA, 25 bp, Mus musculus
gcagcgacctcctgctgtcacgtga

SEQ ID NO: 355961 - DNA, 25 bp, Mus musculus
cagagtgctttcttgagcccgggca

SEQ ID NO: 355962 - DNA, 25 bp, Mus musculus
tcctcccggcagagtgctttcttga

SEQ ID NO: 355963 - DNA, 25 bp, Mus musculus
gaggtcgacttgtcgcttcgccgca

SEQ ID NO: 355964 - DNA, 25 bp, Mus musculus
gctccttttcttccatttcgtccga

SEQ ID NO: 355965 - DNA, 25 bp, Mus musculus
gagcccgacgtcagcggcgttcact

SEQ ID NO: 355966 - DNA, 25 bp, Mus musculus
tgccctggcccacttatgttcatca

SEQ ID NO: 355967 - DNA, 25 bp, Mus musculus
tcgggcgtaatcttggttggtgaac

SEQ ID NO: 355968 - DNA, 25 bp, Mus musculus
atagcgctccatgaccgccagcgga

SEQ ID NO: 355969 - DNA, 25 bp, Mus musculus
ccaatgccaagagctagcgaggatc

SEQ ID NO: 355970 - DNA, 25 bp, Mus musculus
cgaaggggtcacatcgctccttttc

SEQ ID NO: 355971 - DNA, 25 bp, Mus musculus
aacaccacaggctccgaagaccggg

SEQ ID NO: 355972 - DNA, 25 bp, Mus musculus
ttcgtccgaatcacaacaccacagg

SEQ ID NO: 355973 - DNA, 25 bp, Mus musculus
ccctgacgttgtgtgacgtagccaa

SEQ ID NO: 355974 - DNA, 25 bp, Mus musculus
tgccacttggctccgccacgtggaa

SEQ ID NO: 355975 - DNA, 25 bp, Mus musculus
cgattctgactgcagcgaggacggc

SEQ ID NO: 355976 - DNA, 25 bp, Mus musculus
cgctagagatacgtgacagtctcgg

SEQ ID NO: 355977 - DNA, 25 bp, Mus musculus
gccggctgtccagtggcacggctca

SEQ ID NO: 355978 - DNA, 25 bp, Mus musculus
aacggcgagccggagctggacctca

SEQ ID NO: 355979 - DNA, 25 bp, Mus musculus
catggcggcttcgattctgactgca

SEQ ID NO: 355980 - DNA, 25 bp, Mus musculus
gcccgactccatggcggcttcgatt

SEQ ID NO: 355981 - DNA, 25 bp, Mus musculus
gcttaagttcttaaagatggcggcg

SEQ ID NO: 355982 - DNA, 25 bp, Mus musculus
gccggctgcgaattagcttaagttc

SEQ ID NO: 355983 - DNA, 25 bp, Mus musculus
attagttaaatgagccagggaggga

SEQ ID NO: 355984 - DNA, 25 bp, Mus musculus
gcggggccgagcataaattagttaa

SEQ ID NO: 355985 - DNA, 25 bp, Mus musculus
gccgcgcataaattattctaacaag

SEQ ID NO: 355986 - DNA, 25 bp, Mus musculus
ggggaagccgcgcataaattattct

SEQ ID NO: 355987 - DNA, 25 bp, Mus musculus
cctcaccagcaaggtaggcccggga

SEQ ID NO: 355988 - DNA, 25 bp, Mus musculus
ggcgccggagctctaaaggctttag

SEQ ID NO: 355989 - DNA, 25 bp, Mus musculus
aaggctttaggtgcgggagcacaca

SEQ ID NO: 355990 - DNA, 25 bp, Mus musculus
agtacgacctccaggctgtgggacc

SEQ ID NO: 355991 - DNA, 25 bp, Mus musculus
tttgaacacaaaggctccggctcgg

SEQ ID NO: 355992 - DNA, 25 bp, Mus musculus
ccgcccattggttgatttgaacaca

SEQ ID NO: 355993 - DNA, 25 bp, Mus musculus
tgtgggacccgagcgttccctcgcg

SEQ ID NO: 355994 - DNA, 25 bp, Mus musculus
tgccgccgcccattggttgatttga

SEQ ID NO: 355995 - DNA, 25 bp, Mus musculus
cgctgacagcccacaagtcattggc

SEQ ID NO: 355996 - DNA, 25 bp, Mus musculus
tgtgtgcgcctgtcaatcaacgctg

SEQ ID NO: 355997 - DNA, 25 bp, Mus musculus
cacacagggtgtcatgaaattggcc

SEQ ID NO: 355998 - DNA, 25 bp, Mus musculus
cccaggatagggtcctgacgcggcc

SEQ ID NO: 355999 - DNA, 25 bp, Mus musculus
taccttgcgtggttcttcccgcgtc

SEQ ID NO: 356000 - DNA, 25 bp, Mus musculus
tttggacgcttaccagcgtcagccg

SEQ ID NO: 356001 - DNA, 25 bp, Mus musculus
ccaatcccttctttaccttgcgtgg

SEQ ID NO: 356002 - DNA, 25 bp, Mus musculus
gagccagagtgtcttagcaaccatc

SEQ ID NO: 356003 - DNA, 25 bp, Mus musculus
tcatagtcgtcttaagcctgccgga

SEQ ID NO: 356004 - DNA, 25 bp, Mus musculus
aggagcgagccagagtgtcttagca

SEQ ID NO: 356005 - DNA, 25 bp, Mus musculus
cttattattggtgtagagaagtgcc

SEQ ID NO: 356006 - DNA, 25 bp, Mus musculus
gtgtcttagcaaccatcacggaagt

SEQ ID NO: 356007 - DNA, 25 bp, Mus musculus
tagcaaccatcacggaagtcccgtc

SEQ ID NO: 356008 - DNA, 25 bp, Mus musculus
ctagcgttgggccaggccttgtccg

SEQ ID NO: 356009 - DNA, 25 bp, Mus musculus
ccgtcaccggacgttgacagcaata

SEQ ID NO: 356010 - DNA, 25 bp, Mus musculus
accggacgttgacagcaatatcact

SEQ ID NO: 356011 - DNA, 25 bp, Mus musculus
tgccaattaattccgaaggggccta

SEQ ID NO: 356012 - DNA, 25 bp, Mus musculus
ggggcttcgctcatagtcgtcttaa

SEQ ID NO: 356013 - DNA, 25 bp, Mus musculus
cccgccagggttgtcaaggagcgag

SEQ ID NO: 356014 - DNA, 25 bp, Mus musculus
cgtcttaagcctgccggagcagctg

SEQ ID NO: 356015 - DNA, 25 bp, Mus musculus
ggtgtagagaagtgccaattaattc

SEQ ID NO: 356016 - DNA, 25 bp, Mus musculus
tgctgcagcgccgtctggcgcagct

SEQ ID NO: 356017 - DNA, 25 bp, Mus musculus
acggcaccgaggaacgccagcatgc

SEQ ID NO: 356018 - DNA, 25 bp, Mus musculus
tccgcggtgctctgcagcagcaaca

SEQ ID NO: 356019 - DNA, 25 bp, Mus musculus
gcggtgctctgcagcagcaacagct

SEQ ID NO: 356020 - DNA, 25 bp, Mus musculus
ccagcggcgtacagaggaagcgact

SEQ ID NO: 356021 - DNA, 25 bp, Mus musculus
cacgctggcgatgatgcagatgacg

SEQ ID NO: 356022 - DNA, 25 bp, Mus musculus
tgcagatgacggcaccgaggaacgc

SEQ ID NO: 356023 - DNA, 25 bp, Mus musculus
gcagcacggccaggaacttcagcgt

SEQ ID NO: 356024 - DNA, 25 bp, Mus musculus
acggccaggaacttcagcgtgaggc

SEQ ID NO: 356025 - DNA, 25 bp, Mus musculus
ttccgtgccgggagcccgactgcgt

SEQ ID NO: 356026 - DNA, 25 bp, Mus musculus
acgcccagggcttcatctcactcag

SEQ ID NO: 356027 - DNA, 25 bp, Mus musculus
tcgatgcggtctcgcagcgcgcgca

SEQ ID NO: 356028 - DNA, 25 bp, Mus musculus
tcgatgcgctcgatgcggtctcgca

SEQ ID NO: 356029 - DNA, 25 bp, Mus musculus
actcacctcgatgcgctcgatgcgg

SEQ ID NO: 356030 - DNA, 25 bp, Mus musculus
gcaccgcagcgctggagtgcagctt

SEQ ID NO: 356031 - DNA, 25 bp, Mus musculus
cggacccttgtcaatcaccttcagg

SEQ ID NO: 356032 - DNA, 25 bp, Mus musculus
cttgacagagaaatgcacatcactg

SEQ ID NO: 356033 - DNA, 25 bp, Mus musculus
cgtgtgtgggacctcaagacttccc

SEQ ID NO: 356034 - DNA, 25 bp, Mus musculus
cacatcactgatgcggagggcctcc

SEQ ID NO: 356035 - DNA, 25 bp, Mus musculus
cgctcggcttgacagagaaatgcac

SEQ ID NO: 356036 - DNA, 25 bp, Mus musculus
atgtctttcttgagccggtgcaccg

SEQ ID NO: 356037 - DNA, 25 bp, Mus musculus
cagcggcggatgtctttcttgagcc

SEQ ID NO: 356038 - DNA, 25 bp, Mus musculus
cacggtctcagaaaagggcgagatg

SEQ ID NO: 356039 - DNA, 25 bp, Mus musculus
tgatgatgcgcacggtctcagaaaa

SEQ ID NO: 356040 - DNA, 25 bp, Mus musculus
caccttacggttgatgatgcgcacg

SEQ ID NO: 356041 - DNA, 25 bp, Mus musculus
ccggggcttcaccttacggttgatg

SEQ ID NO: 356042 - DNA, 25 bp, Mus musculus
gatgatgcggttccgcttgggctcc

SEQ ID NO: 356043 - DNA, 25 bp, Mus musculus
tcaccttcaggttcaggatgatgcg

SEQ ID NO: 356044 - DNA, 25 bp, Mus musculus
gccgagtcacgcgtacagaagagca

SEQ ID NO: 356045 - DNA, 25 bp, Mus musculus
gtactcgatgcgtccctgaaaaaca

SEQ ID NO: 356046 - DNA, 25 bp, Mus musculus
tttccatttcaccaggtactcgatg

SEQ ID NO: 356047 - DNA, 25 bp, Mus musculus
gggcacaccgcgagggctcaagcac

SEQ ID NO: 356048 - DNA, 25 bp, Mus musculus
ctcaccttgcggatccggcgtttaa

SEQ ID NO: 356049 - DNA, 25 bp, Mus musculus
cagaatgttctcctctggctcccaa

SEQ ID NO: 356050 - DNA, 25 bp, Mus musculus
cgatgagcctcgaatccagaatgtt

SEQ ID NO: 356051 - DNA, 25 bp, Mus musculus
cgtttaatgatggattcggccgcga

SEQ ID NO: 356052 - DNA, 25 bp, Mus musculus
cacttctgctcgaaggctgcgatga

SEQ ID NO: 356053 - DNA, 25 bp, Mus musculus
gcctactgcagacagctccatcttg

SEQ ID NO: 356054 - DNA, 25 bp, Mus musculus
tcccaagtgctgtacctgccgagtc

SEQ ID NO: 356055 - DNA, 25 bp, Mus musculus
gacagctccatcttgctcagcggca

SEQ ID NO: 356056 - DNA, 25 bp, Mus musculus
ctatccaaggcccaggtgtcttctt

SEQ ID NO: 356057 - DNA, 25 bp, Mus musculus
ttgctagggaaaatgagcgctcgcg

SEQ ID NO: 356058 - DNA, 25 bp, Mus musculus
ctgggctgttttcccggaggctgac

SEQ ID NO: 356059 - DNA, 25 bp, Mus musculus
gccctggcgtcccaacaggagactg

SEQ ID NO: 356060 - DNA, 25 bp, Mus musculus
tgttttcccggaggctgacccacca

SEQ ID NO: 356061 - DNA, 25 bp, Mus musculus
ggtgaatggcgcggccgcatcctcc

SEQ ID NO: 356062 - DNA, 25 bp, Mus musculus
ccgctgggctgttttcccggaggct

SEQ ID NO: 356063 - DNA, 25 bp, Mus musculus
gccgcatcctccgctgggctgtttt

SEQ ID NO: 356064 - DNA, 25 bp, Mus musculus
gtcccaacaggagactgcgcagctg

SEQ ID NO: 356065 - DNA, 25 bp, Mus musculus
gctgttttcccggaggctgacccac

SEQ ID NO: 356066 - DNA, 25 bp, Mus musculus
gcgtcccaacaggagactgcgcagc

SEQ ID NO: 356067 - DNA, 25 bp, Mus musculus
gctgacccaccagcggaaccaacgg

SEQ ID NO: 356068 - DNA, 25 bp, Mus musculus
cctggcgtcccaacaggagactgcg

SEQ ID NO: 356069 - DNA, 25 bp, Mus musculus
tggcgtcccaacaggagactgcgca

SEQ ID NO: 356070 - DNA, 25 bp, Mus musculus
gaggctgacccaccagcggaaccaa

SEQ ID NO: 356071 - DNA, 25 bp, Mus musculus
ggaggctgacccaccagcggaacca

SEQ ID NO: 356072 - DNA, 25 bp, Mus musculus
acccttgttaggagctctgagctca

SEQ ID NO: 356073 - DNA, 25 bp, Mus musculus
tagcaattaagacgcgggtttatta

SEQ ID NO: 356074 - DNA, 25 bp, Mus musculus
gccttcgtgttctcgttgtatttta

SEQ ID NO: 356075 - DNA, 25 bp, Mus musculus
gttaagccttcgtgttctcgttgta

SEQ ID NO: 356076 - DNA, 25 bp, Mus musculus
ccatgggccaccaacccttgttagg

SEQ ID NO: 356077 - DNA, 25 bp, Mus musculus
caccaacccttgttaggagctctga

SEQ ID NO: 356078 - DNA, 25 bp, Mus musculus
tgcctaccctgtgtcgcgccatggg

SEQ ID NO: 356079 - DNA, 25 bp, Mus musculus
ccactgttacccaccgtgctggagc

SEQ ID NO: 356080 - DNA, 25 bp, Mus musculus
gagctcagcagctctagacgctgct

SEQ ID NO: 356081 - DNA, 25 bp, Mus musculus
ctagacgctgctgccgtctgctgta

SEQ ID NO: 356082 - DNA, 25 bp, Mus musculus
tgctgccgtctgctgtaggcgccac

SEQ ID NO: 356083 - DNA, 25 bp, Mus musculus
cccaactccagcttcatagcaatta

SEQ ID NO: 356084 - DNA, 25 bp, Mus musculus
tccagcttcatagcaattaagacgc

SEQ ID NO: 356085 - DNA, 25 bp, Mus musculus
tcatagcaattaagacgcgggttta

SEQ ID NO: 356086 - DNA, 25 bp, Mus musculus
ggggcctgccgtgatgtaaacagaa

SEQ ID NO: 356087 - DNA, 25 bp, Mus musculus
tgccacagcccggtaaacaagctct

SEQ ID NO: 356088 - DNA, 25 bp, Mus musculus
cgtgatgtaaacagaaactgggcta

SEQ ID NO: 356089 - DNA, 25 bp, Mus musculus
cagaaactgggctagttagggccgc

SEQ ID NO: 356090 - DNA, 25 bp, Mus musculus
cacgacggcctgctggagataaaca

SEQ ID NO: 356091 - DNA, 25 bp, Mus musculus
gctggagataaacacgaccacgtga

SEQ ID NO: 356092 - DNA, 25 bp, Mus musculus
gcccggtaaacaagctctactactg

SEQ ID NO: 356093 - DNA, 25 bp, Mus musculus
aaacaagctctactactgcacccga

SEQ ID NO: 356094 - DNA, 25 bp, Mus musculus
gacccagctacgcagtaccagcgag

SEQ ID NO: 356095 - DNA, 25 bp, Mus musculus
agctacgcagtaccagcgagctgga

SEQ ID NO: 356096 - DNA, 25 bp, Mus musculus
accagcgagctggagtcaggcgatt

SEQ ID NO: 356097 - DNA, 25 bp, Mus musculus
ccagcaagacaggtcgctgggtccc

SEQ ID NO: 356098 - DNA, 25 bp, Mus musculus
cctgccgtgatgtaaacagaaactg

SEQ ID NO: 356099 - DNA, 25 bp, Mus musculus
cggcctgctggagataaacacgacc

SEQ ID NO: 356100 - DNA, 25 bp, Mus musculus
tcacgccgccgacgttccatttttg

SEQ ID NO: 356101 - DNA, 25 bp, Mus musculus
tatggctgacagctccatgcggggc

SEQ ID NO: 356102 - DNA, 25 bp, Mus musculus
gagcgggaggcaacctcgccctgtc

SEQ ID NO: 356103 - DNA, 25 bp, Mus musculus
cagcctcaccttccgcacgcgcttc

SEQ ID NO: 356104 - DNA, 25 bp, Mus musculus
gcacgcgcttcttccggatgctctc

SEQ ID NO: 356105 - DNA, 25 bp, Mus musculus
gcaaacacctgctcgcctatggctg

SEQ ID NO: 356106 - DNA, 25 bp, Mus musculus
ctcgcctatggctgacagctccatg

SEQ ID NO: 356107 - DNA, 25 bp, Mus musculus
aaagcgcccagagggtcagctccgc

SEQ ID NO: 356108 - DNA, 25 bp, Mus musculus
ctgaaagcgcccagagggtcagctc

SEQ ID NO: 356109 - DNA, 25 bp, Mus musculus
gcgcgtgcctctgaaagcgcccaga

SEQ ID NO: 356110 - DNA, 25 bp, Mus musculus
aacgttttccccagcgccagagagc

SEQ ID NO: 356111 - DNA, 25 bp, Mus musculus
catttttgaacctgcgcaacgtttt

SEQ ID NO: 356112 - DNA, 25 bp, Mus musculus
cgccgacgttccatttttgaacctg

SEQ ID NO: 356113 - DNA, 25 bp, Mus musculus
gacgttccatttttgaacctgcgca

SEQ ID NO: 356114 - DNA, 25 bp, Mus musculus
ggagcctctcattaacattcttaca

SEQ ID NO: 356115 - DNA, 25 bp, Mus musculus
ccgaggccgggcttgtctctgcaac

SEQ ID NO: 356116 - DNA, 25 bp, Mus musculus
ggggagcctctcattaacattctta

SEQ ID NO: 356117 - DNA, 25 bp, Mus musculus
aacattcttacatcagggctcctcc

SEQ ID NO: 356118 - DNA, 25 bp, Mus musculus
agatttggcccaaagccgcaaccgc

SEQ ID NO: 356119 - DNA, 25 bp, Mus musculus
cctggcctactcgcggttgccgggt

SEQ ID NO: 356120 - DNA, 25 bp, Mus musculus
gccgcaaccgcccacgtctacaccc

SEQ ID NO: 356121 - DNA, 25 bp, Mus musculus
cgcccacgtctacacccgcgggaga

SEQ ID NO: 356122 - DNA, 25 bp, Mus musculus
gagacctcgcggcacagcgttactc

SEQ ID NO: 356123 - DNA, 25 bp, Mus musculus
acctcgcggcacagcgttactctaa

SEQ ID NO: 356124 - DNA, 25 bp, Mus musculus
cgcggcacagcgttactctaaggtc

SEQ ID NO: 356125 - DNA, 25 bp, Mus musculus
cggcacagcgttactctaaggtccc

SEQ ID NO: 356126 - DNA, 25 bp, Mus musculus
cccactagttgccggtgctcagatt

SEQ ID NO: 356127 - DNA, 25 bp, Mus musculus
cggtgctcagatttggcccaaagcc

SEQ ID NO: 356128 - DNA, 25 bp, Mus musculus
cccaaaccagtcttagtaggtgatg

SEQ ID NO: 356129 - DNA, 25 bp, Mus musculus
gggaccaggctaggcgctgctaaca

SEQ ID NO: 356130 - DNA, 25 bp, Mus musculus
ccttccctgagggaccaggctaggc

SEQ ID NO: 356131 - DNA, 25 bp, Mus musculus
tcttagtaggtgatgcgaaaacgca

SEQ ID NO: 356132 - DNA, 25 bp, Mus musculus
agcaaagctttccacccggagtacg

SEQ ID NO: 356133 - DNA, 25 bp, Mus musculus
agcacgcttccacccatcaacccaa

SEQ ID NO: 356134 - DNA, 25 bp, Mus musculus
gcctgaacaggtgcctctgagtccc

SEQ ID NO: 356135 - DNA, 25 bp, Mus musculus
ctaagcaggcctgaacaggtgcctc

SEQ ID NO: 356136 - DNA, 25 bp, Mus musculus
tacgtagtctaagcaggcctgaaca

SEQ ID NO: 356137 - DNA, 25 bp, Mus musculus
ccggagtacgtagtctaagcaggcc

SEQ ID NO: 356138 - DNA, 25 bp, Mus musculus
gctaggcgctgctaacacctcgtcg

SEQ ID NO: 356139 - DNA, 25 bp, Mus musculus
tccacccggagtacgtagtctaagc

SEQ ID NO: 356140 - DNA, 25 bp, Mus musculus
ggagggacagacagcaaagctttcc

SEQ ID NO: 356141 - DNA, 25 bp, Mus musculus
gatgcgaaaacgcaccgcgagcgcc

SEQ ID NO: 356142 - DNA, 25 bp, Mus musculus
ttccgagagatctggaacacctctg

SEQ ID NO: 356143 - DNA, 25 bp, Mus musculus
acacagggcggccacaccaggaagt

SEQ ID NO: 356144 - DNA, 25 bp, Mus musculus
acctctgtgcgcgtcttgcactcgg

SEQ ID NO: 356145 - DNA, 25 bp, Mus musculus
ctggaacacctctgtgcgcgtcttg

SEQ ID NO: 356146 - DNA, 25 bp, Mus musculus
cacaccaggaagttggcgttggtgc

SEQ ID NO: 356147 - DNA, 25 bp, Mus musculus
agcagcgctgcacctccacacaggg

SEQ ID NO: 356148 - DNA, 25 bp, Mus musculus
ttgcggttattgcagcagccggagc

SEQ ID NO: 356149 - DNA, 25 bp, Mus musculus
gcacattgcggttattgcagcagcc

SEQ ID NO: 356150 - DNA, 25 bp, Mus musculus
ggcccggcattgcacattgcggtta

SEQ ID NO: 356151 - DNA, 25 bp, Mus musculus
tgcgaggcccggcattgcacattgc

SEQ ID NO: 356152 - DNA, 25 bp, Mus musculus
accggccgcatctgcacctgcgagg

SEQ ID NO: 356153 - DNA, 25 bp, Mus musculus
ttttgcgcacctggaccggccgcat

SEQ ID NO: 356154 - DNA, 25 bp, Mus musculus
gcggattttgcgcacctggaccggc

SEQ ID NO: 356155 - DNA, 25 bp, Mus musculus
gcgatcgatgaggttccgagagatc

SEQ ID NO: 356156 - DNA, 25 bp, Mus musculus
agcgtctgaacctaccgtctgtctg

SEQ ID NO: 356157 - DNA, 25 bp, Mus musculus
cgctgcaaggctccaaagttcactg

SEQ ID NO: 356158 - DNA, 25 bp, Mus musculus
gcagggcagcacacaccttctagga

SEQ ID NO: 356159 - DNA, 25 bp, Mus musculus
ctcgatgccttagacaccctagata

SEQ ID NO: 356160 - DNA, 25 bp, Mus musculus
cacatacttctagggcaggccgggt

SEQ ID NO: 356161 - DNA, 25 bp, Mus musculus
tcctgagttcgaaggcacatacttc

SEQ ID NO: 356162 - DNA, 25 bp, Mus musculus
ggtgcccactctagaccagtgcaga

SEQ ID NO: 356163 - DNA, 25 bp, Mus musculus
gggcactgatccgacctgatcgttc

SEQ ID NO: 356164 - DNA, 25 bp, Mus musculus
tgcctgtctctctagtgtctccgtc

SEQ ID NO: 356165 - DNA, 25 bp, Mus musculus
gtcctgtctctactccaagcgtctg

SEQ ID NO: 356166 - DNA, 25 bp, Mus musculus
ggggctagattccttcagaccaaca

SEQ ID NO: 356167 - DNA, 25 bp, Mus musculus
gaccgcccttgcagctaggcttctg

SEQ ID NO: 356168 - DNA, 25 bp, Mus musculus
gatcgttcccgcagacgtttccata

SEQ ID NO: 356169 - DNA, 25 bp, Mus musculus
acaaggtgcttttggatcgtccagc

SEQ ID NO: 356170 - DNA, 25 bp, Mus musculus
cgccgatgggaggtgaatacaagcc

SEQ ID NO: 356171 - DNA, 25 bp, Mus musculus
atcctttcaggattggcgagccagg

SEQ ID NO: 356172 - DNA, 25 bp, Mus musculus
aggcagcatggccatacgtaccatc

SEQ ID NO: 356173 - DNA, 25 bp, Mus musculus
cgccgcagatagagagcgaccagga

SEQ ID NO: 356174 - DNA, 25 bp, Mus musculus
cgaccaggagccagtgcaggctata

SEQ ID NO: 356175 - DNA, 25 bp, Mus musculus
tataaagccaagtgatggctccgcc

SEQ ID NO: 356176 - DNA, 25 bp, Mus musculus
gcgaacgtgttgacgcataggcgtc

SEQ ID NO: 356177 - DNA, 25 bp, Mus musculus
cccgcccactaggattgacaaatag

SEQ ID NO: 356178 - DNA, 25 bp, Mus musculus
tgacaaatagggtctacggagaatg

SEQ ID NO: 356179 - DNA, 25 bp, Mus musculus
cggagaatgattgggttcaagctta

SEQ ID NO: 356180 - DNA, 25 bp, Mus musculus
ttcaagcttagcgaaacgcctcgtc

SEQ ID NO: 356181 - DNA, 25 bp, Mus musculus
gccaggcccacaggagaccaagtta

SEQ ID NO: 356182 - DNA, 25 bp, Mus musculus
gcctcgtcgacgctgaggtttagaa

SEQ ID NO: 356183 - DNA, 25 bp, Mus musculus
agggcgcgcatcgaatgtcatttta

SEQ ID NO: 356184 - DNA, 25 bp, Mus musculus
agacctccaggctgtcgctgcttta

SEQ ID NO: 356185 - DNA, 25 bp, Mus musculus
cacaccctgatcacgcgctattttg

SEQ ID NO: 356186 - DNA, 25 bp, Mus musculus
cgcgctattttgcaaagaggtcacc

SEQ ID NO: 356187 - DNA, 25 bp, Mus musculus
agaagcacccgctttctgagcgcga

SEQ ID NO: 356188 - DNA, 25 bp, Mus musculus
cggccctgctgacacaagcggatca

SEQ ID NO: 356189 - DNA, 25 bp, Mus musculus
gctgctttacacttagcggctaggt

SEQ ID NO: 356190 - DNA, 25 bp, Mus musculus
agcccaagtttaaggccgcttattg

SEQ ID NO: 356191 - DNA, 25 bp, Mus musculus
gcggatcagggcgtggatctttttc

SEQ ID NO: 356192 - DNA, 25 bp, Mus musculus
gatctttttctagggcgcactgctg

SEQ ID NO: 356193 - DNA, 25 bp, Mus musculus
ggcgaggacctggaactagattttg

SEQ ID NO: 356194 - DNA, 25 bp, Mus musculus
tgttgctcactctgtacgctgcgga

SEQ ID NO: 356195 - DNA, 25 bp, Mus musculus
gagcctggatttttgggttccgtca

SEQ ID NO: 356196 - DNA, 25 bp, Mus musculus
ggttccgtcaagacccgcatctgtt

SEQ ID NO: 356197 - DNA, 25 bp, Mus musculus
cgcgtcgtgtcttgggtaaggacac

SEQ ID NO: 356198 - DNA, 25 bp, Mus musculus
gcgcttgctcaaggcgcctctgctg

SEQ ID NO: 356199 - DNA, 25 bp, Mus musculus
ttagatggcagagcatggccctctc

SEQ ID NO: 356200 - DNA, 25 bp, Mus musculus
ccagcagcaccggagaatagttagc

SEQ ID NO: 356201 - DNA, 25 bp, Mus musculus
cgctgtggataagctccgcggcagc

SEQ ID NO: 356202 - DNA, 25 bp, Mus musculus
caggaactgttgtctttagatggca

SEQ ID NO: 356203 - DNA, 25 bp, Mus musculus
cggagcgtggacacgactaataata

SEQ ID NO: 356204 - DNA, 25 bp, Mus musculus
gcgtggacacgactaataataaata

SEQ ID NO: 356205 - DNA, 25 bp, Mus musculus
ccgcttgtgtaaggcgtgctgtatc

SEQ ID NO: 356206 - DNA, 25 bp, Mus musculus
agtgtgaggaaaccgacccgctctc

SEQ ID NO: 356207 - DNA, 25 bp, Mus musculus
aaggcgtgctgtatctctggcattg

SEQ ID NO: 356208 - DNA, 25 bp, Mus musculus
tatctctggcattgtgtggaccgcc

SEQ ID NO: 356209 - DNA, 25 bp, Mus musculus
tgtggaccgcctcgcgtttataagc

SEQ ID NO: 356210 - DNA, 25 bp, Mus musculus
gcgtttataagcttcgccagcagca

SEQ ID NO: 356211 - DNA, 25 bp, Mus musculus
tcctcgggtgcaggaactgttgtct

SEQ ID NO: 356212 - DNA, 25 bp, Mus musculus
cacccgcacaggacgcccgggcagt

SEQ ID NO: 356213 - DNA, 25 bp, Mus musculus
ttctaccgccgctgctgagacccag

SEQ ID NO: 356214 - DNA, 25 bp, Mus musculus
cccagcggacgatgggtgagttgac

SEQ ID NO: 356215 - DNA, 25 bp, Mus musculus
gcctgctctccgcagctctccgtgg

SEQ ID NO: 356216 - DNA, 25 bp, Mus musculus
ggccagctccgcctcacacagcaca

SEQ ID NO: 356217 - DNA, 25 bp, Mus musculus
cacatacacacgaaagaggcgcggg

SEQ ID NO: 356218 - DNA, 25 bp, Mus musculus
gcacgcacggtcacaggcagggcac

SEQ ID NO: 356219 - DNA, 25 bp, Mus musculus
cgcgtccgattgctgcgcacacaca

SEQ ID NO: 356220 - DNA, 25 bp, Mus musculus
aggcgcggagctccagccatgcttt

SEQ ID NO: 356221 - DNA, 25 bp, Mus musculus
cagccatgctttgtgcgctgcgctc

SEQ ID NO: 356222 - DNA, 25 bp, Mus musculus
atgctttgtgcgctgcgctcccttc

SEQ ID NO: 356223 - DNA, 25 bp, Mus musculus
gctcccttccacctccggcgcagct

SEQ ID NO: 356224 - DNA, 25 bp, Mus musculus
cggagctccagccatgctttgtgcg

SEQ ID NO: 356225 - DNA, 25 bp, Mus musculus
acacagcacacacacccgcacagga

SEQ ID NO: 356226 - DNA, 25 bp, Mus musculus
tcccagggattcactgccgaaagca

SEQ ID NO: 356227 - DNA, 25 bp, Mus musculus
gcagcatgatgccaaagaccacgaa

SEQ ID NO: 356228 - DNA, 25 bp, Mus musculus
ggccaagcagttccagcctagaaca

SEQ ID NO: 356229 - DNA, 25 bp, Mus musculus
gctgctagcaagaggtgcacgccca

SEQ ID NO: 356230 - DNA, 25 bp, Mus musculus
tgagcgcgttgtacaaagacaggta

SEQ ID NO: 356231 - DNA, 25 bp, Mus musculus
tcaactgtgatagcaagcaggctgc

SEQ ID NO: 356232 - DNA, 25 bp, Mus musculus
agcaggctcacagtctccgagggca

SEQ ID NO: 356233 - DNA, 25 bp, Mus musculus
tccgagggcaccacgtactggaaca

SEQ ID NO: 356234 - DNA, 25 bp, Mus musculus
acagcccgccaacaggtcagcagtg

SEQ ID NO: 356235 - DNA, 25 bp, Mus musculus
actgccaccacttgggactcgttga

SEQ ID NO: 356236 - DNA, 25 bp, Mus musculus
cgcacagcagcacatcccagggatt

SEQ ID NO: 356237 - DNA, 25 bp, Mus musculus
agacagctccagtgacccgttaggt

SEQ ID NO: 356238 - DNA, 25 bp, Mus musculus
ctggcagatgcgcacgtacaagtgc

SEQ ID NO: 356239 - DNA, 25 bp, Mus musculus
tttcgcctgcgatcacagttcccga

SEQ ID NO: 356240 - DNA, 25 bp, Mus musculus
ccagtgctcacgcacccgggaccgg

SEQ ID NO: 356241 - DNA, 25 bp, Mus musculus
ccctgcgtgacgcagttgcttaatc

SEQ ID NO: 356242 - DNA, 25 bp, Mus musculus
cgtgacgcagttgcttaatccagca

SEQ ID NO: 356243 - DNA, 25 bp, Mus musculus
cgcagttgcttaatccagcagcagc

SEQ ID NO: 356244 - DNA, 25 bp, Mus musculus
gcttaatccagcagcagctggttta

SEQ ID NO: 356245 - DNA, 25 bp, Mus musculus
agcagcagctggtttacgtgtccga

SEQ ID NO: 356246 - DNA, 25 bp, Mus musculus
agcagctggtttacgtgtccgagca

SEQ ID NO: 356247 - DNA, 25 bp, Mus musculus
tttacgtgtccgagcaggtgcacct

SEQ ID NO: 356248 - DNA, 25 bp, Mus musculus
gtgtccgagcaggtgcacctgtccc

SEQ ID NO: 356249 - DNA, 25 bp, Mus musculus
ggcgaggcttcccagtgctcacgca

SEQ ID NO: 356250 - DNA, 25 bp, Mus musculus
cccacgctacctatgggacaaggga

SEQ ID NO: 356251 - DNA, 25 bp, Mus musculus
acctatgggacaagggacacccgca

SEQ ID NO: 356252 - DNA, 25 bp, Mus musculus
cagtgactcagcagcgattcccatc

SEQ ID NO: 356253 - DNA, 25 bp, Mus musculus
catctggggccacggcgaggcttcc

SEQ ID NO: 356254 - DNA, 25 bp, Mus musculus
cgaagtgtctgagggctcctcagcc

SEQ ID NO: 356255 - DNA, 25 bp, Mus musculus
aggcccatgaggcacgtgttgagta

SEQ ID NO: 356256 - DNA, 25 bp, Mus musculus
cactaggcgcaagtgggttgagtgt

SEQ ID NO: 356257 - DNA, 25 bp, Mus musculus
gtgtgtgcctgccaggctggcacgg

SEQ ID NO: 356258 - DNA, 25 bp, Mus musculus
tgcccacggtggtgcagtattccaa

SEQ ID NO: 356259 - DNA, 25 bp, Mus musculus
gcccgaagtgtctgagggctcctca

SEQ ID NO: 356260 - DNA, 25 bp, Mus musculus
agtattccaacctgcccaccaagga

SEQ ID NO: 356261 - DNA, 25 bp, Mus musculus
gacctgctcggaggcccatgaggca

SEQ ID NO: 356262 - DNA, 25 bp, Mus musculus
caaggaacgcctggtacccagggag

SEQ ID NO: 356263 - DNA, 25 bp, Mus musculus
gtaccgaggcgggttatcaacgcca

SEQ ID NO: 356264 - DNA, 25 bp, Mus musculus
aggcgggttatcaacgccatcaaca

SEQ ID NO: 356265 - DNA, 25 bp, Mus musculus
aacgccatcaacatcaaccacgagt

SEQ ID NO: 356266 - DNA, 25 bp, Mus musculus
cggtggtgcagtattccaacctgcc

SEQ ID NO: 356267 - DNA, 25 bp, Mus musculus
ccatgaggcacgtgttgagtacgcg

SEQ ID NO: 356268 - DNA, 25 bp, Mus musculus
atcatcgacgatgcggacgagatcc

SEQ ID NO: 356269 - DNA, 25 bp, Mus musculus
acctgcggcccgatgacgtctttat

SEQ ID NO: 356270 - DNA, 25 bp, Mus musculus
ctggattgcggatgactacctgcgc

SEQ ID NO: 356271 - DNA, 25 bp, Mus musculus
tcctggaccatttcccacctggtgg

SEQ ID NO: 356272 - DNA, 25 bp, Mus musculus
aggtgctctatgtcttcctggacca

SEQ ID NO: 356273 - DNA, 25 bp, Mus musculus
cttcgagtacatccgccacaaggtg

SEQ ID NO: 356274 - DNA, 25 bp, Mus musculus
gaccaatggcaccttcgagtacatc

SEQ ID NO: 356275 - DNA, 25 bp, Mus musculus
ccgagagatgctgaccaatggcacc

SEQ ID NO: 356276 - DNA, 25 bp, Mus musculus
tcggccgctcaagttccgagagatg

SEQ ID NO: 356277 - DNA, 25 bp, Mus musculus
tgaatctaatttcaccgcctacggg

SEQ ID NO: 356278 - DNA, 25 bp, Mus musculus
gacgccttcgtggtctgtgaatcta

SEQ ID NO: 356279 - DNA, 25 bp, Mus musculus
cgtttccatgagctgggagatgttg

SEQ ID NO: 356280 - DNA, 25 bp, Mus musculus
gacctgctggatgtgcgtttccatg

SEQ ID NO: 356281 - DNA, 25 bp, Mus musculus
atcaaccacgagttcgacctgctgg

SEQ ID NO: 356282 - DNA, 25 bp, Mus musculus
atccgcagcttgatccgcactgggg

SEQ ID NO: 356283 - DNA, 25 bp, Mus musculus
ggacctcaattacatccgcagcttg

SEQ ID NO: 356284 - DNA, 25 bp, Mus musculus
ccaacttccggcagtatgagaaccg

SEQ ID NO: 356285 - DNA, 25 bp, Mus musculus
tgactatgaggacaagagggacctc

SEQ ID NO: 356286 - DNA, 25 bp, Mus musculus
gcgccgccgccagtactacaccatg

SEQ ID NO: 356287 - DNA, 25 bp, Mus musculus
accatgcccaacttccggcagtatg

SEQ ID NO: 356288 - DNA, 25 bp, Mus musculus
gcaccggccacatcctagtgcagtg

SEQ ID NO: 356289 - DNA, 25 bp, Mus musculus
catcctagtgcagtggtctctcggc

SEQ ID NO: 356290 - DNA, 25 bp, Mus musculus
gcacttcgcgggctggcattgctcc

SEQ ID NO: 356291 - DNA, 25 bp, Mus musculus
ctggcattgctcctggtgcttcaca

SEQ ID NO: 356292 - DNA, 25 bp, Mus musculus
ctggtgcttcacacccgagggcatc

SEQ ID NO: 356293 - DNA, 25 bp, Mus musculus
agggcatctactttaaactcgtgtc

SEQ ID NO: 356294 - DNA, 25 bp, Mus musculus
taaactcgtgtcagcccagaatggc

SEQ ID NO: 356295 - DNA, 25 bp, Mus musculus
tgtcagcccagaatggcgacttccc

SEQ ID NO: 356296 - DNA, 25 bp, Mus musculus
ctaggtaacgtcacctaggaggcgg

SEQ ID NO: 356297 - DNA, 25 bp, Mus musculus
agtcagtcactcagcgacctcgttc

SEQ ID NO: 356298 - DNA, 25 bp, Mus musculus
gagcccgtagtcagtcactcagcga

SEQ ID NO: 356299 - DNA, 25 bp, Mus musculus
cgatcggagcccgtagtcagtcact

SEQ ID NO: 356300 - DNA, 25 bp, Mus musculus
gcgttcccgtcctctgggcgttgta

SEQ ID NO: 356301 - DNA, 25 bp, Mus musculus
cggggtctgcgttcccgtcctctgg

SEQ ID NO: 356302 - DNA, 25 bp, Mus musculus
cggttgcctcaagccacagagccag

SEQ ID NO: 356303 - DNA, 25 bp, Mus musculus
cccgtttgagctcgggccagtttgg

SEQ ID NO: 356304 - DNA, 25 bp, Mus musculus
ctggactaagttccgggctccgcct

SEQ ID NO: 356305 - DNA, 25 bp, Mus musculus
cccacgacgggcagcgctggactaa

SEQ ID NO: 356306 - DNA, 25 bp, Mus musculus
ccgtggagctaggtaacgtcaccta

SEQ ID NO: 356307 - DNA, 25 bp, Mus musculus
ggatcgcccgtttgagctcgggcca

SEQ ID NO: 356308 - DNA, 25 bp, Mus musculus
cagcgctggactaagttccgggctc

SEQ ID NO: 356309 - DNA, 25 bp, Mus musculus
agacccggttgcctcaagccacaga

SEQ ID NO: 356310 - DNA, 25 bp, Mus musculus
tcgcctactccggactgacagagag

SEQ ID NO: 356311 - DNA, 25 bp, Mus musculus
cccaatggcacgaaggccacgtgaa

SEQ ID NO: 356312 - DNA, 25 bp, Mus musculus
tggctccgcccaatggcacgaaggc

SEQ ID NO: 356313 - DNA, 25 bp, Mus musculus
gactgacagagagccggaaatgacg

SEQ ID NO: 356314 - DNA, 25 bp, Mus musculus
gcagcctcagggcagaccgctagcg

SEQ ID NO: 356315 - DNA, 25 bp, Mus musculus
gatggcttcccgagcacggtggtcc

SEQ ID NO: 356316 - DNA, 25 bp, Mus musculus
cggagcccagccatgtttgccgagc

SEQ ID NO: 356317 - DNA, 25 bp, Mus musculus
ggcttcgtaattcgagcaaaaggta

SEQ ID NO: 356318 - DNA, 25 bp, Mus musculus
tgaaaacatcccagagtgcgaggct

SEQ ID NO: 356319 - DNA, 25 bp, Mus musculus
ggggctggggaatactgaaaacatc

SEQ ID NO: 356320 - DNA, 25 bp, Mus musculus
tatagaccgaccagtcggtgcccgg

SEQ ID NO: 356321 - DNA, 25 bp, Mus musculus
gtgaccgtagtttatagaccgacca

SEQ ID NO: 356322 - DNA, 25 bp, Mus musculus
atcccagagtgcgaggctctcgagg

SEQ ID NO: 356323 - DNA, 25 bp, Mus musculus
aaatgacggcagcttagaggccctg

SEQ ID NO: 356324 - DNA, 25 bp, Mus musculus
gctgcggtaggatcacgtgaccaca

SEQ ID NO: 356325 - DNA, 25 bp, Mus musculus
ccggggaggcttacacaatggcctt

SEQ ID NO: 356326 - DNA, 25 bp, Mus musculus
taagcctccatcttgtgcaacccga

SEQ ID NO: 356327 - DNA, 25 bp, Mus musculus
agcttaatcatctcgggctcaccgg

SEQ ID NO: 356328 - DNA, 25 bp, Mus musculus
accggcctaagccatggcgtgagta

SEQ ID NO: 356329 - DNA, 25 bp, Mus musculus
tctcgcgtgataacctggcagcttc

SEQ ID NO: 356330 - DNA, 25 bp, Mus musculus
tctgcttgctgtctgccggtttaag

SEQ ID NO: 356331 - DNA, 25 bp, Mus musculus
ggcagcttcggctttgaccgtcaga

SEQ ID NO: 356332 - DNA, 25 bp, Mus musculus
catggggcctttaggacgatctcta

SEQ ID NO: 356333 - DNA, 25 bp, Mus musculus
tagtgcacttttctctcatggggcc

SEQ ID NO: 356334 - DNA, 25 bp, Mus musculus
ccgcggctggtcgtcaacctataaa

SEQ ID NO: 356335 - DNA, 25 bp, Mus musculus
cgccttgtaagacaccggaaattcg

SEQ ID NO: 356336 - DNA, 25 bp, Mus musculus
tcagagctttggctaggtgtcccac

SEQ ID NO: 356337 - DNA, 25 bp, Mus musculus
ccaccatggcgtattagaggcagca

SEQ ID NO: 356338 - DNA, 25 bp, Mus musculus
gaccgagttgaagggcgcgctctcc

SEQ ID NO: 356339 - DNA, 25 bp, Mus musculus
tggctctcctacacagcgcgactgt

SEQ ID NO: 356340 - DNA, 25 bp, Mus musculus
gtctttctcaactcacctagagcgg

SEQ ID NO: 356341 - DNA, 25 bp, Mus musculus
aggcgcctttcccttcgctgagttc

SEQ ID NO: 356342 - DNA, 25 bp, Mus musculus
tgagttccgcagtttcagagcctgg

SEQ ID NO: 356343 - DNA, 25 bp, Mus musculus
agtgctgccttagaacgcaggctca

SEQ ID NO: 356344 - DNA, 25 bp, Mus musculus
ggagtcccgctagcctggacctggc

SEQ ID NO: 356345 - DNA, 25 bp, Mus musculus
taacgccgccgacatgtttccgagc

SEQ ID NO: 356346 - DNA, 25 bp, Mus musculus
cctagagcggacttaggcgcctttc

SEQ ID NO: 356347 - DNA, 25 bp, Mus musculus
acgcaggctcaatggctttcctata

SEQ ID NO: 356348 - DNA, 25 bp, Mus musculus
ttctaagaagcgctcacagtctttc

SEQ ID NO: 356349 - DNA, 25 bp, Mus musculus
tcggcagaaactggagcaggagctc

SEQ ID NO: 356350 - DNA, 25 bp, Mus musculus
cggtgttcgctcctcggcagaaact

SEQ ID NO: 356351 - DNA, 25 bp, Mus musculus
gctacttccgccctggcggtgttcg

SEQ ID NO: 356352 - DNA, 25 bp, Mus musculus
ctctccaaggccacgaaagttctct

SEQ ID NO: 356353 - DNA, 25 bp, Mus musculus
cccagcttggtttcttggcgcgtcg

SEQ ID NO: 356354 - DNA, 25 bp, Mus musculus
gtacccatcaggtgggcgtcacatc

SEQ ID NO: 356355 - DNA, 25 bp, Mus musculus
ctggatcagagctggtgccagtgtc

SEQ ID NO: 356356 - DNA, 25 bp, Mus musculus
cggctctgcgaccagctggatcaga

SEQ ID NO: 356357 - DNA, 25 bp, Mus musculus
ttattcaacaagtcaggctgctggc

SEQ ID NO: 356358 - DNA, 25 bp, Mus musculus
ccagccacgtccatgccaaggtagg

SEQ ID NO: 356359 - DNA, 25 bp, Mus musculus
gccggctcaaccagcgctgcagaaa

SEQ ID NO: 356360 - DNA, 25 bp, Mus musculus
tgccaatactgaaacccaaagccgg

SEQ ID NO: 356361 - DNA, 25 bp, Mus musculus
ggcgcagctgatcccggaatctgag

SEQ ID NO: 356362 - DNA, 25 bp, Mus musculus
atttattatttctggggactgatcc

SEQ ID NO: 356363 - DNA, 25 bp, Mus musculus
gcgcgtcgggctctttctttataga

SEQ ID NO: 356364 - DNA, 25 bp, Mus musculus
ctgcgttggaaggacagggaacttt

SEQ ID NO: 356365 - DNA, 25 bp, Mus musculus
acgaaagttctcttggtgccaatac

SEQ ID NO: 356366 - DNA, 25 bp, Mus musculus
aagccaccctcagctgagcacgagt

SEQ ID NO: 356367 - DNA, 25 bp, Mus musculus
tgaaacacaagccaccctcagctga

SEQ ID NO: 356368 - DNA, 25 bp, Mus musculus
gcacacccaccacgcgcatcatgga

SEQ ID NO: 356369 - DNA, 25 bp, Mus musculus
tcaccaagatggacgaccgccgcga

SEQ ID NO: 356370 - DNA, 25 bp, Mus musculus
agaatgcccaacatagccaaggatg

SEQ ID NO: 356371 - DNA, 25 bp, Mus musculus
ccctgggcacgaggactgcaatggc

SEQ ID NO: 356372 - DNA, 25 bp, Mus musculus
ccagggactctgttgacctggcaga

SEQ ID NO: 356373 - DNA, 25 bp, Mus musculus
caccgtcggacactgtcccttgata

SEQ ID NO: 356374 - DNA, 25 bp, Mus musculus
ggaggatgcgccacctcgcgctgca

SEQ ID NO: 356375 - DNA, 25 bp, Mus musculus
ctgcaatggcagaatgcccaacata

SEQ ID NO: 356376 - DNA, 25 bp, Mus musculus
agctggaacagcctgaaacacaagc

SEQ ID NO: 356377 - DNA, 25 bp, Mus musculus
agctcctactatgggccctggggcc

SEQ ID NO: 356378 - DNA, 25 bp, Mus musculus
gtctttccgcagtccagctcccgga

SEQ ID NO: 356379 - DNA, 25 bp, Mus musculus
gccaaggatgtcttcaccaagatgg

SEQ ID NO: 356380 - DNA, 25 bp, Mus musculus
cgcaggcgtccggactagaacacgt

SEQ ID NO: 356381 - DNA, 25 bp, Mus musculus
gtgcctctgaccacagccgggcttt

SEQ ID NO: 356382 - DNA, 25 bp, Mus musculus
gcgccatggccgagtcccaactgag

SEQ ID NO: 356383 - DNA, 25 bp, Mus musculus
actagaacacgtgctctgggccctg

SEQ ID NO: 356384 - DNA, 25 bp, Mus musculus
cctgcgggaagatgaggctgtaccc

SEQ ID NO: 356385 - DNA, 25 bp, Mus musculus
gccgaccttccctgcactgatgggt

SEQ ID NO: 356386 - DNA, 25 bp, Mus musculus
gcgtgactcaaaggccgcacgtgcc

SEQ ID NO: 356387 - DNA, 25 bp, Mus musculus
caggcctaccgcgaactggtcaaga

SEQ ID NO: 356388 - DNA, 25 bp, Mus musculus
gctttctactactgcgagaggcggc

SEQ ID NO: 356389 - DNA, 25 bp, Mus musculus
gccgattggccgactggcgatcgct

SEQ ID NO: 356390 - DNA, 25 bp, Mus musculus
cccaactgagctgcctggacgaggc

SEQ ID NO: 356391 - DNA, 25 bp, Mus musculus
tgaccgaggcacatgcagctttcta

SEQ ID NO: 356392 - DNA, 25 bp, Mus musculus
aagccctgcagaggcggcggtccct

SEQ ID NO: 356393 - DNA, 25 bp, Mus musculus
ccagccgggctaagtaggccagaga

SEQ ID NO: 356394 - DNA, 25 bp, Mus musculus
gacgacgcctccacagcttgcggag

SEQ ID NO: 356395 - DNA, 25 bp, Mus musculus
tctgagctgcaaatgccaggcggtg

SEQ ID NO: 356396 - DNA, 25 bp, Mus musculus
gcgtgcaggcttatgtgctggaccc

SEQ ID NO: 356397 - DNA, 25 bp, Mus musculus
agccaatcccagctcggcaaacggg

SEQ ID NO: 356398 - DNA, 25 bp, Mus musculus
cagctcggcaaacgggaagcactta

SEQ ID NO: 356399 - DNA, 25 bp, Mus musculus
agcacttagccaatgaggggagacg

SEQ ID NO: 356400 - DNA, 25 bp, Mus musculus
ctgtgggatcgcaatgtgcagacgt

SEQ ID NO: 356401 - DNA, 25 bp, Mus musculus
cttcggcaaggtgaagcgagcgacc

SEQ ID NO: 356402 - DNA, 25 bp, Mus musculus
aggcatcctgcctgcggccaatgga

SEQ ID NO: 356403 - DNA, 25 bp, Mus musculus
ctaaccagtgaaagctagaggcatc

SEQ ID NO: 356404 - DNA, 25 bp, Mus musculus
ttgacgggcacgaaagctaaccagt

SEQ ID NO: 356405 - DNA, 25 bp, Mus musculus
gcctagggccctctgagctgcaaat

SEQ ID NO: 356406 - DNA, 25 bp, Mus musculus
cgccagagtgtttgtgttgtggttt

SEQ ID NO: 356407 - DNA, 25 bp, Mus musculus
ctgtccgagcgcttcgtgtcgccta

SEQ ID NO: 356408 - DNA, 25 bp, Mus musculus
acgggccattcactagctggagggc

SEQ ID NO: 356409 - DNA, 25 bp, Mus musculus
gtctccacgggccattcactagctg

SEQ ID NO: 356410 - DNA, 25 bp, Mus musculus
aaacccaggaatggcgtctccacgg

SEQ ID NO: 356411 - DNA, 25 bp, Mus musculus
gcgggccaaacccaggaatggcgtc

SEQ ID NO: 356412 - DNA, 25 bp, Mus musculus
gacagtctggtaggcttagccttgg

SEQ ID NO: 356413 - DNA, 25 bp, Mus musculus
ccgacagtctggtaggcttagcctt

SEQ ID NO: 356414 - DNA, 25 bp, Mus musculus
ctagggccgacagtctggtaggctt

SEQ ID NO: 356415 - DNA, 25 bp, Mus musculus
tccagaggaggagcctagggccgac

SEQ ID NO: 356416 - DNA, 25 bp, Mus musculus
ggaccaatcagaagccaaggtggcg

SEQ ID NO: 356417 - DNA, 25 bp, Mus musculus
ttcggaccaatcagaagccaaggtg

SEQ ID NO: 356418 - DNA, 25 bp, Mus musculus
tgtagcattcggaccaatcagaagc

SEQ ID NO: 356419 - DNA, 25 bp, Mus musculus
gcctctgtagcattcggaccaatca

SEQ ID NO: 356420 - DNA, 25 bp, Mus musculus
ggagcctctgtagcattcggaccaa

SEQ ID NO: 356421 - DNA, 25 bp, Mus musculus
acagccgaacgcaccgcggggccta

SEQ ID NO: 356422 - DNA, 25 bp, Mus musculus
gccaccacgcgtggaataattctga

SEQ ID NO: 356423 - DNA, 25 bp, Mus musculus
tctgacaggctgctttccggagatc

SEQ ID NO: 356424 - DNA, 25 bp, Mus musculus
agatcggaaccagcaccgcggttta

SEQ ID NO: 356425 - DNA, 25 bp, Mus musculus
taagagtttcggtctccagctgagc

SEQ ID NO: 356426 - DNA, 25 bp, Mus musculus
gcgggactgcagtactccaagtgtc

SEQ ID NO: 356427 - DNA, 25 bp, Mus musculus
tgcctctgcaactttcctttctggg

SEQ ID NO: 356428 - DNA, 25 bp, Mus musculus
cgcgggtcttaatgtgccttcctca

SEQ ID NO: 356429 - DNA, 25 bp, Mus musculus
cgtggggcagagattcgtagaaacc

SEQ ID NO: 356430 - DNA, 25 bp, Mus musculus
ggcgacgagccaaacttgaaccatc

SEQ ID NO: 356431 - DNA, 25 bp, Mus musculus
tcgcgtgttgaaaatggctgcatcc

SEQ ID NO: 356432 - DNA, 25 bp, Mus musculus
gcgaccctggcagtgctgaaagtta

SEQ ID NO: 356433 - DNA, 25 bp, Mus musculus
tgaaagttaccgttctccgctggcg

SEQ ID NO: 356434 - DNA, 25 bp, Mus musculus
acgccagccgcgagatgtgtttctt

SEQ ID NO: 356435 - DNA, 25 bp, Mus musculus
ttcagcgacaggtacaagttccaga

SEQ ID NO: 356436 - DNA, 25 bp, Mus musculus
agtgcctaggccgagtgttagcagc

SEQ ID NO: 356437 - DNA, 25 bp, Mus musculus
ggttcagtgcctaggccgagtgtta

SEQ ID NO: 356438 - DNA, 25 bp, Mus musculus
ccctggaagactcgggttcagtgcc

SEQ ID NO: 356439 - DNA, 25 bp, Mus musculus
ccgacttagctgttcccctggaaga

SEQ ID NO: 356440 - DNA, 25 bp, Mus musculus
tccctcagagccgacttagctgttc

SEQ ID NO: 356441 - DNA, 25 bp, Mus musculus
cggcaggtggcaactctccctcaga

SEQ ID NO: 356442 - DNA, 25 bp, Mus musculus
gcgtctcggcaggtggcaactctcc

SEQ ID NO: 356443 - DNA, 25 bp, Mus musculus
acccggaggaactgcgcctgacgca

SEQ ID NO: 356444 - DNA, 25 bp, Mus musculus
acgcgcgtgacagtgacagacccac

SEQ ID NO: 356445 - DNA, 25 bp, Mus musculus
gggacgctcacctgcctcttgagtg

SEQ ID NO: 356446 - DNA, 25 bp, Mus musculus
agcggtgcgcgagtctccgagtctc

SEQ ID NO: 356447 - DNA, 25 bp, Mus musculus
ctagcctgacctgccgaggtgctga

SEQ ID NO: 356448 - DNA, 25 bp, Mus musculus
agctgctagcctgacctgccgaggt

SEQ ID NO: 356449 - DNA, 25 bp, Mus musculus
gcgcgccgactaggaggcagctgct

SEQ ID NO: 356450 - DNA, 25 bp, Mus musculus
caagcagattacacacactcgggga

SEQ ID NO: 356451 - DNA, 25 bp, Mus musculus
tgcacggtcgcactcgactgtcctg

SEQ ID NO: 356452 - DNA, 25 bp, Mus musculus
ggcgggaacctagctgctccctagc

SEQ ID NO: 356453 - DNA, 25 bp, Mus musculus
tcatcgctgaaggaagtctggaact

SEQ ID NO: 356454 - DNA, 25 bp, Mus musculus
tcggtaactgagagatgacttcatc

SEQ ID NO: 356455 - DNA, 25 bp, Mus musculus
catagcgcagccaatcggtaactga

SEQ ID NO: 356456 - DNA, 25 bp, Mus musculus
cggcgcgacttctgtgactgacatc

SEQ ID NO: 356457 - DNA, 25 bp, Mus musculus
gcgccgttagggctagcccgattta

SEQ ID NO: 356458 - DNA, 25 bp, Mus musculus
gcgacagccgtatcgaccaatcaga

SEQ ID NO: 356459 - DNA, 25 bp, Mus musculus
accaagttagggagaggtccgcgca

SEQ ID NO: 356460 - DNA, 25 bp, Mus musculus
ccagtcagactgcaccaagttaggg

SEQ ID NO: 356461 - DNA, 25 bp, Mus musculus
tcccgagcctctagtaccagtcaga

SEQ ID NO: 356462 - DNA, 25 bp, Mus musculus
ctgtcgagtgaccagggctttgaga

SEQ ID NO: 356463 - DNA, 25 bp, Mus musculus
accggtcggtcccaagcagattaca

SEQ ID NO: 356464 - DNA, 25 bp, Mus musculus
acacttttcactcaggcgcctcaga

SEQ ID NO: 356465 - DNA, 25 bp, Mus musculus
gggtcacagactgccctggttcgct

SEQ ID NO: 356466 - DNA, 25 bp, Mus musculus
gactgcttccgggtcacagactgcc

SEQ ID NO: 356467 - DNA, 25 bp, Mus musculus
ccctgaacatcgattggtccggatc

SEQ ID NO: 356468 - DNA, 25 bp, Mus musculus
ccctggttcgctggggagaacagcc

SEQ ID NO: 356469 - DNA, 25 bp, Mus musculus
ttcgtgaaaggaccgtctcaagccc

SEQ ID NO: 356470 - DNA, 25 bp, Mus musculus
agaggccatggtgccacacttttca

SEQ ID NO: 356471 - DNA, 25 bp, Mus musculus
ttcgtaggacagcacagaggccatg

SEQ ID NO: 356472 - DNA, 25 bp, Mus musculus
ccagactttcgtaggacagcacaga

SEQ ID NO: 356473 - DNA, 25 bp, Mus musculus
ccacggcgtgtaccagactttcgta

SEQ ID NO: 356474 - DNA, 25 bp, Mus musculus
gacccatcccgagatttacttcgaa

SEQ ID NO: 356475 - DNA, 25 bp, Mus musculus
ttccagttgtgacagattcggtccc

SEQ ID NO: 356476 - DNA, 25 bp, Mus musculus
cgtccttttcgttccagttgtgaca

SEQ ID NO: 356477 - DNA, 25 bp, Mus musculus
cgagtgtgaaatgcccaggaacgcc

SEQ ID NO: 356478 - DNA, 25 bp, Mus musculus
acctcttatcttccctttggctcgg

SEQ ID NO: 356479 - DNA, 25 bp, Mus musculus
ggcgaaaaggccaacagacgtcacg

SEQ ID NO: 356480 - DNA, 25 bp, Mus musculus
aggccaacagacgtcacgctatctg

SEQ ID NO: 356481 - DNA, 25 bp, Mus musculus
acgtcacgctatctggtcacgctgc

SEQ ID NO: 356482 - DNA, 25 bp, Mus musculus
ctcttcctccgccttgtagcctccc

SEQ ID NO: 356483 - DNA, 25 bp, Mus musculus
tgtagcctccctgcagcgggtgcga

SEQ ID NO: 356484 - DNA, 25 bp, Mus musculus
ccctgcagcgggtgcgagtcaccat

SEQ ID NO: 356485 - DNA, 25 bp, Mus musculus
gtgcgagtcaccatcgcttaggata

SEQ ID NO: 356486 - DNA, 25 bp, Mus musculus
atcgcttaggataaggccgggcccg

SEQ ID NO: 356487 - DNA, 25 bp, Mus musculus
gccgggcccgtagtcccacgagaga

SEQ ID NO: 356488 - DNA, 25 bp, Mus musculus
ttccctgccgtgtcgcactcggcct

SEQ ID NO: 356489 - DNA, 25 bp, Mus musculus
ttccctttggctcggggaatggaga

SEQ ID NO: 356490 - DNA, 25 bp, Mus musculus
taaggcggcgaaaaggccaacagac

SEQ ID NO: 356491 - DNA, 25 bp, Mus musculus
gagtgcggagtcagcggcctctacc

SEQ ID NO: 356492 - DNA, 25 bp, Mus musculus
cagttgactggtttcctggcgacgc

SEQ ID NO: 356493 - DNA, 25 bp, Mus musculus
catttcctcggtgtgcaggacgctc

SEQ ID NO: 356494 - DNA, 25 bp, Mus musculus
gggtcctgcctacacatcttcacga

SEQ ID NO: 356495 - DNA, 25 bp, Mus musculus
gaaggcccgaagctcgctcactttg

SEQ ID NO: 356496 - DNA, 25 bp, Mus musculus
ctcgctcactttgcggggatccatg

SEQ ID NO: 356497 - DNA, 25 bp, Mus musculus
tggacctgtgctccgcctagaacct

SEQ ID NO: 356498 - DNA, 25 bp, Mus musculus
tctagaagtgtagctgcccgtgaca

SEQ ID NO: 356499 - DNA, 25 bp, Mus musculus
gcccgtgacaatgcctgcttcgatc

SEQ ID NO: 356500 - DNA, 25 bp, Mus musculus
tcggcgaacagtctcactcggattc

SEQ ID NO: 356501 - DNA, 25 bp, Mus musculus
aggaccttgtgtctgtgcgctttca

SEQ ID NO: 356502 - DNA, 25 bp, Mus musculus
tcaagcgggacatagggagacattt

SEQ ID NO: 356503 - DNA, 25 bp, Mus musculus
ttaagcagaacgagacgccgcatgg

SEQ ID NO: 356504 - DNA, 25 bp, Mus musculus
cgagaacctctcgaagccactaaga

SEQ ID NO: 356505 - DNA, 25 bp, Mus musculus
gcgcgcccaaaacctagccgagtga

SEQ ID NO: 356506 - DNA, 25 bp, Mus musculus
aggttgacttcgatgcgggagccaa

SEQ ID NO: 356507 - DNA, 25 bp, Mus musculus
tctggggccctattagtcttgctgg

SEQ ID NO: 356508 - DNA, 25 bp, Mus musculus
cgcagtggtcacacgacagactgtg

SEQ ID NO: 356509 - DNA, 25 bp, Mus musculus
acagactgtgtgtttccaaaatggc

SEQ ID NO: 356510 - DNA, 25 bp, Mus musculus
gggcaagaagcgctttgaagttaaa

SEQ ID NO: 356511 - DNA, 25 bp, Mus musculus
gccagcgccttcctcaaggaagcta

SEQ ID NO: 356512 - DNA, 25 bp, Mus musculus
aagggcttcatttcagggcgttcct

SEQ ID NO: 356513 - DNA, 25 bp, Mus musculus
ttgatcggcatgctggtggcccagt

SEQ ID NO: 356514 - DNA, 25 bp, Mus musculus
ctgcttactgaaatacgcgaggttg

SEQ ID NO: 356515 - DNA, 25 bp, Mus musculus
agccaagcgcttgagctgtcactga

SEQ ID NO: 356516 - DNA, 25 bp, Mus musculus
tgggatgcagactcgtgaagagact

SEQ ID NO: 356517 - DNA, 25 bp, Mus musculus
ccttcctggatcctagaatctattg

SEQ ID NO: 356518 - DNA, 25 bp, Mus musculus
tctattgactccgagggacctggcg

SEQ ID NO: 356519 - DNA, 25 bp, Mus musculus
tggggccaatcgcagagctgcttac

SEQ ID NO: 356520 - DNA, 25 bp, Mus musculus
ggcgctggctgggtctagccacacc

SEQ ID NO: 356521 - DNA, 25 bp, Mus musculus
gcactcgctccctctggggaggctg

SEQ ID NO: 356522 - DNA, 25 bp, Mus musculus
cttgaacctggcgtgcgcgccgcag

SEQ ID NO: 356523 - DNA, 25 bp, Mus musculus
cggcggctcaggctacttccgcaga

SEQ ID NO: 356524 - DNA, 25 bp, Mus musculus
ccctacggtgcacccaggtctgagg

SEQ ID NO: 356525 - DNA, 25 bp, Mus musculus
cgatctctcccgatggtctaggtcc

SEQ ID NO: 356526 - DNA, 25 bp, Mus musculus
tgagtgagtgggcaactatctctca

SEQ ID NO: 356527 - DNA, 25 bp, Mus musculus
cggactcgccctttcatgcttggcg

SEQ ID NO: 356528 - DNA, 25 bp, Mus musculus
gggtctagccacacccagatacctg

SEQ ID NO: 356529 - DNA, 25 bp, Mus musculus
ctccctctggggaggctggtcacgt

SEQ ID NO: 356530 - DNA, 25 bp, Mus musculus
ctacttccgcagaggagggccatca

SEQ ID NO: 356531 - DNA, 25 bp, Mus musculus
tgcaagccattctgcgcactcgctc

SEQ ID NO: 356532 - DNA, 25 bp, Mus musculus
acacccagatacctgggcaagcgcg

SEQ ID NO: 356533 - DNA, 25 bp, Mus musculus
aggtctgagggctcggcttgaacct

SEQ ID NO: 356534 - DNA, 25 bp, Mus musculus
aggcggccggactgatttctcctcc

SEQ ID NO: 356535 - DNA, 25 bp, Mus musculus
acgcccggctgagtgcgaactgcgc

SEQ ID NO: 356536 - DNA, 25 bp, Mus musculus
ggcgcaaaggctgaggcgaccctca

SEQ ID NO: 356537 - DNA, 25 bp, Mus musculus
aaaggctgaggcgaccctcagtccc

SEQ ID NO: 356538 - DNA, 25 bp, Mus musculus
ggaaaccattacataagcccgcgcc

SEQ ID NO: 356539 - DNA, 25 bp, Mus musculus
tctgcttgtccgctgcgcgatgtga

SEQ ID NO: 356540 - DNA, 25 bp, Mus musculus
cccgcctccttgtggcgatgagaag

SEQ ID NO: 356541 - DNA, 25 bp, Mus musculus
gagctgtgagttcccgagaattcgc

SEQ ID NO: 356542 - DNA, 25 bp, Mus musculus
tgagttcccgagaattcgctgcagc

SEQ ID NO: 356543 - DNA, 25 bp, Mus musculus
agaattcgctgcagcggacgtgctc

SEQ ID NO: 356544 - DNA, 25 bp, Mus musculus
acgtgctcgtgggatcagtgttgct

SEQ ID NO: 356545 - DNA, 25 bp, Mus musculus
cagtgttgctgtaccctcctcccgg

SEQ ID NO: 356546 - DNA, 25 bp, Mus musculus
tcggctgagctcagtgtggccatta

SEQ ID NO: 356547 - DNA, 25 bp, Mus musculus
ccctaccatttctgttgagtccgca

SEQ ID NO: 356548 - DNA, 25 bp, Mus musculus
cggcttcctatttcctgcggcatga

SEQ ID NO: 356549 - DNA, 25 bp, Mus musculus
tgcggcatgattggcccgcagctcg

SEQ ID NO: 356550 - DNA, 25 bp, Mus musculus
cagccaatgagcacactctcggaga

SEQ ID NO: 356551 - DNA, 25 bp, Mus musculus
tgagcacactctcggagagcggcga

SEQ ID NO: 356552 - DNA, 25 bp, Mus musculus
agcggcgagggcaatatggcttcct

SEQ ID NO: 356553 - DNA, 25 bp, Mus musculus
cgagggcaatatggcttcctgcacc

SEQ ID NO: 356554 - DNA, 25 bp, Mus musculus
atatggcttcctgcacctggtgacg

SEQ ID NO: 356555 - DNA, 25 bp, Mus musculus
tatttcctgcggcatgattggcccg

SEQ ID NO: 356556 - DNA, 25 bp, Mus musculus
ttgaatttggtatcatggagaaacc

SEQ ID NO: 356557 - DNA, 25 bp, Mus musculus
ctcgctcggcggacgcgccgtttta

SEQ ID NO: 356558 - DNA, 25 bp, Mus musculus
tatcatggagaaaccgcggggcact

SEQ ID NO: 356559 - DNA, 25 bp, Mus musculus
ttcctgcacctggtgacggttgagg

SEQ ID NO: 356560 - DNA, 25 bp, Mus musculus
cgcggaaccggcttcctatttcctg

SEQ ID NO: 356561 - DNA, 25 bp, Mus musculus
gcgagcgcggaaccggcttcctatt

SEQ ID NO: 356562 - DNA, 25 bp, Mus musculus
gtgcacacgctcttgtcacagctga

SEQ ID NO: 356563 - DNA, 25 bp, Mus musculus
acgctgcccttgatctgcacgatca

SEQ ID NO: 356564 - DNA, 25 bp, Mus musculus
gcggtcagccctcttctgcttgctg

SEQ ID NO: 356565 - DNA, 25 bp, Mus musculus
cctggaacagctccttcacgttgta

SEQ ID NO: 356566 - DNA, 25 bp, Mus musculus
tgtagttcatcttcgctgaggtttc

SEQ ID NO: 356567 - DNA, 25 bp, Mus musculus
tgaggtttccatgaaggcgcacttc

SEQ ID NO: 356568 - DNA, 25 bp, Mus musculus
caccagcatgatggggatgtcctcc

SEQ ID NO: 356569 - DNA, 25 bp, Mus musculus
tcaacttgtagatggggctcagctc

SEQ ID NO: 356570 - DNA, 25 bp, Mus musculus
gctcagctcatccagcgactgcttg

SEQ ID NO: 356571 - DNA, 25 bp, Mus musculus
gtgtccgtgatctgcagtgtgcaca

SEQ ID NO: 356572 - DNA, 25 bp, Mus musculus
cgcgcacttgcccttgatgcggtca

SEQ ID NO: 356573 - DNA, 25 bp, Mus musculus
atcacctgccggtacgtgtcctcta

SEQ ID NO: 356574 - DNA, 25 bp, Mus musculus
tttacaaagcggagcaccagcgagc

SEQ ID NO: 356575 - DNA, 25 bp, Mus musculus
gcgactgcttgctggtcaccgagaa

SEQ ID NO: 356576 - DNA, 25 bp, Mus musculus
tctgggtcgacacagctgcaaagtg

SEQ ID NO: 356577 - DNA, 25 bp, Mus musculus
agttgattcctactccacgctggga

SEQ ID NO: 356578 - DNA, 25 bp, Mus musculus
gggagcgttcacgtgctggtctccc

SEQ ID NO: 356579 - DNA, 25 bp, Mus musculus
cagtttccaaaactgcgttacgctt

SEQ ID NO: 356580 - DNA, 25 bp, Mus musculus
cgtacgctcacagccatcttcttta

SEQ ID NO: 356581 - DNA, 25 bp, Mus musculus
gccatcttctttagggagggattaa

SEQ ID NO: 356582 - DNA, 25 bp, Mus musculus
taaaacagccctctgggtcgacaca

SEQ ID NO: 356583 - DNA, 25 bp, Mus musculus
ggaagatcggagttgattcctactc

SEQ ID NO: 356584 - DNA, 25 bp, Mus musculus
ttttccgtggtaccgcagccggtga

SEQ ID NO: 356585 - DNA, 25 bp, Mus musculus
ctgcaaagtgcaagaggttgtcacc

SEQ ID NO: 356586 - DNA, 25 bp, Mus musculus
cctgtcccttccacgcgggaagtga

SEQ ID NO: 356587 - DNA, 25 bp, Mus musculus
ggttgtcaccaagtacgtcagtttc

SEQ ID NO: 356588 - DNA, 25 bp, Mus musculus
tacgctttttccgtggtaccgcagc

SEQ ID NO: 356589 - DNA, 25 bp, Mus musculus
ctccacgctgggagcgttcacgtgc

SEQ ID NO: 356590 - DNA, 25 bp, Mus musculus
cccgggatcctcaggaagcggttgt

SEQ ID NO: 356591 - DNA, 25 bp, Mus musculus
tccaccgcgttgtcctggaggtgta

SEQ ID NO: 356592 - DNA, 25 bp, Mus musculus
aagtggttgcgcctcaggtccagga

SEQ ID NO: 356593 - DNA, 25 bp, Mus musculus
ggacccgtggtccagtgcgagctcc

SEQ ID NO: 356594 - DNA, 25 bp, Mus musculus
gatcctcaggaagcggttgtgctcc

SEQ ID NO: 356595 - DNA, 25 bp, Mus musculus
ttgtgctccaggtacaggtagccca

SEQ ID NO: 356596 - DNA, 25 bp, Mus musculus
gtgcagcgacaccaagtggcgcaag

SEQ ID NO: 356597 - DNA, 25 bp, Mus musculus
tggtccagtgcgagctcccgcaggc

SEQ ID NO: 356598 - DNA, 25 bp, Mus musculus
cctgcagctcgttgtggtgcaggct

SEQ ID NO: 356599 - DNA, 25 bp, Mus musculus
aggcgcaccacagcgggttgccctg

SEQ ID NO: 356600 - DNA, 25 bp, Mus musculus
tgcaggtgcagcgacaccaagtggc

SEQ ID NO: 356601 - DNA, 25 bp, Mus musculus
agcgggttgtgacccagctccagcc

SEQ ID NO: 356602 - DNA, 25 bp, Mus musculus
tcctcctctcccgtgtaggtgagcg

SEQ ID NO: 356603 - DNA, 25 bp, Mus musculus
ccgtcgcaagtgctgtgccgggtct

SEQ ID NO: 356604 - DNA, 25 bp, Mus musculus
tcggtcactgcttgagagtccgcgt

SEQ ID NO: 356605 - DNA, 25 bp, Mus musculus
tcgacccagccaagcgtcagcagtg

SEQ ID NO: 356606 - DNA, 25 bp, Mus musculus
tcagcagtgactcatgccaggcttc

SEQ ID NO: 356607 - DNA, 25 bp, Mus musculus
aaagccgggcgcagcgtgatcaaaa

SEQ ID NO: 356608 - DNA, 25 bp, Mus musculus
cggctcctcgtttagctcgtgcaca

SEQ ID NO: 356609 - DNA, 25 bp, Mus musculus
cggcagtttctttccttcgatttga

SEQ ID NO: 356610 - DNA, 25 bp, Mus musculus
aaaggaagtcctgtcctccggcgct

SEQ ID NO: 356611 - DNA, 25 bp, Mus musculus
ggacgcgcgcgatgaactacaattc

SEQ ID NO: 356612 - DNA, 25 bp, Mus musculus
ccatgatgcagagcgctcggacttc

SEQ ID NO: 356613 - DNA, 25 bp, Mus musculus
ggctctttctctacagtactctgtg

SEQ ID NO: 356614 - DNA, 25 bp, Mus musculus
cggaagcgcccgcagactacaaatc

SEQ ID NO: 356615 - DNA, 25 bp, Mus musculus
ccgacagaccatgccgcgaagtagc

SEQ ID NO: 356616 - DNA, 25 bp, Mus musculus
ttcctaccgcctccaggtgagatgg

SEQ ID NO: 356617 - DNA, 25 bp, Mus musculus
tagccgcacccttccgtagaggtta

SEQ ID NO: 356618 - DNA, 25 bp, Mus musculus
caccccgggcgcgactaaagcgagg

SEQ ID NO: 356619 - DNA, 25 bp, Mus musculus
cggccgcccgtaattaaatagcatt

SEQ ID NO: 356620 - DNA, 25 bp, Mus musculus
tgcggccgcccgtaattaaatagca

SEQ ID NO: 356621 - DNA, 25 bp, Mus musculus
atgcggccgcccgtaattaaatagc

SEQ ID NO: 356622 - DNA, 25 bp, Mus musculus
tccggagccacatggaccgagctgc

SEQ ID NO: 356623 - DNA, 25 bp, Mus musculus
ctccggagccacatggaccgagctg

SEQ ID NO: 356624 - DNA, 25 bp, Mus musculus
aatgaaagtaaagcgctccggagcc

SEQ ID NO: 356625 - DNA, 25 bp, Mus musculus
gctggaaatgaaagtaaagcgctcc

SEQ ID NO: 356626 - DNA, 25 bp, Mus musculus
agcctccagcgggtgctgccgcgag

SEQ ID NO: 356627 - DNA, 25 bp, Mus musculus
gagagctgcagggagacggagcctc

SEQ ID NO: 356628 - DNA, 25 bp, Mus musculus
ctctaggacccgaggagggagagct

SEQ ID NO: 356629 - DNA, 25 bp, Mus musculus
aggaggagctgcgctctctaggacc

SEQ ID NO: 356630 - DNA, 25 bp, Mus musculus
cgcgactaaagcgaggaggagctgc

SEQ ID NO: 356631 - DNA, 25 bp, Mus musculus
aaatagcatttactcttattattac

SEQ ID NO: 356632 - DNA, 25 bp, Mus musculus
cggccacgcgagtccggggatccgg

SEQ ID NO: 356633 - DNA, 25 bp, Mus musculus
agggcatttccggtcgtggcatccg

SEQ ID NO: 356634 - DNA, 25 bp, Mus musculus
tctgctgagcaggagggcatttccg

SEQ ID NO: 356635 - DNA, 25 bp, Mus musculus
gtctgctgagcaggagggcatttcc

SEQ ID NO: 356636 - DNA, 25 bp, Mus musculus
cgagtccggggatccggggcctgcg

SEQ ID NO: 356637 - DNA, 25 bp, Mus musculus
gtcggttaccgcggccacgcgagtc

SEQ ID NO: 356638 - DNA, 25 bp, Mus musculus
cagtcggttaccgcggccacgcgag

SEQ ID NO: 356639 - DNA, 25 bp, Mus musculus
cccagtcggttaccgcggccacgcg

SEQ ID NO: 356640 - DNA, 25 bp, Mus musculus
ctgatgggtcgccccagtcggttac

SEQ ID NO: 356641 - DNA, 25 bp, Mus musculus
aatggccggctgatgggtcgcccca

SEQ ID NO: 356642 - DNA, 25 bp, Mus musculus
acaatggccggctgatgggtcgccc

SEQ ID NO: 356643 - DNA, 25 bp, Mus musculus
cgagggccggggacaatggccggct

SEQ ID NO: 356644 - DNA, 25 bp, Mus musculus
atccgcagtgcctagaggtagaggg

SEQ ID NO: 356645 - DNA, 25 bp, Mus musculus
ggcgcggtctgggtctgctgagcag

SEQ ID NO: 356646 - DNA, 25 bp, Mus musculus
ttttgcggatcccactgcaaggagg

SEQ ID NO: 356647 - DNA, 25 bp, Mus musculus
cgaggctggcagttagggtccccct

SEQ ID NO: 356648 - DNA, 25 bp, Mus musculus
cggatcccactgcaaggaggtggtc

SEQ ID NO: 356649 - DNA, 25 bp, Mus musculus
tgttttgcggatcccactgcaagga

SEQ ID NO: 356650 - DNA, 25 bp, Mus musculus
atcccactgcaaggaggtggtccga

SEQ ID NO: 356651 - DNA, 25 bp, Mus musculus
tcccactgcaaggaggtggtccgag

SEQ ID NO: 356652 - DNA, 25 bp, Mus musculus
ttgcggatcccactgcaaggaggtg

SEQ ID NO: 356653 - DNA, 25 bp, Mus musculus
tccttttgtattcgctttgaatccg

SEQ ID NO: 356654 - DNA, 25 bp, Mus musculus
ttgtattcgctttgaatccgcagtg

SEQ ID NO: 356655 - DNA, 25 bp, Mus musculus
attcgctttgaatccgcagtgccta

SEQ ID NO: 356656 - DNA, 25 bp, Mus musculus
ttcgctttgaatccgcagtgcctag

SEQ ID NO: 356657 - DNA, 25 bp, Mus musculus
cgcgcggatgttttgcggatcccac

SEQ ID NO: 356658 - DNA, 25 bp, Mus musculus
ggatgttttgcggatcccactgcaa

SEQ ID NO: 356659 - DNA, 25 bp, Mus musculus
cgcggatgttttgcggatcccactg

SEQ ID NO: 356660 - DNA, 25 bp, Mus musculus
gagagaacgctctccgcattggcta

SEQ ID NO: 356661 - DNA, 25 bp, Mus musculus
acaacttagcgacggcaggaccatt

SEQ ID NO: 356662 - DNA, 25 bp, Mus musculus
cgacttgcccgcaacaacttagcga

SEQ ID NO: 356663 - DNA, 25 bp, Mus musculus
ccattgggcaaatggcgacattctc

SEQ ID NO: 356664 - DNA, 25 bp, Mus musculus
gcgacattctcgctagccaatcgtg

SEQ ID NO: 356665 - DNA, 25 bp, Mus musculus
actgctttgcgtccgcgctgctgta

SEQ ID NO: 356666 - DNA, 25 bp, Mus musculus
tctccgcgagtcctgagagttcgtc

SEQ ID NO: 356667 - DNA, 25 bp, Mus musculus
tctgcccgggacttttctccgcgag

SEQ ID NO: 356668 - DNA, 25 bp, Mus musculus
tacgtacgccctgaggtgagagtgc

SEQ ID NO: 356669 - DNA, 25 bp, Mus musculus
caagccctccttcgtgtcgtacgta

SEQ ID NO: 356670 - DNA, 25 bp, Mus musculus
cttcggcttcgttgcttcgcaaggc

SEQ ID NO: 356671 - DNA, 25 bp, Mus musculus
ctccgcattggctagagcaaatacc

SEQ ID NO: 356672 - DNA, 25 bp, Mus musculus
gagcaaatacctcggccaacaaggg

SEQ ID NO: 356673 - DNA, 25 bp, Mus musculus
ctagccaatcgtggggaagcccgga

SEQ ID NO: 356674 - DNA, 25 bp, Mus musculus
cactgttccgcaaggcgcgcgccct

SEQ ID NO: 356675 - DNA, 25 bp, Mus musculus
ggcgcgcgccctcaacgagctgggg

SEQ ID NO: 356676 - DNA, 25 bp, Mus musculus
tggggcgccacaaagaggcctatga

SEQ ID NO: 356677 - DNA, 25 bp, Mus musculus
ggcgccacaaagaggcctatgaatg

SEQ ID NO: 356678 - DNA, 25 bp, Mus musculus
caaagaggcctatgaatgcagcagc

SEQ ID NO: 356679 - DNA, 25 bp, Mus musculus
atccgggcactgttccgcaaggcgc

SEQ ID NO: 356680 - DNA, 25 bp, Mus musculus
agagtatccgggcactgttccgcaa

SEQ ID NO: 356681 - DNA, 25 bp, Mus musculus
gcctatgaatgcagcagccggtgct

SEQ ID NO: 356682 - DNA, 25 bp, Mus musculus
cacgtgagtgccgtctcccaagcat

SEQ ID NO: 356683 - DNA, 25 bp, Mus musculus
ggcccatgcgaccacgtccttctgt

SEQ ID NO: 356684 - DNA, 25 bp, Mus musculus
agcagccggtgctccctcgcgcttc

SEQ ID NO: 356685 - DNA, 25 bp, Mus musculus
tgagtgccgtctcccaagcatctgt

SEQ ID NO: 356686 - DNA, 25 bp, Mus musculus
gtccttctgtgcctcggcttcctcc

SEQ ID NO: 356687 - DNA, 25 bp, Mus musculus
tgccgtctcccaagcatctgtactg

SEQ ID NO: 356688 - DNA, 25 bp, Mus musculus
gctccttccctctggtcctgaagaa

SEQ ID NO: 356689 - DNA, 25 bp, Mus musculus
aagaagccgcctgtggagcctcagg

SEQ ID NO: 356690 - DNA, 25 bp, Mus musculus
gctggcctggccttatgaataatga

SEQ ID NO: 356691 - DNA, 25 bp, Mus musculus
ttacgcagcgcgcaccaatcggaag

SEQ ID NO: 356692 - DNA, 25 bp, Mus musculus
tcctagcctgaagagctgtgcccgc

SEQ ID NO: 356693 - DNA, 25 bp, Mus musculus
ggttctcacagccaatcctagcctg

SEQ ID NO: 356694 - DNA, 25 bp, Mus musculus
tggcccagcacgtgtctacatcgtt

SEQ ID NO: 356695 - DNA, 25 bp, Mus musculus
aggcggagcgatactcctcacctgg

SEQ ID NO: 356696 - DNA, 25 bp, Mus musculus
ggacgcgactgaccaaaaaagaaca

SEQ ID NO: 356697 - DNA, 25 bp, Mus musculus
cctgtagtcacgaaagtggtggcga

SEQ ID NO: 356698 - DNA, 25 bp, Mus musculus
ccttcctctgaggtggcttctccga

SEQ ID NO: 356699 - DNA, 25 bp, Mus musculus
gtgcagagcctcgtgcaatcgcgcc

SEQ ID NO: 356700 - DNA, 25 bp, Mus musculus
gccagtcctggctaggcctaggcca

SEQ ID NO: 356701 - DNA, 25 bp, Mus musculus
tgggcaacctgacacccgctgaagc

SEQ ID NO: 356702 - DNA, 25 bp, Mus musculus
cgtgacctacttttcgagcacacta

SEQ ID NO: 356703 - DNA, 25 bp, Mus musculus
ttccgatgcacatgcgcactgcagc

SEQ ID NO: 356704 - DNA, 25 bp, Mus musculus
ggaaaagtttccgatgcacatgcgc

SEQ ID NO: 356705 - DNA, 25 bp, Mus musculus
ctggccaagggtccgaagcccagga

SEQ ID NO: 356706 - DNA, 25 bp, Mus musculus
cccgctctaggtcctggccaagggt

SEQ ID NO: 356707 - DNA, 25 bp, Mus musculus
ggcccagccagatagaccgcgcatg

SEQ ID NO: 356708 - DNA, 25 bp, Mus musculus
tacgcgagggcccagccagatagac

SEQ ID NO: 356709 - DNA, 25 bp, Mus musculus
tccctgtgtactacgcgagggccca

SEQ ID NO: 356710 - DNA, 25 bp, Mus musculus
ttcgagcacactacacttccctgtg

SEQ ID NO: 356711 - DNA, 25 bp, Mus musculus
aggctagaaactcgtgacctacttt

SEQ ID NO: 356712 - DNA, 25 bp, Mus musculus
gcctcctggcgaggctagaaactcg

SEQ ID NO: 356713 - DNA, 25 bp, Mus musculus
agacgtagtcctctggcctcctggc

SEQ ID NO: 356714 - DNA, 25 bp, Mus musculus
tcactcaaggcggtaccgctcagca

SEQ ID NO: 356715 - DNA, 25 bp, Mus musculus
acacttccctgtgtactacgcgagg

SEQ ID NO: 356716 - DNA, 25 bp, Mus musculus
ctcactcgggtctccacgaagggtc

SEQ ID NO: 356717 - DNA, 25 bp, Mus musculus
agagggccgcactcgaaactaggta

SEQ ID NO: 356718 - DNA, 25 bp, Mus musculus
agcccagtcgtaggttgggattcca

SEQ ID NO: 356719 - DNA, 25 bp, Mus musculus
gacgaggaccgagctcatgtgattc

SEQ ID NO: 356720 - DNA, 25 bp, Mus musculus
gctcatgtgattctttccgctgttt

SEQ ID NO: 356721 - DNA, 25 bp, Mus musculus
tccgctgtttttggaggtcgagctc

SEQ ID NO: 356722 - DNA, 25 bp, Mus musculus
aggccagccctggatgtactcgtct

SEQ ID NO: 356723 - DNA, 25 bp, Mus musculus
atagcgatcttctcaccttgtctcc

SEQ ID NO: 356724 - DNA, 25 bp, Mus musculus
ttctgcgggaagtgtaatagcgatc

SEQ ID NO: 356725 - DNA, 25 bp, Mus musculus
tgctcaccctcggaatccttctgag

SEQ ID NO: 356726 - DNA, 25 bp, Mus musculus
ggactacttttcctcccttggcatc

SEQ ID NO: 356727 - DNA, 25 bp, Mus musculus
gcaaccctgcgcatgaatctgcttt

SEQ ID NO: 356728 - DNA, 25 bp, Mus musculus
ctgggcccgaagtgagcaaagtcaa

SEQ ID NO: 356729 - DNA, 25 bp, Mus musculus
atgtactcgtctggcaggtcctgtc

SEQ ID NO: 356730 - DNA, 25 bp, Mus musculus
tatgctcttaaactgcgcgggcagc

SEQ ID NO: 356731 - DNA, 25 bp, Mus musculus
ctcacagtagtaggccaccacgggg

SEQ ID NO: 356732 - DNA, 25 bp, Mus musculus
gcttgtcatgctcctgcgccgttct

SEQ ID NO: 356733 - DNA, 25 bp, Mus musculus
ggactcggagggactcacagtagta

SEQ ID NO: 356734 - DNA, 25 bp, Mus musculus
tgctcctgcgccgttctcaaatggt

SEQ ID NO: 356735 - DNA, 25 bp, Mus musculus
cgccgttctcaaatggtgctgtatg

SEQ ID NO: 356736 - DNA, 25 bp, Mus musculus
atggtgctgtatgctcttaaactgc

SEQ ID NO: 356737 - DNA, 25 bp, Mus musculus
gaagcgctacttcctactcgccggt

SEQ ID NO: 356738 - DNA, 25 bp, Mus musculus
tcctactcgccggtcacagatactt

SEQ ID NO: 356739 - DNA, 25 bp, Mus musculus
tcgccggtcacagatacttccgctt

SEQ ID NO: 356740 - DNA, 25 bp, Mus musculus
gagcgggcaattctcacccacgcat

SEQ ID NO: 356741 - DNA, 25 bp, Mus musculus
ttgctgagacgcttgtccgcgacgg

SEQ ID NO: 356742 - DNA, 25 bp, Mus musculus
agcgcggccatctccactcccggaa

SEQ ID NO: 356743 - DNA, 25 bp, Mus musculus
cacgcatccgttgctgagacgcttg

SEQ ID NO: 356744 - DNA, 25 bp, Mus musculus
tgctgaggtcctcgagctctctgga

SEQ ID NO: 356745 - DNA, 25 bp, Mus musculus
aggtcctcgagctctctggagcagg

SEQ ID NO: 356746 - DNA, 25 bp, Mus musculus
ctctgctgaggtcctcgagctctct

SEQ ID NO: 356747 - DNA, 25 bp, Mus musculus
gagcaggttacccacgcacaggaga

SEQ ID NO: 356748 - DNA, 25 bp, Mus musculus
agctctctggagcaggttacccacg

SEQ ID NO: 356749 - DNA, 25 bp, Mus musculus
gcatgagagccgcgctccttctagc

SEQ ID NO: 356750 - DNA, 25 bp, Mus musculus
gagagcatgagagccgcgctccttc

SEQ ID NO: 356751 - DNA, 25 bp, Mus musculus
cacaggagagcatgagagccgcgct

SEQ ID NO: 356752 - DNA, 25 bp, Mus musculus
ccacgcacaggagagcatgagagcc

SEQ ID NO: 356753 - DNA, 25 bp, Mus musculus
tacccacgcacaggagagcatgaga

SEQ ID NO: 356754 - DNA, 25 bp, Mus musculus
ctctggagcaggttacccacgcaca

SEQ ID NO: 356755 - DNA, 25 bp, Mus musculus
ggttacccacgcacaggagagcatg

SEQ ID NO: 356756 - DNA, 25 bp, Mus musculus
tggagcaggttacccacgcacagga

SEQ ID NO: 356757 - DNA, 25 bp, Mus musculus
ctcgagctctctggagcaggttacc

SEQ ID NO: 356758 - DNA, 25 bp, Mus musculus
caggatggcaggaggaaacctaagc

SEQ ID NO: 356759 - DNA, 25 bp, Mus musculus
tttaaatacgctttcctagacagga

SEQ ID NO: 356760 - DNA, 25 bp, Mus musculus
gccaggatggcaggaggaaacctaa

SEQ ID NO: 356761 - DNA, 25 bp, Mus musculus
aaactccgcggtgccaggatggcag

SEQ ID NO: 356762 - DNA, 25 bp, Mus musculus
gcaaactccgcggtgccaggatggc

SEQ ID NO: 356763 - DNA, 25 bp, Mus musculus
aggaggagagaaatgccgggcggga

SEQ ID NO: 356764 - DNA, 25 bp, Mus musculus
ctttcctagacaggaggagagaaat

SEQ ID NO: 356765 - DNA, 25 bp, Mus musculus
cgctttcctagacaggaggagagaa

SEQ ID NO: 356766 - DNA, 25 bp, Mus musculus
taaatacgctttcctagacaggagg

SEQ ID NO: 356767 - DNA, 25 bp, Mus musculus
agagatttaaatacgctttcctaga

SEQ ID NO: 356768 - DNA, 25 bp, Mus musculus
gatcaacggaggtatagagatttaa

SEQ ID NO: 356769 - DNA, 25 bp, Mus musculus
gagcagagatcaacggaggtataga

SEQ ID NO: 356770 - DNA, 25 bp, Mus musculus
aagagcagagatcaacggaggtata

SEQ ID NO: 356771 - DNA, 25 bp, Mus musculus
atacgctttcctagacaggaggaga

SEQ ID NO: 356772 - DNA, 25 bp, Mus musculus
gcggtgagatcggaaagtttccagt

SEQ ID NO: 356773 - DNA, 25 bp, Mus musculus
ggtgcaacggcagtctccgaaccca

SEQ ID NO: 356774 - DNA, 25 bp, Mus musculus
gtgcgttttattttccttgatcacg

SEQ ID NO: 356775 - DNA, 25 bp, Mus musculus
actgtgtgcgttttattttccttga

SEQ ID NO: 356776 - DNA, 25 bp, Mus musculus
tacgaactgtgtgcgttttattttc

SEQ ID NO: 356777 - DNA, 25 bp, Mus musculus
ccagttacgaactgtgtgcgtttta

SEQ ID NO: 356778 - DNA, 25 bp, Mus musculus
agtttccagttacgaactgtgtgcg

SEQ ID NO: 356779 - DNA, 25 bp, Mus musculus
ttttccttgatcacgtaggcaagag

SEQ ID NO: 356780 - DNA, 25 bp, Mus musculus
tctccgaacccacgtggggcggtga

SEQ ID NO: 356781 - DNA, 25 bp, Mus musculus
tttattttccttgatcacgtaggca

SEQ ID NO: 356782 - DNA, 25 bp, Mus musculus
cgttcctgaaggttccggtgcaacg

SEQ ID NO: 356783 - DNA, 25 bp, Mus musculus
acggcagtctccgaacccacgtggg

SEQ ID NO: 356784 - DNA, 25 bp, Mus musculus
aaggttccggtgcaacggcagtctc

SEQ ID NO: 356785 - DNA, 25 bp, Mus musculus
ttcctgaaggttccggtgcaacggc

SEQ ID NO: 356786 - DNA, 25 bp, Mus musculus
tgtcagtgcacaaaatggcgcctta

SEQ ID NO: 356787 - DNA, 25 bp, Mus musculus
atggcgccttacagcctcctggtca

SEQ ID NO: 356788 - DNA, 25 bp, Mus musculus
gcgacctcatctttgtcagtgcaca

SEQ ID NO: 356789 - DNA, 25 bp, Mus musculus
ggcgccatttgtcacgtcactttca

SEQ ID NO: 356790 - DNA, 25 bp, Mus musculus
cttcgatgcttttttaagggcgcca

SEQ ID NO: 356791 - DNA, 25 bp, Mus musculus
ggttgactcgtctctctgtaagccc

SEQ ID NO: 356792 - DNA, 25 bp, Mus musculus
cacgccgggtttccgtcatgtaagc

SEQ ID NO: 356793 - DNA, 25 bp, Mus musculus
gcatctttgctttccacgccgggtt

SEQ ID NO: 356794 - DNA, 25 bp, Mus musculus
gccgaacgccgagttggcagtttcc

SEQ ID NO: 356795 - DNA, 25 bp, Mus musculus
ttcctgcgttgtcctaggtcaaggc

SEQ ID NO: 356796 - DNA, 25 bp, Mus musculus
gcacaggctgttcgcagttcccatc

SEQ ID NO: 356797 - DNA, 25 bp, Mus musculus
agcgagcccagagacgtgggtttac

SEQ ID NO: 356798 - DNA, 25 bp, Mus musculus
gctatctgcactcttggctgcggga

SEQ ID NO: 356799 - DNA, 25 bp, Mus musculus
tcacccggctgcaggtaagcgagcc

SEQ ID NO: 356800 - DNA, 25 bp, Mus musculus
gaacatcctgcgctagggctctgga

SEQ ID NO: 356801 - DNA, 25 bp, Mus musculus
gcactctcccgcaagtgagagaaga

SEQ ID NO: 356802 - DNA, 25 bp, Mus musculus
cagagcttcgcgaggctcccgtgag

SEQ ID NO: 356803 - DNA, 25 bp, Mus musculus
tgaccaataagaagcatctgcccgc

SEQ ID NO: 356804 - DNA, 25 bp, Mus musculus
tcagcttccggaaaactgaccaata

SEQ ID NO: 356805 - DNA, 25 bp, Mus musculus
tgccaaaccaaatcaactcagcttc

SEQ ID NO: 356806 - DNA, 25 bp, Mus musculus
agctacgctcgtctcccggaggaaa

SEQ ID NO: 356807 - DNA, 25 bp, Mus musculus
tccaattctggaagctacgctcgtc

SEQ ID NO: 356808 - DNA, 25 bp, Mus musculus
agggcctgggctccaattctggaag

SEQ ID NO: 356809 - DNA, 25 bp, Mus musculus
tgacaagccaaacctgcagccgagc

SEQ ID NO: 356810 - DNA, 25 bp, Mus musculus
ctctggagaccggagaggctgccaa

SEQ ID NO: 356811 - DNA, 25 bp, Mus musculus
gtccagcaacgctgcgcttgccaaa

SEQ ID NO: 356812 - DNA, 25 bp, Mus musculus
gtatgcgcacggtgtccaccatctc

SEQ ID NO: 356813 - DNA, 25 bp, Mus musculus
agtttccgctcaaactgccacgggg

SEQ ID NO: 356814 - DNA, 25 bp, Mus musculus
cgtcaaacaggcagaggatgcgctc

SEQ ID NO: 356815 - DNA, 25 bp, Mus musculus
acgccgcgttctcacgctagcttga

SEQ ID NO: 356816 - DNA, 25 bp, Mus musculus
cttgaggacggactagttgtgcatc

SEQ ID NO: 356817 - DNA, 25 bp, Mus musculus
tgcatcctagggctaaaatggggta

SEQ ID NO: 356818 - DNA, 25 bp, Mus musculus
ctggaactggggatacccgccctat

SEQ ID NO: 356819 - DNA, 25 bp, Mus musculus
gggtcccatctcctcggtgacagga

SEQ ID NO: 356820 - DNA, 25 bp, Mus musculus
cgttgacatggcagtgacggcttca

SEQ ID NO: 356821 - DNA, 25 bp, Mus musculus
ttgaggttgatctcagggcgctccc

SEQ ID NO: 356822 - DNA, 25 bp, Mus musculus
tgagggtcccgtccacgtcaaacag

SEQ ID NO: 356823 - DNA, 25 bp, Mus musculus
agagtcctcgtacccgacggagata

SEQ ID NO: 356824 - DNA, 25 bp, Mus musculus
cttagaagcgcacggagctctgcct

SEQ ID NO: 356825 - DNA, 25 bp, Mus musculus
ggatacagcatctgcgctcccggca

SEQ ID NO: 356826 - DNA, 25 bp, Mus musculus
gagctttggaacctcgaggccctta

SEQ ID NO: 356827 - DNA, 25 bp, Mus musculus
tgcactccacgtttccgacagggtc

SEQ ID NO: 356828 - DNA, 25 bp, Mus musculus
gtcaggccatccgttatcttctcct

SEQ ID NO: 356829 - DNA, 25 bp, Mus musculus
cacacttccatggttacgacgacga

SEQ ID NO: 356830 - DNA, 25 bp, Mus musculus
tccatggttacgacgacgacccgaa

SEQ ID NO: 356831 - DNA, 25 bp, Mus musculus
ttgcgtcaggccatccgttatcttc

SEQ ID NO: 356832 - DNA, 25 bp, Mus musculus
cacttccatggttacgacgacgacc

SEQ ID NO: 356833 - DNA, 25 bp, Mus musculus
cccagaaacggaagttgcgtcaggc

SEQ ID NO: 356834 - DNA, 25 bp, Mus musculus
acccacacttccatggttacgacga

SEQ ID NO: 356835 - DNA, 25 bp, Mus musculus
tgaagaacccacacttccatggtta

SEQ ID NO: 356836 - DNA, 25 bp, Mus musculus
acttgaagaacccacacttccatgg

SEQ ID NO: 356837 - DNA, 25 bp, Mus musculus
ggccatccgttatcttctcctccgg

SEQ ID NO: 356838 - DNA, 25 bp, Mus musculus
gcgtcaggccatccgttatcttctc

SEQ ID NO: 356839 - DNA, 25 bp, Mus musculus
gaagttgcgtcaggccatccgttat

SEQ ID NO: 356840 - DNA, 25 bp, Mus musculus
gaaacggaagttgcgtcaggccatc

SEQ ID NO: 356841 - DNA, 25 bp, Mus musculus
cttccatggttacgacgacgacccg

SEQ ID NO: 356842 - DNA, 25 bp, Mus musculus
caggaagaaccgaccgtgcagtgga

SEQ ID NO: 356843 - DNA, 25 bp, Mus musculus
gcctggcggttaagtttgtgcgctc

SEQ ID NO: 356844 - DNA, 25 bp, Mus musculus
cccgaaggtggatgccttgaatatg

SEQ ID NO: 356845 - DNA, 25 bp, Mus musculus
aggtggatgccttgaatatgcacgc

SEQ ID NO: 356846 - DNA, 25 bp, Mus musculus
gaccgtgcagtggatggaggaccca

SEQ ID NO: 356847 - DNA, 25 bp, Mus musculus
aagaaccgaccgtgcagtggatgga

SEQ ID NO: 356848 - DNA, 25 bp, Mus musculus
tcatggcggcctggcggttaagttt

SEQ ID NO: 356849 - DNA, 25 bp, Mus musculus
aggctgccccactttgctggaaatc

SEQ ID NO: 356850 - DNA, 25 bp, Mus musculus
tggcggttaagtttgtgcgctcgca

SEQ ID NO: 356851 - DNA, 25 bp, Mus musculus
tttccgcaattcgacggctccaggc

SEQ ID NO: 356852 - DNA, 25 bp, Mus musculus
gcagcctttccgcaattcgacggct

SEQ ID NO: 356853 - DNA, 25 bp, Mus musculus
taagtttgtgcgctcgcagcctttc

SEQ ID NO: 356854 - DNA, 25 bp, Mus musculus
cggttaagtttgtgcgctcgcagcc

SEQ ID NO: 356855 - DNA, 25 bp, Mus musculus
tccgcaattcgacggctccaggctg

SEQ ID NO: 356856 - DNA, 25 bp, Mus musculus
gctgtcggccctctttcttatgtaa

SEQ ID NO: 356857 - DNA, 25 bp, Mus musculus
cgacgacgacaagggcgactccaag

SEQ ID NO: 356858 - DNA, 25 bp, Mus musculus
cgactccaaggaaacgcggctgacc

SEQ ID NO: 356859 - DNA, 25 bp, Mus musculus
ctgaccctgatggaggaggtgctcc

SEQ ID NO: 356860 - DNA, 25 bp, Mus musculus
agcgccctctcgtcccaaggagtgt

SEQ ID NO: 356861 - DNA, 25 bp, Mus musculus
gggttttcccgtcctctgctcacaa

SEQ ID NO: 356862 - DNA, 25 bp, Mus musculus
agcactcttagttccgaagtcttgg

SEQ ID NO: 356863 - DNA, 25 bp, Mus musculus
gtcttggcgatctttgcgtttcttc

SEQ ID NO: 356864 - DNA, 25 bp, Mus musculus
tcttcgccgtctgccgcaaataatg

SEQ ID NO: 356865 - DNA, 25 bp, Mus musculus
tggcaactccaacccaagactgttg

SEQ ID NO: 356866 - DNA, 25 bp, Mus musculus
tgagatctaaagactcggggctacc

SEQ ID NO: 356867 - DNA, 25 bp, Mus musculus
ccgcggctcccaagtattgagtttt

SEQ ID NO: 356868 - DNA, 25 bp, Mus musculus
ttcgcggatctacttgctgtcggcc

SEQ ID NO: 356869 - DNA, 25 bp, Mus musculus
gggctgaaggctcccttgtgtaccc

SEQ ID NO: 356870 - DNA, 25 bp, Mus musculus
ctctggccgcaagcgttccagttta

SEQ ID NO: 356871 - DNA, 25 bp, Mus musculus
gtaggttcgccgcaccacatgtgtt

SEQ ID NO: 356872 - DNA, 25 bp, Mus musculus
accttctgctgtcccagtggcttgc

SEQ ID NO: 356873 - DNA, 25 bp, Mus musculus
ttgcacgcttagtgtcgcgcgaccc

SEQ ID NO: 356874 - DNA, 25 bp, Mus musculus
ccacatgtgttggatgaggcctgcc

SEQ ID NO: 356875 - DNA, 25 bp, Mus musculus
gcgtgatgacgcaacgtcgctgatt

SEQ ID NO: 356876 - DNA, 25 bp, Mus musculus
tcacgcatgtgcgttcggtgctgac

SEQ ID NO: 356877 - DNA, 25 bp, Mus musculus
cggggacgcactttcacgcatgtgc

SEQ ID NO: 356878 - DNA, 25 bp, Mus musculus
agagatcccagagactccgcacgga

SEQ ID NO: 356879 - DNA, 25 bp, Mus musculus
cgcgaccggcaacgactactgtgag

SEQ ID NO: 356880 - DNA, 25 bp, Mus musculus
cggatagagatttggcggctccatc

SEQ ID NO: 356881 - DNA, 25 bp, Mus musculus
cgtacacgtagagcttcaccggata

SEQ ID NO: 356882 - DNA, 25 bp, Mus musculus
ggcccttggacaggtcgtacacgta

SEQ ID NO: 356883 - DNA, 25 bp, Mus musculus
gcctgccttggtggcttgcttgcac

SEQ ID NO: 356884 - DNA, 25 bp, Mus musculus
tccctaagtcttagttcccgacaga

SEQ ID NO: 356885 - DNA, 25 bp, Mus musculus
gagtgcctcgcatcccgggatttca

SEQ ID NO: 356886 - DNA, 25 bp, Mus musculus
accatcccacgtggggcgctcattt

SEQ ID NO: 356887 - DNA, 25 bp, Mus musculus
ttagttcccgacagaccctggctgc

SEQ ID NO: 356888 - DNA, 25 bp, Mus musculus
tctgggcacgcccacggctgcaaag

SEQ ID NO: 356889 - DNA, 25 bp, Mus musculus
acctgggacctcagctgcccgggat

SEQ ID NO: 356890 - DNA, 25 bp, Mus musculus
caagacgcagcgaacagggcccgcg

SEQ ID NO: 356891 - DNA, 25 bp, Mus musculus
gcgctcactcaccatggctgcggtg

SEQ ID NO: 356892 - DNA, 25 bp, Mus musculus
gactcgacgacagcccaactcaaga

SEQ ID NO: 356893 - DNA, 25 bp, Mus musculus
ctcaagagggactgaaacgccgcgc

SEQ ID NO: 356894 - DNA, 25 bp, Mus musculus
aaggagcggaaatcacttcagaagc

SEQ ID NO: 356895 - DNA, 25 bp, Mus musculus
atcacttcagaagcggcaggaagcg

SEQ ID NO: 356896 - DNA, 25 bp, Mus musculus
acagacgggcttccacacgcgttca

SEQ ID NO: 356897 - DNA, 25 bp, Mus musculus
acgagaaggagaacagacgggcttc

SEQ ID NO: 356898 - DNA, 25 bp, Mus musculus
gctgctgaccatcccgcgtttggga

SEQ ID NO: 356899 - DNA, 25 bp, Mus musculus
cgcgttggaactgctgccggagccc

SEQ ID NO: 356900 - DNA, 25 bp, Mus musculus
aggctcgcgctcctccacgtgcgct

SEQ ID NO: 356901 - DNA, 25 bp, Mus musculus
ctcacgtctgcatggcctgcgcgtt

SEQ ID NO: 356902 - DNA, 25 bp, Mus musculus
agagatgaagaagcggcgctgctcc

SEQ ID NO: 356903 - DNA, 25 bp, Mus musculus
agatgacggctgctgaccatcccgc

SEQ ID NO: 356904 - DNA, 25 bp, Mus musculus
ggcagatgacggctgctgaccatcc

SEQ ID NO: 356905 - DNA, 25 bp, Mus musculus
aaaacctgcgctgcagagccgggga

SEQ ID NO: 356906 - DNA, 25 bp, Mus musculus
cgcgggaaaacctgcgctgcagagc

SEQ ID NO: 356907 - DNA, 25 bp, Mus musculus
cgcttgcgcagaagcggcgcgggaa

SEQ ID NO: 356908 - DNA, 25 bp, Mus musculus
cggagcgctcttccgactgcgcttg

SEQ ID NO: 356909 - DNA, 25 bp, Mus musculus
tctgcatggcctgcgcgttggaact

SEQ ID NO: 356910 - DNA, 25 bp, Mus musculus
acgtgcgctcggagcgctcttccga

SEQ ID NO: 356911 - DNA, 25 bp, Mus musculus
atcaccggcacgatccgcgctggct

SEQ ID NO: 356912 - DNA, 25 bp, Mus musculus
cggaaggtcagcaccagctgctcca

SEQ ID NO: 356913 - DNA, 25 bp, Mus musculus
gcgctcacggtcacagccaacttgg

SEQ ID NO: 356914 - DNA, 25 bp, Mus musculus
acttggccgcatccctcaggggtac

SEQ ID NO: 356915 - DNA, 25 bp, Mus musculus
caccagcgtctcgtggatggccacg

SEQ ID NO: 356916 - DNA, 25 bp, Mus musculus
gccaggccctcgaacacagagtgtg

SEQ ID NO: 356917 - DNA, 25 bp, Mus musculus
acagagtgtgcagacagcgcgaaga

SEQ ID NO: 356918 - DNA, 25 bp, Mus musculus
acaggctgtggctacggttgcccac

SEQ ID NO: 356919 - DNA, 25 bp, Mus musculus
aacgggctctcgtactccgagtcgc

SEQ ID NO: 356920 - DNA, 25 bp, Mus musculus
tgcccgcatctgagccggcgttgaa

SEQ ID NO: 356921 - DNA, 25 bp, Mus musculus
ggcgttgaaggtctccaggtctata

SEQ ID NO: 356922 - DNA, 25 bp, Mus musculus
caggtctataaagggaggccgctcc

SEQ ID NO: 356923 - DNA, 25 bp, Mus musculus
agctgctccacgaacacagtgagga

SEQ ID NO: 356924 - DNA, 25 bp, Mus musculus
atgcccactgggatcatggcgctca

SEQ ID NO: 356925 - DNA, 25 bp, Mus musculus
catcatgagcgtctccgccagcggg

SEQ ID NO: 356926 - DNA, 25 bp, Mus musculus
cggttgctgtagagttccgcgcctt

SEQ ID NO: 356927 - DNA, 25 bp, Mus musculus
ccgaagagtagagtatcagtcatga

SEQ ID NO: 356928 - DNA, 25 bp, Mus musculus
agcgagatttagaggccgaagagta

SEQ ID NO: 356929 - DNA, 25 bp, Mus musculus
cttgccgagtctgaaagagcgctgg

SEQ ID NO: 356930 - DNA, 25 bp, Mus musculus
ctctacaagacgagttcggagtcgc

SEQ ID NO: 356931 - DNA, 25 bp, Mus musculus
ggccactaccacaggctctacaaga

SEQ ID NO: 356932 - DNA, 25 bp, Mus musculus
ccgaagctccaaggcgcggaaccaa

SEQ ID NO: 356933 - DNA, 25 bp, Mus musculus
cgcggtttgctgacgcgctttcagc

SEQ ID NO: 356934 - DNA, 25 bp, Mus musculus
tgccggactgtactgtaggcttctt

SEQ ID NO: 356935 - DNA, 25 bp, Mus musculus
gtctcctagcactgctggccggttg

SEQ ID NO: 356936 - DNA, 25 bp, Mus musculus
cccggtctcattggtcaggagcagc

SEQ ID NO: 356937 - DNA, 25 bp, Mus musculus
gacagctgcagcgacacgcgccaga

SEQ ID NO: 356938 - DNA, 25 bp, Mus musculus
tccaccagaaccgagatcatcagcg

SEQ ID NO: 356939 - DNA, 25 bp, Mus musculus
tcggacacctagaaaggctcgcttg

SEQ ID NO: 356940 - DNA, 25 bp, Mus musculus
ctggtcccattgacaacaaacttgg

SEQ ID NO: 356941 - DNA, 25 bp, Mus musculus
ttgctcctggagctgatccaacgga

SEQ ID NO: 356942 - DNA, 25 bp, Mus musculus
tttccgggctctcgacaaagttgct

SEQ ID NO: 356943 - DNA, 25 bp, Mus musculus
tgatccaacggaaaagtagcggctc

SEQ ID NO: 356944 - DNA, 25 bp, Mus musculus
gtagcggctcctttaagccagaaga

SEQ ID NO: 356945 - DNA, 25 bp, Mus musculus
ggctactctccgctggcgcttggat

SEQ ID NO: 356946 - DNA, 25 bp, Mus musculus
gcggagtcccgctatgcaaatctga

SEQ ID NO: 356947 - DNA, 25 bp, Mus musculus
tggctaatgcaagcctggtcccatt

SEQ ID NO: 356948 - DNA, 25 bp, Mus musculus
acacgcgctctggtttgtccggtct

SEQ ID NO: 356949 - DNA, 25 bp, Mus musculus
gtctccctgagctggacctcacggg

SEQ ID NO: 356950 - DNA, 25 bp, Mus musculus
cgttctggagaccatggagaccctc

SEQ ID NO: 356951 - DNA, 25 bp, Mus musculus
cgatgagctgactctcggggacatc

SEQ ID NO: 356952 - DNA, 25 bp, Mus musculus
ggttcccagttcttctggctccaga

SEQ ID NO: 356953 - DNA, 25 bp, Mus musculus
tctgagctgctgatcgatgacgcac

SEQ ID NO: 356954 - DNA, 25 bp, Mus musculus
cgctgctgtaaaagctcgcctgctg

SEQ ID NO: 356955 - DNA, 25 bp, Mus musculus
cgaacttggcatagtcaggctgcaa

SEQ ID NO: 356956 - DNA, 25 bp, Mus musculus
ctgctttgagggtagcgaacttggc

SEQ ID NO: 356957 - DNA, 25 bp, Mus musculus
ctgtagccttgagcgcagctgcttt

SEQ ID NO: 356958 - DNA, 25 bp, Mus musculus
ttatccctagggaactggccgcagc

SEQ ID NO: 356959 - DNA, 25 bp, Mus musculus
ggtgaagaaggtagcattatcccta

SEQ ID NO: 356960 - DNA, 25 bp, Mus musculus
cccggattggtcaagcgggctccct

SEQ ID NO: 356961 - DNA, 25 bp, Mus musculus
gtcaggctgctcagcacctgcttta

SEQ ID NO: 356962 - DNA, 25 bp, Mus musculus
gatagaagtcctggggtgcaacctc

SEQ ID NO: 356963 - DNA, 25 bp, Mus musculus
tctccgtagagggaaaacgttgata

SEQ ID NO: 356964 - DNA, 25 bp, Mus musculus
cgtcgagcaacgcaggcaagtcctc

SEQ ID NO: 356965 - DNA, 25 bp, Mus musculus
cataagggaccgacgagacaggacc

SEQ ID NO: 356966 - DNA, 25 bp, Mus musculus
tcgggcagcttctccacgctgaact

SEQ ID NO: 356967 - DNA, 25 bp, Mus musculus
aggctgcaacgtcaggctgccacca

SEQ ID NO: 356968 - DNA, 25 bp, Mus musculus
ccactggcccatcacgtcgtaatag

SEQ ID NO: 356969 - DNA, 25 bp, Mus musculus
agaagctgtagacgcccgagctgca

SEQ ID NO: 356970 - DNA, 25 bp, Mus musculus
cccgatgccgaccagcacgagtaga

SEQ ID NO: 356971 - DNA, 25 bp, Mus musculus
cgcacgtgccgcagcagaagctgta

SEQ ID NO: 356972 - DNA, 25 bp, Mus musculus
gcggcgagtgctcgcctgcacagtc

SEQ ID NO: 356973 - DNA, 25 bp, Mus musculus
ccagtctgcacccaggccggtgtgt

SEQ ID NO: 356974 - DNA, 25 bp, Mus musculus
atcacgtcgtaatagccgcggcagc

SEQ ID NO: 356975 - DNA, 25 bp, Mus musculus
cacaagtgagctcggtgtagagtac

SEQ ID NO: 356976 - DNA, 25 bp, Mus musculus
cgtcgtggcaacagaagcggtagcc

SEQ ID NO: 356977 - DNA, 25 bp, Mus musculus
gcctgggtcttttggagactgcgcc

SEQ ID NO: 356978 - DNA, 25 bp, Mus musculus
tagaccgcagtgtggctgcgctccc

SEQ ID NO: 356979 - DNA, 25 bp, Mus musculus
ctgcggttccagacacaagtgagct

SEQ ID NO: 356980 - DNA, 25 bp, Mus musculus
tcacctcggactgcgcacggtggag

SEQ ID NO: 356981 - DNA, 25 bp, Mus musculus
accagcacgagtagagcggcgacac

SEQ ID NO: 356982 - DNA, 25 bp, Mus musculus
ccctgtagtctagaatgaaaccgcg

SEQ ID NO: 356983 - DNA, 25 bp, Mus musculus
gcgtgtggaagagctcacaggacac

SEQ ID NO: 356984 - DNA, 25 bp, Mus musculus
aatgaaaccgcgacgcagcatcctc

SEQ ID NO: 356985 - DNA, 25 bp, Mus musculus
ggtcgaagcactcggtctgattgca

SEQ ID NO: 356986 - DNA, 25 bp, Mus musculus
ggctgtgtgccctgtagtctagaat

SEQ ID NO: 356987 - DNA, 25 bp, Mus musculus
acagttccgagtctgggctgtgtgc

SEQ ID NO: 356988 - DNA, 25 bp, Mus musculus
cctcatgcagctgggacagttccga

SEQ ID NO: 356989 - DNA, 25 bp, Mus musculus
agcactcggtctgattgcactgggt

SEQ ID NO: 356990 - DNA, 25 bp, Mus musculus
tctcaccagagggtcgaagcactcg

SEQ ID NO: 356991 - DNA, 25 bp, Mus musculus
aggacacgcagtttctcaccagagg

SEQ ID NO: 356992 - DNA, 25 bp, Mus musculus
agctcacaggacacgcagtttctca

SEQ ID NO: 356993 - DNA, 25 bp, Mus musculus
gctcctctggcttcggacccggagt

SEQ ID NO: 356994 - DNA, 25 bp, Mus musculus
catgtcgccgcctcatgcagctggg

SEQ ID NO: 356995 - DNA, 25 bp, Mus musculus
cactgggtgggcaccgagctgtccc

SEQ ID NO: 356996 - DNA, 25 bp, Mus musculus
cgcctattggtggaggcgtccctca

SEQ ID NO: 356997 - DNA, 25 bp, Mus musculus
gtggtaaaatcagccgcgcgcctat

SEQ ID NO: 356998 - DNA, 25 bp, Mus musculus
cgccgctccgattggtccagagtaa

SEQ ID NO: 356999 - DNA, 25 bp, Mus musculus
tggcgctttcaaaccgtcgcaaggc

SEQ ID NO: 357000 - DNA, 25 bp, Mus musculus
tggaacgcccactcagccggtggta

SEQ ID NO: 357001 - DNA, 25 bp, Mus musculus
ggagccctaaggagccatccacgga

SEQ ID NO: 357002 - DNA, 25 bp, Mus musculus
caccagctgcgaagggagagaacca

SEQ ID NO: 357003 - DNA, 25 bp, Mus musculus
cggagggagccatttcctcagaaga

SEQ ID NO: 357004 - DNA, 25 bp, Mus musculus
taccaagacggtagccctgttcagg

SEQ ID NO: 357005 - DNA, 25 bp, Mus musculus
tacacactcagctagaggcggctcg

SEQ ID NO: 357006 - DNA, 25 bp, Mus musculus
aaccaggcagatggagatccgagca

SEQ ID NO: 357007 - DNA, 25 bp, Mus musculus
tttgagcatcgactccgccagctgc

SEQ ID NO: 357008 - DNA, 25 bp, Mus musculus
agaagcgcatcctcggtgctcacca

SEQ ID NO: 357009 - DNA, 25 bp, Mus musculus
acgcgggaaagccacgttcgaactg

SEQ ID NO: 357010 - DNA, 25 bp, Mus musculus
aaccgcggcgatccagcgcaatatc

SEQ ID NO: 357011 - DNA, 25 bp, Mus musculus
ataggctctaaggagacagacaagg

SEQ ID NO: 357012 - DNA, 25 bp, Mus musculus
tccggcacccgctccctcgtgctgg

SEQ ID NO: 357013 - DNA, 25 bp, Mus musculus
gatacaggcaccttacccggccgag

SEQ ID NO: 357014 - DNA, 25 bp, Mus musculus
gcgcaatatcccaatcaccgcgtga

SEQ ID NO: 357015 - DNA, 25 bp, Mus musculus
gctagggataggctctaaggagaca

SEQ ID NO: 357016 - DNA, 25 bp, Mus musculus
cacggtcgccggcagctgccaccag

SEQ ID NO: 357017 - DNA, 25 bp, Mus musculus
ggagacagacaaggactgggataca

SEQ ID NO: 357018 - DNA, 25 bp, Mus musculus
aggactgggatacaggcaccttacc

SEQ ID NO: 357019 - DNA, 25 bp, Mus musculus
cgtgactcacgcacgcgcacggtcg

SEQ ID NO: 357020 - DNA, 25 bp, Mus musculus
gcctgggcagaaccgcggcgatcca

SEQ ID NO: 357021 - DNA, 25 bp, Mus musculus
ggcgatccagcgcaatatcccaatc

SEQ ID NO: 357022 - DNA, 25 bp, Mus musculus
aatatcccaatcaccgcgtgactca

SEQ ID NO: 357023 - DNA, 25 bp, Mus musculus
ctcctgcgccctggacctggtaagg

SEQ ID NO: 357024 - DNA, 25 bp, Mus musculus
tttcctgggcggaagcttatccaca

SEQ ID NO: 357025 - DNA, 25 bp, Mus musculus
cctaccggtgttgcagcccaatcgg

SEQ ID NO: 357026 - DNA, 25 bp, Mus musculus
aaaccggctgcttggtgggcagtac

SEQ ID NO: 357027 - DNA, 25 bp, Mus musculus
acgggcagaatgttgtccttaacgc

SEQ ID NO: 357028 - DNA, 25 bp, Mus musculus
tctctttggcctcgccggtagaagc

SEQ ID NO: 357029 - DNA, 25 bp, Mus musculus
tgatagggctgcaccaagacccgcc

SEQ ID NO: 357030 - DNA, 25 bp, Mus musculus
gtgcgatcaaacaactggcctctga

SEQ ID NO: 357031 - DNA, 25 bp, Mus musculus
cgcgctggctggaagctgttattta

SEQ ID NO: 357032 - DNA, 25 bp, Mus musculus
tttctgggctctgtaaatctctctc

SEQ ID NO: 357033 - DNA, 25 bp, Mus musculus
agttccgcgtgtgattccttgagtg

SEQ ID NO: 357034 - DNA, 25 bp, Mus musculus
ggcctctgaatgaccaccgcgtgaa

SEQ ID NO: 357035 - DNA, 25 bp, Mus musculus
accgcgtgaaatcgagtcggcccga

SEQ ID NO: 357036 - DNA, 25 bp, Mus musculus
gtcggcccgagtcagaagctaacta

SEQ ID NO: 357037 - DNA, 25 bp, Mus musculus
gagcggccacatcaaaacgaacctg

SEQ ID NO: 357038 - DNA, 25 bp, Mus musculus
cgtcacgctggacggggactttgtc

SEQ ID NO: 357039 - DNA, 25 bp, Mus musculus
ggaactcaagctgcgtctcagtgac

SEQ ID NO: 357040 - DNA, 25 bp, Mus musculus
ataagaacggggatgtggcagactt

SEQ ID NO: 357041 - DNA, 25 bp, Mus musculus
ctgttaacgggaggcttggagctca

SEQ ID NO: 357042 - DNA, 25 bp, Mus musculus
tgaccgtctgttaacgggaggcttg

SEQ ID NO: 357043 - DNA, 25 bp, Mus musculus
gatgctgccagatgaccgtctgtta

SEQ ID NO: 357044 - DNA, 25 bp, Mus musculus
cccgaagtgatgctgccagatgacc

SEQ ID NO: 357045 - DNA, 25 bp, Mus musculus
ggcttggagctcacggataagaacg

SEQ ID NO: 357046 - DNA, 25 bp, Mus musculus
tctcagtgaccttgcggtcccatca

SEQ ID NO: 357047 - DNA, 25 bp, Mus musculus
gactttgtcatctgcgggagaaggc

SEQ ID NO: 357048 - DNA, 25 bp, Mus musculus
ctgcaggaactcaagctgcgtctca

SEQ ID NO: 357049 - DNA, 25 bp, Mus musculus
ctcactctggttctcgctgcaggaa

SEQ ID NO: 357050 - DNA, 25 bp, Mus musculus
aaggctgctggcctcactctggttc

SEQ ID NO: 357051 - DNA, 25 bp, Mus musculus
accttgcggtcccatcactgggtct

SEQ ID NO: 357052 - DNA, 25 bp, Mus musculus
gctcagtccgcggtaagccgtgaaa

SEQ ID NO: 357053 - DNA, 25 bp, Mus musculus
cttgtacctatagcgacccgggagg

SEQ ID NO: 357054 - DNA, 25 bp, Mus musculus
gaggcggaatgtcacgggacaaccc

SEQ ID NO: 357055 - DNA, 25 bp, Mus musculus
ggacaacccttcttgagcaaccaat

SEQ ID NO: 357056 - DNA, 25 bp, Mus musculus
aacccttcttgagcaaccaatcaga

SEQ ID NO: 357057 - DNA, 25 bp, Mus musculus
ctagcaacgccgtgccctccctcta

SEQ ID NO: 357058 - DNA, 25 bp, Mus musculus
agctccgcccatctaagctcgcgtt

SEQ ID NO: 357059 - DNA, 25 bp, Mus musculus
atctaagctcgcgttctgcgcgttc

SEQ ID NO: 357060 - DNA, 25 bp, Mus musculus
aagctcgcgttctgcgcgttcccga

SEQ ID NO: 357061 - DNA, 25 bp, Mus musculus
gttctgcgcgttcccgaggcgcgct

SEQ ID NO: 357062 - DNA, 25 bp, Mus musculus
tgcctcgggtctggttggagtcctc

SEQ ID NO: 357063 - DNA, 25 bp, Mus musculus
tctggttggagtcctccgtcctccg

SEQ ID NO: 357064 - DNA, 25 bp, Mus musculus
cagtccgcggtaagccgtgaaagcc

SEQ ID NO: 357065 - DNA, 25 bp, Mus musculus
gccgcttgtacctatagcgacccgg

SEQ ID NO: 357066 - DNA, 25 bp, Mus musculus
ggaccaagacgcctgcgcagaaaaa

SEQ ID NO: 357067 - DNA, 25 bp, Mus musculus
cctaaacgctgaccttttcgtgaga

SEQ ID NO: 357068 - DNA, 25 bp, Mus musculus
ggttgggacgctgtctgcctcagtt

SEQ ID NO: 357069 - DNA, 25 bp, Mus musculus
ttcgctctaaaacagaagtgacgtc

SEQ ID NO: 357070 - DNA, 25 bp, Mus musculus
gtgcacccttcgctctaaaacagaa

SEQ ID NO: 357071 - DNA, 25 bp, Mus musculus
cccgaagagagcagaagtccggatc

SEQ ID NO: 357072 - DNA, 25 bp, Mus musculus
tgcgcatgcgctcaagtgcaccctt

SEQ ID NO: 357073 - DNA, 25 bp, Mus musculus
cttttcgtgagaaaaagcgacgagg

SEQ ID NO: 357074 - DNA, 25 bp, Mus musculus
catttcctgtgtaggtttccttttg

SEQ ID NO: 357075 - DNA, 25 bp, Mus musculus
agcacagcgaagctaaacccacaga

SEQ ID NO: 357076 - DNA, 25 bp, Mus musculus
ttgtcccaggggctcccgagcacag

SEQ ID NO: 357077 - DNA, 25 bp, Mus musculus
agcagaagtccggatcacaagccac

SEQ ID NO: 357078 - DNA, 25 bp, Mus musculus
ggctcccgagcacagcgaagctaaa

SEQ ID NO: 357079 - DNA, 25 bp, Mus musculus
tgtaggtttccttttgcgcatgcgc

SEQ ID NO: 357080 - DNA, 25 bp, Mus musculus
agtcctgtggcgcaggcaggtcccc

SEQ ID NO: 357081 - DNA, 25 bp, Mus musculus
acagcatcgcactcgacgggccagg

SEQ ID NO: 357082 - DNA, 25 bp, Mus musculus
agcccagggggcgacagcatcgcac

SEQ ID NO: 357083 - DNA, 25 bp, Mus musculus
ccggggttcagagcgagaaagccca

SEQ ID NO: 357084 - DNA, 25 bp, Mus musculus
ctgcggccacgtttgcgacctgggc

SEQ ID NO: 357085 - DNA, 25 bp, Mus musculus
tcctgcggccacgtttgcgacctgg

SEQ ID NO: 357086 - DNA, 25 bp, Mus musculus
ggcgactttgcggatctggaggcct

SEQ ID NO: 357087 - DNA, 25 bp, Mus musculus
cgagccgaggcgactttgcggatct

SEQ ID NO: 357088 - DNA, 25 bp, Mus musculus
aatatgcgagccgaggcgactttgc

SEQ ID NO: 357089 - DNA, 25 bp, Mus musculus
ctccaatatgcgagccgaggcgact

SEQ ID NO: 357090 - DNA, 25 bp, Mus musculus
ttccctccaatatgcgagccgaggc

SEQ ID NO: 357091 - DNA, 25 bp, Mus musculus
agtttccctccaatatgcgagccga

SEQ ID NO: 357092 - DNA, 25 bp, Mus musculus
ggccgtggacgtggctggaaagccc

SEQ ID NO: 357093 - DNA, 25 bp, Mus musculus
cctcagtttccctccaatatgcgag

SEQ ID NO: 357094 - DNA, 25 bp, Mus musculus
ttcccgtgtgtgtcacgagtctcgc

SEQ ID NO: 357095 - DNA, 25 bp, Mus musculus
ccggtgaaagtgagtgtctgtcttg

SEQ ID NO: 357096 - DNA, 25 bp, Mus musculus
cgccattttgcccaagccggtgaaa

SEQ ID NO: 357097 - DNA, 25 bp, Mus musculus
atcgtcactcgcagcggcgccattt

SEQ ID NO: 357098 - DNA, 25 bp, Mus musculus
ccaggtaccgtcgaggtcagtcatc

SEQ ID NO: 357099 - DNA, 25 bp, Mus musculus
gcagctcaggtctcagccaggtacc

SEQ ID NO: 357100 - DNA, 25 bp, Mus musculus
tgtctacaccgtaccgggcagctca

SEQ ID NO: 357101 - DNA, 25 bp, Mus musculus
gagaggtggcgatgtctacaccgta

SEQ ID NO: 357102 - DNA, 25 bp, Mus musculus
gttgcagttcgacccggggctctct

SEQ ID NO: 357103 - DNA, 25 bp, Mus musculus
tctcgcgagttttggagaaagtttc

SEQ ID NO: 357104 - DNA, 25 bp, Mus musculus
tgacgtcactacgtcgtccgggcgc

SEQ ID NO: 357105 - DNA, 25 bp, Mus musculus
cgaggactttcccaccggcatacga

SEQ ID NO: 357106 - DNA, 25 bp, Mus musculus
atacgaatgcgtgctctgcgcaggc

SEQ ID NO: 357107 - DNA, 25 bp, Mus musculus
gggcgtccttctcctgacgtcacta

SEQ ID NO: 357108 - DNA, 25 bp, Mus musculus
gaggcgctctgtctgctcttaccaa

SEQ ID NO: 357109 - DNA, 25 bp, Mus musculus
caggtcgcgactgaaaatgggcttc

SEQ ID NO: 357110 - DNA, 25 bp, Mus musculus
cgggctctgcaatgcgcatgctcta

SEQ ID NO: 357111 - DNA, 25 bp, Mus musculus
aaatgggcttcaccgaggtactggc

SEQ ID NO: 357112 - DNA, 25 bp, Mus musculus
caatggcagtctttccgcagcaaca

SEQ ID NO: 357113 - DNA, 25 bp, Mus musculus
gcatagataacggtgccaggcggca

SEQ ID NO: 357114 - DNA, 25 bp, Mus musculus
gcaacagtgcgtactgctgagcata

SEQ ID NO: 357115 - DNA, 25 bp, Mus musculus
caaaagtttgttccttcagccaggc

SEQ ID NO: 357116 - DNA, 25 bp, Mus musculus
tagacatggtgtcgatcgcaaaagc

SEQ ID NO: 357117 - DNA, 25 bp, Mus musculus
ggctcgtttctgtcccactacgtga

SEQ ID NO: 357118 - DNA, 25 bp, Mus musculus
acctcccgataccaagcgcggtaga

SEQ ID NO: 357119 - DNA, 25 bp, Mus musculus
ctgactggactagggctctctgatt

SEQ ID NO: 357120 - DNA, 25 bp, Mus musculus
tgcgcatgctctaccgcggaaacac

SEQ ID NO: 357121 - DNA, 25 bp, Mus musculus
ctcggaggagaagacctcgggcata

SEQ ID NO: 357122 - DNA, 25 bp, Mus musculus
ctcaggccgcaacgaccaggtatct

SEQ ID NO: 357123 - DNA, 25 bp, Mus musculus
aggcgacaggcagccgcatccacat

SEQ ID NO: 357124 - DNA, 25 bp, Mus musculus
ataacagagcgtcaggtgacggcgc

SEQ ID NO: 357125 - DNA, 25 bp, Mus musculus
tccacatggcctcaggtgttcgcgc

SEQ ID NO: 357126 - DNA, 25 bp, Mus musculus
ggctgccaagaacgtggacccctca

SEQ ID NO: 357127 - DNA, 25 bp, Mus musculus
agccgcatccacatggcctcaggtg

SEQ ID NO: 357128 - DNA, 25 bp, Mus musculus
ggaagtgcatcctgcgcccctagct

SEQ ID NO: 357129 - DNA, 25 bp, Mus musculus
aggccgcaacgaccaggtatctccg

SEQ ID NO: 357130 - DNA, 25 bp, Mus musculus
tcccgaggctcagcacttgcagggc

SEQ ID NO: 357131 - DNA, 25 bp, Mus musculus
cgggccacgacctgtgctcccagca

SEQ ID NO: 357132 - DNA, 25 bp, Mus musculus
gttttttctctccattctcccaaca

SEQ ID NO: 357133 - DNA, 25 bp, Mus musculus
ccattctcccaacacacaggaaata

SEQ ID NO: 357134 - DNA, 25 bp, Mus musculus
cacaggaaataacagagcgtcaggt

SEQ ID NO: 357135 - DNA, 25 bp, Mus musculus
ggccaagaggccagcaacgccggtc

SEQ ID NO: 357136 - DNA, 25 bp, Mus musculus
agagcaaactttcgcgaccgtggga

SEQ ID NO: 357137 - DNA, 25 bp, Mus musculus
cactcgagcagctgcggcctttgat

SEQ ID NO: 357138 - DNA, 25 bp, Mus musculus
cgcccagcgggcacgcctcacacgc

SEQ ID NO: 357139 - DNA, 25 bp, Mus musculus
acaaggcagtgaaggccgcccagga

SEQ ID NO: 357140 - DNA, 25 bp, Mus musculus
cagctgcggcctttgatggggacaa

SEQ ID NO: 357141 - DNA, 25 bp, Mus musculus
ttcaaagctgcagccgccactcgag

SEQ ID NO: 357142 - DNA, 25 bp, Mus musculus
ggcagtttcaaagctgcagccgcca

SEQ ID NO: 357143 - DNA, 25 bp, Mus musculus
catcgctctttatggcagtttcaaa

SEQ ID NO: 357144 - DNA, 25 bp, Mus musculus
tccctccatcgctctttatggcagt

SEQ ID NO: 357145 - DNA, 25 bp, Mus musculus
tgctgcggctgcactcgaccaacag

SEQ ID NO: 357146 - DNA, 25 bp, Mus musculus
caaactttcgcgaccgtgggagagg

SEQ ID NO: 357147 - DNA, 25 bp, Mus musculus
tcacacgccagagcaaactttcgcg

SEQ ID NO: 357148 - DNA, 25 bp, Mus musculus
gcggccgccctcctgggcactgctc

SEQ ID NO: 357149 - DNA, 25 bp, Mus musculus
tgcctggactgtccctggcccggtg

SEQ ID NO: 357150 - DNA, 25 bp, Mus musculus
ttacaaagtgcgttcacagacatta

SEQ ID NO: 357151 - DNA, 25 bp, Mus musculus
agggcccagagtctgccaaagcctc

SEQ ID NO: 357152 - DNA, 25 bp, Mus musculus
gcctcagggcccagagtctgccaaa

SEQ ID NO: 357153 - DNA, 25 bp, Mus musculus
cgcgtaatcactgagcagagaggcc

SEQ ID NO: 357154 - DNA, 25 bp, Mus musculus
ctgccgcgtaatcactgagcagaga

SEQ ID NO: 357155 - DNA, 25 bp, Mus musculus
accggctgccgcgtaatcactgagc

SEQ ID NO: 357156 - DNA, 25 bp, Mus musculus
aaatctctcgctctggctccggagc

SEQ ID NO: 357157 - DNA, 25 bp, Mus musculus
ataaatctctcgctctggctccgga

SEQ ID NO: 357158 - DNA, 25 bp, Mus musculus
aaccacaataaatctctcgctctgg

SEQ ID NO: 357159 - DNA, 25 bp, Mus musculus
cagtttacaaagtgcgttcacagac

SEQ ID NO: 357160 - DNA, 25 bp, Mus musculus
acagacattatcacgtcggctccta

SEQ ID NO: 357161 - DNA, 25 bp, Mus musculus
ctcccccgctacagtttacaaagtg

SEQ ID NO: 357162 - DNA, 25 bp, Mus musculus
cctcctcggcgccagcaggggcaga

SEQ ID NO: 357163 - DNA, 25 bp, Mus musculus
acattatcacgtcggctcctaaacg

SEQ ID NO: 357164 - DNA, 25 bp, Mus musculus
tccgggagttactcaacgcactcca

SEQ ID NO: 357165 - DNA, 25 bp, Mus musculus
tgcgctcatctacaccgcctcgggg

SEQ ID NO: 357166 - DNA, 25 bp, Mus musculus
ccgtttcagatctcccgggcgcctc

SEQ ID NO: 357167 - DNA, 25 bp, Mus musculus
ctcagccttggggatcagtctgtcc

SEQ ID NO: 357168 - DNA, 25 bp, Mus musculus
agccactgcggacctcagccttggg

SEQ ID NO: 357169 - DNA, 25 bp, Mus musculus
gcgcgcacctccacacactctccag

SEQ ID NO: 357170 - DNA, 25 bp, Mus musculus
ccgagtcccaggaccgcgcgcacct

SEQ ID NO: 357171 - DNA, 25 bp, Mus musculus
agcctcgcttgctcccggctacctg

SEQ ID NO: 357172 - DNA, 25 bp, Mus musculus
caactcgcgtccacagcctcgcttg

SEQ ID NO: 357173 - DNA, 25 bp, Mus musculus
gtggctctgcaacactaccaaccat

SEQ ID NO: 357174 - DNA, 25 bp, Mus musculus
gcgtctacagcttcccgtggctctg

SEQ ID NO: 357175 - DNA, 25 bp, Mus musculus
cagaagcgtctacagcttcccgtgg

SEQ ID NO: 357176 - DNA, 25 bp, Mus musculus
gcactccagcaaactttccagaagc

SEQ ID NO: 357177 - DNA, 25 bp, Mus musculus
aacgcactccagcaaactttccaga

SEQ ID NO: 357178 - DNA, 25 bp, Mus musculus
ccgaaggaccggagcaattccacca

SEQ ID NO: 357179 - DNA, 25 bp, Mus musculus
cagcactgctcttcttgcctggggc

SEQ ID NO: 357180 - DNA, 25 bp, Mus musculus
gggataaagcctgcgcagcactgct

SEQ ID NO: 357181 - DNA, 25 bp, Mus musculus
ctccgagtcacagggataaagcctg

SEQ ID NO: 357182 - DNA, 25 bp, Mus musculus
tggcagctccgagtcacagggataa

SEQ ID NO: 357183 - DNA, 25 bp, Mus musculus
gtggcctccttttatgataaggtta

SEQ ID NO: 357184 - DNA, 25 bp, Mus musculus
caccacgtggcctccttttatgata

SEQ ID NO: 357185 - DNA, 25 bp, Mus musculus
cgctgccataaatagacaccacgtg

SEQ ID NO: 357186 - DNA, 25 bp, Mus musculus
agaattggcacaccgcgagcctcct

SEQ ID NO: 357187 - DNA, 25 bp, Mus musculus
cggagcaattccaccagctctcaga

SEQ ID NO: 357188 - DNA, 25 bp, Mus musculus
ccacatcgtttattctttcaccgca

SEQ ID NO: 357189 - DNA, 25 bp, Mus musculus
ttctttcaccgcatggcaagctccg

SEQ ID NO: 357190 - DNA, 25 bp, Mus musculus
accgcatggcaagctccgaaggacc

SEQ ID NO: 357191 - DNA, 25 bp, Mus musculus
agctctcagaattggcacaccgcga

SEQ ID NO: 357192 - DNA, 25 bp, Mus musculus
acagcggataactagcttctgagga

SEQ ID NO: 357193 - DNA, 25 bp, Mus musculus
ctgcgtttccacgacgacggcgtca

SEQ ID NO: 357194 - DNA, 25 bp, Mus musculus
accatcttggccaactgggagcgca

SEQ ID NO: 357195 - DNA, 25 bp, Mus musculus
ttcttcctgcgagacaccatcttgg

SEQ ID NO: 357196 - DNA, 25 bp, Mus musculus
cagccttccgtttcttcctgcgaga

SEQ ID NO: 357197 - DNA, 25 bp, Mus musculus
gctcggtatgctctcctcgtggccg

SEQ ID NO: 357198 - DNA, 25 bp, Mus musculus
caaaatggtgggtccctggccctca

SEQ ID NO: 357199 - DNA, 25 bp, Mus musculus
atacctgacgagttgccagggcctc

SEQ ID NO: 357200 - DNA, 25 bp, Mus musculus
agccgcggaatcagcacccagagtc

SEQ ID NO: 357201 - DNA, 25 bp, Mus musculus
ctttcggaggaacagccgcggaatc

SEQ ID NO: 357202 - DNA, 25 bp, Mus musculus
gaagctgcaacgctgggcctaggac

SEQ ID NO: 357203 - DNA, 25 bp, Mus musculus
ttctgaggacgacgaagctgcaacg

SEQ ID NO: 357204 - DNA, 25 bp, Mus musculus
aacgagacacgagcagaacagcgga

SEQ ID NO: 357205 - DNA, 25 bp, Mus musculus
ctgcggaagcgcttgttaaagaacg

SEQ ID NO: 357206 - DNA, 25 bp, Mus musculus
cagcgcacaccgtcttggggttatc

SEQ ID NO: 357207 - DNA, 25 bp, Mus musculus
ctctcccagggaaacagcagtccta

SEQ ID NO: 357208 - DNA, 25 bp, Mus musculus
ttgggtgccctcactcgcctctttg

SEQ ID NO: 357209 - DNA, 25 bp, Mus musculus
cgcctctttgcttgaactgggatcc

SEQ ID NO: 357210 - DNA, 25 bp, Mus musculus
cccgattgtcactgaactttctcca

SEQ ID NO: 357211 - DNA, 25 bp, Mus musculus
cttggggttatcgagctcagctacc

SEQ ID NO: 357212 - DNA, 25 bp, Mus musculus
gaagaggagtttgcgccacctaacg

SEQ ID NO: 357213 - DNA, 25 bp, Mus musculus
ctcttacctcccactagaaggaaga

SEQ ID NO: 357214 - DNA, 25 bp, Mus musculus
atttaggcgtcccaggcaaggcgcc

SEQ ID NO: 357215 - DNA, 25 bp, Mus musculus
gattccttccctctgctggatccga

SEQ ID NO: 357216 - DNA, 25 bp, Mus musculus
atgctccgagcctccagaatgggcg

SEQ ID NO: 357217 - DNA, 25 bp, Mus musculus
atcccgagcgtcttgcgatcggtgg

SEQ ID NO: 357218 - DNA, 25 bp, Mus musculus
ggtctcttcacctgttcgcggatcg

SEQ ID NO: 357219 - DNA, 25 bp, Mus musculus
aaggcgcctccggttatcccgctgt

SEQ ID NO: 357220 - DNA, 25 bp, Mus musculus
tcgcaccactgacagggcaagctcg

SEQ ID NO: 357221 - DNA, 25 bp, Mus musculus
acagcagaggaactggctcaggtga

SEQ ID NO: 357222 - DNA, 25 bp, Mus musculus
tgagagccacagcagaggaactggc

SEQ ID NO: 357223 - DNA, 25 bp, Mus musculus
acgcgccttcctagcgtgctcggag

SEQ ID NO: 357224 - DNA, 25 bp, Mus musculus
atgcacactcgcgttgaccagctgc

SEQ ID NO: 357225 - DNA, 25 bp, Mus musculus
tcctgcgcatgcacactcgcgttga

SEQ ID NO: 357226 - DNA, 25 bp, Mus musculus
ctcactcacctatgacagccaattg

SEQ ID NO: 357227 - DNA, 25 bp, Mus musculus
ggtgcgtaaggctccgcctcactca

SEQ ID NO: 357228 - DNA, 25 bp, Mus musculus
agactggttgttcctgcgcatgcac

SEQ ID NO: 357229 - DNA, 25 bp, Mus musculus
taatgtgggcggaaccgcgatgcac

SEQ ID NO: 357230 - DNA, 25 bp, Mus musculus
gcgcatgcgcaaaatcgcaccactg

SEQ ID NO: 357231 - DNA, 25 bp, Mus musculus
ggctccactgtgttcagcgcatgcg

SEQ ID NO: 357232 - DNA, 25 bp, Mus musculus
tgacagccaattgcgggctccactg

SEQ ID NO: 357233 - DNA, 25 bp, Mus musculus
atgcaccggcgccagactggttgtt

SEQ ID NO: 357234 - DNA, 25 bp, Mus musculus
atcctccggggagcaaggccctggc

SEQ ID NO: 357235 - DNA, 25 bp, Mus musculus
tccgctcaacttccgccctcttaac

SEQ ID NO: 357236 - DNA, 25 bp, Mus musculus
cgacagctcaaacgaaaagctcgag

SEQ ID NO: 357237 - DNA, 25 bp, Mus musculus
gacggccaactctcgcgacagctca

SEQ ID NO: 357238 - DNA, 25 bp, Mus musculus
agtcaagagcggcttccggcaaccc

SEQ ID NO: 357239 - DNA, 25 bp, Mus musculus
agatcggccatcttgcggcgcgcag

SEQ ID NO: 357240 - DNA, 25 bp, Mus musculus
gtccagcgagagatcggccatcttg

SEQ ID NO: 357241 - DNA, 25 bp, Mus musculus
agctcgtccagcgagagatcggcca

SEQ ID NO: 357242 - DNA, 25 bp, Mus musculus
cgcgcttccggatgagctcgtccag

SEQ ID NO: 357243 - DNA, 25 bp, Mus musculus
cagcagccagtggaccgaccagcag

SEQ ID NO: 357244 - DNA, 25 bp, Mus musculus
ccaggacctaaaggccgagcggaga

SEQ ID NO: 357245 - DNA, 25 bp, Mus musculus
actcccaggacctaaaggccgagcg

SEQ ID NO: 357246 - DNA, 25 bp, Mus musculus
caaacgaaaagctcgagacggaagg

SEQ ID NO: 357247 - DNA, 25 bp, Mus musculus
cagtggaccgaccagcagctgggcc

SEQ ID NO: 357248 - DNA, 25 bp, Mus musculus
ggtggcctcacgcacggttctacac

SEQ ID NO: 357249 - DNA, 25 bp, Mus musculus
gtgcacctacggttcacacttcacg

SEQ ID NO: 357250 - DNA, 25 bp, Mus musculus
ggttcacacttcacgttcccattta

SEQ ID NO: 357251 - DNA, 25 bp, Mus musculus
aggcacttcaactttctcacactca

SEQ ID NO: 357252 - DNA, 25 bp, Mus musculus
aggcgggcgcgcacgtcactcattc

SEQ ID NO: 357253 - DNA, 25 bp, Mus musculus
gtcactcattccctattctcattcg

SEQ ID NO: 357254 - DNA, 25 bp, Mus musculus
gcacacccaacagggtcctcaatgt

SEQ ID NO: 357255 - DNA, 25 bp, Mus musculus
ccagggcgtgagtcacggtctgcaa

SEQ ID NO: 357256 - DNA, 25 bp, Mus musculus
gaagaagagacggtggcctcacgca

SEQ ID NO: 357257 - DNA, 25 bp, Mus musculus
ctcggtctcaacacctcggaggcgg

SEQ ID NO: 357258 - DNA, 25 bp, Mus musculus
acgccctgcggagccagtcaggagc

SEQ ID NO: 357259 - DNA, 25 bp, Mus musculus
cgcccacttccgcttgtgaagacgg

SEQ ID NO: 357260 - DNA, 25 bp, Mus musculus
cttccgcttgtgaagacgggagtgc

SEQ ID NO: 357261 - DNA, 25 bp, Mus musculus
atgccgcctaccgtgctcagctggg

SEQ ID NO: 357262 - DNA, 25 bp, Mus musculus
cgggtccctgatgtcttgcagctca

SEQ ID NO: 357263 - DNA, 25 bp, Mus musculus
ggtctcgcgactccatgctggcttc

SEQ ID NO: 357264 - DNA, 25 bp, Mus musculus
ggaccgagccctgggtctcgcgact

SEQ ID NO: 357265 - DNA, 25 bp, Mus musculus
tgtccctgagatccaggtacctccg

SEQ ID NO: 357266 - DNA, 25 bp, Mus musculus
cattgtcgcctgtagaacaggtggc

SEQ ID NO: 357267 - DNA, 25 bp, Mus musculus
gcccgcaccattgtcgcctgtagaa

SEQ ID NO: 357268 - DNA, 25 bp, Mus musculus
gcgcggaactggtgcccgcaccatt

SEQ ID NO: 357269 - DNA, 25 bp, Mus musculus
gccgcgctcaacttcggggcgcaga

SEQ ID NO: 357270 - DNA, 25 bp, Mus musculus
ctgaagacccttcccggtgcaggtc

SEQ ID NO: 357271 - DNA, 25 bp, Mus musculus
cgctttgggatctggacttcggatt

SEQ ID NO: 357272 - DNA, 25 bp, Mus musculus
ccaacgtcgccgagcagcgctttgg

SEQ ID NO: 357273 - DNA, 25 bp, Mus musculus
cggcattccattcctctccgggatg

SEQ ID NO: 357274 - DNA, 25 bp, Mus musculus
tgcaggtccgaagccggagcatcca

SEQ ID NO: 357275 - DNA, 25 bp, Mus musculus
tggacttcggattcccagtcgtccc

SEQ ID NO: 357276 - DNA, 25 bp, Mus musculus
cccatagtcactgagaactgaggtg

SEQ ID NO: 357277 - DNA, 25 bp, Mus musculus
ggactcaccagcataccgttgccgg

SEQ ID NO: 357278 - DNA, 25 bp, Mus musculus
cgcctgcggccgttaccttgttagt

SEQ ID NO: 357279 - DNA, 25 bp, Mus musculus
gcgcttgaagatggccaggatgtcc

SEQ ID NO: 357280 - DNA, 25 bp, Mus musculus
caggcccacagtgcgacgtgtcaca

SEQ ID NO: 357281 - DNA, 25 bp, Mus musculus
caaccgggaagagacaaggagtagc

SEQ ID NO: 357282 - DNA, 25 bp, Mus musculus
caaggagtagcggttgccgcctccc

SEQ ID NO: 357283 - DNA, 25 bp, Mus musculus
gcgccgttctccttcactcggtgag

SEQ ID NO: 357284 - DNA, 25 bp, Mus musculus
gcgccactggtttctccgggttcca

SEQ ID NO: 357285 - DNA, 25 bp, Mus musculus
ttccaatttcgaagtcgggcgcggc

SEQ ID NO: 357286 - DNA, 25 bp, Mus musculus
ccagatctcagcgttagttagggtc

SEQ ID NO: 357287 - DNA, 25 bp, Mus musculus
gtcctgcagtgtgggataggaaccc

SEQ ID NO: 357288 - DNA, 25 bp, Mus musculus
gagcatcgggcttacccaccggact

SEQ ID NO: 357289 - DNA, 25 bp, Mus musculus
taccttgttagtgggcaccgagcgc

SEQ ID NO: 357290 - DNA, 25 bp, Mus musculus
cgaaccacagcccaaagcgcgattt

SEQ ID NO: 357291 - DNA, 25 bp, Mus musculus
cggagcaccagtgacgggttactca

SEQ ID NO: 357292 - DNA, 25 bp, Mus musculus
tccaagtcactcagaacccgcgtgg

SEQ ID NO: 357293 - DNA, 25 bp, Mus musculus
cgtgggcgaatacgaccgttgacca

SEQ ID NO: 357294 - DNA, 25 bp, Mus musculus
gcggcctctatgtggttgctaagca

SEQ ID NO: 357295 - DNA, 25 bp, Mus musculus
tgctaagcacgaagcgcaggcggta

SEQ ID NO: 357296 - DNA, 25 bp, Mus musculus
gcggtagaagatggccagtatgtcc

SEQ ID NO: 357297 - DNA, 25 bp, Mus musculus
cagtatgtcctgattgccaaggttc

SEQ ID NO: 357298 - DNA, 25 bp, Mus musculus
ggccacctgacgatccagaggcatg

SEQ ID NO: 357299 - DNA, 25 bp, Mus musculus
gacctcctgagattaactgttaccg

SEQ ID NO: 357300 - DNA, 25 bp, Mus musculus
ctcagagaccaactgccgtgggcgc

SEQ ID NO: 357301 - DNA, 25 bp, Mus musculus
gcgcgatttcacagaagtctctaca

SEQ ID NO: 357302 - DNA, 25 bp, Mus musculus
ctcacgtgcgcagacgccaagtgct

SEQ ID NO: 357303 - DNA, 25 bp, Mus musculus
ctcacagcgcgtggaagtaagctcc

SEQ ID NO: 357304 - DNA, 25 bp, Mus musculus
gaaggcaagagtctgcaaagcgccc

SEQ ID NO: 357305 - DNA, 25 bp, Mus musculus
tcaggcttggctctcaccacggcgg

SEQ ID NO: 357306 - DNA, 25 bp, Mus musculus
tggctctcaccacggcggtcacaga

SEQ ID NO: 357307 - DNA, 25 bp, Mus musculus
tcaccacggcggtcacagagtgtgg

SEQ ID NO: 357308 - DNA, 25 bp, Mus musculus
acggaaatggaaggcaagagtctgc

SEQ ID NO: 357309 - DNA, 25 bp, Mus musculus
cccatgagtgcgtccgcgtgggact

SEQ ID NO: 357310 - DNA, 25 bp, Mus musculus
actagaagtttcgagcggcgcggcc

SEQ ID NO: 357311 - DNA, 25 bp, Mus musculus
gcgcggccaccgacccgtgtcccaa

SEQ ID NO: 357312 - DNA, 25 bp, Mus musculus
cgtgtcccaaccgtcgcggcgcacc

SEQ ID NO: 357313 - DNA, 25 bp, Mus musculus
ccgccgttcgcctcgggtcccactg

SEQ ID NO: 357314 - DNA, 25 bp, Mus musculus
tcgggtcccactgagcacgccgccc

SEQ ID NO: 357315 - DNA, 25 bp, Mus musculus
ttcccgttccgctccaaccgagctc

SEQ ID NO: 357316 - DNA, 25 bp, Mus musculus
gtgttcaccggtcaggcttggctct

SEQ ID NO: 357317 - DNA, 25 bp, Mus musculus
cccgcgcgcggactagaagtttcga

SEQ ID NO: 357318 - DNA, 25 bp, Mus musculus
gtcgcacgcgtcaaggcgcttgtcg

SEQ ID NO: 357319 - DNA, 25 bp, Mus musculus
tcgccgttggggaccgcaatgttga

SEQ ID NO: 357320 - DNA, 25 bp, Mus musculus
ccgcaatgttgagggtgtcgttaat

SEQ ID NO: 357321 - DNA, 25 bp, Mus musculus
ggtgtcgttaatcaggttgtactta

SEQ ID NO: 357322 - DNA, 25 bp, Mus musculus
tcaggttgtacttaaggattcgatc

SEQ ID NO: 357323 - DNA, 25 bp, Mus musculus
ttaaggattcgatcgttggcggtgc

SEQ ID NO: 357324 - DNA, 25 bp, Mus musculus
agacggggacgcgttgacctacaag

SEQ ID NO: 357325 - DNA, 25 bp, Mus musculus
gacgcgttgacctacaagaagaaaa

SEQ ID NO: 357326 - DNA, 25 bp, Mus musculus
gaagaaaaacacatgcccttcgctg

SEQ ID NO: 357327 - DNA, 25 bp, Mus musculus
acacatgcccttcgctgtggcgctt

SEQ ID NO: 357328 - DNA, 25 bp, Mus musculus
ctgtggcgcttccttctgtggaatg

SEQ ID NO: 357329 - DNA, 25 bp, Mus musculus
tccttctgtggaatgagaggcacgg

SEQ ID NO: 357330 - DNA, 25 bp, Mus musculus
gaatctcgccgttggggaccgcaat

SEQ ID NO: 357331 - DNA, 25 bp, Mus musculus
agccagcgtgggtcgcacgcgtcaa

SEQ ID NO: 357332 - DNA, 25 bp, Mus musculus
gtgtcctagcaaccgagaacgcgaa

SEQ ID NO: 357333 - DNA, 25 bp, Mus musculus
accgagaacgcgaaaaccgctggcg

SEQ ID NO: 357334 - DNA, 25 bp, Mus musculus
gacacggactgggtagcagaagcta

SEQ ID NO: 357335 - DNA, 25 bp, Mus musculus
tagcaaccgagaacgcgaaaaccgc

SEQ ID NO: 357336 - DNA, 25 bp, Mus musculus
ccacttccggagaggtgtcctagca

SEQ ID NO: 357337 - DNA, 25 bp, Mus musculus
tgctcactccacttccggagaggtg

SEQ ID NO: 357338 - DNA, 25 bp, Mus musculus
tctctactgcaaccagtccgccttg

SEQ ID NO: 357339 - DNA, 25 bp, Mus musculus
gcggccacgcccacggcgcacaaga

SEQ ID NO: 357340 - DNA, 25 bp, Mus musculus
acgttgagcagcggagacacggact

SEQ ID NO: 357341 - DNA, 25 bp, Mus musculus
cgtgcgcaatctccacgcgcggcca

SEQ ID NO: 357342 - DNA, 25 bp, Mus musculus
gcaagcccgcctgcgcgtgcgcaat

SEQ ID NO: 357343 - DNA, 25 bp, Mus musculus
ccggatccttcacgggcaagcccgc

SEQ ID NO: 357344 - DNA, 25 bp, Mus musculus
tagcagaagctaaaccgcccggatc

SEQ ID NO: 357345 - DNA, 25 bp, Mus musculus
cgcccgcccgtcctctctactgcaa

SEQ ID NO: 357346 - DNA, 25 bp, Mus musculus
gatcctgggattcgcaccgtccctg

SEQ ID NO: 357347 - DNA, 25 bp, Mus musculus
gcggggacacagtagcaggtctaca

SEQ ID NO: 357348 - DNA, 25 bp, Mus musculus
ggtctacaggcgacagaggaatgtc

SEQ ID NO: 357349 - DNA, 25 bp, Mus musculus
acaggggttctgtagctacttattg

SEQ ID NO: 357350 - DNA, 25 bp, Mus musculus
cgccagctcagcttggcaggtaagc

SEQ ID NO: 357351 - DNA, 25 bp, Mus musculus
taagcgtcttgcagccctagcccaa

SEQ ID NO: 357352 - DNA, 25 bp, Mus musculus
cctagcccaagttgctggaaagttg

SEQ ID NO: 357353 - DNA, 25 bp, Mus musculus
tgagcaagtggccttcgttgtcgct

SEQ ID NO: 357354 - DNA, 25 bp, Mus musculus
gccgcgacctggtaattcacacctg

SEQ ID NO: 357355 - DNA, 25 bp, Mus musculus
gaccggagagttcgcatctgtccct

SEQ ID NO: 357356 - DNA, 25 bp, Mus musculus
ggcgtctgcggaaagcacactcgca

SEQ ID NO: 357357 - DNA, 25 bp, Mus musculus
tgttcccgacagaatccagcttcgc

SEQ ID NO: 357358 - DNA, 25 bp, Mus musculus
cctgggtagttcagaccatcatttc

SEQ ID NO: 357359 - DNA, 25 bp, Mus musculus
ctgtgccctggttgtcgaaaactta

SEQ ID NO: 357360 - DNA, 25 bp, Mus musculus
ttatcgctgcggctgagacgcactg

SEQ ID NO: 357361 - DNA, 25 bp, Mus musculus
ggctggcaatgcactgtgcggtcca

SEQ ID NO: 357362 - DNA, 25 bp, Mus musculus
gcaggcacagctccagcagatcgta

SEQ ID NO: 357363 - DNA, 25 bp, Mus musculus
cagatcgtagcccagtacccggtgc

SEQ ID NO: 357364 - DNA, 25 bp, Mus musculus
tgcgcggcctcgtagagctgccgca

SEQ ID NO: 357365 - DNA, 25 bp, Mus musculus
tggagcaggccgctgcccatgccga

SEQ ID NO: 357366 - DNA, 25 bp, Mus musculus
caacacggagcactgtgaaggtggc

SEQ ID NO: 357367 - DNA, 25 bp, Mus musculus
cgagctacccgagcgctcattgcga

SEQ ID NO: 357368 - DNA, 25 bp, Mus musculus
cgcagagccggtggtcgttatcgct

SEQ ID NO: 357369 - DNA, 25 bp, Mus musculus
atgatgtagcttctccacggcggcc

SEQ ID NO: 357370 - DNA, 25 bp, Mus musculus
agcgctcattgcgacgcgcagagcc

SEQ ID NO: 357371 - DNA, 25 bp, Mus musculus
ccgccggctgcagatgatgtagctt

SEQ ID NO: 357372 - DNA, 25 bp, Mus musculus
ccacggcggccagtgaagccacaaa

SEQ ID NO: 357373 - DNA, 25 bp, Mus musculus
aagccacaaagacggcgggctggca

SEQ ID NO: 357374 - DNA, 25 bp, Mus musculus
gaaccaggtggaggagactcgctat

SEQ ID NO: 357375 - DNA, 25 bp, Mus musculus
acgggcgcatccacgcatgggacat

SEQ ID NO: 357376 - DNA, 25 bp, Mus musculus
cgcatgggacatgcgctactacatg

SEQ ID NO: 357377 - DNA, 25 bp, Mus musculus
tgcgctactacatgaaccaggtgga

SEQ ID NO: 357378 - DNA, 25 bp, Mus musculus
tctggagaggagatcggcaagttct

SEQ ID NO: 357379 - DNA, 25 bp, Mus musculus
actcgctatcgtgtggaccagaacc

SEQ ID NO: 357380 - DNA, 25 bp, Mus musculus
ccagaacctgctgaaggagtacttc

SEQ ID NO: 357381 - DNA, 25 bp, Mus musculus
cccatgcaggtggtcacacgtgggc

SEQ ID NO: 357382 - DNA, 25 bp, Mus musculus
tgggctgctggccatctaccaagag

SEQ ID NO: 357383 - DNA, 25 bp, Mus musculus
gactgccattcgacgggcgcatcca

SEQ ID NO: 357384 - DNA, 25 bp, Mus musculus
ccttcacgctggaggaaggtgccgc

SEQ ID NO: 357385 - DNA, 25 bp, Mus musculus
gcacgaggacgtgcggctctactca

SEQ ID NO: 357386 - DNA, 25 bp, Mus musculus
ggctctactcagtgcgggacgccgc

SEQ ID NO: 357387 - DNA, 25 bp, Mus musculus
tggccatctaccaagagctgctggg

SEQ ID NO: 357388 - DNA, 25 bp, Mus musculus
cagccgtggagggtgttatagtaac

SEQ ID NO: 357389 - DNA, 25 bp, Mus musculus
cgcctgatgggttttcagagaacga

SEQ ID NO: 357390 - DNA, 25 bp, Mus musculus
taaactgttcagaatcgcgccctcg

SEQ ID NO: 357391 - DNA, 25 bp, Mus musculus
tcggtcctggacgagtaaactgttc

SEQ ID NO: 357392 - DNA, 25 bp, Mus musculus
ttgcaagtcttgtgtgtcgtcggtc

SEQ ID NO: 357393 - DNA, 25 bp, Mus musculus
ggagatgcaaaccagccaacgtgct

SEQ ID NO: 357394 - DNA, 25 bp, Mus musculus
gtcccgtacttaacctcgcaggctg

SEQ ID NO: 357395 - DNA, 25 bp, Mus musculus
ccaatcacggtgcaaaaggtgctgc

SEQ ID NO: 357396 - DNA, 25 bp, Mus musculus
tcccgtagataggaagcctttcatc

SEQ ID NO: 357397 - DNA, 25 bp, Mus musculus
atctatttgcgaagcgcgagccgtg

SEQ ID NO: 357398 - DNA, 25 bp, Mus musculus
gtgtcactcatgtctccgcgcgtct

SEQ ID NO: 357399 - DNA, 25 bp, Mus musculus
cgacccggtacagatcccgtagata

SEQ ID NO: 357400 - DNA, 25 bp, Mus musculus
tcgacctaaacgatcctgggagttg

SEQ ID NO: 357401 - DNA, 25 bp, Mus musculus
atgtcgattggtctatacgtccgtc

SEQ ID NO: 357402 - DNA, 25 bp, Mus musculus
tgctccagcttgtgcagaaggcggc

SEQ ID NO: 357403 - DNA, 25 bp, Mus musculus
atcaaccgaggcgttgggatgctgc

SEQ ID NO: 357404 - DNA, 25 bp, Mus musculus
cgagccaagcgcatgccggtttgca

SEQ ID NO: 357405 - DNA, 25 bp, Mus musculus
tttgcaggtccctgcgcatcctcgg

SEQ ID NO: 357406 - DNA, 25 bp, Mus musculus
cataaccctgcaggatggcggcaca

SEQ ID NO: 357407 - DNA, 25 bp, Mus musculus
gcacaggcgcatctctcggcctgta

SEQ ID NO: 357408 - DNA, 25 bp, Mus musculus
atctcgtacctcgtgctccagcttg

SEQ ID NO: 357409 - DNA, 25 bp, Mus musculus
catagtcgctctgggactcccgagg

SEQ ID NO: 357410 - DNA, 25 bp, Mus musculus
ggccgtgcagcgacacgaactcgtc

SEQ ID NO: 357411 - DNA, 25 bp, Mus musculus
cggcccggactggatctccatagtg

SEQ ID NO: 357412 - DNA, 25 bp, Mus musculus
ccgcccaccgcaggatttaagcgga

SEQ ID NO: 357413 - DNA, 25 bp, Mus musculus
tgcgaggttccaagagtgcgcacgc

SEQ ID NO: 357414 - DNA, 25 bp, Mus musculus
gtcttctccattcatcccaggactg

SEQ ID NO: 357415 - DNA, 25 bp, Mus musculus
ggtacatcctgctcctgaacttata

SEQ ID NO: 357416 - DNA, 25 bp, Mus musculus
tccgggtatctcctacgcggcagct

SEQ ID NO: 357417 - DNA, 25 bp, Mus musculus
tcctttctgaccacctccgggtatc

SEQ ID NO: 357418 - DNA, 25 bp, Mus musculus
cgcccgtctccgtacgcatgccggg

SEQ ID NO: 357419 - DNA, 25 bp, Mus musculus
ggccgtcgcgcttcctttcttcctc

SEQ ID NO: 357420 - DNA, 25 bp, Mus musculus
cccgggcgatcgcagaagttacttt

SEQ ID NO: 357421 - DNA, 25 bp, Mus musculus
gcagaagttactttgcaaggaggca

SEQ ID NO: 357422 - DNA, 25 bp, Mus musculus
actttgcaaggaggcaggatccggc

SEQ ID NO: 357423 - DNA, 25 bp, Mus musculus
cccagagcgagcagtaggtacaagt

SEQ ID NO: 357424 - DNA, 25 bp, Mus musculus
cagtaggtacaagtgccagcgcacg

SEQ ID NO: 357425 - DNA, 25 bp, Mus musculus
ggtacaagtgccagcgcacggccgc

SEQ ID NO: 357426 - DNA, 25 bp, Mus musculus
cgagcgctcctgtctgcagcgagct

SEQ ID NO: 357427 - DNA, 25 bp, Mus musculus
agcgagctccgctaccgctccggct

SEQ ID NO: 357428 - DNA, 25 bp, Mus musculus
atagccggcgcgcaggacaagctga

SEQ ID NO: 357429 - DNA, 25 bp, Mus musculus
ggacaagctgacagccgcgcgctca

SEQ ID NO: 357430 - DNA, 25 bp, Mus musculus
agcccgcatcagagcgcggctgaca

SEQ ID NO: 357431 - DNA, 25 bp, Mus musculus
gggcatgacgtcatggccgcaccca

SEQ ID NO: 357432 - DNA, 25 bp, Mus musculus
cagctccagggcgtgacgtcacggc

SEQ ID NO: 357433 - DNA, 25 bp, Mus musculus
tcgaagtacttgctctcgaactcgc

SEQ ID NO: 357434 - DNA, 25 bp, Mus musculus
gccgcacgccatggaactcgaagta

SEQ ID NO: 357435 - DNA, 25 bp, Mus musculus
ggaagtcggcgatatcctccatctt

SEQ ID NO: 357436 - DNA, 25 bp, Mus musculus
ccgcaaaggtgcgtcgggtccgtat

SEQ ID NO: 357437 - DNA, 25 bp, Mus musculus
cgggtccgtatcactgcctgtcagt

SEQ ID NO: 357438 - DNA, 25 bp, Mus musculus
cctgtcagtcatgcgtggcaggtca

SEQ ID NO: 357439 - DNA, 25 bp, Mus musculus
aaaaaggaggcgtctgcgcagaccc

SEQ ID NO: 357440 - DNA, 25 bp, Mus musculus
ggaagccgcacctccagaagcttct

SEQ ID NO: 357441 - DNA, 25 bp, Mus musculus
ccagaagcttctgatgccagagatg

SEQ ID NO: 357442 - DNA, 25 bp, Mus musculus
tgccagagatggaagagcccgcatc

SEQ ID NO: 357443 - DNA, 25 bp, Mus musculus
tcagagcgcggctgacaaaggcagc

SEQ ID NO: 357444 - DNA, 25 bp, Mus musculus
acaccgggagcagagctgaactgca

SEQ ID NO: 357445 - DNA, 25 bp, Mus musculus
tcacccgaagacagcttaggcggct

SEQ ID NO: 357446 - DNA, 25 bp, Mus musculus
gagcagacgcgctccgagcatcttc

SEQ ID NO: 357447 - DNA, 25 bp, Mus musculus
taagctcagagcagcaacaccggga

SEQ ID NO: 357448 - DNA, 25 bp, Mus musculus
cgcccggagcttcaagcaccatgta

SEQ ID NO: 357449 - DNA, 25 bp, Mus musculus
cttctaccacgtcggggctacgcta

SEQ ID NO: 357450 - DNA, 25 bp, Mus musculus
ccatgtatgacccagagcgccgctg

SEQ ID NO: 357451 - DNA, 25 bp, Mus musculus
tgcgcgcactttctttggctgctcg

SEQ ID NO: 357452 - DNA, 25 bp, Mus musculus
cacgcggtcaccttcgtgtgcagtc

SEQ ID NO: 357453 - DNA, 25 bp, Mus musculus
ctacacctggggaatcggtaacact

SEQ ID NO: 357454 - DNA, 25 bp, Mus musculus
gaaacctgtccggagagctctcatc

SEQ ID NO: 357455 - DNA, 25 bp, Mus musculus
tcatccttcccggtgccgttgagca

SEQ ID NO: 357456 - DNA, 25 bp, Mus musculus
gcggctgcggctctttaagctcaga

SEQ ID NO: 357457 - DNA, 25 bp, Mus musculus
ctacgctatgtctgagcgagcgcgc

SEQ ID NO: 357458 - DNA, 25 bp, Mus musculus
tgacctgtagccgagcctcttgtgt

SEQ ID NO: 357459 - DNA, 25 bp, Mus musculus
cgttgccttttcacgggaccagctc

SEQ ID NO: 357460 - DNA, 25 bp, Mus musculus
tttcacgggaccagctctgcccata

SEQ ID NO: 357461 - DNA, 25 bp, Mus musculus
tgcccataaccgcagctttctgggc

SEQ ID NO: 357462 - DNA, 25 bp, Mus musculus
ggcgtcactgaacgctccacgcttg

SEQ ID NO: 357463 - DNA, 25 bp, Mus musculus
gcttcctggcgttcttgtgaacatc

SEQ ID NO: 357464 - DNA, 25 bp, Mus musculus
gtcactctctcatacggaccaatga

SEQ ID NO: 357465 - DNA, 25 bp, Mus musculus
accaatgagcggagggtcttgagtc

SEQ ID NO: 357466 - DNA, 25 bp, Mus musculus
cggcacgcagcttccgtgacctgta

SEQ ID NO: 357467 - DNA, 25 bp, Mus musculus
ccgagcctcttgtgtttgtagctga

SEQ ID NO: 357468 - DNA, 25 bp, Mus musculus
aggagctcagctccgttgccttttc

SEQ ID NO: 357469 - DNA, 25 bp, Mus musculus
tccacgcttgcactgggcttcctgg

SEQ ID NO: 357470 - DNA, 25 bp, Mus musculus
accctaggtggtacaacatggcggc

SEQ ID NO: 357471 - DNA, 25 bp, Mus musculus
tgaacatccgggtcactctctcata

SEQ ID NO: 357472 - DNA, 25 bp, Mus musculus
gggagctcagctgcagcaccgggac

SEQ ID NO: 357473 - DNA, 25 bp, Mus musculus
cgcttatgtcctccgcgccaccacg

SEQ ID NO: 357474 - DNA, 25 bp, Mus musculus
cccaagatgaagaaggacgagtctt

SEQ ID NO: 357475 - DNA, 25 bp, Mus musculus
aggacgagtctttcttgggcaagtt

SEQ ID NO: 357476 - DNA, 25 bp, Mus musculus
ctttcttgggcaagttgggcggcac

SEQ ID NO: 357477 - DNA, 25 bp, Mus musculus
ctacgcgacctttgggacaggccgg

SEQ ID NO: 357478 - DNA, 25 bp, Mus musculus
gtggcgcgcactcgcttatgtcctc

SEQ ID NO: 357479 - DNA, 25 bp, Mus musculus
ccctgcgtccctttggcgccagccg

SEQ ID NO: 357480 - DNA, 25 bp, Mus musculus
acgcgcagggtcctgctgtattgcg

SEQ ID NO: 357481 - DNA, 25 bp, Mus musculus
aatgagccctcctgtcgcgctcagg

SEQ ID NO: 357482 - DNA, 25 bp, Mus musculus
tcgcgctcaggctacgcgacctttg

SEQ ID NO: 357483 - DNA, 25 bp, Mus musculus
ctcaggctacgcgacctttgggaca

SEQ ID NO: 357484 - DNA, 25 bp, Mus musculus
gcactacgcgcagggtcctgctgta

SEQ ID NO: 357485 - DNA, 25 bp, Mus musculus
gcggcacactggcaaggaagaagaa

SEQ ID NO: 357486 - DNA, 25 bp, Mus musculus
ctgtcctggccgaggggctcgagca

SEQ ID NO: 357487 - DNA, 25 bp, Mus musculus
gtcctgtttcatccaccgtccctgg

SEQ ID NO: 357488 - DNA, 25 bp, Mus musculus
cccaccgagtgaggtaaaccttgca

SEQ ID NO: 357489 - DNA, 25 bp, Mus musculus
ccgagtgaggtaaaccttgcaaata

SEQ ID NO: 357490 - DNA, 25 bp, Mus musculus
tgaggtaaaccttgcaaatatcgta

SEQ ID NO: 357491 - DNA, 25 bp, Mus musculus
cgtgagcacgaagaagccgtaaatc

SEQ ID NO: 357492 - DNA, 25 bp, Mus musculus
taaatccacactcccagaagcgccg

SEQ ID NO: 357493 - DNA, 25 bp, Mus musculus
ccttgcaaatatcgtagttcatggc

SEQ ID NO: 357494 - DNA, 25 bp, Mus musculus
catggcggaataatagagcagatcc

SEQ ID NO: 357495 - DNA, 25 bp, Mus musculus
gcaaatatcgtagttcatggcggaa

SEQ ID NO: 357496 - DNA, 25 bp, Mus musculus
tatcgtagttcatggcggaataata

SEQ ID NO: 357497 - DNA, 25 bp, Mus musculus
cgaagaagccgtaaatccacactcc

SEQ ID NO: 357498 - DNA, 25 bp, Mus musculus
agccgtaaatccacactcccagaag

SEQ ID NO: 357499 - DNA, 25 bp, Mus musculus
ataatagagcagatccaggaccagc

SEQ ID NO: 357500 - DNA, 25 bp, Mus musculus
cgacgccgtcctgcccgcgatcctc

SEQ ID NO: 357501 - DNA, 25 bp, Mus musculus
cccgggcgcgggattactatggatc

SEQ ID NO: 357502 - DNA, 25 bp, Mus musculus
gctccgcagcgactcccagcctggt

SEQ ID NO: 357503 - DNA, 25 bp, Mus musculus
gatcctcagcactgcgtggacccag

SEQ ID NO: 357504 - DNA, 25 bp, Mus musculus
gcgccggtcgctcctcgctatgtag

SEQ ID NO: 357505 - DNA, 25 bp, Mus musculus
ccgctcacctcgtgcccgcgccggt

SEQ ID NO: 357506 - DNA, 25 bp, Mus musculus
atccaagcgtctcccagcgcggctc

SEQ ID NO: 357507 - DNA, 25 bp, Mus musculus
acccagggcatccaagcgtctccca

SEQ ID NO: 357508 - DNA, 25 bp, Mus musculus
ggttcccgatgtcgccgaacaggaa

SEQ ID NO: 357509 - DNA, 25 bp, Mus musculus
tcggggttcccgatgtcgccgaaca

SEQ ID NO: 357510 - DNA, 25 bp, Mus musculus
gagcctcggggttcccgatgtcgcc

SEQ ID NO: 357511 - DNA, 25 bp, Mus musculus
cggtcctggcgaccaccacctcgcc

SEQ ID NO: 357512 - DNA, 25 bp, Mus musculus
cgcgggattactatggatcgggccc

SEQ ID NO: 357513 - DNA, 25 bp, Mus musculus
attactatggatcgggccctgggag

SEQ ID NO: 357514 - DNA, 25 bp, Mus musculus
aggcactgaccaccggtgccatgcg

SEQ ID NO: 357515 - DNA, 25 bp, Mus musculus
cgctgggaacctggcaactgggcca

SEQ ID NO: 357516 - DNA, 25 bp, Mus musculus
tgccagactttgcaggatgcacctg

SEQ ID NO: 357517 - DNA, 25 bp, Mus musculus
ctttgcaggatgcacctgccggagc

SEQ ID NO: 357518 - DNA, 25 bp, Mus musculus
atgcgcggacctgccagactttgca

SEQ ID NO: 357519 - DNA, 25 bp, Mus musculus
ggctgcggatgcaggcactgaccac

SEQ ID NO: 357520 - DNA, 25 bp, Mus musculus
ccatagagaccgctcgctctcggag

SEQ ID NO: 357521 - DNA, 25 bp, Mus musculus
tccgctgccaagatggcccgagggt

SEQ ID NO: 357522 - DNA, 25 bp, Mus musculus
gaccacccgcgcgtgaacaaaggcg

SEQ ID NO: 357523 - DNA, 25 bp, Mus musculus
gaacaaaggcgtcggcacctgggct

SEQ ID NO: 357524 - DNA, 25 bp, Mus musculus
ggcgtatgtacctgtcgctccgctg

SEQ ID NO: 357525 - DNA, 25 bp, Mus musculus
ggccgccggaactgctttccgggca

SEQ ID NO: 357526 - DNA, 25 bp, Mus musculus
ctgtacgtcacggaggccgccggaa

SEQ ID NO: 357527 - DNA, 25 bp, Mus musculus
caccgcgcggtctttgtgcaggcgc

SEQ ID NO: 357528 - DNA, 25 bp, Mus musculus
tgcgctgcagcgtcagcttcactcg

SEQ ID NO: 357529 - DNA, 25 bp, Mus musculus
cgggaagctgatcgtacagacagac

SEQ ID NO: 357530 - DNA, 25 bp, Mus musculus
gtacagacagacgactgcaccgccg

SEQ ID NO: 357531 - DNA, 25 bp, Mus musculus
tgcaccgccgcaaacattaaacaca

SEQ ID NO: 357532 - DNA, 25 bp, Mus musculus
acattaaacacagcgtccgcctctg

SEQ ID NO: 357533 - DNA, 25 bp, Mus musculus
ctgcccttctacagtaggccgggga

SEQ ID NO: 357534 - DNA, 25 bp, Mus musculus
gtttgagacgcacacgcagccgacc

SEQ ID NO: 357535 - DNA, 25 bp, Mus musculus
aagatctcgcgagagctcggcctgc

SEQ ID NO: 357536 - DNA, 25 bp, Mus musculus
acccgcgtttgagacgcacacgcag

SEQ ID NO: 357537 - DNA, 25 bp, Mus musculus
cttccaccttctgcccggcctaggc

SEQ ID NO: 357538 - DNA, 25 bp, Mus musculus
aggaagccggtgttaccggcactca

SEQ ID NO: 357539 - DNA, 25 bp, Mus musculus
ggtgttaccggcactcactatcaac

SEQ ID NO: 357540 - DNA, 25 bp, Mus musculus
actatcaaccctaccatcgccgagg

SEQ ID NO: 357541 - DNA, 25 bp, Mus musculus
gcgggacctcgcagaaaaagatctc

SEQ ID NO: 357542 - DNA, 25 bp, Mus musculus
tatatacgctttcgcaggaggcgag

SEQ ID NO: 357543 - DNA, 25 bp, Mus musculus
cgggagaaggggctatatacgcttt

SEQ ID NO: 357544 - DNA, 25 bp, Mus musculus
ggctccgcgggcgtggtctctggtg

SEQ ID NO: 357545 - DNA, 25 bp, Mus musculus
cagtccctcccccaggctgtccggg

SEQ ID NO: 357546 - DNA, 25 bp, Mus musculus
gctgtccgggctctgcgtggtggag

SEQ ID NO: 357547 - DNA, 25 bp, Mus musculus
cacggggaccgaggtgagcggcggt

SEQ ID NO: 357548 - DNA, 25 bp, Mus musculus
cggtccgttcgcgaggcgaggctgc

SEQ ID NO: 357549 - DNA, 25 bp, Mus musculus
agaaggggctatatacgctttcgca

SEQ ID NO: 357550 - DNA, 25 bp, Mus musculus
aaggggctatatacgctttcgcagg

SEQ ID NO: 357551 - DNA, 25 bp, Mus musculus
aggggctatatacgctttcgcagga

SEQ ID NO: 357552 - DNA, 25 bp, Mus musculus
gggctatatacgctttcgcaggagg

SEQ ID NO: 357553 - DNA, 25 bp, Mus musculus
tgagtgccgccgagcgtccggaggt

SEQ ID NO: 357554 - DNA, 25 bp, Mus musculus
ctatatacgctttcgcaggaggcga

SEQ ID NO: 357555 - DNA, 25 bp, Mus musculus
ggctatatacgctttcgcaggaggc

SEQ ID NO: 357556 - DNA, 25 bp, Mus musculus
ggaggttcgtccacatcgtccacca

SEQ ID NO: 357557 - DNA, 25 bp, Mus musculus
ggtgccgaggcgcacttacttgaca

SEQ ID NO: 357558 - DNA, 25 bp, Mus musculus
gtggccgagtctttgaagggaccca

SEQ ID NO: 357559 - DNA, 25 bp, Mus musculus
ttgaagggacccaggtagagaaatc

SEQ ID NO: 357560 - DNA, 25 bp, Mus musculus
cgattctcaccgtggccgagtcttt

SEQ ID NO: 357561 - DNA, 25 bp, Mus musculus
tttgctgaagacaggaggttcgtcc

SEQ ID NO: 357562 - DNA, 25 bp, Mus musculus
gatgtaggccagtttgctgaagaca

SEQ ID NO: 357563 - DNA, 25 bp, Mus musculus
tcccgtatctgtaggatgtaggcca

SEQ ID NO: 357564 - DNA, 25 bp, Mus musculus
atccgggcatcctcccgtatctgta

SEQ ID NO: 357565 - DNA, 25 bp, Mus musculus
tggtcgtatttatccgggcatcctc

SEQ ID NO: 357566 - DNA, 25 bp, Mus musculus
acagagcctatggtcgtatttatcc

SEQ ID NO: 357567 - DNA, 25 bp, Mus musculus
ggatcctgagctgcgacagagccta

SEQ ID NO: 357568 - DNA, 25 bp, Mus musculus
attcctggcagcgtcaggatcctga

SEQ ID NO: 357569 - DNA, 25 bp, Mus musculus
cgcacttacttgacaggattcctgg

SEQ ID NO: 357570 - DNA, 25 bp, Mus musculus
gccgcgagccatggttcacagggcc

SEQ ID NO: 357571 - DNA, 25 bp, Mus musculus
gggcttgctgctagccgccgactat

SEQ ID NO: 357572 - DNA, 25 bp, Mus musculus
cgccgactatcgtcgtaggggacgc

SEQ ID NO: 357573 - DNA, 25 bp, Mus musculus
tgagcatgaggactctccgcaggtt

SEQ ID NO: 357574 - DNA, 25 bp, Mus musculus
actctccgcaggttgaagttcatga

SEQ ID NO: 357575 - DNA, 25 bp, Mus musculus
ttgaagttcatgagttcgcccagcc

SEQ ID NO: 357576 - DNA, 25 bp, Mus musculus
tgcgccaacgccacctggaacaggt

SEQ ID NO: 357577 - DNA, 25 bp, Mus musculus
acctggaacaggtaaggcgcgcagc

SEQ ID NO: 357578 - DNA, 25 bp, Mus musculus
tgcaacgtgtcagcggctagagccc

SEQ ID NO: 357579 - DNA, 25 bp, Mus musculus
tcagcggctagagcccacgatcgct

SEQ ID NO: 357580 - DNA, 25 bp, Mus musculus
cagctgccagacattccttaccgga

SEQ ID NO: 357581 - DNA, 25 bp, Mus musculus
cacttcctgtatgcgtgtcgggccc

SEQ ID NO: 357582 - DNA, 25 bp, Mus musculus
ccgctgcacttcctgtatgcgtgtc

SEQ ID NO: 357583 - DNA, 25 bp, Mus musculus
tcgcaggggcgcacttgaacctcgc

SEQ ID NO: 357584 - DNA, 25 bp, Mus musculus
ttccggtcgcccgagttgtgcaaac

SEQ ID NO: 357585 - DNA, 25 bp, Mus musculus
accctgttccctgggcagctctagg

SEQ ID NO: 357586 - DNA, 25 bp, Mus musculus
ctggggtcccacgaaccctggatct

SEQ ID NO: 357587 - DNA, 25 bp, Mus musculus
ttttgctaacagtgagggtcggtgc

SEQ ID NO: 357588 - DNA, 25 bp, Mus musculus
cgccggagtcacaatcgccaaacta

SEQ ID NO: 357589 - DNA, 25 bp, Mus musculus
ccctggatctgcaaacagtgctgga

SEQ ID NO: 357590 - DNA, 25 bp, Mus musculus
gagtccgtgtcgagcaaagctcata

SEQ ID NO: 357591 - DNA, 25 bp, Mus musculus
ccaccgtgcaatgtcgcgcgaagca

SEQ ID NO: 357592 - DNA, 25 bp, Mus musculus
gcttcttgaggtcgccgttctatga

SEQ ID NO: 357593 - DNA, 25 bp, Mus musculus
tgcctttcgtggagctgcttcttga

SEQ ID NO: 357594 - DNA, 25 bp, Mus musculus
tccttacttgtttgtcgctgagcgc

SEQ ID NO: 357595 - DNA, 25 bp, Mus musculus
ttttagggtgctgccaaagtgcccg

SEQ ID NO: 357596 - DNA, 25 bp, Mus musculus
gcgacgaccgtacaggcacttttta

SEQ ID NO: 357597 - DNA, 25 bp, Mus musculus
ggcaactttgaggactgcagccata

SEQ ID NO: 357598 - DNA, 25 bp, Mus musculus
tgtcggactcagagacacacggctc

SEQ ID NO: 357599 - DNA, 25 bp, Mus musculus
gcgcgcgaacctcctcaaactggga

SEQ ID NO: 357600 - DNA, 25 bp, Mus musculus
cggaggcctccaaagtcactgacca

SEQ ID NO: 357601 - DNA, 25 bp, Mus musculus
ggccgacacgtgaccaacgtgctta

SEQ ID NO: 357602 - DNA, 25 bp, Mus musculus
taacccgcgtttgacagtggctttg

SEQ ID NO: 357603 - DNA, 25 bp, Mus musculus
tcctcccggcgactgtttctagggc

SEQ ID NO: 357604 - DNA, 25 bp, Mus musculus
ggaggcgtccattcgagttacaaga

SEQ ID NO: 357605 - DNA, 25 bp, Mus musculus
cggatgtctcttcttgtcctcagtg

SEQ ID NO: 357606 - DNA, 25 bp, Mus musculus
cggctcctggtgttttcctgtgaaa

SEQ ID NO: 357607 - DNA, 25 bp, Mus musculus
gctcccgagttctgctgatcacgaa

SEQ ID NO: 357608 - DNA, 25 bp, Mus musculus
caccgagtttccaggccgttggtca

SEQ ID NO: 357609 - DNA, 25 bp, Mus musculus
cgtccagggccacttttgaggtttg

SEQ ID NO: 357610 - DNA, 25 bp, Mus musculus
tatagtgacctcgatcggctcctgg

SEQ ID NO: 357611 - DNA, 25 bp, Mus musculus
ggcgctctcttcaccgttctgtagc

SEQ ID NO: 357612 - DNA, 25 bp, Mus musculus
gaggtggactcgcgcggacactcac

SEQ ID NO: 357613 - DNA, 25 bp, Mus musculus
gacgccgaggcacaggccctgcccg

SEQ ID NO: 357614 - DNA, 25 bp, Mus musculus
ctgctgtccacggactcccgggagg

SEQ ID NO: 357615 - DNA, 25 bp, Mus musculus
gctcctccgcttcgctgctgtccac

SEQ ID NO: 357616 - DNA, 25 bp, Mus musculus
aacgagcgctcctccgcttcgctgc

SEQ ID NO: 357617 - DNA, 25 bp, Mus musculus
atgtgctgcaacgagcgctcctccg

SEQ ID NO: 357618 - DNA, 25 bp, Mus musculus
gcatgtgctgcaacgagcgctcctc

SEQ ID NO: 357619 - DNA, 25 bp, Mus musculus
cagcatgtgctgcaacgagcgctcc

SEQ ID NO: 357620 - DNA, 25 bp, Mus musculus
gctatggcgcgcagcatgtgctgca

SEQ ID NO: 357621 - DNA, 25 bp, Mus musculus
gctcctcggctatggcgcgcagcat

SEQ ID NO: 357622 - DNA, 25 bp, Mus musculus
aggctaaggcgtccgcgctcctcgg

SEQ ID NO: 357623 - DNA, 25 bp, Mus musculus
cgcagacctcacggcgcaggctaag

SEQ ID NO: 357624 - DNA, 25 bp, Mus musculus
gtcactcacccaggccgcagacctc

SEQ ID NO: 357625 - DNA, 25 bp, Mus musculus
tggactcgcgcggacactcacgcgc

SEQ ID NO: 357626 - DNA, 25 bp, Mus musculus
ggaaactgaagacaaaacagcgctg

SEQ ID NO: 357627 - DNA, 25 bp, Mus musculus
agcacagtccgtgggtccaatcgta

SEQ ID NO: 357628 - DNA, 25 bp, Mus musculus
cgtggacacgacagcacagtccgtg

SEQ ID NO: 357629 - DNA, 25 bp, Mus musculus
gaccaggctcatcgtggacacgaca

SEQ ID NO: 357630 - DNA, 25 bp, Mus musculus
gtctcttaagaccaggctcatcgtg

SEQ ID NO: 357631 - DNA, 25 bp, Mus musculus
agacattcagtctcttaagaccagg

SEQ ID NO: 357632 - DNA, 25 bp, Mus musculus
tgaagacaaaacagcgctgggaaga

SEQ ID NO: 357633 - DNA, 25 bp, Mus musculus
tgatttcagggcggaacgttcgcgc

SEQ ID NO: 357634 - DNA, 25 bp, Mus musculus
aagactggccgcgagacattcagtc

SEQ ID NO: 357635 - DNA, 25 bp, Mus musculus
gtgggtccaatcgtagcttctcttg

SEQ ID NO: 357636 - DNA, 25 bp, Mus musculus
agagcgcgagcgacactggtgtctc

SEQ ID NO: 357637 - DNA, 25 bp, Mus musculus
acactggtgtctccgtggcacggca

SEQ ID NO: 357638 - DNA, 25 bp, Mus musculus
ggccgagctcaacgccttctgcgtt

SEQ ID NO: 357639 - DNA, 25 bp, Mus musculus
tcaacgccttctgcgtttccgcggg

SEQ ID NO: 357640 - DNA, 25 bp, Mus musculus
ttaacaagagccgagagtgggtccc

SEQ ID NO: 357641 - DNA, 25 bp, Mus musculus
gggccaatgatgcaggtgaacctct

SEQ ID NO: 357642 - DNA, 25 bp, Mus musculus
gcggcctcgccacgacttgaaattc

SEQ ID NO: 357643 - DNA, 25 bp, Mus musculus
cttgaaattctccacgagcagcagc

SEQ ID NO: 357644 - DNA, 25 bp, Mus musculus
tccacgagcagcagctcaaggtgcc

SEQ ID NO: 357645 - DNA, 25 bp, Mus musculus
ccgccgggacagacttgctctcaaa

SEQ ID NO: 357646 - DNA, 25 bp, Mus musculus
ctcaaacttttgtgggcgctgcttc

SEQ ID NO: 357647 - DNA, 25 bp, Mus musculus
ttgcccggggaattggatccctgct

SEQ ID NO: 357648 - DNA, 25 bp, Mus musculus
gaacctcttgaaagggccgatgacc

SEQ ID NO: 357649 - DNA, 25 bp, Mus musculus
agaaattcttttcgaagtctcgcga

SEQ ID NO: 357650 - DNA, 25 bp, Mus musculus
ttagcaacggaggttggcgttgccc

SEQ ID NO: 357651 - DNA, 25 bp, Mus musculus
ttaccggagccgttggggccaatga

SEQ ID NO: 357652 - DNA, 25 bp, Mus musculus
ccggcagacccacaggaggcgacaa

SEQ ID NO: 357653 - DNA, 25 bp, Mus musculus
cttcctcgtgctcccgtgaggaaaa

SEQ ID NO: 357654 - DNA, 25 bp, Mus musculus
cagagctgcgtggaatccaggccca

SEQ ID NO: 357655 - DNA, 25 bp, Mus musculus
ccgtgcctttgtccgccgccggagc

SEQ ID NO: 357656 - DNA, 25 bp, Mus musculus
gcgggataattgaacgcggcgcgca

SEQ ID NO: 357657 - DNA, 25 bp, Mus musculus
ccaggcctggctcgagcgtgtagcc

SEQ ID NO: 357658 - DNA, 25 bp, Mus musculus
tgcgtggaatccaggcccacgaccc

SEQ ID NO: 357659 - DNA, 25 bp, Mus musculus
gctgcccgccgtgcctttgtccgcc

SEQ ID NO: 357660 - DNA, 25 bp, Mus musculus
gtgccgtcgcgcctcgtcccgctgc

SEQ ID NO: 357661 - DNA, 25 bp, Mus musculus
aggccccaagctccctggaagtttg

SEQ ID NO: 357662 - DNA, 25 bp, Mus musculus
agcgcgcgctgcacccaggggtcat

SEQ ID NO: 357663 - DNA, 25 bp, Mus musculus
ctgcacccaggggtcatcgcacggt

SEQ ID NO: 357664 - DNA, 25 bp, Mus musculus
cccagagctgcgtggaatccaggcc

SEQ ID NO: 357665 - DNA, 25 bp, Mus musculus
gagctgcgtggaatccaggcccacg

SEQ ID NO: 357666 - DNA, 25 bp, Mus musculus
ggggtcatcgcacggtccccagagc

SEQ ID NO: 357667 - DNA, 25 bp, Mus musculus
tggctcgagcgtgtagccgctgccc

SEQ ID NO: 357668 - DNA, 25 bp, Mus musculus
accctacgcaggagcaggacttccg

SEQ ID NO: 357669 - DNA, 25 bp, Mus musculus
agagccgtgcagaccgcgtctccat

SEQ ID NO: 357670 - DNA, 25 bp, Mus musculus
cctcccggctgtcgggcatcatggt

SEQ ID NO: 357671 - DNA, 25 bp, Mus musculus
cgctcacggcgctcttcaaggagca

SEQ ID NO: 357672 - DNA, 25 bp, Mus musculus
tcaaggagcagcgtaaccggtaact

SEQ ID NO: 357673 - DNA, 25 bp, Mus musculus
atcagctcggcccacgctcaggttg

SEQ ID NO: 357674 - DNA, 25 bp, Mus musculus
cccacgctcaggttgtggctctgtg

SEQ ID NO: 357675 - DNA, 25 bp, Mus musculus
ccaggctctaagaggggcagacgat

SEQ ID NO: 357676 - DNA, 25 bp, Mus musculus
aagctgttggttcggctcctctggc

SEQ ID NO: 357677 - DNA, 25 bp, Mus musculus
ttcgcctgaggcaagccagctagtc

SEQ ID NO: 357678 - DNA, 25 bp, Mus musculus
gccttgtcctcttcgcctgaggcaa

SEQ ID NO: 357679 - DNA, 25 bp, Mus musculus
aagccagctagtctcgcgctctctg

SEQ ID NO: 357680 - DNA, 25 bp, Mus musculus
tctgccttgcagcaccacgggatct

SEQ ID NO: 357681 - DNA, 25 bp, Mus musculus
cagcaccacgggatctgggtgacgc

SEQ ID NO: 357682 - DNA, 25 bp, Mus musculus
tgttttatgtaatcgcggggcggca

SEQ ID NO: 357683 - DNA, 25 bp, Mus musculus
ccagccagccggctgcggggaaaat

SEQ ID NO: 357684 - DNA, 25 bp, Mus musculus
tgcggggaaaattacaaggcctgga

SEQ ID NO: 357685 - DNA, 25 bp, Mus musculus
tacgcccctggcacagccgggtgga

SEQ ID NO: 357686 - DNA, 25 bp, Mus musculus
gtggaggcgactgttttatgtaatc

SEQ ID NO: 357687 - DNA, 25 bp, Mus musculus
ggaggcgactgttttatgtaatcgc

SEQ ID NO: 357688 - DNA, 25 bp, Mus musculus
aggcgactgttttatgtaatcgcgg

SEQ ID NO: 357689 - DNA, 25 bp, Mus musculus
cgactgttttatgtaatcgcggggc

SEQ ID NO: 357690 - DNA, 25 bp, Mus musculus
ctgttttatgtaatcgcggggcggc

SEQ ID NO: 357691 - DNA, 25 bp, Mus musculus
atcgcggggcggcaggtttgctggc

SEQ ID NO: 357692 - DNA, 25 bp, Mus musculus
tttgctggctggctgcaccggtgag

SEQ ID NO: 357693 - DNA, 25 bp, Mus musculus
agccagccggctgcggggaaaatta

SEQ ID NO: 357694 - DNA, 25 bp, Mus musculus
gctgcggggaaaattacaaggcctg

SEQ ID NO: 357695 - DNA, 25 bp, Mus musculus
actgttttatgtaatcgcggggcgg

SEQ ID NO: 357696 - DNA, 25 bp, Mus musculus
ttcacggcgagttgcatccctggaa

SEQ ID NO: 357697 - DNA, 25 bp, Mus musculus
aagtcgcaggcccacaaccggggct

SEQ ID NO: 357698 - DNA, 25 bp, Mus musculus
tctaaagtcgcaggcccacaaccgg

SEQ ID NO: 357699 - DNA, 25 bp, Mus musculus
agagtggtctaaagtcgcaggccca

SEQ ID NO: 357700 - DNA, 25 bp, Mus musculus
cgttggcagagagtggtctaaagtc

SEQ ID NO: 357701 - DNA, 25 bp, Mus musculus
ctgcatggtctcgttggcagagagt

SEQ ID NO: 357702 - DNA, 25 bp, Mus musculus
cctggaacggaacctccgggctgcg

SEQ ID NO: 357703 - DNA, 25 bp, Mus musculus
ggcgagttgcatccctggaacggaa

SEQ ID NO: 357704 - DNA, 25 bp, Mus musculus
cagcttcacggcgagttgcatccct

SEQ ID NO: 357705 - DNA, 25 bp, Mus musculus
gcctctggcagcttcacggcgagtt

SEQ ID NO: 357706 - DNA, 25 bp, Mus musculus
ccgctgccatcgtggtccaggggtc

SEQ ID NO: 357707 - DNA, 25 bp, Mus musculus
gaatccgctgccatcgtggtccagg

SEQ ID NO: 357708 - DNA, 25 bp, Mus musculus
cacaaccggggctcgcatgtagaag

SEQ ID NO: 357709 - DNA, 25 bp, Mus musculus
tgcatccctggaacggaacctccgg

SEQ ID NO: 357710 - DNA, 25 bp, Mus musculus
ccacaccttggtgtactggtgcgtg

SEQ ID NO: 357711 - DNA, 25 bp, Mus musculus
ggcgacttctcgatgtacaccaggt

SEQ ID NO: 357712 - DNA, 25 bp, Mus musculus
ttgcagttacactgccacaccttgg

SEQ ID NO: 357713 - DNA, 25 bp, Mus musculus
caacaccagtggaatttgcagttac

SEQ ID NO: 357714 - DNA, 25 bp, Mus musculus
ttgcacttgacgaagcaacaccagt

SEQ ID NO: 357715 - DNA, 25 bp, Mus musculus
accgctgcgttgtacttctccttga

SEQ ID NO: 357716 - DNA, 25 bp, Mus musculus
cgcagcacatggtgtcacagccgtc

SEQ ID NO: 357717 - DNA, 25 bp, Mus musculus
cccacctcgcggaacttaggtagcg

SEQ ID NO: 357718 - DNA, 25 bp, Mus musculus
tagctgcgtagctgcttgatgcgca

SEQ ID NO: 357719 - DNA, 25 bp, Mus musculus
tccataggcttctggtagctgcgta

SEQ ID NO: 357720 - DNA, 25 bp, Mus musculus
tgtacaccaggtccgtctccatagg

SEQ ID NO: 357721 - DNA, 25 bp, Mus musculus
cgggagcctcacttgcaggtgaaga

SEQ ID NO: 357722 - DNA, 25 bp, Mus musculus
ctcctcgcagtagttgggcgacttc

SEQ ID NO: 357723 - DNA, 25 bp, Mus musculus
cgctcgctgcacgtgttgcacttga

SEQ ID NO: 357724 - DNA, 25 bp, Mus musculus
tctctttctctgattggcttccatc

SEQ ID NO: 357725 - DNA, 25 bp, Mus musculus
tggacctcggcagcagctttctctc

SEQ ID NO: 357726 - DNA, 25 bp, Mus musculus
gcagctttctctcctccacactgtt

SEQ ID NO: 357727 - DNA, 25 bp, Mus musculus
cgcagaaccctaggcgtctcggtct

SEQ ID NO: 357728 - DNA, 25 bp, Mus musculus
accctaggcgtctcggtcttaccag

SEQ ID NO: 357729 - DNA, 25 bp, Mus musculus
cgtctcggtcttaccaggcggcgga

SEQ ID NO: 357730 - DNA, 25 bp, Mus musculus
ctgattggcttccatcaacgctacg

SEQ ID NO: 357731 - DNA, 25 bp, Mus musculus
gcagaggcagcagcgccaccaatgc

SEQ ID NO: 357732 - DNA, 25 bp, Mus musculus
aatgcaaccggactcgcgcgcaagc

SEQ ID NO: 357733 - DNA, 25 bp, Mus musculus
gctgagcatccctcccaactccgtg

SEQ ID NO: 357734 - DNA, 25 bp, Mus musculus
caactccgtgcaccgcaacacccgg

SEQ ID NO: 357735 - DNA, 25 bp, Mus musculus
cggagtggacctcggcagcagcttt

SEQ ID NO: 357736 - DNA, 25 bp, Mus musculus
gcagaggaccgctctctttctctga

SEQ ID NO: 357737 - DNA, 25 bp, Mus musculus
cggcgcagaggaccgctctctttct

SEQ ID NO: 357738 - DNA, 25 bp, Mus musculus
acttccagccttccgcctggttgta

SEQ ID NO: 357739 - DNA, 25 bp, Mus musculus
aggcagcggtgacagcatgcgccac

SEQ ID NO: 357740 - DNA, 25 bp, Mus musculus
acaattgctcagattgccctggctg

SEQ ID NO: 357741 - DNA, 25 bp, Mus musculus
agccacaattgctcagattgccctg

SEQ ID NO: 357742 - DNA, 25 bp, Mus musculus
ccggtcacagccacaattgctcaga

SEQ ID NO: 357743 - DNA, 25 bp, Mus musculus
gttgtagtagccttgcttctcccgg

SEQ ID NO: 357744 - DNA, 25 bp, Mus musculus
agccttccgcctggttgtagtagcc

SEQ ID NO: 357745 - DNA, 25 bp, Mus musculus
cgagaaaagtcgatgccgtagcgga

SEQ ID NO: 357746 - DNA, 25 bp, Mus musculus
catccacaaagcgacgagaaaagtc

SEQ ID NO: 357747 - DNA, 25 bp, Mus musculus
acgggcatccacaaagcgacgagaa

SEQ ID NO: 357748 - DNA, 25 bp, Mus musculus
tgatctcacgggcatccacaaagcg

SEQ ID NO: 357749 - DNA, 25 bp, Mus musculus
ggcgttctttttgatctcacgggca

SEQ ID NO: 357750 - DNA, 25 bp, Mus musculus
cgcctggcgttctttttgatctcac

SEQ ID NO: 357751 - DNA, 25 bp, Mus musculus
ccgcctggttgtagtagccttgctt

SEQ ID NO: 357752 - DNA, 25 bp, Mus musculus
cggcttaggccagcaaagtgaccca

SEQ ID NO: 357753 - DNA, 25 bp, Mus musculus
ttctttttaaatcggaggccagagc

SEQ ID NO: 357754 - DNA, 25 bp, Mus musculus
aggccagagcatatgcgtcccatta

SEQ ID NO: 357755 - DNA, 25 bp, Mus musculus
ggcgatgctccgcatactctctaga

SEQ ID NO: 357756 - DNA, 25 bp, Mus musculus
gaccttgattacctgcgcgcacatt

SEQ ID NO: 357757 - DNA, 25 bp, Mus musculus
ctcccggtgtggaaggacagcacaa

SEQ ID NO: 357758 - DNA, 25 bp, Mus musculus
ctctccttagtgtggcaaggccatg

SEQ ID NO: 357759 - DNA, 25 bp, Mus musculus
acgcgactggctagctctgacactc

SEQ ID NO: 357760 - DNA, 25 bp, Mus musculus
tccctccttcagcagtggtagccag

SEQ ID NO: 357761 - DNA, 25 bp, Mus musculus
ctcgttgtcacagctgtccctcagg

SEQ ID NO: 357762 - DNA, 25 bp, Mus musculus
cccagtttctttgcgcgcagggcat

SEQ ID NO: 357763 - DNA, 25 bp, Mus musculus
tcacaggtaactgccgctggacaga

SEQ ID NO: 357764 - DNA, 25 bp, Mus musculus
cggcggttccataaatcaaacttct

SEQ ID NO: 357765 - DNA, 25 bp, Mus musculus
cgcgctcagtgcacatagcctaatt

SEQ ID NO: 357766 - DNA, 25 bp, Mus musculus
acgcgttgccaccatggtgagccca

SEQ ID NO: 357767 - DNA, 25 bp, Mus musculus
gtaatttcaacatgtccgggtgatg

SEQ ID NO: 357768 - DNA, 25 bp, Mus musculus
ccgagccagccggacgagttgtcaa

SEQ ID NO: 357769 - DNA, 25 bp, Mus musculus
gcccaaacaggtgaaagtacgcgcc

SEQ ID NO: 357770 - DNA, 25 bp, Mus musculus
agctgcggtaggaccacgctcagcc

SEQ ID NO: 357771 - DNA, 25 bp, Mus musculus
tgcgccatagacagctgcggccgga

SEQ ID NO: 357772 - DNA, 25 bp, Mus musculus
ttcgaaagtttctgtgcatgatcca

SEQ ID NO: 357773 - DNA, 25 bp, Mus musculus
cgccaaagcagagaaacacgtaaaa

SEQ ID NO: 357774 - DNA, 25 bp, Mus musculus
cccgagcttcacgtagaggacgcca

SEQ ID NO: 357775 - DNA, 25 bp, Mus musculus
ccagagaaatactcacccgagcttc

SEQ ID NO: 357776 - DNA, 25 bp, Mus musculus
ggccggagataccagccagcctggc

SEQ ID NO: 357777 - DNA, 25 bp, Mus musculus
ttgagtctcaacgaggctgggttga

SEQ ID NO: 357778 - DNA, 25 bp, Mus musculus
tgtccctgctgcgtattggctccgc

SEQ ID NO: 357779 - DNA, 25 bp, Mus musculus
cggacgagttgtcaaggtaatttca

SEQ ID NO: 357780 - DNA, 25 bp, Mus musculus
gcaggcactgcgcaagtccgcatcg

SEQ ID NO: 357781 - DNA, 25 bp, Mus musculus
tccagtcacaaaggttcaaggtcag

SEQ ID NO: 357782 - DNA, 25 bp, Mus musculus
tcgcccatgctaatcagcctggcag

SEQ ID NO: 357783 - DNA, 25 bp, Mus musculus
cgctttgtgtctcggctcggccagc

SEQ ID NO: 357784 - DNA, 25 bp, Mus musculus
gccgccgtctgaggcgctttgtgtc

SEQ ID NO: 357785 - DNA, 25 bp, Mus musculus
cccagcgcgtgaatggccgagagcc

SEQ ID NO: 357786 - DNA, 25 bp, Mus musculus
ctggcccaggcgctattcttcgccc

SEQ ID NO: 357787 - DNA, 25 bp, Mus musculus
tgcatgcgctccagtcacaaaggtt

SEQ ID NO: 357788 - DNA, 25 bp, Mus musculus
cgccgcgatttgcatgcgctccagt

SEQ ID NO: 357789 - DNA, 25 bp, Mus musculus
tgcgcaagtccgcatcggcattcct

SEQ ID NO: 357790 - DNA, 25 bp, Mus musculus
gctaatcagcctggcagcgcgtctg

SEQ ID NO: 357791 - DNA, 25 bp, Mus musculus
gctcgccacgcacacgcaggcactg

SEQ ID NO: 357792 - DNA, 25 bp, Mus musculus
cctactggacggagagtgggctaaa

SEQ ID NO: 357793 - DNA, 25 bp, Mus musculus
ctgcctgcgctgttcccagcccgaa

SEQ ID NO: 357794 - DNA, 25 bp, Mus musculus
ttgcattcagagctggccgacccag

SEQ ID NO: 357795 - DNA, 25 bp, Mus musculus
caaactcatttaggccgcgcgcaga

SEQ ID NO: 357796 - DNA, 25 bp, Mus musculus
tgcccgcactaaggttgggcgtgcc

SEQ ID NO: 357797 - DNA, 25 bp, Mus musculus
cctgagtctgcgcaaactcatttag

SEQ ID NO: 357798 - DNA, 25 bp, Mus musculus
gccgcagcctgctaggccgtaaatt

SEQ ID NO: 357799 - DNA, 25 bp, Mus musculus
gctaggccgtaaatttgcattcaga

SEQ ID NO: 357800 - DNA, 25 bp, Mus musculus
gcgtggagctttctaggtccctaga

SEQ ID NO: 357801 - DNA, 25 bp, Mus musculus
gcaaggctccgcctctagacagggc

SEQ ID NO: 357802 - DNA, 25 bp, Mus musculus
tggacttcatttccggcgcaggcta

SEQ ID NO: 357803 - DNA, 25 bp, Mus musculus
ggcgcaggctacttagaagtcacgc

SEQ ID NO: 357804 - DNA, 25 bp, Mus musculus
tacgtctaccgcgagtctgcttccg

SEQ ID NO: 357805 - DNA, 25 bp, Mus musculus
gggcgcacttctgccttttctgctc

SEQ ID NO: 357806 - DNA, 25 bp, Mus musculus
agctgggcaaggctccgcctctaga

SEQ ID NO: 357807 - DNA, 25 bp, Mus musculus
agcgtgagagttgtgtgttatttta

SEQ ID NO: 357808 - DNA, 25 bp, Mus musculus
gagcctacttctagggacctccaga

SEQ ID NO: 357809 - DNA, 25 bp, Mus musculus
tgtcgttctttctcctgtctcccgg

SEQ ID NO: 357810 - DNA, 25 bp, Mus musculus
gccaggctgctgtctttgttgccaa

SEQ ID NO: 357811 - DNA, 25 bp, Mus musculus
ctttgttgccaagctcagacgtcgc

SEQ ID NO: 357812 - DNA, 25 bp, Mus musculus
aagctcagacgtcgctcctgaaacc

SEQ ID NO: 357813 - DNA, 25 bp, Mus musculus
agcccggaaacttcgagttcagcga

SEQ ID NO: 357814 - DNA, 25 bp, Mus musculus
ttcagcgactgtgcacgaagttgga

SEQ ID NO: 357815 - DNA, 25 bp, Mus musculus
ctgtccttgctgctgtcgttctttc

SEQ ID NO: 357816 - DNA, 25 bp, Mus musculus
ccggagctggccgagtttcgtgacc

SEQ ID NO: 357817 - DNA, 25 bp, Mus musculus
cggactacggcagagcctacttcta

SEQ ID NO: 357818 - DNA, 25 bp, Mus musculus
tacttctagggacctccagacagtc

SEQ ID NO: 357819 - DNA, 25 bp, Mus musculus
ctggcggtggccatgaacttgaccc

SEQ ID NO: 357820 - DNA, 25 bp, Mus musculus
ctccggttgacctggtaaagcgctc

SEQ ID NO: 357821 - DNA, 25 bp, Mus musculus
tttcgtgacccggactacggcagag

SEQ ID NO: 357822 - DNA, 25 bp, Mus musculus
tgagccctctgggtgcagcccgagc

SEQ ID NO: 357823 - DNA, 25 bp, Mus musculus
cggccgcacgactctgagccctctg

SEQ ID NO: 357824 - DNA, 25 bp, Mus musculus
tcagtttccccaagggcgcaccgtg

SEQ ID NO: 357825 - DNA, 25 bp, Mus musculus
gggcgcgaccctctaatccgcttta

SEQ ID NO: 357826 - DNA, 25 bp, Mus musculus
gcgaccctctaatccgctttagtca

SEQ ID NO: 357827 - DNA, 25 bp, Mus musculus
aatccgctttagtcaatatagtgtg

SEQ ID NO: 357828 - DNA, 25 bp, Mus musculus
caatatagtgtgtgctctgctccgc

SEQ ID NO: 357829 - DNA, 25 bp, Mus musculus
tgtgtgctctgctccgccgagcaaa

SEQ ID NO: 357830 - DNA, 25 bp, Mus musculus
tccgccgagcaaacaccgggacaaa

SEQ ID NO: 357831 - DNA, 25 bp, Mus musculus
agcaaacaccgggacaaagcagcgg

SEQ ID NO: 357832 - DNA, 25 bp, Mus musculus
gcgccctttgttcgccctcaatagg

SEQ ID NO: 357833 - DNA, 25 bp, Mus musculus
tgttcgccctcaatagggctgcccg

SEQ ID NO: 357834 - DNA, 25 bp, Mus musculus
cccgcggctaattggggcgcgtgca

SEQ ID NO: 357835 - DNA, 25 bp, Mus musculus
gcagccttcacagcccgtgcctgtg

SEQ ID NO: 357836 - DNA, 25 bp, Mus musculus
gcgcgcctgcccgagattgacaggc

SEQ ID NO: 357837 - DNA, 25 bp, Mus musculus
agcagctgcctgcagaaggctgccc

SEQ ID NO: 357838 - DNA, 25 bp, Mus musculus
cccgcgtcaaagaggaaagtactgg

SEQ ID NO: 357839 - DNA, 25 bp, Mus musculus
cgtcaaagaggaaagtactggtcgc

SEQ ID NO: 357840 - DNA, 25 bp, Mus musculus
gaaagtactggtcgcctgtcgctga

SEQ ID NO: 357841 - DNA, 25 bp, Mus musculus
tactggtcgcctgtcgctgagccac

SEQ ID NO: 357842 - DNA, 25 bp, Mus musculus
agccaccttcgctgcgagtgagagg

SEQ ID NO: 357843 - DNA, 25 bp, Mus musculus
accttcgctgcgagtgagaggcagt

SEQ ID NO: 357844 - DNA, 25 bp, Mus musculus
cgagcagctgcctgcagaaggctgc

SEQ ID NO: 357845 - DNA, 25 bp, Mus musculus
agctgcgcgcctgcccgagattgac

SEQ ID NO: 357846 - DNA, 25 bp, Mus musculus
cctccctgcgcggtccgagcagctg

SEQ ID NO: 357847 - DNA, 25 bp, Mus musculus
tgcccgagattgacaggcggggtcc

SEQ ID NO: 357848 - DNA, 25 bp, Mus musculus
cagtggcagagatggcaggctgcga

SEQ ID NO: 357849 - DNA, 25 bp, Mus musculus
tgtgtgcctggctatcctccctgcg

SEQ ID NO: 357850 - DNA, 25 bp, Mus musculus
ggattgcgcccacacgttgaagttg

SEQ ID NO: 357851 - DNA, 25 bp, Mus musculus
cgcccagacccaaagagaattcgga

SEQ ID NO: 357852 - DNA, 25 bp, Mus musculus
ggtgcttcgcgtgctaagtttccaa

SEQ ID NO: 357853 - DNA, 25 bp, Mus musculus
cgtgctaagtttccaatagggcccg

SEQ ID NO: 357854 - DNA, 25 bp, Mus musculus
ggaagggcacaaggcccgctcccga

SEQ ID NO: 357855 - DNA, 25 bp, Mus musculus
ctttccgagtggtagtggccaaccg

SEQ ID NO: 357856 - DNA, 25 bp, Mus musculus
gcctccgtagctcaggggttctgga

SEQ ID NO: 357857 - DNA, 25 bp, Mus musculus
gggaagccctatccgggattgcgcc

SEQ ID NO: 357858 - DNA, 25 bp, Mus musculus
ttctggagaccaagattgcccgggg

SEQ ID NO: 357859 - DNA, 25 bp, Mus musculus
ttctcctgggctctgtagttctttc

SEQ ID NO: 357860 - DNA, 25 bp, Mus musculus
gtagttctttcgcttatcttcagtg

SEQ ID NO: 357861 - DNA, 25 bp, Mus musculus
tggaaggtggccttggagaataaac

SEQ ID NO: 357862 - DNA, 25 bp, Mus musculus
gggccaatggatactagaaatcgtc

SEQ ID NO: 357863 - DNA, 25 bp, Mus musculus
gttgaagttgcccagaatgaagccc

SEQ ID NO: 357864 - DNA, 25 bp, Mus musculus
gccaactccgagacaaaagacataa

SEQ ID NO: 357865 - DNA, 25 bp, Mus musculus
ttggagaaagtcacggagcacgccg

SEQ ID NO: 357866 - DNA, 25 bp, Mus musculus
cgggatgcacgtgaacttggagaaa

SEQ ID NO: 357867 - DNA, 25 bp, Mus musculus
gccgctccgggatgcacgtgaactt

SEQ ID NO: 357868 - DNA, 25 bp, Mus musculus
tgtgccaagccaccgctgcattcgg

SEQ ID NO: 357869 - DNA, 25 bp, Mus musculus
cattagcatgcaccgggcgcgcggc

SEQ ID NO: 357870 - DNA, 25 bp, Mus musculus
gccggccattagcatgcaccgggcg

SEQ ID NO: 357871 - DNA, 25 bp, Mus musculus
ctctaccggtgggtctccgcggtgc

SEQ ID NO: 357872 - DNA, 25 bp, Mus musculus
aagacataaaataggcggcaacggg

SEQ ID NO: 357873 - DNA, 25 bp, Mus musculus
tgggacaggtgccaactccgagaca

SEQ ID NO: 357874 - DNA, 25 bp, Mus musculus
cgcgctctctgggacaggtgccaac

SEQ ID NO: 357875 - DNA, 25 bp, Mus musculus
attccgggcgcgttcgcaaccctga

SEQ ID NO: 357876 - DNA, 25 bp, Mus musculus
gcacagcggcctcgttggtattccg

SEQ ID NO: 357877 - DNA, 25 bp, Mus musculus
ctgaataattcatggcgcgcccgcc

SEQ ID NO: 357878 - DNA, 25 bp, Mus musculus
ttgaacttcagtcctggccggtgcg

SEQ ID NO: 357879 - DNA, 25 bp, Mus musculus
aaagatcagattccgcctgtccgtc

SEQ ID NO: 357880 - DNA, 25 bp, Mus musculus
gcgccggctccgaacattggtgttc

SEQ ID NO: 357881 - DNA, 25 bp, Mus musculus
aagggcacacgcgtgcgagttttca

SEQ ID NO: 357882 - DNA, 25 bp, Mus musculus
agggcacacgctaggaagggcacac

SEQ ID NO: 357883 - DNA, 25 bp, Mus musculus
gccaatcagacactgccgtccaggg

SEQ ID NO: 357884 - DNA, 25 bp, Mus musculus
ctaaatgggcatcgaggagagctgc

SEQ ID NO: 357885 - DNA, 25 bp, Mus musculus
tctcatcctgggactctaaagatca

SEQ ID NO: 357886 - DNA, 25 bp, Mus musculus
cagacccgcagccttgaacttcagt

SEQ ID NO: 357887 - DNA, 25 bp, Mus musculus
ggcacccggaggaaagctcaaccca

SEQ ID NO: 357888 - DNA, 25 bp, Mus musculus
gaccagctcaacgagggcacccgga

SEQ ID NO: 357889 - DNA, 25 bp, Mus musculus
ggaacaagctgtgcgatctagacca

SEQ ID NO: 357890 - DNA, 25 bp, Mus musculus
gaccttgggcagtcccttcacctaa

SEQ ID NO: 357891 - DNA, 25 bp, Mus musculus
ctcagtttaccaacggatgcccggg

SEQ ID NO: 357892 - DNA, 25 bp, Mus musculus
tgtcccgactgacgtctaaaacgga

SEQ ID NO: 357893 - DNA, 25 bp, Mus musculus
cggggtagagctttactgtcgcttc

SEQ ID NO: 357894 - DNA, 25 bp, Mus musculus
tggcgcctaagcaactccactctgt

SEQ ID NO: 357895 - DNA, 25 bp, Mus musculus
tgaagctccgccacactaccggttt

SEQ ID NO: 357896 - DNA, 25 bp, Mus musculus
tccatggcatttgtgcagcccaatc

SEQ ID NO: 357897 - DNA, 25 bp, Mus musculus
ggacatttccagctagccacgcgcg

SEQ ID NO: 357898 - DNA, 25 bp, Mus musculus
agccggaacacagaggggacatttc

SEQ ID NO: 357899 - DNA, 25 bp, Mus musculus
cttccagaggcaccgaggacagatc

SEQ ID NO: 357900 - DNA, 25 bp, Mus musculus
ttaattcgcacgtcacaggccctcg

SEQ ID NO: 357901 - DNA, 25 bp, Mus musculus
tgcgccttggaaactgacagatgtc

SEQ ID NO: 357902 - DNA, 25 bp, Mus musculus
ttgcgtcctacagaaccgagctttg

SEQ ID NO: 357903 - DNA, 25 bp, Mus musculus
cgtttccgctgctagcttatagtga

SEQ ID NO: 357904 - DNA, 25 bp, Mus musculus
cgcgaacctagctagtggtatctta

SEQ ID NO: 357905 - DNA, 25 bp, Mus musculus
attctattttgggtgtgcgcgaacc

SEQ ID NO: 357906 - DNA, 25 bp, Mus musculus
gagcctcagtctttttggcctcgcc

SEQ ID NO: 357907 - DNA, 25 bp, Mus musculus
gcgggagcctcagtctttttggcct

SEQ ID NO: 357908 - DNA, 25 bp, Mus musculus
ctaggtttagagtctgaagccgccg

SEQ ID NO: 357909 - DNA, 25 bp, Mus musculus
ccacgctttgctcggagctggcggc

SEQ ID NO: 357910 - DNA, 25 bp, Mus musculus
gttactctttgacggccacgctttg

SEQ ID NO: 357911 - DNA, 25 bp, Mus musculus
ttctggttggctgtcccggttactc

SEQ ID NO: 357912 - DNA, 25 bp, Mus musculus
tccgtgctctccttgacctcggtgg

SEQ ID NO: 357913 - DNA, 25 bp, Mus musculus
tttagagtctgaagccgccggggcc

SEQ ID NO: 357914 - DNA, 25 bp, Mus musculus
tggctgtcccggttactctttgacg

SEQ ID NO: 357915 - DNA, 25 bp, Mus musculus
cgcgccttcggccttcttgtctttg

SEQ ID NO: 357916 - DNA, 25 bp, Mus musculus
tcggccttcttgtctttgtccttgg

SEQ ID NO: 357917 - DNA, 25 bp, Mus musculus
gtctttgtccttggccttctcgtcg

SEQ ID NO: 357918 - DNA, 25 bp, Mus musculus
gctccgcgctgctaggtttagagtc

SEQ ID NO: 357919 - DNA, 25 bp, Mus musculus
tctccttgacctcggtggcgtcggc

SEQ ID NO: 357920 - DNA, 25 bp, Mus musculus
gcggggtccgaagagttgactttca

SEQ ID NO: 357921 - DNA, 25 bp, Mus musculus
agcgtgctccgccactccggaataa

SEQ ID NO: 357922 - DNA, 25 bp, Mus musculus
gtgctccgccactccggaataaggc

SEQ ID NO: 357923 - DNA, 25 bp, Mus musculus
gccactccggaataaggcggttcac

SEQ ID NO: 357924 - DNA, 25 bp, Mus musculus
aataaggcggttcacccgaggtgtg

SEQ ID NO: 357925 - DNA, 25 bp, Mus musculus
ttcacccgaggtgtgggttctctcg

SEQ ID NO: 357926 - DNA, 25 bp, Mus musculus
cgtctggcaggacacgttagccttg

SEQ ID NO: 357927 - DNA, 25 bp, Mus musculus
agctgccgggcgcaacggccgtgac

SEQ ID NO: 357928 - DNA, 25 bp, Mus musculus
caggacacgttagccttggcggctg

SEQ ID NO: 357929 - DNA, 25 bp, Mus musculus
tggctgcctagacccaggcccaggc

SEQ ID NO: 357930 - DNA, 25 bp, Mus musculus
agttgactttcaggaggacgcgtgc

SEQ ID NO: 357931 - DNA, 25 bp, Mus musculus
ctttcaggaggacgcgtgcagctgc

SEQ ID NO: 357932 - DNA, 25 bp, Mus musculus
agctgcgcccgagggacacctacgg

SEQ ID NO: 357933 - DNA, 25 bp, Mus musculus
tctggcaggacacgttagccttggc

SEQ ID NO: 357934 - DNA, 25 bp, Mus musculus
tgtcactgcgagactgccaggtacg

SEQ ID NO: 357935 - DNA, 25 bp, Mus musculus
acgcgcaccggttcggctgggtcct

SEQ ID NO: 357936 - DNA, 25 bp, Mus musculus
tcctcggtccgggagttgacccagc

SEQ ID NO: 357937 - DNA, 25 bp, Mus musculus
tataatcatgtcactgcgagactgc

SEQ ID NO: 357938 - DNA, 25 bp, Mus musculus
tccaaaagctttgaccggtgctgtc

SEQ ID NO: 357939 - DNA, 25 bp, Mus musculus
gcagaccaaagctataatcatgtca

SEQ ID NO: 357940 - DNA, 25 bp, Mus musculus
aagctttgaccggtgctgtcactct

SEQ ID NO: 357941 - DNA, 25 bp, Mus musculus
cctctcagagactccaaaagctttg

SEQ ID NO: 357942 - DNA, 25 bp, Mus musculus
ccaatgagagatccggatagcgcgg

SEQ ID NO: 357943 - DNA, 25 bp, Mus musculus
gccaccaatgagagatccggatagc

SEQ ID NO: 357944 - DNA, 25 bp, Mus musculus
tgcgtcccaagccaccaatgagaga

SEQ ID NO: 357945 - DNA, 25 bp, Mus musculus
gcatgtgcgtcccaagccaccaatg

SEQ ID NO: 357946 - DNA, 25 bp, Mus musculus
gccaggtacgcgcaccggttcggct

SEQ ID NO: 357947 - DNA, 25 bp, Mus musculus
gctgtcactctgcagaccaaagcta

SEQ ID NO: 357948 - DNA, 25 bp, Mus musculus
agctcagagccggaaatccgttacc

SEQ ID NO: 357949 - DNA, 25 bp, Mus musculus
cttgcttcctgcagcgaactctgtg

SEQ ID NO: 357950 - DNA, 25 bp, Mus musculus
ttgcctctgacttgcctaattctcc

SEQ ID NO: 357951 - DNA, 25 bp, Mus musculus
tggggcttgcctctgacttgcctaa

SEQ ID NO: 357952 - DNA, 25 bp, Mus musculus
cggtgccagctctgcagctcagagc

SEQ ID NO: 357953 - DNA, 25 bp, Mus musculus
cgagagcgtctcctgtttaaacagg

SEQ ID NO: 357954 - DNA, 25 bp, Mus musculus
agcaagttggggcttgcctctgact

SEQ ID NO: 357955 - DNA, 25 bp, Mus musculus
gtcccgagccgcagagatccgggga

SEQ ID NO: 357956 - DNA, 25 bp, Mus musculus
cctgcagcgaactctgtggaaggag

SEQ ID NO: 357957 - DNA, 25 bp, Mus musculus
tatgccttcccggtcagaggcgagg

SEQ ID NO: 357958 - DNA, 25 bp, Mus musculus
tggattttatgccttcccggtcaga

SEQ ID NO: 357959 - DNA, 25 bp, Mus musculus
agacccagctggattttatgccttc

SEQ ID NO: 357960 - DNA, 25 bp, Mus musculus
aaaccggtgccggagacccagctgg

SEQ ID NO: 357961 - DNA, 25 bp, Mus musculus
tcctgtttaaacaggccaatcggcg

SEQ ID NO: 357962 - DNA, 25 bp, Mus musculus
tcatcgctggcctatctgggacatg

SEQ ID NO: 357963 - DNA, 25 bp, Mus musculus
ggccgacacagcatctcgaccttgt

SEQ ID NO: 357964 - DNA, 25 bp, Mus musculus
cttggacgcagccagaaagctcgcg

SEQ ID NO: 357965 - DNA, 25 bp, Mus musculus
ctcgaccttgtgtgtgcccaggaac

SEQ ID NO: 357966 - DNA, 25 bp, Mus musculus
cgcgcggaacccaaaagcctgcaga

SEQ ID NO: 357967 - DNA, 25 bp, Mus musculus
aaagctcgcggtgtagcctgatgtc

SEQ ID NO: 357968 - DNA, 25 bp, Mus musculus
taagaagccggacccgaccaactca

SEQ ID NO: 357969 - DNA, 25 bp, Mus musculus
cagaagaaaacgtcgcaagggcagc

SEQ ID NO: 357970 - DNA, 25 bp, Mus musculus
ccagctgagcacagaagaaaacgtc

SEQ ID NO: 357971 - DNA, 25 bp, Mus musculus
gctgacccaggagcgccagctgagc

SEQ ID NO: 357972 - DNA, 25 bp, Mus musculus
ctgttcctggtgcagctgacccagg

SEQ ID NO: 357973 - DNA, 25 bp, Mus musculus
ctttgagacctcaagcccgagcgga

SEQ ID NO: 357974 - DNA, 25 bp, Mus musculus
gcccaggaacgcctttgagacctca

SEQ ID NO: 357975 - DNA, 25 bp, Mus musculus
ggacttccggcgtagcttggacgca

SEQ ID NO: 357976 - DNA, 25 bp, Mus musculus
cctctgacgggaagaaccggccacg

SEQ ID NO: 357977 - DNA, 25 bp, Mus musculus
cctgcaggtcctctgacgggaagaa

SEQ ID NO: 357978 - DNA, 25 bp, Mus musculus
tgtccggttcaggtagatctgctcc

SEQ ID NO: 357979 - DNA, 25 bp, Mus musculus
gttgtcatcgaagggcagcactcgc

SEQ ID NO: 357980 - DNA, 25 bp, Mus musculus
cctcaggcagatgttgtcatcgaag

SEQ ID NO: 357981 - DNA, 25 bp, Mus musculus
cctaagcacagacacgcatttcatg

SEQ ID NO: 357982 - DNA, 25 bp, Mus musculus
ggggccgaactgtcaaacctaagca

SEQ ID NO: 357983 - DNA, 25 bp, Mus musculus
agcaccgtggtggaactaatgaagg

SEQ ID NO: 357984 - DNA, 25 bp, Mus musculus
tcaatttcagtctcgcagtagtccc

SEQ ID NO: 357985 - DNA, 25 bp, Mus musculus
agcagtgccgagaaagtcacgttca

SEQ ID NO: 357986 - DNA, 25 bp, Mus musculus
ggagtagcaaagatcaatttcagtc

SEQ ID NO: 357987 - DNA, 25 bp, Mus musculus
ccgagaaagtcacgttcaggatgtt

SEQ ID NO: 357988 - DNA, 25 bp, Mus musculus
cccgcacggattggagtagcaaaga

SEQ ID NO: 357989 - DNA, 25 bp, Mus musculus
gttcaggatgttggagctgacgtcc

SEQ ID NO: 357990 - DNA, 25 bp, Mus musculus
cactattggcatcacggtctcgggc

SEQ ID NO: 357991 - DNA, 25 bp, Mus musculus
atccgtggcactgatggtagcgatg

SEQ ID NO: 357992 - DNA, 25 bp, Mus musculus
acgggccggtcttcactcacactga

SEQ ID NO: 357993 - DNA, 25 bp, Mus musculus
gtggtacgggatcctctagcacata

SEQ ID NO: 357994 - DNA, 25 bp, Mus musculus
tgatgcgggcgttctcacccgtatc

SEQ ID NO: 357995 - DNA, 25 bp, Mus musculus
cacactgaccgtgtagtgggaactc

SEQ ID NO: 357996 - DNA, 25 bp, Mus musculus
tgtaacgttgataaagacctgcgcg

SEQ ID NO: 357997 - DNA, 25 bp, Mus musculus
catcctcattcagacgcagctcata

SEQ ID NO: 357998 - DNA, 25 bp, Mus musculus
acccgtcagctggtaggtgatcaca

SEQ ID NO: 357999 - DNA, 25 bp, Mus musculus
aggtgataaggccaccgccgctctg

SEQ ID NO: 358000 - DNA, 25 bp, Mus musculus
ctgcttgtagtccaggggcagtgcc

SEQ ID NO: 358001 - DNA, 25 bp, Mus musculus
gcacatactgccgttcctgcttgta

SEQ ID NO: 358002 - DNA, 25 bp, Mus musculus
gacgcggtcacagccagcacatact

SEQ ID NO: 358003 - DNA, 25 bp, Mus musculus
ctcatacacaggctgcgtgaacatg

SEQ ID NO: 358004 - DNA, 25 bp, Mus musculus
gctgctacagcagatgatgtcatcg

SEQ ID NO: 358005 - DNA, 25 bp, Mus musculus
aggcgactgcaatggcttggacttc

SEQ ID NO: 358006 - DNA, 25 bp, Mus musculus
actgccttcccatggtctggcttcg

SEQ ID NO: 358007 - DNA, 25 bp, Mus musculus
aacctgctgcgtgccaaggagtacc

SEQ ID NO: 358008 - DNA, 25 bp, Mus musculus
caatgtgggcgacatcctgagtgca

SEQ ID NO: 358009 - DNA, 25 bp, Mus musculus
cgctcacggtcagcacggccaatgt

SEQ ID NO: 358010 - DNA, 25 bp, Mus musculus
cttggacttctatggcccagggccc

SEQ ID NO: 358011 - DNA, 25 bp, Mus musculus
atcgacttcgtgagtgccgaggcac

SEQ ID NO: 358012 - DNA, 25 bp, Mus musculus
ctgtagtggaccagcagaacgtgta

SEQ ID NO: 358013 - DNA, 25 bp, Mus musculus
cttcaagaagctgttcacgtcggga

SEQ ID NO: 358014 - DNA, 25 bp, Mus musculus
gccgcctgcagccagtacttcaaga

SEQ ID NO: 358015 - DNA, 25 bp, Mus musculus
tgacggcgctcatggacttcgccta

SEQ ID NO: 358016 - DNA, 25 bp, Mus musculus
gcagcgacatcctgagcggcctgaa

SEQ ID NO: 358017 - DNA, 25 bp, Mus musculus
gctgctttgcgacgtggtgattctt

SEQ ID NO: 358018 - DNA, 25 bp, Mus musculus
gctgaacctcctggccgcaggcaaa

SEQ ID NO: 358019 - DNA, 25 bp, Mus musculus
gcgtggtgtccaacctgtagctcca

SEQ ID NO: 358020 - DNA, 25 bp, Mus musculus
gcgcgtgcccttagtaccaagctcg

SEQ ID NO: 358021 - DNA, 25 bp, Mus musculus
atggcctcaagcaccgaagtcagcg

SEQ ID NO: 358022 - DNA, 25 bp, Mus musculus
ggaagcagagcgcatctccaagtcc

SEQ ID NO: 358023 - DNA, 25 bp, Mus musculus
tgctcccaactccagggctggcagg

SEQ ID NO: 358024 - DNA, 25 bp, Mus musculus
agggcgcacaccagacgcagctcag

SEQ ID NO: 358025 - DNA, 25 bp, Mus musculus
tattaccagctctacccaaacggcg

SEQ ID NO: 358026 - DNA, 25 bp, Mus musculus
ggcgtcccagaggtcgcctctatta

SEQ ID NO: 358027 - DNA, 25 bp, Mus musculus
ttaagcaacgatggcgacaccgagg

SEQ ID NO: 358028 - DNA, 25 bp, Mus musculus
cactgacacctggtagctgggcagc

SEQ ID NO: 358029 - DNA, 25 bp, Mus musculus
ccgcaggctcattctcaggcactga

SEQ ID NO: 358030 - DNA, 25 bp, Mus musculus
cgcgcagttcgatgaccgcagtgcc

SEQ ID NO: 358031 - DNA, 25 bp, Mus musculus
tctccaagtccaggaactgagcgga

SEQ ID NO: 358032 - DNA, 25 bp, Mus musculus
cgcgggtctccatttggcagtaacc

SEQ ID NO: 358033 - DNA, 25 bp, Mus musculus
ctccatttggcagtaaccgtcaagc

SEQ ID NO: 358034 - DNA, 25 bp, Mus musculus
ggcagtaaccgtcaagccagttcgc

SEQ ID NO: 358035 - DNA, 25 bp, Mus musculus
accgtcaagccagttcgccgggaga

SEQ ID NO: 358036 - DNA, 25 bp, Mus musculus
gacagtggagtgtatccttgtgctc

SEQ ID NO: 358037 - DNA, 25 bp, Mus musculus
tgtatccttgtgctcggttgtgccc

SEQ ID NO: 358038 - DNA, 25 bp, Mus musculus
cttgtgctcggttgtgcccgtggct

SEQ ID NO: 358039 - DNA, 25 bp, Mus musculus
caaacaaaggcggcgccgcgtgatc

SEQ ID NO: 358040 - DNA, 25 bp, Mus musculus
cagactccgcgcagcaggacgtgag

SEQ ID NO: 358041 - DNA, 25 bp, Mus musculus
ccgatcatcccgcagggtaagcggc

SEQ ID NO: 358042 - DNA, 25 bp, Mus musculus
atcccgcagggtaagcggcgcgcac

SEQ ID NO: 358043 - DNA, 25 bp, Mus musculus
cgcacgcggactcccacacggacct

SEQ ID NO: 358044 - DNA, 25 bp, Mus musculus
gtgtgcccacactctcactcggtgg

SEQ ID NO: 358045 - DNA, 25 bp, Mus musculus
actcggtggcccacagcagcgaccc

SEQ ID NO: 358046 - DNA, 25 bp, Mus musculus
ctgcgtcacccggtacgcagagagg

SEQ ID NO: 358047 - DNA, 25 bp, Mus musculus
ggcgctgcgtcacccggtacgcaga

SEQ ID NO: 358048 - DNA, 25 bp, Mus musculus
acagcacggagtgcagcggctccgc

SEQ ID NO: 358049 - DNA, 25 bp, Mus musculus
ttcacccacagcacggagtgcagcg

SEQ ID NO: 358050 - DNA, 25 bp, Mus musculus
gccgtttcacccacagcacggagtg

SEQ ID NO: 358051 - DNA, 25 bp, Mus musculus
tgacggcacagcgtcgccgtttcac

SEQ ID NO: 358052 - DNA, 25 bp, Mus musculus
gctgacggcacagcgtcgccgtttc

SEQ ID NO: 358053 - DNA, 25 bp, Mus musculus
tccgccaccagcgtagcagagcccg

SEQ ID NO: 358054 - DNA, 25 bp, Mus musculus
tggccacacttaccggcacccggcg

SEQ ID NO: 358055 - DNA, 25 bp, Mus musculus
caggtctcctccctccgagttccgc

SEQ ID NO: 358056 - DNA, 25 bp, Mus musculus
gcgcctcggtatcccgggcgcctct

SEQ ID NO: 358057 - DNA, 25 bp, Mus musculus
gcacccgggctctgcgtctcggatt

SEQ ID NO: 358058 - DNA, 25 bp, Mus musculus
cgcggagtacttagaccgcccggca

SEQ ID NO: 358059 - DNA, 25 bp, Mus musculus
ccagaggccgcggagtacttagacc

SEQ ID NO: 358060 - DNA, 25 bp, Mus musculus
cagcgtcgccttctcatggcgtcaa

SEQ ID NO: 358061 - DNA, 25 bp, Mus musculus
ccgtgcctattcgtttttcagctga

SEQ ID NO: 358062 - DNA, 25 bp, Mus musculus
tcgcttcagatgtgctccggtggaa

SEQ ID NO: 358063 - DNA, 25 bp, Mus musculus
aagtcgcttccttcacctcactgtg

SEQ ID NO: 358064 - DNA, 25 bp, Mus musculus
gcagtgtttactgatccggggtcaa

SEQ ID NO: 358065 - DNA, 25 bp, Mus musculus
tggaccacactacagcgggagaagc

SEQ ID NO: 358066 - DNA, 25 bp, Mus musculus
tgctccttctggttctcggtacttg

SEQ ID NO: 358067 - DNA, 25 bp, Mus musculus
tggctgcgagcaaataagaccgact

SEQ ID NO: 358068 - DNA, 25 bp, Mus musculus
cgccagaacatacgcagctcgcaga

SEQ ID NO: 358069 - DNA, 25 bp, Mus musculus
tccggaatcgccgagtcacaacttc

SEQ ID NO: 358070 - DNA, 25 bp, Mus musculus
tacgcttcggagtcctggtgtctct

SEQ ID NO: 358071 - DNA, 25 bp, Mus musculus
cgcaagcgccggcaagatgaagtct

SEQ ID NO: 358072 - DNA, 25 bp, Mus musculus
tgaagtcttcgtgtctccgtgccta

SEQ ID NO: 358073 - DNA, 25 bp, Mus musculus
cgggatccagagacctcagtccgtg

SEQ ID NO: 358074 - DNA, 25 bp, Mus musculus
gggccaagcgttcgatgaatattca

SEQ ID NO: 358075 - DNA, 25 bp, Mus musculus
ccgcgggctgtcaggttcaagccca

SEQ ID NO: 358076 - DNA, 25 bp, Mus musculus
ccagacgttgggttgtagcgtttga

SEQ ID NO: 358077 - DNA, 25 bp, Mus musculus
caagatccaggagtcccgagggcca

SEQ ID NO: 358078 - DNA, 25 bp, Mus musculus
atgctggcgacgtccacaggttagt

SEQ ID NO: 358079 - DNA, 25 bp, Mus musculus
tgtgtgccatccgatccagggattc

SEQ ID NO: 358080 - DNA, 25 bp, Mus musculus
caccgagttcgctccaaggcggaaa

SEQ ID NO: 358081 - DNA, 25 bp, Mus musculus
aaatcactggggcagaggccgtcca

SEQ ID NO: 358082 - DNA, 25 bp, Mus musculus
tgctcctttgaacagcgtgaaaatc

SEQ ID NO: 358083 - DNA, 25 bp, Mus musculus
aaaatcctgaaatcgcacccatgtg

SEQ ID NO: 358084 - DNA, 25 bp, Mus musculus
gtgtcagctcccgtgcaaaatcctg

SEQ ID NO: 358085 - DNA, 25 bp, Mus musculus
tctcggccaagacagaggtgtgtca

SEQ ID NO: 358086 - DNA, 25 bp, Mus musculus
gtgttttattctagcccgccacgta

SEQ ID NO: 358087 - DNA, 25 bp, Mus musculus
tgggaagacagctcagccgcagacc

SEQ ID NO: 358088 - DNA, 25 bp, Mus musculus
ttatggggacgcagcaaccgagccc

SEQ ID NO: 358089 - DNA, 25 bp, Mus musculus
ggcaccgcggcttcaatggcgccat

SEQ ID NO: 358090 - DNA, 25 bp, Mus musculus
accagcagccggcaagatgcgaccg

SEQ ID NO: 358091 - DNA, 25 bp, Mus musculus
tgcccagcatgtcctcaactttttg

SEQ ID NO: 358092 - DNA, 25 bp, Mus musculus
ttgggcattcatgatcctggccagc

SEQ ID NO: 358093 - DNA, 25 bp, Mus musculus
tggagcctctgccttgctaggaagc

SEQ ID NO: 358094 - DNA, 25 bp, Mus musculus
gcgacactccctccggggacttatg

SEQ ID NO: 358095 - DNA, 25 bp, Mus musculus
ccaggctagcgaccgagcggagctt

SEQ ID NO: 358096 - DNA, 25 bp, Mus musculus
gactagccagcagggccggcatcag

SEQ ID NO: 358097 - DNA, 25 bp, Mus musculus
ccataagggcctcgggtcctccaag

SEQ ID NO: 358098 - DNA, 25 bp, Mus musculus
ttcctccgacgcgtggtggagcctc

SEQ ID NO: 358099 - DNA, 25 bp, Mus musculus
actgcagtgagtaccgtgcacccgg

SEQ ID NO: 358100 - DNA, 25 bp, Mus musculus
tgctcatcgcctactgcagtgagta

SEQ ID NO: 358101 - DNA, 25 bp, Mus musculus
gggctcgccagatgctttctgtaaa

SEQ ID NO: 358102 - DNA, 25 bp, Mus musculus
gcggcccgagactttctgctaacct

SEQ ID NO: 358103 - DNA, 25 bp, Mus musculus
caaaagacacagatcgcctcccgga

SEQ ID NO: 358104 - DNA, 25 bp, Mus musculus
gtggaggaaggcgacgccgatctct

SEQ ID NO: 358105 - DNA, 25 bp, Mus musculus
gcagctcgccaagacgccgagccga

SEQ ID NO: 358106 - DNA, 25 bp, Mus musculus
ggcgcggccaccctcagcgtcgccc

SEQ ID NO: 358107 - DNA, 25 bp, Mus musculus
ctccgggccgtgcaagttggactgc

SEQ ID NO: 358108 - DNA, 25 bp, Mus musculus
cctgaagctgcctctgcgcggcggt

SEQ ID NO: 358109 - DNA, 25 bp, Mus musculus
ctgatgcggctcctggaccttcgct

SEQ ID NO: 358110 - DNA, 25 bp, Mus musculus
gccgcggcccgagactttctgctaa

SEQ ID NO: 358111 - DNA, 25 bp, Mus musculus
ccgttgcgcaatccgcggccggtct

SEQ ID NO: 358112 - DNA, 25 bp, Mus musculus
gatcgggcggccaaagcggctgcac

SEQ ID NO: 358113 - DNA, 25 bp, Mus musculus
cagcggcaacagagcagtggaggaa

SEQ ID NO: 358114 - DNA, 25 bp, Mus musculus
gacacagatcgcctcccggagtggc

SEQ ID NO: 358115 - DNA, 25 bp, Mus musculus
ctggaccttcgctgcgcgacttcgg

SEQ ID NO: 358116 - DNA, 25 bp, Mus musculus
cggtcgcagtacctgccgtcatttt

SEQ ID NO: 358117 - DNA, 25 bp, Mus musculus
tgtcacgcttcttggtgcctgccta

SEQ ID NO: 358118 - DNA, 25 bp, Mus musculus
aagcggctaatgaatgggcgcgccc

SEQ ID NO: 358119 - DNA, 25 bp, Mus musculus
ggggcccatccagccgtactctagg

SEQ ID NO: 358120 - DNA, 25 bp, Mus musculus
aactgcgcctgcgtagtcttcgtag

SEQ ID NO: 358121 - DNA, 25 bp, Mus musculus
gtaacctgacctccggagatggggc

SEQ ID NO: 358122 - DNA, 25 bp, Mus musculus
agactgcgccggagtaacctgacct

SEQ ID NO: 358123 - DNA, 25 bp, Mus musculus
ccagacctcgtgtgtgtgagactgc

SEQ ID NO: 358124 - DNA, 25 bp, Mus musculus
gactgcgcctgcgtagtcttcggac

SEQ ID NO: 358125 - DNA, 25 bp, Mus musculus
tgcctgcctagcttgaagcgtgtgc

SEQ ID NO: 358126 - DNA, 25 bp, Mus musculus
ccgtagcgtcttcacggtcgcagta

SEQ ID NO: 358127 - DNA, 25 bp, Mus musculus
taactcaacgctttggctccgtagc

SEQ ID NO: 358128 - DNA, 25 bp, Mus musculus
tctgaccgcggaggcttaacgaaac

SEQ ID NO: 358129 - DNA, 25 bp, Mus musculus
gccagaccgcgcttgcgtagtttga

SEQ ID NO: 358130 - DNA, 25 bp, Mus musculus
ggcgagcctcaattggtccacatca

SEQ ID NO: 358131 - DNA, 25 bp, Mus musculus
cccgcggaactgagcagactgacca

SEQ ID NO: 358132 - DNA, 25 bp, Mus musculus
ttgaggaactcaaaggccgtcacgc

SEQ ID NO: 358133 - DNA, 25 bp, Mus musculus
agggacacgctcagcctctaagtga

SEQ ID NO: 358134 - DNA, 25 bp, Mus musculus
cccgaacttgacatggccaccattg

SEQ ID NO: 358135 - DNA, 25 bp, Mus musculus
catggggacccgatagaagattacg

SEQ ID NO: 358136 - DNA, 25 bp, Mus musculus
ttacggttctgcctcattctcgcgg

SEQ ID NO: 358137 - DNA, 25 bp, Mus musculus
ccttctcattggtggcttctcgtgg

SEQ ID NO: 358138 - DNA, 25 bp, Mus musculus
gattcctccggccaatagaagcgcg

SEQ ID NO: 358139 - DNA, 25 bp, Mus musculus
ggtgccacctccactacaggggatg

SEQ ID NO: 358140 - DNA, 25 bp, Mus musculus
gccaacacggccaggaagaatttcg

SEQ ID NO: 358141 - DNA, 25 bp, Mus musculus
tcaggtgagtgttcccaagaagtgc

SEQ ID NO: 358142 - DNA, 25 bp, Mus musculus
gcccggaagccaagtctttgcccga

SEQ ID NO: 358143 - DNA, 25 bp, Mus musculus
gtagcctcccggaagccgacgatgt

SEQ ID NO: 358144 - DNA, 25 bp, Mus musculus
ccgcactacagggttcgggccctgg

SEQ ID NO: 358145 - DNA, 25 bp, Mus musculus
cgcagcccgcactacagggttcggg

SEQ ID NO: 358146 - DNA, 25 bp, Mus musculus
ttcgggccctgggaaggacgcaaga

SEQ ID NO: 358147 - DNA, 25 bp, Mus musculus
ccctgggaaggacgcaagagcagcg

SEQ ID NO: 358148 - DNA, 25 bp, Mus musculus
gaatcctggagggtttccggtgatg

SEQ ID NO: 358149 - DNA, 25 bp, Mus musculus
gtttccggtgatgggtgatcgggag

SEQ ID NO: 358150 - DNA, 25 bp, Mus musculus
actcacaggggaccggtggatctga

SEQ ID NO: 358151 - DNA, 25 bp, Mus musculus
gtggatctgagtcgcgtgtctcgcc

SEQ ID NO: 358152 - DNA, 25 bp, Mus musculus
gatctgagtcgcgtgtctcgccctt

SEQ ID NO: 358153 - DNA, 25 bp, Mus musculus
atctgagtcgcgtgtctcgcccttt

SEQ ID NO: 358154 - DNA, 25 bp, Mus musculus
tctgagtcgcgtgtctcgccctttc

SEQ ID NO: 358155 - DNA, 25 bp, Mus musculus
tgagtcgcgtgtctcgccctttccc

SEQ ID NO: 358156 - DNA, 25 bp, Mus musculus
accggtggatctgagtcgcgtgtct

SEQ ID NO: 358157 - DNA, 25 bp, Mus musculus
gcagcccgcactacagggttcgggc

SEQ ID NO: 358158 - DNA, 25 bp, Mus musculus
tgtgcgctccgaccatctgcacaga

SEQ ID NO: 358159 - DNA, 25 bp, Mus musculus
gaagccgtacctgtgccagcagtgc

SEQ ID NO: 358160 - DNA, 25 bp, Mus musculus
cttcgcgcacaactacgacctgaag

SEQ ID NO: 358161 - DNA, 25 bp, Mus musculus
acctgaagaaccacatgcgggtgca

SEQ ID NO: 358162 - DNA, 25 bp, Mus musculus
gctgcggccataccagtgcgatagc

SEQ ID NO: 358163 - DNA, 25 bp, Mus musculus
taagaacagagagaaaccaccaccc

SEQ ID NO: 358164 - DNA, 25 bp, Mus musculus
cccagcaccacgagtaagcagttct

SEQ ID NO: 358165 - DNA, 25 bp, Mus musculus
gcaagacctttgtgcgctccgacca

SEQ ID NO: 358166 - DNA, 25 bp, Mus musculus
tgtgtgcgtgtatataccatggccg

SEQ ID NO: 358167 - DNA, 25 bp, Mus musculus
tcaggccgcctgaatgtagcgggca

SEQ ID NO: 358168 - DNA, 25 bp, Mus musculus
ggccaccgccgagggtaacttcgca

SEQ ID NO: 358169 - DNA, 25 bp, Mus musculus
gggtaacttcgcaacctgactcgta

SEQ ID NO: 358170 - DNA, 25 bp, Mus musculus
taagcagttctctgtccagacgccc

SEQ ID NO: 358171 - DNA, 25 bp, Mus musculus
gtgcgatagctgctgcaagaccttt

SEQ ID NO: 358172 - DNA, 25 bp, Mus musculus
tacagccaggtatgtgtggggacca

SEQ ID NO: 358173 - DNA, 25 bp, Mus musculus
tgcgagactcaaaacagccacaccg

SEQ ID NO: 358174 - DNA, 25 bp, Mus musculus
ggcacaggacctcttcgacttcatc

SEQ ID NO: 358175 - DNA, 25 bp, Mus musculus
cgtcatccgcttgctggactggttc

SEQ ID NO: 358176 - DNA, 25 bp, Mus musculus
ggctttgtccgatgaccgccttgtc

SEQ ID NO: 358177 - DNA, 25 bp, Mus musculus
ggatacacatctccgtggtccaaaa

SEQ ID NO: 358178 - DNA, 25 bp, Mus musculus
accgagtggggcagtctcgtaagta

SEQ ID NO: 358179 - DNA, 25 bp, Mus musculus
agccaaggctgacaaggagagcttc

SEQ ID NO: 358180 - DNA, 25 bp, Mus musculus
gggtggctttgggtcatcatcaacc

SEQ ID NO: 358181 - DNA, 25 bp, Mus musculus
tcccagtgaagatcctacagccagg

SEQ ID NO: 358182 - DNA, 25 bp, Mus musculus
cgcctccgcggaaggatacacatct

SEQ ID NO: 358183 - DNA, 25 bp, Mus musculus
atgctgctgtccaagttcggctccc

SEQ ID NO: 358184 - DNA, 25 bp, Mus musculus
acccgattgtttgtcccacagccaa

SEQ ID NO: 358185 - DNA, 25 bp, Mus musculus
gcgtggaccacctcccagtgaagat

SEQ ID NO: 358186 - DNA, 25 bp, Mus musculus
gggcgtctcggtcccgtcttcattc

SEQ ID NO: 358187 - DNA, 25 bp, Mus musculus
ggtcccgtcttcattctcatcctgg

SEQ ID NO: 358188 - DNA, 25 bp, Mus musculus
ggtttccgcagagacgccatgatct

SEQ ID NO: 358189 - DNA, 25 bp, Mus musculus
gcagcagaaggcgccctgcggcatc

SEQ ID NO: 358190 - DNA, 25 bp, Mus musculus
catcaaggcgcagggagaggcttgc

SEQ ID NO: 358191 - DNA, 25 bp, Mus musculus
gcgggcggaagccacagcaaactag

SEQ ID NO: 358192 - DNA, 25 bp, Mus musculus
ccacagcaaactaggcacggcgctt

SEQ ID NO: 358193 - DNA, 25 bp, Mus musculus
taggcacggcgcttggagatcacac

SEQ ID NO: 358194 - DNA, 25 bp, Mus musculus
cggcgcttggagatcacacggaagc

SEQ ID NO: 358195 - DNA, 25 bp, Mus musculus
cttggagatcacacggaagccctgc

SEQ ID NO: 358196 - DNA, 25 bp, Mus musculus
ggagatcacacggaagccctgcgag

SEQ ID NO: 358197 - DNA, 25 bp, Mus musculus
gaaaggggtgctgagacccgcccca

SEQ ID NO: 358198 - DNA, 25 bp, Mus musculus
gtctatgtgtcggtttccgcagaga

SEQ ID NO: 358199 - DNA, 25 bp, Mus musculus
ctggtcctcgtcgtgggctcctcca

SEQ ID NO: 358200 - DNA, 25 bp, Mus musculus
gcaccatgcattgtgcagactcctg

SEQ ID NO: 358201 - DNA, 25 bp, Mus musculus
cgacgtctgggattccaatcggagg

SEQ ID NO: 358202 - DNA, 25 bp, Mus musculus
gcgtcttgcggttgctcagggcaac

SEQ ID NO: 358203 - DNA, 25 bp, Mus musculus
gctttcggcgtgctaagcggcgccc

SEQ ID NO: 358204 - DNA, 25 bp, Mus musculus
tgaaagaggaatccgctggcagcag

SEQ ID NO: 358205 - DNA, 25 bp, Mus musculus
gagcacaggggacacccgagacgca

SEQ ID NO: 358206 - DNA, 25 bp, Mus musculus
cccgagacgcagtccgaacgcagtt

SEQ ID NO: 358207 - DNA, 25 bp, Mus musculus
gaacgcagttgctggcactcacact

SEQ ID NO: 358208 - DNA, 25 bp, Mus musculus
tcacactgagctttggttctagatc

SEQ ID NO: 358209 - DNA, 25 bp, Mus musculus
gttctagatccagtcccatgttacg

SEQ ID NO: 358210 - DNA, 25 bp, Mus musculus
catgttacggtccaaggagcggctt

SEQ ID NO: 358211 - DNA, 25 bp, Mus musculus
agcaggccatgcgtcaggattagtc

SEQ ID NO: 358212 - DNA, 25 bp, Mus musculus
gattagtccttaagtgcctgcgacc

SEQ ID NO: 358213 - DNA, 25 bp, Mus musculus
tgggacccgccctaaagcgcgtgct

SEQ ID NO: 358214 - DNA, 25 bp, Mus musculus
cgctggaagccctcagcaggcctgt

SEQ ID NO: 358215 - DNA, 25 bp, Mus musculus
tggatgccatgctgcgccttgctgc

SEQ ID NO: 358216 - DNA, 25 bp, Mus musculus
aaggtaagggtgcacggagcactcc

SEQ ID NO: 358217 - DNA, 25 bp, Mus musculus
ccaacctctcgtggctaacggtcga

SEQ ID NO: 358218 - DNA, 25 bp, Mus musculus
gctaacggtcgagcctcgtggaata

SEQ ID NO: 358219 - DNA, 25 bp, Mus musculus
agcctcgtggaatatacagggaccc

SEQ ID NO: 358220 - DNA, 25 bp, Mus musculus
cccattggctgagttctatgacagg

SEQ ID NO: 358221 - DNA, 25 bp, Mus musculus
agttctatgacaggcaggcgcaggc

SEQ ID NO: 358222 - DNA, 25 bp, Mus musculus
cccattggctggtttctaccagcgc

SEQ ID NO: 358223 - DNA, 25 bp, Mus musculus
tggtttctaccagcgcatgcgtgct

SEQ ID NO: 358224 - DNA, 25 bp, Mus musculus
accagcgcatgcgtgctggcccatg

SEQ ID NO: 358225 - DNA, 25 bp, Mus musculus
gccaagctggtgtccttcttctgga

SEQ ID NO: 358226 - DNA, 25 bp, Mus musculus
gtgcacggagcactccgctggaagc

SEQ ID NO: 358227 - DNA, 25 bp, Mus musculus
cgccttgctgccaagctggtgtcct

SEQ ID NO: 358228 - DNA, 25 bp, Mus musculus
gtgctggtacccatcctgctggtca

SEQ ID NO: 358229 - DNA, 25 bp, Mus musculus
tgcagctcaagctggaactgccgtt

SEQ ID NO: 358230 - DNA, 25 bp, Mus musculus
tcctgcctggctcgcaggacgacaa

SEQ ID NO: 358231 - DNA, 25 bp, Mus musculus
agaagctgagggagctgatcctgcc

SEQ ID NO: 358232 - DNA, 25 bp, Mus musculus
ttcgaccgcgtggtcaccatcggca

SEQ ID NO: 358233 - DNA, 25 bp, Mus musculus
ggtcaccatcggcaccgtgctggta

SEQ ID NO: 358234 - DNA, 25 bp, Mus musculus
gccaggcagccagcgccagctagac

SEQ ID NO: 358235 - DNA, 25 bp, Mus musculus
tgctggtcaccctggtcttcaccaa

SEQ ID NO: 358236 - DNA, 25 bp, Mus musculus
tggtcttcaccaagaacttcgcagg

SEQ ID NO: 358237 - DNA, 25 bp, Mus musculus
ccaagaacttcgcaggtgaggcagg

SEQ ID NO: 358238 - DNA, 25 bp, Mus musculus
cgcgtccgcaggtgtttagcgccca

SEQ ID NO: 358239 - DNA, 25 bp, Mus musculus
cgcaggtgtttagcgcccagcgctc

SEQ ID NO: 358240 - DNA, 25 bp, Mus musculus
aactgccgttcgaccgcgtggtcac

SEQ ID NO: 358241 - DNA, 25 bp, Mus musculus
agctagaccgcacccacctggccag

SEQ ID NO: 358242 - DNA, 25 bp, Mus musculus
caggctgtggccatccgcgccaagt

SEQ ID NO: 358243 - DNA, 25 bp, Mus musculus
gcgccaagtcctcgtgtcctggtcg

SEQ ID NO: 358244 - DNA, 25 bp, Mus musculus
tcgtgtcctggtcgacgagcacttt

SEQ ID NO: 358245 - DNA, 25 bp, Mus musculus
cgacgagcactttgggtagcaccgc

SEQ ID NO: 358246 - DNA, 25 bp, Mus musculus
aagatgctactcagaagcgcgccca

SEQ ID NO: 358247 - DNA, 25 bp, Mus musculus
cagctctcggctgcttaagatgcta

SEQ ID NO: 358248 - DNA, 25 bp, Mus musculus
gtgctttcatggaagtcaccagctc

SEQ ID NO: 358249 - DNA, 25 bp, Mus musculus
accgcccagagctcaggtctgggtt

SEQ ID NO: 358250 - DNA, 25 bp, Mus musculus
ctcagggtacgttctcccgacttcg

SEQ ID NO: 358251 - DNA, 25 bp, Mus musculus
ctcccgacttcggagagaaagaaag

SEQ ID NO: 358252 - DNA, 25 bp, Mus musculus
tgcaccctaggaaaaggggcttcga

SEQ ID NO: 358253 - DNA, 25 bp, Mus musculus
ttcgactttttgtgcctgtgctttc

SEQ ID NO: 358254 - DNA, 25 bp, Mus musculus
aggctccagctttgcaaggcgccac

SEQ ID NO: 358255 - DNA, 25 bp, Mus musculus
ggcccgaccaggaggctccagcttt

SEQ ID NO: 358256 - DNA, 25 bp, Mus musculus
acatcctggccatgttctgtaacga

SEQ ID NO: 358257 - DNA, 25 bp, Mus musculus
agcctgatggttctgctgagccacc

SEQ ID NO: 358258 - DNA, 25 bp, Mus musculus
tggctgccttggctcagtctaacca

SEQ ID NO: 358259 - DNA, 25 bp, Mus musculus
gagcgacctcatgtacgacaatgtg

SEQ ID NO: 358260 - DNA, 25 bp, Mus musculus
acatcaagtcgctgaaccggctgga

SEQ ID NO: 358261 - DNA, 25 bp, Mus musculus
gtggacatcgtcttgctctgcttca

SEQ ID NO: 358262 - DNA, 25 bp, Mus musculus
cagcggatcattgcaggtgtggaca

SEQ ID NO: 358263 - DNA, 25 bp, Mus musculus
gtggtgcccatctcctacctatgca

SEQ ID NO: 358264 - DNA, 25 bp, Mus musculus
caagctgtacttggcacggcacgtc

SEQ ID NO: 358265 - DNA, 25 bp, Mus musculus
ggtcgcgcacccaagattgagaagc

SEQ ID NO: 358266 - DNA, 25 bp, Mus musculus
tccttcttcaggagatcgacaactg

SEQ ID NO: 358267 - DNA, 25 bp, Mus musculus
ggcctttgccgccatcatgtatgtg

SEQ ID NO: 358268 - DNA, 25 bp, Mus musculus
gcctctggccatcgttgtttgagca

SEQ ID NO: 358269 - DNA, 25 bp, Mus musculus
cggctggacttcatcaccaacgaga

SEQ ID NO: 358270 - DNA, 25 bp, Mus musculus
cttctttagaagtggggacagtctc

SEQ ID NO: 358271 - DNA, 25 bp, Mus musculus
aagaccagggtatccggagctcacc

SEQ ID NO: 358272 - DNA, 25 bp, Mus musculus
cagggtatccggagctcaccgggtc

SEQ ID NO: 358273 - DNA, 25 bp, Mus musculus
agctcaccgggtcgggctgacccag

SEQ ID NO: 358274 - DNA, 25 bp, Mus musculus
tgacccaggacggtgtagatgctcc

SEQ ID NO: 358275 - DNA, 25 bp, Mus musculus
gacggtgtagatgctcctgggctct

SEQ ID NO: 358276 - DNA, 25 bp, Mus musculus
cggaggctcagaagcgccctcgctg

SEQ ID NO: 358277 - DNA, 25 bp, Mus musculus
tgggacgtcaagagcttctttagaa

SEQ ID NO: 358278 - DNA, 25 bp, Mus musculus
ttagaagtggggacagtctccaagc

SEQ ID NO: 358279 - DNA, 25 bp, Mus musculus
tggggacagtctccaagctttcgtg

SEQ ID NO: 358280 - DNA, 25 bp, Mus musculus
gacagtctccaagctttcgtgctcc

SEQ ID NO: 358281 - DNA, 25 bp, Mus musculus
tttcgtgctccccaagcggaggggc

SEQ ID NO: 358282 - DNA, 25 bp, Mus musculus
tggaggtccgctggtcttgtgcgac

SEQ ID NO: 358283 - DNA, 25 bp, Mus musculus
ctttgggacgtcaagagcttcttta

SEQ ID NO: 358284 - DNA, 25 bp, Mus musculus
tgcgctcttcttcagcggcaatgcg

SEQ ID NO: 358285 - DNA, 25 bp, Mus musculus
ctatggagcccacgccgcgttggct

SEQ ID NO: 358286 - DNA, 25 bp, Mus musculus
gaaccaagcttctgggcgtgcctcc

SEQ ID NO: 358287 - DNA, 25 bp, Mus musculus
aggcgaccaatcagaaccaagcttc

SEQ ID NO: 358288 - DNA, 25 bp, Mus musculus
gtggacaaacgagaggcgaccaatc

SEQ ID NO: 358289 - DNA, 25 bp, Mus musculus
acggctcgtagcctggaagtggaca

SEQ ID NO: 358290 - DNA, 25 bp, Mus musculus
aaggtgcccagtggcgctttcgccc

SEQ ID NO: 358291 - DNA, 25 bp, Mus musculus
ggaggcgacacccttctgcgcgcgt

SEQ ID NO: 358292 - DNA, 25 bp, Mus musculus
caggtgcggaactcccggagaactt

SEQ ID NO: 358293 - DNA, 25 bp, Mus musculus
acggtgccgccatgtacctgggcga

SEQ ID NO: 358294 - DNA, 25 bp, Mus musculus
accagttcggtcagttcgctgggca

SEQ ID NO: 358295 - DNA, 25 bp, Mus musculus
cgcactgctactgtggacaccagtt

SEQ ID NO: 358296 - DNA, 25 bp, Mus musculus
tcgaggccgaagctgcgctcttctt

SEQ ID NO: 358297 - DNA, 25 bp, Mus musculus
cagggctgcgctttgacaaccgcgc

SEQ ID NO: 358298 - DNA, 25 bp, Mus musculus
gaaatacgtcatcaggcccgcccta

SEQ ID NO: 358299 - DNA, 25 bp, Mus musculus
gctctcccggaccatgacaagttta

SEQ ID NO: 358300 - DNA, 25 bp, Mus musculus
ccaggagacgcacgggaaatacgtc

SEQ ID NO: 358301 - DNA, 25 bp, Mus musculus
ctaagtgggcgaggcctcagcctca

SEQ ID NO: 358302 - DNA, 25 bp, Mus musculus
ctcagcctcagctttcagagctaga

SEQ ID NO: 358303 - DNA, 25 bp, Mus musculus
atgaccagcctgcaagcccgggacg

SEQ ID NO: 358304 - DNA, 25 bp, Mus musculus
gacaagtttaccgaccgaatgcgta

SEQ ID NO: 358305 - DNA, 25 bp, Mus musculus
tttcgcactgcaagaggccacacgc

SEQ ID NO: 358306 - DNA, 25 bp, Mus musculus
gccgatgtttattgttctggaggta

SEQ ID NO: 358307 - DNA, 25 bp, Mus musculus
gggcccgagtgtgctatttttcacg

SEQ ID NO: 358308 - DNA, 25 bp, Mus musculus
tcacgtgtgaatcgcccaccttgac

SEQ ID NO: 358309 - DNA, 25 bp, Mus musculus
gaacctagcatcttggataatttga

SEQ ID NO: 358310 - DNA, 25 bp, Mus musculus
ctcagtaacggagacagagatgtgt

SEQ ID NO: 358311 - DNA, 25 bp, Mus musculus
atgtgttgtgtttggccgatgttta

SEQ ID NO: 358312 - DNA, 25 bp, Mus musculus
catcttccgaggacgacgagctgtc

SEQ ID NO: 358313 - DNA, 25 bp, Mus musculus
accaggcctttctggaacgggcagc

SEQ ID NO: 358314 - DNA, 25 bp, Mus musculus
gagctgtccagtgtgaggtccacca

SEQ ID NO: 358315 - DNA, 25 bp, Mus musculus
cccatggggaagttaacctgaatga

SEQ ID NO: 358316 - DNA, 25 bp, Mus musculus
tcccggcgagttcatgcggtgacac

SEQ ID NO: 358317 - DNA, 25 bp, Mus musculus
agctccagactggaccgggtattgc

SEQ ID NO: 358318 - DNA, 25 bp, Mus musculus
ccacacaagagcagggcgacagagc

SEQ ID NO: 358319 - DNA, 25 bp, Mus musculus
ggtagctggctagaaaacgacaccc

SEQ ID NO: 358320 - DNA, 25 bp, Mus musculus
cgcgacaccacgttattgcacattg

SEQ ID NO: 358321 - DNA, 25 bp, Mus musculus
ccaccatggcttctcaactaaactg

SEQ ID NO: 358322 - DNA, 25 bp, Mus musculus
aactaaactgctcgcgactgggtca

SEQ ID NO: 358323 - DNA, 25 bp, Mus musculus
ggccgctgtccagtgtccgaaatcc

SEQ ID NO: 358324 - DNA, 25 bp, Mus musculus
ccgggtattgcttcctgacagagtc

SEQ ID NO: 358325 - DNA, 25 bp, Mus musculus
cccaagaggagagtccagaggtaca

SEQ ID NO: 358326 - DNA, 25 bp, Mus musculus
tggagtagaccaaaaggctgagctc

SEQ ID NO: 358327 - DNA, 25 bp, Mus musculus
agcgtgacgccaaacgcctaacttc

SEQ ID NO: 358328 - DNA, 25 bp, Mus musculus
tggaaactgaactaagcgtgacgcc

SEQ ID NO: 358329 - DNA, 25 bp, Mus musculus
tgtcagaagagaaccgctggaaact

SEQ ID NO: 358330 - DNA, 25 bp, Mus musculus
tcaagcccgcccgattgtcagaaga

SEQ ID NO: 358331 - DNA, 25 bp, Mus musculus
tggacctgggcaagaggaaaccacc

SEQ ID NO: 358332 - DNA, 25 bp, Mus musculus
acgaactgggttgtgcacgctggac

SEQ ID NO: 358333 - DNA, 25 bp, Mus musculus
acaatcctcactcgggacgaactgg

SEQ ID NO: 358334 - DNA, 25 bp, Mus musculus
tgcacgtaaacaatcctcactcggg

SEQ ID NO: 358335 - DNA, 25 bp, Mus musculus
ccggtctcacctaactatgcacgta

SEQ ID NO: 358336 - DNA, 25 bp, Mus musculus
caggtaattgcactgcccggtctca

SEQ ID NO: 358337 - DNA, 25 bp, Mus musculus
cctctgccggcaggtaattgcactg

SEQ ID NO: 358338 - DNA, 25 bp, Mus musculus
tttgatccgctctaacgcaacacgc

SEQ ID NO: 358339 - DNA, 25 bp, Mus musculus
cgtggtcactttgatccgctctaac

SEQ ID NO: 358340 - DNA, 25 bp, Mus musculus
tgcccgcctctgagattttcctttg

SEQ ID NO: 358341 - DNA, 25 bp, Mus musculus
cgggctttagactcacgttctcgtg

SEQ ID NO: 358342 - DNA, 25 bp, Mus musculus
ttggtcacctcctggcggtaaaagc

SEQ ID NO: 358343 - DNA, 25 bp, Mus musculus
aggtcttggtacacggcgcgcacct

SEQ ID NO: 358344 - DNA, 25 bp, Mus musculus
ccaacgggctgcaggtcttggtaca

SEQ ID NO: 358345 - DNA, 25 bp, Mus musculus
gacggcttggctagcgaaccggccc

SEQ ID NO: 358346 - DNA, 25 bp, Mus musculus
gaagggccggtacaacttcttgatg

SEQ ID NO: 358347 - DNA, 25 bp, Mus musculus
ggcgcgcttggcaaacagctccgac

SEQ ID NO: 358348 - DNA, 25 bp, Mus musculus
gcgcaactctctgtaggcgcgcttg

SEQ ID NO: 358349 - DNA, 25 bp, Mus musculus
ttctcgtggcgcatgtgtttgagga

SEQ ID NO: 358350 - DNA, 25 bp, Mus musculus
tgcaccataggcaccagagccaacg

SEQ ID NO: 358351 - DNA, 25 bp, Mus musculus
agattttcctttgcgggctcttctc

SEQ ID NO: 358352 - DNA, 25 bp, Mus musculus
tgtgtttgaggaggcgcaactctct

SEQ ID NO: 358353 - DNA, 25 bp, Mus musculus
accttgttgccagtgcggctgtcta

SEQ ID NO: 358354 - DNA, 25 bp, Mus musculus
aggacgctcacacttcgctgaaatc

SEQ ID NO: 358355 - DNA, 25 bp, Mus musculus
gtgagcctctgttgctagctctaaa

SEQ ID NO: 358356 - DNA, 25 bp, Mus musculus
agagcaagcgcctggcctgaatcca

SEQ ID NO: 358357 - DNA, 25 bp, Mus musculus
gggcgagacagcttctttacagcca

SEQ ID NO: 358358 - DNA, 25 bp, Mus musculus
tcctcctcgcgtggatcagcgattg

SEQ ID NO: 358359 - DNA, 25 bp, Mus musculus
aggcgcagctcacggtatgtcctcc

SEQ ID NO: 358360 - DNA, 25 bp, Mus musculus
acgttctcgtgcttcaggtgcttga

SEQ ID NO: 358361 - DNA, 25 bp, Mus musculus
gttcagtcccaacatcaccggtcgg

SEQ ID NO: 358362 - DNA, 25 bp, Mus musculus
aggatgcgtcccttgttcagtccca

SEQ ID NO: 358363 - DNA, 25 bp, Mus musculus
catgggactgtacctccagaggctc

SEQ ID NO: 358364 - DNA, 25 bp, Mus musculus
cttagccttaggcaacgtcccgttg

SEQ ID NO: 358365 - DNA, 25 bp, Mus musculus
ggaaccgaggcaggatcacagctta

SEQ ID NO: 358366 - DNA, 25 bp, Mus musculus
aaatcctcgatggatgtggccggcg

SEQ ID NO: 358367 - DNA, 25 bp, Mus musculus
gccggcgtgaagacgtccaaaagtc

SEQ ID NO: 358368 - DNA, 25 bp, Mus musculus
ccgacatatccacagaagcagctgg

SEQ ID NO: 358369 - DNA, 25 bp, Mus musculus
gcgcggacccgacatatccacagaa

SEQ ID NO: 358370 - DNA, 25 bp, Mus musculus
tggagggtcgcacacgctttcccgc

SEQ ID NO: 358371 - DNA, 25 bp, Mus musculus
ctaccagactgagccgtaggcgccg

SEQ ID NO: 358372 - DNA, 25 bp, Mus musculus
agcccaccgggcgtaggccctgcag

SEQ ID NO: 358373 - DNA, 25 bp, Mus musculus
tgcggcacctcccatactgttttgt

SEQ ID NO: 358374 - DNA, 25 bp, Mus musculus
ggcacctcccatactgttttgttca

SEQ ID NO: 358375 - DNA, 25 bp, Mus musculus
cccatactgttttgttcagctcttg

SEQ ID NO: 358376 - DNA, 25 bp, Mus musculus
ctgttttgttcagctcttgccggta

SEQ ID NO: 358377 - DNA, 25 bp, Mus musculus
tgttcagctcttgccggtagaatcc

SEQ ID NO: 358378 - DNA, 25 bp, Mus musculus
agctcttgccggtagaatcccgcgc

SEQ ID NO: 358379 - DNA, 25 bp, Mus musculus
tgccggtagaatcccgcgcgcggac

SEQ ID NO: 358380 - DNA, 25 bp, Mus musculus
cggacccgacatatccacagaagca

SEQ ID NO: 358381 - DNA, 25 bp, Mus musculus
ccacgtcgcgctggagggtcgcaca

SEQ ID NO: 358382 - DNA, 25 bp, Mus musculus
gtcgttgtagaacacgtactccatg

SEQ ID NO: 358383 - DNA, 25 bp, Mus musculus
tcagcacggtgaggttgtaagcctc

SEQ ID NO: 358384 - DNA, 25 bp, Mus musculus
ggcacagtgaccgtccatccgtatc

SEQ ID NO: 358385 - DNA, 25 bp, Mus musculus
aaagactccggcttcggtcctgagc

SEQ ID NO: 358386 - DNA, 25 bp, Mus musculus
gtggggtctgccacatactcaaaga

SEQ ID NO: 358387 - DNA, 25 bp, Mus musculus
acgccacccgtgaagttctcaaagg

SEQ ID NO: 358388 - DNA, 25 bp, Mus musculus
ttgacctgctttttgacgccacccg

SEQ ID NO: 358389 - DNA, 25 bp, Mus musculus
catggctttgttcagattggttccc

SEQ ID NO: 358390 - DNA, 25 bp, Mus musculus
tgcctcctccagagtcatggctttg

SEQ ID NO: 358391 - DNA, 25 bp, Mus musculus
tcggtcagcgtcttcataatgcaac

SEQ ID NO: 358392 - DNA, 25 bp, Mus musculus
tcacctgtgtggaagctagggctca

SEQ ID NO: 358393 - DNA, 25 bp, Mus musculus
tcgggagccaaacttcacctgtgtg

SEQ ID NO: 358394 - DNA, 25 bp, Mus musculus
gcgtgtcgtactccactcggcctag

SEQ ID NO: 358395 - DNA, 25 bp, Mus musculus
gcacgtcactcgcacgcgtgtcgta

SEQ ID NO: 358396 - DNA, 25 bp, Mus musculus
catcctcgtagaagaggcgcaccga

SEQ ID NO: 358397 - DNA, 25 bp, Mus musculus
aaacagcacgcgctcgccgtcgggg

SEQ ID NO: 358398 - DNA, 25 bp, Mus musculus
cgggtgctcacgatgataccattgt

SEQ ID NO: 358399 - DNA, 25 bp, Mus musculus
gataccattgtcgtgcggcccattg

SEQ ID NO: 358400 - DNA, 25 bp, Mus musculus
accgagatgttgctcatggcgcgca

SEQ ID NO: 358401 - DNA, 25 bp, Mus musculus
attgcctttgcccacaaacagcacg

SEQ ID NO: 358402 - DNA, 25 bp, Mus musculus
tgcccttgaagaggctgccgcactc

SEQ ID NO: 358403 - DNA, 25 bp, Mus musculus
acggtggccactctctcgtcattgc

SEQ ID NO: 358404 - DNA, 25 bp, Mus musculus
tctcgtcattgctggccacgaagga

SEQ ID NO: 358405 - DNA, 25 bp, Mus musculus
ggccacgaaggacttctcgccgctg

SEQ ID NO: 358406 - DNA, 25 bp, Mus musculus
tcgccgctgccatcctcgtagaaga

SEQ ID NO: 358407 - DNA, 25 bp, Mus musculus
aagaggcgcaccgagatgttgctca

SEQ ID NO: 358408 - DNA, 25 bp, Mus musculus
cgcagggcacagatgcccttgaaga

SEQ ID NO: 358409 - DNA, 25 bp, Mus musculus
tgtcgtgcggcccattgcctttgcc

SEQ ID NO: 358410 - DNA, 25 bp, Mus musculus
ccgagcacaagggtaagcgagaccg

SEQ ID NO: 358411 - DNA, 25 bp, Mus musculus
tttgagtttgtcctgcgctcgcatg

SEQ ID NO: 358412 - DNA, 25 bp, Mus musculus
ctagctgacactccgcgccaggtga

SEQ ID NO: 358413 - DNA, 25 bp, Mus musculus
gggaaactttgtgggaatctcctga

SEQ ID NO: 358414 - DNA, 25 bp, Mus musculus
gacagcttctttcccgaggtgagtg

SEQ ID NO: 358415 - DNA, 25 bp, Mus musculus
gcgccggaacaatggacagcttctt

SEQ ID NO: 358416 - DNA, 25 bp, Mus musculus
ttcgcccagaagtgaggaacttgga

SEQ ID NO: 358417 - DNA, 25 bp, Mus musculus
tcccgggagcacttcgcccagaagt

SEQ ID NO: 358418 - DNA, 25 bp, Mus musculus
cgggaagaatgtgccaccagctgtt

SEQ ID NO: 358419 - DNA, 25 bp, Mus musculus
accgttgttggtttgctggtgatcc

SEQ ID NO: 358420 - DNA, 25 bp, Mus musculus
agacgctcagtctccgcaggttgga

SEQ ID NO: 358421 - DNA, 25 bp, Mus musculus
tgggtatatttgagagcagacgctc

SEQ ID NO: 358422 - DNA, 25 bp, Mus musculus
cccgagtctcggatgagtaagccta

SEQ ID NO: 358423 - DNA, 25 bp, Mus musculus
tgctggtgatccgaagtcgtccacc

SEQ ID NO: 358424 - DNA, 25 bp, Mus musculus
ctcagagaaagcgaagctgcccatc

SEQ ID NO: 358425 - DNA, 25 bp, Mus musculus
ccaagcctccgctgttttcaaaaca

SEQ ID NO: 358426 - DNA, 25 bp, Mus musculus
tggcctcattcctcatagacagcac

SEQ ID NO: 358427 - DNA, 25 bp, Mus musculus
gggcgcctgaacagcggaccacact

SEQ ID NO: 358428 - DNA, 25 bp, Mus musculus
ccacggtcctggaacctagggatgc

SEQ ID NO: 358429 - DNA, 25 bp, Mus musculus
ttagctgcgagcgttaaacaaatca

SEQ ID NO: 358430 - DNA, 25 bp, Mus musculus
ctcctccgggatcgcaagacggtta

SEQ ID NO: 358431 - DNA, 25 bp, Mus musculus
tacagtccaggaggctgggtcagtc

SEQ ID NO: 358432 - DNA, 25 bp, Mus musculus
cccacctggcaacctggtcagagta

SEQ ID NO: 358433 - DNA, 25 bp, Mus musculus
cgacgcggtgatcgcatagaagacc

SEQ ID NO: 358434 - DNA, 25 bp, Mus musculus
cgcagccacagagaacggatcgtac

SEQ ID NO: 358435 - DNA, 25 bp, Mus musculus
tcaaaagagacaaaacaggccgcgg

SEQ ID NO: 358436 - DNA, 25 bp, Mus musculus
cgtcctctctcggaaggctacgaaa

SEQ ID NO: 358437 - DNA, 25 bp, Mus musculus
caagacggttacctgggaactgcac

SEQ ID NO: 358438 - DNA, 25 bp, Mus musculus
tgcacaccgctttgcttggagattc

SEQ ID NO: 358439 - DNA, 25 bp, Mus musculus
gggaaccctgcctgccaggacagtc

SEQ ID NO: 358440 - DNA, 25 bp, Mus musculus
agcatcccagcgctgagggcctcgt

SEQ ID NO: 358441 - DNA, 25 bp, Mus musculus
caccattggcaacaggcgggaccac

SEQ ID NO: 358442 - DNA, 25 bp, Mus musculus
ggctcagagccacttatgcacaccg

SEQ ID NO: 358443 - DNA, 25 bp, Mus musculus
tttgcttggagattcgcgcccagta

SEQ ID NO: 358444 - DNA, 25 bp, Mus musculus
aactacaccgggtcgggtgcagctc

SEQ ID NO: 358445 - DNA, 25 bp, Mus musculus
agattcgcgcccagtagcaatccgc

SEQ ID NO: 358446 - DNA, 25 bp, Mus musculus
gcagtctcgtctcctggcaccagtt

SEQ ID NO: 358447 - DNA, 25 bp, Mus musculus
cccgtcatcagaggagttcgctcag

SEQ ID NO: 358448 - DNA, 25 bp, Mus musculus
agttcgctcaggctgggcacaaccc

SEQ ID NO: 358449 - DNA, 25 bp, Mus musculus
cccaggccgaactgaatggcgcacg

SEQ ID NO: 358450 - DNA, 25 bp, Mus musculus
ccagatcgaggcctcaagtgtcttc

SEQ ID NO: 358451 - DNA, 25 bp, Mus musculus
ccaggcccagccgattggaaagaca

SEQ ID NO: 358452 - DNA, 25 bp, Mus musculus
acgaggatcttgtcgcgcctagtcc

SEQ ID NO: 358453 - DNA, 25 bp, Mus musculus
cccgataatggagattgcgtgaccc

SEQ ID NO: 358454 - DNA, 25 bp, Mus musculus
tctagagatggaggcgcttcccgat

SEQ ID NO: 358455 - DNA, 25 bp, Mus musculus
cccagccggttagaagggtctagag

SEQ ID NO: 358456 - DNA, 25 bp, Mus musculus
tcgcctaacgtaccagcgagaaagg

SEQ ID NO: 358457 - DNA, 25 bp, Mus musculus
ccgccctagagtgtcgcctaacgta

SEQ ID NO: 358458 - DNA, 25 bp, Mus musculus
cagccaggcagagaagcgcgcccag

SEQ ID NO: 358459 - DNA, 25 bp, Mus musculus
tcgaaggtgaccacgcacacacact

SEQ ID NO: 358460 - DNA, 25 bp, Mus musculus
tggcccagctccagatcgaaggtga

SEQ ID NO: 358461 - DNA, 25 bp, Mus musculus
gagggtcagccagcccatcagctca

SEQ ID NO: 358462 - DNA, 25 bp, Mus musculus
ctaagacagttctggagggtcagcc

SEQ ID NO: 358463 - DNA, 25 bp, Mus musculus
ccgccgaaggagaggtactaagaca

SEQ ID NO: 358464 - DNA, 25 bp, Mus musculus
ctccatggtagcagctccagcggta

SEQ ID NO: 358465 - DNA, 25 bp, Mus musculus
tgcggagaaacgcaggggttcacct

SEQ ID NO: 358466 - DNA, 25 bp, Mus musculus
attaggccacttcagggaacccagg

SEQ ID NO: 358467 - DNA, 25 bp, Mus musculus
tggtctgcagcttgagacgtgctcg

SEQ ID NO: 358468 - DNA, 25 bp, Mus musculus
gcgtctgctcgtttcgctttcagga

SEQ ID NO: 358469 - DNA, 25 bp, Mus musculus
ctttcaggactggaaatggcagacc

SEQ ID NO: 358470 - DNA, 25 bp, Mus musculus
atggccatgaaccacgggcgcttcc

SEQ ID NO: 358471 - DNA, 25 bp, Mus musculus
ccctcatgggcgagcacatacacta

SEQ ID NO: 358472 - DNA, 25 bp, Mus musculus
ttgaatgcctgaagttcgcggcccg

SEQ ID NO: 358473 - DNA, 25 bp, Mus musculus
ttgctccagcggctgctgcaagacc

SEQ ID NO: 358474 - DNA, 25 bp, Mus musculus
ttatattaacagtggccaaagcccg

SEQ ID NO: 358475 - DNA, 25 bp, Mus musculus
cgcccttcctgagatccttatatta

SEQ ID NO: 358476 - DNA, 25 bp, Mus musculus
atgttccgggatccgtgtgtttgcg

SEQ ID NO: 358477 - DNA, 25 bp, Mus musculus
ggaacggctcggaatttgctccagc

SEQ ID NO: 358478 - DNA, 25 bp, Mus musculus
atcggctgtccctctatgtgctgct

SEQ ID NO: 358479 - DNA, 25 bp, Mus musculus
ccgccttcggtgttccgagcagaaa

SEQ ID NO: 358480 - DNA, 25 bp, Mus musculus
cgccaccgtggccaataactacgga

SEQ ID NO: 358481 - DNA, 25 bp, Mus musculus
gaccgaactgcagcagggtcctcca

SEQ ID NO: 358482 - DNA, 25 bp, Mus musculus
ctcggaacagcgacgcaggtgccca

SEQ ID NO: 358483 - DNA, 25 bp, Mus musculus
accggtcaggattagggcatacttc

SEQ ID NO: 358484 - DNA, 25 bp, Mus musculus
tcttacacaggccatgtcgtccggg

SEQ ID NO: 358485 - DNA, 25 bp, Mus musculus
tacggaggcctcttttcgagagccc

SEQ ID NO: 358486 - DNA, 25 bp, Mus musculus
gggtcttcttagcttcgagtcctca

SEQ ID NO: 358487 - DNA, 25 bp, Mus musculus
ccgaacgccaccagcacgaagtagt

SEQ ID NO: 358488 - DNA, 25 bp, Mus musculus
cgctggccctaagctgcacacttgg

SEQ ID NO: 358489 - DNA, 25 bp, Mus musculus
gacctggcacagtgcgcttccattg

SEQ ID NO: 358490 - DNA, 25 bp, Mus musculus
cttccattgggccactccgcatggg

SEQ ID NO: 358491 - DNA, 25 bp, Mus musculus
tacctcatgctcaaggaccggctca

SEQ ID NO: 358492 - DNA, 25 bp, Mus musculus
ccgcggccgacatttcgacctgaag

SEQ ID NO: 358493 - DNA, 25 bp, Mus musculus
cccaggtgtaggagggatgtttctt

SEQ ID NO: 358494 - DNA, 25 bp, Mus musculus
gttgagccatggttccgggcttcta

SEQ ID NO: 358495 - DNA, 25 bp, Mus musculus
ccctcacctgggatctgggtgtaga

SEQ ID NO: 358496 - DNA, 25 bp, Mus musculus
cgaacaagtagacagcggccacacc

SEQ ID NO: 358497 - DNA, 25 bp, Mus musculus
cggccacaccctgtaggaaaagctg

SEQ ID NO: 358498 - DNA, 25 bp, Mus musculus
tcgccatgtccgctacgcggtcttg

SEQ ID NO: 358499 - DNA, 25 bp, Mus musculus
tgagctccacccagtgccaaagaac

SEQ ID NO: 358500 - DNA, 25 bp, Mus musculus
ggtcttgccgaagtagtgccctcta

SEQ ID NO: 358501 - DNA, 25 bp, Mus musculus
gaatccgtcagtccggtcgggtcac

SEQ ID NO: 358502 - DNA, 25 bp, Mus musculus
gcctgacgtcatacgtgtgcgcgca

SEQ ID NO: 358503 - DNA, 25 bp, Mus musculus
gcagtgccctggctacgtacttccg

SEQ ID NO: 358504 - DNA, 25 bp, Mus musculus
acttcttcgaaactgggcccgcctg

SEQ ID NO: 358505 - DNA, 25 bp, Mus musculus
ccatccgggatctcactaagaactg

SEQ ID NO: 358506 - DNA, 25 bp, Mus musculus
cgggcttctagtcccgttctagaca

SEQ ID NO: 358507 - DNA, 25 bp, Mus musculus
gtgcgctttgctcacctcttgcagc

SEQ ID NO: 358508 - DNA, 25 bp, Mus musculus
cgcctgtccgctaatccaaagaatg

SEQ ID NO: 358509 - DNA, 25 bp, Mus musculus
gcacgtgccaggaccaggaaagatc

SEQ ID NO: 358510 - DNA, 25 bp, Mus musculus
tggattccagacagcgcttacctcg

SEQ ID NO: 358511 - DNA, 25 bp, Mus musculus
cgcttacctcgggacaaacactggc

SEQ ID NO: 358512 - DNA, 25 bp, Mus musculus
aaacactggcccacgtcgaccagta

SEQ ID NO: 358513 - DNA, 25 bp, Mus musculus
gctcggacgcactcaacaatgccta

SEQ ID NO: 358514 - DNA, 25 bp, Mus musculus
tgagaacctactggaggcacgtgcc

SEQ ID NO: 358515 - DNA, 25 bp, Mus musculus
ctggtgccgttgatatccggtctca

SEQ ID NO: 358516 - DNA, 25 bp, Mus musculus
agcagctcctcttgctctcgggcgt

SEQ ID NO: 358517 - DNA, 25 bp, Mus musculus
gggctcccggagcacaatgctttag

SEQ ID NO: 358518 - DNA, 25 bp, Mus musculus
acaatgctttagctaggccggggtc

SEQ ID NO: 358519 - DNA, 25 bp, Mus musculus
cagaggcggttacctaggtcacagc

SEQ ID NO: 358520 - DNA, 25 bp, Mus musculus
gccttggtcttgtgtttccgcctgt

SEQ ID NO: 358521 - DNA, 25 bp, Mus musculus
cctgcgccgaaagcatcagctggaa

SEQ ID NO: 358522 - DNA, 25 bp, Mus musculus
agcaggcaccaggtaactcggcccg

SEQ ID NO: 358523 - DNA, 25 bp, Mus musculus
ttcgggcacagttctccagttcctt

SEQ ID NO: 358524 - DNA, 25 bp, Mus musculus
ccgtgtggcttaggcgaccgtagat

SEQ ID NO: 358525 - DNA, 25 bp, Mus musculus
ccgggcctctgtagagcgccgcgat

SEQ ID NO: 358526 - DNA, 25 bp, Mus musculus
tcgttggcagcttgtattttggccc

SEQ ID NO: 358527 - DNA, 25 bp, Mus musculus
cgagacgggtcgtgcagtttgtaac

SEQ ID NO: 358528 - DNA, 25 bp, Mus musculus
tggcaccagtgtagaccgcccacag

SEQ ID NO: 358529 - DNA, 25 bp, Mus musculus
tccctttttgcttcgggcacagttc

SEQ ID NO: 358530 - DNA, 25 bp, Mus musculus
ggagccaactgtgccgcgcacagtc

SEQ ID NO: 358531 - DNA, 25 bp, Mus musculus
gcgcacagtcatgcgagcaggcacc

SEQ ID NO: 358532 - DNA, 25 bp, Mus musculus
tccgcaggttgcatgccgcaagggt

SEQ ID NO: 358533 - DNA, 25 bp, Mus musculus
gacccagaggctgccagctctgttc

SEQ ID NO: 358534 - DNA, 25 bp, Mus musculus
taatcttctgccctccctttttgct

SEQ ID NO: 358535 - DNA, 25 bp, Mus musculus
cccttgctaccggtgttcgttggca

SEQ ID NO: 358536 - DNA, 25 bp, Mus musculus
tgcctcctaaggacgggactttcca

SEQ ID NO: 358537 - DNA, 25 bp, Mus musculus
gcctcgctcacctctggctgggccc

SEQ ID NO: 358538 - DNA, 25 bp, Mus musculus
cattggcttgcctcctaaggacggg

SEQ ID NO: 358539 - DNA, 25 bp, Mus musculus
gccctcattggcttgcctcctaagg

SEQ ID NO: 358540 - DNA, 25 bp, Mus musculus
ggagggactcctggcaacgacgccc

SEQ ID NO: 358541 - DNA, 25 bp, Mus musculus
cgcgctcgcgctcgggtccgctcca

SEQ ID NO: 358542 - DNA, 25 bp, Mus musculus
taggcatgccgagacagtcggaccc

SEQ ID NO: 358543 - DNA, 25 bp, Mus musculus
aaggtctaggcatgccgagacagtc

SEQ ID NO: 358544 - DNA, 25 bp, Mus musculus
ccctaaggtctaggcatgccgagac

SEQ ID NO: 358545 - DNA, 25 bp, Mus musculus
agtaccgctgggacctcgcctcaga

SEQ ID NO: 358546 - DNA, 25 bp, Mus musculus
cggtgagtaccgctgggacctcgcc

SEQ ID NO: 358547 - DNA, 25 bp, Mus musculus
tggggctggcctctcgccctcattg

SEQ ID NO: 358548 - DNA, 25 bp, Mus musculus
tgaaggtcttcctgtggggcggtga

SEQ ID NO: 358549 - DNA, 25 bp, Mus musculus
aaggagggactcctggcaacgacgc

SEQ ID NO: 358550 - DNA, 25 bp, Mus musculus
gggaccgtttccaagccagatgcga

SEQ ID NO: 358551 - DNA, 25 bp, Mus musculus
ccagatgcgattctcagggctgcgg

SEQ ID NO: 358552 - DNA, 25 bp, Mus musculus
cgatccgcctatcagtctctgcaaa

SEQ ID NO: 358553 - DNA, 25 bp, Mus musculus
caagttactgcgtggactgtgtccg

SEQ ID NO: 358554 - DNA, 25 bp, Mus musculus
ctgtgtccggaaccaaggaagtgac

SEQ ID NO: 358555 - DNA, 25 bp, Mus musculus
aggaagtgacgtaggccaatcccga

SEQ ID NO: 358556 - DNA, 25 bp, Mus musculus
ttggacagtagctccgcaaagctta

SEQ ID NO: 358557 - DNA, 25 bp, Mus musculus
ttggctctgggcacttagcatcctg

SEQ ID NO: 358558 - DNA, 25 bp, Mus musculus
gccttcggctttcttggtggctcca

SEQ ID NO: 358559 - DNA, 25 bp, Mus musculus
taggtttaacgcctgccggtgctca

SEQ ID NO: 358560 - DNA, 25 bp, Mus musculus
ttagcatcctgcaaaccgtccttgg

SEQ ID NO: 358561 - DNA, 25 bp, Mus musculus
aggtactcccggcaccactgatagg

SEQ ID NO: 358562 - DNA, 25 bp, Mus musculus
tgacctcacgggacaaacgctcagc

SEQ ID NO: 358563 - DNA, 25 bp, Mus musculus
gcgtagcactgacggcgaccgaact

SEQ ID NO: 358564 - DNA, 25 bp, Mus musculus
tattccacgctaggaccacgcaagc

SEQ ID NO: 358565 - DNA, 25 bp, Mus musculus
cgggtctcatcttcacgtaggtctc

SEQ ID NO: 358566 - DNA, 25 bp, Mus musculus
tctcatcttcacgtaggtctcttcg

SEQ ID NO: 358567 - DNA, 25 bp, Mus musculus
caggtacgcattcggcgggtctcat

SEQ ID NO: 358568 - DNA, 25 bp, Mus musculus
ctcccggctgcaggtacgcattcgg

SEQ ID NO: 358569 - DNA, 25 bp, Mus musculus
cgcggagatgttttctctctccacc

SEQ ID NO: 358570 - DNA, 25 bp, Mus musculus
cggatcgcgcggagatgttttctct

SEQ ID NO: 358571 - DNA, 25 bp, Mus musculus
ggctcctgcagaaacctttggtcta

SEQ ID NO: 358572 - DNA, 25 bp, Mus musculus
ggtcctggctcctgggtctaccgca

SEQ ID NO: 358573 - DNA, 25 bp, Mus musculus
ccgctgtaaccagaggcgcgcattc

SEQ ID NO: 358574 - DNA, 25 bp, Mus musculus
ccaggagcactgcacaccgctgtaa

SEQ ID NO: 358575 - DNA, 25 bp, Mus musculus
tgaacgctgttcctaagtcctcgcc

SEQ ID NO: 358576 - DNA, 25 bp, Mus musculus
gccggggcatgaacgctgttcctaa

SEQ ID NO: 358577 - DNA, 25 bp, Mus musculus
gaaacctttggtctaccagcgtgtc

SEQ ID NO: 358578 - DNA, 25 bp, Mus musculus
caagccaggtctaactgccctagta

SEQ ID NO: 358579 - DNA, 25 bp, Mus musculus
cgcgccaccatggaggagtacagca

SEQ ID NO: 358580 - DNA, 25 bp, Mus musculus
atcgctggcctgtacgagcgcgcca

SEQ ID NO: 358581 - DNA, 25 bp, Mus musculus
atcggctccatcatcgcgtcagtga

SEQ ID NO: 358582 - DNA, 25 bp, Mus musculus
ctgcgcagtgccgaggttatatacc

SEQ ID NO: 358583 - DNA, 25 bp, Mus musculus
gccctagtaacgctgcccgatcttt

SEQ ID NO: 358584 - DNA, 25 bp, Mus musculus
ttcgccattgccaacgaatgctatc

SEQ ID NO: 358585 - DNA, 25 bp, Mus musculus
cgaatgctatcgctgcttgtggaag

SEQ ID NO: 358586 - DNA, 25 bp, Mus musculus
atgtgcaggtccaagccaggtctaa

SEQ ID NO: 358587 - DNA, 25 bp, Mus musculus
gatcatttcgctggatcgctcccgc

SEQ ID NO: 358588 - DNA, 25 bp, Mus musculus
aaccggctccgtgcatctgcgcagt

SEQ ID NO: 358589 - DNA, 25 bp, Mus musculus
gccgaggcctcgtgaaacgatcatt

SEQ ID NO: 358590 - DNA, 25 bp, Mus musculus
tatacctcagggtgtacggacagcg

SEQ ID NO: 358591 - DNA, 25 bp, Mus musculus
tctgcttgcagacctacatcggctc

SEQ ID NO: 358592 - DNA, 25 bp, Mus musculus
agcctgggccctgccttttccttag

SEQ ID NO: 358593 - DNA, 25 bp, Mus musculus
gccgcatgatctctgagggctcctc

SEQ ID NO: 358594 - DNA, 25 bp, Mus musculus
ggcgaagcagtcaggagctctcatc

SEQ ID NO: 358595 - DNA, 25 bp, Mus musculus
tggacatggacactctttgcgggcc

SEQ ID NO: 358596 - DNA, 25 bp, Mus musculus
tgccctggccagtgcttatctcctg

SEQ ID NO: 358597 - DNA, 25 bp, Mus musculus
acctgagcgaggatgctgactctcc

SEQ ID NO: 358598 - DNA, 25 bp, Mus musculus
ctgagtctgagcctgacctgagcga

SEQ ID NO: 358599 - DNA, 25 bp, Mus musculus
acagcgaatacgagtcgggctctga

SEQ ID NO: 358600 - DNA, 25 bp, Mus musculus
gccaggatgacaccaacagcgaata

SEQ ID NO: 358601 - DNA, 25 bp, Mus musculus
ggagcccgagccactacatgaacct

SEQ ID NO: 358602 - DNA, 25 bp, Mus musculus
agcagtggccgctcatcacatctca

SEQ ID NO: 358603 - DNA, 25 bp, Mus musculus
tagggcgcatgatctcgtccatttc

SEQ ID NO: 358604 - DNA, 25 bp, Mus musculus
accaggctcggactctgaggatgca

SEQ ID NO: 358605 - DNA, 25 bp, Mus musculus
gcctgccagaagaggctgcgtcaca

SEQ ID NO: 358606 - DNA, 25 bp, Mus musculus
gatgcagctaaaccgtgccgccgtc

SEQ ID NO: 358607 - DNA, 25 bp, Mus musculus
gggagctcccgtggactgcagctcc

SEQ ID NO: 358608 - DNA, 25 bp, Mus musculus
gcctggggtttgcagccctccgact

SEQ ID NO: 358609 - DNA, 25 bp, Mus musculus
tctccctctcagtcggcctgtgggt

SEQ ID NO: 358610 - DNA, 25 bp, Mus musculus
cagtcggcctgtgggtcctcttgcc

SEQ ID NO: 358611 - DNA, 25 bp, Mus musculus
cccagtacggtggtctgcgacgctc

SEQ ID NO: 358612 - DNA, 25 bp, Mus musculus
aagccggggccgatgcagctaaacc

SEQ ID NO: 358613 - DNA, 25 bp, Mus musculus
gcgctcctctctccgccgggaacag

SEQ ID NO: 358614 - DNA, 25 bp, Mus musculus
gtcggcatcccggacctgcaacaaa

SEQ ID NO: 358615 - DNA, 25 bp, Mus musculus
acctgcaacaaacggtgagcctttg

SEQ ID NO: 358616 - DNA, 25 bp, Mus musculus
aaacggtgagcctttgcgatctcgc

SEQ ID NO: 358617 - DNA, 25 bp, Mus musculus
tgagcctttgcgatctcgccgtacc

SEQ ID NO: 358618 - DNA, 25 bp, Mus musculus
ctgtgtggcccgctagcggtgaccc

SEQ ID NO: 358619 - DNA, 25 bp, Mus musculus
acggtggtctgcgacgctcgcctgc

SEQ ID NO: 358620 - DNA, 25 bp, Mus musculus
gcgaggagcggtccgtactccgcca

SEQ ID NO: 358621 - DNA, 25 bp, Mus musculus
tttttcaaggcgctggccgctacca

SEQ ID NO: 358622 - DNA, 25 bp, Mus musculus
cccacggttatttttcaaggcgctg

SEQ ID NO: 358623 - DNA, 25 bp, Mus musculus
acaacggacaattgccaaatcccgc

SEQ ID NO: 358624 - DNA, 25 bp, Mus musculus
tctgaccaatcacaacggacaattg

SEQ ID NO: 358625 - DNA, 25 bp, Mus musculus
cgcccgaggatctgaccaatcacaa

SEQ ID NO: 358626 - DNA, 25 bp, Mus musculus
ggaggatgcatcacgcgcacgcgcc

SEQ ID NO: 358627 - DNA, 25 bp, Mus musculus
aaaagcgagtgctggctccttcctc

SEQ ID NO: 358628 - DNA, 25 bp, Mus musculus
cgcgagagccagtaaaagcgagtgc

SEQ ID NO: 358629 - DNA, 25 bp, Mus musculus
agcctgcgcgagagccagtaaaagc

SEQ ID NO: 358630 - DNA, 25 bp, Mus musculus
ccctcgactaaagggcggagcctgc

SEQ ID NO: 358631 - DNA, 25 bp, Mus musculus
gagccactctcgctcactcactttg

SEQ ID NO: 358632 - DNA, 25 bp, Mus musculus
agctccctgcgaggagcggtccgta

SEQ ID NO: 358633 - DNA, 25 bp, Mus musculus
cacgtgagggccctcgactaaaggg

SEQ ID NO: 358634 - DNA, 25 bp, Mus musculus
ttcatcgctgtgaaggcgcacagcc

SEQ ID NO: 358635 - DNA, 25 bp, Mus musculus
atcgcgtccgtcacctacgtgttcg

SEQ ID NO: 358636 - DNA, 25 bp, Mus musculus
cgtccgtcacctacgtgttcgtcta

SEQ ID NO: 358637 - DNA, 25 bp, Mus musculus
catcgctgtgaaggcgcacagcccg

SEQ ID NO: 358638 - DNA, 25 bp, Mus musculus
ctgcaccgcggcgaggccgtgaagg

SEQ ID NO: 358639 - DNA, 25 bp, Mus musculus
aagttcatcgctgtgaaggcgcaca

SEQ ID NO: 358640 - DNA, 25 bp, Mus musculus
gcaagttcatcgctgtgaaggcgca

SEQ ID NO: 358641 - DNA, 25 bp, Mus musculus
gaagcggaaactttacagtgccgtc

SEQ ID NO: 358642 - DNA, 25 bp, Mus musculus
gcccgaagcggaaactttacagtgc

SEQ ID NO: 358643 - DNA, 25 bp, Mus musculus
gcatcgcgtccgtcacctacgtgtt

SEQ ID NO: 358644 - DNA, 25 bp, Mus musculus
tgttcgtctacagccccagtgggcc

SEQ ID NO: 358645 - DNA, 25 bp, Mus musculus
gtcacctacgtgttcgtctacagcc

SEQ ID NO: 358646 - DNA, 25 bp, Mus musculus
tccgtcacctacgtgttcgtctaca

SEQ ID NO: 358647 - DNA, 25 bp, Mus musculus
cgagggcgagatcccgctgcaccgc

SEQ ID NO: 358648 - DNA, 25 bp, Mus musculus
actgcaggactctgcgccagaagtg

SEQ ID NO: 358649 - DNA, 25 bp, Mus musculus
ttcccacgcagcacgtcaatgcagg

SEQ ID NO: 358650 - DNA, 25 bp, Mus musculus
gcgtgaaggtcgaggcattccaccc

SEQ ID NO: 358651 - DNA, 25 bp, Mus musculus
agagcccgctggtgaagcagcttca

SEQ ID NO: 358652 - DNA, 25 bp, Mus musculus
cggaagctttgcacgagaaccctct

SEQ ID NO: 358653 - DNA, 25 bp, Mus musculus
ggccaggcagccttgactacagctc

SEQ ID NO: 358654 - DNA, 25 bp, Mus musculus
tacagctctggagaaggcctaggcc

SEQ ID NO: 358655 - DNA, 25 bp, Mus musculus
taccctgagcgtcagaagcgtgcgc

SEQ ID NO: 358656 - DNA, 25 bp, Mus musculus
cgtgcgcgctccatgatcatactgc

SEQ ID NO: 358657 - DNA, 25 bp, Mus musculus
tgttcctctctgtgggtgccatcga

SEQ ID NO: 358658 - DNA, 25 bp, Mus musculus
tgtatgatccgagcacgcctctggg

SEQ ID NO: 358659 - DNA, 25 bp, Mus musculus
ctgatagtccctatgccaacctggg

SEQ ID NO: 358660 - DNA, 25 bp, Mus musculus
ctccattgatgagcgcctcctgggg

SEQ ID NO: 358661 - DNA, 25 bp, Mus musculus
gacactgtgcgctccagcttcaaac

SEQ ID NO: 358662 - DNA, 25 bp, Mus musculus
cccgcgtcggccatttcaacagaag

SEQ ID NO: 358663 - DNA, 25 bp, Mus musculus
ctcaggcagctggatggcagctgac

SEQ ID NO: 358664 - DNA, 25 bp, Mus musculus
cgcatgaacatcgagcgtgcgctca

SEQ ID NO: 358665 - DNA, 25 bp, Mus musculus
gagcccagtgaaacccgcatcgctg

SEQ ID NO: 358666 - DNA, 25 bp, Mus musculus
acccaaggaagtgcgcttcgtggtg

SEQ ID NO: 358667 - DNA, 25 bp, Mus musculus
ccctgcagctctggagcaagttcga

SEQ ID NO: 358668 - DNA, 25 bp, Mus musculus
cgactggctggagagcatccactta

SEQ ID NO: 358669 - DNA, 25 bp, Mus musculus
agcatccacttaggcgagcaccgag

SEQ ID NO: 358670 - DNA, 25 bp, Mus musculus
accgagaccgcttcgaggaccatga

SEQ ID NO: 358671 - DNA, 25 bp, Mus musculus
ccatgagatcgaaggcgcacacctg

SEQ ID NO: 358672 - DNA, 25 bp, Mus musculus
tgcgctcaccaaggaagacttcgtg

SEQ ID NO: 358673 - DNA, 25 bp, Mus musculus
aagacttcgtggagctgggcgtcac

SEQ ID NO: 358674 - DNA, 25 bp, Mus musculus
cacgcgttggccaccgcatgaacat

SEQ ID NO: 358675 - DNA, 25 bp, Mus musculus
catcccgcacgaacccaaggaagtg

SEQ ID NO: 358676 - DNA, 25 bp, Mus musculus
ccgactatcgactcacaatggaagc

SEQ ID NO: 358677 - DNA, 25 bp, Mus musculus
ctgtccggcaatggcccgaaggacc

SEQ ID NO: 358678 - DNA, 25 bp, Mus musculus
ggtccactcgtttcatattcaaatc

SEQ ID NO: 358679 - DNA, 25 bp, Mus musculus
atccgattcgacaaacactgcttcg

SEQ ID NO: 358680 - DNA, 25 bp, Mus musculus
agattcttcgccagctggacgcacg

SEQ ID NO: 358681 - DNA, 25 bp, Mus musculus
tggacgcacggcattcacactacag

SEQ ID NO: 358682 - DNA, 25 bp, Mus musculus
actacagcctgactgggagtggtcc

SEQ ID NO: 358683 - DNA, 25 bp, Mus musculus
tgactgtcagtgtcttcgcgattta

SEQ ID NO: 358684 - DNA, 25 bp, Mus musculus
tcgcgatttacgagggctttctttc

SEQ ID NO: 358685 - DNA, 25 bp, Mus musculus
tccttataaaggacccgcgatctgc

SEQ ID NO: 358686 - DNA, 25 bp, Mus musculus
ggacccggaacaccgcagatgcgct

SEQ ID NO: 358687 - DNA, 25 bp, Mus musculus
tacagatgactgcagtcccgcagca

SEQ ID NO: 358688 - DNA, 25 bp, Mus musculus
gccgccttacccgtttacagatgac

SEQ ID NO: 358689 - DNA, 25 bp, Mus musculus
caatggaagccctcagtgactgtca

SEQ ID NO: 358690 - DNA, 25 bp, Mus musculus
acagctcggtgatgatgtgcagcgc

SEQ ID NO: 358691 - DNA, 25 bp, Mus musculus
gccaacggacgctgctgccaggtct

SEQ ID NO: 358692 - DNA, 25 bp, Mus musculus
agccctaagagttgcgagttggccc

SEQ ID NO: 358693 - DNA, 25 bp, Mus musculus
cccttggtctgaggcagagccctaa

SEQ ID NO: 358694 - DNA, 25 bp, Mus musculus
gcagctccgttgatctcccttggtc

SEQ ID NO: 358695 - DNA, 25 bp, Mus musculus
actcatcttggcttctgctcgcagc

SEQ ID NO: 358696 - DNA, 25 bp, Mus musculus
gtcctccttgcggaaactcatcttg

SEQ ID NO: 358697 - DNA, 25 bp, Mus musculus
tgcgcttctcctcggagcgctcgga

SEQ ID NO: 358698 - DNA, 25 bp, Mus musculus
tgatgatgtgcagcgccttctggca

SEQ ID NO: 358699 - DNA, 25 bp, Mus musculus
cggctggaaagatgcccgaacactt

SEQ ID NO: 358700 - DNA, 25 bp, Mus musculus
cctggccgctcctatcggctggaaa

SEQ ID NO: 358701 - DNA, 25 bp, Mus musculus
ccgaggcccggcaagataagctcca

SEQ ID NO: 358702 - DNA, 25 bp, Mus musculus
ataagctccagccaggaagtcagcc

SEQ ID NO: 358703 - DNA, 25 bp, Mus musculus
agcgccttctggcacaggctgctca

SEQ ID NO: 358704 - DNA, 25 bp, Mus musculus
ggcggcagcatcacctacaacagct

SEQ ID NO: 358705 - DNA, 25 bp, Mus musculus
tgattgacagagaaaccgtcccgtc

SEQ ID NO: 358706 - DNA, 25 bp, Mus musculus
ccgtcccgtcgttgcataaatgctc

SEQ ID NO: 358707 - DNA, 25 bp, Mus musculus
taaatgctccactccggaaccggtg

SEQ ID NO: 358708 - DNA, 25 bp, Mus musculus
catccattgcgttgcgtcctgttcc

SEQ ID NO: 358709 - DNA, 25 bp, Mus musculus
gcagctggagggctattacttctcg

SEQ ID NO: 358710 - DNA, 25 bp, Mus musculus
ggctattacttctcggccgccttga

SEQ ID NO: 358711 - DNA, 25 bp, Mus musculus
ccttgagctgcaccttcctggtgtc

SEQ ID NO: 358712 - DNA, 25 bp, Mus musculus
ttcagccgcgctctgcgggagccgt

SEQ ID NO: 358713 - DNA, 25 bp, Mus musculus
ggagccgtacatggacgagatcttc

SEQ ID NO: 358714 - DNA, 25 bp, Mus musculus
cagcggtactgcgagggccgcttct

SEQ ID NO: 358715 - DNA, 25 bp, Mus musculus
tctccctgtcgcaggttggtctctg

SEQ ID NO: 358716 - DNA, 25 bp, Mus musculus
agcctctggccactctgagagctgc

SEQ ID NO: 358717 - DNA, 25 bp, Mus musculus
ctgagagctgcgagcagtgattgac

SEQ ID NO: 358718 - DNA, 25 bp, Mus musculus
aaagagagccgcgtcctcacctgca

SEQ ID NO: 358719 - DNA, 25 bp, Mus musculus
cgcacttgccaaaccgcagggattt

SEQ ID NO: 358720 - DNA, 25 bp, Mus musculus
agatcggcgccttgcaacgcacttg

SEQ ID NO: 358721 - DNA, 25 bp, Mus musculus
ctgcaacttttaggcgagggtctcc

SEQ ID NO: 358722 - DNA, 25 bp, Mus musculus
agaggtttcaatgcgtctgccatcc

SEQ ID NO: 358723 - DNA, 25 bp, Mus musculus
ctgttgggacaatcgcagcgttata

SEQ ID NO: 358724 - DNA, 25 bp, Mus musculus
cagcctttgactcctggtgcagagg

SEQ ID NO: 358725 - DNA, 25 bp, Mus musculus
gcaagggatggccaccagcctttga

SEQ ID NO: 358726 - DNA, 25 bp, Mus musculus
cccacttcgggctactggactgatg

SEQ ID NO: 358727 - DNA, 25 bp, Mus musculus
aaagccgcctcggtctcccaagtgg

SEQ ID NO: 358728 - DNA, 25 bp, Mus musculus
agctgaggaacggagcacttgtccc

SEQ ID NO: 358729 - DNA, 25 bp, Mus musculus
cggctgtccatctcgagctgaggaa

SEQ ID NO: 358730 - DNA, 25 bp, Mus musculus
agcaaatagattcctggcggcgcga

SEQ ID NO: 358731 - DNA, 25 bp, Mus musculus
ggacactgacacctccactcgtgtg

SEQ ID NO: 358732 - DNA, 25 bp, Mus musculus
cacagtaaggcgattaaacacattc

SEQ ID NO: 358733 - DNA, 25 bp, Mus musculus
ggcgattaaacacattcagttcgtt

SEQ ID NO: 358734 - DNA, 25 bp, Mus musculus
cgacatacttatcctgctgaactga

SEQ ID NO: 358735 - DNA, 25 bp, Mus musculus
tccctgaggcacagtaaggcgatta

SEQ ID NO: 358736 - DNA, 25 bp, Mus musculus
aactgacggggttccctgaggcaca

SEQ ID NO: 358737 - DNA, 25 bp, Mus musculus
tatcctgctgaactgacggggttcc

SEQ ID NO: 358738 - DNA, 25 bp, Mus musculus
agggctctcttccacgacatactta

SEQ ID NO: 358739 - DNA, 25 bp, Mus musculus
gcggaaggttcgcacagactgttct

SEQ ID NO: 358740 - DNA, 25 bp, Mus musculus
ttcgcacagactgttctgggcagtg

SEQ ID NO: 358741 - DNA, 25 bp, Mus musculus
cattcagttcgttacggggccggct

SEQ ID NO: 358742 - DNA, 25 bp, Mus musculus
gtgagagactagtctcggaagcgcc

SEQ ID NO: 358743 - DNA, 25 bp, Mus musculus
gactagtctcggaagcgcccgaatc

SEQ ID NO: 358744 - DNA, 25 bp, Mus musculus
cggaagcgcccgaatctgagctacg

SEQ ID NO: 358745 - DNA, 25 bp, Mus musculus
agaggccagggctctcttccacgac

SEQ ID NO: 358746 - DNA, 25 bp, Mus musculus
tgcgcctttcgcactccgcatcctc

SEQ ID NO: 358747 - DNA, 25 bp, Mus musculus
cgaacggcgagcgactgcgcctttc

SEQ ID NO: 358748 - DNA, 25 bp, Mus musculus
cttggtgtcggcaccttcgggaaag

SEQ ID NO: 358749 - DNA, 25 bp, Mus musculus
gacacgcttggtgtcggcaccttcg

SEQ ID NO: 358750 - DNA, 25 bp, Mus musculus
ccactacatcctgggggacacgctt

SEQ ID NO: 358751 - DNA, 25 bp, Mus musculus
ggcgacggccgagaagcagaagcac

SEQ ID NO: 358752 - DNA, 25 bp, Mus musculus
ccttccgggtgtctgggctccgtat

SEQ ID NO: 358753 - DNA, 25 bp, Mus musculus
agactcagttcctggagaaagatgg

SEQ ID NO: 358754 - DNA, 25 bp, Mus musculus
taagcaagcatcgtcctcctgggaa

SEQ ID NO: 358755 - DNA, 25 bp, Mus musculus
gcggcgccatgcgcagactcagttc

SEQ ID NO: 358756 - DNA, 25 bp, Mus musculus
acccacagaccctcgggtggccgcg

SEQ ID NO: 358757 - DNA, 25 bp, Mus musculus
tggggtgctgtaccgcacccacaga

SEQ ID NO: 358758 - DNA, 25 bp, Mus musculus
cccgggcaacgtgtaagcaagcatc

SEQ ID NO: 358759 - DNA, 25 bp, Mus musculus
ttcctggagaaagatggcgacggcc

SEQ ID NO: 358760 - DNA, 25 bp, Mus musculus
tccgaccagcgaacgagtggcatcc

SEQ ID NO: 358761 - DNA, 25 bp, Mus musculus
ttcagctcagaaggggcgcagtcct

SEQ ID NO: 358762 - DNA, 25 bp, Mus musculus
ttccggagcgtaccggttcagctca

SEQ ID NO: 358763 - DNA, 25 bp, Mus musculus
gcagcgtgactttctccaactccta

SEQ ID NO: 358764 - DNA, 25 bp, Mus musculus
cccaggagttcttggagtcgctcaa

SEQ ID NO: 358765 - DNA, 25 bp, Mus musculus
tgccagcggagagaagccaaacttc

SEQ ID NO: 358766 - DNA, 25 bp, Mus musculus
acgactcatccgaggaggaccctta

SEQ ID NO: 358767 - DNA, 25 bp, Mus musculus
ccttacatgaactacacggtggtgc

SEQ ID NO: 358768 - DNA, 25 bp, Mus musculus
agtacggtgcttcttgctgcgtcca

SEQ ID NO: 358769 - DNA, 25 bp, Mus musculus
gctagcctgcacaactcctcgagtg

SEQ ID NO: 358770 - DNA, 25 bp, Mus musculus
gggagtccacctactgcatgccgca

SEQ ID NO: 358771 - DNA, 25 bp, Mus musculus
ccgacggcgactatgactatgacca

SEQ ID NO: 358772 - DNA, 25 bp, Mus musculus
gacgattacgaggatggcgccatca

SEQ ID NO: 358773 - DNA, 25 bp, Mus musculus
caacatcgagcgctccctgtcggta

SEQ ID NO: 358774 - DNA, 25 bp, Mus musculus
gtgttaagtcccaaagaccgcgctc

SEQ ID NO: 358775 - DNA, 25 bp, Mus musculus
cttgggagtgtcaactgccgaggtc

SEQ ID NO: 358776 - DNA, 25 bp, Mus musculus
tccctgagggccttgggagtgtcaa

SEQ ID NO: 358777 - DNA, 25 bp, Mus musculus
ggcgccatatctgcgcgtccctgag

SEQ ID NO: 358778 - DNA, 25 bp, Mus musculus
gaccgagacgaatctctggggcagc

SEQ ID NO: 358779 - DNA, 25 bp, Mus musculus
cccacggcagttcaagtgttaagtc

SEQ ID NO: 358780 - DNA, 25 bp, Mus musculus
ctccgctagactcggggaccgagac

SEQ ID NO: 358781 - DNA, 25 bp, Mus musculus
ggtgagtctcctcggctccgctaga

SEQ ID NO: 358782 - DNA, 25 bp, Mus musculus
tgactctgagaatccgtcgccatcc

SEQ ID NO: 358783 - DNA, 25 bp, Mus musculus
tccctgttcacctctgactctgaga

SEQ ID NO: 358784 - DNA, 25 bp, Mus musculus
ggcgttgacgtcagcggtctcttcc

SEQ ID NO: 358785 - DNA, 25 bp, Mus musculus
tgtgcatgcgcagacccgtccacag

SEQ ID NO: 358786 - DNA, 25 bp, Mus musculus
agaccgcgctctgtgcatgcgcaga

SEQ ID NO: 358787 - DNA, 25 bp, Mus musculus
gtgttttcttgaagtccttcaactc

SEQ ID NO: 358788 - DNA, 25 bp, Mus musculus
tcagcgccgtgctccagccatgttg

SEQ ID NO: 358789 - DNA, 25 bp, Mus musculus
ctaaccctccggctggctgacgttg

SEQ ID NO: 358790 - DNA, 25 bp, Mus musculus
gggtgcctatgtcccgcaacacact

SEQ ID NO: 358791 - DNA, 25 bp, Mus musculus
gcttgtcaccgcgacgctttgtctg

SEQ ID NO: 358792 - DNA, 25 bp, Mus musculus
cgacgctttgtctgcggctccgaac

SEQ ID NO: 358793 - DNA, 25 bp, Mus musculus
gtggggacagacacctcgggcccac

SEQ ID NO: 358794 - DNA, 25 bp, Mus musculus
gggcgacgctcacccggaggccaaa

SEQ ID NO: 358795 - DNA, 25 bp, Mus musculus
cacccggaggccaaacgcgaggcgt

SEQ ID NO: 358796 - DNA, 25 bp, Mus musculus
caaacgcgaggcgtccgtgcgtgca

SEQ ID NO: 358797 - DNA, 25 bp, Mus musculus
ccgagaagcagcgatgcgacgcacc

SEQ ID NO: 358798 - DNA, 25 bp, Mus musculus
ctcgtccgcttgctggcttcagctt

SEQ ID NO: 358799 - DNA, 25 bp, Mus musculus
gctctcgtccgcagcgcccaacatg

SEQ ID NO: 358800 - DNA, 25 bp, Mus musculus
tccagccatgttgggcgactgaatg

SEQ ID NO: 358801 - DNA, 25 bp, Mus musculus
tcacctgacagccacgcgcaccgag

SEQ ID NO: 358802 - DNA, 25 bp, Mus musculus
cctctgcgtgaccttcagtgtgcga

SEQ ID NO: 358803 - DNA, 25 bp, Mus musculus
ctggagtgccgccatcattccaggc

SEQ ID NO: 358804 - DNA, 25 bp, Mus musculus
tggtcctggagtgccgccatcattc

SEQ ID NO: 358805 - DNA, 25 bp, Mus musculus
gatccatccggcgtggtcctggagt

SEQ ID NO: 358806 - DNA, 25 bp, Mus musculus
gttgggatccatccggcgtggtcct

SEQ ID NO: 358807 - DNA, 25 bp, Mus musculus
tgtgcgctcgggttgggatccatcc

SEQ ID NO: 358808 - DNA, 25 bp, Mus musculus
gggctctcggtaaggtgtgcgctcg

SEQ ID NO: 358809 - DNA, 25 bp, Mus musculus
agcgtctggagagatgaactgggtc

SEQ ID NO: 358810 - DNA, 25 bp, Mus musculus
tgcgtgaccttcagtgtgcgagctg

SEQ ID NO: 358811 - DNA, 25 bp, Mus musculus
cgtccctctgcgtgaccttcagtgt

SEQ ID NO: 358812 - DNA, 25 bp, Mus musculus
gaaggcactctcactcccgcggtgc

SEQ ID NO: 358813 - DNA, 25 bp, Mus musculus
gttgtaccggaaggcactctcactc

SEQ ID NO: 358814 - DNA, 25 bp, Mus musculus
ggtgttgtaccggaaggcactctca

SEQ ID NO: 358815 - DNA, 25 bp, Mus musculus
tgaccttcagtgtgcgagctgcgag

SEQ ID NO: 358816 - DNA, 25 bp, Mus musculus
cgcagcctctgctaagctggcgcta

SEQ ID NO: 358817 - DNA, 25 bp, Mus musculus
agccgctgctcttctgccacccgag

SEQ ID NO: 358818 - DNA, 25 bp, Mus musculus
ggcgaccgcagattccacgtgggaa

SEQ ID NO: 358819 - DNA, 25 bp, Mus musculus
ctctgctaagctggcgctacggagc

SEQ ID NO: 358820 - DNA, 25 bp, Mus musculus
tcgtgcgtcacttgcccgcttggag

SEQ ID NO: 358821 - DNA, 25 bp, Mus musculus
tctcgtcgcgctggaactgcctgcg

SEQ ID NO: 358822 - DNA, 25 bp, Mus musculus
tgtcgtagccgaacaggaagccgcc

SEQ ID NO: 358823 - DNA, 25 bp, Mus musculus
acaccacgccggtgtcgtagccgaa

SEQ ID NO: 358824 - DNA, 25 bp, Mus musculus
aggcgcatctggcgccgcagcagca

SEQ ID NO: 358825 - DNA, 25 bp, Mus musculus
agcagctcctgccacatcgcgccca

SEQ ID NO: 358826 - DNA, 25 bp, Mus musculus
gagaagggaacgcatcctccacagc

SEQ ID NO: 358827 - DNA, 25 bp, Mus musculus
tcaggctgcgcagcgtgtactccac

SEQ ID NO: 358828 - DNA, 25 bp, Mus musculus
attccacgtgggaatccgggagaag

SEQ ID NO: 358829 - DNA, 25 bp, Mus musculus
gtcctcgctcgccttgcgggacatg

SEQ ID NO: 358830 - DNA, 25 bp, Mus musculus
ttcggccctgccagcggctgtgaca

SEQ ID NO: 358831 - DNA, 25 bp, Mus musculus
ccagctactgtgtggccaggtactg

SEQ ID NO: 358832 - DNA, 25 bp, Mus musculus
cgtgcacgccttgcgggcacgtctt

SEQ ID NO: 358833 - DNA, 25 bp, Mus musculus
tgcgggcacgtcttctgcgccagct

SEQ ID NO: 358834 - DNA, 25 bp, Mus musculus
ctggtccagcaactgcgcgtgcagt

SEQ ID NO: 358835 - DNA, 25 bp, Mus musculus
tggcagtgcacatccagcgctgcgc

SEQ ID NO: 358836 - DNA, 25 bp, Mus musculus
gcggctgtgacagccactgcccagg

SEQ ID NO: 358837 - DNA, 25 bp, Mus musculus
tcggcctctggttgtcgcctgctgt

SEQ ID NO: 358838 - DNA, 25 bp, Mus musculus
tcagcttgttgcagcgcaggtatca

SEQ ID NO: 358839 - DNA, 25 bp, Mus musculus
cgcaggtatcaggagaagttggctc

SEQ ID NO: 358840 - DNA, 25 bp, Mus musculus
ccgctttccagtgccagctactgtg

SEQ ID NO: 358841 - DNA, 25 bp, Mus musculus
ttggctctgtacatggcgcacacgc

SEQ ID NO: 358842 - DNA, 25 bp, Mus musculus
cgcacacgcgcaacttcgtcgggaa

SEQ ID NO: 358843 - DNA, 25 bp, Mus musculus
gcgtgcagtgcaactacagcggaca

SEQ ID NO: 358844 - DNA, 25 bp, Mus musculus
ttcctccaaggacaccgcgagctgg

SEQ ID NO: 358845 - DNA, 25 bp, Mus musculus
atctgtgcttcgtgggatgtcgtaa

SEQ ID NO: 358846 - DNA, 25 bp, Mus musculus
cgtcgggtctaaaacatctgtgctt

SEQ ID NO: 358847 - DNA, 25 bp, Mus musculus
ctcacggacctcagcgtcgggtcta

SEQ ID NO: 358848 - DNA, 25 bp, Mus musculus
gaaaccgtggttaccgcacttgcta

SEQ ID NO: 358849 - DNA, 25 bp, Mus musculus
ggcatcgctgcgttgactaaaaaga

SEQ ID NO: 358850 - DNA, 25 bp, Mus musculus
tggcgctgggcaacttgaattctca

SEQ ID NO: 358851 - DNA, 25 bp, Mus musculus
cgatttttctttgcgcagtttgtgg

SEQ ID NO: 358852 - DNA, 25 bp, Mus musculus
gggctgtaggcccttgccctaaatc

SEQ ID NO: 358853 - DNA, 25 bp, Mus musculus
attgcccggctctgagctgtggaca

SEQ ID NO: 358854 - DNA, 25 bp, Mus musculus
ttcacgccgagccttgagatggatg

SEQ ID NO: 358855 - DNA, 25 bp, Mus musculus
cgtacagcagcgagcagaagccgca

SEQ ID NO: 358856 - DNA, 25 bp, Mus musculus
agccaggaaactaccgcggcctgcg

SEQ ID NO: 358857 - DNA, 25 bp, Mus musculus
cgcccgggcgaactacgaagaatcg

SEQ ID NO: 358858 - DNA, 25 bp, Mus musculus
tgcaggacacaaccggacacgacgc

SEQ ID NO: 358859 - DNA, 25 bp, Mus musculus
catccttccttctggggaagcgacc

SEQ ID NO: 358860 - DNA, 25 bp, Mus musculus
ggcggggactgtcatccttccttct

SEQ ID NO: 358861 - DNA, 25 bp, Mus musculus
gcggccgcgccggagacttcaaacg

SEQ ID NO: 358862 - DNA, 25 bp, Mus musculus
gaaactcctgcctgcgcgcacgtga

SEQ ID NO: 358863 - DNA, 25 bp, Mus musculus
cagcctccagctgtcggggaaactc

SEQ ID NO: 358864 - DNA, 25 bp, Mus musculus
tgccgcttcggcctgcaggacacaa

SEQ ID NO: 358865 - DNA, 25 bp, Mus musculus
atcgcggcccattgtgggcagccgc

SEQ ID NO: 358866 - DNA, 25 bp, Mus musculus
tagccctcatccgaggcgggcttcg

SEQ ID NO: 358867 - DNA, 25 bp, Mus musculus
cgcacatcgcacatcatgcacttga

SEQ ID NO: 358868 - DNA, 25 bp, Mus musculus
atcatgcacttgaaggcctcggcgc

SEQ ID NO: 358869 - DNA, 25 bp, Mus musculus
acttgaaggcctcggcgctgttccg

SEQ ID NO: 358870 - DNA, 25 bp, Mus musculus
gtgcagacactgcagtcccagtagc

SEQ ID NO: 358871 - DNA, 25 bp, Mus musculus
ctgttccggaaggtgcagacactgc

SEQ ID NO: 358872 - DNA, 25 bp, Mus musculus
acgtaggtgagcgagtggctctccg

SEQ ID NO: 358873 - DNA, 25 bp, Mus musculus
aggctcagcagtgggacgtaggtga

SEQ ID NO: 358874 - DNA, 25 bp, Mus musculus
cttcgcgggtttcaccggcggctga

SEQ ID NO: 358875 - DNA, 25 bp, Mus musculus
gacgtctggcttcgcgggtttcacc

SEQ ID NO: 358876 - DNA, 25 bp, Mus musculus
cctttagggcgagcggacgtctggc

SEQ ID NO: 358877 - DNA, 25 bp, Mus musculus
cgcgccggaagtgcctttagggcga

SEQ ID NO: 358878 - DNA, 25 bp, Mus musculus
cggtgcagcgctccttccgactccc

SEQ ID NO: 358879 - DNA, 25 bp, Mus musculus
aaaagcgcgggcgtccgcgaacgca

SEQ ID NO: 358880 - DNA, 25 bp, Mus musculus
agtggctctccgcagaggcgcgagg

SEQ ID NO: 358881 - DNA, 25 bp, Mus musculus
gcggcttcacctccggctgccttcc

SEQ ID NO: 358882 - DNA, 25 bp, Mus musculus
aggcgaagcggagaggatgcgagcc

SEQ ID NO: 358883 - DNA, 25 bp, Mus musculus
ttaccttcggcgcagaggcgaagcg

SEQ ID NO: 358884 - DNA, 25 bp, Mus musculus
gccgtgggagcttaccttcggcgca

SEQ ID NO: 358885 - DNA, 25 bp, Mus musculus
cgtccgcgaacgcagcgcggtgcag

SEQ ID NO: 358886 - DNA, 25 bp, Mus musculus
tgccggatttcgatgtcgtagcttc

SEQ ID NO: 358887 - DNA, 25 bp, Mus musculus
cgtaatcagacgtggcatgggcata

SEQ ID NO: 358888 - DNA, 25 bp, Mus musculus
ctggctatagaggttggcgttctgc

SEQ ID NO: 358889 - DNA, 25 bp, Mus musculus
cgttctgcatgtaggcttggagctc

SEQ ID NO: 358890 - DNA, 25 bp, Mus musculus
cccgggcgcttttattctgtatgaa

SEQ ID NO: 358891 - DNA, 25 bp, Mus musculus
ggtgtacagccgaagtctgtccttg

SEQ ID NO: 358892 - DNA, 25 bp, Mus musculus
tgtccttggcggagtacttcctttc

SEQ ID NO: 358893 - DNA, 25 bp, Mus musculus
tctccgagtccgttcgctcatggga

SEQ ID NO: 358894 - DNA, 25 bp, Mus musculus
tcttcaaagtgatacgcccgtctcc

SEQ ID NO: 358895 - DNA, 25 bp, Mus musculus
ggcgttgtcggaccgagactttctg

SEQ ID NO: 358896 - DNA, 25 bp, Mus musculus
agactttctgcttctccggtggcga

SEQ ID NO: 358897 - DNA, 25 bp, Mus musculus
ccctgggttctgcagggcgtaatca

SEQ ID NO: 358898 - DNA, 25 bp, Mus musculus
gtcgtagcttccgttgtcaatgacg

SEQ ID NO: 358899 - DNA, 25 bp, Mus musculus
cttcctttccgtgaccaggttcagg

SEQ ID NO: 358900 - DNA, 25 bp, Mus musculus
tcacgctcctgcgagagtctctgga

SEQ ID NO: 358901 - DNA, 25 bp, Mus musculus
aggctcacgtcatccagcttccggg

SEQ ID NO: 358902 - DNA, 25 bp, Mus musculus
gtgattcggctttacctcgggctta

SEQ ID NO: 358903 - DNA, 25 bp, Mus musculus
cgggcttattcgtaaccatgttgtc

SEQ ID NO: 358904 - DNA, 25 bp, Mus musculus
ccatgttgtcgggtatccagtgctc

SEQ ID NO: 358905 - DNA, 25 bp, Mus musculus
cctcgctgctctgctgctggaagag

SEQ ID NO: 358906 - DNA, 25 bp, Mus musculus
tttgtcgccgaacttgaggaggagc

SEQ ID NO: 358907 - DNA, 25 bp, Mus musculus
ggaggagctgcgtcatataatcttc

SEQ ID NO: 358908 - DNA, 25 bp, Mus musculus
catgctcagcccattcttcggggtc

SEQ ID NO: 358909 - DNA, 25 bp, Mus musculus
gaggcttcctgctccactctggctt

SEQ ID NO: 358910 - DNA, 25 bp, Mus musculus
ctggctttccagaattcctcgttag

SEQ ID NO: 358911 - DNA, 25 bp, Mus musculus
gttagcgaaacctgctccctgcctg

SEQ ID NO: 358912 - DNA, 25 bp, Mus musculus
aacttgtagttcagggcgggagaca

SEQ ID NO: 358913 - DNA, 25 bp, Mus musculus
agtctctggatctggctgactggaa

SEQ ID NO: 358914 - DNA, 25 bp, Mus musculus
cgctttccaggaactgtcacgctga

SEQ ID NO: 358915 - DNA, 25 bp, Mus musculus
cggccctggaagcttctgtaaactt

SEQ ID NO: 358916 - DNA, 25 bp, Mus musculus
gcagacggccctggaagcttctgta

SEQ ID NO: 358917 - DNA, 25 bp, Mus musculus
cccgtggcacaggactgcggccagc

SEQ ID NO: 358918 - DNA, 25 bp, Mus musculus
gcgcacggcgttcctagaaaagtta

SEQ ID NO: 358919 - DNA, 25 bp, Mus musculus
acgctgaccgtcctctggcaggtgt

SEQ ID NO: 358920 - DNA, 25 bp, Mus musculus
tccaggaactgtcacgctgaccgtc

SEQ ID NO: 358921 - DNA, 25 bp, Mus musculus
ctgcccgacgccctggtggcacagc

SEQ ID NO: 358922 - DNA, 25 bp, Mus musculus
tcgctccgtcgctttccaggaactg

SEQ ID NO: 358923 - DNA, 25 bp, Mus musculus
gcgcacagaccgtttgcgttcgccg

SEQ ID NO: 358924 - DNA, 25 bp, Mus musculus
cccggggcgcacagaccgtttgcgt

SEQ ID NO: 358925 - DNA, 25 bp, Mus musculus
atccagcaagcactgcgcgcctgcg

SEQ ID NO: 358926 - DNA, 25 bp, Mus musculus
aactgtcacgctgaccgtcctctgg

SEQ ID NO: 358927 - DNA, 25 bp, Mus musculus
ccgtgcccgcatccagcaagcactg

SEQ ID NO: 358928 - DNA, 25 bp, Mus musculus
ctcaggatttgtaccggaggttctc

SEQ ID NO: 358929 - DNA, 25 bp, Mus musculus
actcgatggctgaggacggtacgaa

SEQ ID NO: 358930 - DNA, 25 bp, Mus musculus
actagtcaacgtccgcttccgctga

SEQ ID NO: 358931 - DNA, 25 bp, Mus musculus
tgttgggacccaagggacacgcgac

SEQ ID NO: 358932 - DNA, 25 bp, Mus musculus
tgcgtagatgccgtctcaggatttg

SEQ ID NO: 358933 - DNA, 25 bp, Mus musculus
gcgctgtcagcgcatgcgtagatgc

SEQ ID NO: 358934 - DNA, 25 bp, Mus musculus
atgagcgctggttttcgggttttgc

SEQ ID NO: 358935 - DNA, 25 bp, Mus musculus
cgtagtccaatgagcgctggttttc

SEQ ID NO: 358936 - DNA, 25 bp, Mus musculus
tccggttaaagtcgtagtccaatga

SEQ ID NO: 358937 - DNA, 25 bp, Mus musculus
tccgcttccgctgagaggtcagatg

SEQ ID NO: 358938 - DNA, 25 bp, Mus musculus
tccgctgagaggtcagatgctaacc

SEQ ID NO: 358939 - DNA, 25 bp, Mus musculus
ggtcagatgctaaccaatgagcgtg

SEQ ID NO: 358940 - DNA, 25 bp, Mus musculus
gctaaccaatgagcgtgtgcattca

SEQ ID NO: 358941 - DNA, 25 bp, Mus musculus
cgtgtgcattcaatttccggttaaa

SEQ ID NO: 358942 - DNA, 25 bp, Mus musculus
aacaccgctgaagatggcgagcccg

SEQ ID NO: 358943 - DNA, 25 bp, Mus musculus
agctcctgagctggaagaggccgct

SEQ ID NO: 358944 - DNA, 25 bp, Mus musculus
tggcgcgcagacgagctcctgagct

SEQ ID NO: 358945 - DNA, 25 bp, Mus musculus
gccctgacctggctgctcggggaac

SEQ ID NO: 358946 - DNA, 25 bp, Mus musculus
gatgcccggctaccgaggagcagcc

SEQ ID NO: 358947 - DNA, 25 bp, Mus musculus
gagcacgccacacaaggatgcccgg

SEQ ID NO: 358948 - DNA, 25 bp, Mus musculus
gcccgaggagcacgccacacaagga

SEQ ID NO: 358949 - DNA, 25 bp, Mus musculus
acccacggatccgagcccaggatgt

SEQ ID NO: 358950 - DNA, 25 bp, Mus musculus
atccgagcccaggatgtgcagccag

SEQ ID NO: 358951 - DNA, 25 bp, Mus musculus
acacgaacttgaccgcaccctcttt

SEQ ID NO: 358952 - DNA, 25 bp, Mus musculus
ggccaggcctgacgtcacaaggcac

SEQ ID NO: 358953 - DNA, 25 bp, Mus musculus
aggcctgacgtcacaaggcacccag

SEQ ID NO: 358954 - DNA, 25 bp, Mus musculus
cgccagcaaaacaccgctgaagatg

SEQ ID NO: 358955 - DNA, 25 bp, Mus musculus
cgccgcccagctagcacccacggat

SEQ ID NO: 358956 - DNA, 25 bp, Mus musculus
ggggaacctggctgccacgcagcac

SEQ ID NO: 358957 - DNA, 25 bp, Mus musculus
ttcccgggcacgctaggcgcctagt

SEQ ID NO: 358958 - DNA, 25 bp, Mus musculus
cccgccgacgccagtaggtgacagg

SEQ ID NO: 358959 - DNA, 25 bp, Mus musculus
gccagtaggtgacaggcgatcctca

SEQ ID NO: 358960 - DNA, 25 bp, Mus musculus
gtgacaggcgatcctcagccactca

SEQ ID NO: 358961 - DNA, 25 bp, Mus musculus
acctggctgccacgcagcacgaggg

SEQ ID NO: 358962 - DNA, 25 bp, Mus musculus
cccagcagctcttctcgtgcggtcc

SEQ ID NO: 358963 - DNA, 25 bp, Mus musculus
cccgcgccgtgacaacgcggcccga

SEQ ID NO: 358964 - DNA, 25 bp, Mus musculus
ttgagagctgcggtcctccgcgtca

SEQ ID NO: 358965 - DNA, 25 bp, Mus musculus
agtcccggccgctgcagagcacccg

SEQ ID NO: 358966 - DNA, 25 bp, Mus musculus
cgccagcgaaatcccggagcgcgga

SEQ ID NO: 358967 - DNA, 25 bp, Mus musculus
agcgaaatcccggagcgcggacgca

SEQ ID NO: 358968 - DNA, 25 bp, Mus musculus
ctgcgtgcagagcaggggtctccac

SEQ ID NO: 358969 - DNA, 25 bp, Mus musculus
agcctctaggcagccacagcccagc

SEQ ID NO: 358970 - DNA, 25 bp, Mus musculus
aaggccgcatcagcgctcaggttca

SEQ ID NO: 358971 - DNA, 25 bp, Mus musculus
ctgaaatgccggttctggggaaaca

SEQ ID NO: 358972 - DNA, 25 bp, Mus musculus
tccgaactcattgacccgcgtgggg

SEQ ID NO: 358973 - DNA, 25 bp, Mus musculus
ggtcaccacttcgtaggaggccaga

SEQ ID NO: 358974 - DNA, 25 bp, Mus musculus
gagtcttcaccagggcttctgcaac

SEQ ID NO: 358975 - DNA, 25 bp, Mus musculus
tgagccaagcatccctacccaaggt

SEQ ID NO: 358976 - DNA, 25 bp, Mus musculus
ctcaggggcacgacagatatacaca

SEQ ID NO: 358977 - DNA, 25 bp, Mus musculus
gcaccgtgggcatgtactgctttcc

SEQ ID NO: 358978 - DNA, 25 bp, Mus musculus
tcccacgggtcctatatgctctata

SEQ ID NO: 358979 - DNA, 25 bp, Mus musculus
cagcaacccgtgttgtccggatgca

SEQ ID NO: 358980 - DNA, 25 bp, Mus musculus
ccgcatgatcaggagagcgtgtccc

SEQ ID NO: 358981 - DNA, 25 bp, Mus musculus
tggggtctccaaccagtctgcacca

SEQ ID NO: 358982 - DNA, 25 bp, Mus musculus
ggagctacgtttcttccggctgaaa

SEQ ID NO: 358983 - DNA, 25 bp, Mus musculus
agagcaacccggtcagccacttggc

SEQ ID NO: 358984 - DNA, 25 bp, Mus musculus
tgacatcagggtgtgtgagcttaaa

SEQ ID NO: 358985 - DNA, 25 bp, Mus musculus
tgtgcctgtagcatccgggtacgtt

SEQ ID NO: 358986 - DNA, 25 bp, Mus musculus
gggtgtttcacgatgtgcctgtagc

SEQ ID NO: 358987 - DNA, 25 bp, Mus musculus
tagcatccgggtacgttcagcttca

SEQ ID NO: 358988 - DNA, 25 bp, Mus musculus
ttggaaccgcggctacccttgcttc

SEQ ID NO: 358989 - DNA, 25 bp, Mus musculus
gtgagcttaaatgtcgcccttcatc

SEQ ID NO: 358990 - DNA, 25 bp, Mus musculus
tttccctcagacaaacagtagcgta

SEQ ID NO: 358991 - DNA, 25 bp, Mus musculus
tagcgtaacacgaagcgtcaaggtc

SEQ ID NO: 358992 - DNA, 25 bp, Mus musculus
gcgtcaaggtcgaaggacaaggaca

SEQ ID NO: 358993 - DNA, 25 bp, Mus musculus
aggacagcgatgaggctgtatcatc

SEQ ID NO: 358994 - DNA, 25 bp, Mus musculus
ctgtatcatcggagtggggaccttc

SEQ ID NO: 358995 - DNA, 25 bp, Mus musculus
tcaggatggactagtcggtgtgaca

SEQ ID NO: 358996 - DNA, 25 bp, Mus musculus
tggactagtcggtgtgacacgttgc

SEQ ID NO: 358997 - DNA, 25 bp, Mus musculus
agctcaaggcagagcccttggaacc

SEQ ID NO: 358998 - DNA, 25 bp, Mus musculus
acgccgatcgccttgtccaggaagc

SEQ ID NO: 358999 - DNA, 25 bp, Mus musculus
acaggctccggttggtgtagctctt

SEQ ID NO: 359000 - DNA, 25 bp, Mus musculus
ggaaggctgatctcaagccacgatc

SEQ ID NO: 359001 - DNA, 25 bp, Mus musculus
ggtgatcagtcgcttcgctccagaa

SEQ ID NO: 359002 - DNA, 25 bp, Mus musculus
ccagaaccaggaaatgggcgcactc

SEQ ID NO: 359003 - DNA, 25 bp, Mus musculus
gcatcccgatcgcaggcagtctgaa

SEQ ID NO: 359004 - DNA, 25 bp, Mus musculus
tatactctcacccttagctgacctg

SEQ ID NO: 359005 - DNA, 25 bp, Mus musculus
cagggacatttaaagggacaggctc

SEQ ID NO: 359006 - DNA, 25 bp, Mus musculus
cgcctagcctcttacagggacattt

SEQ ID NO: 359007 - DNA, 25 bp, Mus musculus
tccgccgagtgacacagtgcgcatg

SEQ ID NO: 359008 - DNA, 25 bp, Mus musculus
tctacctcgcttccgtgagaaagtg

SEQ ID NO: 359009 - DNA, 25 bp, Mus musculus
atagactctgtgagctctacctcgc

SEQ ID NO: 359010 - DNA, 25 bp, Mus musculus
ggtgacccggcatcctaatagactc

SEQ ID NO: 359011 - DNA, 25 bp, Mus musculus
ccagcagtcttggatccaccggtga

SEQ ID NO: 359012 - DNA, 25 bp, Mus musculus
agcttcggtcttcctgctctcggca

SEQ ID NO: 359013 - DNA, 25 bp, Mus musculus
tctgagagaaaaatccggggagttc

SEQ ID NO: 359014 - DNA, 25 bp, Mus musculus
cagcctacagcggtgggagctgttt

SEQ ID NO: 359015 - DNA, 25 bp, Mus musculus
ggagctgtttggttttcaaacgatc

SEQ ID NO: 359016 - DNA, 25 bp, Mus musculus
caaacgatctgagtgctggagcaat

SEQ ID NO: 359017 - DNA, 25 bp, Mus musculus
ctggagcaatctcctttggcgggtc

SEQ ID NO: 359018 - DNA, 25 bp, Mus musculus
tcccgaggaaaaagtcgctcggctg

SEQ ID NO: 359019 - DNA, 25 bp, Mus musculus
gggacatcctcacatcctcggttct

SEQ ID NO: 359020 - DNA, 25 bp, Mus musculus
acagtcggggccgtcgcacccagag

SEQ ID NO: 359021 - DNA, 25 bp, Mus musculus
cgccgttaccttggatgcctgtctg

SEQ ID NO: 359022 - DNA, 25 bp, Mus musculus
ggcacacccgcgttctgagagaaaa

SEQ ID NO: 359023 - DNA, 25 bp, Mus musculus
cagagcagctccaatgccgtgcgcg

SEQ ID NO: 359024 - DNA, 25 bp, Mus musculus
gatccaggaagtagcggctccgcct

SEQ ID NO: 359025 - DNA, 25 bp, Mus musculus
gggatttctccggaaggaaggcaca

SEQ ID NO: 359026 - DNA, 25 bp, Mus musculus
gccttagaaagttagcggtcccagc

SEQ ID NO: 359027 - DNA, 25 bp, Mus musculus
gggcagcccgaactttcccgctcca

SEQ ID NO: 359028 - DNA, 25 bp, Mus musculus
cgaggtcgccttagaaagttagcgg

SEQ ID NO: 359029 - DNA, 25 bp, Mus musculus
aaagttagcggtcccagctgctggc

SEQ ID NO: 359030 - DNA, 25 bp, Mus musculus
gcgtgggccgcggtatttatagcca

SEQ ID NO: 359031 - DNA, 25 bp, Mus musculus
atgcggttccagcaggccatggccg

SEQ ID NO: 359032 - DNA, 25 bp, Mus musculus
tggcgctctccctaggccgccgcag

SEQ ID NO: 359033 - DNA, 25 bp, Mus musculus
tgtcgccgctcgtcctgcgtccgcc

SEQ ID NO: 359034 - DNA, 25 bp, Mus musculus
tagccaggtgacagcagcgcgccgc

SEQ ID NO: 359035 - DNA, 25 bp, Mus musculus
tccggtccggtctggctccgcagag

SEQ ID NO: 359036 - DNA, 25 bp, Mus musculus
ctgctgatgcggttccagcaggcca

SEQ ID NO: 359037 - DNA, 25 bp, Mus musculus
tttatagccaggtgacagcagcgcg

SEQ ID NO: 359038 - DNA, 25 bp, Mus musculus
ccgctccaccgattccggggcgcag

SEQ ID NO: 359039 - DNA, 25 bp, Mus musculus
ccgcggtatttatagccaggtgaca

SEQ ID NO: 359040 - DNA, 25 bp, Mus musculus
ggtacactccgtgccgtgcttgatc

SEQ ID NO: 359041 - DNA, 25 bp, Mus musculus
gcagcatctctacggcatgggcgca

SEQ ID NO: 359042 - DNA, 25 bp, Mus musculus
ttacgggacacacacgcaagctgcg

SEQ ID NO: 359043 - DNA, 25 bp, Mus musculus
cgtggtgctaacaaagctgaccttc

SEQ ID NO: 359044 - DNA, 25 bp, Mus musculus
tatctcccgtttcccaggcagtcag

SEQ ID NO: 359045 - DNA, 25 bp, Mus musculus
ataggctgttactgcgcatgctggc

SEQ ID NO: 359046 - DNA, 25 bp, Mus musculus
cgttcatctcgtccaggcaggtttt

SEQ ID NO: 359047 - DNA, 25 bp, Mus musculus
cggcctgacaaggatcggtgacaca

SEQ ID NO: 359048 - DNA, 25 bp, Mus musculus
acccgagagccttaccttgcactgg

SEQ ID NO: 359049 - DNA, 25 bp, Mus musculus
cccggtgaagcgaaccacgttcatc

SEQ ID NO: 359050 - DNA, 25 bp, Mus musculus
cttgcactggcagagggtacactcc

SEQ ID NO: 359051 - DNA, 25 bp, Mus musculus
cacctggcaagggtgctcactcctg

SEQ ID NO: 359052 - DNA, 25 bp, Mus musculus
gcatggctcgctacataggctgtta

SEQ ID NO: 359053 - DNA, 25 bp, Mus musculus
tgcttgatccaggaagacccggtga

SEQ ID NO: 359054 - DNA, 25 bp, Mus musculus
caagactcctaggtgaagctggaca

SEQ ID NO: 359055 - DNA, 25 bp, Mus musculus
acttagacactcacgctgcacggca

SEQ ID NO: 359056 - DNA, 25 bp, Mus musculus
agggaagccctcacttagacactca

SEQ ID NO: 359057 - DNA, 25 bp, Mus musculus
gttgcaaagaaaggcacccggccgc

SEQ ID NO: 359058 - DNA, 25 bp, Mus musculus
gcccggcgagagaaaggaccaccca

SEQ ID NO: 359059 - DNA, 25 bp, Mus musculus
agcccgaggatcacgcagaacgttc

SEQ ID NO: 359060 - DNA, 25 bp, Mus musculus
aaatcgggcgcgtgtctccaaagcc

SEQ ID NO: 359061 - DNA, 25 bp, Mus musculus
ggatctcaatgccaggtgccaagtt

SEQ ID NO: 359062 - DNA, 25 bp, Mus musculus
ctccgctcgggatcctaggatctca

SEQ ID NO: 359063 - DNA, 25 bp, Mus musculus
tcagacacctaagaccgagcggggc

SEQ ID NO: 359064 - DNA, 25 bp, Mus musculus
cagtccatcgtctccctctttaaaa

SEQ ID NO: 359065 - DNA, 25 bp, Mus musculus
ggattccatggcgtgcatcgtctca

SEQ ID NO: 359066 - DNA, 25 bp, Mus musculus
gttctcagtaacacccgggattcca

SEQ ID NO: 359067 - DNA, 25 bp, Mus musculus
aggaacccagccaaagcacgcaaga

SEQ ID NO: 359068 - DNA, 25 bp, Mus musculus
tcctctggcagcgtccgggaacggt

SEQ ID NO: 359069 - DNA, 25 bp, Mus musculus
ctgaggggtgagtccttggccctca

SEQ ID NO: 359070 - DNA, 25 bp, Mus musculus
atcccagtaggctccggcctgggcg

SEQ ID NO: 359071 - DNA, 25 bp, Mus musculus
gaggacgccaccacatcccagtagg

SEQ ID NO: 359072 - DNA, 25 bp, Mus musculus
ccgaagagtgctgaggacgccacca

SEQ ID NO: 359073 - DNA, 25 bp, Mus musculus
tcttgcccagactgccaaagccggg

SEQ ID NO: 359074 - DNA, 25 bp, Mus musculus
cgcagcaagttctcgatcaggaaac

SEQ ID NO: 359075 - DNA, 25 bp, Mus musculus
cctgcgcgcagcaagttctcgatca

SEQ ID NO: 359076 - DNA, 25 bp, Mus musculus
cagtggccgcagctgcggacactca

SEQ ID NO: 359077 - DNA, 25 bp, Mus musculus
gcacaccaaagggtccggccgggca

SEQ ID NO: 359078 - DNA, 25 bp, Mus musculus
aaggcccagcgcacaccaaagggtc

SEQ ID NO: 359079 - DNA, 25 bp, Mus musculus
tctggaaggcccagcgcacaccaaa

SEQ ID NO: 359080 - DNA, 25 bp, Mus musculus
agttctcgatcaggaaactcttgcc

SEQ ID NO: 359081 - DNA, 25 bp, Mus musculus
cgtccgggaacggtctgcagatccg

SEQ ID NO: 359082 - DNA, 25 bp, Mus musculus
acagatgtggtgctgatcctggagc

SEQ ID NO: 359083 - DNA, 25 bp, Mus musculus
gtggcgagcttttcgacttcctggc

SEQ ID NO: 359084 - DNA, 25 bp, Mus musculus
ttcctggccgagaaggagtcattga

SEQ ID NO: 359085 - DNA, 25 bp, Mus musculus
acatcatgttgctggacaagcacgc

SEQ ID NO: 359086 - DNA, 25 bp, Mus musculus
tcccgcagcccgagaacatcatgtt

SEQ ID NO: 359087 - DNA, 25 bp, Mus musculus
ggtaaccacgagtcaacacccaatg

SEQ ID NO: 359088 - DNA, 25 bp, Mus musculus
agcgcatcgcacactttgacctgaa

SEQ ID NO: 359089 - DNA, 25 bp, Mus musculus
tcctagacggtgtccactacctgca

SEQ ID NO: 359090 - DNA, 25 bp, Mus musculus
gatcgaacgcgaggtgagcatcctg

SEQ ID NO: 359091 - DNA, 25 bp, Mus musculus
cccgcattaagctcatcgactttgg

SEQ ID NO: 359092 - DNA, 25 bp, Mus musculus
tcattgacggaggatgaggccacgc

SEQ ID NO: 359093 - DNA, 25 bp, Mus musculus
ggccacgcagttcctcaaacaaatc

SEQ ID NO: 359094 - DNA, 25 bp, Mus musculus
cgactttggcatcgcgcacaggatc

SEQ ID NO: 359095 - DNA, 25 bp, Mus musculus
cactgcatgacgtgttcgagaacaa

SEQ ID NO: 359096 - DNA, 25 bp, Mus musculus
ctgagccggattctccgaggccaca

SEQ ID NO: 359097 - DNA, 25 bp, Mus musculus
gtgcgcacgtgtgtcgttttcctcc

SEQ ID NO: 359098 - DNA, 25 bp, Mus musculus
ctaagcgggcaccttgcaacgtctc

SEQ ID NO: 359099 - DNA, 25 bp, Mus musculus
gcaacgtctcgtcattctgcagatt

SEQ ID NO: 359100 - DNA, 25 bp, Mus musculus
ttctgcagattaaagaccctcgtga

SEQ ID NO: 359101 - DNA, 25 bp, Mus musculus
tcgtgagctcatagaagccggcctg

SEQ ID NO: 359102 - DNA, 25 bp, Mus musculus
ccgagtgacggtctccgggagacat

SEQ ID NO: 359103 - DNA, 25 bp, Mus musculus
ccgggagacatgcagatgatgacta

SEQ ID NO: 359104 - DNA, 25 bp, Mus musculus
ctaggaaggtcctgctgaacatgga

SEQ ID NO: 359105 - DNA, 25 bp, Mus musculus
gggttcacgacacacctgagccgga

SEQ ID NO: 359106 - DNA, 25 bp, Mus musculus
acacaaacaaaagggctggagccgc

SEQ ID NO: 359107 - DNA, 25 bp, Mus musculus
tggcgtgttttgttcggcctagttc

SEQ ID NO: 359108 - DNA, 25 bp, Mus musculus
accagcccgcagagacacaaacaaa

SEQ ID NO: 359109 - DNA, 25 bp, Mus musculus
tcgggtctttttcctgcgtccgctc

SEQ ID NO: 359110 - DNA, 25 bp, Mus musculus
acctttgattgacagggcggatcca

SEQ ID NO: 359111 - DNA, 25 bp, Mus musculus
ctgccaagagtttcctgtgcgagtc

SEQ ID NO: 359112 - DNA, 25 bp, Mus musculus
cgcgaagagagcgacatgaaacttc

SEQ ID NO: 359113 - DNA, 25 bp, Mus musculus
gggccttcttaagccagctgccaag

SEQ ID NO: 359114 - DNA, 25 bp, Mus musculus
cgagtcggaagttccctcacttaga

SEQ ID NO: 359115 - DNA, 25 bp, Mus musculus
ggttctctgcgtttgtgggactaga

SEQ ID NO: 359116 - DNA, 25 bp, Mus musculus
gccggtcaggcttagaaggttctcg

SEQ ID NO: 359117 - DNA, 25 bp, Mus musculus
gcgcactacaagacggactggcacc

SEQ ID NO: 359118 - DNA, 25 bp, Mus musculus
tgcggcaagaagttcgccaccttca

SEQ ID NO: 359119 - DNA, 25 bp, Mus musculus
ggagctgctgaacgccaagaacctg

SEQ ID NO: 359120 - DNA, 25 bp, Mus musculus
aagaaagcgcccttcgtgcccacgg

SEQ ID NO: 359121 - DNA, 25 bp, Mus musculus
ccggctccagtggttcgaacagcag

SEQ ID NO: 359122 - DNA, 25 bp, Mus musculus
caggcacacgcccacctttgattga

SEQ ID NO: 359123 - DNA, 25 bp, Mus musculus
tccctcacttagagcccggaagctg

SEQ ID NO: 359124 - DNA, 25 bp, Mus musculus
ggttatttcccaacaggcgcgatta

SEQ ID NO: 359125 - DNA, 25 bp, Mus musculus
ggcgcgattaccgtttgcgtacctc

SEQ ID NO: 359126 - DNA, 25 bp, Mus musculus
gcgtacctccgggttcggtgcacca

SEQ ID NO: 359127 - DNA, 25 bp, Mus musculus
ggaggacgagtgaaaagccttactc

SEQ ID NO: 359128 - DNA, 25 bp, Mus musculus
tctagctccacaaaagtagggcagg

SEQ ID NO: 359129 - DNA, 25 bp, Mus musculus
cgggcgagccgagtctattgttccc

SEQ ID NO: 359130 - DNA, 25 bp, Mus musculus
ttcgatcctacagtttgtcaaagtg

SEQ ID NO: 359131 - DNA, 25 bp, Mus musculus
tgctagcacgatgaagcccggaggc

SEQ ID NO: 359132 - DNA, 25 bp, Mus musculus
agcgagcctgcttctcagtgtggcc

SEQ ID NO: 359133 - DNA, 25 bp, Mus musculus
cccgctttgtgtgcgtgtgaaatgt

SEQ ID NO: 359134 - DNA, 25 bp, Mus musculus
cattgcagatgaaccctaagccggg

SEQ ID NO: 359135 - DNA, 25 bp, Mus musculus
agcagtgttattctcaaagttggga

SEQ ID NO: 359136 - DNA, 25 bp, Mus musculus
gccctctttttcagatactagtgca

SEQ ID NO: 359137 - DNA, 25 bp, Mus musculus
gcagtttccagcctattcgatccta

SEQ ID NO: 359138 - DNA, 25 bp, Mus musculus
agttctgcaccatggactcctccgg

SEQ ID NO: 359139 - DNA, 25 bp, Mus musculus
cccgccgtgtttacctgaggccgag

SEQ ID NO: 359140 - DNA, 25 bp, Mus musculus
gtccgccgctaagttctgcaccatg

SEQ ID NO: 359141 - DNA, 25 bp, Mus musculus
tcgggagcacgcaggcagccacgca

SEQ ID NO: 359142 - DNA, 25 bp, Mus musculus
tcccaactttgctcgcagcgaaaga

SEQ ID NO: 359143 - DNA, 25 bp, Mus musculus
cgcaggcagccacgcagcaggagac

SEQ ID NO: 359144 - DNA, 25 bp, Mus musculus
cggggcttctgggaaacattcttct

SEQ ID NO: 359145 - DNA, 25 bp, Mus musculus
gcttctgggaaacattcttcttgcc

SEQ ID NO: 359146 - DNA, 25 bp, Mus musculus
ggccgacacgttcccactgcgggtg

SEQ ID NO: 359147 - DNA, 25 bp, Mus musculus
cgaactccacgggaaagcgggccag

SEQ ID NO: 359148 - DNA, 25 bp, Mus musculus
gctcggggacgaacgcgaactccac

SEQ ID NO: 359149 - DNA, 25 bp, Mus musculus
tgaagtttggtttcacaagcgggac

SEQ ID NO: 359150 - DNA, 25 bp, Mus musculus
tcacagcctagtgaagtttggtttc

SEQ ID NO: 359151 - DNA, 25 bp, Mus musculus
ggtctccgtcagtccgccgctaagt

SEQ ID NO: 359152 - DNA, 25 bp, Mus musculus
aacgtgcacctgtttaccgcgctgg

SEQ ID NO: 359153 - DNA, 25 bp, Mus musculus
gaggggctccaacctgactcattgg

SEQ ID NO: 359154 - DNA, 25 bp, Mus musculus
ctcccagggctggttgcatcagttt

SEQ ID NO: 359155 - DNA, 25 bp, Mus musculus
ttaccggcgaccttcaggaagagtg

SEQ ID NO: 359156 - DNA, 25 bp, Mus musculus
cccggcagttagatgtccttttttg

SEQ ID NO: 359157 - DNA, 25 bp, Mus musculus
gctctgcccgtgtccacgagacatg

SEQ ID NO: 359158 - DNA, 25 bp, Mus musculus
gcaccggactcctgccttctagaaa

SEQ ID NO: 359159 - DNA, 25 bp, Mus musculus
accagatctggtggcacactccatc

SEQ ID NO: 359160 - DNA, 25 bp, Mus musculus
ttcgcgaaagtgacaccagatctgg

SEQ ID NO: 359161 - DNA, 25 bp, Mus musculus
gcagactgattcactcctcggtgta

SEQ ID NO: 359162 - DNA, 25 bp, Mus musculus
cctatcactggctcttcattcggga

SEQ ID NO: 359163 - DNA, 25 bp, Mus musculus
accggaccaggctctagaggaagta

SEQ ID NO: 359164 - DNA, 25 bp, Mus musculus
cctgcgcaagcagtggccttttgtt

SEQ ID NO: 359165 - DNA, 25 bp, Mus musculus
acatcgcatgcttggttcctaattc

SEQ ID NO: 359166 - DNA, 25 bp, Mus musculus
accggacgattattttcgaggcaca

SEQ ID NO: 359167 - DNA, 25 bp, Mus musculus
gcgggcgttcgcctttgtgtatcaa

SEQ ID NO: 359168 - DNA, 25 bp, Mus musculus
atggcgatcacgatcctccggcgga

SEQ ID NO: 359169 - DNA, 25 bp, Mus musculus
atgtaacagtgacggagtccttttc

SEQ ID NO: 359170 - DNA, 25 bp, Mus musculus
gggctgtctcggtcacacaccagaa

SEQ ID NO: 359171 - DNA, 25 bp, Mus musculus
acccgattgcaagcagccgagcggc

SEQ ID NO: 359172 - DNA, 25 bp, Mus musculus
ttttcgaggcacaagacccgattgc

SEQ ID NO: 359173 - DNA, 25 bp, Mus musculus
gcagcttcccgagcgcgagttatag

SEQ ID NO: 359174 - DNA, 25 bp, Mus musculus
attgattgtcaagccctcgcgcggt

SEQ ID NO: 359175 - DNA, 25 bp, Mus musculus
gtttacagggcgcacgccgagccta

SEQ ID NO: 359176 - DNA, 25 bp, Mus musculus
gcgagaacaaagatgcgcccgccga

SEQ ID NO: 359177 - DNA, 25 bp, Mus musculus
ccgccaggcgagtggaaaagtacca

SEQ ID NO: 359178 - DNA, 25 bp, Mus musculus
ttgtgtatcaacagcacctgggctc

SEQ ID NO: 359179 - DNA, 25 bp, Mus musculus
actgatgcaataccgaggggcgatt

SEQ ID NO: 359180 - DNA, 25 bp, Mus musculus
cacgtgatggcgactcactgggttc

SEQ ID NO: 359181 - DNA, 25 bp, Mus musculus
atgccaggcggccacacatgagttg

SEQ ID NO: 359182 - DNA, 25 bp, Mus musculus
gctgctcgcctctcaggatgccagg

SEQ ID NO: 359183 - DNA, 25 bp, Mus musculus
acatgagttggcctcgcaggcaccc

SEQ ID NO: 359184 - DNA, 25 bp, Mus musculus
gcgcagcctcagtaggtctcctgaa

SEQ ID NO: 359185 - DNA, 25 bp, Mus musculus
aaatttttccactgaggctgcgggc

SEQ ID NO: 359186 - DNA, 25 bp, Mus musculus
gcagctcgtgcgcagaccacttctg

SEQ ID NO: 359187 - DNA, 25 bp, Mus musculus
tgctcgtccagagcccacgtgatgg

SEQ ID NO: 359188 - DNA, 25 bp, Mus musculus
agctcgtgggttgtcttgctaaatc

SEQ ID NO: 359189 - DNA, 25 bp, Mus musculus
actcactgggttccgccttcttttg

SEQ ID NO: 359190 - DNA, 25 bp, Mus musculus
gagccagtgactggggaaacctaga

SEQ ID NO: 359191 - DNA, 25 bp, Mus musculus
ggaaacctagagagtcgtgatcatc

SEQ ID NO: 359192 - DNA, 25 bp, Mus musculus
tcgtgatcatcaggggtaatcctcc

SEQ ID NO: 359193 - DNA, 25 bp, Mus musculus
gcagaccgcttctgctcgtccagag

SEQ ID NO: 359194 - DNA, 25 bp, Mus musculus
tcccgccttcgcttggcgcgaatgt

SEQ ID NO: 359195 - DNA, 25 bp, Mus musculus
tgcttggtgaggttcccgccgtaag

SEQ ID NO: 359196 - DNA, 25 bp, Mus musculus
tgtgcttggtgaggttcccgccgta

SEQ ID NO: 359197 - DNA, 25 bp, Mus musculus
atggcatgaagccgcacactcccgg

SEQ ID NO: 359198 - DNA, 25 bp, Mus musculus
tcccatggcatgaagccgcacactc

SEQ ID NO: 359199 - DNA, 25 bp, Mus musculus
aactcccatggcatgaagccgcaca

SEQ ID NO: 359200 - DNA, 25 bp, Mus musculus
agcaactcccatggcatgaagccgc

SEQ ID NO: 359201 - DNA, 25 bp, Mus musculus
tgagcaactcccatggcatgaagcc

SEQ ID NO: 359202 - DNA, 25 bp, Mus musculus
ttgagcaactcccatggcatgaagc

SEQ ID NO: 359203 - DNA, 25 bp, Mus musculus
ctttgagcaactcccatggcatgaa

SEQ ID NO: 359204 - DNA, 25 bp, Mus musculus
actttgagcaactcccatggcatga

SEQ ID NO: 359205 - DNA, 25 bp, Mus musculus
cttcgcttggcgcgaatgtgcgtgc

SEQ ID NO: 359206 - DNA, 25 bp, Mus musculus
ccgccttcgcttggcgcgaatgtgc

SEQ ID NO: 359207 - DNA, 25 bp, Mus musculus
gttcccgccgtaaggcgcggcgctg

SEQ ID NO: 359208 - DNA, 25 bp, Mus musculus
cgcgaggatcggttcacaggaaccc

SEQ ID NO: 359209 - DNA, 25 bp, Mus musculus
cgccacgagggtccgtccatggaac

SEQ ID NO: 359210 - DNA, 25 bp, Mus musculus
cacgagggtccgtccatggaactcc

SEQ ID NO: 359211 - DNA, 25 bp, Mus musculus
acgagggtccgtccatggaactcca

SEQ ID NO: 359212 - DNA, 25 bp, Mus musculus
cgagggtccgtccatggaactccag

SEQ ID NO: 359213 - DNA, 25 bp, Mus musculus
agggtccgtccatggaactccagcc

SEQ ID NO: 359214 - DNA, 25 bp, Mus musculus
ccgtccatggaactccagcccaatc

SEQ ID NO: 359215 - DNA, 25 bp, Mus musculus
ccgcgaggatcggttcacaggaacc

SEQ ID NO: 359216 - DNA, 25 bp, Mus musculus
gaggatcggttcacaggaaccccaa

SEQ ID NO: 359217 - DNA, 25 bp, Mus musculus
cgatctccaagagggtcccttcacg

SEQ ID NO: 359218 - DNA, 25 bp, Mus musculus
atctccaagagggtcccttcacggg

SEQ ID NO: 359219 - DNA, 25 bp, Mus musculus
atccctccacgggaacctcagaccg

SEQ ID NO: 359220 - DNA, 25 bp, Mus musculus
gaccgatccctccacgggaacctca

SEQ ID NO: 359221 - DNA, 25 bp, Mus musculus
tctccaagagggtcccttcacggga

SEQ ID NO: 359222 - DNA, 25 bp, Mus musculus
cccgatctcggagcctggctttagg

SEQ ID NO: 359223 - DNA, 25 bp, Mus musculus
tcgctcggctgcaggtaccgccgga

SEQ ID NO: 359224 - DNA, 25 bp, Mus musculus
tcctaactcggagacggcggcccga

SEQ ID NO: 359225 - DNA, 25 bp, Mus musculus
atctcggagcctggctttaggggct

SEQ ID NO: 359226 - DNA, 25 bp, Mus musculus
ggaccgcagcgaggcctgcgactct

SEQ ID NO: 359227 - DNA, 25 bp, Mus musculus
tcggctgcaggtaccgccggagctc

SEQ ID NO: 359228 - DNA, 25 bp, Mus musculus
cccagcccggtagggagccgcccag

SEQ ID NO: 359229 - DNA, 25 bp, Mus musculus
caactttggcgagtttcgaggcagc

SEQ ID NO: 359230 - DNA, 25 bp, Mus musculus
gcctctcaactttggcgagtttcga

SEQ ID NO: 359231 - DNA, 25 bp, Mus musculus
ggcggcagcctctcaactttggcga

SEQ ID NO: 359232 - DNA, 25 bp, Mus musculus
tcgcaccttccctccagctcccggt

SEQ ID NO: 359233 - DNA, 25 bp, Mus musculus
cactcacagcgctgggaagccgcag

SEQ ID NO: 359234 - DNA, 25 bp, Mus musculus
tagccgaccactcacagcgctggga

SEQ ID NO: 359235 - DNA, 25 bp, Mus musculus
agccaatcgcagaggcggccccgtg

SEQ ID NO: 359236 - DNA, 25 bp, Mus musculus
tggagaaccgttacgacgcgctagc

SEQ ID NO: 359237 - DNA, 25 bp, Mus musculus
tgctttccacgtactgtcgcctgtc

SEQ ID NO: 359238 - DNA, 25 bp, Mus musculus
taaagctgctttccacgtactgtcg

SEQ ID NO: 359239 - DNA, 25 bp, Mus musculus
tgaggtgcaattcgtgcgcgacctg

SEQ ID NO: 359240 - DNA, 25 bp, Mus musculus
ttacgacgcgctagccgctcaggtg

SEQ ID NO: 359241 - DNA, 25 bp, Mus musculus
tgtgtcgcctggagaaccgttacga

SEQ ID NO: 359242 - DNA, 25 bp, Mus musculus
ggcctgaagcgtcgcctgtgtcgcc

SEQ ID NO: 359243 - DNA, 25 bp, Mus musculus
tcgagcgcttctcacgcgtgctgga

SEQ ID NO: 359244 - DNA, 25 bp, Mus musculus
cgagctacgccagcttcgagcgctt

SEQ ID NO: 359245 - DNA, 25 bp, Mus musculus
agcatgccgcgcaacacgagctacg

SEQ ID NO: 359246 - DNA, 25 bp, Mus musculus
agtacagcctcaagtcccactcgag

SEQ ID NO: 359247 - DNA, 25 bp, Mus musculus
cgcctgcgcgagtacagcctcaagt

SEQ ID NO: 359248 - DNA, 25 bp, Mus musculus
gctctgctcttcacaggtgcgcagg

SEQ ID NO: 359249 - DNA, 25 bp, Mus musculus
ctcaggtggccgctgaggtgcaatt

SEQ ID NO: 359250 - DNA, 25 bp, Mus musculus
gaaggtgtaactggactgcgagctc

SEQ ID NO: 359251 - DNA, 25 bp, Mus musculus
ctgtaccgaccgtgctttagtggca

SEQ ID NO: 359252 - DNA, 25 bp, Mus musculus
gcgttctgtaccgaccgtgctttag

SEQ ID NO: 359253 - DNA, 25 bp, Mus musculus
cagccacgcctccaaaagcaaaatg

SEQ ID NO: 359254 - DNA, 25 bp, Mus musculus
ctttagtggcacgtgtgtcgctgct

SEQ ID NO: 359255 - DNA, 25 bp, Mus musculus
cttgagctccacgtgagaaggtgta

SEQ ID NO: 359256 - DNA, 25 bp, Mus musculus
agtgacctctcggaaacgctccagc

SEQ ID NO: 359257 - DNA, 25 bp, Mus musculus
actgcgagctcgcacgatgccattc

SEQ ID NO: 359258 - DNA, 25 bp, Mus musculus
gatgccattcccgagtcagcctatg

SEQ ID NO: 359259 - DNA, 25 bp, Mus musculus
tcccttccttcacgtcgatgatcga

SEQ ID NO: 359260 - DNA, 25 bp, Mus musculus
tcacgtcgatgatcgatgatcgatg

SEQ ID NO: 359261 - DNA, 25 bp, Mus musculus
tcgatgtgtttgttgtaaagccgcc

SEQ ID NO: 359262 - DNA, 25 bp, Mus musculus
ttgtaaagccgccagtgacctctcg

SEQ ID NO: 359263 - DNA, 25 bp, Mus musculus
tgtcgctgctccagcttgagctcca

SEQ ID NO: 359264 - DNA, 25 bp, Mus musculus
cgcgctcggctgctcttgctttgct

SEQ ID NO: 359265 - DNA, 25 bp, Mus musculus
cagcgggaacggtaaagcctactca

SEQ ID NO: 359266 - DNA, 25 bp, Mus musculus
gcgcagaaggttcggctcccgcgct

SEQ ID NO: 359267 - DNA, 25 bp, Mus musculus
ggaggtctgcgccttcccacaaggc

SEQ ID NO: 359268 - DNA, 25 bp, Mus musculus
tgctcttgctttgctggcggtggac

SEQ ID NO: 359269 - DNA, 25 bp, Mus musculus
ccagggagacgcacggcgtcctaca

SEQ ID NO: 359270 - DNA, 25 bp, Mus musculus
agctcaggccgaaccctgggcagcg

SEQ ID NO: 359271 - DNA, 25 bp, Mus musculus
gacgcggagccagctcaggccgaac

SEQ ID NO: 359272 - DNA, 25 bp, Mus musculus
agcctgcataccctggcctgacgga

SEQ ID NO: 359273 - DNA, 25 bp, Mus musculus
gtcccgtatcaagccaagcctgcat

SEQ ID NO: 359274 - DNA, 25 bp, Mus musculus
ccagagcctggggaaccacgttcac

SEQ ID NO: 359275 - DNA, 25 bp, Mus musculus
ggcaaccagaaacttccagagcctg

SEQ ID NO: 359276 - DNA, 25 bp, Mus musculus
gggttcgttccgcaggcaaccagaa

SEQ ID NO: 359277 - DNA, 25 bp, Mus musculus
ggaaccacgttcacgtcccgtatca

SEQ ID NO: 359278 - DNA, 25 bp, Mus musculus
gcgcttctgcgaggggcaatccgcc

SEQ ID NO: 359279 - DNA, 25 bp, Mus musculus
tcctgcgaaggtcctaggcgccttc

SEQ ID NO: 359280 - DNA, 25 bp, Mus musculus
cgcaagggcgcaggagagcctctac

SEQ ID NO: 359281 - DNA, 25 bp, Mus musculus
ggacagcctcgaagctgagccacct

SEQ ID NO: 359282 - DNA, 25 bp, Mus musculus
tctagccgggcggacagcctcgaag

SEQ ID NO: 359283 - DNA, 25 bp, Mus musculus
ccatgagcgacgagggcaaaaaacg

SEQ ID NO: 359284 - DNA, 25 bp, Mus musculus
ggcggcgactccaccatgagcgacg

SEQ ID NO: 359285 - DNA, 25 bp, Mus musculus
agttccagcagggtcctctcggcac

SEQ ID NO: 359286 - DNA, 25 bp, Mus musculus
cagatccacccagtaacggtttttg

SEQ ID NO: 359287 - DNA, 25 bp, Mus musculus
taggcgccttccagaggtgaagctc

SEQ ID NO: 359288 - DNA, 25 bp, Mus musculus
ccgcgcctctggagcgcatcgtagg

SEQ ID NO: 359289 - DNA, 25 bp, Mus musculus
taacggtttttggatcggcagcttc

SEQ ID NO: 359290 - DNA, 25 bp, Mus musculus
cttttcctttctcactggagccgca

SEQ ID NO: 359291 - DNA, 25 bp, Mus musculus
tttctcactggagccgcagtaccgc

SEQ ID NO: 359292 - DNA, 25 bp, Mus musculus
ccgcaccctgtgaatctaccctcca

SEQ ID NO: 359293 - DNA, 25 bp, Mus musculus
gtgggagcgttgtttactccagaga

SEQ ID NO: 359294 - DNA, 25 bp, Mus musculus
acacgcacactgtgcgggattaccg

SEQ ID NO: 359295 - DNA, 25 bp, Mus musculus
ggacctggcgccttatgaacgtggc

SEQ ID NO: 359296 - DNA, 25 bp, Mus musculus
gcgttgtttactccagagagactgg

SEQ ID NO: 359297 - DNA, 25 bp, Mus musculus
cgtgtccactagagcgtcctctgcg

SEQ ID NO: 359298 - DNA, 25 bp, Mus musculus
ctccatcttcttcgtctggacggtg

SEQ ID NO: 359299 - DNA, 25 bp, Mus musculus
cctctgggacctggcgccttatgaa

SEQ ID NO: 359300 - DNA, 25 bp, Mus musculus
ccggcctttgccaagcggcggtgtc

SEQ ID NO: 359301 - DNA, 25 bp, Mus musculus
tggtctaccgacaaccggggactgc

SEQ ID NO: 359302 - DNA, 25 bp, Mus musculus
gcctactccggcttcagctcggtag

SEQ ID NO: 359303 - DNA, 25 bp, Mus musculus
tctggacggtggtctaccgacaacc

SEQ ID NO: 359304 - DNA, 25 bp, Mus musculus
tcggtagccggcttctccatcttct

SEQ ID NO: 359305 - DNA, 25 bp, Mus musculus
ggcttcagctcggtagccggcttct

SEQ ID NO: 359306 - DNA, 25 bp, Mus musculus
ggggacgtttccctcagctacagga

SEQ ID NO: 359307 - DNA, 25 bp, Mus musculus
acgcccggcccttgcacaggcggcc

SEQ ID NO: 359308 - DNA, 25 bp, Mus musculus
tcagtgggtcctagcctttgccctc

SEQ ID NO: 359309 - DNA, 25 bp, Mus musculus
cgccagttcagtgggtcctagcctt

SEQ ID NO: 359310 - DNA, 25 bp, Mus musculus
ttctacaagacaggggcgctgatgt

SEQ ID NO: 359311 - DNA, 25 bp, Mus musculus
ctccaggggacgtttccctcagcta

SEQ ID NO: 359312 - DNA, 25 bp, Mus musculus
cgtttccctcagctacaggatctga

SEQ ID NO: 359313 - DNA, 25 bp, Mus musculus
tcagctacaggatctgagtagggcc

SEQ ID NO: 359314 - DNA, 25 bp, Mus musculus
tgatgtccagccctgcaagttctgc

SEQ ID NO: 359315 - DNA, 25 bp, Mus musculus
tgcccagttctacaagacaggggcg

SEQ ID NO: 359316 - DNA, 25 bp, Mus musculus
aagttctgcgccagttcagtgggtc

SEQ ID NO: 359317 - DNA, 25 bp, Mus musculus
gccctgcaagttctgcgccagttca

SEQ ID NO: 359318 - DNA, 25 bp, Mus musculus
caggatctgagtagggccctgccca

SEQ ID NO: 359319 - DNA, 25 bp, Mus musculus
ggcgctgatgtccagccctgcaagt

SEQ ID NO: 359320 - DNA, 25 bp, Mus musculus
tgcacccgaacgctgagacctctag

SEQ ID NO: 359321 - DNA, 25 bp, Mus musculus
agctttctcagacttgggtgccctc

SEQ ID NO: 359322 - DNA, 25 bp, Mus musculus
gccagcctcgtacgaacttcagctt

SEQ ID NO: 359323 - DNA, 25 bp, Mus musculus
tgtcgtgtgtgcaaatccacgtttc

SEQ ID NO: 359324 - DNA, 25 bp, Mus musculus
cgtggttctacccaatctgctgtaa

SEQ ID NO: 359325 - DNA, 25 bp, Mus musculus
cgtttctgcctgtgatgatccgtga

SEQ ID NO: 359326 - DNA, 25 bp, Mus musculus
gcccggatctcagtcgccaactttg

SEQ ID NO: 359327 - DNA, 25 bp, Mus musculus
acaggcgtctgccttccgtggaaca

SEQ ID NO: 359328 - DNA, 25 bp, Mus musculus
aaccactgcactgtcgccttggagg

SEQ ID NO: 359329 - DNA, 25 bp, Mus musculus
cagtcctctgaagccctgaaacttt

SEQ ID NO: 359330 - DNA, 25 bp, Mus musculus
agggctcggcagcagctttttgaca

SEQ ID NO: 359331 - DNA, 25 bp, Mus musculus
gagacctctagatcccagacgcctg

SEQ ID NO: 359332 - DNA, 25 bp, Mus musculus
agtcttggactctagcgcttgcacc

SEQ ID NO: 359333 - DNA, 25 bp, Mus musculus
atgatccgtgatgtagccaccaccc

SEQ ID NO: 359334 - DNA, 25 bp, Mus musculus
ccctaccggtgggtaggtgcgctgc

SEQ ID NO: 359335 - DNA, 25 bp, Mus musculus
gcctgaacgcgttcggaacgtggct

SEQ ID NO: 359336 - DNA, 25 bp, Mus musculus
tcggaggcctgaacgcgttcggaac

SEQ ID NO: 359337 - DNA, 25 bp, Mus musculus
ccgagcctcggaggcctgaacgcgt

SEQ ID NO: 359338 - DNA, 25 bp, Mus musculus
ccagcagttggtgcgccacaggtcc

SEQ ID NO: 359339 - DNA, 25 bp, Mus musculus
aactgccagcagttggtgcgccaca

SEQ ID NO: 359340 - DNA, 25 bp, Mus musculus
tcccgggagtaactgccagcagttg

SEQ ID NO: 359341 - DNA, 25 bp, Mus musculus
gtcccgggagtaactgccagcagtt

SEQ ID NO: 359342 - DNA, 25 bp, Mus musculus
agtggtcccgggagtaactgccagc

SEQ ID NO: 359343 - DNA, 25 bp, Mus musculus
ggcgtgacctgagcccgcctcctcg

SEQ ID NO: 359344 - DNA, 25 bp, Mus musculus
agggacgcgctggagctcagggcgc

SEQ ID NO: 359345 - DNA, 25 bp, Mus musculus
ctccgagcacctccgcggttctctg

SEQ ID NO: 359346 - DNA, 25 bp, Mus musculus
aggcgcgccgaggactcgctggagc

SEQ ID NO: 359347 - DNA, 25 bp, Mus musculus
gacgttctgtctccgagcacctccg

SEQ ID NO: 359348 - DNA, 25 bp, Mus musculus
tgtggcacgaaaggggctacagata

SEQ ID NO: 359349 - DNA, 25 bp, Mus musculus
agaagccagcaccaccctaattgtg

SEQ ID NO: 359350 - DNA, 25 bp, Mus musculus
gatcgcctaggtgcggtccgaagaa

SEQ ID NO: 359351 - DNA, 25 bp, Mus musculus
gccaacgctgtaaccagatcgccta

SEQ ID NO: 359352 - DNA, 25 bp, Mus musculus
tgcccaagaaaggagccaacgctgt

SEQ ID NO: 359353 - DNA, 25 bp, Mus musculus
tgtaggattaaatgactgcccaaga

SEQ ID NO: 359354 - DNA, 25 bp, Mus musculus
ccagcagacagacatccgtagagta

SEQ ID NO: 359355 - DNA, 25 bp, Mus musculus
tgtgagagctgctggctgactcttt

SEQ ID NO: 359356 - DNA, 25 bp, Mus musculus
tacagatagcatcctggccgcccga

SEQ ID NO: 359357 - DNA, 25 bp, Mus musculus
cgccgtgcggcataagtgattcttt

SEQ ID NO: 359358 - DNA, 25 bp, Mus musculus
taagtgattctttgtggccggccaa

SEQ ID NO: 359359 - DNA, 25 bp, Mus musculus
tgtggccggccaattaaaaagctac

SEQ ID NO: 359360 - DNA, 25 bp, Mus musculus
gaactgttttgcttcgtcgccgctg

SEQ ID NO: 359361 - DNA, 25 bp, Mus musculus
cgtcgtgaaagctgatcgggttccc

SEQ ID NO: 359362 - DNA, 25 bp, Mus musculus
tccaaaggctggcaaaccggcccaa

SEQ ID NO: 359363 - DNA, 25 bp, Mus musculus
cctgacaccgtaggaccgcggcgat

SEQ ID NO: 359364 - DNA, 25 bp, Mus musculus
cgcccaggccggaccagagcccaca

SEQ ID NO: 359365 - DNA, 25 bp, Mus musculus
ccggtcgctccaaaggctggcaaac

SEQ ID NO: 359366 - DNA, 25 bp, Mus musculus
tatatgctcccggtcgctccaaagg

SEQ ID NO: 359367 - DNA, 25 bp, Mus musculus
aggctccagttatatgctcccggtc

SEQ ID NO: 359368 - DNA, 25 bp, Mus musculus
cccggcagaggctccagttatatgc

SEQ ID NO: 359369 - DNA, 25 bp, Mus musculus
gctccctcatgcaggaggccctagg

SEQ ID NO: 359370 - DNA, 25 bp, Mus musculus
gtccgggtctctaccgctccctcat

SEQ ID NO: 359371 - DNA, 25 bp, Mus musculus
atggctcaccgcgaggcctggcaga

SEQ ID NO: 359372 - DNA, 25 bp, Mus musculus
cgaggcggatcatggctcaccgcga

SEQ ID NO: 359373 - DNA, 25 bp, Mus musculus
cgacttacgggcatcctggccctga

SEQ ID NO: 359374 - DNA, 25 bp, Mus musculus
cctcatgcaggaggccctaggagca

SEQ ID NO: 359375 - DNA, 25 bp, Mus musculus
cccaatgtgcccagtggcctgatcg

SEQ ID NO: 359376 - DNA, 25 bp, Mus musculus
ggaccctgctctggcgggaaactcc

SEQ ID NO: 359377 - DNA, 25 bp, Mus musculus
actcggtaggcgaggagtagcattc

SEQ ID NO: 359378 - DNA, 25 bp, Mus musculus
aggagtagcattcaggtttcaagga

SEQ ID NO: 359379 - DNA, 25 bp, Mus musculus
cttcctcgtagagaacagctcttcc

SEQ ID NO: 359380 - DNA, 25 bp, Mus musculus
agtgagcccaactaccagacccggg

SEQ ID NO: 359381 - DNA, 25 bp, Mus musculus
accggaaccggctgctaggcaaagg

SEQ ID NO: 359382 - DNA, 25 bp, Mus musculus
ggacaagaggtcaaagagcgagcta

SEQ ID NO: 359383 - DNA, 25 bp, Mus musculus
tgtcaccctgtcagactggggcttt

SEQ ID NO: 359384 - DNA, 25 bp, Mus musculus
actggggctttttctcttcgtcgca

SEQ ID NO: 359385 - DNA, 25 bp, Mus musculus
cttcgtcgcacttggagtactgtta

SEQ ID NO: 359386 - DNA, 25 bp, Mus musculus
ctttggttttctctgtccctcggct

SEQ ID NO: 359387 - DNA, 25 bp, Mus musculus
acccgctgtcatctggttccgttcg

SEQ ID NO: 359388 - DNA, 25 bp, Mus musculus
agtactgttagtgcgcccgccgtcc

SEQ ID NO: 359389 - DNA, 25 bp, Mus musculus
ggagcgacagctcaacttcctcgta

SEQ ID NO: 359390 - DNA, 25 bp, Mus musculus
tggtctcatacagcaccagcttctg

SEQ ID NO: 359391 - DNA, 25 bp, Mus musculus
acggggtgctgcctcttcccgacga

SEQ ID NO: 359392 - DNA, 25 bp, Mus musculus
cgtcccgtcgttgtgggtactcaca

SEQ ID NO: 359393 - DNA, 25 bp, Mus musculus
tgacaaaaacagtgtcagaacacca

SEQ ID NO: 359394 - DNA, 25 bp, Mus musculus
ccgtcgttgtgggtactcacagctc

SEQ ID NO: 359395 - DNA, 25 bp, Mus musculus
gtgggtactcacagctctggtctca

SEQ ID NO: 359396 - DNA, 25 bp, Mus musculus
gggctcgccggctgcttccggattc

SEQ ID NO: 359397 - DNA, 25 bp, Mus musculus
agtgtcagaacaccaaacgttcagc

SEQ ID NO: 359398 - DNA, 25 bp, Mus musculus
agcacaccagacacagctgacaaaa

SEQ ID NO: 359399 - DNA, 25 bp, Mus musculus
cctggagacagagcgaggagacccc

SEQ ID NO: 359400 - DNA, 25 bp, Mus musculus
ggccgtgggcatggctccagccaat

SEQ ID NO: 359401 - DNA, 25 bp, Mus musculus
agcttctggaccgagctgatgatgg

SEQ ID NO: 359402 - DNA, 25 bp, Mus musculus
ctcacagctctggtctcatacagca

SEQ ID NO: 359403 - DNA, 25 bp, Mus musculus
aacaccaaacgttcagcagcgggct

SEQ ID NO: 359404 - DNA, 25 bp, Mus musculus
ttgaccatactagggcaagcagctc

SEQ ID NO: 359405 - DNA, 25 bp, Mus musculus
gtctataaagccgagcacgccaacc

SEQ ID NO: 359406 - DNA, 25 bp, Mus musculus
ggcgtcgtgtctataaagccgagca

SEQ ID NO: 359407 - DNA, 25 bp, Mus musculus
gagccggcgtcgtgtctataaagcc

SEQ ID NO: 359408 - DNA, 25 bp, Mus musculus
cctcgctattaataacctggcgggg

SEQ ID NO: 359409 - DNA, 25 bp, Mus musculus
agctccctcgctattaataacctgg

SEQ ID NO: 359410 - DNA, 25 bp, Mus musculus
gggcaagcagctccctcgctattaa

SEQ ID NO: 359411 - DNA, 25 bp, Mus musculus
ctcagctcttgaccatactagggca

SEQ ID NO: 359412 - DNA, 25 bp, Mus musculus
gggcctagccacgttcgcggtcgct

SEQ ID NO: 359413 - DNA, 25 bp, Mus musculus
gcacgtagcagaccgggcctagcca

SEQ ID NO: 359414 - DNA, 25 bp, Mus musculus
ctggaacaggtgcacgtagcagacc

SEQ ID NO: 359415 - DNA, 25 bp, Mus musculus
tcacagcctggaacaggtgcacgta

SEQ ID NO: 359416 - DNA, 25 bp, Mus musculus
cccgtcacagcctggaacaggtgca

SEQ ID NO: 359417 - DNA, 25 bp, Mus musculus
cgcggtcgctcagctcttgaccata

SEQ ID NO: 359418 - DNA, 25 bp, Mus musculus
cgcatgcgttgtgcgcacactctta

SEQ ID NO: 359419 - DNA, 25 bp, Mus musculus
gggccgcccacaacctggtgaagcg

SEQ ID NO: 359420 - DNA, 25 bp, Mus musculus
ggggatcaccaatctgtgtgtcatc

SEQ ID NO: 359421 - DNA, 25 bp, Mus musculus
ccaatctgtgtgtcatcggaggcga

SEQ ID NO: 359422 - DNA, 25 bp, Mus musculus
gtcatcggaggcgatggcagcctca

SEQ ID NO: 359423 - DNA, 25 bp, Mus musculus
ggcagcctcactggggctgacactt

SEQ ID NO: 359424 - DNA, 25 bp, Mus musculus
gggctgacactttccgttcagagtg

SEQ ID NO: 359425 - DNA, 25 bp, Mus musculus
ttccgttcagagtggagcgacttgc

SEQ ID NO: 359426 - DNA, 25 bp, Mus musculus
agcgacttgctgaatgatctccaga

SEQ ID NO: 359427 - DNA, 25 bp, Mus musculus
tctccagaaagacggtgagacattt

SEQ ID NO: 359428 - DNA, 25 bp, Mus musculus
acggtgagacatttcactgtccgta

SEQ ID NO: 359429 - DNA, 25 bp, Mus musculus
actgtccgtactgcttatcatgtga

SEQ ID NO: 359430 - DNA, 25 bp, Mus musculus
ttatcatgtgacatgcacgcatgcg

SEQ ID NO: 359431 - DNA, 25 bp, Mus musculus
ttccgagagcgagaaggacgactcc

SEQ ID NO: 359432 - DNA, 25 bp, Mus musculus
ctaaggggcgttcacaggctgcgaa

SEQ ID NO: 359433 - DNA, 25 bp, Mus musculus
ctgcttataggacgtgggcgcgatc

SEQ ID NO: 359434 - DNA, 25 bp, Mus musculus
ccctgtcgctgcttataggacgtgg

SEQ ID NO: 359435 - DNA, 25 bp, Mus musculus
tttacagcgcaagccggccgagtgc

SEQ ID NO: 359436 - DNA, 25 bp, Mus musculus
ccggaagcagaagcggctcgcatca

SEQ ID NO: 359437 - DNA, 25 bp, Mus musculus
gaagccgctgtcaaggcgtgacccg

SEQ ID NO: 359438 - DNA, 25 bp, Mus musculus
tcacaggctgcgaagcaccgacttg

SEQ ID NO: 359439 - DNA, 25 bp, Mus musculus
atccgggcgagtcccgggagtctca

SEQ ID NO: 359440 - DNA, 25 bp, Mus musculus
cgggcgctcacagcaatccgggcga

SEQ ID NO: 359441 - DNA, 25 bp, Mus musculus
ctgctgcgtcccttgcggcagggac

SEQ ID NO: 359442 - DNA, 25 bp, Mus musculus
ccaatcccaggacgcggacagctgg

SEQ ID NO: 359443 - DNA, 25 bp, Mus musculus
gaggctcccaatcccaggacgcgga

SEQ ID NO: 359444 - DNA, 25 bp, Mus musculus
tgacccttggcctggccggaggctc

SEQ ID NO: 359445 - DNA, 25 bp, Mus musculus
gcactcaccgaaccgcgggtcagat

SEQ ID NO: 359446 - DNA, 25 bp, Mus musculus
accagcgggctatagtctccatgtg

SEQ ID NO: 359447 - DNA, 25 bp, Mus musculus
tgtgacctgtgagcactctttgtcg

SEQ ID NO: 359448 - DNA, 25 bp, Mus musculus
gcggggacataggtaccacactgga

SEQ ID NO: 359449 - DNA, 25 bp, Mus musculus
cctagacaggtcttcgatccataga

SEQ ID NO: 359450 - DNA, 25 bp, Mus musculus
tgccactcaatggaggacagtctgc

SEQ ID NO: 359451 - DNA, 25 bp, Mus musculus
gaactgatggagcacctgaaggccc

SEQ ID NO: 359452 - DNA, 25 bp, Mus musculus
gacagtctgctggagatcatgacca

SEQ ID NO: 359453 - DNA, 25 bp, Mus musculus
atcatgaccaaggacggcggcgaca

SEQ ID NO: 359454 - DNA, 25 bp, Mus musculus
cgtcatttacgtgccgtgcgtcgcc

SEQ ID NO: 359455 - DNA, 25 bp, Mus musculus
aggcctcgcacatccaggttctgtc

SEQ ID NO: 359456 - DNA, 25 bp, Mus musculus
tgtgccagattatgaccactgcgcc

SEQ ID NO: 359457 - DNA, 25 bp, Mus musculus
acaccttcgcctgggatcgaggaca

SEQ ID NO: 359458 - DNA, 25 bp, Mus musculus
cttgctgggtcgtgatcctgatgaa

SEQ ID NO: 359459 - DNA, 25 bp, Mus musculus
gcaaggggagcttcccaagtgttcc

SEQ ID NO: 359460 - DNA, 25 bp, Mus musculus
accaggtagcggagaccctcatctg

SEQ ID NO: 359461 - DNA, 25 bp, Mus musculus
ccctcatctgtgaggcggacgcagc

SEQ ID NO: 359462 - DNA, 25 bp, Mus musculus
tgagctgcgatggtgtgtaagcctt

SEQ ID NO: 359463 - DNA, 25 bp, Mus musculus
tgtaagccttcgtcctccagcacga

SEQ ID NO: 359464 - DNA, 25 bp, Mus musculus
cgaagcagtccgtcatatcaaggta

SEQ ID NO: 359465 - DNA, 25 bp, Mus musculus
ctccttgatggaagtgcagtagatc

SEQ ID NO: 359466 - DNA, 25 bp, Mus musculus
agcgggactccagtttagcaatctc

SEQ ID NO: 359467 - DNA, 25 bp, Mus musculus
ctgaggtacctcaagcgggactcca

SEQ ID NO: 359468 - DNA, 25 bp, Mus musculus
taacgaatgcccacatccgtgatgc

SEQ ID NO: 359469 - DNA, 25 bp, Mus musculus
tgctgcagtatttagccacataacg

SEQ ID NO: 359470 - DNA, 25 bp, Mus musculus
cctcgcattgaggtagcgtaatttg

SEQ ID NO: 359471 - DNA, 25 bp, Mus musculus
agcaatctcccgcaggccaaagtca

SEQ ID NO: 359472 - DNA, 25 bp, Mus musculus
caaagtcactgacaaagcggcagtc

SEQ ID NO: 359473 - DNA, 25 bp, Mus musculus
gtcgctgacactcagctccttgatg

SEQ ID NO: 359474 - DNA, 25 bp, Mus musculus
actgaccctcaggagcgtgcctttc

SEQ ID NO: 359475 - DNA, 25 bp, Mus musculus
tgagaggagatctcccggcgcactt

SEQ ID NO: 359476 - DNA, 25 bp, Mus musculus
gcctttctccaacctggtggacttc

SEQ ID NO: 359477 - DNA, 25 bp, Mus musculus
gggatttgagcacggtcttcccaga

SEQ ID NO: 359478 - DNA, 25 bp, Mus musculus
ctgcccagcgtcaaccgggattgtc

SEQ ID NO: 359479 - DNA, 25 bp, Mus musculus
tagccagcagcgtcgctgccactga

SEQ ID NO: 359480 - DNA, 25 bp, Mus musculus
gcacggtcttcccagaagagtggct

SEQ ID NO: 359481 - DNA, 25 bp, Mus musculus
atttgagcacggtcttcccagaaga

SEQ ID NO: 359482 - DNA, 25 bp, Mus musculus
ttccagaccctgaagtagccagcag

SEQ ID NO: 359483 - DNA, 25 bp, Mus musculus
ggctttgaaatcttccagaccctga

SEQ ID NO: 359484 - DNA, 25 bp, Mus musculus
cctcggctttgaaatcttccagacc

SEQ ID NO: 359485 - DNA, 25 bp, Mus musculus
agcgtcaaccgggattgtcccgcct

SEQ ID NO: 359486 - DNA, 25 bp, Mus musculus
ccctgaagtagccagcagcgtcgct

SEQ ID NO: 359487 - DNA, 25 bp, Mus musculus
agcgtgcctttctccaacctggtgg

SEQ ID NO: 359488 - DNA, 25 bp, Mus musculus
agcgacaagcgacagggccggcgcg

SEQ ID NO: 359489 - DNA, 25 bp, Mus musculus
gcgggcacaggaaatcccgccgctt

SEQ ID NO: 359490 - DNA, 25 bp, Mus musculus
ggcccgcacagcaagcgacaagcga

SEQ ID NO: 359491 - DNA, 25 bp, Mus musculus
ggcacaggaaatcccgccgcttccg

SEQ ID NO: 359492 - DNA, 25 bp, Mus musculus
tggagaggaccgctggacccacact

SEQ ID NO: 359493 - DNA, 25 bp, Mus musculus
tcgccacagcccacgggctttgctg

SEQ ID NO: 359494 - DNA, 25 bp, Mus musculus
aggctggtgccctcctccacgcccg

SEQ ID NO: 359495 - DNA, 25 bp, Mus musculus
ggacccacactcctgtcgccacagc

SEQ ID NO: 359496 - DNA, 25 bp, Mus musculus
aggcatgcgacaccgacgccactgt

SEQ ID NO: 359497 - DNA, 25 bp, Mus musculus
gggaccaggcatgcgacaccgacgc

SEQ ID NO: 359498 - DNA, 25 bp, Mus musculus
gcgggaccaggcatgcgacaccgac

SEQ ID NO: 359499 - DNA, 25 bp, Mus musculus
ggacgcccacgcaagtgacagcggc

SEQ ID NO: 359500 - DNA, 25 bp, Mus musculus
gacgccactgttcccacggccaggc

SEQ ID NO: 359501 - DNA, 25 bp, Mus musculus
cccacgcaagtgacagcggcgggac

SEQ ID NO: 359502 - DNA, 25 bp, Mus musculus
gtcgttcgtagatctctgcttctca

SEQ ID NO: 359503 - DNA, 25 bp, Mus musculus
cgtcatcacggagttcgttctcacc

SEQ ID NO: 359504 - DNA, 25 bp, Mus musculus
gagttcgttctcaccgggctctctg

SEQ ID NO: 359505 - DNA, 25 bp, Mus musculus
ctgatcccggctctactttttgctc

SEQ ID NO: 359506 - DNA, 25 bp, Mus musculus
ctactttttgctctattcctgggga

SEQ ID NO: 359507 - DNA, 25 bp, Mus musculus
ttcctggggatttacgtcctcacca

SEQ ID NO: 359508 - DNA, 25 bp, Mus musculus
gtcctcaccatgacggggaacctga

SEQ ID NO: 359509 - DNA, 25 bp, Mus musculus
aacctgacgatgctgctggtgatca

SEQ ID NO: 359510 - DNA, 25 bp, Mus musculus
tgctggtgatcacggctgactccca

SEQ ID NO: 359511 - DNA, 25 bp, Mus musculus
cttcttaagcaatctgtcgttcgta

SEQ ID NO: 359512 - DNA, 25 bp, Mus musculus
tgcttctcatccgtcacgataccga

SEQ ID NO: 359513 - DNA, 25 bp, Mus musculus
aactgctgaaggacctcctatcggc

SEQ ID NO: 359514 - DNA, 25 bp, Mus musculus
gtcacgataccgaaactgctgaagg

SEQ ID NO: 359515 - DNA, 25 bp, Mus musculus
acacccatgtacttcttcttaagca

SEQ ID NO: 359516 - DNA, 25 bp, Mus musculus
gcgagcagcgcctaacagcaaagga

SEQ ID NO: 359517 - DNA, 25 bp, Mus musculus
tggcaagacgtgaatccgaatcctg

SEQ ID NO: 359518 - DNA, 25 bp, Mus musculus
cacgacagatcgaaacggccttagc

SEQ ID NO: 359519 - DNA, 25 bp, Mus musculus
gccacgagtcctggttgcgtgctcc

SEQ ID NO: 359520 - DNA, 25 bp, Mus musculus
ttggccgaatctccgcagcagcaga

SEQ ID NO: 359521 - DNA, 25 bp, Mus musculus
gtcgtcctacaagcgccatcttgtc

SEQ ID NO: 359522 - DNA, 25 bp, Mus musculus
ctgttcatgccaaaacctgcgggga

SEQ ID NO: 359523 - DNA, 25 bp, Mus musculus
ctccaacgctgcaggagacgacgtg

SEQ ID NO: 359524 - DNA, 25 bp, Mus musculus
cgcgaccctagacgctgattggttg

SEQ ID NO: 359525 - DNA, 25 bp, Mus musculus
agggtgctgtgctcctattggtcag

SEQ ID NO: 359526 - DNA, 25 bp, Mus musculus
tggtcagaactaacactagcctgtg

SEQ ID NO: 359527 - DNA, 25 bp, Mus musculus
ctccacaacgggagtggctgaagtg

SEQ ID NO: 359528 - DNA, 25 bp, Mus musculus
gtctgtcagaaactcggccggtgag

SEQ ID NO: 359529 - DNA, 25 bp, Mus musculus
cccgaaagcctagcaaccagagagg

SEQ ID NO: 359530 - DNA, 25 bp, Mus musculus
cgggcctctagttaacgctcgctgc

SEQ ID NO: 359531 - DNA, 25 bp, Mus musculus
cgggactatctgacgtcgttcttta

SEQ ID NO: 359532 - DNA, 25 bp, Mus musculus
ttaaaggtctcgtctttccgcgcga

SEQ ID NO: 359533 - DNA, 25 bp, Mus musculus
gcctaggccgaaaggatacacgttc

SEQ ID NO: 359534 - DNA, 25 bp, Mus musculus
cgagcgccattgtgggttctcccaa

SEQ ID NO: 359535 - DNA, 25 bp, Mus musculus
ttccgcccagaaagccgaagattcc

SEQ ID NO: 359536 - DNA, 25 bp, Mus musculus
acgttgtcccatgtcctggaggaga

SEQ ID NO: 359537 - DNA, 25 bp, Mus musculus
cctgctggcggtaagagagttcttt

SEQ ID NO: 359538 - DNA, 25 bp, Mus musculus
agagttctttatcggagtccacgcc

SEQ ID NO: 359539 - DNA, 25 bp, Mus musculus
tctccagctgctcgcgagtaaaata

SEQ ID NO: 359540 - DNA, 25 bp, Mus musculus
taccaccgcttgttgttgttcttcc

SEQ ID NO: 359541 - DNA, 25 bp, Mus musculus
agactactgcgacgtgacgaacttc

SEQ ID NO: 359542 - DNA, 25 bp, Mus musculus
cgaccaccgaggttgtgacacactt

SEQ ID NO: 359543 - DNA, 25 bp, Mus musculus
cgggaaattgactccgcctcacttc

SEQ ID NO: 359544 - DNA, 25 bp, Mus musculus
gcgagagtccctgtctctgcatctc

SEQ ID NO: 359545 - DNA, 25 bp, Mus musculus
ggagccggcggcagattcctcagcc

SEQ ID NO: 359546 - DNA, 25 bp, Mus musculus
cagttcctgggttgcgagagtccct

SEQ ID NO: 359547 - DNA, 25 bp, Mus musculus
tgtttcccggcggagcagttcctgg

SEQ ID NO: 359548 - DNA, 25 bp, Mus musculus
tcgcgtctggttgcggcgtctctcc

SEQ ID NO: 359549 - DNA, 25 bp, Mus musculus
tctccaccgggctcgcgtctggttg

SEQ ID NO: 359550 - DNA, 25 bp, Mus musculus
cccatgtatgacgactcctacgtgc

SEQ ID NO: 359551 - DNA, 25 bp, Mus musculus
atgacgactcctacgtgcccgggtt

SEQ ID NO: 359552 - DNA, 25 bp, Mus musculus
ctacgtgcccgggtttgaggactcg

SEQ ID NO: 359553 - DNA, 25 bp, Mus musculus
gggagttgggatgacacctctctct

SEQ ID NO: 359554 - DNA, 25 bp, Mus musculus
gttgggatgacacctctctctcttc

SEQ ID NO: 359555 - DNA, 25 bp, Mus musculus
gcactttgaaaaacgccttggcagc

SEQ ID NO: 359556 - DNA, 25 bp, Mus musculus
tctgagctgcgagcagctggtcttc

SEQ ID NO: 359557 - DNA, 25 bp, Mus musculus
tgaaaaacgccttggcagcgagcgg

SEQ ID NO: 359558 - DNA, 25 bp, Mus musculus
caaccccgcgggactcggtcgtgag

SEQ ID NO: 359559 - DNA, 25 bp, Mus musculus
ctctctggggctagggatggcaggt

SEQ ID NO: 359560 - DNA, 25 bp, Mus musculus
gctagggatggcaggttcgagcagg

SEQ ID NO: 359561 - DNA, 25 bp, Mus musculus
cttgaacgagcacggggcggtgcgt

SEQ ID NO: 359562 - DNA, 25 bp, Mus musculus
ggctccgggaggacgtggacatggc

SEQ ID NO: 359563 - DNA, 25 bp, Mus musculus
tggacatggcggctagcagctcttc

SEQ ID NO: 359564 - DNA, 25 bp, Mus musculus
gacatggcggctagcagctcttccg

SEQ ID NO: 359565 - DNA, 25 bp, Mus musculus
acatggcggctagcagctcttccgg

SEQ ID NO: 359566 - DNA, 25 bp, Mus musculus
ctagcagctcttccggcctcgcgca

SEQ ID NO: 359567 - DNA, 25 bp, Mus musculus
cctcgcgcagggcaccaacccgtcg

SEQ ID NO: 359568 - DNA, 25 bp, Mus musculus
cgtcgtccaggtaacgagccccgtg

SEQ ID NO: 359569 - DNA, 25 bp, Mus musculus
cccgcgggactcggtcgtgagtcac

SEQ ID NO: 359570 - DNA, 25 bp, Mus musculus
gcggagacaggctgaggctctctgg

SEQ ID NO: 359571 - DNA, 25 bp, Mus musculus
gcagggcaccaacccgtcgtccagg

SEQ ID NO: 359572 - DNA, 25 bp, Mus musculus
agtcgccatctttcgcgtttccaga

SEQ ID NO: 359573 - DNA, 25 bp, Mus musculus
cctgcaccacgcgagctgacgaata

SEQ ID NO: 359574 - DNA, 25 bp, Mus musculus
gcgagctgacgaataggccctgaaa

SEQ ID NO: 359575 - DNA, 25 bp, Mus musculus
taggccctgaaaactaccaatccca

SEQ ID NO: 359576 - DNA, 25 bp, Mus musculus
aaagggagttcctgggcctgcacca

SEQ ID NO: 359577 - DNA, 25 bp, Mus musculus
gatcacggaggagcacccaggccgc

SEQ ID NO: 359578 - DNA, 25 bp, Mus musculus
tttcgcgtttccagatcacggagga

SEQ ID NO: 359579 - DNA, 25 bp, Mus musculus
taccaatcccagaatgcacggcgcg

SEQ ID NO: 359580 - DNA, 25 bp, Mus musculus
acgtcgccgaacagtcgccatcttt

SEQ ID NO: 359581 - DNA, 25 bp, Mus musculus
tgaggctacggctatcttcccgctc

SEQ ID NO: 359582 - DNA, 25 bp, Mus musculus
gggctgaggctacggctatcttccc

SEQ ID NO: 359583 - DNA, 25 bp, Mus musculus
cctttcactcttgcccgccggagct

SEQ ID NO: 359584 - DNA, 25 bp, Mus musculus
atcccagaatgcacggcgcgagggc

SEQ ID NO: 359585 - DNA, 25 bp, Mus musculus
ttccagatcacggaggagcacccag

SEQ ID NO: 359586 - DNA, 25 bp, Mus musculus
agcagtctttcgctagcacctgtaa

SEQ ID NO: 359587 - DNA, 25 bp, Mus musculus
gtctttcgctagcacctgtaacatc

SEQ ID NO: 359588 - DNA, 25 bp, Mus musculus
tcacctcgggatagcagtctttcgc

SEQ ID NO: 359589 - DNA, 25 bp, Mus musculus
gtaacatcgccgtcttcccacactg

SEQ ID NO: 359590 - DNA, 25 bp, Mus musculus
cactgcacgtctcccaccaggacga

SEQ ID NO: 359591 - DNA, 25 bp, Mus musculus
accaggacgagcttacacctgacca

SEQ ID NO: 359592 - DNA, 25 bp, Mus musculus
ttacacctgaccaccactggctgcg

SEQ ID NO: 359593 - DNA, 25 bp, Mus musculus
ggtgcccgtctctccttcatggctg

SEQ ID NO: 359594 - DNA, 25 bp, Mus musculus
aggaggtcgcgcctcaagtgtccgc

SEQ ID NO: 359595 - DNA, 25 bp, Mus musculus
gtcgcgcctcaagtgtccgcactag

SEQ ID NO: 359596 - DNA, 25 bp, Mus musculus
gtgtccgcactagcacactagcgcg

SEQ ID NO: 359597 - DNA, 25 bp, Mus musculus
actagcacactagcgcgggttccct

SEQ ID NO: 359598 - DNA, 25 bp, Mus musculus
cccgggacggcagggaagctcacct

SEQ ID NO: 359599 - DNA, 25 bp, Mus musculus
cagggaagctcacctcgggatagca

SEQ ID NO: 359600 - DNA, 25 bp, Mus musculus
tgaggctcccgagcagagcgagctc

SEQ ID NO: 359601 - DNA, 25 bp, Mus musculus
cagccggtgctgaagctgagcctag

SEQ ID NO: 359602 - DNA, 25 bp, Mus musculus
gctgcagcaaaagcagccggtgctg

SEQ ID NO: 359603 - DNA, 25 bp, Mus musculus
agacccatcaccatggcagcggctg

SEQ ID NO: 359604 - DNA, 25 bp, Mus musculus
gttctcgcgagacccatcaccatgg

SEQ ID NO: 359605 - DNA, 25 bp, Mus musculus
agcgagcggcagttctcgcgagacc

SEQ ID NO: 359606 - DNA, 25 bp, Mus musculus
cacctccacgatcgcgcgagaagtg

SEQ ID NO: 359607 - DNA, 25 bp, Mus musculus
ctagcaccggaagccgcgacggcga

SEQ ID NO: 359608 - DNA, 25 bp, Mus musculus
ccgaccgcggtgaagatggtccgct

SEQ ID NO: 359609 - DNA, 25 bp, Mus musculus
gcggaggacaaatccgtgtgcgccc

SEQ ID NO: 359610 - DNA, 25 bp, Mus musculus
cccaaggaaaagagagccaaacagc

SEQ ID NO: 359611 - DNA, 25 bp, Mus musculus
gagagaaaaggcagcgttcctcgca

SEQ ID NO: 359612 - DNA, 25 bp, Mus musculus
aggagaataaccacggcacggcacg

SEQ ID NO: 359613 - DNA, 25 bp, Mus musculus
caccagtaggccctgatactaagcc

SEQ ID NO: 359614 - DNA, 25 bp, Mus musculus
ttgcggttgtgggtatcgataaaga

SEQ ID NO: 359615 - DNA, 25 bp, Mus musculus
gagcccagagtagggtctcgctcgc

SEQ ID NO: 359616 - DNA, 25 bp, Mus musculus
ggagcacgttgtgcccacggccaca

SEQ ID NO: 359617 - DNA, 25 bp, Mus musculus
ggctgccacagccatccaagaggcg

SEQ ID NO: 359618 - DNA, 25 bp, Mus musculus
ccaagaggcggctggtcttgttgca

SEQ ID NO: 359619 - DNA, 25 bp, Mus musculus
tggtcttgttgcaagcccggcctct

SEQ ID NO: 359620 - DNA, 25 bp, Mus musculus
cctctcgtgcctggggagcccagag

SEQ ID NO: 359621 - DNA, 25 bp, Mus musculus
ctcgctcgcagaagtcaggagactt

SEQ ID NO: 359622 - DNA, 25 bp, Mus musculus
gtcaggagacttctcaaagtaaacc

SEQ ID NO: 359623 - DNA, 25 bp, Mus musculus
tggaacgctccagagttgcggttgt

SEQ ID NO: 359624 - DNA, 25 bp, Mus musculus
cgtctgccggagcacgttgtgccca

SEQ ID NO: 359625 - DNA, 25 bp, Mus musculus
ggtatcgataaagatggctctgctc

SEQ ID NO: 359626 - DNA, 25 bp, Mus musculus
aaagatggctctgctcagccgctcc

SEQ ID NO: 359627 - DNA, 25 bp, Mus musculus
cagctctccagagaggcgccgcgga

SEQ ID NO: 359628 - DNA, 25 bp, Mus musculus
cttccaagggccgatttgggcttgg

SEQ ID NO: 359629 - DNA, 25 bp, Mus musculus
accaaagtagggtgcgcctgagctg

SEQ ID NO: 359630 - DNA, 25 bp, Mus musculus
ctgtttgccattgttcgcgcccatc

SEQ ID NO: 359631 - DNA, 25 bp, Mus musculus
cccgacgtcaccaaagtagggtgcg

SEQ ID NO: 359632 - DNA, 25 bp, Mus musculus
tcctccctggacactgcatagctgg

SEQ ID NO: 359633 - DNA, 25 bp, Mus musculus
gacactgcatagctggggcgcacct

SEQ ID NO: 359634 - DNA, 25 bp, Mus musculus
aggaccggacccttagctgcacatg

SEQ ID NO: 359635 - DNA, 25 bp, Mus musculus
agcaaccaccggagctctcagattc

SEQ ID NO: 359636 - DNA, 25 bp, Mus musculus
gagctctcagattccgcgctccggg

SEQ ID NO: 359637 - DNA, 25 bp, Mus musculus
ggacttttgttagcgccaggcgcct

SEQ ID NO: 359638 - DNA, 25 bp, Mus musculus
cgcccagcgtcaatcacagctggag

SEQ ID NO: 359639 - DNA, 25 bp, Mus musculus
actcgcgaaccctccggcgtgaagg

SEQ ID NO: 359640 - DNA, 25 bp, Mus musculus
gtgggactaggtccgctcctggcac

SEQ ID NO: 359641 - DNA, 25 bp, Mus musculus
tgcgcggccttttaaaggggcagca

SEQ ID NO: 359642 - DNA, 25 bp, Mus musculus
cggtgaccagatctagctgagcgca

SEQ ID NO: 359643 - DNA, 25 bp, Mus musculus
ctgacactcgtgaacggcgatgtgc

SEQ ID NO: 359644 - DNA, 25 bp, Mus musculus
agcgcagctcctggggaaattcccg

SEQ ID NO: 359645 - DNA, 25 bp, Mus musculus
tcgcgcagctggtgctgacactcgt

SEQ ID NO: 359646 - DNA, 25 bp, Mus musculus
gctcaccgactgaacaaagccaaga

SEQ ID NO: 359647 - DNA, 25 bp, Mus musculus
ccagctgtcgcttactcagtccgga

SEQ ID NO: 359648 - DNA, 25 bp, Mus musculus
ctcagtccggacagggtcaagcaca

SEQ ID NO: 359649 - DNA, 25 bp, Mus musculus
aagcacacggtgttggccgtcagcg

SEQ ID NO: 359650 - DNA, 25 bp, Mus musculus
agtttaaggcccagaatctcattgc

SEQ ID NO: 359651 - DNA, 25 bp, Mus musculus
ctcattgcttagagccctggggaca

SEQ ID NO: 359652 - DNA, 25 bp, Mus musculus
ccctggggacaagcgacaagggtct

SEQ ID NO: 359653 - DNA, 25 bp, Mus musculus
aagaacaggagacccgcgaggccta

SEQ ID NO: 359654 - DNA, 25 bp, Mus musculus
tccagtgccgagcagttccagcgct

SEQ ID NO: 359655 - DNA, 25 bp, Mus musculus
tccagcatgtcgaagcccggaggct

SEQ ID NO: 359656 - DNA, 25 bp, Mus musculus
ttgaccaggagaacgcagccgctcc

SEQ ID NO: 359657 - DNA, 25 bp, Mus musculus
tgctcgagctgacggaactgcggcc

SEQ ID NO: 359658 - DNA, 25 bp, Mus musculus
ttctgctcgagctgacggaactgcg

SEQ ID NO: 359659 - DNA, 25 bp, Mus musculus
actcacgggtggttctgctcgagct

SEQ ID NO: 359660 - DNA, 25 bp, Mus musculus
cgacctaactcacgggtggttctgc

SEQ ID NO: 359661 - DNA, 25 bp, Mus musculus
ctaactcacgggtggttctgctcga

SEQ ID NO: 359662 - DNA, 25 bp, Mus musculus
gagcgaacccgcgacgaagcaccgg

SEQ ID NO: 359663 - DNA, 25 bp, Mus musculus
ggctttggctctgctcgacctaact

SEQ ID NO: 359664 - DNA, 25 bp, Mus musculus
ttggctctgctcgacctaactcacg

SEQ ID NO: 359665 - DNA, 25 bp, Mus musculus
ggctctgctcgacctaactcacggg

SEQ ID NO: 359666 - DNA, 25 bp, Mus musculus
tctgctcgacctaactcacgggtgg

SEQ ID NO: 359667 - DNA, 25 bp, Mus musculus
gctcgacctaactcacgggtggttc

SEQ ID NO: 359668 - DNA, 25 bp, Mus musculus
ccctgacttgaccaggagaacgcag

SEQ ID NO: 359669 - DNA, 25 bp, Mus musculus
gacttgaccaggagaacgcagccgc

SEQ ID NO: 359670 - DNA, 25 bp, Mus musculus
gccagcctgggaactcgcatcactg

SEQ ID NO: 359671 - DNA, 25 bp, Mus musculus
atccaggctgcaaacaggttgtccc

SEQ ID NO: 359672 - DNA, 25 bp, Mus musculus
tccagacttattagagccagcctgg

SEQ ID NO: 359673 - DNA, 25 bp, Mus musculus
cagcagccaggacagcgaaccatgc

SEQ ID NO: 359674 - DNA, 25 bp, Mus musculus
gtgcctcccgcagtggctgcttcag

SEQ ID NO: 359675 - DNA, 25 bp, Mus musculus
gcgccgcaactataagaggcctata

SEQ ID NO: 359676 - DNA, 25 bp, Mus musculus
gggcagcctcttctcactgcagtca

SEQ ID NO: 359677 - DNA, 25 bp, Mus musculus
ccagtgcgccctggtgcttttagtg

SEQ ID NO: 359678 - DNA, 25 bp, Mus musculus
cactcattgtctgtggccctgacca

SEQ ID NO: 359679 - DNA, 25 bp, Mus musculus
agcttcgctcgccactcattgtctg

SEQ ID NO: 359680 - DNA, 25 bp, Mus musculus
tcagaccggcaagagccacagcttc

SEQ ID NO: 359681 - DNA, 25 bp, Mus musculus
tcagctctttgctcagaccggcaag

SEQ ID NO: 359682 - DNA, 25 bp, Mus musculus
ccgacggttagcctgtcagctcttt

SEQ ID NO: 359683 - DNA, 25 bp, Mus musculus
tcgcggacagcaaccacagtcgtca

SEQ ID NO: 359684 - DNA, 25 bp, Mus musculus
acacctggaccttggctgaagtttc

SEQ ID NO: 359685 - DNA, 25 bp, Mus musculus
gcgggacctacgcttcctcatgaac

SEQ ID NO: 359686 - DNA, 25 bp, Mus musculus
tcgtgggatgttggctttgaccttt

SEQ ID NO: 359687 - DNA, 25 bp, Mus musculus
tcgcccaacttctgcacgtacagtg

SEQ ID NO: 359688 - DNA, 25 bp, Mus musculus
tttacggcaaccgaggcagcaaccg

SEQ ID NO: 359689 - DNA, 25 bp, Mus musculus
ccgtgttctctgagatgcgccaaga

SEQ ID NO: 359690 - DNA, 25 bp, Mus musculus
ctgaagtttccacagcatcgacgtg

SEQ ID NO: 359691 - DNA, 25 bp, Mus musculus
tctcccgagcttagtcacacctgga

SEQ ID NO: 359692 - DNA, 25 bp, Mus musculus
atctcagcgggccattttgcacttc

SEQ ID NO: 359693 - DNA, 25 bp, Mus musculus
cagagtctggccgaatgtccctatc

SEQ ID NO: 359694 - DNA, 25 bp, Mus musculus
gcaggctatcaacacgtgggatgta

SEQ ID NO: 359695 - DNA, 25 bp, Mus musculus
ttggtcgcctctttggccgagagtt

SEQ ID NO: 359696 - DNA, 25 bp, Mus musculus
ggggctgcagtgacaacatcgattt

SEQ ID NO: 359697 - DNA, 25 bp, Mus musculus
ggctccatggcacacttttgaaaga

SEQ ID NO: 359698 - DNA, 25 bp, Mus musculus
taatacaaagaagggctcggcgcgc

SEQ ID NO: 359699 - DNA, 25 bp, Mus musculus
cggttggcgtggattaatacaaaga

SEQ ID NO: 359700 - DNA, 25 bp, Mus musculus
tttggaggtgtcaaggcaggaaacc

SEQ ID NO: 359701 - DNA, 25 bp, Mus musculus
tcaaggcaggaaaccggcgccggta

SEQ ID NO: 359702 - DNA, 25 bp, Mus musculus
gcgccggtaactagggatccagata

SEQ ID NO: 359703 - DNA, 25 bp, Mus musculus
gtaactagggatccagataactggc

SEQ ID NO: 359704 - DNA, 25 bp, Mus musculus
ccagataactggcagtgctggtgta

SEQ ID NO: 359705 - DNA, 25 bp, Mus musculus
taggggcactcgagcaccagcaacc

SEQ ID NO: 359706 - DNA, 25 bp, Mus musculus
ggcactcgagcaccagcaaccgggg

SEQ ID NO: 359707 - DNA, 25 bp, Mus musculus
cagcaaccgggggaatccgcgacct

SEQ ID NO: 359708 - DNA, 25 bp, Mus musculus
cccgtagtggctacagcgagtatca

SEQ ID NO: 359709 - DNA, 25 bp, Mus musculus
agtggctacagcgagtatcacaccc

SEQ ID NO: 359710 - DNA, 25 bp, Mus musculus
ctggtgtaggggcactcgagcacca

SEQ ID NO: 359711 - DNA, 25 bp, Mus musculus
cgtggattaatacaaagaagggctc

SEQ ID NO: 359712 - DNA, 25 bp, Mus musculus
agccctgactcggactcagtgtcac

SEQ ID NO: 359713 - DNA, 25 bp, Mus musculus
tattgcgaggtctgcagggtcagct

SEQ ID NO: 359714 - DNA, 25 bp, Mus musculus
cctggacaggctgccgaagcccaag

SEQ ID NO: 359715 - DNA, 25 bp, Mus musculus
cactattgcgaggtctgcagggtca

SEQ ID NO: 359716 - DNA, 25 bp, Mus musculus
ctctatgcactattgcgaggtctgc

SEQ ID NO: 359717 - DNA, 25 bp, Mus musculus
gccgccctctatgcactattgcgag

SEQ ID NO: 359718 - DNA, 25 bp, Mus musculus
aggccgccctctatgcactattgcg

SEQ ID NO: 359719 - DNA, 25 bp, Mus musculus
atgcgctgccgttcctggacaggct

SEQ ID NO: 359720 - DNA, 25 bp, Mus musculus
ccagcgatgcgctgccgttcctgga

SEQ ID NO: 359721 - DNA, 25 bp, Mus musculus
ctttaccagcgatgcgctgccgttc

SEQ ID NO: 359722 - DNA, 25 bp, Mus musculus
tgactcggactcagtgtcacccggc

SEQ ID NO: 359723 - DNA, 25 bp, Mus musculus
cgcagccctgactcggactcagtgt

SEQ ID NO: 359724 - DNA, 25 bp, Mus musculus
tgggaccccacctttaccagcgatg

SEQ ID NO: 359725 - DNA, 25 bp, Mus musculus
tgccgttcctggacaggctgccgaa

SEQ ID NO: 359726 - DNA, 25 bp, Mus musculus
gcgggttcacttctccgacagggaa

SEQ ID NO: 359727 - DNA, 25 bp, Mus musculus
cgcttccatcagaggagccgctatg

SEQ ID NO: 359728 - DNA, 25 bp, Mus musculus
agatgccttctctaccagcgggacc

SEQ ID NO: 359729 - DNA, 25 bp, Mus musculus
tggcgtcaatgacaaagatgccttc

SEQ ID NO: 359730 - DNA, 25 bp, Mus musculus
tgggactttatcaccacgcatgtgg

SEQ ID NO: 359731 - DNA, 25 bp, Mus musculus
cacgagctgaccctgctgggttcga

SEQ ID NO: 359732 - DNA, 25 bp, Mus musculus
taaggctgtcgctcacactgcacga

SEQ ID NO: 359733 - DNA, 25 bp, Mus musculus
gctcaacagtcgcttttggcaaact

SEQ ID NO: 359734 - DNA, 25 bp, Mus musculus
aggagcgctcctccaatgaagaatc

SEQ ID NO: 359735 - DNA, 25 bp, Mus musculus
gagcccttcaagctgccggcgcata

SEQ ID NO: 359736 - DNA, 25 bp, Mus musculus
gcagggtcctctcattccgccagga

SEQ ID NO: 359737 - DNA, 25 bp, Mus musculus
agccgctatggacgctgagatcctc

SEQ ID NO: 359738 - DNA, 25 bp, Mus musculus
cctcgctcggttggtttaagactcg

SEQ ID NO: 359739 - DNA, 25 bp, Mus musculus
tgagatcctccgcttcgtctgagtc

SEQ ID NO: 359740 - DNA, 25 bp, Mus musculus
cccgaagcgctctggtctggagaaa

SEQ ID NO: 359741 - DNA, 25 bp, Mus musculus
gccttgcgcctttttctctcggtct

SEQ ID NO: 359742 - DNA, 25 bp, Mus musculus
cagccttgcgcctttttctctcggt

SEQ ID NO: 359743 - DNA, 25 bp, Mus musculus
gctgacctaggggactccgtcgggc

SEQ ID NO: 359744 - DNA, 25 bp, Mus musculus
accctgtaggttgggctgcccgaag

SEQ ID NO: 359745 - DNA, 25 bp, Mus musculus
tggaaaccctgtaggttgggctgcc

SEQ ID NO: 359746 - DNA, 25 bp, Mus musculus
tctggagaaaactggaaaccctgta

SEQ ID NO: 359747 - DNA, 25 bp, Mus musculus
gaagcgctctggtctggagaaaact

SEQ ID NO: 359748 - DNA, 25 bp, Mus musculus
cgaagcgctctggtctggagaaaac

SEQ ID NO: 359749 - DNA, 25 bp, Mus musculus
tttttctctcggtctccttggcctc

SEQ ID NO: 359750 - DNA, 25 bp, Mus musculus
ctcggtctccttggcctcccgctcc

SEQ ID NO: 359751 - DNA, 25 bp, Mus musculus
ccgctcctgcgacgccgcctttctt

SEQ ID NO: 359752 - DNA, 25 bp, Mus musculus
agcacggatggtcggggcgctcgcc

SEQ ID NO: 359753 - DNA, 25 bp, Mus musculus
gcgcctttttctctcggtctccttg

SEQ ID NO: 359754 - DNA, 25 bp, Mus musculus
tccttcgcggaaaattcaattctcg

SEQ ID NO: 359755 - DNA, 25 bp, Mus musculus
ctgatcaggacacgacctaaacttg

SEQ ID NO: 359756 - DNA, 25 bp, Mus musculus
ccttcggagtggcagagaaagctcc

SEQ ID NO: 359757 - DNA, 25 bp, Mus musculus
cagcttggaaagctccctggcgcca

SEQ ID NO: 359758 - DNA, 25 bp, Mus musculus
tcggaaaggacttgaggcactcatg

SEQ ID NO: 359759 - DNA, 25 bp, Mus musculus
gctctcatgcaaacttcggaaagga

SEQ ID NO: 359760 - DNA, 25 bp, Mus musculus
aagccgggctcgctcacctaatacg

SEQ ID NO: 359761 - DNA, 25 bp, Mus musculus
gcaatcgcacaaacggggtcctgga

SEQ ID NO: 359762 - DNA, 25 bp, Mus musculus
agtggcctcctggattccttccttc

SEQ ID NO: 359763 - DNA, 25 bp, Mus musculus
gcatgcacagcgtcactgatcagga

SEQ ID NO: 359764 - DNA, 25 bp, Mus musculus
tcgccaagaacgagctgtcaacacg

SEQ ID NO: 359765 - DNA, 25 bp, Mus musculus
ccgcatctgtaaagagccgagccga

SEQ ID NO: 359766 - DNA, 25 bp, Mus musculus
tcctgcgaatgaggtcggtcaaaca

SEQ ID NO: 359767 - DNA, 25 bp, Mus musculus
ctcgcaggatgccaacaattgctta

SEQ ID NO: 359768 - DNA, 25 bp, Mus musculus
ggggttggaccatgcacctctagac

SEQ ID NO: 359769 - DNA, 25 bp, Mus musculus
gggttggaccatgcacctctagacc

SEQ ID NO: 359770 - DNA, 25 bp, Mus musculus
ccgctgaccacaggcggccaggccg

SEQ ID NO: 359771 - DNA, 25 bp, Mus musculus
gcactactttcctctccggttgcaa

SEQ ID NO: 359772 - DNA, 25 bp, Mus musculus
gctgcactactttcctctccggttg

SEQ ID NO: 359773 - DNA, 25 bp, Mus musculus
cactactttcctctccggttgcaaa

SEQ ID NO: 359774 - DNA, 25 bp, Mus musculus
aaatggctgcctcgttccccacttt

SEQ ID NO: 359775 - DNA, 25 bp, Mus musculus
ggttgcaaatggctgcctcgttccc

SEQ ID NO: 359776 - DNA, 25 bp, Mus musculus
agccggggttggaccatgcacctct

SEQ ID NO: 359777 - DNA, 25 bp, Mus musculus
gggtgccgctgaccacaggcggcca

SEQ ID NO: 359778 - DNA, 25 bp, Mus musculus
tagaccccccgcgatcagtgcctgc

SEQ ID NO: 359779 - DNA, 25 bp, Mus musculus
ggttggaccatgcacctctagaccc

SEQ ID NO: 359780 - DNA, 25 bp, Mus musculus
ccggttgcaaatggctgcctcgttc

SEQ ID NO: 359781 - DNA, 25 bp, Mus musculus
cccactttccgctcagtttcctgac

SEQ ID NO: 359782 - DNA, 25 bp, Mus musculus
cctcttggaggaaaggctgtgactc

SEQ ID NO: 359783 - DNA, 25 bp, Mus musculus
ggctgtgactctgcagttctacgca

SEQ ID NO: 359784 - DNA, 25 bp, Mus musculus
gggatccctccgctgcagattaacc

SEQ ID NO: 359785 - DNA, 25 bp, Mus musculus
ccgggcagacacgtgggaataaagc

SEQ ID NO: 359786 - DNA, 25 bp, Mus musculus
agttctacgcacacgctccgggatc

SEQ ID NO: 359787 - DNA, 25 bp, Mus musculus
gtggttcctgcgaagaggctctttc

SEQ ID NO: 359788 - DNA, 25 bp, Mus musculus
ggtacagccctcttggaggaaaggc

SEQ ID NO: 359789 - DNA, 25 bp, Mus musculus
aggaggccctattttgtgttggagc

SEQ ID NO: 359790 - DNA, 25 bp, Mus musculus
ggccgaacctgacacacacccagcg

SEQ ID NO: 359791 - DNA, 25 bp, Mus musculus
gaagaggctctttcctcgccttgga

SEQ ID NO: 359792 - DNA, 25 bp, Mus musculus
tctttcctcgccttggagctgggca

SEQ ID NO: 359793 - DNA, 25 bp, Mus musculus
ctgggcagcgatcgtagagactcgt

SEQ ID NO: 359794 - DNA, 25 bp, Mus musculus
atcgtagagactcgtggagcgtccg

SEQ ID NO: 359795 - DNA, 25 bp, Mus musculus
aggagaagaggaggccctattttgt

SEQ ID NO: 359796 - DNA, 25 bp, Mus musculus
actatggtgaaattcccggcgctca

SEQ ID NO: 359797 - DNA, 25 bp, Mus musculus
ttgtcgagggtgacttttgcagcgc

SEQ ID NO: 359798 - DNA, 25 bp, Mus musculus
atttgacgtggctttgcggcttgtc

SEQ ID NO: 359799 - DNA, 25 bp, Mus musculus
cctttaccctggaccatttgacgtg

SEQ ID NO: 359800 - DNA, 25 bp, Mus musculus
tcggcatcaccaacatagccatcga

SEQ ID NO: 359801 - DNA, 25 bp, Mus musculus
tctcctgctagagcagcagcgcttg

SEQ ID NO: 359802 - DNA, 25 bp, Mus musculus
ggatggacttgagctcgcggctctc

SEQ ID NO: 359803 - DNA, 25 bp, Mus musculus
cccggcagatctttgttgtgtggga

SEQ ID NO: 359804 - DNA, 25 bp, Mus musculus
gcttataatggagccgctgtcagca

SEQ ID NO: 359805 - DNA, 25 bp, Mus musculus
gggcccagagcgcttataatggagc

SEQ ID NO: 359806 - DNA, 25 bp, Mus musculus
tcgtgcgcgcggttatttatttatt

SEQ ID NO: 359807 - DNA, 25 bp, Mus musculus
ttcccaactctggagacggcgctca

SEQ ID NO: 359808 - DNA, 25 bp, Mus musculus
gaagctctactcctggttcccaact

SEQ ID NO: 359809 - DNA, 25 bp, Mus musculus
agccatcgacttcggggagcaggta

SEQ ID NO: 359810 - DNA, 25 bp, Mus musculus
cctgtagcgcaccagcggcatgaca

SEQ ID NO: 359811 - DNA, 25 bp, Mus musculus
gggcagcccacgtgatcacaacaca

SEQ ID NO: 359812 - DNA, 25 bp, Mus musculus
caagacgagcgggatacctagccgg

SEQ ID NO: 359813 - DNA, 25 bp, Mus musculus
acctacggagcggtaccctaggatg

SEQ ID NO: 359814 - DNA, 25 bp, Mus musculus
acgtgatcacaacacagcggctgta

SEQ ID NO: 359815 - DNA, 25 bp, Mus musculus
ttctggccacaaagcaaccgtgctc

SEQ ID NO: 359816 - DNA, 25 bp, Mus musculus
agctacgcccggcaagccaaggaaa

SEQ ID NO: 359817 - DNA, 25 bp, Mus musculus
agctcgctgaagctacgcccggcaa

SEQ ID NO: 359818 - DNA, 25 bp, Mus musculus
actctgggaagaagagtagctcgct

SEQ ID NO: 359819 - DNA, 25 bp, Mus musculus
acccgaagatcagccgaggtgcagg

SEQ ID NO: 359820 - DNA, 25 bp, Mus musculus
ccgagggaacccgaagatcagccga

SEQ ID NO: 359821 - DNA, 25 bp, Mus musculus
aggatggccaccttcctgtagcgca

SEQ ID NO: 359822 - DNA, 25 bp, Mus musculus
aaagcaaccgtgctctcgggagggc

SEQ ID NO: 359823 - DNA, 25 bp, Mus musculus
cacagcggctgtacgcaagggagct

SEQ ID NO: 359824 - DNA, 25 bp, Mus musculus
cagcagcgtcccgtgcgcagtgagc

SEQ ID NO: 359825 - DNA, 25 bp, Mus musculus
tgggcccactggtgactctctagaa

SEQ ID NO: 359826 - DNA, 25 bp, Mus musculus
tggtgactctctagaaccgcgtagc

SEQ ID NO: 359827 - DNA, 25 bp, Mus musculus
tctagaaccgcgtagcaggaggcga

SEQ ID NO: 359828 - DNA, 25 bp, Mus musculus
gaggacgtcgttgaccagcagcgtc

SEQ ID NO: 359829 - DNA, 25 bp, Mus musculus
agatgccagggtgtgagcaacagtt

SEQ ID NO: 359830 - DNA, 25 bp, Mus musculus
cgagcagcgaacaccagatgccagg

SEQ ID NO: 359831 - DNA, 25 bp, Mus musculus
ccggtgcaaagtcacctggagcagg

SEQ ID NO: 359832 - DNA, 25 bp, Mus musculus
cggcgcgcgaacaccggtgcaaagt

SEQ ID NO: 359833 - DNA, 25 bp, Mus musculus
gccagcacgtaagcggcgcgcgaac

SEQ ID NO: 359834 - DNA, 25 bp, Mus musculus
gcaccgagtcgccagcacgtaagcg

SEQ ID NO: 359835 - DNA, 25 bp, Mus musculus
cgcagtgagcggtgcgaacacgccc

SEQ ID NO: 359836 - DNA, 25 bp, Mus musculus
agcggtgcgaacacgcccacggctt

SEQ ID NO: 359837 - DNA, 25 bp, Mus musculus
tggcccgcgagcagcgaacaccaga

SEQ ID NO: 359838 - DNA, 25 bp, Mus musculus
tggctagagcgttcacccgctcttt

SEQ ID NO: 359839 - DNA, 25 bp, Mus musculus
gagcgttcacccgctctttgcaacg

SEQ ID NO: 359840 - DNA, 25 bp, Mus musculus
agagcgttcacccgctctttgcaac

SEQ ID NO: 359841 - DNA, 25 bp, Mus musculus
ctagagcgttcacccgctctttgca

SEQ ID NO: 359842 - DNA, 25 bp, Mus musculus
ggctagagcgttcacccgctctttg

SEQ ID NO: 359843 - DNA, 25 bp, Mus musculus
atggctagagcgttcacccgctctt

SEQ ID NO: 359844 - DNA, 25 bp, Mus musculus
gatggctagagcgttcacccgctct

SEQ ID NO: 359845 - DNA, 25 bp, Mus musculus
gcgatggctagagcgttcacccgct

SEQ ID NO: 359846 - DNA, 25 bp, Mus musculus
cgcgatggctagagcgttcacccgc

SEQ ID NO: 359847 - DNA, 25 bp, Mus musculus
ccgcgatggctagagcgttcacccg

SEQ ID NO: 359848 - DNA, 25 bp, Mus musculus
accgcgatggctagagcgttcaccc

SEQ ID NO: 359849 - DNA, 25 bp, Mus musculus
caccgcgatggctagagcgttcacc

SEQ ID NO: 359850 - DNA, 25 bp, Mus musculus
tcaccgcgatggctagagcgttcac

SEQ ID NO: 359851 - DNA, 25 bp, Mus musculus
gctagagcgttcacccgctctttgc

SEQ ID NO: 359852 - DNA, 25 bp, Mus musculus
cacggccttcgtagtggagtgaatc

SEQ ID NO: 359853 - DNA, 25 bp, Mus musculus
cgtactccgggccacatgttcatca

SEQ ID NO: 359854 - DNA, 25 bp, Mus musculus
gggccacatgttcatcaccgcgatg

SEQ ID NO: 359855 - DNA, 25 bp, Mus musculus
tcagtcacacgtaggcgtactccgg

SEQ ID NO: 359856 - DNA, 25 bp, Mus musculus
gtcccagccttcagtcacacgtagg

SEQ ID NO: 359857 - DNA, 25 bp, Mus musculus
cttcgtagtggagtgaatcctgtgc

SEQ ID NO: 359858 - DNA, 25 bp, Mus musculus
ggttgcgggactcgtagtagaccca

SEQ ID NO: 359859 - DNA, 25 bp, Mus musculus
tggtgatgtccaaggcacggccttc

SEQ ID NO: 359860 - DNA, 25 bp, Mus musculus
tcacggtcagacgtggtgatgtcca

SEQ ID NO: 359861 - DNA, 25 bp, Mus musculus
ccatacttattacggtcacggtcag

SEQ ID NO: 359862 - DNA, 25 bp, Mus musculus
taggcgcgccaacaaaccatactta

SEQ ID NO: 359863 - DNA, 25 bp, Mus musculus
aatccggcttccacagctaggcgcg

SEQ ID NO: 359864 - DNA, 25 bp, Mus musculus
agtagacccagtcgaatccggcttc

SEQ ID NO: 359865 - DNA, 25 bp, Mus musculus
aatcctgtgcgtggtggccgtcctc

SEQ ID NO: 359866 - DNA, 25 bp, Mus musculus
caaactgcttgtatagcagaggcac

SEQ ID NO: 359867 - DNA, 25 bp, Mus musculus
ggcacaagttgcttgcgcacataac

SEQ ID NO: 359868 - DNA, 25 bp, Mus musculus
cgctggcccactcgcgcccagggtc

SEQ ID NO: 359869 - DNA, 25 bp, Mus musculus
gcccagggtccgctcgggcatactg

SEQ ID NO: 359870 - DNA, 25 bp, Mus musculus
cgctcgggcatactgggcacaaact

SEQ ID NO: 359871 - DNA, 25 bp, Mus musculus
gggcatactgggcacaaactgcttg

SEQ ID NO: 359872 - DNA, 25 bp, Mus musculus
ctcatccttgaagattatgtcgggg

SEQ ID NO: 359873 - DNA, 25 bp, Mus musculus
actgggcacaaactgcttgtatagc

SEQ ID NO: 359874 - DNA, 25 bp, Mus musculus
atccttgaagattatgtcggggttg

SEQ ID NO: 359875 - DNA, 25 bp, Mus musculus
ttgcttgcgcacataacgccgccgg

SEQ ID NO: 359876 - DNA, 25 bp, Mus musculus
tacgaggtcccggaagcgctccgac

SEQ ID NO: 359877 - DNA, 25 bp, Mus musculus
cttgtatagcagaggcacaagttgc

SEQ ID NO: 359878 - DNA, 25 bp, Mus musculus
cagaggcacaagttgcttgcgcaca

SEQ ID NO: 359879 - DNA, 25 bp, Mus musculus
aagttgcttgcgcacataacgccgc

SEQ ID NO: 359880 - DNA, 25 bp, Mus musculus
agccttgcaagttgctccgagttga

SEQ ID NO: 359881 - DNA, 25 bp, Mus musculus
tggcacctgtgcccagatgcacgtg

SEQ ID NO: 359882 - DNA, 25 bp, Mus musculus
gtgtacgcgtctcactggcgccctt

SEQ ID NO: 359883 - DNA, 25 bp, Mus musculus
aggcaccagcacaggtgtacgcgtc

SEQ ID NO: 359884 - DNA, 25 bp, Mus musculus
actgcagggcccttgtgcaccacag

SEQ ID NO: 359885 - DNA, 25 bp, Mus musculus
tgcaagtctctgagtgcgcgagtcc

SEQ ID NO: 359886 - DNA, 25 bp, Mus musculus
ttttttctgggtgcggcgtgcaagt

SEQ ID NO: 359887 - DNA, 25 bp, Mus musculus
tggcgcccttgtcgcacacacgggg

SEQ ID NO: 359888 - DNA, 25 bp, Mus musculus
ccgagttgagccactgggtgctcga

SEQ ID NO: 359889 - DNA, 25 bp, Mus musculus
cccaaaatgaggaagccttgcaagt

SEQ ID NO: 359890 - DNA, 25 bp, Mus musculus
gtcttagtgagaccggcgctaggac

SEQ ID NO: 359891 - DNA, 25 bp, Mus musculus
gtactcagcactctgcccggacgga

SEQ ID NO: 359892 - DNA, 25 bp, Mus musculus
agcacccggcacttggtactcagca

SEQ ID NO: 359893 - DNA, 25 bp, Mus musculus
cactgggtgctcgacccgctggcag

SEQ ID NO: 359894 - DNA, 25 bp, Mus musculus
ggtttcttcagaggagcggaactta

SEQ ID NO: 359895 - DNA, 25 bp, Mus musculus
ttactggttcctcgtagactgtcgg

SEQ ID NO: 359896 - DNA, 25 bp, Mus musculus
gtgcccagtgacgacacaaggcctg

SEQ ID NO: 359897 - DNA, 25 bp, Mus musculus
ggggtcactcgcaagcacgtttcaa

SEQ ID NO: 359898 - DNA, 25 bp, Mus musculus
agcccgcctagtcttaaagggctcg

SEQ ID NO: 359899 - DNA, 25 bp, Mus musculus
aactcaaggtaatctggggctcaga

SEQ ID NO: 359900 - DNA, 25 bp, Mus musculus
ctgcccgtgacggaaactcaaggta

SEQ ID NO: 359901 - DNA, 25 bp, Mus musculus
atactctgctcagcatgactggggc

SEQ ID NO: 359902 - DNA, 25 bp, Mus musculus
cacttcgtagtcagctgcttccata

SEQ ID NO: 359903 - DNA, 25 bp, Mus musculus
gttctcgcacggatagcacttcgta

SEQ ID NO: 359904 - DNA, 25 bp, Mus musculus
accctgtcgtggaacagctgttctc

SEQ ID NO: 359905 - DNA, 25 bp, Mus musculus
aggtcccggactcacgatgcactcg

SEQ ID NO: 359906 - DNA, 25 bp, Mus musculus
tttgtttacggctcagggacccagc

SEQ ID NO: 359907 - DNA, 25 bp, Mus musculus
agactgtcggtcatcgctaggagtg

SEQ ID NO: 359908 - DNA, 25 bp, Mus musculus
ctccgagcctcttaagtagcagctg

SEQ ID NO: 359909 - DNA, 25 bp, Mus musculus
gttccagtaagatccgagtgcgccc

SEQ ID NO: 359910 - DNA, 25 bp, Mus musculus
ccgccgctctcaggcgggaatgtaa

SEQ ID NO: 359911 - DNA, 25 bp, Mus musculus
tcgaggtaagtaacgcaatgaggcg

SEQ ID NO: 359912 - DNA, 25 bp, Mus musculus
cgttcccgacaactaagagtcgagg

SEQ ID NO: 359913 - DNA, 25 bp, Mus musculus
ccatgatagcaacgggttagaaggc

SEQ ID NO: 359914 - DNA, 25 bp, Mus musculus
gtgtgataattggagaccgggttcc

SEQ ID NO: 359915 - DNA, 25 bp, Mus musculus
gcacgttccgtgcagggtgtgataa

SEQ ID NO: 359916 - DNA, 25 bp, Mus musculus
gtgcaatctgaacgcgccatgctgc

SEQ ID NO: 359917 - DNA, 25 bp, Mus musculus
ccgagcgggaagagtgcaatctgaa

SEQ ID NO: 359918 - DNA, 25 bp, Mus musculus
cgcgtgcccgaaaagcagcaagcaa

SEQ ID NO: 359919 - DNA, 25 bp, Mus musculus
gccttttcgcaggatagagaaagtg

SEQ ID NO: 359920 - DNA, 25 bp, Mus musculus
ggaatgtaacggttgcgcatgcgcc

SEQ ID NO: 359921 - DNA, 25 bp, Mus musculus
agatagaagcagacaccgggtctcg

SEQ ID NO: 359922 - DNA, 25 bp, Mus musculus
tgctcaccatggttgctgcttcgcg

SEQ ID NO: 359923 - DNA, 25 bp, Mus musculus
agccggggaaggcttgctcaccatg

SEQ ID NO: 359924 - DNA, 25 bp, Mus musculus
aacattttcctagcgaagtggggcg

SEQ ID NO: 359925 - DNA, 25 bp, Mus musculus
tcgatgtaagagaacctgcggcact

SEQ ID NO: 359926 - DNA, 25 bp, Mus musculus
gcgcgactcttaggcggtcgatgta

SEQ ID NO: 359927 - DNA, 25 bp, Mus musculus
aggaggaggtgttgcttcttacagc

SEQ ID NO: 359928 - DNA, 25 bp, Mus musculus
tttccttgcagatctggggcgactg

SEQ ID NO: 359929 - DNA, 25 bp, Mus musculus
gcgctagctcatcggcgctgccttt

SEQ ID NO: 359930 - DNA, 25 bp, Mus musculus
ccgcagaggtgaccaaagccttaga

SEQ ID NO: 359931 - DNA, 25 bp, Mus musculus
gcgctgcctttgttcttcccggtct

SEQ ID NO: 359932 - DNA, 25 bp, Mus musculus
cttaaagcatggagaccaccctttc

SEQ ID NO: 359933 - DNA, 25 bp, Mus musculus
gcggcgggactcaaagactaagata

SEQ ID NO: 359934 - DNA, 25 bp, Mus musculus
cctctatctaccgagagccggggaa

SEQ ID NO: 359935 - DNA, 25 bp, Mus musculus
gttgcttcttacagcgcgactctta

SEQ ID NO: 359936 - DNA, 25 bp, Mus musculus
aattaagctgcacaagccaccagga

SEQ ID NO: 359937 - DNA, 25 bp, Mus musculus
ggcctgaggtagaaatgcaaaattg

SEQ ID NO: 359938 - DNA, 25 bp, Mus musculus
accaagtcgatgcgggacatgatcc

SEQ ID NO: 359939 - DNA, 25 bp, Mus musculus
gcacaccaagtcgatgcgggacatg

SEQ ID NO: 359940 - DNA, 25 bp, Mus musculus
ggcggcagtcaagaattgatgaacc

SEQ ID NO: 359941 - DNA, 25 bp, Mus musculus
aatgcaaaattggagagcagcagcc

SEQ ID NO: 359942 - DNA, 25 bp, Mus musculus
aggaaggcggcagtcaagaattgat

SEQ ID NO: 359943 - DNA, 25 bp, Mus musculus
tgaggcctgaggtagaaatgcaaaa

SEQ ID NO: 359944 - DNA, 25 bp, Mus musculus
tctttgaggcctgaggtagaaatgc

SEQ ID NO: 359945 - DNA, 25 bp, Mus musculus
ctcctggtctttgaggcctgaggta

SEQ ID NO: 359946 - DNA, 25 bp, Mus musculus
caccaggaggttcacctgggtctcc

SEQ ID NO: 359947 - DNA, 25 bp, Mus musculus
gaattaagctgcacaagccaccagg

SEQ ID NO: 359948 - DNA, 25 bp, Mus musculus
tcaagaattgatgaacccggggctg

SEQ ID NO: 359949 - DNA, 25 bp, Mus musculus
ggtctcctggtctttgaggcctgag

SEQ ID NO: 359950 - DNA, 25 bp, Mus musculus
atcctcctgggagagcatcccgtct

SEQ ID NO: 359951 - DNA, 25 bp, Mus musculus
gtggcccggccagggtatataagcc

SEQ ID NO: 359952 - DNA, 25 bp, Mus musculus
tatataagccctgtcctggaggcgg

SEQ ID NO: 359953 - DNA, 25 bp, Mus musculus
tggaggcggaccttacacagcttct

SEQ ID NO: 359954 - DNA, 25 bp, Mus musculus
cccggactccttggtagtctgttag

SEQ ID NO: 359955 - DNA, 25 bp, Mus musculus
gggagatcttcgtcaccctttttca

SEQ ID NO: 359956 - DNA, 25 bp, Mus musculus
tcacttcctcagttttcgcggacca

SEQ ID NO: 359957 - DNA, 25 bp, Mus musculus
cgcggaccacttcaaggactaaata

SEQ ID NO: 359958 - DNA, 25 bp, Mus musculus
cccgggagacgatacctgcaatagc

SEQ ID NO: 359959 - DNA, 25 bp, Mus musculus
gacggccgcctccagttagactggc

SEQ ID NO: 359960 - DNA, 25 bp, Mus musculus
cagttagactggcttctggcgtttg

SEQ ID NO: 359961 - DNA, 25 bp, Mus musculus
tgtgagagcctagtccactaaacta

SEQ ID NO: 359962 - DNA, 25 bp, Mus musculus
actaaactagtgtcgctttgggctg

SEQ ID NO: 359963 - DNA, 25 bp, Mus musculus
gatcctctgtctcgatcctcctggg

SEQ ID NO: 359964 - DNA, 25 bp, Mus musculus
gttacaggagctcaacgaccgcttc

SEQ ID NO: 359965 - DNA, 25 bp, Mus musculus
gccaagcgctgaatgccatcttccg

SEQ ID NO: 359966 - DNA, 25 bp, Mus musculus
atcttccgccagcatgagccatcat

SEQ ID NO: 359967 - DNA, 25 bp, Mus musculus
gagccatcatcactcgtcgggcctg

SEQ ID NO: 359968 - DNA, 25 bp, Mus musculus
tcgggcctgcggtccagcatcagct

SEQ ID NO: 359969 - DNA, 25 bp, Mus musculus
ggggctttctcctactcgtccagct

SEQ ID NO: 359970 - DNA, 25 bp, Mus musculus
agcgcctcgatttctccatggccga

SEQ ID NO: 359971 - DNA, 25 bp, Mus musculus
ccggcctagttctgccaagcgctga

SEQ ID NO: 359972 - DNA, 25 bp, Mus musculus
agttcctggccactcggagcaacga

SEQ ID NO: 359973 - DNA, 25 bp, Mus musculus
tcggagcaacgagaagcaagagtta

SEQ ID NO: 359974 - DNA, 25 bp, Mus musculus
cgccgaccagctttgccagcaggag

SEQ ID NO: 359975 - DNA, 25 bp, Mus musculus
acctagcggcgctcaagcagaggtc

SEQ ID NO: 359976 - DNA, 25 bp, Mus musculus
ggccgaggccctcaaccaagagttc

SEQ ID NO: 359977 - DNA, 25 bp, Mus musculus
gagaccgcagggctataaagccgcc

SEQ ID NO: 359978 - DNA, 25 bp, Mus musculus
cgaggtccgcagagcgcttccgtaa

SEQ ID NO: 359979 - DNA, 25 bp, Mus musculus
tctcggcgcagcttgcaccgggcca

SEQ ID NO: 359980 - DNA, 25 bp, Mus musculus
cttgcaccgggccacgctccgggct

SEQ ID NO: 359981 - DNA, 25 bp, Mus musculus
ctcatccgcggccacgccgggccct

SEQ ID NO: 359982 - DNA, 25 bp, Mus musculus
cgcgccggccgtcaccttcccgccg

SEQ ID NO: 359983 - DNA, 25 bp, Mus musculus
tccgcagagcgcttccgtaagcgtc

SEQ ID NO: 359984 - DNA, 25 bp, Mus musculus
gagcgcttccgtaagcgtcactgtg

SEQ ID NO: 359985 - DNA, 25 bp, Mus musculus
gcttccgtaagcgtcactgtggccc

SEQ ID NO: 359986 - DNA, 25 bp, Mus musculus
ttccgtaagcgtcactgtggcccgc

SEQ ID NO: 359987 - DNA, 25 bp, Mus musculus
gccccgcgacctttgacctgcagca

SEQ ID NO: 359988 - DNA, 25 bp, Mus musculus
ggcgagaggctaggggacctggaac

SEQ ID NO: 359989 - DNA, 25 bp, Mus musculus
cctgcgcagagcggatttgagccgc

SEQ ID NO: 359990 - DNA, 25 bp, Mus musculus
gcgccgtgtgcccactgcgcatgtc

SEQ ID NO: 359991 - DNA, 25 bp, Mus musculus
ctggggcatggttccccgactcatc

SEQ ID NO: 359992 - DNA, 25 bp, Mus musculus
cgcggcaaagaatctgcaggaggca

SEQ ID NO: 359993 - DNA, 25 bp, Mus musculus
cgctgagggacatccgtgcacagta

SEQ ID NO: 359994 - DNA, 25 bp, Mus musculus
cagtacgagaacatcgcggcaaaga

SEQ ID NO: 359995 - DNA, 25 bp, Mus musculus
cagaggagtggtataagtcgaaagt

SEQ ID NO: 359996 - DNA, 25 bp, Mus musculus
taagtcgaaagtgcgagagcattgg

SEQ ID NO: 359997 - DNA, 25 bp, Mus musculus
ggcttgtctgctaccgcgcagtatg

SEQ ID NO: 359998 - DNA, 25 bp, Mus musculus
atgctgacctgtcggacgccgccaa

SEQ ID NO: 359999 - DNA, 25 bp, Mus musculus
cgccaaccgcaaccatgaggcccta

SEQ ID NO: 360000 - DNA, 25 bp, Mus musculus
aggccctacgccaggccaagcaaga

SEQ ID NO: 360001 - DNA, 25 bp, Mus musculus
gccaagcaagagatgaacgagtctc

SEQ ID NO: 360002 - DNA, 25 bp, Mus musculus
aacgagtctcgacgtcagatccaga

SEQ ID NO: 360003 - DNA, 25 bp, Mus musculus
cagatccagagtctgatgtgcgagg

SEQ ID NO: 360004 - DNA, 25 bp, Mus musculus
ctaccgcgcagtatgctgacctgtc

SEQ ID NO: 360005 - DNA, 25 bp, Mus musculus
tccgtgcacagtacgagaacatcgc

SEQ ID NO: 360006 - DNA, 25 bp, Mus musculus
cagccaatcaggagcttggcgtatt

SEQ ID NO: 360007 - DNA, 25 bp, Mus musculus
tcagagtgtggtcaacagtggtctc

SEQ ID NO: 360008 - DNA, 25 bp, Mus musculus
cagtggtctcgatggccaatctttc

SEQ ID NO: 360009 - DNA, 25 bp, Mus musculus
cacaattccgcggtcttcatgaggg

SEQ ID NO: 360010 - DNA, 25 bp, Mus musculus
ctctcgcgagagtacggtaatgccc

SEQ ID NO: 360011 - DNA, 25 bp, Mus musculus
gtaatgcccgttgcagtccagactg

SEQ ID NO: 360012 - DNA, 25 bp, Mus musculus
ttcagaacagcatcctccctggctt

SEQ ID NO: 360013 - DNA, 25 bp, Mus musculus
ctccgtcctcggattggccgagaga

SEQ ID NO: 360014 - DNA, 25 bp, Mus musculus
agagctggtcagttgttctcccatc

SEQ ID NO: 360015 - DNA, 25 bp, Mus musculus
tctcccatcaagaaaacgtttcggc

SEQ ID NO: 360016 - DNA, 25 bp, Mus musculus
tgtgacgtcacgaccctccgagtca

SEQ ID NO: 360017 - DNA, 25 bp, Mus musculus
gcagaagcagaaacccaagaaatcg

SEQ ID NO: 360018 - DNA, 25 bp, Mus musculus
cggccgtgcactacgttcagagtgt

SEQ ID NO: 360019 - DNA, 25 bp, Mus musculus
tttcggcgactagtccttctctggc

SEQ ID NO: 360020 - DNA, 25 bp, Mus musculus
ggcgcctgaaacctgcagcttcttg

SEQ ID NO: 360021 - DNA, 25 bp, Mus musculus
ccctcgggtgcagttctaatgattc

SEQ ID NO: 360022 - DNA, 25 bp, Mus musculus
acgcgacctcgtcagagattttgca

SEQ ID NO: 360023 - DNA, 25 bp, Mus musculus
agacagttgctttcttgcggacagc

SEQ ID NO: 360024 - DNA, 25 bp, Mus musculus
gctcgtggaaagcactacctgcctc

SEQ ID NO: 360025 - DNA, 25 bp, Mus musculus
cggctggtttctcacaggtctaaga

SEQ ID NO: 360026 - DNA, 25 bp, Mus musculus
gccgcggcgaattccttctgtgaca

SEQ ID NO: 360027 - DNA, 25 bp, Mus musculus
tcctcctcacttttgggcgcaatgg

SEQ ID NO: 360028 - DNA, 25 bp, Mus musculus
catctcatagtgtgttggtccgcga

SEQ ID NO: 360029 - DNA, 25 bp, Mus musculus
tgcgacagcgacctagcatctcata

SEQ ID NO: 360030 - DNA, 25 bp, Mus musculus
cctctcccttggcacctggaggtaa

SEQ ID NO: 360031 - DNA, 25 bp, Mus musculus
cttagacccgcgtagaaggcaattc

SEQ ID NO: 360032 - DNA, 25 bp, Mus musculus
tacagtctgatattaccctcgggtg

SEQ ID NO: 360033 - DNA, 25 bp, Mus musculus
agatgccacctctccagacagttgc

SEQ ID NO: 360034 - DNA, 25 bp, Mus musculus
ctttggttccttcggagccaactca

SEQ ID NO: 360035 - DNA, 25 bp, Mus musculus
ctccagatcggctttggaggtgttg

SEQ ID NO: 360036 - DNA, 25 bp, Mus musculus
cgtgttacgtcagccctccagatcg

SEQ ID NO: 360037 - DNA, 25 bp, Mus musculus
tgcagacttccgtgttacgtcagcc

SEQ ID NO: 360038 - DNA, 25 bp, Mus musculus
cgctcgcacgtgcagacttccgtgt

SEQ ID NO: 360039 - DNA, 25 bp, Mus musculus
cctccaggtcttctgaggaccggga

SEQ ID NO: 360040 - DNA, 25 bp, Mus musculus
tcccggatagagaatcctccaggtc

SEQ ID NO: 360041 - DNA, 25 bp, Mus musculus
actcacctggctttttagcatattc

SEQ ID NO: 360042 - DNA, 25 bp, Mus musculus
tgcgcctgcgcagtcaatcctcaga

SEQ ID NO: 360043 - DNA, 25 bp, Mus musculus
gtttggcctccgtaacgctgcgcct

SEQ ID NO: 360044 - DNA, 25 bp, Mus musculus
agcacgcaccgtttggcctccgtaa

SEQ ID NO: 360045 - DNA, 25 bp, Mus musculus
tcactacgctagcacgcaccgtttg

SEQ ID NO: 360046 - DNA, 25 bp, Mus musculus
cctgcgcactgagcgtagaggctag

SEQ ID NO: 360047 - DNA, 25 bp, Mus musculus
gctttttagcatattcccggataga

SEQ ID NO: 360048 - DNA, 25 bp, Mus musculus
gtcggtcccgccatccatcctgtcc

SEQ ID NO: 360049 - DNA, 25 bp, Mus musculus
cgaagcagactcctgcaggtgcggc

SEQ ID NO: 360050 - DNA, 25 bp, Mus musculus
ccaggtctgggcgaagcagactcct

SEQ ID NO: 360051 - DNA, 25 bp, Mus musculus
ggctgggactgcaacctaggcgccc

SEQ ID NO: 360052 - DNA, 25 bp, Mus musculus
tgcccgtcactcagcccgccgccgg

SEQ ID NO: 360053 - DNA, 25 bp, Mus musculus
cccgcataatcacccgctgcccgtc

SEQ ID NO: 360054 - DNA, 25 bp, Mus musculus
atcggaaatgtgaagggtcagcgct

SEQ ID NO: 360055 - DNA, 25 bp, Mus musculus
caaagagcagcttcggatggatgag

SEQ ID NO: 360056 - DNA, 25 bp, Mus musculus
cggccagacaaagagcagcttcgga

SEQ ID NO: 360057 - DNA, 25 bp, Mus musculus
catcctgtccgccagcaattaggcg

SEQ ID NO: 360058 - DNA, 25 bp, Mus musculus
ctttattagggattccgcggctgtc

SEQ ID NO: 360059 - DNA, 25 bp, Mus musculus
cgcggccgcggcctttattagggat

SEQ ID NO: 360060 - DNA, 25 bp, Mus musculus
ggagagcaaccctccgaggctttcg

SEQ ID NO: 360061 - DNA, 25 bp, Mus musculus
cgccagcaattaggcggccagacaa

SEQ ID NO: 360062 - DNA, 25 bp, Mus musculus
cccgagccagtttatagaacaacaa

SEQ ID NO: 360063 - DNA, 25 bp, Mus musculus
tggaagccagcgcagttctcgctca

SEQ ID NO: 360064 - DNA, 25 bp, Mus musculus
ctcagtgggcgcaacagatgtttgc

SEQ ID NO: 360065 - DNA, 25 bp, Mus musculus
cccgtaattgtgacaaagtgagtgc

SEQ ID NO: 360066 - DNA, 25 bp, Mus musculus
gggacctgggcacacttaggaatga

SEQ ID NO: 360067 - DNA, 25 bp, Mus musculus
agcaacttttggtcctgtctggtca

SEQ ID NO: 360068 - DNA, 25 bp, Mus musculus
ccgagagaggcctggaagatgaaaa

SEQ ID NO: 360069 - DNA, 25 bp, Mus musculus
tctgccctctcctcacagtaatggt

SEQ ID NO: 360070 - DNA, 25 bp, Mus musculus
tgtcacggagccgacaagctgggct

SEQ ID NO: 360071 - DNA, 25 bp, Mus musculus
tggcgggtaaatacgttactatgcc

SEQ ID NO: 360072 - DNA, 25 bp, Mus musculus
ggtttctgtatcagccaaggccagc

SEQ ID NO: 360073 - DNA, 25 bp, Mus musculus
tttcctcacgggtttctgtatcagc

SEQ ID NO: 360074 - DNA, 25 bp, Mus musculus
tggggtggccatcaatttcctcacg

SEQ ID NO: 360075 - DNA, 25 bp, Mus musculus
aaccgaggcagctgagaccgagaga

SEQ ID NO: 360076 - DNA, 25 bp, Mus musculus
gtgcggtcctagatttcagaaacta

SEQ ID NO: 360077 - DNA, 25 bp, Mus musculus
agccctttggttcccgcagtgtgga

SEQ ID NO: 360078 - DNA, 25 bp, Mus musculus
ttccagaggataggccggagaaaca

SEQ ID NO: 360079 - DNA, 25 bp, Mus musculus
agcgtgtgtgcggtcctagatttca

SEQ ID NO: 360080 - DNA, 25 bp, Mus musculus
cgcatgcacgagtacgagcgcgcgc

SEQ ID NO: 360081 - DNA, 25 bp, Mus musculus
tcctagatttcagaaactacgtgcg

SEQ ID NO: 360082 - DNA, 25 bp, Mus musculus
tttcctcatcccagacccgggagcg

SEQ ID NO: 360083 - DNA, 25 bp, Mus musculus
aggcggaggctcttctttcctcatc

SEQ ID NO: 360084 - DNA, 25 bp, Mus musculus
gtcgctgtggatccgcgggcactcc

SEQ ID NO: 360085 - DNA, 25 bp, Mus musculus
tcacttaggggcacgctggcgccca

SEQ ID NO: 360086 - DNA, 25 bp, Mus musculus
cgcccactcctagcccggccgcttt

SEQ ID NO: 360087 - DNA, 25 bp, Mus musculus
ttaggtcgcctttcccgcacgcgga

SEQ ID NO: 360088 - DNA, 25 bp, Mus musculus
cgtctcccgcaactcaggcgcgcga

SEQ ID NO: 360089 - DNA, 25 bp, Mus musculus
ataggccggagaaacaatggagtga

SEQ ID NO: 360090 - DNA, 25 bp, Mus musculus
tggacctcactctagcctcaggttt

SEQ ID NO: 360091 - DNA, 25 bp, Mus musculus
cggggagaatcgaactccgcgacta

SEQ ID NO: 360092 - DNA, 25 bp, Mus musculus
tgtctctttaaggaggcggccctga

SEQ ID NO: 360093 - DNA, 25 bp, Mus musculus
tccgcaggaggcctgtctctttaag

SEQ ID NO: 360094 - DNA, 25 bp, Mus musculus
tcctctgatccctctgcaggagaga

SEQ ID NO: 360095 - DNA, 25 bp, Mus musculus
gccagttcccgttctcatgacatta

SEQ ID NO: 360096 - DNA, 25 bp, Mus musculus
ttagagaactctgcatagtcagcgc

SEQ ID NO: 360097 - DNA, 25 bp, Mus musculus
ggttcagaagcctcccttttagaga

SEQ ID NO: 360098 - DNA, 25 bp, Mus musculus
ttccacttttcaggggagccgagcc

SEQ ID NO: 360099 - DNA, 25 bp, Mus musculus
ggtctcgcccaaggcatctggacct

SEQ ID NO: 360100 - DNA, 25 bp, Mus musculus
tggagttcactttcccaatgcgccc

SEQ ID NO: 360101 - DNA, 25 bp, Mus musculus
ctcccgcggcgacagaaacttgagg

SEQ ID NO: 360102 - DNA, 25 bp, Mus musculus
ggctagccaagcacacacagggttc

SEQ ID NO: 360103 - DNA, 25 bp, Mus musculus
ccgcatccgggaaaggcttgactga

SEQ ID NO: 360104 - DNA, 25 bp, Mus musculus
ccgtgcgccttagtggaaaccattt

SEQ ID NO: 360105 - DNA, 25 bp, Mus musculus
ctcagaacactaggagacgagtcgc

SEQ ID NO: 360106 - DNA, 25 bp, Mus musculus
cagagcctggcctgatcggacttac

SEQ ID NO: 360107 - DNA, 25 bp, Mus musculus
tcggacttacgcatgcgcagatttt

SEQ ID NO: 360108 - DNA, 25 bp, Mus musculus
tgcgcagatttttcggggcgatacc

SEQ ID NO: 360109 - DNA, 25 bp, Mus musculus
caaatcttgttgtggggttgtgccc

SEQ ID NO: 360110 - DNA, 25 bp, Mus musculus
aggcacgttgggaaactccacttca

SEQ ID NO: 360111 - DNA, 25 bp, Mus musculus
gggtctcaccattcctaggctgcca

SEQ ID NO: 360112 - DNA, 25 bp, Mus musculus
tccaacaatttctccgcggcgacgg

SEQ ID NO: 360113 - DNA, 25 bp, Mus musculus
agccggcttccgtgagacacatcta

SEQ ID NO: 360114 - DNA, 25 bp, Mus musculus
agacacatctacttccgggttgcga

SEQ ID NO: 360115 - DNA, 25 bp, Mus musculus
gctttcccggttggcagaagcgctt

SEQ ID NO: 360116 - DNA, 25 bp, Mus musculus
gatctcttccggttcgtcctggacc

SEQ ID NO: 360117 - DNA, 25 bp, Mus musculus
tgcgaacgaagggttggacgatctc

SEQ ID NO: 360118 - DNA, 25 bp, Mus musculus
gctcctcggcgagagcaaccggagc

SEQ ID NO: 360119 - DNA, 25 bp, Mus musculus
cgcagggaaaagagccgctctgtga

SEQ ID NO: 360120 - DNA, 25 bp, Mus musculus
agctgtttttactggcgagtgggcc

SEQ ID NO: 360121 - DNA, 25 bp, Mus musculus
tgaggctctggcatggtaacgtccc

SEQ ID NO: 360122 - DNA, 25 bp, Mus musculus
ctctgaggctctggcatggtaacgt

SEQ ID NO: 360123 - DNA, 25 bp, Mus musculus
cggcccagctgctctgaggctctgg

SEQ ID NO: 360124 - DNA, 25 bp, Mus musculus
tttttactggcgagtgggccgagcc

SEQ ID NO: 360125 - DNA, 25 bp, Mus musculus
ccaatcagagctgtttttactggcg

SEQ ID NO: 360126 - DNA, 25 bp, Mus musculus
gggctccgctcctcggcgagagcaa

SEQ ID NO: 360127 - DNA, 25 bp, Mus musculus
gaaattaatggctcggtccggtctg

SEQ ID NO: 360128 - DNA, 25 bp, Mus musculus
ccctctgcgcgggagaaattaatgg

SEQ ID NO: 360129 - DNA, 25 bp, Mus musculus
tgaaccgctgtagtgccctctgcgc

SEQ ID NO: 360130 - DNA, 25 bp, Mus musculus
tctgtgaaccgctgtagtgccctct

SEQ ID NO: 360131 - DNA, 25 bp, Mus musculus
aagagccgctctgtgaaccgctgta

SEQ ID NO: 360132 - DNA, 25 bp, Mus musculus
gcgcgccttattcatgcaggccacg

SEQ ID NO: 360133 - DNA, 25 bp, Mus musculus
tcggtgctctccaggttgcccatcg

SEQ ID NO: 360134 - DNA, 25 bp, Mus musculus
tcctccgggcctcagccctccacct

SEQ ID NO: 360135 - DNA, 25 bp, Mus musculus
ccagggccctcagccgctccgacct

SEQ ID NO: 360136 - DNA, 25 bp, Mus musculus
ctccgacctggctcctccctcagcg

SEQ ID NO: 360137 - DNA, 25 bp, Mus musculus
cgaagcgctcgacgcgctgaagcgc

SEQ ID NO: 360138 - DNA, 25 bp, Mus musculus
ctgaagcgcgccttattcatgcagg

SEQ ID NO: 360139 - DNA, 25 bp, Mus musculus
gacagccgcgcctcccaatcacaga

SEQ ID NO: 360140 - DNA, 25 bp, Mus musculus
gggcgaatctctcttccagctcgca

SEQ ID NO: 360141 - DNA, 25 bp, Mus musculus
agcactagggcgaatctctcttcca

SEQ ID NO: 360142 - DNA, 25 bp, Mus musculus
tcaccagcactagggcgaatctctc

SEQ ID NO: 360143 - DNA, 25 bp, Mus musculus
agcgccggtctcaccagcactaggg

SEQ ID NO: 360144 - DNA, 25 bp, Mus musculus
acggctcgggcatcggcgtcttgcc

SEQ ID NO: 360145 - DNA, 25 bp, Mus musculus
attccggcagcggaccgggaagtct

SEQ ID NO: 360146 - DNA, 25 bp, Mus musculus
cgctgcttcagatgcccgccgtgat

SEQ ID NO: 360147 - DNA, 25 bp, Mus musculus
ctgctttgaagcacgataggtcgca

SEQ ID NO: 360148 - DNA, 25 bp, Mus musculus
ttctcagtccgacctggcaaacacg

SEQ ID NO: 360149 - DNA, 25 bp, Mus musculus
agatgcccgccgtgattctcagtcc

SEQ ID NO: 360150 - DNA, 25 bp, Mus musculus
agaagcgtggataccactttccaca

SEQ ID NO: 360151 - DNA, 25 bp, Mus musculus
tcaatcggcagaagcgtggatacca

SEQ ID NO: 360152 - DNA, 25 bp, Mus musculus
tcacagacgaggaagtcaatcggca

SEQ ID NO: 360153 - DNA, 25 bp, Mus musculus
cgctgtgtcacagacgaggaagtca

SEQ ID NO: 360154 - DNA, 25 bp, Mus musculus
gataggtcgcagcaccgctgtgtca

SEQ ID NO: 360155 - DNA, 25 bp, Mus musculus
ccttgacctattattgctgctttga

SEQ ID NO: 360156 - DNA, 25 bp, Mus musculus
tctgctgacccttgacctattattg

SEQ ID NO: 360157 - DNA, 25 bp, Mus musculus
tggatccatgccaggtgccgaccca

SEQ ID NO: 360158 - DNA, 25 bp, Mus musculus
acgtgctcatttcttggatccatgc

SEQ ID NO: 360159 - DNA, 25 bp, Mus musculus
gtgccgacacggacacgtgctcatt

SEQ ID NO: 360160 - DNA, 25 bp, Mus musculus
tcagccgagttcagggcttgaattc

SEQ ID NO: 360161 - DNA, 25 bp, Mus musculus
cgttttcggacggatcagctcctta

SEQ ID NO: 360162 - DNA, 25 bp, Mus musculus
cgaaggcaggcctcttagcgaccct

SEQ ID NO: 360163 - DNA, 25 bp, Mus musculus
cagttggacctgtgtctgtggcgaa

SEQ ID NO: 360164 - DNA, 25 bp, Mus musculus
cggaggaactaatgccgcgcatgcg

SEQ ID NO: 360165 - DNA, 25 bp, Mus musculus
ggcctgttctgcgtcgagatcgaag

SEQ ID NO: 360166 - DNA, 25 bp, Mus musculus
agctccttaggcaacccggcctgtt

SEQ ID NO: 360167 - DNA, 25 bp, Mus musculus
tgcgaaactaggatcgggcaaaccc

SEQ ID NO: 360168 - DNA, 25 bp, Mus musculus
ggctgagaaggtacgtgcgaaacta

SEQ ID NO: 360169 - DNA, 25 bp, Mus musculus
gagactcagagcacatccggtttta

SEQ ID NO: 360170 - DNA, 25 bp, Mus musculus
tgtgggtagacttccagcgccaacc

SEQ ID NO: 360171 - DNA, 25 bp, Mus musculus
gggccaatgagaactcgcctgggca

SEQ ID NO: 360172 - DNA, 25 bp, Mus musculus
gataacggacaggagcagtgcagcc

SEQ ID NO: 360173 - DNA, 25 bp, Mus musculus
agcggctgctgtttatgaacgtgca

SEQ ID NO: 360174 - DNA, 25 bp, Mus musculus
ttggtagcctcagtgcggcggttca

SEQ ID NO: 360175 - DNA, 25 bp, Mus musculus
cctgaccttgaaggcgcagcacgtt

SEQ ID NO: 360176 - DNA, 25 bp, Mus musculus
accagctggcgatgctgctggtgtt

SEQ ID NO: 360177 - DNA, 25 bp, Mus musculus
cttctcctcgatggccgagtgtggg

SEQ ID NO: 360178 - DNA, 25 bp, Mus musculus
aggcgcagcacgttctcctcaatgc

SEQ ID NO: 360179 - DNA, 25 bp, Mus musculus
gggctggcccttctgagccctggct

SEQ ID NO: 360180 - DNA, 25 bp, Mus musculus
ccggagtccgttcctgaccttgaag

SEQ ID NO: 360181 - DNA, 25 bp, Mus musculus
tgtttggcttcggagcccggagtcc

SEQ ID NO: 360182 - DNA, 25 bp, Mus musculus
tttaaggccaaaccagctggcgatg

SEQ ID NO: 360183 - DNA, 25 bp, Mus musculus
ccttgtttttggtagcctcagtgcg

SEQ ID NO: 360184 - DNA, 25 bp, Mus musculus
ccgtccttgtttttggtagcctcag

SEQ ID NO: 360185 - DNA, 25 bp, Mus musculus
tcttgacttctttccggagtgggga

SEQ ID NO: 360186 - DNA, 25 bp, Mus musculus
gcttccgtcttgacttctttccgga

SEQ ID NO: 360187 - DNA, 25 bp, Mus musculus
tcaccttctcctcgatggccgagtg

SEQ ID NO: 360188 - DNA, 25 bp, Mus musculus
ctcggctctgggtgacgtcatccag

SEQ ID NO: 360189 - DNA, 25 bp, Mus musculus
ggcttcccgcgtgtgctgacagcca

SEQ ID NO: 360190 - DNA, 25 bp, Mus musculus
cgcgccacccgaggctcgcagccgc

SEQ ID NO: 360191 - DNA, 25 bp, Mus musculus
ggtctcgggcttgttttgattcggc

SEQ ID NO: 360192 - DNA, 25 bp, Mus musculus
gcttgttttgattcggctgcgctga

SEQ ID NO: 360193 - DNA, 25 bp, Mus musculus
tttgattcggctgcgctgacacgct

SEQ ID NO: 360194 - DNA, 25 bp, Mus musculus
ccgcgccctccgcttcagaagccgg

SEQ ID NO: 360195 - DNA, 25 bp, Mus musculus
attcggctgcgctgacacgctccag

SEQ ID NO: 360196 - DNA, 25 bp, Mus musculus
cgcccgtgacgacactggggcttga

SEQ ID NO: 360197 - DNA, 25 bp, Mus musculus
acgacactggggcttgagcccggcc

SEQ ID NO: 360198 - DNA, 25 bp, Mus musculus
gtgacctcacggcaactcgctccgc

SEQ ID NO: 360199 - DNA, 25 bp, Mus musculus
cgtgacgtcacgctcggcgctcagc

SEQ ID NO: 360200 - DNA, 25 bp, Mus musculus
gcgctcagccctcggctctgggtga

SEQ ID NO: 360201 - DNA, 25 bp, Mus musculus
tcatccaggcgccttcttgggagag

SEQ ID NO: 360202 - DNA, 25 bp, Mus musculus
ccggagccacctcttgatgtcaagg

SEQ ID NO: 360203 - DNA, 25 bp, Mus musculus
gccggggcatttagaacagagaaaa

SEQ ID NO: 360204 - DNA, 25 bp, Mus musculus
ggccggagctgacctgcaaagcctt

SEQ ID NO: 360205 - DNA, 25 bp, Mus musculus
ttcccaggacgagagctaagtctgc

SEQ ID NO: 360206 - DNA, 25 bp, Mus musculus
agccaatccacgctcagcctgggtg

SEQ ID NO: 360207 - DNA, 25 bp, Mus musculus
ctgagcttgtctggcttggtccaca

SEQ ID NO: 360208 - DNA, 25 bp, Mus musculus
ttaccgaaatcaggtgctgagcttg

SEQ ID NO: 360209 - DNA, 25 bp, Mus musculus
gccaatcaggcgtgaacttaccgaa

SEQ ID NO: 360210 - DNA, 25 bp, Mus musculus
ctcagcccgttaaatgccaatcagg

SEQ ID NO: 360211 - DNA, 25 bp, Mus musculus
gagcctttcactccagactcagcgg

SEQ ID NO: 360212 - DNA, 25 bp, Mus musculus
ttccagccaaagttgccacgagagc

SEQ ID NO: 360213 - DNA, 25 bp, Mus musculus
gtgggcctgaagcatctctctctgc

SEQ ID NO: 360214 - DNA, 25 bp, Mus musculus
ggggcaaggtcagtgctttcaaaga

SEQ ID NO: 360215 - DNA, 25 bp, Mus musculus
ccagctctatccagatgttcccagg

SEQ ID NO: 360216 - DNA, 25 bp, Mus musculus
ccatcccgtggtcctgcgtcaagat

SEQ ID NO: 360217 - DNA, 25 bp, Mus musculus
gcagctgcccggtaacacttccagg

SEQ ID NO: 360218 - DNA, 25 bp, Mus musculus
acacttccagggttgtggctccacg

SEQ ID NO: 360219 - DNA, 25 bp, Mus musculus
gccaggaactcgcacagaccacggt

SEQ ID NO: 360220 - DNA, 25 bp, Mus musculus
atctgcttggccatgtcacctcgga

SEQ ID NO: 360221 - DNA, 25 bp, Mus musculus
ctggtgttgccgaaacagcacgcta

SEQ ID NO: 360222 - DNA, 25 bp, Mus musculus
agcagaaggcttcggtcccaactgg

SEQ ID NO: 360223 - DNA, 25 bp, Mus musculus
tgggtgtgctttgctctgaagagca

SEQ ID NO: 360224 - DNA, 25 bp, Mus musculus
tgacgattcggggattgcctgagtc

SEQ ID NO: 360225 - DNA, 25 bp, Mus musculus
aatctgtccgtgtctcttttgttga

SEQ ID NO: 360226 - DNA, 25 bp, Mus musculus
tcccgtggccttcggaatcttaatc

SEQ ID NO: 360227 - DNA, 25 bp, Mus musculus
aagctccacggtatctctttactgg

SEQ ID NO: 360228 - DNA, 25 bp, Mus musculus
cgattctccgtgttaaagctccacg

SEQ ID NO: 360229 - DNA, 25 bp, Mus musculus
cggaagtgatcaaaactgtggagtc

SEQ ID NO: 360230 - DNA, 25 bp, Mus musculus
cccaggccagcaccacggaggacgc

SEQ ID NO: 360231 - DNA, 25 bp, Mus musculus
atcggcctcttctcgggaccctcgg

SEQ ID NO: 360232 - DNA, 25 bp, Mus musculus
accctcgggagggaagagctgccga

SEQ ID NO: 360233 - DNA, 25 bp, Mus musculus
ggagggaagagctgccgaagaagct

SEQ ID NO: 360234 - DNA, 25 bp, Mus musculus
gcagaaggcggagcctttgctcggg

SEQ ID NO: 360235 - DNA, 25 bp, Mus musculus
cctcttgacaatgtcccgtctgcgg

SEQ ID NO: 360236 - DNA, 25 bp, Mus musculus
tcttgacaatgtcccgtctgcggcc

SEQ ID NO: 360237 - DNA, 25 bp, Mus musculus
gacaatgtcccgtctgcggccatca

SEQ ID NO: 360238 - DNA, 25 bp, Mus musculus
cccgtctgcggccatcacgctctgt

SEQ ID NO: 360239 - DNA, 25 bp, Mus musculus
catcacgctctgtccctcggttggg

SEQ ID NO: 360240 - DNA, 25 bp, Mus musculus
cacgctctgtccctcggttggggcg

SEQ ID NO: 360241 - DNA, 25 bp, Mus musculus
gaaccggaagtctggagcccgcgga

SEQ ID NO: 360242 - DNA, 25 bp, Mus musculus
gctccgatccctgccgcgtcactca

SEQ ID NO: 360243 - DNA, 25 bp, Mus musculus
ttacaccccacgtcgagccctagga

SEQ ID NO: 360244 - DNA, 25 bp, Mus musculus
tcccagtgcagggtagctagctgct

SEQ ID NO: 360245 - DNA, 25 bp, Mus musculus
gtggagctgcactctccgcagagcc

SEQ ID NO: 360246 - DNA, 25 bp, Mus musculus
tgagcctcaagaaggggctcgcccg

SEQ ID NO: 360247 - DNA, 25 bp, Mus musculus
ggtagctagctgctcctgcgcctgc

SEQ ID NO: 360248 - DNA, 25 bp, Mus musculus
ccgccgtcggttcccagtgcagggt

SEQ ID NO: 360249 - DNA, 25 bp, Mus musculus
gcgagcgggtgccagtgccttctcc

SEQ ID NO: 360250 - DNA, 25 bp, Mus musculus
tggtgggcgccgtcatcggttccct

SEQ ID NO: 360251 - DNA, 25 bp, Mus musculus
gtcatcggttccctcctctacaact

SEQ ID NO: 360252 - DNA, 25 bp, Mus musculus
cctcgaccaagagcctgcaggagcg

SEQ ID NO: 360253 - DNA, 25 bp, Mus musculus
cggcagtcggtggagctgcactctc

SEQ ID NO: 360254 - DNA, 25 bp, Mus musculus
ccaagagcctgcaggagcgcctggc

SEQ ID NO: 360255 - DNA, 25 bp, Mus musculus
ggtcttctggatcggacccctggtg

SEQ ID NO: 360256 - DNA, 25 bp, Mus musculus
cactgactgggaggaacgcgaagtg

SEQ ID NO: 360257 - DNA, 25 bp, Mus musculus
ctgcgagcgcggtgagcctcaagaa

SEQ ID NO: 360258 - DNA, 25 bp, Mus musculus
tggcactgtactcccgatccaacgc

SEQ ID NO: 360259 - DNA, 25 bp, Mus musculus
ccgccacgggcggataaggagctaa

SEQ ID NO: 360260 - DNA, 25 bp, Mus musculus
agatgctccggtcgcgcgagcccaa

SEQ ID NO: 360261 - DNA, 25 bp, Mus musculus
taaggagctaagaggcgctgtcctc

SEQ ID NO: 360262 - DNA, 25 bp, Mus musculus
ggcgctgtcctcagagactctcatc

SEQ ID NO: 360263 - DNA, 25 bp, Mus musculus
agagactctcatcactctgacccgt

SEQ ID NO: 360264 - DNA, 25 bp, Mus musculus
cactctgacccgtccgtgggtgaga

SEQ ID NO: 360265 - DNA, 25 bp, Mus musculus
agaccgaccgggtcaagatgctccg

SEQ ID NO: 360266 - DNA, 25 bp, Mus musculus
acttccagagctcggtgcgagagga

SEQ ID NO: 360267 - DNA, 25 bp, Mus musculus
caggagagcccagcacgcacgtcga

SEQ ID NO: 360268 - DNA, 25 bp, Mus musculus
cagcacgcacgtcgaccaggagggc

SEQ ID NO: 360269 - DNA, 25 bp, Mus musculus
tcctagagcccgctgcctagaggca

SEQ ID NO: 360270 - DNA, 25 bp, Mus musculus
cacacgcggcgtcgaggattgccga

SEQ ID NO: 360271 - DNA, 25 bp, Mus musculus
ccagtctacactgccgcgtgggtca

SEQ ID NO: 360272 - DNA, 25 bp, Mus musculus
ccagccaatcacagaggagctcata

SEQ ID NO: 360273 - DNA, 25 bp, Mus musculus
caaggagcgccacgccgagagcagc

SEQ ID NO: 360274 - DNA, 25 bp, Mus musculus
gacgcgcctcactaacggcagtgta

SEQ ID NO: 360275 - DNA, 25 bp, Mus musculus
atgggcatgcgcattacattagcga

SEQ ID NO: 360276 - DNA, 25 bp, Mus musculus
ggcagtgtaaaaccgcgccgccaga

SEQ ID NO: 360277 - DNA, 25 bp, Mus musculus
tacattagcgagacgcccgaaaggc

SEQ ID NO: 360278 - DNA, 25 bp, Mus musculus
caagaccaccttgagggaaccacac

SEQ ID NO: 360279 - DNA, 25 bp, Mus musculus
ggttcaaaatcacgcaccagccaat

SEQ ID NO: 360280 - DNA, 25 bp, Mus musculus
cgactttgcaaggagcgccacgccg

SEQ ID NO: 360281 - DNA, 25 bp, Mus musculus
gaggagctcataatcacgaagacgc

SEQ ID NO: 360282 - DNA, 25 bp, Mus musculus
cacgaagacgcaagtgtcagggcca

SEQ ID NO: 360283 - DNA, 25 bp, Mus musculus
gcaaaacggaatgggcatgcgcatt

SEQ ID NO: 360284 - DNA, 25 bp, Mus musculus
tggggctcgccaagaccaccttgag

SEQ ID NO: 360285 - DNA, 25 bp, Mus musculus
gcgccgccagatccggttcaaaatc

SEQ ID NO: 360286 - DNA, 25 bp, Mus musculus
ctccctgcagggctctacgcgggtg

SEQ ID NO: 360287 - DNA, 25 bp, Mus musculus
taactggctgtcatagggaaccgcg

SEQ ID NO: 360288 - DNA, 25 bp, Mus musculus
gagacaccctcgcagacactcgtag

SEQ ID NO: 360289 - DNA, 25 bp, Mus musculus
atatgactgcgacgagaagctggac

SEQ ID NO: 360290 - DNA, 25 bp, Mus musculus
cgagccgggaatatgactgcgacga

SEQ ID NO: 360291 - DNA, 25 bp, Mus musculus
tctccagcttctggggaggctcggc

SEQ ID NO: 360292 - DNA, 25 bp, Mus musculus
aagccgagactctcctccactgtag

SEQ ID NO: 360293 - DNA, 25 bp, Mus musculus
agccacagggcctcgcaagcagaga

SEQ ID NO: 360294 - DNA, 25 bp, Mus musculus
cggaccaagccgagcgagcaagcgc

SEQ ID NO: 360295 - DNA, 25 bp, Mus musculus
cgatggatccctgcagatcccgggg

SEQ ID NO: 360296 - DNA, 25 bp, Mus musculus
gccggacgatggatccctgcagatc

SEQ ID NO: 360297 - DNA, 25 bp, Mus musculus
tcgcagacactcgtaggcgcgcacg

SEQ ID NO: 360298 - DNA, 25 bp, Mus musculus
tccgggatccgaacgaggcagctct

SEQ ID NO: 360299 - DNA, 25 bp, Mus musculus
ccactgtagctttctccagcttctg

SEQ ID NO: 360300 - DNA, 25 bp, Mus musculus
ccgggtcaagggctgtaccgctctc

SEQ ID NO: 360301 - DNA, 25 bp, Mus musculus
gctcgctcccggcacctctttatcc

SEQ ID NO: 360302 - DNA, 25 bp, Mus musculus
tttatccgcacaccgcttctctatg

SEQ ID NO: 360303 - DNA, 25 bp, Mus musculus
atggtgctccctcctggcccgtgaa

SEQ ID NO: 360304 - DNA, 25 bp, Mus musculus
agggagtggtcagcacgcctttccc

SEQ ID NO: 360305 - DNA, 25 bp, Mus musculus
tggtcagcacgcctttcccgctagt

SEQ ID NO: 360306 - DNA, 25 bp, Mus musculus
tagcccgtagtctcgctgctccgag

SEQ ID NO: 360307 - DNA, 25 bp, Mus musculus
gcgggccgggcccacaaacagccca

SEQ ID NO: 360308 - DNA, 25 bp, Mus musculus
tccggttccggttctttgtgcagct

SEQ ID NO: 360309 - DNA, 25 bp, Mus musculus
tccggttctttgtgcagctgcagcg

SEQ ID NO: 360310 - DNA, 25 bp, Mus musculus
cgggtttccagtctgtggctccgag

SEQ ID NO: 360311 - DNA, 25 bp, Mus musculus
cctcccgtgcgaatgggcccggcgc

SEQ ID NO: 360312 - DNA, 25 bp, Mus musculus
gtcaagggctgtaccgctctccgat

SEQ ID NO: 360313 - DNA, 25 bp, Mus musculus
tttccagtctgtggctccgagcggc

SEQ ID NO: 360314 - DNA, 25 bp, Mus musculus
ggtactcctggatagacccgcctct

SEQ ID NO: 360315 - DNA, 25 bp, Mus musculus
ggcgttccactggttcggatctaga

SEQ ID NO: 360316 - DNA, 25 bp, Mus musculus
tcaccctgggcgttccactggttcg

SEQ ID NO: 360317 - DNA, 25 bp, Mus musculus
ctcagaagctcagcgatgggagcgc

SEQ ID NO: 360318 - DNA, 25 bp, Mus musculus
gcggcgtggaaagctcagaagctca

SEQ ID NO: 360319 - DNA, 25 bp, Mus musculus
cactcagaagctagggcggagtcta

SEQ ID NO: 360320 - DNA, 25 bp, Mus musculus
tcagctactgtgacagccgtccgtg

SEQ ID NO: 360321 - DNA, 25 bp, Mus musculus
ccacctgaggtggtccgagcgcgct

SEQ ID NO: 360322 - DNA, 25 bp, Mus musculus
gccggggactcagatgcaacccacg

SEQ ID NO: 360323 - DNA, 25 bp, Mus musculus
actggttcggatctagagtcctctc

SEQ ID NO: 360324 - DNA, 25 bp, Mus musculus
gaggacaccgaccagcttgtccacg

SEQ ID NO: 360325 - DNA, 25 bp, Mus musculus
ctgaacgcagactgacgcccggtgc

SEQ ID NO: 360326 - DNA, 25 bp, Mus musculus
tacaccctccgggagactgtgctca

SEQ ID NO: 360327 - DNA, 25 bp, Mus musculus
gcagtcccgagctcagctactgtga

SEQ ID NO: 360328 - DNA, 25 bp, Mus musculus
tagaagccggaagttcaaggctggc

SEQ ID NO: 360329 - DNA, 25 bp, Mus musculus
agagaggtagaagccggaagttcaa

SEQ ID NO: 360330 - DNA, 25 bp, Mus musculus
ctcctagtccctgcgctgtgctagc

SEQ ID NO: 360331 - DNA, 25 bp, Mus musculus
cgtcctcggcctgtgcccttgagag

SEQ ID NO: 360332 - DNA, 25 bp, Mus musculus
cgtgtcgccgcttttcacgctgttc

SEQ ID NO: 360333 - DNA, 25 bp, Mus musculus
agttgcagcctccaggtaggccgcg

SEQ ID NO: 360334 - DNA, 25 bp, Mus musculus
tgacgcggccgagttgcagcctcca

SEQ ID NO: 360335 - DNA, 25 bp, Mus musculus
gagcaggcatcgctctgacgcggcc

SEQ ID NO: 360336 - DNA, 25 bp, Mus musculus
tggcagactgagcaggcatcgctct

SEQ ID NO: 360337 - DNA, 25 bp, Mus musculus
cgcgactctgcgagtggcagactga

SEQ ID NO: 360338 - DNA, 25 bp, Mus musculus
ttggtgactgcctcttcctgccctg

SEQ ID NO: 360339 - DNA, 25 bp, Mus musculus
agctgcgcgttggtgactgcctctt

SEQ ID NO: 360340 - DNA, 25 bp, Mus musculus
ctctcgctttagtgggcgagttttc

SEQ ID NO: 360341 - DNA, 25 bp, Mus musculus
ttcaaggctggctctcgctttagtg

SEQ ID NO: 360342 - DNA, 25 bp, Mus musculus
tcacgaccaggcgtaacggagtcca

SEQ ID NO: 360343 - DNA, 25 bp, Mus musculus
acacatcgaggttctcccgggcagc

SEQ ID NO: 360344 - DNA, 25 bp, Mus musculus
ggtttcccacaaagccgatctgagc

SEQ ID NO: 360345 - DNA, 25 bp, Mus musculus
ctcccgcctttctagggctccgcca

SEQ ID NO: 360346 - DNA, 25 bp, Mus musculus
acgaaacgggcacacatcgaggttc

SEQ ID NO: 360347 - DNA, 25 bp, Mus musculus
ttcccacgtacgaaacgggcacaca

SEQ ID NO: 360348 - DNA, 25 bp, Mus musculus
tgttctgttgttttcccacgtacga

SEQ ID NO: 360349 - DNA, 25 bp, Mus musculus
cagggtctgggacgtttttgttctg

SEQ ID NO: 360350 - DNA, 25 bp, Mus musculus
agcccgtgggtaagaagctttgcga

SEQ ID NO: 360351 - DNA, 25 bp, Mus musculus
cggagctgtcacgaccaggcgtaac

SEQ ID NO: 360352 - DNA, 25 bp, Mus musculus
gcgatccggacctggtttcccacaa

SEQ ID NO: 360353 - DNA, 25 bp, Mus musculus
cggacaagcgcgatccggacctggt

SEQ ID NO: 360354 - DNA, 25 bp, Mus musculus
cgatccggtccggacaagcgcgatc

SEQ ID NO: 360355 - DNA, 25 bp, Mus musculus
ctgctcttcctccttcaagtcgggg

SEQ ID NO: 360356 - DNA, 25 bp, Mus musculus
ctcacggagaagatgcacactgcca

SEQ ID NO: 360357 - DNA, 25 bp, Mus musculus
tccatgcgactctgtgatctgcact

SEQ ID NO: 360358 - DNA, 25 bp, Mus musculus
tgatctgcacttctgaggcccagca

SEQ ID NO: 360359 - DNA, 25 bp, Mus musculus
cgctcaaacagcatcctcacggaga

SEQ ID NO: 360360 - DNA, 25 bp, Mus musculus
ttcctggagattgggaggcagcctt

SEQ ID NO: 360361 - DNA, 25 bp, Mus musculus
tgcacactgccagcgggaacaccga

SEQ ID NO: 360362 - DNA, 25 bp, Mus musculus
agcgggaacaccgacagcacgtgct

SEQ ID NO: 360363 - DNA, 25 bp, Mus musculus
aggtccgcccagctcacgttctgag

SEQ ID NO: 360364 - DNA, 25 bp, Mus musculus
ctcacgttctgaggcagccagaagc

SEQ ID NO: 360365 - DNA, 25 bp, Mus musculus
tgctgcagtcgccatcttacgcgcg

SEQ ID NO: 360366 - DNA, 25 bp, Mus musculus
cacagcctcggaggcagtcaaggca

SEQ ID NO: 360367 - DNA, 25 bp, Mus musculus
ggcagccttcgagagctccatgcga

SEQ ID NO: 360368 - DNA, 25 bp, Mus musculus
cactgcgggagcacgactcactctt

SEQ ID NO: 360369 - DNA, 25 bp, Mus musculus
tcaaggcaaaaggaacccgctggga

SEQ ID NO: 360370 - DNA, 25 bp, Mus musculus
tgggcttcgatactttgatcccttc

SEQ ID NO: 360371 - DNA, 25 bp, Mus musculus
ccacttgggcttcgatactttgatc

SEQ ID NO: 360372 - DNA, 25 bp, Mus musculus
cggaggccacttgggcttcgatact

SEQ ID NO: 360373 - DNA, 25 bp, Mus musculus
tccttcagggacgaagaccgccgca

SEQ ID NO: 360374 - DNA, 25 bp, Mus musculus
cgatactttgatcccttcctccagg

SEQ ID NO: 360375 - DNA, 25 bp, Mus musculus
tcttgcagacgtcatcctccggagg

SEQ ID NO: 360376 - DNA, 25 bp, Mus musculus
tttgatcccttcctccagggcactt

SEQ ID NO: 360377 - DNA, 25 bp, Mus musculus
gggcctccgtcttgcagacgtcatc

SEQ ID NO: 360378 - DNA, 25 bp, Mus musculus
aggtccagatctacatcctccgggg

SEQ ID NO: 360379 - DNA, 25 bp, Mus musculus
cagggacgaagaccgccgcagcttc

SEQ ID NO: 360380 - DNA, 25 bp, Mus musculus
cgaaaggaagctgctaccgtaaacg

SEQ ID NO: 360381 - DNA, 25 bp, Mus musculus
tgctaccgtaaacgggcggctcctc

SEQ ID NO: 360382 - DNA, 25 bp, Mus musculus
gcggctcctctccttcagggacgaa

SEQ ID NO: 360383 - DNA, 25 bp, Mus musculus
agacgtcatcctccggaggccactt

SEQ ID NO: 360384 - DNA, 25 bp, Mus musculus
cgcctcaaaatacgcggggagagtg

SEQ ID NO: 360385 - DNA, 25 bp, Mus musculus
ttggagcgaacgtgctcgctcccgg

SEQ ID NO: 360386 - DNA, 25 bp, Mus musculus
aggcgagaggaagcgcttacctgac

SEQ ID NO: 360387 - DNA, 25 bp, Mus musculus
gaggaagcgcttacctgactagaaa

SEQ ID NO: 360388 - DNA, 25 bp, Mus musculus
cttacctgactagaaagccgtcggg

SEQ ID NO: 360389 - DNA, 25 bp, Mus musculus
acggtcctgcgctctgtctgcccag

SEQ ID NO: 360390 - DNA, 25 bp, Mus musculus
cagcgcacctgtcgcaactgggctg

SEQ ID NO: 360391 - DNA, 25 bp, Mus musculus
acctgtcgcaactgggctgcagcac

SEQ ID NO: 360392 - DNA, 25 bp, Mus musculus
cggccttggagcgaacgtgctcgct

SEQ ID NO: 360393 - DNA, 25 bp, Mus musculus
gctcccggcggcgtgttcaactcgt

SEQ ID NO: 360394 - DNA, 25 bp, Mus musculus
gtgttcaactcgtgaccggagcgtc

SEQ ID NO: 360395 - DNA, 25 bp, Mus musculus
aactcgtgaccggagcgtcgcccta

SEQ ID NO: 360396 - DNA, 25 bp, Mus musculus
tgaccggagcgtcgccctagtagcg

SEQ ID NO: 360397 - DNA, 25 bp, Mus musculus
aactgggctgcagcaccttcagctc

SEQ ID NO: 360398 - DNA, 25 bp, Mus musculus
ccgcctgggacggagcgagcaacat

SEQ ID NO: 360399 - DNA, 25 bp, Mus musculus
gcctgccggagcgaagcacgcacag

SEQ ID NO: 360400 - DNA, 25 bp, Mus musculus
cggaagcagttttcctccagaaccg

SEQ ID NO: 360401 - DNA, 25 bp, Mus musculus
aacagttgttgcttcccgggaggag

SEQ ID NO: 360402 - DNA, 25 bp, Mus musculus
gccatgtgactttccaggccgtcca

SEQ ID NO: 360403 - DNA, 25 bp, Mus musculus
agcccgacgagaggctgacacagca

SEQ ID NO: 360404 - DNA, 25 bp, Mus musculus
gtgtcccatatggagctcctgaagg

SEQ ID NO: 360405 - DNA, 25 bp, Mus musculus
ctccagaaccggaaacagttgttgc

SEQ ID NO: 360406 - DNA, 25 bp, Mus musculus
cggtggggttttgtctcgctaactg

SEQ ID NO: 360407 - DNA, 25 bp, Mus musculus
ttaagagagtagaaagctcgcccgc

SEQ ID NO: 360408 - DNA, 25 bp, Mus musculus
cccaagctgcaccaaaattttgttg

SEQ ID NO: 360409 - DNA, 25 bp, Mus musculus
cgtccgccggctctggaacgttcga

SEQ ID NO: 360410 - DNA, 25 bp, Mus musculus
tgacacagcacctgggccgtgcagg

SEQ ID NO: 360411 - DNA, 25 bp, Mus musculus
tgctcttcgttgaggtgagtggctc

SEQ ID NO: 360412 - DNA, 25 bp, Mus musculus
cgcgaagcgcggctgggctttcatt

SEQ ID NO: 360413 - DNA, 25 bp, Mus musculus
gaagcggtggcgctaacccagagac

SEQ ID NO: 360414 - DNA, 25 bp, Mus musculus
ctgcttctctaacaatgcgaggtgc

SEQ ID NO: 360415 - DNA, 25 bp, Mus musculus
ggggacgccgcagctgcacgtcttc

SEQ ID NO: 360416 - DNA, 25 bp, Mus musculus
gctccggcttcagaacgaggcgcag

SEQ ID NO: 360417 - DNA, 25 bp, Mus musculus
ctctgctgccttgctcccgaagggc

SEQ ID NO: 360418 - DNA, 25 bp, Mus musculus
aatgcgaggtgcctcaccagtgaca

SEQ ID NO: 360419 - DNA, 25 bp, Mus musculus
gcggctgggctttcattgttgtccc

SEQ ID NO: 360420 - DNA, 25 bp, Mus musculus
ccctctcgtcttccggagtgtggct

SEQ ID NO: 360421 - DNA, 25 bp, Mus musculus
acgtgaccctcgctcatggcggcgg

SEQ ID NO: 360422 - DNA, 25 bp, Mus musculus
tgcgctctccaagatccgcggtaga

SEQ ID NO: 360423 - DNA, 25 bp, Mus musculus
gctgcacgtcttcctgcttctctaa

SEQ ID NO: 360424 - DNA, 25 bp, Mus musculus
tcaccagtgacaggcgtgagaaagg

SEQ ID NO: 360425 - DNA, 25 bp, Mus musculus
acgggtcagctggagacaaagctgc

SEQ ID NO: 360426 - DNA, 25 bp, Mus musculus
atttgttgcgaagagttcatggtgc

SEQ ID NO: 360427 - DNA, 25 bp, Mus musculus
ttctttttgagacgggatttgttgc

SEQ ID NO: 360428 - DNA, 25 bp, Mus musculus
agggtcagctgtcccgcccgcgaga

SEQ ID NO: 360429 - DNA, 25 bp, Mus musculus
gctcacgtgaccacgcggtgacgca

SEQ ID NO: 360430 - DNA, 25 bp, Mus musculus
ctgtgcggatcatgccgcctgcgac

SEQ ID NO: 360431 - DNA, 25 bp, Mus musculus
aacggtagccgcgacggttggctct

SEQ ID NO: 360432 - DNA, 25 bp, Mus musculus
ttggctctcgagttacgctctcctc

SEQ ID NO: 360433 - DNA, 25 bp, Mus musculus
aagaaaagccgagcggcggcctccg

SEQ ID NO: 360434 - DNA, 25 bp, Mus musculus
gggctcccgcctccatgactgggaa

SEQ ID NO: 360435 - DNA, 25 bp, Mus musculus
catgactgggaaaaccgaggcaacc

SEQ ID NO: 360436 - DNA, 25 bp, Mus musculus
gccgctggccgcctaagttatgata

SEQ ID NO: 360437 - DNA, 25 bp, Mus musculus
tggccgcctaagttatgatagaaac

SEQ ID NO: 360438 - DNA, 25 bp, Mus musculus
agagtctcggtagccgccttttctt

SEQ ID NO: 360439 - DNA, 25 bp, Mus musculus
ttcatggtgcaggacttccagacgc

SEQ ID NO: 360440 - DNA, 25 bp, Mus musculus
ccgccggaagaggagcagccggtca

SEQ ID NO: 360441 - DNA, 25 bp, Mus musculus
ggggcctacagccaccatggcgtca

SEQ ID NO: 360442 - DNA, 25 bp, Mus musculus
gccaccatggcgtcatgggcactga

SEQ ID NO: 360443 - DNA, 25 bp, Mus musculus
ccatggcgtcatgggcactgagcgc

SEQ ID NO: 360444 - DNA, 25 bp, Mus musculus
cggcgcctttgcgtactctgagctg

SEQ ID NO: 360445 - DNA, 25 bp, Mus musculus
tgcgtactctgagctgcactcactg

SEQ ID NO: 360446 - DNA, 25 bp, Mus musculus
agctgcactcactgtcccttaggga

SEQ ID NO: 360447 - DNA, 25 bp, Mus musculus
tcactgtcccttagggagggctctg

SEQ ID NO: 360448 - DNA, 25 bp, Mus musculus
tgtcccttagggagggctctgcgct

SEQ ID NO: 360449 - DNA, 25 bp, Mus musculus
ggcagtatctggtcatgtgcggccc

SEQ ID NO: 360450 - DNA, 25 bp, Mus musculus
tgcgctgggacaggccactgtgcca

SEQ ID NO: 360451 - DNA, 25 bp, Mus musculus
catcttggggcctacagccaccatg

SEQ ID NO: 360452 - DNA, 25 bp, Mus musculus
cagccggtcacgaagggcagtatct

SEQ ID NO: 360453 - DNA, 25 bp, Mus musculus
gctctgcgctgggacaggccactgt

SEQ ID NO: 360454 - DNA, 25 bp, Mus musculus
agcaatctgcaggagttcgccggcc

SEQ ID NO: 360455 - DNA, 25 bp, Mus musculus
cgattctccgtgatgtacaatgagc

SEQ ID NO: 360456 - DNA, 25 bp, Mus musculus
tgtacaatgagcagatggcgagcca

SEQ ID NO: 360457 - DNA, 25 bp, Mus musculus
gcagctgcagttcgagcgcttcgtg

SEQ ID NO: 360458 - DNA, 25 bp, Mus musculus
agcgggagctcttcagcaatctgca

SEQ ID NO: 360459 - DNA, 25 bp, Mus musculus
cctcggggaagctgactctgctgga

SEQ ID NO: 360460 - DNA, 25 bp, Mus musculus
tgcggcaccggagccaacttcaagt

SEQ ID NO: 360461 - DNA, 25 bp, Mus musculus
gcaccggagccaacttcaagttcta

SEQ ID NO: 360462 - DNA, 25 bp, Mus musculus
gggtgcagggtcacttgtatcgacc

SEQ ID NO: 360463 - DNA, 25 bp, Mus musculus
cgagaagttcttgttcaagagcgtc

SEQ ID NO: 360464 - DNA, 25 bp, Mus musculus
ttcttgttcaagagcgtcgcagaga

SEQ ID NO: 360465 - DNA, 25 bp, Mus musculus
tcaagagcgtcgcagagaaccggca

SEQ ID NO: 360466 - DNA, 25 bp, Mus musculus
cagagaaccggcagctgcagttcga

SEQ ID NO: 360467 - DNA, 25 bp, Mus musculus
tggcgagccaaaagcgggagctctt

SEQ ID NO: 360468 - DNA, 25 bp, Mus musculus
ggcgttcttatattggcaactccca

SEQ ID NO: 360469 - DNA, 25 bp, Mus musculus
agtgtccctgaacgaggccttggaa

SEQ ID NO: 360470 - DNA, 25 bp, Mus musculus
agcagcactcaaccgcgaggcctga

SEQ ID NO: 360471 - DNA, 25 bp, Mus musculus
tctcctgattggctggactcctgca

SEQ ID NO: 360472 - DNA, 25 bp, Mus musculus
gcagttcaaaccttcggcgttctta

SEQ ID NO: 360473 - DNA, 25 bp, Mus musculus
cggaatgctcgggacatatacattt

SEQ ID NO: 360474 - DNA, 25 bp, Mus musculus
acgcctttttcctcctaagagatga

SEQ ID NO: 360475 - DNA, 25 bp, Mus musculus
agctacactcgatcctaaggcgcca

SEQ ID NO: 360476 - DNA, 25 bp, Mus musculus
ggcagtccctattagcttcttgagc

SEQ ID NO: 360477 - DNA, 25 bp, Mus musculus
ttcttgagccactgctcggtgccca

SEQ ID NO: 360478 - DNA, 25 bp, Mus musculus
ggtgcccactgacgcgccaagaaca

SEQ ID NO: 360479 - DNA, 25 bp, Mus musculus
accgagaaacttcgaccagtggagc

SEQ ID NO: 360480 - DNA, 25 bp, Mus musculus
tatccatcgcgtgcaagtgtccctg

SEQ ID NO: 360481 - DNA, 25 bp, Mus musculus
cgccacttccttttaggcagctaca

SEQ ID NO: 360482 - DNA, 25 bp, Mus musculus
cggcaccacagagtgttttcaggta

SEQ ID NO: 360483 - DNA, 25 bp, Mus musculus
acagagccctggggcgtgcctccga

SEQ ID NO: 360484 - DNA, 25 bp, Mus musculus
agggtggcccggtgaggtccacaga

SEQ ID NO: 360485 - DNA, 25 bp, Mus musculus
taggcggtagacagggctgagggtt

SEQ ID NO: 360486 - DNA, 25 bp, Mus musculus
ttttcaggtaactggctgcgggtag

SEQ ID NO: 360487 - DNA, 25 bp, Mus musculus
agagtgttttcaggtaactggctgc

SEQ ID NO: 360488 - DNA, 25 bp, Mus musculus
cacagagtgttttcaggtaactggc

SEQ ID NO: 360489 - DNA, 25 bp, Mus musculus
accacagagtgttttcaggtaactg

SEQ ID NO: 360490 - DNA, 25 bp, Mus musculus
gcagaatagtttccgtttccggtgc

SEQ ID NO: 360491 - DNA, 25 bp, Mus musculus
cgtttccggtgccaaagggcacgtg

SEQ ID NO: 360492 - DNA, 25 bp, Mus musculus
ccaaagggcacgtggaatgtaaaca

SEQ ID NO: 360493 - DNA, 25 bp, Mus musculus
gcacgtggaatgtaaacacggcacc

SEQ ID NO: 360494 - DNA, 25 bp, Mus musculus
gtgcctccgacctgggcacggggcg

SEQ ID NO: 360495 - DNA, 25 bp, Mus musculus
tggaatgtaaacacggcaccacaga

SEQ ID NO: 360496 - DNA, 25 bp, Mus musculus
gggttcacgcgctctcccattgcgt

SEQ ID NO: 360497 - DNA, 25 bp, Mus musculus
gcctcttttagatgcatgcggtagc

SEQ ID NO: 360498 - DNA, 25 bp, Mus musculus
ccgcacgtgaacacgtttcttcctg

SEQ ID NO: 360499 - DNA, 25 bp, Mus musculus
gtgcatgcagcgagcctcttttaga

SEQ ID NO: 360500 - DNA, 25 bp, Mus musculus
tttcttcctgcaccggacgccggag

SEQ ID NO: 360501 - DNA, 25 bp, Mus musculus
tttatcctggcagcgtgtgcatgca

SEQ ID NO: 360502 - DNA, 25 bp, Mus musculus
ggtgcggctcttttatcctggcagc

SEQ ID NO: 360503 - DNA, 25 bp, Mus musculus
cattttagggtccttgggtgacacg

SEQ ID NO: 360504 - DNA, 25 bp, Mus musculus
atccattctcaagcgcggcacgggg

SEQ ID NO: 360505 - DNA, 25 bp, Mus musculus
cctgccgggctgatccattctcaag

SEQ ID NO: 360506 - DNA, 25 bp, Mus musculus
ccgccctgtagtgcaggcggcgctt

SEQ ID NO: 360507 - DNA, 25 bp, Mus musculus
ccaattggttaggagcttcgcgtcg

SEQ ID NO: 360508 - DNA, 25 bp, Mus musculus
ggcgctcgcaactcccttgagtgtg

SEQ ID NO: 360509 - DNA, 25 bp, Mus musculus
gcccagtccttatatccaattggtt

SEQ ID NO: 360510 - DNA, 25 bp, Mus musculus
cccgttgctctgagtggactgcacg

SEQ ID NO: 360511 - DNA, 25 bp, Mus musculus
ccacagggcacggacgcgagtgtac

SEQ ID NO: 360512 - DNA, 25 bp, Mus musculus
actgcacggactgctcgctggccga

SEQ ID NO: 360513 - DNA, 25 bp, Mus musculus
cgctggccgaggagcacgtgctcat

SEQ ID NO: 360514 - DNA, 25 bp, Mus musculus
ctctgagtggactgcacggactgct

SEQ ID NO: 360515 - DNA, 25 bp, Mus musculus
ttagtacggaggtttagaagagctg

SEQ ID NO: 360516 - DNA, 25 bp, Mus musculus
gcggtcactgctgcacagtgctgga

SEQ ID NO: 360517 - DNA, 25 bp, Mus musculus
ctggagaaggcggtcactgctgcac

SEQ ID NO: 360518 - DNA, 25 bp, Mus musculus
actcagacaatgcacaggagagctg

SEQ ID NO: 360519 - DNA, 25 bp, Mus musculus
ggccacggacgtgtctactcagaca

SEQ ID NO: 360520 - DNA, 25 bp, Mus musculus
gcacggacgcgagtgtacacacaga

SEQ ID NO: 360521 - DNA, 25 bp, Mus musculus
agcacgtgctcatgcggtctgtgtc

SEQ ID NO: 360522 - DNA, 25 bp, Mus musculus
ttagaggtggctgcattcgtttggt

SEQ ID NO: 360523 - DNA, 25 bp, Mus musculus
tgtacacacagaggccacggacgtg

SEQ ID NO: 360524 - DNA, 25 bp, Mus musculus
acctactccgtgacaagggcgcgtg

SEQ ID NO: 360525 - DNA, 25 bp, Mus musculus
cgcatggcttcagcgtgcttcacgt

SEQ ID NO: 360526 - DNA, 25 bp, Mus musculus
ttcacgtccgttaaaatgcctatgg

SEQ ID NO: 360527 - DNA, 25 bp, Mus musculus
tgcctatggacacaagagggccgtc

SEQ ID NO: 360528 - DNA, 25 bp, Mus musculus
cccttccgagtttcaagtagtcatt

SEQ ID NO: 360529 - DNA, 25 bp, Mus musculus
gcatttttgatgtagaagcccttcc

SEQ ID NO: 360530 - DNA, 25 bp, Mus musculus
tggaaaggggttctacacctgccgc

SEQ ID NO: 360531 - DNA, 25 bp, Mus musculus
acacctgccgccagattgatggagg

SEQ ID NO: 360532 - DNA, 25 bp, Mus musculus
ccgacgagggcactgggttcctcaa

SEQ ID NO: 360533 - DNA, 25 bp, Mus musculus
ggttcctcaaggagacgccgtcctc

SEQ ID NO: 360534 - DNA, 25 bp, Mus musculus
tcggctcacgatagcgacctcaggc

SEQ ID NO: 360535 - DNA, 25 bp, Mus musculus
ctgctgtgaagatggcgctgtccag

SEQ ID NO: 360536 - DNA, 25 bp, Mus musculus
ctgggttttgcttttccatgcagga

SEQ ID NO: 360537 - DNA, 25 bp, Mus musculus
gctggacgcctagaaacccttccga

SEQ ID NO: 360538 - DNA, 25 bp, Mus musculus
atggagtctacacttggcccacacc

SEQ ID NO: 360539 - DNA, 25 bp, Mus musculus
ctgtagggcagttgcccgccttgaa

SEQ ID NO: 360540 - DNA, 25 bp, Mus musculus
gaggctgcggatcctcggctacact

SEQ ID NO: 360541 - DNA, 25 bp, Mus musculus
ctgcctcttataggcgccggcgcgt

SEQ ID NO: 360542 - DNA, 25 bp, Mus musculus
ctactcagcccgtgtgcaaggaggg

SEQ ID NO: 360543 - DNA, 25 bp, Mus musculus
gaggcggccagtgcccaaaagccct

SEQ ID NO: 360544 - DNA, 25 bp, Mus musculus
gctgcagcgctctgcctcttatagg

SEQ ID NO: 360545 - DNA, 25 bp, Mus musculus
acggctgcccgagaactgctgccag

SEQ ID NO: 360546 - DNA, 25 bp, Mus musculus
cggctaacaataggctccggctgca

SEQ ID NO: 360547 - DNA, 25 bp, Mus musculus
tcccggctccggctaacaataggct

SEQ ID NO: 360548 - DNA, 25 bp, Mus musculus
cccgggcagcgaagaccagaaccgt

SEQ ID NO: 360549 - DNA, 25 bp, Mus musculus
gctgcctactcagcccgtgtgcaag

SEQ ID NO: 360550 - DNA, 25 bp, Mus musculus
agcgaagaccagaaccgtcccggct

SEQ ID NO: 360551 - DNA, 25 bp, Mus musculus
cccgagaactgctgccaggcaagga

SEQ ID NO: 360552 - DNA, 25 bp, Mus musculus
ctcggtcctgacagtagagcagaac

SEQ ID NO: 360553 - DNA, 25 bp, Mus musculus
ggctatcgacgcgaaggcttccgcc

SEQ ID NO: 360554 - DNA, 25 bp, Mus musculus
cttcgcagcggtgataggctatcga

SEQ ID NO: 360555 - DNA, 25 bp, Mus musculus
agagactggttctgtcttcgcagcg

SEQ ID NO: 360556 - DNA, 25 bp, Mus musculus
atggcgcaacgtcaccatccatcta

SEQ ID NO: 360557 - DNA, 25 bp, Mus musculus
caaccaatcaggacgtccgctacgg

SEQ ID NO: 360558 - DNA, 25 bp, Mus musculus
gcctcgcttccggtcaaccagataa

SEQ ID NO: 360559 - DNA, 25 bp, Mus musculus
cctggaagcgtggacagcgaaagtt

SEQ ID NO: 360560 - DNA, 25 bp, Mus musculus
tggaagtcagctacaaacccagctc

SEQ ID NO: 360561 - DNA, 25 bp, Mus musculus
cccggcagacagcacagtggaagtc

SEQ ID NO: 360562 - DNA, 25 bp, Mus musculus
ggagcgtaactctacccggcagaca

SEQ ID NO: 360563 - DNA, 25 bp, Mus musculus
tcgatcacttcgtcggctagcggca

SEQ ID NO: 360564 - DNA, 25 bp, Mus musculus
tcggcgcagactcgaagcgcaaacc

SEQ ID NO: 360565 - DNA, 25 bp, Mus musculus
ctcagcctcaaagcggagacgcgca

SEQ ID NO: 360566 - DNA, 25 bp, Mus musculus
acacgctgacactgagccctacggg

SEQ ID NO: 360567 - DNA, 25 bp, Mus musculus
ctgaaagacgttcagcttgctggtg

SEQ ID NO: 360568 - DNA, 25 bp, Mus musculus
cctcccggtcgtagttgagctcctt

SEQ ID NO: 360569 - DNA, 25 bp, Mus musculus
tctggcgtcgattacagaaccagac

SEQ ID NO: 360570 - DNA, 25 bp, Mus musculus
gccctacgggatctgaaagacgttc

SEQ ID NO: 360571 - DNA, 25 bp, Mus musculus
gatctccgtgatctcctggccggtg

SEQ ID NO: 360572 - DNA, 25 bp, Mus musculus
aagtgcgccgcttgcgtttcttgga

SEQ ID NO: 360573 - DNA, 25 bp, Mus musculus
agtaggcattgagagcctctatggc

SEQ ID NO: 360574 - DNA, 25 bp, Mus musculus
gggtttttctcaaagtaggcattga

SEQ ID NO: 360575 - DNA, 25 bp, Mus musculus
cagcttgctggtgttcttcagtgtc

SEQ ID NO: 360576 - DNA, 25 bp, Mus musculus
tcttcagtgtctggcgtcgattaca

SEQ ID NO: 360577 - DNA, 25 bp, Mus musculus
cctctatggcctgcggtgtgaagga

SEQ ID NO: 360578 - DNA, 25 bp, Mus musculus
tttcttggagggctcgccgcccacg

SEQ ID NO: 360579 - DNA, 25 bp, Mus musculus
gagctccttggcgatctccgtgatc

SEQ ID NO: 360580 - DNA, 25 bp, Mus musculus
cctcctcgagtgtccgcggggaccg

SEQ ID NO: 360581 - DNA, 25 bp, Mus musculus
tagcggtgacaggtcgccagggaac

SEQ ID NO: 360582 - DNA, 25 bp, Mus musculus
cgggatccaggactctacgtgcctc

SEQ ID NO: 360583 - DNA, 25 bp, Mus musculus
gcagggcgtccacccaagcggccgc

SEQ ID NO: 360584 - DNA, 25 bp, Mus musculus
cggccctcgactcccagagctccag

SEQ ID NO: 360585 - DNA, 25 bp, Mus musculus
cgcgcctttttctctctttatcata

SEQ ID NO: 360586 - DNA, 25 bp, Mus musculus
aaattatgctaattacgggcattgc

SEQ ID NO: 360587 - DNA, 25 bp, Mus musculus
gctaattacgggcattgcatattaa

SEQ ID NO: 360588 - DNA, 25 bp, Mus musculus
cgggcattgcatattaaccaaattc

SEQ ID NO: 360589 - DNA, 25 bp, Mus musculus
gcatattaaccaaattcgaaacctc

SEQ ID NO: 360590 - DNA, 25 bp, Mus musculus
agcggccaccggctagacactcatc

SEQ ID NO: 360591 - DNA, 25 bp, Mus musculus
gccgcccgcagacaaagaagccgga

SEQ ID NO: 360592 - DNA, 25 bp, Mus musculus
cgcagacaaagaagccggagcggct

SEQ ID NO: 360593 - DNA, 25 bp, Mus musculus
ggatccaggactctacgtgcctctc

SEQ ID NO: 360594 - DNA, 25 bp, Mus musculus
ggagtccgttcaccaaggacctctc

SEQ ID NO: 360595 - DNA, 25 bp, Mus musculus
tctggacaactgagcgcgggctaaa

SEQ ID NO: 360596 - DNA, 25 bp, Mus musculus
gacgtcgtcgctactcttctggaca

SEQ ID NO: 360597 - DNA, 25 bp, Mus musculus
aaatgtgatcactgtcctaagagac

SEQ ID NO: 360598 - DNA, 25 bp, Mus musculus
gcgttcggttgctcagcagatattc

SEQ ID NO: 360599 - DNA, 25 bp, Mus musculus
tgcatctatgagagcgcgttcggtt

SEQ ID NO: 360600 - DNA, 25 bp, Mus musculus
ggtcggttcctctgtgcatctatga

SEQ ID NO: 360601 - DNA, 25 bp, Mus musculus
tgaccacgcacaacacgaacttctg

SEQ ID NO: 360602 - DNA, 25 bp, Mus musculus
tgtcggacgaatcaggagtccgttc

SEQ ID NO: 360603 - DNA, 25 bp, Mus musculus
gacacggtccatctccgagcacgaa

SEQ ID NO: 360604 - DNA, 25 bp, Mus musculus
agcgcgggctaaaccactcacaaca

SEQ ID NO: 360605 - DNA, 25 bp, Mus musculus
ctcacaacatctgtagggagttttc

SEQ ID NO: 360606 - DNA, 25 bp, Mus musculus
acttctgcagacagctgcggcggtc

SEQ ID NO: 360607 - DNA, 25 bp, Mus musculus
tggggcacggtctatctcaggacag

SEQ ID NO: 360608 - DNA, 25 bp, Mus musculus
agcttaactgctgaggtgccggctc

SEQ ID NO: 360609 - DNA, 25 bp, Mus musculus
ccctgtgcgttgctaatgtttgtga

SEQ ID NO: 360610 - DNA, 25 bp, Mus musculus
ctcggaacaacaggcctcggccgag

SEQ ID NO: 360611 - DNA, 25 bp, Mus musculus
gcactcgggcatctcctgacgcaga

SEQ ID NO: 360612 - DNA, 25 bp, Mus musculus
gcttttccgtgacggacagcggctg

SEQ ID NO: 360613 - DNA, 25 bp, Mus musculus
tctgtgcggctctcttcagcgggcc

SEQ ID NO: 360614 - DNA, 25 bp, Mus musculus
agtgggagcggactcagagccacca

SEQ ID NO: 360615 - DNA, 25 bp, Mus musculus
gcctcggccgagcttaactgctgag

SEQ ID NO: 360616 - DNA, 25 bp, Mus musculus
ataaccgtccgcgacgccgagtggg

SEQ ID NO: 360617 - DNA, 25 bp, Mus musculus
ctccgaacaggaagaggacgagaaa

SEQ ID NO: 360618 - DNA, 25 bp, Mus musculus
cgtgacacggaagtgactccgaaca

SEQ ID NO: 360619 - DNA, 25 bp, Mus musculus
tggacgaacgtcacgtgacacggaa

SEQ ID NO: 360620 - DNA, 25 bp, Mus musculus
tcctgacgcagagtggacgaacgtc

SEQ ID NO: 360621 - DNA, 25 bp, Mus musculus
tgtttgtgagaacatggtcgcgttc

SEQ ID NO: 360622 - DNA, 25 bp, Mus musculus
tgagcgatccgggtcccttagccac

SEQ ID NO: 360623 - DNA, 25 bp, Mus musculus
cccatgagcgatccgggtcccttag

SEQ ID NO: 360624 - DNA, 25 bp, Mus musculus
gaaaggccactgtccggagccgctc

SEQ ID NO: 360625 - DNA, 25 bp, Mus musculus
tagccacctgcattacctgggcttc

SEQ ID NO: 360626 - DNA, 25 bp, Mus musculus
cacctgcattacctgggcttccagg

SEQ ID NO: 360627 - DNA, 25 bp, Mus musculus
agccgcgcagtacccgtgcgggtca

SEQ ID NO: 360628 - DNA, 25 bp, Mus musculus
cgcgcgtccttttgaactcgccggg

SEQ ID NO: 360629 - DNA, 25 bp, Mus musculus
cgtgtcccgcgggagctcagtcacg

SEQ ID NO: 360630 - DNA, 25 bp, Mus musculus
tgggccctctggagtccgcgacttc

SEQ ID NO: 360631 - DNA, 25 bp, Mus musculus
agtccgcgacttcggggcgacttag

SEQ ID NO: 360632 - DNA, 25 bp, Mus musculus
tcggggcgacttagccgagcacctc

SEQ ID NO: 360633 - DNA, 25 bp, Mus musculus
ttccgcgtgcgaccttcccaggagg

SEQ ID NO: 360634 - DNA, 25 bp, Mus musculus
ccggttgcgcccatgagcgatccgg

SEQ ID NO: 360635 - DNA, 25 bp, Mus musculus
ctcagtcacgcgtgggccctctgga

SEQ ID NO: 360636 - DNA, 25 bp, Mus musculus
cttgagcacacgaggtggtcaaatc

SEQ ID NO: 360637 - DNA, 25 bp, Mus musculus
cgagagcagcaagccacggtgtgca

SEQ ID NO: 360638 - DNA, 25 bp, Mus musculus
acctgctccgcagggcgagagcagc

SEQ ID NO: 360639 - DNA, 25 bp, Mus musculus
aggccagactgcatcgcgggcagct

SEQ ID NO: 360640 - DNA, 25 bp, Mus musculus
cgctcacgttgggtgcacggtccga

SEQ ID NO: 360641 - DNA, 25 bp, Mus musculus
gcaggtgctgtgactccgctcccaa

SEQ ID NO: 360642 - DNA, 25 bp, Mus musculus
ccgagctgctcgtgggtttcccgac

SEQ ID NO: 360643 - DNA, 25 bp, Mus musculus
gtcgcgacccgttgctgcttaccta

SEQ ID NO: 360644 - DNA, 25 bp, Mus musculus
gcaccatggggtcgcgacccgttgc

SEQ ID NO: 360645 - DNA, 25 bp, Mus musculus
cgagagacgctagatggcaccgcgc

SEQ ID NO: 360646 - DNA, 25 bp, Mus musculus
gggtctcaccgcgagagacgctaga

SEQ ID NO: 360647 - DNA, 25 bp, Mus musculus
ttaaccgcagaggtgaaggggtctc

SEQ ID NO: 360648 - DNA, 25 bp, Mus musculus
gcaagccacggtgtgcaacgtgctg

SEQ ID NO: 360649 - DNA, 25 bp, Mus musculus
ctcagcttcttaaccgcagaggtga

SEQ ID NO: 360650 - DNA, 25 bp, Mus musculus
gcaggtttaagttccgcccactcta

SEQ ID NO: 360651 - DNA, 25 bp, Mus musculus
accggttgctacaaggctaccctag

SEQ ID NO: 360652 - DNA, 25 bp, Mus musculus
tgctacaaggctaccctagaaaccg

SEQ ID NO: 360653 - DNA, 25 bp, Mus musculus
tagaaaccgaggactcccgcgagcg

SEQ ID NO: 360654 - DNA, 25 bp, Mus musculus
aggactcccgcgagcgcttgggtct

SEQ ID NO: 360655 - DNA, 25 bp, Mus musculus
gccctgcaggtttaagttccgccca

SEQ ID NO: 360656 - DNA, 25 bp, Mus musculus
tttgacgtccttttccaagcccagc

SEQ ID NO: 360657 - DNA, 25 bp, Mus musculus
cctaagcgcagtttctgggttcatt

SEQ ID NO: 360658 - DNA, 25 bp, Mus musculus
agcgcagtttctgggttcattggcc

SEQ ID NO: 360659 - DNA, 25 bp, Mus musculus
gccctcagatccaatgtgtccatct

SEQ ID NO: 360660 - DNA, 25 bp, Mus musculus
tcagatccaatgtgtccatctcgcc

SEQ ID NO: 360661 - DNA, 25 bp, Mus musculus
agtcggccactctcgactacatatc

SEQ ID NO: 360662 - DNA, 25 bp, Mus musculus
cctgcccgtacccattcacagttcg

SEQ ID NO: 360663 - DNA, 25 bp, Mus musculus
ttttagaagtacaccgggccctgca

SEQ ID NO: 360664 - DNA, 25 bp, Mus musculus
ccggtgtcccggagcagtgacctct

SEQ ID NO: 360665 - DNA, 25 bp, Mus musculus
tggtagcccagggtaccgccggaca

SEQ ID NO: 360666 - DNA, 25 bp, Mus musculus
ggcgtcctcagctatcaggtgggcc

SEQ ID NO: 360667 - DNA, 25 bp, Mus musculus
agcaacgagccggacggcgtcctca

SEQ ID NO: 360668 - DNA, 25 bp, Mus musculus
tcaacctggaacctaccggcgagac

SEQ ID NO: 360669 - DNA, 25 bp, Mus musculus
tgcagctcaacctggaacctaccgg

SEQ ID NO: 360670 - DNA, 25 bp, Mus musculus
cagggcgcggactgctgcagctcaa

SEQ ID NO: 360671 - DNA, 25 bp, Mus musculus
ctcacactggactacagggcgcgga

SEQ ID NO: 360672 - DNA, 25 bp, Mus musculus
cgtgcgatcgtctcacactggacta

SEQ ID NO: 360673 - DNA, 25 bp, Mus musculus
ttgaccgatccttggatccagggta

SEQ ID NO: 360674 - DNA, 25 bp, Mus musculus
gcgccggttgatggttgaccgatcc

SEQ ID NO: 360675 - DNA, 25 bp, Mus musculus
cgcctcgcgggctgatggctatgaa

SEQ ID NO: 360676 - DNA, 25 bp, Mus musculus
tgattggctgctcggggcgccctct

SEQ ID NO: 360677 - DNA, 25 bp, Mus musculus
agcagtgacctctgtccgcgggtcc

SEQ ID NO: 360678 - DNA, 25 bp, Mus musculus
cggctcttcttgtgcttgtgggcca

SEQ ID NO: 360679 - DNA, 25 bp, Mus musculus
gacctcccggctcttcttgtgcttg

SEQ ID NO: 360680 - DNA, 25 bp, Mus musculus
atccgcgctcttacggacctcccgg

SEQ ID NO: 360681 - DNA, 25 bp, Mus musculus
gaatccttctgcgatccagcatccg

SEQ ID NO: 360682 - DNA, 25 bp, Mus musculus
cgctgtcatccgaatccttctgcga

SEQ ID NO: 360683 - DNA, 25 bp, Mus musculus
ggcagcgctgtcatccgaatccttc

SEQ ID NO: 360684 - DNA, 25 bp, Mus musculus
ttcgatggtttcatcctgcggggtg

SEQ ID NO: 360685 - DNA, 25 bp, Mus musculus
gacccacctcttcgatggtttcatc

SEQ ID NO: 360686 - DNA, 25 bp, Mus musculus
ttcgcgtagacccacctcttcgatg

SEQ ID NO: 360687 - DNA, 25 bp, Mus musculus
ggcaacccaagcctttcgcgtagac

SEQ ID NO: 360688 - DNA, 25 bp, Mus musculus
tgcccatcggccttaccgctgctga

SEQ ID NO: 360689 - DNA, 25 bp, Mus musculus
acggggctcgtgagccacttgcgca

SEQ ID NO: 360690 - DNA, 25 bp, Mus musculus
gccgcacggggctcgtgagccactt

SEQ ID NO: 360691 - DNA, 25 bp, Mus musculus
ggccagcttcttcgcatgcccatcg

SEQ ID NO: 360692 - DNA, 25 bp, Mus musculus
tcgtgcacccaccatgctcaggttt

SEQ ID NO: 360693 - DNA, 25 bp, Mus musculus
tcaggtttctggagccccaccgcgg

SEQ ID NO: 360694 - DNA, 25 bp, Mus musculus
gcacccaccacgctcaggtttctgg

SEQ ID NO: 360695 - DNA, 25 bp, Mus musculus
tcccaccgcgatcgtgcacccacca

SEQ ID NO: 360696 - DNA, 25 bp, Mus musculus
cccaccgcgggcgtgcacccaccat

SEQ ID NO: 360697 - DNA, 25 bp, Mus musculus
gatcgtgcacccaccatgctcaggt

SEQ ID NO: 360698 - DNA, 25 bp, Mus musculus
gagtcccaccgcgatcgtgcaccca

SEQ ID NO: 360699 - DNA, 25 bp, Mus musculus
cgtgcacccaccatgctcaggtttc

SEQ ID NO: 360700 - DNA, 25 bp, Mus musculus
gcacccaccatgctcaggtttctgg

SEQ ID NO: 360701 - DNA, 25 bp, Mus musculus
gcgtgcacccaccatgctcaggttt

SEQ ID NO: 360702 - DNA, 25 bp, Mus musculus
tttctggagccccaccgcgggcgtg

SEQ ID NO: 360703 - DNA, 25 bp, Mus musculus
cacccaccatgctcaggtttctgga

SEQ ID NO: 360704 - DNA, 25 bp, Mus musculus
ggcgtgcacccaccatgctcaggtt

SEQ ID NO: 360705 - DNA, 25 bp, Mus musculus
ttctggagtcccaccgcgatcgtgc

SEQ ID NO: 360706 - DNA, 25 bp, Mus musculus
ctttgcacgggtgtttggaagtctt

SEQ ID NO: 360707 - DNA, 25 bp, Mus musculus
aggatgggggaccaccagctcccac

SEQ ID NO: 360708 - DNA, 25 bp, Mus musculus
tttgccggggttcctgaggaggatg

SEQ ID NO: 360709 - DNA, 25 bp, Mus musculus
tgcttccttctacggtgtttgccgg

SEQ ID NO: 360710 - DNA, 25 bp, Mus musculus
ggctttgccgcagagcgcacggcgc

SEQ ID NO: 360711 - DNA, 25 bp, Mus musculus
ttggaagtcttgcttccttctacgg

SEQ ID NO: 360712 - DNA, 25 bp, Mus musculus
cctccaggttgcctggtcgtccagg

SEQ ID NO: 360713 - DNA, 25 bp, Mus musculus
ccaggttgcctggtcgtccagggac

SEQ ID NO: 360714 - DNA, 25 bp, Mus musculus
ccttcgtgctttgcacgggtgtttg

SEQ ID NO: 360715 - DNA, 25 bp, Mus musculus
tttatgcccttcgtgctttgcacgg

SEQ ID NO: 360716 - DNA, 25 bp, Mus musculus
aagatggcgcccaccgcagtcccgc

SEQ ID NO: 360717 - DNA, 25 bp, Mus musculus
gggtttatgcccttcgtgctttgca

SEQ ID NO: 360718 - DNA, 25 bp, Mus musculus
gagcggggtttatgcccttcgtgct

SEQ ID NO: 360719 - DNA, 25 bp, Mus musculus
gtcttgcttccttctacggtgtttg

SEQ ID NO: 360720 - DNA, 25 bp, Mus musculus
atcgggcctggctcgcacatcgggc

SEQ ID NO: 360721 - DNA, 25 bp, Mus musculus
tgaaacgcaacagcaccgtggactg

SEQ ID NO: 360722 - DNA, 25 bp, Mus musculus
ccggttcggagaacgagttcgcaga

SEQ ID NO: 360723 - DNA, 25 bp, Mus musculus
tggtgtcgctcatcgggcctggctc

SEQ ID NO: 360724 - DNA, 25 bp, Mus musculus
aacagcaccgtggactgcaatggcg

SEQ ID NO: 360725 - DNA, 25 bp, Mus musculus
tgcggcgcagcgtgaaacgcaacag

SEQ ID NO: 360726 - DNA, 25 bp, Mus musculus
ggctacagccagtgcagccgctcgt

SEQ ID NO: 360727 - DNA, 25 bp, Mus musculus
ggctacagcggctacagccagtgca

SEQ ID NO: 360728 - DNA, 25 bp, Mus musculus
agctacagcggctacagcggctaca

SEQ ID NO: 360729 - DNA, 25 bp, Mus musculus
cgcagcagctacagcggctacagcg

SEQ ID NO: 360730 - DNA, 25 bp, Mus musculus
agggccggcgcgactcgctcttcat

SEQ ID NO: 360731 - DNA, 25 bp, Mus musculus
acgacgagcacagcacagtggagga

SEQ ID NO: 360732 - DNA, 25 bp, Mus musculus
gttcgcagacgacgagcacagcaca

SEQ ID NO: 360733 - DNA, 25 bp, Mus musculus
gactgcaatggcgtggtgtcgctca

SEQ ID NO: 360734 - DNA, 25 bp, Mus musculus
caccctgctctttgccttaatgatg

SEQ ID NO: 360735 - DNA, 25 bp, Mus musculus
tgccttaatgatgtcgctgcccgcc

SEQ ID NO: 360736 - DNA, 25 bp, Mus musculus
atcttctccatctttgggatgtcca

SEQ ID NO: 360737 - DNA, 25 bp, Mus musculus
tgggatgtccaacttcgcgtacgtg

SEQ ID NO: 360738 - DNA, 25 bp, Mus musculus
tccaacttcgcgtacgtgaagcacg

SEQ ID NO: 360739 - DNA, 25 bp, Mus musculus
gtacgtgaagcacgaggccggcatt

SEQ ID NO: 360740 - DNA, 25 bp, Mus musculus
gggcgccaaagggatccgcaccctg

SEQ ID NO: 360741 - DNA, 25 bp, Mus musculus
tgatgacatgttcaacttcgagacg

SEQ ID NO: 360742 - DNA, 25 bp, Mus musculus
attggcccgcatcgggcgcatcttg

SEQ ID NO: 360743 - DNA, 25 bp, Mus musculus
cgaggccggcattgatgacatgttc

SEQ ID NO: 360744 - DNA, 25 bp, Mus musculus
tcgggcgcatcttgcgtctgatcaa

SEQ ID NO: 360745 - DNA, 25 bp, Mus musculus
tattccgcgtcatccgattggcccg

SEQ ID NO: 360746 - DNA, 25 bp, Mus musculus
accctattccgcgtcatccgattgg

SEQ ID NO: 360747 - DNA, 25 bp, Mus musculus
tgcgtctgatcaagggcgccaaagg

SEQ ID NO: 360748 - DNA, 25 bp, Mus musculus
ggttcgtggcgtccaatccttccaa

SEQ ID NO: 360749 - DNA, 25 bp, Mus musculus
agtgtcttacgagcctatcacgacc

SEQ ID NO: 360750 - DNA, 25 bp, Mus musculus
caaagtgtcttacgagcctatcacg

SEQ ID NO: 360751 - DNA, 25 bp, Mus musculus
ttccaaagtgtcttacgagcctatc

SEQ ID NO: 360752 - DNA, 25 bp, Mus musculus
atccttccaaagtgtcttacgagcc

SEQ ID NO: 360753 - DNA, 25 bp, Mus musculus
cgtccaatccttccaaagtgtctta

SEQ ID NO: 360754 - DNA, 25 bp, Mus musculus
tggcgtccaatccttccaaagtgtc

SEQ ID NO: 360755 - DNA, 25 bp, Mus musculus
aggagcggttcgtggcgtccaatcc

SEQ ID NO: 360756 - DNA, 25 bp, Mus musculus
cgtggcgtccaatccttccaaagtg

SEQ ID NO: 360757 - DNA, 25 bp, Mus musculus
ttacgagcctatcacgaccactctg

SEQ ID NO: 360758 - DNA, 25 bp, Mus musculus
gttggacatcctgcggcagcagatg

SEQ ID NO: 360759 - DNA, 25 bp, Mus musculus
gagttggacatcctgcggcagcaga

SEQ ID NO: 360760 - DNA, 25 bp, Mus musculus
agcctatcacgaccactctgcggcg

SEQ ID NO: 360761 - DNA, 25 bp, Mus musculus
acatcctgcggcagcagatggagga

SEQ ID NO: 360762 - DNA, 25 bp, Mus musculus
gtaagctggccgactttgccgacgc

SEQ ID NO: 360763 - DNA, 25 bp, Mus musculus
cgccgatcctctgagcgaggacgac

SEQ ID NO: 360764 - DNA, 25 bp, Mus musculus
gcgaggacgacttcgagactttcta

SEQ ID NO: 360765 - DNA, 25 bp, Mus musculus
cttcgagactttctatgagatctgg

SEQ ID NO: 360766 - DNA, 25 bp, Mus musculus
ctgggagaagtttgatcctgatgcc

SEQ ID NO: 360767 - DNA, 25 bp, Mus musculus
aagtttgatcctgatgccacccagt

SEQ ID NO: 360768 - DNA, 25 bp, Mus musculus
cgagtactgtaagctggccgacttt

SEQ ID NO: 360769 - DNA, 25 bp, Mus musculus
cgccctggagcatccgctccgagta

SEQ ID NO: 360770 - DNA, 25 bp, Mus musculus
acaccatcgagctcatcgccatgga

SEQ ID NO: 360771 - DNA, 25 bp, Mus musculus
ccatggtgagcggagatcgaatcca

SEQ ID NO: 360772 - DNA, 25 bp, Mus musculus
ggagatcgaatccactgcttggaca

SEQ ID NO: 360773 - DNA, 25 bp, Mus musculus
tgcttggacatccttttcgccttca

SEQ ID NO: 360774 - DNA, 25 bp, Mus musculus
ttcgccttcaccaagcgagtcctgg

SEQ ID NO: 360775 - DNA, 25 bp, Mus musculus
gccacccagttcatcgagtactgta

SEQ ID NO: 360776 - DNA, 25 bp, Mus musculus
tgaacgaaagtggttgcactcctcg

SEQ ID NO: 360777 - DNA, 25 bp, Mus musculus
aacctcactggactcggatgtgccc

SEQ ID NO: 360778 - DNA, 25 bp, Mus musculus
gcgccgccgtcaagcggttcacaga

SEQ ID NO: 360779 - DNA, 25 bp, Mus musculus
tcgggtacctcgaggagtgaacgaa

SEQ ID NO: 360780 - DNA, 25 bp, Mus musculus
gcgtcgccagcaagtcctcagataa

SEQ ID NO: 360781 - DNA, 25 bp, Mus musculus
gcggcagcggtcagaaacctcactg

SEQ ID NO: 360782 - DNA, 25 bp, Mus musculus
gcctgagcggccaaccaggttgcca

SEQ ID NO: 360783 - DNA, 25 bp, Mus musculus
aggttcttggccagctcccgtgcca

SEQ ID NO: 360784 - DNA, 25 bp, Mus musculus
tgcaggtaatttgcgccggtcctcc

SEQ ID NO: 360785 - DNA, 25 bp, Mus musculus
ggccaggagttgctgcaggtaattt

SEQ ID NO: 360786 - DNA, 25 bp, Mus musculus
gatccagcttgtcccagtcaggcgc

SEQ ID NO: 360787 - DNA, 25 bp, Mus musculus
ggcaggcgctccatgatcagatcca

SEQ ID NO: 360788 - DNA, 25 bp, Mus musculus
cgccggtgatccacagcgtgagcac

SEQ ID NO: 360789 - DNA, 25 bp, Mus musculus
cgggccaactccttgtccaggtcgg

SEQ ID NO: 360790 - DNA, 25 bp, Mus musculus
ggccaaagcagctcctcctctaggg

SEQ ID NO: 360791 - DNA, 25 bp, Mus musculus
agtctaccatcttgctgctcaccag

SEQ ID NO: 360792 - DNA, 25 bp, Mus musculus
ccttggccggctcgtaagcgtactt

SEQ ID NO: 360793 - DNA, 25 bp, Mus musculus
ggcggcctcagcaagggccaaagca

SEQ ID NO: 360794 - DNA, 25 bp, Mus musculus
cgtacttgcggtagcgggcttccgc

SEQ ID NO: 360795 - DNA, 25 bp, Mus musculus
gggcccgcagtctaccatcttgctg

SEQ ID NO: 360796 - DNA, 25 bp, Mus musculus
cgtccaccgccttgcgcttcagcga

SEQ ID NO: 360797 - DNA, 25 bp, Mus musculus
cggcgctcgtttgcgcgcagtagcc

SEQ ID NO: 360798 - DNA, 25 bp, Mus musculus
gcgcagtagccggacgccaggtacc

SEQ ID NO: 360799 - DNA, 25 bp, Mus musculus
cacgcgttgcccgtgtacagcggct

SEQ ID NO: 360800 - DNA, 25 bp, Mus musculus
gtacagcggctcagtcaggttgcca

SEQ ID NO: 360801 - DNA, 25 bp, Mus musculus
cggctcgtaagcgtacttgcggtag

SEQ ID NO: 360802 - DNA, 25 bp, Mus musculus
agcccaggaccttgagagggccgcc

SEQ ID NO: 360803 - DNA, 25 bp, Mus musculus
ggcccgaagaacagcacggtccgcg

SEQ ID NO: 360804 - DNA, 25 bp, Mus musculus
tctggacatcggaccgcacagtcgc

SEQ ID NO: 360805 - DNA, 25 bp, Mus musculus
cgcccgcggacaaagctctggacat

SEQ ID NO: 360806 - DNA, 25 bp, Mus musculus
acaaagctctggacatcggaccgca

SEQ ID NO: 360807 - DNA, 25 bp, Mus musculus
catcccggccgggtcctaggtgagt

SEQ ID NO: 360808 - DNA, 25 bp, Mus musculus
gccctccgacctccgcctagttgga

SEQ ID NO: 360809 - DNA, 25 bp, Mus musculus
gaccgaggggcgatctcaactggtc

SEQ ID NO: 360810 - DNA, 25 bp, Mus musculus
cagagtccgccgctcgctaacacca

SEQ ID NO: 360811 - DNA, 25 bp, Mus musculus
cgccgaggccaggactgagctcctg

SEQ ID NO: 360812 - DNA, 25 bp, Mus musculus
aaagagcaaatgaccctcggtgcga

SEQ ID NO: 360813 - DNA, 25 bp, Mus musculus
gtcagcggcgctcaccatcctgggg

SEQ ID NO: 360814 - DNA, 25 bp, Mus musculus
aatgaccctcggtgcgagcgtgtcc

SEQ ID NO: 360815 - DNA, 25 bp, Mus musculus
ggaaatgaccctgggctcccacgca

SEQ ID NO: 360816 - DNA, 25 bp, Mus musculus
agcgtgtccttgcaccactctcagg

SEQ ID NO: 360817 - DNA, 25 bp, Mus musculus
gacccgaacccgcaaatcctagctc

SEQ ID NO: 360818 - DNA, 25 bp, Mus musculus
cctggttgtttacgcgcgcgcatgc

SEQ ID NO: 360819 - DNA, 25 bp, Mus musculus
ctccggagaaatctcgggttatgtt

SEQ ID NO: 360820 - DNA, 25 bp, Mus musculus
ccgccaaatgggtcgggactctcgc

SEQ ID NO: 360821 - DNA, 25 bp, Mus musculus
agcttcctggttgtttacgcgcgcg

SEQ ID NO: 360822 - DNA, 25 bp, Mus musculus
ggcgccaagcttcctggttgtttac

SEQ ID NO: 360823 - DNA, 25 bp, Mus musculus
agagcgccgcgccaaaggaaagccc

SEQ ID NO: 360824 - DNA, 25 bp, Mus musculus
acagtccttagagcgccgcgccaaa

SEQ ID NO: 360825 - DNA, 25 bp, Mus musculus
tcaggcgcactttggacagtcctta

SEQ ID NO: 360826 - DNA, 25 bp, Mus musculus
attccctgtgatcaggcgcactttg

SEQ ID NO: 360827 - DNA, 25 bp, Mus musculus
gttagagggagtaagtcattccctg

SEQ ID NO: 360828 - DNA, 25 bp, Mus musculus
atgttgtccctggagtcccggttag

SEQ ID NO: 360829 - DNA, 25 bp, Mus musculus
ctcgggttatgttgtccctggagtc

SEQ ID NO: 360830 - DNA, 25 bp, Mus musculus
tcccagcttgagaactccggagaaa

SEQ ID NO: 360831 - DNA, 25 bp, Mus musculus
tcgcgctcacggtctgtgggtcgca

SEQ ID NO: 360832 - DNA, 25 bp, Mus musculus
ggagtcggccggagcctcctccttc

SEQ ID NO: 360833 - DNA, 25 bp, Mus musculus
acgccggtcaggagactctggcgac

SEQ ID NO: 360834 - DNA, 25 bp, Mus musculus
ttgtgtccagctcgctgcagcggga

SEQ ID NO: 360835 - DNA, 25 bp, Mus musculus
gtagttgtgtccagctcgctgcagc

SEQ ID NO: 360836 - DNA, 25 bp, Mus musculus
tcgcacaggtagttgtgtccagctc

SEQ ID NO: 360837 - DNA, 25 bp, Mus musculus
ctcgctcgcacaggtagttgtgtcc

SEQ ID NO: 360838 - DNA, 25 bp, Mus musculus
acagacgctcgctcgcacaggtagt

SEQ ID NO: 360839 - DNA, 25 bp, Mus musculus
aaacacagacgctcgctcgcacagg

SEQ ID NO: 360840 - DNA, 25 bp, Mus musculus
tcaggagactctggcgacgaaccca

SEQ ID NO: 360841 - DNA, 25 bp, Mus musculus
ctctggcgacgaacccagcgggaca

SEQ ID NO: 360842 - DNA, 25 bp, Mus musculus
gcgacgaacccagcgggacacaacg

SEQ ID NO: 360843 - DNA, 25 bp, Mus musculus
tttcggctcagctccgcacgggtgc

SEQ ID NO: 360844 - DNA, 25 bp, Mus musculus
accggctcccgggagctcacgtgcc

SEQ ID NO: 360845 - DNA, 25 bp, Mus musculus
ctttaaggcgggcgcacgcgcgcac

SEQ ID NO: 360846 - DNA, 25 bp, Mus musculus
agattcggtaccctgccttcttcct

SEQ ID NO: 360847 - DNA, 25 bp, Mus musculus
aggactatcaccctgccgagctgta

SEQ ID NO: 360848 - DNA, 25 bp, Mus musculus
tccgccgactcaggaagctgcagca

SEQ ID NO: 360849 - DNA, 25 bp, Mus musculus
agttcgggtggctctccgctccatt

SEQ ID NO: 360850 - DNA, 25 bp, Mus musculus
aggtgcgttacttaacctgcatccc

SEQ ID NO: 360851 - DNA, 25 bp, Mus musculus
acgcctctcgggagtctataaagca

SEQ ID NO: 360852 - DNA, 25 bp, Mus musculus
gcagcactggaggactatcaccctg

SEQ ID NO: 360853 - DNA, 25 bp, Mus musculus
cgtccctaacaccatcaagcagaga

SEQ ID NO: 360854 - DNA, 25 bp, Mus musculus
cactcgggtctcagaaggctgtagc

SEQ ID NO: 360855 - DNA, 25 bp, Mus musculus
aggtgcaaacctgcccactcgggtc

SEQ ID NO: 360856 - DNA, 25 bp, Mus musculus
ccttgctccgcccagaaggtgcaaa

SEQ ID NO: 360857 - DNA, 25 bp, Mus musculus
tgccttcttccttccgcaggataca

SEQ ID NO: 360858 - DNA, 25 bp, Mus musculus
gcctcgccgaaaggtgcgttactta

SEQ ID NO: 360859 - DNA, 25 bp, Mus musculus
tataaagcaaggctacacgcggccc

SEQ ID NO: 360860 - DNA, 25 bp, Mus musculus
ggtccagctaccagcggcccaaaag

SEQ ID NO: 360861 - DNA, 25 bp, Mus musculus
gagcgcgcccacatagacgaggaca

SEQ ID NO: 360862 - DNA, 25 bp, Mus musculus
cgtgggtaacctgacacgccggcgt

SEQ ID NO: 360863 - DNA, 25 bp, Mus musculus
tcggccctccagcaagagacaaaga

SEQ ID NO: 360864 - DNA, 25 bp, Mus musculus
tcaccggatcggaagaaggccgcga

SEQ ID NO: 360865 - DNA, 25 bp, Mus musculus
gtgagctcgtcctccgggacaccgg

SEQ ID NO: 360866 - DNA, 25 bp, Mus musculus
cccaaaagctattacagggcagagc

SEQ ID NO: 360867 - DNA, 25 bp, Mus musculus
gggcaaccgcggtactcaccggatc

SEQ ID NO: 360868 - DNA, 25 bp, Mus musculus
aggccgcgatgtcggctaggtcctt

SEQ ID NO: 360869 - DNA, 25 bp, Mus musculus
tgctgccgctcatggcttcggcggc

SEQ ID NO: 360870 - DNA, 25 bp, Mus musculus
ataatggggttggtggtccagctac

SEQ ID NO: 360871 - DNA, 25 bp, Mus musculus
agtcgggacactcgctgataatggg

SEQ ID NO: 360872 - DNA, 25 bp, Mus musculus
caccaaggctggatgacaggctaga

SEQ ID NO: 360873 - DNA, 25 bp, Mus musculus
cgtttcacagaaccgtacaccaagg

SEQ ID NO: 360874 - DNA, 25 bp, Mus musculus
ttgcttcccgggtcgctgccctttg

SEQ ID NO: 360875 - DNA, 25 bp, Mus musculus
gtaccgcagcttccgcagacggctg

SEQ ID NO: 360876 - DNA, 25 bp, Mus musculus
ctgcctctacggcgcaggcttgctt

SEQ ID NO: 360877 - DNA, 25 bp, Mus musculus
gcagacggctgctcaagttcatccc

SEQ ID NO: 360878 - DNA, 25 bp, Mus musculus
ccaaaggggacacagacgacgccgt

SEQ ID NO: 360879 - DNA, 25 bp, Mus musculus
ggtcgctgccctttgggcctctgct

SEQ ID NO: 360880 - DNA, 25 bp, Mus musculus
cgttaggcccgagctccgcggagac

SEQ ID NO: 360881 - DNA, 25 bp, Mus musculus
cagacgacgccgtgtaccacacgtg

SEQ ID NO: 360882 - DNA, 25 bp, Mus musculus
gtccgtgctgtttcccgcacctcgc

SEQ ID NO: 360883 - DNA, 25 bp, Mus musculus
gcacctcgctccacgctcagccgca

SEQ ID NO: 360884 - DNA, 25 bp, Mus musculus
cactctggactgaggcccgcgagca

SEQ ID NO: 360885 - DNA, 25 bp, Mus musculus
ggcgccggcctacgcaagaccaagt

SEQ ID NO: 360886 - DNA, 25 bp, Mus musculus
acgcaagaccaagtaccgcagcttc

SEQ ID NO: 360887 - DNA, 25 bp, Mus musculus
gtgtaccacacgtgcttctttgggg

SEQ ID NO: 360888 - DNA, 25 bp, Mus musculus
ggaagctcgggccaaatccggtctc

SEQ ID NO: 360889 - DNA, 25 bp, Mus musculus
cgttggctcaacgacgatttgcatg

SEQ ID NO: 360890 - DNA, 25 bp, Mus musculus
cgacgatttgcatgctctcacgcta

SEQ ID NO: 360891 - DNA, 25 bp, Mus musculus
tctcacgctattggctgcgagggcg

SEQ ID NO: 360892 - DNA, 25 bp, Mus musculus
gccaatggctgcagcggtgtttaca

SEQ ID NO: 360893 - DNA, 25 bp, Mus musculus
gtaatggaatcctggctagcccgcc

SEQ ID NO: 360894 - DNA, 25 bp, Mus musculus
actgcgcggtgacgtagcggcttcc

SEQ ID NO: 360895 - DNA, 25 bp, Mus musculus
cgccgcgttccttccggcttggtgt

SEQ ID NO: 360896 - DNA, 25 bp, Mus musculus
ccagcgccaaaggaagcgttggctc

SEQ ID NO: 360897 - DNA, 25 bp, Mus musculus
cggcttgggtgatgtaatggaatcc

SEQ ID NO: 360898 - DNA, 25 bp, Mus musculus
catggctcgcccgaggctcggtgct

SEQ ID NO: 360899 - DNA, 25 bp, Mus musculus
agctccctgcggactgcgcggtgac

SEQ ID NO: 360900 - DNA, 25 bp, Mus musculus
gtctatttgcatgcaccagcgccaa

SEQ ID NO: 360901 - DNA, 25 bp, Mus musculus
cgggcaatgacgtctatttgcatgc

SEQ ID NO: 360902 - DNA, 25 bp, Mus musculus
gccgccgggattccggagacgtcaa

SEQ ID NO: 360903 - DNA, 25 bp, Mus musculus
cgcgttatgtaacggggtgtgcggc

SEQ ID NO: 360904 - DNA, 25 bp, Mus musculus
ggcgctcgaggctattccgggcgcc

SEQ ID NO: 360905 - DNA, 25 bp, Mus musculus
tccgggcgccgctatttttagccca

SEQ ID NO: 360906 - DNA, 25 bp, Mus musculus
ggcgccgctatttttagcccattga

SEQ ID NO: 360907 - DNA, 25 bp, Mus musculus
gccgctatttttagcccattgatga

SEQ ID NO: 360908 - DNA, 25 bp, Mus musculus
cattgatgaggctgcgtcggctgcc

SEQ ID NO: 360909 - DNA, 25 bp, Mus musculus
attccggagacgtcaatgggcgcgc

SEQ ID NO: 360910 - DNA, 25 bp, Mus musculus
gtcaatgggcgcgcgtcacggtccc

SEQ ID NO: 360911 - DNA, 25 bp, Mus musculus
gcgaccaggcatgggcgaccctgca

SEQ ID NO: 360912 - DNA, 25 bp, Mus musculus
ctgcggggacctgcgttcgccgatc

SEQ ID NO: 360913 - DNA, 25 bp, Mus musculus
cgttcgccgatctgcgggtcaacgt

SEQ ID NO: 360914 - DNA, 25 bp, Mus musculus
ccgatctgcgggtcaacgtggtccc

SEQ ID NO: 360915 - DNA, 25 bp, Mus musculus
tttagcccattgatgaggctgcgtc

SEQ ID NO: 360916 - DNA, 25 bp, Mus musculus
ctactatatttagccggcgcagcgg

SEQ ID NO: 360917 - DNA, 25 bp, Mus musculus
cgcagggagcgtgtttctgtttcta

SEQ ID NO: 360918 - DNA, 25 bp, Mus musculus
cccagtgcaggaggctgcgaaagtt

SEQ ID NO: 360919 - DNA, 25 bp, Mus musculus
tcacggagcgcttaagatgtgggtc

SEQ ID NO: 360920 - DNA, 25 bp, Mus musculus
atggccaaagctcgccgggccgtgt

SEQ ID NO: 360921 - DNA, 25 bp, Mus musculus
tctgtttctagggacagtgcatgaa

SEQ ID NO: 360922 - DNA, 25 bp, Mus musculus
gcgtcacgcgcgcagacattccagg

SEQ ID NO: 360923 - DNA, 25 bp, Mus musculus
atccgcgctccctgcgtcaatggaa

SEQ ID NO: 360924 - DNA, 25 bp, Mus musculus
tcccgggtccggcttggtgagccta

SEQ ID NO: 360925 - DNA, 25 bp, Mus musculus
cagcgggcgagaggaaaactattta

SEQ ID NO: 360926 - DNA, 25 bp, Mus musculus
cctagtgggtctggaagctactata

SEQ ID NO: 360927 - DNA, 25 bp, Mus musculus
ctctccatgcgtcacggagcgctta

SEQ ID NO: 360928 - DNA, 25 bp, Mus musculus
tttatagatcaaacaatccgcgctc

SEQ ID NO: 360929 - DNA, 25 bp, Mus musculus
cgcgcccttgtatggccaaagctcg

SEQ ID NO: 360930 - DNA, 25 bp, Mus musculus
agcttcctgatgtcgtggctgcagc

SEQ ID NO: 360931 - DNA, 25 bp, Mus musculus
tcagaattctcggtgcgggtccaaa

SEQ ID NO: 360932 - DNA, 25 bp, Mus musculus
acgtccggtccggtcagaattctcg

SEQ ID NO: 360933 - DNA, 25 bp, Mus musculus
gcgcggatggttccttccggttcca

SEQ ID NO: 360934 - DNA, 25 bp, Mus musculus
tgcgggtccaaatagcctgtttttg

SEQ ID NO: 360935 - DNA, 25 bp, Mus musculus
tcctcttaacgagcctagggcccga

SEQ ID NO: 360936 - DNA, 25 bp, Mus musculus
agcccaaacaacgttctcggtggtg

SEQ ID NO: 360937 - DNA, 25 bp, Mus musculus
gaagtgagttgtcccagcccaaaca

SEQ ID NO: 360938 - DNA, 25 bp, Mus musculus
cctctcgtctcgatggcggaagtga

SEQ ID NO: 360939 - DNA, 25 bp, Mus musculus
gtcttaaggttgtcagctccgaatg

SEQ ID NO: 360940 - DNA, 25 bp, Mus musculus
tctcgggatctctcttgtcttaagg

SEQ ID NO: 360941 - DNA, 25 bp, Mus musculus
atgttatggccttgatctcgggatc

SEQ ID NO: 360942 - DNA, 25 bp, Mus musculus
cccaggcgcctctcagatgttatgg

SEQ ID NO: 360943 - DNA, 25 bp, Mus musculus
ggactcggtcctcgtcgtctgcact

SEQ ID NO: 360944 - DNA, 25 bp, Mus musculus
tgggctcatcaaggcctcgtgtggc

SEQ ID NO: 360945 - DNA, 25 bp, Mus musculus
agcctcagtcgcacggttctttccg

SEQ ID NO: 360946 - DNA, 25 bp, Mus musculus
tcgacaaggtgagacagcctcagtc

SEQ ID NO: 360947 - DNA, 25 bp, Mus musculus
aaattcgcctccttcatcgacaagg

SEQ ID NO: 360948 - DNA, 25 bp, Mus musculus
ggagcgcgagcagatcaagaccctc

SEQ ID NO: 360949 - DNA, 25 bp, Mus musculus
ccgctgagtgtggacatcgatccca

SEQ ID NO: 360950 - DNA, 25 bp, Mus musculus
ggcatccgcgagatcaccatcaatc

SEQ ID NO: 360951 - DNA, 25 bp, Mus musculus
agcctctatggcctgggctcatcaa

SEQ ID NO: 360952 - DNA, 25 bp, Mus musculus
cagcttcggcagcaggagcctctat

SEQ ID NO: 360953 - DNA, 25 bp, Mus musculus
cagctgtgtccagccgctatgtcca

SEQ ID NO: 360954 - DNA, 25 bp, Mus musculus
aaaggtcgcagactgcctgaggtca

SEQ ID NO: 360955 - DNA, 25 bp, Mus musculus
cccgcatggaggaataaaaggtcgc

SEQ ID NO: 360956 - DNA, 25 bp, Mus musculus
cttcccgagtggacgaagagccttg

SEQ ID NO: 360957 - DNA, 25 bp, Mus musculus
atcaatcagagcttgctggcgccgc

SEQ ID NO: 360958 - DNA, 25 bp, Mus musculus
gaggagaagcaagacatggttcaga

SEQ ID NO: 360959 - DNA, 25 bp, Mus musculus
cacgaagcgcctggtcagctccggg

SEQ ID NO: 360960 - DNA, 25 bp, Mus musculus
tggttcagaggcgatacagagtcag

SEQ ID NO: 360961 - DNA, 25 bp, Mus musculus
ggcgatacagagtcaggctggaccc

SEQ ID NO: 360962 - DNA, 25 bp, Mus musculus
gcgtttatgagcttgcctgttggaa

SEQ ID NO: 360963 - DNA, 25 bp, Mus musculus
tgcctgttggaatcaaagcagcccg

SEQ ID NO: 360964 - DNA, 25 bp, Mus musculus
ccgccctggctttatggtgccacga

SEQ ID NO: 360965 - DNA, 25 bp, Mus musculus
gctttatggtgccacgaagcgcctg

SEQ ID NO: 360966 - DNA, 25 bp, Mus musculus
gaccacatgccgaggcgcagctgaa

SEQ ID NO: 360967 - DNA, 25 bp, Mus musculus
cccgaggctcgctctgagccttata

SEQ ID NO: 360968 - DNA, 25 bp, Mus musculus
tgagccttatatcgtgcaggaggga

SEQ ID NO: 360969 - DNA, 25 bp, Mus musculus
ctcgctctgagccttatatcgtgca

SEQ ID NO: 360970 - DNA, 25 bp, Mus musculus
agccagagcggaagggcccgcagac

SEQ ID NO: 360971 - DNA, 25 bp, Mus musculus
ccgcccaggcgtttatgagcttgcc

SEQ ID NO: 360972 - DNA, 25 bp, Mus musculus
ctccggggtcacgtgatgctacggc

SEQ ID NO: 360973 - DNA, 25 bp, Mus musculus
tagcaagtccctgcggggcggccct

SEQ ID NO: 360974 - DNA, 25 bp, Mus musculus
atgctacggcccttgtgcgcgcttc

SEQ ID NO: 360975 - DNA, 25 bp, Mus musculus
ccgtagatctcccttgcgtgggttc

SEQ ID NO: 360976 - DNA, 25 bp, Mus musculus
tatttcaccgtagatctcccttgcg

SEQ ID NO: 360977 - DNA, 25 bp, Mus musculus
tccgcgcgttatttcaccgtagatc

SEQ ID NO: 360978 - DNA, 25 bp, Mus musculus
ccgctgctcagagcggggcctctga

SEQ ID NO: 360979 - DNA, 25 bp, Mus musculus
ggctgaccgtagcaagtccctgcgg

SEQ ID NO: 360980 - DNA, 25 bp, Mus musculus
ccggttagtgccctctgggcagccg

SEQ ID NO: 360981 - DNA, 25 bp, Mus musculus
gcgacaggcccggttagtgccctct

SEQ ID NO: 360982 - DNA, 25 bp, Mus musculus
agtccggagctacagcgtagtggtg

SEQ ID NO: 360983 - DNA, 25 bp, Mus musculus
cgcgcttccgggttgacagacgccg

SEQ ID NO: 360984 - DNA, 25 bp, Mus musculus
ggtcacgtgatgctacggcccttgt

SEQ ID NO: 360985 - DNA, 25 bp, Mus musculus
gggcctctgaatccgcgcgttattt

SEQ ID NO: 360986 - DNA, 25 bp, Mus musculus
cgatggcactcacagaaccagtcct

SEQ ID NO: 360987 - DNA, 25 bp, Mus musculus
gaggcgaagccagagccttcgacca

SEQ ID NO: 360988 - DNA, 25 bp, Mus musculus
cagaagtctaggaggcgaagccaga

SEQ ID NO: 360989 - DNA, 25 bp, Mus musculus
tgatgtgtccttcccacaggtcaga

SEQ ID NO: 360990 - DNA, 25 bp, Mus musculus
aacaggtcttgatgtgtccttccca

SEQ ID NO: 360991 - DNA, 25 bp, Mus musculus
cccagcagcagccagcattgaacag

SEQ ID NO: 360992 - DNA, 25 bp, Mus musculus
cttcgagacgcctgaggagaagcgt

SEQ ID NO: 360993 - DNA, 25 bp, Mus musculus
gcagccagcattgaacaggtcttga

SEQ ID NO: 360994 - DNA, 25 bp, Mus musculus
aaggccttcgagacgcctgaggaga

SEQ ID NO: 360995 - DNA, 25 bp, Mus musculus
ctaaggaacgcaagaagcgggagaa

SEQ ID NO: 360996 - DNA, 25 bp, Mus musculus
acctgctcggcaccttcatctggaa

SEQ ID NO: 360997 - DNA, 25 bp, Mus musculus
gctcggcaccttcatctggaacaag

SEQ ID NO: 360998 - DNA, 25 bp, Mus musculus
tcacagaaccagtcctcatgctctg

SEQ ID NO: 360999 - DNA, 25 bp, Mus musculus
gcccgtaagggtcacaggcgctcgt

SEQ ID NO: 361000 - DNA, 25 bp, Mus musculus
atggccgtgcctgacaaggtttccc

SEQ ID NO: 361001 - DNA, 25 bp, Mus musculus
tggtggtgggcacccccaatgcctg

SEQ ID NO: 361002 - DNA, 25 bp, Mus musculus
gtcaacacaagagtgtgcagcgccc

SEQ ID NO: 361003 - DNA, 25 bp, Mus musculus
cctgctgtcaacacaagagtgtgca

SEQ ID NO: 361004 - DNA, 25 bp, Mus musculus
gatctctgcgtctctggtactgccc

SEQ ID NO: 361005 - DNA, 25 bp, Mus musculus
gcgatctctgcgtctctggtactgc

SEQ ID NO: 361006 - DNA, 25 bp, Mus musculus
tggcgtcgtctgtggcgatctctgc

SEQ ID NO: 361007 - DNA, 25 bp, Mus musculus
caatggccgtgcctgacaaggtttc

SEQ ID NO: 361008 - DNA, 25 bp, Mus musculus
acacttgagcttgctgcggagactc

SEQ ID NO: 361009 - DNA, 25 bp, Mus musculus
agcttgctgcggagactcttggcaa

SEQ ID NO: 361010 - DNA, 25 bp, Mus musculus
tgctgcggagactcttggcaatggc

SEQ ID NO: 361011 - DNA, 25 bp, Mus musculus
gactcttggcaatggccgtgcctga

SEQ ID NO: 361012 - DNA, 25 bp, Mus musculus
cgggaacacttgagcttgctgcgga

SEQ ID NO: 361013 - DNA, 25 bp, Mus musculus
gctttcaggtgtgagcagctcccgc

SEQ ID NO: 361014 - DNA, 25 bp, Mus musculus
tccagttcgaaagccacaggtcatg

SEQ ID NO: 361015 - DNA, 25 bp, Mus musculus
ctgaggcgcagctgaagtttccagt

SEQ ID NO: 361016 - DNA, 25 bp, Mus musculus
ggctgaggcgcagctgaagtttcca

SEQ ID NO: 361017 - DNA, 25 bp, Mus musculus
caggctgaggcgcagctgaagtttc

SEQ ID NO: 361018 - DNA, 25 bp, Mus musculus
gaaggccccacagacactctggctg

SEQ ID NO: 361019 - DNA, 25 bp, Mus musculus
agccggagcggaaggccccacagac

SEQ ID NO: 361020 - DNA, 25 bp, Mus musculus
tttccagttcgaaagccacaggtca

SEQ ID NO: 361021 - DNA, 25 bp, Mus musculus
gaggcgcagctgaagtttccagttc

SEQ ID NO: 361022 - DNA, 25 bp, Mus musculus
gcgcagctgaagtttccagttcgaa

SEQ ID NO: 361023 - DNA, 25 bp, Mus musculus
ggcgcagctgaagtttccagttcga

SEQ ID NO: 361024 - DNA, 25 bp, Mus musculus
agttcgaaagccacaggtcatggtg

SEQ ID NO: 361025 - DNA, 25 bp, Mus musculus
gtttccagttcgaaagccacaggtc

SEQ ID NO: 361026 - DNA, 25 bp, Mus musculus
caggtcatggtggaggagaagacac

SEQ ID NO: 361027 - DNA, 25 bp, Mus musculus
ttcgaaagccacaggtcatggtgga

SEQ ID NO: 361028 - DNA, 25 bp, Mus musculus
gccctgaccagtggggtttgcagca

SEQ ID NO: 361029 - DNA, 25 bp, Mus musculus
ggtttgcagcaggaaggactataga

SEQ ID NO: 361030 - DNA, 25 bp, Mus musculus
ggactatagaagctgctctctcctc

SEQ ID NO: 361031 - DNA, 25 bp, Mus musculus
cccgcagcctccatggggaagcaaa

SEQ ID NO: 361032 - DNA, 25 bp, Mus musculus
gctaaggagtttcagtggctatgga

SEQ ID NO: 361033 - DNA, 25 bp, Mus musculus
aggggagagcataacttagccttgg

SEQ ID NO: 361034 - DNA, 25 bp, Mus musculus
gacctctggaacagtttgcccgctg

SEQ ID NO: 361035 - DNA, 25 bp, Mus musculus
ctggaaactgggcggcttgcagcca

SEQ ID NO: 361036 - DNA, 25 bp, Mus musculus
tggggaagcaaagtccgcaaaaatc

SEQ ID NO: 361037 - DNA, 25 bp, Mus musculus
gtccgcaaaaatcccaggttgccag

SEQ ID NO: 361038 - DNA, 25 bp, Mus musculus
cctccatggggaagcaaagtccgca

SEQ ID NO: 361039 - DNA, 25 bp, Mus musculus
gcctgagtcagcagggaaccgccca

SEQ ID NO: 361040 - DNA, 25 bp, Mus musculus
ggccagcctgagtcagcagggaacc

SEQ ID NO: 361041 - DNA, 25 bp, Mus musculus
cccattggctgtgcccgagcgctcc

SEQ ID NO: 361042 - DNA, 25 bp, Mus musculus
cagtgtctttcttggagcggttacc

SEQ ID NO: 361043 - DNA, 25 bp, Mus musculus
ggccgcgctccgacaacaaaagcgg

SEQ ID NO: 361044 - DNA, 25 bp, Mus musculus
ttaccaagtggcttctccgcgtgct

SEQ ID NO: 361045 - DNA, 25 bp, Mus musculus
ctgccgccgcgaaaaccagaagtgg

SEQ ID NO: 361046 - DNA, 25 bp, Mus musculus
ctctctcggcggcactgggcatgct

SEQ ID NO: 361047 - DNA, 25 bp, Mus musculus
acaaaagcggaggatgctgcagctg

SEQ ID NO: 361048 - DNA, 25 bp, Mus musculus
tgcagctgggcaaggtcaggacctt

SEQ ID NO: 361049 - DNA, 25 bp, Mus musculus
cccgactgaggagctgtctttggcg

SEQ ID NO: 361050 - DNA, 25 bp, Mus musculus
tgcatgttcgccaggaagcagtcgg

SEQ ID NO: 361051 - DNA, 25 bp, Mus musculus
ccgcgccgttcggtgagttgcctta

SEQ ID NO: 361052 - DNA, 25 bp, Mus musculus
gtgagttgccttagctgagctgctg

SEQ ID NO: 361053 - DNA, 25 bp, Mus musculus
gtcctcttgctcaccgccggtgggg

SEQ ID NO: 361054 - DNA, 25 bp, Mus musculus
accagaagtggaattcgcgtggcga

SEQ ID NO: 361055 - DNA, 25 bp, Mus musculus
gggaggaccgcgatcctaccggctc

SEQ ID NO: 361056 - DNA, 25 bp, Mus musculus
tcccgcggcgatataacaacaggtc

SEQ ID NO: 361057 - DNA, 25 bp, Mus musculus
gctccgggtcccggatatccgtgtc

SEQ ID NO: 361058 - DNA, 25 bp, Mus musculus
cagccagcgtctatgcaggtgctgg

SEQ ID NO: 361059 - DNA, 25 bp, Mus musculus
agcagcgcagccagcgtctatgcag

SEQ ID NO: 361060 - DNA, 25 bp, Mus musculus
tctgtgcgaactcccagccagcggg

SEQ ID NO: 361061 - DNA, 25 bp, Mus musculus
accaactaccggtccctgggctctg

SEQ ID NO: 361062 - DNA, 25 bp, Mus musculus
ctcgctccaccaccttctccaccaa

SEQ ID NO: 361063 - DNA, 25 bp, Mus musculus
aagatgagcttcacaactcgctcca

SEQ ID NO: 361064 - DNA, 25 bp, Mus musculus
ccagacaagatgagcttcacaactc

SEQ ID NO: 361065 - DNA, 25 bp, Mus musculus
tctcctctccagacaagatgagctt

SEQ ID NO: 361066 - DNA, 25 bp, Mus musculus
actcctgttctggtctctcgcttcg

SEQ ID NO: 361067 - DNA, 25 bp, Mus musculus
cggcggaactcctgttctggtctct

SEQ ID NO: 361068 - DNA, 25 bp, Mus musculus
taacaacaggtcgaggactgccacc

SEQ ID NO: 361069 - DNA, 25 bp, Mus musculus
tcctcccgcggcgatataacaacag

SEQ ID NO: 361070 - DNA, 25 bp, Mus musculus
ccacaagtctgtgcgccaggagact

SEQ ID NO: 361071 - DNA, 25 bp, Mus musculus
gctgctttacgaacccagcgcggcg

SEQ ID NO: 361072 - DNA, 25 bp, Mus musculus
tggtttcacgtctccaagcccgtcg

SEQ ID NO: 361073 - DNA, 25 bp, Mus musculus
cgtcgcgcccgctataatcacgtga

SEQ ID NO: 361074 - DNA, 25 bp, Mus musculus
aatcacgtgactgcctcatccgggt

SEQ ID NO: 361075 - DNA, 25 bp, Mus musculus
ctcatccgggtcctttgcgttctct

SEQ ID NO: 361076 - DNA, 25 bp, Mus musculus
catggccgcttgaggttaccgcctc

SEQ ID NO: 361077 - DNA, 25 bp, Mus musculus
gtggaccctgccttcaattggagga

SEQ ID NO: 361078 - DNA, 25 bp, Mus musculus
tctcaaaggcgtgaagcaccgcgcc

SEQ ID NO: 361079 - DNA, 25 bp, Mus musculus
cgcctcagaaacacgcgctgctgga

SEQ ID NO: 361080 - DNA, 25 bp, Mus musculus
tgctggactccagatgggaagcctg

SEQ ID NO: 361081 - DNA, 25 bp, Mus musculus
gatggacctggcttttgctcgttta

SEQ ID NO: 361082 - DNA, 25 bp, Mus musculus
tgctcgtttatgaccttgtacttta

SEQ ID NO: 361083 - DNA, 25 bp, Mus musculus
aagggtttcgcgacagctcagactc

SEQ ID NO: 361084 - DNA, 25 bp, Mus musculus
acagttgaagatactagaggtgacc

SEQ ID NO: 361085 - DNA, 25 bp, Mus musculus
cgcggctgtggacctagctcaggcc

SEQ ID NO: 361086 - DNA, 25 bp, Mus musculus
tgtggacctagctcaggccgccacg

SEQ ID NO: 361087 - DNA, 25 bp, Mus musculus
ggctgtcctcccacgtgcgatccca

SEQ ID NO: 361088 - DNA, 25 bp, Mus musculus
tcccctccgggtctcggtgagctag

SEQ ID NO: 361089 - DNA, 25 bp, Mus musculus
cggtccgagccagggacgggcacca

SEQ ID NO: 361090 - DNA, 25 bp, Mus musculus
agcgtcggccctctgcgtcacagcg

SEQ ID NO: 361091 - DNA, 25 bp, Mus musculus
agctaggggacagttgaagatacta

SEQ ID NO: 361092 - DNA, 25 bp, Mus musculus
gcctccgcgtatcgcggcgcggcta

SEQ ID NO: 361093 - DNA, 25 bp, Mus musculus
aaggtggcgattggagcccaggaag

SEQ ID NO: 361094 - DNA, 25 bp, Mus musculus
gagtctcagccggagcctgcctcgg

SEQ ID NO: 361095 - DNA, 25 bp, Mus musculus
gctccgtctgcgagtctcagccgga

SEQ ID NO: 361096 - DNA, 25 bp, Mus musculus
tgcgatcccactcgggctctggctg

SEQ ID NO: 361097 - DNA, 25 bp, Mus musculus
ttgaagatactagaggtgaccaggg

SEQ ID NO: 361098 - DNA, 25 bp, Mus musculus
ataggcctctcagctccgcgttgta

SEQ ID NO: 361099 - DNA, 25 bp, Mus musculus
gggtctctcaggtgacacccgggac

SEQ ID NO: 361100 - DNA, 25 bp, Mus musculus
cttcttgaagatgggcgccctcagc

SEQ ID NO: 361101 - DNA, 25 bp, Mus musculus
acctcggacgcctggagctcaggga

SEQ ID NO: 361102 - DNA, 25 bp, Mus musculus
gtacctaacactcggcggcgtctga

SEQ ID NO: 361103 - DNA, 25 bp, Mus musculus
acggcctcaggaccgcggggtctct

SEQ ID NO: 361104 - DNA, 25 bp, Mus musculus
cacccggccttaacctgtcaatgag

SEQ ID NO: 361105 - DNA, 25 bp, Mus musculus
ttaacctgtcaatgaggctacgccc

SEQ ID NO: 361106 - DNA, 25 bp, Mus musculus
tcgtcacaggccctggctgcaatgg

SEQ ID NO: 361107 - DNA, 25 bp, Mus musculus
cgagatctgcagagaccgaggcctc

SEQ ID NO: 361108 - DNA, 25 bp, Mus musculus
ctgaccaatccgcagcgcttcttga

SEQ ID NO: 361109 - DNA, 25 bp, Mus musculus
agctccgcgttgtagctcttcggcc

SEQ ID NO: 361110 - DNA, 25 bp, Mus musculus
cagccaatcgcagggcacaggcggt

SEQ ID NO: 361111 - DNA, 25 bp, Mus musculus
gcccggtgagctgggtacctaacac

SEQ ID NO: 361112 - DNA, 25 bp, Mus musculus
cgctgcgggctcagggtccgcctta

SEQ ID NO: 361113 - DNA, 25 bp, Mus musculus
ctgtcaacgcgccagagggccgtcg

SEQ ID NO: 361114 - DNA, 25 bp, Mus musculus
tgctaatcggccagggccgctgtca

SEQ ID NO: 361115 - DNA, 25 bp, Mus musculus
cagggccgctgtcaacgcgccagag

SEQ ID NO: 361116 - DNA, 25 bp, Mus musculus
ctaatgctgttgttcgctgcgggct

SEQ ID NO: 361117 - DNA, 25 bp, Mus musculus
ctgcagacggctgtacagaagccgg

SEQ ID NO: 361118 - DNA, 25 bp, Mus musculus
acagaagccggaggctgtctcagga

SEQ ID NO: 361119 - DNA, 25 bp, Mus musculus
tctcaggagagagggacaaccgtgc

SEQ ID NO: 361120 - DNA, 25 bp, Mus musculus
ctttgcgggcgctgctaatcggcca

SEQ ID NO: 361121 - DNA, 25 bp, Mus musculus
cgagagaacgaagaggcgcctttgc

SEQ ID NO: 361122 - DNA, 25 bp, Mus musculus
gcggggtctacagccctaagtgcgc

SEQ ID NO: 361123 - DNA, 25 bp, Mus musculus
gatcgcctgcagacggctgtacaga

SEQ ID NO: 361124 - DNA, 25 bp, Mus musculus
caaccgtgcggggtctacagcccta

SEQ ID NO: 361125 - DNA, 25 bp, Mus musculus
ctgctcatgctgctaatgctgttgt

SEQ ID NO: 361126 - DNA, 25 bp, Mus musculus
agcccggaagtggatgtggccgctt

SEQ ID NO: 361127 - DNA, 25 bp, Mus musculus
tggatgtggccgcttggcaaagagg

SEQ ID NO: 361128 - DNA, 25 bp, Mus musculus
tggtgtttgtaaacttgcctcggtc

SEQ ID NO: 361129 - DNA, 25 bp, Mus musculus
tgtaaacttgcctcggtcccgacgc

SEQ ID NO: 361130 - DNA, 25 bp, Mus musculus
gaggccgcgccaggcaggtaggcgc

SEQ ID NO: 361131 - DNA, 25 bp, Mus musculus
gcgagcgggcggacagcagctcgca

SEQ ID NO: 361132 - DNA, 25 bp, Mus musculus
acagcagctcgcaggccgtggggcg

SEQ ID NO: 361133 - DNA, 25 bp, Mus musculus
tgcggctgcctgcagagcgcgcgca

SEQ ID NO: 361134 - DNA, 25 bp, Mus musculus
gcctccgcggcggcgaatttacgaa

SEQ ID NO: 361135 - DNA, 25 bp, Mus musculus
accttcgggcggactccgagcgacg

SEQ ID NO: 361136 - DNA, 25 bp, Mus musculus
ggcggactccgagcgacgctcacgt

SEQ ID NO: 361137 - DNA, 25 bp, Mus musculus
tccgagcgacgctcacgtgcgggca

SEQ ID NO: 361138 - DNA, 25 bp, Mus musculus
agcgacgctcacgtgcgggcactgc

SEQ ID NO: 361139 - DNA, 25 bp, Mus musculus
cacgtgcgggcactgccagccaccc

SEQ ID NO: 361140 - DNA, 25 bp, Mus musculus
tgcctctggacgcacacgtgctgga

SEQ ID NO: 361141 - DNA, 25 bp, Mus musculus
cttcaagatcgtcagtcgtgagtgg

SEQ ID NO: 361142 - DNA, 25 bp, Mus musculus
tgcgggaccgccctacgaggacatc

SEQ ID NO: 361143 - DNA, 25 bp, Mus musculus
cattctgcgcttccatgcgggaccg

SEQ ID NO: 361144 - DNA, 25 bp, Mus musculus
caaccgggactttgccattctgcgc

SEQ ID NO: 361145 - DNA, 25 bp, Mus musculus
ttcctggaggcttgtgcagacaacc

SEQ ID NO: 361146 - DNA, 25 bp, Mus musculus
cacccaagattgtgcagggctacaa

SEQ ID NO: 361147 - DNA, 25 bp, Mus musculus
agacgcattatgacttcgacaaccc

SEQ ID NO: 361148 - DNA, 25 bp, Mus musculus
ggccgcgaaaacctcgcttcttcaa

SEQ ID NO: 361149 - DNA, 25 bp, Mus musculus
gccgggcctatctgtgggccgacaa

SEQ ID NO: 361150 - DNA, 25 bp, Mus musculus
tctgccctcacaggtgatgcgagtg

SEQ ID NO: 361151 - DNA, 25 bp, Mus musculus
cacacgtgctggagcctcacgagga

SEQ ID NO: 361152 - DNA, 25 bp, Mus musculus
ggagtattcgcaccgccatggcttc

SEQ ID NO: 361153 - DNA, 25 bp, Mus musculus
ctggcccagactggggaccttgtca

SEQ ID NO: 361154 - DNA, 25 bp, Mus musculus
cgcagcgcctcgcctctgcctctcc

SEQ ID NO: 361155 - DNA, 25 bp, Mus musculus
gagccagtagctcctctcgccgcgc

SEQ ID NO: 361156 - DNA, 25 bp, Mus musculus
gggcacccgcgagccagtagctcct

SEQ ID NO: 361157 - DNA, 25 bp, Mus musculus
cctcctggcggcctctcggctcctc

SEQ ID NO: 361158 - DNA, 25 bp, Mus musculus
ctgcagcacctcctggcggcctctc

SEQ ID NO: 361159 - DNA, 25 bp, Mus musculus
gctgagcggcttgtcctgcagcacc

SEQ ID NO: 361160 - DNA, 25 bp, Mus musculus
tctccctggctgagcggcttgtcct

SEQ ID NO: 361161 - DNA, 25 bp, Mus musculus
cgatctccctggctgagcggcttgt

SEQ ID NO: 361162 - DNA, 25 bp, Mus musculus
cgcgatctccctggctgagcggctt

SEQ ID NO: 361163 - DNA, 25 bp, Mus musculus
acgcggatccgctgcggggccagct

SEQ ID NO: 361164 - DNA, 25 bp, Mus musculus
cctggtcgcagcgtgacgcggatcc

SEQ ID NO: 361165 - DNA, 25 bp, Mus musculus
tcacctggtcgcagcgtgacgcgga

SEQ ID NO: 361166 - DNA, 25 bp, Mus musculus
gactcacctggtcgcagcgtgacgc

SEQ ID NO: 361167 - DNA, 25 bp, Mus musculus
ccggactcacctggtcgcagcgtga

SEQ ID NO: 361168 - DNA, 25 bp, Mus musculus
ggacaaacgattccatgcagtcgta

SEQ ID NO: 361169 - DNA, 25 bp, Mus musculus
gcttggagagaaactgggtgctaga

SEQ ID NO: 361170 - DNA, 25 bp, Mus musculus
catcgcgacccggcttggagagaaa

SEQ ID NO: 361171 - DNA, 25 bp, Mus musculus
cgtacatcgcgacccggcttggaga

SEQ ID NO: 361172 - DNA, 25 bp, Mus musculus
gtcgtacatcgcgacccggcttgga

SEQ ID NO: 361173 - DNA, 25 bp, Mus musculus
gcagtcgtacatcgcgacccggctt

SEQ ID NO: 361174 - DNA, 25 bp, Mus musculus
catgcagtcgtacatcgcgacccgg

SEQ ID NO: 361175 - DNA, 25 bp, Mus musculus
ttccatgcagtcgtacatcgcgacc

SEQ ID NO: 361176 - DNA, 25 bp, Mus musculus
aaacgattccatgcagtcgtacatc

SEQ ID NO: 361177 - DNA, 25 bp, Mus musculus
ccgggacaaacgattccatgcagtc

SEQ ID NO: 361178 - DNA, 25 bp, Mus musculus
gacccgggacaaacgattccatgca

SEQ ID NO: 361179 - DNA, 25 bp, Mus musculus
cggacccgggacaaacgattccatg

SEQ ID NO: 361180 - DNA, 25 bp, Mus musculus
tagcgtagggcgctgagatgcatgg

SEQ ID NO: 361181 - DNA, 25 bp, Mus musculus
gattccatgcagtcgtacatcgcga

SEQ ID NO: 361182 - DNA, 25 bp, Mus musculus
gtttccactgtgctaagggcttccc

SEQ ID NO: 361183 - DNA, 25 bp, Mus musculus
ttcgcagtaactgccctgctggtca

SEQ ID NO: 361184 - DNA, 25 bp, Mus musculus
gtcattcacggctcagggtcactta

SEQ ID NO: 361185 - DNA, 25 bp, Mus musculus
ggtggggcgcacttttctaagaatc

SEQ ID NO: 361186 - DNA, 25 bp, Mus musculus
tggccacgtcagaagtttgcccttg

SEQ ID NO: 361187 - DNA, 25 bp, Mus musculus
agacgaaactgatccctcccaatga

SEQ ID NO: 361188 - DNA, 25 bp, Mus musculus
tgtccctacagtcccaaacttgcga

SEQ ID NO: 361189 - DNA, 25 bp, Mus musculus
cctgacttcagttttagagcacaaa

SEQ ID NO: 361190 - DNA, 25 bp, Mus musculus
tgacactcccaaagtgcctcgggta

SEQ ID NO: 361191 - DNA, 25 bp, Mus musculus
tatccttcctctaccgagggctggg

SEQ ID NO: 361192 - DNA, 25 bp, Mus musculus
gctcccgcggtgaactctccgggaa

SEQ ID NO: 361193 - DNA, 25 bp, Mus musculus
tactacattcctgcggctcactgcg

SEQ ID NO: 361194 - DNA, 25 bp, Mus musculus
acgcgcttcagagctgaatactaca

SEQ ID NO: 361195 - DNA, 25 bp, Mus musculus
tctgtcagcgctgctcacacgggga

SEQ ID NO: 361196 - DNA, 25 bp, Mus musculus
ttttctcccaaaccgcacactgact

SEQ ID NO: 361197 - DNA, 25 bp, Mus musculus
cccgcctgactcacctggaggggag

SEQ ID NO: 361198 - DNA, 25 bp, Mus musculus
tcggggatggagcaccgcggtgtta

SEQ ID NO: 361199 - DNA, 25 bp, Mus musculus
cgcggtgttagtgactcgcggtaat

SEQ ID NO: 361200 - DNA, 25 bp, Mus musculus
ggcacggctctaggctgggacaatc

SEQ ID NO: 361201 - DNA, 25 bp, Mus musculus
acggctctaggctgggacaatcccg

SEQ ID NO: 361202 - DNA, 25 bp, Mus musculus
ctctaggctgggacaatcccggggc

SEQ ID NO: 361203 - DNA, 25 bp, Mus musculus
ggctgggacaatcccggggcctctc

SEQ ID NO: 361204 - DNA, 25 bp, Mus musculus
ggacaatcccggggcctctcggagc

SEQ ID NO: 361205 - DNA, 25 bp, Mus musculus
cccaaaatatccgacacattttctc

SEQ ID NO: 361206 - DNA, 25 bp, Mus musculus
atatccgacacattttctcccaaac

SEQ ID NO: 361207 - DNA, 25 bp, Mus musculus
cgcacactgactccgcaggcgggga

SEQ ID NO: 361208 - DNA, 25 bp, Mus musculus
ccctggctcatttcagcagaggagc

SEQ ID NO: 361209 - DNA, 25 bp, Mus musculus
cactgactccgcaggcggggacacg

SEQ ID NO: 361210 - DNA, 25 bp, Mus musculus
tctgagcgcgcctgttctctgctct

SEQ ID NO: 361211 - DNA, 25 bp, Mus musculus
tctccacgcgtagcctgggcgcaga

SEQ ID NO: 361212 - DNA, 25 bp, Mus musculus
agcctgggcgcagaagttgtcttct

SEQ ID NO: 361213 - DNA, 25 bp, Mus musculus
agctgagctccaccatcggcaccta

SEQ ID NO: 361214 - DNA, 25 bp, Mus musculus
cgtgcagtccaccatctcctcttcg

SEQ ID NO: 361215 - DNA, 25 bp, Mus musculus
agacgcatgcctctcgcctctttgt

SEQ ID NO: 361216 - DNA, 25 bp, Mus musculus
atcaacatcgtcgtgtcctcggccg

SEQ ID NO: 361217 - DNA, 25 bp, Mus musculus
tgcctctcgcctctttgtcagcggg

SEQ ID NO: 361218 - DNA, 25 bp, Mus musculus
agctcgcccatcaacatcgtcgtgt

SEQ ID NO: 361219 - DNA, 25 bp, Mus musculus
ttgtcagcgggcctctgctaacccg

SEQ ID NO: 361220 - DNA, 25 bp, Mus musculus
ggctaagtcctacagcaccagctcg

SEQ ID NO: 361221 - DNA, 25 bp, Mus musculus
agccgcctggctaagtcctacagca

SEQ ID NO: 361222 - DNA, 25 bp, Mus musculus
agaagttgtcttctgcagccgggcg

SEQ ID NO: 361223 - DNA, 25 bp, Mus musculus
ggcggctcacccaccaagctgcagc

SEQ ID NO: 361224 - DNA, 25 bp, Mus musculus
tcagccgtgacccatagccggggaa

SEQ ID NO: 361225 - DNA, 25 bp, Mus musculus
acggggctatcatggcggcggccac

SEQ ID NO: 361226 - DNA, 25 bp, Mus musculus
cataggctcttccgctcctgggcgg

SEQ ID NO: 361227 - DNA, 25 bp, Mus musculus
gatattggccagctggaggacccta

SEQ ID NO: 361228 - DNA, 25 bp, Mus musculus
tgctcaggcgcccaagagaacagcg

SEQ ID NO: 361229 - DNA, 25 bp, Mus musculus
aagagaacagcgcaccgctccagca

SEQ ID NO: 361230 - DNA, 25 bp, Mus musculus
cgcgctgctggaacccgagcggagc

SEQ ID NO: 361231 - DNA, 25 bp, Mus musculus
cgcaaggagggtcagccgtgaccca

SEQ ID NO: 361232 - DNA, 25 bp, Mus musculus
ccgtgacccatagccggggaacctg

SEQ ID NO: 361233 - DNA, 25 bp, Mus musculus
tgcgcgcgcgtgaccgcgaagcatt

SEQ ID NO: 361234 - DNA, 25 bp, Mus musculus
gaggaccctatggtacccgcctgct

SEQ ID NO: 361235 - DNA, 25 bp, Mus musculus
accgcgaagcattggagaggccggc

SEQ ID NO: 361236 - DNA, 25 bp, Mus musculus
ccagctggaggaccctatggtaccc

SEQ ID NO: 361237 - DNA, 25 bp, Mus musculus
acgtgtccggagcgtcccggcagac

SEQ ID NO: 361238 - DNA, 25 bp, Mus musculus
ctggcgcggaaaacgaagcgtgccc

SEQ ID NO: 361239 - DNA, 25 bp, Mus musculus
acgcggccggcctgcgttacgcttt

SEQ ID NO: 361240 - DNA, 25 bp, Mus musculus
cgttacgctttctcgctgattggtc

SEQ ID NO: 361241 - DNA, 25 bp, Mus musculus
acgtgacagacagcgcggcagataa

SEQ ID NO: 361242 - DNA, 25 bp, Mus musculus
ccctccaggaacacgtgacagacag

SEQ ID NO: 361243 - DNA, 25 bp, Mus musculus
cagcgcggcagataaactacaactc

SEQ ID NO: 361244 - DNA, 25 bp, Mus musculus
actagggatatttgaaaggaggtgc

SEQ ID NO: 361245 - DNA, 25 bp, Mus musculus
tgcccacccggtgcttggtggagct

SEQ ID NO: 361246 - DNA, 25 bp, Mus musculus
aggaacggcagcttcgagggaatta

SEQ ID NO: 361247 - DNA, 25 bp, Mus musculus
agcttcgagggaattaaggcacgga

SEQ ID NO: 361248 - DNA, 25 bp, Mus musculus
tgagcgcgcgctcaagccgcggtaa

SEQ ID NO: 361249 - DNA, 25 bp, Mus musculus
gtgacattcccattgctgacctggg

SEQ ID NO: 361250 - DNA, 25 bp, Mus musculus
gccgcggtaagtgacattcccattg

SEQ ID NO: 361251 - DNA, 25 bp, Mus musculus
cgctgattggtcactagggatattt

SEQ ID NO: 361252 - DNA, 25 bp, Mus musculus
cgggtccgaaacacaggatcataga

SEQ ID NO: 361253 - DNA, 25 bp, Mus musculus
caggatcatagagacgacgggcgca

SEQ ID NO: 361254 - DNA, 25 bp, Mus musculus
agacgacgggcgcagagcgtatccc

SEQ ID NO: 361255 - DNA, 25 bp, Mus musculus
cctggcggcaccacggaggtaacgc

SEQ ID NO: 361256 - DNA, 25 bp, Mus musculus
ggcggctagagcgtcactcgcccag

SEQ ID NO: 361257 - DNA, 25 bp, Mus musculus
tcggcagtcctccttcccaacatgg

SEQ ID NO: 361258 - DNA, 25 bp, Mus musculus
cccaacatggcgcagtcgattaaca

SEQ ID NO: 361259 - DNA, 25 bp, Mus musculus
ttaacatcacggagctgaatctgcc

SEQ ID NO: 361260 - DNA, 25 bp, Mus musculus
gctgaatctgccacaactggaaatg

SEQ ID NO: 361261 - DNA, 25 bp, Mus musculus
tgccacaactggaaatgctcaagaa

SEQ ID NO: 361262 - DNA, 25 bp, Mus musculus
gctcaagaaccagctggaccaggtg

SEQ ID NO: 361263 - DNA, 25 bp, Mus musculus
agctggaccaggtgaggacctgtcc

SEQ ID NO: 361264 - DNA, 25 bp, Mus musculus
ggtgaggacctgtcccagcaccttc

SEQ ID NO: 361265 - DNA, 25 bp, Mus musculus
tggcgcagtcgattaacatcacgga

SEQ ID NO: 361266 - DNA, 25 bp, Mus musculus
gaatcgggacgcacaacggcacctt

SEQ ID NO: 361267 - DNA, 25 bp, Mus musculus
gtgcctgacacttcctcttccgggt

SEQ ID NO: 361268 - DNA, 25 bp, Mus musculus
cggaagtgaagctgtgcctgacact

SEQ ID NO: 361269 - DNA, 25 bp, Mus musculus
aactatatgggtagacgtttcctgc

SEQ ID NO: 361270 - DNA, 25 bp, Mus musculus
acgtttcctgcgtggtatcttaaca

SEQ ID NO: 361271 - DNA, 25 bp, Mus musculus
cgtggtatcttaacattgccgctcc

SEQ ID NO: 361272 - DNA, 25 bp, Mus musculus
attgccgctccggtcagttctccaa

SEQ ID NO: 361273 - DNA, 25 bp, Mus musculus
agcaccgcatgcttggctcagagca

SEQ ID NO: 361274 - DNA, 25 bp, Mus musculus
tcagagcaggatccgcccgctaaaa

SEQ ID NO: 361275 - DNA, 25 bp, Mus musculus
tacgcggtacggacctgcgaaccta

SEQ ID NO: 361276 - DNA, 25 bp, Mus musculus
aagacctcgcaacaacctcatggca

SEQ ID NO: 361277 - DNA, 25 bp, Mus musculus
tccactgcgatgaagctctggcttg

SEQ ID NO: 361278 - DNA, 25 bp, Mus musculus
accttcccttggagggaactatatg

SEQ ID NO: 361279 - DNA, 25 bp, Mus musculus
ctgatgctgcaatggcctgagaacc

SEQ ID NO: 361280 - DNA, 25 bp, Mus musculus
tgcaaggaagaaagttccgagtcgg

SEQ ID NO: 361281 - DNA, 25 bp, Mus musculus
cgggctctcatagctgttgccggtc

SEQ ID NO: 361282 - DNA, 25 bp, Mus musculus
atacagggtgacttgacctctaggc

SEQ ID NO: 361283 - DNA, 25 bp, Mus musculus
agggagcacatcttgccagtccgga

SEQ ID NO: 361284 - DNA, 25 bp, Mus musculus
gccagtccggagagcgtctggaatc

SEQ ID NO: 361285 - DNA, 25 bp, Mus musculus
gtctggaatcgacaggctcccggct

SEQ ID NO: 361286 - DNA, 25 bp, Mus musculus
tagttcccgggctagattcgtgtga

SEQ ID NO: 361287 - DNA, 25 bp, Mus musculus
ggtagccgtacaggacaaacgactg

SEQ ID NO: 361288 - DNA, 25 bp, Mus musculus
tgacacgtccgaggaccgacctgtg

SEQ ID NO: 361289 - DNA, 25 bp, Mus musculus
ctgcgcgaagctgaacggaagtgca

SEQ ID NO: 361290 - DNA, 25 bp, Mus musculus
gagcgggcacgacgctgacacgtcc

SEQ ID NO: 361291 - DNA, 25 bp, Mus musculus
ctcgttattgtgctcatacagggtg

SEQ ID NO: 361292 - DNA, 25 bp, Mus musculus
gttgccggtcaccagctcgttattg

SEQ ID NO: 361293 - DNA, 25 bp, Mus musculus
aggacaaacgactgcgcgaagctga

SEQ ID NO: 361294 - DNA, 25 bp, Mus musculus
ctgccttgttggactggcgagccac

SEQ ID NO: 361295 - DNA, 25 bp, Mus musculus
tcaggcttaggagccatgtggccca

SEQ ID NO: 361296 - DNA, 25 bp, Mus musculus
catgtggcccaatggcacctcgctg

SEQ ID NO: 361297 - DNA, 25 bp, Mus musculus
tttcgcccggtgaacatcacgctgc

SEQ ID NO: 361298 - DNA, 25 bp, Mus musculus
gtccaacctgctggcactgagtgtg

SEQ ID NO: 361299 - DNA, 25 bp, Mus musculus
tggcgtcgcaacacgctgccttgtt

SEQ ID NO: 361300 - DNA, 25 bp, Mus musculus
agctgccgcctgtgctacttcatgg

SEQ ID NO: 361301 - DNA, 25 bp, Mus musculus
ctgagcgcttcgtgggcatcacacg

SEQ ID NO: 361302 - DNA, 25 bp, Mus musculus
ctgctgccactactggggcttggcc

SEQ ID NO: 361303 - DNA, 25 bp, Mus musculus
cttggccgctacagtgtgcagtacc

SEQ ID NO: 361304 - DNA, 25 bp, Mus musculus
ggtgcttcctgacactcgggacaca

SEQ ID NO: 361305 - DNA, 25 bp, Mus musculus
tcgggctcatattcgcactcctggg

SEQ ID NO: 361306 - DNA, 25 bp, Mus musculus
cctcctgctcaacaccgttagtgtg

SEQ ID NO: 361307 - DNA, 25 bp, Mus musculus
ggccttgttctcaccgacttcctgg

SEQ ID NO: 361308 - DNA, 25 bp, Mus musculus
tgaggcggtttttatctcccagaaa

SEQ ID NO: 361309 - DNA, 25 bp, Mus musculus
tggtctccttcgacacttcttcgga

SEQ ID NO: 361310 - DNA, 25 bp, Mus musculus
gacacttcttcggaactcggatttc

SEQ ID NO: 361311 - DNA, 25 bp, Mus musculus
ctcggatttcttcaaagcgcctttg

SEQ ID NO: 361312 - DNA, 25 bp, Mus musculus
ccagagggctgagatcttgcacctg

SEQ ID NO: 361313 - DNA, 25 bp, Mus musculus
gacggcggtcccagagcagatgcct

SEQ ID NO: 361314 - DNA, 25 bp, Mus musculus
agatgcctgggaaagcgctccatgc

SEQ ID NO: 361315 - DNA, 25 bp, Mus musculus
ggcaggggccgcacaaagccctatt

SEQ ID NO: 361316 - DNA, 25 bp, Mus musculus
taggccacagagtggcttttgtttc

SEQ ID NO: 361317 - DNA, 25 bp, Mus musculus
ttctccactaactccgaggcaggca

SEQ ID NO: 361318 - DNA, 25 bp, Mus musculus
ggcaggcacgactgattgcaggccc

SEQ ID NO: 361319 - DNA, 25 bp, Mus musculus
ggagtctcaccacagccgcgctggg

SEQ ID NO: 361320 - DNA, 25 bp, Mus musculus
cgcgccgccgctatttgaggcggtt

SEQ ID NO: 361321 - DNA, 25 bp, Mus musculus
cccaagccgagtctagcaagatgaa

SEQ ID NO: 361322 - DNA, 25 bp, Mus musculus
cccgtgggtgcgctgatgtttgctc

SEQ ID NO: 361323 - DNA, 25 bp, Mus musculus
ctctcgccagtgtgccagcgcaagt

SEQ ID NO: 361324 - DNA, 25 bp, Mus musculus
ctttcagatgcgaagccttgccgta

SEQ ID NO: 361325 - DNA, 25 bp, Mus musculus
gatgcgaagccttgccgtacacctt

SEQ ID NO: 361326 - DNA, 25 bp, Mus musculus
gggcggctgattggcttcttcttcc

SEQ ID NO: 361327 - DNA, 25 bp, Mus musculus
tgatgtttgctcaagtggtcgcttc

SEQ ID NO: 361328 - DNA, 25 bp, Mus musculus
cttggaacagagcaggcaggtgaac

SEQ ID NO: 361329 - DNA, 25 bp, Mus musculus
gcaggcaggtgaacttcttctcccg

SEQ ID NO: 361330 - DNA, 25 bp, Mus musculus
gcacgtggcgctccagctcgtcaga

SEQ ID NO: 361331 - DNA, 25 bp, Mus musculus
gccagcgcaagtgggctttcagatg

SEQ ID NO: 361332 - DNA, 25 bp, Mus musculus
gctcgtcagagcgagtgaacctctt

SEQ ID NO: 361333 - DNA, 25 bp, Mus musculus
gagtgaacctcttgccgcagaaaag

SEQ ID NO: 361334 - DNA, 25 bp, Mus musculus
cgcttctggtaaagcgcttggaaca

SEQ ID NO: 361335 - DNA, 25 bp, Mus musculus
gttgcagacgaaaggcctctcgcca

SEQ ID NO: 361336 - DNA, 25 bp, Mus musculus
cggcgcgtaattggctgttcgttca

SEQ ID NO: 361337 - DNA, 25 bp, Mus musculus
ccaggattctggttggtcgttgtcc

SEQ ID NO: 361338 - DNA, 25 bp, Mus musculus
ctttgcccaggcatgcccaggattc

SEQ ID NO: 361339 - DNA, 25 bp, Mus musculus
gaagcttgctcctatcccattccgg

SEQ ID NO: 361340 - DNA, 25 bp, Mus musculus
taactgcccgcctgaattctgattg

SEQ ID NO: 361341 - DNA, 25 bp, Mus musculus
gtcaatacgcgtcctgttccggctc

SEQ ID NO: 361342 - DNA, 25 bp, Mus musculus
tcagctgccaccatgagcggtaagg

SEQ ID NO: 361343 - DNA, 25 bp, Mus musculus
cttcgctgcctcattggcttgagta

SEQ ID NO: 361344 - DNA, 25 bp, Mus musculus
gtttctctgcaagtccatcgtcatc

SEQ ID NO: 361345 - DNA, 25 bp, Mus musculus
ttgctaaaactgagagggcggcctt

SEQ ID NO: 361346 - DNA, 25 bp, Mus musculus
cttgctcttacacgcctcagcgaga

SEQ ID NO: 361347 - DNA, 25 bp, Mus musculus
agagagcgagtcctaccattgggta

SEQ ID NO: 361348 - DNA, 25 bp, Mus musculus
cctggaggttgactggtttctctgc

SEQ ID NO: 361349 - DNA, 25 bp, Mus musculus
ggctcttttcagttatcgtccaatc

SEQ ID NO: 361350 - DNA, 25 bp, Mus musculus
ggactccggccctattctggagcct

SEQ ID NO: 361351 - DNA, 25 bp, Mus musculus
tcgtgacatccttcttggcggactc

SEQ ID NO: 361352 - DNA, 25 bp, Mus musculus
agcttcttcttccactcgtgacatc

SEQ ID NO: 361353 - DNA, 25 bp, Mus musculus
cgtagacccgcatgagcgtctacta

SEQ ID NO: 361354 - DNA, 25 bp, Mus musculus
attctggagcctcggcctctcgtag

SEQ ID NO: 361355 - DNA, 25 bp, Mus musculus
cgcgcctccaggtaagcttaaaatc

SEQ ID NO: 361356 - DNA, 25 bp, Mus musculus
aaagtgtggacgacgcagtcgactc

SEQ ID NO: 361357 - DNA, 25 bp, Mus musculus
aaggagccgctctaggctccgggaa

SEQ ID NO: 361358 - DNA, 25 bp, Mus musculus
tgccgacgctgtccaaggagccgct

SEQ ID NO: 361359 - DNA, 25 bp, Mus musculus
ttactggccgtctcgctggtgccga

SEQ ID NO: 361360 - DNA, 25 bp, Mus musculus
ctatctcagacctcgccgctggtta

SEQ ID NO: 361361 - DNA, 25 bp, Mus musculus
agcgtctactacttcactctgcctg

SEQ ID NO: 361362 - DNA, 25 bp, Mus musculus
gggcattcacgcgaggccctggctc

SEQ ID NO: 361363 - DNA, 25 bp, Mus musculus
gcctagtaggcctcgcgcagagcct

SEQ ID NO: 361364 - DNA, 25 bp, Mus musculus
aagctctcggcccacctgctggacc

SEQ ID NO: 361365 - DNA, 25 bp, Mus musculus
tgctgcccgtatgcagatgcggacc

SEQ ID NO: 361366 - DNA, 25 bp, Mus musculus
caggctatatttgctgcccgtatgc

SEQ ID NO: 361367 - DNA, 25 bp, Mus musculus
gacctgggcaggctatatttgctgc

SEQ ID NO: 361368 - DNA, 25 bp, Mus musculus
cccagggtcacgtgaacgcgaggca

SEQ ID NO: 361369 - DNA, 25 bp, Mus musculus
attagcccagggtcacgtgaacgcg

SEQ ID NO: 361370 - DNA, 25 bp, Mus musculus
ccgggacaagattagcccagggtca

SEQ ID NO: 361371 - DNA, 25 bp, Mus musculus
cccgtgaagtcaccgggacaagatt

SEQ ID NO: 361372 - DNA, 25 bp, Mus musculus
actactgggcccgtgaagtcaccgg

SEQ ID NO: 361373 - DNA, 25 bp, Mus musculus
cgtaaccatgactactgggcccgtg

SEQ ID NO: 361374 - DNA, 25 bp, Mus musculus
gcgctgcggcgtaaccatgactact

SEQ ID NO: 361375 - DNA, 25 bp, Mus musculus
tgctggaccgcctggccaccagtga

SEQ ID NO: 361376 - DNA, 25 bp, Mus musculus
gcaccggagaatttcctgcaaacga

SEQ ID NO: 361377 - DNA, 25 bp, Mus musculus
cttcccgaccgtcacgtggtgcggg

SEQ ID NO: 361378 - DNA, 25 bp, Mus musculus
agtgaacacgcaccacgggtccagc

SEQ ID NO: 361379 - DNA, 25 bp, Mus musculus
cagaaggaaagctggagaccaaagc

SEQ ID NO: 361380 - DNA, 25 bp, Mus musculus
tcttcgcctccagaaggaaagctgg

SEQ ID NO: 361381 - DNA, 25 bp, Mus musculus
ggcgccatgtcttcgcctccagaag

SEQ ID NO: 361382 - DNA, 25 bp, Mus musculus
tgccacgcagccgtttggagccacg

SEQ ID NO: 361383 - DNA, 25 bp, Mus musculus
ctgcgcatgctccacaaggacgggc

SEQ ID NO: 361384 - DNA, 25 bp, Mus musculus
catccttcccatacaatagccttgg

SEQ ID NO: 361385 - DNA, 25 bp, Mus musculus
cagcttggctagtgaacacgcacca

SEQ ID NO: 361386 - DNA, 25 bp, Mus musculus
gccggtactgactggtttgcactat

SEQ ID NO: 361387 - DNA, 25 bp, Mus musculus
atagccttggagtcgtacgtggcgc

SEQ ID NO: 361388 - DNA, 25 bp, Mus musculus
gtttgcactatgtcttggggcgccg

SEQ ID NO: 361389 - DNA, 25 bp, Mus musculus
gggtctcgaaccaccagcaggctac

SEQ ID NO: 361390 - DNA, 25 bp, Mus musculus
ttccctcagtgacagcttggctagt

SEQ ID NO: 361391 - DNA, 25 bp, Mus musculus
cagcaggctacgcttccctcagtga

SEQ ID NO: 361392 - DNA, 25 bp, Mus musculus
ctccctccacgccaggatcccaaga

SEQ ID NO: 361393 - DNA, 25 bp, Mus musculus
cgcagcacaaaaggcggcgctgctg

SEQ ID NO: 361394 - DNA, 25 bp, Mus musculus
ctccaccggacctggagagctgtca

SEQ ID NO: 361395 - DNA, 25 bp, Mus musculus
gacctggagagctgtcaccggcgat

SEQ ID NO: 361396 - DNA, 25 bp, Mus musculus
tcaccggcgatgctcgtgtggaact

SEQ ID NO: 361397 - DNA, 25 bp, Mus musculus
ctgcgctggagtcgccggcctctta

SEQ ID NO: 361398 - DNA, 25 bp, Mus musculus
gaactcaggtgtacgggtgtcagcc

SEQ ID NO: 361399 - DNA, 25 bp, Mus musculus
ctatctccaggcgtcgggtccaggg

SEQ ID NO: 361400 - DNA, 25 bp, Mus musculus
ggtccagggctctagttccttcata

SEQ ID NO: 361401 - DNA, 25 bp, Mus musculus
cgccacaattgtatcccgaccctcc

SEQ ID NO: 361402 - DNA, 25 bp, Mus musculus
tcgcccggttccttcctatctccag

SEQ ID NO: 361403 - DNA, 25 bp, Mus musculus
acagcttcagcatcctcgagtcacc

SEQ ID NO: 361404 - DNA, 25 bp, Mus musculus
tagttccttcataccacagcttcag

SEQ ID NO: 361405 - DNA, 25 bp, Mus musculus
atgctcgtgtggaactcaggtgtac

SEQ ID NO: 361406 - DNA, 25 bp, Mus musculus
tgtagttctctcagggagacagacc

SEQ ID NO: 361407 - DNA, 25 bp, Mus musculus
tggccgcctacacgcagctaatacg

SEQ ID NO: 361408 - DNA, 25 bp, Mus musculus
taatacgcatgctcacagtgtcggc

SEQ ID NO: 361409 - DNA, 25 bp, Mus musculus
catgctcacagtgtcggcttgggag

SEQ ID NO: 361410 - DNA, 25 bp, Mus musculus
aacccaacccactcgtagtagcttg

SEQ ID NO: 361411 - DNA, 25 bp, Mus musculus
aggatcagggctccggcactactac

SEQ ID NO: 361412 - DNA, 25 bp, Mus musculus
ggctccggcactactacaggctgcg

SEQ ID NO: 361413 - DNA, 25 bp, Mus musculus
actactacaggctgcgggctgccca

SEQ ID NO: 361414 - DNA, 25 bp, Mus musculus
gagctgcctcgcttggattcctgaa

SEQ ID NO: 361415 - DNA, 25 bp, Mus musculus
gattcctgaaggacgaaaagtgtga

SEQ ID NO: 361416 - DNA, 25 bp, Mus musculus
aatgagtgaagaggatcagggctcc

SEQ ID NO: 361417 - DNA, 25 bp, Mus musculus
cataagaagacacaaggagccgagt

SEQ ID NO: 361418 - DNA, 25 bp, Mus musculus
cgggtagctcggatccataagaaga

SEQ ID NO: 361419 - DNA, 25 bp, Mus musculus
actcgtagtagcttgggaagcttcc

SEQ ID NO: 361420 - DNA, 25 bp, Mus musculus
gtccggccaggcgtgttcacttctc

SEQ ID NO: 361421 - DNA, 25 bp, Mus musculus
gagagcggccctggcgtctaacgct

SEQ ID NO: 361422 - DNA, 25 bp, Mus musculus
cgactcgcacgtgttcggctgcaaa

SEQ ID NO: 361423 - DNA, 25 bp, Mus musculus
gcgctgtacacacgactcgcacgtg

SEQ ID NO: 361424 - DNA, 25 bp, Mus musculus
caggcgtgttcacttctcgcgagaa

SEQ ID NO: 361425 - DNA, 25 bp, Mus musculus
gagcagatactttcctcccgtccgg

SEQ ID NO: 361426 - DNA, 25 bp, Mus musculus
gctcggtcccacaatctgtctcctg

SEQ ID NO: 361427 - DNA, 25 bp, Mus musculus
aggactcacccgctggtagctccgg

SEQ ID NO: 361428 - DNA, 25 bp, Mus musculus
tgttaacaggactcacccgctggta

SEQ ID NO: 361429 - DNA, 25 bp, Mus musculus
ccacggactagctaatgttaacagg

SEQ ID NO: 361430 - DNA, 25 bp, Mus musculus
tcaggccacggactagctaatgtta

SEQ ID NO: 361431 - DNA, 25 bp, Mus musculus
gaaggagagactcctgtcaggccac

SEQ ID NO: 361432 - DNA, 25 bp, Mus musculus
ctggccagagtagaaggagagactc

SEQ ID NO: 361433 - DNA, 25 bp, Mus musculus
aaggttgggcgagcgctgtacacac

SEQ ID NO: 361434 - DNA, 25 bp, Mus musculus
cctcgcaaggggtactgctgcgcgc

SEQ ID NO: 361435 - DNA, 25 bp, Mus musculus
agagaacacgctcgccagcatctgc

SEQ ID NO: 361436 - DNA, 25 bp, Mus musculus
cagcatctgcctttcgccggccgca

SEQ ID NO: 361437 - DNA, 25 bp, Mus musculus
cgagtcgcttttctccatggataga

SEQ ID NO: 361438 - DNA, 25 bp, Mus musculus
ccgtgagacacccaagatggcgcca

SEQ ID NO: 361439 - DNA, 25 bp, Mus musculus
ccatggatagagtggacacaagcta

SEQ ID NO: 361440 - DNA, 25 bp, Mus musculus
gagacacccaagatggcgccaggcc

SEQ ID NO: 361441 - DNA, 25 bp, Mus musculus
ccgcgcggttagaggtcatcggcac

SEQ ID NO: 361442 - DNA, 25 bp, Mus musculus
cacaagctagaggatcggccgggac

SEQ ID NO: 361443 - DNA, 25 bp, Mus musculus
acccgcgtgggagctagcaaggtca

SEQ ID NO: 361444 - DNA, 25 bp, Mus musculus
gccacgcgtcctcgcaaggggtact

SEQ ID NO: 361445 - DNA, 25 bp, Mus musculus
gcacgaagaggacgcgaggcctcaa

SEQ ID NO: 361446 - DNA, 25 bp, Mus musculus
aggccttacctgctcccagggcaga

SEQ ID NO: 361447 - DNA, 25 bp, Mus musculus
gccggagccaacgagtcgcttttct

SEQ ID NO: 361448 - DNA, 25 bp, Mus musculus
cgctagccacaagcgtcgtgggcct

SEQ ID NO: 361449 - DNA, 25 bp, Mus musculus
gacagagggacaggatgcacaagca

SEQ ID NO: 361450 - DNA, 25 bp, Mus musculus
caggatgcacaagcaaaagagatgg

SEQ ID NO: 361451 - DNA, 25 bp, Mus musculus
tgactgtgagctccggcgcatgctt

SEQ ID NO: 361452 - DNA, 25 bp, Mus musculus
cagctcggggtctcggatgcccatg

SEQ ID NO: 361453 - DNA, 25 bp, Mus musculus
cggatgcccatgtagctctccagca

SEQ ID NO: 361454 - DNA, 25 bp, Mus musculus
catgtagctctccagcaggtcgtcc

SEQ ID NO: 361455 - DNA, 25 bp, Mus musculus
tgccgcttccacatcgctgggctgc

SEQ ID NO: 361456 - DNA, 25 bp, Mus musculus
cgtccaggccgcgtgcgaaagcctg

SEQ ID NO: 361457 - DNA, 25 bp, Mus musculus
gaaaggcgaactcgcccagaacggc

SEQ ID NO: 361458 - DNA, 25 bp, Mus musculus
ccgctgcgggaccagacagacagag

SEQ ID NO: 361459 - DNA, 25 bp, Mus musculus
accacgaactcgtctggaaaggcga

SEQ ID NO: 361460 - DNA, 25 bp, Mus musculus
cgtcgtgggcctcgccgatagctgc

SEQ ID NO: 361461 - DNA, 25 bp, Mus musculus
gccgagctccgagcagtctccacca

SEQ ID NO: 361462 - DNA, 25 bp, Mus musculus
tgcggccaatccatcttgcaggcgg

SEQ ID NO: 361463 - DNA, 25 bp, Mus musculus
gctttcctgcgctagtcctggagca

SEQ ID NO: 361464 - DNA, 25 bp, Mus musculus
cggaggaatttcaatgcggccaatc

SEQ ID NO: 361465 - DNA, 25 bp, Mus musculus
cgagtttaattatcctcgcggagga

SEQ ID NO: 361466 - DNA, 25 bp, Mus musculus
cccgagcgacgccattacaggaatg

SEQ ID NO: 361467 - DNA, 25 bp, Mus musculus
ccgctgaaagcccacggagcaattt

SEQ ID NO: 361468 - DNA, 25 bp, Mus musculus
agcagctttacggtcccggaggaga

SEQ ID NO: 361469 - DNA, 25 bp, Mus musculus
ggaggataaatcacggcagcagctt

SEQ ID NO: 361470 - DNA, 25 bp, Mus musculus
aggcaaatccgccaccctctgaggg

SEQ ID NO: 361471 - DNA, 25 bp, Mus musculus
ccgcggctgtaaataaaggcaaatc

SEQ ID NO: 361472 - DNA, 25 bp, Mus musculus
ctagcagacggctgcaaggctgacc

SEQ ID NO: 361473 - DNA, 25 bp, Mus musculus
agcaggcctttgtgtacacgcagga

SEQ ID NO: 361474 - DNA, 25 bp, Mus musculus
caggaatgtaattttgcccggatga

SEQ ID NO: 361475 - DNA, 25 bp, Mus musculus
cacgcaggaacgcacgagcctagca

SEQ ID NO: 361476 - DNA, 25 bp, Mus musculus
gaggctgccgctcgccatcaccgca

SEQ ID NO: 361477 - DNA, 25 bp, Mus musculus
aggcgtttgtagcagggtgaaagcc

SEQ ID NO: 361478 - DNA, 25 bp, Mus musculus
ttaaatggtggcatattgttcgcgc

SEQ ID NO: 361479 - DNA, 25 bp, Mus musculus
ccgcagcgcgccaggccctgtagcc

SEQ ID NO: 361480 - DNA, 25 bp, Mus musculus
taacatcacaatcggcggctggcgc

SEQ ID NO: 361481 - DNA, 25 bp, Mus musculus
tattgttcgcgcacggtctcggcca

SEQ ID NO: 361482 - DNA, 25 bp, Mus musculus
tcggcctccttggaggctgccgctc

SEQ ID NO: 361483 - DNA, 25 bp, Mus musculus
gaattaacatcacaatcggcggctg

SEQ ID NO: 361484 - DNA, 25 bp, Mus musculus
gctggcgcgcgttcagacttaaatg

SEQ ID NO: 361485 - DNA, 25 bp, Mus musculus
cgcgcgttcagacttaaatggtggc

SEQ ID NO: 361486 - DNA, 25 bp, Mus musculus
gcgttcagacttaaatggtggcata

SEQ ID NO: 361487 - DNA, 25 bp, Mus musculus
tggcatattgttcgcgcacggtctc

SEQ ID NO: 361488 - DNA, 25 bp, Mus musculus
acggtctcggccagacccgcgggat

SEQ ID NO: 361489 - DNA, 25 bp, Mus musculus
tcatcgccgaattaacatcacaatc

SEQ ID NO: 361490 - DNA, 25 bp, Mus musculus
cctgcaaacgggcaagaggcatgat

SEQ ID NO: 361491 - DNA, 25 bp, Mus musculus
aaacgggcaagaggcatgatggacc

SEQ ID NO: 361492 - DNA, 25 bp, Mus musculus
ggtgcgcatcctaaccggccaagtc

SEQ ID NO: 361493 - DNA, 25 bp, Mus musculus
gttattacggaaaacgcgacctgca

SEQ ID NO: 361494 - DNA, 25 bp, Mus musculus
cagccgcattaaaggttattacgga

SEQ ID NO: 361495 - DNA, 25 bp, Mus musculus
tggccagccgcattaaaggttatta

SEQ ID NO: 361496 - DNA, 25 bp, Mus musculus
catcgcgaacatttgggccttggcc

SEQ ID NO: 361497 - DNA, 25 bp, Mus musculus
atcgtccatctgatgcgcggggccc

SEQ ID NO: 361498 - DNA, 25 bp, Mus musculus
aaacgcgacctgcaaacgggcaaga

SEQ ID NO: 361499 - DNA, 25 bp, Mus musculus
gactttctgcgggacggctccctgg

SEQ ID NO: 361500 - DNA, 25 bp, Mus musculus
ctccctgggggatgattaacacttc

SEQ ID NO: 361501 - DNA, 25 bp, Mus musculus
gattaacacttcatcgtccatctga

SEQ ID NO: 361502 - DNA, 25 bp, Mus musculus
ccagcgctccatcgcgaacatttgg

SEQ ID NO: 361503 - DNA, 25 bp, Mus musculus
aacatttgggccttggccagccgca

SEQ ID NO: 361504 - DNA, 25 bp, Mus musculus
gcacccgcctgctctttagggtctg

SEQ ID NO: 361505 - DNA, 25 bp, Mus musculus
gctccgggtattcgccatttctctg

SEQ ID NO: 361506 - DNA, 25 bp, Mus musculus
ggacgcagtcatccgcccttagtgg

SEQ ID NO: 361507 - DNA, 25 bp, Mus musculus
acatcgacgaggactgttggacgca

SEQ ID NO: 361508 - DNA, 25 bp, Mus musculus
gtcccacagctcagaggaggggttc

SEQ ID NO: 361509 - DNA, 25 bp, Mus musculus
cctggctcggtgtccttgagctgaa

SEQ ID NO: 361510 - DNA, 25 bp, Mus musculus
cagccaatttcatgccagcgccggg

SEQ ID NO: 361511 - DNA, 25 bp, Mus musculus
gctcatgcgcgtaggccttcactag

SEQ ID NO: 361512 - DNA, 25 bp, Mus musculus
gcctccaaatgcctgtcccagtttg

SEQ ID NO: 361513 - DNA, 25 bp, Mus musculus
cgcagagcggtggaacgttttaatt

SEQ ID NO: 361514 - DNA, 25 bp, Mus musculus
gcggactcattacggctgcagccaa

SEQ ID NO: 361515 - DNA, 25 bp, Mus musculus
cttcactagcatcagggccttgggc

SEQ ID NO: 361516 - DNA, 25 bp, Mus musculus
ccgcgggtcccttttcatacatcga

SEQ ID NO: 361517 - DNA, 25 bp, Mus musculus
gcagacatcgacttcggagccaatc

SEQ ID NO: 361518 - DNA, 25 bp, Mus musculus
actgggctctttccaatggctggga

SEQ ID NO: 361519 - DNA, 25 bp, Mus musculus
aatgcgctggggaagaaatctgctc

SEQ ID NO: 361520 - DNA, 25 bp, Mus musculus
acagtcaggtgtactgctccaagga

SEQ ID NO: 361521 - DNA, 25 bp, Mus musculus
tgttgaaggctaccagcactgggct

SEQ ID NO: 361522 - DNA, 25 bp, Mus musculus
acgacgcgctcatccctgttgaagg

SEQ ID NO: 361523 - DNA, 25 bp, Mus musculus
caatgcccggctacctggacgtgtc

SEQ ID NO: 361524 - DNA, 25 bp, Mus musculus
ccagggctaaggagttcgccttcta

SEQ ID NO: 361525 - DNA, 25 bp, Mus musculus
acctgcagcagaagccttgcgccta

SEQ ID NO: 361526 - DNA, 25 bp, Mus musculus
tcagggcgccgtctacacggacatc

SEQ ID NO: 361527 - DNA, 25 bp, Mus musculus
gcctgtcgcacaacgtgaacctgca

SEQ ID NO: 361528 - DNA, 25 bp, Mus musculus
cagcgccaccctgggctatggttac

SEQ ID NO: 361529 - DNA, 25 bp, Mus musculus
tgccgggtccagagtgaagcaatca

SEQ ID NO: 361530 - DNA, 25 bp, Mus musculus
ggtgacgacctgtcctccagggcta

SEQ ID NO: 361531 - DNA, 25 bp, Mus musculus
tgctccaaggagcagtcgcagtccg

SEQ ID NO: 361532 - DNA, 25 bp, Mus musculus
cagctttgtaccataacggaatcca

SEQ ID NO: 361533 - DNA, 25 bp, Mus musculus
tgccctataccaaggtgcagctgaa

SEQ ID NO: 361534 - DNA, 25 bp, Mus musculus
ctagagaaggagtacgcagccagca

SEQ ID NO: 361535 - DNA, 25 bp, Mus musculus
gcagccagcaaattcatcaccaaag

SEQ ID NO: 361536 - DNA, 25 bp, Mus musculus
tcatcaccaaagagaagcgccggcg

SEQ ID NO: 361537 - DNA, 25 bp, Mus musculus
cgtcaggtcaccatctggttccaga

SEQ ID NO: 361538 - DNA, 25 bp, Mus musculus
aagagaaaaaggtggtcagcaaatc

SEQ ID NO: 361539 - DNA, 25 bp, Mus musculus
gtcagcaaatctaaagcgcctcatc

SEQ ID NO: 361540 - DNA, 25 bp, Mus musculus
cggaatccacccgaaggacgctgca

SEQ ID NO: 361541 - DNA, 25 bp, Mus musculus
cgactatttatgtcacagctttgta

SEQ ID NO: 361542 - DNA, 25 bp, Mus musculus
cgcaagaagcgcgtgccctatacca

SEQ ID NO: 361543 - DNA, 25 bp, Mus musculus
acgaacctctcggagcgtcaggtca

SEQ ID NO: 361544 - DNA, 25 bp, Mus musculus
gcccgtcccgactatttatgtcaca

SEQ ID NO: 361545 - DNA, 25 bp, Mus musculus
ttccagaatcgacgcgtgaaagaga

SEQ ID NO: 361546 - DNA, 25 bp, Mus musculus
gtcttctcctgtctgctcgctacgg

SEQ ID NO: 361547 - DNA, 25 bp, Mus musculus
gtcactggcgactggagaaaagccc

SEQ ID NO: 361548 - DNA, 25 bp, Mus musculus
aaggaatcgtccgatgcgatgctgc

SEQ ID NO: 361549 - DNA, 25 bp, Mus musculus
agaagtcttcgtactcctcgtagtc

SEQ ID NO: 361550 - DNA, 25 bp, Mus musculus
tccagcctggcagaaagcagctcca

SEQ ID NO: 361551 - DNA, 25 bp, Mus musculus
gctcccggtgcaaagtcactggcga

SEQ ID NO: 361552 - DNA, 25 bp, Mus musculus
acggccactttgtcccgagcaggga

SEQ ID NO: 361553 - DNA, 25 bp, Mus musculus
gaaaggcttgttcgggagatcctga

SEQ ID NO: 361554 - DNA, 25 bp, Mus musculus
gatcctgaagctgtaactcgagagg

SEQ ID NO: 361555 - DNA, 25 bp, Mus musculus
actcgagaggctgaaagctagcgtg

SEQ ID NO: 361556 - DNA, 25 bp, Mus musculus
gtccggagacgccaaaggctaagca

SEQ ID NO: 361557 - DNA, 25 bp, Mus musculus
tttccagcgtcggaaagtacccgca

SEQ ID NO: 361558 - DNA, 25 bp, Mus musculus
gtgtccggcagactagagaagtctt

SEQ ID NO: 361559 - DNA, 25 bp, Mus musculus
tcccgggagcatcagagatcctctc

SEQ ID NO: 361560 - DNA, 25 bp, Mus musculus
ttcgctccgggagcggtggaattca

SEQ ID NO: 361561 - DNA, 25 bp, Mus musculus
agacctccgaggttccagagtgggt

SEQ ID NO: 361562 - DNA, 25 bp, Mus musculus
accaagcgggctgccaggaaggctc

SEQ ID NO: 361563 - DNA, 25 bp, Mus musculus
gctgaggaaggagaaccggccaagc

SEQ ID NO: 361564 - DNA, 25 bp, Mus musculus
cccgcggggacacatttctgtcgga

SEQ ID NO: 361565 - DNA, 25 bp, Mus musculus
cggggacacatttctgtcggaatga

SEQ ID NO: 361566 - DNA, 25 bp, Mus musculus
acacatttctgtcggaatgagcagc

SEQ ID NO: 361567 - DNA, 25 bp, Mus musculus
ctgtcggaatgagcagctatggttt

SEQ ID NO: 361568 - DNA, 25 bp, Mus musculus
cacggacaagacctccgaggttcca

SEQ ID NO: 361569 - DNA, 25 bp, Mus musculus
tgggatatgaattcgctccgggagc

SEQ ID NO: 361570 - DNA, 25 bp, Mus musculus
agaatctgcttttctttccgccgcg

SEQ ID NO: 361571 - DNA, 25 bp, Mus musculus
cgggagcggtggaattcaaagaatc

SEQ ID NO: 361572 - DNA, 25 bp, Mus musculus
cggtggaattcaaagaatctgcttt

SEQ ID NO: 361573 - DNA, 25 bp, Mus musculus
cagctatggtttgggatatgaattc

SEQ ID NO: 361574 - DNA, 25 bp, Mus musculus
tcgtccctactcaacgagggcaata

SEQ ID NO: 361575 - DNA, 25 bp, Mus musculus
tctggtttcgccgttgaacccaggc

SEQ ID NO: 361576 - DNA, 25 bp, Mus musculus
atgggcgagcataatctcctgaatc

SEQ ID NO: 361577 - DNA, 25 bp, Mus musculus
ctcctgaatcctgggtttgtggggc

SEQ ID NO: 361578 - DNA, 25 bp, Mus musculus
ggggccgctggtgaatatccacaca

SEQ ID NO: 361579 - DNA, 25 bp, Mus musculus
caacttccgcgcgtcaggggcacaa

SEQ ID NO: 361580 - DNA, 25 bp, Mus musculus
gcgacaacgtgtgctcgctgccttg

SEQ ID NO: 361581 - DNA, 25 bp, Mus musculus
ggccgagccgtgcaatggctaccca

SEQ ID NO: 361582 - DNA, 25 bp, Mus musculus
tatctcggcagtcccgtgtctctca

SEQ ID NO: 361583 - DNA, 25 bp, Mus musculus
gttactaccgagaaccctgcgctga

SEQ ID NO: 361584 - DNA, 25 bp, Mus musculus
cagcgctactgcagctggagccgtc

SEQ ID NO: 361585 - DNA, 25 bp, Mus musculus
ctgcgctcggcttcaagtacgacta

SEQ ID NO: 361586 - DNA, 25 bp, Mus musculus
ggaatccgactccagttcgtcccta

SEQ ID NO: 361587 - DNA, 25 bp, Mus musculus
caagtacgactacacggcgagcggc

SEQ ID NO: 361588 - DNA, 25 bp, Mus musculus
cgcaaaggtctatggcccgtgcctc

SEQ ID NO: 361589 - DNA, 25 bp, Mus musculus
cgctgatagatgacgcgggcgccta

SEQ ID NO: 361590 - DNA, 25 bp, Mus musculus
gctcgtcgccgctgatagatgacgc

SEQ ID NO: 361591 - DNA, 25 bp, Mus musculus
ttctcccgaggaggcccgagacaaa

SEQ ID NO: 361592 - DNA, 25 bp, Mus musculus
ctctggtggttgcttctcccgagga

SEQ ID NO: 361593 - DNA, 25 bp, Mus musculus
tctcccgctagatcgcagcctttgg

SEQ ID NO: 361594 - DNA, 25 bp, Mus musculus
gcggagcctgagtctgatcacccac

SEQ ID NO: 361595 - DNA, 25 bp, Mus musculus
cgaacagttaccgattttcagcgca

SEQ ID NO: 361596 - DNA, 25 bp, Mus musculus
ttggcagcgaacctccgaacagtta

SEQ ID NO: 361597 - DNA, 25 bp, Mus musculus
acggacgcctcttcttggcagcgaa

SEQ ID NO: 361598 - DNA, 25 bp, Mus musculus
tcggtttagagaggacggacgcctc

SEQ ID NO: 361599 - DNA, 25 bp, Mus musculus
ttttcagcgcaaaggtctatggccc

SEQ ID NO: 361600 - DNA, 25 bp, Mus musculus
cgcacacatttcgtctcggtttaga

SEQ ID NO: 361601 - DNA, 25 bp, Mus musculus
ttagccggctctggtggttgcttct

SEQ ID NO: 361602 - DNA, 25 bp, Mus musculus
aaggcctcggcgatcttggcgtaaa

SEQ ID NO: 361603 - DNA, 25 bp, Mus musculus
gaccctgtctgtgaactccgtgcct

SEQ ID NO: 361604 - DNA, 25 bp, Mus musculus
ggtgctgcgtccagtcttggcctcc

SEQ ID NO: 361605 - DNA, 25 bp, Mus musculus
ctcgcggggcgcagcactgtccatg

SEQ ID NO: 361606 - DNA, 25 bp, Mus musculus
tgcgccagctgcgtgcggaacacta

SEQ ID NO: 361607 - DNA, 25 bp, Mus musculus
gaagccctcgatcctgccggtcgga

SEQ ID NO: 361608 - DNA, 25 bp, Mus musculus
tgaactccgtgccttgtccctctgt

SEQ ID NO: 361609 - DNA, 25 bp, Mus musculus
agcgatgccgaaggcctcggcgatc

SEQ ID NO: 361610 - DNA, 25 bp, Mus musculus
accctcacctcggtaggagcgatgc

SEQ ID NO: 361611 - DNA, 25 bp, Mus musculus
atcctgggtggtgtccgcggtccac

SEQ ID NO: 361612 - DNA, 25 bp, Mus musculus
cctgtctttcgcgtggagtgcagac

SEQ ID NO: 361613 - DNA, 25 bp, Mus musculus
ctcccagggtctgatcctgtctttc

SEQ ID NO: 361614 - DNA, 25 bp, Mus musculus
cgcggacattggtgaagccctcgat

SEQ ID NO: 361615 - DNA, 25 bp, Mus musculus
tcttggcgtaaagctcgcggacatt

SEQ ID NO: 361616 - DNA, 25 bp, Mus musculus
tctgcccagttgcacttactacgtg

SEQ ID NO: 361617 - DNA, 25 bp, Mus musculus
gttcttcccactcggcgaccaagga

SEQ ID NO: 361618 - DNA, 25 bp, Mus musculus
ggcttctactcctcagtcaacaaga

SEQ ID NO: 361619 - DNA, 25 bp, Mus musculus
cgacgagcttatgcaccgggagtgc

SEQ ID NO: 361620 - DNA, 25 bp, Mus musculus
ctactcgtcttgttatgcggcggcc

SEQ ID NO: 361621 - DNA, 25 bp, Mus musculus
ctactttggatcacgtgctcgggga

SEQ ID NO: 361622 - DNA, 25 bp, Mus musculus
gtggcaccatcggaacagctactcg

SEQ ID NO: 361623 - DNA, 25 bp, Mus musculus
aggctccctctcgtcagatttctta

SEQ ID NO: 361624 - DNA, 25 bp, Mus musculus
gcgtcatctcgccttcccaaaattt

SEQ ID NO: 361625 - DNA, 25 bp, Mus musculus
ttctgctcgccttcgcgcaaggaga

SEQ ID NO: 361626 - DNA, 25 bp, Mus musculus
actcggtcaacctgggcaacttctg

SEQ ID NO: 361627 - DNA, 25 bp, Mus musculus
tcgctagatcgggtccaaaacctcc

SEQ ID NO: 361628 - DNA, 25 bp, Mus musculus
gcttcttcgacaacgcctactgcgg

SEQ ID NO: 361629 - DNA, 25 bp, Mus musculus
ctgcgaagtgctccgaactgatata

SEQ ID NO: 361630 - DNA, 25 bp, Mus musculus
cgctgcccttattcgaaattccaga

SEQ ID NO: 361631 - DNA, 25 bp, Mus musculus
atccgggaactggagcgagagtttt

SEQ ID NO: 361632 - DNA, 25 bp, Mus musculus
ccgcaagaagcgctgcccttattcg

SEQ ID NO: 361633 - DNA, 25 bp, Mus musculus
cagcggatacggaagaggagccgcc

SEQ ID NO: 361634 - DNA, 25 bp, Mus musculus
ggaactggagcgagagtttttcttc

SEQ ID NO: 361635 - DNA, 25 bp, Mus musculus
tccagatccgggaactggagcgaga

SEQ ID NO: 361636 - DNA, 25 bp, Mus musculus
ttcgaaattccagatccgggaactg

SEQ ID NO: 361637 - DNA, 25 bp, Mus musculus
gcccttattcgaaattccagatccg

SEQ ID NO: 361638 - DNA, 25 bp, Mus musculus
gaagcgctgcccttattcgaaattc

SEQ ID NO: 361639 - DNA, 25 bp, Mus musculus
tgagctttcagcgactgggttggct

SEQ ID NO: 361640 - DNA, 25 bp, Mus musculus
tagctgagctttcagcgactgggtt

SEQ ID NO: 361641 - DNA, 25 bp, Mus musculus
tgtgtagctgagctttcagcgactg

SEQ ID NO: 361642 - DNA, 25 bp, Mus musculus
actgggagctgtgtagctgagcttt

SEQ ID NO: 361643 - DNA, 25 bp, Mus musculus
ctggagcgagagtttttcttcaacg

SEQ ID NO: 361644 - DNA, 25 bp, Mus musculus
tcacatggtgaggaccgaatgcgcg

SEQ ID NO: 361645 - DNA, 25 bp, Mus musculus
cgctgacgtcacgaccgtctgaatc

SEQ ID NO: 361646 - DNA, 25 bp, Mus musculus
ggggcgcttcctttgttcgccagga

SEQ ID NO: 361647 - DNA, 25 bp, Mus musculus
ccattttcaaatcccattggtctag

SEQ ID NO: 361648 - DNA, 25 bp, Mus musculus
atcccattggtctagccgtcacatg

SEQ ID NO: 361649 - DNA, 25 bp, Mus musculus
gccgtcacatggtgaggaccgaatg

SEQ ID NO: 361650 - DNA, 25 bp, Mus musculus
cgtctgaatcatcaaggccattttc

SEQ ID NO: 361651 - DNA, 25 bp, Mus musculus
gctccgcctgccgacaacttgaccc

SEQ ID NO: 361652 - DNA, 25 bp, Mus musculus
tcctttgttcgccaggaagggctcc

SEQ ID NO: 361653 - DNA, 25 bp, Mus musculus
cagctgctaggtggcgctgttactc

SEQ ID NO: 361654 - DNA, 25 bp, Mus musculus
tgctaggtggcgctgttactccacg

SEQ ID NO: 361655 - DNA, 25 bp, Mus musculus
tggcgctgttactccacgctgagcg

SEQ ID NO: 361656 - DNA, 25 bp, Mus musculus
tactccacgctgagcgctccgcctg

SEQ ID NO: 361657 - DNA, 25 bp, Mus musculus
attggtctagccgtcacatggtgag

SEQ ID NO: 361658 - DNA, 25 bp, Mus musculus
tgctggggccaacgagttcgaagcc

SEQ ID NO: 361659 - DNA, 25 bp, Mus musculus
cagtcccaatgagatcaagacagag

SEQ ID NO: 361660 - DNA, 25 bp, Mus musculus
agctactccgcgctggacaaaacgc

SEQ ID NO: 361661 - DNA, 25 bp, Mus musculus
aacccgcgcaccgaacatctggaat

SEQ ID NO: 361662 - DNA, 25 bp, Mus musculus
gaacatctggaatcgcctcagcttg

SEQ ID NO: 361663 - DNA, 25 bp, Mus musculus
acgaagctaaaggtaaggccgtctg

SEQ ID NO: 361664 - DNA, 25 bp, Mus musculus
ggcaaagtgagttttcctgagaccc

SEQ ID NO: 361665 - DNA, 25 bp, Mus musculus
ccagacacctcggataacgaagcta

SEQ ID NO: 361666 - DNA, 25 bp, Mus musculus
tgagatcaagacagagcaaagcctg

SEQ ID NO: 361667 - DNA, 25 bp, Mus musculus
agagcaaagcctggcgggcccaaaa

SEQ ID NO: 361668 - DNA, 25 bp, Mus musculus
aggaacgggccaagaccgcagactc

SEQ ID NO: 361669 - DNA, 25 bp, Mus musculus
aagaccgcagactccagtccagaca

SEQ ID NO: 361670 - DNA, 25 bp, Mus musculus
gactccagtccagacacctcggata

SEQ ID NO: 361671 - DNA, 25 bp, Mus musculus
atcgcctcagcttgggggcaaagtg

SEQ ID NO: 361672 - DNA, 25 bp, Mus musculus
cgcccaagccggctgtattcagtac

SEQ ID NO: 361673 - DNA, 25 bp, Mus musculus
ggcggggacagctagattacagccc

SEQ ID NO: 361674 - DNA, 25 bp, Mus musculus
cctggaccctagtaagttgggagca

SEQ ID NO: 361675 - DNA, 25 bp, Mus musculus
cgctggccggcagcaagcacaaaga

SEQ ID NO: 361676 - DNA, 25 bp, Mus musculus
ctacatgtacggctcgcccggggaa

SEQ ID NO: 361677 - DNA, 25 bp, Mus musculus
cgcagctacccggactacatgtacg

SEQ ID NO: 361678 - DNA, 25 bp, Mus musculus
ccgacacgcgctacatgcggacttg

SEQ ID NO: 361679 - DNA, 25 bp, Mus musculus
ctgtattcagtacgtcgtgggcgcc

SEQ ID NO: 361680 - DNA, 25 bp, Mus musculus
attttccgtcctgtagcttcgcgcc

SEQ ID NO: 361681 - DNA, 25 bp, Mus musculus
tgccggactgtagcgattttccgtc

SEQ ID NO: 361682 - DNA, 25 bp, Mus musculus
agacctcctagcgtccaggtttccg

SEQ ID NO: 361683 - DNA, 25 bp, Mus musculus
gactcgctcatctctcacgacaatg

SEQ ID NO: 361684 - DNA, 25 bp, Mus musculus
gacggggcccatcagtaactattac

SEQ ID NO: 361685 - DNA, 25 bp, Mus musculus
tcgcagtcgtctgtggtctatcacc

SEQ ID NO: 361686 - DNA, 25 bp, Mus musculus
ttacgactgccggttccctcagagc

SEQ ID NO: 361687 - DNA, 25 bp, Mus musculus
gtctgaggaattcgcctgggctgtt

SEQ ID NO: 361688 - DNA, 25 bp, Mus musculus
gcgaatcgcgtgtaagcgccgccac

SEQ ID NO: 361689 - DNA, 25 bp, Mus musculus
cctgggctgttagaggaaagagcta

SEQ ID NO: 361690 - DNA, 25 bp, Mus musculus
gcgcgctctacctaccgacagtgag

SEQ ID NO: 361691 - DNA, 25 bp, Mus musculus
gccgcgggttttcatgtacccagca

SEQ ID NO: 361692 - DNA, 25 bp, Mus musculus
ccagcatgagctcctacttcgtcaa

SEQ ID NO: 361693 - DNA, 25 bp, Mus musculus
cctggaaccggcctattacgactgc

SEQ ID NO: 361694 - DNA, 25 bp, Mus musculus
ctccaaattctatggctacgaggcg

SEQ ID NO: 361695 - DNA, 25 bp, Mus musculus
tccctcagagcgtgggcagaagcca

SEQ ID NO: 361696 - DNA, 25 bp, Mus musculus
actcgggctaccagcagaacccatg

SEQ ID NO: 361697 - DNA, 25 bp, Mus musculus
agaacccatgctcgctgagctgcca

SEQ ID NO: 361698 - DNA, 25 bp, Mus musculus
gctgccacggagacgcctccaaatt

SEQ ID NO: 361699 - DNA, 25 bp, Mus musculus
tacaaaggcggcgagtccctggaac

SEQ ID NO: 361700 - DNA, 25 bp, Mus musculus
gcggccgccagatctactctcggta

SEQ ID NO: 361701 - DNA, 25 bp, Mus musculus
aatctcacgtccacactctcagggg

SEQ ID NO: 361702 - DNA, 25 bp, Mus musculus
agaatctaatctcacgtccacactc

SEQ ID NO: 361703 - DNA, 25 bp, Mus musculus
gaagtggaaaaaagaatctaatctc

SEQ ID NO: 361704 - DNA, 25 bp, Mus musculus
tgctctgtgcctgaccgagcgacag

SEQ ID NO: 361705 - DNA, 25 bp, Mus musculus
gccaatgctctgtgcctgaccgagc

SEQ ID NO: 361706 - DNA, 25 bp, Mus musculus
atcgccaatgctctgtgcctgaccg

SEQ ID NO: 361707 - DNA, 25 bp, Mus musculus
gagatcgccaatgctctgtgcctga

SEQ ID NO: 361708 - DNA, 25 bp, Mus musculus
atcgagatcgccaatgctctgtgcc

SEQ ID NO: 361709 - DNA, 25 bp, Mus musculus
gcgcatcgagatcgccaatgctctg

SEQ ID NO: 361710 - DNA, 25 bp, Mus musculus
cgctacctaactcggcgccggcgca

SEQ ID NO: 361711 - DNA, 25 bp, Mus musculus
atctactctcggtaccagaccctgg

SEQ ID NO: 361712 - DNA, 25 bp, Mus musculus
cgccagatctactctcggtaccaga

SEQ ID NO: 361713 - DNA, 25 bp, Mus musculus
cacgtccacactctcagggggtggc

SEQ ID NO: 361714 - DNA, 25 bp, Mus musculus
ctgcttgaggatgtccggcagctcc

SEQ ID NO: 361715 - DNA, 25 bp, Mus musculus
cgtcggcgtctgtactcggtaacgg

SEQ ID NO: 361716 - DNA, 25 bp, Mus musculus
cacgtccgccggctgcgtacggatg

SEQ ID NO: 361717 - DNA, 25 bp, Mus musculus
atggcagccttggtgaactgcttga

SEQ ID NO: 361718 - DNA, 25 bp, Mus musculus
cccaagaggtctcgaccagggtctc

SEQ ID NO: 361719 - DNA, 25 bp, Mus musculus
tctgctgcgcgcagaacatggtgtc

SEQ ID NO: 361720 - DNA, 25 bp, Mus musculus
ggcccaaccgcccagagcggataga

SEQ ID NO: 361721 - DNA, 25 bp, Mus musculus
cccagagcggatagagcacgcgatt

SEQ ID NO: 361722 - DNA, 25 bp, Mus musculus
cagcttgttttcctaaaacgcggag

SEQ ID NO: 361723 - DNA, 25 bp, Mus musculus
gtgcggtctccaggcaacccgagct

SEQ ID NO: 361724 - DNA, 25 bp, Mus musculus
gctggcctctgtgaccaacgagtga

SEQ ID NO: 361725 - DNA, 25 bp, Mus musculus
ccaacgagtgaccacagagcggaga

SEQ ID NO: 361726 - DNA, 25 bp, Mus musculus
ggagagcgccataaaacagcttgtt

SEQ ID NO: 361727 - DNA, 25 bp, Mus musculus
gcggaggttgcgctaatccgaaccc

SEQ ID NO: 361728 - DNA, 25 bp, Mus musculus
cctgcggccataaattttacgatcc

SEQ ID NO: 361729 - DNA, 25 bp, Mus musculus
ggcatcaatggctcgtaaaactgtc

SEQ ID NO: 361730 - DNA, 25 bp, Mus musculus
ctgtgtgcgcccaaatttacgacga

SEQ ID NO: 361731 - DNA, 25 bp, Mus musculus
cggatctcgagggtgcttattgttc

SEQ ID NO: 361732 - DNA, 25 bp, Mus musculus
ctgcacatgagccacggtaaacttt

SEQ ID NO: 361733 - DNA, 25 bp, Mus musculus
acgttggagtgctgcacgctattca

SEQ ID NO: 361734 - DNA, 25 bp, Mus musculus
cggctcctctgaaccctgggatgta

SEQ ID NO: 361735 - DNA, 25 bp, Mus musculus
cccgccacagatttacccgtggatg

SEQ ID NO: 361736 - DNA, 25 bp, Mus musculus
gtccgcctgggttttataggccatg

SEQ ID NO: 361737 - DNA, 25 bp, Mus musculus
gatgtacagtcagaaggcggctcgc

SEQ ID NO: 361738 - DNA, 25 bp, Mus musculus
taggacttcattttgcgcgctcggg

SEQ ID NO: 361739 - DNA, 25 bp, Mus musculus
gtggaaagtttcctgcccaggcgga

SEQ ID NO: 361740 - DNA, 25 bp, Mus musculus
cccgtggatgaccaaactgcacatg

SEQ ID NO: 361741 - DNA, 25 bp, Mus musculus
atggcaagcggtcccgaaccagtta

SEQ ID NO: 361742 - DNA, 25 bp, Mus musculus
ctttgaaatgtaaggcgagacggcc

SEQ ID NO: 361743 - DNA, 25 bp, Mus musculus
gcgtcccgaagaagccctagagaaa

SEQ ID NO: 361744 - DNA, 25 bp, Mus musculus
gccctagagaaaatcaatcgcgtaa

SEQ ID NO: 361745 - DNA, 25 bp, Mus musculus
tcgcgtaattagaacagggagaggt

SEQ ID NO: 361746 - DNA, 25 bp, Mus musculus
ggtccgaggttctgtggcctaaata

SEQ ID NO: 361747 - DNA, 25 bp, Mus musculus
ctcagagacagaggcgtcccgaaga

SEQ ID NO: 361748 - DNA, 25 bp, Mus musculus
gcgagacggcctagggacctcaaaa

SEQ ID NO: 361749 - DNA, 25 bp, Mus musculus
gtggcttggccatttctttgaaatg

SEQ ID NO: 361750 - DNA, 25 bp, Mus musculus
ggcaagatcatgttgtcgcagtctc

SEQ ID NO: 361751 - DNA, 25 bp, Mus musculus
tagggacctcaaaacgcgccagccg

SEQ ID NO: 361752 - DNA, 25 bp, Mus musculus
gcggaaagatttaaacactcagaga

SEQ ID NO: 361753 - DNA, 25 bp, Mus musculus
gtgtgactggcctgtccgcccggac

SEQ ID NO: 361754 - DNA, 25 bp, Mus musculus
cagccgccggcacatctcgggagaa

SEQ ID NO: 361755 - DNA, 25 bp, Mus musculus
catctcgggagaactcgggaaaaga

SEQ ID NO: 361756 - DNA, 25 bp, Mus musculus
tcgggcgaggcctaattgaaaagtg

SEQ ID NO: 361757 - DNA, 25 bp, Mus musculus
agcaccgcattctgctcctcgaagg

SEQ ID NO: 361758 - DNA, 25 bp, Mus musculus
acgcgcgctgctcatgctctgcgtg

SEQ ID NO: 361759 - DNA, 25 bp, Mus musculus
tgctgcaatgccagtgtgcgccgct

SEQ ID NO: 361760 - DNA, 25 bp, Mus musculus
cgcgcgatcagtctctcgtgctgcg

SEQ ID NO: 361761 - DNA, 25 bp, Mus musculus
aagctagccgtgagcgcctgcctca

SEQ ID NO: 361762 - DNA, 25 bp, Mus musculus
tcctcgaaggccacgttcatctttc

SEQ ID NO: 361763 - DNA, 25 bp, Mus musculus
gttcatctttctcaggcgccgcagc

SEQ ID NO: 361764 - DNA, 25 bp, Mus musculus
cagtgggttagagagaggcctccca

SEQ ID NO: 361765 - DNA, 25 bp, Mus musculus
atgtaaaagtccagcgtcccgaggg

SEQ ID NO: 361766 - DNA, 25 bp, Mus musculus
aggatctccttgacgcgcgcgatca

SEQ ID NO: 361767 - DNA, 25 bp, Mus musculus
tgaagccgcgccatgtaaaagtcca

SEQ ID NO: 361768 - DNA, 25 bp, Mus musculus
gtcgcgctcgatggctccatgaagc

SEQ ID NO: 361769 - DNA, 25 bp, Mus musculus
acggcctgtagttgctgctgcaatg

SEQ ID NO: 361770 - DNA, 25 bp, Mus musculus
agccctataaaagctgtagcgagga

SEQ ID NO: 361771 - DNA, 25 bp, Mus musculus
ctataaaagctgtagcgaggaggca

SEQ ID NO: 361772 - DNA, 25 bp, Mus musculus
tgacgttttacagccctataaaagc

SEQ ID NO: 361773 - DNA, 25 bp, Mus musculus
gaggaggcaagcgctcctaccaccg

SEQ ID NO: 361774 - DNA, 25 bp, Mus musculus
tgatttatgacgttttacagcccta

SEQ ID NO: 361775 - DNA, 25 bp, Mus musculus
ccctgtgccgccgacacaaagagtg

SEQ ID NO: 361776 - DNA, 25 bp, Mus musculus
cgcgagactgatttatgacgtttta

SEQ ID NO: 361777 - DNA, 25 bp, Mus musculus
tcacattacgacttttcgtggaaag

SEQ ID NO: 361778 - DNA, 25 bp, Mus musculus
cggcggcgatcataataataaaatc

SEQ ID NO: 361779 - DNA, 25 bp, Mus musculus
tcacggcggcgatcataataataaa

SEQ ID NO: 361780 - DNA, 25 bp, Mus musculus
agattgactaatcacggcggcgatc

SEQ ID NO: 361781 - DNA, 25 bp, Mus musculus
cggcgaattaaaggtagattgacta

SEQ ID NO: 361782 - DNA, 25 bp, Mus musculus
gggcgattccgcgagactgatttat

SEQ ID NO: 361783 - DNA, 25 bp, Mus musculus
cgacacaaagagtgcgggcgattcc

SEQ ID NO: 361784 - DNA, 25 bp, Mus musculus
taccctgagcgtcagtatagctgca

SEQ ID NO: 361785 - DNA, 25 bp, Mus musculus
cctgaacacagtccggaatattacg

SEQ ID NO: 361786 - DNA, 25 bp, Mus musculus
gatccgaaatttcctccatgcgaag

SEQ ID NO: 361787 - DNA, 25 bp, Mus musculus
ttcctccatgcgaagaatattcgca

SEQ ID NO: 361788 - DNA, 25 bp, Mus musculus
tattcgcaaaatagctacatccctg

SEQ ID NO: 361789 - DNA, 25 bp, Mus musculus
gctacatccctgaacacagtccgga

SEQ ID NO: 361790 - DNA, 25 bp, Mus musculus
atattacggccggaccagggaatcg

SEQ ID NO: 361791 - DNA, 25 bp, Mus musculus
gccggaccagggaatcgggattcca

SEQ ID NO: 361792 - DNA, 25 bp, Mus musculus
caccaggagctgtacccaccaccgc

SEQ ID NO: 361793 - DNA, 25 bp, Mus musculus
agtatagctgcaccagtctccaggg

SEQ ID NO: 361794 - DNA, 25 bp, Mus musculus
tctccaggggcctggcaattcgcga

SEQ ID NO: 361795 - DNA, 25 bp, Mus musculus
ggcctggcaattcgcgagcccacgg

SEQ ID NO: 361796 - DNA, 25 bp, Mus musculus
accctgagaaatcgcagccgctctg

SEQ ID NO: 361797 - DNA, 25 bp, Mus musculus
aatcgggattccagcatcaccacca

SEQ ID NO: 361798 - DNA, 25 bp, Mus musculus
caaaaccgtcgtatgaaatggaaga

SEQ ID NO: 361799 - DNA, 25 bp, Mus musculus
acttctgaagaccactcccagagcg

SEQ ID NO: 361800 - DNA, 25 bp, Mus musculus
cccgaaggagaaggatcgagatcgc

SEQ ID NO: 361801 - DNA, 25 bp, Mus musculus
aaggatcgagatcgcccactcgctg

SEQ ID NO: 361802 - DNA, 25 bp, Mus musculus
cactcgctgtgcctctctgagaggc

SEQ ID NO: 361803 - DNA, 25 bp, Mus musculus
ctctctgagaggcagatcaaaatct

SEQ ID NO: 361804 - DNA, 25 bp, Mus musculus
gaaatggaagaaggaccaccgactc

SEQ ID NO: 361805 - DNA, 25 bp, Mus musculus
cccaacaccaaagtgaggtcagcgc

SEQ ID NO: 361806 - DNA, 25 bp, Mus musculus
caacaccaaagtgaggtcagcgccc

SEQ ID NO: 361807 - DNA, 25 bp, Mus musculus
tacctgacccgaaggagaaggatcg

SEQ ID NO: 361808 - DNA, 25 bp, Mus musculus
ggcacttctgaagaccactcccaga

SEQ ID NO: 361809 - DNA, 25 bp, Mus musculus
cccagagcgccacgccgccggagca

SEQ ID NO: 361810 - DNA, 25 bp, Mus musculus
cgtatgaaatggaagaaggaccacc

SEQ ID NO: 361811 - DNA, 25 bp, Mus musculus
gcgcccagcaccctctcggcagcca

SEQ ID NO: 361812 - DNA, 25 bp, Mus musculus
aacatcccgggagctgcctacagga

SEQ ID NO: 361813 - DNA, 25 bp, Mus musculus
ctcacgccgcggctcttcccagtcc

SEQ ID NO: 361814 - DNA, 25 bp, Mus musculus
ttttgtttccctctccgctgctctt

SEQ ID NO: 361815 - DNA, 25 bp, Mus musculus
ggcacttctgtatcccagtggccca

SEQ ID NO: 361816 - DNA, 25 bp, Mus musculus
ccagtggcccaaccgatttcggcta

SEQ ID NO: 361817 - DNA, 25 bp, Mus musculus
tctaggaagggaacatcccgggagc

SEQ ID NO: 361818 - DNA, 25 bp, Mus musculus
agaaaatttcaaggcgccctagctt

SEQ ID NO: 361819 - DNA, 25 bp, Mus musculus
atcccagtggcccaaccgatttcgg

SEQ ID NO: 361820 - DNA, 25 bp, Mus musculus
ttcctttatggaaatcgcttggctc

SEQ ID NO: 361821 - DNA, 25 bp, Mus musculus
cggtcttcgcttcctttatggaaat

SEQ ID NO: 361822 - DNA, 25 bp, Mus musculus
cgcttggctccaacttcggaaaaga

SEQ ID NO: 361823 - DNA, 25 bp, Mus musculus
gagctgcctacaggagctccggcct

SEQ ID NO: 361824 - DNA, 25 bp, Mus musculus
taaaaggctctaggaagggaacatc

SEQ ID NO: 361825 - DNA, 25 bp, Mus musculus
tggaaatcgcttggctccaacttcg

SEQ ID NO: 361826 - DNA, 25 bp, Mus musculus
aaatatgggccattttcccagctcc

SEQ ID NO: 361827 - DNA, 25 bp, Mus musculus
ggtaatatttaaggcctcgcgcctg

SEQ ID NO: 361828 - DNA, 25 bp, Mus musculus
catgctgctgacgatcgtaaagggc

SEQ ID NO: 361829 - DNA, 25 bp, Mus musculus
gggcggctccgctttatttgcagca

SEQ ID NO: 361830 - DNA, 25 bp, Mus musculus
ccctcagcgttaattaaaacttgcg

SEQ ID NO: 361831 - DNA, 25 bp, Mus musculus
tcggctttgggacccagtcaccttg

SEQ ID NO: 361832 - DNA, 25 bp, Mus musculus
gccctctgagtggtgacaaccgtcc

SEQ ID NO: 361833 - DNA, 25 bp, Mus musculus
ctggaagatcgcgatggccctctga

SEQ ID NO: 361834 - DNA, 25 bp, Mus musculus
ctcagagtgtcaaccgcgggagtcg

SEQ ID NO: 361835 - DNA, 25 bp, Mus musculus
cagacgtccgggaactgcagccacg

SEQ ID NO: 361836 - DNA, 25 bp, Mus musculus
tgccaaggccaaacagaggcgcttc

SEQ ID NO: 361837 - DNA, 25 bp, Mus musculus
tctgccgctcaggagcaagctgttg

SEQ ID NO: 361838 - DNA, 25 bp, Mus musculus
aacgggcagcctgacgtcgctccat

SEQ ID NO: 361839 - DNA, 25 bp, Mus musculus
ctcaagtccgagaagctgcgcgatc

SEQ ID NO: 361840 - DNA, 25 bp, Mus musculus
cgcttgcatatatttgcatgcgatt

SEQ ID NO: 361841 - DNA, 25 bp, Mus musculus
cagccctcgcccagaagagaggacg

SEQ ID NO: 361842 - DNA, 25 bp, Mus musculus
caaaacctcatttgggctccggccg

SEQ ID NO: 361843 - DNA, 25 bp, Mus musculus
ttatgaaaccgccatacatcagcgc

SEQ ID NO: 361844 - DNA, 25 bp, Mus musculus
ggctcctcttcaaaacctcatttgg

SEQ ID NO: 361845 - DNA, 25 bp, Mus musculus
cgcagcactagctcgcttgcatata

SEQ ID NO: 361846 - DNA, 25 bp, Mus musculus
tgccctccgcgtgaacccgccttta

SEQ ID NO: 361847 - DNA, 25 bp, Mus musculus
gccgctgattgatggcgctgccctc

SEQ ID NO: 361848 - DNA, 25 bp, Mus musculus
ccagcccattgaggccgctgattga

SEQ ID NO: 361849 - DNA, 25 bp, Mus musculus
ctcgcggaggatcccagcccattga

SEQ ID NO: 361850 - DNA, 25 bp, Mus musculus
gcacatcctcctgggtgcggccagg

SEQ ID NO: 361851 - DNA, 25 bp, Mus musculus
ttgcatgagatcaacttcacgttca

SEQ ID NO: 361852 - DNA, 25 bp, Mus musculus
atgcgatttgcatgagatcaacttc

SEQ ID NO: 361853 - DNA, 25 bp, Mus musculus
gcctttaataccgaggaagttatga

SEQ ID NO: 361854 - DNA, 25 bp, Mus musculus
gcggcgctagtttacgtctctctca

SEQ ID NO: 361855 - DNA, 25 bp, Mus musculus
ctctgcaggaatgtggccgggtccc

SEQ ID NO: 361856 - DNA, 25 bp, Mus musculus
actccgccagtgcaggagggcgcaa

SEQ ID NO: 361857 - DNA, 25 bp, Mus musculus
atctctgcgagcgtagggatctccc

SEQ ID NO: 361858 - DNA, 25 bp, Mus musculus
acagacatctctgcgagcgtaggga

SEQ ID NO: 361859 - DNA, 25 bp, Mus musculus
ggctcggggaaacagacatctctgc

SEQ ID NO: 361860 - DNA, 25 bp, Mus musculus
gtactgcggcgctagtttacgtctc

SEQ ID NO: 361861 - DNA, 25 bp, Mus musculus
cccagtctccgcacctcatggcctg

SEQ ID NO: 361862 - DNA, 25 bp, Mus musculus
tacgtctctctcattatcctgcggg

SEQ ID NO: 361863 - DNA, 25 bp, Mus musculus
tctcattatcctgcgggtctttgcc

SEQ ID NO: 361864 - DNA, 25 bp, Mus musculus
gtctttgcctccgagctcaccgcgc

SEQ ID NO: 361865 - DNA, 25 bp, Mus musculus
tcccgcctgcccatgtcactcaagg

SEQ ID NO: 361866 - DNA, 25 bp, Mus musculus
ccctgtctgtgacccggcccagtct

SEQ ID NO: 361867 - DNA, 25 bp, Mus musculus
acctcatggcctgcccttcgccctg

SEQ ID NO: 361868 - DNA, 25 bp, Mus musculus
cacacacccggtgtcaaccgcgggg

SEQ ID NO: 361869 - DNA, 25 bp, Mus musculus
cggatagcgtctatggggtccaccg

SEQ ID NO: 361870 - DNA, 25 bp, Mus musculus
gggacttaaactccctactgtgtgc

SEQ ID NO: 361871 - DNA, 25 bp, Mus musculus
ctccctactgtgtgcttccaaattg

SEQ ID NO: 361872 - DNA, 25 bp, Mus musculus
tactgtgtgcttccaaattgcgacc

SEQ ID NO: 361873 - DNA, 25 bp, Mus musculus
ttccaaattgcgaccacccagggcg

SEQ ID NO: 361874 - DNA, 25 bp, Mus musculus
attgcgaccacccagggcgacttgg

SEQ ID NO: 361875 - DNA, 25 bp, Mus musculus
cccagggcgacttgggcactggaaa

SEQ ID NO: 361876 - DNA, 25 bp, Mus musculus
cgaggcaggtcctgcagacagtctc

SEQ ID NO: 361877 - DNA, 25 bp, Mus musculus
ggcaggtcctgcagacagtctcgcc

SEQ ID NO: 361878 - DNA, 25 bp, Mus musculus
gccacgatgtgagcacctggtccga

SEQ ID NO: 361879 - DNA, 25 bp, Mus musculus
gatgtgagcacctggtccgacccgc

SEQ ID NO: 361880 - DNA, 25 bp, Mus musculus
acgtgccggagcagggcctcgctct

SEQ ID NO: 361881 - DNA, 25 bp, Mus musculus
ctatggggtccaccggcggcctgca

SEQ ID NO: 361882 - DNA, 25 bp, Mus musculus
cacgtctcggacaccgaagtcctgg

SEQ ID NO: 361883 - DNA, 25 bp, Mus musculus
cagcgactgacagaaagcgagcgcc

SEQ ID NO: 361884 - DNA, 25 bp, Mus musculus
ttcctcggcggtgtccatcttgtct

SEQ ID NO: 361885 - DNA, 25 bp, Mus musculus
gcctcgggcaccctatggtctccag

SEQ ID NO: 361886 - DNA, 25 bp, Mus musculus
cccagtgtcccagccgaggctgagt

SEQ ID NO: 361887 - DNA, 25 bp, Mus musculus
tgtcccagccgaggctgagtcctcg

SEQ ID NO: 361888 - DNA, 25 bp, Mus musculus
gctgagtcctcgtcgcccgcgggaa

SEQ ID NO: 361889 - DNA, 25 bp, Mus musculus
cgaaacacggcctgactggtggcga

SEQ ID NO: 361890 - DNA, 25 bp, Mus musculus
cttccgatccgagcccgctggagga

SEQ ID NO: 361891 - DNA, 25 bp, Mus musculus
agcccgctggaggaccagctcgagc

SEQ ID NO: 361892 - DNA, 25 bp, Mus musculus
ggcaagcaaactgcccgcgggatcc

SEQ ID NO: 361893 - DNA, 25 bp, Mus musculus
gatggagactgaaaacctagaggca

SEQ ID NO: 361894 - DNA, 25 bp, Mus musculus
aaacctagaggcaggcggcaggcac

SEQ ID NO: 361895 - DNA, 25 bp, Mus musculus
gcagagggtcaccttccgatccgag

SEQ ID NO: 361896 - DNA, 25 bp, Mus musculus
cggtcctttgacgagtgagtttgta

SEQ ID NO: 361897 - DNA, 25 bp, Mus musculus
agcggtccattcatttcgtacaata

SEQ ID NO: 361898 - DNA, 25 bp, Mus musculus
cgggtagacgagactctgccactta

SEQ ID NO: 361899 - DNA, 25 bp, Mus musculus
gcctgcacggttcctctgtggtaaa

SEQ ID NO: 361900 - DNA, 25 bp, Mus musculus
gcctgcgcaaccaatcctgggcttg

SEQ ID NO: 361901 - DNA, 25 bp, Mus musculus
atttcacgtgttccaggcagcaggc

SEQ ID NO: 361902 - DNA, 25 bp, Mus musculus
ctactttgtagcgtgcggtcctttg

SEQ ID NO: 361903 - DNA, 25 bp, Mus musculus
atcccttggggcatcagtgactcaa

SEQ ID NO: 361904 - DNA, 25 bp, Mus musculus
tgccgtttcttagcagggcgtcttc

SEQ ID NO: 361905 - DNA, 25 bp, Mus musculus
ggcgggcacgttcgttatcgtattc

SEQ ID NO: 361906 - DNA, 25 bp, Mus musculus
ttctgctctttgacgctgccgagga

SEQ ID NO: 361907 - DNA, 25 bp, Mus musculus
atcgctgaaggctctcgtaactcta

SEQ ID NO: 361908 - DNA, 25 bp, Mus musculus
tctaccgtcatgtctaagtccgagg

SEQ ID NO: 361909 - DNA, 25 bp, Mus musculus
cgccggcgtgaactcgccattttta

SEQ ID NO: 361910 - DNA, 25 bp, Mus musculus
cgatgcccgactggccgtagaccgg

SEQ ID NO: 361911 - DNA, 25 bp, Mus musculus
atcagcgggctaggcgacacgctgt

SEQ ID NO: 361912 - DNA, 25 bp, Mus musculus
ccggccaggccttacacagcggcca

SEQ ID NO: 361913 - DNA, 25 bp, Mus musculus
taggcgatgcccgactggccgtaga

SEQ ID NO: 361914 - DNA, 25 bp, Mus musculus
ggctaggcgacacgctgttgagctg

SEQ ID NO: 361915 - DNA, 25 bp, Mus musculus
agcatcagcgggctaggcgacacgc

SEQ ID NO: 361916 - DNA, 25 bp, Mus musculus
caggaaaggagacagctgcggcggc

SEQ ID NO: 361917 - DNA, 25 bp, Mus musculus
acctgctggccgtgcgggtgcagga

SEQ ID NO: 361918 - DNA, 25 bp, Mus musculus
tctccaggtagtagggcacctgctg

SEQ ID NO: 361919 - DNA, 25 bp, Mus musculus
ctcgttctccaggtagtagggcacc

SEQ ID NO: 361920 - DNA, 25 bp, Mus musculus
ggctcgttctccaggtagtagggca

SEQ ID NO: 361921 - DNA, 25 bp, Mus musculus
gatgtggcgcgggtacctgtagaag

SEQ ID NO: 361922 - DNA, 25 bp, Mus musculus
ttacacagcggccaccccgatgtgg

SEQ ID NO: 361923 - DNA, 25 bp, Mus musculus
aagcccccaggctgttggcactgaa

SEQ ID NO: 361924 - DNA, 25 bp, Mus musculus
aagggctgaccacacggaaaccaca

SEQ ID NO: 361925 - DNA, 25 bp, Mus musculus
ctgaccacacggaaaccacagaagg

SEQ ID NO: 361926 - DNA, 25 bp, Mus musculus
cacacggaaaccacagaagggacgg

SEQ ID NO: 361927 - DNA, 25 bp, Mus musculus
gcccccgcccgagttgtgcagtgga

SEQ ID NO: 361928 - DNA, 25 bp, Mus musculus
gcagccatgaggtctaggaactgga

SEQ ID NO: 361929 - DNA, 25 bp, Mus musculus
gccatgaggtctaggaactggaatg

SEQ ID NO: 361930 - DNA, 25 bp, Mus musculus
ttgctcacagttttgcggaaggcga

SEQ ID NO: 361931 - DNA, 25 bp, Mus musculus
tgctttttgctcacagttttgcgga

SEQ ID NO: 361932 - DNA, 25 bp, Mus musculus
aggcttctattgctttttgctcaca

SEQ ID NO: 361933 - DNA, 25 bp, Mus musculus
ggggcgaggcttctattgctttttg

SEQ ID NO: 361934 - DNA, 25 bp, Mus musculus
acggcaaatcctgcggaaagggacg

SEQ ID NO: 361935 - DNA, 25 bp, Mus musculus
ggctacagacggcaaatcctgcgga

SEQ ID NO: 361936 - DNA, 25 bp, Mus musculus
atggggaggctacagacggcaaatc

SEQ ID NO: 361937 - DNA, 25 bp, Mus musculus
ctggaagggctgaccacacggaaac

SEQ ID NO: 361938 - DNA, 25 bp, Mus musculus
tgggcagcatggtgatataaaggta

SEQ ID NO: 361939 - DNA, 25 bp, Mus musculus
tgctttcaggaaaggccttgttccg

SEQ ID NO: 361940 - DNA, 25 bp, Mus musculus
gaccagactctgctttcaggaaagg

SEQ ID NO: 361941 - DNA, 25 bp, Mus musculus
tagagaccgcgaccagactctgctt

SEQ ID NO: 361942 - DNA, 25 bp, Mus musculus
tctggcagaaaaagctagagaccgc

SEQ ID NO: 361943 - DNA, 25 bp, Mus musculus
ccagttgggctccagagatcggtga

SEQ ID NO: 361944 - DNA, 25 bp, Mus musculus
tatccaacaaggtggcagtagtcgg

SEQ ID NO: 361945 - DNA, 25 bp, Mus musculus
agaggctagcgtatccaacaaggtg

SEQ ID NO: 361946 - DNA, 25 bp, Mus musculus
ctgggaagcagaggctagcgtatcc

SEQ ID NO: 361947 - DNA, 25 bp, Mus musculus
agattttggggattccaaggacctg

SEQ ID NO: 361948 - DNA, 25 bp, Mus musculus
caagtctgagattttggggattcca

SEQ ID NO: 361949 - DNA, 25 bp, Mus musculus
tataaaggtaggtgtaggaccgatg

SEQ ID NO: 361950 - DNA, 25 bp, Mus musculus
ggtctgggcagcatggtgatataaa

SEQ ID NO: 361951 - DNA, 25 bp, Mus musculus
gaccgatggcaagtctgagattttg

SEQ ID NO: 361952 - DNA, 25 bp, Mus musculus
caagtcttggtctttccaaactccg

SEQ ID NO: 361953 - DNA, 25 bp, Mus musculus
agcgcgggcccccaattctagcttg

SEQ ID NO: 361954 - DNA, 25 bp, Mus musculus
actcaagtcctggtcgcttccagtc

SEQ ID NO: 361955 - DNA, 25 bp, Mus musculus
cccaactcaagtcttggtctttcca

SEQ ID NO: 361956 - DNA, 25 bp, Mus musculus
aaacctcccagaggcgaatgactca

SEQ ID NO: 361957 - DNA, 25 bp, Mus musculus
gcttcctaaacctcccagaggcgaa

SEQ ID NO: 361958 - DNA, 25 bp, Mus musculus
gccaccgacccggagccgcttccta

SEQ ID NO: 361959 - DNA, 25 bp, Mus musculus
atcgaggcgaccgtggcgtccagct

SEQ ID NO: 361960 - DNA, 25 bp, Mus musculus
cagcagcaccgcgtggagaggagat

SEQ ID NO: 361961 - DNA, 25 bp, Mus musculus
ccaacctggagtggtggcggccaca

SEQ ID NO: 361962 - DNA, 25 bp, Mus musculus
ggcctccgcgtctaggttgaagccc

SEQ ID NO: 361963 - DNA, 25 bp, Mus musculus
agtcctggtcgcttccagtcctcgg

SEQ ID NO: 361964 - DNA, 25 bp, Mus musculus
gagtttgccaaactcccggctgggc

SEQ ID NO: 361965 - DNA, 25 bp, Mus musculus
atctcacactccacgtcggccacgg

SEQ ID NO: 361966 - DNA, 25 bp, Mus musculus
caccatccacacgaagtcctgcggg

SEQ ID NO: 361967 - DNA, 25 bp, Mus musculus
agtggctacactgcgcggtagaccg

SEQ ID NO: 361968 - DNA, 25 bp, Mus musculus
tgggcgcttctgagtgtgtgcaccc

SEQ ID NO: 361969 - DNA, 25 bp, Mus musculus
gcgctcgcccttgggcgcttctgag

SEQ ID NO: 361970 - DNA, 25 bp, Mus musculus
agccactcgtactgggcgcctgtga

SEQ ID NO: 361971 - DNA, 25 bp, Mus musculus
cgcgcgctgtcaacacgcactaccc

SEQ ID NO: 361972 - DNA, 25 bp, Mus musculus
tctgaacacacccagagggaaccac

SEQ ID NO: 361973 - DNA, 25 bp, Mus musculus
gaaactctgaacacacccagaggga

SEQ ID NO: 361974 - DNA, 25 bp, Mus musculus
atgcgcgcattcacagaaactctga

SEQ ID NO: 361975 - DNA, 25 bp, Mus musculus
tcttgggaccacatgcgcgcattca

SEQ ID NO: 361976 - DNA, 25 bp, Mus musculus
agccacgcgtggaatcttgggacca

SEQ ID NO: 361977 - DNA, 25 bp, Mus musculus
cgggcaaccagccacgcgtggaatc

SEQ ID NO: 361978 - DNA, 25 bp, Mus musculus
aggatacgcgggcaaccagccacgc

SEQ ID NO: 361979 - DNA, 25 bp, Mus musculus
agggcacacgcagcagccactcgta

SEQ ID NO: 361980 - DNA, 25 bp, Mus musculus
aaactggatcttccgtgggctgttg

SEQ ID NO: 361981 - DNA, 25 bp, Mus musculus
gttggtcgctgtcctagaccacccg

SEQ ID NO: 361982 - DNA, 25 bp, Mus musculus
ggcaaggcagggattcaagtctcac

SEQ ID NO: 361983 - DNA, 25 bp, Mus musculus
gattcaagtctcacggccaggtccc

SEQ ID NO: 361984 - DNA, 25 bp, Mus musculus
cagcgggaccgtaaactggatcttc

SEQ ID NO: 361985 - DNA, 25 bp, Mus musculus
gctgttgtcgggctccatggctccc

SEQ ID NO: 361986 - DNA, 25 bp, Mus musculus
cgctccctctctgttgcgctccggc

SEQ ID NO: 361987 - DNA, 25 bp, Mus musculus
ctccgcttggggactgtgttgttgc

SEQ ID NO: 361988 - DNA, 25 bp, Mus musculus
gtgttgttgcggattggctcgtcac

SEQ ID NO: 361989 - DNA, 25 bp, Mus musculus
tgcggattggctcgtcaccgtccct

SEQ ID NO: 361990 - DNA, 25 bp, Mus musculus
aggtcgccgcccctcaagctaagga

SEQ ID NO: 361991 - DNA, 25 bp, Mus musculus
tcaagctaaggatccagaccccggt

SEQ ID NO: 361992 - DNA, 25 bp, Mus musculus
cccggttggtcgctgtcctagacca

SEQ ID NO: 361993 - DNA, 25 bp, Mus musculus
gaggctccagcagcgggaccgtaaa

SEQ ID NO: 361994 - DNA, 25 bp, Mus musculus
cgggaagagagacacaccgcacctc

SEQ ID NO: 361995 - DNA, 25 bp, Mus musculus
gttggtagattccacttccggtctc

SEQ ID NO: 361996 - DNA, 25 bp, Mus musculus
cagatgttacagatgcaccggcgca

SEQ ID NO: 361997 - DNA, 25 bp, Mus musculus
ccggcaccggagattctcgagcttt

SEQ ID NO: 361998 - DNA, 25 bp, Mus musculus
cccatgagacgggacttgcgatctt

SEQ ID NO: 361999 - DNA, 25 bp, Mus musculus
gaaggcgacgtctagcacacaaatg

SEQ ID NO: 362000 - DNA, 25 bp, Mus musculus
cgccatggtggacgaactagaacga

SEQ ID NO: 362001 - DNA, 25 bp, Mus musculus
ctctcgcgagaggacgcagaatccc

SEQ ID NO: 362002 - DNA, 25 bp, Mus musculus
cccgcgacttacttttcaacagtga

SEQ ID NO: 362003 - DNA, 25 bp, Mus musculus
tcttttctttgattgccgcccgggc

SEQ ID NO: 362004 - DNA, 25 bp, Mus musculus
ttgcagcggggagcttatttcctta

SEQ ID NO: 362005 - DNA, 25 bp, Mus musculus
gcccgggctctaagacgttggtaga

SEQ ID NO: 362006 - DNA, 25 bp, Mus musculus
ccgcttctaagggacaagcgactta

SEQ ID NO: 362007 - DNA, 25 bp, Mus musculus
aaaggggcgcccatactcatcgaag

SEQ ID NO: 362008 - DNA, 25 bp, Mus musculus
cgtacatgtaagagaaggcggcgta

SEQ ID NO: 362009 - DNA, 25 bp, Mus musculus
ccacgtagtggctgtagaagtaggc

SEQ ID NO: 362010 - DNA, 25 bp, Mus musculus
gccgcttgtccacgtagtggctgta

SEQ ID NO: 362011 - DNA, 25 bp, Mus musculus
cacgttagatgcatagatggcgaag

SEQ ID NO: 362012 - DNA, 25 bp, Mus musculus
cgcgcagaacagcacgttagatgca

SEQ ID NO: 362013 - DNA, 25 bp, Mus musculus
tcggatctgcccaggcccatgttgg

SEQ ID NO: 362014 - DNA, 25 bp, Mus musculus
gggtactgccgctcggatctgccca

SEQ ID NO: 362015 - DNA, 25 bp, Mus musculus
ccgttacgttggtggtccagtcgat

SEQ ID NO: 362016 - DNA, 25 bp, Mus musculus
ctgaagccggcgtacatgtaagaga

SEQ ID NO: 362017 - DNA, 25 bp, Mus musculus
acaccagcacgttgcagagcacggt

SEQ ID NO: 362018 - DNA, 25 bp, Mus musculus
gcccaacgaggtgcggcgcatgaac

SEQ ID NO: 362019 - DNA, 25 bp, Mus musculus
catggtgctgctccgtgcccaacga

SEQ ID NO: 362020 - DNA, 25 bp, Mus musculus
gccggaaactcctgcggcggcgaaa

SEQ ID NO: 362021 - DNA, 25 bp, Mus musculus
tccagtcgatgaagcaccaggtgcc

SEQ ID NO: 362022 - DNA, 25 bp, Mus musculus
gtttgtgtcttagcctttccctgga

SEQ ID NO: 362023 - DNA, 25 bp, Mus musculus
ggctgcctcgacttccctcgtagta

SEQ ID NO: 362024 - DNA, 25 bp, Mus musculus
tcgtagtacactgaagaggaccctt

SEQ ID NO: 362025 - DNA, 25 bp, Mus musculus
cccgcagagtccctgagtgtcatag

SEQ ID NO: 362026 - DNA, 25 bp, Mus musculus
agctgagaccctgcacgtgtgaact

SEQ ID NO: 362027 - DNA, 25 bp, Mus musculus
tccatttgcgggtggtgtaagtctc

SEQ ID NO: 362028 - DNA, 25 bp, Mus musculus
cgcacgcatttcatacccgggttca

SEQ ID NO: 362029 - DNA, 25 bp, Mus musculus
tttccctggatacgagcgtggattg

SEQ ID NO: 362030 - DNA, 25 bp, Mus musculus
agcacctttcaggtacccgtggaga

SEQ ID NO: 362031 - DNA, 25 bp, Mus musculus
ccgtggagatctgtgtgcgtaatcc

SEQ ID NO: 362032 - DNA, 25 bp, Mus musculus
cttcagcaggatgagctccaatcgc

SEQ ID NO: 362033 - DNA, 25 bp, Mus musculus
ggttcccacgcgcagctactaagca

SEQ ID NO: 362034 - DNA, 25 bp, Mus musculus
aggcgcgtgcaggactaccatcaaa

SEQ ID NO: 362035 - DNA, 25 bp, Mus musculus
aagtctctggtagggtcactctgca

SEQ ID NO: 362036 - DNA, 25 bp, Mus musculus
gcacaacgcagagtaggacaagacc

SEQ ID NO: 362037 - DNA, 25 bp, Mus musculus
tcgcgcatccctgccgccgttcgcc

SEQ ID NO: 362038 - DNA, 25 bp, Mus musculus
gtgaaagcacaacgcagagtaggac

SEQ ID NO: 362039 - DNA, 25 bp, Mus musculus
gaaagcacaacgcagagtaggacaa

SEQ ID NO: 362040 - DNA, 25 bp, Mus musculus
aagcacaacgcagagtaggacaaga

SEQ ID NO: 362041 - DNA, 25 bp, Mus musculus
cacaacgcagagtaggacaagacca

SEQ ID NO: 362042 - DNA, 25 bp, Mus musculus
caacgcagagtaggacaagaccaag

SEQ ID NO: 362043 - DNA, 25 bp, Mus musculus
aacgcagagtaggacaagaccaaga

SEQ ID NO: 362044 - DNA, 25 bp, Mus musculus
acgcagagtaggacaagaccaagaa

SEQ ID NO: 362045 - DNA, 25 bp, Mus musculus
cgcagagtaggacaagaccaagaaa

SEQ ID NO: 362046 - DNA, 25 bp, Mus musculus
cagagtaggacaagaccaagaaaac

SEQ ID NO: 362047 - DNA, 25 bp, Mus musculus
agagtaggacaagaccaagaaaaca

SEQ ID NO: 362048 - DNA, 25 bp, Mus musculus
gcagatcgcgcatccctgccgccgt

SEQ ID NO: 362049 - DNA, 25 bp, Mus musculus
acaacgcagagtaggacaagaccaa

SEQ ID NO: 362050 - DNA, 25 bp, Mus musculus
ggcatcctaaacttgagcggcagct

SEQ ID NO: 362051 - DNA, 25 bp, Mus musculus
agacaccggagtccgccgagtgaaa

SEQ ID NO: 362052 - DNA, 25 bp, Mus musculus
ccggagtccgccgagtgaaagcaca

SEQ ID NO: 362053 - DNA, 25 bp, Mus musculus
agtccgccgagtgaaagcacaacgc

SEQ ID NO: 362054 - DNA, 25 bp, Mus musculus
aagccaacaagtgagaaggcgccgc

SEQ ID NO: 362055 - DNA, 25 bp, Mus musculus
aacaagtgagaaggcgccgcgtttc

SEQ ID NO: 362056 - DNA, 25 bp, Mus musculus
acagcattgcgacccagacaccgga

SEQ ID NO: 362057 - DNA, 25 bp, Mus musculus
atcagacagcattgcgacccagaca

SEQ ID NO: 362058 - DNA, 25 bp, Mus musculus
cttcaaatcagacagcattgcgacc

SEQ ID NO: 362059 - DNA, 25 bp, Mus musculus
gcttgcttcaaatcagacagcattg

SEQ ID NO: 362060 - DNA, 25 bp, Mus musculus
tcgactgcttgcttcaaatcagaca

SEQ ID NO: 362061 - DNA, 25 bp, Mus musculus
cttgagcggcagctcggtttcaacc

SEQ ID NO: 362062 - DNA, 25 bp, Mus musculus
ccagacaccggagtccgccgagtga

SEQ ID NO: 362063 - DNA, 25 bp, Mus musculus
tcctaaacttgagcggcagctcggt

SEQ ID NO: 362064 - DNA, 25 bp, Mus musculus
cgctgccctgtaggaccagaccaag

SEQ ID NO: 362065 - DNA, 25 bp, Mus musculus
cagggagaacgctagagcaggcgcc

SEQ ID NO: 362066 - DNA, 25 bp, Mus musculus
gcgcagggagaacgctagagcaggc

SEQ ID NO: 362067 - DNA, 25 bp, Mus musculus
ccggggcgcagggagaacgctagag

SEQ ID NO: 362068 - DNA, 25 bp, Mus musculus
ctgccctgtaggaccagaccaagaa

SEQ ID NO: 362069 - DNA, 25 bp, Mus musculus
gctgccctgtaggaccagaccaaga

SEQ ID NO: 362070 - DNA, 25 bp, Mus musculus
aacgctgccctgtaggaccagacca

SEQ ID NO: 362071 - DNA, 25 bp, Mus musculus
acaacgctgccctgtaggaccagac

SEQ ID NO: 362072 - DNA, 25 bp, Mus musculus
cacaacgctgccctgtaggaccaga

SEQ ID NO: 362073 - DNA, 25 bp, Mus musculus
aagcacaacgctgccctgtaggacc

SEQ ID NO: 362074 - DNA, 25 bp, Mus musculus
aaagcacaacgctgccctgtaggac

SEQ ID NO: 362075 - DNA, 25 bp, Mus musculus
acgctgccctgtaggaccagaccaa

SEQ ID NO: 362076 - DNA, 25 bp, Mus musculus
gaaagcacaacgctgccctgtagga

SEQ ID NO: 362077 - DNA, 25 bp, Mus musculus
gtgaaagcacaacgctgccctgtag

SEQ ID NO: 362078 - DNA, 25 bp, Mus musculus
ctgcaaacatcgattggggctgccc

SEQ ID NO: 362079 - DNA, 25 bp, Mus musculus
ggaccacaagcgcttcgtccctttg

SEQ ID NO: 362080 - DNA, 25 bp, Mus musculus
cctccgcagtgcagagagcaatgtc

SEQ ID NO: 362081 - DNA, 25 bp, Mus musculus
gagagcaatgtcatgacaccacttc

SEQ ID NO: 362082 - DNA, 25 bp, Mus musculus
ccaaccaagctgacgccaaatgcaa

SEQ ID NO: 362083 - DNA, 25 bp, Mus musculus
gttgcaccgctgcaaacatcgattg

SEQ ID NO: 362084 - DNA, 25 bp, Mus musculus
ccggccggcaaaacgtcacgtgagc

SEQ ID NO: 362085 - DNA, 25 bp, Mus musculus
tacaaagggcgcgtgtccaaggccc

SEQ ID NO: 362086 - DNA, 25 bp, Mus musculus
cttcccagacgtcgggtccagcttt

SEQ ID NO: 362087 - DNA, 25 bp, Mus musculus
caggactagctcacctctccgattg

SEQ ID NO: 362088 - DNA, 25 bp, Mus musculus
tctccgattgcttccttcttcacgg

SEQ ID NO: 362089 - DNA, 25 bp, Mus musculus
ttcttcacggaagagctgctgctgc

SEQ ID NO: 362090 - DNA, 25 bp, Mus musculus
gggtctgaaccctgtactcggcttc

SEQ ID NO: 362091 - DNA, 25 bp, Mus musculus
cgccaaatgcaaaacccacacgttg

SEQ ID NO: 362092 - DNA, 25 bp, Mus musculus
tcccacggttcccacgaagctggtg

SEQ ID NO: 362093 - DNA, 25 bp, Mus musculus
aggacccactgcacccagtgattgg

SEQ ID NO: 362094 - DNA, 25 bp, Mus musculus
acgaagctggcctctccatggcaac

SEQ ID NO: 362095 - DNA, 25 bp, Mus musculus
taccagcccagggtctctacgaagc

SEQ ID NO: 362096 - DNA, 25 bp, Mus musculus
acaaggtttcaaagccgctaccagc

SEQ ID NO: 362097 - DNA, 25 bp, Mus musculus
tcatggtgccagagaacaaggtttc

SEQ ID NO: 362098 - DNA, 25 bp, Mus musculus
ttcgtcgtgccaggcgtcttccgca

SEQ ID NO: 362099 - DNA, 25 bp, Mus musculus
ggccctctccaggtccggatcaggg

SEQ ID NO: 362100 - DNA, 25 bp, Mus musculus
tttccaatgcgggagccgcgtcgca

SEQ ID NO: 362101 - DNA, 25 bp, Mus musculus
cggggactcgccgatttccaatgcg

SEQ ID NO: 362102 - DNA, 25 bp, Mus musculus
gctccgagtatctggggccttcctc

SEQ ID NO: 362103 - DNA, 25 bp, Mus musculus
tcccactaactgtggcctgaggtcc

SEQ ID NO: 362104 - DNA, 25 bp, Mus musculus
catcttcggcttcccactaactgtg

SEQ ID NO: 362105 - DNA, 25 bp, Mus musculus
tctgtggtggcttttcgtcgtgcca

SEQ ID NO: 362106 - DNA, 25 bp, Mus musculus
gtcatcccgcgagtctctctgacgg

SEQ ID NO: 362107 - DNA, 25 bp, Mus musculus
gcctaggttttctgcgcacggagtt

SEQ ID NO: 362108 - DNA, 25 bp, Mus musculus
tagggagaaaaagccggtccactgc

SEQ ID NO: 362109 - DNA, 25 bp, Mus musculus
gagactgggaacctttggctctccc

SEQ ID NO: 362110 - DNA, 25 bp, Mus musculus
agatttctagctcccgcttcgcaag

SEQ ID NO: 362111 - DNA, 25 bp, Mus musculus
ggagttccaccgtcagatttctagc

SEQ ID NO: 362112 - DNA, 25 bp, Mus musculus
tgaatccctctcagcatccagaaag

SEQ ID NO: 362113 - DNA, 25 bp, Mus musculus
tcatactccgatgggtttggccgcc

SEQ ID NO: 362114 - DNA, 25 bp, Mus musculus
agagcggaaagcctgctcatactcc

SEQ ID NO: 362115 - DNA, 25 bp, Mus musculus
ccaccactgcaggaaagagagcgga

SEQ ID NO: 362116 - DNA, 25 bp, Mus musculus
gtgaattacacgtgctcgctgcctc

SEQ ID NO: 362117 - DNA, 25 bp, Mus musculus
gctccctctggaagcatccaactgg

SEQ ID NO: 362118 - DNA, 25 bp, Mus musculus
gaaagcccgagcctgaaggagttcc

SEQ ID NO: 362119 - DNA, 25 bp, Mus musculus
tgctcttccttctaggttacggctg

SEQ ID NO: 362120 - DNA, 25 bp, Mus musculus
agcgagcgacgctctcacaaacttc

SEQ ID NO: 362121 - DNA, 25 bp, Mus musculus
agcggacccaagacgaagcgagcga

SEQ ID NO: 362122 - DNA, 25 bp, Mus musculus
cctctcgagaggattttcctgcgta

SEQ ID NO: 362123 - DNA, 25 bp, Mus musculus
tgggaaattcttgttcctctcgaga

SEQ ID NO: 362124 - DNA, 25 bp, Mus musculus
ttcgcgtccgagcagaaacggttgg

SEQ ID NO: 362125 - DNA, 25 bp, Mus musculus
gcgatcatccgcctaaagttgtatt

SEQ ID NO: 362126 - DNA, 25 bp, Mus musculus
cgcgccactaagtcgcttctaggtc

SEQ ID NO: 362127 - DNA, 25 bp, Mus musculus
agctgctgtttgtgctgccatgtcc

SEQ ID NO: 362128 - DNA, 25 bp, Mus musculus
ggactcggttctactcccacagctg

SEQ ID NO: 362129 - DNA, 25 bp, Mus musculus
tcacaaacttccacgagcgccggag

SEQ ID NO: 362130 - DNA, 25 bp, Mus musculus
agccggtggtgacatcacgagcccg

SEQ ID NO: 362131 - DNA, 25 bp, Mus musculus
ggtcttcgagcccagtgtcccgtcg

SEQ ID NO: 362132 - DNA, 25 bp, Mus musculus
tctcggtacagtgcagagccaaggg

SEQ ID NO: 362133 - DNA, 25 bp, Mus musculus
gctatgaagatggtcgctccctgga

SEQ ID NO: 362134 - DNA, 25 bp, Mus musculus
cacatggggcggcagtagtacccga

SEQ ID NO: 362135 - DNA, 25 bp, Mus musculus
tccaacccttgtacggcaccgcctc

SEQ ID NO: 362136 - DNA, 25 bp, Mus musculus
agagcgcactgggatgggacttgaa

SEQ ID NO: 362137 - DNA, 25 bp, Mus musculus
ttgaaggcggcttctcaggacacgg

SEQ ID NO: 362138 - DNA, 25 bp, Mus musculus
aggcggcttctcaggacacggcgct

SEQ ID NO: 362139 - DNA, 25 bp, Mus musculus
tggcgcgggattcttgttcgcgtcc

SEQ ID NO: 362140 - DNA, 25 bp, Mus musculus
gacgcaaaatctgtccctctcctgg

SEQ ID NO: 362141 - DNA, 25 bp, Mus musculus
acccgggagcagatgacccactgac

SEQ ID NO: 362142 - DNA, 25 bp, Mus musculus
agcagatgacccactgaccgacaga

SEQ ID NO: 362143 - DNA, 25 bp, Mus musculus
tcgcgccgccctttcagggagcctc

SEQ ID NO: 362144 - DNA, 25 bp, Mus musculus
tcggccgggagaagtcccgccacgc

SEQ ID NO: 362145 - DNA, 25 bp, Mus musculus
cactgaccgacagacgcaaaatctg

SEQ ID NO: 362146 - DNA, 25 bp, Mus musculus
cggaccacggagactgacactcaca

SEQ ID NO: 362147 - DNA, 25 bp, Mus musculus
cagccagcaagcgcggagagcgcac

SEQ ID NO: 362148 - DNA, 25 bp, Mus musculus
tccgggtcacaagcagaacagcgct

SEQ ID NO: 362149 - DNA, 25 bp, Mus musculus
tgcaaagctcttctaggccgacaga

SEQ ID NO: 362150 - DNA, 25 bp, Mus musculus
agtagtctgcggtagttggttgcta

SEQ ID NO: 362151 - DNA, 25 bp, Mus musculus
aacagcgcttgcgagagtagtctgc

SEQ ID NO: 362152 - DNA, 25 bp, Mus musculus
tccagagcgtcaaacaccagctagc

SEQ ID NO: 362153 - DNA, 25 bp, Mus musculus
agcgacaagtcgtccacccagtgtg

SEQ ID NO: 362154 - DNA, 25 bp, Mus musculus
acccagtgtgctcaaatctatccgc

SEQ ID NO: 362155 - DNA, 25 bp, Mus musculus
tcggcttcactcaccgtcttctttg

SEQ ID NO: 362156 - DNA, 25 bp, Mus musculus
ttcctgccttaggtgcgggacaacc

SEQ ID NO: 362157 - DNA, 25 bp, Mus musculus
tgatcttcctgtttgccgctccgta

SEQ ID NO: 362158 - DNA, 25 bp, Mus musculus
cccgtgactgctcaccaggagcgga

SEQ ID NO: 362159 - DNA, 25 bp, Mus musculus
gtctccgcctgacgttgtcttgggc

SEQ ID NO: 362160 - DNA, 25 bp, Mus musculus
tttgttctgctgcagcgggctgaca

SEQ ID NO: 362161 - DNA, 25 bp, Mus musculus
ggaaggagctcccacaatgcaaagc

SEQ ID NO: 362162 - DNA, 25 bp, Mus musculus
cgcttttcacttggggaggtccatg

SEQ ID NO: 362163 - DNA, 25 bp, Mus musculus
tcgcacggcccgatgggaattgtag

SEQ ID NO: 362164 - DNA, 25 bp, Mus musculus
ttacaagcgactccgggacacgtgg

SEQ ID NO: 362165 - DNA, 25 bp, Mus musculus
tcaccctctgtggtgggagcttcta

SEQ ID NO: 362166 - DNA, 25 bp, Mus musculus
tgggagcttctagggatctcagaac

SEQ ID NO: 362167 - DNA, 25 bp, Mus musculus
tagggatctcagaaccttgtcattc

SEQ ID NO: 362168 - DNA, 25 bp, Mus musculus
ttgtcattcttaccggcgaagccct

SEQ ID NO: 362169 - DNA, 25 bp, Mus musculus
cgaagccctcggaacttttggcagg

SEQ ID NO: 362170 - DNA, 25 bp, Mus musculus
cctcggaacttttggcaggttggtg

SEQ ID NO: 362171 - DNA, 25 bp, Mus musculus
tggtggtgaggcactaatgcttagc

SEQ ID NO: 362172 - DNA, 25 bp, Mus musculus
cactaatgcttagccggggccgcca

SEQ ID NO: 362173 - DNA, 25 bp, Mus musculus
cggcttcggcttgcggcgcttttca

SEQ ID NO: 362174 - DNA, 25 bp, Mus musculus
cttgcccacagtggcggcttcggct

SEQ ID NO: 362175 - DNA, 25 bp, Mus musculus
ttgtagtttacaagcgactccggga

SEQ ID NO: 362176 - DNA, 25 bp, Mus musculus
gcccagtatgtgaagttccgagaca

SEQ ID NO: 362177 - DNA, 25 bp, Mus musculus
agccaagtgtcagcgtcacgtgtca

SEQ ID NO: 362178 - DNA, 25 bp, Mus musculus
gtcagcgtcacgtgtcagctctacc

SEQ ID NO: 362179 - DNA, 25 bp, Mus musculus
gcggccttacctggtttctgcgata

SEQ ID NO: 362180 - DNA, 25 bp, Mus musculus
tttctgcgataccaggcgctcgaca

SEQ ID NO: 362181 - DNA, 25 bp, Mus musculus
caggcgctcgacagcgagccgttgc

SEQ ID NO: 362182 - DNA, 25 bp, Mus musculus
cctggtgcccagtatgtgaagttcc

SEQ ID NO: 362183 - DNA, 25 bp, Mus musculus
aagttccgagacagctcgtctagga

SEQ ID NO: 362184 - DNA, 25 bp, Mus musculus
cggagccgccatgaggactgaatcc

SEQ ID NO: 362185 - DNA, 25 bp, Mus musculus
ggactgaatccacgcgctgggactc

SEQ ID NO: 362186 - DNA, 25 bp, Mus musculus
aatccacgcgctgggactcgggcgc

SEQ ID NO: 362187 - DNA, 25 bp, Mus musculus
cgcagccacttcctgcccggcgacc

SEQ ID NO: 362188 - DNA, 25 bp, Mus musculus
atgggtagccaagtgtcagcgtcac

SEQ ID NO: 362189 - DNA, 25 bp, Mus musculus
tctaggacggccgaggcgtcgtcct

SEQ ID NO: 362190 - DNA, 25 bp, Mus musculus
ggctctgacctgaggccgttcatct

SEQ ID NO: 362191 - DNA, 25 bp, Mus musculus
gacctgaggccgttcatcttcctct

SEQ ID NO: 362192 - DNA, 25 bp, Mus musculus
tttcgagcttcgctctcggcgtctc

SEQ ID NO: 362193 - DNA, 25 bp, Mus musculus
tcggcgtctccagcctctgaacaaa

SEQ ID NO: 362194 - DNA, 25 bp, Mus musculus
ccgggcttccattggctgatctgga

SEQ ID NO: 362195 - DNA, 25 bp, Mus musculus
agcagcgggctgaacggacagctac

SEQ ID NO: 362196 - DNA, 25 bp, Mus musculus
acagctaccggagaaggcggctgcc

SEQ ID NO: 362197 - DNA, 25 bp, Mus musculus
ccaggaaacgccagctcgagcttcg

SEQ ID NO: 362198 - DNA, 25 bp, Mus musculus
tcagcgtccaggtgtgtcgccgcca

SEQ ID NO: 362199 - DNA, 25 bp, Mus musculus
ccgccacgcgtgcaggtggaacaga

SEQ ID NO: 362200 - DNA, 25 bp, Mus musculus
aacagagcgtaggtccgggctccct

SEQ ID NO: 362201 - DNA, 25 bp, Mus musculus
tccactgggcctggggctctgacct

SEQ ID NO: 362202 - DNA, 25 bp, Mus musculus
cgctgaggccgctccttgggctctg

SEQ ID NO: 362203 - DNA, 25 bp, Mus musculus
ggcggggcgagacctcctctagcac

SEQ ID NO: 362204 - DNA, 25 bp, Mus musculus
ggctcaaggccctctgcaaggcgca

SEQ ID NO: 362205 - DNA, 25 bp, Mus musculus
agccacctgtgagcctctcgcggat

SEQ ID NO: 362206 - DNA, 25 bp, Mus musculus
ttttagaacgcgcaaggcgagctcc

SEQ ID NO: 362207 - DNA, 25 bp, Mus musculus
cccaggtaagcgcttttagaacgcg

SEQ ID NO: 362208 - DNA, 25 bp, Mus musculus
tcccgtgcacccaggtaagcgcttt

SEQ ID NO: 362209 - DNA, 25 bp, Mus musculus
ttgccagcaggtcggggaagtttcc

SEQ ID NO: 362210 - DNA, 25 bp, Mus musculus
cgtccaccgcggtgatgcttgccag

SEQ ID NO: 362211 - DNA, 25 bp, Mus musculus
caccaccgcgcagcaccaggctcaa

SEQ ID NO: 362212 - DNA, 25 bp, Mus musculus
cgcgctcggagctgtccgttcagca

SEQ ID NO: 362213 - DNA, 25 bp, Mus musculus
cgtctcaagagtctgggcggcgact

SEQ ID NO: 362214 - DNA, 25 bp, Mus musculus
tgctccggaacgtctcaagagtctg

SEQ ID NO: 362215 - DNA, 25 bp, Mus musculus
acagaatgatgctccggaacgtctc

SEQ ID NO: 362216 - DNA, 25 bp, Mus musculus
gggcgcccgaagaacagaatgatgc

SEQ ID NO: 362217 - DNA, 25 bp, Mus musculus
acacagacaagcactcacatctaca

SEQ ID NO: 362218 - DNA, 25 bp, Mus musculus
cgggccctagctcagccagggatag

SEQ ID NO: 362219 - DNA, 25 bp, Mus musculus
gccactcaatttgcggcgcaccagg

SEQ ID NO: 362220 - DNA, 25 bp, Mus musculus
aatttgcggcgcaccaggccctcaa

SEQ ID NO: 362221 - DNA, 25 bp, Mus musculus
caggccctcaagacgtcggcacgga

SEQ ID NO: 362222 - DNA, 25 bp, Mus musculus
acgtcggcacggagactcggcgtcc

SEQ ID NO: 362223 - DNA, 25 bp, Mus musculus
cgtcgttacctcttggacgccggcg

SEQ ID NO: 362224 - DNA, 25 bp, Mus musculus
cagccggccgaacgcaagggatcac

SEQ ID NO: 362225 - DNA, 25 bp, Mus musculus
cgcaagggatcacaccgggaaactc

SEQ ID NO: 362226 - DNA, 25 bp, Mus musculus
gaacctagcgcggtccagaagagtg

SEQ ID NO: 362227 - DNA, 25 bp, Mus musculus
ccagcgagggccactcaatttgcgg

SEQ ID NO: 362228 - DNA, 25 bp, Mus musculus
ctagctcagccagggatagtgaaca

SEQ ID NO: 362229 - DNA, 25 bp, Mus musculus
ccagggatagtgaacaggatgcgcc

SEQ ID NO: 362230 - DNA, 25 bp, Mus musculus
tagtgaacaggatgcgccctggaag

SEQ ID NO: 362231 - DNA, 25 bp, Mus musculus
ctttcacgtaactccgcggcggatc

SEQ ID NO: 362232 - DNA, 25 bp, Mus musculus
accgtgggacatggccactccgggc

SEQ ID NO: 362233 - DNA, 25 bp, Mus musculus
tgagacgcggcgacggtccaaccaa

SEQ ID NO: 362234 - DNA, 25 bp, Mus musculus
cgccctcatgctaatgaacccaagg

SEQ ID NO: 362235 - DNA, 25 bp, Mus musculus
gaacccaaggatagcgctctaattg

SEQ ID NO: 362236 - DNA, 25 bp, Mus musculus
tagcgctctaattggctgaggcctc

SEQ ID NO: 362237 - DNA, 25 bp, Mus musculus
acagggcttatccagggtcgggaca

SEQ ID NO: 362238 - DNA, 25 bp, Mus musculus
cactccgggcgggatctggaacaga

SEQ ID NO: 362239 - DNA, 25 bp, Mus musculus
tctggaacagaagccggcaaaggtc

SEQ ID NO: 362240 - DNA, 25 bp, Mus musculus
cctccatgagaggtggggtcatgca

SEQ ID NO: 362241 - DNA, 25 bp, Mus musculus
tcatgcagattagtctcggcgcgcc

SEQ ID NO: 362242 - DNA, 25 bp, Mus musculus
gtgcgtcaagttcggctgcgctccg

SEQ ID NO: 362243 - DNA, 25 bp, Mus musculus
cgctcgggaccaatcggaggcgact

SEQ ID NO: 362244 - DNA, 25 bp, Mus musculus
gtcctgcctgccacctcgatgggaa

SEQ ID NO: 362245 - DNA, 25 bp, Mus musculus
ctttgttgcgagatcgagtcccgga

SEQ ID NO: 362246 - DNA, 25 bp, Mus musculus
tctacctggtgagccggctctctca

SEQ ID NO: 362247 - DNA, 25 bp, Mus musculus
acgaggcttattgcaggtctgtcta

SEQ ID NO: 362248 - DNA, 25 bp, Mus musculus
cagcggcctagagaagctgcggttc

SEQ ID NO: 362249 - DNA, 25 bp, Mus musculus
ggctagagttcttcccaggctgaga

SEQ ID NO: 362250 - DNA, 25 bp, Mus musculus
ggctctctcaaagcgtgcggacttg

SEQ ID NO: 362251 - DNA, 25 bp, Mus musculus
ggccagttttctgcaacgaggctta

SEQ ID NO: 362252 - DNA, 25 bp, Mus musculus
acgccaggacaccacggctcgtttg

SEQ ID NO: 362253 - DNA, 25 bp, Mus musculus
cagactcggcttctgcacgccagga

SEQ ID NO: 362254 - DNA, 25 bp, Mus musculus
tggcagctgaaacccgacagggagc

SEQ ID NO: 362255 - DNA, 25 bp, Mus musculus
gactgaagctgacccgatccacgga

SEQ ID NO: 362256 - DNA, 25 bp, Mus musculus
tcgaaagcccagagccgtgaggact

SEQ ID NO: 362257 - DNA, 25 bp, Mus musculus
tcagcgtgtccctgttgtcgaaagc

SEQ ID NO: 362258 - DNA, 25 bp, Mus musculus
ttcagcccgctccaggtcagcgtgt

SEQ ID NO: 362259 - DNA, 25 bp, Mus musculus
accgcgctgctacctgcaaagattc

SEQ ID NO: 362260 - DNA, 25 bp, Mus musculus
ccgatcatcgtactttgtggccaga

SEQ ID NO: 362261 - DNA, 25 bp, Mus musculus
tgacctttccaagctgtgcgtcctg

SEQ ID NO: 362262 - DNA, 25 bp, Mus musculus
cgctactaaagccttggactccggg

SEQ ID NO: 362263 - DNA, 25 bp, Mus musculus
cagtccgcggtcagaaactggccca

SEQ ID NO: 362264 - DNA, 25 bp, Mus musculus
ctgggcgagctctgagcactcatcc

SEQ ID NO: 362265 - DNA, 25 bp, Mus musculus
cacggactgccgaagaccaattacc

SEQ ID NO: 362266 - DNA, 25 bp, Mus musculus
agttctcccagtttggacctcatga

SEQ ID NO: 362267 - DNA, 25 bp, Mus musculus
tccggacctagtctgaaccgcgctg

SEQ ID NO: 362268 - DNA, 25 bp, Mus musculus
gctgcccaggcagacatcggttctg

SEQ ID NO: 362269 - DNA, 25 bp, Mus musculus
cagggccaggctgtagccttccaaa

SEQ ID NO: 362270 - DNA, 25 bp, Mus musculus
tctcagtctggagcgctacaagttc

SEQ ID NO: 362271 - DNA, 25 bp, Mus musculus
cacggtgcaatcaagccagcgactc

SEQ ID NO: 362272 - DNA, 25 bp, Mus musculus
ttgtacttttgtgcgctgtccctta

SEQ ID NO: 362273 - DNA, 25 bp, Mus musculus
gactcccagctaatacactcagttg

SEQ ID NO: 362274 - DNA, 25 bp, Mus musculus
aaggcgtctgcgcttccgaccggca

SEQ ID NO: 362275 - DNA, 25 bp, Mus musculus
aggcccggtgagacgtgacagccca

SEQ ID NO: 362276 - DNA, 25 bp, Mus musculus
cgttgcagggacgaattcgcagccg

SEQ ID NO: 362277 - DNA, 25 bp, Mus musculus
gacgaattcgcagccgggatgcgaa

SEQ ID NO: 362278 - DNA, 25 bp, Mus musculus
cttccgaccggcaggaggcgttgca

SEQ ID NO: 362279 - DNA, 25 bp, Mus musculus
gcccttaaggcgtctgcgcttccga

SEQ ID NO: 362280 - DNA, 25 bp, Mus musculus
agaggcccttaaggcgtctgcgctt

SEQ ID NO: 362281 - DNA, 25 bp, Mus musculus
ctcctagacggcgagaggcccttaa

SEQ ID NO: 362282 - DNA, 25 bp, Mus musculus
gcgctacggagacggctcgcctgtc

SEQ ID NO: 362283 - DNA, 25 bp, Mus musculus
tgcggcctacgctcccacgcgtgct

SEQ ID NO: 362284 - DNA, 25 bp, Mus musculus
tttcctagagctgcagtgctgcggc

SEQ ID NO: 362285 - DNA, 25 bp, Mus musculus
tctccctttcctagagctgcagtgc

SEQ ID NO: 362286 - DNA, 25 bp, Mus musculus
acgtgacagcccacgcatatgggtg

SEQ ID NO: 362287 - DNA, 25 bp, Mus musculus
gcccacgcatatgggtgacccaggg

SEQ ID NO: 362288 - DNA, 25 bp, Mus musculus
aagcaggacgtgctgtcctcccacg

SEQ ID NO: 362289 - DNA, 25 bp, Mus musculus
cgactactaagcctcttgggcagta

SEQ ID NO: 362290 - DNA, 25 bp, Mus musculus
tcctcgtcaggtgaggcgctcagtt

SEQ ID NO: 362291 - DNA, 25 bp, Mus musculus
ggtgcttccactttaccggtccgca

SEQ ID NO: 362292 - DNA, 25 bp, Mus musculus
ggatcgccggtgcttccactttacc

SEQ ID NO: 362293 - DNA, 25 bp, Mus musculus
atggccggagatccgcctgcgttcc

SEQ ID NO: 362294 - DNA, 25 bp, Mus musculus
cttgggcagtattgggtcacgtccc

SEQ ID NO: 362295 - DNA, 25 bp, Mus musculus
ccgcaccgagctcttcgtagagtta

SEQ ID NO: 362296 - DNA, 25 bp, Mus musculus
ttcctaacccagagcggtggcagcg

SEQ ID NO: 362297 - DNA, 25 bp, Mus musculus
ctagccaagccggagtcgtcccagg

SEQ ID NO: 362298 - DNA, 25 bp, Mus musculus
caccgcggaaacctgacggacggcg

SEQ ID NO: 362299 - DNA, 25 bp, Mus musculus
ggcgaagcccgcacacccggaagtg

SEQ ID NO: 362300 - DNA, 25 bp, Mus musculus
ctctgtggcgtgtttaccttggagc

SEQ ID NO: 362301 - DNA, 25 bp, Mus musculus
ccagctcggtcctatggccggagat

SEQ ID NO: 362302 - DNA, 25 bp, Mus musculus
ccaaaagtattcaagcgcgcatcca

SEQ ID NO: 362303 - DNA, 25 bp, Mus musculus
gagagccttccagcagcacgcatgc

SEQ ID NO: 362304 - DNA, 25 bp, Mus musculus
gttctcggagaaacggagagccttc

SEQ ID NO: 362305 - DNA, 25 bp, Mus musculus
ctggccgcggcaaaatacaagggga

SEQ ID NO: 362306 - DNA, 25 bp, Mus musculus
tgaggctccgcagagctcctccgga

SEQ ID NO: 362307 - DNA, 25 bp, Mus musculus
tccggagccctaagagcgcacgcgg

SEQ ID NO: 362308 - DNA, 25 bp, Mus musculus
tcaaggtcaacctggccgcggcaaa

SEQ ID NO: 362309 - DNA, 25 bp, Mus musculus
gcacgcatgcgcaagagtcgatgga

SEQ ID NO: 362310 - DNA, 25 bp, Mus musculus
caacgcgcccacgaggaaggcaggc

SEQ ID NO: 362311 - DNA, 25 bp, Mus musculus
tggcctaaggagtccaaaagtattc

SEQ ID NO: 362312 - DNA, 25 bp, Mus musculus
tccactgggctgtgacgtgcaagac

SEQ ID NO: 362313 - DNA, 25 bp, Mus musculus
cacgagaagccgagaaacccgcagt

SEQ ID NO: 362314 - DNA, 25 bp, Mus musculus
cgcaggtcaaacgacccaatcaagg

SEQ ID NO: 362315 - DNA, 25 bp, Mus musculus
gtgcaagacatcctagttcgccgcc

SEQ ID NO: 362316 - DNA, 25 bp, Mus musculus
ggggagcagatcctcccacagcgaa

SEQ ID NO: 362317 - DNA, 25 bp, Mus musculus
tggggctgcccgctgttgccataga

SEQ ID NO: 362318 - DNA, 25 bp, Mus musculus
tccgggtgcccgagcactgcggcag

SEQ ID NO: 362319 - DNA, 25 bp, Mus musculus
cacctacccgccgagagccgcttct

SEQ ID NO: 362320 - DNA, 25 bp, Mus musculus
tccggcatcctgtcgggggaaccca

SEQ ID NO: 362321 - DNA, 25 bp, Mus musculus
atcctgtcgggggaacccagctgcc

SEQ ID NO: 362322 - DNA, 25 bp, Mus musculus
tgtctggggagcgactgccgcccca

SEQ ID NO: 362323 - DNA, 25 bp, Mus musculus
ttgccatagagctggacaaagcaga

SEQ ID NO: 362324 - DNA, 25 bp, Mus musculus
ccatagagctggacaaagcagaggc

SEQ ID NO: 362325 - DNA, 25 bp, Mus musculus
tagagctggacaaagcagaggcgcc

SEQ ID NO: 362326 - DNA, 25 bp, Mus musculus
ggacaaagcagaggcgcctgggcca

SEQ ID NO: 362327 - DNA, 25 bp, Mus musculus
ggagcagatcctcccacagcgaagg

SEQ ID NO: 362328 - DNA, 25 bp, Mus musculus
cggccgttactgtggagatcgcacg

SEQ ID NO: 362329 - DNA, 25 bp, Mus musculus
agcggccgttactgtggagatcgca

SEQ ID NO: 362330 - DNA, 25 bp, Mus musculus
cagccgcactctccggcctctctcc

SEQ ID NO: 362331 - DNA, 25 bp, Mus musculus
ggaaggtcaagtcgctcggaatctc

SEQ ID NO: 362332 - DNA, 25 bp, Mus musculus
atcactgcgtgcgaccagactggag

SEQ ID NO: 362333 - DNA, 25 bp, Mus musculus
ttggtccctgcatcactgcgtgcga

SEQ ID NO: 362334 - DNA, 25 bp, Mus musculus
ctgttggtccctgcatcactgcgtg

SEQ ID NO: 362335 - DNA, 25 bp, Mus musculus
tgctccatccagctctctgttggtc

SEQ ID NO: 362336 - DNA, 25 bp, Mus musculus
cgccctcatcccttcgcagctccgc

SEQ ID NO: 362337 - DNA, 25 bp, Mus musculus
ccagtcttggacctgggggaatctc

SEQ ID NO: 362338 - DNA, 25 bp, Mus musculus
cccaccttccgtctgagcgctcgcc

SEQ ID NO: 362339 - DNA, 25 bp, Mus musculus
tgcgggcgggactaacggtcgtcac

SEQ ID NO: 362340 - DNA, 25 bp, Mus musculus
tcccgactagagaccagagatgccc

SEQ ID NO: 362341 - DNA, 25 bp, Mus musculus
gggaatctcccgactagagaccaga

SEQ ID NO: 362342 - DNA, 25 bp, Mus musculus
tctctccagccagtcttggacctgg

SEQ ID NO: 362343 - DNA, 25 bp, Mus musculus
ggtcaagtcgctcggaatctctccg

SEQ ID NO: 362344 - DNA, 25 bp, Mus musculus
tcccggtgcgcccttctctacagcg

SEQ ID NO: 362345 - DNA, 25 bp, Mus musculus
ggcaattcgcagaggcagccgcgca

SEQ ID NO: 362346 - DNA, 25 bp, Mus musculus
caacgagctgttccgcggcgggcaa

SEQ ID NO: 362347 - DNA, 25 bp, Mus musculus
cagcggcctcaagagacggggcaac

SEQ ID NO: 362348 - DNA, 25 bp, Mus musculus
cggcgacagtcactacccggaggag

SEQ ID NO: 362349 - DNA, 25 bp, Mus musculus
agcgacggccagcaccggcgacagt

SEQ ID NO: 362350 - DNA, 25 bp, Mus musculus
cctgcgagagacagcgacggccagc

SEQ ID NO: 362351 - DNA, 25 bp, Mus musculus
cagaagaagctgatggtccgccgga

SEQ ID NO: 362352 - DNA, 25 bp, Mus musculus
cgggacagggatgtatgtactcacc

SEQ ID NO: 362353 - DNA, 25 bp, Mus musculus
tctacagcggccatgggcaacattc

SEQ ID NO: 362354 - DNA, 25 bp, Mus musculus
tgtatgtactcacctcccggtgcgc

SEQ ID NO: 362355 - DNA, 25 bp, Mus musculus
ccgcgcaatactcggtggcgatagc

SEQ ID NO: 362356 - DNA, 25 bp, Mus musculus
ttcgcagaggcagccgcgcaatact

SEQ ID NO: 362357 - DNA, 25 bp, Mus musculus
gccatgggcaacattcagaagaagc

SEQ ID NO: 362358 - DNA, 25 bp, Mus musculus
cactcgaagtggcaatccagggaac

SEQ ID NO: 362359 - DNA, 25 bp, Mus musculus
cgcggctatttaagtggcgttctcc

SEQ ID NO: 362360 - DNA, 25 bp, Mus musculus
tacgtgcaccctttctggcccaagg

SEQ ID NO: 362361 - DNA, 25 bp, Mus musculus
gcacgctcctttttccgggtctctg

SEQ ID NO: 362362 - DNA, 25 bp, Mus musculus
cgccggatctccgtggctttagttc

SEQ ID NO: 362363 - DNA, 25 bp, Mus musculus
ttcccttttcctgtccttacgtgca

SEQ ID NO: 362364 - DNA, 25 bp, Mus musculus
ccagggaacggatctgcgaaacgca

SEQ ID NO: 362365 - DNA, 25 bp, Mus musculus
tagaaccatatctctaccgggagtg

SEQ ID NO: 362366 - DNA, 25 bp, Mus musculus
gtttggaagactcggcagacacgtt

SEQ ID NO: 362367 - DNA, 25 bp, Mus musculus
ctggagagtcctcagagccagcatc

SEQ ID NO: 362368 - DNA, 25 bp, Mus musculus
atgagttcgcagttcgcgtgccacg

SEQ ID NO: 362369 - DNA, 25 bp, Mus musculus
ccaggcggtttaggatgagttcgca

SEQ ID NO: 362370 - DNA, 25 bp, Mus musculus
taaaggcgcgtctttgttcaaaatg

SEQ ID NO: 362371 - DNA, 25 bp, Mus musculus
gagccagcatctgattagaaccata

SEQ ID NO: 362372 - DNA, 25 bp, Mus musculus
ggctatacggctttccgcgccggtg

SEQ ID NO: 362373 - DNA, 25 bp, Mus musculus
cgaccagccgcggttatctctggga

SEQ ID NO: 362374 - DNA, 25 bp, Mus musculus
agcgcgccttgcgtcttggcgtcaa

SEQ ID NO: 362375 - DNA, 25 bp, Mus musculus
tggttccttggctccagcacgttcg

SEQ ID NO: 362376 - DNA, 25 bp, Mus musculus
tctgtgactccagtcggaccgtcgc

SEQ ID NO: 362377 - DNA, 25 bp, Mus musculus
aggacgacttttcagcaccgccgcg

SEQ ID NO: 362378 - DNA, 25 bp, Mus musculus
gaggcagaacggaggacgacttttc

SEQ ID NO: 362379 - DNA, 25 bp, Mus musculus
tggacagtcacaacaccgacggggc

SEQ ID NO: 362380 - DNA, 25 bp, Mus musculus
tttcacccgtcaggaatgcgctccg

SEQ ID NO: 362381 - DNA, 25 bp, Mus musculus
gctcccgaaggaggcggtcatctcc

SEQ ID NO: 362382 - DNA, 25 bp, Mus musculus
acttactcggaacgcgccgggcagt

SEQ ID NO: 362383 - DNA, 25 bp, Mus musculus
agccgggaaccaacacagcaactgc

SEQ ID NO: 362384 - DNA, 25 bp, Mus musculus
gcgtcccgttagaggcgatttcacc

SEQ ID NO: 362385 - DNA, 25 bp, Mus musculus
cggaaccttctcagctagggcgaga

SEQ ID NO: 362386 - DNA, 25 bp, Mus musculus
aggctccgccctgttgaggcggctc

SEQ ID NO: 362387 - DNA, 25 bp, Mus musculus
gcctcctcttgctgattgggcgccg

SEQ ID NO: 362388 - DNA, 25 bp, Mus musculus
tgtcgcctccgtcggacgacgcagg

SEQ ID NO: 362389 - DNA, 25 bp, Mus musculus
tgagcttcgcggtcggccacttcct

SEQ ID NO: 362390 - DNA, 25 bp, Mus musculus
ctcaacgacctgtgcgccggcatgt

SEQ ID NO: 362391 - DNA, 25 bp, Mus musculus
cggcatgtggttcacctacctgcta

SEQ ID NO: 362392 - DNA, 25 bp, Mus musculus
gttcacctacctgctactattcctg

SEQ ID NO: 362393 - DNA, 25 bp, Mus musculus
gccaagtggccgacgggctctgcac

SEQ ID NO: 362394 - DNA, 25 bp, Mus musculus
tctgcacgccgctcgtgggctacga

SEQ ID NO: 362395 - DNA, 25 bp, Mus musculus
gcacctagcgggtgagcctttccct

SEQ ID NO: 362396 - DNA, 25 bp, Mus musculus
gggtgagcctttccctgccctgact

SEQ ID NO: 362397 - DNA, 25 bp, Mus musculus
gccctgactgtcgtcctgtgtccgt

SEQ ID NO: 362398 - DNA, 25 bp, Mus musculus
tattcctgcactccgtgcgcgggta

SEQ ID NO: 362399 - DNA, 25 bp, Mus musculus
ggccacgcctcctcttgctgattgg

SEQ ID NO: 362400 - DNA, 25 bp, Mus musculus
accgctaaggtgttgacaattccta

SEQ ID NO: 362401 - DNA, 25 bp, Mus musculus
ggcctaagcgcaaagtgtgcaaatc

SEQ ID NO: 362402 - DNA, 25 bp, Mus musculus
ttcatgatcacctgaggcctaagcg

SEQ ID NO: 362403 - DNA, 25 bp, Mus musculus
cgacgcgtgtcaagtgtgaaagttc

SEQ ID NO: 362404 - DNA, 25 bp, Mus musculus
caactgcgttttaacgacgcgtgtc

SEQ ID NO: 362405 - DNA, 25 bp, Mus musculus
atccggagaggaagcaactgcgttt

SEQ ID NO: 362406 - DNA, 25 bp, Mus musculus
tccacggccctcagaggagctgtca

SEQ ID NO: 362407 - DNA, 25 bp, Mus musculus
acgaccacagaggtggagctcgcga

SEQ ID NO: 362408 - DNA, 25 bp, Mus musculus
ctctcatggcggttcggcctctagc

SEQ ID NO: 362409 - DNA, 25 bp, Mus musculus
tagctatgctttgaatccctgcctg

SEQ ID NO: 362410 - DNA, 25 bp, Mus musculus
ataccctgggcagtgtgacagtccg

SEQ ID NO: 362411 - DNA, 25 bp, Mus musculus
tgtgcaaatcttttctctccgcgga

SEQ ID NO: 362412 - DNA, 25 bp, Mus musculus
ggtctcctcgtgaaccgctaaggtg

SEQ ID NO: 362413 - DNA, 25 bp, Mus musculus
tgacagtccggacagatcacacgca

SEQ ID NO: 362414 - DNA, 25 bp, Mus musculus
aaggcctcggtctctgggttcctgc

SEQ ID NO: 362415 - DNA, 25 bp, Mus musculus
ttcaaccggaatcgacgcgtactca

SEQ ID NO: 362416 - DNA, 25 bp, Mus musculus
ccacgtacagagaggccatggggta

SEQ ID NO: 362417 - DNA, 25 bp, Mus musculus
tggggttcatctcggcacggctgcc

SEQ ID NO: 362418 - DNA, 25 bp, Mus musculus
cgacctttcccgtgagaggaggaga

SEQ ID NO: 362419 - DNA, 25 bp, Mus musculus
gcagagggacaaaattcaaccggaa

SEQ ID NO: 362420 - DNA, 25 bp, Mus musculus
aggggccgacttcccgctgcgcaaa

SEQ ID NO: 362421 - DNA, 25 bp, Mus musculus
gaaagagcgttaacccgtcagcgca

SEQ ID NO: 362422 - DNA, 25 bp, Mus musculus
aggcgccacagccaggggccgactt

SEQ ID NO: 362423 - DNA, 25 bp, Mus musculus
ctctcagcactaaccgccggggaga

SEQ ID NO: 362424 - DNA, 25 bp, Mus musculus
gacgcgtactcaacggccgtggaac

SEQ ID NO: 362425 - DNA, 25 bp, Mus musculus
tcggctgcttcaccgggttatttta

SEQ ID NO: 362426 - DNA, 25 bp, Mus musculus
tcccgctgcgcaaagccaggaaagg

SEQ ID NO: 362427 - DNA, 25 bp, Mus musculus
taataaatgtgtgttccgagcccgg

SEQ ID NO: 362428 - DNA, 25 bp, Mus musculus
agccgctccgcagacacggggtttc

SEQ ID NO: 362429 - DNA, 25 bp, Mus musculus
cgattcaaagtcacgggcggaagca

SEQ ID NO: 362430 - DNA, 25 bp, Mus musculus
gccctctctgatgggaccgctaact

SEQ ID NO: 362431 - DNA, 25 bp, Mus musculus
gaccgctaactattcgcgccgggcg

SEQ ID NO: 362432 - DNA, 25 bp, Mus musculus
tgttttcgttttgagggtatcctca

SEQ ID NO: 362433 - DNA, 25 bp, Mus musculus
attttgtcgtccttcccacacggcg

SEQ ID NO: 362434 - DNA, 25 bp, Mus musculus
tcacctgcgccacgggcgattcaaa

SEQ ID NO: 362435 - DNA, 25 bp, Mus musculus
acacggcgcgtcctgagagtctttt

SEQ ID NO: 362436 - DNA, 25 bp, Mus musculus
agagtcttttctggcattgcgggcc

SEQ ID NO: 362437 - DNA, 25 bp, Mus musculus
agcagcccggcaggccagaagcaag

SEQ ID NO: 362438 - DNA, 25 bp, Mus musculus
cggctcctcacctgtgtccggagtg

SEQ ID NO: 362439 - DNA, 25 bp, Mus musculus
aggctgagactctgtccctgatctg

SEQ ID NO: 362440 - DNA, 25 bp, Mus musculus
ctgatctggctgctcacaggctaca

SEQ ID NO: 362441 - DNA, 25 bp, Mus musculus
ggtatcctcacgctaatgtattttg

SEQ ID NO: 362442 - DNA, 25 bp, Mus musculus
ttgccatcgcaacgtcaggtacgcc

SEQ ID NO: 362443 - DNA, 25 bp, Mus musculus
caccctctcctcgtgggtaggggtg

SEQ ID NO: 362444 - DNA, 25 bp, Mus musculus
aggcccagactgttgccaggcaggc

SEQ ID NO: 362445 - DNA, 25 bp, Mus musculus
acctctgagcctgcgcatactgctg

SEQ ID NO: 362446 - DNA, 25 bp, Mus musculus
tgcggggacaaagccgtgccatcac

SEQ ID NO: 362447 - DNA, 25 bp, Mus musculus
agcctgcgcatactgctgcattttc

SEQ ID NO: 362448 - DNA, 25 bp, Mus musculus
ccctcgaaacggtcttgcactgtcg

SEQ ID NO: 362449 - DNA, 25 bp, Mus musculus
gaactaggcgccaggcactgggaaa

SEQ ID NO: 362450 - DNA, 25 bp, Mus musculus
cactgggaaaggacgtccgcgctac

SEQ ID NO: 362451 - DNA, 25 bp, Mus musculus
ccgcgctactttgttgccatcgcaa

SEQ ID NO: 362452 - DNA, 25 bp, Mus musculus
gctccatgccgtgcggggacaaagc

SEQ ID NO: 362453 - DNA, 25 bp, Mus musculus
catcgcaacgtcaggtacgcccagg

SEQ ID NO: 362454 - DNA, 25 bp, Mus musculus
gcgcgcgaactaggcgccaggcact

SEQ ID NO: 362455 - DNA, 25 bp, Mus musculus
ggacgtccgcgctactttgttgcca

SEQ ID NO: 362456 - DNA, 25 bp, Mus musculus
tgtgacctccggtctacgggcggct

SEQ ID NO: 362457 - DNA, 25 bp, Mus musculus
ttcgtgtttcactcacccggcctgg

SEQ ID NO: 362458 - DNA, 25 bp, Mus musculus
cagcagtcactctttcgtgtttcac

SEQ ID NO: 362459 - DNA, 25 bp, Mus musculus
gtggctcagcagtcactctttcgtg

SEQ ID NO: 362460 - DNA, 25 bp, Mus musculus
tcggccgagtggctcagcagtcact

SEQ ID NO: 362461 - DNA, 25 bp, Mus musculus
acagccattcgtgggcagactcaac

SEQ ID NO: 362462 - DNA, 25 bp, Mus musculus
ctgcccttgcggtgtgtgacctccg

SEQ ID NO: 362463 - DNA, 25 bp, Mus musculus
cgctctctcggtgtcgtctcagcgt

SEQ ID NO: 362464 - DNA, 25 bp, Mus musculus
ccctgttacataagcgcgcgggggc

SEQ ID NO: 362465 - DNA, 25 bp, Mus musculus
gtctgcaggccaatggcagctctcc

SEQ ID NO: 362466 - DNA, 25 bp, Mus musculus
gcgtccttccggtctgcaggccaat

SEQ ID NO: 362467 - DNA, 25 bp, Mus musculus
ccagctctcaacagccattcgtggg

SEQ ID NO: 362468 - DNA, 25 bp, Mus musculus
cgccacccgcagaggaaggaccgag

SEQ ID NO: 362469 - DNA, 25 bp, Mus musculus
agcagagccgggagcacaacagccc

SEQ ID NO: 362470 - DNA, 25 bp, Mus musculus
cacgactgtttgcttagtggcttta

SEQ ID NO: 362471 - DNA, 25 bp, Mus musculus
gtcggtattttcagcgagccgcggc

SEQ ID NO: 362472 - DNA, 25 bp, Mus musculus
ggcattattcgctctggtcggtatt

SEQ ID NO: 362473 - DNA, 25 bp, Mus musculus
cggtttcacttataaacaggcatta

SEQ ID NO: 362474 - DNA, 25 bp, Mus musculus
cagctgacacaggtgtacggtttca

SEQ ID NO: 362475 - DNA, 25 bp, Mus musculus
cccttgaagatcaggctggcagctg

SEQ ID NO: 362476 - DNA, 25 bp, Mus musculus
gtggctttattgactcaggtcccgc

SEQ ID NO: 362477 - DNA, 25 bp, Mus musculus
actgtacaaactgagcacgactgtt

SEQ ID NO: 362478 - DNA, 25 bp, Mus musculus
ccgtgtaaacaaagctgggctcgga

SEQ ID NO: 362479 - DNA, 25 bp, Mus musculus
cttgccgtgagacgagccgtgtaaa

SEQ ID NO: 362480 - DNA, 25 bp, Mus musculus
acagacctccagtcccgctgtgtga

SEQ ID NO: 362481 - DNA, 25 bp, Mus musculus
cacgcagccctgtttcatcaagata

SEQ ID NO: 362482 - DNA, 25 bp, Mus musculus
cacgaagtgactgcggctaacgagc

SEQ ID NO: 362483 - DNA, 25 bp, Mus musculus
gctgaggcggcctttctttctttca

SEQ ID NO: 362484 - DNA, 25 bp, Mus musculus
cattcaggcggtcatgctgagcgct

SEQ ID NO: 362485 - DNA, 25 bp, Mus musculus
gcgttcaggcggtcatgctgagcac

SEQ ID NO: 362486 - DNA, 25 bp, Mus musculus
caggcggtcatgctgagcactgtgc

SEQ ID NO: 362487 - DNA, 25 bp, Mus musculus
tgctgagcactgtgctgggcgttca

SEQ ID NO: 362488 - DNA, 25 bp, Mus musculus
ttcaggcggtcatgctgagcactgt

SEQ ID NO: 362489 - DNA, 25 bp, Mus musculus
atgctgagcactgtgctgggcgttc

SEQ ID NO: 362490 - DNA, 25 bp, Mus musculus
cgttcaggctgtcactccctgagca

SEQ ID NO: 362491 - DNA, 25 bp, Mus musculus
cgttcaggcggtcatgctgagcact

SEQ ID NO: 362492 - DNA, 25 bp, Mus musculus
ggcgttcaggcgctcatgctgagca

SEQ ID NO: 362493 - DNA, 25 bp, Mus musculus
gggcgttcaggctgtcactccctga

SEQ ID NO: 362494 - DNA, 25 bp, Mus musculus
ggctgtcactccctgagcactgtgc

SEQ ID NO: 362495 - DNA, 25 bp, Mus musculus
tcaggcggtcatgctgagcactgtg

SEQ ID NO: 362496 - DNA, 25 bp, Mus musculus
ctcatgctgagcactgtgctgggcg

SEQ ID NO: 362497 - DNA, 25 bp, Mus musculus
cgttcaggcggtcatgctgagcgct

SEQ ID NO: 362498 - DNA, 25 bp, Mus musculus
gtagctcttgttctgccatctcggg

SEQ ID NO: 362499 - DNA, 25 bp, Mus musculus
tgcgattgcagacacggccatcttc

SEQ ID NO: 362500 - DNA, 25 bp, Mus musculus
gtgtgcgctcaacaaaggcctttta

SEQ ID NO: 362501 - DNA, 25 bp, Mus musculus
gggcctcttttgtgtgcgctcaaca

SEQ ID NO: 362502 - DNA, 25 bp, Mus musculus
ctggaaaagcggtctgggcctcttt

SEQ ID NO: 362503 - DNA, 25 bp, Mus musculus
agtcgacttccttcgattaggccaa

SEQ ID NO: 362504 - DNA, 25 bp, Mus musculus
gccggttggaagttcagtcgacttc

SEQ ID NO: 362505 - DNA, 25 bp, Mus musculus
ctcagacttcctgggccggttggaa

SEQ ID NO: 362506 - DNA, 25 bp, Mus musculus
cccttgggcactgattgaggttttg

SEQ ID NO: 362507 - DNA, 25 bp, Mus musculus
gaccctactcgaacgtgaatgttta

SEQ ID NO: 362508 - DNA, 25 bp, Mus musculus
cccgattcaggggagagaccctact

SEQ ID NO: 362509 - DNA, 25 bp, Mus musculus
tttggtgtatccagaccctctcgga

SEQ ID NO: 362510 - DNA, 25 bp, Mus musculus
gggagcgagttcattggatcaaaca

SEQ ID NO: 362511 - DNA, 25 bp, Mus musculus
ggactgattttgaggccgagtacga

SEQ ID NO: 362512 - DNA, 25 bp, Mus musculus
cgcgtggttatctttgaacagactc

SEQ ID NO: 362513 - DNA, 25 bp, Mus musculus
ctatctcaaggacgaccagcgcagc

SEQ ID NO: 362514 - DNA, 25 bp, Mus musculus
cgaagcgcgagcagtacagtgtatc

SEQ ID NO: 362515 - DNA, 25 bp, Mus musculus
cgagagctttaaggacggcgcctcg

SEQ ID NO: 362516 - DNA, 25 bp, Mus musculus
acgccggacagcacctacagcgaga

SEQ ID NO: 362517 - DNA, 25 bp, Mus musculus
tttcacaccggtgttcatggcgccc

SEQ ID NO: 362518 - DNA, 25 bp, Mus musculus
ttgaacagactcagtacgacctgcc

SEQ ID NO: 362519 - DNA, 25 bp, Mus musculus
agcagcgcgtggttatctttgaaca

SEQ ID NO: 362520 - DNA, 25 bp, Mus musculus
agccgaggatttcacaccggtgttc

SEQ ID NO: 362521 - DNA, 25 bp, Mus musculus
caggcatcaccgtggtgaaagccga

SEQ ID NO: 362522 - DNA, 25 bp, Mus musculus
ccgtgtcaggcatcaccgtggtgaa

SEQ ID NO: 362523 - DNA, 25 bp, Mus musculus
gtatccatcaccgagagctctgccg

SEQ ID NO: 362524 - DNA, 25 bp, Mus musculus
cgcgagcagtacagtgtatccatca

SEQ ID NO: 362525 - DNA, 25 bp, Mus musculus
gcacctacagcgagagctttaagga

SEQ ID NO: 362526 - DNA, 25 bp, Mus musculus
ttcatgatgactcggatgcgggaca

SEQ ID NO: 362527 - DNA, 25 bp, Mus musculus
cagccaaaggccaaggcgcgtgtgt

SEQ ID NO: 362528 - DNA, 25 bp, Mus musculus
tgtgtagcgcgcagacgcaagagaa

SEQ ID NO: 362529 - DNA, 25 bp, Mus musculus
tcctgcagagcgaaagcggcgcagt

SEQ ID NO: 362530 - DNA, 25 bp, Mus musculus
acgctgggagccagacgatcctgca

SEQ ID NO: 362531 - DNA, 25 bp, Mus musculus
gcagccgaacccttaactacgcgtg

SEQ ID NO: 362532 - DNA, 25 bp, Mus musculus
tcgggagagctcttcatgatgactc

SEQ ID NO: 362533 - DNA, 25 bp, Mus musculus
agcgcctcctggttgatgctcgaca

SEQ ID NO: 362534 - DNA, 25 bp, Mus musculus
gggcaatgacacgagccgctggtcc

SEQ ID NO: 362535 - DNA, 25 bp, Mus musculus
atccctctcggaaacgccggggcag

SEQ ID NO: 362536 - DNA, 25 bp, Mus musculus
cagtctcccggaagaagcgctctca

SEQ ID NO: 362537 - DNA, 25 bp, Mus musculus
aagaagcgctctcaggcgtccgagt

SEQ ID NO: 362538 - DNA, 25 bp, Mus musculus
tccgagtgcttgctcgggcagtccc

SEQ ID NO: 362539 - DNA, 25 bp, Mus musculus
ttgatgctcgacacctcgggagagc

SEQ ID NO: 362540 - DNA, 25 bp, Mus musculus
ctggcgactcgcactatttgtgttc

SEQ ID NO: 362541 - DNA, 25 bp, Mus musculus
tccacccggaaagaaggtcggctgc

SEQ ID NO: 362542 - DNA, 25 bp, Mus musculus
ggtgtcaaagaccatcgctgaggta

SEQ ID NO: 362543 - DNA, 25 bp, Mus musculus
cccagcatgtcacgtgcggttgccg

SEQ ID NO: 362544 - DNA, 25 bp, Mus musculus
caggcttgaagttgatgcgaggccc

SEQ ID NO: 362545 - DNA, 25 bp, Mus musculus
tcggcttccaccagcaacaggcttg

SEQ ID NO: 362546 - DNA, 25 bp, Mus musculus
tactgggacaaaggccgtccttcca

SEQ ID NO: 362547 - DNA, 25 bp, Mus musculus
ttccagattcttaggtccttcggtg

SEQ ID NO: 362548 - DNA, 25 bp, Mus musculus
ggcgactcctgcgttactgggacaa

SEQ ID NO: 362549 - DNA, 25 bp, Mus musculus
cgccggcagtcctggaaggaatctc

SEQ ID NO: 362550 - DNA, 25 bp, Mus musculus
cccgacccaggaacgcgagctggtt

SEQ ID NO: 362551 - DNA, 25 bp, Mus musculus
tggggctcttcaaaagctccagctt

SEQ ID NO: 362552 - DNA, 25 bp, Mus musculus
gattgcgcgcacaggcttattgccc

SEQ ID NO: 362553 - DNA, 25 bp, Mus musculus
atctcgggtggactgttccagattc

SEQ ID NO: 362554 - DNA, 25 bp, Mus musculus
cgtcccatgggcgtgaatttccagc

SEQ ID NO: 362555 - DNA, 25 bp, Mus musculus
ggggctcccaaatccttatgctgac

SEQ ID NO: 362556 - DNA, 25 bp, Mus musculus
ttcttttgacactagctagcccagg

SEQ ID NO: 362557 - DNA, 25 bp, Mus musculus
ccctatctctgcctccgagagtgga

SEQ ID NO: 362558 - DNA, 25 bp, Mus musculus
tggagtgacccacgtgcagtactac

SEQ ID NO: 362559 - DNA, 25 bp, Mus musculus
gaactccttgccacggatttgcctg

SEQ ID NO: 362560 - DNA, 25 bp, Mus musculus
cctgagttgagatactgcgcggtta

SEQ ID NO: 362561 - DNA, 25 bp, Mus musculus
ccatctcccgcaagtgctgtgtgta

SEQ ID NO: 362562 - DNA, 25 bp, Mus musculus
tgtcagtttgagacccacgggtgtg

SEQ ID NO: 362563 - DNA, 25 bp, Mus musculus
gcgactctgaaagcagccgtgccaa

SEQ ID NO: 362564 - DNA, 25 bp, Mus musculus
cggtagcacggctttatcagagcgc

SEQ ID NO: 362565 - DNA, 25 bp, Mus musculus
tccagcgcacggcttgtttgatggc

SEQ ID NO: 362566 - DNA, 25 bp, Mus musculus
ttgtaccaggcatcaccaggttctg

SEQ ID NO: 362567 - DNA, 25 bp, Mus musculus
cacgaccggaggtgggatactcacc

SEQ ID NO: 362568 - DNA, 25 bp, Mus musculus
gcactccggtggtccaaggcgcagc

SEQ ID NO: 362569 - DNA, 25 bp, Mus musculus
tgtgacaatagacggcgcggcactc

SEQ ID NO: 362570 - DNA, 25 bp, Mus musculus
gccagctatgggctgtgacaataga

SEQ ID NO: 362571 - DNA, 25 bp, Mus musculus
cgtccttcgtcaacaacgactggga

SEQ ID NO: 362572 - DNA, 25 bp, Mus musculus
tccgggtgtagcagtttcagatttc

SEQ ID NO: 362573 - DNA, 25 bp, Mus musculus
agcgtggccgcttctgactttaaaa

SEQ ID NO: 362574 - DNA, 25 bp, Mus musculus
cattgcagtgaagcttccggcagcg

SEQ ID NO: 362575 - DNA, 25 bp, Mus musculus
ttgttgcggcccattgcagtgaagc

SEQ ID NO: 362576 - DNA, 25 bp, Mus musculus
tcaaagttgagaacgagccggggcc

SEQ ID NO: 362577 - DNA, 25 bp, Mus musculus
ttcagatttccggtagggcgctctt

SEQ ID NO: 362578 - DNA, 25 bp, Mus musculus
accgccgcttctcttcatcaaagtt

SEQ ID NO: 362579 - DNA, 25 bp, Mus musculus
gcagcccgacgggagtctctttcca

SEQ ID NO: 362580 - DNA, 25 bp, Mus musculus
gcgagctccagctacatccaggggc

SEQ ID NO: 362581 - DNA, 25 bp, Mus musculus
cgcagcgctgagagccgtaaacagc

SEQ ID NO: 362582 - DNA, 25 bp, Mus musculus
agtctcacctcttggcgtccgaggc

SEQ ID NO: 362583 - DNA, 25 bp, Mus musculus
ttttctccagtctcacctcttggcg

SEQ ID NO: 362584 - DNA, 25 bp, Mus musculus
tgcccgctccattcttttctccagt

SEQ ID NO: 362585 - DNA, 25 bp, Mus musculus
gcaacctaaatctgcgaacctggcc

SEQ ID NO: 362586 - DNA, 25 bp, Mus musculus
ggccacgcccatcgcaacctaaatc

SEQ ID NO: 362587 - DNA, 25 bp, Mus musculus
agcatctgcagctgcccgttaacca

SEQ ID NO: 362588 - DNA, 25 bp, Mus musculus
actagacccagcgaggaagtgactc

SEQ ID NO: 362589 - DNA, 25 bp, Mus musculus
acccagcgaggaagtgactcaccca

SEQ ID NO: 362590 - DNA, 25 bp, Mus musculus
tgactcacccagaaaacgcagcatc

SEQ ID NO: 362591 - DNA, 25 bp, Mus musculus
tcacccagaaaacgcagcatctgca

SEQ ID NO: 362592 - DNA, 25 bp, Mus musculus
aatgagcggttccggccggccacgc

SEQ ID NO: 362593 - DNA, 25 bp, Mus musculus
tgcccgttaaccagctgcgggctgg

SEQ ID NO: 362594 - DNA, 25 bp, Mus musculus
gagaccacggcgacgtcgactagac

SEQ ID NO: 362595 - DNA, 25 bp, Mus musculus
cgacgtcgactagacccagcgagga

SEQ ID NO: 362596 - DNA, 25 bp, Mus musculus
gcacgatgcgttcgccgttccacag

SEQ ID NO: 362597 - DNA, 25 bp, Mus musculus
cgaaaagcgcgtcaggtcccagcac

SEQ ID NO: 362598 - DNA, 25 bp, Mus musculus
ggaaaactgctcgtcgtagcctacg

SEQ ID NO: 362599 - DNA, 25 bp, Mus musculus
acgaacagcgtgttcttgccggccc

SEQ ID NO: 362600 - DNA, 25 bp, Mus musculus
gcacgcctcggtcaacctggagaag

SEQ ID NO: 362601 - DNA, 25 bp, Mus musculus
agcactccgtcgcagtcgaacagga

SEQ ID NO: 362602 - DNA, 25 bp, Mus musculus
gcagcttcaccaattggcgcgcaga

SEQ ID NO: 362603 - DNA, 25 bp, Mus musculus
gccactatccgacaggcggcagctg

SEQ ID NO: 362604 - DNA, 25 bp, Mus musculus
cggggctacgaacacaggcttcagc

SEQ ID NO: 362605 - DNA, 25 bp, Mus musculus
caggcttcagccaatagcgactaga

SEQ ID NO: 362606 - DNA, 25 bp, Mus musculus
atttagtcgaaggtgctggccgatc

SEQ ID NO: 362607 - DNA, 25 bp, Mus musculus
gacagcctggtctgcagcgaatcgc

SEQ ID NO: 362608 - DNA, 25 bp, Mus musculus
gcggcagctgcaggaattccgaaaa

SEQ ID NO: 362609 - DNA, 25 bp, Mus musculus
cgccggctgttgttgctcacgaaca

SEQ ID NO: 362610 - DNA, 25 bp, Mus musculus
gtccgcggcgctccacctctcagac

SEQ ID NO: 362611 - DNA, 25 bp, Mus musculus
gcagtagattccagagcccgacccg

SEQ ID NO: 362612 - DNA, 25 bp, Mus musculus
tgcagtagattccagagcccgaccc

SEQ ID NO: 362613 - DNA, 25 bp, Mus musculus
actgcagtagattccagagcccgac

SEQ ID NO: 362614 - DNA, 25 bp, Mus musculus
ccactgcagtagattccagagcccg

SEQ ID NO: 362615 - DNA, 25 bp, Mus musculus
tgccactgcagtagattccagagcc

SEQ ID NO: 362616 - DNA, 25 bp, Mus musculus
ctgccactgcagtagattccagagc

SEQ ID NO: 362617 - DNA, 25 bp, Mus musculus
gacgctgccactgcagtagattcca

SEQ ID NO: 362618 - DNA, 25 bp, Mus musculus
ctctcagacgctgccactgcagtag

SEQ ID NO: 362619 - DNA, 25 bp, Mus musculus
ctctctgcctgaggccggggcttgt

SEQ ID NO: 362620 - DNA, 25 bp, Mus musculus
cgctctctgcctgaggccggggctt

SEQ ID NO: 362621 - DNA, 25 bp, Mus musculus
cagacgctgccactgcagtagattc

SEQ ID NO: 362622 - DNA, 25 bp, Mus musculus
tcagacgctgccactgcagtagatt

SEQ ID NO: 362623 - DNA, 25 bp, Mus musculus
cgctgccactgcagtagattccaga

SEQ ID NO: 362624 - DNA, 25 bp, Mus musculus
gcagagatcgccacagacgacgcca

SEQ ID NO: 362625 - DNA, 25 bp, Mus musculus
tcaggcacggccattgccaagagtc

SEQ ID NO: 362626 - DNA, 25 bp, Mus musculus
tgccaagagtctccgcagcaagctc

SEQ ID NO: 362627 - DNA, 25 bp, Mus musculus
tccgcagcaagctcaagtgttcccg

SEQ ID NO: 362628 - DNA, 25 bp, Mus musculus
cggagaacaggggaaaccttgtcag

SEQ ID NO: 362629 - DNA, 25 bp, Mus musculus
ggtgcccaccaccacgtttccgctg

SEQ ID NO: 362630 - DNA, 25 bp, Mus musculus
acagacgacgccaccgcgggagctg

SEQ ID NO: 362631 - DNA, 25 bp, Mus musculus
ggcgctgcacactcttgtgttgaca

SEQ ID NO: 362632 - DNA, 25 bp, Mus musculus
ccagagacgcagagatcgccacaga

SEQ ID NO: 362633 - DNA, 25 bp, Mus musculus
gggcagtaccagagacgcagagatc

SEQ ID NO: 362634 - DNA, 25 bp, Mus musculus
tgtgttgacagcaggggcagtacca

SEQ ID NO: 362635 - DNA, 25 bp, Mus musculus
cactcttgtgttgacagcaggggca

SEQ ID NO: 362636 - DNA, 25 bp, Mus musculus
ggaaaccttgtcaggcacggccatt

SEQ ID NO: 362637 - DNA, 25 bp, Mus musculus
gcgggagctgctcacacctgaaagc

SEQ ID NO: 362638 - DNA, 25 bp, Mus musculus
agccgtggcctactgctgtacagaa

SEQ ID NO: 362639 - DNA, 25 bp, Mus musculus
gatttcgacggttccgctttcagga

SEQ ID NO: 362640 - DNA, 25 bp, Mus musculus
aggcctcccatctgcgatttcgacg

SEQ ID NO: 362641 - DNA, 25 bp, Mus musculus
aagggctcctcatagtgaaactgga

SEQ ID NO: 362642 - DNA, 25 bp, Mus musculus
gcatgactatggctgcgggcccaag

SEQ ID NO: 362643 - DNA, 25 bp, Mus musculus
ctgtacagaacccagggcgtctctc

SEQ ID NO: 362644 - DNA, 25 bp, Mus musculus
gacgctgcaggcctgatattgctga

SEQ ID NO: 362645 - DNA, 25 bp, Mus musculus
cgacttaagttctgtgcgggcctga

SEQ ID NO: 362646 - DNA, 25 bp, Mus musculus
tgacgcctaactcgcgtgctgaggc

SEQ ID NO: 362647 - DNA, 25 bp, Mus musculus
gcggccgttggcttatgacgcctaa

SEQ ID NO: 362648 - DNA, 25 bp, Mus musculus
gcaaattttccttgtcctgggtgga

SEQ ID NO: 362649 - DNA, 25 bp, Mus musculus
tggtgagacccgacccaatgggaga

SEQ ID NO: 362650 - DNA, 25 bp, Mus musculus
gcccttagccggcttcaggagcttt

SEQ ID NO: 362651 - DNA, 25 bp, Mus musculus
ccctcccgctcttttatgcaaattt

SEQ ID NO: 362652 - DNA, 25 bp, Mus musculus
gcggcggtccctccttaatggacca

SEQ ID NO: 362653 - DNA, 25 bp, Mus musculus
ccctgagggacacggtgattccgaa

SEQ ID NO: 362654 - DNA, 25 bp, Mus musculus
acgcagtagctgcagggaaaccgcc

SEQ ID NO: 362655 - DNA, 25 bp, Mus musculus
cgcccagccgagacgcgacaaagga

SEQ ID NO: 362656 - DNA, 25 bp, Mus musculus
tccgaaagcagagaccggaccactc

SEQ ID NO: 362657 - DNA, 25 bp, Mus musculus
ttcagtcggagcagtagaatggtcc

SEQ ID NO: 362658 - DNA, 25 bp, Mus musculus
ccgcctgttgatatgttcagtcgga

SEQ ID NO: 362659 - DNA, 25 bp, Mus musculus
tacaagcagccgtttccggttcctc

SEQ ID NO: 362660 - DNA, 25 bp, Mus musculus
ggctattcctgagcttctacaagca

SEQ ID NO: 362661 - DNA, 25 bp, Mus musculus
gcacctggcaactgagaggctattc

SEQ ID NO: 362662 - DNA, 25 bp, Mus musculus
ttcccgaggacctgaatcgcacctg

SEQ ID NO: 362663 - DNA, 25 bp, Mus musculus
atggaccaattgagcagcttcccga

SEQ ID NO: 362664 - DNA, 25 bp, Mus musculus
cctgattggccagcgtactcccgag

SEQ ID NO: 362665 - DNA, 25 bp, Mus musculus
accactctggagtcgatcacggatg

SEQ ID NO: 362666 - DNA, 25 bp, Mus musculus
cttctcaagagaccgcctaccaccg

SEQ ID NO: 362667 - DNA, 25 bp, Mus musculus
caaagcgccgggaggtgtgcacgct

SEQ ID NO: 362668 - DNA, 25 bp, Mus musculus
cgtgctgaggcgtaccggcacgacc

SEQ ID NO: 362669 - DNA, 25 bp, Mus musculus
gaggcgtaccggcacgaccatccga

SEQ ID NO: 362670 - DNA, 25 bp, Mus musculus
acgaccatccgaccgacgaaaagtg

SEQ ID NO: 362671 - DNA, 25 bp, Mus musculus
tccgaccgacgaaaagtggcctcga

SEQ ID NO: 362672 - DNA, 25 bp, Mus musculus
gcctatgggcgggaactccaccaga

SEQ ID NO: 362673 - DNA, 25 bp, Mus musculus
atgggcgggaactccaccagacgcc

SEQ ID NO: 362674 - DNA, 25 bp, Mus musculus
gcacgctgagaaggcgtggctaatc

SEQ ID NO: 362675 - DNA, 25 bp, Mus musculus
ctgagaaggcgtggctaatcccgga

SEQ ID NO: 362676 - DNA, 25 bp, Mus musculus
tggctaatcccggaaggggcgtgaa

SEQ ID NO: 362677 - DNA, 25 bp, Mus musculus
tgaacgcgccaagggtttccacagc

SEQ ID NO: 362678 - DNA, 25 bp, Mus musculus
gccaagggtttccacagccttctca

SEQ ID NO: 362679 - DNA, 25 bp, Mus musculus
tttccacagccttctcaagagaccg

SEQ ID NO: 362680 - DNA, 25 bp, Mus musculus
gagcagcaactagggaaccagcttg

SEQ ID NO: 362681 - DNA, 25 bp, Mus musculus
tgtcctgcaggtggaactcagagcc

SEQ ID NO: 362682 - DNA, 25 bp, Mus musculus
tgtagcgcatcctctgccctgaatc

SEQ ID NO: 362683 - DNA, 25 bp, Mus musculus
ttactctctgactcgcgatgtagcg

SEQ ID NO: 362684 - DNA, 25 bp, Mus musculus
ccctgttcgcaggagcaacacaatc

SEQ ID NO: 362685 - DNA, 25 bp, Mus musculus
gtccagtcaggtacgtgcagtgtct

SEQ ID NO: 362686 - DNA, 25 bp, Mus musculus
tttctactatggaggggagcagcta

SEQ ID NO: 362687 - DNA, 25 bp, Mus musculus
gcgaggacttcaggttcttgacatc

SEQ ID NO: 362688 - DNA, 25 bp, Mus musculus
ttgaatcctcccgaagaaacatctg

SEQ ID NO: 362689 - DNA, 25 bp, Mus musculus
ctggcggaggccaaattcagcatgc

SEQ ID NO: 362690 - DNA, 25 bp, Mus musculus
agggcctgtcattgcgatgctcata

SEQ ID NO: 362691 - DNA, 25 bp, Mus musculus
tgacagcggttctctttcgaatgcc

SEQ ID NO: 362692 - DNA, 25 bp, Mus musculus
tgcggcctcgactctttcttcctta

SEQ ID NO: 362693 - DNA, 25 bp, Mus musculus
cagtgtctcagatcatgccctagtc

SEQ ID NO: 362694 - DNA, 25 bp, Mus musculus
tcccagcgtcctgtcgacttcccga

SEQ ID NO: 362695 - DNA, 25 bp, Mus musculus
tctagtcgcaagtagccttctcaga

SEQ ID NO: 362696 - DNA, 25 bp, Mus musculus
gtagccttctcagacccagcagcgt

SEQ ID NO: 362697 - DNA, 25 bp, Mus musculus
gcaagtagccttctcagacccagca

SEQ ID NO: 362698 - DNA, 25 bp, Mus musculus
cctctctagtcgcaagtagccttct

SEQ ID NO: 362699 - DNA, 25 bp, Mus musculus
atcgctgccacctctattcaggagc

SEQ ID NO: 362700 - DNA, 25 bp, Mus musculus
tcccaccgacctccctacatcgctg

SEQ ID NO: 362701 - DNA, 25 bp, Mus musculus
cgcctcacaggcagtcacgatgctg

SEQ ID NO: 362702 - DNA, 25 bp, Mus musculus
ttcccgactcctctcttcaccagaa

SEQ ID NO: 362703 - DNA, 25 bp, Mus musculus
tcccaccggtaccagacctcccagc

SEQ ID NO: 362704 - DNA, 25 bp, Mus musculus
gatgtcacagcggtagtccgcccgc

SEQ ID NO: 362705 - DNA, 25 bp, Mus musculus
aggcagtcacgatgctgccacaacc

SEQ ID NO: 362706 - DNA, 25 bp, Mus musculus
cacaggcagtcacgatgctgccaca

SEQ ID NO: 362707 - DNA, 25 bp, Mus musculus
ttcaccagaaccctctcccaccgac

SEQ ID NO: 362708 - DNA, 25 bp, Mus musculus
cggcctccgcggtagctaatatggc

SEQ ID NO: 362709 - DNA, 25 bp, Mus musculus
tagaacaggagtaactaggcgcgga

SEQ ID NO: 362710 - DNA, 25 bp, Mus musculus
cagtcggggaagaccacggctgaat

SEQ ID NO: 362711 - DNA, 25 bp, Mus musculus
agacggcacttgttgcccggggcaa

SEQ ID NO: 362712 - DNA, 25 bp, Mus musculus
tacaggaagcgagacggcacttgtt

SEQ ID NO: 362713 - DNA, 25 bp, Mus musculus
caggatttaaatcaatacaggaagc

SEQ ID NO: 362714 - DNA, 25 bp, Mus musculus
tgggacgtccttcaggatttaaatc

SEQ ID NO: 362715 - DNA, 25 bp, Mus musculus
cagctcgggagtatgggacgtcctt

SEQ ID NO: 362716 - DNA, 25 bp, Mus musculus
ctagacactcccactctgtgccgtg

SEQ ID NO: 362717 - DNA, 25 bp, Mus musculus
caaggttttccgtgggcaagccacg

SEQ ID NO: 362718 - DNA, 25 bp, Mus musculus
gcggtagctaatatggcggaactca

SEQ ID NO: 362719 - DNA, 25 bp, Mus musculus
gggacgactagaacaggagtaacta

SEQ ID NO: 362720 - DNA, 25 bp, Mus musculus
ccctgaagctatgattcactcaaca

SEQ ID NO: 362721 - DNA, 25 bp, Mus musculus
gcggaactcagtggcaacccgactc

SEQ ID NO: 362722 - DNA, 25 bp, Mus musculus
agctataatcctttcgacgatgacg

SEQ ID NO: 362723 - DNA, 25 bp, Mus musculus
cgatgacgtggaagaggaagacacc

SEQ ID NO: 362724 - DNA, 25 bp, Mus musculus
tctggctatcctaaaagctataatc

SEQ ID NO: 362725 - DNA, 25 bp, Mus musculus
tggaagaggaagacacccggcccgc

SEQ ID NO: 362726 - DNA, 25 bp, Mus musculus
gtggaaggacgtccgcgacctgcct

SEQ ID NO: 362727 - DNA, 25 bp, Mus musculus
acgcgcccattgacaggcagcagta

SEQ ID NO: 362728 - DNA, 25 bp, Mus musculus
acaggcagcagtacctgagacagga

SEQ ID NO: 362729 - DNA, 25 bp, Mus musculus
tacctgagacaggaggtgttgcgca

SEQ ID NO: 362730 - DNA, 25 bp, Mus musculus
cgctgccagtaccagcaggtccttg

SEQ ID NO: 362731 - DNA, 25 bp, Mus musculus
ggtccttgtctctcatgtatgaatc

SEQ ID NO: 362732 - DNA, 25 bp, Mus musculus
ctcatgtatgaatcggagaagatcg

SEQ ID NO: 362733 - DNA, 25 bp, Mus musculus
cggagaagatcggagtcgcctcttc

SEQ ID NO: 362734 - DNA, 25 bp, Mus musculus
tcctgcttcctaggtgcaggccgtc

SEQ ID NO: 362735 - DNA, 25 bp, Mus musculus
ccgcaccatgtctggctatcctaaa

SEQ ID NO: 362736 - DNA, 25 bp, Mus musculus
actatgtactgtccgtgtccgagaa

SEQ ID NO: 362737 - DNA, 25 bp, Mus musculus
ttcccaagcaagagagccgcagacg

SEQ ID NO: 362738 - DNA, 25 bp, Mus musculus
actcctgattggcagcgcccagtga

SEQ ID NO: 362739 - DNA, 25 bp, Mus musculus
ccgcgtccgccattttgttgctgtg

SEQ ID NO: 362740 - DNA, 25 bp, Mus musculus
tactccggccagctgagaagcccga

SEQ ID NO: 362741 - DNA, 25 bp, Mus musculus
acgtcctgaccaagccctctgattg

SEQ ID NO: 362742 - DNA, 25 bp, Mus musculus
ctcgaagtgttctgagaggcccttc

SEQ ID NO: 362743 - DNA, 25 bp, Mus musculus
gccgacagcgggtaaaggcttccca

SEQ ID NO: 362744 - DNA, 25 bp, Mus musculus
atggcatgttcctagtccgggactc

SEQ ID NO: 362745 - DNA, 25 bp, Mus musculus
gccgctttaagatcggggaccagga

SEQ ID NO: 362746 - DNA, 25 bp, Mus musculus
accaggagtttgaccatttgccggc

SEQ ID NO: 362747 - DNA, 25 bp, Mus musculus
ttgccggccttgttagagttctaca

SEQ ID NO: 362748 - DNA, 25 bp, Mus musculus
cctccgccaggtttgattcttcaga

SEQ ID NO: 362749 - DNA, 25 bp, Mus musculus
tcagaccgctctgcctggtacatgg

SEQ ID NO: 362750 - DNA, 25 bp, Mus musculus
tccgagcgtggactttgaccacagc

SEQ ID NO: 362751 - DNA, 25 bp, Mus musculus
tcccgccctgtgacgaattcgtggg

SEQ ID NO: 362752 - DNA, 25 bp, Mus musculus
cctgaacaagggatggctggctccg

SEQ ID NO: 362753 - DNA, 25 bp, Mus musculus
ttcgaaacagtgcatcgctggcggc

SEQ ID NO: 362754 - DNA, 25 bp, Mus musculus
gctcaactttggacccttcgaaaca

SEQ ID NO: 362755 - DNA, 25 bp, Mus musculus
gtcgagtacctgacgctcaactttg

SEQ ID NO: 362756 - DNA, 25 bp, Mus musculus
gccttgacaggaggggtacgctcca

SEQ ID NO: 362757 - DNA, 25 bp, Mus musculus
caaaccggccggaagtgctacacca

SEQ ID NO: 362758 - DNA, 25 bp, Mus musculus
tggcggcctatccagcctgaacaag

SEQ ID NO: 362759 - DNA, 25 bp, Mus musculus
tgaccacagctgctcagacagtgtc

SEQ ID NO: 362760 - DNA, 25 bp, Mus musculus
tgggaagtgtagtcctttggctctg

SEQ ID NO: 362761 - DNA, 25 bp, Mus musculus
aggttcctcgatagcgagccgcgtc

SEQ ID NO: 362762 - DNA, 25 bp, Mus musculus
tgagtcctgcaacctggcggcctat

SEQ ID NO: 362763 - DNA, 25 bp, Mus musculus
cgatatacgataatgcgaggagccg

SEQ ID NO: 362764 - DNA, 25 bp, Mus musculus
tccctgttttgtttgagcgtctgtc

SEQ ID NO: 362765 - DNA, 25 bp, Mus musculus
gttcaagcctcacatcgacctcggg

SEQ ID NO: 362766 - DNA, 25 bp, Mus musculus
aagcgccgtctcctgcgaggcctaa

SEQ ID NO: 362767 - DNA, 25 bp, Mus musculus
gaggactgtcttcacgcccaactgt

SEQ ID NO: 362768 - DNA, 25 bp, Mus musculus
accagtcttgtcctagctcgttcta

SEQ ID NO: 362769 - DNA, 25 bp, Mus musculus
gttctatagactcccgtcagcggta

SEQ ID NO: 362770 - DNA, 25 bp, Mus musculus
cagcggtactcacggtcttgccatt

SEQ ID NO: 362771 - DNA, 25 bp, Mus musculus
cgccgccaaaatctcgcgatgggtg

SEQ ID NO: 362772 - DNA, 25 bp, Mus musculus
gagcagagatactccgtcgcccgtg

SEQ ID NO: 362773 - DNA, 25 bp, Mus musculus
gctcccgagttgaggtttctgcatc

SEQ ID NO: 362774 - DNA, 25 bp, Mus musculus
ctgcatctgtagtttcgggtccctg

SEQ ID NO: 362775 - DNA, 25 bp, Mus musculus
tctgtcgtttggacgaagcagctgg

SEQ ID NO: 362776 - DNA, 25 bp, Mus musculus
ttttccggctggactcgagactatg

SEQ ID NO: 362777 - DNA, 25 bp, Mus musculus
tgtggtctgtactgctccctgaaca

SEQ ID NO: 362778 - DNA, 25 bp, Mus musculus
cccactagtttacaacgcctgcgtg

SEQ ID NO: 362779 - DNA, 25 bp, Mus musculus
cacatcactggttgggttctgtaca

SEQ ID NO: 362780 - DNA, 25 bp, Mus musculus
gcctcacgactcacatcactggttg

SEQ ID NO: 362781 - DNA, 25 bp, Mus musculus
cactggttgggttctgtacagggtc

SEQ ID NO: 362782 - DNA, 25 bp, Mus musculus
cgttcccgcagcagcggtccctcca

SEQ ID NO: 362783 - DNA, 25 bp, Mus musculus
agcggtccctccagacccgctatga

SEQ ID NO: 362784 - DNA, 25 bp, Mus musculus
agacccgctatgacccacctgctgt

SEQ ID NO: 362785 - DNA, 25 bp, Mus musculus
tatgacccacctgctgtcgccgtcg

SEQ ID NO: 362786 - DNA, 25 bp, Mus musculus
ccgtcgctgccaccgtgcgcactgc

SEQ ID NO: 362787 - DNA, 25 bp, Mus musculus
agataaacccgagcctcacgactca

SEQ ID NO: 362788 - DNA, 25 bp, Mus musculus
aggcgccagataaacccgagcctca

SEQ ID NO: 362789 - DNA, 25 bp, Mus musculus
gctgccaggcgccagataaacccga

SEQ ID NO: 362790 - DNA, 25 bp, Mus musculus
tttacaacgcctgcgtgcagggccc

SEQ ID NO: 362791 - DNA, 25 bp, Mus musculus
acgactcacatcactggttgggttc

SEQ ID NO: 362792 - DNA, 25 bp, Mus musculus
tgtgctatcagcacggcaggtgagt

SEQ ID NO: 362793 - DNA, 25 bp, Mus musculus
atggcggctcccttctctgagaagc

SEQ ID NO: 362794 - DNA, 25 bp, Mus musculus
tcgagatttgtgctatcagcacggc

SEQ ID NO: 362795 - DNA, 25 bp, Mus musculus
cagcttgatgacgacattaggcgcc

SEQ ID NO: 362796 - DNA, 25 bp, Mus musculus
agcccagcaccgtgcggttttctcg

SEQ ID NO: 362797 - DNA, 25 bp, Mus musculus
gaggctggctccgttcctcctcgag

SEQ ID NO: 362798 - DNA, 25 bp, Mus musculus
gctccgttcctcctcgagctgtggg

SEQ ID NO: 362799 - DNA, 25 bp, Mus musculus
gggacttgggcctcccgacagctcg

SEQ ID NO: 362800 - DNA, 25 bp, Mus musculus
cgagtgtccgaatggcggctccctt

SEQ ID NO: 362801 - DNA, 25 bp, Mus musculus
acgccgctctccagggtcatggctt

SEQ ID NO: 362802 - DNA, 25 bp, Mus musculus
ctccagggtcatggctttctgccgc

SEQ ID NO: 362803 - DNA, 25 bp, Mus musculus
ttcctgcgtggtcctcgcagacggt

SEQ ID NO: 362804 - DNA, 25 bp, Mus musculus
acattaggcgccgagtgtccgaatg

SEQ ID NO: 362805 - DNA, 25 bp, Mus musculus
tgagaagctcgagatttgtgctatc

SEQ ID NO: 362806 - DNA, 25 bp, Mus musculus
cgctacgccagtcggtctcctgccc

SEQ ID NO: 362807 - DNA, 25 bp, Mus musculus
cggaagccgagcgatcccgctactg

SEQ ID NO: 362808 - DNA, 25 bp, Mus musculus
agcggacaccgcagcttctgaccag

SEQ ID NO: 362809 - DNA, 25 bp, Mus musculus
aagccgagcgatcccgctactgggc

SEQ ID NO: 362810 - DNA, 25 bp, Mus musculus
tcttgtagcccgagtccctaccggc

SEQ ID NO: 362811 - DNA, 25 bp, Mus musculus
cttctgccgaaaggcggcgctacgc

SEQ ID NO: 362812 - DNA, 25 bp, Mus musculus
cagcttctgccgaaaggcggcgcta

SEQ ID NO: 362813 - DNA, 25 bp, Mus musculus
tggctgaccagcttctgccgaaagg

SEQ ID NO: 362814 - DNA, 25 bp, Mus musculus
ctcacatttggctgaccagcttctg

SEQ ID NO: 362815 - DNA, 25 bp, Mus musculus
caggccacactcacatttggctgac

SEQ ID NO: 362816 - DNA, 25 bp, Mus musculus
aagagcgggtctagcccggcctcac

SEQ ID NO: 362817 - DNA, 25 bp, Mus musculus
ctgaccagggtcaagagcgggtcta

SEQ ID NO: 362818 - DNA, 25 bp, Mus musculus
ccgcagcttctgaccagggtcaaga

SEQ ID NO: 362819 - DNA, 25 bp, Mus musculus
tctaccacagcgacaggcccgaacc

SEQ ID NO: 362820 - DNA, 25 bp, Mus musculus
ctaaggggtagagacctacaggttg

SEQ ID NO: 362821 - DNA, 25 bp, Mus musculus
tagagacctacaggttgtgcacaac

SEQ ID NO: 362822 - DNA, 25 bp, Mus musculus
ttgtgcacaactgagttaagatccc

SEQ ID NO: 362823 - DNA, 25 bp, Mus musculus
ttttgatagtttcaggcagtcccta

SEQ ID NO: 362824 - DNA, 25 bp, Mus musculus
tcccgctaagctgcctctgggagac

SEQ ID NO: 362825 - DNA, 25 bp, Mus musculus
ccacaccctgctgcctctgttgcca

SEQ ID NO: 362826 - DNA, 25 bp, Mus musculus
ctctgttgccaccacctccgtgggc

SEQ ID NO: 362827 - DNA, 25 bp, Mus musculus
tgaatcattatgtaaatctctgttt

SEQ ID NO: 362828 - DNA, 25 bp, Mus musculus
tgtggacactaagccagtttaccag

SEQ ID NO: 362829 - DNA, 25 bp, Mus musculus
ccagtttaccagaacctgaggcaga

SEQ ID NO: 362830 - DNA, 25 bp, Mus musculus
tgaggcagaaggtggataacacatc

SEQ ID NO: 362831 - DNA, 25 bp, Mus musculus
ggtggataacacatctggacaaaca

SEQ ID NO: 362832 - DNA, 25 bp, Mus musculus
taacacatctggacaaacaggaatg

SEQ ID NO: 362833 - DNA, 25 bp, Mus musculus
tcaatcccgctaagctgcctctggg

SEQ ID NO: 362834 - DNA, 25 bp, Mus musculus
gtgaaagccaccagcagcaagcatg

SEQ ID NO: 362835 - DNA, 25 bp, Mus musculus
cctactccaagagggctgcagagtc

SEQ ID NO: 362836 - DNA, 25 bp, Mus musculus
cgcggtcagccggagaatgcaagat

SEQ ID NO: 362837 - DNA, 25 bp, Mus musculus
ggcaccttctgagtgggcaccatga

SEQ ID NO: 362838 - DNA, 25 bp, Mus musculus
cgcctgcagcggacaaaagtggaca

SEQ ID NO: 362839 - DNA, 25 bp, Mus musculus
caccgacccggcatagagaactaca

SEQ ID NO: 362840 - DNA, 25 bp, Mus musculus
accacgtgggtctgtttgcaattta

SEQ ID NO: 362841 - DNA, 25 bp, Mus musculus
ggttcccagaaagcgcgagtaagca

SEQ ID NO: 362842 - DNA, 25 bp, Mus musculus
taaaggtccacgtacgcctcgcaac

SEQ ID NO: 362843 - DNA, 25 bp, Mus musculus
ccctgcttgaagcatggccactaaa

SEQ ID NO: 362844 - DNA, 25 bp, Mus musculus
ggggaccgcaacttccctgcttgaa

SEQ ID NO: 362845 - DNA, 25 bp, Mus musculus
cacgtccaggcctcgctagtaaaca

SEQ ID NO: 362846 - DNA, 25 bp, Mus musculus
tgcaatttacaaacgtcgcgactcg

SEQ ID NO: 362847 - DNA, 25 bp, Mus musculus
tgcgactagtgactgccaacgtgtg

SEQ ID NO: 362848 - DNA, 25 bp, Mus musculus
ggacagcggatccttcggaagagca

SEQ ID NO: 362849 - DNA, 25 bp, Mus musculus
ctgcttcctagggtaaggcctgatc

SEQ ID NO: 362850 - DNA, 25 bp, Mus musculus
ctgtacaggccgaacgaacggacct

SEQ ID NO: 362851 - DNA, 25 bp, Mus musculus
tactagtttagatcctgtacaggcc

SEQ ID NO: 362852 - DNA, 25 bp, Mus musculus
gcaagcgctgtcagtgcaaaatccc

SEQ ID NO: 362853 - DNA, 25 bp, Mus musculus
gtgacctcaagctcatcagccgcgg

SEQ ID NO: 362854 - DNA, 25 bp, Mus musculus
agagcagccggggtctgacccttca

SEQ ID NO: 362855 - DNA, 25 bp, Mus musculus
tcgagcagggattgcaacaggcagc

SEQ ID NO: 362856 - DNA, 25 bp, Mus musculus
cgtccctcgaagctattcgagcagg

SEQ ID NO: 362857 - DNA, 25 bp, Mus musculus
ccttcttcgccgagcttgtgctgca

SEQ ID NO: 362858 - DNA, 25 bp, Mus musculus
accaggtcagctgcgaggcatgtac

SEQ ID NO: 362859 - DNA, 25 bp, Mus musculus
ctcagcttgcggcagcaccaggtca

SEQ ID NO: 362860 - DNA, 25 bp, Mus musculus
gcatcccacgtgacggagaggctcc

SEQ ID NO: 362861 - DNA, 25 bp, Mus musculus
tgatctccgagatgctcctcgtccg

SEQ ID NO: 362862 - DNA, 25 bp, Mus musculus
cggagcttattgacgagtccctgta

SEQ ID NO: 362863 - DNA, 25 bp, Mus musculus
atggttccgcccagcatggtcacgt

SEQ ID NO: 362864 - DNA, 25 bp, Mus musculus
ccctgtagacgaaaacacggtgagc

SEQ ID NO: 362865 - DNA, 25 bp, Mus musculus
ttccgctttgaggtactcgctgctc

SEQ ID NO: 362866 - DNA, 25 bp, Mus musculus
atctgtcccgagtatacggagctta

SEQ ID NO: 362867 - DNA, 25 bp, Mus musculus
cggacctgttcttggagctgtcgca

SEQ ID NO: 362868 - DNA, 25 bp, Mus musculus
ctagtcgcgacgatggttccgccca

SEQ ID NO: 362869 - DNA, 25 bp, Mus musculus
tctccggctcttaggacagtcctgg

SEQ ID NO: 362870 - DNA, 25 bp, Mus musculus
ggaagttgcttctccggctcttagg

SEQ ID NO: 362871 - DNA, 25 bp, Mus musculus
tgggagagacggtcggaaactcttc

SEQ ID NO: 362872 - DNA, 25 bp, Mus musculus
tcttttctctatgggagagacggtc

SEQ ID NO: 362873 - DNA, 25 bp, Mus musculus
cccggttgtgctgtgaatgggatca

SEQ ID NO: 362874 - DNA, 25 bp, Mus musculus
gtagaacatagccacgcccactata

SEQ ID NO: 362875 - DNA, 25 bp, Mus musculus
tgtcgcagcgactctctccatctgt

SEQ ID NO: 362876 - DNA, 25 bp, Mus musculus
gccggctggaccagaaatcacctga

SEQ ID NO: 362877 - DNA, 25 bp, Mus musculus
ggagctactccctaagccaagcaag

SEQ ID NO: 362878 - DNA, 25 bp, Mus musculus
cgagacttggaaggacagatttgtc

SEQ ID NO: 362879 - DNA, 25 bp, Mus musculus
cggacaaggctacactcacggtgga

SEQ ID NO: 362880 - DNA, 25 bp, Mus musculus
gtggaccagaaaccggagtgcttga

SEQ ID NO: 362881 - DNA, 25 bp, Mus musculus
cttgaggacaatgatggacgcgcga

SEQ ID NO: 362882 - DNA, 25 bp, Mus musculus
ctgagaggatcttgctaggaaagcc

SEQ ID NO: 362883 - DNA, 25 bp, Mus musculus
acaggcccagccagaaagcagtgga

SEQ ID NO: 362884 - DNA, 25 bp, Mus musculus
acctgtctgctcgtcggagccacga

SEQ ID NO: 362885 - DNA, 25 bp, Mus musculus
ccacgacgcagtcaaggcatctctg

SEQ ID NO: 362886 - DNA, 25 bp, Mus musculus
catctctgcagaggcgaggaaccca

SEQ ID NO: 362887 - DNA, 25 bp, Mus musculus
tccgaaatcgggtcgagaggacaca

SEQ ID NO: 362888 - DNA, 25 bp, Mus musculus
ccaggggtactatgtggtgtccaaa

SEQ ID NO: 362889 - DNA, 25 bp, Mus musculus
gggcgcctgactagccatctgcttc

SEQ ID NO: 362890 - DNA, 25 bp, Mus musculus
ttctacggcgaaggttgtggccacc

SEQ ID NO: 362891 - DNA, 25 bp, Mus musculus
gctgcgagcatgcttgccaatgcca

SEQ ID NO: 362892 - DNA, 25 bp, Mus musculus
gcttgctattgcagcgctacttccc

SEQ ID NO: 362893 - DNA, 25 bp, Mus musculus
gctacttcccggtgcgatccacaga

SEQ ID NO: 362894 - DNA, 25 bp, Mus musculus
tggggccgcagctgtaacaaccagt

SEQ ID NO: 362895 - DNA, 25 bp, Mus musculus
gcgcccgctgtgatcgctattgcca

SEQ ID NO: 362896 - DNA, 25 bp, Mus musculus
gctattgccagtgctctcacggtcg

SEQ ID NO: 362897 - DNA, 25 bp, Mus musculus
gggcaagtattgtcgcgagccatgc

SEQ ID NO: 362898 - DNA, 25 bp, Mus musculus
gcttcctgacccttccgtaggtgtg

SEQ ID NO: 362899 - DNA, 25 bp, Mus musculus
ccagcagccgtgcacggtagtcgaa

SEQ ID NO: 362900 - DNA, 25 bp, Mus musculus
tcgaaggccgctgtctgacatgcga

SEQ ID NO: 362901 - DNA, 25 bp, Mus musculus
ccggctggaacggaaccaaatgtga

SEQ ID NO: 362902 - DNA, 25 bp, Mus musculus
tacgcactgcaatgcgggctggatc

SEQ ID NO: 362903 - DNA, 25 bp, Mus musculus
tgcaaccatgtcaccggcaagtgta

SEQ ID NO: 362904 - DNA, 25 bp, Mus musculus
tcacgaggaatcatgcgacccggtc

SEQ ID NO: 362905 - DNA, 25 bp, Mus musculus
cccgtgcaaggaaaggaggcattct

SEQ ID NO: 362906 - DNA, 25 bp, Mus musculus
gaggcattctggactcccaaacttt

SEQ ID NO: 362907 - DNA, 25 bp, Mus musculus
tgctcacgctgctcctcggcctgct

SEQ ID NO: 362908 - DNA, 25 bp, Mus musculus
caatcagcgcaaaggtgtgatgggc

SEQ ID NO: 362909 - DNA, 25 bp, Mus musculus
ccacagagaccaatcagcgcaaagg

SEQ ID NO: 362910 - DNA, 25 bp, Mus musculus
cgtgatcctgcgctgagccgctgct

SEQ ID NO: 362911 - DNA, 25 bp, Mus musculus
ggaatcatgcgacccggtcaccggt

SEQ ID NO: 362912 - DNA, 25 bp, Mus musculus
aggcctgcagctgtcacgaggaatc

SEQ ID NO: 362913 - DNA, 25 bp, Mus musculus
ctgctcggttgttgctgcgcctgcc

SEQ ID NO: 362914 - DNA, 25 bp, Mus musculus
ctgtaatgtaacttgcccggccggg

SEQ ID NO: 362915 - DNA, 25 bp, Mus musculus
tcccaaactttgcagctgtaatgta

SEQ ID NO: 362916 - DNA, 25 bp, Mus musculus
ctgctgctctcgctgctcggttgtt

SEQ ID NO: 362917 - DNA, 25 bp, Mus musculus
accggtgcctgccacctgggtgagt

SEQ ID NO: 362918 - DNA, 25 bp, Mus musculus
cctaaggtgtcctggatccacggca

SEQ ID NO: 362919 - DNA, 25 bp, Mus musculus
agaccctgccaccaagcctaaggtg

SEQ ID NO: 362920 - DNA, 25 bp, Mus musculus
cgagcgctccgcatcaagcgtggag

SEQ ID NO: 362921 - DNA, 25 bp, Mus musculus
gacctggaagcgactgccgctctca

SEQ ID NO: 362922 - DNA, 25 bp, Mus musculus
aggaggcagcggtcctccctgcatc

SEQ ID NO: 362923 - DNA, 25 bp, Mus musculus
gctgtgtccttagagcccacgggca

SEQ ID NO: 362924 - DNA, 25 bp, Mus musculus
ccgctctcactgaggtggccgctgt

SEQ ID NO: 362925 - DNA, 25 bp, Mus musculus
caggaggctttctcaccaccatttc

SEQ ID NO: 362926 - DNA, 25 bp, Mus musculus
ccaagcctgcgtctggttggcctag

SEQ ID NO: 362927 - DNA, 25 bp, Mus musculus
cggccgcagcgaaggcatttcattg

SEQ ID NO: 362928 - DNA, 25 bp, Mus musculus
aggccgcctctatgctggcagctga

SEQ ID NO: 362929 - DNA, 25 bp, Mus musculus
tgcgcgacaagactcgcagcttagg

SEQ ID NO: 362930 - DNA, 25 bp, Mus musculus
tccagaaaccgcctcggaagaagag

SEQ ID NO: 362931 - DNA, 25 bp, Mus musculus
ggttggcctaggctcaagcagccgc

SEQ ID NO: 362932 - DNA, 25 bp, Mus musculus
gagccgcactcgcagtacttgaagg

SEQ ID NO: 362933 - DNA, 25 bp, Mus musculus
tgcaggaataccttcccgcactggc

SEQ ID NO: 362934 - DNA, 25 bp, Mus musculus
gccgggagctttgcaggaatacctt

SEQ ID NO: 362935 - DNA, 25 bp, Mus musculus
atctgaaggccattgcgcaagtgca

SEQ ID NO: 362936 - DNA, 25 bp, Mus musculus
gccttgctgcactcgtggcatctga

SEQ ID NO: 362937 - DNA, 25 bp, Mus musculus
tgctccacgaggtcggcgctccaga

SEQ ID NO: 362938 - DNA, 25 bp, Mus musculus
gcaccgcgcttgtagggccgatcgc

SEQ ID NO: 362939 - DNA, 25 bp, Mus musculus
gtgcgtgctgaacagcgagctgccc

SEQ ID NO: 362940 - DNA, 25 bp, Mus musculus
ctctcacccgtgtggccgtagaggt

SEQ ID NO: 362941 - DNA, 25 bp, Mus musculus
gatctcctcgtgcacggtgagcgaa

SEQ ID NO: 362942 - DNA, 25 bp, Mus musculus
ttgtggccacggtggatctcctcgt

SEQ ID NO: 362943 - DNA, 25 bp, Mus musculus
tacttgaagggcatgtcgccgtgtg

SEQ ID NO: 362944 - DNA, 25 bp, Mus musculus
cgcactcgaagcaccggaacgactt

SEQ ID NO: 362945 - DNA, 25 bp, Mus musculus
ccagcacttgagtggcttgtggcca

SEQ ID NO: 362946 - DNA, 25 bp, Mus musculus
gcggtgcttctacagattcctcaga

SEQ ID NO: 362947 - DNA, 25 bp, Mus musculus
ctcggcacggtgaacgcgttggttt

SEQ ID NO: 362948 - DNA, 25 bp, Mus musculus
gtgaacgcgttggtttcgtcctcca

SEQ ID NO: 362949 - DNA, 25 bp, Mus musculus
tttcgtcctccagggcagcggagaa

SEQ ID NO: 362950 - DNA, 25 bp, Mus musculus
gacagcctggcgaaccgagccatgg

SEQ ID NO: 362951 - DNA, 25 bp, Mus musculus
catggcccgcaagaaccacaagaaa

SEQ ID NO: 362952 - DNA, 25 bp, Mus musculus
cacaagaaaactccagtgcctccag

SEQ ID NO: 362953 - DNA, 25 bp, Mus musculus
tgcctccagcggctgcgcaaagcgg

SEQ ID NO: 362954 - DNA, 25 bp, Mus musculus
actggaggcaaatcggacgatgtgc

SEQ ID NO: 362955 - DNA, 25 bp, Mus musculus
cgatgtgcggtgcttctacagattc

SEQ ID NO: 362956 - DNA, 25 bp, Mus musculus
gagctcgcagcccaacgggccggtt

SEQ ID NO: 362957 - DNA, 25 bp, Mus musculus
tacagattcctcagatgccgccagc

SEQ ID NO: 362958 - DNA, 25 bp, Mus musculus
gtcgttcccacagacgtcccagggc

SEQ ID NO: 362959 - DNA, 25 bp, Mus musculus
caaatcggacgatgtgcggtgcttc

SEQ ID NO: 362960 - DNA, 25 bp, Mus musculus
ctcctggccagtgggtcccagagca

SEQ ID NO: 362961 - DNA, 25 bp, Mus musculus
tggacctgggtctaaaggcaacatc

SEQ ID NO: 362962 - DNA, 25 bp, Mus musculus
aggcaacatcctcgaggctccgaac

SEQ ID NO: 362963 - DNA, 25 bp, Mus musculus
ccgaaccctggtacactccaatttg

SEQ ID NO: 362964 - DNA, 25 bp, Mus musculus
cgtgccattggctgaaccgagaggt

SEQ ID NO: 362965 - DNA, 25 bp, Mus musculus
catgagcacgagaggcctagggaat

SEQ ID NO: 362966 - DNA, 25 bp, Mus musculus
atgagattccggctcgcgcaagatg

SEQ ID NO: 362967 - DNA, 25 bp, Mus musculus
gcggcaagagaacgccaccgactcg

SEQ ID NO: 362968 - DNA, 25 bp, Mus musculus
gggcaccatttatcctccgttcatc

SEQ ID NO: 362969 - DNA, 25 bp, Mus musculus
ggctcggtgacagtgagaaccagca

SEQ ID NO: 362970 - DNA, 25 bp, Mus musculus
cactccaatttgtgccagggcaggg

SEQ ID NO: 362971 - DNA, 25 bp, Mus musculus
ctagcaggaaatgaggcgtgccatt

SEQ ID NO: 362972 - DNA, 25 bp, Mus musculus
cagcaggaaggcaccgctgtctgcc

SEQ ID NO: 362973 - DNA, 25 bp, Mus musculus
gcactaaccaatgaacgccgagctg

SEQ ID NO: 362974 - DNA, 25 bp, Mus musculus
acgcatctacattgtcatggagctg

SEQ ID NO: 362975 - DNA, 25 bp, Mus musculus
ggatgtggcacgcaagatgttccgc

SEQ ID NO: 362976 - DNA, 25 bp, Mus musculus
gcacgcaagatgttccgccagctct

SEQ ID NO: 362977 - DNA, 25 bp, Mus musculus
gccagctctcctcagccgtcaagta

SEQ ID NO: 362978 - DNA, 25 bp, Mus musculus
agccgtcaagtactgccacgacctg

SEQ ID NO: 362979 - DNA, 25 bp, Mus musculus
actgccacgacctggatgtcgtcca

SEQ ID NO: 362980 - DNA, 25 bp, Mus musculus
tcaagtgccgaggagccctgcatga

SEQ ID NO: 362981 - DNA, 25 bp, Mus musculus
agggcgacctcctcgagttcatcaa

SEQ ID NO: 362982 - DNA, 25 bp, Mus musculus
cgagttcatcaagtgccgaggagcc

SEQ ID NO: 362983 - DNA, 25 bp, Mus musculus
gtcaaccaccgttccatcattaaga

SEQ ID NO: 362984 - DNA, 25 bp, Mus musculus
cgttccatcattaagacctacgaga

SEQ ID NO: 362985 - DNA, 25 bp, Mus musculus
agacctacgagatctttgagacctc

SEQ ID NO: 362986 - DNA, 25 bp, Mus musculus
ctttgagacctctgatggacgcatc

SEQ ID NO: 362987 - DNA, 25 bp, Mus musculus
tgatggacgcatctacattgtcatg

SEQ ID NO: 362988 - DNA, 25 bp, Mus musculus
cgccagcgctcgcactgagctggta

SEQ ID NO: 362989 - DNA, 25 bp, Mus musculus
atcccagaatcgctcgggcggcgtc

SEQ ID NO: 362990 - DNA, 25 bp, Mus musculus
agaaacagagcacccgccgaggtcc

SEQ ID NO: 362991 - DNA, 25 bp, Mus musculus
gaggacagaaacagagcacccgccg

SEQ ID NO: 362992 - DNA, 25 bp, Mus musculus
acgcggaggacagaaacagagcacc

SEQ ID NO: 362993 - DNA, 25 bp, Mus musculus
cagccgcgcgcttccttgagggcgc

SEQ ID NO: 362994 - DNA, 25 bp, Mus musculus
gcttctcgcaactccggcctctcca

SEQ ID NO: 362995 - DNA, 25 bp, Mus musculus
aggacccgctgcctgcttctcgcaa

SEQ ID NO: 362996 - DNA, 25 bp, Mus musculus
tgtactcttcttcatccaggacccg

SEQ ID NO: 362997 - DNA, 25 bp, Mus musculus
ctggtacctcgatgtactcttcttc

SEQ ID NO: 362998 - DNA, 25 bp, Mus musculus
actgagctggtacctcgatgtactc

SEQ ID NO: 362999 - DNA, 25 bp, Mus musculus
cgctcgcactgagctggtacctcga

SEQ ID NO: 363000 - DNA, 25 bp, Mus musculus
cggaagtcgccagcgctcgcactga

SEQ ID NO: 363001 - DNA, 25 bp, Mus musculus
cgcactgagctggtacctcgatgta

SEQ ID NO: 363002 - DNA, 25 bp, Mus musculus
acgactcaaaaatgtgtcgcggccg

SEQ ID NO: 363003 - DNA, 25 bp, Mus musculus
cttggtcacgactcaaaaatgtgtc

SEQ ID NO: 363004 - DNA, 25 bp, Mus musculus
ggagggagtttccacttggtcacga

SEQ ID NO: 363005 - DNA, 25 bp, Mus musculus
tgggattcccgcctccgcggaggct

SEQ ID NO: 363006 - DNA, 25 bp, Mus musculus
cattcatatttatgagccggtgggg

SEQ ID NO: 363007 - DNA, 25 bp, Mus musculus
gcgcccagtcgcctcattcatattt

SEQ ID NO: 363008 - DNA, 25 bp, Mus musculus
gatatgctaacacttccgcgcccag

SEQ ID NO: 363009 - DNA, 25 bp, Mus musculus
cagggctgggatatgctaacacttc

SEQ ID NO: 363010 - DNA, 25 bp, Mus musculus
ggacgcccgaggctagccaacgccc

SEQ ID NO: 363011 - DNA, 25 bp, Mus musculus
gtggagaacacacaagaggtcagct

SEQ ID NO: 363012 - DNA, 25 bp, Mus musculus
cgcgacaggcagtggagaacacaca

SEQ ID NO: 363013 - DNA, 25 bp, Mus musculus
acacctacggactgccgcgagctcc

SEQ ID NO: 363014 - DNA, 25 bp, Mus musculus
gcgggacaaagcttagccacaccta

SEQ ID NO: 363015 - DNA, 25 bp, Mus musculus
aaagcttagccacacctacggactg

SEQ ID NO: 363016 - DNA, 25 bp, Mus musculus
ctccttgacggccacgccaatatgg

SEQ ID NO: 363017 - DNA, 25 bp, Mus musculus
tacgaagtcttcacggcactcgggc

SEQ ID NO: 363018 - DNA, 25 bp, Mus musculus
cagtcacagccagtacgaagtcttc

SEQ ID NO: 363019 - DNA, 25 bp, Mus musculus
gccttcttgccagtcacagccagta

SEQ ID NO: 363020 - DNA, 25 bp, Mus musculus
tggacagcacacagcctggcgcctt

SEQ ID NO: 363021 - DNA, 25 bp, Mus musculus
ttctggtccgggttggacagcacac

SEQ ID NO: 363022 - DNA, 25 bp, Mus musculus
gcaggcagtcgatgcgccgcatctt

SEQ ID NO: 363023 - DNA, 25 bp, Mus musculus
gctcccgcacaaagtaggccaggta

SEQ ID NO: 363024 - DNA, 25 bp, Mus musculus
cttctgcttcacttcggccttttca

SEQ ID NO: 363025 - DNA, 25 bp, Mus musculus
gccaggtacaggtccagctccttga

SEQ ID NO: 363026 - DNA, 25 bp, Mus musculus
atctgtgctctccagtgggatgccc

SEQ ID NO: 363027 - DNA, 25 bp, Mus musculus
cgccaatatggtgcggctgcacaca

SEQ ID NO: 363028 - DNA, 25 bp, Mus musculus
tgcccttgaacaggatgaccatgac

SEQ ID NO: 363029 - DNA, 25 bp, Mus musculus
aggtccagacgccacactttgtcgg

SEQ ID NO: 363030 - DNA, 25 bp, Mus musculus
tcctcgctgaagatggtacggtggc

SEQ ID NO: 363031 - DNA, 25 bp, Mus musculus
aagagtgcctcgagcgcctgcagct

SEQ ID NO: 363032 - DNA, 25 bp, Mus musculus
gagcctgctctaggcgccgtcaagg

SEQ ID NO: 363033 - DNA, 25 bp, Mus musculus
gcgcaagaggcggaatatatacata

SEQ ID NO: 363034 - DNA, 25 bp, Mus musculus
ccgcgccctcatcgagtgatcatag

SEQ ID NO: 363035 - DNA, 25 bp, Mus musculus
taatcccgtcgccagtcctcagaga

SEQ ID NO: 363036 - DNA, 25 bp, Mus musculus
ctgcagctgctcctcgctgaagatg

SEQ ID NO: 363037 - DNA, 25 bp, Mus musculus
actggttctgtacgaagagtgcctc

SEQ ID NO: 363038 - DNA, 25 bp, Mus musculus
cctacgtcgggatactggttctgta

SEQ ID NO: 363039 - DNA, 25 bp, Mus musculus
accgccaagcgttcgcgtgtgccta

SEQ ID NO: 363040 - DNA, 25 bp, Mus musculus
cgctcctctcgcaggcggatgcgga

SEQ ID NO: 363041 - DNA, 25 bp, Mus musculus
tttgaaaaataagagtggcgccgga

SEQ ID NO: 363042 - DNA, 25 bp, Mus musculus
tgtagccggctacgagttgaagccc

SEQ ID NO: 363043 - DNA, 25 bp, Mus musculus
gggtctcccttcagtgtagccggct

SEQ ID NO: 363044 - DNA, 25 bp, Mus musculus
aagtgaattccaagagccctcgctc

SEQ ID NO: 363045 - DNA, 25 bp, Mus musculus
gagtgtctacgaggcgcttccagat

SEQ ID NO: 363046 - DNA, 25 bp, Mus musculus
agcgagctcgggaaaaaccatagga

SEQ ID NO: 363047 - DNA, 25 bp, Mus musculus
gctccggtagtcaggtggttatatc

SEQ ID NO: 363048 - DNA, 25 bp, Mus musculus
gtggttatatcagcgcaatccctgc

SEQ ID NO: 363049 - DNA, 25 bp, Mus musculus
ccctgactataaggtgcgtccttgt

SEQ ID NO: 363050 - DNA, 25 bp, Mus musculus
tgtgatgtcatcaacaagcgccgcc

SEQ ID NO: 363051 - DNA, 25 bp, Mus musculus
aagagctgccttgctccggcttacg

SEQ ID NO: 363052 - DNA, 25 bp, Mus musculus
ttccagattagactggcggccgaga

SEQ ID NO: 363053 - DNA, 25 bp, Mus musculus
gcgctaggtagcacttcttccagaa

SEQ ID NO: 363054 - DNA, 25 bp, Mus musculus
agcgaaactgcaagctccggtagtc

SEQ ID NO: 363055 - DNA, 25 bp, Mus musculus
tcgctcgcacaccaaacggtctgtg

SEQ ID NO: 363056 - DNA, 25 bp, Mus musculus
aacggtctgtgctctccatgctgca

SEQ ID NO: 363057 - DNA, 25 bp, Mus musculus
ttccgaaaccgtggagagcgctagg

SEQ ID NO: 363058 - DNA, 25 bp, Mus musculus
ccgagtgacccacctgctaggattg

SEQ ID NO: 363059 - DNA, 25 bp, Mus musculus
gctgcagctgcgtcttcacgtattc

SEQ ID NO: 363060 - DNA, 25 bp, Mus musculus
gcagatttcgatgcctccagccagg

SEQ ID NO: 363061 - DNA, 25 bp, Mus musculus
aaatgcctggggctagggacaccct

SEQ ID NO: 363062 - DNA, 25 bp, Mus musculus
gcctggagtgcccaagagactctga

SEQ ID NO: 363063 - DNA, 25 bp, Mus musculus
agcgctgtcggacaggctctgagtt

SEQ ID NO: 363064 - DNA, 25 bp, Mus musculus
gggttcgctcgttcatctagctgca

SEQ ID NO: 363065 - DNA, 25 bp, Mus musculus
cggaggctactgagaccacgaccaa

SEQ ID NO: 363066 - DNA, 25 bp, Mus musculus
cacgaccaattctggtccgggaggc

SEQ ID NO: 363067 - DNA, 25 bp, Mus musculus
cgtggtctccggacagcaacgctaa

SEQ ID NO: 363068 - DNA, 25 bp, Mus musculus
caacgctaagccaaggcgggtagca

SEQ ID NO: 363069 - DNA, 25 bp, Mus musculus
tagcagtgggtcaaggtgcagttta

SEQ ID NO: 363070 - DNA, 25 bp, Mus musculus
ttagagacacgtgcgtctggagcgc

SEQ ID NO: 363071 - DNA, 25 bp, Mus musculus
agcgacagcagacgagtggacttag

SEQ ID NO: 363072 - DNA, 25 bp, Mus musculus
cggtgtttgaaatcgtgcagggtct

SEQ ID NO: 363073 - DNA, 25 bp, Mus musculus
agcctctacaaccagagactgcggc

SEQ ID NO: 363074 - DNA, 25 bp, Mus musculus
ggctgcagaacgaacaccgaggtgc

SEQ ID NO: 363075 - DNA, 25 bp, Mus musculus
cacctcactgagaagagcctctaca

SEQ ID NO: 363076 - DNA, 25 bp, Mus musculus
cttctggagattcagcacctcactg

SEQ ID NO: 363077 - DNA, 25 bp, Mus musculus
tcgtgcagggtcttctggagattca

SEQ ID NO: 363078 - DNA, 25 bp, Mus musculus
acagagcctggtcaaggagctgccc

SEQ ID NO: 363079 - DNA, 25 bp, Mus musculus
ctgctgtcagcactacagagcctgg

SEQ ID NO: 363080 - DNA, 25 bp, Mus musculus
caccacggtgaacggccggagaccg

SEQ ID NO: 363081 - DNA, 25 bp, Mus musculus
gagcggcactaccagctgctgtcag

SEQ ID NO: 363082 - DNA, 25 bp, Mus musculus
taaaccgcgcgatggaccgctatgc

SEQ ID NO: 363083 - DNA, 25 bp, Mus musculus
tcgttcgcgctggagaatgacgtga

SEQ ID NO: 363084 - DNA, 25 bp, Mus musculus
ttattgtgcctgacgcaccacggtg

SEQ ID NO: 363085 - DNA, 25 bp, Mus musculus
gctgctcgacggaacggtgtttgaa

SEQ ID NO: 363086 - DNA, 25 bp, Mus musculus
gcacacagccgcagcactagcaggt

SEQ ID NO: 363087 - DNA, 25 bp, Mus musculus
ttggtgaagtccacggctggcacag

SEQ ID NO: 363088 - DNA, 25 bp, Mus musculus
cctcctgcgtgttggtgaagtccac

SEQ ID NO: 363089 - DNA, 25 bp, Mus musculus
ctgcgatacgcctcctgcgtgttgg

SEQ ID NO: 363090 - DNA, 25 bp, Mus musculus
gaccgcagcaagaagacgcgcttga

SEQ ID NO: 363091 - DNA, 25 bp, Mus musculus
agaagacgcgcttgagagccatggc

SEQ ID NO: 363092 - DNA, 25 bp, Mus musculus
gagccatggcggagccgatacacgc

SEQ ID NO: 363093 - DNA, 25 bp, Mus musculus
ccgatacacgcgctcaggaggctta

SEQ ID NO: 363094 - DNA, 25 bp, Mus musculus
gcactagcaggttgcgcaccaactc

SEQ ID NO: 363095 - DNA, 25 bp, Mus musculus
gtggtgccaccgaccgcagcaagaa

SEQ ID NO: 363096 - DNA, 25 bp, Mus musculus
caggaggcttaagtacactgggtta

SEQ ID NO: 363097 - DNA, 25 bp, Mus musculus
cgcacctgctcgtggtgcgctagca

SEQ ID NO: 363098 - DNA, 25 bp, Mus musculus
gtacactgggttagccacgccctgg

SEQ ID NO: 363099 - DNA, 25 bp, Mus musculus
gtgcgctagcagcaccggcgacgca

SEQ ID NO: 363100 - DNA, 25 bp, Mus musculus
gaccgggcggattccgcgcgtcaaa

SEQ ID NO: 363101 - DNA, 25 bp, Mus musculus
gttaatgagcgggtttgcagaaacg

SEQ ID NO: 363102 - DNA, 25 bp, Mus musculus
gaatgcgccgcctttgtctgggacc

SEQ ID NO: 363103 - DNA, 25 bp, Mus musculus
cccgaagatgaagagggcgtcctcc

SEQ ID NO: 363104 - DNA, 25 bp, Mus musculus
tcctccggaggtgagtgtcagcgcc

SEQ ID NO: 363105 - DNA, 25 bp, Mus musculus
gcatggctcacgctgccagagatgg

SEQ ID NO: 363106 - DNA, 25 bp, Mus musculus
ctggccgctagcaactgggccctgg

SEQ ID NO: 363107 - DNA, 25 bp, Mus musculus
gtacgaggttccagatgttggacca

SEQ ID NO: 363108 - DNA, 25 bp, Mus musculus
cggcagccgcaaaagttgcggcttt

SEQ ID NO: 363109 - DNA, 25 bp, Mus musculus
tttgcagaaacgtgggcaccggacc

SEQ ID NO: 363110 - DNA, 25 bp, Mus musculus
caaaagttgcggctttgcgggaaag

SEQ ID NO: 363111 - DNA, 25 bp, Mus musculus
cataaaacattcatcctctcctggc

SEQ ID NO: 363112 - DNA, 25 bp, Mus musculus
gcgcgtcaaaccacatgatcccata

SEQ ID NO: 363113 - DNA, 25 bp, Mus musculus
gcggggtcccacctgagagcgcaaa

SEQ ID NO: 363114 - DNA, 25 bp, Mus musculus
ccgactcacgtgaatacgaagaaga

SEQ ID NO: 363115 - DNA, 25 bp, Mus musculus
tgctaatccgcccagcccaccgccg

SEQ ID NO: 363116 - DNA, 25 bp, Mus musculus
gctgctaccaggctctggacccggc

SEQ ID NO: 363117 - DNA, 25 bp, Mus musculus
cggcgccgactcacgtgaatacgaa

SEQ ID NO: 363118 - DNA, 25 bp, Mus musculus
tcacgtgaatacgaagaagagtgtg

SEQ ID NO: 363119 - DNA, 25 bp, Mus musculus
gagtgtgctggaaccaaccaacagc

SEQ ID NO: 363120 - DNA, 25 bp, Mus musculus
ctggaaccaaccaacagcgcggcgg

SEQ ID NO: 363121 - DNA, 25 bp, Mus musculus
cggccgtggccaccgggatgtactt

SEQ ID NO: 363122 - DNA, 25 bp, Mus musculus
cgggcggccaactcctcttttgcgg

SEQ ID NO: 363123 - DNA, 25 bp, Mus musculus
gccaactcctcttttgcggggtagc

SEQ ID NO: 363124 - DNA, 25 bp, Mus musculus
tcctcttttgcggggtagcccgaca

SEQ ID NO: 363125 - DNA, 25 bp, Mus musculus
agcgcccatctggaccgacaggaca

SEQ ID NO: 363126 - DNA, 25 bp, Mus musculus
ccctcgccgcaacctgctaatccgc

SEQ ID NO: 363127 - DNA, 25 bp, Mus musculus
ggacccggcgccgactcacgtgaat

SEQ ID NO: 363128 - DNA, 25 bp, Mus musculus
tgacgtcatcggaaccaagccctta

SEQ ID NO: 363129 - DNA, 25 bp, Mus musculus
tctgcgtgcaactggaaggaggatt

SEQ ID NO: 363130 - DNA, 25 bp, Mus musculus
tgtcctaatgaatgaaggggtctgc

SEQ ID NO: 363131 - DNA, 25 bp, Mus musculus
gtcccagctctgagcacccgagttt

SEQ ID NO: 363132 - DNA, 25 bp, Mus musculus
cccttagagagaggagacgcagcta

SEQ ID NO: 363133 - DNA, 25 bp, Mus musculus
acccgagttttgagtccctgtgtgg

SEQ ID NO: 363134 - DNA, 25 bp, Mus musculus
gctccgacagcggacattcattgtc

SEQ ID NO: 363135 - DNA, 25 bp, Mus musculus
cagtgtagctttattggctccgaca

SEQ ID NO: 363136 - DNA, 25 bp, Mus musculus
cgcgcagtgattcaaaaccagtgta

SEQ ID NO: 363137 - DNA, 25 bp, Mus musculus
tcgactagctcaggcgtcgctggct

SEQ ID NO: 363138 - DNA, 25 bp, Mus musculus
tgttcatccgcagaccacaaggtca

SEQ ID NO: 363139 - DNA, 25 bp, Mus musculus
cccagtttgggcatggctgttcatc

SEQ ID NO: 363140 - DNA, 25 bp, Mus musculus
ctaatgggaagatcacaagtgggcc

SEQ ID NO: 363141 - DNA, 25 bp, Mus musculus
tggggacagtgcatccgcaaacctc

SEQ ID NO: 363142 - DNA, 25 bp, Mus musculus
ggccttggcggagggctaccaatca

SEQ ID NO: 363143 - DNA, 25 bp, Mus musculus
cggcccaattgcgaggcgctatgga

SEQ ID NO: 363144 - DNA, 25 bp, Mus musculus
gaaggcccttgcaaagcgctcggct

SEQ ID NO: 363145 - DNA, 25 bp, Mus musculus
ggcgttgaggtgtccctgcccacac

SEQ ID NO: 363146 - DNA, 25 bp, Mus musculus
agccgcaagcctggcacttctaacg

SEQ ID NO: 363147 - DNA, 25 bp, Mus musculus
agggctaccaatcacggcgcacggc

SEQ ID NO: 363148 - DNA, 25 bp, Mus musculus
agcgctcggctcttgagacccgctg

SEQ ID NO: 363149 - DNA, 25 bp, Mus musculus
acaacccgcgaaggcccttgcaaag

SEQ ID NO: 363150 - DNA, 25 bp, Mus musculus
ctacgttcatgatgcctgggctccg

SEQ ID NO: 363151 - DNA, 25 bp, Mus musculus
aggcagacagcaccctacgttcatg

SEQ ID NO: 363152 - DNA, 25 bp, Mus musculus
gggcttcgttaccaggcagacagca

SEQ ID NO: 363153 - DNA, 25 bp, Mus musculus
gcgaggcaatggcttcgggcccacc

SEQ ID NO: 363154 - DNA, 25 bp, Mus musculus
tctcccgccagaaggcgaggcaatg

SEQ ID NO: 363155 - DNA, 25 bp, Mus musculus
tggcacttctaacggctgtcgctcc

SEQ ID NO: 363156 - DNA, 25 bp, Mus musculus
cgcggccttgttggccgtatgtgct

SEQ ID NO: 363157 - DNA, 25 bp, Mus musculus
ccagagcgctcgctattgggcgcag

SEQ ID NO: 363158 - DNA, 25 bp, Mus musculus
ccgtatgtgctgtcgcttagagata

SEQ ID NO: 363159 - DNA, 25 bp, Mus musculus
gctgtcgcttagagatatagcgctc

SEQ ID NO: 363160 - DNA, 25 bp, Mus musculus
cagaaccgcggccttgttggccgta

SEQ ID NO: 363161 - DNA, 25 bp, Mus musculus
gcggagcatcgaacccagaaccgcg

SEQ ID NO: 363162 - DNA, 25 bp, Mus musculus
cagcgaagggcggagcatcgaaccc

SEQ ID NO: 363163 - DNA, 25 bp, Mus musculus
gcctccagagcgctcgctattgggc

SEQ ID NO: 363164 - DNA, 25 bp, Mus musculus
gcgggctttagcctccagcccagaa

SEQ ID NO: 363165 - DNA, 25 bp, Mus musculus
gccgacttccgggtgccgcacccgc

SEQ ID NO: 363166 - DNA, 25 bp, Mus musculus
agccacccgctgcacactcaccgcc

SEQ ID NO: 363167 - DNA, 25 bp, Mus musculus
cgccaggagcgcagcccgctagccc

SEQ ID NO: 363168 - DNA, 25 bp, Mus musculus
gcggaccgcctcgtcctcgaccaac

SEQ ID NO: 363169 - DNA, 25 bp, Mus musculus
acctgatccagaccgcgttccagga

SEQ ID NO: 363170 - DNA, 25 bp, Mus musculus
ctccaacggggtgagaggtcaaagc

SEQ ID NO: 363171 - DNA, 25 bp, Mus musculus
cggccttgccggtctatatttagaa

SEQ ID NO: 363172 - DNA, 25 bp, Mus musculus
tgtctgtgcggacgccgcgttcccg

SEQ ID NO: 363173 - DNA, 25 bp, Mus musculus
gcgttcccgcctatgtactgcagcg

SEQ ID NO: 363174 - DNA, 25 bp, Mus musculus
tctccaaacacctccaacggggtga

SEQ ID NO: 363175 - DNA, 25 bp, Mus musculus
cggggtgagaggtcaaagcaaaatc

SEQ ID NO: 363176 - DNA, 25 bp, Mus musculus
tcaaagcaaaatcagcggctgccgg

SEQ ID NO: 363177 - DNA, 25 bp, Mus musculus
cctatgtactgcagcggtccgagca

SEQ ID NO: 363178 - DNA, 25 bp, Mus musculus
cggctcggccttgccggtctatatt

SEQ ID NO: 363179 - DNA, 25 bp, Mus musculus
attttccgctaagctgcgcgcgccg

SEQ ID NO: 363180 - DNA, 25 bp, Mus musculus
ggcgcagcggccattttccgctaag

SEQ ID NO: 363181 - DNA, 25 bp, Mus musculus
ggctgcagcctctcgagtgcggtcc

SEQ ID NO: 363182 - DNA, 25 bp, Mus musculus
tgatataaaaaactaaactcgcgcg

SEQ ID NO: 363183 - DNA, 25 bp, Mus musculus
gccggtctatatttagaagatgata

SEQ ID NO: 363184 - DNA, 25 bp, Mus musculus
ggcagcgtaaccagagggtcgcctc

SEQ ID NO: 363185 - DNA, 25 bp, Mus musculus
agtcgaggaggacgcgcgtctctgc

SEQ ID NO: 363186 - DNA, 25 bp, Mus musculus
atcagggccttccaagaggcatttc

SEQ ID NO: 363187 - DNA, 25 bp, Mus musculus
ggccttccaagaggcatttctatca

SEQ ID NO: 363188 - DNA, 25 bp, Mus musculus
ggcatttctatcacctccgcggcag

SEQ ID NO: 363189 - DNA, 25 bp, Mus musculus
caggggcgggatatctcgccctgcc

SEQ ID NO: 363190 - DNA, 25 bp, Mus musculus
ccaggccttgtcctagcgctgccct

SEQ ID NO: 363191 - DNA, 25 bp, Mus musculus
gcgcacgctccgtctggcagctggc

SEQ ID NO: 363192 - DNA, 25 bp, Mus musculus
ccgcagtagtgagaggggtttgtag

SEQ ID NO: 363193 - DNA, 25 bp, Mus musculus
cctccctcccttgcaaagacatccc

SEQ ID NO: 363194 - DNA, 25 bp, Mus musculus
tccctgccccgagctgcagatgtgg

SEQ ID NO: 363195 - DNA, 25 bp, Mus musculus
agcccggcagccgaggtaggaagcc

SEQ ID NO: 363196 - DNA, 25 bp, Mus musculus
cgggccattgtgagccctcgctgag

SEQ ID NO: 363197 - DNA, 25 bp, Mus musculus
gccggagccagtcagcccggcagcc

SEQ ID NO: 363198 - DNA, 25 bp, Mus musculus
ggcgcgtctctctaccaatgggaaa

SEQ ID NO: 363199 - DNA, 25 bp, Mus musculus
tagcctgcttgctggctgctccagt

SEQ ID NO: 363200 - DNA, 25 bp, Mus musculus
cctcctcacaagcacaagttgtggc

SEQ ID NO: 363201 - DNA, 25 bp, Mus musculus
aagggaatgtccctacgcagcgacg

SEQ ID NO: 363202 - DNA, 25 bp, Mus musculus
ttggcgatgccaagggaatgtccct

SEQ ID NO: 363203 - DNA, 25 bp, Mus musculus
ccgacggctatggaaactttaccag

SEQ ID NO: 363204 - DNA, 25 bp, Mus musculus
cagcctccgggatgaactggaccca

SEQ ID NO: 363205 - DNA, 25 bp, Mus musculus
cggcttcagcctccgggctgttcag

SEQ ID NO: 363206 - DNA, 25 bp, Mus musculus
ctcagggctctgtccaacctggcta

SEQ ID NO: 363207 - DNA, 25 bp, Mus musculus
gcgggtccctttgtgcatgacctca

SEQ ID NO: 363208 - DNA, 25 bp, Mus musculus
aagctggttcttctgctcacccgcg

SEQ ID NO: 363209 - DNA, 25 bp, Mus musculus
gtcctgggctcggactttaggtctg

SEQ ID NO: 363210 - DNA, 25 bp, Mus musculus
ctagactgagatgcggactaagata

SEQ ID NO: 363211 - DNA, 25 bp, Mus musculus
cgagctggtatagtgtctagactga

SEQ ID NO: 363212 - DNA, 25 bp, Mus musculus
ccgcagctattgtctgctctggagc

SEQ ID NO: 363213 - DNA, 25 bp, Mus musculus
tgaggccctggcctaccgagaagac

SEQ ID NO: 363214 - DNA, 25 bp, Mus musculus
tggcctaccgagaagacctgctttt

SEQ ID NO: 363215 - DNA, 25 bp, Mus musculus
tttgtttcggcgagcagccagccct

SEQ ID NO: 363216 - DNA, 25 bp, Mus musculus
tgtgcgaacaccatgcgcctcggta

SEQ ID NO: 363217 - DNA, 25 bp, Mus musculus
acaccatgcgcctcggtaccttaga

SEQ ID NO: 363218 - DNA, 25 bp, Mus musculus
ctcggtaccttagaggctggagccc

SEQ ID NO: 363219 - DNA, 25 bp, Mus musculus
agacctgcttttgtttcggcgagca

SEQ ID NO: 363220 - DNA, 25 bp, Mus musculus
tcccgattggctgctggtcttggcc

SEQ ID NO: 363221 - DNA, 25 bp, Mus musculus
ccgcctgcactggagggagtcagta

SEQ ID NO: 363222 - DNA, 25 bp, Mus musculus
agcttcccagcctcggtccgatgcc

SEQ ID NO: 363223 - DNA, 25 bp, Mus musculus
cgatgccggccgaactcagacaggt

SEQ ID NO: 363224 - DNA, 25 bp, Mus musculus
ccggccgaactcagacaggttggaa

SEQ ID NO: 363225 - DNA, 25 bp, Mus musculus
gaactcagacaggttggaaagaact

SEQ ID NO: 363226 - DNA, 25 bp, Mus musculus
gtattaagcggcgagtgcggcagct

SEQ ID NO: 363227 - DNA, 25 bp, Mus musculus
tatggccgggatactgacaacaagg

SEQ ID NO: 363228 - DNA, 25 bp, Mus musculus
gggatactgacaacaaggccgccat

SEQ ID NO: 363229 - DNA, 25 bp, Mus musculus
tactgacaacaaggccgccatccgg

SEQ ID NO: 363230 - DNA, 25 bp, Mus musculus
aacaaggccgccatccgggactgcg

SEQ ID NO: 363231 - DNA, 25 bp, Mus musculus
tcctatggccgggatactgacaaca

SEQ ID NO: 363232 - DNA, 25 bp, Mus musculus
gggcactgcgcaacctctcctatgg

SEQ ID NO: 363233 - DNA, 25 bp, Mus musculus
gcctgtggggcactgcgcaacctct

SEQ ID NO: 363234 - DNA, 25 bp, Mus musculus
ctagatcaccctcgggctgaggtgc

SEQ ID NO: 363235 - DNA, 25 bp, Mus musculus
ccctgcttgtggcattactagatca

SEQ ID NO: 363236 - DNA, 25 bp, Mus musculus
cgcaacctctcctatggccgggata

SEQ ID NO: 363237 - DNA, 25 bp, Mus musculus
gcgtgccagccctggtgcgcctact

SEQ ID NO: 363238 - DNA, 25 bp, Mus musculus
cctactgcgggcggcccgtgacaat

SEQ ID NO: 363239 - DNA, 25 bp, Mus musculus
tggcattactagatcaccctcgggc

SEQ ID NO: 363240 - DNA, 25 bp, Mus musculus
atgcagattctgatcccgagtccga

SEQ ID NO: 363241 - DNA, 25 bp, Mus musculus
ttctgatcccgagtccgagctccgg

SEQ ID NO: 363242 - DNA, 25 bp, Mus musculus
gagggtgcctgtgcgagtgtccaca

SEQ ID NO: 363243 - DNA, 25 bp, Mus musculus
acacgggctctgacacgcgggacaa

SEQ ID NO: 363244 - DNA, 25 bp, Mus musculus
cgaagggcagccctgaccgcctgag

SEQ ID NO: 363245 - DNA, 25 bp, Mus musculus
ctcaggcagtgcgaagggcagccct

SEQ ID NO: 363246 - DNA, 25 bp, Mus musculus
gtcaaggccgcgcacaggtctgacc

SEQ ID NO: 363247 - DNA, 25 bp, Mus musculus
gttcggtgcatgcagattctgatcc

SEQ ID NO: 363248 - DNA, 25 bp, Mus musculus
gcaccactcacctcgtcaaggccgc

SEQ ID NO: 363249 - DNA, 25 bp, Mus musculus
gtcccagttcggtgcatgcagattc

SEQ ID NO: 363250 - DNA, 25 bp, Mus musculus
ccctagtcccagttcggtgcatgca

SEQ ID NO: 363251 - DNA, 25 bp, Mus musculus
tcagaaccagttcccacgtacgggc

SEQ ID NO: 363252 - DNA, 25 bp, Mus musculus
cgctctcctaggtcagaaccagttc

SEQ ID NO: 363253 - DNA, 25 bp, Mus musculus
ggcttgcgctctcctaggtcagaac

SEQ ID NO: 363254 - DNA, 25 bp, Mus musculus
tctcctgggtctcgggagcagagaa

SEQ ID NO: 363255 - DNA, 25 bp, Mus musculus
tgttctccagcggagcctctgatcc

SEQ ID NO: 363256 - DNA, 25 bp, Mus musculus
ccgggcctctccacttagtacggtg

SEQ ID NO: 363257 - DNA, 25 bp, Mus musculus
tgaccctctgcgagatggaggcctc

SEQ ID NO: 363258 - DNA, 25 bp, Mus musculus
ccgacgaggtggcagcaagaccctc

SEQ ID NO: 363259 - DNA, 25 bp, Mus musculus
tccggttgcgttaggctcggatctt

SEQ ID NO: 363260 - DNA, 25 bp, Mus musculus
gggccctgtcttgaagagtcccgtc

SEQ ID NO: 363261 - DNA, 25 bp, Mus musculus
tcctaggtaggtggacttagttgtc

SEQ ID NO: 363262 - DNA, 25 bp, Mus musculus
tcccggagcttaagagctgaatgtc

SEQ ID NO: 363263 - DNA, 25 bp, Mus musculus
agctgaatgtcctgcatggcgtttc

SEQ ID NO: 363264 - DNA, 25 bp, Mus musculus
ggtagtctgtcctccactcacatgg

SEQ ID NO: 363265 - DNA, 25 bp, Mus musculus
acttcggaggaagagtaccgtgcgc

SEQ ID NO: 363266 - DNA, 25 bp, Mus musculus
ggcatgttctgttcccgggtctcct

SEQ ID NO: 363267 - DNA, 25 bp, Mus musculus
tcacatggtggctttgggcatgttc

SEQ ID NO: 363268 - DNA, 25 bp, Mus musculus
gtcgcctccctgtgcaactctgaag

SEQ ID NO: 363269 - DNA, 25 bp, Mus musculus
agccacgggattccgagagcgagca

SEQ ID NO: 363270 - DNA, 25 bp, Mus musculus
ggtcctacctttgtctgagccattg

SEQ ID NO: 363271 - DNA, 25 bp, Mus musculus
ttccgagagcgagcaaaggcactca

SEQ ID NO: 363272 - DNA, 25 bp, Mus musculus
tttgtctgagccattgggctgcgtg

SEQ ID NO: 363273 - DNA, 25 bp, Mus musculus
aactctgaagcactgacgcccgggg

SEQ ID NO: 363274 - DNA, 25 bp, Mus musculus
tccggagtcacggtcgaactcgcgc

SEQ ID NO: 363275 - DNA, 25 bp, Mus musculus
gccgacgagtacacgttggctgctg

SEQ ID NO: 363276 - DNA, 25 bp, Mus musculus
ctatctggggcagtagtcgtaggca

SEQ ID NO: 363277 - DNA, 25 bp, Mus musculus
ccgcctggacgggagctttggcact

SEQ ID NO: 363278 - DNA, 25 bp, Mus musculus
taaataccacttccttccgcctgga

SEQ ID NO: 363279 - DNA, 25 bp, Mus musculus
tcgcggagaacaataaataccactt

SEQ ID NO: 363280 - DNA, 25 bp, Mus musculus
gcgacgaggtctcgcggagaacaat

SEQ ID NO: 363281 - DNA, 25 bp, Mus musculus
aaggcactcacgagcggcagcgctc

SEQ ID NO: 363282 - DNA, 25 bp, Mus musculus
acgctggccaccttcgggttcttct

SEQ ID NO: 363283 - DNA, 25 bp, Mus musculus
cggagatcatgacccgaaggccacc

SEQ ID NO: 363284 - DNA, 25 bp, Mus musculus
cagaggcacagaacgcacgtggaca

SEQ ID NO: 363285 - DNA, 25 bp, Mus musculus
agagctgcgtgagccacggactaga

SEQ ID NO: 363286 - DNA, 25 bp, Mus musculus
gggttcttcttcaccggagccttga

SEQ ID NO: 363287 - DNA, 25 bp, Mus musculus
gattgaactcgtcccacagcgcctt

SEQ ID NO: 363288 - DNA, 25 bp, Mus musculus
cacggactagacacggcggagatca

SEQ ID NO: 363289 - DNA, 25 bp, Mus musculus
tctcggtgcccagctgattgaactc

SEQ ID NO: 363290 - DNA, 25 bp, Mus musculus
gcctgccttggtgacgatcatctcg

SEQ ID NO: 363291 - DNA, 25 bp, Mus musculus
ccacgcgggagtttcctaggtggca

SEQ ID NO: 363292 - DNA, 25 bp, Mus musculus
cgggcgcacattcggcccaaagatt

SEQ ID NO: 363293 - DNA, 25 bp, Mus musculus
ccctcgaattcgaagagtcccagga

SEQ ID NO: 363294 - DNA, 25 bp, Mus musculus
tgcgcatccctgacacgcagtcaga

SEQ ID NO: 363295 - DNA, 25 bp, Mus musculus
gatcccaggccgctcagactgctgg

SEQ ID NO: 363296 - DNA, 25 bp, Mus musculus
ttcagccaatattagcccaggagtc

SEQ ID NO: 363297 - DNA, 25 bp, Mus musculus
agctgaggacacgtcggagaaattc

SEQ ID NO: 363298 - DNA, 25 bp, Mus musculus
cagggcccaagggattatggcgtca

SEQ ID NO: 363299 - DNA, 25 bp, Mus musculus
gtccgaacatttggagcaccctgga

SEQ ID NO: 363300 - DNA, 25 bp, Mus musculus
tgccttgtaagctctctgtccctgg

SEQ ID NO: 363301 - DNA, 25 bp, Mus musculus
cccttgaacatcctgcagcttttgc

SEQ ID NO: 363302 - DNA, 25 bp, Mus musculus
ggcgaagccaccaccagagtctaca

SEQ ID NO: 363303 - DNA, 25 bp, Mus musculus
gtctcgaacactcagtcccaatgtg

SEQ ID NO: 363304 - DNA, 25 bp, Mus musculus
tcccaatgtgagatggcagggcatt

SEQ ID NO: 363305 - DNA, 25 bp, Mus musculus
cactgagatgctgcctgagtctagc

SEQ ID NO: 363306 - DNA, 25 bp, Mus musculus
ccctgcacctgggtaagagagctcc

SEQ ID NO: 363307 - DNA, 25 bp, Mus musculus
tcgcacaggccacaggcagatagcc

SEQ ID NO: 363308 - DNA, 25 bp, Mus musculus
cctctggccaggacgcttttacatc

SEQ ID NO: 363309 - DNA, 25 bp, Mus musculus
caggccctttgggtcagcttgcttt

SEQ ID NO: 363310 - DNA, 25 bp, Mus musculus
ggtcgcccagtaactggcctgcgct

SEQ ID NO: 363311 - DNA, 25 bp, Mus musculus
tgtagtcctacaccctagcgcgaag

SEQ ID NO: 363312 - DNA, 25 bp, Mus musculus
gcttgactgcgagccagtggtttgc

SEQ ID NO: 363313 - DNA, 25 bp, Mus musculus
caccctagcgcgaaggttcagaatg

SEQ ID NO: 363314 - DNA, 25 bp, Mus musculus
ggttcagaatggacacagagcctta

SEQ ID NO: 363315 - DNA, 25 bp, Mus musculus
gggaaatgctcctccctcacctgca

SEQ ID NO: 363316 - DNA, 25 bp, Mus musculus
cggcgcttccgtcacagcggtaagg

SEQ ID NO: 363317 - DNA, 25 bp, Mus musculus
tcacagcggtaaggggcttgactgc

SEQ ID NO: 363318 - DNA, 25 bp, Mus musculus
ggaacgaacccactctgtagtccta

SEQ ID NO: 363319 - DNA, 25 bp, Mus musculus
tcgatgcctggtcgcccagtaactg

SEQ ID NO: 363320 - DNA, 25 bp, Mus musculus
gcgctcctctcctgacgctgcctca

SEQ ID NO: 363321 - DNA, 25 bp, Mus musculus
ggttcttgcccggagcgctaaggaa

SEQ ID NO: 363322 - DNA, 25 bp, Mus musculus
cgctaaggaacgaacccactctgta

SEQ ID NO: 363323 - DNA, 25 bp, Mus musculus
cgaaactgtgaggtcgatgcctggt

SEQ ID NO: 363324 - DNA, 25 bp, Mus musculus
atcaccgagtggttggaccgaccag

SEQ ID NO: 363325 - DNA, 25 bp, Mus musculus
acttgcgctgagtggcaggaccagt

SEQ ID NO: 363326 - DNA, 25 bp, Mus musculus
cgctgagtggcaggaccagtaccaa

SEQ ID NO: 363327 - DNA, 25 bp, Mus musculus
ctgagtggcaggaccagtaccaagg

SEQ ID NO: 363328 - DNA, 25 bp, Mus musculus
gtgctgaggaccagacccgggccaa

SEQ ID NO: 363329 - DNA, 25 bp, Mus musculus
agggggtttcctcgcttgtccattg

SEQ ID NO: 363330 - DNA, 25 bp, Mus musculus
tgcggctaggctgtggcatcaccga

SEQ ID NO: 363331 - DNA, 25 bp, Mus musculus
gaggctgcggaacgctgtgtgccac

SEQ ID NO: 363332 - DNA, 25 bp, Mus musculus
tgtggcatcaccgagtggttggacc

SEQ ID NO: 363333 - DNA, 25 bp, Mus musculus
ctgagccacaggaccagagcagagg

SEQ ID NO: 363334 - DNA, 25 bp, Mus musculus
gaacctcaagggccgccgttccatg

SEQ ID NO: 363335 - DNA, 25 bp, Mus musculus
ctgcggagagcagaggccatactga

SEQ ID NO: 363336 - DNA, 25 bp, Mus musculus
agagcagaggccatactgagccaca

SEQ ID NO: 363337 - DNA, 25 bp, Mus musculus
gaggccatactgagccacaggacca

SEQ ID NO: 363338 - DNA, 25 bp, Mus musculus
cgcggccccaagcactcaaaggaag

SEQ ID NO: 363339 - DNA, 25 bp, Mus musculus
ttgtccacgcacgtgactggcccga

SEQ ID NO: 363340 - DNA, 25 bp, Mus musculus
cgtgactggcccgaggctataaccg

SEQ ID NO: 363341 - DNA, 25 bp, Mus musculus
gctccgtcgtcagtttgtccacgca

SEQ ID NO: 363342 - DNA, 25 bp, Mus musculus
ccggcgcgctccgtcgtcagtttgt

SEQ ID NO: 363343 - DNA, 25 bp, Mus musculus
gctgcctccgcaggaacccaggccc

SEQ ID NO: 363344 - DNA, 25 bp, Mus musculus
ctgcctcggcgtccgggacgaggac

SEQ ID NO: 363345 - DNA, 25 bp, Mus musculus
cagggttcgaccttcgccggagccg

SEQ ID NO: 363346 - DNA, 25 bp, Mus musculus
ctccgaggcgcagggttcgaccttc

SEQ ID NO: 363347 - DNA, 25 bp, Mus musculus
aggccaggaacaacttccccgacag

SEQ ID NO: 363348 - DNA, 25 bp, Mus musculus
acccgcggaagtctccgaggcgcag

SEQ ID NO: 363349 - DNA, 25 bp, Mus musculus
cccgacagggttgacgtcggcggct

SEQ ID NO: 363350 - DNA, 25 bp, Mus musculus
gtcgtcagtttgtccacgcacgtga

SEQ ID NO: 363351 - DNA, 25 bp, Mus musculus
aagccggcggctaggccaggaacaa

SEQ ID NO: 363352 - DNA, 25 bp, Mus musculus
gactctgcttcctgtgaggaacccg

SEQ ID NO: 363353 - DNA, 25 bp, Mus musculus
gggcgccacgctacagactctgctt

SEQ ID NO: 363354 - DNA, 25 bp, Mus musculus
gcggttaaaagccaagcgacacaac

SEQ ID NO: 363355 - DNA, 25 bp, Mus musculus
gcgacacaacaccaatatcgccgag

SEQ ID NO: 363356 - DNA, 25 bp, Mus musculus
atatcgccgagtcctgccactcagg

SEQ ID NO: 363357 - DNA, 25 bp, Mus musculus
aggagccggcccagtcaacgaccgt

SEQ ID NO: 363358 - DNA, 25 bp, Mus musculus
atcaggaccagagcccgctgctgga

SEQ ID NO: 363359 - DNA, 25 bp, Mus musculus
cgctgctggactccgatttgacctc

SEQ ID NO: 363360 - DNA, 25 bp, Mus musculus
tcaccatggcggacgctccacttta

SEQ ID NO: 363361 - DNA, 25 bp, Mus musculus
ccgacccagtgggaccagctcaagg

SEQ ID NO: 363362 - DNA, 25 bp, Mus musculus
cgtgcgcaaggacgcgacgcgtttc

SEQ ID NO: 363363 - DNA, 25 bp, Mus musculus
acgcgtttccagaggcgtgactctc

SEQ ID NO: 363364 - DNA, 25 bp, Mus musculus
tgactctcgcggcaccgcgcatgtg

SEQ ID NO: 363365 - DNA, 25 bp, Mus musculus
tggccgggagctttccgccaaccga

SEQ ID NO: 363366 - DNA, 25 bp, Mus musculus
tgccgcctggccagaaataactccg

SEQ ID NO: 363367 - DNA, 25 bp, Mus musculus
cagcagtgctagctgggccaccagt

SEQ ID NO: 363368 - DNA, 25 bp, Mus musculus
atcctccgccacgtagggcagcaag

SEQ ID NO: 363369 - DNA, 25 bp, Mus musculus
ggttgttgccggtcagcaccaattc

SEQ ID NO: 363370 - DNA, 25 bp, Mus musculus
acggggccctgaaagagaagcacta

SEQ ID NO: 363371 - DNA, 25 bp, Mus musculus
tggctcgagtttccatccacctctg

SEQ ID NO: 363372 - DNA, 25 bp, Mus musculus
ccaagactttgcctattgatgccca

SEQ ID NO: 363373 - DNA, 25 bp, Mus musculus
gatgcccaaactagaacacctcctg

SEQ ID NO: 363374 - DNA, 25 bp, Mus musculus
gtggctcttcctagaaagctgcaga

SEQ ID NO: 363375 - DNA, 25 bp, Mus musculus
gcctgcctgagtctacagcaacaga

SEQ ID NO: 363376 - DNA, 25 bp, Mus musculus
cgttgcgaaggcagatagggtacta

SEQ ID NO: 363377 - DNA, 25 bp, Mus musculus
ctccgcaggcgacctagtagaagtg

SEQ ID NO: 363378 - DNA, 25 bp, Mus musculus
aagtgccaatagcagcgcgtgtagc

SEQ ID NO: 363379 - DNA, 25 bp, Mus musculus
atggtggcctacttcgttctggaga

SEQ ID NO: 363380 - DNA, 25 bp, Mus musculus
acggtcgcctggaaattgggccgca

SEQ ID NO: 363381 - DNA, 25 bp, Mus musculus
agcagcggctccagtgcgagcacga

SEQ ID NO: 363382 - DNA, 25 bp, Mus musculus
agaagtcctgcgagccattcccttg

SEQ ID NO: 363383 - DNA, 25 bp, Mus musculus
taggccgctgacctcagaagtcctg

SEQ ID NO: 363384 - DNA, 25 bp, Mus musculus
ttttgaagacgcgaaaactgagccc

SEQ ID NO: 363385 - DNA, 25 bp, Mus musculus
ttctgcctcgggttttgaagacgcg

SEQ ID NO: 363386 - DNA, 25 bp, Mus musculus
gagcctcgagaaaacggctgcgatg

SEQ ID NO: 363387 - DNA, 25 bp, Mus musculus
ctacaccagggtcaggcctgtcggg

SEQ ID NO: 363388 - DNA, 25 bp, Mus musculus
tcttaagccctcttctgcctcgggt

SEQ ID NO: 363389 - DNA, 25 bp, Mus musculus
tgccagtgagtccatcgtggtgacc

SEQ ID NO: 363390 - DNA, 25 bp, Mus musculus
tttgcgctgggtaaatctgctctta

SEQ ID NO: 363391 - DNA, 25 bp, Mus musculus
cggaacgctccggactcacatgcaa

SEQ ID NO: 363392 - DNA, 25 bp, Mus musculus
tcgtggaactctgcctctgggacgt

SEQ ID NO: 363393 - DNA, 25 bp, Mus musculus
ggccagcgatctcgagcgatttgcg

SEQ ID NO: 363394 - DNA, 25 bp, Mus musculus
gtgccacaatgggtgacagccggtc

SEQ ID NO: 363395 - DNA, 25 bp, Mus musculus
ccgcgcgagtgcagccgggctattc

SEQ ID NO: 363396 - DNA, 25 bp, Mus musculus
taccgcagtcctgtgctcatggtgg

SEQ ID NO: 363397 - DNA, 25 bp, Mus musculus
gccagcttgcttttgtaccgcagtc

SEQ ID NO: 363398 - DNA, 25 bp, Mus musculus
ctcacctggggtcgccagcttgctt

SEQ ID NO: 363399 - DNA, 25 bp, Mus musculus
ccctacagacaatcgattaacgcca

SEQ ID NO: 363400 - DNA, 25 bp, Mus musculus
ccaccagcatcggtgccacaatggg

SEQ ID NO: 363401 - DNA, 25 bp, Mus musculus
ggtgacagccggtccgatctcacca

SEQ ID NO: 363402 - DNA, 25 bp, Mus musculus
cggcgcaacgccagtacctgtttgt

SEQ ID NO: 363403 - DNA, 25 bp, Mus musculus
cagtacctgtttgtcctctgcatgg

SEQ ID NO: 363404 - DNA, 25 bp, Mus musculus
tcctctgcatggtccgggtcgtgat

SEQ ID NO: 363405 - DNA, 25 bp, Mus musculus
acgcggacaggctctgggctcacct

SEQ ID NO: 363406 - DNA, 25 bp, Mus musculus
agccgggctattcccacggcttcgt

SEQ ID NO: 363407 - DNA, 25 bp, Mus musculus
tcgattaacgccaaaggactgggtg

SEQ ID NO: 363408 - DNA, 25 bp, Mus musculus
tgccggtgtcacagaagtacgagct

SEQ ID NO: 363409 - DNA, 25 bp, Mus musculus
tggcactctttgttaccttgaccgg

SEQ ID NO: 363410 - DNA, 25 bp, Mus musculus
agcccgcgatgggaaagaccgatgc

SEQ ID NO: 363411 - DNA, 25 bp, Mus musculus
cccagttaaggcacgggtagcactc

SEQ ID NO: 363412 - DNA, 25 bp, Mus musculus
agcactcacgggaggagcgctttac

SEQ ID NO: 363413 - DNA, 25 bp, Mus musculus
ctgctggttcgccaacatcgttgtc

SEQ ID NO: 363414 - DNA, 25 bp, Mus musculus
ctgagttcagcttcccggtcaagta

SEQ ID NO: 363415 - DNA, 25 bp, Mus musculus
ccgggcacatgcagtgcaaggtgta

SEQ ID NO: 363416 - DNA, 25 bp, Mus musculus
cgctctcagagtccgttgaccatca

SEQ ID NO: 363417 - DNA, 25 bp, Mus musculus
gtgggtggaacgctcagatttcatc

SEQ ID NO: 363418 - DNA, 25 bp, Mus musculus
gaccttttcttctatgcgcagttgg

SEQ ID NO: 363419 - DNA, 25 bp, Mus musculus
acggccaatggcgattacgacaaga

SEQ ID NO: 363420 - DNA, 25 bp, Mus musculus
cgggccctgctcagaacagactaca

SEQ ID NO: 363421 - DNA, 25 bp, Mus musculus
cgcgagttctatgatccgacggtgc

SEQ ID NO: 363422 - DNA, 25 bp, Mus musculus
cggcatcaccaaacgctgtcagtca

SEQ ID NO: 363423 - DNA, 25 bp, Mus musculus
ccgagagcttctgtcccaagtggga

SEQ ID NO: 363424 - DNA, 25 bp, Mus musculus
caagtgggacccataattacgagcc

SEQ ID NO: 363425 - DNA, 25 bp, Mus musculus
acgagccacctcttttcttcttagc

SEQ ID NO: 363426 - DNA, 25 bp, Mus musculus
cgacactgtcccgagagcttctgtc

SEQ ID NO: 363427 - DNA, 25 bp, Mus musculus
tcttcttagcttgtccgagtcatga

SEQ ID NO: 363428 - DNA, 25 bp, Mus musculus
cgctgtcagtcatggtgagttgacc

SEQ ID NO: 363429 - DNA, 25 bp, Mus musculus
gttcaggaaaagaagcggcatcacc

SEQ ID NO: 363430 - DNA, 25 bp, Mus musculus
caaagagggagctgtgggtttttat

SEQ ID NO: 363431 - DNA, 25 bp, Mus musculus
tcgaatgcctttcggcgggacagca

SEQ ID NO: 363432 - DNA, 25 bp, Mus musculus
agtcatgactcgaatgcctttcggc

SEQ ID NO: 363433 - DNA, 25 bp, Mus musculus
agcctctcgcggtttctgggtttca

SEQ ID NO: 363434 - DNA, 25 bp, Mus musculus
tgcggtgttccgtcacttccggcga

SEQ ID NO: 363435 - DNA, 25 bp, Mus musculus
tcgcgaaccggatgatgccagagtt

SEQ ID NO: 363436 - DNA, 25 bp, Mus musculus
ctctctcgtgtttctctcctgagta

SEQ ID NO: 363437 - DNA, 25 bp, Mus musculus
agctctgccgcagcgtcgggcacgt

SEQ ID NO: 363438 - DNA, 25 bp, Mus musculus
tttagacagcctcagttacggggtg

SEQ ID NO: 363439 - DNA, 25 bp, Mus musculus
tcgggcacgtcctacaccactacta

SEQ ID NO: 363440 - DNA, 25 bp, Mus musculus
tacgtccacggcaagcggccggatt

SEQ ID NO: 363441 - DNA, 25 bp, Mus musculus
cgacctgactaactgccgcgagtgg

SEQ ID NO: 363442 - DNA, 25 bp, Mus musculus
gtgtggatgtatgcgcagatccttg

SEQ ID NO: 363443 - DNA, 25 bp, Mus musculus
tatgcgcagatccttggggcaactc

SEQ ID NO: 363444 - DNA, 25 bp, Mus musculus
actgcgttatcaacgagactttaga

SEQ ID NO: 363445 - DNA, 25 bp, Mus musculus
ttggggcaactctctcgtgtttctc

SEQ ID NO: 363446 - DNA, 25 bp, Mus musculus
ctctcctgagtaccaaactgcgtta

SEQ ID NO: 363447 - DNA, 25 bp, Mus musculus
ccgtgcgaggtctaccgcgccgagt

SEQ ID NO: 363448 - DNA, 25 bp, Mus musculus
acgagactttagacagcctcagtta

SEQ ID NO: 363449 - DNA, 25 bp, Mus musculus
agatccttggggcaactctctcgtg

SEQ ID NO: 363450 - DNA, 25 bp, Mus musculus
gaagctcttgaagccaacctgggtc

SEQ ID NO: 363451 - DNA, 25 bp, Mus musculus
tcttctaataaatgcgcccgtctgg

SEQ ID NO: 363452 - DNA, 25 bp, Mus musculus
gcctagttcttttatgcatgcaatc

SEQ ID NO: 363453 - DNA, 25 bp, Mus musculus
cctgggtcaaccacaatggtgagtg

SEQ ID NO: 363454 - DNA, 25 bp, Mus musculus
atgctgcggtgttttcctgctctct

SEQ ID NO: 363455 - DNA, 25 bp, Mus musculus
gcagcggccgaacaatgaagctctt

SEQ ID NO: 363456 - DNA, 25 bp, Mus musculus
tgtctaccgaagaaccgaggcggcc

SEQ ID NO: 363457 - DNA, 25 bp, Mus musculus
ccacatcagtggcagcggagtatcc

SEQ ID NO: 363458 - DNA, 25 bp, Mus musculus
tagagatctgcacaccaccctggtt

SEQ ID NO: 363459 - DNA, 25 bp, Mus musculus
ccgcggaggtagaactagagatctg

SEQ ID NO: 363460 - DNA, 25 bp, Mus musculus
tagttactaagctggactcggagcc

SEQ ID NO: 363461 - DNA, 25 bp, Mus musculus
gcgagatgcccaatagcgcgaattg

SEQ ID NO: 363462 - DNA, 25 bp, Mus musculus
tgccgtctgccgctagatgcatgct

SEQ ID NO: 363463 - DNA, 25 bp, Mus musculus
gctccgcctggcctatgtgtttaca

SEQ ID NO: 363464 - DNA, 25 bp, Mus musculus
aggccacaccgtgccacagaggctg

SEQ ID NO: 363465 - DNA, 25 bp, Mus musculus
gcctctggtgtgttgctatcggctg

SEQ ID NO: 363466 - DNA, 25 bp, Mus musculus
gagcagcctctggtgtgttgctatc

SEQ ID NO: 363467 - DNA, 25 bp, Mus musculus
atgtatcgggtagtcgcctccgcac

SEQ ID NO: 363468 - DNA, 25 bp, Mus musculus
atcacctcaatgtatcgggtagtcg

SEQ ID NO: 363469 - DNA, 25 bp, Mus musculus
cggcatcacctcaatgtatcgggta

SEQ ID NO: 363470 - DNA, 25 bp, Mus musculus
gtgcgcggcatcacctcaatgtatc

SEQ ID NO: 363471 - DNA, 25 bp, Mus musculus
agggtgcgcggcatcacctcaatgt

SEQ ID NO: 363472 - DNA, 25 bp, Mus musculus
ggcccgaccgtcacagccacagcta

SEQ ID NO: 363473 - DNA, 25 bp, Mus musculus
cacaccgtgccacagaggctgcaga

SEQ ID NO: 363474 - DNA, 25 bp, Mus musculus
gggcttggctgtcctactccggctt

SEQ ID NO: 363475 - DNA, 25 bp, Mus musculus
ctatcggctggagggcatgagccag

SEQ ID NO: 363476 - DNA, 25 bp, Mus musculus
ttggctgtcctactccggcttgctc

SEQ ID NO: 363477 - DNA, 25 bp, Mus musculus
tctgccctgttactacacggcccga

SEQ ID NO: 363478 - DNA, 25 bp, Mus musculus
tgccgccgcttcactccgtcagcgg

SEQ ID NO: 363479 - DNA, 25 bp, Mus musculus
gtgcccacctttgtgcacgccggtg

SEQ ID NO: 363480 - DNA, 25 bp, Mus musculus
ccacctttgtgcacgccggtgtgcg

SEQ ID NO: 363481 - DNA, 25 bp, Mus musculus
tgcgggtccttgagcaccgtcagct

SEQ ID NO: 363482 - DNA, 25 bp, Mus musculus
ggcttgaggtcctgttcgtgcaagt

SEQ ID NO: 363483 - DNA, 25 bp, Mus musculus
ttgaggtcctgttcgtgcaagtggc

SEQ ID NO: 363484 - DNA, 25 bp, Mus musculus
caagtggcgcgggatctggcccacg

SEQ ID NO: 363485 - DNA, 25 bp, Mus musculus
atggcgtccaggtccttcatgccgt

SEQ ID NO: 363486 - DNA, 25 bp, Mus musculus
aggagctgtggtgccgccgcttcac

SEQ ID NO: 363487 - DNA, 25 bp, Mus musculus
cggttgcgccacagcgcctctggcg

SEQ ID NO: 363488 - DNA, 25 bp, Mus musculus
tggcggccgcctcggctacttcagg

SEQ ID NO: 363489 - DNA, 25 bp, Mus musculus
gagcggtgcccacctttgtgcacgc

SEQ ID NO: 363490 - DNA, 25 bp, Mus musculus
ggttcaagggtacagaggcggacgc

SEQ ID NO: 363491 - DNA, 25 bp, Mus musculus
gtccaggtccttcatgccgtcgggc

SEQ ID NO: 363492 - DNA, 25 bp, Mus musculus
cggatttacccggaatgccaatggg

SEQ ID NO: 363493 - DNA, 25 bp, Mus musculus
tttacccggaatgccaatggggaga

SEQ ID NO: 363494 - DNA, 25 bp, Mus musculus
gcggggtccagagcaccggatttac

SEQ ID NO: 363495 - DNA, 25 bp, Mus musculus
tgtgccgcaggtacgatccgacccg

SEQ ID NO: 363496 - DNA, 25 bp, Mus musculus
cttttgtgccgcaggtacgatccga

SEQ ID NO: 363497 - DNA, 25 bp, Mus musculus
agctgccgcttttgtgccgcaggta

SEQ ID NO: 363498 - DNA, 25 bp, Mus musculus
accctaggcctagctgccgcttttg

SEQ ID NO: 363499 - DNA, 25 bp, Mus musculus
gcgcctttgttcactgcggcctggt

SEQ ID NO: 363500 - DNA, 25 bp, Mus musculus
ttccctcggcgagcgcctttgttca

SEQ ID NO: 363501 - DNA, 25 bp, Mus musculus
cttcccggtccggaggtgcagcgaa

SEQ ID NO: 363502 - DNA, 25 bp, Mus musculus
tcttcgttgcgagccggggcttccc

SEQ ID NO: 363503 - DNA, 25 bp, Mus musculus
agacagacggctcttcgttgcgagc

SEQ ID NO: 363504 - DNA, 25 bp, Mus musculus
atggtcaggaagacagacggctctt

SEQ ID NO: 363505 - DNA, 25 bp, Mus musculus
tgggcggcgaccaccctaggcctag

SEQ ID NO: 363506 - DNA, 25 bp, Mus musculus
cagccagcagcacagttgcgaaaca

SEQ ID NO: 363507 - DNA, 25 bp, Mus musculus
ggcgagttccgaatttttattggca

SEQ ID NO: 363508 - DNA, 25 bp, Mus musculus
tgaccgtgagtgctgtcgcctagca

SEQ ID NO: 363509 - DNA, 25 bp, Mus musculus
aggtaccagggtggccgctccaagc

SEQ ID NO: 363510 - DNA, 25 bp, Mus musculus
ccagcctgcgccgagaggtaccagg

SEQ ID NO: 363511 - DNA, 25 bp, Mus musculus
cgccctcgcctgaaggtgacctgga

SEQ ID NO: 363512 - DNA, 25 bp, Mus musculus
ctggcgtaggacagcgcgcagctct

SEQ ID NO: 363513 - DNA, 25 bp, Mus musculus
cacccgaggcgaagatcgttcgggc

SEQ ID NO: 363514 - DNA, 25 bp, Mus musculus
caagccctgggcacccgaggcgaag

SEQ ID NO: 363515 - DNA, 25 bp, Mus musculus
cacagttgcgaaacatgcggggcgt

SEQ ID NO: 363516 - DNA, 25 bp, Mus musculus
ctgtcgcctagcacggataaggatc

SEQ ID NO: 363517 - DNA, 25 bp, Mus musculus
aatacacttagggtggaagcggccg

SEQ ID NO: 363518 - DNA, 25 bp, Mus musculus
ccgcggcagcaatacacttagggtg

SEQ ID NO: 363519 - DNA, 25 bp, Mus musculus
gggctaacccgtagctcctggcgta

SEQ ID NO: 363520 - DNA, 25 bp, Mus musculus
aacttcgagtctggagccggagcca

SEQ ID NO: 363521 - DNA, 25 bp, Mus musculus
attctccagtgggactgcgactgcc

SEQ ID NO: 363522 - DNA, 25 bp, Mus musculus
acgggacgcagcagcctctggatcc

SEQ ID NO: 363523 - DNA, 25 bp, Mus musculus
tgaggccttggaccgcaccgcctgg

SEQ ID NO: 363524 - DNA, 25 bp, Mus musculus
cttcctgagtgggttcaggggcctc

SEQ ID NO: 363525 - DNA, 25 bp, Mus musculus
cctgggcgggaacgtccagttgcac

SEQ ID NO: 363526 - DNA, 25 bp, Mus musculus
gcacactagcacattctccagtggg

SEQ ID NO: 363527 - DNA, 25 bp, Mus musculus
tggaacagcacactagcacattctc

SEQ ID NO: 363528 - DNA, 25 bp, Mus musculus
tgatcacactggaacagcacactag

SEQ ID NO: 363529 - DNA, 25 bp, Mus musculus
ggcgacaggcggagctgatcacact

SEQ ID NO: 363530 - DNA, 25 bp, Mus musculus
ttcagccgcagtcgtctcctggtga

SEQ ID NO: 363531 - DNA, 25 bp, Mus musculus
acgcagcagcctctggatcccggga

SEQ ID NO: 363532 - DNA, 25 bp, Mus musculus
agtcgtctcctggtgagtgtctagg

SEQ ID NO: 363533 - DNA, 25 bp, Mus musculus
agtcaacttcgagtctggagccgga

SEQ ID NO: 363534 - DNA, 25 bp, Mus musculus
agaagtctgcacgagagcgtaggac

SEQ ID NO: 363535 - DNA, 25 bp, Mus musculus
gcctcagacgggtcgctttgcagcc

SEQ ID NO: 363536 - DNA, 25 bp, Mus musculus
cgcgcagcctcagacgggtcgcttt

SEQ ID NO: 363537 - DNA, 25 bp, Mus musculus
gagggttcttctcgccgcgcagcct

SEQ ID NO: 363538 - DNA, 25 bp, Mus musculus
tttcgctctttctctccgcgtgggg

SEQ ID NO: 363539 - DNA, 25 bp, Mus musculus
gggaggagacctttcgctctttctc

SEQ ID NO: 363540 - DNA, 25 bp, Mus musculus
tcccgagacgaggtcgcctcggcaa

SEQ ID NO: 363541 - DNA, 25 bp, Mus musculus
tgcgagaagtctgcacgagagcgta

SEQ ID NO: 363542 - DNA, 25 bp, Mus musculus
cttaggaaggttgcgagaagtctgc

SEQ ID NO: 363543 - DNA, 25 bp, Mus musculus
cccaaagaaatctgcggcggcttag

SEQ ID NO: 363544 - DNA, 25 bp, Mus musculus
cggcaagtttggatttgcccaaaga

SEQ ID NO: 363545 - DNA, 25 bp, Mus musculus
aggtcgcctcggcaagtttggattt

SEQ ID NO: 363546 - DNA, 25 bp, Mus musculus
ctgctctgtcgtgagcttccgcgcg

SEQ ID NO: 363547 - DNA, 25 bp, Mus musculus
ttccacgggaggagacctttcgctc

SEQ ID NO: 363548 - DNA, 25 bp, Mus musculus
gcgcgcggttcgcacaccgaaatcg

SEQ ID NO: 363549 - DNA, 25 bp, Mus musculus
cccgatgggcgctcttgagccgcat

SEQ ID NO: 363550 - DNA, 25 bp, Mus musculus
accggcagcacgtagaccgtccggg

SEQ ID NO: 363551 - DNA, 25 bp, Mus musculus
gtcgctactacagctgcgtccgcgt

SEQ ID NO: 363552 - DNA, 25 bp, Mus musculus
gagacgctgcagtctgcgcccgact

SEQ ID NO: 363553 - DNA, 25 bp, Mus musculus
ctcccggggtccgagtaaccatgca

SEQ ID NO: 363554 - DNA, 25 bp, Mus musculus
aaccatgcagagtcagcggcaccgc

SEQ ID NO: 363555 - DNA, 25 bp, Mus musculus
agcacagccggctgatgcagggcca

SEQ ID NO: 363556 - DNA, 25 bp, Mus musculus
attcgaagcattcctctgccgcagc

SEQ ID NO: 363557 - DNA, 25 bp, Mus musculus
gccagctacccacctataagacgtg

SEQ ID NO: 363558 - DNA, 25 bp, Mus musculus
accgaaatcgcgctggtactgggtg

SEQ ID NO: 363559 - DNA, 25 bp, Mus musculus
agcggtccagctggttccatcgccg

SEQ ID NO: 363560 - DNA, 25 bp, Mus musculus
cacctataagacgtggtcgctacta

SEQ ID NO: 363561 - DNA, 25 bp, Mus musculus
ccaccgcaggtccagattcgaagca

SEQ ID NO: 363562 - DNA, 25 bp, Mus musculus
aggatgcgcgcaaccccagctcatg

SEQ ID NO: 363563 - DNA, 25 bp, Mus musculus
ccacacagcgcggaggagtggtcta

SEQ ID NO: 363564 - DNA, 25 bp, Mus musculus
gccagacacctctcgcggctcggca

SEQ ID NO: 363565 - DNA, 25 bp, Mus musculus
aggaggaccaaggaaaagctaggca

SEQ ID NO: 363566 - DNA, 25 bp, Mus musculus
agctaggcagggaggagtcagcttt

SEQ ID NO: 363567 - DNA, 25 bp, Mus musculus
tcagctttagcaaagacctcgtaaa

SEQ ID NO: 363568 - DNA, 25 bp, Mus musculus
ttagcaaagacctcgtaaacaatgg

SEQ ID NO: 363569 - DNA, 25 bp, Mus musculus
tcgtaaacaatggaaagcgggagcc

SEQ ID NO: 363570 - DNA, 25 bp, Mus musculus
ttacctgcgtccaagcagccgcggg

SEQ ID NO: 363571 - DNA, 25 bp, Mus musculus
cctcgctgtacccaaccttgcaacg

SEQ ID NO: 363572 - DNA, 25 bp, Mus musculus
cgccacccaagggaggcgcccacgc

SEQ ID NO: 363573 - DNA, 25 bp, Mus musculus
aaaaagccacacagcgcggaggagt

SEQ ID NO: 363574 - DNA, 25 bp, Mus musculus
agcgccacctggaggccgttcagtt

SEQ ID NO: 363575 - DNA, 25 bp, Mus musculus
ccaccatggcccgacctctctaacc

SEQ ID NO: 363576 - DNA, 25 bp, Mus musculus
caagcctttatagcggcatagtccc

SEQ ID NO: 363577 - DNA, 25 bp, Mus musculus
cccgccttggagagcccaaagaagt

SEQ ID NO: 363578 - DNA, 25 bp, Mus musculus
ccaaagaagtgagcccgtgacagcc

SEQ ID NO: 363579 - DNA, 25 bp, Mus musculus
gtgacagcctccgacactgcatgaa

SEQ ID NO: 363580 - DNA, 25 bp, Mus musculus
ctgcatgaaaaaggcgtgaaccgtc

SEQ ID NO: 363581 - DNA, 25 bp, Mus musculus
cacgagagcaaacagcccgggcacg

SEQ ID NO: 363582 - DNA, 25 bp, Mus musculus
acgctcgcgaacatcggaccctgag

SEQ ID NO: 363583 - DNA, 25 bp, Mus musculus
tggaaccttctctgccttagtcacg

SEQ ID NO: 363584 - DNA, 25 bp, Mus musculus
cccggtttctgatgcccagtctgga

SEQ ID NO: 363585 - DNA, 25 bp, Mus musculus
acgtttcccagaagcaccgctggtg

SEQ ID NO: 363586 - DNA, 25 bp, Mus musculus
gaatcgtagtccctcatccggcagc

SEQ ID NO: 363587 - DNA, 25 bp, Mus musculus
ttgcgcaagaccgaagggaatcgta

SEQ ID NO: 363588 - DNA, 25 bp, Mus musculus
cgcgcaagcgcgatgcacaaagctt

SEQ ID NO: 363589 - DNA, 25 bp, Mus musculus
ggaccctgagcaaaacaagccttta

SEQ ID NO: 363590 - DNA, 25 bp, Mus musculus
ccctccaggcagttctagtggccga

SEQ ID NO: 363591 - DNA, 25 bp, Mus musculus
cccggctcgcgagcagtctgccggc

SEQ ID NO: 363592 - DNA, 25 bp, Mus musculus
tgagcacccggctcgcgagcagtct

SEQ ID NO: 363593 - DNA, 25 bp, Mus musculus
cgatagcttcaaccgccgcttcttc

SEQ ID NO: 363594 - DNA, 25 bp, Mus musculus
tggccgatagcttcaaccgccgctt

SEQ ID NO: 363595 - DNA, 25 bp, Mus musculus
tagtggccgatagcttcaaccgccg

SEQ ID NO: 363596 - DNA, 25 bp, Mus musculus
tctagtggccgatagcttcaaccgc

SEQ ID NO: 363597 - DNA, 25 bp, Mus musculus
gttctagtggccgatagcttcaacc

SEQ ID NO: 363598 - DNA, 25 bp, Mus musculus
ggcagttctagtggccgatagcttc

SEQ ID NO: 363599 - DNA, 25 bp, Mus musculus
ctccaggcagttctagtggccgata

SEQ ID NO: 363600 - DNA, 25 bp, Mus musculus
gtgctggctgcgaagcaagatggca

SEQ ID NO: 363601 - DNA, 25 bp, Mus musculus
cgtgccgtgtgacttcccggcggac

SEQ ID NO: 363602 - DNA, 25 bp, Mus musculus
ccaggcagttctagtggccgatagc

SEQ ID NO: 363603 - DNA, 25 bp, Mus musculus
tgccgtgtgacttcccggcggacgt

SEQ ID NO: 363604 - DNA, 25 bp, Mus musculus
gagacttccaggtccagctgcctga

SEQ ID NO: 363605 - DNA, 25 bp, Mus musculus
ggaccctgcacacggttccgccagt

SEQ ID NO: 363606 - DNA, 25 bp, Mus musculus
cgggctgagacttccaggtccagct

SEQ ID NO: 363607 - DNA, 25 bp, Mus musculus
agcgcgtcaccttggcggactttaa

SEQ ID NO: 363608 - DNA, 25 bp, Mus musculus
ctggacggccaggagacgccgtacc

SEQ ID NO: 363609 - DNA, 25 bp, Mus musculus
agatcatctaccacctggacggcca

SEQ ID NO: 363610 - DNA, 25 bp, Mus musculus
tgggcgagaccaagatcatctacca

SEQ ID NO: 363611 - DNA, 25 bp, Mus musculus
tctgcagcggcccagctataagttc

SEQ ID NO: 363612 - DNA, 25 bp, Mus musculus
gcggcccagctataagttcttcttc

SEQ ID NO: 363613 - DNA, 25 bp, Mus musculus
agttcttcttcaagtctatggacga

SEQ ID NO: 363614 - DNA, 25 bp, Mus musculus
cttcaagtctatggacgacgatttt

SEQ ID NO: 363615 - DNA, 25 bp, Mus musculus
tctatggacgacgattttgggtgag

SEQ ID NO: 363616 - DNA, 25 bp, Mus musculus
ttggcggactttaagggcgttctgc

SEQ ID NO: 363617 - DNA, 25 bp, Mus musculus
agccatgggcgagaccaagatcatc

SEQ ID NO: 363618 - DNA, 25 bp, Mus musculus
acacgcagcagtctgagggggccac

SEQ ID NO: 363619 - DNA, 25 bp, Mus musculus
ccaaaagctggggactccaagtcag

SEQ ID NO: 363620 - DNA, 25 bp, Mus musculus
ctccaagtcaggtggtagcggcagc

SEQ ID NO: 363621 - DNA, 25 bp, Mus musculus
agcggcagcgagtcagaccacacta

SEQ ID NO: 363622 - DNA, 25 bp, Mus musculus
gagtcagaccacactacacgcagca

SEQ ID NO: 363623 - DNA, 25 bp, Mus musculus
cgggcaccaagcgagcgatcaggcc

SEQ ID NO: 363624 - DNA, 25 bp, Mus musculus
ccagcgagcacagccaccgcagtca

SEQ ID NO: 363625 - DNA, 25 bp, Mus musculus
gcagtcaccattcgctgaccagcag

SEQ ID NO: 363626 - DNA, 25 bp, Mus musculus
agcagcctgcgcagccaccacacac

SEQ ID NO: 363627 - DNA, 25 bp, Mus musculus
caagctatggcccacccggagtgcc

SEQ ID NO: 363628 - DNA, 25 bp, Mus musculus
ctatggtcccccgatgctgatgatg

SEQ ID NO: 363629 - DNA, 25 bp, Mus musculus
ctccagggcgtgacctggcctcggt

SEQ ID NO: 363630 - DNA, 25 bp, Mus musculus
cagcgaccggcgcaaggagaaggac

SEQ ID NO: 363631 - DNA, 25 bp, Mus musculus
agcgatcaggcccagcggccagcga

SEQ ID NO: 363632 - DNA, 25 bp, Mus musculus
aggcacgacgccttcagcacgttct

SEQ ID NO: 363633 - DNA, 25 bp, Mus musculus
tgagcgagcctcgttttaaacggct

SEQ ID NO: 363634 - DNA, 25 bp, Mus musculus
atgtagtctttcttgtgagcgagcc

SEQ ID NO: 363635 - DNA, 25 bp, Mus musculus
ggcagcactgcggacggccctgtct

SEQ ID NO: 363636 - DNA, 25 bp, Mus musculus
tgccctagggtccttcgggcagcac

SEQ ID NO: 363637 - DNA, 25 bp, Mus musculus
tccttcggggagagccacgaacagc

SEQ ID NO: 363638 - DNA, 25 bp, Mus musculus
gacgccttcagcacgttctcgagca

SEQ ID NO: 363639 - DNA, 25 bp, Mus musculus
ataaagccgagtggcaggcacgacg

SEQ ID NO: 363640 - DNA, 25 bp, Mus musculus
cggcgggcaagaagacgataaagcc

SEQ ID NO: 363641 - DNA, 25 bp, Mus musculus
ccacgagcagcaacacggcgggcaa

SEQ ID NO: 363642 - DNA, 25 bp, Mus musculus
tacacggtgaactcgtgcgcggcgt

SEQ ID NO: 363643 - DNA, 25 bp, Mus musculus
tgctgcatgcggtacacggtgaact

SEQ ID NO: 363644 - DNA, 25 bp, Mus musculus
cgcaccgtatggctggccctgcagg

SEQ ID NO: 363645 - DNA, 25 bp, Mus musculus
gccctgcaggtcgtactgctgcatg

SEQ ID NO: 363646 - DNA, 25 bp, Mus musculus
cacggtgctgggtggaaaactgccc

SEQ ID NO: 363647 - DNA, 25 bp, Mus musculus
gcagtgaaagccgaggcagcagaca

SEQ ID NO: 363648 - DNA, 25 bp, Mus musculus
gctgctgactccaggtgagctggga

SEQ ID NO: 363649 - DNA, 25 bp, Mus musculus
ctgggaggcttgacttagaggtcct

SEQ ID NO: 363650 - DNA, 25 bp, Mus musculus
cttagaggtccttatcaggcgacga

SEQ ID NO: 363651 - DNA, 25 bp, Mus musculus
ggtgctgtggtagcctgccttgccc

SEQ ID NO: 363652 - DNA, 25 bp, Mus musculus
tgccttgccctgcacggtgctgggt

SEQ ID NO: 363653 - DNA, 25 bp, Mus musculus
agtgacccgccaggcgtctccggga

SEQ ID NO: 363654 - DNA, 25 bp, Mus musculus
ctggaatcctagagcgggagacgcc

SEQ ID NO: 363655 - DNA, 25 bp, Mus musculus
cgccaggcgtctccgggaagagact

SEQ ID NO: 363656 - DNA, 25 bp, Mus musculus
cttcagacccgggagggagtagaca

SEQ ID NO: 363657 - DNA, 25 bp, Mus musculus
gagcactgcagtgaaagccgaggca

SEQ ID NO: 363658 - DNA, 25 bp, Mus musculus
gggagtggcctcagccttcagaccc

SEQ ID NO: 363659 - DNA, 25 bp, Mus musculus
aagagactagggctggaatcctaga

SEQ ID NO: 363660 - DNA, 25 bp, Mus musculus
gcggggaaggtatccaagctgtaaa

SEQ ID NO: 363661 - DNA, 25 bp, Mus musculus
ctttcttacgtcaaccctgcgcatg

SEQ ID NO: 363662 - DNA, 25 bp, Mus musculus
acgggcaggtcttcgactacgtgac

SEQ ID NO: 363663 - DNA, 25 bp, Mus musculus
cctggactcacgcagactctgcttt

SEQ ID NO: 363664 - DNA, 25 bp, Mus musculus
cggcgcttgcgtcccgttctactag

SEQ ID NO: 363665 - DNA, 25 bp, Mus musculus
aacccgcacaggtggtagacgtaga

SEQ ID NO: 363666 - DNA, 25 bp, Mus musculus
ttccagaaggcagcgaaaacccgca

SEQ ID NO: 363667 - DNA, 25 bp, Mus musculus
tacgataagcctcgggcgatcctgc

SEQ ID NO: 363668 - DNA, 25 bp, Mus musculus
gtgagtcagcaaaacgccaaaggtg

SEQ ID NO: 363669 - DNA, 25 bp, Mus musculus
gtctcaccacgactgcgcagattgg

SEQ ID NO: 363670 - DNA, 25 bp, Mus musculus
gatacaacctccactttccagaagg

SEQ ID NO: 363671 - DNA, 25 bp, Mus musculus
ggcgacttgcgctgatatcctgcga

SEQ ID NO: 363672 - DNA, 25 bp, Mus musculus
cctgcgaagcgagttccctgaaatt

SEQ ID NO: 363673 - DNA, 25 bp, Mus musculus
gcgcagattggatcccgagtgaaca

SEQ ID NO: 363674 - DNA, 25 bp, Mus musculus
caggtctgcctgttcctgctcgcag

SEQ ID NO: 363675 - DNA, 25 bp, Mus musculus
ctcgaatgccagctcaggttcttgc

SEQ ID NO: 363676 - DNA, 25 bp, Mus musculus
gcgccctcgaatgccagctcaggtt

SEQ ID NO: 363677 - DNA, 25 bp, Mus musculus
cgcacagggtaagctccgagcccga

SEQ ID NO: 363678 - DNA, 25 bp, Mus musculus
ccgctgcgcacagggtaagctccga

SEQ ID NO: 363679 - DNA, 25 bp, Mus musculus
ttccagttgcatagccggcgccgat

SEQ ID NO: 363680 - DNA, 25 bp, Mus musculus
cgtctccttccagttgcatagccgg

SEQ ID NO: 363681 - DNA, 25 bp, Mus musculus
gcctgttcctgctcgcaggcgtgtt

SEQ ID NO: 363682 - DNA, 25 bp, Mus musculus
agctcaggttcttgcaccctcgtgc

SEQ ID NO: 363683 - DNA, 25 bp, Mus musculus
tgcgtgcccggcttacctaccacaa

SEQ ID NO: 363684 - DNA, 25 bp, Mus musculus
aagggaccctgcctcagcctgcgtg

SEQ ID NO: 363685 - DNA, 25 bp, Mus musculus
gggcctatgccaagggaccctgcct

SEQ ID NO: 363686 - DNA, 25 bp, Mus musculus
tgcgtccgggcctatgccaagggac

SEQ ID NO: 363687 - DNA, 25 bp, Mus musculus
tgttcgtgtaccctctggctgaggc

SEQ ID NO: 363688 - DNA, 25 bp, Mus musculus
caggggtgatcctagactgctggaa

SEQ ID NO: 363689 - DNA, 25 bp, Mus musculus
ctactagggcgcgtcatcagacctc

SEQ ID NO: 363690 - DNA, 25 bp, Mus musculus
acccaactactagggcgcgtcatca

SEQ ID NO: 363691 - DNA, 25 bp, Mus musculus
cgggatcacccaactactagggcgc

SEQ ID NO: 363692 - DNA, 25 bp, Mus musculus
tgctgcgaggcctcctggggtaaca

SEQ ID NO: 363693 - DNA, 25 bp, Mus musculus
ctgttcgcgtctgggagtgctgcga

SEQ ID NO: 363694 - DNA, 25 bp, Mus musculus
aacagaggcctgttcgcgtctggga

SEQ ID NO: 363695 - DNA, 25 bp, Mus musculus
gccgaccggaaacagaggcctgttc

SEQ ID NO: 363696 - DNA, 25 bp, Mus musculus
caggttcccagcaaggccgaccgga

SEQ ID NO: 363697 - DNA, 25 bp, Mus musculus
cgtcgacagtttcccagccaggttc

SEQ ID NO: 363698 - DNA, 25 bp, Mus musculus
ggagaccggcgtcgacagtttccca

SEQ ID NO: 363699 - DNA, 25 bp, Mus musculus
actagggcgcgtcatcagacctccg

SEQ ID NO: 363700 - DNA, 25 bp, Mus musculus
cgacagtttcccagccaggttccca

SEQ ID NO: 363701 - DNA, 25 bp, Mus musculus
cccggagcaggggtgatcctagact

SEQ ID NO: 363702 - DNA, 25 bp, Mus musculus
cgggcagttcgttaatatgacacca

SEQ ID NO: 363703 - DNA, 25 bp, Mus musculus
taatgagcctggtcacgtctagtga

SEQ ID NO: 363704 - DNA, 25 bp, Mus musculus
gcttcccagccggacgattttcaaa

SEQ ID NO: 363705 - DNA, 25 bp, Mus musculus
gaccagatccggtttgccacgagga

SEQ ID NO: 363706 - DNA, 25 bp, Mus musculus
ccacgaggagatgtggtcgagttta

SEQ ID NO: 363707 - DNA, 25 bp, Mus musculus
ccacgtgtttgtgtggagcagctgc

SEQ ID NO: 363708 - DNA, 25 bp, Mus musculus
tgccctcctagagccggagctgtgt

SEQ ID NO: 363709 - DNA, 25 bp, Mus musculus
gtggttcggagacttcgcttccttc

SEQ ID NO: 363710 - DNA, 25 bp, Mus musculus
ctctggaccctacgagtggttcgga

SEQ ID NO: 363711 - DNA, 25 bp, Mus musculus
agcgctacaaagacgcggccgactc

SEQ ID NO: 363712 - DNA, 25 bp, Mus musculus
gtccagtactgggaccagcgctaca

SEQ ID NO: 363713 - DNA, 25 bp, Mus musculus
tcttacctcggtgattgggctcctt

SEQ ID NO: 363714 - DNA, 25 bp, Mus musculus
ggagacacaggctccgccttccatt

SEQ ID NO: 363715 - DNA, 25 bp, Mus musculus
acacgagaggatgcagtaatgagcc

SEQ ID NO: 363716 - DNA, 25 bp, Mus musculus
cagctgccacttgacggggaacggc

SEQ ID NO: 363717 - DNA, 25 bp, Mus musculus
atgggacaactccacagcagggacc

SEQ ID NO: 363718 - DNA, 25 bp, Mus musculus
cttcgaatccgggacacagtattcc

SEQ ID NO: 363719 - DNA, 25 bp, Mus musculus
tccagaagtggagagcttcgaatcc

SEQ ID NO: 363720 - DNA, 25 bp, Mus musculus
agccggggctctttttccagaagtg

SEQ ID NO: 363721 - DNA, 25 bp, Mus musculus
ttgtgttcccagtgccaagcagccc

SEQ ID NO: 363722 - DNA, 25 bp, Mus musculus
tgtcacctggtgtaaccctttcctc

SEQ ID NO: 363723 - DNA, 25 bp, Mus musculus
ggaattggcccaccaccttgtgttc

SEQ ID NO: 363724 - DNA, 25 bp, Mus musculus
tacctctcttggctcggccgatctg

SEQ ID NO: 363725 - DNA, 25 bp, Mus musculus
ctactcatctcagcccaaggaattg

SEQ ID NO: 363726 - DNA, 25 bp, Mus musculus
gccggcggaaggatgaagtcataca

SEQ ID NO: 363727 - DNA, 25 bp, Mus musculus
cggaatgacgatgagcgcccgactg

SEQ ID NO: 363728 - DNA, 25 bp, Mus musculus
cctcaccgtagggtaggatctcgga

SEQ ID NO: 363729 - DNA, 25 bp, Mus musculus
ccctgttttgatagtgccttcctga

SEQ ID NO: 363730 - DNA, 25 bp, Mus musculus
tagttcctgggcgggtcaacctcgc

SEQ ID NO: 363731 - DNA, 25 bp, Mus musculus
cgcggaacgtggtctgggcgcggat

SEQ ID NO: 363732 - DNA, 25 bp, Mus musculus
aacgtcgcgctgcacgagttgggtg

SEQ ID NO: 363733 - DNA, 25 bp, Mus musculus
atgaacgtcgcgctgcacgagttgg

SEQ ID NO: 363734 - DNA, 25 bp, Mus musculus
caccatgaacgtcgcgctgcacgag

SEQ ID NO: 363735 - DNA, 25 bp, Mus musculus
ttgctccactccaccatgaacgtcg

SEQ ID NO: 363736 - DNA, 25 bp, Mus musculus
gcgggtcaacctcgcccagccctaa

SEQ ID NO: 363737 - DNA, 25 bp, Mus musculus
gtggcctgggccgtagttcctgggc

SEQ ID NO: 363738 - DNA, 25 bp, Mus musculus
tcagcgggtggcctgggccgtagtt

SEQ ID NO: 363739 - DNA, 25 bp, Mus musculus
gtgactgtgatggagggcagcggcg

SEQ ID NO: 363740 - DNA, 25 bp, Mus musculus
caggggctgcagcagtgactgtgat

SEQ ID NO: 363741 - DNA, 25 bp, Mus musculus
agacctgagaaagccgggccgccgc

SEQ ID NO: 363742 - DNA, 25 bp, Mus musculus
cgctgggtcggggagacctgagaaa

SEQ ID NO: 363743 - DNA, 25 bp, Mus musculus
caacctcgcccagccctaaggcgcg

SEQ ID NO: 363744 - DNA, 25 bp, Mus musculus
tggctcgaaggcctcgggcccgact

SEQ ID NO: 363745 - DNA, 25 bp, Mus musculus
caggatggggcgaccctttctttat

SEQ ID NO: 363746 - DNA, 25 bp, Mus musculus
actcgggatccgcagggcgcttccg

SEQ ID NO: 363747 - DNA, 25 bp, Mus musculus
gcgcttccggtctggaggacaacgc

SEQ ID NO: 363748 - DNA, 25 bp, Mus musculus
tctggaggacaacgcgcgtggcctt

SEQ ID NO: 363749 - DNA, 25 bp, Mus musculus
gtgcagtcccaacagccctccgcga

SEQ ID NO: 363750 - DNA, 25 bp, Mus musculus
gatgccggggaaaaagacaaagagc

SEQ ID NO: 363751 - DNA, 25 bp, Mus musculus
tgagtcactgctggctcgaaggcct

SEQ ID NO: 363752 - DNA, 25 bp, Mus musculus
gcccgactccgtactgcccaccgca

SEQ ID NO: 363753 - DNA, 25 bp, Mus musculus
gagactcaggatggggcgacccttt

SEQ ID NO: 363754 - DNA, 25 bp, Mus musculus
cgtcctgctccagagggcgggactc

SEQ ID NO: 363755 - DNA, 25 bp, Mus musculus
agtaattcccgtcctgctccagagg

SEQ ID NO: 363756 - DNA, 25 bp, Mus musculus
ggctggaagccggaacagtaattcc

SEQ ID NO: 363757 - DNA, 25 bp, Mus musculus
gccttgggctgagtcactgctggct

SEQ ID NO: 363758 - DNA, 25 bp, Mus musculus
gggcggagcaaatcccatgtgcttc

SEQ ID NO: 363759 - DNA, 25 bp, Mus musculus
gactgaaggtaaagccgccatgtcc

SEQ ID NO: 363760 - DNA, 25 bp, Mus musculus
gccggaaatggttgtggactacgtc

SEQ ID NO: 363761 - DNA, 25 bp, Mus musculus
tgaaggagactgaaggtaaagccgc

SEQ ID NO: 363762 - DNA, 25 bp, Mus musculus
tatcacggccggagcagccggcttc

SEQ ID NO: 363763 - DNA, 25 bp, Mus musculus
ccaggccctactcgccaggccgatc

SEQ ID NO: 363764 - DNA, 25 bp, Mus musculus
gtggcggcgagacagtcacctccgc

SEQ ID NO: 363765 - DNA, 25 bp, Mus musculus
ccgccgggaagtgacacgttgttct

SEQ ID NO: 363766 - DNA, 25 bp, Mus musculus
acacgttgttctttggcactggccg

SEQ ID NO: 363767 - DNA, 25 bp, Mus musculus
ttctttggcactggccgcgttgcgc

SEQ ID NO: 363768 - DNA, 25 bp, Mus musculus
actcgcgcccttcctggcttgtgtt

SEQ ID NO: 363769 - DNA, 25 bp, Mus musculus
gcggcaggcttcgaacccggtgtcc

SEQ ID NO: 363770 - DNA, 25 bp, Mus musculus
gagcagccggcttcatttgtgatcc

SEQ ID NO: 363771 - DNA, 25 bp, Mus musculus
ttgtggactacgtctgtgcggctgc

SEQ ID NO: 363772 - DNA, 25 bp, Mus musculus
gaccctctgcaaggcgatggcccgg

SEQ ID NO: 363773 - DNA, 25 bp, Mus musculus
ggcccgaccctctgcaaggcgatgg

SEQ ID NO: 363774 - DNA, 25 bp, Mus musculus
ctgtattggctctcggcgctcagcc

SEQ ID NO: 363775 - DNA, 25 bp, Mus musculus
cctctgcaaggcgatggcccgggtc

SEQ ID NO: 363776 - DNA, 25 bp, Mus musculus
gctagcgtgcctgggtgccttgcca

SEQ ID NO: 363777 - DNA, 25 bp, Mus musculus
cctgggtgccttgccatgggctgta

SEQ ID NO: 363778 - DNA, 25 bp, Mus musculus
gccatgggctgtattggctctcggc

SEQ ID NO: 363779 - DNA, 25 bp, Mus musculus
tctcggcgctcagccggtcagggta

SEQ ID NO: 363780 - DNA, 25 bp, Mus musculus
agggagtcgggctacatagctgcca

SEQ ID NO: 363781 - DNA, 25 bp, Mus musculus
agtcgggctacatagctgccaggtg

SEQ ID NO: 363782 - DNA, 25 bp, Mus musculus
ctacatagctgccaggtggggccgt

SEQ ID NO: 363783 - DNA, 25 bp, Mus musculus
agagggaggagcctgcgtcaggaag

SEQ ID NO: 363784 - DNA, 25 bp, Mus musculus
ccgcgcttacgtcaccggccctgtt

SEQ ID NO: 363785 - DNA, 25 bp, Mus musculus
gaggccggagcatggatagggagtc

SEQ ID NO: 363786 - DNA, 25 bp, Mus musculus
tgcccaacgacgtggtcctccaggt

SEQ ID NO: 363787 - DNA, 25 bp, Mus musculus
agtgcaaaccgttaggaaatgctgc

SEQ ID NO: 363788 - DNA, 25 bp, Mus musculus
gcgacatcgagagcaccaagaaggt

SEQ ID NO: 363789 - DNA, 25 bp, Mus musculus
caacgacgtggtcctccaggtaccg

SEQ ID NO: 363790 - DNA, 25 bp, Mus musculus
ttctcctactgcgacatcgagagca

SEQ ID NO: 363791 - DNA, 25 bp, Mus musculus
actcggatctcttctcctactgcga

SEQ ID NO: 363792 - DNA, 25 bp, Mus musculus
gcagaaatactactcggatctcttc

SEQ ID NO: 363793 - DNA, 25 bp, Mus musculus
tgagcgacgccgagcagaaatacta

SEQ ID NO: 363794 - DNA, 25 bp, Mus musculus
aaggcttgacgctgagcgacgccga

SEQ ID NO: 363795 - DNA, 25 bp, Mus musculus
ccagcccggtgggtgtttctctctc

SEQ ID NO: 363796 - DNA, 25 bp, Mus musculus
gcagtgcgacctgaaccctccgcgt

SEQ ID NO: 363797 - DNA, 25 bp, Mus musculus
aatgctgcacgccagaagctgccgc

SEQ ID NO: 363798 - DNA, 25 bp, Mus musculus
ccgttaggaaatgctgcacgccaga

SEQ ID NO: 363799 - DNA, 25 bp, Mus musculus
tcaacgggcgagtgctcgagctgtt

SEQ ID NO: 363800 - DNA, 25 bp, Mus musculus
gtccttcttccgtggacagccagga

SEQ ID NO: 363801 - DNA, 25 bp, Mus musculus
atatacacctttttctttgggccag

SEQ ID NO: 363802 - DNA, 25 bp, Mus musculus
gttgccagggagatatacacctttt

SEQ ID NO: 363803 - DNA, 25 bp, Mus musculus
cctgttgcatggtgatgggttgcca

SEQ ID NO: 363804 - DNA, 25 bp, Mus musculus
gtatcccgggagaccctgttgcatg

SEQ ID NO: 363805 - DNA, 25 bp, Mus musculus
gacgtcagcgcatcccaggccgtat

SEQ ID NO: 363806 - DNA, 25 bp, Mus musculus
ctagcgccttcggtgctgacgtcag

SEQ ID NO: 363807 - DNA, 25 bp, Mus musculus
cttcgggctcttttttcctgctagc

SEQ ID NO: 363808 - DNA, 25 bp, Mus musculus
tcaccatcctgcttcgggctctttt

SEQ ID NO: 363809 - DNA, 25 bp, Mus musculus
tggcgttcacattgagggttcgtgt

SEQ ID NO: 363810 - DNA, 25 bp, Mus musculus
ccttttctgtgcatgtttggcggcg

SEQ ID NO: 363811 - DNA, 25 bp, Mus musculus
aggtgctgcgccttttctgtgcatg

SEQ ID NO: 363812 - DNA, 25 bp, Mus musculus
ttttctttgggccagggccgcagct

SEQ ID NO: 363813 - DNA, 25 bp, Mus musculus
ccaggacttgccagaggtgctgcgc

SEQ ID NO: 363814 - DNA, 25 bp, Mus musculus
gcctcccagtgaaaggcgcacttca

SEQ ID NO: 363815 - DNA, 25 bp, Mus musculus
tcagtgtccagaagagggtggtata

SEQ ID NO: 363816 - DNA, 25 bp, Mus musculus
atcaaggttcctggctgggttaggc

SEQ ID NO: 363817 - DNA, 25 bp, Mus musculus
gctcgcaccagctttggggatcttg

SEQ ID NO: 363818 - DNA, 25 bp, Mus musculus
ctccggtgatgtctagctggtccga

SEQ ID NO: 363819 - DNA, 25 bp, Mus musculus
atggcaaattcccaaaccggacgca

SEQ ID NO: 363820 - DNA, 25 bp, Mus musculus
cccgagagtgacatcatggcaaatt

SEQ ID NO: 363821 - DNA, 25 bp, Mus musculus
ctgtaatgagaggaggtagcaccta

SEQ ID NO: 363822 - DNA, 25 bp, Mus musculus
tccaagaaacaagagggtgccgcgc

SEQ ID NO: 363823 - DNA, 25 bp, Mus musculus
cctggaatggctaggcctggaaaga

SEQ ID NO: 363824 - DNA, 25 bp, Mus musculus
ttcacactttcaggcggctcagacg

SEQ ID NO: 363825 - DNA, 25 bp, Mus musculus
ggggcagcctctgcttcacactttc

SEQ ID NO: 363826 - DNA, 25 bp, Mus musculus
ggctctctaagccagaccggacagg

SEQ ID NO: 363827 - DNA, 25 bp, Mus musculus
tgacaggcagtaccaagttcagttg

SEQ ID NO: 363828 - DNA, 25 bp, Mus musculus
cggaacgctggtgtcctaagtagta

SEQ ID NO: 363829 - DNA, 25 bp, Mus musculus
gcgcctagggcactaaagtggagta

SEQ ID NO: 363830 - DNA, 25 bp, Mus musculus
agcactgcccatccgttccgagaag

SEQ ID NO: 363831 - DNA, 25 bp, Mus musculus
tggcaagtctacatccacagggaga

SEQ ID NO: 363832 - DNA, 25 bp, Mus musculus
ggagcaggcattacggcacgagcaa

SEQ ID NO: 363833 - DNA, 25 bp, Mus musculus
ccttcggcgggaaggtctatgcctt

SEQ ID NO: 363834 - DNA, 25 bp, Mus musculus
tatgccttggacgagacgtggcacc

SEQ ID NO: 363835 - DNA, 25 bp, Mus musculus
cggtgagtggataacgcagctgcct

SEQ ID NO: 363836 - DNA, 25 bp, Mus musculus
gctgcctgccctactctagagggta

SEQ ID NO: 363837 - DNA, 25 bp, Mus musculus
tactctagagggtagcggaacgctg

SEQ ID NO: 363838 - DNA, 25 bp, Mus musculus
cataaaacgggccagagccggcgcc

SEQ ID NO: 363839 - DNA, 25 bp, Mus musculus
ctaagtagtagactcggagatgctc

SEQ ID NO: 363840 - DNA, 25 bp, Mus musculus
gctggtccgcaaatcggaggaaacc

SEQ ID NO: 363841 - DNA, 25 bp, Mus musculus
cggaggaaaccgctttcaagtctgc

SEQ ID NO: 363842 - DNA, 25 bp, Mus musculus
cgcgaggaccagcagaagtgagtac

SEQ ID NO: 363843 - DNA, 25 bp, Mus musculus
aatgtgggcgactcagcatcaaggc

SEQ ID NO: 363844 - DNA, 25 bp, Mus musculus
cgcacctctggaaggcgaggaaatg

SEQ ID NO: 363845 - DNA, 25 bp, Mus musculus
catttggaagggatagcctacagtc

SEQ ID NO: 363846 - DNA, 25 bp, Mus musculus
gggaaactgctagcatcaggactca

SEQ ID NO: 363847 - DNA, 25 bp, Mus musculus
ggctccgcagccctctttggggaaa

SEQ ID NO: 363848 - DNA, 25 bp, Mus musculus
gctgagcacacgtccaaggagactc

SEQ ID NO: 363849 - DNA, 25 bp, Mus musculus
ctccctgacgggatctcttggactg

SEQ ID NO: 363850 - DNA, 25 bp, Mus musculus
ttgggcgacacctcggttacagagc

SEQ ID NO: 363851 - DNA, 25 bp, Mus musculus
tccgtccagattcccgcgggaacga

SEQ ID NO: 363852 - DNA, 25 bp, Mus musculus
cgagcgcacaaggatcccgggatct

SEQ ID NO: 363853 - DNA, 25 bp, Mus musculus
agcagagtgctctcgcagcagaacc

SEQ ID NO: 363854 - DNA, 25 bp, Mus musculus
aagagcggccaactgaactccagca

SEQ ID NO: 363855 - DNA, 25 bp, Mus musculus
ccgcttcccgagtcattgggcatca

SEQ ID NO: 363856 - DNA, 25 bp, Mus musculus
agaagccgccctggactcttgcagc

SEQ ID NO: 363857 - DNA, 25 bp, Mus musculus
tgccgaaacttggacaccttgaagc

SEQ ID NO: 363858 - DNA, 25 bp, Mus musculus
tggacaccttgaagcgactcatggc

SEQ ID NO: 363859 - DNA, 25 bp, Mus musculus
agcgactcatggcagctgggacaga

SEQ ID NO: 363860 - DNA, 25 bp, Mus musculus
catggcagctgggacagagcaagct

SEQ ID NO: 363861 - DNA, 25 bp, Mus musculus
gaatgaagagaagccgccctggact

SEQ ID NO: 363862 - DNA, 25 bp, Mus musculus
tcggaagctcctgcggcctgcctag

SEQ ID NO: 363863 - DNA, 25 bp, Mus musculus
agcctggtgccacgcccttattgat

SEQ ID NO: 363864 - DNA, 25 bp, Mus musculus
tgccacgcccttattgatgacaacc

SEQ ID NO: 363865 - DNA, 25 bp, Mus musculus
ggccgggcctccatatgccgaaact

SEQ ID NO: 363866 - DNA, 25 bp, Mus musculus
accaatcggaagctcctgcggcctg

SEQ ID NO: 363867 - DNA, 25 bp, Mus musculus
tcacccttcttcagcgcgacggcct

SEQ ID NO: 363868 - DNA, 25 bp, Mus musculus
ttgatgacaaccaatcggaagctcc

SEQ ID NO: 363869 - DNA, 25 bp, Mus musculus
ggtcgtcaggtactaggtgaatgaa

SEQ ID NO: 363870 - DNA, 25 bp, Mus musculus
tcgatgccgggcgtgtcaacaccaa

SEQ ID NO: 363871 - DNA, 25 bp, Mus musculus
tgtaacagcattcccaacatccctg

SEQ ID NO: 363872 - DNA, 25 bp, Mus musculus
ttcaccgtaagagactgtaacagca

SEQ ID NO: 363873 - DNA, 25 bp, Mus musculus
cgtctacgtggagctgaagttcacc

SEQ ID NO: 363874 - DNA, 25 bp, Mus musculus
gaagtccagcgcgtctacgtggagc

SEQ ID NO: 363875 - DNA, 25 bp, Mus musculus
aactggctgcggacgggtttcatct

SEQ ID NO: 363876 - DNA, 25 bp, Mus musculus
tgcgtgagtcgagccagaacaactg

SEQ ID NO: 363877 - DNA, 25 bp, Mus musculus
tcaacaccaaggtgcgcagcttcgg

SEQ ID NO: 363878 - DNA, 25 bp, Mus musculus
tgatagcgatgtggcctcagcctcc

SEQ ID NO: 363879 - DNA, 25 bp, Mus musculus
atgagagcttctcgcggctcgatgc

SEQ ID NO: 363880 - DNA, 25 bp, Mus musculus
caccattgcgccagatgagagcttc

SEQ ID NO: 363881 - DNA, 25 bp, Mus musculus
ccctacgtgaaagtggacaccattg

SEQ ID NO: 363882 - DNA, 25 bp, Mus musculus
ccttttctactacgaggctgatagc

SEQ ID NO: 363883 - DNA, 25 bp, Mus musculus
atcaggtgtgtaatgtgcgtgagtc

SEQ ID NO: 363884 - DNA, 25 bp, Mus musculus
actagctcatctcgggccagccagg

SEQ ID NO: 363885 - DNA, 25 bp, Mus musculus
tgctcgaaccttaagcgggcaagga

SEQ ID NO: 363886 - DNA, 25 bp, Mus musculus
ggtccgccgagacatcgactgctgc

SEQ ID NO: 363887 - DNA, 25 bp, Mus musculus
ccctccggatggagagtgccgagac

SEQ ID NO: 363888 - DNA, 25 bp, Mus musculus
tttgcaggaagacgctcacactagc

SEQ ID NO: 363889 - DNA, 25 bp, Mus musculus
ggtcggatttggctcctcccaagac

SEQ ID NO: 363890 - DNA, 25 bp, Mus musculus
caaaatcctgtctgggcgcacgcta

SEQ ID NO: 363891 - DNA, 25 bp, Mus musculus
tagtggcggaagaaaccagagctct

SEQ ID NO: 363892 - DNA, 25 bp, Mus musculus
caagcctctgggagcttggctgcct

SEQ ID NO: 363893 - DNA, 25 bp, Mus musculus
tggctgcctcttgccaaggtcaatc

SEQ ID NO: 363894 - DNA, 25 bp, Mus musculus
ccaaggtcaatcaagccgtcccata

SEQ ID NO: 363895 - DNA, 25 bp, Mus musculus
cccatattcaggagcgctgcgagca

SEQ ID NO: 363896 - DNA, 25 bp, Mus musculus
ctcccggcaggtgctcgaaccttaa

SEQ ID NO: 363897 - DNA, 25 bp, Mus musculus
gccgagacgacttaatttgcaggaa

SEQ ID NO: 363898 - DNA, 25 bp, Mus musculus
ctggcggcgtgcaatggctcctgca

SEQ ID NO: 363899 - DNA, 25 bp, Mus musculus
tagactggcggcgtgcaatggctcc

SEQ ID NO: 363900 - DNA, 25 bp, Mus musculus
ggctcctgcaggtgcaggcgccgcg

SEQ ID NO: 363901 - DNA, 25 bp, Mus musculus
agtgccgctcgcagcccttccgctt

SEQ ID NO: 363902 - DNA, 25 bp, Mus musculus
gcccttccgcttcctcctagactgg

SEQ ID NO: 363903 - DNA, 25 bp, Mus musculus
cgggcaggcggtgcccggcatgcca

SEQ ID NO: 363904 - DNA, 25 bp, Mus musculus
actgcgcgaacaggcccgggaagac

SEQ ID NO: 363905 - DNA, 25 bp, Mus musculus
acccgcccacgatcgcgcagccgca

SEQ ID NO: 363906 - DNA, 25 bp, Mus musculus
agcatcatgaggtcgcggcgagtcc

SEQ ID NO: 363907 - DNA, 25 bp, Mus musculus
ttccggcttgctcggccaagatggc

SEQ ID NO: 363908 - DNA, 25 bp, Mus musculus
cagccgcagtctgggctcgccactt

SEQ ID NO: 363909 - DNA, 25 bp, Mus musculus
caagatggcagcggcagtgccgctc

SEQ ID NO: 363910 - DNA, 25 bp, Mus musculus
tgaggtcgcggcgagtcccacaccc

SEQ ID NO: 363911 - DNA, 25 bp, Mus musculus
cttccggcttgctcggccaagatgg

SEQ ID NO: 363912 - DNA, 25 bp, Mus musculus
agtctgacttcgcactaggttagca

SEQ ID NO: 363913 - DNA, 25 bp, Mus musculus
ccagctgccgagactgcgcgtgcgt

SEQ ID NO: 363914 - DNA, 25 bp, Mus musculus
gtcacgtgtgctggggtcccgtcaa

SEQ ID NO: 363915 - DNA, 25 bp, Mus musculus
ccgtcaaggcagacgccggctcagg

SEQ ID NO: 363916 - DNA, 25 bp, Mus musculus
acgccggctcaggtaacacgtattc

SEQ ID NO: 363917 - DNA, 25 bp, Mus musculus
ctcaggtaacacgtattccgaacgg

SEQ ID NO: 363918 - DNA, 25 bp, Mus musculus
ccaccgcgggctggctcaggagtct

SEQ ID NO: 363919 - DNA, 25 bp, Mus musculus
accgcccagtgcagggcgtctctgg

SEQ ID NO: 363920 - DNA, 25 bp, Mus musculus
ttcctcctcgcctcctgccaggtgt

SEQ ID NO: 363921 - DNA, 25 bp, Mus musculus
gcactaggttagcagtttccacccg

SEQ ID NO: 363922 - DNA, 25 bp, Mus musculus
cgccgcacggcgtggaggttctcac

SEQ ID NO: 363923 - DNA, 25 bp, Mus musculus
gttctcacccggtccgactgacgtg

SEQ ID NO: 363924 - DNA, 25 bp, Mus musculus
ggtccgactgacgtgcagcccgtgc

SEQ ID NO: 363925 - DNA, 25 bp, Mus musculus
ggctcaggagtctgacttcgcacta

SEQ ID NO: 363926 - DNA, 25 bp, Mus musculus
ccagtaaccgctggttggtggattc

SEQ ID NO: 363927 - DNA, 25 bp, Mus musculus
gacatctggaggacactgagttaca

SEQ ID NO: 363928 - DNA, 25 bp, Mus musculus
gctgacgtgagaagactagtgtcga

SEQ ID NO: 363929 - DNA, 25 bp, Mus musculus
ccagtgttggtatgctgacgtgaga

SEQ ID NO: 363930 - DNA, 25 bp, Mus musculus
aacaagctagcatttctgtggcatc

SEQ ID NO: 363931 - DNA, 25 bp, Mus musculus
caggctcaggagaagactgcaacca

SEQ ID NO: 363932 - DNA, 25 bp, Mus musculus
caagatgtggtctctgacaggctca

SEQ ID NO: 363933 - DNA, 25 bp, Mus musculus
taggagcaaagagcaagatgtggtc

SEQ ID NO: 363934 - DNA, 25 bp, Mus musculus
gttggtggattcatagcagttagga

SEQ ID NO: 363935 - DNA, 25 bp, Mus musculus
agtgttaactcagtttgtcttccca

SEQ ID NO: 363936 - DNA, 25 bp, Mus musculus
tagtgtcgagctggtgtcagacatc

SEQ ID NO: 363937 - DNA, 25 bp, Mus musculus
atggagatgaggaggaaatctgttc

SEQ ID NO: 363938 - DNA, 25 bp, Mus musculus
ttctgtggcatcaggagaaccggcc

SEQ ID NO: 363939 - DNA, 25 bp, Mus musculus
cccactcatgtcaggaatggagatg

SEQ ID NO: 363940 - DNA, 25 bp, Mus musculus
caccatggtggcgaagcgctcgccg

SEQ ID NO: 363941 - DNA, 25 bp, Mus musculus
ttcagcaggcagtagtacacccagc

SEQ ID NO: 363942 - DNA, 25 bp, Mus musculus
tcactcagtgtgatgttcagcaggc

SEQ ID NO: 363943 - DNA, 25 bp, Mus musculus
gccaggcctgtgagcaggtcactca

SEQ ID NO: 363944 - DNA, 25 bp, Mus musculus
gttgaccacgtaggccaggcctgtg

SEQ ID NO: 363945 - DNA, 25 bp, Mus musculus
ctgacagcagcacgttgaccacgta

SEQ ID NO: 363946 - DNA, 25 bp, Mus musculus
ggtacgagtccctgacagcagcacg

SEQ ID NO: 363947 - DNA, 25 bp, Mus musculus
tgacagctggaaggtacgagtccct

SEQ ID NO: 363948 - DNA, 25 bp, Mus musculus
cgcaggaaccagtgcaccggtgaca

SEQ ID NO: 363949 - DNA, 25 bp, Mus musculus
agcaccatggcgttctccagcacca

SEQ ID NO: 363950 - DNA, 25 bp, Mus musculus
cgccggccgtgaagagcagactgaa

SEQ ID NO: 363951 - DNA, 25 bp, Mus musculus
cagtagtacacccagcggcgggacc

SEQ ID NO: 363952 - DNA, 25 bp, Mus musculus
cccagcggcgggaccgcatgtagat

SEQ ID NO: 363953 - DNA, 25 bp, Mus musculus
ccaaggccatgaagagcaggccctc

SEQ ID NO: 363954 - DNA, 25 bp, Mus musculus
tgcagcttgaagcacttgccgtggc

SEQ ID NO: 363955 - DNA, 25 bp, Mus musculus
cgggtcccacatgcccataggacag

SEQ ID NO: 363956 - DNA, 25 bp, Mus musculus
atctctccggttgaagagccgggcc

SEQ ID NO: 363957 - DNA, 25 bp, Mus musculus
tggccgcactcatctctccggttga

SEQ ID NO: 363958 - DNA, 25 bp, Mus musculus
acagcccgtcgcacggctggaagtc

SEQ ID NO: 363959 - DNA, 25 bp, Mus musculus
ctgtgcgtggcacagatggacagcc

SEQ ID NO: 363960 - DNA, 25 bp, Mus musculus
aggtgacagcaccagtgcagcttga

SEQ ID NO: 363961 - DNA, 25 bp, Mus musculus
cttacagtgacaccatcccaggtga

SEQ ID NO: 363962 - DNA, 25 bp, Mus musculus
cgacgcggctccacttacagtgaca

SEQ ID NO: 363963 - DNA, 25 bp, Mus musculus
gcccataggacagtcagcacacatc

SEQ ID NO: 363964 - DNA, 25 bp, Mus musculus
ggagggcgtacctccggctacagtc

SEQ ID NO: 363965 - DNA, 25 bp, Mus musculus
ccgcagcctttaggcacagggtcta

SEQ ID NO: 363966 - DNA, 25 bp, Mus musculus
acagggtctagcctggtccttagca

SEQ ID NO: 363967 - DNA, 25 bp, Mus musculus
gtggcgtcctgctgggcacacactc

SEQ ID NO: 363968 - DNA, 25 bp, Mus musculus
cggattggagcggtaaatttcagca

SEQ ID NO: 363969 - DNA, 25 bp, Mus musculus
cgggccgagcgctttgaagaagtaa

SEQ ID NO: 363970 - DNA, 25 bp, Mus musculus
gaagtaagtcttctaggaacctagc

SEQ ID NO: 363971 - DNA, 25 bp, Mus musculus
tcagcatggacgagtctgtagaata

SEQ ID NO: 363972 - DNA, 25 bp, Mus musculus
tgcctactcctgagcccgggatgga

SEQ ID NO: 363973 - DNA, 25 bp, Mus musculus
taaaaccacgggagcccactgctga

SEQ ID NO: 363974 - DNA, 25 bp, Mus musculus
gcgacccggtctcctataggtcttg

SEQ ID NO: 363975 - DNA, 25 bp, Mus musculus
aaggaattgggtcactcagcccagg

SEQ ID NO: 363976 - DNA, 25 bp, Mus musculus
actggcgcagctgctgagtgcatcc

SEQ ID NO: 363977 - DNA, 25 bp, Mus musculus
cgtgggactcgacaatctcgtgatt

SEQ ID NO: 363978 - DNA, 25 bp, Mus musculus
cgacacccggcagagacgtgggact

SEQ ID NO: 363979 - DNA, 25 bp, Mus musculus
agtgcatcccgggtgtcagcatccc

SEQ ID NO: 363980 - DNA, 25 bp, Mus musculus
acacctgctggaaagggtttggaca

SEQ ID NO: 363981 - DNA, 25 bp, Mus musculus
tttggacagagtgcgaagcccgact

SEQ ID NO: 363982 - DNA, 25 bp, Mus musculus
tctgacaaggagtgtgctgttcggc

SEQ ID NO: 363983 - DNA, 25 bp, Mus musculus
tcgagatctcctcccactcagatgg

SEQ ID NO: 363984 - DNA, 25 bp, Mus musculus
tggacgacctgctgtctcagacacc

SEQ ID NO: 363985 - DNA, 25 bp, Mus musculus
agacgctggacgacctgctgtctca

SEQ ID NO: 363986 - DNA, 25 bp, Mus musculus
accgcctggcagagacgctggacga

SEQ ID NO: 363987 - DNA, 25 bp, Mus musculus
tcccactcagatgggctgtctgaca

SEQ ID NO: 363988 - DNA, 25 bp, Mus musculus
ctgtctgacaaggagtgtgctgttc

SEQ ID NO: 363989 - DNA, 25 bp, Mus musculus
ttcggcgcgtgaagacacagatgtc

SEQ ID NO: 363990 - DNA, 25 bp, Mus musculus
gcgcgtgaagacacagatgtcccta

SEQ ID NO: 363991 - DNA, 25 bp, Mus musculus
acacagatgtccctaggcaagctgt

SEQ ID NO: 363992 - DNA, 25 bp, Mus musculus
cgaacagtcccgatgaatccgccaa

SEQ ID NO: 363993 - DNA, 25 bp, Mus musculus
gtcccgatgaatccgccaacagacg

SEQ ID NO: 363994 - DNA, 25 bp, Mus musculus
atgaatccgccaacagacggcagga

SEQ ID NO: 363995 - DNA, 25 bp, Mus musculus
caacagacggcaggaccgcctggca

SEQ ID NO: 363996 - DNA, 25 bp, Mus musculus
tgcagagaagtgcaagggcccccga

SEQ ID NO: 363997 - DNA, 25 bp, Mus musculus
agcaggtataatgcgaaggtgcagc

SEQ ID NO: 363998 - DNA, 25 bp, Mus musculus
cagccgcgtggagagcaggtataat

SEQ ID NO: 363999 - DNA, 25 bp, Mus musculus
caggtataatgcgaaggtgcagcct

SEQ ID NO: 364000 - DNA, 25 bp, Mus musculus
ggtgtcctccctctcaccggccttc

SEQ ID NO: 364001 - DNA, 25 bp, Mus musculus
cgaggcatcactgccaaccctccga

SEQ ID NO: 364002 - DNA, 25 bp, Mus musculus
ccgaatacgaggagcaagccgagca

SEQ ID NO: 364003 - DNA, 25 bp, Mus musculus
cgaccgcgtgtgcagagaagtgcaa

SEQ ID NO: 364004 - DNA, 25 bp, Mus musculus
tgccaaccctccgacctcctcccag

SEQ ID NO: 364005 - DNA, 25 bp, Mus musculus
cctccgaatacgaggagcaagccga

SEQ ID NO: 364006 - DNA, 25 bp, Mus musculus
atacgaggagcaagccgagcagcgc

SEQ ID NO: 364007 - DNA, 25 bp, Mus musculus
agggcgtggccctcgcaaagctccg

SEQ ID NO: 364008 - DNA, 25 bp, Mus musculus
aaggtgcagcctccgaatacgagga

SEQ ID NO: 364009 - DNA, 25 bp, Mus musculus
gtgcagcctccgaatacgaggagca

SEQ ID NO: 364010 - DNA, 25 bp, Mus musculus
ggcccagcatcgatacacgtggttt

SEQ ID NO: 364011 - DNA, 25 bp, Mus musculus
gccttgtcccgagatcgactcctga

SEQ ID NO: 364012 - DNA, 25 bp, Mus musculus
gatcgactcctgactggctctgcca

SEQ ID NO: 364013 - DNA, 25 bp, Mus musculus
gtcccgcttcctgttgctaggctta

SEQ ID NO: 364014 - DNA, 25 bp, Mus musculus
gcttacaaggagcaggcccagactg

SEQ ID NO: 364015 - DNA, 25 bp, Mus musculus
aacgttaaatctgtgggccctctga

SEQ ID NO: 364016 - DNA, 25 bp, Mus musculus
tttgcccgtagtcgtttgactgcga

SEQ ID NO: 364017 - DNA, 25 bp, Mus musculus
tggcgtcacaagtccgcgcctgatc

SEQ ID NO: 364018 - DNA, 25 bp, Mus musculus
gcctgatcctggctacggctgaagc

SEQ ID NO: 364019 - DNA, 25 bp, Mus musculus
cctggaatgtacagatggctggcta

SEQ ID NO: 364020 - DNA, 25 bp, Mus musculus
gctggctaaggttctcggcaccatt

SEQ ID NO: 364021 - DNA, 25 bp, Mus musculus
tcggcaccattcttcgcttgtgtga

SEQ ID NO: 364022 - DNA, 25 bp, Mus musculus
tcactaggttaggagtttgcccgta

SEQ ID NO: 364023 - DNA, 25 bp, Mus musculus
cgtcaacggcttctagagagtcctc

SEQ ID NO: 364024 - DNA, 25 bp, Mus musculus
cgcgtgcgcaatgcttacgctctgc

SEQ ID NO: 364025 - DNA, 25 bp, Mus musculus
tagtggcaacatccctgtgtcgcaa

SEQ ID NO: 364026 - DNA, 25 bp, Mus musculus
accgaggcgcgtgcgcaatgcttac

SEQ ID NO: 364027 - DNA, 25 bp, Mus musculus
atgcttacgctctgcgtgctacgga

SEQ ID NO: 364028 - DNA, 25 bp, Mus musculus
tacgctctgcgtgctacggatgcct

SEQ ID NO: 364029 - DNA, 25 bp, Mus musculus
tgctacggatgcctcgcctccggaa

SEQ ID NO: 364030 - DNA, 25 bp, Mus musculus
gatgcctcgcctccggaagacgcga

SEQ ID NO: 364031 - DNA, 25 bp, Mus musculus
tgtgtcgcaagctgtgcgtctctgc

SEQ ID NO: 364032 - DNA, 25 bp, Mus musculus
gcgtctctgccttcgggctttccat

SEQ ID NO: 364033 - DNA, 25 bp, Mus musculus
cttcgggctttccatgggcgctcac

SEQ ID NO: 364034 - DNA, 25 bp, Mus musculus
gctgctgacattgagacccggtgtc

SEQ ID NO: 364035 - DNA, 25 bp, Mus musculus
tgctgacattgagacccggtgtccg

SEQ ID NO: 364036 - DNA, 25 bp, Mus musculus
aacatccctgtgtcgcaagctgtgc

SEQ ID NO: 364037 - DNA, 25 bp, Mus musculus
gccaaaatggctgcgtggtgttccc

SEQ ID NO: 364038 - DNA, 25 bp, Mus musculus
ctcgaagggttcagtaggtgaagtc

SEQ ID NO: 364039 - DNA, 25 bp, Mus musculus
tctttggcacgaggcatgggaagaa

SEQ ID NO: 364040 - DNA, 25 bp, Mus musculus
ctctggagagcagctgggcactcca

SEQ ID NO: 364041 - DNA, 25 bp, Mus musculus
ctccaggggcgctcctagggagcca

SEQ ID NO: 364042 - DNA, 25 bp, Mus musculus
cacagggtcgcctcgactctgaggc

SEQ ID NO: 364043 - DNA, 25 bp, Mus musculus
gcccagttctggtcggggtagtcca

SEQ ID NO: 364044 - DNA, 25 bp, Mus musculus
ataggagcgcttccgagaccagaga

SEQ ID NO: 364045 - DNA, 25 bp, Mus musculus
gagtgctcacccgagagggtctcga

SEQ ID NO: 364046 - DNA, 25 bp, Mus musculus
attcagggaaaaataggagcgcttc

SEQ ID NO: 364047 - DNA, 25 bp, Mus musculus
cccaagacctcgaagggttcagtag

SEQ ID NO: 364048 - DNA, 25 bp, Mus musculus
gagttcttctcaataaaatcggaca

SEQ ID NO: 364049 - DNA, 25 bp, Mus musculus
ctcgtaaaaaggtgctcctggccga

SEQ ID NO: 364050 - DNA, 25 bp, Mus musculus
ccaccgagttgagacagggtacctc

SEQ ID NO: 364051 - DNA, 25 bp, Mus musculus
accagagagagggaactgagcttcg

SEQ ID NO: 364052 - DNA, 25 bp, Mus musculus
tgtgacgccacgctctttaacctgg

SEQ ID NO: 364053 - DNA, 25 bp, Mus musculus
gatgtccgtagccttgccacactcg

SEQ ID NO: 364054 - DNA, 25 bp, Mus musculus
tctcctcgggacaccgtgatgtccg

SEQ ID NO: 364055 - DNA, 25 bp, Mus musculus
ctttgggcgtctgttgtggtctcct

SEQ ID NO: 364056 - DNA, 25 bp, Mus musculus
aaagtgtgcgcctgcctttgggcgt

SEQ ID NO: 364057 - DNA, 25 bp, Mus musculus
ctagtacccggccacagcgtggcgg

SEQ ID NO: 364058 - DNA, 25 bp, Mus musculus
tgcaggggcgcttcccaaaccggac

SEQ ID NO: 364059 - DNA, 25 bp, Mus musculus
ggcttttctccgcttcacccttgga

SEQ ID NO: 364060 - DNA, 25 bp, Mus musculus
ttccaaccgctttctcctgcagggg

SEQ ID NO: 364061 - DNA, 25 bp, Mus musculus
accggtctaacactgccggatgtga

SEQ ID NO: 364062 - DNA, 25 bp, Mus musculus
ccgagaggcctagaagaagtagcag

SEQ ID NO: 364063 - DNA, 25 bp, Mus musculus
ggcgaaagaagataccgttcccatc

SEQ ID NO: 364064 - DNA, 25 bp, Mus musculus
gcttcgcaggagagcaacggcgaaa

SEQ ID NO: 364065 - DNA, 25 bp, Mus musculus
gccattttgtgcctctggcagcgcg

SEQ ID NO: 364066 - DNA, 25 bp, Mus musculus
ttacataatttatgcgctgggcgcc

SEQ ID NO: 364067 - DNA, 25 bp, Mus musculus
cgccctcagaggtctgttttacata

SEQ ID NO: 364068 - DNA, 25 bp, Mus musculus
gcggagcgtttcttctcgcgagcct

SEQ ID NO: 364069 - DNA, 25 bp, Mus musculus
agcaccggcttgtttatataatgaa

SEQ ID NO: 364070 - DNA, 25 bp, Mus musculus
gggcgttcggcccatagaaacacaa

SEQ ID NO: 364071 - DNA, 25 bp, Mus musculus
acctcttgtttaccctgtcttcagg

SEQ ID NO: 364072 - DNA, 25 bp, Mus musculus
cagcgatcggggatgaagaccgctc

SEQ ID NO: 364073 - DNA, 25 bp, Mus musculus
ttggctaacggtcggcctccctcaa

SEQ ID NO: 364074 - DNA, 25 bp, Mus musculus
gctgggcgccattgaccaatcagca

SEQ ID NO: 364075 - DNA, 25 bp, Mus musculus
tgaagctcttaaaggggccactcgc

SEQ ID NO: 364076 - DNA, 25 bp, Mus musculus
tgcagcagcgagctaagttatcatt

SEQ ID NO: 364077 - DNA, 25 bp, Mus musculus
ctcaggcgagaggaattcgtcattc

SEQ ID NO: 364078 - DNA, 25 bp, Mus musculus
cagaaactcgctgaccctgcctggg

SEQ ID NO: 364079 - DNA, 25 bp, Mus musculus
tgtcttcaggcaaatccagctgggc

SEQ ID NO: 364080 - DNA, 25 bp, Mus musculus
ggtcgcggtcttacctcaccatgca

SEQ ID NO: 364081 - DNA, 25 bp, Mus musculus
tcaagatgagcgcaggggcctcgtc

SEQ ID NO: 364082 - DNA, 25 bp, Mus musculus
aggggcctcgtctgcagttcctttc

SEQ ID NO: 364083 - DNA, 25 bp, Mus musculus
tgcagttcctttccctatcgcggga

SEQ ID NO: 364084 - DNA, 25 bp, Mus musculus
tatcgcgggacccactcttgctttg

SEQ ID NO: 364085 - DNA, 25 bp, Mus musculus
tcttgctttgccctggctctccaag

SEQ ID NO: 364086 - DNA, 25 bp, Mus musculus
cccaaactggtgatccctggttcgc

SEQ ID NO: 364087 - DNA, 25 bp, Mus musculus
gtcttacctcaccatgcaacacttg

SEQ ID NO: 364088 - DNA, 25 bp, Mus musculus
tgcaacacttggttgcgcgcttgcc

SEQ ID NO: 364089 - DNA, 25 bp, Mus musculus
ctagccgcttattcccttacttggg

SEQ ID NO: 364090 - DNA, 25 bp, Mus musculus
agacatcaggcagccaccagggttg

SEQ ID NO: 364091 - DNA, 25 bp, Mus musculus
cttccgccttcgctgctggaaggga

SEQ ID NO: 364092 - DNA, 25 bp, Mus musculus
ggaaggctgcctctgctacccgcta

SEQ ID NO: 364093 - DNA, 25 bp, Mus musculus
tggctctccaagttgctgccgggtc

SEQ ID NO: 364094 - DNA, 25 bp, Mus musculus
agtggtcccgacgacgcaaatgccc

SEQ ID NO: 364095 - DNA, 25 bp, Mus musculus
agtgctagacggagcctgctttgcc

SEQ ID NO: 364096 - DNA, 25 bp, Mus musculus
tgggcagttccatccttgccagggc

SEQ ID NO: 364097 - DNA, 25 bp, Mus musculus
agtggcccggcaaactcttggatcc

SEQ ID NO: 364098 - DNA, 25 bp, Mus musculus
gcgcggtcagcagaactcaagctca

SEQ ID NO: 364099 - DNA, 25 bp, Mus musculus
ggtctcagagcctccgggcttctta

SEQ ID NO: 364100 - DNA, 25 bp, Mus musculus
gctaccgaggggtcacgtgacacct

SEQ ID NO: 364101 - DNA, 25 bp, Mus musculus
ccctcgctacgtcacgtgggcagtt

SEQ ID NO: 364102 - DNA, 25 bp, Mus musculus
gatcccgtggttccgtcattactga

SEQ ID NO: 364103 - DNA, 25 bp, Mus musculus
cgcgcgtgatcctcccaggacaaga

SEQ ID NO: 364104 - DNA, 25 bp, Mus musculus
tttgccgcagcttttctcccggacg

SEQ ID NO: 364105 - DNA, 25 bp, Mus musculus
acgcctgggctgaagacacaatgtc

SEQ ID NO: 364106 - DNA, 25 bp, Mus musculus
gtgccgaccacgaccaccaaagtgg

SEQ ID NO: 364107 - DNA, 25 bp, Mus musculus
tgaggaaagctccattgtgccgcgc

SEQ ID NO: 364108 - DNA, 25 bp, Mus musculus
ccacgaccgcgtcgcgcttggggtt

SEQ ID NO: 364109 - DNA, 25 bp, Mus musculus
aagatgaagctcttggcggcctctg

SEQ ID NO: 364110 - DNA, 25 bp, Mus musculus
ggaggtatgtcctcgccacgaccgc

SEQ ID NO: 364111 - DNA, 25 bp, Mus musculus
cgcatacatgtccaagatgaagctc

SEQ ID NO: 364112 - DNA, 25 bp, Mus musculus
cccgcgtcacagcaggttgatctcg

SEQ ID NO: 364113 - DNA, 25 bp, Mus musculus
cagcaggttgatctcgtccaggtac

SEQ ID NO: 364114 - DNA, 25 bp, Mus musculus
atctcgtccaggtaccgggccagca

SEQ ID NO: 364115 - DNA, 25 bp, Mus musculus
cgcacgtccttgaacacgctgcgga

SEQ ID NO: 364116 - DNA, 25 bp, Mus musculus
cggacgctttgcgtgtccgtggcac

SEQ ID NO: 364117 - DNA, 25 bp, Mus musculus
tttgcgtgtccgtggcacaggtgaa

SEQ ID NO: 364118 - DNA, 25 bp, Mus musculus
tttcctgccaccgtcctggggctct

SEQ ID NO: 364119 - DNA, 25 bp, Mus musculus
gggctctgcgcagctcgcgtacacg

SEQ ID NO: 364120 - DNA, 25 bp, Mus musculus
cgtacacgcgcgcatacatgtccaa

SEQ ID NO: 364121 - DNA, 25 bp, Mus musculus
tccttgaacacgctgcggacgcttt

SEQ ID NO: 364122 - DNA, 25 bp, Mus musculus
gtgctggaagccgaatcttaactta

SEQ ID NO: 364123 - DNA, 25 bp, Mus musculus
cggcgtctctacaaggtaccaggtc

SEQ ID NO: 364124 - DNA, 25 bp, Mus musculus
tgctgctgtacctcatcgggactgt

SEQ ID NO: 364125 - DNA, 25 bp, Mus musculus
gcaccttctgcctgttgctgctgta

SEQ ID NO: 364126 - DNA, 25 bp, Mus musculus
ttctgctgtctgattggcttcccgc

SEQ ID NO: 364127 - DNA, 25 bp, Mus musculus
cggcgcgaacctctgacgttttctc

SEQ ID NO: 364128 - DNA, 25 bp, Mus musculus
ggtttcctacagcagcgcgctcttt

SEQ ID NO: 364129 - DNA, 25 bp, Mus musculus
ctctctcaagcaattggtcggaatc

SEQ ID NO: 364130 - DNA, 25 bp, Mus musculus
ccagactggtagtaagacctctctc

SEQ ID NO: 364131 - DNA, 25 bp, Mus musculus
tgcacatggcgtagcttccagactg

SEQ ID NO: 364132 - DNA, 25 bp, Mus musculus
agcgctcgcaagtcacgtgtgcaca

SEQ ID NO: 364133 - DNA, 25 bp, Mus musculus
cacgtactttgacacctcctggggt

SEQ ID NO: 364134 - DNA, 25 bp, Mus musculus
tcttttccacggtagcgagactgta

SEQ ID NO: 364135 - DNA, 25 bp, Mus musculus
agcctcgcgattggtggacattcgg

SEQ ID NO: 364136 - DNA, 25 bp, Mus musculus
ccacactgcaggtatgcgggctttt

SEQ ID NO: 364137 - DNA, 25 bp, Mus musculus
ggcctggtcctagggcactgagtaa

SEQ ID NO: 364138 - DNA, 25 bp, Mus musculus
aatcacgccggcttgcgcagagtta

SEQ ID NO: 364139 - DNA, 25 bp, Mus musculus
gggacgatcaccctggaccgtgaaa

SEQ ID NO: 364140 - DNA, 25 bp, Mus musculus
acattgtgacatcttggctgctgcc

SEQ ID NO: 364141 - DNA, 25 bp, Mus musculus
tgcccttcgagaagcttccatgatg

SEQ ID NO: 364142 - DNA, 25 bp, Mus musculus
cgggctttttcttagggcacacact

SEQ ID NO: 364143 - DNA, 25 bp, Mus musculus
cggtggcctgtagtcaaggtcacta

SEQ ID NO: 364144 - DNA, 25 bp, Mus musculus
gtggctccgcggattacaacaggta

SEQ ID NO: 364145 - DNA, 25 bp, Mus musculus
gcctgtcttttcagtcgggcgctga

SEQ ID NO: 364146 - DNA, 25 bp, Mus musculus
ttgtcatcgactcctgtagggcttc

SEQ ID NO: 364147 - DNA, 25 bp, Mus musculus
tccgggaacgctgtaataccaagta

SEQ ID NO: 364148 - DNA, 25 bp, Mus musculus
gcggtcgcgctgctgcaatattctt

SEQ ID NO: 364149 - DNA, 25 bp, Mus musculus
ttccgccgaaagcaaagagtcccag

SEQ ID NO: 364150 - DNA, 25 bp, Mus musculus
tccctttttggctagcggtggctaa

SEQ ID NO: 364151 - DNA, 25 bp, Mus musculus
cccttcgccggaaggggacactgtg

SEQ ID NO: 364152 - DNA, 25 bp, Mus musculus
ctaagctcggcttctgggtgcatct

SEQ ID NO: 364153 - DNA, 25 bp, Mus musculus
gatcctgtgtagactccgcggccag

SEQ ID NO: 364154 - DNA, 25 bp, Mus musculus
tcggcccagcagacactgcagagcg

SEQ ID NO: 364155 - DNA, 25 bp, Mus musculus
agcgcgccacgcaataacgtcactt

SEQ ID NO: 364156 - DNA, 25 bp, Mus musculus
gccgacctaaggagaaagctttgct

SEQ ID NO: 364157 - DNA, 25 bp, Mus musculus
aagctttgctcgaaggaccgggcct

SEQ ID NO: 364158 - DNA, 25 bp, Mus musculus
ccacgctgggagaggctttcattaa

SEQ ID NO: 364159 - DNA, 25 bp, Mus musculus
agccagtggcttcttgggtttgctg

SEQ ID NO: 364160 - DNA, 25 bp, Mus musculus
gggtttgctgccatcgtccgtcagc

SEQ ID NO: 364161 - DNA, 25 bp, Mus musculus
ggtcagggccaagacgtgctcactt

SEQ ID NO: 364162 - DNA, 25 bp, Mus musculus
gtgctcacttgacccttcgccggaa

SEQ ID NO: 364163 - DNA, 25 bp, Mus musculus
gtgacgcgctccctttttggctagc

SEQ ID NO: 364164 - DNA, 25 bp, Mus musculus
aacctacactgcagcgtctgtattg

SEQ ID NO: 364165 - DNA, 25 bp, Mus musculus
tctgtattgtgtaaggcgttgactc

SEQ ID NO: 364166 - DNA, 25 bp, Mus musculus
cggggacgcaggaacctacactgca

SEQ ID NO: 364167 - DNA, 25 bp, Mus musculus
acaaacccacgtgtgcggggacgca

SEQ ID NO: 364168 - DNA, 25 bp, Mus musculus
ttcccgattgagagagctgcaagtg

SEQ ID NO: 364169 - DNA, 25 bp, Mus musculus
cgcagccgccttcccgattgagaga

SEQ ID NO: 364170 - DNA, 25 bp, Mus musculus
cctaacaaagggaatcggactgcgc

SEQ ID NO: 364171 - DNA, 25 bp, Mus musculus
tggcactgcccgaccctaacaaagg

SEQ ID NO: 364172 - DNA, 25 bp, Mus musculus
gcccggcaagatccagaggcacctg

SEQ ID NO: 364173 - DNA, 25 bp, Mus musculus
cggagcttgagtcccgggctcttct

SEQ ID NO: 364174 - DNA, 25 bp, Mus musculus
ctcaaggggactcactcggagcttg

SEQ ID NO: 364175 - DNA, 25 bp, Mus musculus
gatccgttctcaaggggactcactc

SEQ ID NO: 364176 - DNA, 25 bp, Mus musculus
tctctgcttcccagaagatccgttc

SEQ ID NO: 364177 - DNA, 25 bp, Mus musculus
tttgcataacggagaccaagcgtcc

SEQ ID NO: 364178 - DNA, 25 bp, Mus musculus
ccggcgacaccgcggagagttctgc

SEQ ID NO: 364179 - DNA, 25 bp, Mus musculus
aagcagctctgctacgagtgcggta

SEQ ID NO: 364180 - DNA, 25 bp, Mus musculus
agctctgctacgagtgcggtacagc

SEQ ID NO: 364181 - DNA, 25 bp, Mus musculus
ctacgagtgcggtacagcacggctg

SEQ ID NO: 364182 - DNA, 25 bp, Mus musculus
ggtacagcacggctggatgagtcca

SEQ ID NO: 364183 - DNA, 25 bp, Mus musculus
cagcacggctggatgagtccagcat

SEQ ID NO: 364184 - DNA, 25 bp, Mus musculus
catgctggaggagaacatcgaaagc

SEQ ID NO: 364185 - DNA, 25 bp, Mus musculus
ctggaggagaacatcgaaagcctgg

SEQ ID NO: 364186 - DNA, 25 bp, Mus musculus
aacatcgaaagcctggtggacaacc

SEQ ID NO: 364187 - DNA, 25 bp, Mus musculus
gtttgcgagagcagtgctacgggga

SEQ ID NO: 364188 - DNA, 25 bp, Mus musculus
tggtggccactaccgcatccatgtg

SEQ ID NO: 364189 - DNA, 25 bp, Mus musculus
catccatgtggccagccggcaggac

SEQ ID NO: 364190 - DNA, 25 bp, Mus musculus
gcgtgtgttcaagcagctctgctac

SEQ ID NO: 364191 - DNA, 25 bp, Mus musculus
ccggcaggacaaccggcgacaccgc

SEQ ID NO: 364192 - DNA, 25 bp, Mus musculus
ccgcccaaagccaggacgatgcaga

SEQ ID NO: 364193 - DNA, 25 bp, Mus musculus
tagcgtctccttcagccgctatgga

SEQ ID NO: 364194 - DNA, 25 bp, Mus musculus
gacggcttcggtagcgtctccttca

SEQ ID NO: 364195 - DNA, 25 bp, Mus musculus
agcagcgacggcttcggtagcgtct

SEQ ID NO: 364196 - DNA, 25 bp, Mus musculus
cagtctagtcgcaggtcctcaggca

SEQ ID NO: 364197 - DNA, 25 bp, Mus musculus
tgggtcagtctagtcgcaggtcctc

SEQ ID NO: 364198 - DNA, 25 bp, Mus musculus
gacagcatcttccttgcctcaggca

SEQ ID NO: 364199 - DNA, 25 bp, Mus musculus
ccaggacgatgcagagcgcagccag

SEQ ID NO: 364200 - DNA, 25 bp, Mus musculus
ttcagccgctatggagctctccacg

SEQ ID NO: 364201 - DNA, 25 bp, Mus musculus
gtgacaccgcccaaagccaggacga

SEQ ID NO: 364202 - DNA, 25 bp, Mus musculus
cagaaactgacggagtctggggtcc

SEQ ID NO: 364203 - DNA, 25 bp, Mus musculus
cttctgcagaaactgacggagtctg

SEQ ID NO: 364204 - DNA, 25 bp, Mus musculus
ggcagccgccagagacttctgcaga

SEQ ID NO: 364205 - DNA, 25 bp, Mus musculus
cactggagacggcaggacagcatct

SEQ ID NO: 364206 - DNA, 25 bp, Mus musculus
cctctcggctgcgaaggtacagaga

SEQ ID NO: 364207 - DNA, 25 bp, Mus musculus
cgcagacgcggagactgactgacct

SEQ ID NO: 364208 - DNA, 25 bp, Mus musculus
ctcccagcgtcacgaatgctcttga

SEQ ID NO: 364209 - DNA, 25 bp, Mus musculus
ccactgacggtgagtggtccgctct

SEQ ID NO: 364210 - DNA, 25 bp, Mus musculus
ttcttcgaagctctgctccgctgtc

SEQ ID NO: 364211 - DNA, 25 bp, Mus musculus
accgagcgggccttgagcgtcaaat

SEQ ID NO: 364212 - DNA, 25 bp, Mus musculus
tgagcgtcaaatgagcccgaaaccg

SEQ ID NO: 364213 - DNA, 25 bp, Mus musculus
gaaaccgcggacgtcgcgctctaga

SEQ ID NO: 364214 - DNA, 25 bp, Mus musculus
tctagacggctttgagctccatccc

SEQ ID NO: 364215 - DNA, 25 bp, Mus musculus
actgactgacctgcggagccactga

SEQ ID NO: 364216 - DNA, 25 bp, Mus musculus
agcctacctgaggtcccggaggagc

SEQ ID NO: 364217 - DNA, 25 bp, Mus musculus
cagcgcagcacatgagcctacctga

SEQ ID NO: 364218 - DNA, 25 bp, Mus musculus
tcgaagttagtgcagcagcgcagca

SEQ ID NO: 364219 - DNA, 25 bp, Mus musculus
ccaagagtcctctggtgttcccgtg

SEQ ID NO: 364220 - DNA, 25 bp, Mus musculus
gcactgagccaacacgctgggcacg

SEQ ID NO: 364221 - DNA, 25 bp, Mus musculus
gcatgcgcactgagccaacacgctg

SEQ ID NO: 364222 - DNA, 25 bp, Mus musculus
actgcggtgcaatccgctgtctggc

SEQ ID NO: 364223 - DNA, 25 bp, Mus musculus
aatccgctgtctggccggctggcta

SEQ ID NO: 364224 - DNA, 25 bp, Mus musculus
tacgtggatgcggtactggccacca

SEQ ID NO: 364225 - DNA, 25 bp, Mus musculus
ggatgcggtactggccaccatcctc

SEQ ID NO: 364226 - DNA, 25 bp, Mus musculus
ctcatcgtaacactgctcgcgcaga

SEQ ID NO: 364227 - DNA, 25 bp, Mus musculus
acactgctcgcgcagactggtgatg

SEQ ID NO: 364228 - DNA, 25 bp, Mus musculus
gccctcgatattctcctccagcatg

SEQ ID NO: 364229 - DNA, 25 bp, Mus musculus
gctggactcgtccagccgcgacgtg

SEQ ID NO: 364230 - DNA, 25 bp, Mus musculus
cgcgacgtgccgcactgatagcaca

SEQ ID NO: 364231 - DNA, 25 bp, Mus musculus
tgccgcactgatagcacagctgctt

SEQ ID NO: 364232 - DNA, 25 bp, Mus musculus
atagcacagctgcttgaacacgcgc

SEQ ID NO: 364233 - DNA, 25 bp, Mus musculus
gcagaactcactgcggtgcaatccg

SEQ ID NO: 364234 - DNA, 25 bp, Mus musculus
tgtctctgcgatgaggacgccacta

SEQ ID NO: 364235 - DNA, 25 bp, Mus musculus
ccagtgcgtcggtgcaaccgggcca

SEQ ID NO: 364236 - DNA, 25 bp, Mus musculus
cgatgaggacgccactagaggccgc

SEQ ID NO: 364237 - DNA, 25 bp, Mus musculus
gacagctgtgtctctgcgatgagga

SEQ ID NO: 364238 - DNA, 25 bp, Mus musculus
agatgaactggattcctcccggccc

SEQ ID NO: 364239 - DNA, 25 bp, Mus musculus
tcccgcagtgatagaagatgaactg

SEQ ID NO: 364240 - DNA, 25 bp, Mus musculus
ggacaactcccgcagtgatagaaga

SEQ ID NO: 364241 - DNA, 25 bp, Mus musculus
gcctgggacaactcccgcagtgata

SEQ ID NO: 364242 - DNA, 25 bp, Mus musculus
aggcgcatttctccgcggcggcctg

SEQ ID NO: 364243 - DNA, 25 bp, Mus musculus
aacagaggcgcatttctccgcggcg

SEQ ID NO: 364244 - DNA, 25 bp, Mus musculus
tccaacccgaacagaggcgcatttc

SEQ ID NO: 364245 - DNA, 25 bp, Mus musculus
cagattcgtttccaacccgaacaga

SEQ ID NO: 364246 - DNA, 25 bp, Mus musculus
gcttcagacacgtccccagattcgt

SEQ ID NO: 364247 - DNA, 25 bp, Mus musculus
gcgtcggtgcaaccgggccatctcg

SEQ ID NO: 364248 - DNA, 25 bp, Mus musculus
agacacgatacttcatctggcttta

SEQ ID NO: 364249 - DNA, 25 bp, Mus musculus
tcatctggctttatgaccaaaaaga

SEQ ID NO: 364250 - DNA, 25 bp, Mus musculus
gcgaagccttcccaaaacactgtct

SEQ ID NO: 364251 - DNA, 25 bp, Mus musculus
aaagcaagccaagccgcgcgaagcc

SEQ ID NO: 364252 - DNA, 25 bp, Mus musculus
tgcaagcgagcagagaaagcaagcc

SEQ ID NO: 364253 - DNA, 25 bp, Mus musculus
ccagccgaggagttggcttgcattc

SEQ ID NO: 364254 - DNA, 25 bp, Mus musculus
ctcaaaggaaactgcagacacgata

SEQ ID NO: 364255 - DNA, 25 bp, Mus musculus
ccttgggaagatcacggctctcaaa

SEQ ID NO: 364256 - DNA, 25 bp, Mus musculus
aaaacactgtctctccttgggaaga

SEQ ID NO: 364257 - DNA, 25 bp, Mus musculus
ctgaaagcgccgcaggtgcaaaaaa

SEQ ID NO: 364258 - DNA, 25 bp, Mus musculus
gcagtcacgcagcacccaaaataca

SEQ ID NO: 364259 - DNA, 25 bp, Mus musculus
cgctgagagccaacgcagtcacgca

SEQ ID NO: 364260 - DNA, 25 bp, Mus musculus
ctgcctcgactccaaccaagaaaga

SEQ ID NO: 364261 - DNA, 25 bp, Mus musculus
aaggcagtttgcaagcgagcagaga

SEQ ID NO: 364262 - DNA, 25 bp, Mus musculus
gtcgctcaggcaacacgccatcatg

SEQ ID NO: 364263 - DNA, 25 bp, Mus musculus
cgggcacgcagctcaccaagtagca

SEQ ID NO: 364264 - DNA, 25 bp, Mus musculus
agctcaccaagtagcagcagcttga

SEQ ID NO: 364265 - DNA, 25 bp, Mus musculus
ttgtcccgccgcagctgtttctcga

SEQ ID NO: 364266 - DNA, 25 bp, Mus musculus
agctgtttctcgatctccgcgttga

SEQ ID NO: 364267 - DNA, 25 bp, Mus musculus
gttgatgcgcttcgactccttcacc

SEQ ID NO: 364268 - DNA, 25 bp, Mus musculus
actccagagtcatcgtcgcggtcct

SEQ ID NO: 364269 - DNA, 25 bp, Mus musculus
ccgaggacctgaagcgctgccacgg

SEQ ID NO: 364270 - DNA, 25 bp, Mus musculus
ctcggaagcccgagctcggttcctt

SEQ ID NO: 364271 - DNA, 25 bp, Mus musculus
tgaaggggtcgcacccgactgtcac

SEQ ID NO: 364272 - DNA, 25 bp, Mus musculus
cgaggacatccgaggtggcccgaca

SEQ ID NO: 364273 - DNA, 25 bp, Mus musculus
cgatctccgcgttgatgcgcttcga

SEQ ID NO: 364274 - DNA, 25 bp, Mus musculus
tactcgccggggaccagagaccgcg

SEQ ID NO: 364275 - DNA, 25 bp, Mus musculus
cgcagggacaggactttaggatcgc

SEQ ID NO: 364276 - DNA, 25 bp, Mus musculus
cctcccggccggcagaatgcctcgg

SEQ ID NO: 364277 - DNA, 25 bp, Mus musculus
gctcgccgccctatagtgcggatcg

SEQ ID NO: 364278 - DNA, 25 bp, Mus musculus
tcgccgccctatagtgcggatcgtg

SEQ ID NO: 364279 - DNA, 25 bp, Mus musculus
agtgcggatcgtggttcccgcagca

SEQ ID NO: 364280 - DNA, 25 bp, Mus musculus
gcggatcgtggttcccgcagcaccg

SEQ ID NO: 364281 - DNA, 25 bp, Mus musculus
cgcgcgcggctacaaggcgaccctc

SEQ ID NO: 364282 - DNA, 25 bp, Mus musculus
gggccaccgatggaaccgcccgctc

SEQ ID NO: 364283 - DNA, 25 bp, Mus musculus
cgctccgccgccgtcacgtgggctc

SEQ ID NO: 364284 - DNA, 25 bp, Mus musculus
ccgtcacgtgggctccgtgacgtcg

SEQ ID NO: 364285 - DNA, 25 bp, Mus musculus
gctccgtgacgtcggcgtcttcgct

SEQ ID NO: 364286 - DNA, 25 bp, Mus musculus
acgtcggcgtcttcgctgtagcaaa

SEQ ID NO: 364287 - DNA, 25 bp, Mus musculus
cgtcggcgtcttcgctgtagcaaag

SEQ ID NO: 364288 - DNA, 25 bp, Mus musculus
tcggcgtcttcgctgtagcaaagct

SEQ ID NO: 364289 - DNA, 25 bp, Mus musculus
ggcgtcttcgctgtagcaaagctcg

SEQ ID NO: 364290 - DNA, 25 bp, Mus musculus
tcgtggaatcccagttgtcaccgcg

SEQ ID NO: 364291 - DNA, 25 bp, Mus musculus
ttcgagctttcgtggaatcccagtt

SEQ ID NO: 364292 - DNA, 25 bp, Mus musculus
cggtggcttcgagctttcgtggaat

SEQ ID NO: 364293 - DNA, 25 bp, Mus musculus
tcgtagcgaaggcttcctcccgcag

SEQ ID NO: 364294 - DNA, 25 bp, Mus musculus
cccaggtatcgtagcgaaggcttcc

SEQ ID NO: 364295 - DNA, 25 bp, Mus musculus
tcccgggataagtagcgttagcggc

SEQ ID NO: 364296 - DNA, 25 bp, Mus musculus
cgctcgagctttcccgggataagta

SEQ ID NO: 364297 - DNA, 25 bp, Mus musculus
cactttttgtctgtgggttcgctcc

SEQ ID NO: 364298 - DNA, 25 bp, Mus musculus
ccggcctgctgctgaagtttcactt

SEQ ID NO: 364299 - DNA, 25 bp, Mus musculus
tgacgtcagcctccagcgctcaggg

SEQ ID NO: 364300 - DNA, 25 bp, Mus musculus
caggcaaagtcaggaattcaggccc

SEQ ID NO: 364301 - DNA, 25 bp, Mus musculus
tgcgtgcaggcaaagtcaggaattc

SEQ ID NO: 364302 - DNA, 25 bp, Mus musculus
cttacatggacaaatgcgtgcaggc

SEQ ID NO: 364303 - DNA, 25 bp, Mus musculus
cccataccttacatggacaaatgcg

SEQ ID NO: 364304 - DNA, 25 bp, Mus musculus
ctgcaggtagttgtagggaactctg

SEQ ID NO: 364305 - DNA, 25 bp, Mus musculus
tagcgagccgatcctgccgtgatcc

SEQ ID NO: 364306 - DNA, 25 bp, Mus musculus
aactccgagggctagcgagccgatc

SEQ ID NO: 364307 - DNA, 25 bp, Mus musculus
gagatcgtcgcgcttcttgcctgcc

SEQ ID NO: 364308 - DNA, 25 bp, Mus musculus
gcagccacgccgctggcgtagagca

SEQ ID NO: 364309 - DNA, 25 bp, Mus musculus
tcgccgctgtagtaggcagccacgc

SEQ ID NO: 364310 - DNA, 25 bp, Mus musculus
ctcgctcatagtcgccgctgtagta

SEQ ID NO: 364311 - DNA, 25 bp, Mus musculus
cggtgactgctcagggcggcttcca

SEQ ID NO: 364312 - DNA, 25 bp, Mus musculus
ggaactctgcgttggaagtcgctgc

SEQ ID NO: 364313 - DNA, 25 bp, Mus musculus
agtaccttgatgtaggccctctgca

SEQ ID NO: 364314 - DNA, 25 bp, Mus musculus
cagccacgttcagtaccttgatgta

SEQ ID NO: 364315 - DNA, 25 bp, Mus musculus
atgggcgcagccacgttcagtacct

SEQ ID NO: 364316 - DNA, 25 bp, Mus musculus
cgctcttaaagggacgcctccagct

SEQ ID NO: 364317 - DNA, 25 bp, Mus musculus
aagtcgctgcgcacgtcctcgctga

SEQ ID NO: 364318 - DNA, 25 bp, Mus musculus
ttcggcttggaccagggcgctgaaa

SEQ ID NO: 364319 - DNA, 25 bp, Mus musculus
tggctttcctaggttcggcttggac

SEQ ID NO: 364320 - DNA, 25 bp, Mus musculus
gtcggccaccctgcatccatctggt

SEQ ID NO: 364321 - DNA, 25 bp, Mus musculus
atcccagggccaatcgcgcggtggc

SEQ ID NO: 364322 - DNA, 25 bp, Mus musculus
cccagtggcccacgcggtggcaccc

SEQ ID NO: 364323 - DNA, 25 bp, Mus musculus
cctggcatccgccagcgggcggacc

SEQ ID NO: 364324 - DNA, 25 bp, Mus musculus
gcgattcaccgcgtgggtggagtct

SEQ ID NO: 364325 - DNA, 25 bp, Mus musculus
tgactggatcccagggccaatcgcg

SEQ ID NO: 364326 - DNA, 25 bp, Mus musculus
aaagtgcggcggaaagtaagaggct

SEQ ID NO: 364327 - DNA, 25 bp, Mus musculus
tgcatccatctggtcgctgtcgccg

SEQ ID NO: 364328 - DNA, 25 bp, Mus musculus
gccagcatctggctttcctaggttc

SEQ ID NO: 364329 - DNA, 25 bp, Mus musculus
agtctgtgactggatcccagggcca

SEQ ID NO: 364330 - DNA, 25 bp, Mus musculus
atctggctttcctaggttcggcttg

SEQ ID NO: 364331 - DNA, 25 bp, Mus musculus
ggaaggctgccagcatctggctttc

SEQ ID NO: 364332 - DNA, 25 bp, Mus musculus
cgcgaggctcctggctcttgctgct

SEQ ID NO: 364333 - DNA, 25 bp, Mus musculus
tgcccgtgagagctgagtctacaga

SEQ ID NO: 364334 - DNA, 25 bp, Mus musculus
cttgctgctctctgatttagtagga

SEQ ID NO: 364335 - DNA, 25 bp, Mus musculus
ctgatttagtaggaggctgtcaaac

SEQ ID NO: 364336 - DNA, 25 bp, Mus musculus
ctgtcaaacaggtgacgtacgtgcc

SEQ ID NO: 364337 - DNA, 25 bp, Mus musculus
acgtacgtgcctagggagccgccca

SEQ ID NO: 364338 - DNA, 25 bp, Mus musculus
cagcctaagccacggacacttcaga

SEQ ID NO: 364339 - DNA, 25 bp, Mus musculus
gccacggacacttcagagacaccag

SEQ ID NO: 364340 - DNA, 25 bp, Mus musculus
gagacaccagcactggcacctgaga

SEQ ID NO: 364341 - DNA, 25 bp, Mus musculus
cacctgagacatgcgcgtcgccttg

SEQ ID NO: 364342 - DNA, 25 bp, Mus musculus
ccgaccaaagcctgtgcccgtgaga

SEQ ID NO: 364343 - DNA, 25 bp, Mus musculus
gagctgagtctacagagtctacctg

SEQ ID NO: 364344 - DNA, 25 bp, Mus musculus
agttctaatccgctggagctgccag

SEQ ID NO: 364345 - DNA, 25 bp, Mus musculus
acagagtctacctggcgcagtggca

SEQ ID NO: 364346 - DNA, 25 bp, Mus musculus
cgccgcctttctggcacctctctcc

SEQ ID NO: 364347 - DNA, 25 bp, Mus musculus
tgtagatcagtccaagttgccgggc

SEQ ID NO: 364348 - DNA, 25 bp, Mus musculus
gaggcggtctggctcgcacgcctct

SEQ ID NO: 364349 - DNA, 25 bp, Mus musculus
atcagtccaagttgccgggcgtgaa

SEQ ID NO: 364350 - DNA, 25 bp, Mus musculus
tgaaggaaggtaggtcgggactcgc

SEQ ID NO: 364351 - DNA, 25 bp, Mus musculus
cggcgcctagctggcaggtgcagcc

SEQ ID NO: 364352 - DNA, 25 bp, Mus musculus
ctgcgtgcggtgcagccttgcagcc

SEQ ID NO: 364353 - DNA, 25 bp, Mus musculus
gccttcaggccgcagagctgtggcc

SEQ ID NO: 364354 - DNA, 25 bp, Mus musculus
acgcctctgcgtgcggtgcagcctt

SEQ ID NO: 364355 - DNA, 25 bp, Mus musculus
actggactccggtgcatttccggcc

SEQ ID NO: 364356 - DNA, 25 bp, Mus musculus
tgagtgtagatcagtccaagttgcc

SEQ ID NO: 364357 - DNA, 25 bp, Mus musculus
ccgacgtgagtgtagatcagtccaa

SEQ ID NO: 364358 - DNA, 25 bp, Mus musculus
ccatggccgacgtgagtgtagatca

SEQ ID NO: 364359 - DNA, 25 bp, Mus musculus
cctccgtactggactccggtgcatt

SEQ ID NO: 364360 - DNA, 25 bp, Mus musculus
ccgcagctcagataggggttacccg

SEQ ID NO: 364361 - DNA, 25 bp, Mus musculus
ccaccaaccgcgacagagaagagga

SEQ ID NO: 364362 - DNA, 25 bp, Mus musculus
agcgatccacgtccaaagggcagta

SEQ ID NO: 364363 - DNA, 25 bp, Mus musculus
agggagtttggtcacactgcgttca

SEQ ID NO: 364364 - DNA, 25 bp, Mus musculus
ctgcgttcagggtaccaagtggaaa

SEQ ID NO: 364365 - DNA, 25 bp, Mus musculus
gcgcaagcgttgtaaggtgtccaaa

SEQ ID NO: 364366 - DNA, 25 bp, Mus musculus
acccgtttacaaggcagagtctgga

SEQ ID NO: 364367 - DNA, 25 bp, Mus musculus
agcaatttaactccctgtggcccgc

SEQ ID NO: 364368 - DNA, 25 bp, Mus musculus
ttctgaagattaggaggtccgtccc

SEQ ID NO: 364369 - DNA, 25 bp, Mus musculus
tgaggtctacgaaatgcatcgcacc

SEQ ID NO: 364370 - DNA, 25 bp, Mus musculus
tcactgcctgcgttccggcatgaga

SEQ ID NO: 364371 - DNA, 25 bp, Mus musculus
gacgggcacagttggtgattattta

SEQ ID NO: 364372 - DNA, 25 bp, Mus musculus
cctggcggacttgggatcaggtcat

SEQ ID NO: 364373 - DNA, 25 bp, Mus musculus
gcaaagctgccgaaggtgtcctccc

SEQ ID NO: 364374 - DNA, 25 bp, Mus musculus
gcggctcgcagctgtcttgagcttc

SEQ ID NO: 364375 - DNA, 25 bp, Mus musculus
gccttttgagtcagggcttctagca

SEQ ID NO: 364376 - DNA, 25 bp, Mus musculus
ggcgtagcagccaatgatcttccgg

SEQ ID NO: 364377 - DNA, 25 bp, Mus musculus
agcgcccagtttgtttccgtgacgg

SEQ ID NO: 364378 - DNA, 25 bp, Mus musculus
gctgagccttgagacaccgtccgct

SEQ ID NO: 364379 - DNA, 25 bp, Mus musculus
ccctgccggttacataatctgtcgc

SEQ ID NO: 364380 - DNA, 25 bp, Mus musculus
aggcttgccagctcccaacatggtg

SEQ ID NO: 364381 - DNA, 25 bp, Mus musculus
tccacgcatgcacgcaagggcagct

SEQ ID NO: 364382 - DNA, 25 bp, Mus musculus
tgattgaggaaaggcgcggaaaccc

SEQ ID NO: 364383 - DNA, 25 bp, Mus musculus
aaggcgccctctgacccgcttgatt

SEQ ID NO: 364384 - DNA, 25 bp, Mus musculus
gcttgatcgaggaaaggcgccctct

SEQ ID NO: 364385 - DNA, 25 bp, Mus musculus
gagctcctctgacccgcttgatcga

SEQ ID NO: 364386 - DNA, 25 bp, Mus musculus
ctattaatactaacctccagtgggg

SEQ ID NO: 364387 - DNA, 25 bp, Mus musculus
tcaccagcgccagcatctattaata

SEQ ID NO: 364388 - DNA, 25 bp, Mus musculus
gaggctatgaggtgtgctgataaac

SEQ ID NO: 364389 - DNA, 25 bp, Mus musculus
agggcaagatggtgccaggtcaata

SEQ ID NO: 364390 - DNA, 25 bp, Mus musculus
aggtggtcacatatagggcaagatg

SEQ ID NO: 364391 - DNA, 25 bp, Mus musculus
cttcttgtttaagtggaggtggtca

SEQ ID NO: 364392 - DNA, 25 bp, Mus musculus
tgctgggtaggaagcttcttgttta

SEQ ID NO: 364393 - DNA, 25 bp, Mus musculus
tcatctgctgggtaggaagcttctt

SEQ ID NO: 364394 - DNA, 25 bp, Mus musculus
ggaaatcttcatctgctgggtagga

SEQ ID NO: 364395 - DNA, 25 bp, Mus musculus
gtctgagggaaatcttcatctgctg

SEQ ID NO: 364396 - DNA, 25 bp, Mus musculus
tgctgataaactgagtctgagggaa

SEQ ID NO: 364397 - DNA, 25 bp, Mus musculus
gccaggtcaatataggagtgaactc

SEQ ID NO: 364398 - DNA, 25 bp, Mus musculus
acatggcgcccggttaaaatgcagg

SEQ ID NO: 364399 - DNA, 25 bp, Mus musculus
gttaaaatgcaggttggaggctatg

SEQ ID NO: 364400 - DNA, 25 bp, Mus musculus
aggtgtgctgataaactgagtctga

SEQ ID NO: 364401 - DNA, 25 bp, Mus musculus
cgcccggttaaaatgcaggttggag

SEQ ID NO: 364402 - DNA, 25 bp, Mus musculus
ggacccgctagctccagcttgggtg

SEQ ID NO: 364403 - DNA, 25 bp, Mus musculus
ctccgcgcgacactttgggactttc

SEQ ID NO: 364404 - DNA, 25 bp, Mus musculus
agccgtgcgacctgtacgccgggct

SEQ ID NO: 364405 - DNA, 25 bp, Mus musculus
ctgcgacccagcgatggcctgcgag

SEQ ID NO: 364406 - DNA, 25 bp, Mus musculus
ttcatggagagactcgcgcagggtc

SEQ ID NO: 364407 - DNA, 25 bp, Mus musculus
cgcaagaatcttcatggagagactc

SEQ ID NO: 364408 - DNA, 25 bp, Mus musculus
tcttcagagaaagcgcaagaatctt

SEQ ID NO: 364409 - DNA, 25 bp, Mus musculus
gcatatgcactcctttcttcagaga

SEQ ID NO: 364410 - DNA, 25 bp, Mus musculus
ccacagaggcactgcagcatatgca

SEQ ID NO: 364411 - DNA, 25 bp, Mus musculus
tcaggctccttccacagaggcactg

SEQ ID NO: 364412 - DNA, 25 bp, Mus musculus
gcgctcggaagcctcgggccctttg

SEQ ID NO: 364413 - DNA, 25 bp, Mus musculus
gtgacttcagggctacacacactca

SEQ ID NO: 364414 - DNA, 25 bp, Mus musculus
acactttgggactttcgagagggcg

SEQ ID NO: 364415 - DNA, 25 bp, Mus musculus
gcgggtgacttcagggctacacaca

SEQ ID NO: 364416 - DNA, 25 bp, Mus musculus
tggcgctgtcggaagccaaaggctt

SEQ ID NO: 364417 - DNA, 25 bp, Mus musculus
ctgtcggaagccaaaggctttggcc

SEQ ID NO: 364418 - DNA, 25 bp, Mus musculus
ttgacagccagagcagatgcggcgc

SEQ ID NO: 364419 - DNA, 25 bp, Mus musculus
gccaaaggctttggcctccctgagg

SEQ ID NO: 364420 - DNA, 25 bp, Mus musculus
aggctttggcctccctgagggagtc

SEQ ID NO: 364421 - DNA, 25 bp, Mus musculus
cggcgcgcggtagcttctgggattc

SEQ ID NO: 364422 - DNA, 25 bp, Mus musculus
ctgagggagtcgctttcccggcccg

SEQ ID NO: 364423 - DNA, 25 bp, Mus musculus
cccgggtcggatcaatgggctgtaa

SEQ ID NO: 364424 - DNA, 25 bp, Mus musculus
gggtcggatcaatgggctgtaatta

SEQ ID NO: 364425 - DNA, 25 bp, Mus musculus
tcaatgggctgtaattataccgcgc

SEQ ID NO: 364426 - DNA, 25 bp, Mus musculus
gctgtaattataccgcgccgggccg

SEQ ID NO: 364427 - DNA, 25 bp, Mus musculus
ggggcgcagacccacgttactttga

SEQ ID NO: 364428 - DNA, 25 bp, Mus musculus
ctttgattgacagccagagcagatg

SEQ ID NO: 364429 - DNA, 25 bp, Mus musculus
tggcctccctgagggagtcgctttc

SEQ ID NO: 364430 - DNA, 25 bp, Mus musculus
tcttcatgcaaaacgcgccgagcgg

SEQ ID NO: 364431 - DNA, 25 bp, Mus musculus
gccgcaaccacgacagaagcaactt

SEQ ID NO: 364432 - DNA, 25 bp, Mus musculus
tactctggaacacccaacaagtttg

SEQ ID NO: 364433 - DNA, 25 bp, Mus musculus
ggagccgccatcttcatgcaaaacg

SEQ ID NO: 364434 - DNA, 25 bp, Mus musculus
aaggcaggcttgttgttgcagccca

SEQ ID NO: 364435 - DNA, 25 bp, Mus musculus
cctggatgagtttgttcagttcctc

SEQ ID NO: 364436 - DNA, 25 bp, Mus musculus
gtgcctggtgaattcctggatgagt

SEQ ID NO: 364437 - DNA, 25 bp, Mus musculus
ccagcgctctctggtcgtcgtattc

SEQ ID NO: 364438 - DNA, 25 bp, Mus musculus
atccttggcagtgtggatctccagc

SEQ ID NO: 364439 - DNA, 25 bp, Mus musculus
ccgttctccttacccagcatggaaa

SEQ ID NO: 364440 - DNA, 25 bp, Mus musculus
agagcggggaccatagcttccaccc

SEQ ID NO: 364441 - DNA, 25 bp, Mus musculus
ggacctcacggaaccaggggtgaca

SEQ ID NO: 364442 - DNA, 25 bp, Mus musculus
cgcggccgaggaaccaacaaaagag

SEQ ID NO: 364443 - DNA, 25 bp, Mus musculus
gaagcaacttgtcgctccagcacgg

SEQ ID NO: 364444 - DNA, 25 bp, Mus musculus
ccgagctccaaagaccaggggtagg

SEQ ID NO: 364445 - DNA, 25 bp, Mus musculus
gtctgggccgagctccaaagaccag

SEQ ID NO: 364446 - DNA, 25 bp, Mus musculus
gcaccgcagcgagcccgtggagaac

SEQ ID NO: 364447 - DNA, 25 bp, Mus musculus
cagggtctgctagcggcaccgcagc

SEQ ID NO: 364448 - DNA, 25 bp, Mus musculus
gtcacccagggtctgctagcggcac

SEQ ID NO: 364449 - DNA, 25 bp, Mus musculus
atggagtcacccagggtctgctagc

SEQ ID NO: 364450 - DNA, 25 bp, Mus musculus
atgcggatggagtcacccagggtct

SEQ ID NO: 364451 - DNA, 25 bp, Mus musculus
gccttggcctcagggcgatgcggat

SEQ ID NO: 364452 - DNA, 25 bp, Mus musculus
ctgtggtggccttggctgtggcctt

SEQ ID NO: 364453 - DNA, 25 bp, Mus musculus
cggacgctggcgttgacgcagcgga

SEQ ID NO: 364454 - DNA, 25 bp, Mus musculus
aggaacccgcggagggatcagaggt

SEQ ID NO: 364455 - DNA, 25 bp, Mus musculus
atgcagtctggcaggcgcgcgccag

SEQ ID NO: 364456 - DNA, 25 bp, Mus musculus
gccagggaccccaggatgcagtctg

SEQ ID NO: 364457 - DNA, 25 bp, Mus musculus
cgggtctgggccgagctccaaagac

SEQ ID NO: 364458 - DNA, 25 bp, Mus musculus
gtaagtgcggcctgcgacctggccc

SEQ ID NO: 364459 - DNA, 25 bp, Mus musculus
gtccatgcgccattgggagggactc

SEQ ID NO: 364460 - DNA, 25 bp, Mus musculus
atccgcggcccgtttgtgcagcctg

SEQ ID NO: 364461 - DNA, 25 bp, Mus musculus
gtttgtgcagcctgcctagcgttcc

SEQ ID NO: 364462 - DNA, 25 bp, Mus musculus
tagcgttcctgtgggtggttatttc

SEQ ID NO: 364463 - DNA, 25 bp, Mus musculus
ttatttcggagacggactgactacg

SEQ ID NO: 364464 - DNA, 25 bp, Mus musculus
actgactacgggagcccagccggct

SEQ ID NO: 364465 - DNA, 25 bp, Mus musculus
ggtggctgctctatgcccttgttgc

SEQ ID NO: 364466 - DNA, 25 bp, Mus musculus
tcttgcggaagtccatgcgccattg

SEQ ID NO: 364467 - DNA, 25 bp, Mus musculus
tctcagcgcctgtgtgtggtctgct

SEQ ID NO: 364468 - DNA, 25 bp, Mus musculus
ccttgttgctgagggcctcttcctg

SEQ ID NO: 364469 - DNA, 25 bp, Mus musculus
cctcttcctgggtcattgtcggagc

SEQ ID NO: 364470 - DNA, 25 bp, Mus musculus
tcattgtcggagcaggaatcggact

SEQ ID NO: 364471 - DNA, 25 bp, Mus musculus
ccagccggctcttgcggaagtccat

SEQ ID NO: 364472 - DNA, 25 bp, Mus musculus
acgcgccctcggaggagaccagccg

SEQ ID NO: 364473 - DNA, 25 bp, Mus musculus
tttcacttttccacaaggacgcgcc

SEQ ID NO: 364474 - DNA, 25 bp, Mus musculus
aaggagacctttgtgccgccctctg

SEQ ID NO: 364475 - DNA, 25 bp, Mus musculus
gcctgctggggaccacatgcctccc

SEQ ID NO: 364476 - DNA, 25 bp, Mus musculus
ctgctttgagccctgaagaagccag

SEQ ID NO: 364477 - DNA, 25 bp, Mus musculus
ccctgaagaagccaggctgcgagca

SEQ ID NO: 364478 - DNA, 25 bp, Mus musculus
aagccaggctgcgagcatgtcgcca

SEQ ID NO: 364479 - DNA, 25 bp, Mus musculus
aggctgcgagcatgtcgccaccgca

SEQ ID NO: 364480 - DNA, 25 bp, Mus musculus
gtcgccaccgcagccgatccagatg

SEQ ID NO: 364481 - DNA, 25 bp, Mus musculus
agccgatccagatgccgcgggcctc

SEQ ID NO: 364482 - DNA, 25 bp, Mus musculus
ctgcccacatgaaagcgcgcggcgg

SEQ ID NO: 364483 - DNA, 25 bp, Mus musculus
gaaatggcaagggcgtgagtcacca

SEQ ID NO: 364484 - DNA, 25 bp, Mus musculus
tctggaggacaaccggcacccgctg

SEQ ID NO: 364485 - DNA, 25 bp, Mus musculus
agcaagccgtgcgagcccttccctg

SEQ ID NO: 364486 - DNA, 25 bp, Mus musculus
gcgagccagctccaggcaccctgat

SEQ ID NO: 364487 - DNA, 25 bp, Mus musculus
gcaccctgatccttaactgccgctt

SEQ ID NO: 364488 - DNA, 25 bp, Mus musculus
tgccgcttccaaagtcccggctgat

SEQ ID NO: 364489 - DNA, 25 bp, Mus musculus
gccgcctcttttcataaactttatc

SEQ ID NO: 364490 - DNA, 25 bp, Mus musculus
cctaatcagtgtgggaaaggagcgc

SEQ ID NO: 364491 - DNA, 25 bp, Mus musculus
ccaaagtcccggctgatcctaatca

SEQ ID NO: 364492 - DNA, 25 bp, Mus musculus
gtcccggctgatcctaatcagtgtg

SEQ ID NO: 364493 - DNA, 25 bp, Mus musculus
cggctgatcctaatcagtgtgggaa

SEQ ID NO: 364494 - DNA, 25 bp, Mus musculus
agcgcacgccctgcctcggcccgca

SEQ ID NO: 364495 - DNA, 25 bp, Mus musculus
aataaacgagcaggcccgagtgtgc

SEQ ID NO: 364496 - DNA, 25 bp, Mus musculus
accataaataaacgagcaggcccga

SEQ ID NO: 364497 - DNA, 25 bp, Mus musculus
ttcataaactttatcgccgcggtgc

SEQ ID NO: 364498 - DNA, 25 bp, Mus musculus
ccctgataaagcaccataaataaac

SEQ ID NO: 364499 - DNA, 25 bp, Mus musculus
cataaactttatcgccgcggtgcac

SEQ ID NO: 364500 - DNA, 25 bp, Mus musculus
ctgggccactcgctgcgggtggcgc

SEQ ID NO: 364501 - DNA, 25 bp, Mus musculus
cgagagcaggttccgactttggcac

SEQ ID NO: 364502 - DNA, 25 bp, Mus musculus
agctgccgagagcaggttccgactt

SEQ ID NO: 364503 - DNA, 25 bp, Mus musculus
gtgagtcaaggcagcgcggggagct

SEQ ID NO: 364504 - DNA, 25 bp, Mus musculus
cgcgccaggcctggcggtgagtcaa

SEQ ID NO: 364505 - DNA, 25 bp, Mus musculus
cgctcacacattccacagccggcgg

SEQ ID NO: 364506 - DNA, 25 bp, Mus musculus
tgacacatggcgctcacacattcca

SEQ ID NO: 364507 - DNA, 25 bp, Mus musculus
ggcggtgacacatggcgctcacaca

SEQ ID NO: 364508 - DNA, 25 bp, Mus musculus
tttcccacagtctggggcggtgaca

SEQ ID NO: 364509 - DNA, 25 bp, Mus musculus
gcagcgttttcccacagtctggggc

SEQ ID NO: 364510 - DNA, 25 bp, Mus musculus
ggagcagcgttttcccacagtctgg

SEQ ID NO: 364511 - DNA, 25 bp, Mus musculus
gtgagcggagcagcgttttcccaca

SEQ ID NO: 364512 - DNA, 25 bp, Mus musculus
caaaagaagggcgtgctgggccact

SEQ ID NO: 364513 - DNA, 25 bp, Mus musculus
gcggagcagcgttttcccacagtct

SEQ ID NO: 364514 - DNA, 25 bp, Mus musculus
tgcagtcaaggaagcaccacctcgt

SEQ ID NO: 364515 - DNA, 25 bp, Mus musculus
gtttaacagtgtctggcgttccatc

SEQ ID NO: 364516 - DNA, 25 bp, Mus musculus
cggggatcaaacaacgcgctgggat

SEQ ID NO: 364517 - DNA, 25 bp, Mus musculus
caaacaacgcgctgggatcccgagc

SEQ ID NO: 364518 - DNA, 25 bp, Mus musculus
ccggtgcgccttgtgtgccaggcct

SEQ ID NO: 364519 - DNA, 25 bp, Mus musculus
acagtgtctggcgttccatcacaaa

SEQ ID NO: 364520 - DNA, 25 bp, Mus musculus
tgtctggcgttccatcacaaagggg

SEQ ID NO: 364521 - DNA, 25 bp, Mus musculus
aggtcatgcagtcaaggaagcacca

SEQ ID NO: 364522 - DNA, 25 bp, Mus musculus
tcccagggtttaacagtgtctggcg

SEQ ID NO: 364523 - DNA, 25 bp, Mus musculus
caaggaagcaccacctcgtccggga

SEQ ID NO: 364524 - DNA, 25 bp, Mus musculus
aagcaccacctcgtccgggaccaga

SEQ ID NO: 364525 - DNA, 25 bp, Mus musculus
agctggagaaatctttcacatgatc

SEQ ID NO: 364526 - DNA, 25 bp, Mus musculus
ttcacatgatctcagtgggaggttg

SEQ ID NO: 364527 - DNA, 25 bp, Mus musculus
tgcccaaggtcatgcagtcaaggaa

SEQ ID NO: 364528 - DNA, 25 bp, Mus musculus
tctatccgtattgccaactgggagc

SEQ ID NO: 364529 - DNA, 25 bp, Mus musculus
tatccgtattgccaactgggagcct

SEQ ID NO: 364530 - DNA, 25 bp, Mus musculus
atccgtattgccaactgggagcctg

SEQ ID NO: 364531 - DNA, 25 bp, Mus musculus
gtctatccgtattgccaactgggag

SEQ ID NO: 364532 - DNA, 25 bp, Mus musculus
tccgtattgccaactgggagcctgc

SEQ ID NO: 364533 - DNA, 25 bp, Mus musculus
ccgtattgccaactgggagcctgcg

SEQ ID NO: 364534 - DNA, 25 bp, Mus musculus
cgtattgccaactgggagcctgcgg

SEQ ID NO: 364535 - DNA, 25 bp, Mus musculus
cccgactcccttgcccgccgtctat

SEQ ID NO: 364536 - DNA, 25 bp, Mus musculus
cgccgtctatccgtattgccaactg

SEQ ID NO: 364537 - DNA, 25 bp, Mus musculus
gccgtctatccgtattgccaactgg

SEQ ID NO: 364538 - DNA, 25 bp, Mus musculus
ccgtctatccgtattgccaactggg

SEQ ID NO: 364539 - DNA, 25 bp, Mus musculus
cgtctatccgtattgccaactggga

SEQ ID NO: 364540 - DNA, 25 bp, Mus musculus
attgccaactgggagcctgcgggga

SEQ ID NO: 364541 - DNA, 25 bp, Mus musculus
aaaggtagagagagtggcggaggaa

SEQ ID NO: 364542 - DNA, 25 bp, Mus musculus
agctcggctggtggagctcttaaag

SEQ ID NO: 364543 - DNA, 25 bp, Mus musculus
cagctcggctggtggagctcttaaa

SEQ ID NO: 364544 - DNA, 25 bp, Mus musculus
caaactgcagctcggctggtggagc

SEQ ID NO: 364545 - DNA, 25 bp, Mus musculus
tgtcaaactgcagctcggctggtgg

SEQ ID NO: 364546 - DNA, 25 bp, Mus musculus
gccggccggctgatgtcaaactgca

SEQ ID NO: 364547 - DNA, 25 bp, Mus musculus
ctcgccggccggctgatgtcaaact

SEQ ID NO: 364548 - DNA, 25 bp, Mus musculus
cacgtgctccgactccaggcgcgcc

SEQ ID NO: 364549 - DNA, 25 bp, Mus musculus
aaacatcctggcacgtgctccgact

SEQ ID NO: 364550 - DNA, 25 bp, Mus musculus
ataaaacatcctggcacgtgctccg

SEQ ID NO: 364551 - DNA, 25 bp, Mus musculus
cggcaataaaacatcctggcacgtg

SEQ ID NO: 364552 - DNA, 25 bp, Mus musculus
cggcggcaataaaacatcctggcac

SEQ ID NO: 364553 - DNA, 25 bp, Mus musculus
ccgcggcggcaataaaacatcctgg

SEQ ID NO: 364554 - DNA, 25 bp, Mus musculus
gccgcggcggcaataaaacatcctg

SEQ ID NO: 364555 - DNA, 25 bp, Mus musculus
cagccgcggcggcaataaaacatcc

SEQ ID NO: 364556 - DNA, 25 bp, Mus musculus
tgcggccaaggtggctcgcccagca

SEQ ID NO: 364557 - DNA, 25 bp, Mus musculus
cccagggcagccacactgggccggc

SEQ ID NO: 364558 - DNA, 25 bp, Mus musculus
ttctggcaggaaatgaatagctccc

SEQ ID NO: 364559 - DNA, 25 bp, Mus musculus
gctgctttctggcaggaaatgaata

SEQ ID NO: 364560 - DNA, 25 bp, Mus musculus
gcaggaaatgaatagctcccagatg

SEQ ID NO: 364561 - DNA, 25 bp, Mus musculus
ctcccagatgagctcaggcaacctg

SEQ ID NO: 364562 - DNA, 25 bp, Mus musculus
tcaggcaacctgagaggtcgtgaga

SEQ ID NO: 364563 - DNA, 25 bp, Mus musculus
gggcgggagccgctgacacacaacc

SEQ ID NO: 364564 - DNA, 25 bp, Mus musculus
agccgcagagtctcggccgcccgac

SEQ ID NO: 364565 - DNA, 25 bp, Mus musculus
gcggcctgccagtgtttttccagtt

SEQ ID NO: 364566 - DNA, 25 bp, Mus musculus
tgccagtgtttttccagttctcccg

SEQ ID NO: 364567 - DNA, 25 bp, Mus musculus
gctcgcccagcaggcccggctgctt

SEQ ID NO: 364568 - DNA, 25 bp, Mus musculus
cagcgtttagaagccgcggagctgg

SEQ ID NO: 364569 - DNA, 25 bp, Mus musculus
tagctcggggcagcgtttagaagcc

SEQ ID NO: 364570 - DNA, 25 bp, Mus musculus
tctaccagaggactcgcagcactca

SEQ ID NO: 364571 - DNA, 25 bp, Mus musculus
ggagcgccacgtagagccaagtcta

SEQ ID NO: 364572 - DNA, 25 bp, Mus musculus
aagtctagacctgcaaaccggcggg

SEQ ID NO: 364573 - DNA, 25 bp, Mus musculus
cagccgtcgcttacagaaaagtaga

SEQ ID NO: 364574 - DNA, 25 bp, Mus musculus
gcgtgataatcacccgagtgggctg

SEQ ID NO: 364575 - DNA, 25 bp, Mus musculus
ggccctggaatgctagccctcgcag

SEQ ID NO: 364576 - DNA, 25 bp, Mus musculus
gtttacctcgaaatccagaagcctg

SEQ ID NO: 364577 - DNA, 25 bp, Mus musculus
ccgcaccgagaggaccctggaattt

SEQ ID NO: 364578 - DNA, 25 bp, Mus musculus
atttgtagtctttcggcgcacccgc

SEQ ID NO: 364579 - DNA, 25 bp, Mus musculus
tcggaagccgcttggaagtctcaga

SEQ ID NO: 364580 - DNA, 25 bp, Mus musculus
cttcgcgcctcacgcaatgagcttg

SEQ ID NO: 364581 - DNA, 25 bp, Mus musculus
gctgtggagaaaggcccaacctcct

SEQ ID NO: 364582 - DNA, 25 bp, Mus musculus
atcaactgccctgattttgcgtggc

SEQ ID NO: 364583 - DNA, 25 bp, Mus musculus
cagcattccctgaggcgggagccta

SEQ ID NO: 364584 - DNA, 25 bp, Mus musculus
ccagcgggtcttggaaccgaagaag

SEQ ID NO: 364585 - DNA, 25 bp, Mus musculus
ttttccaggctcagtctccttgcac

SEQ ID NO: 364586 - DNA, 25 bp, Mus musculus
agcttttccaggctcagtctccttg

SEQ ID NO: 364587 - DNA, 25 bp, Mus musculus
tctcctagcttttccaggctcagtc

SEQ ID NO: 364588 - DNA, 25 bp, Mus musculus
cggcttctctcctagcttttccagg

SEQ ID NO: 364589 - DNA, 25 bp, Mus musculus
tgctctttctttgcgtaaaaatccc

SEQ ID NO: 364590 - DNA, 25 bp, Mus musculus
cctggctgctctttctttgcgtaaa

SEQ ID NO: 364591 - DNA, 25 bp, Mus musculus
tacaaccccggacgcgctggctgga

SEQ ID NO: 364592 - DNA, 25 bp, Mus musculus
ggcgggaacactaggatcgaaccca

SEQ ID NO: 364593 - DNA, 25 bp, Mus musculus
gtcttggaaccgaagaagcagagca

SEQ ID NO: 364594 - DNA, 25 bp, Mus musculus
agctctagcttagcaccccaaattc

SEQ ID NO: 364595 - DNA, 25 bp, Mus musculus
taggatcgaacccaagcctcagttt

SEQ ID NO: 364596 - DNA, 25 bp, Mus musculus
ctccgcagccactgaggccaccagc

SEQ ID NO: 364597 - DNA, 25 bp, Mus musculus
cagaggcgcgcgcacagagattttt

SEQ ID NO: 364598 - DNA, 25 bp, Mus musculus
ggtgggcgggcacccacttaccagc

SEQ ID NO: 364599 - DNA, 25 bp, Mus musculus
agggccttctgggtcctccctgtca

SEQ ID NO: 364600 - DNA, 25 bp, Mus musculus
actgcagcatgagtgagggccttct

SEQ ID NO: 364601 - DNA, 25 bp, Mus musculus
ggaccggctcaagactgcagcatga

SEQ ID NO: 364602 - DNA, 25 bp, Mus musculus
cggaggaccggaccggctcaagact

SEQ ID NO: 364603 - DNA, 25 bp, Mus musculus
acttaccagcagctccacgaggctg

SEQ ID NO: 364604 - DNA, 25 bp, Mus musculus
tcctatcgtcaaccgggatgtgggg

SEQ ID NO: 364605 - DNA, 25 bp, Mus musculus
ctcgggatcctatcgtcaaccggga

SEQ ID NO: 364606 - DNA, 25 bp, Mus musculus
gtagagtctcgggatcctatcgtca

SEQ ID NO: 364607 - DNA, 25 bp, Mus musculus
ctccttgtagagtctcgggatccta

SEQ ID NO: 364608 - DNA, 25 bp, Mus musculus
agccctgctccttgtagagtctcgg

SEQ ID NO: 364609 - DNA, 25 bp, Mus musculus
gcgccagccctgctccttgtagagt

SEQ ID NO: 364610 - DNA, 25 bp, Mus musculus
ctgtcatttaaacagcccctcgtga

SEQ ID NO: 364611 - DNA, 25 bp, Mus musculus
acgaggctgccgggtcaataagaag

SEQ ID NO: 364612 - DNA, 25 bp, Mus musculus
gaaccggggcttccagagcattttc

SEQ ID NO: 364613 - DNA, 25 bp, Mus musculus
ccagagcattttcggttggagggtc

SEQ ID NO: 364614 - DNA, 25 bp, Mus musculus
tgcagcagctcccagaacgacaggc

SEQ ID NO: 364615 - DNA, 25 bp, Mus musculus
atgtccgggtgatgccgcagccact

SEQ ID NO: 364616 - DNA, 25 bp, Mus musculus
agggccacaggccacagtcgcagag

SEQ ID NO: 364617 - DNA, 25 bp, Mus musculus
cagagccaggggttgtgacccagca

SEQ ID NO: 364618 - DNA, 25 bp, Mus musculus
tcagctggggcagagccgcgaacac

SEQ ID NO: 364619 - DNA, 25 bp, Mus musculus
acgctctcgaggctgctgaggttgc

SEQ ID NO: 364620 - DNA, 25 bp, Mus musculus
gcgaacacgtctcctggcagcgtct

SEQ ID NO: 364621 - DNA, 25 bp, Mus musculus
agcgtctccagctggttgtgctcta

SEQ ID NO: 364622 - DNA, 25 bp, Mus musculus
gtgggtgccgttcagccacagctcc

SEQ ID NO: 364623 - DNA, 25 bp, Mus musculus
ttgtgctctagctgcacgctctcga

SEQ ID NO: 364624 - DNA, 25 bp, Mus musculus
ccagcgtctgcaagccgctcaggtt

SEQ ID NO: 364625 - DNA, 25 bp, Mus musculus
caagccgctcaggttgcggaaggca

SEQ ID NO: 364626 - DNA, 25 bp, Mus musculus
gagcactgcgcggcatcgcggacca

SEQ ID NO: 364627 - DNA, 25 bp, Mus musculus
ggcatcgcggaccacacacttgcag

SEQ ID NO: 364628 - DNA, 25 bp, Mus musculus
ttgggcacgcaagagtgcgagcacc

SEQ ID NO: 364629 - DNA, 25 bp, Mus musculus
gcatcgcggaccacacacttgcagg

SEQ ID NO: 364630 - DNA, 25 bp, Mus musculus
atcgcggaccacacacttgcaggtt

SEQ ID NO: 364631 - DNA, 25 bp, Mus musculus
tcagcgatgtgagccacgctgccgc

SEQ ID NO: 364632 - DNA, 25 bp, Mus musculus
cgcggaccacacacttgcaggtttt

SEQ ID NO: 364633 - DNA, 25 bp, Mus musculus
gcggaccacacacttgcaggttttg

SEQ ID NO: 364634 - DNA, 25 bp, Mus musculus
cggaccacacacttgcaggttttgg

SEQ ID NO: 364635 - DNA, 25 bp, Mus musculus
gaccacacacttgcaggttttgggg

SEQ ID NO: 364636 - DNA, 25 bp, Mus musculus
ccacacacttgcaggttttggggca

SEQ ID NO: 364637 - DNA, 25 bp, Mus musculus
acacacttgcaggttttggggcagg

SEQ ID NO: 364638 - DNA, 25 bp, Mus musculus
acgcaagagtgcgagcaccgcggac

SEQ ID NO: 364639 - DNA, 25 bp, Mus musculus
tcgcggaccacacacttgcaggttt

SEQ ID NO: 364640 - DNA, 25 bp, Mus musculus
cgcgtcaacctgagggttttcagtt

SEQ ID NO: 364641 - DNA, 25 bp, Mus musculus
tgtgtgaggttcgtaggcagaccta

SEQ ID NO: 364642 - DNA, 25 bp, Mus musculus
ggttcgtaggcagacctagctcagc

SEQ ID NO: 364643 - DNA, 25 bp, Mus musculus
cgctgaagctgtggttccgcaatat

SEQ ID NO: 364644 - DNA, 25 bp, Mus musculus
cgcacgtggaagacgagagattttg

SEQ ID NO: 364645 - DNA, 25 bp, Mus musculus
tatgccctggtccattcggaagagc

SEQ ID NO: 364646 - DNA, 25 bp, Mus musculus
tgtggttccgcaatatgccctggtc

SEQ ID NO: 364647 - DNA, 25 bp, Mus musculus
tgaaggactgtcatgccgctgaagc

SEQ ID NO: 364648 - DNA, 25 bp, Mus musculus
atcaggcgctgaaggactgtcatgc

SEQ ID NO: 364649 - DNA, 25 bp, Mus musculus
gctatctgagagcatcaggcgctga

SEQ ID NO: 364650 - DNA, 25 bp, Mus musculus
cgatggcggaaatgtggctatctga

SEQ ID NO: 364651 - DNA, 25 bp, Mus musculus
gttttcagttttaccaggtcattga

SEQ ID NO: 364652 - DNA, 25 bp, Mus musculus
cgagagattttgttgcgcgtcaacc

SEQ ID NO: 364653 - DNA, 25 bp, Mus musculus
tccattcggaagagcaggatgtgtg

SEQ ID NO: 364654 - DNA, 25 bp, Mus musculus
cccagagaggtgatgtccgattcga

SEQ ID NO: 364655 - DNA, 25 bp, Mus musculus
gtgaggtcacgtgattgcctcatcc

SEQ ID NO: 364656 - DNA, 25 bp, Mus musculus
cagcccgcctaagcgagaactgcta

SEQ ID NO: 364657 - DNA, 25 bp, Mus musculus
actcccgcgccggatgtgaggtcac

SEQ ID NO: 364658 - DNA, 25 bp, Mus musculus
tctgtgctgcgaagcggtctcccgc

SEQ ID NO: 364659 - DNA, 25 bp, Mus musculus
tccgattcgagtcgaggaagcagcc

SEQ ID NO: 364660 - DNA, 25 bp, Mus musculus
tacacgtgctcccagacagtgccgg

SEQ ID NO: 364661 - DNA, 25 bp, Mus musculus
acgcagagggtgcactccagacctc

SEQ ID NO: 364662 - DNA, 25 bp, Mus musculus
tggactttctagagcggctggccta

SEQ ID NO: 364663 - DNA, 25 bp, Mus musculus
cgggcacatcaccttctggactttc

SEQ ID NO: 364664 - DNA, 25 bp, Mus musculus
agcaccggcacggacccatctgggg

SEQ ID NO: 364665 - DNA, 25 bp, Mus musculus
cgagaactgctagcgggatgctgct

SEQ ID NO: 364666 - DNA, 25 bp, Mus musculus
tgctgctcaggactcattttgcggg

SEQ ID NO: 364667 - DNA, 25 bp, Mus musculus
atctggggcccttcccacattcttg

SEQ ID NO: 364668 - DNA, 25 bp, Mus musculus
gccgctgcccgcagtgttcccgtgc

SEQ ID NO: 364669 - DNA, 25 bp, Mus musculus
cccaaatggagttgttatcctgact

SEQ ID NO: 364670 - DNA, 25 bp, Mus musculus
tggagttgttatcctgactcaggcc

SEQ ID NO: 364671 - DNA, 25 bp, Mus musculus
tatcctgactcaggccagctttgtg

SEQ ID NO: 364672 - DNA, 25 bp, Mus musculus
tcaggccagctttgtgtggctcggc

SEQ ID NO: 364673 - DNA, 25 bp, Mus musculus
ccagctttgtgtggctcggctgctg

SEQ ID NO: 364674 - DNA, 25 bp, Mus musculus
gaacgctacttgctatcccccaggg

SEQ ID NO: 364675 - DNA, 25 bp, Mus musculus
ccgtcgagggtgagcttcggagtca

SEQ ID NO: 364676 - DNA, 25 bp, Mus musculus
actcggagggagagaccggcctctt

SEQ ID NO: 364677 - DNA, 25 bp, Mus musculus
ggagagaccggcctcttagccatac

SEQ ID NO: 364678 - DNA, 25 bp, Mus musculus
cctcttagccataccctgcggagta

SEQ ID NO: 364679 - DNA, 25 bp, Mus musculus
tagccataccctgcggagtacgaag

SEQ ID NO: 364680 - DNA, 25 bp, Mus musculus
gcatcccggaagtgccccaaatgga

SEQ ID NO: 364681 - DNA, 25 bp, Mus musculus
ccctgcggagtacgaagaaatgccc

SEQ ID NO: 364682 - DNA, 25 bp, Mus musculus
agcgctccaggtagtcccagttcaa

SEQ ID NO: 364683 - DNA, 25 bp, Mus musculus
gtccagaaaggactccacttcagtc

SEQ ID NO: 364684 - DNA, 25 bp, Mus musculus
ctccacttcagtccacatagcaatg

SEQ ID NO: 364685 - DNA, 25 bp, Mus musculus
atagcaatgtcagatccgaactcgg

SEQ ID NO: 364686 - DNA, 25 bp, Mus musculus
tccgaactcggacttgagctacctg

SEQ ID NO: 364687 - DNA, 25 bp, Mus musculus
cggacttgagctacctgcaggacgc

SEQ ID NO: 364688 - DNA, 25 bp, Mus musculus
ccattacagcgtgtgggcagcgatc

SEQ ID NO: 364689 - DNA, 25 bp, Mus musculus
ccacaggccgaaggagatgcagacg

SEQ ID NO: 364690 - DNA, 25 bp, Mus musculus
ccaggtagtcccagttcaagagcgg

SEQ ID NO: 364691 - DNA, 25 bp, Mus musculus
agcctcgcctattgtggggctctgc

SEQ ID NO: 364692 - DNA, 25 bp, Mus musculus
agcacccagtccctttgcgggttcg

SEQ ID NO: 364693 - DNA, 25 bp, Mus musculus
gttcgcccggttccaaagccagaca

SEQ ID NO: 364694 - DNA, 25 bp, Mus musculus
agacaatactctggcgcggaccagc

SEQ ID NO: 364695 - DNA, 25 bp, Mus musculus
aggcggcgcagatccacaggccgaa

SEQ ID NO: 364696 - DNA, 25 bp, Mus musculus
tgccggataagtactcggcccaggg

SEQ ID NO: 364697 - DNA, 25 bp, Mus musculus
gctgagtctgctgccggataagtac

SEQ ID NO: 364698 - DNA, 25 bp, Mus musculus
gcctaagttgtccagtccggaagtg

SEQ ID NO: 364699 - DNA, 25 bp, Mus musculus
gcgagcctaagttgtccagtccgga

SEQ ID NO: 364700 - DNA, 25 bp, Mus musculus
gaagtgatgtaagagcgagcctaag

SEQ ID NO: 364701 - DNA, 25 bp, Mus musculus
tggctgcggcttcgctgagtctgct

SEQ ID NO: 364702 - DNA, 25 bp, Mus musculus
tccggctgtgaacccggaagtgatg

SEQ ID NO: 364703 - DNA, 25 bp, Mus musculus
ttctccggctgtgaacccggaagtg

SEQ ID NO: 364704 - DNA, 25 bp, Mus musculus
agcacgcgaggcttccggtttctcc

SEQ ID NO: 364705 - DNA, 25 bp, Mus musculus
aaccactgctcagcacgcgaggctt

SEQ ID NO: 364706 - DNA, 25 bp, Mus musculus
atcaacagcacaaaccactgctcag

SEQ ID NO: 364707 - DNA, 25 bp, Mus musculus
cataaccacgcatcaacagcacaaa

SEQ ID NO: 364708 - DNA, 25 bp, Mus musculus
cggcgctcgtctccgacccataacc

SEQ ID NO: 364709 - DNA, 25 bp, Mus musculus
tgtccagtccggaagtgtaacagcg

SEQ ID NO: 364710 - DNA, 25 bp, Mus musculus
ctgcggggttcccaagcactatctg

SEQ ID NO: 364711 - DNA, 25 bp, Mus musculus
cacacttggggcaagctgcttattc

SEQ ID NO: 364712 - DNA, 25 bp, Mus musculus
cagacctctcggaccacacttgggg

SEQ ID NO: 364713 - DNA, 25 bp, Mus musculus
cgcactgctgtagtttccgcggctc

SEQ ID NO: 364714 - DNA, 25 bp, Mus musculus
tggccctggcccaagacttgtgtgt

SEQ ID NO: 364715 - DNA, 25 bp, Mus musculus
gtcacgttcgctgaagaagagttcc

SEQ ID NO: 364716 - DNA, 25 bp, Mus musculus
accatcccggttgctttggccgagc

SEQ ID NO: 364717 - DNA, 25 bp, Mus musculus
tccgctccgctctcttattttgttg

SEQ ID NO: 364718 - DNA, 25 bp, Mus musculus
gccggccgtcaagggactaagatga

SEQ ID NO: 364719 - DNA, 25 bp, Mus musculus
cccagcctgagttttatttttcgag

SEQ ID NO: 364720 - DNA, 25 bp, Mus musculus
ctgccgtggaagaagcacaagttcg

SEQ ID NO: 364721 - DNA, 25 bp, Mus musculus
agggctacgctgtgagcctgcacta

SEQ ID NO: 364722 - DNA, 25 bp, Mus musculus
tacactgtgctctacctggggaatg

SEQ ID NO: 364723 - DNA, 25 bp, Mus musculus
cgagccgcccacctttatttatttg

SEQ ID NO: 364724 - DNA, 25 bp, Mus musculus
ctggacaggctacgggcacaggaat

SEQ ID NO: 364725 - DNA, 25 bp, Mus musculus
ttcgcagccgccaggtcctaaattc

SEQ ID NO: 364726 - DNA, 25 bp, Mus musculus
tcacgagcgtggatacctaaaaggc

SEQ ID NO: 364727 - DNA, 25 bp, Mus musculus
gggcccactcagagcagcactctag

SEQ ID NO: 364728 - DNA, 25 bp, Mus musculus
gcccaggtagtagaaggcgcacacc

SEQ ID NO: 364729 - DNA, 25 bp, Mus musculus
tcagcctcttggtggcgctggagaa

SEQ ID NO: 364730 - DNA, 25 bp, Mus musculus
aacatcatcagcaggtggtagtcca

SEQ ID NO: 364731 - DNA, 25 bp, Mus musculus
gtgctccgccttggtgaacatcatc

SEQ ID NO: 364732 - DNA, 25 bp, Mus musculus
acctcgtgcgcctcgaatttggcga

SEQ ID NO: 364733 - DNA, 25 bp, Mus musculus
ggctggcctcttcgctcacgaagtg

SEQ ID NO: 364734 - DNA, 25 bp, Mus musculus
tcaccttgcacttgaagccggcggc

SEQ ID NO: 364735 - DNA, 25 bp, Mus musculus
ccggagatgccgatgacagctcaga

SEQ ID NO: 364736 - DNA, 25 bp, Mus musculus
gcacaggaatcggacagcgctcacc

SEQ ID NO: 364737 - DNA, 25 bp, Mus musculus
attccgagggattagaccgcagatg

SEQ ID NO: 364738 - DNA, 25 bp, Mus musculus
ccgcgaagactgcaacggctcggca

SEQ ID NO: 364739 - DNA, 25 bp, Mus musculus
gatgcccagaaagcttgcgcgcaga

SEQ ID NO: 364740 - DNA, 25 bp, Mus musculus
ggggcgagtccttcagacactcctc

SEQ ID NO: 364741 - DNA, 25 bp, Mus musculus
gcactaggagacacggcggttacct

SEQ ID NO: 364742 - DNA, 25 bp, Mus musculus
attgctccctgggtcgacgagtgat

SEQ ID NO: 364743 - DNA, 25 bp, Mus musculus
gctaccagggctagcgattgctccc

SEQ ID NO: 364744 - DNA, 25 bp, Mus musculus
agggtattcccagatcagacgatgc

SEQ ID NO: 364745 - DNA, 25 bp, Mus musculus
tgcactcagatctgcgggtgtaccc

SEQ ID NO: 364746 - DNA, 25 bp, Mus musculus
agcgctagagcaggacgcgacttta

SEQ ID NO: 364747 - DNA, 25 bp, Mus musculus
gattccatcgaatctgcctccagcg

SEQ ID NO: 364748 - DNA, 25 bp, Mus musculus
ctcccgaaaccgaggcggcagagta

SEQ ID NO: 364749 - DNA, 25 bp, Mus musculus
tagcgggaagaggaactaagtgacc

SEQ ID NO: 364750 - DNA, 25 bp, Mus musculus
taagtgacccgcaaagatgcccaga

SEQ ID NO: 364751 - DNA, 25 bp, Mus musculus
cctgggcatagcagccgcgaagact

SEQ ID NO: 364752 - DNA, 25 bp, Mus musculus
ctgcagcgacggtaacatcgtggtc

SEQ ID NO: 364753 - DNA, 25 bp, Mus musculus
tcagttcccaggtgcgctcacaatc

SEQ ID NO: 364754 - DNA, 25 bp, Mus musculus
gcttcagcagcatgacttcagttcc

SEQ ID NO: 364755 - DNA, 25 bp, Mus musculus
gcctggacaacactgtgcgctgctg

SEQ ID NO: 364756 - DNA, 25 bp, Mus musculus
gacatatcagactacgggacccggc

SEQ ID NO: 364757 - DNA, 25 bp, Mus musculus
gggccagctgcatcgacatatcaga

SEQ ID NO: 364758 - DNA, 25 bp, Mus musculus
gtagacagttccagggccacacgga

SEQ ID NO: 364759 - DNA, 25 bp, Mus musculus
gacgtctgctctcgccctgtagaca

SEQ ID NO: 364760 - DNA, 25 bp, Mus musculus
acaggtgactgcagtcttggacgtc

SEQ ID NO: 364761 - DNA, 25 bp, Mus musculus
atcgtggtctgggacctgcagaacc

SEQ ID NO: 364762 - DNA, 25 bp, Mus musculus
gccaaggtctgcttctcctgctgca

SEQ ID NO: 364763 - DNA, 25 bp, Mus musculus
gccgtcagtccggacgccaaggtct

SEQ ID NO: 364764 - DNA, 25 bp, Mus musculus
cagaaccaggccatggtcaggtgtg

SEQ ID NO: 364765 - DNA, 25 bp, Mus musculus
ggcctgctatgctctggccgtcagt

SEQ ID NO: 364766 - DNA, 25 bp, Mus musculus
gcttgccttatcactgggccctgga

SEQ ID NO: 364767 - DNA, 25 bp, Mus musculus
ttcaaggcgctgctagaaatcacca

SEQ ID NO: 364768 - DNA, 25 bp, Mus musculus
gcatctttctgtcccagtgacgtca

SEQ ID NO: 364769 - DNA, 25 bp, Mus musculus
tagcagttgcttcgcctgatcggcc

SEQ ID NO: 364770 - DNA, 25 bp, Mus musculus
ggtaaacaaagctggccgcccaatg

SEQ ID NO: 364771 - DNA, 25 bp, Mus musculus
ctaactcttggccagtcgtgcagga

SEQ ID NO: 364772 - DNA, 25 bp, Mus musculus
gcgaagttgcgaaccagggaccatt

SEQ ID NO: 364773 - DNA, 25 bp, Mus musculus
ttccagagctcgcaaggcatctttg

SEQ ID NO: 364774 - DNA, 25 bp, Mus musculus
tcgcgactgtaccaatgggccgtca

SEQ ID NO: 364775 - DNA, 25 bp, Mus musculus
tttggtcctactccactgccctagg

SEQ ID NO: 364776 - DNA, 25 bp, Mus musculus
gcgctcttaggggactctctgatag

SEQ ID NO: 364777 - DNA, 25 bp, Mus musculus
cctgtgtgctgctgtgcttagcatc

SEQ ID NO: 364778 - DNA, 25 bp, Mus musculus
gggaccattgcacaagcttgcctta

SEQ ID NO: 364779 - DNA, 25 bp, Mus musculus
gacctggtgtttgagctcgtccatg

SEQ ID NO: 364780 - DNA, 25 bp, Mus musculus
tccctctcgcgatatctagggcggg

SEQ ID NO: 364781 - DNA, 25 bp, Mus musculus
ccctctcgcgatatctagggcgggg

SEQ ID NO: 364782 - DNA, 25 bp, Mus musculus
ctccctctcgcgatatctagggcgg

SEQ ID NO: 364783 - DNA, 25 bp, Mus musculus
cggccctccctctcgcgatatctag

SEQ ID NO: 364784 - DNA, 25 bp, Mus musculus
tgccgaagccaagcccggccctccc

SEQ ID NO: 364785 - DNA, 25 bp, Mus musculus
acgcggatgccgaagccaagcccgg

SEQ ID NO: 364786 - DNA, 25 bp, Mus musculus
gacgcggatgccgaagccaagcccg

SEQ ID NO: 364787 - DNA, 25 bp, Mus musculus
ggcctcccggctctccctcactcac

SEQ ID NO: 364788 - DNA, 25 bp, Mus musculus
ttccaggctggcctcccggctctcc

SEQ ID NO: 364789 - DNA, 25 bp, Mus musculus
gtcctccgggaaggcgaggcttcca

SEQ ID NO: 364790 - DNA, 25 bp, Mus musculus
gccacggcctctggcggctccggcc

SEQ ID NO: 364791 - DNA, 25 bp, Mus musculus
aacgccacggcctctggcggctccg

SEQ ID NO: 364792 - DNA, 25 bp, Mus musculus
cgcgacaaacgccacggcctctggc

SEQ ID NO: 364793 - DNA, 25 bp, Mus musculus
tccctcactcacctcagttcctctt

SEQ ID NO: 364794 - DNA, 25 bp, Mus musculus
ctttattatcgctaccggaggcccg

SEQ ID NO: 364795 - DNA, 25 bp, Mus musculus
ctcagccaattggagcccagccttg

SEQ ID NO: 364796 - DNA, 25 bp, Mus musculus
ggaggagaattctggtcccggcatt

SEQ ID NO: 364797 - DNA, 25 bp, Mus musculus
ctgtgctcggaaaggatgctggaca

SEQ ID NO: 364798 - DNA, 25 bp, Mus musculus
attctctgggttttggcagcgcctc

SEQ ID NO: 364799 - DNA, 25 bp, Mus musculus
gcctccactaggctctattctctgg

SEQ ID NO: 364800 - DNA, 25 bp, Mus musculus
agccacttatgcagccttaacaagg

SEQ ID NO: 364801 - DNA, 25 bp, Mus musculus
ccgagtctgggtcgaagccacttat

SEQ ID NO: 364802 - DNA, 25 bp, Mus musculus
ctggcccaaggtcacttcgtagttc

SEQ ID NO: 364803 - DNA, 25 bp, Mus musculus
ccaggtgaaacgttcagcactcatc

SEQ ID NO: 364804 - DNA, 25 bp, Mus musculus
gcgcctccaggaacaaggtccttta

SEQ ID NO: 364805 - DNA, 25 bp, Mus musculus
tcgtgtcctctagacagccctgcgg

SEQ ID NO: 364806 - DNA, 25 bp, Mus musculus
cctgcagagctacgggttcagacga

SEQ ID NO: 364807 - DNA, 25 bp, Mus musculus
cactcatcgtttactgccggtgtga

SEQ ID NO: 364808 - DNA, 25 bp, Mus musculus
tcctcacttctcattggctgagagc

SEQ ID NO: 364809 - DNA, 25 bp, Mus musculus
aagggtcctccttccagtactccag

SEQ ID NO: 364810 - DNA, 25 bp, Mus musculus
gtggatgcttaagggtcctccttcc

SEQ ID NO: 364811 - DNA, 25 bp, Mus musculus
tccctgtggatgcttaagggtcctc

SEQ ID NO: 364812 - DNA, 25 bp, Mus musculus
ctccgcaaggcgcttccctgtggat

SEQ ID NO: 364813 - DNA, 25 bp, Mus musculus
agagccgcttccaccggagctcctc

SEQ ID NO: 364814 - DNA, 25 bp, Mus musculus
agagcgcgtgtcaactcctttgtcc

SEQ ID NO: 364815 - DNA, 25 bp, Mus musculus
gccacctgtagagcgcgtgtcaact

SEQ ID NO: 364816 - DNA, 25 bp, Mus musculus
gccacttcgggccacctgtagagcg

SEQ ID NO: 364817 - DNA, 25 bp, Mus musculus
cttgctgtcccaaagccacttcggg

SEQ ID NO: 364818 - DNA, 25 bp, Mus musculus
caacgtgcaggcttgctgtcccaaa

SEQ ID NO: 364819 - DNA, 25 bp, Mus musculus
agttcagaaccgcaggccaccggag

SEQ ID NO: 364820 - DNA, 25 bp, Mus musculus
tccggcgcgctagttcagaaccgca

SEQ ID NO: 364821 - DNA, 25 bp, Mus musculus
cttctcattggctgagagcgtcggg

SEQ ID NO: 364822 - DNA, 25 bp, Mus musculus
ggcaaatagcccgtctccgcctgta

SEQ ID NO: 364823 - DNA, 25 bp, Mus musculus
ccggctgttgggcaaatagcccgtc

SEQ ID NO: 364824 - DNA, 25 bp, Mus musculus
tctccagccggctgttgggcaaata

SEQ ID NO: 364825 - DNA, 25 bp, Mus musculus
tgtctctctccagccggctgttggg

SEQ ID NO: 364826 - DNA, 25 bp, Mus musculus
agcatcggtgctagtcgccccagaa

SEQ ID NO: 364827 - DNA, 25 bp, Mus musculus
gccctactcgcctagagcatcggtg

SEQ ID NO: 364828 - DNA, 25 bp, Mus musculus
ctcgggagtggtgcatagatctgca

SEQ ID NO: 364829 - DNA, 25 bp, Mus musculus
cctgggaaacgacaggctcgggagt

SEQ ID NO: 364830 - DNA, 25 bp, Mus musculus
gattcgagggacctgggaaacgaca

SEQ ID NO: 364831 - DNA, 25 bp, Mus musculus
gcacgtccctccagctgtaggcggg

SEQ ID NO: 364832 - DNA, 25 bp, Mus musculus
ttaggaagacctcgtgccgccaggg

SEQ ID NO: 364833 - DNA, 25 bp, Mus musculus
ggtttaggaagacctcgtgccgcca

SEQ ID NO: 364834 - DNA, 25 bp, Mus musculus
aaatagcccgtctccgcctgtagca

SEQ ID NO: 364835 - DNA, 25 bp, Mus musculus
ccctgccatgcaggcggtgccagga

SEQ ID NO: 364836 - DNA, 25 bp, Mus musculus
tctgtcccgcaggcgcagggcgtta

SEQ ID NO: 364837 - DNA, 25 bp, Mus musculus
tccaggcgaccagggttgccagcgc

SEQ ID NO: 364838 - DNA, 25 bp, Mus musculus
tctgcctgatcccttggcctaattc

SEQ ID NO: 364839 - DNA, 25 bp, Mus musculus
cgcgaccactgcagactgcgggact

SEQ ID NO: 364840 - DNA, 25 bp, Mus musculus
gctttcgctccaggcgaccagggtt

SEQ ID NO: 364841 - DNA, 25 bp, Mus musculus
ccgtggagagggaacgccatcgccc

SEQ ID NO: 364842 - DNA, 25 bp, Mus musculus
atcccttggcctaattccctggttg

SEQ ID NO: 364843 - DNA, 25 bp, Mus musculus
agttctgcctgatcccttggcctaa

SEQ ID NO: 364844 - DNA, 25 bp, Mus musculus
gtagctagttctgcctgatcccttg

SEQ ID NO: 364845 - DNA, 25 bp, Mus musculus
tccgcgtagctagttctgcctgatc

SEQ ID NO: 364846 - DNA, 25 bp, Mus musculus
ttctctccgcgtagctagttctgcc

SEQ ID NO: 364847 - DNA, 25 bp, Mus musculus
ctggttgaagtccagagtcggccgt

SEQ ID NO: 364848 - DNA, 25 bp, Mus musculus
aattccctggttgaagtccagagtc

SEQ ID NO: 364849 - DNA, 25 bp, Mus musculus
tggcctaattccctggttgaagtcc

SEQ ID NO: 364850 - DNA, 25 bp, Mus musculus
taccgggaccagcactttcgggtga

SEQ ID NO: 364851 - DNA, 25 bp, Mus musculus
ttaggattcgaagcagcgtagcgtc

SEQ ID NO: 364852 - DNA, 25 bp, Mus musculus
cctggagatgactcgtgactgctga

SEQ ID NO: 364853 - DNA, 25 bp, Mus musculus
gactgctgaggtcggtgtagatcac

SEQ ID NO: 364854 - DNA, 25 bp, Mus musculus
agggtccagtccgtgcttacgcttt

SEQ ID NO: 364855 - DNA, 25 bp, Mus musculus
agttcctcggtgaaagtgtccttga

SEQ ID NO: 364856 - DNA, 25 bp, Mus musculus
gtccttgaacctcacgacgcggcga

SEQ ID NO: 364857 - DNA, 25 bp, Mus musculus
agccgctccaccagctgcgggttgt

SEQ ID NO: 364858 - DNA, 25 bp, Mus musculus
agcagccgccggaagaccatggctc

SEQ ID NO: 364859 - DNA, 25 bp, Mus musculus
actagccggcgctgtatgatgacga

SEQ ID NO: 364860 - DNA, 25 bp, Mus musculus
tgtatgatgacgacacggctcgccc

SEQ ID NO: 364861 - DNA, 25 bp, Mus musculus
tcgggtttggtgtttctgcatcatg

SEQ ID NO: 364862 - DNA, 25 bp, Mus musculus
gcgcagcgactcctacgtggaactc

SEQ ID NO: 364863 - DNA, 25 bp, Mus musculus
tctgcatcatgtcgggtggcttact

SEQ ID NO: 364864 - DNA, 25 bp, Mus musculus
cgaagagcgtgactagggcgttaac

SEQ ID NO: 364865 - DNA, 25 bp, Mus musculus
cgcccacgccttgtgcgaagagcgt

SEQ ID NO: 364866 - DNA, 25 bp, Mus musculus
tggtcagcagcactgcggacgtctc

SEQ ID NO: 364867 - DNA, 25 bp, Mus musculus
agcactgcggacgtctcctggcctg

SEQ ID NO: 364868 - DNA, 25 bp, Mus musculus
ttacctacgttctttgctcccggca

SEQ ID NO: 364869 - DNA, 25 bp, Mus musculus
tacgttctttgctcccggcacctaa

SEQ ID NO: 364870 - DNA, 25 bp, Mus musculus
gcacctaagcttctgcctggacgga

SEQ ID NO: 364871 - DNA, 25 bp, Mus musculus
aagcttctgcctggacggacgctgc

SEQ ID NO: 364872 - DNA, 25 bp, Mus musculus
tgcgggaccgctgtttcgccttcgc

SEQ ID NO: 364873 - DNA, 25 bp, Mus musculus
gaaagccaggccagccaccggggct

SEQ ID NO: 364874 - DNA, 25 bp, Mus musculus
tccggcctgctttcggccggcaagg

SEQ ID NO: 364875 - DNA, 25 bp, Mus musculus
accagcgcctgcttttcgcgtcacc

SEQ ID NO: 364876 - DNA, 25 bp, Mus musculus
ttccttgcccttccgccagaagctc

SEQ ID NO: 364877 - DNA, 25 bp, Mus musculus
tgactagggcgttaacctcgaggcg

SEQ ID NO: 364878 - DNA, 25 bp, Mus musculus
ccagagaggaaaggtctccgcccga

SEQ ID NO: 364879 - DNA, 25 bp, Mus musculus
ggaagcggaacaaccgctgccgctg

SEQ ID NO: 364880 - DNA, 25 bp, Mus musculus
gacaggattcccgagcgacgagact

SEQ ID NO: 364881 - DNA, 25 bp, Mus musculus
cccgagcgacgagactgcagagaac

SEQ ID NO: 364882 - DNA, 25 bp, Mus musculus
gactgcagagaacgcagctggtaaa

SEQ ID NO: 364883 - DNA, 25 bp, Mus musculus
cgcagctggtaaaggagggaacatc

SEQ ID NO: 364884 - DNA, 25 bp, Mus musculus
catccaggaacaaacccgagtcgtc

SEQ ID NO: 364885 - DNA, 25 bp, Mus musculus
caaacccgagtcgtccggtgcagcg

SEQ ID NO: 364886 - DNA, 25 bp, Mus musculus
ttcctctcggccgaagcttagagcc

SEQ ID NO: 364887 - DNA, 25 bp, Mus musculus
ccgaagcttagagccagggcgcaga

SEQ ID NO: 364888 - DNA, 25 bp, Mus musculus
ccagggcgcagacaatgagccaccg

SEQ ID NO: 364889 - DNA, 25 bp, Mus musculus
gggcgagcggcaaccgcacttacca

SEQ ID NO: 364890 - DNA, 25 bp, Mus musculus
ctaccgaggccgtgaggcgcagaac

SEQ ID NO: 364891 - DNA, 25 bp, Mus musculus
cggcaaccgcacttaccagagagga

SEQ ID NO: 364892 - DNA, 25 bp, Mus musculus
ttctgttgccttgggaacgatcctc

SEQ ID NO: 364893 - DNA, 25 bp, Mus musculus
ggctaacacttccaccctaggatct

SEQ ID NO: 364894 - DNA, 25 bp, Mus musculus
taggatctccctacaactccaggtt

SEQ ID NO: 364895 - DNA, 25 bp, Mus musculus
gcaagcgcaaattgagagccttctg

SEQ ID NO: 364896 - DNA, 25 bp, Mus musculus
ggcgagctgccttaggaccgcactc

SEQ ID NO: 364897 - DNA, 25 bp, Mus musculus
ctttcccgatgacccgaacagaact

SEQ ID NO: 364898 - DNA, 25 bp, Mus musculus
ccgaaggaatctgagcacgctgagc

SEQ ID NO: 364899 - DNA, 25 bp, Mus musculus
cccgaacagaactcggctaacactt

SEQ ID NO: 364900 - DNA, 25 bp, Mus musculus
gcaagctgcggtcaccgaaggaatc

SEQ ID NO: 364901 - DNA, 25 bp, Mus musculus
tgcccaaaggagcagccaggccaca

SEQ ID NO: 364902 - DNA, 25 bp, Mus musculus
cgtcgctgaagtccgcggcgagcct

SEQ ID NO: 364903 - DNA, 25 bp, Mus musculus
taccagcgctgaaaggggcgtcgct

SEQ ID NO: 364904 - DNA, 25 bp, Mus musculus
ccctgacctttaccagcgctgaaag

SEQ ID NO: 364905 - DNA, 25 bp, Mus musculus
ctacaactccaggttccggagaggc

SEQ ID NO: 364906 - DNA, 25 bp, Mus musculus
ctcattgctcagtttgtggccgtgc

SEQ ID NO: 364907 - DNA, 25 bp, Mus musculus
cctcgcgttccaggtgtggcgattc

SEQ ID NO: 364908 - DNA, 25 bp, Mus musculus
tgggctgcgagccagaatgctcatt

SEQ ID NO: 364909 - DNA, 25 bp, Mus musculus
agcccacgtgggctgcgagccagaa

SEQ ID NO: 364910 - DNA, 25 bp, Mus musculus
tatcagggcccaggccacggtgcac

SEQ ID NO: 364911 - DNA, 25 bp, Mus musculus
aagcgtgtatcagggcccaggccac

SEQ ID NO: 364912 - DNA, 25 bp, Mus musculus
ctgcacccaccgagggaagcgtgta

SEQ ID NO: 364913 - DNA, 25 bp, Mus musculus
gccagaatgctcattgctcagtttg

SEQ ID NO: 364914 - DNA, 25 bp, Mus musculus
cggcttaaccctcgcgttccaggtg

SEQ ID NO: 364915 - DNA, 25 bp, Mus musculus
agtttgtggccgtgctgtcaatcac

SEQ ID NO: 364916 - DNA, 25 bp, Mus musculus
gtgctgtcaatcacggagttcctgc

SEQ ID NO: 364917 - DNA, 25 bp, Mus musculus
tcacggagttcctgcttcggcttaa

SEQ ID NO: 364918 - DNA, 25 bp, Mus musculus
gagttcctgcttcggcttaaccctc

SEQ ID NO: 364919 - DNA, 25 bp, Mus musculus
acccaccgagggaagcgtgtatcag

SEQ ID NO: 364920 - DNA, 25 bp, Mus musculus
ggcaatgctcaacgaacccacgcaa

SEQ ID NO: 364921 - DNA, 25 bp, Mus musculus
ggagctgatgcctaacctcccacca

SEQ ID NO: 364922 - DNA, 25 bp, Mus musculus
cttgtagcccggcaatgctcaacga

SEQ ID NO: 364923 - DNA, 25 bp, Mus musculus
tcctggacagcacttgccgctgctg

SEQ ID NO: 364924 - DNA, 25 bp, Mus musculus
tgcctactcgctctggggcatcaga

SEQ ID NO: 364925 - DNA, 25 bp, Mus musculus
cgctctggggcatcagattatttta

SEQ ID NO: 364926 - DNA, 25 bp, Mus musculus
gggcatcagattattttagcacttg

SEQ ID NO: 364927 - DNA, 25 bp, Mus musculus
ttagcacttgcggaaggaaccaacg

SEQ ID NO: 364928 - DNA, 25 bp, Mus musculus
tggagagctcgcctctcagcgactc

SEQ ID NO: 364929 - DNA, 25 bp, Mus musculus
tgcggaaggaaccaacggaaactga

SEQ ID NO: 364930 - DNA, 25 bp, Mus musculus
cgtcttagaaggaactgccaccgcg

SEQ ID NO: 364931 - DNA, 25 bp, Mus musculus
actcagcccgcgtcttagaaggaac

SEQ ID NO: 364932 - DNA, 25 bp, Mus musculus
tctcagcgactcagcactcagcccg

SEQ ID NO: 364933 - DNA, 25 bp, Mus musculus
cggaaactgaagtcacatggagagc

SEQ ID NO: 364934 - DNA, 25 bp, Mus musculus
ggacatcgacatacaggccaactcg

SEQ ID NO: 364935 - DNA, 25 bp, Mus musculus
gctggccggtagaaacgcgcaccat

SEQ ID NO: 364936 - DNA, 25 bp, Mus musculus
tacaggccaactcggcctatcgcta

SEQ ID NO: 364937 - DNA, 25 bp, Mus musculus
taccctccgaagtccggtgagcttc

SEQ ID NO: 364938 - DNA, 25 bp, Mus musculus
cgggcgtagaggacatcgacataca

SEQ ID NO: 364939 - DNA, 25 bp, Mus musculus
agaaacgcgcaccatgggctccatc

SEQ ID NO: 364940 - DNA, 25 bp, Mus musculus
tatcgctaccctccgaagtccggtg

SEQ ID NO: 364941 - DNA, 25 bp, Mus musculus
tctcctctccggctggccggtagaa

SEQ ID NO: 364942 - DNA, 25 bp, Mus musculus
gacgccgcagcccacaacctctcct

SEQ ID NO: 364943 - DNA, 25 bp, Mus musculus
ccatgtccgtgtgaggacgccgcag

SEQ ID NO: 364944 - DNA, 25 bp, Mus musculus
ctgttttgggccatgtccgtgtgag

SEQ ID NO: 364945 - DNA, 25 bp, Mus musculus
aagtccggtgagcttccgaggacgc

SEQ ID NO: 364946 - DNA, 25 bp, Mus musculus
cttcccggtacctgtggagtttgag

SEQ ID NO: 364947 - DNA, 25 bp, Mus musculus
cctgagtcgccgcatcgcgggcgta

SEQ ID NO: 364948 - DNA, 25 bp, Mus musculus
ggcaagaagcaagggcgcacgccca

SEQ ID NO: 364949 - DNA, 25 bp, Mus musculus
agcccaggtatgaggctgttggcca

SEQ ID NO: 364950 - DNA, 25 bp, Mus musculus
accagtgcttgcaaaccagggcgca

SEQ ID NO: 364951 - DNA, 25 bp, Mus musculus
agaggcgcctcgctccctaaagctt

SEQ ID NO: 364952 - DNA, 25 bp, Mus musculus
tccgtgcgcagagcctcttctgcta

SEQ ID NO: 364953 - DNA, 25 bp, Mus musculus
acctcgctgttctcgtcgccgtgga

SEQ ID NO: 364954 - DNA, 25 bp, Mus musculus
cctaaagcttgatgggattggatgc

SEQ ID NO: 364955 - DNA, 25 bp, Mus musculus
ccgccatgcgagttgagggcaagaa

SEQ ID NO: 364956 - DNA, 25 bp, Mus musculus
tcttctgctaggctgcgggcgcaca

SEQ ID NO: 364957 - DNA, 25 bp, Mus musculus
gggattccctcaccttggccttgta

SEQ ID NO: 364958 - DNA, 25 bp, Mus musculus
caccttggccttgtagctgggcagg

SEQ ID NO: 364959 - DNA, 25 bp, Mus musculus
gcagctcggacagctccaggtagga

SEQ ID NO: 364960 - DNA, 25 bp, Mus musculus
ctccaggtaggagaacaccaactcc

SEQ ID NO: 364961 - DNA, 25 bp, Mus musculus
ccgcctcactgagggcagatggcgc

SEQ ID NO: 364962 - DNA, 25 bp, Mus musculus
aggcgggaacgcagacgcagctccc

SEQ ID NO: 364963 - DNA, 25 bp, Mus musculus
ccaaaagcgggaggagttgctacta

SEQ ID NO: 364964 - DNA, 25 bp, Mus musculus
gaagtcccgcccgactgagcggttc

SEQ ID NO: 364965 - DNA, 25 bp, Mus musculus
tccggccgcggccagtagaccgatt

SEQ ID NO: 364966 - DNA, 25 bp, Mus musculus
ccagtagaccgattggcaggacagc

SEQ ID NO: 364967 - DNA, 25 bp, Mus musculus
ggtaccgcgaggtgttccagaagct

SEQ ID NO: 364968 - DNA, 25 bp, Mus musculus
tggagggctgcctccaccgcaacgg

SEQ ID NO: 364969 - DNA, 25 bp, Mus musculus
caccgcaacggcgagacggaagtcc

SEQ ID NO: 364970 - DNA, 25 bp, Mus musculus
gtgcccgggcttccggctctggcaa

SEQ ID NO: 364971 - DNA, 25 bp, Mus musculus
cctcgcgcgtagaggcgggtcctca

SEQ ID NO: 364972 - DNA, 25 bp, Mus musculus
aggcgggtcctcaccgcgtaagaag

SEQ ID NO: 364973 - DNA, 25 bp, Mus musculus
cctcaccgcgtaagaaggggagctg

SEQ ID NO: 364974 - DNA, 25 bp, Mus musculus
gcgcggggagacagaaccactctcc

SEQ ID NO: 364975 - DNA, 25 bp, Mus musculus
aggagttgctactagcaggctaggc

SEQ ID NO: 364976 - DNA, 25 bp, Mus musculus
agggccgtctcgctttaacggtgag

SEQ ID NO: 364977 - DNA, 25 bp, Mus musculus
cggagagtacgcctgcgcaaaacgc

SEQ ID NO: 364978 - DNA, 25 bp, Mus musculus
gtgggttctgctgcgccttcacaca

SEQ ID NO: 364979 - DNA, 25 bp, Mus musculus
tgtgtgtctgtgttgttgttccgcg

SEQ ID NO: 364980 - DNA, 25 bp, Mus musculus
tcggtatcgtgctgcccgcggacca

SEQ ID NO: 364981 - DNA, 25 bp, Mus musculus
cgtcggcgctgaaggggttaatcca

SEQ ID NO: 364982 - DNA, 25 bp, Mus musculus
gttaatccagcagttcaccgccatc

SEQ ID NO: 364983 - DNA, 25 bp, Mus musculus
ccatcaccggtaagagacgcggtta

SEQ ID NO: 364984 - DNA, 25 bp, Mus musculus
tggtgcattcctcactcgggctctc

SEQ ID NO: 364985 - DNA, 25 bp, Mus musculus
ctctcctgaggcacaggcgacgacg

SEQ ID NO: 364986 - DNA, 25 bp, Mus musculus
cccagccggtccagtacaggggatg

SEQ ID NO: 364987 - DNA, 25 bp, Mus musculus
atcacctcctctcggtatcgtgctg

SEQ ID NO: 364988 - DNA, 25 bp, Mus musculus
caaaacgcgcacagacagggagagg

SEQ ID NO: 364989 - DNA, 25 bp, Mus musculus
gggcttcgcctcaccttggtgcatt

SEQ ID NO: 364990 - DNA, 25 bp, Mus musculus
ccctagcgacctgtgccgggatctt

SEQ ID NO: 364991 - DNA, 25 bp, Mus musculus
atgcgtgagcttccctaaggagaca

SEQ ID NO: 364992 - DNA, 25 bp, Mus musculus
ttttccagcaaaggcgcgtagcaga

SEQ ID NO: 364993 - DNA, 25 bp, Mus musculus
tctgaggcccattttccagcaaagg

SEQ ID NO: 364994 - DNA, 25 bp, Mus musculus
ggggagcctgagaacacctacattc

SEQ ID NO: 364995 - DNA, 25 bp, Mus musculus
gtcgacaagaactcaggggagcctg

SEQ ID NO: 364996 - DNA, 25 bp, Mus musculus
ttatcggctcactccgagggcttga

SEQ ID NO: 364997 - DNA, 25 bp, Mus musculus
acgcagggatatggctgtgtccttc

SEQ ID NO: 364998 - DNA, 25 bp, Mus musculus
ctagagatctgttggaccagacgca

SEQ ID NO: 364999 - DNA, 25 bp, Mus musculus
cggtggtcaccacacgtcacgtgtg

SEQ ID NO: 365000 - DNA, 25 bp, Mus musculus
cgggatcttcggagccgcaaccgac

SEQ ID NO: 365001 - DNA, 25 bp, Mus musculus
tcacgtgtgagacccgttgccctag

SEQ ID NO: 365002 - DNA, 25 bp, Mus musculus
attgggcgggtttatgcattccgac

SEQ ID NO: 365003 - DNA, 25 bp, Mus musculus
gaccacacttccttctagagatctg

SEQ ID NO: 365004 - DNA, 25 bp, Mus musculus
actacccggggactgactgatcgat

SEQ ID NO: 365005 - DNA, 25 bp, Mus musculus
ttgatccgagggaccatgaagcagc

SEQ ID NO: 365006 - DNA, 25 bp, Mus musculus
aggaggcgccacacatccggaattc

SEQ ID NO: 365007 - DNA, 25 bp, Mus musculus
cctctggaagcggaactactctgtc

SEQ ID NO: 365008 - DNA, 25 bp, Mus musculus
ctactctgtcaggttgtggttttca

SEQ ID NO: 365009 - DNA, 25 bp, Mus musculus
acttccggtccgcagtccggtcaga

SEQ ID NO: 365010 - DNA, 25 bp, Mus musculus
tccggtcagatgtttcccgggcgtc

SEQ ID NO: 365011 - DNA, 25 bp, Mus musculus
cccatttgacttcgctagtcggtga

SEQ ID NO: 365012 - DNA, 25 bp, Mus musculus
caggaggctactgtgaccgaggtac

SEQ ID NO: 365013 - DNA, 25 bp, Mus musculus
gaccgaggtacaatgacagccaaga

SEQ ID NO: 365014 - DNA, 25 bp, Mus musculus
acagccaagaggactgtgacccagg

SEQ ID NO: 365015 - DNA, 25 bp, Mus musculus
ccggagcagtaaatgcgagggactc

SEQ ID NO: 365016 - DNA, 25 bp, Mus musculus
cgacgggaccatgaccgagtaagta

SEQ ID NO: 365017 - DNA, 25 bp, Mus musculus
tatgcagcagtgactacccggggac

SEQ ID NO: 365018 - DNA, 25 bp, Mus musculus
gggcgacaggccaactccaaagaca

SEQ ID NO: 365019 - DNA, 25 bp, Mus musculus
cgcagttcgcctccagcggtcttgg

SEQ ID NO: 365020 - DNA, 25 bp, Mus musculus
ttttctaggctactccgcgcacgca

SEQ ID NO: 365021 - DNA, 25 bp, Mus musculus
tgcggaaggaagtgacgtagatcca

SEQ ID NO: 365022 - DNA, 25 bp, Mus musculus
gcattgcggactgtagaggcgcttc

SEQ ID NO: 365023 - DNA, 25 bp, Mus musculus
aggcgcttcctagtgagtgactccc

SEQ ID NO: 365024 - DNA, 25 bp, Mus musculus
gtgactcccttgtcagcggcacggc

SEQ ID NO: 365025 - DNA, 25 bp, Mus musculus
tccgggccttcgcaggccagtgcta

SEQ ID NO: 365026 - DNA, 25 bp, Mus musculus
agtcaccacgctgaggcgcaggctt

SEQ ID NO: 365027 - DNA, 25 bp, Mus musculus
aacttgcaccgcagggttgggtgtc

SEQ ID NO: 365028 - DNA, 25 bp, Mus musculus
cacctcggtaggtgtacgtgcggaa

SEQ ID NO: 365029 - DNA, 25 bp, Mus musculus
aggccgcgggttcgagagtcaccac

SEQ ID NO: 365030 - DNA, 25 bp, Mus musculus
aggcagcgctgccttcagaaggcgt

SEQ ID NO: 365031 - DNA, 25 bp, Mus musculus
ccgccttggcgccttttctaggcta

SEQ ID NO: 365032 - DNA, 25 bp, Mus musculus
ctgctcttctctagcagacgctccc

SEQ ID NO: 365033 - DNA, 25 bp, Mus musculus
gtgctcccgcgcacgcaagcagccc

SEQ ID NO: 365034 - DNA, 25 bp, Mus musculus
aagtctccctgtgctcccgcgcacg

SEQ ID NO: 365035 - DNA, 25 bp, Mus musculus
tcatgccagccaagtctccctgtgc

SEQ ID NO: 365036 - DNA, 25 bp, Mus musculus
caggccgcttcgaccgccagggtac

SEQ ID NO: 365037 - DNA, 25 bp, Mus musculus
agagaggctccaggccgcttcgacc

SEQ ID NO: 365038 - DNA, 25 bp, Mus musculus
atccggactataaggccgtctcggg

SEQ ID NO: 365039 - DNA, 25 bp, Mus musculus
catccggactataaggccgtctcgg

SEQ ID NO: 365040 - DNA, 25 bp, Mus musculus
cgcatccggactataaggccgtctc

SEQ ID NO: 365041 - DNA, 25 bp, Mus musculus
ggacgcatccggactataaggccgt

SEQ ID NO: 365042 - DNA, 25 bp, Mus musculus
ctccggacgcatccggactataagg

SEQ ID NO: 365043 - DNA, 25 bp, Mus musculus
catcgccgccgccaagatccattcc

SEQ ID NO: 365044 - DNA, 25 bp, Mus musculus
gactgccagccgctcccagcccacc

SEQ ID NO: 365045 - DNA, 25 bp, Mus musculus
ccaagatccattcccgcgccctccg

SEQ ID NO: 365046 - DNA, 25 bp, Mus musculus
cccagtcatgaaccggtttggcacc

SEQ ID NO: 365047 - DNA, 25 bp, Mus musculus
tgagaacctggacaaaatcgatatg

SEQ ID NO: 365048 - DNA, 25 bp, Mus musculus
atagcttgtctggtgtgaatgccca

SEQ ID NO: 365049 - DNA, 25 bp, Mus musculus
cagggtccgtagctgctgtcttctt

SEQ ID NO: 365050 - DNA, 25 bp, Mus musculus
cgatatgtccctgggtgagagacca

SEQ ID NO: 365051 - DNA, 25 bp, Mus musculus
tttggcacccggttggtaggagcca

SEQ ID NO: 365052 - DNA, 25 bp, Mus musculus
tctgcgctgcagctagtctgcgtgc

SEQ ID NO: 365053 - DNA, 25 bp, Mus musculus
aggcgctaggacagccgctattccc

SEQ ID NO: 365054 - DNA, 25 bp, Mus musculus
ctagtcgttcagactcggtttcgga

SEQ ID NO: 365055 - DNA, 25 bp, Mus musculus
aacagcagggccaggctagtcgttc

SEQ ID NO: 365056 - DNA, 25 bp, Mus musculus
caggacggagtctcttgggctaccc

SEQ ID NO: 365057 - DNA, 25 bp, Mus musculus
cagcctggggctgcaactgactaaa

SEQ ID NO: 365058 - DNA, 25 bp, Mus musculus
ccagcaaccgcgagaatagcttgtc

SEQ ID NO: 365059 - DNA, 25 bp, Mus musculus
cgaaagcacgaagcaatgagaacct

SEQ ID NO: 365060 - DNA, 25 bp, Mus musculus
aacactgcagctctcacctcgggca

SEQ ID NO: 365061 - DNA, 25 bp, Mus musculus
cgcacttgcccttatccgcgtaagg

SEQ ID NO: 365062 - DNA, 25 bp, Mus musculus
ttatccgcgtaaggcgacaaccctg

SEQ ID NO: 365063 - DNA, 25 bp, Mus musculus
agagtagccgccttccctagatacg

SEQ ID NO: 365064 - DNA, 25 bp, Mus musculus
tgttgaggccgcttccgccggaagt

SEQ ID NO: 365065 - DNA, 25 bp, Mus musculus
tgccgcacgggaacaataaagtttc

SEQ ID NO: 365066 - DNA, 25 bp, Mus musculus
ggcgctgccgcacgggaacaataaa

SEQ ID NO: 365067 - DNA, 25 bp, Mus musculus
taattcaccgacatcgtcgccggcg

SEQ ID NO: 365068 - DNA, 25 bp, Mus musculus
cccgtctggggtcattcggtgactc

SEQ ID NO: 365069 - DNA, 25 bp, Mus musculus
tggggtcattcggtgactcgaacac

SEQ ID NO: 365070 - DNA, 25 bp, Mus musculus
ttcggtgactcgaacactgcagctc

SEQ ID NO: 365071 - DNA, 25 bp, Mus musculus
tgctgcataattcaccgacatcgtc

SEQ ID NO: 365072 - DNA, 25 bp, Mus musculus
ggcgacaaccctgctgcataattca

SEQ ID NO: 365073 - DNA, 25 bp, Mus musculus
cgtaaggcgacaaccctgctgcata

SEQ ID NO: 365074 - DNA, 25 bp, Mus musculus
agaggcagttgacgggtgatctttc

SEQ ID NO: 365075 - DNA, 25 bp, Mus musculus
ttccctggaaaacctgcttgtgggc

SEQ ID NO: 365076 - DNA, 25 bp, Mus musculus
agaaatctcggcatcagtgcccgcc

SEQ ID NO: 365077 - DNA, 25 bp, Mus musculus
gctctcagaaatctcggcatcagtg

SEQ ID NO: 365078 - DNA, 25 bp, Mus musculus
ttgaatcgctctcagaaatctcggc

SEQ ID NO: 365079 - DNA, 25 bp, Mus musculus
acgggtgatctttcttgaatcgctc

SEQ ID NO: 365080 - DNA, 25 bp, Mus musculus
cacccagcggatcgcgtggcgcatg

SEQ ID NO: 365081 - DNA, 25 bp, Mus musculus
gcggccaaccatgacctgacggaca

SEQ ID NO: 365082 - DNA, 25 bp, Mus musculus
gagcggccaaccatgacctgacgga

SEQ ID NO: 365083 - DNA, 25 bp, Mus musculus
ctctccggtgcgacctgtgggccga

SEQ ID NO: 365084 - DNA, 25 bp, Mus musculus
gaaacctctccggtgcgacctgtgg

SEQ ID NO: 365085 - DNA, 25 bp, Mus musculus
agtactctggccctgtggcgtccgg

SEQ ID NO: 365086 - DNA, 25 bp, Mus musculus
cctgctacccgggacccgtggagtg

SEQ ID NO: 365087 - DNA, 25 bp, Mus musculus
tagcggctgcggagtactctggccc

SEQ ID NO: 365088 - DNA, 25 bp, Mus musculus
tgggacgccgactgaagccatctct

SEQ ID NO: 365089 - DNA, 25 bp, Mus musculus
cgtttagtttcatccctcaccgaga

SEQ ID NO: 365090 - DNA, 25 bp, Mus musculus
caacgcgtcgcgcaagctctttttt

SEQ ID NO: 365091 - DNA, 25 bp, Mus musculus
ttgtcggagccctgagtattttgcc

SEQ ID NO: 365092 - DNA, 25 bp, Mus musculus
ccgagtcgttcgttgtcattggttg

SEQ ID NO: 365093 - DNA, 25 bp, Mus musculus
ttaaagttcttgagcgcggcttggc

SEQ ID NO: 365094 - DNA, 25 bp, Mus musculus
acctttgctttctggcgcagtgtga

SEQ ID NO: 365095 - DNA, 25 bp, Mus musculus
ctctcgcgccgggaaatagtgacag

SEQ ID NO: 365096 - DNA, 25 bp, Mus musculus
taatcggtagctatggcaacgcgtc

SEQ ID NO: 365097 - DNA, 25 bp, Mus musculus
ggcctttgcccacgattccgagtcg

SEQ ID NO: 365098 - DNA, 25 bp, Mus musculus
agctgctttctgtactgatggaggc

SEQ ID NO: 365099 - DNA, 25 bp, Mus musculus
gatctcgcctgtgttagctgctttc

SEQ ID NO: 365100 - DNA, 25 bp, Mus musculus
gacaacctggcgtctcggagaaccc

SEQ ID NO: 365101 - DNA, 25 bp, Mus musculus
tacgtgttgccgcttacaaagacga

SEQ ID NO: 365102 - DNA, 25 bp, Mus musculus
cgtttctcagtgctggtgaggagct

SEQ ID NO: 365103 - DNA, 25 bp, Mus musculus
cgggctttatgcacgtggaagcacg

SEQ ID NO: 365104 - DNA, 25 bp, Mus musculus
tcaagatgtcgaccacgacggttcc

SEQ ID NO: 365105 - DNA, 25 bp, Mus musculus
tatgcacgtggaagcacgaggattg

SEQ ID NO: 365106 - DNA, 25 bp, Mus musculus
tgggcctggagcacatcaagatgtc

SEQ ID NO: 365107 - DNA, 25 bp, Mus musculus
cttcgacgggctgctaggctttccc

SEQ ID NO: 365108 - DNA, 25 bp, Mus musculus
ttccggagctgaaacagatcagtcg

SEQ ID NO: 365109 - DNA, 25 bp, Mus musculus
atcagtcgggaggaagcaatgcgct

SEQ ID NO: 365110 - DNA, 25 bp, Mus musculus
gtcattcatgccacgccatgctata

SEQ ID NO: 365111 - DNA, 25 bp, Mus musculus
atacaggcttgggacgcccagtgga

SEQ ID NO: 365112 - DNA, 25 bp, Mus musculus
acgtcctgaccaagcttaccttgca

SEQ ID NO: 365113 - DNA, 25 bp, Mus musculus
accaagcttaccttgcagatgcaga

SEQ ID NO: 365114 - DNA, 25 bp, Mus musculus
ggcccggctggagtcattcatgcca

SEQ ID NO: 365115 - DNA, 25 bp, Mus musculus
acgacggttccggagctgaaacaga

SEQ ID NO: 365116 - DNA, 25 bp, Mus musculus
gggttcccacagctcagttcacgtg

SEQ ID NO: 365117 - DNA, 25 bp, Mus musculus
tacggaatgaagtggcagcagcagc

SEQ ID NO: 365118 - DNA, 25 bp, Mus musculus
agcagcttctgaatgcgccgctccg

SEQ ID NO: 365119 - DNA, 25 bp, Mus musculus
cacgcccgaccgctttgcactaatc

SEQ ID NO: 365120 - DNA, 25 bp, Mus musculus
tagcccagggttcccacagctcagt

SEQ ID NO: 365121 - DNA, 25 bp, Mus musculus
cacagctcagttcacgtgggctgcc

SEQ ID NO: 365122 - DNA, 25 bp, Mus musculus
aggaggcgtcgcactccatggtaac

SEQ ID NO: 365123 - DNA, 25 bp, Mus musculus
tcgcactccatggtaacgacgccgg

SEQ ID NO: 365124 - DNA, 25 bp, Mus musculus
ccatggtaacgacgccggcccgaag

SEQ ID NO: 365125 - DNA, 25 bp, Mus musculus
cgtgtcgccatcacgtcctttcgga

SEQ ID NO: 365126 - DNA, 25 bp, Mus musculus
gccatcacgtcctttcggacactga

SEQ ID NO: 365127 - DNA, 25 bp, Mus musculus
cctttcggacactgaggtagggcga

SEQ ID NO: 365128 - DNA, 25 bp, Mus musculus
cgagcgcttagctgctacggaatga

SEQ ID NO: 365129 - DNA, 25 bp, Mus musculus
acccggcgtaatgccggccaatggc

SEQ ID NO: 365130 - DNA, 25 bp, Mus musculus
ctcggagtgtggcaccgagccctct

SEQ ID NO: 365131 - DNA, 25 bp, Mus musculus
atggcgccgccgcttcaatgctagc

SEQ ID NO: 365132 - DNA, 25 bp, Mus musculus
caatgctagcggaaatgagctcaca

SEQ ID NO: 365133 - DNA, 25 bp, Mus musculus
tgagctcacacgacaccggaaagga

SEQ ID NO: 365134 - DNA, 25 bp, Mus musculus
cacacgacaccggaaaggaaggcgg

SEQ ID NO: 365135 - DNA, 25 bp, Mus musculus
ccctggctctggcttttacgtttag

SEQ ID NO: 365136 - DNA, 25 bp, Mus musculus
gctctggcttttacgtttagggcta

SEQ ID NO: 365137 - DNA, 25 bp, Mus musculus
cgtttagggctaaggaagctccagg

SEQ ID NO: 365138 - DNA, 25 bp, Mus musculus
agcggtcggctcctgtgaactccgt

SEQ ID NO: 365139 - DNA, 25 bp, Mus musculus
ctcctgtgaactccgtggggctcca

SEQ ID NO: 365140 - DNA, 25 bp, Mus musculus
tggacagggccctttctcccgagga

SEQ ID NO: 365141 - DNA, 25 bp, Mus musculus
ttcccaggcagaggatccgcgacct

SEQ ID NO: 365142 - DNA, 25 bp, Mus musculus
accgcctcctttcgggatcgtctgc

SEQ ID NO: 365143 - DNA, 25 bp, Mus musculus
cccggctgctcctcggagtgtggca

SEQ ID NO: 365144 - DNA, 25 bp, Mus musculus
cacccgagaagacggctcaggggtc

SEQ ID NO: 365145 - DNA, 25 bp, Mus musculus
acgagggcacccgagaagacggctc

SEQ ID NO: 365146 - DNA, 25 bp, Mus musculus
tcccgagaccggaggatgacccgat

SEQ ID NO: 365147 - DNA, 25 bp, Mus musculus
gccctgaagaggctcgctgctgttt

SEQ ID NO: 365148 - DNA, 25 bp, Mus musculus
tcgctgctgtttccggccggccgag

SEQ ID NO: 365149 - DNA, 25 bp, Mus musculus
ctacacccttggtgagaggcgagtg

SEQ ID NO: 365150 - DNA, 25 bp, Mus musculus
tggcctatggacacgtcgggaaata

SEQ ID NO: 365151 - DNA, 25 bp, Mus musculus
tcgggaaatagacatcagcgtcacg

SEQ ID NO: 365152 - DNA, 25 bp, Mus musculus
aaatggactcacaggcgcggcgtgc

SEQ ID NO: 365153 - DNA, 25 bp, Mus musculus
tcgcggtgccaaactacagctatgg

SEQ ID NO: 365154 - DNA, 25 bp, Mus musculus
gcgcactggactcgcggtgccaaac

SEQ ID NO: 365155 - DNA, 25 bp, Mus musculus
cagggcggagctaccacaagcagag

SEQ ID NO: 365156 - DNA, 25 bp, Mus musculus
cgagaagctcttgcagcctggaccc

SEQ ID NO: 365157 - DNA, 25 bp, Mus musculus
actacagctatggagcaggcacctc

SEQ ID NO: 365158 - DNA, 25 bp, Mus musculus
gagctgccacagcaaaagttctctc

SEQ ID NO: 365159 - DNA, 25 bp, Mus musculus
tgtgcgatgcttcccataatgcacc

SEQ ID NO: 365160 - DNA, 25 bp, Mus musculus
cttcctgtgtgcgatgcttcccata

SEQ ID NO: 365161 - DNA, 25 bp, Mus musculus
gcccggagcgcttcctgtgtgcgat

SEQ ID NO: 365162 - DNA, 25 bp, Mus musculus
gcttggtctcgcagccaggtctccg

SEQ ID NO: 365163 - DNA, 25 bp, Mus musculus
aaagccacgcttggtctcgcagcca

SEQ ID NO: 365164 - DNA, 25 bp, Mus musculus
ggcgccagaatcaaagccacgcttg

SEQ ID NO: 365165 - DNA, 25 bp, Mus musculus
catgtctgcctctcgactgctctgg

SEQ ID NO: 365166 - DNA, 25 bp, Mus musculus
ggcgacgctctagccgcgccatgtc

SEQ ID NO: 365167 - DNA, 25 bp, Mus musculus
ccgcggtaaacgctcggcctggcag

SEQ ID NO: 365168 - DNA, 25 bp, Mus musculus
gggttctccgccgtcttggtgcagt

SEQ ID NO: 365169 - DNA, 25 bp, Mus musculus
ccgtcttggtgcagtgctttctgca

SEQ ID NO: 365170 - DNA, 25 bp, Mus musculus
agtgctttctgcaccgcaggcctcg

SEQ ID NO: 365171 - DNA, 25 bp, Mus musculus
ctgctgacacgcaggcgccagaatc

SEQ ID NO: 365172 - DNA, 25 bp, Mus musculus
cactgactatgcgtgtggaggcatc

SEQ ID NO: 365173 - DNA, 25 bp, Mus musculus
ttgtgtgcctctcgctataggggcc

SEQ ID NO: 365174 - DNA, 25 bp, Mus musculus
cctctcgctataggggccgaggtcg

SEQ ID NO: 365175 - DNA, 25 bp, Mus musculus
cccgtggcattgagtagtctgcgga

SEQ ID NO: 365176 - DNA, 25 bp, Mus musculus
cattgagtagtctgcggagtgctcc

SEQ ID NO: 365177 - DNA, 25 bp, Mus musculus
gggagagcaaatcacgacacttaga

SEQ ID NO: 365178 - DNA, 25 bp, Mus musculus
aagcactttgggaacactgactatg

SEQ ID NO: 365179 - DNA, 25 bp, Mus musculus
ctatgcgtgtggaggcatcacgacg

SEQ ID NO: 365180 - DNA, 25 bp, Mus musculus
ggggctgccaggcatgcctgtatcc

SEQ ID NO: 365181 - DNA, 25 bp, Mus musculus
acatcggagagtgggcagtcacagc

SEQ ID NO: 365182 - DNA, 25 bp, Mus musculus
gcgagcatgttctgcctgcgaccct

SEQ ID NO: 365183 - DNA, 25 bp, Mus musculus
agtcacagcgagtcgctgaggcaga

SEQ ID NO: 365184 - DNA, 25 bp, Mus musculus
atgcctgtatcctgcacatcggaga

SEQ ID NO: 365185 - DNA, 25 bp, Mus musculus
gacacttagaggctaaagcactttg

SEQ ID NO: 365186 - DNA, 25 bp, Mus musculus
gtgatgtcaaccgaggaggagccgc

SEQ ID NO: 365187 - DNA, 25 bp, Mus musculus
cgccaccatggccacgccgcgcgcc

SEQ ID NO: 365188 - DNA, 25 bp, Mus musculus
ggcccatcgaacactcctcccggtc

SEQ ID NO: 365189 - DNA, 25 bp, Mus musculus
atcgaacactcctcccggtcgcggg

SEQ ID NO: 365190 - DNA, 25 bp, Mus musculus
gtcgcgggaccgctttcgccgcctg

SEQ ID NO: 365191 - DNA, 25 bp, Mus musculus
agtgagagtctccagcgagggtcag

SEQ ID NO: 365192 - DNA, 25 bp, Mus musculus
ccatcccggccgaggctccgtggac

SEQ ID NO: 365193 - DNA, 25 bp, Mus musculus
gctgattggcgtgtggcagcaccag

SEQ ID NO: 365194 - DNA, 25 bp, Mus musculus
ttttgcggctgagagcgcgctcgca

SEQ ID NO: 365195 - DNA, 25 bp, Mus musculus
tccgtgaactcacccgggagaccga

SEQ ID NO: 365196 - DNA, 25 bp, Mus musculus
aacttttgcggctgagagcgcgctc

SEQ ID NO: 365197 - DNA, 25 bp, Mus musculus
cagcaccagggctgcctccgccctc

SEQ ID NO: 365198 - DNA, 25 bp, Mus musculus
gcggctcccacaacttttgcggctg

SEQ ID NO: 365199 - DNA, 25 bp, Mus musculus
tcccacaacttttgcggctgagagc

SEQ ID NO: 365200 - DNA, 25 bp, Mus musculus
gtgctggggccctagctcttcgctc

SEQ ID NO: 365201 - DNA, 25 bp, Mus musculus
tctacgcctgtctgctcgggctctg

SEQ ID NO: 365202 - DNA, 25 bp, Mus musculus
taaactgaccgagtggcggcccgca

SEQ ID NO: 365203 - DNA, 25 bp, Mus musculus
caactccgagcgtcccagcgggcca

SEQ ID NO: 365204 - DNA, 25 bp, Mus musculus
ctcgttccgcgcctcgcaggtaagc

SEQ ID NO: 365205 - DNA, 25 bp, Mus musculus
tcctcaacttttgctcgcccgcggc

SEQ ID NO: 365206 - DNA, 25 bp, Mus musculus
cgcgggcatcagatctgcgtgcgct

SEQ ID NO: 365207 - DNA, 25 bp, Mus musculus
gccttcccttcctgtgtaaacagtg

SEQ ID NO: 365208 - DNA, 25 bp, Mus musculus
cctgtgtaaacagtgtgcgtctggt

SEQ ID NO: 365209 - DNA, 25 bp, Mus musculus
ccaaagtgtggcgaccgagtcatcc

SEQ ID NO: 365210 - DNA, 25 bp, Mus musculus
tcgcctgcacaaagcggcccttgtg

SEQ ID NO: 365211 - DNA, 25 bp, Mus musculus
cgcctagccgtaaactgaccgagtg

SEQ ID NO: 365212 - DNA, 25 bp, Mus musculus
tagctcttcgctcgcctgcacaaag

SEQ ID NO: 365213 - DNA, 25 bp, Mus musculus
gaagggtctccgagagtagacgcgc

SEQ ID NO: 365214 - DNA, 25 bp, Mus musculus
agctagaggcgcttcgggaattgct

SEQ ID NO: 365215 - DNA, 25 bp, Mus musculus
gcaggccacggaggcagactgcacc

SEQ ID NO: 365216 - DNA, 25 bp, Mus musculus
gcaccggagcgcaggacacagctat

SEQ ID NO: 365217 - DNA, 25 bp, Mus musculus
ccactgtgacagagactacggaagc

SEQ ID NO: 365218 - DNA, 25 bp, Mus musculus
ctacggaagccgagaccagcggcac

SEQ ID NO: 365219 - DNA, 25 bp, Mus musculus
gaattgctggccacggccacggcta

SEQ ID NO: 365220 - DNA, 25 bp, Mus musculus
ggtcgccgaactcagctctaccgtg

SEQ ID NO: 365221 - DNA, 25 bp, Mus musculus
ggttcctgcggacgagcacgagcac

SEQ ID NO: 365222 - DNA, 25 bp, Mus musculus
gcaggcacgagaagactagcgcaga

SEQ ID NO: 365223 - DNA, 25 bp, Mus musculus
actagcgcagaggtcttccaggtga

SEQ ID NO: 365224 - DNA, 25 bp, Mus musculus
ccaggctgtcctttcagaggatttc

SEQ ID NO: 365225 - DNA, 25 bp, Mus musculus
tttcagaggatttccgcgtgggcct

SEQ ID NO: 365226 - DNA, 25 bp, Mus musculus
cgcaggccgattgctggcaggccac

SEQ ID NO: 365227 - DNA, 25 bp, Mus musculus
ccgagttgcgccaagcgctagctgc

SEQ ID NO: 365228 - DNA, 25 bp, Mus musculus
cttcaggacgaagctcccgaacttg

SEQ ID NO: 365229 - DNA, 25 bp, Mus musculus
tacctgactgagaagacgcgggcgt

SEQ ID NO: 365230 - DNA, 25 bp, Mus musculus
aagacgcgggcgtgacacgatgccc

SEQ ID NO: 365231 - DNA, 25 bp, Mus musculus
ggctggtacctgactgagaagacgc

SEQ ID NO: 365232 - DNA, 25 bp, Mus musculus
cgtccctcggggctggtacctgact

SEQ ID NO: 365233 - DNA, 25 bp, Mus musculus
gagagcccgctcttcaggacgaagc

SEQ ID NO: 365234 - DNA, 25 bp, Mus musculus
actggggaggagagcccgctcttca

SEQ ID NO: 365235 - DNA, 25 bp, Mus musculus
tcccgaacttgaaagcctgcacgtc

SEQ ID NO: 365236 - DNA, 25 bp, Mus musculus
gcctgcacgtcatacagctcggtga

SEQ ID NO: 365237 - DNA, 25 bp, Mus musculus
atacagctcggtgaccaaggggccc

SEQ ID NO: 365238 - DNA, 25 bp, Mus musculus
ccagggcttggctggcgacctccat

SEQ ID NO: 365239 - DNA, 25 bp, Mus musculus
ttggctggcgacctccattctcgcg

SEQ ID NO: 365240 - DNA, 25 bp, Mus musculus
attctcgcgcgctcagttcgctctg

SEQ ID NO: 365241 - DNA, 25 bp, Mus musculus
gcgctcagttcgctctggaagccga

SEQ ID NO: 365242 - DNA, 25 bp, Mus musculus
gaaaccgtgcccgagatcttacctg

SEQ ID NO: 365243 - DNA, 25 bp, Mus musculus
tgtccgaagacaccgcgtccgaggc

SEQ ID NO: 365244 - DNA, 25 bp, Mus musculus
aaaggcgtccacgtccgagtcggcg

SEQ ID NO: 365245 - DNA, 25 bp, Mus musculus
actcccgcaactggggtgaacgccg

SEQ ID NO: 365246 - DNA, 25 bp, Mus musculus
tgaagcggcgcgctgcaaagtgatc

SEQ ID NO: 365247 - DNA, 25 bp, Mus musculus
gcgcgctgcaaagtgatccaacatc

SEQ ID NO: 365248 - DNA, 25 bp, Mus musculus
agaacaacgtgaacctccgcaactc

SEQ ID NO: 365249 - DNA, 25 bp, Mus musculus
agtgatccaacatctcccagagaag

SEQ ID NO: 365250 - DNA, 25 bp, Mus musculus
catctcccagagaagcggtccatgg

SEQ ID NO: 365251 - DNA, 25 bp, Mus musculus
agaagcggtccatggggaccgcctc

SEQ ID NO: 365252 - DNA, 25 bp, Mus musculus
cacagactcccgcaactggggtgaa

SEQ ID NO: 365253 - DNA, 25 bp, Mus musculus
agccagcaccgccagaacaacgtga

SEQ ID NO: 365254 - DNA, 25 bp, Mus musculus
caaacttgtccgaagacaccgcgtc

SEQ ID NO: 365255 - DNA, 25 bp, Mus musculus
cgagatcttacctgtccggaaaaag

SEQ ID NO: 365256 - DNA, 25 bp, Mus musculus
gtttccctacgcctgggctcttctg

SEQ ID NO: 365257 - DNA, 25 bp, Mus musculus
aaaaatagtaactgcggcgcgcccg

SEQ ID NO: 365258 - DNA, 25 bp, Mus musculus
tccggatctcgaccgggccaggtga

SEQ ID NO: 365259 - DNA, 25 bp, Mus musculus
cagagcgcagtttggtgtcagaccc

SEQ ID NO: 365260 - DNA, 25 bp, Mus musculus
aatgctttattcagggcggccgtgc

SEQ ID NO: 365261 - DNA, 25 bp, Mus musculus
ctgcggacctgatgagtccactgtg

SEQ ID NO: 365262 - DNA, 25 bp, Mus musculus
acgcggagtctgttgcgcacgccca

SEQ ID NO: 365263 - DNA, 25 bp, Mus musculus
cagggctccaggttccgacccgaag

SEQ ID NO: 365264 - DNA, 25 bp, Mus musculus
cgccaaggaggctatgagtcccggc

SEQ ID NO: 365265 - DNA, 25 bp, Mus musculus
gtccggacatctcggcggttaattc

SEQ ID NO: 365266 - DNA, 25 bp, Mus musculus
caagtattcgtttccctacgcctgg

SEQ ID NO: 365267 - DNA, 25 bp, Mus musculus
agaaatggtcaggtccggatctcga

SEQ ID NO: 365268 - DNA, 25 bp, Mus musculus
aggacgtccctagatgaatgcttta

SEQ ID NO: 365269 - DNA, 25 bp, Mus musculus
tgccagtcttccagagcgcagtttg

SEQ ID NO: 365270 - DNA, 25 bp, Mus musculus
tcggctctagcacggactgcctcgt

SEQ ID NO: 365271 - DNA, 25 bp, Mus musculus
ccattcgctcgggagccaatcctga

SEQ ID NO: 365272 - DNA, 25 bp, Mus musculus
ggcgactatgcacgaccgcaggctc

SEQ ID NO: 365273 - DNA, 25 bp, Mus musculus
gttcccttgacaacgacgcctggcg

SEQ ID NO: 365274 - DNA, 25 bp, Mus musculus
gcaagtgggagaccgcggaaaccca

SEQ ID NO: 365275 - DNA, 25 bp, Mus musculus
tggctcagcagtctggccgacacct

SEQ ID NO: 365276 - DNA, 25 bp, Mus musculus
ccgtactcagcacggggacaaggca

SEQ ID NO: 365277 - DNA, 25 bp, Mus musculus
ccttagtttagcaccacggcggcgg

SEQ ID NO: 365278 - DNA, 25 bp, Mus musculus
acccgagcagactcagggcgccttg

SEQ ID NO: 365279 - DNA, 25 bp, Mus musculus
cggaagtaatcctcgcacggcgcag

SEQ ID NO: 365280 - DNA, 25 bp, Mus musculus
ggtgacggacgttctgttattgaca

SEQ ID NO: 365281 - DNA, 25 bp, Mus musculus
tgacacgccacagcagcccatgaga

SEQ ID NO: 365282 - DNA, 25 bp, Mus musculus
tgagatggcagataccggcccattc

SEQ ID NO: 365283 - DNA, 25 bp, Mus musculus
accttgcaaggcctcaggttcccgg

SEQ ID NO: 365284 - DNA, 25 bp, Mus musculus
tagggtcgccacatcggcgctcgca

SEQ ID NO: 365285 - DNA, 25 bp, Mus musculus
aagcgcgtggaagttgctgcgccta

SEQ ID NO: 365286 - DNA, 25 bp, Mus musculus
gtggcaggtccattcctggagcttc

SEQ ID NO: 365287 - DNA, 25 bp, Mus musculus
acatgcaaataagcgcgtggaagtt

SEQ ID NO: 365288 - DNA, 25 bp, Mus musculus
caaatgacatgcaaataagcgcgtg

SEQ ID NO: 365289 - DNA, 25 bp, Mus musculus
cctggagcttcatgcaaatgacatg

SEQ ID NO: 365290 - DNA, 25 bp, Mus musculus
gtgagtgagcctgcccgcgcttttg

SEQ ID NO: 365291 - DNA, 25 bp, Mus musculus
gtggaagttgctgcgcctagagctt

SEQ ID NO: 365292 - DNA, 25 bp, Mus musculus
ttttgtcctgccacggtcaccctgt

SEQ ID NO: 365293 - DNA, 25 bp, Mus musculus
ttgctgcgcctagagctttcccagt

SEQ ID NO: 365294 - DNA, 25 bp, Mus musculus
gcgcctagagctttcccagtccaga

SEQ ID NO: 365295 - DNA, 25 bp, Mus musculus
tttcccagtccagagagccgcgctg

SEQ ID NO: 365296 - DNA, 25 bp, Mus musculus
gcctagagctttcccagtccagaga

SEQ ID NO: 365297 - DNA, 25 bp, Mus musculus
agctttcccagtccagagagccgcg

SEQ ID NO: 365298 - DNA, 25 bp, Mus musculus
gccacggcgtacctggtcatctaca

SEQ ID NO: 365299 - DNA, 25 bp, Mus musculus
ccacacggattgtgcgccggaagtt

SEQ ID NO: 365300 - DNA, 25 bp, Mus musculus
ccctatccaagatggcggctacgga

SEQ ID NO: 365301 - DNA, 25 bp, Mus musculus
agacgagcgcctggagcgtctttgc

SEQ ID NO: 365302 - DNA, 25 bp, Mus musculus
tggagcgtctttgccctcatccaag

SEQ ID NO: 365303 - DNA, 25 bp, Mus musculus
gtctttgccctcatccaagatggcg

SEQ ID NO: 365304 - DNA, 25 bp, Mus musculus
cctcgtagagcccagttgggtctga

SEQ ID NO: 365305 - DNA, 25 bp, Mus musculus
ggcgtacctggtcatctacaatgtg

SEQ ID NO: 365306 - DNA, 25 bp, Mus musculus
cctggctgcggagatcattcattta

SEQ ID NO: 365307 - DNA, 25 bp, Mus musculus
gatcattcatttaggcggccgcttt

SEQ ID NO: 365308 - DNA, 25 bp, Mus musculus
aaacccaggcgggagcgttcgtctg

SEQ ID NO: 365309 - DNA, 25 bp, Mus musculus
gtggtcgaagttttccgccagccgc

SEQ ID NO: 365310 - DNA, 25 bp, Mus musculus
cgctggatgcccacacggattgtgc

SEQ ID NO: 365311 - DNA, 25 bp, Mus musculus
atctacaatgtggtgatgacggcgg

SEQ ID NO: 365312 - DNA, 25 bp, Mus musculus
cggactcgagtctgacagctctgga

SEQ ID NO: 365313 - DNA, 25 bp, Mus musculus
ctgacagctctggaagcggccaata

SEQ ID NO: 365314 - DNA, 25 bp, Mus musculus
accgtagctgaagttgggctgaatg

SEQ ID NO: 365315 - DNA, 25 bp, Mus musculus
tctggaagcggccaatagagccgga

SEQ ID NO: 365316 - DNA, 25 bp, Mus musculus
tccgacgagggatccgcccgttgac

SEQ ID NO: 365317 - DNA, 25 bp, Mus musculus
ctacccaggtccgacgagggatccg

SEQ ID NO: 365318 - DNA, 25 bp, Mus musculus
agcagcaccgtagctgaagttgggc

SEQ ID NO: 365319 - DNA, 25 bp, Mus musculus
tggattgcccgctacccaggtccga

SEQ ID NO: 365320 - DNA, 25 bp, Mus musculus
ccaatagagccggaccagagaaggg

SEQ ID NO: 365321 - DNA, 25 bp, Mus musculus
gcggccaatagagccggaccagaga

SEQ ID NO: 365322 - DNA, 25 bp, Mus musculus
aagagcgccggactcgagtctgaca

SEQ ID NO: 365323 - DNA, 25 bp, Mus musculus
cgcccaataagagcgccggactcga

SEQ ID NO: 365324 - DNA, 25 bp, Mus musculus
gccgggccacagaatcgcccaataa

SEQ ID NO: 365325 - DNA, 25 bp, Mus musculus
cgcgccctccgttggcaccgtcgcc

SEQ ID NO: 365326 - DNA, 25 bp, Mus musculus
ggagaagccgattcccgcgccaatg

SEQ ID NO: 365327 - DNA, 25 bp, Mus musculus
ggatgtccggctccaaaagcgtgag

SEQ ID NO: 365328 - DNA, 25 bp, Mus musculus
agccaactccgtctcggacctggga

SEQ ID NO: 365329 - DNA, 25 bp, Mus musculus
gggactctggactctaattcgtagc

SEQ ID NO: 365330 - DNA, 25 bp, Mus musculus
ttcgtagctacttctcacctcgggg

SEQ ID NO: 365331 - DNA, 25 bp, Mus musculus
ctcgacgtgtgaccctagcctggtc

SEQ ID NO: 365332 - DNA, 25 bp, Mus musculus
tggctgtccgccctctccttggaga

SEQ ID NO: 365333 - DNA, 25 bp, Mus musculus
gccttgctgcagatattccgctcta

SEQ ID NO: 365334 - DNA, 25 bp, Mus musculus
tccgctctaagtccgcctggcagga

SEQ ID NO: 365335 - DNA, 25 bp, Mus musculus
ggcttcggcttcagcttccgctcta

SEQ ID NO: 365336 - DNA, 25 bp, Mus musculus
tccactaagcggtgatgaccctctg

SEQ ID NO: 365337 - DNA, 25 bp, Mus musculus
tgacgacgaagaccctccactaagc

SEQ ID NO: 365338 - DNA, 25 bp, Mus musculus
ccgcggctccaccaagagatctggg

SEQ ID NO: 365339 - DNA, 25 bp, Mus musculus
caggagtccggacatctctgcgtcc

SEQ ID NO: 365340 - DNA, 25 bp, Mus musculus
acgccgtgggaagcatccaaagacc

SEQ ID NO: 365341 - DNA, 25 bp, Mus musculus
tcgcacgggcctatcggacgccgtg

SEQ ID NO: 365342 - DNA, 25 bp, Mus musculus
ttccagcggggatgcccgcgtccaa

SEQ ID NO: 365343 - DNA, 25 bp, Mus musculus
tgacgtgccacgcagtgcattgtgg

SEQ ID NO: 365344 - DNA, 25 bp, Mus musculus
aggggccgggccatacctgtcgctc

SEQ ID NO: 365345 - DNA, 25 bp, Mus musculus
cggtcaagccgaggtggaactccga

SEQ ID NO: 365346 - DNA, 25 bp, Mus musculus
cggctcggacaactaccggtcaagc

SEQ ID NO: 365347 - DNA, 25 bp, Mus musculus
ctcgcagccctaggtcgcagggact

SEQ ID NO: 365348 - DNA, 25 bp, Mus musculus
ggacaggcctgctaaacagcaaccg

SEQ ID NO: 365349 - DNA, 25 bp, Mus musculus
gcccatcctaggacaggcctgctaa

SEQ ID NO: 365350 - DNA, 25 bp, Mus musculus
gagtcaacactacggctcgctggca

SEQ ID NO: 365351 - DNA, 25 bp, Mus musculus
acatcgggagccagggagtcaacac

SEQ ID NO: 365352 - DNA, 25 bp, Mus musculus
agtgagtcggtgtgctgctgacatc

SEQ ID NO: 365353 - DNA, 25 bp, Mus musculus
gggccacctaccagcccgagtgagt

SEQ ID NO: 365354 - DNA, 25 bp, Mus musculus
agttcccggtgccacgtctgccaaa

SEQ ID NO: 365355 - DNA, 25 bp, Mus musculus
gggtccaacccacgagcaagtgttc

SEQ ID NO: 365356 - DNA, 25 bp, Mus musculus
cgtctgacaacctccttagcgggta

SEQ ID NO: 365357 - DNA, 25 bp, Mus musculus
ggtatctttacggtttcccatctca

SEQ ID NO: 365358 - DNA, 25 bp, Mus musculus
tcccatctcatagaaggaacgcaga

SEQ ID NO: 365359 - DNA, 25 bp, Mus musculus
acacgtttacagatccagggcgcca

SEQ ID NO: 365360 - DNA, 25 bp, Mus musculus
gttcacgagaagctcgggatgcctc

SEQ ID NO: 365361 - DNA, 25 bp, Mus musculus
catcaccgtgggagcagaactcttg

SEQ ID NO: 365362 - DNA, 25 bp, Mus musculus
ctctgcctcggactttgcctgagga

SEQ ID NO: 365363 - DNA, 25 bp, Mus musculus
caagtgttcctgctgcgcaagtgga

SEQ ID NO: 365364 - DNA, 25 bp, Mus musculus
ctgcttaggctaaggacatcccaga

SEQ ID NO: 365365 - DNA, 25 bp, Mus musculus
aaagaccctattgccacccggcgag

SEQ ID NO: 365366 - DNA, 25 bp, Mus musculus
ctgccaaagcatgcgcaccaggcta

SEQ ID NO: 365367 - DNA, 25 bp, Mus musculus
gggcgccacacacacagctcgaaag

SEQ ID NO: 365368 - DNA, 25 bp, Mus musculus
tcggagcccacagtgtcctctaagg

SEQ ID NO: 365369 - DNA, 25 bp, Mus musculus
gagcttccggagctttttccctcgc

SEQ ID NO: 365370 - DNA, 25 bp, Mus musculus
ctggggctgtgagttgcaaacttca

SEQ ID NO: 365371 - DNA, 25 bp, Mus musculus
caaacttcagcaactaggataggta

SEQ ID NO: 365372 - DNA, 25 bp, Mus musculus
ttctggctccactgggctgcgatca

SEQ ID NO: 365373 - DNA, 25 bp, Mus musculus
gagtgtgaaatctcccgcgcaggga

SEQ ID NO: 365374 - DNA, 25 bp, Mus musculus
agtgtcctctaaggccctggatgga

SEQ ID NO: 365375 - DNA, 25 bp, Mus musculus
tcctgcctcagccagtgaagcgggt

SEQ ID NO: 365376 - DNA, 25 bp, Mus musculus
ctaaaggggcgatttcctgatttat

SEQ ID NO: 365377 - DNA, 25 bp, Mus musculus
tttgtctttgtgattggggctgccc

SEQ ID NO: 365378 - DNA, 25 bp, Mus musculus
tggggctgcccattcactttccgct

SEQ ID NO: 365379 - DNA, 25 bp, Mus musculus
ttccgctcacgtcgtgcgggagatc

SEQ ID NO: 365380 - DNA, 25 bp, Mus musculus
cggagacagaagtagcagcaggacc

SEQ ID NO: 365381 - DNA, 25 bp, Mus musculus
cgatcagcgcgtctaggctgcagcc

SEQ ID NO: 365382 - DNA, 25 bp, Mus musculus
caacgagaacctcacggagcgcagc

SEQ ID NO: 365383 - DNA, 25 bp, Mus musculus
tctacataggcacgggtgagccggc

SEQ ID NO: 365384 - DNA, 25 bp, Mus musculus
cacgtactctacataggcacgggtg

SEQ ID NO: 365385 - DNA, 25 bp, Mus musculus
aggacacgctctatcacgtactcta

SEQ ID NO: 365386 - DNA, 25 bp, Mus musculus
gtagaccttgtgcaagctaaggaca

SEQ ID NO: 365387 - DNA, 25 bp, Mus musculus
atctcgtggtagaccttgtgcaagc

SEQ ID NO: 365388 - DNA, 25 bp, Mus musculus
agcgtccgcttctcacatctcgtgg

SEQ ID NO: 365389 - DNA, 25 bp, Mus musculus
gtgtcacccaggacagcgtccgctt

SEQ ID NO: 365390 - DNA, 25 bp, Mus musculus
gagccctgtgtcacccaggacagcg

SEQ ID NO: 365391 - DNA, 25 bp, Mus musculus
ctgtgcagccagtgacaccagagcc

SEQ ID NO: 365392 - DNA, 25 bp, Mus musculus
ttcctgatgagcgaagctgtgcagc

SEQ ID NO: 365393 - DNA, 25 bp, Mus musculus
gacgcacagcggctcttcctgatga

SEQ ID NO: 365394 - DNA, 25 bp, Mus musculus
agaacctcacggagcgcagcctgca

SEQ ID NO: 365395 - DNA, 25 bp, Mus musculus
gcctgcaggacgcacagcggctctt

SEQ ID NO: 365396 - DNA, 25 bp, Mus musculus
tctgcagttcggcaagaggaggaca

SEQ ID NO: 365397 - DNA, 25 bp, Mus musculus
gacagagaccaggacttgcccggca

SEQ ID NO: 365398 - DNA, 25 bp, Mus musculus
acccgcacggtctgcagttcggcaa

SEQ ID NO: 365399 - DNA, 25 bp, Mus musculus
ggagcagcgattccgcttcacctgc

SEQ ID NO: 365400 - DNA, 25 bp, Mus musculus
agaatggcaactcgtgcccgggttg

SEQ ID NO: 365401 - DNA, 25 bp, Mus musculus
cccgaaggagttcaagacctgcaac

SEQ ID NO: 365402 - DNA, 25 bp, Mus musculus
agtgcgacgcaacacaccctggacg

SEQ ID NO: 365403 - DNA, 25 bp, Mus musculus
acttgcccggcagacggcaccggag

SEQ ID NO: 365404 - DNA, 25 bp, Mus musculus
cggagcctgcgacaccgacggtaca

SEQ ID NO: 365405 - DNA, 25 bp, Mus musculus
gccgttcttgcgagaatggcaactc

SEQ ID NO: 365406 - DNA, 25 bp, Mus musculus
tcgcgacgccgttcttgcgagaatg

SEQ ID NO: 365407 - DNA, 25 bp, Mus musculus
gaaagcccaaggtcagggtcgctga

SEQ ID NO: 365408 - DNA, 25 bp, Mus musculus
ttgcccggaagtgcgacgcaacaca

SEQ ID NO: 365409 - DNA, 25 bp, Mus musculus
cgacaccgacggtacagccaggagc

SEQ ID NO: 365410 - DNA, 25 bp, Mus musculus
cagtggctcgctcgtcagcagagaa

SEQ ID NO: 365411 - DNA, 25 bp, Mus musculus
cattgatgcgattgctgtggcagtg

SEQ ID NO: 365412 - DNA, 25 bp, Mus musculus
tcgtagagaggaatggcgccgcatt

SEQ ID NO: 365413 - DNA, 25 bp, Mus musculus
tcagcagagaaccacgtcgtagaga

SEQ ID NO: 365414 - DNA, 25 bp, Mus musculus
ccgaggtaactcagcattgatgcga

SEQ ID NO: 365415 - DNA, 25 bp, Mus musculus
ggtctcgattcggtctttaatatga

SEQ ID NO: 365416 - DNA, 25 bp, Mus musculus
gggcccgacgagaaacgcacacgct

SEQ ID NO: 365417 - DNA, 25 bp, Mus musculus
gctccaccgaggtaactcagcattg

SEQ ID NO: 365418 - DNA, 25 bp, Mus musculus
tggcgccgcattcatgacagtcgga

SEQ ID NO: 365419 - DNA, 25 bp, Mus musculus
cggtctttaatatgagccctgctac

SEQ ID NO: 365420 - DNA, 25 bp, Mus musculus
atatgagccctgctactctccgcag

SEQ ID NO: 365421 - DNA, 25 bp, Mus musculus
actctccgcagcgagaaggggtgcc

SEQ ID NO: 365422 - DNA, 25 bp, Mus musculus
gtcccgttgggagctggaacaacca

SEQ ID NO: 365423 - DNA, 25 bp, Mus musculus
attcatgacagtcggacctgccagt

SEQ ID NO: 365424 - DNA, 25 bp, Mus musculus
cagcatctgctgtgtgcgattggca

SEQ ID NO: 365425 - DNA, 25 bp, Mus musculus
cgggtcacgctcagcatctgctgtg

SEQ ID NO: 365426 - DNA, 25 bp, Mus musculus
ctgtttttcagcagggacccgggct

SEQ ID NO: 365427 - DNA, 25 bp, Mus musculus
agcgttaccttgaggatgtcctgca

SEQ ID NO: 365428 - DNA, 25 bp, Mus musculus
tgcagctgtctcagcacggcgtgca

SEQ ID NO: 365429 - DNA, 25 bp, Mus musculus
acggcgtgcacctcagcgtgcagta

SEQ ID NO: 365430 - DNA, 25 bp, Mus musculus
cgtgcagtaaccagcgaaactcctc

SEQ ID NO: 365431 - DNA, 25 bp, Mus musculus
gcaccgtctctgaggtctgtagtca

SEQ ID NO: 365432 - DNA, 25 bp, Mus musculus
ctcccgtgaccgattggcaaatagg

SEQ ID NO: 365433 - DNA, 25 bp, Mus musculus
tggcaaatagggcacaagctccgcc

SEQ ID NO: 365434 - DNA, 25 bp, Mus musculus
agccggctacgcctcaagcgactgg

SEQ ID NO: 365435 - DNA, 25 bp, Mus musculus
aagcgactggctgtagcttctagtc

SEQ ID NO: 365436 - DNA, 25 bp, Mus musculus
tggctagacggataggccacgcctc

SEQ ID NO: 365437 - DNA, 25 bp, Mus musculus
cgggctttggccaccactgattggt

SEQ ID NO: 365438 - DNA, 25 bp, Mus musculus
caggtgttccagaccaggccctggg

SEQ ID NO: 365439 - DNA, 25 bp, Mus musculus
acatgaacgcgaagcagggcaggaa

SEQ ID NO: 365440 - DNA, 25 bp, Mus musculus
ggcaggaagcctatgggcccccaga

SEQ ID NO: 365441 - DNA, 25 bp, Mus musculus
ccaggagcgcgatgtcccatccgga

SEQ ID NO: 365442 - DNA, 25 bp, Mus musculus
agcgcgatgtcccatccggagaagc

SEQ ID NO: 365443 - DNA, 25 bp, Mus musculus
tgctcgctgggaacccaggaatgcc

SEQ ID NO: 365444 - DNA, 25 bp, Mus musculus
aagccataggcctggcgcgccgagt

SEQ ID NO: 365445 - DNA, 25 bp, Mus musculus
tcgctgctccaacccgagcccatgg

SEQ ID NO: 365446 - DNA, 25 bp, Mus musculus
gccgcagaccagccgggagctgact

SEQ ID NO: 365447 - DNA, 25 bp, Mus musculus
agccggagctgctctagtcctcggc

SEQ ID NO: 365448 - DNA, 25 bp, Mus musculus
ttacctctcttgtccagcagccaca

SEQ ID NO: 365449 - DNA, 25 bp, Mus musculus
cggggtccaccctgctcgctgggaa

SEQ ID NO: 365450 - DNA, 25 bp, Mus musculus
cagccacatgaacgcgaagcagggc

SEQ ID NO: 365451 - DNA, 25 bp, Mus musculus
tgtcccatccggagaagccataggc

SEQ ID NO: 365452 - DNA, 25 bp, Mus musculus
cagcagacgctaagggtggaagaaa

SEQ ID NO: 365453 - DNA, 25 bp, Mus musculus
cgcgagtccgactgagagaaagcca

SEQ ID NO: 365454 - DNA, 25 bp, Mus musculus
tggaagaaaggagccacagcccagc

SEQ ID NO: 365455 - DNA, 25 bp, Mus musculus
atgggcgcggctccatcccaagtct

SEQ ID NO: 365456 - DNA, 25 bp, Mus musculus
ccaaggcgaagatggaggatccgac

SEQ ID NO: 365457 - DNA, 25 bp, Mus musculus
cgcgataaccatggcagcaggctgc

SEQ ID NO: 365458 - DNA, 25 bp, Mus musculus
tcgccgcctttcagcttccaaagag

SEQ ID NO: 365459 - DNA, 25 bp, Mus musculus
ggggtctcctaaatcgcgagtccga

SEQ ID NO: 365460 - DNA, 25 bp, Mus musculus
agagcaaaacaaaccggcgtggcca

SEQ ID NO: 365461 - DNA, 25 bp, Mus musculus
cagaggcggaggatccttcctgtgt

SEQ ID NO: 365462 - DNA, 25 bp, Mus musculus
acgccgaagtgcctccgagcggtgc

SEQ ID NO: 365463 - DNA, 25 bp, Mus musculus
ccttcctgtgtggaagccgcagatc

SEQ ID NO: 365464 - DNA, 25 bp, Mus musculus
gaagccgcagatcccggtgagccct

SEQ ID NO: 365465 - DNA, 25 bp, Mus musculus
catcctcggcgcgataaccatggca

SEQ ID NO: 365466 - DNA, 25 bp, Mus musculus
ctgaactaggaagcggcgactgctg

SEQ ID NO: 365467 - DNA, 25 bp, Mus musculus
gttgcgctcgccacgcagattctgc

SEQ ID NO: 365468 - DNA, 25 bp, Mus musculus
aggatctcccgcaccgaacgagctg

SEQ ID NO: 365469 - DNA, 25 bp, Mus musculus
tgcagccgagggctagacctggcac

SEQ ID NO: 365470 - DNA, 25 bp, Mus musculus
cctcaccatcctccggggagaagag

SEQ ID NO: 365471 - DNA, 25 bp, Mus musculus
gcacccggaagcgtgctgggttccc

SEQ ID NO: 365472 - DNA, 25 bp, Mus musculus
cctccggatttcttccggctctgga

SEQ ID NO: 365473 - DNA, 25 bp, Mus musculus
ttccggctctggaagtacacttgca

SEQ ID NO: 365474 - DNA, 25 bp, Mus musculus
gcaacttgttgatcaagttctttgg

SEQ ID NO: 365475 - DNA, 25 bp, Mus musculus
aagagccctcgaccagcagcgggaa

SEQ ID NO: 365476 - DNA, 25 bp, Mus musculus
tgccatcctgactgaactaggaagc

SEQ ID NO: 365477 - DNA, 25 bp, Mus musculus
cctcgaccagcagcgggaaggaacc

SEQ ID NO: 365478 - DNA, 25 bp, Mus musculus
agcgggaaggaacccgacgctgcca

SEQ ID NO: 365479 - DNA, 25 bp, Mus musculus
ctggaagtacacttgcaacttgttg

SEQ ID NO: 365480 - DNA, 25 bp, Mus musculus
aaggtccctccttgttctccgcaga

SEQ ID NO: 365481 - DNA, 25 bp, Mus musculus
tggaaacctgctggttctacccttg

SEQ ID NO: 365482 - DNA, 25 bp, Mus musculus
gcatgcagggatcggtttggaaacc

SEQ ID NO: 365483 - DNA, 25 bp, Mus musculus
atacgaggctctctccgccactgtg

SEQ ID NO: 365484 - DNA, 25 bp, Mus musculus
catcagcggctggactcatacgagg

SEQ ID NO: 365485 - DNA, 25 bp, Mus musculus
gtatatctcgagcttcctgtgcgcc

SEQ ID NO: 365486 - DNA, 25 bp, Mus musculus
atggactcccgcagccgtacgagta

SEQ ID NO: 365487 - DNA, 25 bp, Mus musculus
tggaagccatggctatccgcgtctg

SEQ ID NO: 365488 - DNA, 25 bp, Mus musculus
agacccgagaggcaaagtttcagtt

SEQ ID NO: 365489 - DNA, 25 bp, Mus musculus
ctgtcttgctctgccatctctcaga

SEQ ID NO: 365490 - DNA, 25 bp, Mus musculus
atcacccggtgagtagttcgcacgc

SEQ ID NO: 365491 - DNA, 25 bp, Mus musculus
tgggcgctcagaggaagtttcccta

SEQ ID NO: 365492 - DNA, 25 bp, Mus musculus
caggtcgcccttctattcttgcagg

SEQ ID NO: 365493 - DNA, 25 bp, Mus musculus
gcccggctctggaagtatatctcga

SEQ ID NO: 365494 - DNA, 25 bp, Mus musculus
gctggtcaaggttgtgcgcagaaga

SEQ ID NO: 365495 - DNA, 25 bp, Mus musculus
agggcgtccacgctcggagactccg

SEQ ID NO: 365496 - DNA, 25 bp, Mus musculus
ggcttgcagtttacagatgtcataa

SEQ ID NO: 365497 - DNA, 25 bp, Mus musculus
gggccaagagcgagcgtctccctct

SEQ ID NO: 365498 - DNA, 25 bp, Mus musculus
gagcgagcgtctccctcttcgtagt

SEQ ID NO: 365499 - DNA, 25 bp, Mus musculus
ctagcctagggcgtccacgctcgga

SEQ ID NO: 365500 - DNA, 25 bp, Mus musculus
ttatagcaatgacaagttggtcggc

SEQ ID NO: 365501 - DNA, 25 bp, Mus musculus
aatgacaagttggtcggctgtgtga

SEQ ID NO: 365502 - DNA, 25 bp, Mus musculus
gatgtcataactacgcgggcctgga

SEQ ID NO: 365503 - DNA, 25 bp, Mus musculus
cctcttcgtagtggcaccgggaccg

SEQ ID NO: 365504 - DNA, 25 bp, Mus musculus
gtctccctcttcgtagtggcaccgg

SEQ ID NO: 365505 - DNA, 25 bp, Mus musculus
acgggaggcttgcagtttacagatg

SEQ ID NO: 365506 - DNA, 25 bp, Mus musculus
ggggtgtggtaattatagcaatgac

SEQ ID NO: 365507 - DNA, 25 bp, Mus musculus
aacgctggtgctcgccgtgaggaac

SEQ ID NO: 365508 - DNA, 25 bp, Mus musculus
cgggaactttctcggccgcgctgct

SEQ ID NO: 365509 - DNA, 25 bp, Mus musculus
caggtggttcccagccggcctttct

SEQ ID NO: 365510 - DNA, 25 bp, Mus musculus
ctctccaatccagagggagggaagg

SEQ ID NO: 365511 - DNA, 25 bp, Mus musculus
acattttcggggagctcgagggcca

SEQ ID NO: 365512 - DNA, 25 bp, Mus musculus
gccgaggcgctttcctgcctgcaaa

SEQ ID NO: 365513 - DNA, 25 bp, Mus musculus
tgcctgcaaacttcagcggggcccg

SEQ ID NO: 365514 - DNA, 25 bp, Mus musculus
aaaatccgtgagtggctggtggccc

SEQ ID NO: 365515 - DNA, 25 bp, Mus musculus
tgggtcaccgcaccgccgagttgca

SEQ ID NO: 365516 - DNA, 25 bp, Mus musculus
tggagcaggtcagctcgcacaccct

SEQ ID NO: 365517 - DNA, 25 bp, Mus musculus
ctcttccgctcgctggagcaggtca

SEQ ID NO: 365518 - DNA, 25 bp, Mus musculus
tgcccttccaccaacgaagcgtaga

SEQ ID NO: 365519 - DNA, 25 bp, Mus musculus
ccgggaccctcctttgtgttggatg

SEQ ID NO: 365520 - DNA, 25 bp, Mus musculus
gaccaccggcgagtgaaaatccgtg

SEQ ID NO: 365521 - DNA, 25 bp, Mus musculus
ggcgtgaactccgtgatcgccggtc

SEQ ID NO: 365522 - DNA, 25 bp, Mus musculus
atcctgttttgtgtgacgtcatctg

SEQ ID NO: 365523 - DNA, 25 bp, Mus musculus
gaagagccgcagaaacccaactatg

SEQ ID NO: 365524 - DNA, 25 bp, Mus musculus
gccagcagagagagcacagtcactt

SEQ ID NO: 365525 - DNA, 25 bp, Mus musculus
ggatctatggcgaccgagcatctgc

SEQ ID NO: 365526 - DNA, 25 bp, Mus musculus
gggaagcccgcgcaaattatagagc

SEQ ID NO: 365527 - DNA, 25 bp, Mus musculus
ggaccttatagaggagcccatgtta

SEQ ID NO: 365528 - DNA, 25 bp, Mus musculus
ttgctgactgggaacggaccttata

SEQ ID NO: 365529 - DNA, 25 bp, Mus musculus
tgacagcatctgacacgagtacgga

SEQ ID NO: 365530 - DNA, 25 bp, Mus musculus
cgtcatctgttgcttgaggttccca

SEQ ID NO: 365531 - DNA, 25 bp, Mus musculus
tgagcctctcataaatcctgttttg

SEQ ID NO: 365532 - DNA, 25 bp, Mus musculus
ctgtgatccgtgatgctatagaaga

SEQ ID NO: 365533 - DNA, 25 bp, Mus musculus
tcagacttactcttgcggggcactc

SEQ ID NO: 365534 - DNA, 25 bp, Mus musculus
ttcccagacattttggagctgcgga

SEQ ID NO: 365535 - DNA, 25 bp, Mus musculus
ggatcggcctagtcctttgacagca

SEQ ID NO: 365536 - DNA, 25 bp, Mus musculus
ggctcacggtatttgctgtcaggca

SEQ ID NO: 365537 - DNA, 25 bp, Mus musculus
aatgagcgccagataccagggtctc

SEQ ID NO: 365538 - DNA, 25 bp, Mus musculus
ggtcctcacacggttgcagtaagca

SEQ ID NO: 365539 - DNA, 25 bp, Mus musculus
ggcgctggcgctcaatgtcaccaag

SEQ ID NO: 365540 - DNA, 25 bp, Mus musculus
atgtctgccaactgcgaagcgctga

SEQ ID NO: 365541 - DNA, 25 bp, Mus musculus
tgtgcaagcgagtcacacacgcgga

SEQ ID NO: 365542 - DNA, 25 bp, Mus musculus
gaatgcccgaaggaagcctgctttc

SEQ ID NO: 365543 - DNA, 25 bp, Mus musculus
cgccgttagtttctcgacgcttctt

SEQ ID NO: 365544 - DNA, 25 bp, Mus musculus
tcgacgcttcttcgaggggctcatc

SEQ ID NO: 365545 - DNA, 25 bp, Mus musculus
cttagcgagaggaaaggcaaccgcc

SEQ ID NO: 365546 - DNA, 25 bp, Mus musculus
tctgctccacggtgattggtcggct

SEQ ID NO: 365547 - DNA, 25 bp, Mus musculus
ggggtcctcgtgttcgttcaatatg

SEQ ID NO: 365548 - DNA, 25 bp, Mus musculus
cgcccagtggcagtgtgaactgtga

SEQ ID NO: 365549 - DNA, 25 bp, Mus musculus
acccgatgctctaggcttagcgaga

SEQ ID NO: 365550 - DNA, 25 bp, Mus musculus
gggtctcgacactattgatgttttc

SEQ ID NO: 365551 - DNA, 25 bp, Mus musculus
cgttgtaggatatccgtaaatgttc

SEQ ID NO: 365552 - DNA, 25 bp, Mus musculus
gctaagtacacgttgtaggatatcc

SEQ ID NO: 365553 - DNA, 25 bp, Mus musculus
ccatgtaaggggtctcgacactatt

SEQ ID NO: 365554 - DNA, 25 bp, Mus musculus
ctcgacactattgatgttttcatcc

SEQ ID NO: 365555 - DNA, 25 bp, Mus musculus
aaggcagtggagctattgagtaacc

SEQ ID NO: 365556 - DNA, 25 bp, Mus musculus
attgagtaacctgttgccgccttcc

SEQ ID NO: 365557 - DNA, 25 bp, Mus musculus
tgttgccgccttcctcgtgacttct

SEQ ID NO: 365558 - DNA, 25 bp, Mus musculus
cctcgtgacttctcacgaaggtgtc

SEQ ID NO: 365559 - DNA, 25 bp, Mus musculus
tctcacgaaggtgtccacgggtaaa

SEQ ID NO: 365560 - DNA, 25 bp, Mus musculus
tggagtagacggctaagtacacgtt

SEQ ID NO: 365561 - DNA, 25 bp, Mus musculus
cgtgcgcaatggagtagacggctaa

SEQ ID NO: 365562 - DNA, 25 bp, Mus musculus
tccgtaaatgttcgtagtccatgta

SEQ ID NO: 365563 - DNA, 25 bp, Mus musculus
gttcgtagtccatgtaaggggtctc

SEQ ID NO: 365564 - DNA, 25 bp, Mus musculus
tcgcatagttcgacctacgggctcc

SEQ ID NO: 365565 - DNA, 25 bp, Mus musculus
cggctgatgaagaaagactcgcctc

SEQ ID NO: 365566 - DNA, 25 bp, Mus musculus
gggacgctcccgtcgcatagttcga

SEQ ID NO: 365567 - DNA, 25 bp, Mus musculus
acggagacggctagaggctctgttt

SEQ ID NO: 365568 - DNA, 25 bp, Mus musculus
tgatgaagaaagactcgcctctccg

SEQ ID NO: 365569 - DNA, 25 bp, Mus musculus
acctacgggctcctcggagatgcgt

SEQ ID NO: 365570 - DNA, 25 bp, Mus musculus
atagttcgacctacgggctcctcgg

SEQ ID NO: 365571 - DNA, 25 bp, Mus musculus
tcccgtcgcatagttcgacctacgg

SEQ ID NO: 365572 - DNA, 25 bp, Mus musculus
ccagaggggacgctcccgtcgcata

SEQ ID NO: 365573 - DNA, 25 bp, Mus musculus
gctcagagagcctcaggtaccggtg

SEQ ID NO: 365574 - DNA, 25 bp, Mus musculus
cacctggcagcctgtgacaggtagg

SEQ ID NO: 365575 - DNA, 25 bp, Mus musculus
gacggctagaggctctgtttcctgc

SEQ ID NO: 365576 - DNA, 25 bp, Mus musculus
agatgggtcacctggcagcctgtga

SEQ ID NO: 365577 - DNA, 25 bp, Mus musculus
tgtttcctgcggagatgggtcacct

SEQ ID NO: 365578 - DNA, 25 bp, Mus musculus
acgccagacacccagggcagaactg

SEQ ID NO: 365579 - DNA, 25 bp, Mus musculus
cggggaagctaggacgccagacacc

SEQ ID NO: 365580 - DNA, 25 bp, Mus musculus
agcgcggctgcttctcgaaactttc

SEQ ID NO: 365581 - DNA, 25 bp, Mus musculus
gcctagcttgagaacccgctcgcga

SEQ ID NO: 365582 - DNA, 25 bp, Mus musculus
atgaggtaacagacccgagatggcg

SEQ ID NO: 365583 - DNA, 25 bp, Mus musculus
agctcggcggagaccgcctcgctga

SEQ ID NO: 365584 - DNA, 25 bp, Mus musculus
gtcgcgacgcacacagctcggcgga

SEQ ID NO: 365585 - DNA, 25 bp, Mus musculus
attggctgtctggagacacctgccc

SEQ ID NO: 365586 - DNA, 25 bp, Mus musculus
cactggctgcgagcttgagttcggt

SEQ ID NO: 365587 - DNA, 25 bp, Mus musculus
tctggaacagctgcactggctgcga

SEQ ID NO: 365588 - DNA, 25 bp, Mus musculus
cgaaactttcgcctagcttgagaac

SEQ ID NO: 365589 - DNA, 25 bp, Mus musculus
cgcgacggtccaggtatgcaagtcc

SEQ ID NO: 365590 - DNA, 25 bp, Mus musculus
taacgggagcgtgggcctcctccgc

SEQ ID NO: 365591 - DNA, 25 bp, Mus musculus
atgcaagtcccgctggtccactcat

SEQ ID NO: 365592 - DNA, 25 bp, Mus musculus
cctgaccacgtgacgggtgtttgct

SEQ ID NO: 365593 - DNA, 25 bp, Mus musculus
ttcttggacgtggacttggcatatc

SEQ ID NO: 365594 - DNA, 25 bp, Mus musculus
cgccgtccggagtgcataataaaac

SEQ ID NO: 365595 - DNA, 25 bp, Mus musculus
aataaaactactcctgggccagctg

SEQ ID NO: 365596 - DNA, 25 bp, Mus musculus
gctggcaaccctgcgaccaggaaaa

SEQ ID NO: 365597 - DNA, 25 bp, Mus musculus
ggaaaagcagcttcgcgccgtcttt

SEQ ID NO: 365598 - DNA, 25 bp, Mus musculus
gtctttcgttcagcgctggtcgcca

SEQ ID NO: 365599 - DNA, 25 bp, Mus musculus
accgcccattggagttggcctgacc

SEQ ID NO: 365600 - DNA, 25 bp, Mus musculus
tgtttgctgtcatccgcctagcgga

SEQ ID NO: 365601 - DNA, 25 bp, Mus musculus
tcgtgacaacgaagcatccgcggtc

SEQ ID NO: 365602 - DNA, 25 bp, Mus musculus
cgcttccgggactctagactcattt

SEQ ID NO: 365603 - DNA, 25 bp, Mus musculus
cccgctgcttccgttacggctgtta

SEQ ID NO: 365604 - DNA, 25 bp, Mus musculus
gtcgaagcccagagactccaagctc

SEQ ID NO: 365605 - DNA, 25 bp, Mus musculus
gcgtcgcccgacttgttttcttgga

SEQ ID NO: 365606 - DNA, 25 bp, Mus musculus
cggggacacagacacccagtcagtc

SEQ ID NO: 365607 - DNA, 25 bp, Mus musculus
aggtcgacgccttgattcagccttc

SEQ ID NO: 365608 - DNA, 25 bp, Mus musculus
tctcacggcgagtggctgactccca

SEQ ID NO: 365609 - DNA, 25 bp, Mus musculus
cgccgtgcttgggttaccgagctga

SEQ ID NO: 365610 - DNA, 25 bp, Mus musculus
ggttaccgagctgacgtggcttcga

SEQ ID NO: 365611 - DNA, 25 bp, Mus musculus
cggggagctccgcaacggctctgct

SEQ ID NO: 365612 - DNA, 25 bp, Mus musculus
acccagtcagtctgccggcagggtc

SEQ ID NO: 365613 - DNA, 25 bp, Mus musculus
tggtcagccctacgtgcacggacgg

SEQ ID NO: 365614 - DNA, 25 bp, Mus musculus
cggggacgctagaggcaacctgccc

SEQ ID NO: 365615 - DNA, 25 bp, Mus musculus
cccagccctgaacaaacttagtgtt

SEQ ID NO: 365616 - DNA, 25 bp, Mus musculus
ctgtcgccgttaccgcagtcgaggc

SEQ ID NO: 365617 - DNA, 25 bp, Mus musculus
ctgagcaccgctccgataggtcgac

SEQ ID NO: 365618 - DNA, 25 bp, Mus musculus
tagtgttccgctgtcgccgttaccg

SEQ ID NO: 365619 - DNA, 25 bp, Mus musculus
tgattcagccttccgtctcacggcg

SEQ ID NO: 365620 - DNA, 25 bp, Mus musculus
aggcctatgggactgtgtcgtgtcc

SEQ ID NO: 365621 - DNA, 25 bp, Mus musculus
aggccggaagccagatatcagcgcg

SEQ ID NO: 365622 - DNA, 25 bp, Mus musculus
ccactctatggtagtcgggttattc

SEQ ID NO: 365623 - DNA, 25 bp, Mus musculus
ctagccaggagaactctgtggttcc

SEQ ID NO: 365624 - DNA, 25 bp, Mus musculus
agctgtcactaggttggggttctcc

SEQ ID NO: 365625 - DNA, 25 bp, Mus musculus
acagggacaggtactcgacccgcgg

SEQ ID NO: 365626 - DNA, 25 bp, Mus musculus
aaacggcggcgttcatcgtccggct

SEQ ID NO: 365627 - DNA, 25 bp, Mus musculus
tgctgggaggcctgcatttgaagat

SEQ ID NO: 365628 - DNA, 25 bp, Mus musculus
tgcaatgagtcttccgcgccggagt

SEQ ID NO: 365629 - DNA, 25 bp, Mus musculus
tgtggaccggtgctgagtccacctc

SEQ ID NO: 365630 - DNA, 25 bp, Mus musculus
ccggctccgacacgttctcgggaga

SEQ ID NO: 365631 - DNA, 25 bp, Mus musculus
ctcgggagatggtgatagctttgtt

SEQ ID NO: 365632 - DNA, 25 bp, Mus musculus
cctgaacagtcgagaggagcttgtt

SEQ ID NO: 365633 - DNA, 25 bp, Mus musculus
gctttgttagccctcagctccggtg

SEQ ID NO: 365634 - DNA, 25 bp, Mus musculus
acagacagccgggaagccacacgca

SEQ ID NO: 365635 - DNA, 25 bp, Mus musculus
ctctccgaggtcctaaccgagcggg

SEQ ID NO: 365636 - DNA, 25 bp, Mus musculus
tggagccctcacagacagccgggaa

SEQ ID NO: 365637 - DNA, 25 bp, Mus musculus
ccaagcagggcgctgaggctaccac

SEQ ID NO: 365638 - DNA, 25 bp, Mus musculus
aagccacacgcacctcagacagctg

SEQ ID NO: 365639 - DNA, 25 bp, Mus musculus
gcgctctccctcttgcacaggcaca

SEQ ID NO: 365640 - DNA, 25 bp, Mus musculus
tggggaccccagacttagcaccttc

SEQ ID NO: 365641 - DNA, 25 bp, Mus musculus
ttcctcagacgccactagccgccgg

SEQ ID NO: 365642 - DNA, 25 bp, Mus musculus
tcacaggcgggcgaaggtccagccc

SEQ ID NO: 365643 - DNA, 25 bp, Mus musculus
cttctcgggtccctctggtcctggt

SEQ ID NO: 365644 - DNA, 25 bp, Mus musculus
ctcccagccaagcagggcgctgagg

SEQ ID NO: 365645 - DNA, 25 bp, Mus musculus
acacacaggcgtgcgcacaggtgtg

SEQ ID NO: 365646 - DNA, 25 bp, Mus musculus
ctgaggctaccaccgcgggctacga

SEQ ID NO: 365647 - DNA, 25 bp, Mus musculus
ggtgcctggcgctctccgaggtcct

SEQ ID NO: 365648 - DNA, 25 bp, Mus musculus
ccctgcgctgattggtgagaatcca

SEQ ID NO: 365649 - DNA, 25 bp, Mus musculus
gtgccctccaccagctgtgttcaga

SEQ ID NO: 365650 - DNA, 25 bp, Mus musculus
aatgagatgatttgccctgcccaca

SEQ ID NO: 365651 - DNA, 25 bp, Mus musculus
gtcacgctctgaccgaccaatgaga

SEQ ID NO: 365652 - DNA, 25 bp, Mus musculus
acgcctaattcctgcgaccggtttg

SEQ ID NO: 365653 - DNA, 25 bp, Mus musculus
cttgcgagacaaggacgaacgccta

SEQ ID NO: 365654 - DNA, 25 bp, Mus musculus
gtgagccgcttaacccacgtctggg

SEQ ID NO: 365655 - DNA, 25 bp, Mus musculus
tacccaagtggatgctcgaacactc

SEQ ID NO: 365656 - DNA, 25 bp, Mus musculus
ccatgaaatgccacgccaggtcaga

SEQ ID NO: 365657 - DNA, 25 bp, Mus musculus
gggcgtcaacctcaaggaaatcgtg

SEQ ID NO: 365658 - DNA, 25 bp, Mus musculus
cgtcctacccgaggtcgcacatggg

SEQ ID NO: 365659 - DNA, 25 bp, Mus musculus
gacaccgctctctcttcgctgttta

SEQ ID NO: 365660 - DNA, 25 bp, Mus musculus
tgggactaccaacacgcccgagctt

SEQ ID NO: 365661 - DNA, 25 bp, Mus musculus
gctccggggcaatggttctttagaa

SEQ ID NO: 365662 - DNA, 25 bp, Mus musculus
actgtcacttttccctgctggtggc

SEQ ID NO: 365663 - DNA, 25 bp, Mus musculus
atcttggggcgcacgaaatatgtcg

SEQ ID NO: 365664 - DNA, 25 bp, Mus musculus
cgcgaactgcgcttctcgagcaatc

SEQ ID NO: 365665 - DNA, 25 bp, Mus musculus
gcgtcctcgttttttgccctgcaga

SEQ ID NO: 365666 - DNA, 25 bp, Mus musculus
acagtcggtcctctaattgggcgtc

SEQ ID NO: 365667 - DNA, 25 bp, Mus musculus
aagacgcctccaaggaccctggtgc

SEQ ID NO: 365668 - DNA, 25 bp, Mus musculus
cgcctagacgctggatccttgcgga

SEQ ID NO: 365669 - DNA, 25 bp, Mus musculus
gggtatcccaaacgctgcgccctgg

SEQ ID NO: 365670 - DNA, 25 bp, Mus musculus
cgtcgttgttgctgttgcacttgcc

SEQ ID NO: 365671 - DNA, 25 bp, Mus musculus
cgaagctccttacggtcgtatttca

SEQ ID NO: 365672 - DNA, 25 bp, Mus musculus
tgtccaggtacctcgcagccgtaca

SEQ ID NO: 365673 - DNA, 25 bp, Mus musculus
ctgggagccagagccacggaaaatt

SEQ ID NO: 365674 - DNA, 25 bp, Mus musculus
ccgggagagagatcacgcaacgaca

SEQ ID NO: 365675 - DNA, 25 bp, Mus musculus
tctggaagaagacacgcgcaccgcc

SEQ ID NO: 365676 - DNA, 25 bp, Mus musculus
tgcgcacagcctgagaaattgcttg

SEQ ID NO: 365677 - DNA, 25 bp, Mus musculus
aaattgcttggaaactcttcgcgtc

SEQ ID NO: 365678 - DNA, 25 bp, Mus musculus
aaaccggacctctccctggcacagg

SEQ ID NO: 365679 - DNA, 25 bp, Mus musculus
gcgtcattctgcagggcgcgcgcat

SEQ ID NO: 365680 - DNA, 25 bp, Mus musculus
aactcttcgcgtcattctgcagggc

SEQ ID NO: 365681 - DNA, 25 bp, Mus musculus
cctgagaaattgcttggaaactctt

SEQ ID NO: 365682 - DNA, 25 bp, Mus musculus
cttggaaactcttcgcgtcattctg

SEQ ID NO: 365683 - DNA, 25 bp, Mus musculus
gaaccgtctgttggacgcggcgccc

SEQ ID NO: 365684 - DNA, 25 bp, Mus musculus
cctcgcaggcggaaaccggacctct

SEQ ID NO: 365685 - DNA, 25 bp, Mus musculus
gcgcctgcgcacagcctgagaaatt

SEQ ID NO: 365686 - DNA, 25 bp, Mus musculus
acctgaggttactgagggtctttgc

SEQ ID NO: 365687 - DNA, 25 bp, Mus musculus
gcccggtgtgattccgttcgttcac

SEQ ID NO: 365688 - DNA, 25 bp, Mus musculus
gattccgttcgttcacctgaggtta

SEQ ID NO: 365689 - DNA, 25 bp, Mus musculus
ccgttcgttcacctgaggttactga

SEQ ID NO: 365690 - DNA, 25 bp, Mus musculus
gtctgaccttcaggctcaggaagtg

SEQ ID NO: 365691 - DNA, 25 bp, Mus musculus
cggtgtccagcacacggagggagct

SEQ ID NO: 365692 - DNA, 25 bp, Mus musculus
ccactgagccgaaggccgaagttga

SEQ ID NO: 365693 - DNA, 25 bp, Mus musculus
ctttgaccactgagccgaaggccga

SEQ ID NO: 365694 - DNA, 25 bp, Mus musculus
tgtgcccacgcgagatgcggctgcc

SEQ ID NO: 365695 - DNA, 25 bp, Mus musculus
gcgcggatatgagggctgccctctc

SEQ ID NO: 365696 - DNA, 25 bp, Mus musculus
tgccctctcgagtctgaccttcagg

SEQ ID NO: 365697 - DNA, 25 bp, Mus musculus
ttcaggctcaggaagtgcgcctgcg

SEQ ID NO: 365698 - DNA, 25 bp, Mus musculus
tgcgcgcgcacaaggcgctctggca

SEQ ID NO: 365699 - DNA, 25 bp, Mus musculus
tgggtggagcctttgccaatcctcc

SEQ ID NO: 365700 - DNA, 25 bp, Mus musculus
ctccttcacgccctcgtcccgcgta

SEQ ID NO: 365701 - DNA, 25 bp, Mus musculus
gtcccgcgtattctgcgcgtgcgca

SEQ ID NO: 365702 - DNA, 25 bp, Mus musculus
cgatccctttgaccactgagccgaa

SEQ ID NO: 365703 - DNA, 25 bp, Mus musculus
atgagggctgccctctcgagtctga

SEQ ID NO: 365704 - DNA, 25 bp, Mus musculus
ggacttcctcggagcctggtgataa

SEQ ID NO: 365705 - DNA, 25 bp, Mus musculus
atgcctgcggtgcatggacgctcct

SEQ ID NO: 365706 - DNA, 25 bp, Mus musculus
agcctggtgataagcgacgctccca

SEQ ID NO: 365707 - DNA, 25 bp, Mus musculus
ggtgataagcgacgctcccaccttc

SEQ ID NO: 365708 - DNA, 25 bp, Mus musculus
cttcgcctctaactcgctgccgcca

SEQ ID NO: 365709 - DNA, 25 bp, Mus musculus
tctgtgggacccgaagaagtttcta

SEQ ID NO: 365710 - DNA, 25 bp, Mus musculus
ggggcccagcgccttcactctcacc

SEQ ID NO: 365711 - DNA, 25 bp, Mus musculus
cctcttctctcttccgcagatgtgg

SEQ ID NO: 365712 - DNA, 25 bp, Mus musculus
tccgcagatgtggaaacgatggctg

SEQ ID NO: 365713 - DNA, 25 bp, Mus musculus
gaaacgatggctggcgctctcgctg

SEQ ID NO: 365714 - DNA, 25 bp, Mus musculus
tctcgctggtgaccatcgccctggt

SEQ ID NO: 365715 - DNA, 25 bp, Mus musculus
catcgccctggtccacggcgaggta

SEQ ID NO: 365716 - DNA, 25 bp, Mus musculus
catggacgctcctgggctactggcg

SEQ ID NO: 365717 - DNA, 25 bp, Mus musculus
ggcgagcccaggtcggacttcctcg

SEQ ID NO: 365718 - DNA, 25 bp, Mus musculus
agctcctggacgtgagcggcaactc

SEQ ID NO: 365719 - DNA, 25 bp, Mus musculus
ggcgccgaccatcgcgtgactcgga

SEQ ID NO: 365720 - DNA, 25 bp, Mus musculus
acgcggcgctcgctttaggttccgg

SEQ ID NO: 365721 - DNA, 25 bp, Mus musculus
ggaggccgaactcaactggtcccgc

SEQ ID NO: 365722 - DNA, 25 bp, Mus musculus
aactggtcccgcctcagcgtgtcgg

SEQ ID NO: 365723 - DNA, 25 bp, Mus musculus
tgcgcacgctgctggccaggaacaa

SEQ ID NO: 365724 - DNA, 25 bp, Mus musculus
agctgtttactctggcggccaaggc

SEQ ID NO: 365725 - DNA, 25 bp, Mus musculus
ggcggcaaccagctgcagagcatcc

SEQ ID NO: 365726 - DNA, 25 bp, Mus musculus
cccgccgagatcgagaacttgcgga

SEQ ID NO: 365727 - DNA, 25 bp, Mus musculus
ggggactaggcgagccattgtcacc

SEQ ID NO: 365728 - DNA, 25 bp, Mus musculus
gagccattgtcacccgtagcgtctg

SEQ ID NO: 365729 - DNA, 25 bp, Mus musculus
acccgtagcgtctgaccaagggtgg

SEQ ID NO: 365730 - DNA, 25 bp, Mus musculus
ccaccgggtgccacactataaaggg

SEQ ID NO: 365731 - DNA, 25 bp, Mus musculus
ctggccaggaacaaccggctcggcg

SEQ ID NO: 365732 - DNA, 25 bp, Mus musculus
cgacccgcagggcaccgcgcacacc

SEQ ID NO: 365733 - DNA, 25 bp, Mus musculus
ccactccggctgtctacgaggcgat

SEQ ID NO: 365734 - DNA, 25 bp, Mus musculus
gccaccttccaaacccgagagccca

SEQ ID NO: 365735 - DNA, 25 bp, Mus musculus
cgagagcccaccagagaccggaaga

SEQ ID NO: 365736 - DNA, 25 bp, Mus musculus
caccagagaccggaagagcacgcgc

SEQ ID NO: 365737 - DNA, 25 bp, Mus musculus
accggaagagcacgcgcgtcccaat

SEQ ID NO: 365738 - DNA, 25 bp, Mus musculus
cgctgcaagcggctctttgagcaca

SEQ ID NO: 365739 - DNA, 25 bp, Mus musculus
cggctctttgagcacagcagcagga

SEQ ID NO: 365740 - DNA, 25 bp, Mus musculus
tttgagcacagcagcaggaagtcgc

SEQ ID NO: 365741 - DNA, 25 bp, Mus musculus
gcagcaggaagtcgcccagagaacc

SEQ ID NO: 365742 - DNA, 25 bp, Mus musculus
ccagagaaccgctcaaacaggagtg

SEQ ID NO: 365743 - DNA, 25 bp, Mus musculus
cgctcaaacaggagtggacgtcttt

SEQ ID NO: 365744 - DNA, 25 bp, Mus musculus
cgcgcacaccgcacagccgccactc

SEQ ID NO: 365745 - DNA, 25 bp, Mus musculus
actccggagtagagaggcctgcagc

SEQ ID NO: 365746 - DNA, 25 bp, Mus musculus
gacgtctctgattggttccggcttg

SEQ ID NO: 365747 - DNA, 25 bp, Mus musculus
ttctgttcggctaccttcggcattc

SEQ ID NO: 365748 - DNA, 25 bp, Mus musculus
gcgagcgattcccagacgcctgtaa

SEQ ID NO: 365749 - DNA, 25 bp, Mus musculus
ctttttccggcaggagctgcaagca

SEQ ID NO: 365750 - DNA, 25 bp, Mus musculus
tggttatccaggtcgctcggctttt

SEQ ID NO: 365751 - DNA, 25 bp, Mus musculus
gcggcgtctcctcattggttatcca

SEQ ID NO: 365752 - DNA, 25 bp, Mus musculus
aggccaatcccactgcagctaggtc

SEQ ID NO: 365753 - DNA, 25 bp, Mus musculus
attgcacagcagtgagcgcctattg

SEQ ID NO: 365754 - DNA, 25 bp, Mus musculus
ctcgacgctgcagaccaatgagatg

SEQ ID NO: 365755 - DNA, 25 bp, Mus musculus
cccagcggagttgtccagccaatga

SEQ ID NO: 365756 - DNA, 25 bp, Mus musculus
tcttgaggcttttccctgagggcca

SEQ ID NO: 365757 - DNA, 25 bp, Mus musculus
cagctaggtcttgcgattgcacagc

SEQ ID NO: 365758 - DNA, 25 bp, Mus musculus
ttgtcgactcttctctctagccagc

SEQ ID NO: 365759 - DNA, 25 bp, Mus musculus
ctgattggccactgtcgctattgtc

SEQ ID NO: 365760 - DNA, 25 bp, Mus musculus
ttgcgcacgcgcttcttagacttac

SEQ ID NO: 365761 - DNA, 25 bp, Mus musculus
gagcgaggccttgtaccacttcttt

SEQ ID NO: 365762 - DNA, 25 bp, Mus musculus
ccgaggctcaggagaagaagccact

SEQ ID NO: 365763 - DNA, 25 bp, Mus musculus
agaagccactgaagccctgctgtgc

SEQ ID NO: 365764 - DNA, 25 bp, Mus musculus
tgtgcctgcccggaaaccaagaagg

SEQ ID NO: 365765 - DNA, 25 bp, Mus musculus
cggaaaccaagaaggcgcgtgatgc

SEQ ID NO: 365766 - DNA, 25 bp, Mus musculus
tgacgccacgcccttggagcgaggc

SEQ ID NO: 365767 - DNA, 25 bp, Mus musculus
cttagacttacttccgtccggagag

SEQ ID NO: 365768 - DNA, 25 bp, Mus musculus
tgtaccacttcttttgcgcacgcgc

SEQ ID NO: 365769 - DNA, 25 bp, Mus musculus
ttcgcctggaaagatgccgggactg

SEQ ID NO: 365770 - DNA, 25 bp, Mus musculus
cgctcatagttgctttcgcctggaa

SEQ ID NO: 365771 - DNA, 25 bp, Mus musculus
cccttcgattgactgcggaagtgga

SEQ ID NO: 365772 - DNA, 25 bp, Mus musculus
attgactgcggaagtggagacagac

SEQ ID NO: 365773 - DNA, 25 bp, Mus musculus
gagctttgcgcgtgtgcgctcatag

SEQ ID NO: 365774 - DNA, 25 bp, Mus musculus
ctcagagatcgcagacgcggccagt

SEQ ID NO: 365775 - DNA, 25 bp, Mus musculus
gcggccctgagaactcagagatcgc

SEQ ID NO: 365776 - DNA, 25 bp, Mus musculus
tcagagatcgcagacgcggccagtt

SEQ ID NO: 365777 - DNA, 25 bp, Mus musculus
cagagatcgcagacgcggccagttt

SEQ ID NO: 365778 - DNA, 25 bp, Mus musculus
agagatcgcagacgcggccagtttc

SEQ ID NO: 365779 - DNA, 25 bp, Mus musculus
cagacgcggccagtttcggggatag

SEQ ID NO: 365780 - DNA, 25 bp, Mus musculus
ccctgagaaatcacgcagtgaaaaa

SEQ ID NO: 365781 - DNA, 25 bp, Mus musculus
tgagaaatcacgcagtgaaaaattg

SEQ ID NO: 365782 - DNA, 25 bp, Mus musculus
aatcacgcagtgaaaaattggtctg

SEQ ID NO: 365783 - DNA, 25 bp, Mus musculus
tcacgcagtgaaaaattggtctgtc

SEQ ID NO: 365784 - DNA, 25 bp, Mus musculus
cacgcagtgaaaaattggtctgtcc

SEQ ID NO: 365785 - DNA, 25 bp, Mus musculus
acgcagtgaaaaattggtctgtccc

SEQ ID NO: 365786 - DNA, 25 bp, Mus musculus
tgaaaaattggtctgtccccaccca

SEQ ID NO: 365787 - DNA, 25 bp, Mus musculus
actcagagatcgcagacgcggccag

SEQ ID NO: 365788 - DNA, 25 bp, Mus musculus
gtgtgcgagctccttccaggaatcc

SEQ ID NO: 365789 - DNA, 25 bp, Mus musculus
ccaggagggcatcgtaggcaatcat

SEQ ID NO: 365790 - DNA, 25 bp, Mus musculus
ggggcatcgtgtccgctgctgccac

SEQ ID NO: 365791 - DNA, 25 bp, Mus musculus
aaggctctgtgtgcgagctccttcc

SEQ ID NO: 365792 - DNA, 25 bp, Mus musculus
ctccaccgtggaagaaggctctgtg

SEQ ID NO: 365793 - DNA, 25 bp, Mus musculus
ggaatcactgtctccaccgtggaag

SEQ ID NO: 365794 - DNA, 25 bp, Mus musculus
aatggcggccgtggaatcactgtct

SEQ ID NO: 365795 - DNA, 25 bp, Mus musculus
ccagcagccagcaatggcggccgtg

SEQ ID NO: 365796 - DNA, 25 bp, Mus musculus
gctgtcggtattcgagcttctcgta

SEQ ID NO: 365797 - DNA, 25 bp, Mus musculus
ctcttctagccgctgtcggtattcg

SEQ ID NO: 365798 - DNA, 25 bp, Mus musculus
agcccgagtagctcacgtcgatgta

SEQ ID NO: 365799 - DNA, 25 bp, Mus musculus
ttccttcacaccaaagggctgcggg

SEQ ID NO: 365800 - DNA, 25 bp, Mus musculus
tgtagaactgatccctttccttcac

SEQ ID NO: 365801 - DNA, 25 bp, Mus musculus
agcttctcgtagttggcgggattta

SEQ ID NO: 365802 - DNA, 25 bp, Mus musculus
ggccgctctcgatgctcacttggat

SEQ ID NO: 365803 - DNA, 25 bp, Mus musculus
cggcatatgccgtaaaaagagcgga

SEQ ID NO: 365804 - DNA, 25 bp, Mus musculus
tgccgtaaaaagagcggacgcaagg

SEQ ID NO: 365805 - DNA, 25 bp, Mus musculus
gccaccctcgtgactgttgaaggga

SEQ ID NO: 365806 - DNA, 25 bp, Mus musculus
ctcgtgactgttgaagggaatccta

SEQ ID NO: 365807 - DNA, 25 bp, Mus musculus
acgcaaggctgccgaggtagcccgt

SEQ ID NO: 365808 - DNA, 25 bp, Mus musculus
ctctcgatgctcacttggatcagca

SEQ ID NO: 365809 - DNA, 25 bp, Mus musculus
ttggatcagcagatccagttggctg

SEQ ID NO: 365810 - DNA, 25 bp, Mus musculus
gttgaagggaatcctatagccgtcg

SEQ ID NO: 365811 - DNA, 25 bp, Mus musculus
cgtgactgttgaagggaatcctata

SEQ ID NO: 365812 - DNA, 25 bp, Mus musculus
cgcagccaccctcgtgactgttgaa

SEQ ID NO: 365813 - DNA, 25 bp, Mus musculus
cccgatgcacatggcgcgcatggca

SEQ ID NO: 365814 - DNA, 25 bp, Mus musculus
gaacctcagcccgatgcacatggcg

SEQ ID NO: 365815 - DNA, 25 bp, Mus musculus
taaaaagagcggacgcaaggctgcc

SEQ ID NO: 365816 - DNA, 25 bp, Mus musculus
caggagtcctgctgtgggcacccaa

SEQ ID NO: 365817 - DNA, 25 bp, Mus musculus
tgtgggcacccaagccaaaagccga

SEQ ID NO: 365818 - DNA, 25 bp, Mus musculus
gactcctggctgtacctgctgaggc

SEQ ID NO: 365819 - DNA, 25 bp, Mus musculus
gcacccaagccaaaagccgaacagg

SEQ ID NO: 365820 - DNA, 25 bp, Mus musculus
gcgtcctccgcactggacggaagga

SEQ ID NO: 365821 - DNA, 25 bp, Mus musculus
agccttgcgcatcagctcgggaacc

SEQ ID NO: 365822 - DNA, 25 bp, Mus musculus
cagggttctgccctgccagggttct

SEQ ID NO: 365823 - DNA, 25 bp, Mus musculus
gaccgttggactcccagagcctggt

SEQ ID NO: 365824 - DNA, 25 bp, Mus musculus
agcggcttgggctcaccgattctaa

SEQ ID NO: 365825 - DNA, 25 bp, Mus musculus
gggctcaccgattctaaccctagtc

SEQ ID NO: 365826 - DNA, 25 bp, Mus musculus
tctaaccctagtccgttcagccgtg

SEQ ID NO: 365827 - DNA, 25 bp, Mus musculus
ctagtccgttcagccgtggttctgc

SEQ ID NO: 365828 - DNA, 25 bp, Mus musculus
gaccgagcgggtactaaggtcagta

SEQ ID NO: 365829 - DNA, 25 bp, Mus musculus
tactaaggtcagtaagaggagagtg

SEQ ID NO: 365830 - DNA, 25 bp, Mus musculus
ctgcgcctgcgtacaacttgggacg

SEQ ID NO: 365831 - DNA, 25 bp, Mus musculus
gcaccattcagtgcacgcgcatgcg

SEQ ID NO: 365832 - DNA, 25 bp, Mus musculus
tgcaaagcaccattcagtgcacgcg

SEQ ID NO: 365833 - DNA, 25 bp, Mus musculus
gtccgcaaagtgcaaagcaccattc

SEQ ID NO: 365834 - DNA, 25 bp, Mus musculus
gctgtccgcaaagtgcaaagcacca

SEQ ID NO: 365835 - DNA, 25 bp, Mus musculus
acctgctgtccgcaaagtgcaaagc

SEQ ID NO: 365836 - DNA, 25 bp, Mus musculus
ccggacctgctgtccgcaaagtgca

SEQ ID NO: 365837 - DNA, 25 bp, Mus musculus
cgtacaacttgggacgccggacctg

SEQ ID NO: 365838 - DNA, 25 bp, Mus musculus
gggacctctgatcgacttagttccc

SEQ ID NO: 365839 - DNA, 25 bp, Mus musculus
gcgggacctctgatcgacttagttc

SEQ ID NO: 365840 - DNA, 25 bp, Mus musculus
ggaggcgggacctctgatcgactta

SEQ ID NO: 365841 - DNA, 25 bp, Mus musculus
cctcatctcccaggcggaggcggga

SEQ ID NO: 365842 - DNA, 25 bp, Mus musculus
gtgtgattccctttgttccccctga

SEQ ID NO: 365843 - DNA, 25 bp, Mus musculus
ggacgccggacctgctgtccgcaaa

SEQ ID NO: 365844 - DNA, 25 bp, Mus musculus
tacgtgctgagctcgttggtgcgca

SEQ ID NO: 365845 - DNA, 25 bp, Mus musculus
agacaacctgcagggtggcaatgac

SEQ ID NO: 365846 - DNA, 25 bp, Mus musculus
cagacaacctgcagggtggcaatga

SEQ ID NO: 365847 - DNA, 25 bp, Mus musculus
acagtgggtgcagtggcaggcgaca

SEQ ID NO: 365848 - DNA, 25 bp, Mus musculus
gtagacaatccgggccacccgtaca

SEQ ID NO: 365849 - DNA, 25 bp, Mus musculus
tcgtgacagttgcacgccgagcggc

SEQ ID NO: 365850 - DNA, 25 bp, Mus musculus
cttcgtgacagttgcacgccgagcg

SEQ ID NO: 365851 - DNA, 25 bp, Mus musculus
ccgagcttcgtgacagttgcacgcc

SEQ ID NO: 365852 - DNA, 25 bp, Mus musculus
atgccgagcttcgtgacagttgcac

SEQ ID NO: 365853 - DNA, 25 bp, Mus musculus
tgtatgccgagcttcgtgacagttg

SEQ ID NO: 365854 - DNA, 25 bp, Mus musculus
gagctgtatgccgagcttcgtgaca

SEQ ID NO: 365855 - DNA, 25 bp, Mus musculus
cccgagctgtatgccgagcttcgtg

SEQ ID NO: 365856 - DNA, 25 bp, Mus musculus
gccttcgccatacccttctccaaca

SEQ ID NO: 365857 - DNA, 25 bp, Mus musculus
cgcccgctgccttcgccataccctt

SEQ ID NO: 365858 - DNA, 25 bp, Mus musculus
ttcagactggcgtagacaatccggg

SEQ ID NO: 365859 - DNA, 25 bp, Mus musculus
ccagcccagtgatgagcacaagacc

SEQ ID NO: 365860 - DNA, 25 bp, Mus musculus
cacgccgagcggctttactttggac

SEQ ID NO: 365861 - DNA, 25 bp, Mus musculus
cgttcttctgcgctgcgccaggagc

SEQ ID NO: 365862 - DNA, 25 bp, Mus musculus
ttctccaacagccataatacgcaga

SEQ ID NO: 365863 - DNA, 25 bp, Mus musculus
tttggacgacgccattcagactggc

SEQ ID NO: 365864 - DNA, 25 bp, Mus musculus
aaccatatggccaaggtgctgaccc

SEQ ID NO: 365865 - DNA, 25 bp, Mus musculus
aggagagttacgacgtattcaagga

SEQ ID NO: 365866 - DNA, 25 bp, Mus musculus
ccacaacaaccatatggccaaggtg

SEQ ID NO: 365867 - DNA, 25 bp, Mus musculus
ttccctgatctgagcagccacaaca

SEQ ID NO: 365868 - DNA, 25 bp, Mus musculus
gaagctgcgcttcccggccgaggat

SEQ ID NO: 365869 - DNA, 25 bp, Mus musculus
ccataatacgcagaagctgcgcttc

SEQ ID NO: 365870 - DNA, 25 bp, Mus musculus
gctaccagcccagtgatgagcacaa

SEQ ID NO: 365871 - DNA, 25 bp, Mus musculus
ggctttactttggacgacgccattc

SEQ ID NO: 365872 - DNA, 25 bp, Mus musculus
tctccaatgctgaccgcctgagctt

SEQ ID NO: 365873 - DNA, 25 bp, Mus musculus
gcgtgtttgatgtctccaatgctga

SEQ ID NO: 365874 - DNA, 25 bp, Mus musculus
cgctgctgtctgtggcgtgtttgat

SEQ ID NO: 365875 - DNA, 25 bp, Mus musculus
gagaagttctcggaggtgctcaatc

SEQ ID NO: 365876 - DNA, 25 bp, Mus musculus
gtctgtggcgtgtttgatgtctcca

SEQ ID NO: 365877 - DNA, 25 bp, Mus musculus
ccgcctgagcttctcggaggtggag

SEQ ID NO: 365878 - DNA, 25 bp, Mus musculus
ggtggacggagtgaaactgctcatt

SEQ ID NO: 365879 - DNA, 25 bp, Mus musculus
cggagtgaaactgctcattgagatg

SEQ ID NO: 365880 - DNA, 25 bp, Mus musculus
aactgctcattgagatggagcagcg

SEQ ID NO: 365881 - DNA, 25 bp, Mus musculus
gctcgagcagggtcaggcaatcgac

SEQ ID NO: 365882 - DNA, 25 bp, Mus musculus
cagggtcaggcaatcgacgacctca

SEQ ID NO: 365883 - DNA, 25 bp, Mus musculus
tcaggcaatcgacgacctcatgccg

SEQ ID NO: 365884 - DNA, 25 bp, Mus musculus
ttctcggaggtgctcaatcggctgc

SEQ ID NO: 365885 - DNA, 25 bp, Mus musculus
tgatgtctccaatgctgaccgcctg

SEQ ID NO: 365886 - DNA, 25 bp, Mus musculus
cggccgtttcgtttcatctcagtga

SEQ ID NO: 365887 - DNA, 25 bp, Mus musculus
cgggcagagagaactttcagcgtcg

SEQ ID NO: 365888 - DNA, 25 bp, Mus musculus
aactttcagcgtcgcagggaccgcg

SEQ ID NO: 365889 - DNA, 25 bp, Mus musculus
accgcaccggcagcaaagactcggg

SEQ ID NO: 365890 - DNA, 25 bp, Mus musculus
ggtctgagacacctgaacgctgctc

SEQ ID NO: 365891 - DNA, 25 bp, Mus musculus
ggggacactgaacctcacatccggt

SEQ ID NO: 365892 - DNA, 25 bp, Mus musculus
acaaagcctggggaatccgcagcca

SEQ ID NO: 365893 - DNA, 25 bp, Mus musculus
gctcgggacgtagaaactggaactg

SEQ ID NO: 365894 - DNA, 25 bp, Mus musculus
tccggaagctctcggaaaggagacc

SEQ ID NO: 365895 - DNA, 25 bp, Mus musculus
aactgagagctctttcggtagcgca

SEQ ID NO: 365896 - DNA, 25 bp, Mus musculus
agagggtgacctgtacagcccacta

SEQ ID NO: 365897 - DNA, 25 bp, Mus musculus
tgtacagcccactagcggcacgttg

SEQ ID NO: 365898 - DNA, 25 bp, Mus musculus
tctttggcaaacagctgccggaggc

SEQ ID NO: 365899 - DNA, 25 bp, Mus musculus
ctcagtgatgtcctttggcgtttgc

SEQ ID NO: 365900 - DNA, 25 bp, Mus musculus
ttgcagccgcacagcatcctccgcg

SEQ ID NO: 365901 - DNA, 25 bp, Mus musculus
ggagcccacctgagtccttctggcg

SEQ ID NO: 365902 - DNA, 25 bp, Mus musculus
ccctgcaccgggcacaggagcagta

SEQ ID NO: 365903 - DNA, 25 bp, Mus musculus
ccgctgtccagctcgcgttgcagcc

SEQ ID NO: 365904 - DNA, 25 bp, Mus musculus
cacggcacgtgggagctgccctaca

SEQ ID NO: 365905 - DNA, 25 bp, Mus musculus
tgggagctgccctacacaaagatgg

SEQ ID NO: 365906 - DNA, 25 bp, Mus musculus
tgccctacacaaagatggctgccga

SEQ ID NO: 365907 - DNA, 25 bp, Mus musculus
cgggcacaggagcagtaacagcatc

SEQ ID NO: 365908 - DNA, 25 bp, Mus musculus
ccacagcgagcacccagggacccga

SEQ ID NO: 365909 - DNA, 25 bp, Mus musculus
gagcagtaacagcatccatgcccta

SEQ ID NO: 365910 - DNA, 25 bp, Mus musculus
gcccgacgctccatcacccgcagac

SEQ ID NO: 365911 - DNA, 25 bp, Mus musculus
agcatccatgccctaagccgagagc

SEQ ID NO: 365912 - DNA, 25 bp, Mus musculus
cggaagcgccgcccagcagaaggat

SEQ ID NO: 365913 - DNA, 25 bp, Mus musculus
agaccactgcggattcccacccgca

SEQ ID NO: 365914 - DNA, 25 bp, Mus musculus
gagagctttcttcgactgtccagtg

SEQ ID NO: 365915 - DNA, 25 bp, Mus musculus
gagagtcccactgcgcaggtgcgcc

SEQ ID NO: 365916 - DNA, 25 bp, Mus musculus
tctgctggccgcaagcctgtttccg

SEQ ID NO: 365917 - DNA, 25 bp, Mus musculus
agcgcgacgcagagctgacgtcatc

SEQ ID NO: 365918 - DNA, 25 bp, Mus musculus
tgacgtcatcgctgtgcgctgccac

SEQ ID NO: 365919 - DNA, 25 bp, Mus musculus
gtcggactgtgcttctgactttagc

SEQ ID NO: 365920 - DNA, 25 bp, Mus musculus
gactttagctctggctctggcacgg

SEQ ID NO: 365921 - DNA, 25 bp, Mus musculus
acctagcgacccgagagctttcttc

SEQ ID NO: 365922 - DNA, 25 bp, Mus musculus
taacctgctttgtcatctcgccggc

SEQ ID NO: 365923 - DNA, 25 bp, Mus musculus
tgtccagtgggatcctgcctgcgtc

SEQ ID NO: 365924 - DNA, 25 bp, Mus musculus
ctgcgtcccggcagctgtttttgga

SEQ ID NO: 365925 - DNA, 25 bp, Mus musculus
gctgtttttggagcgctttagagga

SEQ ID NO: 365926 - DNA, 25 bp, Mus musculus
cagcctgtcccatgcgtgagtttta

SEQ ID NO: 365927 - DNA, 25 bp, Mus musculus
ggtctgggtctggtaacctagcgac

SEQ ID NO: 365928 - DNA, 25 bp, Mus musculus
tccgcaccgctgatgagggtttcgg

SEQ ID NO: 365929 - DNA, 25 bp, Mus musculus
ttcctgccgccagtcaggctctttg

SEQ ID NO: 365930 - DNA, 25 bp, Mus musculus
gtcccggaggaaatcggcctcgcga

SEQ ID NO: 365931 - DNA, 25 bp, Mus musculus
ctagtccagagtatcgcccagggcc

SEQ ID NO: 365932 - DNA, 25 bp, Mus musculus
cccgaagtggctctgctagtccaga

SEQ ID NO: 365933 - DNA, 25 bp, Mus musculus
agagatcgcgctctcccgaagtggc

SEQ ID NO: 365934 - DNA, 25 bp, Mus musculus
tttgtgagtgcagtcgaaggaagta

SEQ ID NO: 365935 - DNA, 25 bp, Mus musculus
cggaggttggaaatttttggcagct

SEQ ID NO: 365936 - DNA, 25 bp, Mus musculus
ctcaggaagcgctggaaggaagtca

SEQ ID NO: 365937 - DNA, 25 bp, Mus musculus
tgtcttacaaatcccaggatcgtcc

SEQ ID NO: 365938 - DNA, 25 bp, Mus musculus
ggaccgcgaacagccagcatcacgt

SEQ ID NO: 365939 - DNA, 25 bp, Mus musculus
cgctctgccttcagagcgctggagg

SEQ ID NO: 365940 - DNA, 25 bp, Mus musculus
cgcgcttctcggctgagccttgcga

SEQ ID NO: 365941 - DNA, 25 bp, Mus musculus
gtcaggctctttgcacagcgcagga

SEQ ID NO: 365942 - DNA, 25 bp, Mus musculus
agccggggctgcagagccgcctccc

SEQ ID NO: 365943 - DNA, 25 bp, Mus musculus
ggctgcaccaggtcttgagagaacc

SEQ ID NO: 365944 - DNA, 25 bp, Mus musculus
ctgcaccaggtcttgagagaaccgg

SEQ ID NO: 365945 - DNA, 25 bp, Mus musculus
ccaggtcttgagagaaccgggcaga

SEQ ID NO: 365946 - DNA, 25 bp, Mus musculus
gtcttgagagaaccgggcagacccg

SEQ ID NO: 365947 - DNA, 25 bp, Mus musculus
gcaggcggtccacgagcgcgatccc

SEQ ID NO: 365948 - DNA, 25 bp, Mus musculus
gtccacgggatggtgccgggcggac

SEQ ID NO: 365949 - DNA, 25 bp, Mus musculus
tcggcgctgctgtcctgccggccga

SEQ ID NO: 365950 - DNA, 25 bp, Mus musculus
cagagctggggagatgttgcgcgca

SEQ ID NO: 365951 - DNA, 25 bp, Mus musculus
atgttgcgcgcagcggggagatgca

SEQ ID NO: 365952 - DNA, 25 bp, Mus musculus
atgcagggtgcatccggccgcgtcc

SEQ ID NO: 365953 - DNA, 25 bp, Mus musculus
cgtccgggtgcttgcgtctcccggc

SEQ ID NO: 365954 - DNA, 25 bp, Mus musculus
gaggctgcaccaggtcttgagagaa

SEQ ID NO: 365955 - DNA, 25 bp, Mus musculus
ctccgagcggccatcgtcgggctgt

SEQ ID NO: 365956 - DNA, 25 bp, Mus musculus
gcgcttaccttgcaggcggggcttc

SEQ ID NO: 365957 - DNA, 25 bp, Mus musculus
atcgccggccacttgcttgcctgcc

SEQ ID NO: 365958 - DNA, 25 bp, Mus musculus
tctgggtcactacaggaacagggcg

SEQ ID NO: 365959 - DNA, 25 bp, Mus musculus
catcgtgcacatagagcctggcgcg

SEQ ID NO: 365960 - DNA, 25 bp, Mus musculus
gcgcccatcgtgcacatagagcctg

SEQ ID NO: 365961 - DNA, 25 bp, Mus musculus
taggccgcgcccatcgtgcacatag

SEQ ID NO: 365962 - DNA, 25 bp, Mus musculus
gacgactaggccacctgcgctaggc

SEQ ID NO: 365963 - DNA, 25 bp, Mus musculus
aacctggacgactaggccacctgcg

SEQ ID NO: 365964 - DNA, 25 bp, Mus musculus
cgccagaacctggacgactaggcca

SEQ ID NO: 365965 - DNA, 25 bp, Mus musculus
gcagcctgtcgccagaacctggacg

SEQ ID NO: 365966 - DNA, 25 bp, Mus musculus
cctgttactgcagaggctgcgcagc

SEQ ID NO: 365967 - DNA, 25 bp, Mus musculus
ccctgttgcctgttactgcagaggc

SEQ ID NO: 365968 - DNA, 25 bp, Mus musculus
gcttcggacgcgctccctgggtccc

SEQ ID NO: 365969 - DNA, 25 bp, Mus musculus
gcggctctgggtcactacaggaaca

SEQ ID NO: 365970 - DNA, 25 bp, Mus musculus
tgctcggtgagtaactcagcttgtc

SEQ ID NO: 365971 - DNA, 25 bp, Mus musculus
cattctgcggctggccactaggcgt

SEQ ID NO: 365972 - DNA, 25 bp, Mus musculus
agccttgagttctgtgcattctgcg

SEQ ID NO: 365973 - DNA, 25 bp, Mus musculus
gtcgcactggagtcgcggttgccct

SEQ ID NO: 365974 - DNA, 25 bp, Mus musculus
tgtcccgcttggtcccacgctgcac

SEQ ID NO: 365975 - DNA, 25 bp, Mus musculus
ctccggcatgactcggcggcgctcc

SEQ ID NO: 365976 - DNA, 25 bp, Mus musculus
cggcgtcctggctgctcgtgtcgct

SEQ ID NO: 365977 - DNA, 25 bp, Mus musculus
ttctgtgcattctgcggctggccac

SEQ ID NO: 365978 - DNA, 25 bp, Mus musculus
tgtcgctgctcggtgagtaactcag

SEQ ID NO: 365979 - DNA, 25 bp, Mus musculus
ggtgagtaactcagcttgtcctgcc

SEQ ID NO: 365980 - DNA, 25 bp, Mus musculus
agtaactcagcttgtcctgccgcct

SEQ ID NO: 365981 - DNA, 25 bp, Mus musculus
tgcccgcagggcctgggaaccggct

SEQ ID NO: 365982 - DNA, 25 bp, Mus musculus
gccaggtgtccccaagcgctgtaac

SEQ ID NO: 365983 - DNA, 25 bp, Mus musculus
ctcgtgtcgctgctcggtgagtaac

SEQ ID NO: 365984 - DNA, 25 bp, Mus musculus
acctactggctgcacagcgtctggg

SEQ ID NO: 365985 - DNA, 25 bp, Mus musculus
gattcgctgggagactgctcagtcc

SEQ ID NO: 365986 - DNA, 25 bp, Mus musculus
ctgggagagccctgagggaaaccaa

SEQ ID NO: 365987 - DNA, 25 bp, Mus musculus
agcgagcagcgcgttttactagaga

SEQ ID NO: 365988 - DNA, 25 bp, Mus musculus
tgctgtagtccaggctaggtcccga

SEQ ID NO: 365989 - DNA, 25 bp, Mus musculus
tttctacccgcggtgctgtagtcca

SEQ ID NO: 365990 - DNA, 25 bp, Mus musculus
acaagtccggtgatgcgtttctacc

SEQ ID NO: 365991 - DNA, 25 bp, Mus musculus
cagaatccggcttattgacaagtcc

SEQ ID NO: 365992 - DNA, 25 bp, Mus musculus
ctgggtctacacagaatccggctta

SEQ ID NO: 365993 - DNA, 25 bp, Mus musculus
cggactgcgagcatccttcaggacc

SEQ ID NO: 365994 - DNA, 25 bp, Mus musculus
gtccctcttctcattgcaaggtagg

SEQ ID NO: 365995 - DNA, 25 bp, Mus musculus
cttggcgacatgaggacctactggc

SEQ ID NO: 365996 - DNA, 25 bp, Mus musculus
accgggctcgcgctcttggagaaga

SEQ ID NO: 365997 - DNA, 25 bp, Mus musculus
gggtcaccagcgctctgggtctaca

SEQ ID NO: 365998 - DNA, 25 bp, Mus musculus
tcccgcaggtggaagcgggacctct

SEQ ID NO: 365999 - DNA, 25 bp, Mus musculus
attgacttaggtctcctggctgcgc

SEQ ID NO: 366000 - DNA, 25 bp, Mus musculus
aagcgggacctctcattgacttagg

SEQ ID NO: 366001 - DNA, 25 bp, Mus musculus
tttgttcccgagttgtggtcccgca

SEQ ID NO: 366002 - DNA, 25 bp, Mus musculus
tcattccgtttgttcccgagttgtg

SEQ ID NO: 366003 - DNA, 25 bp, Mus musculus
cggcgtcggtgtcattccgtttgtt

SEQ ID NO: 366004 - DNA, 25 bp, Mus musculus
tgcttcccgcagctgtgaggagagt

SEQ ID NO: 366005 - DNA, 25 bp, Mus musculus
gtgaccctgcttcccgcagctgtga

SEQ ID NO: 366006 - DNA, 25 bp, Mus musculus
tccatccatgttgggcgcagtgacc

SEQ ID NO: 366007 - DNA, 25 bp, Mus musculus
aggaagactcctccatccatgttgg

SEQ ID NO: 366008 - DNA, 25 bp, Mus musculus
ccaatcggaatggaggcgggcactt

SEQ ID NO: 366009 - DNA, 25 bp, Mus musculus
cgaggcggaacaccaatcggaatgg

SEQ ID NO: 366010 - DNA, 25 bp, Mus musculus
cttataaaccattctgggctggctg

SEQ ID NO: 366011 - DNA, 25 bp, Mus musculus
cgggagctgggcttataaaccattc

SEQ ID NO: 366012 - DNA, 25 bp, Mus musculus
cgggagagttcagcccgatcggaaa

SEQ ID NO: 366013 - DNA, 25 bp, Mus musculus
ctgcccgttcgcagcgtggatttta

SEQ ID NO: 366014 - DNA, 25 bp, Mus musculus
actcgccgaggccaccatggtcggg

SEQ ID NO: 366015 - DNA, 25 bp, Mus musculus
cgcccgagcagccttggcagtggct

SEQ ID NO: 366016 - DNA, 25 bp, Mus musculus
cgcagcgtggattttaaccgaggca

SEQ ID NO: 366017 - DNA, 25 bp, Mus musculus
aacatcaccgtgagacagggggaca

SEQ ID NO: 366018 - DNA, 25 bp, Mus musculus
cttcttcccacaggactgcccgttc

SEQ ID NO: 366019 - DNA, 25 bp, Mus musculus
tactgagactgctctgccttcttcc

SEQ ID NO: 366020 - DNA, 25 bp, Mus musculus
tgccgctggtcctactgagactgct

SEQ ID NO: 366021 - DNA, 25 bp, Mus musculus
tcggaaacagttgccgctggtccta

SEQ ID NO: 366022 - DNA, 25 bp, Mus musculus
gttcagcccgatcggaaacagttgc

SEQ ID NO: 366023 - DNA, 25 bp, Mus musculus
aggccaccatggtcgggagagttca

SEQ ID NO: 366024 - DNA, 25 bp, Mus musculus
gtccaccgcggaccaactcgccgag

SEQ ID NO: 366025 - DNA, 25 bp, Mus musculus
tttaaccgaggcacggacaacatca

SEQ ID NO: 366026 - DNA, 25 bp, Mus musculus
tggcgtctgcgaagccgcgatgctt

SEQ ID NO: 366027 - DNA, 25 bp, Mus musculus
ctgcgaagccgcgatgcttgcacgt

SEQ ID NO: 366028 - DNA, 25 bp, Mus musculus
aagccgcgatgcttgcacgtgccac

SEQ ID NO: 366029 - DNA, 25 bp, Mus musculus
cgcgatgcttgcacgtgccacgagg

SEQ ID NO: 366030 - DNA, 25 bp, Mus musculus
cgcaccgccatccagcgcggcagga

SEQ ID NO: 366031 - DNA, 25 bp, Mus musculus
cggctgctctcttggcgtcacccat

SEQ ID NO: 366032 - DNA, 25 bp, Mus musculus
ctgacagccgcgtaaggtttccgcc

SEQ ID NO: 366033 - DNA, 25 bp, Mus musculus
cttggcgtcacccatcaccgctgct

SEQ ID NO: 366034 - DNA, 25 bp, Mus musculus
tcaccgctgctgacagccgcgtaag

SEQ ID NO: 366035 - DNA, 25 bp, Mus musculus
ccgctgctgacagccgcgtaaggtt

SEQ ID NO: 366036 - DNA, 25 bp, Mus musculus
tccctggatgtccacggatgggcgc

SEQ ID NO: 366037 - DNA, 25 bp, Mus musculus
cctgctccctggatgtccacggatg

SEQ ID NO: 366038 - DNA, 25 bp, Mus musculus
taaggtttccgcctgctccctggat

SEQ ID NO: 366039 - DNA, 25 bp, Mus musculus
agccgcgtaaggtttccgcctgctc

SEQ ID NO: 366040 - DNA, 25 bp, Mus musculus
ccctcccaccgccaggatcctgctc

SEQ ID NO: 366041 - DNA, 25 bp, Mus musculus
acctgcttctcactggccgccgccg

SEQ ID NO: 366042 - DNA, 25 bp, Mus musculus
agacacctgcttctcactggccgcc

SEQ ID NO: 366043 - DNA, 25 bp, Mus musculus
gcggcagacacctgcttctcactgg

SEQ ID NO: 366044 - DNA, 25 bp, Mus musculus
catcccggctccataggcggcgcgc

SEQ ID NO: 366045 - DNA, 25 bp, Mus musculus
ctccgctggggcatcccggctccat

SEQ ID NO: 366046 - DNA, 25 bp, Mus musculus
gacagcgggtaaccgccgcctccgc

SEQ ID NO: 366047 - DNA, 25 bp, Mus musculus
gcgagccagacagcgggtaaccgcc

SEQ ID NO: 366048 - DNA, 25 bp, Mus musculus
ccctcctccctgcactgaacccctt

SEQ ID NO: 366049 - DNA, 25 bp, Mus musculus
atccactgcccgtgaccacgacacc

SEQ ID NO: 366050 - DNA, 25 bp, Mus musculus
atcctgctcgctaggacatccactg

SEQ ID NO: 366051 - DNA, 25 bp, Mus musculus
caggatcctgctcgctaggacatcc

SEQ ID NO: 366052 - DNA, 25 bp, Mus musculus
gcccagcggtccctcccaccgccag

SEQ ID NO: 366053 - DNA, 25 bp, Mus musculus
ggatcctgctcgctaggacatccac

SEQ ID NO: 366054 - DNA, 25 bp, Mus musculus
tcacgagggctgtccaaacgctatt

SEQ ID NO: 366055 - DNA, 25 bp, Mus musculus
cggcaacctcacgagggctgtccaa

SEQ ID NO: 366056 - DNA, 25 bp, Mus musculus
caaacgctattggtcagctgaagca

SEQ ID NO: 366057 - DNA, 25 bp, Mus musculus
tattggtcagctgaagcagcgagtg

SEQ ID NO: 366058 - DNA, 25 bp, Mus musculus
agtggcatgcgagccgcccaatagt

SEQ ID NO: 366059 - DNA, 25 bp, Mus musculus
tgcgagccgcccaatagtaggacaa

SEQ ID NO: 366060 - DNA, 25 bp, Mus musculus
atagtaggacaaggtagaggttcgc

SEQ ID NO: 366061 - DNA, 25 bp, Mus musculus
cccaatgtgggccttctgccgaaga

SEQ ID NO: 366062 - DNA, 25 bp, Mus musculus
tgtgggccttctgccgaagaagtag

SEQ ID NO: 366063 - DNA, 25 bp, Mus musculus
ttgaggaaagaagattaaagagcgc

SEQ ID NO: 366064 - DNA, 25 bp, Mus musculus
ttaaagagcgcgaggaggtaacgcc

SEQ ID NO: 366065 - DNA, 25 bp, Mus musculus
gagcgcgaggaggtaacgccaaaaa

SEQ ID NO: 366066 - DNA, 25 bp, Mus musculus
cgccaaaaactctaatttgttgtgg

SEQ ID NO: 366067 - DNA, 25 bp, Mus musculus
ttcgggcgcccaatgtgggccttct

SEQ ID NO: 366068 - DNA, 25 bp, Mus musculus
gaagttctcccacaagaccctgctg

SEQ ID NO: 366069 - DNA, 25 bp, Mus musculus
gctacatctgcaaaaagaagttctc

SEQ ID NO: 366070 - DNA, 25 bp, Mus musculus
agtcctatgagtgctacatctgcaa

SEQ ID NO: 366071 - DNA, 25 bp, Mus musculus
ggggagaagtcctatgagtgctaca

SEQ ID NO: 366072 - DNA, 25 bp, Mus musculus
ctgcaccgcggggagaagtcctatg

SEQ ID NO: 366073 - DNA, 25 bp, Mus musculus
ctgcacagtgccagcaacgggaccc

SEQ ID NO: 366074 - DNA, 25 bp, Mus musculus
ctggagcgacacgtggccctgcaca

SEQ ID NO: 366075 - DNA, 25 bp, Mus musculus
cccagaagagttccctcaacgtgca

SEQ ID NO: 366076 - DNA, 25 bp, Mus musculus
gagttccctcaacgtgcacatgcgc

SEQ ID NO: 366077 - DNA, 25 bp, Mus musculus
cgcacaccggcgtgagagcgtacca

SEQ ID NO: 366078 - DNA, 25 bp, Mus musculus
cgtgagagcgtaccagtgtagcatc

SEQ ID NO: 366079 - DNA, 25 bp, Mus musculus
gcgtaccagtgtagcatctgcaaca

SEQ ID NO: 366080 - DNA, 25 bp, Mus musculus
gtgtagcatctgcaacaagcgcttc

SEQ ID NO: 366081 - DNA, 25 bp, Mus musculus
acaagcgcttcacccagaagagttc

SEQ ID NO: 366082 - DNA, 25 bp, Mus musculus
cttatccaacttgttctcgctcgcg

SEQ ID NO: 366083 - DNA, 25 bp, Mus musculus
agcccggcttatccaacttgttctc

SEQ ID NO: 366084 - DNA, 25 bp, Mus musculus
gccttcccttgaggcccgctgtgga

SEQ ID NO: 366085 - DNA, 25 bp, Mus musculus
accttggccgccttcagaggtgcca

SEQ ID NO: 366086 - DNA, 25 bp, Mus musculus
ttggggttcgatccgcaccttggcc

SEQ ID NO: 366087 - DNA, 25 bp, Mus musculus
acaggcgttggggttcgatccgcac

SEQ ID NO: 366088 - DNA, 25 bp, Mus musculus
ctccagcgccggcaacaggcgttgg

SEQ ID NO: 366089 - DNA, 25 bp, Mus musculus
agtcgcccacctgtgagcaccgccg

SEQ ID NO: 366090 - DNA, 25 bp, Mus musculus
aagttacctgccctcccgacagagg

SEQ ID NO: 366091 - DNA, 25 bp, Mus musculus
tcaccctcgcaggtgcaggcagcga

SEQ ID NO: 366092 - DNA, 25 bp, Mus musculus
gccgtggaaactcaccctcgcaggt

SEQ ID NO: 366093 - DNA, 25 bp, Mus musculus
ttcacctgagggtgccggctcaaag

SEQ ID NO: 366094 - DNA, 25 bp, Mus musculus
gctagggcggcccagttcacctgag

SEQ ID NO: 366095 - DNA, 25 bp, Mus musculus
gttcccatggcgacagccgaccacg

SEQ ID NO: 366096 - DNA, 25 bp, Mus musculus
agaggaaactgcaggcgaagccacc

SEQ ID NO: 366097 - DNA, 25 bp, Mus musculus
aggctcgcgggagacacaggaaacc

SEQ ID NO: 366098 - DNA, 25 bp, Mus musculus
caacttttcgaattacgccaaagag

SEQ ID NO: 366099 - DNA, 25 bp, Mus musculus
cgccaaagagtacagaggaaaggga

SEQ ID NO: 366100 - DNA, 25 bp, Mus musculus
agggaggaattaattatcataatcg

SEQ ID NO: 366101 - DNA, 25 bp, Mus musculus
atcataatcggagcgggttcaaaca

SEQ ID NO: 366102 - DNA, 25 bp, Mus musculus
tcaaacaaccgtgcagaggaaactg

SEQ ID NO: 366103 - DNA, 25 bp, Mus musculus
aggcgaagccacctctcgggagcca

SEQ ID NO: 366104 - DNA, 25 bp, Mus musculus
aggctgcttacctggcgcgccgtga

SEQ ID NO: 366105 - DNA, 25 bp, Mus musculus
agagcgccctccatcgccgcaccct

SEQ ID NO: 366106 - DNA, 25 bp, Mus musculus
gcacgcgcgtccctgagagctcccg

SEQ ID NO: 366107 - DNA, 25 bp, Mus musculus
acctccagatcaggccgagcgcttt

SEQ ID NO: 366108 - DNA, 25 bp, Mus musculus
tcaggccgagcgctttgcgtcctct

SEQ ID NO: 366109 - DNA, 25 bp, Mus musculus
cgggttcaaacaaccgtgcagagga

SEQ ID NO: 366110 - DNA, 25 bp, Mus musculus
cgttgcgcagctcgcaaggtgcttg

SEQ ID NO: 366111 - DNA, 25 bp, Mus musculus
tgggcttcccaggatctcgagactc

SEQ ID NO: 366112 - DNA, 25 bp, Mus musculus
ctttcccgtgggcttcccaggatct

SEQ ID NO: 366113 - DNA, 25 bp, Mus musculus
ccgcagtaaggctgcacccggcttt

SEQ ID NO: 366114 - DNA, 25 bp, Mus musculus
tctttccgcgacctccgcagtaagg

SEQ ID NO: 366115 - DNA, 25 bp, Mus musculus
gaccagagcgccatgtctttccgcg

SEQ ID NO: 366116 - DNA, 25 bp, Mus musculus
ccagtggactcttggggaccagagc

SEQ ID NO: 366117 - DNA, 25 bp, Mus musculus
aactctacagagacgggcagcggcg

SEQ ID NO: 366118 - DNA, 25 bp, Mus musculus
gctgggcctgcgaactctacagaga

SEQ ID NO: 366119 - DNA, 25 bp, Mus musculus
agcgttgctatagagaccggagagc

SEQ ID NO: 366120 - DNA, 25 bp, Mus musculus
caaggcctctgagcgttgctataga

SEQ ID NO: 366121 - DNA, 25 bp, Mus musculus
ttcgcttcctgtcctgtttggcctg

SEQ ID NO: 366122 - DNA, 25 bp, Mus musculus
cacctgttggtctgtgtcctgcgct

SEQ ID NO: 366123 - DNA, 25 bp, Mus musculus
cgcaaggtgcttggcgccacctgtt

SEQ ID NO: 366124 - DNA, 25 bp, Mus musculus
gccgggacggctgtgtcctccacag

SEQ ID NO: 366125 - DNA, 25 bp, Mus musculus
cggctgcactcacccgaagcttagg

SEQ ID NO: 366126 - DNA, 25 bp, Mus musculus
ccatattggattggtgctccggtca

SEQ ID NO: 366127 - DNA, 25 bp, Mus musculus
cactcgccagtgctcatgcggaaga

SEQ ID NO: 366128 - DNA, 25 bp, Mus musculus
cgtcggataccgaactgcgcgttct

SEQ ID NO: 366129 - DNA, 25 bp, Mus musculus
gcaggtcatcgtcgcgggaaaccct

SEQ ID NO: 366130 - DNA, 25 bp, Mus musculus
tctcgcgagggacgtctgcgcgcta

SEQ ID NO: 366131 - DNA, 25 bp, Mus musculus
tcctgctctgggctacctgagcgca

SEQ ID NO: 366132 - DNA, 25 bp, Mus musculus
ccctcgaagtgcgacacgaaggtgc

SEQ ID NO: 366133 - DNA, 25 bp, Mus musculus
ccgggctccagcaccgagaaagtgc

SEQ ID NO: 366134 - DNA, 25 bp, Mus musculus
tgtcctccacagtagcgcggcgctt

SEQ ID NO: 366135 - DNA, 25 bp, Mus musculus
ccaccgttctgagcgatgcggcaac

SEQ ID NO: 366136 - DNA, 25 bp, Mus musculus
ctcatgcggaagaagccaccgttct

SEQ ID NO: 366137 - DNA, 25 bp, Mus musculus
gctgtgcctgagagcgctcaggaaa

SEQ ID NO: 366138 - DNA, 25 bp, Mus musculus
cggacacttccggtccgctatagtg

SEQ ID NO: 366139 - DNA, 25 bp, Mus musculus
cgctatagtgcaggctcgactgagt

SEQ ID NO: 366140 - DNA, 25 bp, Mus musculus
tagtgcaggctcgactgagtgtctg

SEQ ID NO: 366141 - DNA, 25 bp, Mus musculus
cttgccgaccggacctgtgagcaga

SEQ ID NO: 366142 - DNA, 25 bp, Mus musculus
agaataggagcggacacttccggtc

SEQ ID NO: 366143 - DNA, 25 bp, Mus musculus
actgagtgtctgagggaggctcccc

SEQ ID NO: 366144 - DNA, 25 bp, Mus musculus
ccgcggtctctgttccgtgctgtga

SEQ ID NO: 366145 - DNA, 25 bp, Mus musculus
tctctgttccgtgctgtgacttgcc

SEQ ID NO: 366146 - DNA, 25 bp, Mus musculus
tgtgacttgccgaccggacctgtga

SEQ ID NO: 366147 - DNA, 25 bp, Mus musculus
agctgggcgagctcggaatccgcac

SEQ ID NO: 366148 - DNA, 25 bp, Mus musculus
cgaagcggactggtagtcagaatag

SEQ ID NO: 366149 - DNA, 25 bp, Mus musculus
tagtcagaataggagcggacacttc

SEQ ID NO: 366150 - DNA, 25 bp, Mus musculus
acttccggtccgctatagtgcaggc

SEQ ID NO: 366151 - DNA, 25 bp, Mus musculus
tccgtgctgtgacttgccgaccgga

SEQ ID NO: 366152 - DNA, 25 bp, Mus musculus
caagggcgcgagtccacggtttcac

SEQ ID NO: 366153 - DNA, 25 bp, Mus musculus
ctcagccaaaagaccggcgtgtggg

SEQ ID NO: 366154 - DNA, 25 bp, Mus musculus
gcttctcagccaaaagaccggcgtg

SEQ ID NO: 366155 - DNA, 25 bp, Mus musculus
gcctggcttggcttctcagccaaaa

SEQ ID NO: 366156 - DNA, 25 bp, Mus musculus
agcctcagggcctggcttggcttct

SEQ ID NO: 366157 - DNA, 25 bp, Mus musculus
cgagtgtcccgagtgcacgtgtgga

SEQ ID NO: 366158 - DNA, 25 bp, Mus musculus
attttgccgccggagcctaccaagc

SEQ ID NO: 366159 - DNA, 25 bp, Mus musculus
cggctgtaacgacggcctcagcaga

SEQ ID NO: 366160 - DNA, 25 bp, Mus musculus
aacgacggcctcagcagacggggaa

SEQ ID NO: 366161 - DNA, 25 bp, Mus musculus
gagccacctgaaggtgctcctccag

SEQ ID NO: 366162 - DNA, 25 bp, Mus musculus
tccacggtttcacgtgtgtgcaccg

SEQ ID NO: 366163 - DNA, 25 bp, Mus musculus
cctcttcccgggagcgcaccaccga

SEQ ID NO: 366164 - DNA, 25 bp, Mus musculus
tgtgcaccgcctgagatcacgggga

SEQ ID NO: 366165 - DNA, 25 bp, Mus musculus
ctccagatccgggaacggcgctgtg

SEQ ID NO: 366166 - DNA, 25 bp, Mus musculus
cggccttggtcattgggccgcccga

SEQ ID NO: 366167 - DNA, 25 bp, Mus musculus
ggggcgatcgctctcttcactccgg

SEQ ID NO: 366168 - DNA, 25 bp, Mus musculus
gaggcctgttccctcctagcttttc

SEQ ID NO: 366169 - DNA, 25 bp, Mus musculus
cggcttctgactggccacggtggca

SEQ ID NO: 366170 - DNA, 25 bp, Mus musculus
ccagcaccggattggccggccggtt

SEQ ID NO: 366171 - DNA, 25 bp, Mus musculus
cgcatccaggctaggctgtgcgcgt

SEQ ID NO: 366172 - DNA, 25 bp, Mus musculus
cggacccagaggctcgcctagacgg

SEQ ID NO: 366173 - DNA, 25 bp, Mus musculus
gaggctcgcctagacggccagacac

SEQ ID NO: 366174 - DNA, 25 bp, Mus musculus
tatcccggggcgatcgctctcttca

SEQ ID NO: 366175 - DNA, 25 bp, Mus musculus
ttcactccggcatgctcgcaccctg

SEQ ID NO: 366176 - DNA, 25 bp, Mus musculus
cggaatcccggcttctgactggcca

SEQ ID NO: 366177 - DNA, 25 bp, Mus musculus
tcgcaccctgggtgccaggcctgag

SEQ ID NO: 366178 - DNA, 25 bp, Mus musculus
ccctccagcctagcgcagcggaatc

SEQ ID NO: 366179 - DNA, 25 bp, Mus musculus
ctcctgggaccatgacccaggcggg

SEQ ID NO: 366180 - DNA, 25 bp, Mus musculus
tgtgctccgtgttcagtctcggtgt

SEQ ID NO: 366181 - DNA, 25 bp, Mus musculus
ggtgcgttgtgctccgtgttcagtc

SEQ ID NO: 366182 - DNA, 25 bp, Mus musculus
ttgtgctccgtgttcagtctcggtg

SEQ ID NO: 366183 - DNA, 25 bp, Mus musculus
gctccgtgttcagtctcggtgtgaa

SEQ ID NO: 366184 - DNA, 25 bp, Mus musculus
gggtgcattgtgctccgtgttcagt

SEQ ID NO: 366185 - DNA, 25 bp, Mus musculus
gtgcattgtgctccgtgttcagtct

SEQ ID NO: 366186 - DNA, 25 bp, Mus musculus
cgttgtgctccgtgttcagtctcgg

SEQ ID NO: 366187 - DNA, 25 bp, Mus musculus
gttgtgctccgtgttcagtctcggt

SEQ ID NO: 366188 - DNA, 25 bp, Mus musculus
tccgtgttcagtctcggtgtgaagg

SEQ ID NO: 366189 - DNA, 25 bp, Mus musculus
gtgcgttgtgctccgtgttcagtct

SEQ ID NO: 366190 - DNA, 25 bp, Mus musculus
gcgttgtgctccgtgttcagtctcg

SEQ ID NO: 366191 - DNA, 25 bp, Mus musculus
ctccgtgttcagtctcggtgtgaag

SEQ ID NO: 366192 - DNA, 25 bp, Mus musculus
cgtgttcagtctcggtgtgaagggg

SEQ ID NO: 366193 - DNA, 25 bp, Mus musculus
tgctccgtgttcagtctcggtgtga

SEQ ID NO: 366194 - DNA, 25 bp, Mus musculus
agtccagcatggtgggcacctcacc

SEQ ID NO: 366195 - DNA, 25 bp, Mus musculus
ggggagcgagcagatcaaatactga

SEQ ID NO: 366196 - DNA, 25 bp, Mus musculus
atactgatgtgccacctggggtctc

SEQ ID NO: 366197 - DNA, 25 bp, Mus musculus
gtagccatcccgacttcccggagaa

SEQ ID NO: 366198 - DNA, 25 bp, Mus musculus
gcctgagccaggatccgcagaggat

SEQ ID NO: 366199 - DNA, 25 bp, Mus musculus
cggtgcccaaagcagctgccaaggc

SEQ ID NO: 366200 - DNA, 25 bp, Mus musculus
ggcagcgattgccttacaggagaga

SEQ ID NO: 366201 - DNA, 25 bp, Mus musculus
ctgaggtctcccgaggtcaattccc

SEQ ID NO: 366202 - DNA, 25 bp, Mus musculus
cttccgaagctgcttgtggcgctga

SEQ ID NO: 366203 - DNA, 25 bp, Mus musculus
ggtcaattcccagcgcagcctgagg

SEQ ID NO: 366204 - DNA, 25 bp, Mus musculus
agagagcgtcttacctggccaggat

SEQ ID NO: 366205 - DNA, 25 bp, Mus musculus
cgctgtagacgcgatcgaaatccgc

SEQ ID NO: 366206 - DNA, 25 bp, Mus musculus
cgagcacggagatggtccttccgaa

SEQ ID NO: 366207 - DNA, 25 bp, Mus musculus
atgttctcggtgctgaggctcacca

SEQ ID NO: 366208 - DNA, 25 bp, Mus musculus
tcccgctagggagtggcagagtatc

SEQ ID NO: 366209 - DNA, 25 bp, Mus musculus
ctcgccggatgtacgcaaaggcgtg

SEQ ID NO: 366210 - DNA, 25 bp, Mus musculus
ggcggagctctggtaacccaggcaa

SEQ ID NO: 366211 - DNA, 25 bp, Mus musculus
ctctgtggttctggaggctgaactt

SEQ ID NO: 366212 - DNA, 25 bp, Mus musculus
tctggaggctgaacttttagtcggg

SEQ ID NO: 366213 - DNA, 25 bp, Mus musculus
gcacagtcggccagcggcaaggcag

SEQ ID NO: 366214 - DNA, 25 bp, Mus musculus
tcgcagagcctgagagtgcggttcc

SEQ ID NO: 366215 - DNA, 25 bp, Mus musculus
ttcccgcaccctgctggcgggagaa

SEQ ID NO: 366216 - DNA, 25 bp, Mus musculus
ccggcgggtgatgcagttgtttact

SEQ ID NO: 366217 - DNA, 25 bp, Mus musculus
cagttgtttactgtcccgctaggga

SEQ ID NO: 366218 - DNA, 25 bp, Mus musculus
tttactgtcccgctagggagtggca

SEQ ID NO: 366219 - DNA, 25 bp, Mus musculus
acagggcgcgtcctttaagttgagc

SEQ ID NO: 366220 - DNA, 25 bp, Mus musculus
agtaccgcctctgggtcgcctcgga

SEQ ID NO: 366221 - DNA, 25 bp, Mus musculus
cctcggaggagctcgccggatgtac

SEQ ID NO: 366222 - DNA, 25 bp, Mus musculus
tccgggaacttcgtgcggcgtcagg

SEQ ID NO: 366223 - DNA, 25 bp, Mus musculus
cagcttccgggaaccgcgggagcta

SEQ ID NO: 366224 - DNA, 25 bp, Mus musculus
aaccgcgggagctaaccgagccaga

SEQ ID NO: 366225 - DNA, 25 bp, Mus musculus
caagagagggaagcccggcggccct

SEQ ID NO: 366226 - DNA, 25 bp, Mus musculus
gcgtcaggccctgactctagtcgga

SEQ ID NO: 366227 - DNA, 25 bp, Mus musculus
gccctgactctagtcggatccagtc

SEQ ID NO: 366228 - DNA, 25 bp, Mus musculus
ctctagtcggatccagtcaagcgct

SEQ ID NO: 366229 - DNA, 25 bp, Mus musculus
cggatccagtcaagcgctgggattc

SEQ ID NO: 366230 - DNA, 25 bp, Mus musculus
tcaagcgctgggattccgggcaaga

SEQ ID NO: 366231 - DNA, 25 bp, Mus musculus
gggcaagagcccagctcagagatcg

SEQ ID NO: 366232 - DNA, 25 bp, Mus musculus
agcccagctcagagatcggagcgca

SEQ ID NO: 366233 - DNA, 25 bp, Mus musculus
atcggagcgcaagcccgagtccagc

SEQ ID NO: 366234 - DNA, 25 bp, Mus musculus
ctcagagatcggagcgcaagcccga

SEQ ID NO: 366235 - DNA, 25 bp, Mus musculus
taaccgagccagaccgggcaagaga

SEQ ID NO: 366236 - DNA, 25 bp, Mus musculus
gggcaaggcagaggacgccgcgccc

SEQ ID NO: 366237 - DNA, 25 bp, Mus musculus
gcaggcgggcaaggcagaggacgcc

SEQ ID NO: 366238 - DNA, 25 bp, Mus musculus
aagccagagccgtggtggcagcggc

SEQ ID NO: 366239 - DNA, 25 bp, Mus musculus
ccagctcagggtccccactgcagga

SEQ ID NO: 366240 - DNA, 25 bp, Mus musculus
ccggagctgacaccagcgagaccca

SEQ ID NO: 366241 - DNA, 25 bp, Mus musculus
ggccggccggagctgacaccagcga

SEQ ID NO: 366242 - DNA, 25 bp, Mus musculus
gcgagagtgtgagaatgcggccggc

SEQ ID NO: 366243 - DNA, 25 bp, Mus musculus
tacgaggtgcgagagtgtgagaatg

SEQ ID NO: 366244 - DNA, 25 bp, Mus musculus
agcaacaaaagagcccaggacccag

SEQ ID NO: 366245 - DNA, 25 bp, Mus musculus
cggagcaacaaaagagcccaggacc

SEQ ID NO: 366246 - DNA, 25 bp, Mus musculus
gccggagcaacaaaagagcccagga

SEQ ID NO: 366247 - DNA, 25 bp, Mus musculus
cagccggagcaacaaaagagcccag

SEQ ID NO: 366248 - DNA, 25 bp, Mus musculus
gcagccggagcaacaaaagagccca

SEQ ID NO: 366249 - DNA, 25 bp, Mus musculus
ccgcagccggagcaacaaaagagcc

SEQ ID NO: 366250 - DNA, 25 bp, Mus musculus
caagcgcctgggcttcgccgtgact

SEQ ID NO: 366251 - DNA, 25 bp, Mus musculus
ccaaacgctgcctgggtcctgtgct

SEQ ID NO: 366252 - DNA, 25 bp, Mus musculus
tagtcccggccctgcatgtgtagcc

SEQ ID NO: 366253 - DNA, 25 bp, Mus musculus
ggagagcacgactagtcccggccct

SEQ ID NO: 366254 - DNA, 25 bp, Mus musculus
gccggcaaggaagtcctagcgtgtc

SEQ ID NO: 366255 - DNA, 25 bp, Mus musculus
ttcgccgtgactgtgctggaacagg

SEQ ID NO: 366256 - DNA, 25 bp, Mus musculus
caaggatcggggctgtcacccaagt

SEQ ID NO: 366257 - DNA, 25 bp, Mus musculus
gggctgtcacccaagtaccgtacgc

SEQ ID NO: 366258 - DNA, 25 bp, Mus musculus
catgaggattgctggcaagcgcctg

SEQ ID NO: 366259 - DNA, 25 bp, Mus musculus
tccggcctggatagtgtggcatgag

SEQ ID NO: 366260 - DNA, 25 bp, Mus musculus
gcagcacgctgaccgtgcgggaccc

SEQ ID NO: 366261 - DNA, 25 bp, Mus musculus
tcctagcgtgtctccgggaaccggc

SEQ ID NO: 366262 - DNA, 25 bp, Mus musculus
ggaagtcctagcgtgtctccgggaa

SEQ ID NO: 366263 - DNA, 25 bp, Mus musculus
ctggaacaggagagcacgactagtc

SEQ ID NO: 366264 - DNA, 25 bp, Mus musculus
agtctctgttcgataaggccaggcc

SEQ ID NO: 366265 - DNA, 25 bp, Mus musculus
agctgaggtactcgatgcggttccg

SEQ ID NO: 366266 - DNA, 25 bp, Mus musculus
gggcaccgcacacgagtggcgcatc

SEQ ID NO: 366267 - DNA, 25 bp, Mus musculus
caggctcgggtcgaagagtctctgt

SEQ ID NO: 366268 - DNA, 25 bp, Mus musculus
ggtggcctcaaagatgctctccgcc

SEQ ID NO: 366269 - DNA, 25 bp, Mus musculus
gcacctacagtagacccggcggtca

SEQ ID NO: 366270 - DNA, 25 bp, Mus musculus
ctcaggctctcgcacctacagtaga

SEQ ID NO: 366271 - DNA, 25 bp, Mus musculus
tgagcacaggccgactcaggctctc

SEQ ID NO: 366272 - DNA, 25 bp, Mus musculus
cgctgggtgacaggaaatgagcaca

SEQ ID NO: 366273 - DNA, 25 bp, Mus musculus
agctctctcgctgggtgacaggaaa

SEQ ID NO: 366274 - DNA, 25 bp, Mus musculus
cttttgctgttacgagctctctcgc

SEQ ID NO: 366275 - DNA, 25 bp, Mus musculus
cacggagtgttttcttttgctgtta

SEQ ID NO: 366276 - DNA, 25 bp, Mus musculus
gtggcgcatccacacggagtgtttt

SEQ ID NO: 366277 - DNA, 25 bp, Mus musculus
cgatgtcctccaggctcgggtcgaa

SEQ ID NO: 366278 - DNA, 25 bp, Mus musculus
attgcgcaggcgcgctcattccagc

SEQ ID NO: 366279 - DNA, 25 bp, Mus musculus
gggcctccttttgtcacgtgtcctg

SEQ ID NO: 366280 - DNA, 25 bp, Mus musculus
gggcagtttttgactcccctgtggc

SEQ ID NO: 366281 - DNA, 25 bp, Mus musculus
tgtggcccggattgcgacagtccct

SEQ ID NO: 366282 - DNA, 25 bp, Mus musculus
aagagcagcctgagcggccattgcg

SEQ ID NO: 366283 - DNA, 25 bp, Mus musculus
cgcccgctagggaagagcagcctga

SEQ ID NO: 366284 - DNA, 25 bp, Mus musculus
tgccgctgcgaggttcgatgccagt

SEQ ID NO: 366285 - DNA, 25 bp, Mus musculus
acgtgtcctgggagagtcgagtcac

SEQ ID NO: 366286 - DNA, 25 bp, Mus musculus
agtcgagtcacgtgaggccttaggt

SEQ ID NO: 366287 - DNA, 25 bp, Mus musculus
ttcgatgccagtcgggcacgtccgg

SEQ ID NO: 366288 - DNA, 25 bp, Mus musculus
tcaacacggtgaagggaaaggctct

SEQ ID NO: 366289 - DNA, 25 bp, Mus musculus
aaaggctctggaagtggccgagtac

SEQ ID NO: 366290 - DNA, 25 bp, Mus musculus
gcttgctctgccctggttgcccaag

SEQ ID NO: 366291 - DNA, 25 bp, Mus musculus
ggatgcagaatgtgatcaacacggt

SEQ ID NO: 366292 - DNA, 25 bp, Mus musculus
ctcccaggcaagagcagatccctga

SEQ ID NO: 366293 - DNA, 25 bp, Mus musculus
cggaatctgcgccatggtgagaggg

SEQ ID NO: 366294 - DNA, 25 bp, Mus musculus
gagaggggccgccatccccatacgg

SEQ ID NO: 366295 - DNA, 25 bp, Mus musculus
cgggagcccgcatggcgttcgttcc

SEQ ID NO: 366296 - DNA, 25 bp, Mus musculus
ttcgcgaaccggcagcgagtcggtg

SEQ ID NO: 366297 - DNA, 25 bp, Mus musculus
tgcccccgtgaggtcccgtgagttc

SEQ ID NO: 366298 - DNA, 25 bp, Mus musculus
tggggtccctgcacctcccaggcaa

SEQ ID NO: 366299 - DNA, 25 bp, Mus musculus
ccaggcaagagcagatccctgaatg

SEQ ID NO: 366300 - DNA, 25 bp, Mus musculus
agatccctgaatgacttcgatcagc

SEQ ID NO: 366301 - DNA, 25 bp, Mus musculus
tgaatgacttcgatcagctgcctgc

SEQ ID NO: 366302 - DNA, 25 bp, Mus musculus
gacttcgatcagctgcctgcgcctg

SEQ ID NO: 366303 - DNA, 25 bp, Mus musculus
caaagaatggggaacggcgcctttg

SEQ ID NO: 366304 - DNA, 25 bp, Mus musculus
gcgcctttgtgtgaaaacatccttg

SEQ ID NO: 366305 - DNA, 25 bp, Mus musculus
cgtgagttccgtggggtccctgcac

SEQ ID NO: 366306 - DNA, 25 bp, Mus musculus
cggcaaacgggcagggcccggcaca

SEQ ID NO: 366307 - DNA, 25 bp, Mus musculus
ggcccagagcggcttttcggtgacg

SEQ ID NO: 366308 - DNA, 25 bp, Mus musculus
cattggcccagagcggcttttcggt

SEQ ID NO: 366309 - DNA, 25 bp, Mus musculus
accacgcgctgtcattggcccagag

SEQ ID NO: 366310 - DNA, 25 bp, Mus musculus
taccacgcgctgtcattggcccaga

SEQ ID NO: 366311 - DNA, 25 bp, Mus musculus
cttgtggaagcgtgggcggcaaacg

SEQ ID NO: 366312 - DNA, 25 bp, Mus musculus
gcccggcacatggtcgtcgtggtgc

SEQ ID NO: 366313 - DNA, 25 bp, Mus musculus
gctgctgctgggcttgtggaagcgt

SEQ ID NO: 366314 - DNA, 25 bp, Mus musculus
ccaagatggcagcgtcctgcgtggc

SEQ ID NO: 366315 - DNA, 25 bp, Mus musculus
ttccgggcccggtcacgtgctcggc

SEQ ID NO: 366316 - DNA, 25 bp, Mus musculus
tgcgcatagcgaggcttccgggccc

SEQ ID NO: 366317 - DNA, 25 bp, Mus musculus
cttgcgcatagcgaggcttccgggc

SEQ ID NO: 366318 - DNA, 25 bp, Mus musculus
cgcttgcgcatagcgaggcttccgg

SEQ ID NO: 366319 - DNA, 25 bp, Mus musculus
agtaccacgcgctgtcattggccca

SEQ ID NO: 366320 - DNA, 25 bp, Mus musculus
ggataccacttctccaaagaacagc

SEQ ID NO: 366321 - DNA, 25 bp, Mus musculus
tggcttctgagagccgcggctccag

SEQ ID NO: 366322 - DNA, 25 bp, Mus musculus
agatcgcccattccgccctccttcg

SEQ ID NO: 366323 - DNA, 25 bp, Mus musculus
gcaggctccactggcttctgagagc

SEQ ID NO: 366324 - DNA, 25 bp, Mus musculus
ttgcttttctcgcaggctccactgg

SEQ ID NO: 366325 - DNA, 25 bp, Mus musculus
cagcttccttgcttttctcgcaggc

SEQ ID NO: 366326 - DNA, 25 bp, Mus musculus
cttctccaaagaacagcttccttgc

SEQ ID NO: 366327 - DNA, 25 bp, Mus musculus
ctagatacacgcgttccccgggctt

SEQ ID NO: 366328 - DNA, 25 bp, Mus musculus
agcaaagccgcccaccctagataca

SEQ ID NO: 366329 - DNA, 25 bp, Mus musculus
tcgcagcaaggagcaaagccgccca

SEQ ID NO: 366330 - DNA, 25 bp, Mus musculus
tggaatcgcagcaaggagcaaagcc

SEQ ID NO: 366331 - DNA, 25 bp, Mus musculus
tcgcaatggaatcgcagcaaggagc

SEQ ID NO: 366332 - DNA, 25 bp, Mus musculus
cgtgttttcgcaatggaatcgcagc

SEQ ID NO: 366333 - DNA, 25 bp, Mus musculus
ggtgcctccttacagagctccgagc

SEQ ID NO: 366334 - DNA, 25 bp, Mus musculus
ggccgaaggacacagccgcccagcc

SEQ ID NO: 366335 - DNA, 25 bp, Mus musculus
tccagacgggcactggacggtcgcc

SEQ ID NO: 366336 - DNA, 25 bp, Mus musculus
aagccggctccagacgggcactgga

SEQ ID NO: 366337 - DNA, 25 bp, Mus musculus
ggtcccgaggtcacgcacgcgcagt

SEQ ID NO: 366338 - DNA, 25 bp, Mus musculus
cacctccgacaaggggcccaggccg

SEQ ID NO: 366339 - DNA, 25 bp, Mus musculus
tcaggcccgggtgccggccgaagga

SEQ ID NO: 366340 - DNA, 25 bp, Mus musculus
tccgagctagtgacgcgctcaggcc

SEQ ID NO: 366341 - DNA, 25 bp, Mus musculus
cttccgagctagtgacgcgctcagg

SEQ ID NO: 366342 - DNA, 25 bp, Mus musculus
ggcttccgagctagtgacgcgctca

SEQ ID NO: 366343 - DNA, 25 bp, Mus musculus
cttccgtacactaacctgagagcca

SEQ ID NO: 366344 - DNA, 25 bp, Mus musculus
caccttccgtacactaacctgagag

SEQ ID NO: 366345 - DNA, 25 bp, Mus musculus
acagacgcgcgcaggtcgcgcggtc

SEQ ID NO: 366346 - DNA, 25 bp, Mus musculus
ggcactggacggtcgccgggccttc

SEQ ID NO: 366347 - DNA, 25 bp, Mus musculus
ccctgcgcccgctacagacgcgcgc

SEQ ID NO: 366348 - DNA, 25 bp, Mus musculus
tggccgaatgcaggcggccacagaa

SEQ ID NO: 366349 - DNA, 25 bp, Mus musculus
cagagagacgggcggctaccaagtc

SEQ ID NO: 366350 - DNA, 25 bp, Mus musculus
acccgagtttcgaggcaccgcagcg

SEQ ID NO: 366351 - DNA, 25 bp, Mus musculus
cccaaggagccaccagggtgcgcaa

SEQ ID NO: 366352 - DNA, 25 bp, Mus musculus
caccagggtgcgcaaaggcaatgcg

SEQ ID NO: 366353 - DNA, 25 bp, Mus musculus
cgcaaaggcaatgcgggccggctcc

SEQ ID NO: 366354 - DNA, 25 bp, Mus musculus
tctgtagcccactactcacctgggg

SEQ ID NO: 366355 - DNA, 25 bp, Mus musculus
ccactactcacctggggcgataagg

SEQ ID NO: 366356 - DNA, 25 bp, Mus musculus
aggcaccctgggtgctctgtgtcac

SEQ ID NO: 366357 - DNA, 25 bp, Mus musculus
tgggtgctctgtgtcacactcagca

SEQ ID NO: 366358 - DNA, 25 bp, Mus musculus
gctctgtgtcacactcagcagagcc

SEQ ID NO: 366359 - DNA, 25 bp, Mus musculus
gtggtggactcctcgaagctccctc

SEQ ID NO: 366360 - DNA, 25 bp, Mus musculus
tggtcccgacccgagtttcgaggca

SEQ ID NO: 366361 - DNA, 25 bp, Mus musculus
gcggccacagaaggcaggcaccctg

SEQ ID NO: 366362 - DNA, 25 bp, Mus musculus
ctccggaaggggagatgtgcaccgt

SEQ ID NO: 366363 - DNA, 25 bp, Mus musculus
tctctctgattggacaacgctctga

SEQ ID NO: 366364 - DNA, 25 bp, Mus musculus
ttggacaacgctctgagggcccgcc

SEQ ID NO: 366365 - DNA, 25 bp, Mus musculus
cactccagcggggtagcgagtggac

SEQ ID NO: 366366 - DNA, 25 bp, Mus musculus
cgcactgccgggcagatttgccaga

SEQ ID NO: 366367 - DNA, 25 bp, Mus musculus
ctgattggacaacgctctgagggcc

SEQ ID NO: 366368 - DNA, 25 bp, Mus musculus
cgggattctctctgattggacaacg

SEQ ID NO: 366369 - DNA, 25 bp, Mus musculus
tggcgggattctctctgattggaca

SEQ ID NO: 366370 - DNA, 25 bp, Mus musculus
tgattggtcgttggcgggattctct

SEQ ID NO: 366371 - DNA, 25 bp, Mus musculus
actaggcgagctgtgattggtcgtt

SEQ ID NO: 366372 - DNA, 25 bp, Mus musculus
cagactaggcgagctgtgattggtc

SEQ ID NO: 366373 - DNA, 25 bp, Mus musculus
atttgccagactaggcgagctgtga

SEQ ID NO: 366374 - DNA, 25 bp, Mus musculus
ggcagatttgccagactaggcgagc

SEQ ID NO: 366375 - DNA, 25 bp, Mus musculus
actgccgggcagatttgccagacta

SEQ ID NO: 366376 - DNA, 25 bp, Mus musculus
cgggcttctcccgaggctaagcaat

SEQ ID NO: 366377 - DNA, 25 bp, Mus musculus
caagatgagggtaccggctctccgc

SEQ ID NO: 366378 - DNA, 25 bp, Mus musculus
ccctagcgggaccagggataaccag

SEQ ID NO: 366379 - DNA, 25 bp, Mus musculus
ggactcctagtcctgcctttttctc

SEQ ID NO: 366380 - DNA, 25 bp, Mus musculus
agcgctggagatggtctcgcccact

SEQ ID NO: 366381 - DNA, 25 bp, Mus musculus
caatctggaccaggcaaggcggccc

SEQ ID NO: 366382 - DNA, 25 bp, Mus musculus
tgcctaatttgggaagctggatacc

SEQ ID NO: 366383 - DNA, 25 bp, Mus musculus
agcaggggaataagcagcagcagca

SEQ ID NO: 366384 - DNA, 25 bp, Mus musculus
aggaaacgccgaggaaagttgtgct

SEQ ID NO: 366385 - DNA, 25 bp, Mus musculus
gaaagttgtgctttgccgcctccag

SEQ ID NO: 366386 - DNA, 25 bp, Mus musculus
tctcccgaggctaagcaatctggac

SEQ ID NO: 366387 - DNA, 25 bp, Mus musculus
tcatccacttggaaaaccgggcttc

SEQ ID NO: 366388 - DNA, 25 bp, Mus musculus
cacccaggcgtagggactgaaagga

SEQ ID NO: 366389 - DNA, 25 bp, Mus musculus
ttgccgcctccaggacacaacgggg

SEQ ID NO: 366390 - DNA, 25 bp, Mus musculus
tctccgggtgactttggaacattcc

SEQ ID NO: 366391 - DNA, 25 bp, Mus musculus
ctcagggagaaacagcatatgcaac

SEQ ID NO: 366392 - DNA, 25 bp, Mus musculus
ttggaacattcctgcctcttttgta

SEQ ID NO: 366393 - DNA, 25 bp, Mus musculus
catatgcaacagaagatgaaacacc

SEQ ID NO: 366394 - DNA, 25 bp, Mus musculus
ttttgaagactgttctccgggtgac

SEQ ID NO: 366395 - DNA, 25 bp, Mus musculus
ggcttggctgggtctcatttttatt

SEQ ID NO: 366396 - DNA, 25 bp, Mus musculus
ggggcggccaccaagaatgaatagc

SEQ ID NO: 366397 - DNA, 25 bp, Mus musculus
aaaataaagtcctctcggagtagcg

SEQ ID NO: 366398 - DNA, 25 bp, Mus musculus
acagtccaaagttgtaatgggatac

SEQ ID NO: 366399 - DNA, 25 bp, Mus musculus
ttatcatatgcagtaggaacaccta

SEQ ID NO: 366400 - DNA, 25 bp, Mus musculus
ccacaactctgatgttatcatatgc

SEQ ID NO: 366401 - DNA, 25 bp, Mus musculus
ataaatatctcctagttcacccaca

SEQ ID NO: 366402 - DNA, 25 bp, Mus musculus
tgaatgtgtccttgatcatcataaa

SEQ ID NO: 366403 - DNA, 25 bp, Mus musculus
gcctcttttgtaatgctcagggaga

SEQ ID NO: 366404 - DNA, 25 bp, Mus musculus
gtccgaccggaacaggaagctgcca

SEQ ID NO: 366405 - DNA, 25 bp, Mus musculus
taaagttccggctgcctcatcacgg

SEQ ID NO: 366406 - DNA, 25 bp, Mus musculus
ccacaggtcttagcctgcgcgagtc

SEQ ID NO: 366407 - DNA, 25 bp, Mus musculus
ctccgagttcctcaccgtgtctaga

SEQ ID NO: 366408 - DNA, 25 bp, Mus musculus
tccacagaatgagcccgcacgagct

SEQ ID NO: 366409 - DNA, 25 bp, Mus musculus
cgtgttcgcggacctccagccgaaa

SEQ ID NO: 366410 - DNA, 25 bp, Mus musculus
gcatggattccaccgcctgcttgaa

SEQ ID NO: 366411 - DNA, 25 bp, Mus musculus
cttgaagtccctgctcctgagcatc

SEQ ID NO: 366412 - DNA, 25 bp, Mus musculus
tcagtcagtacaaggccgttaagtc

SEQ ID NO: 366413 - DNA, 25 bp, Mus musculus
aggcgaacgccactcagctgctgag

SEQ ID NO: 366414 - DNA, 25 bp, Mus musculus
cagctgctgaggcacttggaggtaa

SEQ ID NO: 366415 - DNA, 25 bp, Mus musculus
agctgcttcgctgtccttgcactgg

SEQ ID NO: 366416 - DNA, 25 bp, Mus musculus
cgactccgggatgctctctctctat

SEQ ID NO: 366417 - DNA, 25 bp, Mus musculus
cgcacgagctcgtctcgcgagattc

SEQ ID NO: 366418 - DNA, 25 bp, Mus musculus
ggagctactccgaaagagcaatctg

SEQ ID NO: 366419 - DNA, 25 bp, Mus musculus
gacgatgcgccacgcccatagggcg

SEQ ID NO: 366420 - DNA, 25 bp, Mus musculus
ccctaggccagggaccagcatggcg

SEQ ID NO: 366421 - DNA, 25 bp, Mus musculus
gaccagcatggcgtgacgtcacgta

SEQ ID NO: 366422 - DNA, 25 bp, Mus musculus
gacgtcacgtaagaatccagctttg

SEQ ID NO: 366423 - DNA, 25 bp, Mus musculus
tccagctttgattggtgaaaattta

SEQ ID NO: 366424 - DNA, 25 bp, Mus musculus
tggtgaaaatttagagaggccggct

SEQ ID NO: 366425 - DNA, 25 bp, Mus musculus
ggctgccctgcggttgcctggtaac

SEQ ID NO: 366426 - DNA, 25 bp, Mus musculus
ctgcagagatcctggccggagccca

SEQ ID NO: 366427 - DNA, 25 bp, Mus musculus
caggagcggcctaccacatgttcgt

SEQ ID NO: 366428 - DNA, 25 bp, Mus musculus
catgttcgtggtgatggaagactta

SEQ ID NO: 366429 - DNA, 25 bp, Mus musculus
atggaagacttagtggagaagctga

SEQ ID NO: 366430 - DNA, 25 bp, Mus musculus
gagaagctgaagctgctccgctacg

SEQ ID NO: 366431 - DNA, 25 bp, Mus musculus
ctccgctacgaggaggagctactcc

SEQ ID NO: 366432 - DNA, 25 bp, Mus musculus
agcagagagtgcaacccgcgcagcc

SEQ ID NO: 366433 - DNA, 25 bp, Mus musculus
cggctctcaggctggtgcgcagcac

SEQ ID NO: 366434 - DNA, 25 bp, Mus musculus
agtggctcggggatcccggctctca

SEQ ID NO: 366435 - DNA, 25 bp, Mus musculus
cgtttcccttgaaggcagcagcgga

SEQ ID NO: 366436 - DNA, 25 bp, Mus musculus
ctgctggtcggtcgtttcccttgaa

SEQ ID NO: 366437 - DNA, 25 bp, Mus musculus
tcacgtcaacgagcagaggcggcca

SEQ ID NO: 366438 - DNA, 25 bp, Mus musculus
tgtgaggctggcgtcacgtcaacga

SEQ ID NO: 366439 - DNA, 25 bp, Mus musculus
gacaggctgattcttggcgctctcc

SEQ ID NO: 366440 - DNA, 25 bp, Mus musculus
atgctcccgtctttcaggccggccc

SEQ ID NO: 366441 - DNA, 25 bp, Mus musculus
gagcgtgtgtgtcccatgctcccgt

SEQ ID NO: 366442 - DNA, 25 bp, Mus musculus
gttccggtgagcgtgtgtgtcccat

SEQ ID NO: 366443 - DNA, 25 bp, Mus musculus
aagcagcgcctacaccgggagagca

SEQ ID NO: 366444 - DNA, 25 bp, Mus musculus
aagatggtgaaagcagaagcagcgc

SEQ ID NO: 366445 - DNA, 25 bp, Mus musculus
tgattcttggcgctctccgccggag

SEQ ID NO: 366446 - DNA, 25 bp, Mus musculus
aagcggaggcaatactcgcgcaggc

SEQ ID NO: 366447 - DNA, 25 bp, Mus musculus
gcaggcgcactcgattgtttctgac

SEQ ID NO: 366448 - DNA, 25 bp, Mus musculus
gcaacaccacctcgggtgcccccgc

SEQ ID NO: 366449 - DNA, 25 bp, Mus musculus
ttcccacgactatgcgcgcacgaga

SEQ ID NO: 366450 - DNA, 25 bp, Mus musculus
tcccacgactatgcgcgcacgagac

SEQ ID NO: 366451 - DNA, 25 bp, Mus musculus
cgactatgcgcgcacgagactgtac

SEQ ID NO: 366452 - DNA, 25 bp, Mus musculus
agcggaaagcggaggcaatactcgc

SEQ ID NO: 366453 - DNA, 25 bp, Mus musculus
ggaaagcggaggcaatactcgcgca

SEQ ID NO: 366454 - DNA, 25 bp, Mus musculus
gaaagcggaggcaatactcgcgcag

SEQ ID NO: 366455 - DNA, 25 bp, Mus musculus
aaagcggaggcaatactcgcgcagg

SEQ ID NO: 366456 - DNA, 25 bp, Mus musculus
gcgcaggcgcactcgattgtttctg

SEQ ID NO: 366457 - DNA, 25 bp, Mus musculus
cgcaggcgcactcgattgtttctga

SEQ ID NO: 366458 - DNA, 25 bp, Mus musculus
caggcgcactcgattgtttctgacg

SEQ ID NO: 366459 - DNA, 25 bp, Mus musculus
cggaggcaatactcgcgcaggcgca

SEQ ID NO: 366460 - DNA, 25 bp, Mus musculus
agcattttcaagtaggcggaccagg

SEQ ID NO: 366461 - DNA, 25 bp, Mus musculus
gagggctcggcggttcctcgctccc

SEQ ID NO: 366462 - DNA, 25 bp, Mus musculus
agactgtaccgcggagtgcacgcgc

SEQ ID NO: 366463 - DNA, 25 bp, Mus musculus
cagggagacaggtcacagggtcgct

SEQ ID NO: 366464 - DNA, 25 bp, Mus musculus
cagcactcaccaggtcaggccgata

SEQ ID NO: 366465 - DNA, 25 bp, Mus musculus
ctcaccaggtcaggccgatagtacc

SEQ ID NO: 366466 - DNA, 25 bp, Mus musculus
ccaggtcaggccgatagtaccaatg

SEQ ID NO: 366467 - DNA, 25 bp, Mus musculus
ggtcaggccgatagtaccaatgcac

SEQ ID NO: 366468 - DNA, 25 bp, Mus musculus
tccagcgggcaggaaccaaagtaca

SEQ ID NO: 366469 - DNA, 25 bp, Mus musculus
tcaagtaggcggaccagggtacgcc

SEQ ID NO: 366470 - DNA, 25 bp, Mus musculus
acctccagcgggcaggaaccaaagt

SEQ ID NO: 366471 - DNA, 25 bp, Mus musculus
cccgcgaccagcgagcggggcacct

SEQ ID NO: 366472 - DNA, 25 bp, Mus musculus
ccgaggatgggcacgcgccctacag

SEQ ID NO: 366473 - DNA, 25 bp, Mus musculus
tgggcacgcgccctacagcactcac

SEQ ID NO: 366474 - DNA, 25 bp, Mus musculus
gtcgattgctgcacgggattggcga

SEQ ID NO: 366475 - DNA, 25 bp, Mus musculus
cgtcccatcccaggctggtgaggta

SEQ ID NO: 366476 - DNA, 25 bp, Mus musculus
gctggtctttcagcagcgtcccatc

SEQ ID NO: 366477 - DNA, 25 bp, Mus musculus
ctaggctggtctttcagcagcgtcc

SEQ ID NO: 366478 - DNA, 25 bp, Mus musculus
agccgaaggctaggctggtctttca

SEQ ID NO: 366479 - DNA, 25 bp, Mus musculus
ctgcgcagagagaagagccgaaggc

SEQ ID NO: 366480 - DNA, 25 bp, Mus musculus
ccctaaggtcctgcgcagagagaag

SEQ ID NO: 366481 - DNA, 25 bp, Mus musculus
gcacgggaccctaaggtcctgcgca

SEQ ID NO: 366482 - DNA, 25 bp, Mus musculus
cgagagtgagtggttaggggacaca

SEQ ID NO: 366483 - DNA, 25 bp, Mus musculus
gtggcaggaacctccgcgcagcatc

SEQ ID NO: 366484 - DNA, 25 bp, Mus musculus
agtgagctgtaaagtggcaggaacc

SEQ ID NO: 366485 - DNA, 25 bp, Mus musculus
cgagccagtgagctgtaaagtggca

SEQ ID NO: 366486 - DNA, 25 bp, Mus musculus
gtagcgcgagccagtgagctgtaaa

SEQ ID NO: 366487 - DNA, 25 bp, Mus musculus
ccatcccaggctggtgaggtagcgc

SEQ ID NO: 366488 - DNA, 25 bp, Mus musculus
ggctagtctatgttccggcccagga

SEQ ID NO: 366489 - DNA, 25 bp, Mus musculus
cgcccgtggtgctcgaccctgatac

SEQ ID NO: 366490 - DNA, 25 bp, Mus musculus
aaactctgcagcagagacgtggccc

SEQ ID NO: 366491 - DNA, 25 bp, Mus musculus
gttgcctggaaacgggcggaagcga

SEQ ID NO: 366492 - DNA, 25 bp, Mus musculus
ggcagggccagggttgcctggaaac

SEQ ID NO: 366493 - DNA, 25 bp, Mus musculus
tcgtggtcctcaggcgccatcgcgg

SEQ ID NO: 366494 - DNA, 25 bp, Mus musculus
ctagtctatgttccggcccaggagg

SEQ ID NO: 366495 - DNA, 25 bp, Mus musculus
ggcgctcgaaactctgcagcagaga

SEQ ID NO: 366496 - DNA, 25 bp, Mus musculus
aagcggcgctcgaaactctgcagca

SEQ ID NO: 366497 - DNA, 25 bp, Mus musculus
gctcgaccctgatacccgccgcacg

SEQ ID NO: 366498 - DNA, 25 bp, Mus musculus
gtgagcaaaggcggcccgagactcc

SEQ ID NO: 366499 - DNA, 25 bp, Mus musculus
cccagtccagcggtgagcaaaggcg

SEQ ID NO: 366500 - DNA, 25 bp, Mus musculus
cgtggcaactaggaggtaagatgtg

SEQ ID NO: 366501 - DNA, 25 bp, Mus musculus
agccgccaggaagcggcgctcgaaa

SEQ ID NO: 366502 - DNA, 25 bp, Mus musculus
gcgtggggaacccacgccgcgagtg

SEQ ID NO: 366503 - DNA, 25 bp, Mus musculus
cacggccggtagacgagaactggac

SEQ ID NO: 366504 - DNA, 25 bp, Mus musculus
caaaagtcgcgcgagcagaggtggc

SEQ ID NO: 366505 - DNA, 25 bp, Mus musculus
ccctggccgtagactggctacaaaa

SEQ ID NO: 366506 - DNA, 25 bp, Mus musculus
gtgaccgcccggagatgtccgctgc

SEQ ID NO: 366507 - DNA, 25 bp, Mus musculus
cgtccacggccggtagacgagaact

SEQ ID NO: 366508 - DNA, 25 bp, Mus musculus
cccaggaacagcagcccggcgtcca

SEQ ID NO: 366509 - DNA, 25 bp, Mus musculus
cgcccctcctcgtgcagggaaagta

SEQ ID NO: 366510 - DNA, 25 bp, Mus musculus
caagggatggccgagagcgcccctc

SEQ ID NO: 366511 - DNA, 25 bp, Mus musculus
agaggacgcgcgtggggaacccacg

SEQ ID NO: 366512 - DNA, 25 bp, Mus musculus
tggctacaaaagtcgcgcgagcaga

SEQ ID NO: 366513 - DNA, 25 bp, Mus musculus
actggctacaaaagtcgcgcgagca

SEQ ID NO: 366514 - DNA, 25 bp, Mus musculus
cgtagactggctacaaaagtcgcgc

SEQ ID NO: 366515 - DNA, 25 bp, Mus musculus
tggccgtagactggctacaaaagtc

SEQ ID NO: 366516 - DNA, 25 bp, Mus musculus
aaaacagaaagtgcgggagagcgcc

SEQ ID NO: 366517 - DNA, 25 bp, Mus musculus
ctcattttatataaggcagcctgcc

SEQ ID NO: 366518 - DNA, 25 bp, Mus musculus
tctgcagatgaacgagcaaccgggc

SEQ ID NO: 366519 - DNA, 25 bp, Mus musculus
accgtcgcacacacaccaaatgtag

SEQ ID NO: 366520 - DNA, 25 bp, Mus musculus
tccacgtactttcgcctccttgaag

SEQ ID NO: 366521 - DNA, 25 bp, Mus musculus
tcgcctccttgaagtttggggctcc

SEQ ID NO: 366522 - DNA, 25 bp, Mus musculus
ttgttgttttcctcgggcggctcaa

SEQ ID NO: 366523 - DNA, 25 bp, Mus musculus
gtgctgcctgcaaacgcagcctggc

SEQ ID NO: 366524 - DNA, 25 bp, Mus musculus
atacagtacatgcaacccggagaga

SEQ ID NO: 366525 - DNA, 25 bp, Mus musculus
cggctcgcaagtgagtaggaaaaca

SEQ ID NO: 366526 - DNA, 25 bp, Mus musculus
agtcaggggctctctatgggaaagt

SEQ ID NO: 366527 - DNA, 25 bp, Mus musculus
ggaacacccaaatcctaactctgca

SEQ ID NO: 366528 - DNA, 25 bp, Mus musculus
cccggagagactgaaaacactcatt

SEQ ID NO: 366529 - DNA, 25 bp, Mus musculus
tcgccacccaaagttttggctgagg

SEQ ID NO: 366530 - DNA, 25 bp, Mus musculus
cgattgtcctggagaacagcgcggc

SEQ ID NO: 366531 - DNA, 25 bp, Mus musculus
tcagggcaatcgcaaatgaacttcc

SEQ ID NO: 366532 - DNA, 25 bp, Mus musculus
cgtaactttgcgagaatcagggcaa

SEQ ID NO: 366533 - DNA, 25 bp, Mus musculus
tgtgaaggatctctagccgagccgc

SEQ ID NO: 366534 - DNA, 25 bp, Mus musculus
tttcagtgagagaagcccgagggta

SEQ ID NO: 366535 - DNA, 25 bp, Mus musculus
tcggaggtagcctcctagaaagatc

SEQ ID NO: 366536 - DNA, 25 bp, Mus musculus
gcatgtgcttcttacggggctttca

SEQ ID NO: 366537 - DNA, 25 bp, Mus musculus
gcagactctgcttccgccagatcgg

SEQ ID NO: 366538 - DNA, 25 bp, Mus musculus
gagctcccgaaggtcccagtggact

SEQ ID NO: 366539 - DNA, 25 bp, Mus musculus
ggcatccgcacagtgcaggcgccta

SEQ ID NO: 366540 - DNA, 25 bp, Mus musculus
acctacgcaaacacagtcggggctg

SEQ ID NO: 366541 - DNA, 25 bp, Mus musculus
cgaacaagttaggatacggccgagc

SEQ ID NO: 366542 - DNA, 25 bp, Mus musculus
acgaaattagaaacacccgagagtg

SEQ ID NO: 366543 - DNA, 25 bp, Mus musculus
aagccgccaggcaatctcggaggta

SEQ ID NO: 366544 - DNA, 25 bp, Mus musculus
aggtcacgcccaccgcttagctttg

SEQ ID NO: 366545 - DNA, 25 bp, Mus musculus
gcaactttgctagaagcgcggcctg

SEQ ID NO: 366546 - DNA, 25 bp, Mus musculus
ctgacagctctacgcacgcgcggtg

SEQ ID NO: 366547 - DNA, 25 bp, Mus musculus
acaggtctgcccgttgctttgcaac

SEQ ID NO: 366548 - DNA, 25 bp, Mus musculus
cgccgggatcttcaccgttctgaca

SEQ ID NO: 366549 - DNA, 25 bp, Mus musculus
tcgccttttttccatcgccgggatc

SEQ ID NO: 366550 - DNA, 25 bp, Mus musculus
cctacgcggagcagtttcgcctttt

SEQ ID NO: 366551 - DNA, 25 bp, Mus musculus
ctcgaacaaggtgcgatgccactcc

SEQ ID NO: 366552 - DNA, 25 bp, Mus musculus
gcgggaacttcttcggactcgaaca

SEQ ID NO: 366553 - DNA, 25 bp, Mus musculus
gccggcttagagaagcgggaacttc

SEQ ID NO: 366554 - DNA, 25 bp, Mus musculus
aggagactcgcatcccttcagccgg

SEQ ID NO: 366555 - DNA, 25 bp, Mus musculus
tcccgttgggacaagaggagactcg

SEQ ID NO: 366556 - DNA, 25 bp, Mus musculus
gaacgctcaggacgctcgcactctt

SEQ ID NO: 366557 - DNA, 25 bp, Mus musculus
ctcaggatgccctgaacgctcagga

SEQ ID NO: 366558 - DNA, 25 bp, Mus musculus
gctttggaccacttgataccgggta

SEQ ID NO: 366559 - DNA, 25 bp, Mus musculus
gagggaccaccggagaagtgaactc

SEQ ID NO: 366560 - DNA, 25 bp, Mus musculus
ctgtctggcagaaagcagcctctca

SEQ ID NO: 366561 - DNA, 25 bp, Mus musculus
cctctcaggattggttcgaagactc

SEQ ID NO: 366562 - DNA, 25 bp, Mus musculus
gtggagctttttgcacggtaattgc

SEQ ID NO: 366563 - DNA, 25 bp, Mus musculus
cccgcgtctcggtgttcctagatct

SEQ ID NO: 366564 - DNA, 25 bp, Mus musculus
gttcctagatctcggtggctccttc

SEQ ID NO: 366565 - DNA, 25 bp, Mus musculus
agcgctctcctagggcgattccaca

SEQ ID NO: 366566 - DNA, 25 bp, Mus musculus
ggacagccctagcttccagctgctg

SEQ ID NO: 366567 - DNA, 25 bp, Mus musculus
ccaagtggggatttaaacagcagtc

SEQ ID NO: 366568 - DNA, 25 bp, Mus musculus
gggtctagggctactttatctttgc

SEQ ID NO: 366569 - DNA, 25 bp, Mus musculus
tgctgagttcctcgtctctttccca

SEQ ID NO: 366570 - DNA, 25 bp, Mus musculus
cctggaaagggtacagacgttctga

SEQ ID NO: 366571 - DNA, 25 bp, Mus musculus
gacgttctgaaacaaagctttggac

SEQ ID NO: 366572 - DNA, 25 bp, Mus musculus
gcctgtggagaacagcgggccaagc

SEQ ID NO: 366573 - DNA, 25 bp, Mus musculus
gctgcccgaattccgcccgcagtgg

SEQ ID NO: 366574 - DNA, 25 bp, Mus musculus
gcagtctggggcctcgcccatctag

SEQ ID NO: 366575 - DNA, 25 bp, Mus musculus
ctgcgctgcccgaattccgcccgca

SEQ ID NO: 366576 - DNA, 25 bp, Mus musculus
ggtctccagaactccggctgcgctg

SEQ ID NO: 366577 - DNA, 25 bp, Mus musculus
tggtctccagaactccggctgcgct

SEQ ID NO: 366578 - DNA, 25 bp, Mus musculus
tccgtggtctccagaactccggctg

SEQ ID NO: 366579 - DNA, 25 bp, Mus musculus
aggtgacctcccacagcctccgtgg

SEQ ID NO: 366580 - DNA, 25 bp, Mus musculus
acagggctgcaggacgcaggtgacc

SEQ ID NO: 366581 - DNA, 25 bp, Mus musculus
agcgcagtcccatcctggccactca

SEQ ID NO: 366582 - DNA, 25 bp, Mus musculus
gggcactgcctgagccagcgcagtc

SEQ ID NO: 366583 - DNA, 25 bp, Mus musculus
acgggcactgcctgagccagcgcag

SEQ ID NO: 366584 - DNA, 25 bp, Mus musculus
cagcgcaagattccacgggcactgc

SEQ ID NO: 366585 - DNA, 25 bp, Mus musculus
tgcagcgcaagattccacgggcact

SEQ ID NO: 366586 - DNA, 25 bp, Mus musculus
cacaggacacgctggccaatgaaga

SEQ ID NO: 366587 - DNA, 25 bp, Mus musculus
ttctcttcttgcaaaggagaggata

SEQ ID NO: 366588 - DNA, 25 bp, Mus musculus
tcgggtctgtgccacacgcaacttt

SEQ ID NO: 366589 - DNA, 25 bp, Mus musculus
tctggcagctactcccaggacgggc

SEQ ID NO: 366590 - DNA, 25 bp, Mus musculus
cgggcgaccctcttattccaggaga

SEQ ID NO: 366591 - DNA, 25 bp, Mus musculus
ggatgctgtcttctagtagtttctc

SEQ ID NO: 366592 - DNA, 25 bp, Mus musculus
agtcagtcaaggtagacgcggtttc

SEQ ID NO: 366593 - DNA, 25 bp, Mus musculus
gctgcaggaccaagtcggagactga

SEQ ID NO: 366594 - DNA, 25 bp, Mus musculus
cgatccgcagcctagaggcgctgca

SEQ ID NO: 366595 - DNA, 25 bp, Mus musculus
ggcgtgtgtaagctgcctgtctcct

SEQ ID NO: 366596 - DNA, 25 bp, Mus musculus
ttgcaccgtgcacggatcaccggga

SEQ ID NO: 366597 - DNA, 25 bp, Mus musculus
acgcggtttctttttggatgctgtc

SEQ ID NO: 366598 - DNA, 25 bp, Mus musculus
gggacagcgacttttttccaagaca

SEQ ID NO: 366599 - DNA, 25 bp, Mus musculus
ccaggagacgcttcagtagtcagtc

SEQ ID NO: 366600 - DNA, 25 bp, Mus musculus
gcctccaaacctggaagcggttgcc

SEQ ID NO: 366601 - DNA, 25 bp, Mus musculus
gtgcagagttcagtctcctcccttg

SEQ ID NO: 366602 - DNA, 25 bp, Mus musculus
gctgcaagaacaggtccgcccagtt

SEQ ID NO: 366603 - DNA, 25 bp, Mus musculus
ttggccttcgctggacgcaccgcat

SEQ ID NO: 366604 - DNA, 25 bp, Mus musculus
tgcccgggatgaggcaatgtgccct

SEQ ID NO: 366605 - DNA, 25 bp, Mus musculus
agtttccagtaaaatgcccgggatg

SEQ ID NO: 366606 - DNA, 25 bp, Mus musculus
cgcctccggatgtgtctagtttcca

SEQ ID NO: 366607 - DNA, 25 bp, Mus musculus
ggaccgggctatttaaatgaactga

SEQ ID NO: 366608 - DNA, 25 bp, Mus musculus
agacacctgcgccaccggatggcta

SEQ ID NO: 366609 - DNA, 25 bp, Mus musculus
gccacctatgggacgggactccacg

SEQ ID NO: 366610 - DNA, 25 bp, Mus musculus
gcgccgtacaagtaagccaggttga

SEQ ID NO: 366611 - DNA, 25 bp, Mus musculus
gtccagcagcttgtccacgatcatg

SEQ ID NO: 366612 - DNA, 25 bp, Mus musculus
cacgatcatgctcccaggctaggcg

SEQ ID NO: 366613 - DNA, 25 bp, Mus musculus
cagagcgactagtacgtgcgcgccc

SEQ ID NO: 366614 - DNA, 25 bp, Mus musculus
ccctccgtcaccgtggactgtaaag

SEQ ID NO: 366615 - DNA, 25 bp, Mus musculus
ccgaaaaggacacgccattggcctg

SEQ ID NO: 366616 - DNA, 25 bp, Mus musculus
ccgcgcggttcttcaccctccgtca

SEQ ID NO: 366617 - DNA, 25 bp, Mus musculus
tcaccgtggactgtaaaggcgaagc

SEQ ID NO: 366618 - DNA, 25 bp, Mus musculus
cccgcgagctttaaaaggtggtgtg

SEQ ID NO: 366619 - DNA, 25 bp, Mus musculus
cccgatcctgtggtgagtccgcgcg

SEQ ID NO: 366620 - DNA, 25 bp, Mus musculus
actcgccgcggtgatgtagcagcgt

SEQ ID NO: 366621 - DNA, 25 bp, Mus musculus
cgccgagatccacgtttcccgaaag

SEQ ID NO: 366622 - DNA, 25 bp, Mus musculus
attggcctggccagcatcacgtgat

SEQ ID NO: 366623 - DNA, 25 bp, Mus musculus
gagatccacgtttcccgaaaggcta

SEQ ID NO: 366624 - DNA, 25 bp, Mus musculus
ctgtaaaggcgaagcgggtaccctg

SEQ ID NO: 366625 - DNA, 25 bp, Mus musculus
agctttaaaaggtggtgtgtgcccg

SEQ ID NO: 366626 - DNA, 25 bp, Mus musculus
agcatcacgtgatggcgaggccgcc

SEQ ID NO: 366627 - DNA, 25 bp, Mus musculus
gctcggcaggagtggccgtaccctc

SEQ ID NO: 366628 - DNA, 25 bp, Mus musculus
tcatccggaccttggcagtcgcagc

SEQ ID NO: 366629 - DNA, 25 bp, Mus musculus
cagcccagggctgaagctctgcctg

SEQ ID NO: 366630 - DNA, 25 bp, Mus musculus
ccaggctgttctctcccggcttcct

SEQ ID NO: 366631 - DNA, 25 bp, Mus musculus
tcccacgggatgtggacgctccgat

SEQ ID NO: 366632 - DNA, 25 bp, Mus musculus
ctcaccgggtctccggtctcgctcg

SEQ ID NO: 366633 - DNA, 25 bp, Mus musculus
atagtcgcagctcgcactcaccggg

SEQ ID NO: 366634 - DNA, 25 bp, Mus musculus
cggaacacagggctctgcagctgcg

SEQ ID NO: 366635 - DNA, 25 bp, Mus musculus
gtccgcgcgcggaacacagggctct

SEQ ID NO: 366636 - DNA, 25 bp, Mus musculus
cggggccgcagctccctacacccgg

SEQ ID NO: 366637 - DNA, 25 bp, Mus musculus
gctctggaacgcagttgggactccc

SEQ ID NO: 366638 - DNA, 25 bp, Mus musculus
gaagctctgcctgcgtcttcgaccg

SEQ ID NO: 366639 - DNA, 25 bp, Mus musculus
cttggcagtcgcagcccagggctga

SEQ ID NO: 366640 - DNA, 25 bp, Mus musculus
ttcctgaccgcgctacggagcctca

SEQ ID NO: 366641 - DNA, 25 bp, Mus musculus
tcggatcatccggaccttggcagtc

SEQ ID NO: 366642 - DNA, 25 bp, Mus musculus
aacacggagttttcgctgctttcta

SEQ ID NO: 366643 - DNA, 25 bp, Mus musculus
cctgcagacagggaacttgctctgt

SEQ ID NO: 366644 - DNA, 25 bp, Mus musculus
ctctgtcagggaggagtgaaaccca

SEQ ID NO: 366645 - DNA, 25 bp, Mus musculus
cgagtctcggtctttgacgcatttc

SEQ ID NO: 366646 - DNA, 25 bp, Mus musculus
gccagtccgaactctgatccgaaga

SEQ ID NO: 366647 - DNA, 25 bp, Mus musculus
gctgctggacggaggttaaatactg

SEQ ID NO: 366648 - DNA, 25 bp, Mus musculus
aaagtctggcgctgatctcccttgc

SEQ ID NO: 366649 - DNA, 25 bp, Mus musculus
acttgatataggaggcacgtcgggc

SEQ ID NO: 366650 - DNA, 25 bp, Mus musculus
tgcagtcactgtgctcctcggctgt

SEQ ID NO: 366651 - DNA, 25 bp, Mus musculus
gagtgttgtcctgctcactggctga

SEQ ID NO: 366652 - DNA, 25 bp, Mus musculus
tctcctgccacatcgtcagaatcgg

SEQ ID NO: 366653 - DNA, 25 bp, Mus musculus
ctttccggagaacaagcgaggtgac

SEQ ID NO: 366654 - DNA, 25 bp, Mus musculus
gggtgacgccagagtacttgatata

SEQ ID NO: 366655 - DNA, 25 bp, Mus musculus
tgagctctccctactgcagtcactg

SEQ ID NO: 366656 - DNA, 25 bp, Mus musculus
tgaagatgcagacaagctgagagga

SEQ ID NO: 366657 - DNA, 25 bp, Mus musculus
tggcgagccagcagagttgtacaga

SEQ ID NO: 366658 - DNA, 25 bp, Mus musculus
ctccggagcagaagaggttgaggct

SEQ ID NO: 366659 - DNA, 25 bp, Mus musculus
caggattgacccgtcacccgcagtg

SEQ ID NO: 366660 - DNA, 25 bp, Mus musculus
cagtgcccattacggccagcagagg

SEQ ID NO: 366661 - DNA, 25 bp, Mus musculus
agccagcagagttgtacagagctgc

SEQ ID NO: 366662 - DNA, 25 bp, Mus musculus
gacccggagtccgagcgcagaaacc

SEQ ID NO: 366663 - DNA, 25 bp, Mus musculus
actgccaccgcgaggcggcttgcag

SEQ ID NO: 366664 - DNA, 25 bp, Mus musculus
ggaggcgcctgcttctttcctcatc

SEQ ID NO: 366665 - DNA, 25 bp, Mus musculus
caagatcaggcatcgagagccccca

SEQ ID NO: 366666 - DNA, 25 bp, Mus musculus
agccctgaagatgcagacaagctga

SEQ ID NO: 366667 - DNA, 25 bp, Mus musculus
gaggacgacgctccggagcagaaga

SEQ ID NO: 366668 - DNA, 25 bp, Mus musculus
acggagccacgacaccgcgtccagc

SEQ ID NO: 366669 - DNA, 25 bp, Mus musculus
cgcagtgcccattacggccagcaga

SEQ ID NO: 366670 - DNA, 25 bp, Mus musculus
gtctccgggttatgagcctcaactc

SEQ ID NO: 366671 - DNA, 25 bp, Mus musculus
aaaggtcaccgcagtccgaagccca

SEQ ID NO: 366672 - DNA, 25 bp, Mus musculus
cctgtgggcactcggaactcaaagt

SEQ ID NO: 366673 - DNA, 25 bp, Mus musculus
aggctgcactaatttcctgtgggca

SEQ ID NO: 366674 - DNA, 25 bp, Mus musculus
gcttcctgaacgttctcggacgaga

SEQ ID NO: 366675 - DNA, 25 bp, Mus musculus
ttcaagcagactgtgatgcggtttc

SEQ ID NO: 366676 - DNA, 25 bp, Mus musculus
cacggctactggtcacttccaaaga

SEQ ID NO: 366677 - DNA, 25 bp, Mus musculus
gaggcatctcccaagcacaggcgca

SEQ ID NO: 366678 - DNA, 25 bp, Mus musculus
tcgacacatgttttagccgaactcc

SEQ ID NO: 366679 - DNA, 25 bp, Mus musculus
agcgtccgcacacaattcctaagtg

SEQ ID NO: 366680 - DNA, 25 bp, Mus musculus
cttcgagatgaaaactagactgtcc

SEQ ID NO: 366681 - DNA, 25 bp, Mus musculus
cggttttcttatcacgtgaggcgtc

SEQ ID NO: 366682 - DNA, 25 bp, Mus musculus
ctcctagagggtttcaatgcttttc

SEQ ID NO: 366683 - DNA, 25 bp, Mus musculus
caacgcgtgtctgggtcattctcag

SEQ ID NO: 366684 - DNA, 25 bp, Mus musculus
gagctaccggggatggctcctcttt

SEQ ID NO: 366685 - DNA, 25 bp, Mus musculus
catcctgaggccgagctaccgggga

SEQ ID NO: 366686 - DNA, 25 bp, Mus musculus
ggatggctcctctttgcagcgcaca

SEQ ID NO: 366687 - DNA, 25 bp, Mus musculus
gctcctctttgcagcgcacatacta

SEQ ID NO: 366688 - DNA, 25 bp, Mus musculus
gcagcgcacatactaacgagcttcg

SEQ ID NO: 366689 - DNA, 25 bp, Mus musculus
acgagcttcgccttttccttccagg

SEQ ID NO: 366690 - DNA, 25 bp, Mus musculus
tttccttccagggtcgagctgtgca

SEQ ID NO: 366691 - DNA, 25 bp, Mus musculus
tcaccatgaagtaagcgggcgcccg

SEQ ID NO: 366692 - DNA, 25 bp, Mus musculus
cggcaggccgacatctatcaccatg

SEQ ID NO: 366693 - DNA, 25 bp, Mus musculus
ggccgacatctatcaccatgaagta

SEQ ID NO: 366694 - DNA, 25 bp, Mus musculus
cagtttcagcgggtacaagatctac

SEQ ID NO: 366695 - DNA, 25 bp, Mus musculus
gcgggtacaagatctacccgggaca

SEQ ID NO: 366696 - DNA, 25 bp, Mus musculus
ctgggagtagaaggacggtcctctc

SEQ ID NO: 366697 - DNA, 25 bp, Mus musculus
tcgagctgtgcagtttcagcgggta

SEQ ID NO: 366698 - DNA, 25 bp, Mus musculus
accgcaagaccttcgccgagctgga

SEQ ID NO: 366699 - DNA, 25 bp, Mus musculus
agccattttgtcagtcgccagcgga

SEQ ID NO: 366700 - DNA, 25 bp, Mus musculus
cggctatgtcaagcgaggagagcta

SEQ ID NO: 366701 - DNA, 25 bp, Mus musculus
tcctgcgctacctgacgaacgaacg

SEQ ID NO: 366702 - DNA, 25 bp, Mus musculus
cgagggcaatgtcaagcggaagatc

SEQ ID NO: 366703 - DNA, 25 bp, Mus musculus
ctgacgaacgaacgcgagccctatg

SEQ ID NO: 366704 - DNA, 25 bp, Mus musculus
tcacttccggtggtgcagcagccat

SEQ ID NO: 366705 - DNA, 25 bp, Mus musculus
cagacctggcacgacctgtccaaga

SEQ ID NO: 366706 - DNA, 25 bp, Mus musculus
cctgtccaagacctactggtggcga

SEQ ID NO: 366707 - DNA, 25 bp, Mus musculus
acccgcgagccctcaagtctgggga

SEQ ID NO: 366708 - DNA, 25 bp, Mus musculus
gggcctcatcgaggcggcccatttg

SEQ ID NO: 366709 - DNA, 25 bp, Mus musculus
gcgcagagccgtagcgcgctccaat

SEQ ID NO: 366710 - DNA, 25 bp, Mus musculus
catgtcctccgcagtgttgacgtca

SEQ ID NO: 366711 - DNA, 25 bp, Mus musculus
gggacgcgaaagcagccgcacttcc

SEQ ID NO: 366712 - DNA, 25 bp, Mus musculus
tcgtggaacggtgggttcaatccta

SEQ ID NO: 366713 - DNA, 25 bp, Mus musculus
agagcatcaaccctcgttacgtgta

SEQ ID NO: 366714 - DNA, 25 bp, Mus musculus
cctctctgattaggcgacgcggacc

SEQ ID NO: 366715 - DNA, 25 bp, Mus musculus
ggttagtacggactcaccgatcgtg

SEQ ID NO: 366716 - DNA, 25 bp, Mus musculus
ttcaatcctaggtgcttccacgctc

SEQ ID NO: 366717 - DNA, 25 bp, Mus musculus
tcgcggctggtccttcattttacgg

SEQ ID NO: 366718 - DNA, 25 bp, Mus musculus
cattttacgggatagggctgtgttc

SEQ ID NO: 366719 - DNA, 25 bp, Mus musculus
caaccacaaagcttcgggcgggcca

SEQ ID NO: 366720 - DNA, 25 bp, Mus musculus
ttacgtgtaaccgagaggccggcga

SEQ ID NO: 366721 - DNA, 25 bp, Mus musculus
tccgcggcttttgcattcgtgaaaa

SEQ ID NO: 366722 - DNA, 25 bp, Mus musculus
agatcacgtcgtagagccttacgga

SEQ ID NO: 366723 - DNA, 25 bp, Mus musculus
tgcaatgacaccgaaaagagactta

SEQ ID NO: 366724 - DNA, 25 bp, Mus musculus
cggtccggtgtgcaattatcgtttc

SEQ ID NO: 366725 - DNA, 25 bp, Mus musculus
cggacgctgtcttagtgttgacacc

SEQ ID NO: 366726 - DNA, 25 bp, Mus musculus
ccgcatcctggaaagccagcgggtc

SEQ ID NO: 366727 - DNA, 25 bp, Mus musculus
gctctcaacttggtcactctcgtta

SEQ ID NO: 366728 - DNA, 25 bp, Mus musculus
ggcggttagaactcgaatccttaca

SEQ ID NO: 366729 - DNA, 25 bp, Mus musculus
gccctgccacatcatttattgcttg

SEQ ID NO: 366730 - DNA, 25 bp, Mus musculus
taaagtcgctctgcgacctcgccga

SEQ ID NO: 366731 - DNA, 25 bp, Mus musculus
taactcggcaggcagtttgtttccc

SEQ ID NO: 366732 - DNA, 25 bp, Mus musculus
cggccacggcctctgacgtttaact

SEQ ID NO: 366733 - DNA, 25 bp, Mus musculus
agcacctaggcagagagacagaccc

SEQ ID NO: 366734 - DNA, 25 bp, Mus musculus
agaagctccgcaggtacccagactg

SEQ ID NO: 366735 - DNA, 25 bp, Mus musculus
ttcctctcgcctggggttctcagag

SEQ ID NO: 366736 - DNA, 25 bp, Mus musculus
gtagcgccgtgcctaacgactccta

SEQ ID NO: 366737 - DNA, 25 bp, Mus musculus
gtgaacgcggcttccgcttcaggta

SEQ ID NO: 366738 - DNA, 25 bp, Mus musculus
ttaaagcgcgacacaggagacgatc

SEQ ID NO: 366739 - DNA, 25 bp, Mus musculus
actccggagcagatccgcgtgcaca

SEQ ID NO: 366740 - DNA, 25 bp, Mus musculus
agggccgagccgaccattgtacctg

SEQ ID NO: 366741 - DNA, 25 bp, Mus musculus
tgcgcaagcgcgaatctcacttctg

SEQ ID NO: 366742 - DNA, 25 bp, Mus musculus
ccgggacacgctccttgattgtctt

SEQ ID NO: 366743 - DNA, 25 bp, Mus musculus
attgtcttcggtccagcggtcttct

SEQ ID NO: 366744 - DNA, 25 bp, Mus musculus
agcggtcttctctgctggctatagc

SEQ ID NO: 366745 - DNA, 25 bp, Mus musculus
tggctatagccgctgtcctgccacg

SEQ ID NO: 366746 - DNA, 25 bp, Mus musculus
aattgcacccgcgttcactttcgct

SEQ ID NO: 366747 - DNA, 25 bp, Mus musculus
gcacaagatgtcactctcctttctg

SEQ ID NO: 366748 - DNA, 25 bp, Mus musculus
tccctccttcctttggcagatcaga

SEQ ID NO: 366749 - DNA, 25 bp, Mus musculus
cgcggcagcgcctcgagtaaataaa

SEQ ID NO: 366750 - DNA, 25 bp, Mus musculus
aaataaaatactcctgctgtccctc

SEQ ID NO: 366751 - DNA, 25 bp, Mus musculus
ggcgcccgcagctgtcgaaaagcct

SEQ ID NO: 366752 - DNA, 25 bp, Mus musculus
tctcgtccgacaggctcgtttaata

SEQ ID NO: 366753 - DNA, 25 bp, Mus musculus
tcctgaggtgacagcgcctggaagt

SEQ ID NO: 366754 - DNA, 25 bp, Mus musculus
tgtcgcagaggaggcttccaaaccc

SEQ ID NO: 366755 - DNA, 25 bp, Mus musculus
atgcgcagggaattaccagcacttc

SEQ ID NO: 366756 - DNA, 25 bp, Mus musculus
gacctcctccttgagtcgccacgcg

SEQ ID NO: 366757 - DNA, 25 bp, Mus musculus
ctcactcggtgtcgcagaggaggct

SEQ ID NO: 366758 - DNA, 25 bp, Mus musculus
caggctgcgcagagctggccaatcg

SEQ ID NO: 366759 - DNA, 25 bp, Mus musculus
tggccaatcgcacgcacccgacgag

SEQ ID NO: 366760 - DNA, 25 bp, Mus musculus
gacgagcctagcgacagccacggtc

SEQ ID NO: 366761 - DNA, 25 bp, Mus musculus
gacagccacggtcccgtacgtggca

SEQ ID NO: 366762 - DNA, 25 bp, Mus musculus
gcgcacaagccagtcaggacgcatg

SEQ ID NO: 366763 - DNA, 25 bp, Mus musculus
cggcttcctcactggatgaccgagt

SEQ ID NO: 366764 - DNA, 25 bp, Mus musculus
cactggatgaccgagtgtaggaagt

SEQ ID NO: 366765 - DNA, 25 bp, Mus musculus
gcggacacgcatgcgcagggaatta

SEQ ID NO: 366766 - DNA, 25 bp, Mus musculus
cagggaattaccagcacttccggtt

SEQ ID NO: 366767 - DNA, 25 bp, Mus musculus
gcgcgcctcactccggcggacatac

SEQ ID NO: 366768 - DNA, 25 bp, Mus musculus
ccatccgggagctgatgatcatctt

SEQ ID NO: 366769 - DNA, 25 bp, Mus musculus
tcctcaactggaggcgggtttcctc

SEQ ID NO: 366770 - DNA, 25 bp, Mus musculus
gacaccgagccgtggccatccggga

SEQ ID NO: 366771 - DNA, 25 bp, Mus musculus
gcggacgagctgcacgtctacaata

SEQ ID NO: 366772 - DNA, 25 bp, Mus musculus
ctacaataccggtaggcggcggctc

SEQ ID NO: 366773 - DNA, 25 bp, Mus musculus
gacgcgggcctgacagctgtcaccg

SEQ ID NO: 366774 - DNA, 25 bp, Mus musculus
ctcgcaacgtgttggaaggcggctc

SEQ ID NO: 366775 - DNA, 25 bp, Mus musculus
ttccgcgggctggacgtgactccac

SEQ ID NO: 366776 - DNA, 25 bp, Mus musculus
gtgactccaccggtagacatcgaga

SEQ ID NO: 366777 - DNA, 25 bp, Mus musculus
ggagatcccgccagtgtcaagaaca

SEQ ID NO: 366778 - DNA, 25 bp, Mus musculus
cggggaggttctcctggctgcctct

SEQ ID NO: 366779 - DNA, 25 bp, Mus musculus
cggaagcccgcaagacagttctcta

SEQ ID NO: 366780 - DNA, 25 bp, Mus musculus
cagttctctaaactcgcggcggaga

SEQ ID NO: 366781 - DNA, 25 bp, Mus musculus
tgcctcttcagcgtaggtacagtta

SEQ ID NO: 366782 - DNA, 25 bp, Mus musculus
gatgcagcttttccttgacccgttg

SEQ ID NO: 366783 - DNA, 25 bp, Mus musculus
tcgtccgctcctgctgcttagcgtg

SEQ ID NO: 366784 - DNA, 25 bp, Mus musculus
ccacgggtccttctgtcctggagaa

SEQ ID NO: 366785 - DNA, 25 bp, Mus musculus
tcctggagaagaggtctgcagtcac

SEQ ID NO: 366786 - DNA, 25 bp, Mus musculus
ctgcagtcacgcaaggcctgagacc

SEQ ID NO: 366787 - DNA, 25 bp, Mus musculus
tgagacctcccgagcgattctaggc

SEQ ID NO: 366788 - DNA, 25 bp, Mus musculus
ctaggcaaccgcctgcaagaggaaa

SEQ ID NO: 366789 - DNA, 25 bp, Mus musculus
gacagtcgtcatggccgcctctaag

SEQ ID NO: 366790 - DNA, 25 bp, Mus musculus
tctaagcccatagaggcggcgatgg

SEQ ID NO: 366791 - DNA, 25 bp, Mus musculus
gctatgtacctgtggagccgaaggc

SEQ ID NO: 366792 - DNA, 25 bp, Mus musculus
ccagcggcctgaagcgcaacagtga

SEQ ID NO: 366793 - DNA, 25 bp, Mus musculus
tccctgtgaatggtgagaagccgcc

SEQ ID NO: 366794 - DNA, 25 bp, Mus musculus
ccaccggtcggaaactgccgagtga

SEQ ID NO: 366795 - DNA, 25 bp, Mus musculus
gccaccacgacggttctggggactc

SEQ ID NO: 366796 - DNA, 25 bp, Mus musculus
ccgcggacaccggtgacaagagcca

SEQ ID NO: 366797 - DNA, 25 bp, Mus musculus
acacctcgagtgacgggcctattac

SEQ ID NO: 366798 - DNA, 25 bp, Mus musculus
gcctattacgggaacaacatttaca

SEQ ID NO: 366799 - DNA, 25 bp, Mus musculus
gccaggacagtgcaactataaactt

SEQ ID NO: 366800 - DNA, 25 bp, Mus musculus
tttacagacgaggaactgcggagtg

SEQ ID NO: 366801 - DNA, 25 bp, Mus musculus
tgcggagtgaggtgtgattatccac

SEQ ID NO: 366802 - DNA, 25 bp, Mus musculus
tatccaccgctttgtgaggcgagga

SEQ ID NO: 366803 - DNA, 25 bp, Mus musculus
tgaccagctccgacagcacaggacg

SEQ ID NO: 366804 - DNA, 25 bp, Mus musculus
cgctgggagctggacaaccagacca

SEQ ID NO: 366805 - DNA, 25 bp, Mus musculus
gaccacgagccacttactagacatg

SEQ ID NO: 366806 - DNA, 25 bp, Mus musculus
agacatggctcttccacggtgcacc

SEQ ID NO: 366807 - DNA, 25 bp, Mus musculus
acagggactcctgccagtcaatctc

SEQ ID NO: 366808 - DNA, 25 bp, Mus musculus
agtcaatctcctccgcagcgtgcag

SEQ ID NO: 366809 - DNA, 25 bp, Mus musculus
ggaagtcagagccacgagttggaca

SEQ ID NO: 366810 - DNA, 25 bp, Mus musculus
ttgagactcaccagagcgaaagagg

SEQ ID NO: 366811 - DNA, 25 bp, Mus musculus
cccgacgttgacagtggcagaagct

SEQ ID NO: 366812 - DNA, 25 bp, Mus musculus
gtggcagaagctcttctccttccgc

SEQ ID NO: 366813 - DNA, 25 bp, Mus musculus
tccgccattgctgttgacgtccacg

SEQ ID NO: 366814 - DNA, 25 bp, Mus musculus
gacgtccacgtcactttgccgaaaa

SEQ ID NO: 366815 - DNA, 25 bp, Mus musculus
ctttgccgaaaagtggacctggcac

SEQ ID NO: 366816 - DNA, 25 bp, Mus musculus
gacctggcaccgagactgtctcaga

SEQ ID NO: 366817 - DNA, 25 bp, Mus musculus
agctttgcgagagggagaagattat

SEQ ID NO: 366818 - DNA, 25 bp, Mus musculus
tggaaggatgcaacgtcaccacgtc

SEQ ID NO: 366819 - DNA, 25 bp, Mus musculus
cgaggaattggaaggatgcaacgtc

SEQ ID NO: 366820 - DNA, 25 bp, Mus musculus
gtcgtaaaaggagttatgaagtctg

SEQ ID NO: 366821 - DNA, 25 bp, Mus musculus
ctgtctcagagattcagtgtcgtaa

SEQ ID NO: 366822 - DNA, 25 bp, Mus musculus
tcaccacgtctctagggcgaaaggc

SEQ ID NO: 366823 - DNA, 25 bp, Mus musculus
tgaagtctgagacttgagactcacc

SEQ ID NO: 366824 - DNA, 25 bp, Mus musculus
gcggacccgagaaaccaccagtgag

SEQ ID NO: 366825 - DNA, 25 bp, Mus musculus
atgcacacatttttctcgcgctctc

SEQ ID NO: 366826 - DNA, 25 bp, Mus musculus
ctggattttgttggttgcgctcttc

SEQ ID NO: 366827 - DNA, 25 bp, Mus musculus
accagtgagtcgctcagctcgcatc

SEQ ID NO: 366828 - DNA, 25 bp, Mus musculus
atctgagaggacctagcgcatctcc

SEQ ID NO: 366829 - DNA, 25 bp, Mus musculus
tcgggattatttttggctcgccagc

SEQ ID NO: 366830 - DNA, 25 bp, Mus musculus
cccttaggagtgatccggaccttcg

SEQ ID NO: 366831 - DNA, 25 bp, Mus musculus
gcgctccctggtgctcgggattatt

SEQ ID NO: 366832 - DNA, 25 bp, Mus musculus
tttgcttctcctccggtccagcttg

SEQ ID NO: 366833 - DNA, 25 bp, Mus musculus
ggatcccagaagtgtcagtcgcagc

SEQ ID NO: 366834 - DNA, 25 bp, Mus musculus
cggctgatacctcggataggggtcc

SEQ ID NO: 366835 - DNA, 25 bp, Mus musculus
ggaattactccctcttcttatcgcg

SEQ ID NO: 366836 - DNA, 25 bp, Mus musculus
agacccggctgcaccacggaagagt

SEQ ID NO: 366837 - DNA, 25 bp, Mus musculus
tcctcccagctcaggacagatctga

SEQ ID NO: 366838 - DNA, 25 bp, Mus musculus
ggtcatcagacctgtgccaaattgc

SEQ ID NO: 366839 - DNA, 25 bp, Mus musculus
cagaggacaactcttggagtggatt

SEQ ID NO: 366840 - DNA, 25 bp, Mus musculus
caactcttggagtggattttctctg

SEQ ID NO: 366841 - DNA, 25 bp, Mus musculus
gattttctctggtcacctggtggga

SEQ ID NO: 366842 - DNA, 25 bp, Mus musculus
tcacctggtgggatctggacactga

SEQ ID NO: 366843 - DNA, 25 bp, Mus musculus
ctggtgggatctggacactgaattc

SEQ ID NO: 366844 - DNA, 25 bp, Mus musculus
tctggacactgaattctggtcatca

SEQ ID NO: 366845 - DNA, 25 bp, Mus musculus
ctgaattctggtcatcagacctgtg

SEQ ID NO: 366846 - DNA, 25 bp, Mus musculus
cgtctgtctgtcggttcatcccgca

SEQ ID NO: 366847 - DNA, 25 bp, Mus musculus
tcagacctgtgccaaattgcctcta

SEQ ID NO: 366848 - DNA, 25 bp, Mus musculus
gccaaattgcctctacccataagtg

SEQ ID NO: 366849 - DNA, 25 bp, Mus musculus
cttggtccgtctgccatggcgtgtg

SEQ ID NO: 366850 - DNA, 25 bp, Mus musculus
actccttggtccgtctgccatggcg

SEQ ID NO: 366851 - DNA, 25 bp, Mus musculus
attgcctctacccataagtgccact

SEQ ID NO: 366852 - DNA, 25 bp, Mus musculus
cgccttataaggctgagcggtgacg

SEQ ID NO: 366853 - DNA, 25 bp, Mus musculus
tcggcgtcccgctcgcattgttcgg

SEQ ID NO: 366854 - DNA, 25 bp, Mus musculus
tgagcggtgacgtaacgccccaagg

SEQ ID NO: 366855 - DNA, 25 bp, Mus musculus
cgtcccgctcgcattgttcgggagg

SEQ ID NO: 366856 - DNA, 25 bp, Mus musculus
cccgctcgcattgttcgggaggctc

SEQ ID NO: 366857 - DNA, 25 bp, Mus musculus
ccttataaggctgagcggtgacgta

SEQ ID NO: 366858 - DNA, 25 bp, Mus musculus
cgcgcgccttataaggctgagcggt

SEQ ID NO: 366859 - DNA, 25 bp, Mus musculus
cagagcggcgggcaggttttgcaga

SEQ ID NO: 366860 - DNA, 25 bp, Mus musculus
ccgctcagcttcagagcggcgggca

SEQ ID NO: 366861 - DNA, 25 bp, Mus musculus
caagtgtgtgggtcgcgcccagcac

SEQ ID NO: 366862 - DNA, 25 bp, Mus musculus
gcgcccgcagctcaggtaagcccga

SEQ ID NO: 366863 - DNA, 25 bp, Mus musculus
aggctcccggagagcgcacagccgc

SEQ ID NO: 366864 - DNA, 25 bp, Mus musculus
gctcgcattgttcgggaggctcccg

SEQ ID NO: 366865 - DNA, 25 bp, Mus musculus
taaggctgagcggtgacgtaacgcc

SEQ ID NO: 366866 - DNA, 25 bp, Mus musculus
acacaggctcagacgttcaagatcg

SEQ ID NO: 366867 - DNA, 25 bp, Mus musculus
gccacgactgccacacgcgggtaag

SEQ ID NO: 366868 - DNA, 25 bp, Mus musculus
ggtgtcgccgtttccacacaggctc

SEQ ID NO: 366869 - DNA, 25 bp, Mus musculus
cgtgtgacacggtgttgtccctccc

SEQ ID NO: 366870 - DNA, 25 bp, Mus musculus
tgccacacgcgggtaaggcagctga

SEQ ID NO: 366871 - DNA, 25 bp, Mus musculus
gcgccactggagatgacgtcacaga

SEQ ID NO: 366872 - DNA, 25 bp, Mus musculus
acaaccagatgaaagcaaggcggcc

SEQ ID NO: 366873 - DNA, 25 bp, Mus musculus
gcgctcctgggctcagcttcactgg

SEQ ID NO: 366874 - DNA, 25 bp, Mus musculus
ctcagcttcactggcggcgttagca

SEQ ID NO: 366875 - DNA, 25 bp, Mus musculus
tggcggcgttagcaacgctacacgc

SEQ ID NO: 366876 - DNA, 25 bp, Mus musculus
tagcaacgctacacgcggaaaaacc

SEQ ID NO: 366877 - DNA, 25 bp, Mus musculus
ccggacgcgaactgacaaccagatg

SEQ ID NO: 366878 - DNA, 25 bp, Mus musculus
ccgtgagacccggacgcgaactgac

SEQ ID NO: 366879 - DNA, 25 bp, Mus musculus
ggtccctctcgttccacgtgtgaca

SEQ ID NO: 366880 - DNA, 25 bp, Mus musculus
tcacatgccatgagaacgcgccatg

SEQ ID NO: 366881 - DNA, 25 bp, Mus musculus
tgagaacgcgccatgagaacgtgcc

SEQ ID NO: 366882 - DNA, 25 bp, Mus musculus
tggctcacatgccatgagaacgcgc

SEQ ID NO: 366883 - DNA, 25 bp, Mus musculus
ctcacatgccatgagaacgcgccat

SEQ ID NO: 366884 - DNA, 25 bp, Mus musculus
tgagaacgcgccatgagaacgcgcc

SEQ ID NO: 366885 - DNA, 25 bp, Mus musculus
cgcgccatgagaacgcgccatgaga

SEQ ID NO: 366886 - DNA, 25 bp, Mus musculus
aacgcgccatgagaacgcgccatga

SEQ ID NO: 366887 - DNA, 25 bp, Mus musculus
gagaacgcgccatgagaacgtgccc

SEQ ID NO: 366888 - DNA, 25 bp, Mus musculus
tggctcacatgccatgagaacgtgc

SEQ ID NO: 366889 - DNA, 25 bp, Mus musculus
cacatgccatgagaacgcgccatga

SEQ ID NO: 366890 - DNA, 25 bp, Mus musculus
catggctcacatgccatgagaacgc

SEQ ID NO: 366891 - DNA, 25 bp, Mus musculus
cccatggctcacatgccatgagaac

SEQ ID NO: 366892 - DNA, 25 bp, Mus musculus
cacatgccatgagaacgtgccatga

SEQ ID NO: 366893 - DNA, 25 bp, Mus musculus
tgagaacgtgccatgagaacgtgcc

SEQ ID NO: 366894 - DNA, 25 bp, Mus musculus
ctcattggtctcagcatgaggagga

SEQ ID NO: 366895 - DNA, 25 bp, Mus musculus
attgccgcccgccacgatggcgagc

SEQ ID NO: 366896 - DNA, 25 bp, Mus musculus
cgcgcgcactatgccggcggattgc

SEQ ID NO: 366897 - DNA, 25 bp, Mus musculus
gtgctatcctccgatccgccgcgct

SEQ ID NO: 366898 - DNA, 25 bp, Mus musculus
gcccgcccgagagacggtcggtcta

SEQ ID NO: 366899 - DNA, 25 bp, Mus musculus
tggccgctcattggtctcagcatga

SEQ ID NO: 366900 - DNA, 25 bp, Mus musculus
tggaccagatctggccgctcattgg

SEQ ID NO: 366901 - DNA, 25 bp, Mus musculus
atgattggacggcacggaaggagct

SEQ ID NO: 366902 - DNA, 25 bp, Mus musculus
cgacagagcagacggcgtgatgatt

SEQ ID NO: 366903 - DNA, 25 bp, Mus musculus
ggagctaacaggtcgacagagcaga

SEQ ID NO: 366904 - DNA, 25 bp, Mus musculus
gctttaggagaggagctaacaggtc

SEQ ID NO: 366905 - DNA, 25 bp, Mus musculus
tcccagaggtccagggcgattggca

SEQ ID NO: 366906 - DNA, 25 bp, Mus musculus
acgctcccagaggtccagggcgatt

SEQ ID NO: 366907 - DNA, 25 bp, Mus musculus
cccgagagacggtcggtctacgagc

SEQ ID NO: 366908 - DNA, 25 bp, Mus musculus
cggggtgacaagaacgcgatccctt

SEQ ID NO: 366909 - DNA, 25 bp, Mus musculus
ctccggtgatttagcagaggacgaa

SEQ ID NO: 366910 - DNA, 25 bp, Mus musculus
cagcggttgcagaatcggagtgcct

SEQ ID NO: 366911 - DNA, 25 bp, Mus musculus
gagtgcctgggcagcatcccaaatc

SEQ ID NO: 366912 - DNA, 25 bp, Mus musculus
caaatcccatgctgggtcggggaac

SEQ ID NO: 366913 - DNA, 25 bp, Mus musculus
cagctaagcagacccgcagcgtggc

SEQ ID NO: 366914 - DNA, 25 bp, Mus musculus
ggccagccgcagagttacctgccga

SEQ ID NO: 366915 - DNA, 25 bp, Mus musculus
tacgccgcgggaagctcctccttat

SEQ ID NO: 366916 - DNA, 25 bp, Mus musculus
tcctccttattgctggcgccagatg

SEQ ID NO: 366917 - DNA, 25 bp, Mus musculus
agttcctgccgaaaagtgctgcccg

SEQ ID NO: 366918 - DNA, 25 bp, Mus musculus
tctctggctcctacctttagggcgg

SEQ ID NO: 366919 - DNA, 25 bp, Mus musculus
accagccgcttgctctcgctgggag

SEQ ID NO: 366920 - DNA, 25 bp, Mus musculus
cgtctgcagcatcgggtcccgagca

SEQ ID NO: 366921 - DNA, 25 bp, Mus musculus
agaggcatgcacagggctctccgca

SEQ ID NO: 366922 - DNA, 25 bp, Mus musculus
acacctccaatgcagccctggttgg

SEQ ID NO: 366923 - DNA, 25 bp, Mus musculus
aggccggcgttctcatccagagctc

SEQ ID NO: 366924 - DNA, 25 bp, Mus musculus
tggctcccgtctccaatcggctgtt

SEQ ID NO: 366925 - DNA, 25 bp, Mus musculus
ccaatcggctgtttggttggacaga

SEQ ID NO: 366926 - DNA, 25 bp, Mus musculus
aatggctgcgaaggaaccagtccca

SEQ ID NO: 366927 - DNA, 25 bp, Mus musculus
gatgttcgctcttcagggcgtccga

SEQ ID NO: 366928 - DNA, 25 bp, Mus musculus
cgatcattggccgaagcgagacaca

SEQ ID NO: 366929 - DNA, 25 bp, Mus musculus
agtcggtttatgagcgatcattggc

SEQ ID NO: 366930 - DNA, 25 bp, Mus musculus
ttctagctaaagtggagtcggttta

SEQ ID NO: 366931 - DNA, 25 bp, Mus musculus
gccgggaggagacggacatttcatt

SEQ ID NO: 366932 - DNA, 25 bp, Mus musculus
cgcccgaagactgcggactgcgagt

SEQ ID NO: 366933 - DNA, 25 bp, Mus musculus
gtgactgaaacctccgtgcaacctc

SEQ ID NO: 366934 - DNA, 25 bp, Mus musculus
ggtgctccgtaaattctttgttctc

SEQ ID NO: 366935 - DNA, 25 bp, Mus musculus
caaggcgcgcggtccgtaaaagcgc

SEQ ID NO: 366936 - DNA, 25 bp, Mus musculus
agcaccttcatgtcctcgccggtga

SEQ ID NO: 366937 - DNA, 25 bp, Mus musculus
cagggtgcagtcttatctgctcttt

SEQ ID NO: 366938 - DNA, 25 bp, Mus musculus
tatctgctctttccgggagcggtca

SEQ ID NO: 366939 - DNA, 25 bp, Mus musculus
gcgataggacgggactacagttccc

SEQ ID NO: 366940 - DNA, 25 bp, Mus musculus
agcagctcttccgaactccacgtag

SEQ ID NO: 366941 - DNA, 25 bp, Mus musculus
tctgggtctcaggaccctgggagct

SEQ ID NO: 366942 - DNA, 25 bp, Mus musculus
gacccacctctgtgcgcagggtgca

SEQ ID NO: 366943 - DNA, 25 bp, Mus musculus
tctgcaggatcggatttgcccagtc

SEQ ID NO: 366944 - DNA, 25 bp, Mus musculus
atgtcctcgccggtgaccgagctgc

SEQ ID NO: 366945 - DNA, 25 bp, Mus musculus
gatttgcccagtcccggcgggagat

SEQ ID NO: 366946 - DNA, 25 bp, Mus musculus
gtgctgggcgactatgctcagctgc

SEQ ID NO: 366947 - DNA, 25 bp, Mus musculus
tctgccagctgcctggcacggctgg

SEQ ID NO: 366948 - DNA, 25 bp, Mus musculus
agccgccgcctttgggcacgtgcag

SEQ ID NO: 366949 - DNA, 25 bp, Mus musculus
tccacgtagcagtgctggggagtct

SEQ ID NO: 366950 - DNA, 25 bp, Mus musculus
taggtgtgacgactacttctttata

SEQ ID NO: 366951 - DNA, 25 bp, Mus musculus
ggaggctttccgcttcgtgaagacg

SEQ ID NO: 366952 - DNA, 25 bp, Mus musculus
ctccaaggaggaggctttccgcttc

SEQ ID NO: 366953 - DNA, 25 bp, Mus musculus
atcttttttgacgatcttgactccc

SEQ ID NO: 366954 - DNA, 25 bp, Mus musculus
cggcggcatcttttttgacgatctt

SEQ ID NO: 366955 - DNA, 25 bp, Mus musculus
cttctttatagttcaccgcggggag

SEQ ID NO: 366956 - DNA, 25 bp, Mus musculus
ctgcccgttctaggtgtgacgacta

SEQ ID NO: 366957 - DNA, 25 bp, Mus musculus
catgctttttctctgctgcccgttc

SEQ ID NO: 366958 - DNA, 25 bp, Mus musculus
ctcatcttttagtccatgctttttc

SEQ ID NO: 366959 - DNA, 25 bp, Mus musculus
gtcgcacgcatctctcatcttttag

SEQ ID NO: 366960 - DNA, 25 bp, Mus musculus
cggatcgtttcaagtcgcacgcatc

SEQ ID NO: 366961 - DNA, 25 bp, Mus musculus
tgaacccaacggatcgtttcaagtc

SEQ ID NO: 366962 - DNA, 25 bp, Mus musculus
gagcgggcgttgaacccaacggatc

SEQ ID NO: 366963 - DNA, 25 bp, Mus musculus
gggcatcggcggcatcttttttgac

SEQ ID NO: 366964 - DNA, 25 bp, Mus musculus
cagggaagtacgtcagaggaggcgc

SEQ ID NO: 366965 - DNA, 25 bp, Mus musculus
gcagcttccagaacccggcctttaa

SEQ ID NO: 366966 - DNA, 25 bp, Mus musculus
ccgcccgcccatgccaggccctgct

SEQ ID NO: 366967 - DNA, 25 bp, Mus musculus
tgcgctaggcgcagcttccagaacc

SEQ ID NO: 366968 - DNA, 25 bp, Mus musculus
gtgactgcgctaggcgcagcttcca

SEQ ID NO: 366969 - DNA, 25 bp, Mus musculus
ccctgctgtgcggcccagggtgact

SEQ ID NO: 366970 - DNA, 25 bp, Mus musculus
gctaggcgcagcttccagaacccgg

SEQ ID NO: 366971 - DNA, 25 bp, Mus musculus
aagggctccttgctggcgcggccag

SEQ ID NO: 366972 - DNA, 25 bp, Mus musculus
cggctcgcgacctggggaaagggct

SEQ ID NO: 366973 - DNA, 25 bp, Mus musculus
agagtagggtgctgtggtcggagct

SEQ ID NO: 366974 - DNA, 25 bp, Mus musculus
ctctgcagggaagtacgtcagagga

SEQ ID NO: 366975 - DNA, 25 bp, Mus musculus
cccagggccgctttggcccggcctg

SEQ ID NO: 366976 - DNA, 25 bp, Mus musculus
cagcttccagaacccggcctttaag

SEQ ID NO: 366977 - DNA, 25 bp, Mus musculus
aagccggtggagtgagaggatgggc

SEQ ID NO: 366978 - DNA, 25 bp, Mus musculus
gcacacgccggcgagctagagccag

SEQ ID NO: 366979 - DNA, 25 bp, Mus musculus
tggccacgtgcaccgccggactggt

SEQ ID NO: 366980 - DNA, 25 bp, Mus musculus
cctaactggtgagccgggtggctga

SEQ ID NO: 366981 - DNA, 25 bp, Mus musculus
tcaggctgagaagtgcagctctgga

SEQ ID NO: 366982 - DNA, 25 bp, Mus musculus
acgcaacaggccgtgccggtgcagc

SEQ ID NO: 366983 - DNA, 25 bp, Mus musculus
ctgggtcaacttgcggaagacacgc

SEQ ID NO: 366984 - DNA, 25 bp, Mus musculus
gccttagctgggtcaacttgcggaa

SEQ ID NO: 366985 - DNA, 25 bp, Mus musculus
tccatgccttagctgggtcaacttg

SEQ ID NO: 366986 - DNA, 25 bp, Mus musculus
gcccttccatgccttagctgggtca

SEQ ID NO: 366987 - DNA, 25 bp, Mus musculus
tgaccacgccgtcgcgcccttccat

SEQ ID NO: 366988 - DNA, 25 bp, Mus musculus
cccgccctggacgtgaccacgccgt

SEQ ID NO: 366989 - DNA, 25 bp, Mus musculus
gactgtcgcccagctcgggacttgg

SEQ ID NO: 366990 - DNA, 25 bp, Mus musculus
cacgccggcgagctagagccaggct

SEQ ID NO: 366991 - DNA, 25 bp, Mus musculus
ttgcggaagacacgcaacaggccgt

SEQ ID NO: 366992 - DNA, 25 bp, Mus musculus
ggccgcggatcagaatccggacctg

SEQ ID NO: 366993 - DNA, 25 bp, Mus musculus
aagcccgctggacggatgcttggga

SEQ ID NO: 366994 - DNA, 25 bp, Mus musculus
tgtgcgaattgacattcggggctgc

SEQ ID NO: 366995 - DNA, 25 bp, Mus musculus
cgaattgacattcggggctgcctgt

SEQ ID NO: 366996 - DNA, 25 bp, Mus musculus
gctgcctgtggcaggcgagccgccg

SEQ ID NO: 366997 - DNA, 25 bp, Mus musculus
agccgctgtccaacgttagctcaga

SEQ ID NO: 366998 - DNA, 25 bp, Mus musculus
cgcggatcagaatccggacctggcg

SEQ ID NO: 366999 - DNA, 25 bp, Mus musculus
ccgctgtccaacgttagctcagaga

SEQ ID NO: 367000 - DNA, 25 bp, Mus musculus
cgctgtccaacgttagctcagagaa

SEQ ID NO: 367001 - DNA, 25 bp, Mus musculus
tgtccaacgttagctcagagaaggt

SEQ ID NO: 367002 - DNA, 25 bp, Mus musculus
tccaacgttagctcagagaaggtgg

SEQ ID NO: 367003 - DNA, 25 bp, Mus musculus
caacgttagctcagagaaggtggcg

SEQ ID NO: 367004 - DNA, 25 bp, Mus musculus
cgtgtgcacctctggggccgcggat

SEQ ID NO: 367005 - DNA, 25 bp, Mus musculus
gagcatcccgaagcccgctggacgg

SEQ ID NO: 367006 - DNA, 25 bp, Mus musculus
agccctggctcgctgagcgcagcga

SEQ ID NO: 367007 - DNA, 25 bp, Mus musculus
aggggcgcgagattccctcggcagc

SEQ ID NO: 367008 - DNA, 25 bp, Mus musculus
cagcttcagagcctcccggagtgga

SEQ ID NO: 367009 - DNA, 25 bp, Mus musculus
ccagatctaagccacccagggcggg

SEQ ID NO: 367010 - DNA, 25 bp, Mus musculus
atctaagccacccagggcgggaccg

SEQ ID NO: 367011 - DNA, 25 bp, Mus musculus
ccgcggctcccacctggctgcactc

SEQ ID NO: 367012 - DNA, 25 bp, Mus musculus
acctggctgcactccggctcactcc

SEQ ID NO: 367013 - DNA, 25 bp, Mus musculus
ctgtcggccacagcgtgcagatccg

SEQ ID NO: 367014 - DNA, 25 bp, Mus musculus
aagaaccgagagaagctgtgccagg

SEQ ID NO: 367015 - DNA, 25 bp, Mus musculus
tcgctgagcgcagcgagagtcggcc

SEQ ID NO: 367016 - DNA, 25 bp, Mus musculus
cagcccggccggcacgagcgctccc

SEQ ID NO: 367017 - DNA, 25 bp, Mus musculus
gccagtggccgcgaccgccctgtcg

SEQ ID NO: 367018 - DNA, 25 bp, Mus musculus
gccctgtcggccacagcgtgcagat

SEQ ID NO: 367019 - DNA, 25 bp, Mus musculus
tcccgagaagggttccgcggagcga

SEQ ID NO: 367020 - DNA, 25 bp, Mus musculus
gcgcatcgctggttgctggcctccg

SEQ ID NO: 367021 - DNA, 25 bp, Mus musculus
gcgttcccttggcaacgggagcttc

SEQ ID NO: 367022 - DNA, 25 bp, Mus musculus
gcaacgggagcttcttccggtccca

SEQ ID NO: 367023 - DNA, 25 bp, Mus musculus
taggtgtccgcccacaggttctcct

SEQ ID NO: 367024 - DNA, 25 bp, Mus musculus
acaggttctcctttctgcggctgga

SEQ ID NO: 367025 - DNA, 25 bp, Mus musculus
ttaatggcctgattcccgcagagga

SEQ ID NO: 367026 - DNA, 25 bp, Mus musculus
ccgcagaggaactctgttagcgaga

SEQ ID NO: 367027 - DNA, 25 bp, Mus musculus
ctctgttagcgagagtgtgagcacg

SEQ ID NO: 367028 - DNA, 25 bp, Mus musculus
aagacacggggagccgccactgcat

SEQ ID NO: 367029 - DNA, 25 bp, Mus musculus
tagctcccgtgctgctgggacgcaa

SEQ ID NO: 367030 - DNA, 25 bp, Mus musculus
ttctggttagcgcttttggccggac

SEQ ID NO: 367031 - DNA, 25 bp, Mus musculus
tggccggactgccatatctgtgggt

SEQ ID NO: 367032 - DNA, 25 bp, Mus musculus
tggcaatgttttggcttgaccgccc

SEQ ID NO: 367033 - DNA, 25 bp, Mus musculus
ccactgcattgggagccgagtggta

SEQ ID NO: 367034 - DNA, 25 bp, Mus musculus
ctgggagcagcccaaggtctgagca

SEQ ID NO: 367035 - DNA, 25 bp, Mus musculus
caataccctgtctcccaggtccggg

SEQ ID NO: 367036 - DNA, 25 bp, Mus musculus
ggtgcgctctccttgctccggatgc

SEQ ID NO: 367037 - DNA, 25 bp, Mus musculus
cgtggtcaagtccaaggcagcccgc

SEQ ID NO: 367038 - DNA, 25 bp, Mus musculus
gtccgggctctcctaagccggttca

SEQ ID NO: 367039 - DNA, 25 bp, Mus musculus
gttgccacctgcagtctccaagctg

SEQ ID NO: 367040 - DNA, 25 bp, Mus musculus
cactggctacttacttggtgggacc

SEQ ID NO: 367041 - DNA, 25 bp, Mus musculus
ctgatgggaagtggtgttgccacct

SEQ ID NO: 367042 - DNA, 25 bp, Mus musculus
tcccgtctgacagcagctgtggctc

SEQ ID NO: 367043 - DNA, 25 bp, Mus musculus
agccgagcgatctcccgtctgacag

SEQ ID NO: 367044 - DNA, 25 bp, Mus musculus
caaggtctgagcagtgcgtggtcaa

SEQ ID NO: 367045 - DNA, 25 bp, Mus musculus
ctcggtggagccgagcgatctcccg

SEQ ID NO: 367046 - DNA, 25 bp, Mus musculus
agtctccaagctgtcgccctgctgc

SEQ ID NO: 367047 - DNA, 25 bp, Mus musculus
agccggttcactggctacttacttg

SEQ ID NO: 367048 - DNA, 25 bp, Mus musculus
cgcgggagactcaggtcctgcaaga

SEQ ID NO: 367049 - DNA, 25 bp, Mus musculus
gcagtgacaatgtcgccggcccgcg

SEQ ID NO: 367050 - DNA, 25 bp, Mus musculus
agcagcaccaggaacacactcagca

SEQ ID NO: 367051 - DNA, 25 bp, Mus musculus
acactcagcacggttccgggctgtg

SEQ ID NO: 367052 - DNA, 25 bp, Mus musculus
agagcctcacccgagtcagcatggt

SEQ ID NO: 367053 - DNA, 25 bp, Mus musculus
tgagctcgccaactacgggtctccg

SEQ ID NO: 367054 - DNA, 25 bp, Mus musculus
ctccgctagagttcgcgcggggtaa

SEQ ID NO: 367055 - DNA, 25 bp, Mus musculus
gtaacacgaagaaacgccatacttc

SEQ ID NO: 367056 - DNA, 25 bp, Mus musculus
ccatacttccgggtcctgcgaggag

SEQ ID NO: 367057 - DNA, 25 bp, Mus musculus
tcgcagttcctgtttccggtctcgc

SEQ ID NO: 367058 - DNA, 25 bp, Mus musculus
tgtagacaaaaatctcgcgggagac

SEQ ID NO: 367059 - DNA, 25 bp, Mus musculus
ctgcaagaggcggagccaaagctct

SEQ ID NO: 367060 - DNA, 25 bp, Mus musculus
gccaaagctctctggggactccgga

SEQ ID NO: 367061 - DNA, 25 bp, Mus musculus
ccggtctcgcgagattgtagacaaa

SEQ ID NO: 367062 - DNA, 25 bp, Mus musculus
gcagcagttggccatcagactgaac

SEQ ID NO: 367063 - DNA, 25 bp, Mus musculus
ctcccgccaccgcttgaacaagttg

SEQ ID NO: 367064 - DNA, 25 bp, Mus musculus
ccgggcttctgagcggccgaagact

SEQ ID NO: 367065 - DNA, 25 bp, Mus musculus
tcagactgaacatcccaggtctctc

SEQ ID NO: 367066 - DNA, 25 bp, Mus musculus
ggcctcaggcgtccctagtgtggac

SEQ ID NO: 367067 - DNA, 25 bp, Mus musculus
ggcctgcgccctagcctacctgaca

SEQ ID NO: 367068 - DNA, 25 bp, Mus musculus
tgagcggccgaagactccttgctcc

SEQ ID NO: 367069 - DNA, 25 bp, Mus musculus
gcagaactacgtcccgggcttctga

SEQ ID NO: 367070 - DNA, 25 bp, Mus musculus
atcagaggctgcagaactacgtccc

SEQ ID NO: 367071 - DNA, 25 bp, Mus musculus
cgcttctccaatcagaggctgcaga

SEQ ID NO: 367072 - DNA, 25 bp, Mus musculus
taccacacgcttctccaatcagagg

SEQ ID NO: 367073 - DNA, 25 bp, Mus musculus
gctgacgttcccgaagctcggaaga

SEQ ID NO: 367074 - DNA, 25 bp, Mus musculus
actggctcaggaacacaggagcggc

SEQ ID NO: 367075 - DNA, 25 bp, Mus musculus
ggacagcccgaacactggctcagga

SEQ ID NO: 367076 - DNA, 25 bp, Mus musculus
aagctctgtgtcagcgtggagctga

SEQ ID NO: 367077 - DNA, 25 bp, Mus musculus
aggagctctcactttgcggggacaa

SEQ ID NO: 367078 - DNA, 25 bp, Mus musculus
ttgtacggtccaattaggagctctc

SEQ ID NO: 367079 - DNA, 25 bp, Mus musculus
ccttgttcatgtaagctctgtgtca

SEQ ID NO: 367080 - DNA, 25 bp, Mus musculus
ggtggtttcaccttccttgttcatg

SEQ ID NO: 367081 - DNA, 25 bp, Mus musculus
cgagaagagctggtggtttcacctt

SEQ ID NO: 367082 - DNA, 25 bp, Mus musculus
ctcagtttgcttccgtcaggcctcg

SEQ ID NO: 367083 - DNA, 25 bp, Mus musculus
cccgcagctctttatcctcagtttg

SEQ ID NO: 367084 - DNA, 25 bp, Mus musculus
agccactaggaacccgcagctcttt

SEQ ID NO: 367085 - DNA, 25 bp, Mus musculus
ttccgagcagcgaggatgttgtacg

SEQ ID NO: 367086 - DNA, 25 bp, Mus musculus
cggggactggatttttgctttgtca

SEQ ID NO: 367087 - DNA, 25 bp, Mus musculus
tggcttcccggagccactaggaacc

SEQ ID NO: 367088 - DNA, 25 bp, Mus musculus
cctactaagagcagggcgtggcttc

SEQ ID NO: 367089 - DNA, 25 bp, Mus musculus
tgtcattctgacacgggcagttcgc

SEQ ID NO: 367090 - DNA, 25 bp, Mus musculus
cctctcagcaatgagggtcctgagc

SEQ ID NO: 367091 - DNA, 25 bp, Mus musculus
cagcaatgagggtcctgagcgcacg

SEQ ID NO: 367092 - DNA, 25 bp, Mus musculus
tcagcaatgagggtcctgagcgcac

SEQ ID NO: 367093 - DNA, 25 bp, Mus musculus
tctcagcaatgagggtcctgagcgc

SEQ ID NO: 367094 - DNA, 25 bp, Mus musculus
tccaggaaatgtcccagtcaccgct

SEQ ID NO: 367095 - DNA, 25 bp, Mus musculus
atcctctcagcaatgagggtcctga

SEQ ID NO: 367096 - DNA, 25 bp, Mus musculus
ccatcctctcagcaatgagggtcct

SEQ ID NO: 367097 - DNA, 25 bp, Mus musculus
ggccatcctctcagcaatgagggtc

SEQ ID NO: 367098 - DNA, 25 bp, Mus musculus
ccggccatcctctcagcaatgaggg

SEQ ID NO: 367099 - DNA, 25 bp, Mus musculus
gccgccctagcgcaggcacggtccc

SEQ ID NO: 367100 - DNA, 25 bp, Mus musculus
gctgggccgcggcagagctgggaga

SEQ ID NO: 367101 - DNA, 25 bp, Mus musculus
aggaaatgtcccagtcaccgcttcc

SEQ ID NO: 367102 - DNA, 25 bp, Mus musculus
caggaaatgtcccagtcaccgcttc

SEQ ID NO: 367103 - DNA, 25 bp, Mus musculus
ttccaggaaatgtcccagtcaccgc

SEQ ID NO: 367104 - DNA, 25 bp, Mus musculus
tccatcgttccatggccatccgggc

SEQ ID NO: 367105 - DNA, 25 bp, Mus musculus
aacagtcagaggagttctgctccca

SEQ ID NO: 367106 - DNA, 25 bp, Mus musculus
atgcttgctagcttccttcctaagg

SEQ ID NO: 367107 - DNA, 25 bp, Mus musculus
cgcgttggttgcaagatgcttgcta

SEQ ID NO: 367108 - DNA, 25 bp, Mus musculus
tagcagctcctaggctgcaggcaga

SEQ ID NO: 367109 - DNA, 25 bp, Mus musculus
cgcagagaggcggtagcagctccta

SEQ ID NO: 367110 - DNA, 25 bp, Mus musculus
ctcccaggagctcttcggctgctgt

SEQ ID NO: 367111 - DNA, 25 bp, Mus musculus
ctcttcggctgctgtgggcgcagtc

SEQ ID NO: 367112 - DNA, 25 bp, Mus musculus
agtcgtccagaggagccggcacaga

SEQ ID NO: 367113 - DNA, 25 bp, Mus musculus
cacagagcgagccatgggatgccag

SEQ ID NO: 367114 - DNA, 25 bp, Mus musculus
ccgcgctccagcactgacttcggta

SEQ ID NO: 367115 - DNA, 25 bp, Mus musculus
catgggatgccaggtgcccaaagca

SEQ ID NO: 367116 - DNA, 25 bp, Mus musculus
agaggagttctgctcccaggagctc

SEQ ID NO: 367117 - DNA, 25 bp, Mus musculus
ttccttcctaaggaaacagtcagag

SEQ ID NO: 367118 - DNA, 25 bp, Mus musculus
agtctggctgcctttctgcgaaccc

SEQ ID NO: 367119 - DNA, 25 bp, Mus musculus
gtgggctcagttctccggagcagct

SEQ ID NO: 367120 - DNA, 25 bp, Mus musculus
aatccatgttgctggtgcaccgggc

SEQ ID NO: 367121 - DNA, 25 bp, Mus musculus
ccgggcagtgagaggagcatatctc

SEQ ID NO: 367122 - DNA, 25 bp, Mus musculus
ctccgcgaagcataccactgatgtg

SEQ ID NO: 367123 - DNA, 25 bp, Mus musculus
cgctctgattgctggagaagttacc

SEQ ID NO: 367124 - DNA, 25 bp, Mus musculus
agaagttaccatgctccgctcgcag

SEQ ID NO: 367125 - DNA, 25 bp, Mus musculus
tccgttccacggagctgcggaagaa

SEQ ID NO: 367126 - DNA, 25 bp, Mus musculus
gtcaagtttgacactggagataagg

SEQ ID NO: 367127 - DNA, 25 bp, Mus musculus
tcttgggagccattccgttttcacg

SEQ ID NO: 367128 - DNA, 25 bp, Mus musculus
ctcggggacttctctgggtcctagt

SEQ ID NO: 367129 - DNA, 25 bp, Mus musculus
cctggcttaccttcgttggaaggct

SEQ ID NO: 367130 - DNA, 25 bp, Mus musculus
ccagaagatgtgctgggacagcgac

SEQ ID NO: 367131 - DNA, 25 bp, Mus musculus
gctcgcagtctgatgtcaagtttga

SEQ ID NO: 367132 - DNA, 25 bp, Mus musculus
gctgcagagctgtgcagcgccaacc

SEQ ID NO: 367133 - DNA, 25 bp, Mus musculus
gacaccggaagtgccttttcaatcc

SEQ ID NO: 367134 - DNA, 25 bp, Mus musculus
cgccttggcaacagacaccggaagt

SEQ ID NO: 367135 - DNA, 25 bp, Mus musculus
tccgcaaaagtttgcccagccggta

SEQ ID NO: 367136 - DNA, 25 bp, Mus musculus
cgggtccgcatgtccgcaaaagttt

SEQ ID NO: 367137 - DNA, 25 bp, Mus musculus
ggcgcctaccttggcggtccacagg

SEQ ID NO: 367138 - DNA, 25 bp, Mus musculus
ccacaggctgcaccaggcggttggt

SEQ ID NO: 367139 - DNA, 25 bp, Mus musculus
acggtgtcgcaaagggccatgatct

SEQ ID NO: 367140 - DNA, 25 bp, Mus musculus
catgatctcgtcgttgtccagcagg

SEQ ID NO: 367141 - DNA, 25 bp, Mus musculus
ccagcaggccgagtaggtttcggca

SEQ ID NO: 367142 - DNA, 25 bp, Mus musculus
agtaggtttcggcagccctccgact

SEQ ID NO: 367143 - DNA, 25 bp, Mus musculus
gccctccgactctaagtggctgagc

SEQ ID NO: 367144 - DNA, 25 bp, Mus musculus
agaggacgacgccaccagtgtcgcc

SEQ ID NO: 367145 - DNA, 25 bp, Mus musculus
ttttcaatccctcgcaagcgccgga

SEQ ID NO: 367146 - DNA, 25 bp, Mus musculus
aatggccacgagctcttctccgagg

SEQ ID NO: 367147 - DNA, 25 bp, Mus musculus
tcctacggtcccgaagagctgggaa

SEQ ID NO: 367148 - DNA, 25 bp, Mus musculus
ttccttcctggcgagggctcgtgca

SEQ ID NO: 367149 - DNA, 25 bp, Mus musculus
agcggcggccgcaacgggatctcct

SEQ ID NO: 367150 - DNA, 25 bp, Mus musculus
cggttgctgaggaccgcctacgagc

SEQ ID NO: 367151 - DNA, 25 bp, Mus musculus
tggtccacactactcggcggttgct

SEQ ID NO: 367152 - DNA, 25 bp, Mus musculus
caggcctgccatctgttggtccaca

SEQ ID NO: 367153 - DNA, 25 bp, Mus musculus
actagccgtctgtttgccaggcctg

SEQ ID NO: 367154 - DNA, 25 bp, Mus musculus
tcctattggttacactagccgtctg

SEQ ID NO: 367155 - DNA, 25 bp, Mus musculus
tggaggaaggacaccgccaatcata

SEQ ID NO: 367156 - DNA, 25 bp, Mus musculus
agggctactcgcctgggctctactt

SEQ ID NO: 367157 - DNA, 25 bp, Mus musculus
ttctccgaggcgctcggcctcttgg

SEQ ID NO: 367158 - DNA, 25 bp, Mus musculus
ggggactccacaatggccacgagct

SEQ ID NO: 367159 - DNA, 25 bp, Mus musculus
aggctgtctagacgtccggcggccc

SEQ ID NO: 367160 - DNA, 25 bp, Mus musculus
ttacgcgatcccacccgcacgtgct

SEQ ID NO: 367161 - DNA, 25 bp, Mus musculus
ttcagccggcgtctatcttcgcttc

SEQ ID NO: 367162 - DNA, 25 bp, Mus musculus
atgatgtaccagaagtcggtgccga

SEQ ID NO: 367163 - DNA, 25 bp, Mus musculus
aggcgcacccgcatctcccagcgtt

SEQ ID NO: 367164 - DNA, 25 bp, Mus musculus
ccgtctgttcgctgcactccagatt

SEQ ID NO: 367165 - DNA, 25 bp, Mus musculus
tgcactccagattctccagcgtgga

SEQ ID NO: 367166 - DNA, 25 bp, Mus musculus
agattctccagcgtggatctctggc

SEQ ID NO: 367167 - DNA, 25 bp, Mus musculus
tggatctctggctccacttacgcga

SEQ ID NO: 367168 - DNA, 25 bp, Mus musculus
gtgctccggcccaaatcagtgtcct

SEQ ID NO: 367169 - DNA, 25 bp, Mus musculus
agtgtcctcagggatccctgtcctc

SEQ ID NO: 367170 - DNA, 25 bp, Mus musculus
ctcccgggtccgactagcacaggtg

SEQ ID NO: 367171 - DNA, 25 bp, Mus musculus
gcccaaatcagtgtcctcagggatc

SEQ ID NO: 367172 - DNA, 25 bp, Mus musculus
cgttccagcgtctcctcctttctgg

SEQ ID NO: 367173 - DNA, 25 bp, Mus musculus
gtccgactagcacaggtgccacctg

SEQ ID NO: 367174 - DNA, 25 bp, Mus musculus
gttccagacgccagtccactcgagg

SEQ ID NO: 367175 - DNA, 25 bp, Mus musculus
cgccgcggtcgttctctggcgacaa

SEQ ID NO: 367176 - DNA, 25 bp, Mus musculus
gttctctggcgacaacagcgcgtcc

SEQ ID NO: 367177 - DNA, 25 bp, Mus musculus
aacagcgcgtcccggctgctcttgg

SEQ ID NO: 367178 - DNA, 25 bp, Mus musculus
gcgagctgaatgcgcgctgcagctt

SEQ ID NO: 367179 - DNA, 25 bp, Mus musculus
gctctagggcgggttccagacgcca

SEQ ID NO: 367180 - DNA, 25 bp, Mus musculus
agacgccagtccactcgagggccga

SEQ ID NO: 367181 - DNA, 25 bp, Mus musculus
taaggggctctggtccctagcccgc

SEQ ID NO: 367182 - DNA, 25 bp, Mus musculus
cgctgcagcttggggcgcagctcta

SEQ ID NO: 367183 - DNA, 25 bp, Mus musculus
cgcgtactcaccagagcgaagctaa

SEQ ID NO: 367184 - DNA, 25 bp, Mus musculus
gggcagcctcgcgtactcaccagag

SEQ ID NO: 367185 - DNA, 25 bp, Mus musculus
ctccgggccggaccatcccgtgcct

SEQ ID NO: 367186 - DNA, 25 bp, Mus musculus
tcaccagagcgaagctaaggggctc

SEQ ID NO: 367187 - DNA, 25 bp, Mus musculus
ggtgcccagggcagcctcgcgtact

SEQ ID NO: 367188 - DNA, 25 bp, Mus musculus
caccgtccacagtcttcttcttgaa

SEQ ID NO: 367189 - DNA, 25 bp, Mus musculus
gacacttttttggagaagtcacttc

SEQ ID NO: 367190 - DNA, 25 bp, Mus musculus
atgtgaccgggaactaagacacttt

SEQ ID NO: 367191 - DNA, 25 bp, Mus musculus
aacgcgtcctgggtgctcatgtgac

SEQ ID NO: 367192 - DNA, 25 bp, Mus musculus
gtggctccgcgaggctcccgagaac

SEQ ID NO: 367193 - DNA, 25 bp, Mus musculus
ggtctccaagctcgacctgcggcgg

SEQ ID NO: 367194 - DNA, 25 bp, Mus musculus
tagaaggacggatcccggagaagcc

SEQ ID NO: 367195 - DNA, 25 bp, Mus musculus
gaagtcacttctatgcggcgcgtgc

SEQ ID NO: 367196 - DNA, 25 bp, Mus musculus
ggacagcacccgatccgaggccgga

SEQ ID NO: 367197 - DNA, 25 bp, Mus musculus
gtcacgcagccatggtcacctgtgg

SEQ ID NO: 367198 - DNA, 25 bp, Mus musculus
taagccagtggagccggagtcacgc

SEQ ID NO: 367199 - DNA, 25 bp, Mus musculus
tcttcttgaagagggaggccatggt

SEQ ID NO: 367200 - DNA, 25 bp, Mus musculus
aggacggggtctccaagctcgacct

SEQ ID NO: 367201 - DNA, 25 bp, Mus musculus
tgcgcagtctgcgagcacgcctgcg

SEQ ID NO: 367202 - DNA, 25 bp, Mus musculus
gcgtcgtcccgtcgctatataagcg

SEQ ID NO: 367203 - DNA, 25 bp, Mus musculus
caccgggtatcggtgtcaggctcat

SEQ ID NO: 367204 - DNA, 25 bp, Mus musculus
cctggccagcaggtgagtcaccagc

SEQ ID NO: 367205 - DNA, 25 bp, Mus musculus
cttagccgcagtagcagctggttca

SEQ ID NO: 367206 - DNA, 25 bp, Mus musculus
tgagcccagcgctgtcatgctcctg

SEQ ID NO: 367207 - DNA, 25 bp, Mus musculus
tacgctcctgtctcggatgcggttg

SEQ ID NO: 367208 - DNA, 25 bp, Mus musculus
ccgctgtggacctgagttgatggaa

SEQ ID NO: 367209 - DNA, 25 bp, Mus musculus
ccctagcccggactgggtagcagct

SEQ ID NO: 367210 - DNA, 25 bp, Mus musculus
cccgggcgtgcattgtgtgtatgca

SEQ ID NO: 367211 - DNA, 25 bp, Mus musculus
cccgcgctagtgataggacgagtcc

SEQ ID NO: 367212 - DNA, 25 bp, Mus musculus
gggctgcaaacttcgctccaatccg

SEQ ID NO: 367213 - DNA, 25 bp, Mus musculus
tttctgataaactgctcctgagagc

SEQ ID NO: 367214 - DNA, 25 bp, Mus musculus
tggtactgcggagtacgctcctgtc

SEQ ID NO: 367215 - DNA, 25 bp, Mus musculus
gttgtgcggaggtgatgtatcaccc

SEQ ID NO: 367216 - DNA, 25 bp, Mus musculus
gtaccgccgctgctgtgttcgaacc

SEQ ID NO: 367217 - DNA, 25 bp, Mus musculus
cggaagctggttgccggcagcaaaa

SEQ ID NO: 367218 - DNA, 25 bp, Mus musculus
cagagcacccgcagaatggggtttc

SEQ ID NO: 367219 - DNA, 25 bp, Mus musculus
accgcgctgcgtttccaaatcatgg

SEQ ID NO: 367220 - DNA, 25 bp, Mus musculus
gattaccttgtaacaggagcccgca

SEQ ID NO: 367221 - DNA, 25 bp, Mus musculus
accacacagtgcaagggctccgctg

SEQ ID NO: 367222 - DNA, 25 bp, Mus musculus
ccaaatcatggtcccttcttttaag

SEQ ID NO: 367223 - DNA, 25 bp, Mus musculus
caaggagatgctggttgagcgaacc

SEQ ID NO: 367224 - DNA, 25 bp, Mus musculus
tcctttcggagctcgaggcaagtcc

SEQ ID NO: 367225 - DNA, 25 bp, Mus musculus
gatctgcccggcaccggtttggacc

SEQ ID NO: 367226 - DNA, 25 bp, Mus musculus
ctgtagaagcggagaaccgcgctgc

SEQ ID NO: 367227 - DNA, 25 bp, Mus musculus
aggagcccgcagacactgtagaagc

SEQ ID NO: 367228 - DNA, 25 bp, Mus musculus
gtttcttctccttctgctgctggtg

SEQ ID NO: 367229 - DNA, 25 bp, Mus musculus
tcggtgggctaaatagtttcttctc

SEQ ID NO: 367230 - DNA, 25 bp, Mus musculus
atggcgtcggcaccagagtttccga

SEQ ID NO: 367231 - DNA, 25 bp, Mus musculus
tagtttctgtcgcaaacagagcgcg

SEQ ID NO: 367232 - DNA, 25 bp, Mus musculus
cagaaccgttggttcgcgggcaaag

SEQ ID NO: 367233 - DNA, 25 bp, Mus musculus
cacggcctccagaaccgttggttcg

SEQ ID NO: 367234 - DNA, 25 bp, Mus musculus
atggacgctcccagttaaccacggc

SEQ ID NO: 367235 - DNA, 25 bp, Mus musculus
gcttaccagatggacgctcccagtt

SEQ ID NO: 367236 - DNA, 25 bp, Mus musculus
aagcctaccacgcttaccagatgga

SEQ ID NO: 367237 - DNA, 25 bp, Mus musculus
gaacgggtcacaaccaagcctacca

SEQ ID NO: 367238 - DNA, 25 bp, Mus musculus
caaagacaagtgtcgcggtggcatc

SEQ ID NO: 367239 - DNA, 25 bp, Mus musculus
tcggcaccagagtttccgaggggaa

SEQ ID NO: 367240 - DNA, 25 bp, Mus musculus
gaagcaatcccagatggcgtcggca

SEQ ID NO: 367241 - DNA, 25 bp, Mus musculus
ccacgacggaaaggaagcaatccca

SEQ ID NO: 367242 - DNA, 25 bp, Mus musculus
cggcaagccacgacggaaaggaagc

SEQ ID NO: 367243 - DNA, 25 bp, Mus musculus
tttttcactgaacgggtcacaacca

SEQ ID NO: 367244 - DNA, 25 bp, Mus musculus
atgcctcggagtctgtccttttcgg

SEQ ID NO: 367245 - DNA, 25 bp, Mus musculus
ggacaccagcgctcgcatgtcagcg

SEQ ID NO: 367246 - DNA, 25 bp, Mus musculus
catgtcagcggctgagatgctcaag

SEQ ID NO: 367247 - DNA, 25 bp, Mus musculus
agatgctcaagtctacggaccctcg

SEQ ID NO: 367248 - DNA, 25 bp, Mus musculus
acggaccctcgcttccagagatcta

SEQ ID NO: 367249 - DNA, 25 bp, Mus musculus
tccagagatctaggtcggagccttc

SEQ ID NO: 367250 - DNA, 25 bp, Mus musculus
gagccttcggcagacagcccggaca

SEQ ID NO: 367251 - DNA, 25 bp, Mus musculus
cccaacaagaacaggagagctcagg

SEQ ID NO: 367252 - DNA, 25 bp, Mus musculus
aaggcctgatgcctcggagtctgtc

SEQ ID NO: 367253 - DNA, 25 bp, Mus musculus
ttttcgggccctcggtacagccgca

SEQ ID NO: 367254 - DNA, 25 bp, Mus musculus
cggccagcagcaggtacagcatgcg

SEQ ID NO: 367255 - DNA, 25 bp, Mus musculus
caggtacagcatgcggaaccgcatc

SEQ ID NO: 367256 - DNA, 25 bp, Mus musculus
atgcggaaccgcatccagagcagcc

SEQ ID NO: 367257 - DNA, 25 bp, Mus musculus
tgggccaagaacgaaggcctgatgc

SEQ ID NO: 367258 - DNA, 25 bp, Mus musculus
ttgggcctcggctactcgggctgct

SEQ ID NO: 367259 - DNA, 25 bp, Mus musculus
actcaacccactcgaccctcttggg

SEQ ID NO: 367260 - DNA, 25 bp, Mus musculus
cgccctgccgctcgcactccactca

SEQ ID NO: 367261 - DNA, 25 bp, Mus musculus
tccgccgctataaagggcaagtccc

SEQ ID NO: 367262 - DNA, 25 bp, Mus musculus
ccgctccgccgctataaagggcaag

SEQ ID NO: 367263 - DNA, 25 bp, Mus musculus
ctcctgcggcaggggaaacaggccc

SEQ ID NO: 367264 - DNA, 25 bp, Mus musculus
gatgctcgtttggagcccgctctgg

SEQ ID NO: 367265 - DNA, 25 bp, Mus musculus
cctcgcacgccaatcatgcggtggg

SEQ ID NO: 367266 - DNA, 25 bp, Mus musculus
ccaatcatgcggtgggcgtggctcc

SEQ ID NO: 367267 - DNA, 25 bp, Mus musculus
ggagttcctgaacttttctgctgca

SEQ ID NO: 367268 - DNA, 25 bp, Mus musculus
tgaacttttctgctgcacgtccgcc

SEQ ID NO: 367269 - DNA, 25 bp, Mus musculus
cctacgtgctgggacaggcagcgct

SEQ ID NO: 367270 - DNA, 25 bp, Mus musculus
ctgaggacgtgtgtcccgggctcac

SEQ ID NO: 367271 - DNA, 25 bp, Mus musculus
agcgctgcagccacgcagcggcttc

SEQ ID NO: 367272 - DNA, 25 bp, Mus musculus
ttgactgcaatctccgccagagggg

SEQ ID NO: 367273 - DNA, 25 bp, Mus musculus
caactttgcaatcgccgcgcagcgg

SEQ ID NO: 367274 - DNA, 25 bp, Mus musculus
ttggggtgcatctcttcctttgctc

SEQ ID NO: 367275 - DNA, 25 bp, Mus musculus
ggtggcctgctactctctggctctc

SEQ ID NO: 367276 - DNA, 25 bp, Mus musculus
cccgtgaacctagagactgttctcc

SEQ ID NO: 367277 - DNA, 25 bp, Mus musculus
ttcgctccctcctggtgcgcagagt

SEQ ID NO: 367278 - DNA, 25 bp, Mus musculus
ccgcatcccgcgagtgatgggaaca

SEQ ID NO: 367279 - DNA, 25 bp, Mus musculus
cagtagaagcaggacccgggacgat

SEQ ID NO: 367280 - DNA, 25 bp, Mus musculus
tccaggagcaaggagtaagactagc

SEQ ID NO: 367281 - DNA, 25 bp, Mus musculus
ggagcagcctctccgaagcttccag

SEQ ID NO: 367282 - DNA, 25 bp, Mus musculus
aacttcagacgctgcaagctcccag

SEQ ID NO: 367283 - DNA, 25 bp, Mus musculus
aggcagcgtgagagcagaaacttca

SEQ ID NO: 367284 - DNA, 25 bp, Mus musculus
cccacgagctgtcgagccgaaagga

SEQ ID NO: 367285 - DNA, 25 bp, Mus musculus
ctccggtagacggaggagcactttt

SEQ ID NO: 367286 - DNA, 25 bp, Mus musculus
gagattctttacgagctgttccttc

SEQ ID NO: 367287 - DNA, 25 bp, Mus musculus
cgagtgcgggaagagattctttacg

SEQ ID NO: 367288 - DNA, 25 bp, Mus musculus
gcggagccgcgcagtaaagcggagc

SEQ ID NO: 367289 - DNA, 25 bp, Mus musculus
caggaccgtgtttgtgggcaattta

SEQ ID NO: 367290 - DNA, 25 bp, Mus musculus
ctgacaggaccgtgtttgtgggcaa

SEQ ID NO: 367291 - DNA, 25 bp, Mus musculus
tttgtgggcaatttagaggcccgag

SEQ ID NO: 367292 - DNA, 25 bp, Mus musculus
ttacgagctgttccttcaggtaccg

SEQ ID NO: 367293 - DNA, 25 bp, Mus musculus
ctgttccttcaggtaccgtccgcgg

SEQ ID NO: 367294 - DNA, 25 bp, Mus musculus
cttccctcgcttaggctcgcaagtg

SEQ ID NO: 367295 - DNA, 25 bp, Mus musculus
ctcgcttaggctcgcaagtgtgcag

SEQ ID NO: 367296 - DNA, 25 bp, Mus musculus
cggctcaggaggaggctgacaggac

SEQ ID NO: 367297 - DNA, 25 bp, Mus musculus
gaccgcagggatgttcccggctcag

SEQ ID NO: 367298 - DNA, 25 bp, Mus musculus
cttaggctcgcaagtgtgcagccgg

SEQ ID NO: 367299 - DNA, 25 bp, Mus musculus
gggcttcggcacctcctccatccct

SEQ ID NO: 367300 - DNA, 25 bp, Mus musculus
gaaatgtagtccgtcggctccgaat

SEQ ID NO: 367301 - DNA, 25 bp, Mus musculus
ccctgagatactgacctaagatcgt

SEQ ID NO: 367302 - DNA, 25 bp, Mus musculus
aagatcgtcatctctccggccatca

SEQ ID NO: 367303 - DNA, 25 bp, Mus musculus
tcagtcccgccgaacaggcagaagg

SEQ ID NO: 367304 - DNA, 25 bp, Mus musculus
gatgactgtaccgatgggaggcacc

SEQ ID NO: 367305 - DNA, 25 bp, Mus musculus
ggctccgaattagccggaggaacta

SEQ ID NO: 367306 - DNA, 25 bp, Mus musculus
gatttccaccacagcaatgactcca

SEQ ID NO: 367307 - DNA, 25 bp, Mus musculus
agcaatgactccatctaccatgagg

SEQ ID NO: 367308 - DNA, 25 bp, Mus musculus
ctccatctaccatgaggccgcgggg

SEQ ID NO: 367309 - DNA, 25 bp, Mus musculus
cggggcggattttactcaggccagt

SEQ ID NO: 367310 - DNA, 25 bp, Mus musculus
ttactcaggccagtgagggaagact

SEQ ID NO: 367311 - DNA, 25 bp, Mus musculus
ccagtgagggaagactcggcctccc

SEQ ID NO: 367312 - DNA, 25 bp, Mus musculus
tcgacttccatagttgcagggaccc

SEQ ID NO: 367313 - DNA, 25 bp, Mus musculus
gccggaggaactacgatttccacca

SEQ ID NO: 367314 - DNA, 25 bp, Mus musculus
ccggtgtttgcaagacaggtctatg

SEQ ID NO: 367315 - DNA, 25 bp, Mus musculus
gtcatctgtaaagctcgggttgtta

SEQ ID NO: 367316 - DNA, 25 bp, Mus musculus
ctctctcgttctggctgtgcccgtt

SEQ ID NO: 367317 - DNA, 25 bp, Mus musculus
tctcaaaactgctcgctctctcgtt

SEQ ID NO: 367318 - DNA, 25 bp, Mus musculus
ccactgctgtcatctgtaaagctcg

SEQ ID NO: 367319 - DNA, 25 bp, Mus musculus
gtacgagctttcgtctccactgctg

SEQ ID NO: 367320 - DNA, 25 bp, Mus musculus
acaggtctatgggaacgcaattgga

SEQ ID NO: 367321 - DNA, 25 bp, Mus musculus
tccggcttttcgatccggtgtttgc

SEQ ID NO: 367322 - DNA, 25 bp, Mus musculus
ggccgctcagcttccggcttttcga

SEQ ID NO: 367323 - DNA, 25 bp, Mus musculus
tcgggttgttatcggagtactcatc

SEQ ID NO: 367324 - DNA, 25 bp, Mus musculus
atcggagtactcatcaatcgtggtg

SEQ ID NO: 367325 - DNA, 25 bp, Mus musculus
ctcatcaatcgtggtgggcgtgcta

SEQ ID NO: 367326 - DNA, 25 bp, Mus musculus
gtgggcgtgctactctcaaaactgc

SEQ ID NO: 367327 - DNA, 25 bp, Mus musculus
cgcaattggagtacgagctttcgtc

SEQ ID NO: 367328 - DNA, 25 bp, Mus musculus
gctgggaactccacaacttggcggc

SEQ ID NO: 367329 - DNA, 25 bp, Mus musculus
cctcccattgtcacccgggccgagc

SEQ ID NO: 367330 - DNA, 25 bp, Mus musculus
ccgcgattgccactcaccgaggccg

SEQ ID NO: 367331 - DNA, 25 bp, Mus musculus
ccattcagctcttcagccaagtttc

SEQ ID NO: 367332 - DNA, 25 bp, Mus musculus
gaactccacaacttggcggctgcgc

SEQ ID NO: 367333 - DNA, 25 bp, Mus musculus
tccttcccaggttagccgtgccctg

SEQ ID NO: 367334 - DNA, 25 bp, Mus musculus
ctcgcgccaaggctggcacggacga

SEQ ID NO: 367335 - DNA, 25 bp, Mus musculus
gtcgcctcccgagttcggggctctg

SEQ ID NO: 367336 - DNA, 25 bp, Mus musculus
cgagttcggggctctgctgcaatgt

SEQ ID NO: 367337 - DNA, 25 bp, Mus musculus
gctgcaatgtctgcgaggctgactt

SEQ ID NO: 367338 - DNA, 25 bp, Mus musculus
aggctgactttgagcgcctcgctcg

SEQ ID NO: 367339 - DNA, 25 bp, Mus musculus
tgggtcccggcgcagaacacccagg

SEQ ID NO: 367340 - DNA, 25 bp, Mus musculus
gctcttcagccaagtttcttaaccc

SEQ ID NO: 367341 - DNA, 25 bp, Mus musculus
tccgctcccgcgagctccgcacgga

SEQ ID NO: 367342 - DNA, 25 bp, Mus musculus
cttcagaccagtgtcatggcgggta

SEQ ID NO: 367343 - DNA, 25 bp, Mus musculus
cacgaccttgaagtctgaaccctca

SEQ ID NO: 367344 - DNA, 25 bp, Mus musculus
tgagagccaagcttacacgaccttg

SEQ ID NO: 367345 - DNA, 25 bp, Mus musculus
gaagtctgaaccctcagcctcagtt

SEQ ID NO: 367346 - DNA, 25 bp, Mus musculus
cccagggagcatcttggctttgaga

SEQ ID NO: 367347 - DNA, 25 bp, Mus musculus
ttccctttctgtatgggacgtctcg

SEQ ID NO: 367348 - DNA, 25 bp, Mus musculus
tatgggacgtctcggtttccgtgct

SEQ ID NO: 367349 - DNA, 25 bp, Mus musculus
gttccgcgtgggacttcagaccagt

SEQ ID NO: 367350 - DNA, 25 bp, Mus musculus
ggcagtcccactctgtctcggatta

SEQ ID NO: 367351 - DNA, 25 bp, Mus musculus
actctgtctcggattaggaagggaa

SEQ ID NO: 367352 - DNA, 25 bp, Mus musculus
cgggttagcgactggcttcttcaga

SEQ ID NO: 367353 - DNA, 25 bp, Mus musculus
ttcagagtgactggccgctaatgga

SEQ ID NO: 367354 - DNA, 25 bp, Mus musculus
caagctgtccgtcatggcggcttcc

SEQ ID NO: 367355 - DNA, 25 bp, Mus musculus
ttccgtgctgggtgaggcagtccca

SEQ ID NO: 367356 - DNA, 25 bp, Mus musculus
ccgctcccgcgggtcacaatgtagg

SEQ ID NO: 367357 - DNA, 25 bp, Mus musculus
ctgcggattgctctcccagaaccga

SEQ ID NO: 367358 - DNA, 25 bp, Mus musculus
cgcgtccactcccttctgcggattg

SEQ ID NO: 367359 - DNA, 25 bp, Mus musculus
tagtgagaggcttcgcgtccactcc

SEQ ID NO: 367360 - DNA, 25 bp, Mus musculus
tgcagtagtgagaggcttcgcgtcc

SEQ ID NO: 367361 - DNA, 25 bp, Mus musculus
agcagaatgtgctgcagcagagcgc

SEQ ID NO: 367362 - DNA, 25 bp, Mus musculus
ccatgaccgtggagcagaatgtgct

SEQ ID NO: 367363 - DNA, 25 bp, Mus musculus
cggtggcgctctccggtagcgtctc

SEQ ID NO: 367364 - DNA, 25 bp, Mus musculus
cccgcgcgctgagaggagcttagac

SEQ ID NO: 367365 - DNA, 25 bp, Mus musculus
ttgatcgtgctctccgtcgcctgcg

SEQ ID NO: 367366 - DNA, 25 bp, Mus musculus
acgcggcccggcttgatcgtgctct

SEQ ID NO: 367367 - DNA, 25 bp, Mus musculus
gcgaagctgagtgcgaacgcgtgac

SEQ ID NO: 367368 - DNA, 25 bp, Mus musculus
tcccgcgggtcacaatgtagggtta

SEQ ID NO: 367369 - DNA, 25 bp, Mus musculus
gattgctctcccagaaccgacggcg

SEQ ID NO: 367370 - DNA, 25 bp, Mus musculus
agccagtcgggagtgtaccaggctc

SEQ ID NO: 367371 - DNA, 25 bp, Mus musculus
gcctactgtgcttcgtgctcttgtg

SEQ ID NO: 367372 - DNA, 25 bp, Mus musculus
accagggctcccagccgagatcgtt

SEQ ID NO: 367373 - DNA, 25 bp, Mus musculus
gccgagatcgtttacctgcaagcca

SEQ ID NO: 367374 - DNA, 25 bp, Mus musculus
ggcagctaccatggcgcgcctactg

SEQ ID NO: 367375 - DNA, 25 bp, Mus musculus
cgccagcccggagaatgcatcggtc

SEQ ID NO: 367376 - DNA, 25 bp, Mus musculus
tatttgagagaagactgagccgttc

SEQ ID NO: 367377 - DNA, 25 bp, Mus musculus
ctggggaccatttggctttatctgc

SEQ ID NO: 367378 - DNA, 25 bp, Mus musculus
tatctgcccttgtctgtttcccgcg

SEQ ID NO: 367379 - DNA, 25 bp, Mus musculus
ccgggctgcgagtttttaggtatcg

SEQ ID NO: 367380 - DNA, 25 bp, Mus musculus
tccaagccggggaggctgaattacc

SEQ ID NO: 367381 - DNA, 25 bp, Mus musculus
ggctgaattaccaacgccattattt

SEQ ID NO: 367382 - DNA, 25 bp, Mus musculus
gaagtgacgcgttcacctgccgagc

SEQ ID NO: 367383 - DNA, 25 bp, Mus musculus
ggcagcttaccctggggaccatttg

SEQ ID NO: 367384 - DNA, 25 bp, Mus musculus
aggtcgcagtgcctcctgcgcgagc

SEQ ID NO: 367385 - DNA, 25 bp, Mus musculus
ccggcgccgcgaagaaccaatccgc

SEQ ID NO: 367386 - DNA, 25 bp, Mus musculus
gccgacagggcgaacgcagtcccga

SEQ ID NO: 367387 - DNA, 25 bp, Mus musculus
aggcctgccctcctcactgccaccg

SEQ ID NO: 367388 - DNA, 25 bp, Mus musculus
acctgtgcaaacaaaccggcttgcc

SEQ ID NO: 367389 - DNA, 25 bp, Mus musculus
gcgccgcgtctaacctgtgcaaaca

SEQ ID NO: 367390 - DNA, 25 bp, Mus musculus
cccagtaacgaaaaagccactcgca

SEQ ID NO: 367391 - DNA, 25 bp, Mus musculus
aacttctccaggtggacgctgccga

SEQ ID NO: 367392 - DNA, 25 bp, Mus musculus
ttctagaaaccacaacttctccagg

SEQ ID NO: 367393 - DNA, 25 bp, Mus musculus
aagccactcgcagtttctagaaacc

SEQ ID NO: 367394 - DNA, 25 bp, Mus musculus
gatccagatgcagccggatcgggct

SEQ ID NO: 367395 - DNA, 25 bp, Mus musculus
ccttctaggagtttctaactttgca

SEQ ID NO: 367396 - DNA, 25 bp, Mus musculus
ggagtttctaactttgcagtctccc

SEQ ID NO: 367397 - DNA, 25 bp, Mus musculus
ccagcgggatccagatgcagccgga

SEQ ID NO: 367398 - DNA, 25 bp, Mus musculus
agtccactggcgagagtgacccagg

SEQ ID NO: 367399 - DNA, 25 bp, Mus musculus
ggaaggctcactgccgctctgcttt

SEQ ID NO: 367400 - DNA, 25 bp, Mus musculus
agcgtctttgtggaccttcgttttg

SEQ ID NO: 367401 - DNA, 25 bp, Mus musculus
tgggacactgcaggctggcgaccca

SEQ ID NO: 367402 - DNA, 25 bp, Mus musculus
tctgctttgtgccacagagggcggc

SEQ ID NO: 367403 - DNA, 25 bp, Mus musculus
ttagccgccatgcagagcttttctg

SEQ ID NO: 367404 - DNA, 25 bp, Mus musculus
ggctgcttaagggtcggagtccact

SEQ ID NO: 367405 - DNA, 25 bp, Mus musculus
acgaggctggtgtttttagccgcca

SEQ ID NO: 367406 - DNA, 25 bp, Mus musculus
ttaatgttaggtggctacgaggctg

SEQ ID NO: 367407 - DNA, 25 bp, Mus musculus
accagaccacgcagtgttaatgtta

SEQ ID NO: 367408 - DNA, 25 bp, Mus musculus
cccggcgcagcgatcaaaaaccaga

SEQ ID NO: 367409 - DNA, 25 bp, Mus musculus
ccaggaagccctgggtgttgcattc

SEQ ID NO: 367410 - DNA, 25 bp, Mus musculus
ttgcccgcggtttcagattccagga

SEQ ID NO: 367411 - DNA, 25 bp, Mus musculus
tggtccagccctgaaggtaggagct

SEQ ID NO: 367412 - DNA, 25 bp, Mus musculus
agactcttcagccacggaccggagg

SEQ ID NO: 367413 - DNA, 25 bp, Mus musculus
atcggctcacgtcggagactcttca

SEQ ID NO: 367414 - DNA, 25 bp, Mus musculus
gcgtctggaggcgtcccgctaactc

SEQ ID NO: 367415 - DNA, 25 bp, Mus musculus
gccacgatccgatccgcactattgt

SEQ ID NO: 367416 - DNA, 25 bp, Mus musculus
ttgccaacttctgggtgagcgtctg

SEQ ID NO: 367417 - DNA, 25 bp, Mus musculus
gctgggacgcggctttgccaacttc

SEQ ID NO: 367418 - DNA, 25 bp, Mus musculus
aaccaacttcgggtcggtcgctgtg

SEQ ID NO: 367419 - DNA, 25 bp, Mus musculus
cgccactcgaggatcgtgggcgtcc

SEQ ID NO: 367420 - DNA, 25 bp, Mus musculus
ccaccctagcgcagggagtgtagcc

SEQ ID NO: 367421 - DNA, 25 bp, Mus musculus
atccgcactattgtttccgccggcg

SEQ ID NO: 367422 - DNA, 25 bp, Mus musculus
ggatccgtctcgtctgtccgtccgt

SEQ ID NO: 367423 - DNA, 25 bp, Mus musculus
ccagagcggctcagagaaggacctc

SEQ ID NO: 367424 - DNA, 25 bp, Mus musculus
gagaaggacctctaccgtccggctc

SEQ ID NO: 367425 - DNA, 25 bp, Mus musculus
cggcctgtcaaccaacttcgggtcg

SEQ ID NO: 367426 - DNA, 25 bp, Mus musculus
ctttaagaataaagcaccgcgcggc

SEQ ID NO: 367427 - DNA, 25 bp, Mus musculus
ttaagaataaagcaccgcgcggcgg

SEQ ID NO: 367428 - DNA, 25 bp, Mus musculus
cgcgcggcgggtcaggaaagtccac

SEQ ID NO: 367429 - DNA, 25 bp, Mus musculus
tcaggaaagtccacggcgcgggtgg

SEQ ID NO: 367430 - DNA, 25 bp, Mus musculus
gaaaggggagcacccggttctcgca

SEQ ID NO: 367431 - DNA, 25 bp, Mus musculus
agcacccggttctcgcagcgctgga

SEQ ID NO: 367432 - DNA, 25 bp, Mus musculus
ccggttctcgcagcgctggactttt

SEQ ID NO: 367433 - DNA, 25 bp, Mus musculus
tctcgcagcgctggactttttttgt

SEQ ID NO: 367434 - DNA, 25 bp, Mus musculus
cttttgcagccggcgctggtcggtt

SEQ ID NO: 367435 - DNA, 25 bp, Mus musculus
cgctggtcggttatgagtcacgagc

SEQ ID NO: 367436 - DNA, 25 bp, Mus musculus
tcggttatgagtcacgagcgggcta

SEQ ID NO: 367437 - DNA, 25 bp, Mus musculus
gtcacgagcgggctataaaagggtc

SEQ ID NO: 367438 - DNA, 25 bp, Mus musculus
ctataaaagggtcgccggtgcgcag

SEQ ID NO: 367439 - DNA, 25 bp, Mus musculus
cctgggaacacggagcgagggcagc

SEQ ID NO: 367440 - DNA, 25 bp, Mus musculus
ggaatctgtgtctcgtccctggatg

SEQ ID NO: 367441 - DNA, 25 bp, Mus musculus
actgcacggagtaaccgggaatctg

SEQ ID NO: 367442 - DNA, 25 bp, Mus musculus
ttccgaatgatctaggcacgactgc

SEQ ID NO: 367443 - DNA, 25 bp, Mus musculus
cgtcctagaactcttttccgaatga

SEQ ID NO: 367444 - DNA, 25 bp, Mus musculus
cgtgttgattttgcaaagaacgtcc

SEQ ID NO: 367445 - DNA, 25 bp, Mus musculus
ggccacgttcctgggctcttggaaa

SEQ ID NO: 367446 - DNA, 25 bp, Mus musculus
caaaagtgagtttcaggtcggctgc

SEQ ID NO: 367447 - DNA, 25 bp, Mus musculus
cagccacgccgggtacaactctaga

SEQ ID NO: 367448 - DNA, 25 bp, Mus musculus
aggactctttgcgttacgtctttga

SEQ ID NO: 367449 - DNA, 25 bp, Mus musculus
gcctttgtctcacgagggttccaga

SEQ ID NO: 367450 - DNA, 25 bp, Mus musculus
gaggagtcacacaggcgcctttgtc

SEQ ID NO: 367451 - DNA, 25 bp, Mus musculus
ctgaggagtcgcagaagtgtctatt

SEQ ID NO: 367452 - DNA, 25 bp, Mus musculus
cggaggttccgtaggactgatcagc

SEQ ID NO: 367453 - DNA, 25 bp, Mus musculus
cttcccgaagtagccaaggtagctc

SEQ ID NO: 367454 - DNA, 25 bp, Mus musculus
agacacaaagcggatcagtctgggg

SEQ ID NO: 367455 - DNA, 25 bp, Mus musculus
agggttctccctcaagaggctagtc

SEQ ID NO: 367456 - DNA, 25 bp, Mus musculus
aagaggctagtcctctgccgccact

SEQ ID NO: 367457 - DNA, 25 bp, Mus musculus
cctctgccgccactcgcttaggacc

SEQ ID NO: 367458 - DNA, 25 bp, Mus musculus
gcttaggaccctgcggacaccgcgt

SEQ ID NO: 367459 - DNA, 25 bp, Mus musculus
ccttcaaaagaaggactgtcccaga

SEQ ID NO: 367460 - DNA, 25 bp, Mus musculus
cgacagtcgctggagacaccccaga

SEQ ID NO: 367461 - DNA, 25 bp, Mus musculus
cgcgggactagacacaaagcggatc

SEQ ID NO: 367462 - DNA, 25 bp, Mus musculus
gaccggagagactgacatcgggaca

SEQ ID NO: 367463 - DNA, 25 bp, Mus musculus
gactgacatcgggacaggacccgcc

SEQ ID NO: 367464 - DNA, 25 bp, Mus musculus
ctcctgcagggggaccctcagctag

SEQ ID NO: 367465 - DNA, 25 bp, Mus musculus
ctcagctaggcagccagctggcgcc

SEQ ID NO: 367466 - DNA, 25 bp, Mus musculus
gacaccacgtcctagggccagaaga

SEQ ID NO: 367467 - DNA, 25 bp, Mus musculus
cgacctgcagggttctccctcaaga

SEQ ID NO: 367468 - DNA, 25 bp, Mus musculus
tacgcatgcgtattctggcctgtcc

SEQ ID NO: 367469 - DNA, 25 bp, Mus musculus
cgcggcttcagtcgttcgacgctca

SEQ ID NO: 367470 - DNA, 25 bp, Mus musculus
tacccgccatcgcaaggcactatgg

SEQ ID NO: 367471 - DNA, 25 bp, Mus musculus
tcaccttgcactgagtcccgagctg

SEQ ID NO: 367472 - DNA, 25 bp, Mus musculus
ggcagccctctctcctcgtgaagaa

SEQ ID NO: 367473 - DNA, 25 bp, Mus musculus
cgcctctaggtgagacagaagccaa

SEQ ID NO: 367474 - DNA, 25 bp, Mus musculus
tgcgactcccatttccgttcgtgga

SEQ ID NO: 367475 - DNA, 25 bp, Mus musculus
tccctcttggagacactgcactgta

SEQ ID NO: 367476 - DNA, 25 bp, Mus musculus
tcaagctcccttcggagtcagcgtc

SEQ ID NO: 367477 - DNA, 25 bp, Mus musculus
tggggttccttagcgccgattccac

SEQ ID NO: 367478 - DNA, 25 bp, Mus musculus
ggaccttaccctgctactcgcggga

SEQ ID NO: 367479 - DNA, 25 bp, Mus musculus
ccgcctctgtgttttgtttccgctg

SEQ ID NO: 367480 - DNA, 25 bp, Mus musculus
ctcaccggacaggaagcgcctcgaa

SEQ ID NO: 367481 - DNA, 25 bp, Mus musculus
aagtgcttccgggtccctcagctaa

SEQ ID NO: 367482 - DNA, 25 bp, Mus musculus
ccatgagtccgatgatggcgccttt

SEQ ID NO: 367483 - DNA, 25 bp, Mus musculus
atagctcagcgaagcgtgagttggt

SEQ ID NO: 367484 - DNA, 25 bp, Mus musculus
atgtagcaaagtttcaggggaccct

SEQ ID NO: 367485 - DNA, 25 bp, Mus musculus
gcctttgttcgaacccacatcttca

SEQ ID NO: 367486 - DNA, 25 bp, Mus musculus
gccgcccaccatgagtccgatgatg

SEQ ID NO: 367487 - DNA, 25 bp, Mus musculus
gaacaccttcgaaaggaagccgaga

SEQ ID NO: 367488 - DNA, 25 bp, Mus musculus
gatgatggcgcctttgttcgaaccc

SEQ ID NO: 367489 - DNA, 25 bp, Mus musculus
aggcaacggatgtagcaaagtttca

SEQ ID NO: 367490 - DNA, 25 bp, Mus musculus
ctgtaagcgcaagaggcaacggatg

SEQ ID NO: 367491 - DNA, 25 bp, Mus musculus
gccgagaaaaaggtctgtaagcgca

SEQ ID NO: 367492 - DNA, 25 bp, Mus musculus
ctccgccatagctcagcgaagcgtg

SEQ ID NO: 367493 - DNA, 25 bp, Mus musculus
catcttcagcaaagaacaccttcga

SEQ ID NO: 367494 - DNA, 25 bp, Mus musculus
cggttgctatgacaacgccgcccac

SEQ ID NO: 367495 - DNA, 25 bp, Mus musculus
gggtccctaggactgagcgtcctcg

SEQ ID NO: 367496 - DNA, 25 bp, Mus musculus
atggtccacacaatcgaacacagcc

SEQ ID NO: 367497 - DNA, 25 bp, Mus musculus
tcggaacttgtcgatgccgcagggc

SEQ ID NO: 367498 - DNA, 25 bp, Mus musculus
ccacagctagaagagtcggacagca

SEQ ID NO: 367499 - DNA, 25 bp, Mus musculus
gacagcagccatggtccacacaatc

SEQ ID NO: 367500 - DNA, 25 bp, Mus musculus
gccatagtcgtgcaagttagtgctc

SEQ ID NO: 367501 - DNA, 25 bp, Mus musculus
cgcagggcagcagcatgccatagtc

SEQ ID NO: 367502 - DNA, 25 bp, Mus musculus
ccaggacaatggaaccgcagcaagg

SEQ ID NO: 367503 - DNA, 25 bp, Mus musculus
gcagaatccacgctgtcgctttcct

SEQ ID NO: 367504 - DNA, 25 bp, Mus musculus
ccgcagcaaggacagtcggactaca

SEQ ID NO: 367505 - DNA, 25 bp, Mus musculus
agtcggactacagccacagcccaga

SEQ ID NO: 367506 - DNA, 25 bp, Mus musculus
cccggacaatcgaaccacagctaga

SEQ ID NO: 367507 - DNA, 25 bp, Mus musculus
ttctcgctgcatgtctacaaaagga

SEQ ID NO: 367508 - DNA, 25 bp, Mus musculus
ggaccgcagccgcagccaggacaat

SEQ ID NO: 367509 - DNA, 25 bp, Mus musculus
ttcctcggccaacgggcagcataca

SEQ ID NO: 367510 - DNA, 25 bp, Mus musculus
cagccaggagcatcggaaggtgatc

SEQ ID NO: 367511 - DNA, 25 bp, Mus musculus
gcagcctgtagatcgcagcccgggc

SEQ ID NO: 367512 - DNA, 25 bp, Mus musculus
atcgcagcctgtagatcgcagcccg

SEQ ID NO: 367513 - DNA, 25 bp, Mus musculus
ccgcggatcgcagcctgtagatcgc

SEQ ID NO: 367514 - DNA, 25 bp, Mus musculus
tcctatccacggaggtcggactctg

SEQ ID NO: 367515 - DNA, 25 bp, Mus musculus
catcggaaggtgatcgcgcaagtcc

SEQ ID NO: 367516 - DNA, 25 bp, Mus musculus
aggtaagtgcgacgcgtctgtacgc

SEQ ID NO: 367517 - DNA, 25 bp, Mus musculus
cgacgcgtctgtacgcgcgtggctc

SEQ ID NO: 367518 - DNA, 25 bp, Mus musculus
ctcattggctgaggcgcaagcaagg

SEQ ID NO: 367519 - DNA, 25 bp, Mus musculus
tgctctcattggctgaggcgcaagc

SEQ ID NO: 367520 - DNA, 25 bp, Mus musculus
ccgggcgcatcctatccacggaggt

SEQ ID NO: 367521 - DNA, 25 bp, Mus musculus
gcccatggcgggtgctctcattggc

SEQ ID NO: 367522 - DNA, 25 bp, Mus musculus
tatccacggaggtcggactctgccc

SEQ ID NO: 367523 - DNA, 25 bp, Mus musculus
gatcgcgcaagtccggcccgcggat

SEQ ID NO: 367524 - DNA, 25 bp, Mus musculus
tcgcagccggcagagtcagctgatc

SEQ ID NO: 367525 - DNA, 25 bp, Mus musculus
aggagcggtctacccgtgacagccc

SEQ ID NO: 367526 - DNA, 25 bp, Mus musculus
gggagacacgaaaatgcacaaagtt

SEQ ID NO: 367527 - DNA, 25 bp, Mus musculus
gccgccgaggaaactgacagagctg

SEQ ID NO: 367528 - DNA, 25 bp, Mus musculus
cgagattcaagctcctcggtgggga

SEQ ID NO: 367529 - DNA, 25 bp, Mus musculus
ccagccctaggctggcacggatatg

SEQ ID NO: 367530 - DNA, 25 bp, Mus musculus
cggagtccagctctcaacgcaggga

SEQ ID NO: 367531 - DNA, 25 bp, Mus musculus
cctcgaactgggtgtctctcgcatc

SEQ ID NO: 367532 - DNA, 25 bp, Mus musculus
gacgctacgctttcggttttccaca

SEQ ID NO: 367533 - DNA, 25 bp, Mus musculus
gggcactgaatcctgagacgctacg

SEQ ID NO: 367534 - DNA, 25 bp, Mus musculus
cggcgatttcctcgcagggcactga

SEQ ID NO: 367535 - DNA, 25 bp, Mus musculus
agcccagcttcgcagtcaagacagg

SEQ ID NO: 367536 - DNA, 25 bp, Mus musculus
ggccgccaggagcaaagcccagctt

SEQ ID NO: 367537 - DNA, 25 bp, Mus musculus
agcatcgtgatcctgcgtgggccac

SEQ ID NO: 367538 - DNA, 25 bp, Mus musculus
tccttgtaggtagaaggcaccacgc

SEQ ID NO: 367539 - DNA, 25 bp, Mus musculus
agggcaggaccagctcctcatcttc

SEQ ID NO: 367540 - DNA, 25 bp, Mus musculus
gatcaccgttcaccgtgccagagta

SEQ ID NO: 367541 - DNA, 25 bp, Mus musculus
agaaaccgctgtccggctgcaactt

SEQ ID NO: 367542 - DNA, 25 bp, Mus musculus
tcagatgtagctgctggccaaaggc

SEQ ID NO: 367543 - DNA, 25 bp, Mus musculus
cccgcgcacatagcagcattgttat

SEQ ID NO: 367544 - DNA, 25 bp, Mus musculus
tagacgtttagacgcgtagagcttc

SEQ ID NO: 367545 - DNA, 25 bp, Mus musculus
agctccgggtcacttagaaagattc

SEQ ID NO: 367546 - DNA, 25 bp, Mus musculus
ttagaaagattctgcactggcgcgc

SEQ ID NO: 367547 - DNA, 25 bp, Mus musculus
ctggcgcgcgggaattttttcattc

SEQ ID NO: 367548 - DNA, 25 bp, Mus musculus
tggccttgcgatagcacctagctcg

SEQ ID NO: 367549 - DNA, 25 bp, Mus musculus
ctgctttctagcgagtgcaaggacc

SEQ ID NO: 367550 - DNA, 25 bp, Mus musculus
gctggctgaatgaagaactcctctc

SEQ ID NO: 367551 - DNA, 25 bp, Mus musculus
ggacttttggctgcatggcaccgca

SEQ ID NO: 367552 - DNA, 25 bp, Mus musculus
accagctgaaacaaccagtctcgtg

SEQ ID NO: 367553 - DNA, 25 bp, Mus musculus
ctgaaacaaccagtctcgtgggact

SEQ ID NO: 367554 - DNA, 25 bp, Mus musculus
ccagtctcgtgggactgagcaagta

SEQ ID NO: 367555 - DNA, 25 bp, Mus musculus
acacacctacgatcccagatgcagt

SEQ ID NO: 367556 - DNA, 25 bp, Mus musculus
gttggactacagactttcccaccag

SEQ ID NO: 367557 - DNA, 25 bp, Mus musculus
gacccacgcataattcggctcatct

SEQ ID NO: 367558 - DNA, 25 bp, Mus musculus
acagctgaccaaccttgggttagtt

SEQ ID NO: 367559 - DNA, 25 bp, Mus musculus
ccatgagctgcagtggctttggcgc

SEQ ID NO: 367560 - DNA, 25 bp, Mus musculus
gattacacacctacgatcccagatg

SEQ ID NO: 367561 - DNA, 25 bp, Mus musculus
ttcagacccacgcataattcggctc

SEQ ID NO: 367562 - DNA, 25 bp, Mus musculus
cgcataattcggctcatctcactag

SEQ ID NO: 367563 - DNA, 25 bp, Mus musculus
ctcgtgggactgagcaagtactaga

SEQ ID NO: 367564 - DNA, 25 bp, Mus musculus
attcacagctgaccaaccttgggtt

SEQ ID NO: 367565 - DNA, 25 bp, Mus musculus
aattcggctcatctcactagctgcc

SEQ ID NO: 367566 - DNA, 25 bp, Mus musculus
gttgtaaatggcctcgctcccgtgt

SEQ ID NO: 367567 - DNA, 25 bp, Mus musculus
gaggcccaacgcagacaagatcttt

SEQ ID NO: 367568 - DNA, 25 bp, Mus musculus
ggcaccggtgccactgtgagaactt

SEQ ID NO: 367569 - DNA, 25 bp, Mus musculus
gaatccgcagcagagagccagcctg

SEQ ID NO: 367570 - DNA, 25 bp, Mus musculus
cacactggcgtgcaaggttgagtca

SEQ ID NO: 367571 - DNA, 25 bp, Mus musculus
cgcgactgagtctagctggatgctt

SEQ ID NO: 367572 - DNA, 25 bp, Mus musculus
cagcctgaggctgcctggttttatc

SEQ ID NO: 367573 - DNA, 25 bp, Mus musculus
cgctgcccggccaagggttgtaaat

SEQ ID NO: 367574 - DNA, 25 bp, Mus musculus
ctttgccaccgccagagtagagttg

SEQ ID NO: 367575 - DNA, 25 bp, Mus musculus
gtcatctctctccaggtccagcagg

SEQ ID NO: 367576 - DNA, 25 bp, Mus musculus
tcctcctgcagtaacgatgctacca

SEQ ID NO: 367577 - DNA, 25 bp, Mus musculus
cgtccacggtgcctctgtagaaaca

SEQ ID NO: 367578 - DNA, 25 bp, Mus musculus
cccgcagaggtcaaagacagctagg

SEQ ID NO: 367579 - DNA, 25 bp, Mus musculus
gtagcagcaacaagggcgcccactc

SEQ ID NO: 367580 - DNA, 25 bp, Mus musculus
gttagagcatcgctcagatgttcct

SEQ ID NO: 367581 - DNA, 25 bp, Mus musculus
cggcctactttctggtgattgacag

SEQ ID NO: 367582 - DNA, 25 bp, Mus musculus
agccttccgcgacgtgtacgagcca

SEQ ID NO: 367583 - DNA, 25 bp, Mus musculus
ctggggttagagcatcgctcagatg

SEQ ID NO: 367584 - DNA, 25 bp, Mus musculus
cgcatgcgcagcaagcctgacgcgt

SEQ ID NO: 367585 - DNA, 25 bp, Mus musculus
tcaacgcccgcccataggaagcgga

SEQ ID NO: 367586 - DNA, 25 bp, Mus musculus
cccacgccgttgtacgggcacgtgg

SEQ ID NO: 367587 - DNA, 25 bp, Mus musculus
acgtgtacgagccagcggaggacac

SEQ ID NO: 367588 - DNA, 25 bp, Mus musculus
ccagcggaggacacgttcctgttac

SEQ ID NO: 367589 - DNA, 25 bp, Mus musculus
aagcctgacgcgtgcgtactcaacg

SEQ ID NO: 367590 - DNA, 25 bp, Mus musculus
ttcctgttactggacgcgctcgagg

SEQ ID NO: 367591 - DNA, 25 bp, Mus musculus
ttgccgccctcctccggaagtggtg

SEQ ID NO: 367592 - DNA, 25 bp, Mus musculus
actttctggtgattgacagcagaga

SEQ ID NO: 367593 - DNA, 25 bp, Mus musculus
ccataggaagcggaagggaaaagat

SEQ ID NO: 367594 - DNA, 25 bp, Mus musculus
ttgggtcccaactcctcgacttgtc

SEQ ID NO: 367595 - DNA, 25 bp, Mus musculus
tctcagtctgcagagccgaagttga

SEQ ID NO: 367596 - DNA, 25 bp, Mus musculus
taagaaaccagcgttgagcccgtgg

SEQ ID NO: 367597 - DNA, 25 bp, Mus musculus
gtggcgtcactgctgaccaataaga

SEQ ID NO: 367598 - DNA, 25 bp, Mus musculus
tccgctgcctgaaacgtaacaaaga

SEQ ID NO: 367599 - DNA, 25 bp, Mus musculus
aggactctgaccatccgctgcctga

SEQ ID NO: 367600 - DNA, 25 bp, Mus musculus
ccctcgcgccggaaggggattcact

SEQ ID NO: 367601 - DNA, 25 bp, Mus musculus
ttagtccgctgcttgttcttcccgc

SEQ ID NO: 367602 - DNA, 25 bp, Mus musculus
ggggctaccatcaccacaggactca

SEQ ID NO: 367603 - DNA, 25 bp, Mus musculus
tgacaccgacctgacaccgggcata

SEQ ID NO: 367604 - DNA, 25 bp, Mus musculus
actgagcgagtgaagcccacgcttg

SEQ ID NO: 367605 - DNA, 25 bp, Mus musculus
ctccgtttcccagatccggcgtgaa

SEQ ID NO: 367606 - DNA, 25 bp, Mus musculus
gcacacaccgggaggtcacactctt

SEQ ID NO: 367607 - DNA, 25 bp, Mus musculus
tgctcactgtcaccgtttcccgatg

SEQ ID NO: 367608 - DNA, 25 bp, Mus musculus
caggaaacaccgaagacggttctga

SEQ ID NO: 367609 - DNA, 25 bp, Mus musculus
ttccgcttagcaagggcatccagtg

SEQ ID NO: 367610 - DNA, 25 bp, Mus musculus
agagaaagggaacggcgcgatcttt

SEQ ID NO: 367611 - DNA, 25 bp, Mus musculus
cggcgcgatctttgaacccttcttg

SEQ ID NO: 367612 - DNA, 25 bp, Mus musculus
tgaacccttcttgcgggaagccagc

SEQ ID NO: 367613 - DNA, 25 bp, Mus musculus
gttctgaccaatgggcggaagtgct

SEQ ID NO: 367614 - DNA, 25 bp, Mus musculus
gcggagccaggaaacaccgaagacg

SEQ ID NO: 367615 - DNA, 25 bp, Mus musculus
gcctgcgcgtgaggacgcaagtccc

SEQ ID NO: 367616 - DNA, 25 bp, Mus musculus
cgcaagtcccggaagcaggaagctc

SEQ ID NO: 367617 - DNA, 25 bp, Mus musculus
aggaagctcctctcttcttgcttag

SEQ ID NO: 367618 - DNA, 25 bp, Mus musculus
tcttcttgcttagcgttcacgtctg

SEQ ID NO: 367619 - DNA, 25 bp, Mus musculus
ggaaacatggccttcattccgctta

SEQ ID NO: 367620 - DNA, 25 bp, Mus musculus
gcggaagtgctgctccagcgaccgc

SEQ ID NO: 367621 - DNA, 25 bp, Mus musculus
ttagcgttcacgtctggagcagcga

SEQ ID NO: 367622 - DNA, 25 bp, Mus musculus
cgggaccgagcattactgttttata

SEQ ID NO: 367623 - DNA, 25 bp, Mus musculus
cagcaggagttgtgatttcagccaa

SEQ ID NO: 367624 - DNA, 25 bp, Mus musculus
gctttccgacattgccttggtggtg

SEQ ID NO: 367625 - DNA, 25 bp, Mus musculus
ggaggccgagccatttcccacaatg

SEQ ID NO: 367626 - DNA, 25 bp, Mus musculus
ccacaatgccgcgttccggaagttg

SEQ ID NO: 367627 - DNA, 25 bp, Mus musculus
tctctctgcgtcacctggaggaagc

SEQ ID NO: 367628 - DNA, 25 bp, Mus musculus
tcatcctcatctactgcgggtgctg

SEQ ID NO: 367629 - DNA, 25 bp, Mus musculus
cccggtgacaccgtgtgcgttgtaa

SEQ ID NO: 367630 - DNA, 25 bp, Mus musculus
ctccgggtgacagcctacgtcgaaa

SEQ ID NO: 367631 - DNA, 25 bp, Mus musculus
gcctacgtcgaaactggagagccac

SEQ ID NO: 367632 - DNA, 25 bp, Mus musculus
agacctgctgacaggggctttccga

SEQ ID NO: 367633 - DNA, 25 bp, Mus musculus
tactgttttatagacgccgttccca

SEQ ID NO: 367634 - DNA, 25 bp, Mus musculus
agagccacgttgtagagagacctgc

SEQ ID NO: 367635 - DNA, 25 bp, Mus musculus
ccaaggtggcaattctcgtctgaaa

SEQ ID NO: 367636 - DNA, 25 bp, Mus musculus
gtccaagttcattaacgcatcgcca

SEQ ID NO: 367637 - DNA, 25 bp, Mus musculus
cgcatcgccagctcgcgttaagggc

SEQ ID NO: 367638 - DNA, 25 bp, Mus musculus
gctgggatgcaaacccgaagccgcc

SEQ ID NO: 367639 - DNA, 25 bp, Mus musculus
ccttgagcatctgggcaaagcccgg

SEQ ID NO: 367640 - DNA, 25 bp, Mus musculus
atccagagcacgcttccctttctag

SEQ ID NO: 367641 - DNA, 25 bp, Mus musculus
cagttccagcgagccggcatccaga

SEQ ID NO: 367642 - DNA, 25 bp, Mus musculus
agaaatgcccaccagttccagcgag

SEQ ID NO: 367643 - DNA, 25 bp, Mus musculus
gaacccagagcgtgcatgctccctt

SEQ ID NO: 367644 - DNA, 25 bp, Mus musculus
agcggacgatcaggccgaacccaga

SEQ ID NO: 367645 - DNA, 25 bp, Mus musculus
ttcccgatcaaagcggacgatcagg

SEQ ID NO: 367646 - DNA, 25 bp, Mus musculus
acagacctgatctgccgattcccga

SEQ ID NO: 367647 - DNA, 25 bp, Mus musculus
ccagaggttccagcagacagacctg

SEQ ID NO: 367648 - DNA, 25 bp, Mus musculus
gaaatatcgcgagaaccagaggttc

SEQ ID NO: 367649 - DNA, 25 bp, Mus musculus
acctgcagcgtctctgaaatatcgc

SEQ ID NO: 367650 - DNA, 25 bp, Mus musculus
ctggcgctcagcaatacaatccaca

SEQ ID NO: 367651 - DNA, 25 bp, Mus musculus
tggagctcggcagggcttcagctac

SEQ ID NO: 367652 - DNA, 25 bp, Mus musculus
cctggagctcggcagggcttcagct

SEQ ID NO: 367653 - DNA, 25 bp, Mus musculus
aggctcttactagcggagggcgtgg

SEQ ID NO: 367654 - DNA, 25 bp, Mus musculus
atagagaggctcttactagcggagg

SEQ ID NO: 367655 - DNA, 25 bp, Mus musculus
aggcgaaatagagaggctcttacta

SEQ ID NO: 367656 - DNA, 25 bp, Mus musculus
caggaggcgaaatagagaggctctt

SEQ ID NO: 367657 - DNA, 25 bp, Mus musculus
aacgttacacggagctcgcaggagg

SEQ ID NO: 367658 - DNA, 25 bp, Mus musculus
cacaacgttacacggagctcgcagg

SEQ ID NO: 367659 - DNA, 25 bp, Mus musculus
atccacaacgttacacggagctcgc

SEQ ID NO: 367660 - DNA, 25 bp, Mus musculus
tacaatccacaacgttacacggagc

SEQ ID NO: 367661 - DNA, 25 bp, Mus musculus
gctcagcaatacaatccacaacgtt

SEQ ID NO: 367662 - DNA, 25 bp, Mus musculus
gacgcggttggaggcctggcgctca

SEQ ID NO: 367663 - DNA, 25 bp, Mus musculus
gcaatacaatccacaacgttacacg

SEQ ID NO: 367664 - DNA, 25 bp, Mus musculus
agtcgtggcctcacgcccgcaagat

SEQ ID NO: 367665 - DNA, 25 bp, Mus musculus
gagactgagctgcttggggcttctt

SEQ ID NO: 367666 - DNA, 25 bp, Mus musculus
tctctgctctcaggagagcgaggtg

SEQ ID NO: 367667 - DNA, 25 bp, Mus musculus
atgttccgagtctgcacaccgcgcg

SEQ ID NO: 367668 - DNA, 25 bp, Mus musculus
gcccgcaagatgcacccaacttggg

SEQ ID NO: 367669 - DNA, 25 bp, Mus musculus
attcatgccgaaacacagtcgtggc

SEQ ID NO: 367670 - DNA, 25 bp, Mus musculus
cgcgctccatctttcaagcttctta

SEQ ID NO: 367671 - DNA, 25 bp, Mus musculus
tggataaggactgtgccgcgctcca

SEQ ID NO: 367672 - DNA, 25 bp, Mus musculus
ccagagcccgggttggataaggact

SEQ ID NO: 367673 - DNA, 25 bp, Mus musculus
tgtccagctggtgtccctggtccag

SEQ ID NO: 367674 - DNA, 25 bp, Mus musculus
tagcacaggaaatagaggagtgtcc

SEQ ID NO: 367675 - DNA, 25 bp, Mus musculus
caccgatcctgagcacttgagggga

SEQ ID NO: 367676 - DNA, 25 bp, Mus musculus
cgcgctgagctttcgcgggcacaga

SEQ ID NO: 367677 - DNA, 25 bp, Mus musculus
atcctccctggatgttccgagtctg

SEQ ID NO: 367678 - DNA, 25 bp, Mus musculus
atggccactctctgtctcttcgaca

SEQ ID NO: 367679 - DNA, 25 bp, Mus musculus
gctcttaagctctgaaccgggtgtg

SEQ ID NO: 367680 - DNA, 25 bp, Mus musculus
gcagaccgtccacgtgacccaaggg

SEQ ID NO: 367681 - DNA, 25 bp, Mus musculus
gggaatcttcccatggtgccttgga

SEQ ID NO: 367682 - DNA, 25 bp, Mus musculus
ccggtttcccgaatggtcagcccag

SEQ ID NO: 367683 - DNA, 25 bp, Mus musculus
cgcctgctacaggacgcacgctgta

SEQ ID NO: 367684 - DNA, 25 bp, Mus musculus
cgcacgctgtacttgtcaccggaaa

SEQ ID NO: 367685 - DNA, 25 bp, Mus musculus
caccggaaagttgaagggcgcatgc

SEQ ID NO: 367686 - DNA, 25 bp, Mus musculus
gccaccggtgttctgtgaaccatta

SEQ ID NO: 367687 - DNA, 25 bp, Mus musculus
aagttcgggcctgagtttcttctcg

SEQ ID NO: 367688 - DNA, 25 bp, Mus musculus
ccgagtaggaaacgtgttcagagtc

SEQ ID NO: 367689 - DNA, 25 bp, Mus musculus
ctcttcgacatggatgggaccctga

SEQ ID NO: 367690 - DNA, 25 bp, Mus musculus
tttctgactggagaaatggccactc

SEQ ID NO: 367691 - DNA, 25 bp, Mus musculus
tgctgccctagaccgcggtaacgac

SEQ ID NO: 367692 - DNA, 25 bp, Mus musculus
cttcttcatcttctcgtccatgtcg

SEQ ID NO: 367693 - DNA, 25 bp, Mus musculus
ttcttcgagtcggtgacggaagaca

SEQ ID NO: 367694 - DNA, 25 bp, Mus musculus
tctcgtccatgtcgatcttctgctc

SEQ ID NO: 367695 - DNA, 25 bp, Mus musculus
gctccagcttcttgatttccgactt

SEQ ID NO: 367696 - DNA, 25 bp, Mus musculus
tcttgatttccgacttgaggaggcg

SEQ ID NO: 367697 - DNA, 25 bp, Mus musculus
cgtgtcctccttgtggtggtgcctt

SEQ ID NO: 367698 - DNA, 25 bp, Mus musculus
cctccttgtggtggtgccttgcgac

SEQ ID NO: 367699 - DNA, 25 bp, Mus musculus
gctaacaaatctggcccgctccaga

SEQ ID NO: 367700 - DNA, 25 bp, Mus musculus
cgctccagacgcacaaaggcggtcg

SEQ ID NO: 367701 - DNA, 25 bp, Mus musculus
cacaaaggcggtcggtcacctggtc

SEQ ID NO: 367702 - DNA, 25 bp, Mus musculus
cacctggtctaggatggtcttcttc

SEQ ID NO: 367703 - DNA, 25 bp, Mus musculus
tctaggatggtcttcttcttcttcg

SEQ ID NO: 367704 - DNA, 25 bp, Mus musculus
tcggtgacggaagacagctgcatct

SEQ ID NO: 367705 - DNA, 25 bp, Mus musculus
gtgacggaagacagctgcatctccc

SEQ ID NO: 367706 - DNA, 25 bp, Mus musculus
tcactggagcgcaatgaagtagctt

SEQ ID NO: 367707 - DNA, 25 bp, Mus musculus
gcggccaggacaaagccatgaagcc

SEQ ID NO: 367708 - DNA, 25 bp, Mus musculus
cggttgtgtcatggaaacgttcacg

SEQ ID NO: 367709 - DNA, 25 bp, Mus musculus
tggaaacgttcacgcaacctcgaga

SEQ ID NO: 367710 - DNA, 25 bp, Mus musculus
gttcacgcaacctcgagacagcggc

SEQ ID NO: 367711 - DNA, 25 bp, Mus musculus
cgggaaacagctggacgcgaccacg

SEQ ID NO: 367712 - DNA, 25 bp, Mus musculus
ctggacgcgaccacgtctcgggtag

SEQ ID NO: 367713 - DNA, 25 bp, Mus musculus
gctgcgagttgcgtttggtaaaacc

SEQ ID NO: 367714 - DNA, 25 bp, Mus musculus
gccctggaatatatagatcactgga

SEQ ID NO: 367715 - DNA, 25 bp, Mus musculus
caatgaagtagcttttggcgaggga

SEQ ID NO: 367716 - DNA, 25 bp, Mus musculus
tttcaccctctagaccagagtcggg

SEQ ID NO: 367717 - DNA, 25 bp, Mus musculus
cctctagaccagagtcggggcctcg

SEQ ID NO: 367718 - DNA, 25 bp, Mus musculus
ctggacagtcacagaggccagtgca

SEQ ID NO: 367719 - DNA, 25 bp, Mus musculus
cctcggagagcctcggtgaagctag

SEQ ID NO: 367720 - DNA, 25 bp, Mus musculus
cagcccggggctctgcagcacagaa

SEQ ID NO: 367721 - DNA, 25 bp, Mus musculus
ttcggaaggaacttgagagcacctg

SEQ ID NO: 367722 - DNA, 25 bp, Mus musculus
gcagacatgcatcacgttcggaagg

SEQ ID NO: 367723 - DNA, 25 bp, Mus musculus
gccctcgcctgtgttaacatccttg

SEQ ID NO: 367724 - DNA, 25 bp, Mus musculus
atctcctggacaagaggtccgtgtc

SEQ ID NO: 367725 - DNA, 25 bp, Mus musculus
tagcttgagttggtggcattggatc

SEQ ID NO: 367726 - DNA, 25 bp, Mus musculus
gctgcccacaaaggctcggcctgtg

SEQ ID NO: 367727 - DNA, 25 bp, Mus musculus
ccctgttgaactgctgccgctgtcg

SEQ ID NO: 367728 - DNA, 25 bp, Mus musculus
tcatctccagttcccgcctgaagtt

SEQ ID NO: 367729 - DNA, 25 bp, Mus musculus
tcactgttggtggtactcatctcca

SEQ ID NO: 367730 - DNA, 25 bp, Mus musculus
ctcctccaggctctcactgttggtg

SEQ ID NO: 367731 - DNA, 25 bp, Mus musculus
gctcatcgctgtgcgcagagccagc

SEQ ID NO: 367732 - DNA, 25 bp, Mus musculus
gttccgctgctctgctcatcgctgt

SEQ ID NO: 367733 - DNA, 25 bp, Mus musculus
gcagccgttagcaggatgtccgact

SEQ ID NO: 367734 - DNA, 25 bp, Mus musculus
tggtctccacgtggcgtctaatcta

SEQ ID NO: 367735 - DNA, 25 bp, Mus musculus
ctggcctggcgccaacccgttatgt

SEQ ID NO: 367736 - DNA, 25 bp, Mus musculus
tgataaaacctcgtcccggtccaca

SEQ ID NO: 367737 - DNA, 25 bp, Mus musculus
ctgacggggtgaagacttgataaaa

SEQ ID NO: 367738 - DNA, 25 bp, Mus musculus
acacttgggcttaacgcacccaaca

SEQ ID NO: 367739 - DNA, 25 bp, Mus musculus
ggaccgaccagaacacttgggctta

SEQ ID NO: 367740 - DNA, 25 bp, Mus musculus
cacgtggcgtctaatctacaggatt

SEQ ID NO: 367741 - DNA, 25 bp, Mus musculus
tcagaccctcgtggtctccacgtgg

SEQ ID NO: 367742 - DNA, 25 bp, Mus musculus
ttgcgaatcgcctgcacacctcaga

SEQ ID NO: 367743 - DNA, 25 bp, Mus musculus
cgtccttcctgttcgttgggacatt

SEQ ID NO: 367744 - DNA, 25 bp, Mus musculus
tggcgccactttggaaccgtccttc

SEQ ID NO: 367745 - DNA, 25 bp, Mus musculus
ccttcttggcgccactttggaaccg

SEQ ID NO: 367746 - DNA, 25 bp, Mus musculus
acccgttatgtcctccgcttgctgg

SEQ ID NO: 367747 - DNA, 25 bp, Mus musculus
ctacaggattacgatcggaccgacc

SEQ ID NO: 367748 - DNA, 25 bp, Mus musculus
tgtctcggctagtttctggactctc

SEQ ID NO: 367749 - DNA, 25 bp, Mus musculus
tgtctgcccacccataggattctgc

SEQ ID NO: 367750 - DNA, 25 bp, Mus musculus
accgcaggtccttcacactgtgtgc

SEQ ID NO: 367751 - DNA, 25 bp, Mus musculus
agcatggatggccaaggtgaacacc

SEQ ID NO: 367752 - DNA, 25 bp, Mus musculus
tgaacacccggcaacgttggcgaag

SEQ ID NO: 367753 - DNA, 25 bp, Mus musculus
ctgtcacttgcattcggctccagta

SEQ ID NO: 367754 - DNA, 25 bp, Mus musculus
ggtctgtaaacaaaagccggcctca

SEQ ID NO: 367755 - DNA, 25 bp, Mus musculus
tgccaatgggaactgtcagggctcc

SEQ ID NO: 367756 - DNA, 25 bp, Mus musculus
tggactctccttggcgcgatacaga

SEQ ID NO: 367757 - DNA, 25 bp, Mus musculus
gcaccgcggctctaggcattctcat

SEQ ID NO: 367758 - DNA, 25 bp, Mus musculus
atcgccatccctcgtggagactctg

SEQ ID NO: 367759 - DNA, 25 bp, Mus musculus
cttaggccagggtactcaccagtga

SEQ ID NO: 367760 - DNA, 25 bp, Mus musculus
cagtgacgttcacccaggatcttga

SEQ ID NO: 367761 - DNA, 25 bp, Mus musculus
tccagaatgatcgaatgccaacgcc

SEQ ID NO: 367762 - DNA, 25 bp, Mus musculus
aggctcctcgggaactttctcagtc

SEQ ID NO: 367763 - DNA, 25 bp, Mus musculus
tttctcagtccgcacgctccaggag

SEQ ID NO: 367764 - DNA, 25 bp, Mus musculus
cgggtagcgattggttccgtgccaa

SEQ ID NO: 367765 - DNA, 25 bp, Mus musculus
gcgtggtcagactcaggcctataaa

SEQ ID NO: 367766 - DNA, 25 bp, Mus musculus
cgcatttccagacacagtgggttca

SEQ ID NO: 367767 - DNA, 25 bp, Mus musculus
gcgctgtgcaaagtcagtgacaatc

SEQ ID NO: 367768 - DNA, 25 bp, Mus musculus
ctcggccgacgtcacagttagaaga

SEQ ID NO: 367769 - DNA, 25 bp, Mus musculus
cagggaaccatccacttcgagcaga

SEQ ID NO: 367770 - DNA, 25 bp, Mus musculus
cctgagcccgctaagtgctgagtca

SEQ ID NO: 367771 - DNA, 25 bp, Mus musculus
gccggcttggcatccgttatccttc

SEQ ID NO: 367772 - DNA, 25 bp, Mus musculus
ctgcttttccggtgtccgtgtccca

SEQ ID NO: 367773 - DNA, 25 bp, Mus musculus
tataaaagctccgtggcgccagggc

SEQ ID NO: 367774 - DNA, 25 bp, Mus musculus
ccaccggctgcgattgttgtaagaa

SEQ ID NO: 367775 - DNA, 25 bp, Mus musculus
taagaatatttgaacccggtggtgc

SEQ ID NO: 367776 - DNA, 25 bp, Mus musculus
agccgctagcgtgtgaccgcgcgtt

SEQ ID NO: 367777 - DNA, 25 bp, Mus musculus
actcggtgctcgaaagccctcgggc

SEQ ID NO: 367778 - DNA, 25 bp, Mus musculus
ctcacctcctggttgaaggcgttga

SEQ ID NO: 367779 - DNA, 25 bp, Mus musculus
tgaaggcgttgacggcgtccatgtt

SEQ ID NO: 367780 - DNA, 25 bp, Mus musculus
cgccggtcacctagacctggagcgg

SEQ ID NO: 367781 - DNA, 25 bp, Mus musculus
cggggctccaacatgtccgtttggc

SEQ ID NO: 367782 - DNA, 25 bp, Mus musculus
tctcctctctttcgccagcaggatg

SEQ ID NO: 367783 - DNA, 25 bp, Mus musculus
gcgcgaagcaccctgggacagctcg

SEQ ID NO: 367784 - DNA, 25 bp, Mus musculus
agcataagggccacgttgaagaagc

SEQ ID NO: 367785 - DNA, 25 bp, Mus musculus
ctgcgacaaacaaagcgcggagggt

SEQ ID NO: 367786 - DNA, 25 bp, Mus musculus
ggagagttcccgtcttctgggctca

SEQ ID NO: 367787 - DNA, 25 bp, Mus musculus
cttctgggctcaggatccggacgac

SEQ ID NO: 367788 - DNA, 25 bp, Mus musculus
attgtgtccgggcaggactgcgccc

SEQ ID NO: 367789 - DNA, 25 bp, Mus musculus
gcgccctgctgctgcgacaaacaaa

SEQ ID NO: 367790 - DNA, 25 bp, Mus musculus
ttgaaagtgctcaagctgcggagtg

SEQ ID NO: 367791 - DNA, 25 bp, Mus musculus
cgcccgcgagcggattaaatttctg

SEQ ID NO: 367792 - DNA, 25 bp, Mus musculus
ccctctccagcgagggtcgagttcg

SEQ ID NO: 367793 - DNA, 25 bp, Mus musculus
ctacctcatcggcagcaggaagctg

SEQ ID NO: 367794 - DNA, 25 bp, Mus musculus
caagcgcgtgggcaactacctcatc

SEQ ID NO: 367795 - DNA, 25 bp, Mus musculus
tgttccctctcacagccgatcgggg

SEQ ID NO: 367796 - DNA, 25 bp, Mus musculus
gggccaccgggcacctactgatgga

SEQ ID NO: 367797 - DNA, 25 bp, Mus musculus
ccaacccagtgtggctagacgcacg

SEQ ID NO: 367798 - DNA, 25 bp, Mus musculus
tgcgagggaagtttcctgcccgcct

SEQ ID NO: 367799 - DNA, 25 bp, Mus musculus
tcgccagctattgtctgcgcgcggc

SEQ ID NO: 367800 - DNA, 25 bp, Mus musculus
gatcctcggaggacgaacttctcgg

SEQ ID NO: 367801 - DNA, 25 bp, Mus musculus
gcgatctgggcgatcgatcctcgga

SEQ ID NO: 367802 - DNA, 25 bp, Mus musculus
ggacttccagcaccacaagcgcgtg

SEQ ID NO: 367803 - DNA, 25 bp, Mus musculus
acgctcaggctctcctagtgggcca

SEQ ID NO: 367804 - DNA, 25 bp, Mus musculus
agcaggaaacatcgagtctcggacc

SEQ ID NO: 367805 - DNA, 25 bp, Mus musculus
cacggcagctaagccggaaacgtta

SEQ ID NO: 367806 - DNA, 25 bp, Mus musculus
tgtgaacgactgtgggcccatttcg

SEQ ID NO: 367807 - DNA, 25 bp, Mus musculus
tgtgtgtgaacgactgtgggcccat

SEQ ID NO: 367808 - DNA, 25 bp, Mus musculus
tagtgaggagcacgcgcgtacatgc

SEQ ID NO: 367809 - DNA, 25 bp, Mus musculus
aacgttagtgaggagcacgcgcgta

SEQ ID NO: 367810 - DNA, 25 bp, Mus musculus
agccggaaacgttagtgaggagcac

SEQ ID NO: 367811 - DNA, 25 bp, Mus musculus
cagagccaggccacggcagctaagc

SEQ ID NO: 367812 - DNA, 25 bp, Mus musculus
catcgagtctcggaccacagagcca

SEQ ID NO: 367813 - DNA, 25 bp, Mus musculus
cggaaagcaggaaacatcgagtctc

SEQ ID NO: 367814 - DNA, 25 bp, Mus musculus
cagctccagaggatcggaaagcagg

SEQ ID NO: 367815 - DNA, 25 bp, Mus musculus
cccacgcagacaacaagccagcacc

SEQ ID NO: 367816 - DNA, 25 bp, Mus musculus
aacccacgcggtctccacgcccacg

SEQ ID NO: 367817 - DNA, 25 bp, Mus musculus
agtctcggaccacagagccaggcca

SEQ ID NO: 367818 - DNA, 25 bp, Mus musculus
ggacctgaagaagggcccgactgca

SEQ ID NO: 367819 - DNA, 25 bp, Mus musculus
ttccgacagacgcttctccagcagg

SEQ ID NO: 367820 - DNA, 25 bp, Mus musculus
gggaataatacctctgcgcatgcgc

SEQ ID NO: 367821 - DNA, 25 bp, Mus musculus
agccatgacatacgaatttgccgcg

SEQ ID NO: 367822 - DNA, 25 bp, Mus musculus
tcccagagaccaggaagcagccatg

SEQ ID NO: 367823 - DNA, 25 bp, Mus musculus
ccacaagcggtcaaggaacatccca

SEQ ID NO: 367824 - DNA, 25 bp, Mus musculus
tcgctcgacatagccaggcggtttt

SEQ ID NO: 367825 - DNA, 25 bp, Mus musculus
tgtttgcccacttctgcagccgcag

SEQ ID NO: 367826 - DNA, 25 bp, Mus musculus
cgtctgcgctcgacatgtttgccca

SEQ ID NO: 367827 - DNA, 25 bp, Mus musculus
cgacagcgggcacaaaggaacacca

SEQ ID NO: 367828 - DNA, 25 bp, Mus musculus
cccgactgcatcgaaggcgcatgct

SEQ ID NO: 367829 - DNA, 25 bp, Mus musculus
ggcccgaactgactgcgcaacagga

SEQ ID NO: 367830 - DNA, 25 bp, Mus musculus
caacaggatgcagttggtgtcctcc

SEQ ID NO: 367831 - DNA, 25 bp, Mus musculus
gtagcggctcgagtcttccgacaga

SEQ ID NO: 367832 - DNA, 25 bp, Mus musculus
taaaagagccggtcttcgggtgaga

SEQ ID NO: 367833 - DNA, 25 bp, Mus musculus
ttcagcagggtcttgaaccgcacgc

SEQ ID NO: 367834 - DNA, 25 bp, Mus musculus
gtgccggctactgccccgaagctga

SEQ ID NO: 367835 - DNA, 25 bp, Mus musculus
cgaagctgaggagtccgctcccact

SEQ ID NO: 367836 - DNA, 25 bp, Mus musculus
tccgctcccactcacccggtcctgg

SEQ ID NO: 367837 - DNA, 25 bp, Mus musculus
ctgggccctgcgcatccttcagcag

SEQ ID NO: 367838 - DNA, 25 bp, Mus musculus
catccttcagcagggtcttgaaccg

SEQ ID NO: 367839 - DNA, 25 bp, Mus musculus
ggtcttgaaccgcacgcccgtgaac

SEQ ID NO: 367840 - DNA, 25 bp, Mus musculus
acgcccgtgaactcctccgctcgcg

SEQ ID NO: 367841 - DNA, 25 bp, Mus musculus
ctccgctcgcgttcgcttgactgtg

SEQ ID NO: 367842 - DNA, 25 bp, Mus musculus
cgcgttcgcttgactgtgccagcgg

SEQ ID NO: 367843 - DNA, 25 bp, Mus musculus
ctctgacgccttcctcttggggacc

SEQ ID NO: 367844 - DNA, 25 bp, Mus musculus
gggccagcaaaacggcaccctcgga

SEQ ID NO: 367845 - DNA, 25 bp, Mus musculus
atggcccaaaccaccgggccagcaa

SEQ ID NO: 367846 - DNA, 25 bp, Mus musculus
ctgcgcgtgcgcaagactatgtacg

SEQ ID NO: 367847 - DNA, 25 bp, Mus musculus
actacaacgtttccgggcagtgtga

SEQ ID NO: 367848 - DNA, 25 bp, Mus musculus
cctgaggcttgcgagcagagaatga

SEQ ID NO: 367849 - DNA, 25 bp, Mus musculus
tccggggaaggctgacaagacagac

SEQ ID NO: 367850 - DNA, 25 bp, Mus musculus
tgaggtcacacgagctagcagtgta

SEQ ID NO: 367851 - DNA, 25 bp, Mus musculus
ggtctctcaaagcaactacaacgtt

SEQ ID NO: 367852 - DNA, 25 bp, Mus musculus
ggtcggcttccggtctctcaaagca

SEQ ID NO: 367853 - DNA, 25 bp, Mus musculus
caagactatgtacgtggtccgagtt

SEQ ID NO: 367854 - DNA, 25 bp, Mus musculus
caggcgcatgatctgcgcgtgcgca

SEQ ID NO: 367855 - DNA, 25 bp, Mus musculus
ttcagccgcaccttcttaacggaga

SEQ ID NO: 367856 - DNA, 25 bp, Mus musculus
accgggacactctaggccgatgccg

SEQ ID NO: 367857 - DNA, 25 bp, Mus musculus
tcaggcctcgcagaagaggggaaac

SEQ ID NO: 367858 - DNA, 25 bp, Mus musculus
tgacaagacagacggcttcaggcct

SEQ ID NO: 367859 - DNA, 25 bp, Mus musculus
agcagtgtagtcttgctggctgcgc

SEQ ID NO: 367860 - DNA, 25 bp, Mus musculus
acgagcactggcagacggtctactc

SEQ ID NO: 367861 - DNA, 25 bp, Mus musculus
gttcacgcagaagtacaacacctcc

SEQ ID NO: 367862 - DNA, 25 bp, Mus musculus
gaggaggactccaattacgtactgc

SEQ ID NO: 367863 - DNA, 25 bp, Mus musculus
cgacgagatgaccacggagttcttc

SEQ ID NO: 367864 - DNA, 25 bp, Mus musculus
ggagttcttccagaacatcagcgcc

SEQ ID NO: 367865 - DNA, 25 bp, Mus musculus
ggtgtctgcctaccgcaacaagttc

SEQ ID NO: 367866 - DNA, 25 bp, Mus musculus
ttccacaagcgctacggcaccaaga

SEQ ID NO: 367867 - DNA, 25 bp, Mus musculus
ggagttcgtggcctacctcatcgac

SEQ ID NO: 367868 - DNA, 25 bp, Mus musculus
cgggaggagcccttcaacgagcact

SEQ ID NO: 367869 - DNA, 25 bp, Mus musculus
cgacctcgtgggcaagtatgagaca

SEQ ID NO: 367870 - DNA, 25 bp, Mus musculus
caattacgtactgcagctggccgga

SEQ ID NO: 367871 - DNA, 25 bp, Mus musculus
gagtgagcggctacctgaagttccc

SEQ ID NO: 367872 - DNA, 25 bp, Mus musculus
gtccacccgaactaccgacgagatg

SEQ ID NO: 367873 - DNA, 25 bp, Mus musculus
aacccttcgagaggctggtgtctgc

SEQ ID NO: 367874 - DNA, 25 bp, Mus musculus
gactgcaagaaaagatcggggactt

SEQ ID NO: 367875 - DNA, 25 bp, Mus musculus
gtggcccagagagaagtactaaccg

SEQ ID NO: 367876 - DNA, 25 bp, Mus musculus
acaggcagccaaccgcgaggggtca

SEQ ID NO: 367877 - DNA, 25 bp, Mus musculus
tccagcccgccagaaaacgcagagg

SEQ ID NO: 367878 - DNA, 25 bp, Mus musculus
cggtgcccgggaaagtggcacaatc

SEQ ID NO: 367879 - DNA, 25 bp, Mus musculus
acgctcaaaaaacaggtggcccaga

SEQ ID NO: 367880 - DNA, 25 bp, Mus musculus
aacctgcccttgactcgagataagc

SEQ ID NO: 367881 - DNA, 25 bp, Mus musculus
caagtatcggtgttgtggccacacc

SEQ ID NO: 367882 - DNA, 25 bp, Mus musculus
gggcacccatcacggagctggagaa

SEQ ID NO: 367883 - DNA, 25 bp, Mus musculus
ccacagaggggaagcaaagtgcaga

SEQ ID NO: 367884 - DNA, 25 bp, Mus musculus
cagctgctgctcttcgactgcaaga

SEQ ID NO: 367885 - DNA, 25 bp, Mus musculus
ccgcaggacctttgtgttgatgccc

SEQ ID NO: 367886 - DNA, 25 bp, Mus musculus
tggcacaatcgggtctcggcgtgct

SEQ ID NO: 367887 - DNA, 25 bp, Mus musculus
agggcgcgcctcctacgctcaaaaa

SEQ ID NO: 367888 - DNA, 25 bp, Mus musculus
taggctggctccctaggttcatgga

SEQ ID NO: 367889 - DNA, 25 bp, Mus musculus
ttcatggagccaggaagatttcttc

SEQ ID NO: 367890 - DNA, 25 bp, Mus musculus
cgcacgtagtcaacagggtcatata

SEQ ID NO: 367891 - DNA, 25 bp, Mus musculus
ttctgaagaaactacgcctcggcct

SEQ ID NO: 367892 - DNA, 25 bp, Mus musculus
gctccatccgagcaaaaggaacctg

SEQ ID NO: 367893 - DNA, 25 bp, Mus musculus
gcctcgtgactggtttgagactacc

SEQ ID NO: 367894 - DNA, 25 bp, Mus musculus
agctccctcaggtccggactgctag

SEQ ID NO: 367895 - DNA, 25 bp, Mus musculus
ctcccattcagtgcgatcagacgta

SEQ ID NO: 367896 - DNA, 25 bp, Mus musculus
tgcgtgcttggtggctgaacaacaa

SEQ ID NO: 367897 - DNA, 25 bp, Mus musculus
cggtaatgtctctatctccgggacc

SEQ ID NO: 367898 - DNA, 25 bp, Mus musculus
gtacgctgctgccttggttctaaag

SEQ ID NO: 367899 - DNA, 25 bp, Mus musculus
cgatctattggtctacgggtgtcca

SEQ ID NO: 367900 - DNA, 25 bp, Mus musculus
acaccggcgtggaaagcgctcaagc

SEQ ID NO: 367901 - DNA, 25 bp, Mus musculus
ctgctagagcctaggcagatttcta

SEQ ID NO: 367902 - DNA, 25 bp, Mus musculus
tagttccacagctgtctatcgcccg

SEQ ID NO: 367903 - DNA, 25 bp, Mus musculus
tgccaggggcaacagtcaaacattg

SEQ ID NO: 367904 - DNA, 25 bp, Mus musculus
cagtacgttcgcacttcccggaagc

SEQ ID NO: 367905 - DNA, 25 bp, Mus musculus
ttcctccagccgttggtctttcatc

SEQ ID NO: 367906 - DNA, 25 bp, Mus musculus
tttccgcacctgagcagagccggtg

SEQ ID NO: 367907 - DNA, 25 bp, Mus musculus
gcgcctgcagtaagaactggctctc

SEQ ID NO: 367908 - DNA, 25 bp, Mus musculus
cggacccacaccagcctgagattaa

SEQ ID NO: 367909 - DNA, 25 bp, Mus musculus
cattgagctcgtgcccagttagaac

SEQ ID NO: 367910 - DNA, 25 bp, Mus musculus
gagcatggcgactcctggattaaga

SEQ ID NO: 367911 - DNA, 25 bp, Mus musculus
gccgccgccaaactcagactggttt

SEQ ID NO: 367912 - DNA, 25 bp, Mus musculus
ggatcgcttccggaaatgccttctg

SEQ ID NO: 367913 - DNA, 25 bp, Mus musculus
atcgcccgtcccatggagtctcggt

SEQ ID NO: 367914 - DNA, 25 bp, Mus musculus
gctgtgcagagctcatttagttcca

SEQ ID NO: 367915 - DNA, 25 bp, Mus musculus
aatgccttctgctttgggtctccgg

SEQ ID NO: 367916 - DNA, 25 bp, Mus musculus
cgggattatcacaccgcggactctc

SEQ ID NO: 367917 - DNA, 25 bp, Mus musculus
gcagggaaagccacacaggtgactg

SEQ ID NO: 367918 - DNA, 25 bp, Mus musculus
tgcccagtcacgaagctcaccgtga

SEQ ID NO: 367919 - DNA, 25 bp, Mus musculus
cctccgcagacctgatgggcgatgg

SEQ ID NO: 367920 - DNA, 25 bp, Mus musculus
tgattcgtgctcgagtcgggcatca

SEQ ID NO: 367921 - DNA, 25 bp, Mus musculus
gcccgtgttgattcgtgctcgagtc

SEQ ID NO: 367922 - DNA, 25 bp, Mus musculus
tcctcgcgtggagccctgtagctct

SEQ ID NO: 367923 - DNA, 25 bp, Mus musculus
cagagggagggtccgtcctcctcgc

SEQ ID NO: 367924 - DNA, 25 bp, Mus musculus
ggtccgtgaagcgagcctccgtcgc

SEQ ID NO: 367925 - DNA, 25 bp, Mus musculus
cgcttactggtcaccgggttcctgc

SEQ ID NO: 367926 - DNA, 25 bp, Mus musculus
gaagcgtcacttccgctccagcagg

SEQ ID NO: 367927 - DNA, 25 bp, Mus musculus
ttacgcaccgccagagatacccggg

SEQ ID NO: 367928 - DNA, 25 bp, Mus musculus
cgccactcaacgagatcccggggag

SEQ ID NO: 367929 - DNA, 25 bp, Mus musculus
tcaccgtgacgaatggatcccaccg

SEQ ID NO: 367930 - DNA, 25 bp, Mus musculus
ttgcgcggcttcagcccattgccgg

SEQ ID NO: 367931 - DNA, 25 bp, Mus musculus
gggcacctctttgttctcgcgaggc

SEQ ID NO: 367932 - DNA, 25 bp, Mus musculus
cacagccgctcgctgactgagagga

SEQ ID NO: 367933 - DNA, 25 bp, Mus musculus
tcctcctcgtcttggaagctgagca

SEQ ID NO: 367934 - DNA, 25 bp, Mus musculus
gagtcgttccgcttgcgcacgttca

SEQ ID NO: 367935 - DNA, 25 bp, Mus musculus
cacgcacgcgcagtcgcaagagttc

SEQ ID NO: 367936 - DNA, 25 bp, Mus musculus
tatcgcgccgcctcgattgcgcatg

SEQ ID NO: 367937 - DNA, 25 bp, Mus musculus
actacttgggcggagtctctttgca

SEQ ID NO: 367938 - DNA, 25 bp, Mus musculus
tccgactccagtgttgttccaaagg

SEQ ID NO: 367939 - DNA, 25 bp, Mus musculus
aggagcgagtgtagtctgtcgtctc

SEQ ID NO: 367940 - DNA, 25 bp, Mus musculus
tcgtctcggagcgtgttgctgcaat

SEQ ID NO: 367941 - DNA, 25 bp, Mus musculus
tgctgcaatgcgtcttccgcgctta

SEQ ID NO: 367942 - DNA, 25 bp, Mus musculus
cttccgcgcttatacggagccgtta

SEQ ID NO: 367943 - DNA, 25 bp, Mus musculus
gactgttggcatggtaccctccgac

SEQ ID NO: 367944 - DNA, 25 bp, Mus musculus
cgtggctcaggtggccagaattcca

SEQ ID NO: 367945 - DNA, 25 bp, Mus musculus
tgaagctgctgctaaccgcggacca

SEQ ID NO: 367946 - DNA, 25 bp, Mus musculus
tgggcttccaagtgctgctcagcga

SEQ ID NO: 367947 - DNA, 25 bp, Mus musculus
agagcgacacgagcccagcctcagt

SEQ ID NO: 367948 - DNA, 25 bp, Mus musculus
ctgtccattgtcgttgtctcccttc

SEQ ID NO: 367949 - DNA, 25 bp, Mus musculus
agctgcatctcattcctgtccattg

SEQ ID NO: 367950 - DNA, 25 bp, Mus musculus
ggcgttcaagaactttacctcagtc

SEQ ID NO: 367951 - DNA, 25 bp, Mus musculus
ttcccaccgagccaggcgttcaaga

SEQ ID NO: 367952 - DNA, 25 bp, Mus musculus
acctgtctccgtgattctgggcttc

SEQ ID NO: 367953 - DNA, 25 bp, Mus musculus
gccagaattccacggggctccgaat

SEQ ID NO: 367954 - DNA, 25 bp, Mus musculus
agcttcgctcctgcgctgcgtggct

SEQ ID NO: 367955 - DNA, 25 bp, Mus musculus
agcagcgatgattgcggtggactcc

SEQ ID NO: 367956 - DNA, 25 bp, Mus musculus
ggctccgaatttacacaggtttatg

SEQ ID NO: 367957 - DNA, 25 bp, Mus musculus
ttagaacggaagagcgacacgagcc

SEQ ID NO: 367958 - DNA, 25 bp, Mus musculus
ggacggcgattgtctcacttctttc

SEQ ID NO: 367959 - DNA, 25 bp, Mus musculus
tctctattcagatctccggtccaga

SEQ ID NO: 367960 - DNA, 25 bp, Mus musculus
tcaacatcgccatggacggcctgcg

SEQ ID NO: 367961 - DNA, 25 bp, Mus musculus
cagcagctgcgcctgaagatcaaca

SEQ ID NO: 367962 - DNA, 25 bp, Mus musculus
cggccacgtcttccaccaagaaaga

SEQ ID NO: 367963 - DNA, 25 bp, Mus musculus
gcggtggcttcaagtcatcttcctc

SEQ ID NO: 367964 - DNA, 25 bp, Mus musculus
aacccgatgatctttttctgcccgc

SEQ ID NO: 367965 - DNA, 25 bp, Mus musculus
agcctggtgtctagtcgcccatcgt

SEQ ID NO: 367966 - DNA, 25 bp, Mus musculus
tgtctggttctctcctcaagttcgg

SEQ ID NO: 367967 - DNA, 25 bp, Mus musculus
cgtagatgccaaccacctttgcggg

SEQ ID NO: 367968 - DNA, 25 bp, Mus musculus
tcattgagggccacccagaagtccc

SEQ ID NO: 367969 - DNA, 25 bp, Mus musculus
tcctcatttattccaggccggactg

SEQ ID NO: 367970 - DNA, 25 bp, Mus musculus
ccggtccagagaaaagtcctcattt

SEQ ID NO: 367971 - DNA, 25 bp, Mus musculus
agagcttagatcatccctggggcca

SEQ ID NO: 367972 - DNA, 25 bp, Mus musculus
gcgaagctctttgttcacgtgactc

SEQ ID NO: 367973 - DNA, 25 bp, Mus musculus
cgcctgcctcctaaccttccacctc

SEQ ID NO: 367974 - DNA, 25 bp, Mus musculus
tgcgcgatgcgaagctctttgttca

SEQ ID NO: 367975 - DNA, 25 bp, Mus musculus
gaagctctttgttcacgtgactccc

SEQ ID NO: 367976 - DNA, 25 bp, Mus musculus
gtctaagcccgctgttttctttctg

SEQ ID NO: 367977 - DNA, 25 bp, Mus musculus
gttttctttctgtgtcgttgccctc

SEQ ID NO: 367978 - DNA, 25 bp, Mus musculus
ttctttctgtgtcgttgccctccca

SEQ ID NO: 367979 - DNA, 25 bp, Mus musculus
caccttttgccaccgttaacacgag

SEQ ID NO: 367980 - DNA, 25 bp, Mus musculus
tgccaccgttaacacgaggggcaaa

SEQ ID NO: 367981 - DNA, 25 bp, Mus musculus
cctggcgcgacctgcattacaacgt

SEQ ID NO: 367982 - DNA, 25 bp, Mus musculus
gacctgcattacaacgtgggcttta

SEQ ID NO: 367983 - DNA, 25 bp, Mus musculus
tacaacgtgggctttactgcgcctg

SEQ ID NO: 367984 - DNA, 25 bp, Mus musculus
gtgggctttactgcgcctgcctcct

SEQ ID NO: 367985 - DNA, 25 bp, Mus musculus
cgaaatgcgcgatgcgaagctcttt

SEQ ID NO: 367986 - DNA, 25 bp, Mus musculus
cggaagcgcatgcaggacctgaact

SEQ ID NO: 367987 - DNA, 25 bp, Mus musculus
cgacagactgtagggcgccttcttc

SEQ ID NO: 367988 - DNA, 25 bp, Mus musculus
cgcaactacatcctgctgctgggta

SEQ ID NO: 367989 - DNA, 25 bp, Mus musculus
cgtcctttccttgtccagggcctga

SEQ ID NO: 367990 - DNA, 25 bp, Mus musculus
cccaacagtgtctacccagaggggc

SEQ ID NO: 367991 - DNA, 25 bp, Mus musculus
cgggctattctcgtatccgtgagca

SEQ ID NO: 367992 - DNA, 25 bp, Mus musculus
ccaagcgggtgttccaaggagcgat

SEQ ID NO: 367993 - DNA, 25 bp, Mus musculus
aggaggacatttccagacttctctc

SEQ ID NO: 367994 - DNA, 25 bp, Mus musculus
ccgcgtcctggatctaggcagagct

SEQ ID NO: 367995 - DNA, 25 bp, Mus musculus
tgcaggcccagttctccaagtgagg

SEQ ID NO: 367996 - DNA, 25 bp, Mus musculus
ggccagttctctctcccagctggtg

SEQ ID NO: 367997 - DNA, 25 bp, Mus musculus
agtacctgtctctagcgctcgacga

SEQ ID NO: 367998 - DNA, 25 bp, Mus musculus
cgctgcgcgaagttatcctacccta

SEQ ID NO: 367999 - DNA, 25 bp, Mus musculus
tcccacctgtttagagccagaagtc

SEQ ID NO: 368000 - DNA, 25 bp, Mus musculus
acccggcgattcaggtactgtactg

SEQ ID NO: 368001 - DNA, 25 bp, Mus musculus
cccgacccacaagctgcgtatgggg

SEQ ID NO: 368002 - DNA, 25 bp, Mus musculus
ccgtggagagtctgaggattctagc

SEQ ID NO: 368003 - DNA, 25 bp, Mus musculus
tcctgcctttcttccgtggagagtc

SEQ ID NO: 368004 - DNA, 25 bp, Mus musculus
ttcaattctcctcttcgggactccg

SEQ ID NO: 368005 - DNA, 25 bp, Mus musculus
gacatgaatgggtgtcgctcgcctc

SEQ ID NO: 368006 - DNA, 25 bp, Mus musculus
tcaggtactgtactgcgggcattac

SEQ ID NO: 368007 - DNA, 25 bp, Mus musculus
gggattcacgagacccggcgattca

SEQ ID NO: 368008 - DNA, 25 bp, Mus musculus
cgcctgatgcccagagcagctcgga

SEQ ID NO: 368009 - DNA, 25 bp, Mus musculus
accaggctgccagcggagactcttc

SEQ ID NO: 368010 - DNA, 25 bp, Mus musculus
cctagaccaggggaaaccaggctgc

SEQ ID NO: 368011 - DNA, 25 bp, Mus musculus
agcctgcgtggtctagccctagacc

SEQ ID NO: 368012 - DNA, 25 bp, Mus musculus
aaagtgcccatttgtcgccggctcc

SEQ ID NO: 368013 - DNA, 25 bp, Mus musculus
ctgcgggcattacggggacatgaat

SEQ ID NO: 368014 - DNA, 25 bp, Mus musculus
caggctccaggggtgagcgcaaccc

SEQ ID NO: 368015 - DNA, 25 bp, Mus musculus
gcgctcttctgggaggccaaaggac

SEQ ID NO: 368016 - DNA, 25 bp, Mus musculus
ggtccagctcgcgttccttgctgag

SEQ ID NO: 368017 - DNA, 25 bp, Mus musculus
ctgctcagccgagctttgcagtttg

SEQ ID NO: 368018 - DNA, 25 bp, Mus musculus
agccaagtgcactgcgctgctcagc

SEQ ID NO: 368019 - DNA, 25 bp, Mus musculus
cctccgagcgcctggcagggtcaga

SEQ ID NO: 368020 - DNA, 25 bp, Mus musculus
ctggctggttagcttaggctgtcct

SEQ ID NO: 368021 - DNA, 25 bp, Mus musculus
aggggtgagcgcaacccgcctcgca

SEQ ID NO: 368022 - DNA, 25 bp, Mus musculus
cgcagcatctgcatccgagctcacc

SEQ ID NO: 368023 - DNA, 25 bp, Mus musculus
cgctgccactgacagtcgcccgatg

SEQ ID NO: 368024 - DNA, 25 bp, Mus musculus
cggcttgttcgcctgcccacttgac

SEQ ID NO: 368025 - DNA, 25 bp, Mus musculus
gccagctacgactcctggctggtta

SEQ ID NO: 368026 - DNA, 25 bp, Mus musculus
ccttgctgagcggaatgaagccgag

SEQ ID NO: 368027 - DNA, 25 bp, Mus musculus
tgggagtcgttcgttgcgctcttct

SEQ ID NO: 368028 - DNA, 25 bp, Mus musculus
tggcaggcttgggaactcggaggcg

SEQ ID NO: 368029 - DNA, 25 bp, Mus musculus
ggcttggcccatgggctccccgaaa

SEQ ID NO: 368030 - DNA, 25 bp, Mus musculus
ttctggtgccaggtgaggtcggcga

SEQ ID NO: 368031 - DNA, 25 bp, Mus musculus
ggggctgccgcacggggccatgtcc

SEQ ID NO: 368032 - DNA, 25 bp, Mus musculus
aggctccggtcctcagtggggctgc

SEQ ID NO: 368033 - DNA, 25 bp, Mus musculus
cgccctcgaggctccggtcctcagt

SEQ ID NO: 368034 - DNA, 25 bp, Mus musculus
gctagatcctgggtggacccttccc

SEQ ID NO: 368035 - DNA, 25 bp, Mus musculus
ctggctagatcctgggtggaccctt

SEQ ID NO: 368036 - DNA, 25 bp, Mus musculus
ccgctggctagatcctgggtggacc

SEQ ID NO: 368037 - DNA, 25 bp, Mus musculus
acacccgcggcgatgcgctgccgct

SEQ ID NO: 368038 - DNA, 25 bp, Mus musculus
accaggaagggtacccctcgccatg

SEQ ID NO: 368039 - DNA, 25 bp, Mus musculus
aaagggacctgtgcggcgcccagca

SEQ ID NO: 368040 - DNA, 25 bp, Mus musculus
ccgaaagggacctgtgcggcgccca

SEQ ID NO: 368041 - DNA, 25 bp, Mus musculus
gggcgtccccaaggcttggcccatg

SEQ ID NO: 368042 - DNA, 25 bp, Mus musculus
ttaaagatggcgaggccctcgcgtg

SEQ ID NO: 368043 - DNA, 25 bp, Mus musculus
tgcgctgcacaatgcgtgaactcgg

SEQ ID NO: 368044 - DNA, 25 bp, Mus musculus
cctggttaaagatggcgaggccctc

SEQ ID NO: 368045 - DNA, 25 bp, Mus musculus
gactccggcgctttgtgcccagcag

SEQ ID NO: 368046 - DNA, 25 bp, Mus musculus
cctaatttacgactccggcgctttg

SEQ ID NO: 368047 - DNA, 25 bp, Mus musculus
ctgggtacccggagccaacacacct

SEQ ID NO: 368048 - DNA, 25 bp, Mus musculus
agcaggcccaaccagcctggccaga

SEQ ID NO: 368049 - DNA, 25 bp, Mus musculus
gcagcccggcctggttaaagatggc

SEQ ID NO: 368050 - DNA, 25 bp, Mus musculus
gcggccgcccggaccacaatgaaat

SEQ ID NO: 368051 - DNA, 25 bp, Mus musculus
caacacacctcgatcctaatttacg

SEQ ID NO: 368052 - DNA, 25 bp, Mus musculus
gtgcaggggaacctgcgcacccgct

SEQ ID NO: 368053 - DNA, 25 bp, Mus musculus
aatggcggcggcgtgaaatgtcact

SEQ ID NO: 368054 - DNA, 25 bp, Mus musculus
cgtgaaatgtcacttccgcatgggg

SEQ ID NO: 368055 - DNA, 25 bp, Mus musculus
tctcctctgtgaggcagcggagcgc

SEQ ID NO: 368056 - DNA, 25 bp, Mus musculus
ccttaggtgagcgaaggccgagcaa

SEQ ID NO: 368057 - DNA, 25 bp, Mus musculus
cgtctctggtgctgctggcccaggc

SEQ ID NO: 368058 - DNA, 25 bp, Mus musculus
aggcacctcgggttctgcccgtagc

SEQ ID NO: 368059 - DNA, 25 bp, Mus musculus
gtagcttgagtccagcgctctcacc

SEQ ID NO: 368060 - DNA, 25 bp, Mus musculus
ctgcccgtagccttaggtgagcgaa

SEQ ID NO: 368061 - DNA, 25 bp, Mus musculus
caacggggagtaattgctgggcgca

SEQ ID NO: 368062 - DNA, 25 bp, Mus musculus
cgcaggtagcttgagtccagcgctc

SEQ ID NO: 368063 - DNA, 25 bp, Mus musculus
cggagcaaatagatggggtgttccc

SEQ ID NO: 368064 - DNA, 25 bp, Mus musculus
caaatagatggggtgttcccgaagg

SEQ ID NO: 368065 - DNA, 25 bp, Mus musculus
gggctgcaatgggccaaggattttt

SEQ ID NO: 368066 - DNA, 25 bp, Mus musculus
tcacttgaagtgacagaagacgtaa

SEQ ID NO: 368067 - DNA, 25 bp, Mus musculus
gaagtgacagaagacgtaagaggta

SEQ ID NO: 368068 - DNA, 25 bp, Mus musculus
ctgtcgtaggctcggcgtctctggt

SEQ ID NO: 368069 - DNA, 25 bp, Mus musculus
ttttttggcgcgtcacttgaagtga

SEQ ID NO: 368070 - DNA, 25 bp, Mus musculus
tgcgccgctcttcagcctgaggacg

SEQ ID NO: 368071 - DNA, 25 bp, Mus musculus
taaggacaatgctgggcagtctttc

SEQ ID NO: 368072 - DNA, 25 bp, Mus musculus
agcgtggcagggacctcaaagtccc

SEQ ID NO: 368073 - DNA, 25 bp, Mus musculus
aggccttgactggaccgcgcccggt

SEQ ID NO: 368074 - DNA, 25 bp, Mus musculus
ttcagcctgaggacgctacccgggc

SEQ ID NO: 368075 - DNA, 25 bp, Mus musculus
cggtactttccgagccgcttgctcg

SEQ ID NO: 368076 - DNA, 25 bp, Mus musculus
tccggacaaaaacaggaagctgagc

SEQ ID NO: 368077 - DNA, 25 bp, Mus musculus
ctttccgagccgcttgctcgcggag

SEQ ID NO: 368078 - DNA, 25 bp, Mus musculus
cctagctgcccagaggtagtctcca

SEQ ID NO: 368079 - DNA, 25 bp, Mus musculus
tagtctccagctccgcggtgctgct

SEQ ID NO: 368080 - DNA, 25 bp, Mus musculus
ggcctcccaagacgatgctcgctgt

SEQ ID NO: 368081 - DNA, 25 bp, Mus musculus
caagacgatgctcgctgtcgtgggc

SEQ ID NO: 368082 - DNA, 25 bp, Mus musculus
ggcgccttgggtgctaccctcagct

SEQ ID NO: 368083 - DNA, 25 bp, Mus musculus
cctctcaggagtctaaggacaatgc

SEQ ID NO: 368084 - DNA, 25 bp, Mus musculus
ctcggcgaggtgtggccggagtcac

SEQ ID NO: 368085 - DNA, 25 bp, Mus musculus
gtgcgagtctgagcggcgtccaccc

SEQ ID NO: 368086 - DNA, 25 bp, Mus musculus
ccatgcggcctttgccactgtggct

SEQ ID NO: 368087 - DNA, 25 bp, Mus musculus
gcctttgccactgtggctgccgtcg

SEQ ID NO: 368088 - DNA, 25 bp, Mus musculus
tgccgtcgctgctgctctgtgggct

SEQ ID NO: 368089 - DNA, 25 bp, Mus musculus
ggcgtcctcgccaggtaagcgcgac

SEQ ID NO: 368090 - DNA, 25 bp, Mus musculus
ctcgggctctcctgggtgtcgcgtc

SEQ ID NO: 368091 - DNA, 25 bp, Mus musculus
tctcctgggtgtcgcgtccgcgcgt

SEQ ID NO: 368092 - DNA, 25 bp, Mus musculus
cgggagcttgcacccggcacagggt

SEQ ID NO: 368093 - DNA, 25 bp, Mus musculus
acccggcacagggtggggttctgca

SEQ ID NO: 368094 - DNA, 25 bp, Mus musculus
gggttctgcagtcgttcccgatctg

SEQ ID NO: 368095 - DNA, 25 bp, Mus musculus
gcagtcgttcccgatctgcgggtga

SEQ ID NO: 368096 - DNA, 25 bp, Mus musculus
tcgttcccgatctgcgggtgaccgc

SEQ ID NO: 368097 - DNA, 25 bp, Mus musculus
cccgatctgcgggtgaccgcgatcg

SEQ ID NO: 368098 - DNA, 25 bp, Mus musculus
catcccggaacaaatcgaagaggtc

SEQ ID NO: 368099 - DNA, 25 bp, Mus musculus
atcgaagaggtcagtgcgcagatgc

SEQ ID NO: 368100 - DNA, 25 bp, Mus musculus
gagtgaagtactggtttcaggctcc

SEQ ID NO: 368101 - DNA, 25 bp, Mus musculus
atgcgcgagtgacccgctgtggccc

SEQ ID NO: 368102 - DNA, 25 bp, Mus musculus
tcaggctccgccaaacatcccggaa

SEQ ID NO: 368103 - DNA, 25 bp, Mus musculus
ctcgtggtaggcgagaatggacacc

SEQ ID NO: 368104 - DNA, 25 bp, Mus musculus
cagtgcgcagatgcgcgagtgaccc

SEQ ID NO: 368105 - DNA, 25 bp, Mus musculus
atcttcgcattgctgctcggcctga

SEQ ID NO: 368106 - DNA, 25 bp, Mus musculus
caaagccgagtgaagtactggtttc

SEQ ID NO: 368107 - DNA, 25 bp, Mus musculus
gttcctcaaataccaaagccgagtg

SEQ ID NO: 368108 - DNA, 25 bp, Mus musculus
tcaccctgttcctcaaataccaaag

SEQ ID NO: 368109 - DNA, 25 bp, Mus musculus
cgcattgctgctcggcctgacgggc

SEQ ID NO: 368110 - DNA, 25 bp, Mus musculus
cgttgggcatcttcgcattgctgct

SEQ ID NO: 368111 - DNA, 25 bp, Mus musculus
tgacgggcgcctgcttcaccctgtt

SEQ ID NO: 368112 - DNA, 25 bp, Mus musculus
ggcagatcacagaaacccgagacct

SEQ ID NO: 368113 - DNA, 25 bp, Mus musculus
gtccggacctctcctgctgcggttt

SEQ ID NO: 368114 - DNA, 25 bp, Mus musculus
ccagactcaggacgagatgcgcggc

SEQ ID NO: 368115 - DNA, 25 bp, Mus musculus
ctgcggtttgcggtagtagtgtaaa

SEQ ID NO: 368116 - DNA, 25 bp, Mus musculus
gtagtgtaaactcaagcgcctcagc

SEQ ID NO: 368117 - DNA, 25 bp, Mus musculus
tgctctacctgcgtcctggagctga

SEQ ID NO: 368118 - DNA, 25 bp, Mus musculus
gcgcctcagcatcggtgagagcacc

SEQ ID NO: 368119 - DNA, 25 bp, Mus musculus
catagtgcgaccgattagatagagg

SEQ ID NO: 368120 - DNA, 25 bp, Mus musculus
gcgcaccgcaggaaccaatgggatt

SEQ ID NO: 368121 - DNA, 25 bp, Mus musculus
tgcgaagtctacaccgagcccaggc

SEQ ID NO: 368122 - DNA, 25 bp, Mus musculus
cgatcaacctcagtccgggagccgg

SEQ ID NO: 368123 - DNA, 25 bp, Mus musculus
accaatgggattgcagcaagtggcc

SEQ ID NO: 368124 - DNA, 25 bp, Mus musculus
ctctgcggagaccaatcatagtgcg

SEQ ID NO: 368125 - DNA, 25 bp, Mus musculus
cgccctgcgttcgatcggcagatca

SEQ ID NO: 368126 - DNA, 25 bp, Mus musculus
ctccgtccctgtctcggctactgga

SEQ ID NO: 368127 - DNA, 25 bp, Mus musculus
ggttcagcggctcgaagctcaagct

SEQ ID NO: 368128 - DNA, 25 bp, Mus musculus
cccacggaacagaggacagactccc

SEQ ID NO: 368129 - DNA, 25 bp, Mus musculus
gcgatctctttcttataaaaccatc

SEQ ID NO: 368130 - DNA, 25 bp, Mus musculus
gggacagcgatctctttcttataaa

SEQ ID NO: 368131 - DNA, 25 bp, Mus musculus
ctcaccagggacagcgatctctttc

SEQ ID NO: 368132 - DNA, 25 bp, Mus musculus
caggtagtttccctcaccagggaca

SEQ ID NO: 368133 - DNA, 25 bp, Mus musculus
tcataccttactacgacaggtagtt

SEQ ID NO: 368134 - DNA, 25 bp, Mus musculus
tgcgcctttgcgcagcacgcgtggc

SEQ ID NO: 368135 - DNA, 25 bp, Mus musculus
ggctactggaccctctgccgcgcta

SEQ ID NO: 368136 - DNA, 25 bp, Mus musculus
gctcgaagctcaagctgcgcctttg

SEQ ID NO: 368137 - DNA, 25 bp, Mus musculus
agactcccctggacgcttgttgttg

SEQ ID NO: 368138 - DNA, 25 bp, Mus musculus
tactcaccttcacagacgtgatggg

SEQ ID NO: 368139 - DNA, 25 bp, Mus musculus
tgccgcgctacactgcagagccttt

SEQ ID NO: 368140 - DNA, 25 bp, Mus musculus
aggtcgctcagacgctccagccttt

SEQ ID NO: 368141 - DNA, 25 bp, Mus musculus
gtggcatctttcacggaacgccgtc

SEQ ID NO: 368142 - DNA, 25 bp, Mus musculus
ctgtcacttaaggtccctgcgttta

SEQ ID NO: 368143 - DNA, 25 bp, Mus musculus
ctttgctaaaaactacgcgaggccg

SEQ ID NO: 368144 - DNA, 25 bp, Mus musculus
cgaggccggttatagcaagcatcga

SEQ ID NO: 368145 - DNA, 25 bp, Mus musculus
tggctcctttccaactcatagtggg

SEQ ID NO: 368146 - DNA, 25 bp, Mus musculus
cggggatttctttctcatgcacgtc

SEQ ID NO: 368147 - DNA, 25 bp, Mus musculus
cgacttctcctgtaatggcgcctgc

SEQ ID NO: 368148 - DNA, 25 bp, Mus musculus
ggcgcctgcgtcaaccactaacatg

SEQ ID NO: 368149 - DNA, 25 bp, Mus musculus
gcggcgcaaacgtcagcagctctac

SEQ ID NO: 368150 - DNA, 25 bp, Mus musculus
gcggccgacatcgagcaggttttca

SEQ ID NO: 368151 - DNA, 25 bp, Mus musculus
caggtctttcgtggtcagtaaattc

SEQ ID NO: 368152 - DNA, 25 bp, Mus musculus
gctttccaggtaaacgcttcccaga

SEQ ID NO: 368153 - DNA, 25 bp, Mus musculus
cttggcgcttgcaacaaacgcgttc

SEQ ID NO: 368154 - DNA, 25 bp, Mus musculus
ggaggagtagccgatcaagatctaa

SEQ ID NO: 368155 - DNA, 25 bp, Mus musculus
ggaagaggtcgtccaagtccaaatc

SEQ ID NO: 368156 - DNA, 25 bp, Mus musculus
ccgttctcagacacggtcacggtca

SEQ ID NO: 368157 - DNA, 25 bp, Mus musculus
gtcacggtcacgctcaagacgcagg

SEQ ID NO: 368158 - DNA, 25 bp, Mus musculus
gcgcaccagtgagtcgcgttctaga

SEQ ID NO: 368159 - DNA, 25 bp, Mus musculus
tgaacataagtcacgcaagcgcacc

SEQ ID NO: 368160 - DNA, 25 bp, Mus musculus
ccaaagcatagatccaagtccaggg

SEQ ID NO: 368161 - DNA, 25 bp, Mus musculus
ctcacgagacaaccggaaagcagct

SEQ ID NO: 368162 - DNA, 25 bp, Mus musculus
cggcggagtaggagccacactccta

SEQ ID NO: 368163 - DNA, 25 bp, Mus musculus
ccagccgtcggagaagatcacggtc

SEQ ID NO: 368164 - DNA, 25 bp, Mus musculus
ctcggagtaagcgttccaagtcttc

SEQ ID NO: 368165 - DNA, 25 bp, Mus musculus
gtctgcggtaagaagacgaagcttc

SEQ ID NO: 368166 - DNA, 25 bp, Mus musculus
cgaagcttcagtatatcaccggtca

SEQ ID NO: 368167 - DNA, 25 bp, Mus musculus
tcctagtcggaggagacggtctaga

SEQ ID NO: 368168 - DNA, 25 bp, Mus musculus
atatccgggcttctttcagtggcgc

SEQ ID NO: 368169 - DNA, 25 bp, Mus musculus
taccgcggagtctgggacgctaatt

SEQ ID NO: 368170 - DNA, 25 bp, Mus musculus
acaccgagagagtccgagacgctgc

SEQ ID NO: 368171 - DNA, 25 bp, Mus musculus
agaccctgcgatggctagggatgcc

SEQ ID NO: 368172 - DNA, 25 bp, Mus musculus
aagccaaggagctcgagacgctgtg

SEQ ID NO: 368173 - DNA, 25 bp, Mus musculus
cgggaacgctactggagacactgca

SEQ ID NO: 368174 - DNA, 25 bp, Mus musculus
tcctggtgtttcttcgtcttctgta

SEQ ID NO: 368175 - DNA, 25 bp, Mus musculus
cgtgccttcctatatccgggcttct

SEQ ID NO: 368176 - DNA, 25 bp, Mus musculus
acctcctagtttcggccaattgctg

SEQ ID NO: 368177 - DNA, 25 bp, Mus musculus
gagctctggccacgcacccgtaagt

SEQ ID NO: 368178 - DNA, 25 bp, Mus musculus
gaacttcatctctaggcgcgagctc

SEQ ID NO: 368179 - DNA, 25 bp, Mus musculus
ggttcccgtgggtctgaacttcatc

SEQ ID NO: 368180 - DNA, 25 bp, Mus musculus
cccacgcagtgtggtgccttgttcc

SEQ ID NO: 368181 - DNA, 25 bp, Mus musculus
tagcctgctcgcaggtcacggtgtc

SEQ ID NO: 368182 - DNA, 25 bp, Mus musculus
ggagcggctcttcgctggcctcgtc

SEQ ID NO: 368183 - DNA, 25 bp, Mus musculus
ctcaggcggcctcttgaagctaggc

SEQ ID NO: 368184 - DNA, 25 bp, Mus musculus
cctcttgaagctaggcgagtagccg

SEQ ID NO: 368185 - DNA, 25 bp, Mus musculus
cgagacagccattgcgcagcaccga

SEQ ID NO: 368186 - DNA, 25 bp, Mus musculus
ccgcgctgctcacggactggaggct

SEQ ID NO: 368187 - DNA, 25 bp, Mus musculus
tcacggactggaggctcctgaggcc

SEQ ID NO: 368188 - DNA, 25 bp, Mus musculus
acagatttcccggtggccgcttccg

SEQ ID NO: 368189 - DNA, 25 bp, Mus musculus
ggattaacagtaccaactcggcagc

SEQ ID NO: 368190 - DNA, 25 bp, Mus musculus
accaactcggcagcgggcgtagtgt

SEQ ID NO: 368191 - DNA, 25 bp, Mus musculus
tccaggcgagcgaaagggttcctgc

SEQ ID NO: 368192 - DNA, 25 bp, Mus musculus
gcggcaccatggtcccgagaccttt

SEQ ID NO: 368193 - DNA, 25 bp, Mus musculus
catggtcccgagaccttttccggcg

SEQ ID NO: 368194 - DNA, 25 bp, Mus musculus
tcgtccgagactcgcggccggttgt

SEQ ID NO: 368195 - DNA, 25 bp, Mus musculus
cgcacggtctcaggcggcctcttga

SEQ ID NO: 368196 - DNA, 25 bp, Mus musculus
caagctaggcctgagccagggcatc

SEQ ID NO: 368197 - DNA, 25 bp, Mus musculus
catggcaactgaacccggaactaca

SEQ ID NO: 368198 - DNA, 25 bp, Mus musculus
cagcatgctgcttcccgtagagaga

SEQ ID NO: 368199 - DNA, 25 bp, Mus musculus
ggctgtgacgaacgccatggcaact

SEQ ID NO: 368200 - DNA, 25 bp, Mus musculus
tcactaccgcaggatgaccgatctg

SEQ ID NO: 368201 - DNA, 25 bp, Mus musculus
ccattggtcagactgcccgtcacta

SEQ ID NO: 368202 - DNA, 25 bp, Mus musculus
ttgggtccaaacagtactgccattg

SEQ ID NO: 368203 - DNA, 25 bp, Mus musculus
gagcccgccttcttgggtccaaaca

SEQ ID NO: 368204 - DNA, 25 bp, Mus musculus
agtccttctgcagagagcccgcctt

SEQ ID NO: 368205 - DNA, 25 bp, Mus musculus
tggctcacctggctcggagcaacct

SEQ ID NO: 368206 - DNA, 25 bp, Mus musculus
agagacacacatcgttcttccctgg

SEQ ID NO: 368207 - DNA, 25 bp, Mus musculus
caggcgtttctccatttttcgccca

SEQ ID NO: 368208 - DNA, 25 bp, Mus musculus
cccagggttagacagctccttcagg

SEQ ID NO: 368209 - DNA, 25 bp, Mus musculus
gcgtgtgatgcgaagtaccagtctc

SEQ ID NO: 368210 - DNA, 25 bp, Mus musculus
gcgcagcccgagcacaagcaacaga

SEQ ID NO: 368211 - DNA, 25 bp, Mus musculus
tggtcgcacgcaaacactgtcaact

SEQ ID NO: 368212 - DNA, 25 bp, Mus musculus
ccgtggctcagctctacaaaggtga

SEQ ID NO: 368213 - DNA, 25 bp, Mus musculus
cttctgctttggttggtcgcacgca

SEQ ID NO: 368214 - DNA, 25 bp, Mus musculus
cagtcttcaagttccctgacattta

SEQ ID NO: 368215 - DNA, 25 bp, Mus musculus
cccgcccattgatgacatcagttcg

SEQ ID NO: 368216 - DNA, 25 bp, Mus musculus
catcagttcgacaggcgggtaagcc

SEQ ID NO: 368217 - DNA, 25 bp, Mus musculus
ggtaagccaatcagaacgctgcgtt

SEQ ID NO: 368218 - DNA, 25 bp, Mus musculus
gccgccgtagacgacgttcctcagt

SEQ ID NO: 368219 - DNA, 25 bp, Mus musculus
ttcctcagtcttcgaggtgggctcg

SEQ ID NO: 368220 - DNA, 25 bp, Mus musculus
acgggccggagcattggttctccaa

SEQ ID NO: 368221 - DNA, 25 bp, Mus musculus
agcaggacgagcagttgtctcccga

SEQ ID NO: 368222 - DNA, 25 bp, Mus musculus
tgtggcatctcttccagaactcggc

SEQ ID NO: 368223 - DNA, 25 bp, Mus musculus
cggcgctttccagtcagcatgtggg

SEQ ID NO: 368224 - DNA, 25 bp, Mus musculus
acggcggctcgcaagggagcatccc

SEQ ID NO: 368225 - DNA, 25 bp, Mus musculus
ttgctccgtagtacggcggctcgca

SEQ ID NO: 368226 - DNA, 25 bp, Mus musculus
tgcgggctgcactgatttgtgtgag

SEQ ID NO: 368227 - DNA, 25 bp, Mus musculus
gctccgcccggtctttctcatcctc

SEQ ID NO: 368228 - DNA, 25 bp, Mus musculus
cctttttctctagcgcctgcttgga

SEQ ID NO: 368229 - DNA, 25 bp, Mus musculus
ctagcgcctgcttggaataccctgt

SEQ ID NO: 368230 - DNA, 25 bp, Mus musculus
ttggaataccctgtcaagtgaaggg

SEQ ID NO: 368231 - DNA, 25 bp, Mus musculus
cctgtcaagtgaagggcggtcaatg

SEQ ID NO: 368232 - DNA, 25 bp, Mus musculus
cggtcaatgccgtttgggccgaagt

SEQ ID NO: 368233 - DNA, 25 bp, Mus musculus
gggctggctctgatggcatttaaca

SEQ ID NO: 368234 - DNA, 25 bp, Mus musculus
ggcatttaacagaaagcggctaccc

SEQ ID NO: 368235 - DNA, 25 bp, Mus musculus
agaaagcggctacccttgcagcggg

SEQ ID NO: 368236 - DNA, 25 bp, Mus musculus
gctacccttgcagcgggcgtgcgtc

SEQ ID NO: 368237 - DNA, 25 bp, Mus musculus
gcgcagcttggttgctccgtagtac

SEQ ID NO: 368238 - DNA, 25 bp, Mus musculus
ggcggctgtaggtcaaacccaaatg

SEQ ID NO: 368239 - DNA, 25 bp, Mus musculus
cgccagcttctacctgtcgagacag

SEQ ID NO: 368240 - DNA, 25 bp, Mus musculus
tgcaggcgcggccatcttttcccgg

SEQ ID NO: 368241 - DNA, 25 bp, Mus musculus
acccaaatgaaaagagactactggc

SEQ ID NO: 368242 - DNA, 25 bp, Mus musculus
gactactggcgccagagcgcacgcg

SEQ ID NO: 368243 - DNA, 25 bp, Mus musculus
cgccagcgtgatcgctcggctttct

SEQ ID NO: 368244 - DNA, 25 bp, Mus musculus
gatcgctcggctttctgggaaatgt

SEQ ID NO: 368245 - DNA, 25 bp, Mus musculus
tttctgggaaatgtacgcgtcagga

SEQ ID NO: 368246 - DNA, 25 bp, Mus musculus
tgtgggtaagaacctcttgcatgct

SEQ ID NO: 368247 - DNA, 25 bp, Mus musculus
taagaacctcttgcatgctgggagt

SEQ ID NO: 368248 - DNA, 25 bp, Mus musculus
agttgtagtccgtacctgccgcggt

SEQ ID NO: 368249 - DNA, 25 bp, Mus musculus
cgcggtccggctggactcgtgaacc

SEQ ID NO: 368250 - DNA, 25 bp, Mus musculus
tgggagggagcctcccgccagcttc

SEQ ID NO: 368251 - DNA, 25 bp, Mus musculus
ctgtcgagacagtccggacgctgca

SEQ ID NO: 368252 - DNA, 25 bp, Mus musculus
gcagctgccggagcctttaaacccg

SEQ ID NO: 368253 - DNA, 25 bp, Mus musculus
atgcggcgggtaagtgaccttccct

SEQ ID NO: 368254 - DNA, 25 bp, Mus musculus
agtgaccttccctcagaccgagttc

SEQ ID NO: 368255 - DNA, 25 bp, Mus musculus
ctccggagtccgatggaaggactgc

SEQ ID NO: 368256 - DNA, 25 bp, Mus musculus
cgggaggacacacgcgcgagaaccc

SEQ ID NO: 368257 - DNA, 25 bp, Mus musculus
gcccacgcgtcgagaagctgctcgt

SEQ ID NO: 368258 - DNA, 25 bp, Mus musculus
tcagcgtccgcgatcagttacagcc

SEQ ID NO: 368259 - DNA, 25 bp, Mus musculus
aaagcccgccagtgccggctgtgta

SEQ ID NO: 368260 - DNA, 25 bp, Mus musculus
cggctgtgtacccacgcacttgtca

SEQ ID NO: 368261 - DNA, 25 bp, Mus musculus
ttgaggtgcaagtgcaaggcgccct

SEQ ID NO: 368262 - DNA, 25 bp, Mus musculus
acgggctgctcgagaccgtgtccac

SEQ ID NO: 368263 - DNA, 25 bp, Mus musculus
tccagagcccaaggttggtaggcgc

SEQ ID NO: 368264 - DNA, 25 bp, Mus musculus
gctacgagttggctttgattctgaa

SEQ ID NO: 368265 - DNA, 25 bp, Mus musculus
tttgattctgaaagccatgcggcgg

SEQ ID NO: 368266 - DNA, 25 bp, Mus musculus
cggtgcctgttgaaggacacaagcc

SEQ ID NO: 368267 - DNA, 25 bp, Mus musculus
ccttggggcggccatatttgttagg

SEQ ID NO: 368268 - DNA, 25 bp, Mus musculus
tcccacgcggcgacgtttggaaaca

SEQ ID NO: 368269 - DNA, 25 bp, Mus musculus
ggcagagcttctgcggttcccacgc

SEQ ID NO: 368270 - DNA, 25 bp, Mus musculus
gacgggatttttgtcacgtgacacc

SEQ ID NO: 368271 - DNA, 25 bp, Mus musculus
gcagaccaataatacgacgggattt

SEQ ID NO: 368272 - DNA, 25 bp, Mus musculus
cacaagccgggtgttagcctgtgga

SEQ ID NO: 368273 - DNA, 25 bp, Mus musculus
agctctcgcggagcccaagaacgtt

SEQ ID NO: 368274 - DNA, 25 bp, Mus musculus
ctgcttttctgacagctggcggtgc

SEQ ID NO: 368275 - DNA, 25 bp, Mus musculus
gcgaagggccgcagagtcaccctac

SEQ ID NO: 368276 - DNA, 25 bp, Mus musculus
gaggcctctggccagttctgctttt

SEQ ID NO: 368277 - DNA, 25 bp, Mus musculus
ggcctcgaatcgtagctctcgcgga

SEQ ID NO: 368278 - DNA, 25 bp, Mus musculus
tctcgcagtcgatgaagctccagtc

SEQ ID NO: 368279 - DNA, 25 bp, Mus musculus
agtcccgcccttcctatagagcaga

SEQ ID NO: 368280 - DNA, 25 bp, Mus musculus
cttcgcttctagaaccgcgagtggg

SEQ ID NO: 368281 - DNA, 25 bp, Mus musculus
ccaaggaggtcgctccaggttccca

SEQ ID NO: 368282 - DNA, 25 bp, Mus musculus
ggcgcgctagggttgcagatcaacc

SEQ ID NO: 368283 - DNA, 25 bp, Mus musculus
ccacagagatcggagggaacgagtc

SEQ ID NO: 368284 - DNA, 25 bp, Mus musculus
gggtgttttaccatggctgaggcca

SEQ ID NO: 368285 - DNA, 25 bp, Mus musculus
ccaggatgaggcgattgagattgta

SEQ ID NO: 368286 - DNA, 25 bp, Mus musculus
ctcaccctgagcagcgtcgaggaag

SEQ ID NO: 368287 - DNA, 25 bp, Mus musculus
ggcaacccgaaggtgcgacaatcga

SEQ ID NO: 368288 - DNA, 25 bp, Mus musculus
agctgcagaggcacctagggacctg

SEQ ID NO: 368289 - DNA, 25 bp, Mus musculus
caacatggacacagaggcacccgca

SEQ ID NO: 368290 - DNA, 25 bp, Mus musculus
gctctgggttagactctcagggtga

SEQ ID NO: 368291 - DNA, 25 bp, Mus musculus
aggcagaatctggtcaggaagcgca

SEQ ID NO: 368292 - DNA, 25 bp, Mus musculus
gatcaacccagaagtccagggactt

SEQ ID NO: 368293 - DNA, 25 bp, Mus musculus
ccagggacttgcaggggacaacatg

SEQ ID NO: 368294 - DNA, 25 bp, Mus musculus
tgccgatgccgatgcccgacgtgac

SEQ ID NO: 368295 - DNA, 25 bp, Mus musculus
tgacatgccgatgccgatgcccgac

SEQ ID NO: 368296 - DNA, 25 bp, Mus musculus
ctcatggctgacatgccgatgccga

SEQ ID NO: 368297 - DNA, 25 bp, Mus musculus
agaggccgagctcatggctgacatg

SEQ ID NO: 368298 - DNA, 25 bp, Mus musculus
ccgaggcgccgtagtatagatggta

SEQ ID NO: 368299 - DNA, 25 bp, Mus musculus
catggagaactggtaggaaccggcc

SEQ ID NO: 368300 - DNA, 25 bp, Mus musculus
tccaccacgtcgctctggctgggga

SEQ ID NO: 368301 - DNA, 25 bp, Mus musculus
ctcgatggcgatggcgctcagctca

SEQ ID NO: 368302 - DNA, 25 bp, Mus musculus
ggcgctcagctcagtagggccgcca

SEQ ID NO: 368303 - DNA, 25 bp, Mus musculus
caggcccagtccctcgatggcgatg

SEQ ID NO: 368304 - DNA, 25 bp, Mus musculus
tgcatggacggcaggcccagtccct

SEQ ID NO: 368305 - DNA, 25 bp, Mus musculus
agttgctatggctgccctcggtctc

SEQ ID NO: 368306 - DNA, 25 bp, Mus musculus
tgggcgagttgctatggctgccctc

SEQ ID NO: 368307 - DNA, 25 bp, Mus musculus
ctccgcccaccatggagaactggta

SEQ ID NO: 368308 - DNA, 25 bp, Mus musculus
agccgattgagtaaggaccctgaaa

SEQ ID NO: 368309 - DNA, 25 bp, Mus musculus
ccagggtggtcagctagtacctcca

SEQ ID NO: 368310 - DNA, 25 bp, Mus musculus
ggtcagctagtacctccaccatgct

SEQ ID NO: 368311 - DNA, 25 bp, Mus musculus
ctccaccatgctgcggtcgccgctc

SEQ ID NO: 368312 - DNA, 25 bp, Mus musculus
gtcgccgctcctcagcttgctggcc

SEQ ID NO: 368313 - DNA, 25 bp, Mus musculus
gctcatcttgccggggctcagcgcg

SEQ ID NO: 368314 - DNA, 25 bp, Mus musculus
ctcgtgctggcatctacggggatac

SEQ ID NO: 368315 - DNA, 25 bp, Mus musculus
ggcatctacggggatacgcatcaca

SEQ ID NO: 368316 - DNA, 25 bp, Mus musculus
gctcctactagacggcgacaggggc

SEQ ID NO: 368317 - DNA, 25 bp, Mus musculus
cactagctcgccagggtggtcagct

SEQ ID NO: 368318 - DNA, 25 bp, Mus musculus
acagctcctactagacggcgacagg

SEQ ID NO: 368319 - DNA, 25 bp, Mus musculus
cgcatcacaacaagccgattgagta

SEQ ID NO: 368320 - DNA, 25 bp, Mus musculus
tacggggatacgcatcacaacaagc

SEQ ID NO: 368321 - DNA, 25 bp, Mus musculus
gtaaggaccctgaaaacagctccta

SEQ ID NO: 368322 - DNA, 25 bp, Mus musculus
actctgtcgcccgactgggacttcg

SEQ ID NO: 368323 - DNA, 25 bp, Mus musculus
aggaacggaatgtgccctgagaaca

SEQ ID NO: 368324 - DNA, 25 bp, Mus musculus
ctcccggaatcggtgacgggccagc

SEQ ID NO: 368325 - DNA, 25 bp, Mus musculus
tctgcgtgaccgtgtggtcgcgtct

SEQ ID NO: 368326 - DNA, 25 bp, Mus musculus
ctgggacttcgaccgcgtggacgac

SEQ ID NO: 368327 - DNA, 25 bp, Mus musculus
cgatggccgtggacactctgtcgcc

SEQ ID NO: 368328 - DNA, 25 bp, Mus musculus
gccgaagccggaagtcacgtgccgt

SEQ ID NO: 368329 - DNA, 25 bp, Mus musculus
gtggacgacggctctcagagtaagc

SEQ ID NO: 368330 - DNA, 25 bp, Mus musculus
agcaggcggtcgactcgctttccca

SEQ ID NO: 368331 - DNA, 25 bp, Mus musculus
ggcagccatcactatggcggccgcg

SEQ ID NO: 368332 - DNA, 25 bp, Mus musculus
gatgccaacggcagccatcactatg

SEQ ID NO: 368333 - DNA, 25 bp, Mus musculus
accaggaaaggatgcaggatgccaa

SEQ ID NO: 368334 - DNA, 25 bp, Mus musculus
tcgtgaacggcagcgagaccaggaa

SEQ ID NO: 368335 - DNA, 25 bp, Mus musculus
tgagaacagtcgtgaacggcagcga

SEQ ID NO: 368336 - DNA, 25 bp, Mus musculus
tttagtgtcttttctctgcggctgg

SEQ ID NO: 368337 - DNA, 25 bp, Mus musculus
tttgcatagaggagaccgacggcca

SEQ ID NO: 368338 - DNA, 25 bp, Mus musculus
ccggagctctccttcaggcaacgaa

SEQ ID NO: 368339 - DNA, 25 bp, Mus musculus
tcgcagagttgctttatttagtgtc

SEQ ID NO: 368340 - DNA, 25 bp, Mus musculus
tgggttttaagcatcctctccttcg

SEQ ID NO: 368341 - DNA, 25 bp, Mus musculus
gccactgctccaccgcagaagtttt

SEQ ID NO: 368342 - DNA, 25 bp, Mus musculus
cattccctcagctcgtttgcataga

SEQ ID NO: 368343 - DNA, 25 bp, Mus musculus
ctccctgggccagactagcagctga

SEQ ID NO: 368344 - DNA, 25 bp, Mus musculus
actgcagtccatgagccaaggcttg

SEQ ID NO: 368345 - DNA, 25 bp, Mus musculus
ggaatggtccctaggcagccttgca

SEQ ID NO: 368346 - DNA, 25 bp, Mus musculus
catgtttgcccgaagccaggcccag

SEQ ID NO: 368347 - DNA, 25 bp, Mus musculus
tggacacaaagctgccaccgcgagg

SEQ ID NO: 368348 - DNA, 25 bp, Mus musculus
aggttcagatcccacgccaggcagc

SEQ ID NO: 368349 - DNA, 25 bp, Mus musculus
gtggcaccgagtcatttaaacaagg

SEQ ID NO: 368350 - DNA, 25 bp, Mus musculus
gtccactgatgctgcgcacaccgtg

SEQ ID NO: 368351 - DNA, 25 bp, Mus musculus
ctgatgctgcgcacacggtgaagaa

SEQ ID NO: 368352 - DNA, 25 bp, Mus musculus
gaacggagccacccactgatgctgc

SEQ ID NO: 368353 - DNA, 25 bp, Mus musculus
actgatgctgcgcacacggtgaaga

SEQ ID NO: 368354 - DNA, 25 bp, Mus musculus
gagccgtccactgatgctgcgcaca

SEQ ID NO: 368355 - DNA, 25 bp, Mus musculus
ctgcgcacaccgtggagaacggagc

SEQ ID NO: 368356 - DNA, 25 bp, Mus musculus
gtggagaacggagccacccactgat

SEQ ID NO: 368357 - DNA, 25 bp, Mus musculus
cgtccactgatgctgcgcacacggt

SEQ ID NO: 368358 - DNA, 25 bp, Mus musculus
tgcgcacacggtgaagaacggagcc

SEQ ID NO: 368359 - DNA, 25 bp, Mus musculus
tgcgcacaccgtggagaacggagcc

SEQ ID NO: 368360 - DNA, 25 bp, Mus musculus
gaacggagccgtccactgatgctgc

SEQ ID NO: 368361 - DNA, 25 bp, Mus musculus
gtggagaacggagccgtccactgat

SEQ ID NO: 368362 - DNA, 25 bp, Mus musculus
gaacagagccgtccactgatgctgc

SEQ ID NO: 368363 - DNA, 25 bp, Mus musculus
tccactgatgctgcgcacaccgtgg

SEQ ID NO: 368364 - DNA, 25 bp, Mus musculus
gttccacacgcgcagaggaaattgg

SEQ ID NO: 368365 - DNA, 25 bp, Mus musculus
gtcctggagcccacgtgtggtgcac

SEQ ID NO: 368366 - DNA, 25 bp, Mus musculus
acgcctgcgcagtagtcgctctggt

SEQ ID NO: 368367 - DNA, 25 bp, Mus musculus
tggacggaccggacatcaatcaatc

SEQ ID NO: 368368 - DNA, 25 bp, Mus musculus
tcctggctcgcagtcctggacggac

SEQ ID NO: 368369 - DNA, 25 bp, Mus musculus
tcagtgatggccacacgccacagcg

SEQ ID NO: 368370 - DNA, 25 bp, Mus musculus
ttccgggagaggttccacacgcgca

SEQ ID NO: 368371 - DNA, 25 bp, Mus musculus
caccggggcctcagtgatggccaca

SEQ ID NO: 368372 - DNA, 25 bp, Mus musculus
tggtcctgacttccgttccgggaga

SEQ ID NO: 368373 - DNA, 25 bp, Mus musculus
aggaaattggggtctggagctacac

SEQ ID NO: 368374 - DNA, 25 bp, Mus musculus
ctccaccagctacggagaaagcggc

SEQ ID NO: 368375 - DNA, 25 bp, Mus musculus
ggaagtgctcctgcttaccttagaa

SEQ ID NO: 368376 - DNA, 25 bp, Mus musculus
tggtgcacaaggacgcgcagttcca

SEQ ID NO: 368377 - DNA, 25 bp, Mus musculus
ggagctacacagaactcaaaaaagc

SEQ ID NO: 368378 - DNA, 25 bp, Mus musculus
cccacagatttcgaagttcgcgttc

SEQ ID NO: 368379 - DNA, 25 bp, Mus musculus
ttcagcgctggagtacccttctccg

SEQ ID NO: 368380 - DNA, 25 bp, Mus musculus
caccgcaatgttcagcgctggagta

SEQ ID NO: 368381 - DNA, 25 bp, Mus musculus
tgtgacccagcagcaccgcaatgtt

SEQ ID NO: 368382 - DNA, 25 bp, Mus musculus
gtcacgtcgtggctgtgacccagca

SEQ ID NO: 368383 - DNA, 25 bp, Mus musculus
aggtcgcacacatgcgtgatgaggc

SEQ ID NO: 368384 - DNA, 25 bp, Mus musculus
ttcgaagttcgcgttctgtcacgtc

SEQ ID NO: 368385 - DNA, 25 bp, Mus musculus
cccggacatgaggtcgcacacatgc

SEQ ID NO: 368386 - DNA, 25 bp, Mus musculus
cgttcacatccaggggcaagccggt

SEQ ID NO: 368387 - DNA, 25 bp, Mus musculus
caccacgttcacatccaggggcaag

SEQ ID NO: 368388 - DNA, 25 bp, Mus musculus
gttcatcaataacgccaccacgttc

SEQ ID NO: 368389 - DNA, 25 bp, Mus musculus
gggtcagtgcggttcatcaataacg

SEQ ID NO: 368390 - DNA, 25 bp, Mus musculus
ggctcttagggtcagtgcggttcat

SEQ ID NO: 368391 - DNA, 25 bp, Mus musculus
gttcgcgttctgtcacgtcgtggct

SEQ ID NO: 368392 - DNA, 25 bp, Mus musculus
gtcttccagcagacccgtggcgctg

SEQ ID NO: 368393 - DNA, 25 bp, Mus musculus
tttctgctcaaggaatacggaggcc

SEQ ID NO: 368394 - DNA, 25 bp, Mus musculus
agcattcgcgcactgcgcgactttc

SEQ ID NO: 368395 - DNA, 25 bp, Mus musculus
atcgacaacccgcagagcattcgcg

SEQ ID NO: 368396 - DNA, 25 bp, Mus musculus
agcggggccaaacggcagtgcaaaa

SEQ ID NO: 368397 - DNA, 25 bp, Mus musculus
tgcgacattgtcgacgccaatttca

SEQ ID NO: 368398 - DNA, 25 bp, Mus musculus
cgcatgcgtgctaggtgcgacattg

SEQ ID NO: 368399 - DNA, 25 bp, Mus musculus
cggtgctaacaaaggaatcggattc

SEQ ID NO: 368400 - DNA, 25 bp, Mus musculus
tcacgcagccatgtcttccagcaga

SEQ ID NO: 368401 - DNA, 25 bp, Mus musculus
caagttccttggtctccgacggcct

SEQ ID NO: 368402 - DNA, 25 bp, Mus musculus
agaggcagagtttgcgccaagttcc

SEQ ID NO: 368403 - DNA, 25 bp, Mus musculus
tccagcagcctcgagaggcagagtt

SEQ ID NO: 368404 - DNA, 25 bp, Mus musculus
tcggattcgcgatcactcgtgacct

SEQ ID NO: 368405 - DNA, 25 bp, Mus musculus
agtgaaccggtcttgaaccactctc

SEQ ID NO: 368406 - DNA, 25 bp, Mus musculus
ctctgggatccggaggctgcgccat

SEQ ID NO: 368407 - DNA, 25 bp, Mus musculus
atcggctttgcgatcacgcgtgacc

SEQ ID NO: 368408 - DNA, 25 bp, Mus musculus
agcatccgtgcgctgcgcgactttc

SEQ ID NO: 368409 - DNA, 25 bp, Mus musculus
cgactttctgcgcaaggagtacggg

SEQ ID NO: 368410 - DNA, 25 bp, Mus musculus
caacaacgcgggcatcgcctttaga

SEQ ID NO: 368411 - DNA, 25 bp, Mus musculus
cgggcatcgcctttagaagtaggtg

SEQ ID NO: 368412 - DNA, 25 bp, Mus musculus
ccatcaggtggtccgtgtgtccctc

SEQ ID NO: 368413 - DNA, 25 bp, Mus musculus
atcgacgacccgcagagcatccgtg

SEQ ID NO: 368414 - DNA, 25 bp, Mus musculus
ctggggctaacaaaggcatcggctt

SEQ ID NO: 368415 - DNA, 25 bp, Mus musculus
tgtccctctgacatgtcgtcctgca

SEQ ID NO: 368416 - DNA, 25 bp, Mus musculus
tacgccacggttttgaccacgcgtg

SEQ ID NO: 368417 - DNA, 25 bp, Mus musculus
aatctagtcctacgccacggttttg

SEQ ID NO: 368418 - DNA, 25 bp, Mus musculus
agcgccgggtcccagaatctagtcc

SEQ ID NO: 368419 - DNA, 25 bp, Mus musculus
tggccctggtaactggggctaacaa

SEQ ID NO: 368420 - DNA, 25 bp, Mus musculus
ctgccgaagcgcagagccgccttgt

SEQ ID NO: 368421 - DNA, 25 bp, Mus musculus
tagagtcccgcccacgaggagagag

SEQ ID NO: 368422 - DNA, 25 bp, Mus musculus
aggcgccgccataccgttaaggctc

SEQ ID NO: 368423 - DNA, 25 bp, Mus musculus
ttcgaggtctctgccgaagcgcaga

SEQ ID NO: 368424 - DNA, 25 bp, Mus musculus
tctccgccctatgtgactgaccagg

SEQ ID NO: 368425 - DNA, 25 bp, Mus musculus
gtgggcttcagacccggccttctgc

SEQ ID NO: 368426 - DNA, 25 bp, Mus musculus
gtcgaatggccaccgctgtcagcct

SEQ ID NO: 368427 - DNA, 25 bp, Mus musculus
ctagccggcccagggccgttctgga

SEQ ID NO: 368428 - DNA, 25 bp, Mus musculus
ggcagggcttccaggttccctaatg

SEQ ID NO: 368429 - DNA, 25 bp, Mus musculus
caggttccctaatggtgtcccagca

SEQ ID NO: 368430 - DNA, 25 bp, Mus musculus
tggtgtcccagcagccggcgtgcac

SEQ ID NO: 368431 - DNA, 25 bp, Mus musculus
ataagccgcggaggaggtgctcacc

SEQ ID NO: 368432 - DNA, 25 bp, Mus musculus
ctcagcctttgttgggcagggcttc

SEQ ID NO: 368433 - DNA, 25 bp, Mus musculus
gcagcgatacctccgccttcgaggt

SEQ ID NO: 368434 - DNA, 25 bp, Mus musculus
cagctgttgtgggagccgcgccctc

SEQ ID NO: 368435 - DNA, 25 bp, Mus musculus
gccggtcctggctttgtagctcact

SEQ ID NO: 368436 - DNA, 25 bp, Mus musculus
tctgcggcgcccgacagctgttgtg

SEQ ID NO: 368437 - DNA, 25 bp, Mus musculus
cgccatgtctcctcgctcggaggag

SEQ ID NO: 368438 - DNA, 25 bp, Mus musculus
ctttgtagctcactcaagatggcgg

SEQ ID NO: 368439 - DNA, 25 bp, Mus musculus
ggcggactcgtagcctcccagtcgg

SEQ ID NO: 368440 - DNA, 25 bp, Mus musculus
tggcctggtgttgtcggttccgccc

SEQ ID NO: 368441 - DNA, 25 bp, Mus musculus
tcgcctttgcccgaggcggaaatga

SEQ ID NO: 368442 - DNA, 25 bp, Mus musculus
cctctgctgagaatcctaattcgcc

SEQ ID NO: 368443 - DNA, 25 bp, Mus musculus
tccagctacgcgaggcgaggagctc

SEQ ID NO: 368444 - DNA, 25 bp, Mus musculus
cgcgccaatcttcaatctcaaggtc

SEQ ID NO: 368445 - DNA, 25 bp, Mus musculus
ctcgcggcatctcggggcaagccga

SEQ ID NO: 368446 - DNA, 25 bp, Mus musculus
ttcaatctcaaggtccagctacgcg

SEQ ID NO: 368447 - DNA, 25 bp, Mus musculus
accgggatccgcctcagcgcggtga

SEQ ID NO: 368448 - DNA, 25 bp, Mus musculus
tctcgggttagcacgtcaaagctgg

SEQ ID NO: 368449 - DNA, 25 bp, Mus musculus
gctgctgttggctaagcgtgcaatc

SEQ ID NO: 368450 - DNA, 25 bp, Mus musculus
gcgtgcaatcagctgcctgcgtctc

SEQ ID NO: 368451 - DNA, 25 bp, Mus musculus
gtaggacgtcttgcatctcgggtta

SEQ ID NO: 368452 - DNA, 25 bp, Mus musculus
tcaaagctggacgagcctggactcc

SEQ ID NO: 368453 - DNA, 25 bp, Mus musculus
accgagttactgcaggtaggtttgc

SEQ ID NO: 368454 - DNA, 25 bp, Mus musculus
taggtttgctgatacccggcttccg

SEQ ID NO: 368455 - DNA, 25 bp, Mus musculus
agaaggcagttcgtcccagaccaca

SEQ ID NO: 368456 - DNA, 25 bp, Mus musculus
cgggatgatagccagtactccggta

SEQ ID NO: 368457 - DNA, 25 bp, Mus musculus
aacacgatgctctgtgctgcccgtc

SEQ ID NO: 368458 - DNA, 25 bp, Mus musculus
tctcttccggaaccgtacactggtg

SEQ ID NO: 368459 - DNA, 25 bp, Mus musculus
ctacctgcgggagcattttagctga

SEQ ID NO: 368460 - DNA, 25 bp, Mus musculus
cgtcgctaatggcttctgtgctctt

SEQ ID NO: 368461 - DNA, 25 bp, Mus musculus
tccgatgagcatgtgacactgacgc

SEQ ID NO: 368462 - DNA, 25 bp, Mus musculus
aggcaggagatgaccatgagcgccc

SEQ ID NO: 368463 - DNA, 25 bp, Mus musculus
caacaggcaggagatgaccatgagc

SEQ ID NO: 368464 - DNA, 25 bp, Mus musculus
cgacaacaggcaggagatgaccatg

SEQ ID NO: 368465 - DNA, 25 bp, Mus musculus
aggccatgcccgacaacaggcagga

SEQ ID NO: 368466 - DNA, 25 bp, Mus musculus
cattcgtggtccaggacacggccac

SEQ ID NO: 368467 - DNA, 25 bp, Mus musculus
aggcgcaggccatgcccgacaacag

SEQ ID NO: 368468 - DNA, 25 bp, Mus musculus
cccgacaacaggcaggagatgacca

SEQ ID NO: 368469 - DNA, 25 bp, Mus musculus
tgcctttggcgcagcgtgtgcactt

SEQ ID NO: 368470 - DNA, 25 bp, Mus musculus
cagcactgcaaaggtggtcttggcg

SEQ ID NO: 368471 - DNA, 25 bp, Mus musculus
cccagcactgcaaaggtggtcttgg

SEQ ID NO: 368472 - DNA, 25 bp, Mus musculus
accatgcacagcaggccggccagca

SEQ ID NO: 368473 - DNA, 25 bp, Mus musculus
tggtccaggacacggccaccatgca

SEQ ID NO: 368474 - DNA, 25 bp, Mus musculus
cacttcatgcccactactgcgcagg

SEQ ID NO: 368475 - DNA, 25 bp, Mus musculus
ggacacggccaccatgcacagcagg

SEQ ID NO: 368476 - DNA, 25 bp, Mus musculus
caccggaagtgtggcgaccacgctt

SEQ ID NO: 368477 - DNA, 25 bp, Mus musculus
agcgcctcctccagcaggagcttgt

SEQ ID NO: 368478 - DNA, 25 bp, Mus musculus
ctccagcaggagcttgtccacggcg

SEQ ID NO: 368479 - DNA, 25 bp, Mus musculus
gcgctcggggacttgagacttagct

SEQ ID NO: 368480 - DNA, 25 bp, Mus musculus
tcggggacttgagacttagctcgga

SEQ ID NO: 368481 - DNA, 25 bp, Mus musculus
ttgagacttagctcggagcccgcgc

SEQ ID NO: 368482 - DNA, 25 bp, Mus musculus
cccgctgccgggatcaacaggaagt

SEQ ID NO: 368483 - DNA, 25 bp, Mus musculus
atcaacaggaagtgtggcaggcgcc

SEQ ID NO: 368484 - DNA, 25 bp, Mus musculus
caggcgccggacatgtagacagtcc

SEQ ID NO: 368485 - DNA, 25 bp, Mus musculus
cagtccgggacaggacaccggaagt

SEQ ID NO: 368486 - DNA, 25 bp, Mus musculus
aagtgtggcgaccacgcttccgtcc

SEQ ID NO: 368487 - DNA, 25 bp, Mus musculus
agcgcagcagcaccgggaggttccg

SEQ ID NO: 368488 - DNA, 25 bp, Mus musculus
ccgtgctcatggcgcatctccgggt

SEQ ID NO: 368489 - DNA, 25 bp, Mus musculus
ccggacatgtagacagtccgggaca

SEQ ID NO: 368490 - DNA, 25 bp, Mus musculus
aagctgaggcccacgcaggggtaaa

SEQ ID NO: 368491 - DNA, 25 bp, Mus musculus
ttccgatagctaccagacggatccc

SEQ ID NO: 368492 - DNA, 25 bp, Mus musculus
ctgaggcccacgcaggggtaaaaga

SEQ ID NO: 368493 - DNA, 25 bp, Mus musculus
cccacgcaggggtaaaagactcact

SEQ ID NO: 368494 - DNA, 25 bp, Mus musculus
cgcagcaattccacaacgggggaca

SEQ ID NO: 368495 - DNA, 25 bp, Mus musculus
tggcttccgatagctaccagacgga

SEQ ID NO: 368496 - DNA, 25 bp, Mus musculus
ggacacggaagctgaggcccacgca

SEQ ID NO: 368497 - DNA, 25 bp, Mus musculus
cacgcaggggtaaaagactcactgg

SEQ ID NO: 368498 - DNA, 25 bp, Mus musculus
caggggtaaaagactcactggcttc

SEQ ID NO: 368499 - DNA, 25 bp, Mus musculus
gggtaaaagactcactggcttccga

SEQ ID NO: 368500 - DNA, 25 bp, Mus musculus
gtaaaagactcactggcttccgata

SEQ ID NO: 368501 - DNA, 25 bp, Mus musculus
aagactcactggcttccgatagcta

SEQ ID NO: 368502 - DNA, 25 bp, Mus musculus
actcactggcttccgatagctacca

SEQ ID NO: 368503 - DNA, 25 bp, Mus musculus
tcactggcttccgatagctaccaga

SEQ ID NO: 368504 - DNA, 25 bp, Mus musculus
ggagctgagccgctcccgccgaatt

SEQ ID NO: 368505 - DNA, 25 bp, Mus musculus
gctcccgccgaattgagactcttca

SEQ ID NO: 368506 - DNA, 25 bp, Mus musculus
taccggagtttcagcggtcccaggc

SEQ ID NO: 368507 - DNA, 25 bp, Mus musculus
ccaggccactggttcccgtgtagaa

SEQ ID NO: 368508 - DNA, 25 bp, Mus musculus
ttcccgtgtagaaagaacttgtgga

SEQ ID NO: 368509 - DNA, 25 bp, Mus musculus
gagacccagcttatgcgacttccca

SEQ ID NO: 368510 - DNA, 25 bp, Mus musculus
gcgcgagagtcacgctcactgagca

SEQ ID NO: 368511 - DNA, 25 bp, Mus musculus
gctcactgagcaaacctctaggttc

SEQ ID NO: 368512 - DNA, 25 bp, Mus musculus
actcttcacgcggagtgcgagcctg

SEQ ID NO: 368513 - DNA, 25 bp, Mus musculus
tctaggttcaggagagctgtggacc

SEQ ID NO: 368514 - DNA, 25 bp, Mus musculus
agctgtggacctgccgccaggtttt

SEQ ID NO: 368515 - DNA, 25 bp, Mus musculus
gttttcagtctgaaaaaggccagaa

SEQ ID NO: 368516 - DNA, 25 bp, Mus musculus
ccaactcgcacagggtccagaaggt

SEQ ID NO: 368517 - DNA, 25 bp, Mus musculus
ggccagaaaaatcccatcaccaact

SEQ ID NO: 368518 - DNA, 25 bp, Mus musculus
gcagtggccaggatatggaaatccc

SEQ ID NO: 368519 - DNA, 25 bp, Mus musculus
ttacttgcccggagcggctaaaggc

SEQ ID NO: 368520 - DNA, 25 bp, Mus musculus
tgctccgtacacgtgcaccgtacta

SEQ ID NO: 368521 - DNA, 25 bp, Mus musculus
gcaccgtactactgcaggacccaga

SEQ ID NO: 368522 - DNA, 25 bp, Mus musculus
ctcaagcgcgaagcgtgagcacctc

SEQ ID NO: 368523 - DNA, 25 bp, Mus musculus
gtctacaactcctcgaaggccttcg

SEQ ID NO: 368524 - DNA, 25 bp, Mus musculus
ggcctgcaagcttttctcgggcttg

SEQ ID NO: 368525 - DNA, 25 bp, Mus musculus
gggtttccaaggtcagactctctgc

SEQ ID NO: 368526 - DNA, 25 bp, Mus musculus
tttacagccaccaagcgagccacgg

SEQ ID NO: 368527 - DNA, 25 bp, Mus musculus
ctgcgtctctgtctgggatccaaga

SEQ ID NO: 368528 - DNA, 25 bp, Mus musculus
tccaagacgcctgggaaatggcatc

SEQ ID NO: 368529 - DNA, 25 bp, Mus musculus
gaaatggcatctgacccgcgtcgga

SEQ ID NO: 368530 - DNA, 25 bp, Mus musculus
ccgcgtcggaagatttaggctccaa

SEQ ID NO: 368531 - DNA, 25 bp, Mus musculus
agaatctgcttcacgcgagtggtta

SEQ ID NO: 368532 - DNA, 25 bp, Mus musculus
ccgaaggcgggtctgccataaacaa

SEQ ID NO: 368533 - DNA, 25 bp, Mus musculus
cagctacctgaagatgcgcgcggtc

SEQ ID NO: 368534 - DNA, 25 bp, Mus musculus
ggacaaagcgtccatcatccgactc

SEQ ID NO: 368535 - DNA, 25 bp, Mus musculus
gccatcacctcgcagctggacaaag

SEQ ID NO: 368536 - DNA, 25 bp, Mus musculus
ggcgagttttacgagctggccaagc

SEQ ID NO: 368537 - DNA, 25 bp, Mus musculus
cgcagcgaggtctaatatgcccaga

SEQ ID NO: 368538 - DNA, 25 bp, Mus musculus
ccttgcagaagacgttgggtgctcc

SEQ ID NO: 368539 - DNA, 25 bp, Mus musculus
cgcagctggtttgcgacggactcag

SEQ ID NO: 368540 - DNA, 25 bp, Mus musculus
gatcaggtccacacgggacggtcca

SEQ ID NO: 368541 - DNA, 25 bp, Mus musculus
gactaaacagggtcggcgcctgctc

SEQ ID NO: 368542 - DNA, 25 bp, Mus musculus
gcagcgggtacaagccctcctttaa

SEQ ID NO: 368543 - DNA, 25 bp, Mus musculus
ggaaagcgcaccgagctcaggcttg

SEQ ID NO: 368544 - DNA, 25 bp, Mus musculus
acaaacgcagctcggtcacacgtgg

SEQ ID NO: 368545 - DNA, 25 bp, Mus musculus
ccggctgcagaaaggaggcttccgt

SEQ ID NO: 368546 - DNA, 25 bp, Mus musculus
agttggggcaaactccagccttggc

SEQ ID NO: 368547 - DNA, 25 bp, Mus musculus
agcagccaccaggtttagcgggttc

SEQ ID NO: 368548 - DNA, 25 bp, Mus musculus
agacacgcgcgcttttctgcgcata

SEQ ID NO: 368549 - DNA, 25 bp, Mus musculus
cggccagctggagccttcaaacgtc

SEQ ID NO: 368550 - DNA, 25 bp, Mus musculus
gtcctcagacggtgtgcacacaagc

SEQ ID NO: 368551 - DNA, 25 bp, Mus musculus
tgtgccaggtgcacaacagtgcttg

SEQ ID NO: 368552 - DNA, 25 bp, Mus musculus
cttgcctgaaaatgcctgtacggtc

SEQ ID NO: 368553 - DNA, 25 bp, Mus musculus
ctgtacggtcgtgcacgcgtgtaca

SEQ ID NO: 368554 - DNA, 25 bp, Mus musculus
cttcggctcgggtgttgttgcaccc

SEQ ID NO: 368555 - DNA, 25 bp, Mus musculus
cagccttggctttttagggtgagca

SEQ ID NO: 368556 - DNA, 25 bp, Mus musculus
tatatcctcccaggcccgggaagtc

SEQ ID NO: 368557 - DNA, 25 bp, Mus musculus
cgggaagtccgtatcaccaactagg

SEQ ID NO: 368558 - DNA, 25 bp, Mus musculus
ctcttcaccggttgagcctatatcc

SEQ ID NO: 368559 - DNA, 25 bp, Mus musculus
caactaggacgtacctgtagccgga

SEQ ID NO: 368560 - DNA, 25 bp, Mus musculus
agctctcctgtggacgctggtttgt

SEQ ID NO: 368561 - DNA, 25 bp, Mus musculus
tgagagactcctatatcgttttccc

SEQ ID NO: 368562 - DNA, 25 bp, Mus musculus
tgctctgggaaacgatgatacgggc

SEQ ID NO: 368563 - DNA, 25 bp, Mus musculus
tggataagctcggacgctgccgtta

SEQ ID NO: 368564 - DNA, 25 bp, Mus musculus
cgctgccgttaagagaaaagggatc

SEQ ID NO: 368565 - DNA, 25 bp, Mus musculus
gggtgggcctgagtgtaacatctca

SEQ ID NO: 368566 - DNA, 25 bp, Mus musculus
tacagcgggcaattgtcaccgggcc

SEQ ID NO: 368567 - DNA, 25 bp, Mus musculus
aatagcggcctgctggatggacact

SEQ ID NO: 368568 - DNA, 25 bp, Mus musculus
atggacactctccagcgggtgacgg

SEQ ID NO: 368569 - DNA, 25 bp, Mus musculus
caacttgcctccctttgctctggga

SEQ ID NO: 368570 - DNA, 25 bp, Mus musculus
ctccgagagtttgtgagcagattcg

SEQ ID NO: 368571 - DNA, 25 bp, Mus musculus
tctcaggatttgaaagcgctacagc

SEQ ID NO: 368572 - DNA, 25 bp, Mus musculus
tgatacgggcaggaggacaagaaac

SEQ ID NO: 368573 - DNA, 25 bp, Mus musculus
ccaacgctgaggctccgagagtttg

SEQ ID NO: 368574 - DNA, 25 bp, Mus musculus
ctgtgaacctggcacgagcgtctct

SEQ ID NO: 368575 - DNA, 25 bp, Mus musculus
gaccaacggaggaggactaacgatg

SEQ ID NO: 368576 - DNA, 25 bp, Mus musculus
tgtgatggaggatcccatgactctg

SEQ ID NO: 368577 - DNA, 25 bp, Mus musculus
ccatgactctgtgcgtgatggagca

SEQ ID NO: 368578 - DNA, 25 bp, Mus musculus
cgaggaggaccctgtggctttctgt

SEQ ID NO: 368579 - DNA, 25 bp, Mus musculus
aggacctcgtcgcactgcaagagtg

SEQ ID NO: 368580 - DNA, 25 bp, Mus musculus
acgagcgtctctgtgcaaggccacc

SEQ ID NO: 368581 - DNA, 25 bp, Mus musculus
tgcagagcagaggatggacacgttt

SEQ ID NO: 368582 - DNA, 25 bp, Mus musculus
acacgtttctgagtgggcggcttcc

SEQ ID NO: 368583 - DNA, 25 bp, Mus musculus
agctgcggccactaccgcgaggagc

SEQ ID NO: 368584 - DNA, 25 bp, Mus musculus
cgcagttgcccttcgtgctgctcaa

SEQ ID NO: 368585 - DNA, 25 bp, Mus musculus
gaccgcattacctgggcgcctcggt

SEQ ID NO: 368586 - DNA, 25 bp, Mus musculus
tcggtcatcatcaccaacggcaggt

SEQ ID NO: 368587 - DNA, 25 bp, Mus musculus
cgcgtgtagctcaatgcaggaccga

SEQ ID NO: 368588 - DNA, 25 bp, Mus musculus
aaagctgcccttgcgtcggggacgc

SEQ ID NO: 368589 - DNA, 25 bp, Mus musculus
ttcccagcgagttccggtcgcgcga

SEQ ID NO: 368590 - DNA, 25 bp, Mus musculus
tcgcgcgactgcacgcatgcgcagt

SEQ ID NO: 368591 - DNA, 25 bp, Mus musculus
ccgactcacgctgcagtgctgggac

SEQ ID NO: 368592 - DNA, 25 bp, Mus musculus
acgctgcagtgctgggacgataccc

SEQ ID NO: 368593 - DNA, 25 bp, Mus musculus
ccatcctgctggtcgacggctccag

SEQ ID NO: 368594 - DNA, 25 bp, Mus musculus
tccgcagggtgatcgcactgagatc

SEQ ID NO: 368595 - DNA, 25 bp, Mus musculus
cgggaggcacttcccagcgagttcc

SEQ ID NO: 368596 - DNA, 25 bp, Mus musculus
gacacatttgcctctaggtacccac

SEQ ID NO: 368597 - DNA, 25 bp, Mus musculus
ggacgcgcagccagtctgccatctg

SEQ ID NO: 368598 - DNA, 25 bp, Mus musculus
agccaggcttgccattcgcgcagca

SEQ ID NO: 368599 - DNA, 25 bp, Mus musculus
gcagcaccgcgtgccagacacattt

SEQ ID NO: 368600 - DNA, 25 bp, Mus musculus
cgcgtgccagacacatttgcctcta

SEQ ID NO: 368601 - DNA, 25 bp, Mus musculus
tgatcgcactgagatcccgctgcgc

SEQ ID NO: 368602 - DNA, 25 bp, Mus musculus
acgcctctgccactgtccgggggat

SEQ ID NO: 368603 - DNA, 25 bp, Mus musculus
cagtttttaaacctggcgccgagtg

SEQ ID NO: 368604 - DNA, 25 bp, Mus musculus
atgatcccgggaggctaccgctgcc

SEQ ID NO: 368605 - DNA, 25 bp, Mus musculus
ctctgccactgtccgggggatgatc

SEQ ID NO: 368606 - DNA, 25 bp, Mus musculus
cgcggggacgcctctgccactgtcc

SEQ ID NO: 368607 - DNA, 25 bp, Mus musculus
acccgcaccatgagaccggaggcgg

SEQ ID NO: 368608 - DNA, 25 bp, Mus musculus
gacacccgcaccatgagaccggagg

SEQ ID NO: 368609 - DNA, 25 bp, Mus musculus
ctgagagattcgcgcgacacccgca

SEQ ID NO: 368610 - DNA, 25 bp, Mus musculus
ggctgagagattcgcgcgacacccg

SEQ ID NO: 368611 - DNA, 25 bp, Mus musculus
gggctgagagattcgcgcgacaccc

SEQ ID NO: 368612 - DNA, 25 bp, Mus musculus
tcgggctgagagattcgcgcgacac

SEQ ID NO: 368613 - DNA, 25 bp, Mus musculus
ttcagccagggggaccaggcgccgt

SEQ ID NO: 368614 - DNA, 25 bp, Mus musculus
ttttaaacctggcgccgagtgagcg

SEQ ID NO: 368615 - DNA, 25 bp, Mus musculus
gatgatcccgggaggctaccgctgc

SEQ ID NO: 368616 - DNA, 25 bp, Mus musculus
ttcgctctgcgggtctggttgacgt

SEQ ID NO: 368617 - DNA, 25 bp, Mus musculus
caggaggcccgggaccttgagtcct

SEQ ID NO: 368618 - DNA, 25 bp, Mus musculus
cgcatgcgcaccctaagccacgtga

SEQ ID NO: 368619 - DNA, 25 bp, Mus musculus
ccgcccttgcccttgtgggtgtgtt

SEQ ID NO: 368620 - DNA, 25 bp, Mus musculus
cttgtgggtgtgttccctttgtcca

SEQ ID NO: 368621 - DNA, 25 bp, Mus musculus
cctttgtccagtgaccctcgggcgt

SEQ ID NO: 368622 - DNA, 25 bp, Mus musculus
tccagtgaccctcgggcgtccttaa

SEQ ID NO: 368623 - DNA, 25 bp, Mus musculus
ttcccgcgttccgagcgctcgggga

SEQ ID NO: 368624 - DNA, 25 bp, Mus musculus
ggctggcccgctttgttcctacgct

SEQ ID NO: 368625 - DNA, 25 bp, Mus musculus
cctacgacggcgtgggcgtccttct

SEQ ID NO: 368626 - DNA, 25 bp, Mus musculus
gggcgtccttctcatcctctgagga

SEQ ID NO: 368627 - DNA, 25 bp, Mus musculus
tcatcctctgaggatggtggttccc

SEQ ID NO: 368628 - DNA, 25 bp, Mus musculus
tcactgccttccctgtggtgtgcgc

SEQ ID NO: 368629 - DNA, 25 bp, Mus musculus
gaccttgagtcctgcgagcaccgac

SEQ ID NO: 368630 - DNA, 25 bp, Mus musculus
tggagctcgcctgcttctggaaaga

SEQ ID NO: 368631 - DNA, 25 bp, Mus musculus
gccaccaatgcttggcccaggaacg

SEQ ID NO: 368632 - DNA, 25 bp, Mus musculus
cgaagaaagagagcgaaggtgaaca

SEQ ID NO: 368633 - DNA, 25 bp, Mus musculus
tcgcctgcttctggaaagaccgaga

SEQ ID NO: 368634 - DNA, 25 bp, Mus musculus
tcgagcctggagctcgcctgcttct

SEQ ID NO: 368635 - DNA, 25 bp, Mus musculus
ggcccatcctcaatttcgagcctgg

SEQ ID NO: 368636 - DNA, 25 bp, Mus musculus
gggcgcagttccttcggcccatcct

SEQ ID NO: 368637 - DNA, 25 bp, Mus musculus
acctgaggtccagagcgcggcttcc

SEQ ID NO: 368638 - DNA, 25 bp, Mus musculus
gtctcctccactgggacctgaggtc

SEQ ID NO: 368639 - DNA, 25 bp, Mus musculus
ttggcccaggaacgcgcagaaggct

SEQ ID NO: 368640 - DNA, 25 bp, Mus musculus
actttcaaccgccaccaatgcttgg

SEQ ID NO: 368641 - DNA, 25 bp, Mus musculus
cggaccacgccttctgccatgaccc

SEQ ID NO: 368642 - DNA, 25 bp, Mus musculus
gtgagacctgctgcggaccacgcct

SEQ ID NO: 368643 - DNA, 25 bp, Mus musculus
ggctagggctgtccctagtcccgcg

SEQ ID NO: 368644 - DNA, 25 bp, Mus musculus
aggcgccagctctggaagtggtctt

SEQ ID NO: 368645 - DNA, 25 bp, Mus musculus
cccacgacgcagagccaaggtttcg

SEQ ID NO: 368646 - DNA, 25 bp, Mus musculus
cgccagtatcctccgggcggacgag

SEQ ID NO: 368647 - DNA, 25 bp, Mus musculus
gccagatgttctgaggcgccaccgc

SEQ ID NO: 368648 - DNA, 25 bp, Mus musculus
agccgcgtctgctgccagatgttct

SEQ ID NO: 368649 - DNA, 25 bp, Mus musculus
ccggaagtgatagcaggaacgtgtc

SEQ ID NO: 368650 - DNA, 25 bp, Mus musculus
gcgaggccgcttcgcagcgtttttt

SEQ ID NO: 368651 - DNA, 25 bp, Mus musculus
gcgggagtgtgctctctgttctccc

SEQ ID NO: 368652 - DNA, 25 bp, Mus musculus
cacacacttccggaacgcgggagtg

SEQ ID NO: 368653 - DNA, 25 bp, Mus musculus
cgcggacaggggcacgaaacccaca

SEQ ID NO: 368654 - DNA, 25 bp, Mus musculus
ctggagaccgcagagcttgaagccc

SEQ ID NO: 368655 - DNA, 25 bp, Mus musculus
gattatccgcaaaggccgcaacttc

SEQ ID NO: 368656 - DNA, 25 bp, Mus musculus
taatcttgatgtccagagtggtccc

SEQ ID NO: 368657 - DNA, 25 bp, Mus musculus
cccggcgtgatacactttattcgct

SEQ ID NO: 368658 - DNA, 25 bp, Mus musculus
caaggacaatgcacgggatcagaaa

SEQ ID NO: 368659 - DNA, 25 bp, Mus musculus
tgtgctcggaagtcgggccgtgagc

SEQ ID NO: 368660 - DNA, 25 bp, Mus musculus
ttctgggcaaggacaatgcacggga

SEQ ID NO: 368661 - DNA, 25 bp, Mus musculus
cataatttcggtccccaccggcgtg

SEQ ID NO: 368662 - DNA, 25 bp, Mus musculus
gtcacccagtgcaccggaggggccg

SEQ ID NO: 368663 - DNA, 25 bp, Mus musculus
ccgtgagcgcgggtcacccagtgca

SEQ ID NO: 368664 - DNA, 25 bp, Mus musculus
acctggggacctggtgtgctcggaa

SEQ ID NO: 368665 - DNA, 25 bp, Mus musculus
agcctgctgcctgcgaggcccagtg

SEQ ID NO: 368666 - DNA, 25 bp, Mus musculus
gtcgggaggcgaggacgcaaggccc

SEQ ID NO: 368667 - DNA, 25 bp, Mus musculus
ggatcagaaaatggggctggcggtc

SEQ ID NO: 368668 - DNA, 25 bp, Mus musculus
atgcacgggatcagaaaatggggct

SEQ ID NO: 368669 - DNA, 25 bp, Mus musculus
gacaatgcacgggatcagaaaatgg

SEQ ID NO: 368670 - DNA, 25 bp, Mus musculus
ctgggcaaggacaatgcacgggatc

SEQ ID NO: 368671 - DNA, 25 bp, Mus musculus
tgagcgcgggtcacccagtgcaccg

SEQ ID NO: 368672 - DNA, 25 bp, Mus musculus
tgatagaccttgcagggagacgtca

SEQ ID NO: 368673 - DNA, 25 bp, Mus musculus
gagaaccgaggcgacacagtgatca

SEQ ID NO: 368674 - DNA, 25 bp, Mus musculus
actggctccctctggctggagggct

SEQ ID NO: 368675 - DNA, 25 bp, Mus musculus
tcgtttaggagcaaagtgatagacc

SEQ ID NO: 368676 - DNA, 25 bp, Mus musculus
acacagtgatcagcttcgcggcgag

SEQ ID NO: 368677 - DNA, 25 bp, Mus musculus
gtctctggataaaagcgggcgcagc

SEQ ID NO: 368678 - DNA, 25 bp, Mus musculus
cgaagcgacgcgtctctggataaaa

SEQ ID NO: 368679 - DNA, 25 bp, Mus musculus
gcgctgtcagcgcacgaagcgacgc

SEQ ID NO: 368680 - DNA, 25 bp, Mus musculus
tcaacgaatgctactcggttccagc

SEQ ID NO: 368681 - DNA, 25 bp, Mus musculus
gggaataaatcctcgtttaggagca

SEQ ID NO: 368682 - DNA, 25 bp, Mus musculus
ggagacgtcatgaaagccgcagatt

SEQ ID NO: 368683 - DNA, 25 bp, Mus musculus
ccttgagtggcagagggaataaatc

SEQ ID NO: 368684 - DNA, 25 bp, Mus musculus
tgaaagccgcagattcaacgaatgc

SEQ ID NO: 368685 - DNA, 25 bp, Mus musculus
ctccagccaggtgctgccgtctggt

SEQ ID NO: 368686 - DNA, 25 bp, Mus musculus
ctctcagggtgctgagtggctcagc

SEQ ID NO: 368687 - DNA, 25 bp, Mus musculus
gtgcactcgtgtccctgaacgccag

SEQ ID NO: 368688 - DNA, 25 bp, Mus musculus
gattgcgtgcactcgtgtccctgaa

SEQ ID NO: 368689 - DNA, 25 bp, Mus musculus
cgccaccacgagaaacggaggactt

SEQ ID NO: 368690 - DNA, 25 bp, Mus musculus
aggacttacccagagcccggtgctg

SEQ ID NO: 368691 - DNA, 25 bp, Mus musculus
gagaaacggaggacttacccagagc

SEQ ID NO: 368692 - DNA, 25 bp, Mus musculus
gccgggcagcactgactctcagggt

SEQ ID NO: 368693 - DNA, 25 bp, Mus musculus
gctcagctcctgctgtggcgcggac

SEQ ID NO: 368694 - DNA, 25 bp, Mus musculus
tgtgaatggagatcctctgtgtggc

SEQ ID NO: 368695 - DNA, 25 bp, Mus musculus
cgtgcaagtgtgaatggagatcctc

SEQ ID NO: 368696 - DNA, 25 bp, Mus musculus
cggaccttggggaagctctggctcc

SEQ ID NO: 368697 - DNA, 25 bp, Mus musculus
tggctcccgccaatcactgagcagg

SEQ ID NO: 368698 - DNA, 25 bp, Mus musculus
aatcactgagcagggctggcccgag

SEQ ID NO: 368699 - DNA, 25 bp, Mus musculus
ccagttcgtgggtacccgcgcgtgt

SEQ ID NO: 368700 - DNA, 25 bp, Mus musculus
tggacaccactgaggcccgtcagtc

SEQ ID NO: 368701 - DNA, 25 bp, Mus musculus
cggcgttgagcacagagtggacacc

SEQ ID NO: 368702 - DNA, 25 bp, Mus musculus
tccggctggttcctaggcacccagt

SEQ ID NO: 368703 - DNA, 25 bp, Mus musculus
tgcgcgatggtcctcagcagagact

SEQ ID NO: 368704 - DNA, 25 bp, Mus musculus
cagctcggacctgcagacagcctaa

SEQ ID NO: 368705 - DNA, 25 bp, Mus musculus
gttacttccttcaccgcggcgttga

SEQ ID NO: 368706 - DNA, 25 bp, Mus musculus
gagatcgggctggttacttccttca

SEQ ID NO: 368707 - DNA, 25 bp, Mus musculus
tagctggacctcctgggcataacgc

SEQ ID NO: 368708 - DNA, 25 bp, Mus musculus
tacggccctgcctttctagctggac

SEQ ID NO: 368709 - DNA, 25 bp, Mus musculus
gccatccgcaccgaggcagtaggag

SEQ ID NO: 368710 - DNA, 25 bp, Mus musculus
cgtatgagtctttcacgacgaagga

SEQ ID NO: 368711 - DNA, 25 bp, Mus musculus
gaaatcaggacccacacgtagctcc

SEQ ID NO: 368712 - DNA, 25 bp, Mus musculus
gggcaggctccaccgcagaagccta

SEQ ID NO: 368713 - DNA, 25 bp, Mus musculus
cgtagctccaagcacagggcaggct

SEQ ID NO: 368714 - DNA, 25 bp, Mus musculus
aagccaggatcctagggcacgcttc

SEQ ID NO: 368715 - DNA, 25 bp, Mus musculus
tctggtgctgctgaagaatcaatta

SEQ ID NO: 368716 - DNA, 25 bp, Mus musculus
tggcgcgcaaccttggtgctgaaac

SEQ ID NO: 368717 - DNA, 25 bp, Mus musculus
aacaaggccgacctaggtgtctggc

SEQ ID NO: 368718 - DNA, 25 bp, Mus musculus
cccgcgcaatccgacgttgtttgga

SEQ ID NO: 368719 - DNA, 25 bp, Mus musculus
cttaggacttgttctcagccagcga

SEQ ID NO: 368720 - DNA, 25 bp, Mus musculus
gaggcgcccaccacagcaacttagg

SEQ ID NO: 368721 - DNA, 25 bp, Mus musculus
ggccaccgcggttcacaacactgga

SEQ ID NO: 368722 - DNA, 25 bp, Mus musculus
gcgttcggttcctcacttggtcagc

SEQ ID NO: 368723 - DNA, 25 bp, Mus musculus
tttatgctccactccggacagcggc

SEQ ID NO: 368724 - DNA, 25 bp, Mus musculus
agccctggctcagctttatgctcca

SEQ ID NO: 368725 - DNA, 25 bp, Mus musculus
atctccagggctgattgctgccgcc

SEQ ID NO: 368726 - DNA, 25 bp, Mus musculus
ttcagatctctgctacggattcctc

SEQ ID NO: 368727 - DNA, 25 bp, Mus musculus
acatagttctcagcagtggccaccc

SEQ ID NO: 368728 - DNA, 25 bp, Mus musculus
aacgtggcagccatggtccctcagc

SEQ ID NO: 368729 - DNA, 25 bp, Mus musculus
ctccgagcgaggatacgccttccgt

SEQ ID NO: 368730 - DNA, 25 bp, Mus musculus
ccgacatgcggcgtgacctaaagtg

SEQ ID NO: 368731 - DNA, 25 bp, Mus musculus
tgcggcgtgacctaaagtgcacggt

SEQ ID NO: 368732 - DNA, 25 bp, Mus musculus
tgccgacgtcccagcgtgaacgcag

SEQ ID NO: 368733 - DNA, 25 bp, Mus musculus
cagcgtgaacgcagggcaccctgca

SEQ ID NO: 368734 - DNA, 25 bp, Mus musculus
accacctcgccaaagaacgtggcag

SEQ ID NO: 368735 - DNA, 25 bp, Mus musculus
gagaacctaagagcttccggtccgc

SEQ ID NO: 368736 - DNA, 25 bp, Mus musculus
agagcttccggtccgccgcgagaaa

SEQ ID NO: 368737 - DNA, 25 bp, Mus musculus
cgcgagaaatgtcccgcggcgcgct

SEQ ID NO: 368738 - DNA, 25 bp, Mus musculus
cggcgcgcttccgtcatcctgttaa

SEQ ID NO: 368739 - DNA, 25 bp, Mus musculus
gtcatcctgttaaccggggcacgca

SEQ ID NO: 368740 - DNA, 25 bp, Mus musculus
gagcctgacctcttccgcgccagct

SEQ ID NO: 368741 - DNA, 25 bp, Mus musculus
gacaccgcctgacgctcgcagcctt

SEQ ID NO: 368742 - DNA, 25 bp, Mus musculus
gacacgaaaggcgtccgggtgacca

SEQ ID NO: 368743 - DNA, 25 bp, Mus musculus
agctgctcaccaattcctcgtagct

SEQ ID NO: 368744 - DNA, 25 bp, Mus musculus
ctgttgtgctcgttgccctcccagt

SEQ ID NO: 368745 - DNA, 25 bp, Mus musculus
agtccaacctcttcggcaacagctg

SEQ ID NO: 368746 - DNA, 25 bp, Mus musculus
cttcggcaacagctggaatgagaca

SEQ ID NO: 368747 - DNA, 25 bp, Mus musculus
tggcacgacgcggatgtggctcctt

SEQ ID NO: 368748 - DNA, 25 bp, Mus musculus
ctggaatgagacacgaaaggcgtcc

SEQ ID NO: 368749 - DNA, 25 bp, Mus musculus
gaccagcgaacaagtggagcgcgta

SEQ ID NO: 368750 - DNA, 25 bp, Mus musculus
ggaccgacctggtactgctccagct

SEQ ID NO: 368751 - DNA, 25 bp, Mus musculus
gcaccagcacctgcggcagagaaga

SEQ ID NO: 368752 - DNA, 25 bp, Mus musculus
agcgggcgatgagaaagtacagctc

SEQ ID NO: 368753 - DNA, 25 bp, Mus musculus
ggccgtgtcttacccgactcgatga

SEQ ID NO: 368754 - DNA, 25 bp, Mus musculus
ttacccgactcgatgagaggcaccg

SEQ ID NO: 368755 - DNA, 25 bp, Mus musculus
attcctcgtagctcctgttgtgctc

SEQ ID NO: 368756 - DNA, 25 bp, Mus musculus
agcacagcggagaacaatgcggccg

SEQ ID NO: 368757 - DNA, 25 bp, Mus musculus
tgtcacgtggcctcagcatcgcttt

SEQ ID NO: 368758 - DNA, 25 bp, Mus musculus
tgcctggacaccttttcgaaaccta

SEQ ID NO: 368759 - DNA, 25 bp, Mus musculus
cgggcttctggcaagagataaatta

SEQ ID NO: 368760 - DNA, 25 bp, Mus musculus
gcgcggtacttacggccgacagcct

SEQ ID NO: 368761 - DNA, 25 bp, Mus musculus
tgagcagcgcatgtgagcggcaccc

SEQ ID NO: 368762 - DNA, 25 bp, Mus musculus
catccgcgctaacctgcaggagaaa

SEQ ID NO: 368763 - DNA, 25 bp, Mus musculus
cctgcaggagaaagcacagcggaga

SEQ ID NO: 368764 - DNA, 25 bp, Mus musculus
gatggaaccggattggagcccgccc

SEQ ID NO: 368765 - DNA, 25 bp, Mus musculus
ccttgctcccgaataggcacggcga

SEQ ID NO: 368766 - DNA, 25 bp, Mus musculus
cccgaataggcacggcgagctgtca

SEQ ID NO: 368767 - DNA, 25 bp, Mus musculus
ccgctaggtagtttgtttgaagccg

SEQ ID NO: 368768 - DNA, 25 bp, Mus musculus
agcctccattggctgtctaggccca

SEQ ID NO: 368769 - DNA, 25 bp, Mus musculus
tttgaagccgacagcaaaagtgcgg

SEQ ID NO: 368770 - DNA, 25 bp, Mus musculus
ccaagccacgcttcgcgacagagga

SEQ ID NO: 368771 - DNA, 25 bp, Mus musculus
tccgagcttctcacagatcgcgagg

SEQ ID NO: 368772 - DNA, 25 bp, Mus musculus
tcctcgtttgtaagtagctgccggg

SEQ ID NO: 368773 - DNA, 25 bp, Mus musculus
gatcgcgaggttgcaaccagctctg

SEQ ID NO: 368774 - DNA, 25 bp, Mus musculus
gcggtccatgctgcaagctctcttc

SEQ ID NO: 368775 - DNA, 25 bp, Mus musculus
aagtgggctatcacccggctacgga

SEQ ID NO: 368776 - DNA, 25 bp, Mus musculus
ggctgctaagtaacatcccatgctg

SEQ ID NO: 368777 - DNA, 25 bp, Mus musculus
ccctggtgctgccatagcggaacag

SEQ ID NO: 368778 - DNA, 25 bp, Mus musculus
cgcagttgacgacgctgctcccagg

SEQ ID NO: 368779 - DNA, 25 bp, Mus musculus
gtcaccatggcgctgtcgtagcggt

SEQ ID NO: 368780 - DNA, 25 bp, Mus musculus
gatccagcatgagcgcgtccgagac

SEQ ID NO: 368781 - DNA, 25 bp, Mus musculus
tgagcttcgtgttcgggtgtaactt

SEQ ID NO: 368782 - DNA, 25 bp, Mus musculus
tgccgtccctgtcctcgtttgtaag

SEQ ID NO: 368783 - DNA, 25 bp, Mus musculus
gtgtaacttgctgcgcatcctcctg

SEQ ID NO: 368784 - DNA, 25 bp, Mus musculus
gcctggggccctttgcttcagccgt

SEQ ID NO: 368785 - DNA, 25 bp, Mus musculus
cccagcagctaagggccagggtcta

SEQ ID NO: 368786 - DNA, 25 bp, Mus musculus
tcgccgctgacactgtgattggcgg

SEQ ID NO: 368787 - DNA, 25 bp, Mus musculus
agtcgccgctgacactgtgattggc

SEQ ID NO: 368788 - DNA, 25 bp, Mus musculus
ttagtcgccgctgacactgtgattg

SEQ ID NO: 368789 - DNA, 25 bp, Mus musculus
ccttagtcgccgctgacactgtgat

SEQ ID NO: 368790 - DNA, 25 bp, Mus musculus
gagtaagaggagcatcggcgtaccc

SEQ ID NO: 368791 - DNA, 25 bp, Mus musculus
gtgggcgaggacagaggagtaagag

SEQ ID NO: 368792 - DNA, 25 bp, Mus musculus
gtgccctctggcttggcggaggtgg

SEQ ID NO: 368793 - DNA, 25 bp, Mus musculus
actgctggattgcggggtgccctct

SEQ ID NO: 368794 - DNA, 25 bp, Mus musculus
ctgggctcgatgactgctggattgc

SEQ ID NO: 368795 - DNA, 25 bp, Mus musculus
gggccctttgcttcagccgtgcagc

SEQ ID NO: 368796 - DNA, 25 bp, Mus musculus
agctaagggccagggtctaccgcct

SEQ ID NO: 368797 - DNA, 25 bp, Mus musculus
cagccctgggctcgatgactgctgg

SEQ ID NO: 368798 - DNA, 25 bp, Mus musculus
ggtgcgtgtcgttgttcactctttg

SEQ ID NO: 368799 - DNA, 25 bp, Mus musculus
gttaccggcggtgagtcacagtccc

SEQ ID NO: 368800 - DNA, 25 bp, Mus musculus
gcttgggccgatcggcctcggataa

SEQ ID NO: 368801 - DNA, 25 bp, Mus musculus
ccgtccgcagctagcttgggccgat

SEQ ID NO: 368802 - DNA, 25 bp, Mus musculus
tactgcgggccgtccgcagctagct

SEQ ID NO: 368803 - DNA, 25 bp, Mus musculus
gttgttcactctttgtgcggcgcgg

SEQ ID NO: 368804 - DNA, 25 bp, Mus musculus
gcctcggataaaggtcgcaggtccc

SEQ ID NO: 368805 - DNA, 25 bp, Mus musculus
cgacggcgactgcacatctggcgtc

SEQ ID NO: 368806 - DNA, 25 bp, Mus musculus
tgagacgacccgtcctggctctggc

SEQ ID NO: 368807 - DNA, 25 bp, Mus musculus
agcagcattgctgagacgacccgtc

SEQ ID NO: 368808 - DNA, 25 bp, Mus musculus
ccgcagaggcgacaacgcacagagc

SEQ ID NO: 368809 - DNA, 25 bp, Mus musculus
gggccacccttcttcatgtttgtta

SEQ ID NO: 368810 - DNA, 25 bp, Mus musculus
ttcatgtttgttatggtgtggcgga

SEQ ID NO: 368811 - DNA, 25 bp, Mus musculus
tggggatcgtcagtgctcttgtccc

SEQ ID NO: 368812 - DNA, 25 bp, Mus musculus
gggctgatgagaccaccactgctgg

SEQ ID NO: 368813 - DNA, 25 bp, Mus musculus
ttgcgcgcatgcgtacttgggccaa

SEQ ID NO: 368814 - DNA, 25 bp, Mus musculus
accagttgcgcgcatgcgtacttgg

SEQ ID NO: 368815 - DNA, 25 bp, Mus musculus
tacttggcactgtggaaaagccggc

SEQ ID NO: 368816 - DNA, 25 bp, Mus musculus
tgcgcacgcgtagtacttggcactg

SEQ ID NO: 368817 - DNA, 25 bp, Mus musculus
ctccaccctggacttaaggaagcgc

SEQ ID NO: 368818 - DNA, 25 bp, Mus musculus
gcatcctcccggatgggtgtgcgct

SEQ ID NO: 368819 - DNA, 25 bp, Mus musculus
ggacactgatcagcgatcccaccgg

SEQ ID NO: 368820 - DNA, 25 bp, Mus musculus
tcgctctctgcactttggaggtgga

SEQ ID NO: 368821 - DNA, 25 bp, Mus musculus
ttgggacccgttctcgctctctgca

SEQ ID NO: 368822 - DNA, 25 bp, Mus musculus
gtagcgaatgcttcggggttccgaa

SEQ ID NO: 368823 - DNA, 25 bp, Mus musculus
agcaccagccgggtagcgaatgctt

SEQ ID NO: 368824 - DNA, 25 bp, Mus musculus
tgccagggttggaaggaaaagcacc

SEQ ID NO: 368825 - DNA, 25 bp, Mus musculus
tcgccatggaaaccacgcggggcct

SEQ ID NO: 368826 - DNA, 25 bp, Mus musculus
caggacgacggtaaggaattgctgc

SEQ ID NO: 368827 - DNA, 25 bp, Mus musculus
gctgcgggactcaagtgcacctcct

SEQ ID NO: 368828 - DNA, 25 bp, Mus musculus
agcagctcgctgctctgtggtccag

SEQ ID NO: 368829 - DNA, 25 bp, Mus musculus
ctctgtggtccagggacccaggctc

SEQ ID NO: 368830 - DNA, 25 bp, Mus musculus
gggacccaggctctgactaaccggc

SEQ ID NO: 368831 - DNA, 25 bp, Mus musculus
aggctctgactaaccggccgctgct

SEQ ID NO: 368832 - DNA, 25 bp, Mus musculus
ttctccataacgcagcagctcgctg

SEQ ID NO: 368833 - DNA, 25 bp, Mus musculus
atcacagtccctaagcgcattgccg

SEQ ID NO: 368834 - DNA, 25 bp, Mus musculus
ccacttgcaaatgccagtccagctt

SEQ ID NO: 368835 - DNA, 25 bp, Mus musculus
aatgccagtccagcttgcggctgcc

SEQ ID NO: 368836 - DNA, 25 bp, Mus musculus
tctcagctccagcaggacgacggta

SEQ ID NO: 368837 - DNA, 25 bp, Mus musculus
ggttcctgctgcttctccataacgc

SEQ ID NO: 368838 - DNA, 25 bp, Mus musculus
gggaccttggcagccggttcctgct

SEQ ID NO: 368839 - DNA, 25 bp, Mus musculus
gctgccctggcctggacagagcctt

SEQ ID NO: 368840 - DNA, 25 bp, Mus musculus
actccggaagggtgccagctaggca

SEQ ID NO: 368841 - DNA, 25 bp, Mus musculus
cgatgtgcagcaggattcggagtcc

SEQ ID NO: 368842 - DNA, 25 bp, Mus musculus
tttgatgcgatgtgcagcaggattc

SEQ ID NO: 368843 - DNA, 25 bp, Mus musculus
tagcagttttgatgcgatgtgcagc

SEQ ID NO: 368844 - DNA, 25 bp, Mus musculus
accgcgaggcgttagcagttttgat

SEQ ID NO: 368845 - DNA, 25 bp, Mus musculus
tgaccactccggaagggtgccagct

SEQ ID NO: 368846 - DNA, 25 bp, Mus musculus
gctctgcagtcttaaagcagcagca

SEQ ID NO: 368847 - DNA, 25 bp, Mus musculus
cctcaccctccgcagccaggcagca

SEQ ID NO: 368848 - DNA, 25 bp, Mus musculus
tggggcgctctgcagtcttaaagca

SEQ ID NO: 368849 - DNA, 25 bp, Mus musculus
cagcccatcgtgtgtagctctgttc

SEQ ID NO: 368850 - DNA, 25 bp, Mus musculus
gtagctctgttcttgcaggttgtta

SEQ ID NO: 368851 - DNA, 25 bp, Mus musculus
tgcaggttgttaatgagatgcggcc

SEQ ID NO: 368852 - DNA, 25 bp, Mus musculus
cggatcacgcagtcggcgggaccca

SEQ ID NO: 368853 - DNA, 25 bp, Mus musculus
agaggctcagagacgcgtccccaca

SEQ ID NO: 368854 - DNA, 25 bp, Mus musculus
gactgagaacttgttcaactctgca

SEQ ID NO: 368855 - DNA, 25 bp, Mus musculus
cgtcatatccgttagccgtggcctc

SEQ ID NO: 368856 - DNA, 25 bp, Mus musculus
ttgcactccagtttcccggggaaga

SEQ ID NO: 368857 - DNA, 25 bp, Mus musculus
ggggcagcgactgagaacttgttca

SEQ ID NO: 368858 - DNA, 25 bp, Mus musculus
cggccggctaaggaccgcagaaccg

SEQ ID NO: 368859 - DNA, 25 bp, Mus musculus
aggaccgcagaaccgcgctcgcaga

SEQ ID NO: 368860 - DNA, 25 bp, Mus musculus
agcactcttgctcccggtgctggcg

SEQ ID NO: 368861 - DNA, 25 bp, Mus musculus
cgcagtggctcttgagtgcggtccc

SEQ ID NO: 368862 - DNA, 25 bp, Mus musculus
agtggcccgggccacgaaccacaga

SEQ ID NO: 368863 - DNA, 25 bp, Mus musculus
cacgaaccacagagcctcggctgtt

SEQ ID NO: 368864 - DNA, 25 bp, Mus musculus
acagagcctcggctgttcccggact

SEQ ID NO: 368865 - DNA, 25 bp, Mus musculus
gcctcggctgttcccggactcggga

SEQ ID NO: 368866 - DNA, 25 bp, Mus musculus
catccttgaccttggccacggagga

SEQ ID NO: 368867 - DNA, 25 bp, Mus musculus
gcttcgagcactcttgctcccggtg

SEQ ID NO: 368868 - DNA, 25 bp, Mus musculus
actgcggacaaacctctagctctgc

SEQ ID NO: 368869 - DNA, 25 bp, Mus musculus
cccaggacgtacactcgggcgaatc

SEQ ID NO: 368870 - DNA, 25 bp, Mus musculus
cagtcagacggtcgcacctgtagtg

SEQ ID NO: 368871 - DNA, 25 bp, Mus musculus
tagtgccttggcctctcctaactca

SEQ ID NO: 368872 - DNA, 25 bp, Mus musculus
tgtcaggcgcgctactcacctgttg

SEQ ID NO: 368873 - DNA, 25 bp, Mus musculus
ttggcttcctcgtccgctccaagta

SEQ ID NO: 368874 - DNA, 25 bp, Mus musculus
caagggcttgctccactgaaggacc

SEQ ID NO: 368875 - DNA, 25 bp, Mus musculus
ctctgcgctctaggaaaggatatca

SEQ ID NO: 368876 - DNA, 25 bp, Mus musculus
ccaagctattagtcagggatccgca

SEQ ID NO: 368877 - DNA, 25 bp, Mus musculus
ccttcccacaggtgacggacaattc

SEQ ID NO: 368878 - DNA, 25 bp, Mus musculus
ggacaattcccgtcttgccaaggtc

SEQ ID NO: 368879 - DNA, 25 bp, Mus musculus
ggcatcttagccagttttcagtttc

SEQ ID NO: 368880 - DNA, 25 bp, Mus musculus
agcccgactgccgagattttcccga

SEQ ID NO: 368881 - DNA, 25 bp, Mus musculus
gccgctcgaatctatagagttgatc

SEQ ID NO: 368882 - DNA, 25 bp, Mus musculus
gcctgagtggcgcaaactctcttcc

SEQ ID NO: 368883 - DNA, 25 bp, Mus musculus
acagccggtgcttccgaacgaaata

SEQ ID NO: 368884 - DNA, 25 bp, Mus musculus
tcgcgtgcgtatcgcaagcagcctg

SEQ ID NO: 368885 - DNA, 25 bp, Mus musculus
tacggtcttacaccaatttgtgctc

SEQ ID NO: 368886 - DNA, 25 bp, Mus musculus
agcctgcgaattcgccggcgtcgaa

SEQ ID NO: 368887 - DNA, 25 bp, Mus musculus
gtgctccgacgaaaattactaagtg

SEQ ID NO: 368888 - DNA, 25 bp, Mus musculus
gcaatttctctaagcccggcgcgga

SEQ ID NO: 368889 - DNA, 25 bp, Mus musculus
gcacatggcgcaccttgtacacctg

SEQ ID NO: 368890 - DNA, 25 bp, Mus musculus
gagccacgtcttccagtgcacatgg

SEQ ID NO: 368891 - DNA, 25 bp, Mus musculus
tcccaccagggatcggtggaatccc

SEQ ID NO: 368892 - DNA, 25 bp, Mus musculus
cgagcacttgatcgcgagccacgtc

SEQ ID NO: 368893 - DNA, 25 bp, Mus musculus
tgacctgtcgtcgacgtgcagactg

SEQ ID NO: 368894 - DNA, 25 bp, Mus musculus
aagcagcctggctcaaccgtgtccg

SEQ ID NO: 368895 - DNA, 25 bp, Mus musculus
ttcacaaagcgcagaggcccacacg

SEQ ID NO: 368896 - DNA, 25 bp, Mus musculus
cgctcttccaggtaccgcaggtgaa

SEQ ID NO: 368897 - DNA, 25 bp, Mus musculus
aggccggccttcagtcagtttactt

SEQ ID NO: 368898 - DNA, 25 bp, Mus musculus
gagatttagtctagctccagcccaa

SEQ ID NO: 368899 - DNA, 25 bp, Mus musculus
tctgtcattggctggcacgaggccc

SEQ ID NO: 368900 - DNA, 25 bp, Mus musculus
aactggcatttgctgtttgcggcgc

SEQ ID NO: 368901 - DNA, 25 bp, Mus musculus
agcgacgccgctccaggtacgttgc

SEQ ID NO: 368902 - DNA, 25 bp, Mus musculus
gctcggccctcggaggccggataaa

SEQ ID NO: 368903 - DNA, 25 bp, Mus musculus
ccggataaagtgtgcacccaggttc

SEQ ID NO: 368904 - DNA, 25 bp, Mus musculus
cacccaggttcctggccggacttgg

SEQ ID NO: 368905 - DNA, 25 bp, Mus musculus
gccgcctgaggcagaacgacccggt

SEQ ID NO: 368906 - DNA, 25 bp, Mus musculus
gggctctctgaccttcgctctgtca

SEQ ID NO: 368907 - DNA, 25 bp, Mus musculus
gcccaaccgcgggtcattttgtctg

SEQ ID NO: 368908 - DNA, 25 bp, Mus musculus
cagtttacttttccctgagccgcgc

SEQ ID NO: 368909 - DNA, 25 bp, Mus musculus
tgccactgtgattggctgggctctc

SEQ ID NO: 368910 - DNA, 25 bp, Mus musculus
tgtaacaaagaacaggcggcgcggc

SEQ ID NO: 368911 - DNA, 25 bp, Mus musculus
cacagcctcggactttcttaaacgc

SEQ ID NO: 368912 - DNA, 25 bp, Mus musculus
ggttgcgatccgctccggaaactgc

SEQ ID NO: 368913 - DNA, 25 bp, Mus musculus
ccggggctttacctgcctgtggaat

SEQ ID NO: 368914 - DNA, 25 bp, Mus musculus
cggaaactgcgcagcaccggaagcc

SEQ ID NO: 368915 - DNA, 25 bp, Mus musculus
gttttgactccgatcgcccacggcg

SEQ ID NO: 368916 - DNA, 25 bp, Mus musculus
ccagccgggttttgactccgatcgc

SEQ ID NO: 368917 - DNA, 25 bp, Mus musculus
agcggctccggattccagccgggtt

SEQ ID NO: 368918 - DNA, 25 bp, Mus musculus
cacttagggcagaggccaagcccgc

SEQ ID NO: 368919 - DNA, 25 bp, Mus musculus
gctcggaacccaggctgggcactta

SEQ ID NO: 368920 - DNA, 25 bp, Mus musculus
actgtagagacttgagcccgcagcc

SEQ ID NO: 368921 - DNA, 25 bp, Mus musculus
tcttaaacgccaaaggggctggaga

SEQ ID NO: 368922 - DNA, 25 bp, Mus musculus
cacggcacagcctcggactttctta

SEQ ID NO: 368923 - DNA, 25 bp, Mus musculus
cggatccggactccgggttgcgatc

SEQ ID NO: 368924 - DNA, 25 bp, Mus musculus
ttgggaagtgcaaggcaaaggctct

SEQ ID NO: 368925 - DNA, 25 bp, Mus musculus
acatccgccggtacgcaggggcaca

SEQ ID NO: 368926 - DNA, 25 bp, Mus musculus
gaccggtaagcgaaccaaattgagc

SEQ ID NO: 368927 - DNA, 25 bp, Mus musculus
cgaaccaaattgagcgctgcgcgcc

SEQ ID NO: 368928 - DNA, 25 bp, Mus musculus
agccaaacgcgggacagaggaagct

SEQ ID NO: 368929 - DNA, 25 bp, Mus musculus
ggcaaaggctcttcttcccagcttg

SEQ ID NO: 368930 - DNA, 25 bp, Mus musculus
ccgcggcccgtagtaaccgcaggag

SEQ ID NO: 368931 - DNA, 25 bp, Mus musculus
caggagcggagtctctttttacagc

SEQ ID NO: 368932 - DNA, 25 bp, Mus musculus
gttaagggcgcaagtcctctcctgc

SEQ ID NO: 368933 - DNA, 25 bp, Mus musculus
gaagagccactgcacctcgctgagc

SEQ ID NO: 368934 - DNA, 25 bp, Mus musculus
atgctgacggcgcatacccggcgag

SEQ ID NO: 368935 - DNA, 25 bp, Mus musculus
cactaccttgagtggtgggtgagaa

SEQ ID NO: 368936 - DNA, 25 bp, Mus musculus
tcgctgagccacgagcccatgctga

SEQ ID NO: 368937 - DNA, 25 bp, Mus musculus
ctgcgccaagtacaggcccacggtg

SEQ ID NO: 368938 - DNA, 25 bp, Mus musculus
ccggctgttttgaagcttggggctg

SEQ ID NO: 368939 - DNA, 25 bp, Mus musculus
gtgatgtcaggagccgccgatccag

SEQ ID NO: 368940 - DNA, 25 bp, Mus musculus
gcccgtgatgtcaggagccgccgat

SEQ ID NO: 368941 - DNA, 25 bp, Mus musculus
tgcccgcccgtgatgtcaggagccg

SEQ ID NO: 368942 - DNA, 25 bp, Mus musculus
cgaggcgccggctgttttgaagctt

SEQ ID NO: 368943 - DNA, 25 bp, Mus musculus
gcgtctggacacagtggcgggctgc

SEQ ID NO: 368944 - DNA, 25 bp, Mus musculus
gacgtcaccgcagtcccttgtcgcg

SEQ ID NO: 368945 - DNA, 25 bp, Mus musculus
actgctccctgtcattccggaaccc

SEQ ID NO: 368946 - DNA, 25 bp, Mus musculus
gagggcacactgctccctgtcattc

SEQ ID NO: 368947 - DNA, 25 bp, Mus musculus
cccgattcctaaagagggcacactg

SEQ ID NO: 368948 - DNA, 25 bp, Mus musculus
cctgtcccgattcctaaagagggca

SEQ ID NO: 368949 - DNA, 25 bp, Mus musculus
ctggcctgtcccgattcctaaagag

SEQ ID NO: 368950 - DNA, 25 bp, Mus musculus
gtcaagcacggatcccctggcctgt

SEQ ID NO: 368951 - DNA, 25 bp, Mus musculus
cgggactgccgcacgaaccgcaccc

SEQ ID NO: 368952 - DNA, 25 bp, Mus musculus
tctgagtcaccggaatcaaggtgtg

SEQ ID NO: 368953 - DNA, 25 bp, Mus musculus
tcaccggaatcaaggtgtggctgga

SEQ ID NO: 368954 - DNA, 25 bp, Mus musculus
gccgcctcttcctttagtcgcggtg

SEQ ID NO: 368955 - DNA, 25 bp, Mus musculus
ctcttcctttagtcgcggtgtcagc

SEQ ID NO: 368956 - DNA, 25 bp, Mus musculus
gcaggaccactcttggccgctgctc

SEQ ID NO: 368957 - DNA, 25 bp, Mus musculus
cctgcgagcgctgcaggtggatcct

SEQ ID NO: 368958 - DNA, 25 bp, Mus musculus
atcgccttcgacatcatcgcgctgg

SEQ ID NO: 368959 - DNA, 25 bp, Mus musculus
ggctggctgcagtctagcaaccaca

SEQ ID NO: 368960 - DNA, 25 bp, Mus musculus
tagcaaccacatccagacatcgtcg

SEQ ID NO: 368961 - DNA, 25 bp, Mus musculus
cagacatcgtcgctttggtggaggt

SEQ ID NO: 368962 - DNA, 25 bp, Mus musculus
atcgtcgctttggtggaggtgtttc

SEQ ID NO: 368963 - DNA, 25 bp, Mus musculus
cagcggctcctacgacgatggctgc

SEQ ID NO: 368964 - DNA, 25 bp, Mus musculus
ctacgacgatggctgccagagcctc

SEQ ID NO: 368965 - DNA, 25 bp, Mus musculus
gccagagcctcatggagtacggtga

SEQ ID NO: 368966 - DNA, 25 bp, Mus musculus
tcccttggggtgtagcgacagaaga

SEQ ID NO: 368967 - DNA, 25 bp, Mus musculus
ccacgcgttcaggtagcggtatccg

SEQ ID NO: 368968 - DNA, 25 bp, Mus musculus
ctgagcattcctcggggattgtctg

SEQ ID NO: 368969 - DNA, 25 bp, Mus musculus
ctccacgcgttcaggtagcggtatc

SEQ ID NO: 368970 - DNA, 25 bp, Mus musculus
gcgatcttgtggaagacgctgggtc

SEQ ID NO: 368971 - DNA, 25 bp, Mus musculus
attgtctgggaggtggcgatcttgt

SEQ ID NO: 368972 - DNA, 25 bp, Mus musculus
gatgcctgagcattcctcggggatt

SEQ ID NO: 368973 - DNA, 25 bp, Mus musculus
cagatcattggagcggtcccagtcc

SEQ ID NO: 368974 - DNA, 25 bp, Mus musculus
tgcagatcattggagcggtcccagt

SEQ ID NO: 368975 - DNA, 25 bp, Mus musculus
tgcattcctgatctgcagatcattg

SEQ ID NO: 368976 - DNA, 25 bp, Mus musculus
agccgcgaggcctctgcattcctga

SEQ ID NO: 368977 - DNA, 25 bp, Mus musculus
cgaggcctctgcattcctgatctgc

SEQ ID NO: 368978 - DNA, 25 bp, Mus musculus
gtcccagtcccttggggtgtagcga

SEQ ID NO: 368979 - DNA, 25 bp, Mus musculus
aagacgctgggtctccacgcgttca

SEQ ID NO: 368980 - DNA, 25 bp, Mus musculus
ttggacctgcgaggcggaaacacgc

SEQ ID NO: 368981 - DNA, 25 bp, Mus musculus
aggcgccccacggtgagctatcgca

SEQ ID NO: 368982 - DNA, 25 bp, Mus musculus
tcagattggacctgcgaggcggaaa

SEQ ID NO: 368983 - DNA, 25 bp, Mus musculus
ctatcgcaggacgtgtgggtggtcc

SEQ ID NO: 368984 - DNA, 25 bp, Mus musculus
gctgggaccgaaccactctgactgt

SEQ ID NO: 368985 - DNA, 25 bp, Mus musculus
tgggaccgaaccactctgactgtgc

SEQ ID NO: 368986 - DNA, 25 bp, Mus musculus
gaaccactctgactgtgccttcgtc

SEQ ID NO: 368987 - DNA, 25 bp, Mus musculus
tgactgtgccttcgtcttcccgcag

SEQ ID NO: 368988 - DNA, 25 bp, Mus musculus
tgtgccttcgtcttcccgcaggctg

SEQ ID NO: 368989 - DNA, 25 bp, Mus musculus
ggagcctcgtgccagggatgcccca

SEQ ID NO: 368990 - DNA, 25 bp, Mus musculus
gggatgccccaaccagaggctgtgc

SEQ ID NO: 368991 - DNA, 25 bp, Mus musculus
ctgctccggatcccggtgaggaagc

SEQ ID NO: 368992 - DNA, 25 bp, Mus musculus
cagtcctggtctggcgagacagttc

SEQ ID NO: 368993 - DNA, 25 bp, Mus musculus
gtctggcgagacagttcccgcggcc

SEQ ID NO: 368994 - DNA, 25 bp, Mus musculus
tccctaggcgggagcatcccattct

SEQ ID NO: 368995 - DNA, 25 bp, Mus musculus
aaggtcgctgatcccttgcattgtg

SEQ ID NO: 368996 - DNA, 25 bp, Mus musculus
ttggatctcagtgacaaggtcgctg

SEQ ID NO: 368997 - DNA, 25 bp, Mus musculus
gggccctgaagactgtactttttga

SEQ ID NO: 368998 - DNA, 25 bp, Mus musculus
tgcgagaacgggaacgcagcaaacc

SEQ ID NO: 368999 - DNA, 25 bp, Mus musculus
ccaaggcgttgcctgtgcgagaacg

SEQ ID NO: 369000 - DNA, 25 bp, Mus musculus
gtgtggctaacagcctaacagagtg

SEQ ID NO: 369001 - DNA, 25 bp, Mus musculus
tgcttcctttcccaagtgtggctaa

SEQ ID NO: 369002 - DNA, 25 bp, Mus musculus
agtgtgcacacagcctcagacgccg

SEQ ID NO: 369003 - DNA, 25 bp, Mus musculus
ccgccggtctaagagtgtgcacaca

SEQ ID NO: 369004 - DNA, 25 bp, Mus musculus
ctaccagggactgacgagagcaggc

SEQ ID NO: 369005 - DNA, 25 bp, Mus musculus
cgtctgcaatcaggactaccaggga

SEQ ID NO: 369006 - DNA, 25 bp, Mus musculus
ttgtcaacccaagcgcgggagcgtc

SEQ ID NO: 369007 - DNA, 25 bp, Mus musculus
cgcgtgcaacgaacttgtcaaccca

SEQ ID NO: 369008 - DNA, 25 bp, Mus musculus
gggtctgaaagtacgccgaggtcca

SEQ ID NO: 369009 - DNA, 25 bp, Mus musculus
catcgtaaaggccagagccagggtc

SEQ ID NO: 369010 - DNA, 25 bp, Mus musculus
acccagaggctcttcattcattggc

SEQ ID NO: 369011 - DNA, 25 bp, Mus musculus
tggtccaagtcctcgggcaggaaga

SEQ ID NO: 369012 - DNA, 25 bp, Mus musculus
ggcaggaagacgaggcccacattga

SEQ ID NO: 369013 - DNA, 25 bp, Mus musculus
ggcccacattgagaacgatgtattc

SEQ ID NO: 369014 - DNA, 25 bp, Mus musculus
ggcgtagtaaaggatcagcacattg

SEQ ID NO: 369015 - DNA, 25 bp, Mus musculus
cattgacgaagaacaggcccacgta

SEQ ID NO: 369016 - DNA, 25 bp, Mus musculus
cacgtagaacatagagggcagcagc

SEQ ID NO: 369017 - DNA, 25 bp, Mus musculus
ggcggcctccgaagacgctccttga

SEQ ID NO: 369018 - DNA, 25 bp, Mus musculus
gcgactcgctttgtacgctgcgctc

SEQ ID NO: 369019 - DNA, 25 bp, Mus musculus
gcagccgccaagtcgctctgggctt

SEQ ID NO: 369020 - DNA, 25 bp, Mus musculus
attcattggccagtcgcatgctcgc

SEQ ID NO: 369021 - DNA, 25 bp, Mus musculus
cgtcaagctctgagtcggcatcgta

SEQ ID NO: 369022 - DNA, 25 bp, Mus musculus
cgtcaagagcctcgccggagaactt

SEQ ID NO: 369023 - DNA, 25 bp, Mus musculus
cgagtcatgccggtccttgtagtcc

SEQ ID NO: 369024 - DNA, 25 bp, Mus musculus
ggacatgtttggacgctcacggagc

SEQ ID NO: 369025 - DNA, 25 bp, Mus musculus
tcgcagagtcctgtcgtcaagagcc

SEQ ID NO: 369026 - DNA, 25 bp, Mus musculus
ctccttggaccacctgaagtgagtg

SEQ ID NO: 369027 - DNA, 25 bp, Mus musculus
gccggagaacttcatttcccagatt

SEQ ID NO: 369028 - DNA, 25 bp, Mus musculus
atttcccagatttcctcgcggcggc

SEQ ID NO: 369029 - DNA, 25 bp, Mus musculus
ccggttccggctgaatgtcagtgcg

SEQ ID NO: 369030 - DNA, 25 bp, Mus musculus
agcaaggtgcttggcagtctctcca

SEQ ID NO: 369031 - DNA, 25 bp, Mus musculus
ggcttgagatgtcgccgcggacacc

SEQ ID NO: 369032 - DNA, 25 bp, Mus musculus
ctgggcggctcggacatgaaaccgt

SEQ ID NO: 369033 - DNA, 25 bp, Mus musculus
acatgaaaccgtgaggcaggcgaca

SEQ ID NO: 369034 - DNA, 25 bp, Mus musculus
acagggctggtctgcggacatgttt

SEQ ID NO: 369035 - DNA, 25 bp, Mus musculus
tccttgtagtccgttcgcagagtcc

SEQ ID NO: 369036 - DNA, 25 bp, Mus musculus
cagtggaagagatgtgagtgtgtgc

SEQ ID NO: 369037 - DNA, 25 bp, Mus musculus
cacactgcagagtgcacgtggcagt

SEQ ID NO: 369038 - DNA, 25 bp, Mus musculus
gaagagatgtgagtgtgtgcgcacg

SEQ ID NO: 369039 - DNA, 25 bp, Mus musculus
cggccacactgcagagtgcacgtga

SEQ ID NO: 369040 - DNA, 25 bp, Mus musculus
cggccacactgcagagtgcacgtgg

SEQ ID NO: 369041 - DNA, 25 bp, Mus musculus
cacgtgacagtggaagagatgtgag

SEQ ID NO: 369042 - DNA, 25 bp, Mus musculus
cacactgcagagtgcacgtgacagt

SEQ ID NO: 369043 - DNA, 25 bp, Mus musculus
acggccacactgcagagtgcacgtg

SEQ ID NO: 369044 - DNA, 25 bp, Mus musculus
ctgcagagtgcacgtgacagtggaa

SEQ ID NO: 369045 - DNA, 25 bp, Mus musculus
agtgcacgtgacagtggaagagatg

SEQ ID NO: 369046 - DNA, 25 bp, Mus musculus
gcagagtgcacgtgacagtggaaga

SEQ ID NO: 369047 - DNA, 25 bp, Mus musculus
tggaagagatgtgagtgtgtgcgca

SEQ ID NO: 369048 - DNA, 25 bp, Mus musculus
tgagtgtgtgcgcacggccacactg

SEQ ID NO: 369049 - DNA, 25 bp, Mus musculus
ccacactgcagagtgcacgtgacag

SEQ ID NO: 369050 - DNA, 25 bp, Mus musculus
ggaggagatcctttcgcacacacga

SEQ ID NO: 369051 - DNA, 25 bp, Mus musculus
cgaggcccagcgtgagaacctcagc

SEQ ID NO: 369052 - DNA, 25 bp, Mus musculus
cgatcatggatcctagcagcggcgg

SEQ ID NO: 369053 - DNA, 25 bp, Mus musculus
ccggcgagtgagtcattgactgtca

SEQ ID NO: 369054 - DNA, 25 bp, Mus musculus
agttccagccgcttccggtgacgct

SEQ ID NO: 369055 - DNA, 25 bp, Mus musculus
acgcttgagcgctgaactccgactc

SEQ ID NO: 369056 - DNA, 25 bp, Mus musculus
ttgtagtttagctatcggccgcgct

SEQ ID NO: 369057 - DNA, 25 bp, Mus musculus
aggtcaattctctccaaacgtgggg

SEQ ID NO: 369058 - DNA, 25 bp, Mus musculus
gctttcagccggcaactcaacgtca

SEQ ID NO: 369059 - DNA, 25 bp, Mus musculus
cctggtctcgagtgtactgtctgga

SEQ ID NO: 369060 - DNA, 25 bp, Mus musculus
acgccgctgaattcgtgccgtcctt

SEQ ID NO: 369061 - DNA, 25 bp, Mus musculus
ttcgcacacacgaggagggttgagc

SEQ ID NO: 369062 - DNA, 25 bp, Mus musculus
ctgtctggactgtagctgctgccca

SEQ ID NO: 369063 - DNA, 25 bp, Mus musculus
cacagacgggaactaccgaggcgaa

SEQ ID NO: 369064 - DNA, 25 bp, Mus musculus
aagggctctgcgtccgaatctccca

SEQ ID NO: 369065 - DNA, 25 bp, Mus musculus
agcgacagggtttttcaggcctgca

SEQ ID NO: 369066 - DNA, 25 bp, Mus musculus
gctcctgagagaccgactcattttt

SEQ ID NO: 369067 - DNA, 25 bp, Mus musculus
gcctagcgttggcagtttctcttta

SEQ ID NO: 369068 - DNA, 25 bp, Mus musculus
ttcccgctctgcagaagacagcacg

SEQ ID NO: 369069 - DNA, 25 bp, Mus musculus
gaccgctcttttacagctggacaga

SEQ ID NO: 369070 - DNA, 25 bp, Mus musculus
gggctttagtctctccttagggcgc

SEQ ID NO: 369071 - DNA, 25 bp, Mus musculus
gatgctgccgctagaataactctgg

SEQ ID NO: 369072 - DNA, 25 bp, Mus musculus
ctgggcacagtctacgaccgcaaca

SEQ ID NO: 369073 - DNA, 25 bp, Mus musculus
agggcgggcccaacatctaatttcg

SEQ ID NO: 369074 - DNA, 25 bp, Mus musculus
cgcctcgccggaaatgacgtgatac

SEQ ID NO: 369075 - DNA, 25 bp, Mus musculus
gcgaccaccaccgacgtgcaagtga

SEQ ID NO: 369076 - DNA, 25 bp, Mus musculus
tccacacgaggcgacatgaagggct

SEQ ID NO: 369077 - DNA, 25 bp, Mus musculus
ggctgcgcatgagctctgacttcta

SEQ ID NO: 369078 - DNA, 25 bp, Mus musculus
ctagcttttggtggtttagcatttc

SEQ ID NO: 369079 - DNA, 25 bp, Mus musculus
catttcgttattcctgggtgctggg

SEQ ID NO: 369080 - DNA, 25 bp, Mus musculus
ggcgtccgtgttagtaagtgtctcg

SEQ ID NO: 369081 - DNA, 25 bp, Mus musculus
gttcggagactgtacgagggttctc

SEQ ID NO: 369082 - DNA, 25 bp, Mus musculus
taagtgtctcggtttggggacgctc

SEQ ID NO: 369083 - DNA, 25 bp, Mus musculus
ggccgacatccacgcactagctttt

SEQ ID NO: 369084 - DNA, 25 bp, Mus musculus
ctcctcgggagtcgtaatccgggca

SEQ ID NO: 369085 - DNA, 25 bp, Mus musculus
acgcgcggccgttaacggacttcag

SEQ ID NO: 369086 - DNA, 25 bp, Mus musculus
agggtcgcgctcttccaatcgcgtg

SEQ ID NO: 369087 - DNA, 25 bp, Mus musculus
ctcttgagccggtgaacgcacatcc

SEQ ID NO: 369088 - DNA, 25 bp, Mus musculus
gctgcgagactgtgagagctcttga

SEQ ID NO: 369089 - DNA, 25 bp, Mus musculus
acgcagccaatggtagcgtttgcgg

SEQ ID NO: 369090 - DNA, 25 bp, Mus musculus
gctgacactggcaacgcagccaatg

SEQ ID NO: 369091 - DNA, 25 bp, Mus musculus
tcgcgacgccagctgagtgcgcgct

SEQ ID NO: 369092 - DNA, 25 bp, Mus musculus
atataagacttgctaaggtggccca

SEQ ID NO: 369093 - DNA, 25 bp, Mus musculus
agggacttaagtggccatgacaata

SEQ ID NO: 369094 - DNA, 25 bp, Mus musculus
tgcagtggcacctcttgttttggga

SEQ ID NO: 369095 - DNA, 25 bp, Mus musculus
ttcactcatgcagtggcacctcttg

SEQ ID NO: 369096 - DNA, 25 bp, Mus musculus
acacacaaagacactcaaagatata

SEQ ID NO: 369097 - DNA, 25 bp, Mus musculus
ctaaggtggcccagaagagaacgtc

SEQ ID NO: 369098 - DNA, 25 bp, Mus musculus
cccagaagagaacgtcagtgccagc

SEQ ID NO: 369099 - DNA, 25 bp, Mus musculus
tgccagcgatgtacacgtacactca

SEQ ID NO: 369100 - DNA, 25 bp, Mus musculus
gtacactcatattttccacaccata

SEQ ID NO: 369101 - DNA, 25 bp, Mus musculus
ttccacaccataccatcttagcaga

SEQ ID NO: 369102 - DNA, 25 bp, Mus musculus
tcttagcagaattcacttagatcgc

SEQ ID NO: 369103 - DNA, 25 bp, Mus musculus
tcagtgccagcgatgtacacgtaca

SEQ ID NO: 369104 - DNA, 25 bp, Mus musculus
ccaaatgtatttcactcatgcagtg

SEQ ID NO: 369105 - DNA, 25 bp, Mus musculus
agaattcacttagatcgcagcgagg

SEQ ID NO: 369106 - DNA, 25 bp, Mus musculus
cccggctaccctcgagaggagtcag

SEQ ID NO: 369107 - DNA, 25 bp, Mus musculus
atggctgagactcccagtgccccgg

SEQ ID NO: 369108 - DNA, 25 bp, Mus musculus
cggatggctgagactcccagtgccc

SEQ ID NO: 369109 - DNA, 25 bp, Mus musculus
cccggatggctgagactcccagtgc

SEQ ID NO: 369110 - DNA, 25 bp, Mus musculus
cggctaccctcgagaggagtcagcg

SEQ ID NO: 369111 - DNA, 25 bp, Mus musculus
cggctgcccggatggctgagactcc

SEQ ID NO: 369112 - DNA, 25 bp, Mus musculus
gcctgccacgcaagcgggccgccgc

SEQ ID NO: 369113 - DNA, 25 bp, Mus musculus
ccctttgtttggccgagggcatggc

SEQ ID NO: 369114 - DNA, 25 bp, Mus musculus
cttggagcccctttgtttggccgag

SEQ ID NO: 369115 - DNA, 25 bp, Mus musculus
gcgcccttgtccgaggggctcgcgg

SEQ ID NO: 369116 - DNA, 25 bp, Mus musculus
ctgcccggatggctgagactcccag

SEQ ID NO: 369117 - DNA, 25 bp, Mus musculus
taccctcgagaggagtcagcggggt

SEQ ID NO: 369118 - DNA, 25 bp, Mus musculus
ctgagcactgtgctgagcacgatcc

SEQ ID NO: 369119 - DNA, 25 bp, Mus musculus
tgagcactgtgctgagcacgatccc

SEQ ID NO: 369120 - DNA, 25 bp, Mus musculus
cgcactagcgacaatctgagcccta

SEQ ID NO: 369121 - DNA, 25 bp, Mus musculus
ttgcctgcgaccacaggcttgacct

SEQ ID NO: 369122 - DNA, 25 bp, Mus musculus
aagtcgagcctgaccttgcctgcga

SEQ ID NO: 369123 - DNA, 25 bp, Mus musculus
tgctcttcgccctcaagttcacttg

SEQ ID NO: 369124 - DNA, 25 bp, Mus musculus
ccacggggagcatgtaatgtcggaa

SEQ ID NO: 369125 - DNA, 25 bp, Mus musculus
atctctgaagtgtggctgacgtgga

SEQ ID NO: 369126 - DNA, 25 bp, Mus musculus
tgcaagcctgcgcagagtcgctaca

SEQ ID NO: 369127 - DNA, 25 bp, Mus musculus
acaaggtctagcttgagtgactgca

SEQ ID NO: 369128 - DNA, 25 bp, Mus musculus
gcgtcagcgcagtgaatgaaggaca

SEQ ID NO: 369129 - DNA, 25 bp, Mus musculus
actagcttccggacgcgaggatgta

SEQ ID NO: 369130 - DNA, 25 bp, Mus musculus
taaggagacaccaccaactagcttc

SEQ ID NO: 369131 - DNA, 25 bp, Mus musculus
cggaaggactcgctaaggagacacc

SEQ ID NO: 369132 - DNA, 25 bp, Mus musculus
ctgagccctaacagtacccggaagg

SEQ ID NO: 369133 - DNA, 25 bp, Mus musculus
ccactctcctagttcggcgtggagg

SEQ ID NO: 369134 - DNA, 25 bp, Mus musculus
cccacgaagggatccggatagaagt

SEQ ID NO: 369135 - DNA, 25 bp, Mus musculus
gaggagggagcgactccacaccacc

SEQ ID NO: 369136 - DNA, 25 bp, Mus musculus
gtgctgtgtgcaacccacgaaggga

SEQ ID NO: 369137 - DNA, 25 bp, Mus musculus
tccggatagaagtgagcgcccgcga

SEQ ID NO: 369138 - DNA, 25 bp, Mus musculus
tgagcgcccgcgaccggaaggttcc

SEQ ID NO: 369139 - DNA, 25 bp, Mus musculus
aaggttctgcagctctggagtgccc

SEQ ID NO: 369140 - DNA, 25 bp, Mus musculus
ctgcgagggaggaacaactccgaca

SEQ ID NO: 369141 - DNA, 25 bp, Mus musculus
cgaagagccaagcagtacctgagga

SEQ ID NO: 369142 - DNA, 25 bp, Mus musculus
aagcacccaacactgcgagggagga

SEQ ID NO: 369143 - DNA, 25 bp, Mus musculus
tgaggaaaacgcgtccagggtcctg

SEQ ID NO: 369144 - DNA, 25 bp, Mus musculus
cgggctctgtggaaaacatccgccg

SEQ ID NO: 369145 - DNA, 25 bp, Mus musculus
tgtggaaaacatccgccgcctccat

SEQ ID NO: 369146 - DNA, 25 bp, Mus musculus
acatggcgagcgactggccttgcct

SEQ ID NO: 369147 - DNA, 25 bp, Mus musculus
ccttgcctgggcacgttctgtgaga

SEQ ID NO: 369148 - DNA, 25 bp, Mus musculus
ggccgtggttctttccacctgccga

SEQ ID NO: 369149 - DNA, 25 bp, Mus musculus
tcggggctacttcgatgtcatgggc

SEQ ID NO: 369150 - DNA, 25 bp, Mus musculus
ttccacctgccgagaaatcagagct

SEQ ID NO: 369151 - DNA, 25 bp, Mus musculus
cttcattccacaagtgtcgcttctc

SEQ ID NO: 369152 - DNA, 25 bp, Mus musculus
tctctccagcgcacttggcgtgcta

SEQ ID NO: 369153 - DNA, 25 bp, Mus musculus
cgtgctagagaggtgaagagcatcc

SEQ ID NO: 369154 - DNA, 25 bp, Mus musculus
ggacacagcgactctctcctgtttt

SEQ ID NO: 369155 - DNA, 25 bp, Mus musculus
gcgaacgcagtctgagccgagcgca

SEQ ID NO: 369156 - DNA, 25 bp, Mus musculus
gggagacacgatgcgccgagtcctt

SEQ ID NO: 369157 - DNA, 25 bp, Mus musculus
cgagtccttcggctgcttctcggct

SEQ ID NO: 369158 - DNA, 25 bp, Mus musculus
gctgcttcctcaccgagctgtgtgc

SEQ ID NO: 369159 - DNA, 25 bp, Mus musculus
cgccagactcctgtcggggctactt

SEQ ID NO: 369160 - DNA, 25 bp, Mus musculus
cagagctgttctttcgagcctggca

SEQ ID NO: 369161 - DNA, 25 bp, Mus musculus
agcttgctgcttttgcccgagctct

SEQ ID NO: 369162 - DNA, 25 bp, Mus musculus
tgaggaaaaacaatgcgccgagcgg

SEQ ID NO: 369163 - DNA, 25 bp, Mus musculus
cggctgttgattcctcaattaaaaa

SEQ ID NO: 369164 - DNA, 25 bp, Mus musculus
atggcggctgttgattcctcaatta

SEQ ID NO: 369165 - DNA, 25 bp, Mus musculus
ggccgagtagatcgcgctcgaagcc

SEQ ID NO: 369166 - DNA, 25 bp, Mus musculus
ggcggggcacgcttgtacgtcaccc

SEQ ID NO: 369167 - DNA, 25 bp, Mus musculus
gccgccgccgtgaggaaaaacaatg

SEQ ID NO: 369168 - DNA, 25 bp, Mus musculus
ccacttaatgaattcgcccgcggcc

SEQ ID NO: 369169 - DNA, 25 bp, Mus musculus
gaacatggtggtaccgccgccgcct

SEQ ID NO: 369170 - DNA, 25 bp, Mus musculus
aggcggcggccaaatctcagcctca

SEQ ID NO: 369171 - DNA, 25 bp, Mus musculus
acctgctcgcggaaacagccctgag

SEQ ID NO: 369172 - DNA, 25 bp, Mus musculus
ggccatcttcacctgctcgcggaaa

SEQ ID NO: 369173 - DNA, 25 bp, Mus musculus
tccagcaagttctcggccatcttca

SEQ ID NO: 369174 - DNA, 25 bp, Mus musculus
ttgggcggtccgtccagcaagttct

SEQ ID NO: 369175 - DNA, 25 bp, Mus musculus
ccggtcggatccgcgacaagatggc

SEQ ID NO: 369176 - DNA, 25 bp, Mus musculus
tggtgctcaacacgcagccggccga

SEQ ID NO: 369177 - DNA, 25 bp, Mus musculus
catccgatgcgagatcggcgcggta

SEQ ID NO: 369178 - DNA, 25 bp, Mus musculus
tctaccatttcctgcggcttcactg

SEQ ID NO: 369179 - DNA, 25 bp, Mus musculus
aactgctcgacagcgacgggctggt

SEQ ID NO: 369180 - DNA, 25 bp, Mus musculus
cagcaggtgctggaactgctcgaca

SEQ ID NO: 369181 - DNA, 25 bp, Mus musculus
ttcggctggactcggctctttccgt

SEQ ID NO: 369182 - DNA, 25 bp, Mus musculus
ttacatctgttctgcgctccttcgg

SEQ ID NO: 369183 - DNA, 25 bp, Mus musculus
ctcagtcggccattgcagttacatc

SEQ ID NO: 369184 - DNA, 25 bp, Mus musculus
atcggttggctctcttgaactcgcg

SEQ ID NO: 369185 - DNA, 25 bp, Mus musculus
cttttcggctacaatcggttggctc

SEQ ID NO: 369186 - DNA, 25 bp, Mus musculus
cgcctcgattccttttcggctacaa

SEQ ID NO: 369187 - DNA, 25 bp, Mus musculus
cctgcctggtgctggtgctcaacac

SEQ ID NO: 369188 - DNA, 25 bp, Mus musculus
cctctcggctgagttcgggtagacc

SEQ ID NO: 369189 - DNA, 25 bp, Mus musculus
tgggctcgggcacattccggccaca

SEQ ID NO: 369190 - DNA, 25 bp, Mus musculus
tcccgaaattgcacgcacgcagcgt

SEQ ID NO: 369191 - DNA, 25 bp, Mus musculus
tgtctgcaagccctcccgaaattgc

SEQ ID NO: 369192 - DNA, 25 bp, Mus musculus
agagggtgtgtctgcaagccctccc

SEQ ID NO: 369193 - DNA, 25 bp, Mus musculus
gaaattgcacgcacgcagcgttccg

SEQ ID NO: 369194 - DNA, 25 bp, Mus musculus
ctgcagtgaggtgcagcagcgcctt

SEQ ID NO: 369195 - DNA, 25 bp, Mus musculus
ccacgctggaactgcagtgaggtgc

SEQ ID NO: 369196 - DNA, 25 bp, Mus musculus
cgctcccacgctggaactgcagtga

SEQ ID NO: 369197 - DNA, 25 bp, Mus musculus
gtaccaggcgcttcgcttgcgcgct

SEQ ID NO: 369198 - DNA, 25 bp, Mus musculus
cctggagttggtaccaggcgcttcg

SEQ ID NO: 369199 - DNA, 25 bp, Mus musculus
cccgggcagcctggagttggtacca

SEQ ID NO: 369200 - DNA, 25 bp, Mus musculus
acgggctccgtgccttcagacggga

SEQ ID NO: 369201 - DNA, 25 bp, Mus musculus
gcgctacctggagcttccaggacgg

SEQ ID NO: 369202 - DNA, 25 bp, Mus musculus
gctcggcgctacctggagcttccag

SEQ ID NO: 369203 - DNA, 25 bp, Mus musculus
aacctccgggagtcggctcggcgct

SEQ ID NO: 369204 - DNA, 25 bp, Mus musculus
gtgaacgagcccactgacggagctg

SEQ ID NO: 369205 - DNA, 25 bp, Mus musculus
agctcatgggagtggcgccagcata

SEQ ID NO: 369206 - DNA, 25 bp, Mus musculus
cactcgcgcccgtcaggcgagctca

SEQ ID NO: 369207 - DNA, 25 bp, Mus musculus
gttgcactcggctcaggcgcgcact

SEQ ID NO: 369208 - DNA, 25 bp, Mus musculus
actggcgctcgagctacgaggagcc

SEQ ID NO: 369209 - DNA, 25 bp, Mus musculus
gcgccggcaactggcgctcgagcta

SEQ ID NO: 369210 - DNA, 25 bp, Mus musculus
gcctgcccacgggaactccaagcgg

SEQ ID NO: 369211 - DNA, 25 bp, Mus musculus
tcgggatctgcggacccgcctccgc

SEQ ID NO: 369212 - DNA, 25 bp, Mus musculus
gccaggcaagctccgctcgggatct

SEQ ID NO: 369213 - DNA, 25 bp, Mus musculus
cggaaacagagacgccaggcaagct

SEQ ID NO: 369214 - DNA, 25 bp, Mus musculus
ttcgaactacggaaacagagacgcc

SEQ ID NO: 369215 - DNA, 25 bp, Mus musculus
ccactgacggagctgggattcgaac

SEQ ID NO: 369216 - DNA, 25 bp, Mus musculus
cgactgcgcaagtgaacgagcccac

SEQ ID NO: 369217 - DNA, 25 bp, Mus musculus
agctgggattcgaactacggaaaca

SEQ ID NO: 369218 - DNA, 25 bp, Mus musculus
gacctggaacgattctggtttgaaa

SEQ ID NO: 369219 - DNA, 25 bp, Mus musculus
ccttcgagaagagaggaaaccctgc

SEQ ID NO: 369220 - DNA, 25 bp, Mus musculus
tccacacccggagtcagctggagtc

SEQ ID NO: 369221 - DNA, 25 bp, Mus musculus
cagctggagtccttctagtttgcga

SEQ ID NO: 369222 - DNA, 25 bp, Mus musculus
gagtccttctagtttgcgattttta

SEQ ID NO: 369223 - DNA, 25 bp, Mus musculus
aaggaaatccgtagaagtgggcatc

SEQ ID NO: 369224 - DNA, 25 bp, Mus musculus
atccgtagaagtgggcatcgccttc

SEQ ID NO: 369225 - DNA, 25 bp, Mus musculus
aaatgtaagcctctggcgcggagcc

SEQ ID NO: 369226 - DNA, 25 bp, Mus musculus
tagaagtgggcatcgccttcgagaa

SEQ ID NO: 369227 - DNA, 25 bp, Mus musculus
agagaggaaaccctgcccggacctg

SEQ ID NO: 369228 - DNA, 25 bp, Mus musculus
tgcccggacctggaacgattctggt

SEQ ID NO: 369229 - DNA, 25 bp, Mus musculus
tggtttgaaaatgtaagcctctggc

SEQ ID NO: 369230 - DNA, 25 bp, Mus musculus
cctagctaaaatgggtcacgtggtc

SEQ ID NO: 369231 - DNA, 25 bp, Mus musculus
aaatgggtcacgtggtccagaggca

SEQ ID NO: 369232 - DNA, 25 bp, Mus musculus
agcaaaagctgctggctcgctgccg

SEQ ID NO: 369233 - DNA, 25 bp, Mus musculus
gaaaacccattcgagaaactgactc

SEQ ID NO: 369234 - DNA, 25 bp, Mus musculus
cccgatatcaatgccgcgcagagca

SEQ ID NO: 369235 - DNA, 25 bp, Mus musculus
gagaaactgactcgctgcgtgaccc

SEQ ID NO: 369236 - DNA, 25 bp, Mus musculus
tgagtgtcccagctcttcctgcaca

SEQ ID NO: 369237 - DNA, 25 bp, Mus musculus
ttcccgggacccagcttgtctgggc

SEQ ID NO: 369238 - DNA, 25 bp, Mus musculus
ttgtctgggctgctaccaccctgac

SEQ ID NO: 369239 - DNA, 25 bp, Mus musculus
caccctgacggctgcagacatgatc

SEQ ID NO: 369240 - DNA, 25 bp, Mus musculus
ccctttcccaatggggcgtgtgtga

SEQ ID NO: 369241 - DNA, 25 bp, Mus musculus
ggacaaggcggctccgacttcccta

SEQ ID NO: 369242 - DNA, 25 bp, Mus musculus
gctccgacttccctagtgctagcta

SEQ ID NO: 369243 - DNA, 25 bp, Mus musculus
tgaaccaggaggtagaaaaatcaac

SEQ ID NO: 369244 - DNA, 25 bp, Mus musculus
ctagctagggcttggagatgaacca

SEQ ID NO: 369245 - DNA, 25 bp, Mus musculus
taccgccgagaggatcgcgtggaat

SEQ ID NO: 369246 - DNA, 25 bp, Mus musculus
cccgctaaactcgagaggtctgggc

SEQ ID NO: 369247 - DNA, 25 bp, Mus musculus
aactcgagaggtctgggcctagcac

SEQ ID NO: 369248 - DNA, 25 bp, Mus musculus
ttgtgcggcggacacgcactgctcc

SEQ ID NO: 369249 - DNA, 25 bp, Mus musculus
gacacgcactgctccggattatctc

SEQ ID NO: 369250 - DNA, 25 bp, Mus musculus
gattatctccatcctgcggcgcaga

SEQ ID NO: 369251 - DNA, 25 bp, Mus musculus
atcctgcggcgcagacggaaccttg

SEQ ID NO: 369252 - DNA, 25 bp, Mus musculus
gtccacgcgcagagttccgcagcaa

SEQ ID NO: 369253 - DNA, 25 bp, Mus musculus
cgcagagttccgcagcaaaagcagc

SEQ ID NO: 369254 - DNA, 25 bp, Mus musculus
ttccgcagcaaaagcagcgtgggga

SEQ ID NO: 369255 - DNA, 25 bp, Mus musculus
tcggaggccgccacgaaacagcaca

SEQ ID NO: 369256 - DNA, 25 bp, Mus musculus
cgccacgaaacagcacaggacactt

SEQ ID NO: 369257 - DNA, 25 bp, Mus musculus
aacagcacaggacacttccggaaac

SEQ ID NO: 369258 - DNA, 25 bp, Mus musculus
tgcgcctgcgtcagatctgtgtcac

SEQ ID NO: 369259 - DNA, 25 bp, Mus musculus
tcagatctgtgtcacgttaggggcg

SEQ ID NO: 369260 - DNA, 25 bp, Mus musculus
ccaatccctcgtccctggaggagtg

SEQ ID NO: 369261 - DNA, 25 bp, Mus musculus
tctcgtgtgcaaatggctttctgtc

SEQ ID NO: 369262 - DNA, 25 bp, Mus musculus
ctctgggccctttaaataccgcgtg

SEQ ID NO: 369263 - DNA, 25 bp, Mus musculus
ggaccgtaccaccactgaatatagg

SEQ ID NO: 369264 - DNA, 25 bp, Mus musculus
tccgaacgctttaggccctacagca

SEQ ID NO: 369265 - DNA, 25 bp, Mus musculus
agtccatttcatcctacctggtaaa

SEQ ID NO: 369266 - DNA, 25 bp, Mus musculus
tgtccgttcggttggagttagtcca

SEQ ID NO: 369267 - DNA, 25 bp, Mus musculus
cgcgagcggacaccagaagtctgtc

SEQ ID NO: 369268 - DNA, 25 bp, Mus musculus
tttttatattactgccgcgagcgga

SEQ ID NO: 369269 - DNA, 25 bp, Mus musculus
ccgcttggtcgtgatgacatccctt

SEQ ID NO: 369270 - DNA, 25 bp, Mus musculus
cctcggccctatgtttgggtcttgt

SEQ ID NO: 369271 - DNA, 25 bp, Mus musculus
tttcctcgagtctctacgcgggatc

SEQ ID NO: 369272 - DNA, 25 bp, Mus musculus
agggctccttgtgccctccgagttc

SEQ ID NO: 369273 - DNA, 25 bp, Mus musculus
ctccgagttcgggacatttgacctc

SEQ ID NO: 369274 - DNA, 25 bp, Mus musculus
tgggcgcccgccacgtcggctaaat

SEQ ID NO: 369275 - DNA, 25 bp, Mus musculus
cttacttgcgggctatgggcgcccg

SEQ ID NO: 369276 - DNA, 25 bp, Mus musculus
tgtttccacttacttgcgggctatg

SEQ ID NO: 369277 - DNA, 25 bp, Mus musculus
cagagatgggtcttgtttccactta

SEQ ID NO: 369278 - DNA, 25 bp, Mus musculus
ggtcagagccactcgaccctggggt

SEQ ID NO: 369279 - DNA, 25 bp, Mus musculus
tacgaggcgaagacccacgccactg

SEQ ID NO: 369280 - DNA, 25 bp, Mus musculus
gcgggagacggaactgaacccgctc

SEQ ID NO: 369281 - DNA, 25 bp, Mus musculus
tgacagagtgggtaccaggactagt

SEQ ID NO: 369282 - DNA, 25 bp, Mus musculus
aagccttgtcctctacttccgcggg

SEQ ID NO: 369283 - DNA, 25 bp, Mus musculus
ttatttccggaagcgaagccttgtc

SEQ ID NO: 369284 - DNA, 25 bp, Mus musculus
tctcctctatggttgcgggagctga

SEQ ID NO: 369285 - DNA, 25 bp, Mus musculus
agagcataaagaggtctctcctcta

SEQ ID NO: 369286 - DNA, 25 bp, Mus musculus
tcgcacggggttgagagcataaaga

SEQ ID NO: 369287 - DNA, 25 bp, Mus musculus
tagagcagccgctctaggcagccgg

SEQ ID NO: 369288 - DNA, 25 bp, Mus musculus
ttgcgtggaagatgttgagcctctc

SEQ ID NO: 369289 - DNA, 25 bp, Mus musculus
gcctctcggagcttccgcaaaagaa

SEQ ID NO: 369290 - DNA, 25 bp, Mus musculus
cttgggtcgctgcagtcactttttt

SEQ ID NO: 369291 - DNA, 25 bp, Mus musculus
cgccaacttgctgttctacgacatg

SEQ ID NO: 369292 - DNA, 25 bp, Mus musculus
tagcatcagctctacggacccgggg

SEQ ID NO: 369293 - DNA, 25 bp, Mus musculus
cgacatgctgctctatttgggttcc

SEQ ID NO: 369294 - DNA, 25 bp, Mus musculus
gcccgctccagtttcctggtgtgga

SEQ ID NO: 369295 - DNA, 25 bp, Mus musculus
tacaccggcaacatagaggcgctcc

SEQ ID NO: 369296 - DNA, 25 bp, Mus musculus
cgtcgcttctcgctgacccttagga

SEQ ID NO: 369297 - DNA, 25 bp, Mus musculus
aggagcgtctccgacacctttcagc

SEQ ID NO: 369298 - DNA, 25 bp, Mus musculus
gtcgtccagcggatcagtagcatca

SEQ ID NO: 369299 - DNA, 25 bp, Mus musculus
cactgggcgcaaacgcagaaggttc

SEQ ID NO: 369300 - DNA, 25 bp, Mus musculus
ttgccatggagagtgtctaaagccc

SEQ ID NO: 369301 - DNA, 25 bp, Mus musculus
cttcgtcagtctcctgtggtggatc

SEQ ID NO: 369302 - DNA, 25 bp, Mus musculus
cggttaaggtcagacgcaagcctac

SEQ ID NO: 369303 - DNA, 25 bp, Mus musculus
acgcaggagcctctggttccctcgg

SEQ ID NO: 369304 - DNA, 25 bp, Mus musculus
gctgagagctctccgcatgtgccga

SEQ ID NO: 369305 - DNA, 25 bp, Mus musculus
agcccgctgagagctctccgcatgt

SEQ ID NO: 369306 - DNA, 25 bp, Mus musculus
tgccacgctgagtgcgtcgcggact

SEQ ID NO: 369307 - DNA, 25 bp, Mus musculus
ggcagcggcctctgccacgctgagt

SEQ ID NO: 369308 - DNA, 25 bp, Mus musculus
cgatgtgacggcagcggcctctgcc

SEQ ID NO: 369309 - DNA, 25 bp, Mus musculus
acacgcgcttgtcgggcgatgtgac

SEQ ID NO: 369310 - DNA, 25 bp, Mus musculus
cgctgcttcacacgcgcttgtcggg

SEQ ID NO: 369311 - DNA, 25 bp, Mus musculus
gttcgctcagttcaggccgaatggc

SEQ ID NO: 369312 - DNA, 25 bp, Mus musculus
caaggccgggcgttcgctcagttca

SEQ ID NO: 369313 - DNA, 25 bp, Mus musculus
tacgctctgctcacgtgggccgcgt

SEQ ID NO: 369314 - DNA, 25 bp, Mus musculus
tcttgctgcgatccttacgctctgc

SEQ ID NO: 369315 - DNA, 25 bp, Mus musculus
taaggtcagacgcaagcctacccgc

SEQ ID NO: 369316 - DNA, 25 bp, Mus musculus
ctgccagctgaaagggacgttgact

SEQ ID NO: 369317 - DNA, 25 bp, Mus musculus
tccgcgtccttaatgctcaagtctc

SEQ ID NO: 369318 - DNA, 25 bp, Mus musculus
cttctgcactacgtctgccagctga

SEQ ID NO: 369319 - DNA, 25 bp, Mus musculus
caagtctctgcgactacagctgctg

SEQ ID NO: 369320 - DNA, 25 bp, Mus musculus
tgagtggacgccgacaaagtttgga

SEQ ID NO: 369321 - DNA, 25 bp, Mus musculus
tcccgtgatgccttgcagcccaagg

SEQ ID NO: 369322 - DNA, 25 bp, Mus musculus
agggctattccgtctcctcgatctc

SEQ ID NO: 369323 - DNA, 25 bp, Mus musculus
gcggcctagacgatgccactgctgg

SEQ ID NO: 369324 - DNA, 25 bp, Mus musculus
gacgcgctttcactagggacctggt

SEQ ID NO: 369325 - DNA, 25 bp, Mus musculus
tgacttacggaaggtcgcacagcgc

SEQ ID NO: 369326 - DNA, 25 bp, Mus musculus
cccgcattacccagctgcagaaagg

SEQ ID NO: 369327 - DNA, 25 bp, Mus musculus
gtcccagttctttgcgcgctcattc

SEQ ID NO: 369328 - DNA, 25 bp, Mus musculus
cgaggctaccctcgaggttctcctt

SEQ ID NO: 369329 - DNA, 25 bp, Mus musculus
ttttgcgaatcaactcggccgaggc

SEQ ID NO: 369330 - DNA, 25 bp, Mus musculus
tcttaaggcaggagcagtctcgatg

SEQ ID NO: 369331 - DNA, 25 bp, Mus musculus
caggcggtcgacctggctagagcta

SEQ ID NO: 369332 - DNA, 25 bp, Mus musculus
acctggctagagctaggtggcgccc

SEQ ID NO: 369333 - DNA, 25 bp, Mus musculus
ggcgcctcccgtttctgggacaagc

SEQ ID NO: 369334 - DNA, 25 bp, Mus musculus
tccgagagcagcaggcggtcgacct

SEQ ID NO: 369335 - DNA, 25 bp, Mus musculus
aggagcagtctcgatggctgccagc

SEQ ID NO: 369336 - DNA, 25 bp, Mus musculus
gtctcgatggctgccagcgctggca

SEQ ID NO: 369337 - DNA, 25 bp, Mus musculus
ccgggatcttaaggcaggagcagtc

SEQ ID NO: 369338 - DNA, 25 bp, Mus musculus
cccaaagagagacgccgggatctta

SEQ ID NO: 369339 - DNA, 25 bp, Mus musculus
ttcactgcacacctcacgcctctgg

SEQ ID NO: 369340 - DNA, 25 bp, Mus musculus
ccctatcccgccagtgcccttcact

SEQ ID NO: 369341 - DNA, 25 bp, Mus musculus
aattgaagcgggacctgggcctcac

SEQ ID NO: 369342 - DNA, 25 bp, Mus musculus
caagcggatgtggaagaattgaagc

SEQ ID NO: 369343 - DNA, 25 bp, Mus musculus
cccgtttctgggacaagcggatgtg

SEQ ID NO: 369344 - DNA, 25 bp, Mus musculus
gcgtccaccgagacccagggtggaa

SEQ ID NO: 369345 - DNA, 25 bp, Mus musculus
ctagaatttcatcatggagctgggc

SEQ ID NO: 369346 - DNA, 25 bp, Mus musculus
atgtccgcgtctggttgttctagaa

SEQ ID NO: 369347 - DNA, 25 bp, Mus musculus
cctatgtccgcgtctggttgttcta

SEQ ID NO: 369348 - DNA, 25 bp, Mus musculus
gaatttcatcatggagctgggctcc

SEQ ID NO: 369349 - DNA, 25 bp, Mus musculus
ttcatcatggagctgggctcctgca

SEQ ID NO: 369350 - DNA, 25 bp, Mus musculus
gctctggccgccaccgtggagacct

SEQ ID NO: 369351 - DNA, 25 bp, Mus musculus
gtcgccgaaggaagtcgtggtgctt

SEQ ID NO: 369352 - DNA, 25 bp, Mus musculus
ccaccgagacccagggtggaacgcg

SEQ ID NO: 369353 - DNA, 25 bp, Mus musculus
ccgcgtctggttgttctagaatttc

SEQ ID NO: 369354 - DNA, 25 bp, Mus musculus
cgtctggttgttctagaatttcatc

SEQ ID NO: 369355 - DNA, 25 bp, Mus musculus
gcgccggtaggacggccggcgacat

SEQ ID NO: 369356 - DNA, 25 bp, Mus musculus
aagtcgtggtgcttgagcgccggta

SEQ ID NO: 369357 - DNA, 25 bp, Mus musculus
cttggagcccgctgccgctcgcagg

SEQ ID NO: 369358 - DNA, 25 bp, Mus musculus
gtcctaacgctgcttggtggcaaga

SEQ ID NO: 369359 - DNA, 25 bp, Mus musculus
acttgaagcctgtgacgaccgtcgc

SEQ ID NO: 369360 - DNA, 25 bp, Mus musculus
gcgacaactaggacttcttcccgta

SEQ ID NO: 369361 - DNA, 25 bp, Mus musculus
aggctttcaagtcctccgccgtcaa

SEQ ID NO: 369362 - DNA, 25 bp, Mus musculus
gtcgcaatgagatatccaccaggta

SEQ ID NO: 369363 - DNA, 25 bp, Mus musculus
ccgccgtcaacaccggtcaggaatg

SEQ ID NO: 369364 - DNA, 25 bp, Mus musculus
tctatagggcggtccaacttgaagc

SEQ ID NO: 369365 - DNA, 25 bp, Mus musculus
cgcaggtatcctgcggcttgctgaa

SEQ ID NO: 369366 - DNA, 25 bp, Mus musculus
ctaggcttccgtacttgggcgtcac

SEQ ID NO: 369367 - DNA, 25 bp, Mus musculus
accttctccagggacgcgtccatgg

SEQ ID NO: 369368 - DNA, 25 bp, Mus musculus
gccgagcctcggtaaagccaaagcc

SEQ ID NO: 369369 - DNA, 25 bp, Mus musculus
tgtcaccctacaggaccagcgcggg

SEQ ID NO: 369370 - DNA, 25 bp, Mus musculus
gcttctggggcccacaccgattgct

SEQ ID NO: 369371 - DNA, 25 bp, Mus musculus
tatcgactcagctgcacggcccaag

SEQ ID NO: 369372 - DNA, 25 bp, Mus musculus
gccgtgaccttccacggaaacttca

SEQ ID NO: 369373 - DNA, 25 bp, Mus musculus
cgtggcccactaacgtgctgctcta

SEQ ID NO: 369374 - DNA, 25 bp, Mus musculus
actaacgtgctgctctacgccgggc

SEQ ID NO: 369375 - DNA, 25 bp, Mus musculus
ctacgccgggctcttctcggcgggt

SEQ ID NO: 369376 - DNA, 25 bp, Mus musculus
cgggtgatgccctgcagcagcgact

SEQ ID NO: 369377 - DNA, 25 bp, Mus musculus
actctggccgtgaccttccacggaa

SEQ ID NO: 369378 - DNA, 25 bp, Mus musculus
aactacgtgtggctgcgcctactgg

SEQ ID NO: 369379 - DNA, 25 bp, Mus musculus
tatgcgatcagactgtcggagggcc

SEQ ID NO: 369380 - DNA, 25 bp, Mus musculus
tcggagggccgatagccctctctgc

SEQ ID NO: 369381 - DNA, 25 bp, Mus musculus
ggcgctatccgtggcccactaacgt

SEQ ID NO: 369382 - DNA, 25 bp, Mus musculus
ctggtggcgcgcgtttccacaggca

SEQ ID NO: 369383 - DNA, 25 bp, Mus musculus
cggaaacttcaactacgtgtggctg

SEQ ID NO: 369384 - DNA, 25 bp, Mus musculus
ctctctgccttctacgtcggtgagg

SEQ ID NO: 369385 - DNA, 25 bp, Mus musculus
tcctggccaaggtgctatgcgatca

SEQ ID NO: 369386 - DNA, 25 bp, Mus musculus
tagctccttcttggctcacattccg

SEQ ID NO: 369387 - DNA, 25 bp, Mus musculus
atcccagaagcatcagtctgagggg

SEQ ID NO: 369388 - DNA, 25 bp, Mus musculus
gcgagcaggaagacaagcgccagct

SEQ ID NO: 369389 - DNA, 25 bp, Mus musculus
ccagctgggactaaacgcctcggaa

SEQ ID NO: 369390 - DNA, 25 bp, Mus musculus
gagcactggagagcgactttttcgc

SEQ ID NO: 369391 - DNA, 25 bp, Mus musculus
ggagagcgactttttcgcacggccc

SEQ ID NO: 369392 - DNA, 25 bp, Mus musculus
agtcccggtccttcaatcccagaag

SEQ ID NO: 369393 - DNA, 25 bp, Mus musculus
aaaggcgtcgtttccagaccagcta

SEQ ID NO: 369394 - DNA, 25 bp, Mus musculus
gaccagctacgttgctgatcagagc

SEQ ID NO: 369395 - DNA, 25 bp, Mus musculus
tgatcagagcatccggtacgcccta

SEQ ID NO: 369396 - DNA, 25 bp, Mus musculus
tacgccctagtggagtcccggcact

SEQ ID NO: 369397 - DNA, 25 bp, Mus musculus
agaggactcacctcagccactagct

SEQ ID NO: 369398 - DNA, 25 bp, Mus musculus
attttgattcccgactccgcagctc

SEQ ID NO: 369399 - DNA, 25 bp, Mus musculus
cggcactgacagaggactcacctca

SEQ ID NO: 369400 - DNA, 25 bp, Mus musculus
ggataccaacctatatccaaccttc

SEQ ID NO: 369401 - DNA, 25 bp, Mus musculus
cgcgcccgggcctagagagaaaaag

SEQ ID NO: 369402 - DNA, 25 bp, Mus musculus
tggcacggcgagtaccgagccgcca

SEQ ID NO: 369403 - DNA, 25 bp, Mus musculus
cctcgatgcctataggtctcggccg

SEQ ID NO: 369404 - DNA, 25 bp, Mus musculus
atgcctataggtctcggccgctgga

SEQ ID NO: 369405 - DNA, 25 bp, Mus musculus
gctgccgcacggataccaacctata

SEQ ID NO: 369406 - DNA, 25 bp, Mus musculus
tttctatcctcgaacgtcctcaaga

SEQ ID NO: 369407 - DNA, 25 bp, Mus musculus
ctgctggctgcttttctatcctcga

SEQ ID NO: 369408 - DNA, 25 bp, Mus musculus
aactccgttcctcttctgctggctg

SEQ ID NO: 369409 - DNA, 25 bp, Mus musculus
gcaccgcgcagtaccggcgaaggct

SEQ ID NO: 369410 - DNA, 25 bp, Mus musculus
tggccgagtcagacgcgtcccgaga

SEQ ID NO: 369411 - DNA, 25 bp, Mus musculus
cgctgattggccgagtcagacgcgt

SEQ ID NO: 369412 - DNA, 25 bp, Mus musculus
acctcgcttctttgcgctgattggc

SEQ ID NO: 369413 - DNA, 25 bp, Mus musculus
agtttccaaacctcgcttctttgcg

SEQ ID NO: 369414 - DNA, 25 bp, Mus musculus
acaccagtgggtgtagttttccaca

SEQ ID NO: 369415 - DNA, 25 bp, Mus musculus
tagttttccacatccggctcggtca

SEQ ID NO: 369416 - DNA, 25 bp, Mus musculus
ggttcctccgcaggttaggccctga

SEQ ID NO: 369417 - DNA, 25 bp, Mus musculus
accggaggagaacgcacaccactct

SEQ ID NO: 369418 - DNA, 25 bp, Mus musculus
cagaacttctgcacatgctcggagc

SEQ ID NO: 369419 - DNA, 25 bp, Mus musculus
cacgggcggatgtgaacattctgcc

SEQ ID NO: 369420 - DNA, 25 bp, Mus musculus
gcgagacctcggaagtacaccagtg

SEQ ID NO: 369421 - DNA, 25 bp, Mus musculus
tgccgacttcttcctctaccgtgaa

SEQ ID NO: 369422 - DNA, 25 bp, Mus musculus
tctaccgtgaatggaatggatgttc

SEQ ID NO: 369423 - DNA, 25 bp, Mus musculus
aatggatgttctagccgaggagttc

SEQ ID NO: 369424 - DNA, 25 bp, Mus musculus
gccgatcccgactgtggaggtaagt

SEQ ID NO: 369425 - DNA, 25 bp, Mus musculus
ttgccgggagagttttcaggatgac

SEQ ID NO: 369426 - DNA, 25 bp, Mus musculus
ccctgggcttctacgcatgctcaga

SEQ ID NO: 369427 - DNA, 25 bp, Mus musculus
actctccgcgtgctacttgcttgga

SEQ ID NO: 369428 - DNA, 25 bp, Mus musculus
aaggccaggcgcaattctcgaaaca

SEQ ID NO: 369429 - DNA, 25 bp, Mus musculus
ctctggctccccctgactaaatatg

SEQ ID NO: 369430 - DNA, 25 bp, Mus musculus
tgactaaatatggtcccgcgcagcc

SEQ ID NO: 369431 - DNA, 25 bp, Mus musculus
cagcgtggcataccagcggggctct

SEQ ID NO: 369432 - DNA, 25 bp, Mus musculus
gaattcccagcgtggcataccagcg

SEQ ID NO: 369433 - DNA, 25 bp, Mus musculus
acaggaattcccagcgtggcatacc

SEQ ID NO: 369434 - DNA, 25 bp, Mus musculus
cgaaacaggaattcccagcgtggca

SEQ ID NO: 369435 - DNA, 25 bp, Mus musculus
tctcgaaacaggaattcccagcgtg

SEQ ID NO: 369436 - DNA, 25 bp, Mus musculus
ccctgactaaatatggtcccgcgca

SEQ ID NO: 369437 - DNA, 25 bp, Mus musculus
gccaggcgcaattctcgaaacagga

SEQ ID NO: 369438 - DNA, 25 bp, Mus musculus
agacaacccaaaaaggccaggcgca

SEQ ID NO: 369439 - DNA, 25 bp, Mus musculus
ctggtcctccctcctgggcctgggc

SEQ ID NO: 369440 - DNA, 25 bp, Mus musculus
gccagaccggggacgcctcgctccc

SEQ ID NO: 369441 - DNA, 25 bp, Mus musculus
ggcgcaattctcgaaacaggaattc

SEQ ID NO: 369442 - DNA, 25 bp, Mus musculus
aggttcgacgcttcccgcaaccgag

SEQ ID NO: 369443 - DNA, 25 bp, Mus musculus
tgccaccctagaacgaccctggaaa

SEQ ID NO: 369444 - DNA, 25 bp, Mus musculus
ccctggaaaaagatgagccgatgtc

SEQ ID NO: 369445 - DNA, 25 bp, Mus musculus
tcatatacggaaggttcgacgcttc

SEQ ID NO: 369446 - DNA, 25 bp, Mus musculus
tcaccagctttcagttccgtaacag

SEQ ID NO: 369447 - DNA, 25 bp, Mus musculus
gttccgtaacagtcgccatttttca

SEQ ID NO: 369448 - DNA, 25 bp, Mus musculus
tttttcaacggctgctggtgccacg

SEQ ID NO: 369449 - DNA, 25 bp, Mus musculus
tggtgccacgcctctccagtgcgta

SEQ ID NO: 369450 - DNA, 25 bp, Mus musculus
gcgcggcctccaaccaataggagta

SEQ ID NO: 369451 - DNA, 25 bp, Mus musculus
taggagtatggctctgctagaccgc

SEQ ID NO: 369452 - DNA, 25 bp, Mus musculus
gactccaccaatcagcgaccgtgtg

SEQ ID NO: 369453 - DNA, 25 bp, Mus musculus
gctagaccgcgtctgtgcctgcgct

SEQ ID NO: 369454 - DNA, 25 bp, Mus musculus
ttggcgagccgccacatgagactcc

SEQ ID NO: 369455 - DNA, 25 bp, Mus musculus
tctgtcccatccctatcatatacgg

SEQ ID NO: 369456 - DNA, 25 bp, Mus musculus
gctccgatccactctgggtaaggtg

SEQ ID NO: 369457 - DNA, 25 bp, Mus musculus
ttagggtcacctgggatgaagccca

SEQ ID NO: 369458 - DNA, 25 bp, Mus musculus
gccagcggtacagttagggtcacct

SEQ ID NO: 369459 - DNA, 25 bp, Mus musculus
tgtcggctttaggagccgccagtga

SEQ ID NO: 369460 - DNA, 25 bp, Mus musculus
caggcccaggccagggcaactcgtg

SEQ ID NO: 369461 - DNA, 25 bp, Mus musculus
agggcaactcgtggccgtgctcgct

SEQ ID NO: 369462 - DNA, 25 bp, Mus musculus
gctgcatcccggtgacgcgggccaa

SEQ ID NO: 369463 - DNA, 25 bp, Mus musculus
agcgctgatggctccgatccactct

SEQ ID NO: 369464 - DNA, 25 bp, Mus musculus
cgctctcttactctggggaccgggt

SEQ ID NO: 369465 - DNA, 25 bp, Mus musculus
tagccggagccctgctctgcttacg

SEQ ID NO: 369466 - DNA, 25 bp, Mus musculus
ccctgctctgcttacgcggggattc

SEQ ID NO: 369467 - DNA, 25 bp, Mus musculus
tgcttacgcggggattcgccacccg

SEQ ID NO: 369468 - DNA, 25 bp, Mus musculus
gtagccgccgctctcttactctggg

SEQ ID NO: 369469 - DNA, 25 bp, Mus musculus
ctgcgcagcttctgcagcgctgatg

SEQ ID NO: 369470 - DNA, 25 bp, Mus musculus
ggtgacttcagaggcgcctgcctgt

SEQ ID NO: 369471 - DNA, 25 bp, Mus musculus
ccgcggttctattgcttgactcaga

SEQ ID NO: 369472 - DNA, 25 bp, Mus musculus
tgtgcgcgagtaaaccgcggttcta

SEQ ID NO: 369473 - DNA, 25 bp, Mus musculus
gcctctgtaaatctgtgcgcgagta

SEQ ID NO: 369474 - DNA, 25 bp, Mus musculus
cacacaggtaaaaatcgcctctgta

SEQ ID NO: 369475 - DNA, 25 bp, Mus musculus
caactacagcgaactggacacacac

SEQ ID NO: 369476 - DNA, 25 bp, Mus musculus
agaagcccaactacagcgaactgga

SEQ ID NO: 369477 - DNA, 25 bp, Mus musculus
atttcaacgcctccaagaagcccaa

SEQ ID NO: 369478 - DNA, 25 bp, Mus musculus
tggtcaagaaacatttcaacgcctc

SEQ ID NO: 369479 - DNA, 25 bp, Mus musculus
gctccttcctggtcaagaaacattt

SEQ ID NO: 369480 - DNA, 25 bp, Mus musculus
taggaccgccgcctggaccgttatc

SEQ ID NO: 369481 - DNA, 25 bp, Mus musculus
cgatgctataggaccgccgcctgga

SEQ ID NO: 369482 - DNA, 25 bp, Mus musculus
gcacctgagccaccgcgatgctata

SEQ ID NO: 369483 - DNA, 25 bp, Mus musculus
ttgactcagagaacacaccgggccg

SEQ ID NO: 369484 - DNA, 25 bp, Mus musculus
cctcgcgcagtaaatgggcatccga

SEQ ID NO: 369485 - DNA, 25 bp, Mus musculus
tcccggccagagcaattgcggtctc

SEQ ID NO: 369486 - DNA, 25 bp, Mus musculus
agcaattgcggtctcgcgggccgcc

SEQ ID NO: 369487 - DNA, 25 bp, Mus musculus
ctggcacgcggaaacgcgcgatcca

SEQ ID NO: 369488 - DNA, 25 bp, Mus musculus
cccggctcagagaggcgcgctaatg

SEQ ID NO: 369489 - DNA, 25 bp, Mus musculus
agagaggcgcgctaatgaccgaccc

SEQ ID NO: 369490 - DNA, 25 bp, Mus musculus
agtaaatgggcatccgaggctcgtc

SEQ ID NO: 369491 - DNA, 25 bp, Mus musculus
agagtggctgcctcgcgcagtaaat

SEQ ID NO: 369492 - DNA, 25 bp, Mus musculus
tgccgcggctccagagtggctgcct

SEQ ID NO: 369493 - DNA, 25 bp, Mus musculus
gactccatccagatgtgccgcggct

SEQ ID NO: 369494 - DNA, 25 bp, Mus musculus
aggctcgtcaatcccggccagagca

SEQ ID NO: 369495 - DNA, 25 bp, Mus musculus
gctcggcggctgactccatccagat

SEQ ID NO: 369496 - DNA, 25 bp, Mus musculus
atgggcatccgaggctcgtcaatcc

SEQ ID NO: 369497 - DNA, 25 bp, Mus musculus
ggcggctgactccatccagatgtgc

SEQ ID NO: 369498 - DNA, 25 bp, Mus musculus
ctgcagctccagagggaagttcaga

SEQ ID NO: 369499 - DNA, 25 bp, Mus musculus
tgttcaccaaaactgcccataacgg

SEQ ID NO: 369500 - DNA, 25 bp, Mus musculus
ggaaggcaccaccatatgttcacca

SEQ ID NO: 369501 - DNA, 25 bp, Mus musculus
agcgccaaggcgagcgagaaccgca

SEQ ID NO: 369502 - DNA, 25 bp, Mus musculus
agcgagaaccgcacgggccgtacct

SEQ ID NO: 369503 - DNA, 25 bp, Mus musculus
agccacttgggaaggcaccaccata

SEQ ID NO: 369504 - DNA, 25 bp, Mus musculus
acctggtgctcccagggttctcgtg

SEQ ID NO: 369505 - DNA, 25 bp, Mus musculus
gcaccgggagcagctttcgcaaaaa

SEQ ID NO: 369506 - DNA, 25 bp, Mus musculus
ttcgcaaaaacaactcgggaggcga

SEQ ID NO: 369507 - DNA, 25 bp, Mus musculus
ttgcggctaagcaccagcgggctac

SEQ ID NO: 369508 - DNA, 25 bp, Mus musculus
cctgcctgagctacagatgccgctg

SEQ ID NO: 369509 - DNA, 25 bp, Mus musculus
ccgctgcctcaggtcggaagagtag

SEQ ID NO: 369510 - DNA, 25 bp, Mus musculus
tcggaagagtagcagccgcagccgc

SEQ ID NO: 369511 - DNA, 25 bp, Mus musculus
aagttcagaccttgagcgctcgggg

SEQ ID NO: 369512 - DNA, 25 bp, Mus musculus
gtctggtggactcccagcctagatc

SEQ ID NO: 369513 - DNA, 25 bp, Mus musculus
cagcgcgttgctctccgtcatagag

SEQ ID NO: 369514 - DNA, 25 bp, Mus musculus
cgcacgcagggcgtcaacgtcactt

SEQ ID NO: 369515 - DNA, 25 bp, Mus musculus
taccagacgcaccaccgcacgcagg

SEQ ID NO: 369516 - DNA, 25 bp, Mus musculus
gacctgtggagaccgccatcttctc

SEQ ID NO: 369517 - DNA, 25 bp, Mus musculus
taggaaccgacctgtggagaccgcc

SEQ ID NO: 369518 - DNA, 25 bp, Mus musculus
gttgctctccgtcatagagggaccg

SEQ ID NO: 369519 - DNA, 25 bp, Mus musculus
gtctgtctggtggactcccagccta

SEQ ID NO: 369520 - DNA, 25 bp, Mus musculus
atcctcccgcacgtgtctgtctggt

SEQ ID NO: 369521 - DNA, 25 bp, Mus musculus
agcagccaccctccggttagtccta

SEQ ID NO: 369522 - DNA, 25 bp, Mus musculus
gtcgccctcttattccagacagcag

SEQ ID NO: 369523 - DNA, 25 bp, Mus musculus
cacctaagtaaaatcgtcgccctct

SEQ ID NO: 369524 - DNA, 25 bp, Mus musculus
agacccggctaggaaccgacctgtg

SEQ ID NO: 369525 - DNA, 25 bp, Mus musculus
ccgttgatgggcaatgccaccgcca

SEQ ID NO: 369526 - DNA, 25 bp, Mus musculus
tcacagcggcaaaggcgtgtagctc

SEQ ID NO: 369527 - DNA, 25 bp, Mus musculus
tgcaggagttcctgtccgcagcaga

SEQ ID NO: 369528 - DNA, 25 bp, Mus musculus
ggttctgtccctttgcattccgatg

SEQ ID NO: 369529 - DNA, 25 bp, Mus musculus
tctccgcatggttagactggttctg

SEQ ID NO: 369530 - DNA, 25 bp, Mus musculus
tgcgttgtcccgagtgcaaacacca

SEQ ID NO: 369531 - DNA, 25 bp, Mus musculus
tccgggttagttgcaaacgcgcaca

SEQ ID NO: 369532 - DNA, 25 bp, Mus musculus
ggccggcacaactcccttgtgtgtt

SEQ ID NO: 369533 - DNA, 25 bp, Mus musculus
gttctcgaccgctacctaggaatta

SEQ ID NO: 369534 - DNA, 25 bp, Mus musculus
tgcgccacccaggagaacgttcctg

SEQ ID NO: 369535 - DNA, 25 bp, Mus musculus
aaggtttccggccaatcacagcggc

SEQ ID NO: 369536 - DNA, 25 bp, Mus musculus
cgcctccggaaagcgccgtaagtga

SEQ ID NO: 369537 - DNA, 25 bp, Mus musculus
agcgaccgaagacgcctggccaatc

SEQ ID NO: 369538 - DNA, 25 bp, Mus musculus
ccgcgagagtataagggagcagttc

SEQ ID NO: 369539 - DNA, 25 bp, Mus musculus
ttgctgcgcgacaaaagaaatctgg

SEQ ID NO: 369540 - DNA, 25 bp, Mus musculus
gcacgcgccttgtggccaactgctt

SEQ ID NO: 369541 - DNA, 25 bp, Mus musculus
tgagccgcttttcccagtaggcagg

SEQ ID NO: 369542 - DNA, 25 bp, Mus musculus
aacttggggagtaaagagcaactga

SEQ ID NO: 369543 - DNA, 25 bp, Mus musculus
cacgatctcgtgtaattaccagttc

SEQ ID NO: 369544 - DNA, 25 bp, Mus musculus
cgcagcttgatgacgctatttccgg

SEQ ID NO: 369545 - DNA, 25 bp, Mus musculus
tttgcttttgcaggcgcttttcccg

SEQ ID NO: 369546 - DNA, 25 bp, Mus musculus
tctgcacttgattggcttttgcttt

SEQ ID NO: 369547 - DNA, 25 bp, Mus musculus
tgtggccaactgcttctgcacttga

SEQ ID NO: 369548 - DNA, 25 bp, Mus musculus
gcaactgaggacgtcactgcgcacg

SEQ ID NO: 369549 - DNA, 25 bp, Mus musculus
tttaaacggatacgcactcctgtcc

SEQ ID NO: 369550 - DNA, 25 bp, Mus musculus
gctttgcttttaaacggatacgcac

SEQ ID NO: 369551 - DNA, 25 bp, Mus musculus
tgacggtccctaaacagctttgctt

SEQ ID NO: 369552 - DNA, 25 bp, Mus musculus
ttaccagttctgttgacggtcccta

SEQ ID NO: 369553 - DNA, 25 bp, Mus musculus
gctatttccgggttgtgtgtctgga

SEQ ID NO: 369554 - DNA, 25 bp, Mus musculus
actcgagctgcggagccttgatccc

SEQ ID NO: 369555 - DNA, 25 bp, Mus musculus
aacgcaccgcggttagggtggccat

SEQ ID NO: 369556 - DNA, 25 bp, Mus musculus
ggccatcactcttccgttggctttg

SEQ ID NO: 369557 - DNA, 25 bp, Mus musculus
gcccggttgatctgtccgtctatca

SEQ ID NO: 369558 - DNA, 25 bp, Mus musculus
ccgtctatcaggctctgttgctgaa

SEQ ID NO: 369559 - DNA, 25 bp, Mus musculus
tgttgctgaacctaacctcgacggc

SEQ ID NO: 369560 - DNA, 25 bp, Mus musculus
ccacggttcactagttctggtctcg

SEQ ID NO: 369561 - DNA, 25 bp, Mus musculus
ttgatccctgttccgcctttgctat

SEQ ID NO: 369562 - DNA, 25 bp, Mus musculus
tttgctatgtctgaaggcgtcctgc

SEQ ID NO: 369563 - DNA, 25 bp, Mus musculus
gtgtcggggccaaatccagattttc

SEQ ID NO: 369564 - DNA, 25 bp, Mus musculus
agattttcatttcgctccaggcttg

SEQ ID NO: 369565 - DNA, 25 bp, Mus musculus
cgctccaggcttggacggctaagta

SEQ ID NO: 369566 - DNA, 25 bp, Mus musculus
cggctaagtaggtccaaaccgcaca

SEQ ID NO: 369567 - DNA, 25 bp, Mus musculus
ggttcgaatttcaggaggctcccac

SEQ ID NO: 369568 - DNA, 25 bp, Mus musculus
tattctaatcacagcgcggccggcc

SEQ ID NO: 369569 - DNA, 25 bp, Mus musculus
tgcctctgtccatggtcaaagcagc

SEQ ID NO: 369570 - DNA, 25 bp, Mus musculus
tcatattctaatcacagcgcggccg

SEQ ID NO: 369571 - DNA, 25 bp, Mus musculus
gccgagcccattcatattctaatca

SEQ ID NO: 369572 - DNA, 25 bp, Mus musculus
cagcggggtaatccgcctttctctt

SEQ ID NO: 369573 - DNA, 25 bp, Mus musculus
cgcctttctcttccgcccgccgagc

SEQ ID NO: 369574 - DNA, 25 bp, Mus musculus
agcagcggggtaatccgcctttctc

SEQ ID NO: 369575 - DNA, 25 bp, Mus musculus
catggtcaaagcagcggggtaatcc

SEQ ID NO: 369576 - DNA, 25 bp, Mus musculus
tgtccatggtcaaagcagcggggta

SEQ ID NO: 369577 - DNA, 25 bp, Mus musculus
ctctgtccatggtcaaagcagcggg

SEQ ID NO: 369578 - DNA, 25 bp, Mus musculus
gggcaagaagcgcacccggctcggc

SEQ ID NO: 369579 - DNA, 25 bp, Mus musculus
gcgctgcctctgtccatggtcaaag

SEQ ID NO: 369580 - DNA, 25 bp, Mus musculus
gcgagcggccactttcccggggcca

SEQ ID NO: 369581 - DNA, 25 bp, Mus musculus
ccgccgagcccattcatattctaat

SEQ ID NO: 369582 - DNA, 25 bp, Mus musculus
aatcgctagtttctttgggacctgc

SEQ ID NO: 369583 - DNA, 25 bp, Mus musculus
cagacgccgcccgaatcgctagttt

SEQ ID NO: 369584 - DNA, 25 bp, Mus musculus
tgagactctgaacgacctatacctc

SEQ ID NO: 369585 - DNA, 25 bp, Mus musculus
cgtgggcctttgagactctgaacga

SEQ ID NO: 369586 - DNA, 25 bp, Mus musculus
cctccggcagttcttcaaaaaactg

SEQ ID NO: 369587 - DNA, 25 bp, Mus musculus
gcgtggagcagctcacccgggacct

SEQ ID NO: 369588 - DNA, 25 bp, Mus musculus
ctgcatcagcgcgtggagcagctca

SEQ ID NO: 369589 - DNA, 25 bp, Mus musculus
acgagaagctgcatcagcgcgtgga

SEQ ID NO: 369590 - DNA, 25 bp, Mus musculus
tcggccgagaacgagaagctgcatc

SEQ ID NO: 369591 - DNA, 25 bp, Mus musculus
gcaaccaggagatgcagcagaagct

SEQ ID NO: 369592 - DNA, 25 bp, Mus musculus
agcgccgcaaccaggagatgcagca

SEQ ID NO: 369593 - DNA, 25 bp, Mus musculus
ccggcacagtccgagaaaagggcgc

SEQ ID NO: 369594 - DNA, 25 bp, Mus musculus
tcgcgcccggcacagtccgagaaaa

SEQ ID NO: 369595 - DNA, 25 bp, Mus musculus
gctagtttctttgggacctgcgagc

SEQ ID NO: 369596 - DNA, 25 bp, Mus musculus
ggcgcaccagctcccttcaccggac

SEQ ID NO: 369597 - DNA, 25 bp, Mus musculus
ttgcgaaagccgtcgtctcaagttc

SEQ ID NO: 369598 - DNA, 25 bp, Mus musculus
atctcctacgtgcacagtcttcctg

SEQ ID NO: 369599 - DNA, 25 bp, Mus musculus
tccagacatctcctacgtgcacagt

SEQ ID NO: 369600 - DNA, 25 bp, Mus musculus
cacagcgtaccttggacgtgccggg

SEQ ID NO: 369601 - DNA, 25 bp, Mus musculus
tagcaacagcacagcgtaccttgga

SEQ ID NO: 369602 - DNA, 25 bp, Mus musculus
gccctctgctttcatagcaacagca

SEQ ID NO: 369603 - DNA, 25 bp, Mus musculus
gaagcccacagaggttacacgcccg

SEQ ID NO: 369604 - DNA, 25 bp, Mus musculus
gcacgagaagcccacagaggttaca

SEQ ID NO: 369605 - DNA, 25 bp, Mus musculus
accaacgggctcgtgccggtcagac

SEQ ID NO: 369606 - DNA, 25 bp, Mus musculus
ttcaccggaccagggacaggcacga

SEQ ID NO: 369607 - DNA, 25 bp, Mus musculus
gccggtcagactgggcgcaccagct

SEQ ID NO: 369608 - DNA, 25 bp, Mus musculus
gaaagccgtcgtctcaagttccacg

SEQ ID NO: 369609 - DNA, 25 bp, Mus musculus
accagggacaggcacgagaagccca

SEQ ID NO: 369610 - DNA, 25 bp, Mus musculus
tcactggccgagtgtggctacatcc

SEQ ID NO: 369611 - DNA, 25 bp, Mus musculus
ctacatccggactgtgctgggccag

SEQ ID NO: 369612 - DNA, 25 bp, Mus musculus
gggtcacctggacagctccagcctg

SEQ ID NO: 369613 - DNA, 25 bp, Mus musculus
tgtctgtattaaagaattcgatcgg

SEQ ID NO: 369614 - DNA, 25 bp, Mus musculus
ctgcggtcagcggtgagtcgaaccc

SEQ ID NO: 369615 - DNA, 25 bp, Mus musculus
aggtcctggcagtccctcctggtca

SEQ ID NO: 369616 - DNA, 25 bp, Mus musculus
cacccgccgtgctagtcgtaggtct

SEQ ID NO: 369617 - DNA, 25 bp, Mus musculus
ctctgcggctttgcgggcaggtcct

SEQ ID NO: 369618 - DNA, 25 bp, Mus musculus
tgttgctcaccttaccttttccggc

SEQ ID NO: 369619 - DNA, 25 bp, Mus musculus
cttttccggctcgtggttggtcgct

SEQ ID NO: 369620 - DNA, 25 bp, Mus musculus
gttggtcgctttggacacgcttcct

SEQ ID NO: 369621 - DNA, 25 bp, Mus musculus
tgcgcctgctttgcaggagccacgc

SEQ ID NO: 369622 - DNA, 25 bp, Mus musculus
tctggtctaccttattcgtttgtta

SEQ ID NO: 369623 - DNA, 25 bp, Mus musculus
attcgatcggtttcacccttcgccg

SEQ ID NO: 369624 - DNA, 25 bp, Mus musculus
ccgagcatgcgtagagagacaccga

SEQ ID NO: 369625 - DNA, 25 bp, Mus musculus
ttccgcatgggcactctgctgagcc

SEQ ID NO: 369626 - DNA, 25 bp, Mus musculus
cagcacctggtggatttcctggcca

SEQ ID NO: 369627 - DNA, 25 bp, Mus musculus
acaacgcggcctggttccaggagca

SEQ ID NO: 369628 - DNA, 25 bp, Mus musculus
ggctctttcacggtgctggacaacg

SEQ ID NO: 369629 - DNA, 25 bp, Mus musculus
ccacaacgtgatcgcgctcgtggga

SEQ ID NO: 369630 - DNA, 25 bp, Mus musculus
actctgttggggctcttccacttcc

SEQ ID NO: 369631 - DNA, 25 bp, Mus musculus
acgtggggcacctgctaactctgtt

SEQ ID NO: 369632 - DNA, 25 bp, Mus musculus
ccagacggtgtactgcggcttcgac

SEQ ID NO: 369633 - DNA, 25 bp, Mus musculus
ccgagagcggcacgaagacagagct

SEQ ID NO: 369634 - DNA, 25 bp, Mus musculus
ccgcggcttgttcaaggagttcttc

SEQ ID NO: 369635 - DNA, 25 bp, Mus musculus
tccgcagtccctggtctggctacga

SEQ ID NO: 369636 - DNA, 25 bp, Mus musculus
agaggtccagcatgccttgcgtgtc

SEQ ID NO: 369637 - DNA, 25 bp, Mus musculus
tgagcgtgcagtcgcgtctcaagag

SEQ ID NO: 369638 - DNA, 25 bp, Mus musculus
acccagcaggccactgcaatgaatg

SEQ ID NO: 369639 - DNA, 25 bp, Mus musculus
atgtagttcaggctgagtggaacgc

SEQ ID NO: 369640 - DNA, 25 bp, Mus musculus
caggccacgcgccacgacagaggtg

SEQ ID NO: 369641 - DNA, 25 bp, Mus musculus
cctcagcggccggaaggaagcgaca

SEQ ID NO: 369642 - DNA, 25 bp, Mus musculus
gaaggaagcgacagccgcccacacg

SEQ ID NO: 369643 - DNA, 25 bp, Mus musculus
tgcagggccactcagtcccgctgag

SEQ ID NO: 369644 - DNA, 25 bp, Mus musculus
atcgcggcctcatcttacctgcgtt

SEQ ID NO: 369645 - DNA, 25 bp, Mus musculus
ctgcgttcccactacgacgatctga

SEQ ID NO: 369646 - DNA, 25 bp, Mus musculus
atctgaggcagctggatgatgtccg

SEQ ID NO: 369647 - DNA, 25 bp, Mus musculus
atgatgtccgcacccactgtgttga

SEQ ID NO: 369648 - DNA, 25 bp, Mus musculus
tgtgttgaagacgtcctgcagctta

SEQ ID NO: 369649 - DNA, 25 bp, Mus musculus
ctgcagcttattgatgaccgggatc

SEQ ID NO: 369650 - DNA, 25 bp, Mus musculus
tgaatggggactcgacccacagccc

SEQ ID NO: 369651 - DNA, 25 bp, Mus musculus
tgaccgggatcagcgcctccatgac

SEQ ID NO: 369652 - DNA, 25 bp, Mus musculus
actccgtcgtcggactctccggcag

SEQ ID NO: 369653 - DNA, 25 bp, Mus musculus
cgctgcacagccaatcgccagagtg

SEQ ID NO: 369654 - DNA, 25 bp, Mus musculus
gctgttcatggtggcctgcggtcac

SEQ ID NO: 369655 - DNA, 25 bp, Mus musculus
tccaggttgcgcgactccctgcgct

SEQ ID NO: 369656 - DNA, 25 bp, Mus musculus
aatcgccagagtgcagcgcggtccc

SEQ ID NO: 369657 - DNA, 25 bp, Mus musculus
gctccgctcacccacgcattacctg

SEQ ID NO: 369658 - DNA, 25 bp, Mus musculus
tggccacccgcctgaagttatggtc

SEQ ID NO: 369659 - DNA, 25 bp, Mus musculus
tcgctctcgctgttcatggtggcct

SEQ ID NO: 369660 - DNA, 25 bp, Mus musculus
gcaattgcggcgaaggcctgctcca

SEQ ID NO: 369661 - DNA, 25 bp, Mus musculus
ggtaggagcctgacttccgccggat

SEQ ID NO: 369662 - DNA, 25 bp, Mus musculus
gccggatggccacccgcctgaagtt

SEQ ID NO: 369663 - DNA, 25 bp, Mus musculus
cccgcctgaagttatggtcgctctc

SEQ ID NO: 369664 - DNA, 25 bp, Mus musculus
cgacacggtcaaggcgccgcaattg

SEQ ID NO: 369665 - DNA, 25 bp, Mus musculus
aagttatggtcgctctcgctgttca

SEQ ID NO: 369666 - DNA, 25 bp, Mus musculus
cgaaaagatcttgggaccggctgcc

SEQ ID NO: 369667 - DNA, 25 bp, Mus musculus
ccgcccactcgagactcagtgtaga

SEQ ID NO: 369668 - DNA, 25 bp, Mus musculus
cgacagcaccgagagatggccgcta

SEQ ID NO: 369669 - DNA, 25 bp, Mus musculus
gccagcacgacagcaccgagagatg

SEQ ID NO: 369670 - DNA, 25 bp, Mus musculus
ctgcgcatgcgctgtgccagcacga

SEQ ID NO: 369671 - DNA, 25 bp, Mus musculus
agactcaggaagcaccgcgaggttc

SEQ ID NO: 369672 - DNA, 25 bp, Mus musculus
accgcgaggttccacgtctgcgcat

SEQ ID NO: 369673 - DNA, 25 bp, Mus musculus
ttgaggggactttgagcctcgaaaa

SEQ ID NO: 369674 - DNA, 25 bp, Mus musculus
ctcggactcggacacgaaggagttg

SEQ ID NO: 369675 - DNA, 25 bp, Mus musculus
cggatacaagacagagctcggactc

SEQ ID NO: 369676 - DNA, 25 bp, Mus musculus
ctcacgtcccactagatctcggata

SEQ ID NO: 369677 - DNA, 25 bp, Mus musculus
taatggcgtgcaactacctcacgtc

SEQ ID NO: 369678 - DNA, 25 bp, Mus musculus
gcgctgaggtaatggcgtgcaacta

SEQ ID NO: 369679 - DNA, 25 bp, Mus musculus
actcagtgtagactcaggaagcacc

SEQ ID NO: 369680 - DNA, 25 bp, Mus musculus
cagggcaaccgacagcaaccggata

SEQ ID NO: 369681 - DNA, 25 bp, Mus musculus
gctctgccaccatctgcacgaattg

SEQ ID NO: 369682 - DNA, 25 bp, Mus musculus
tggtactgctcgaacactgaggaga

SEQ ID NO: 369683 - DNA, 25 bp, Mus musculus
cgatgttttggggtcttgtcgccag

SEQ ID NO: 369684 - DNA, 25 bp, Mus musculus
tcgaacactgaggagacagacccgg

SEQ ID NO: 369685 - DNA, 25 bp, Mus musculus
gacagacccggtagaggtgccctgt

SEQ ID NO: 369686 - DNA, 25 bp, Mus musculus
gcacctgcttctccaggtccaagtg

SEQ ID NO: 369687 - DNA, 25 bp, Mus musculus
aagtggtgggcagctaccaggacct

SEQ ID NO: 369688 - DNA, 25 bp, Mus musculus
cctccgccaccgttgagctggtagt

SEQ ID NO: 369689 - DNA, 25 bp, Mus musculus
caccagcaaaggtcgtgacgtcacg

SEQ ID NO: 369690 - DNA, 25 bp, Mus musculus
ctctgtgtatgcgtctccagggcaa

SEQ ID NO: 369691 - DNA, 25 bp, Mus musculus
ccggatacaaccaccagcaaaggtc

SEQ ID NO: 369692 - DNA, 25 bp, Mus musculus
tgcacgaattgcgtccgggctttct

SEQ ID NO: 369693 - DNA, 25 bp, Mus musculus
gtagtgggatccgttcctctgtgta

SEQ ID NO: 369694 - DNA, 25 bp, Mus musculus
cggaatggtagcagcgctccgaccc

SEQ ID NO: 369695 - DNA, 25 bp, Mus musculus
cacagacggacagagccggaagtga

SEQ ID NO: 369696 - DNA, 25 bp, Mus musculus
gtggtcgcttttccaacgagctccc

SEQ ID NO: 369697 - DNA, 25 bp, Mus musculus
ggcagtggtcgcttttccaacgagc

SEQ ID NO: 369698 - DNA, 25 bp, Mus musculus
tagtgggcagtggtcgcttttccaa

SEQ ID NO: 369699 - DNA, 25 bp, Mus musculus
agggtcctgccctggcgcggctttt

SEQ ID NO: 369700 - DNA, 25 bp, Mus musculus
atttccggaatggtagcagcgctcc

SEQ ID NO: 369701 - DNA, 25 bp, Mus musculus
caggcatttccggaatggtagcagc

SEQ ID NO: 369702 - DNA, 25 bp, Mus musculus
gacgctggctttccccaggcatttc

SEQ ID NO: 369703 - DNA, 25 bp, Mus musculus
aggaagcggaagacgctggctttcc

SEQ ID NO: 369704 - DNA, 25 bp, Mus musculus
acgccacagacggacagagccggaa

SEQ ID NO: 369705 - DNA, 25 bp, Mus musculus
ccaccggggaaagcacagccggagc

SEQ ID NO: 369706 - DNA, 25 bp, Mus musculus
cggaagtgagttcgtgagtggccac

SEQ ID NO: 369707 - DNA, 25 bp, Mus musculus
tggcgcggctttttcgccatccagc

SEQ ID NO: 369708 - DNA, 25 bp, Mus musculus
agcataagtcgagcggcagccgcga

SEQ ID NO: 369709 - DNA, 25 bp, Mus musculus
cagccgcgaagcgtcgaaccgaacg

SEQ ID NO: 369710 - DNA, 25 bp, Mus musculus
tctcgtacatcggagaaggcgccta

SEQ ID NO: 369711 - DNA, 25 bp, Mus musculus
cctacggcatggtttggtgagtatc

SEQ ID NO: 369712 - DNA, 25 bp, Mus musculus
agtatccgcgctggatttcaggccc

SEQ ID NO: 369713 - DNA, 25 bp, Mus musculus
tgtggctgatctggacgcacccacg

SEQ ID NO: 369714 - DNA, 25 bp, Mus musculus
ggcttcttggccttcactcctggag

SEQ ID NO: 369715 - DNA, 25 bp, Mus musculus
gcttaggtgttgctcctcgtcttcc

SEQ ID NO: 369716 - DNA, 25 bp, Mus musculus
ctctgctgcttctcgtttgcggttg

SEQ ID NO: 369717 - DNA, 25 bp, Mus musculus
ttgaggccaggactcgaagactccg

SEQ ID NO: 369718 - DNA, 25 bp, Mus musculus
gcttggtcttaaagcgcgtactttc

SEQ ID NO: 369719 - DNA, 25 bp, Mus musculus
agcgcgtactttcgaggcttctccc

SEQ ID NO: 369720 - DNA, 25 bp, Mus musculus
agagaagccaatcaacacgcacgcc

SEQ ID NO: 369721 - DNA, 25 bp, Mus musculus
gcggttaattctctcctctgtgttg

SEQ ID NO: 369722 - DNA, 25 bp, Mus musculus
tttgttccgcgcatcgagctggtaa

SEQ ID NO: 369723 - DNA, 25 bp, Mus musculus
ggtcctcggctctctggtttctcaa

SEQ ID NO: 369724 - DNA, 25 bp, Mus musculus
ggtttctcaacacgacaaagcaaag

SEQ ID NO: 369725 - DNA, 25 bp, Mus musculus
tcgaagatagcactctggcggcttc

SEQ ID NO: 369726 - DNA, 25 bp, Mus musculus
gctgcaaaggcagccggtgcgctca

SEQ ID NO: 369727 - DNA, 25 bp, Mus musculus
ggtgcgctcaggatccatcaacgtg

SEQ ID NO: 369728 - DNA, 25 bp, Mus musculus
ggatccatcaacgtgcgggtcctcc

SEQ ID NO: 369729 - DNA, 25 bp, Mus musculus
tcctccaggactaagtttaacagtc

SEQ ID NO: 369730 - DNA, 25 bp, Mus musculus
cgcgcatcgagctggtaatatattc

SEQ ID NO: 369731 - DNA, 25 bp, Mus musculus
ttaacagtcggcgacaacacgcacg

SEQ ID NO: 369732 - DNA, 25 bp, Mus musculus
cccaaagtgagtgctcagactcgtt

SEQ ID NO: 369733 - DNA, 25 bp, Mus musculus
agtgctcagactcgtttggcagtca

SEQ ID NO: 369734 - DNA, 25 bp, Mus musculus
agtcactatctacgagggccgctgg

SEQ ID NO: 369735 - DNA, 25 bp, Mus musculus
aatacactacaagtgtggcgccaag

SEQ ID NO: 369736 - DNA, 25 bp, Mus musculus
cgttccgaggccgtttatggcggct

SEQ ID NO: 369737 - DNA, 25 bp, Mus musculus
cgccacgttccgaggccgtttatgg

SEQ ID NO: 369738 - DNA, 25 bp, Mus musculus
cgggaccgcctgaaaaccgagctcg

SEQ ID NO: 369739 - DNA, 25 bp, Mus musculus
tgcggagacctgaggatctccggct

SEQ ID NO: 369740 - DNA, 25 bp, Mus musculus
tctctgcggagacctgaggatctcc

SEQ ID NO: 369741 - DNA, 25 bp, Mus musculus
ttctctgcggagacctgaggatctc

SEQ ID NO: 369742 - DNA, 25 bp, Mus musculus
cctcaggggttctctgcggagacct

SEQ ID NO: 369743 - DNA, 25 bp, Mus musculus
cggccgtgagtacgggcgggcctca

SEQ ID NO: 369744 - DNA, 25 bp, Mus musculus
agctcgcgccgaccgagcctgggcc

SEQ ID NO: 369745 - DNA, 25 bp, Mus musculus
tgaaaaccgagctcgcgccgaccga

SEQ ID NO: 369746 - DNA, 25 bp, Mus musculus
cctcgcgcccggagtgggcgccaac

SEQ ID NO: 369747 - DNA, 25 bp, Mus musculus
ggaccgcctgaaaaccgagctcgcg

SEQ ID NO: 369748 - DNA, 25 bp, Mus musculus
tgggctgggctacgggtccaaaaca

SEQ ID NO: 369749 - DNA, 25 bp, Mus musculus
caggaggatgcctcgcgcccggagt

SEQ ID NO: 369750 - DNA, 25 bp, Mus musculus
ctcaggggcaaaactcgttcgcaga

SEQ ID NO: 369751 - DNA, 25 bp, Mus musculus
ccgctttctcaactacttccggaga

SEQ ID NO: 369752 - DNA, 25 bp, Mus musculus
accgaagagaccacagcagacactg

SEQ ID NO: 369753 - DNA, 25 bp, Mus musculus
tcttgtccttctggtgctgtcgctt

SEQ ID NO: 369754 - DNA, 25 bp, Mus musculus
gagacgcgacccaacttacatcttg

SEQ ID NO: 369755 - DNA, 25 bp, Mus musculus
agctgagacgagagacgcgacccaa

SEQ ID NO: 369756 - DNA, 25 bp, Mus musculus
ttcagcacggcgacgagctgagacg

SEQ ID NO: 369757 - DNA, 25 bp, Mus musculus
tttcagatgatagccttcagcacgg

SEQ ID NO: 369758 - DNA, 25 bp, Mus musculus
cgaagcggacaaccaactcaggggc

SEQ ID NO: 369759 - DNA, 25 bp, Mus musculus
ctcgttcgcagaaaggctaggggta

SEQ ID NO: 369760 - DNA, 25 bp, Mus musculus
gcagacactgactatggcgcctccg

SEQ ID NO: 369761 - DNA, 25 bp, Mus musculus
cttccggagatcgacgcactggatc

SEQ ID NO: 369762 - DNA, 25 bp, Mus musculus
gcgcctgtgagagctgaggctttca

SEQ ID NO: 369763 - DNA, 25 bp, Mus musculus
ccatggtggcaacaaaccgaagaga

SEQ ID NO: 369764 - DNA, 25 bp, Mus musculus
cggccaggttccagctgctctagac

SEQ ID NO: 369765 - DNA, 25 bp, Mus musculus
tgttgagcagcttcagcactgaccc

SEQ ID NO: 369766 - DNA, 25 bp, Mus musculus
agcggccaatccagctctgacagcg

SEQ ID NO: 369767 - DNA, 25 bp, Mus musculus
cgcgttcctcctgcactgctattgg

SEQ ID NO: 369768 - DNA, 25 bp, Mus musculus
gaggattttaactggtccacgcttc

SEQ ID NO: 369769 - DNA, 25 bp, Mus musculus
cgcttccgaggacccgccaataaag

SEQ ID NO: 369770 - DNA, 25 bp, Mus musculus
ccctgcgcaccagatccgtatttga

SEQ ID NO: 369771 - DNA, 25 bp, Mus musculus
cctaagtaccggtggacatcgccct

SEQ ID NO: 369772 - DNA, 25 bp, Mus musculus
tccggaccctcgtcttgaacactaa

SEQ ID NO: 369773 - DNA, 25 bp, Mus musculus
ttggccgctgcctgaagagtaacag

SEQ ID NO: 369774 - DNA, 25 bp, Mus musculus
aactattggcatcgtcggactcctc

SEQ ID NO: 369775 - DNA, 25 bp, Mus musculus
ccgcgaatccgccagtaactattgg

SEQ ID NO: 369776 - DNA, 25 bp, Mus musculus
ccgtatttgatgtcgtgtgagtgca

SEQ ID NO: 369777 - DNA, 25 bp, Mus musculus
tgtcagtcacgacccacaagcgagt

SEQ ID NO: 369778 - DNA, 25 bp, Mus musculus
cgtgtcactgctggttaacggcaca

SEQ ID NO: 369779 - DNA, 25 bp, Mus musculus
cttcccgaagctcatagtatctgtg

SEQ ID NO: 369780 - DNA, 25 bp, Mus musculus
cagggtttggcagccatggcttttc

SEQ ID NO: 369781 - DNA, 25 bp, Mus musculus
cggggtctggatgctccaacctatt

SEQ ID NO: 369782 - DNA, 25 bp, Mus musculus
tggacggtcaccagcacgtgcatgt

SEQ ID NO: 369783 - DNA, 25 bp, Mus musculus
tggcaccagacggagctcctagttt

SEQ ID NO: 369784 - DNA, 25 bp, Mus musculus
gttcaaaggctggagcagtcgcatc

SEQ ID NO: 369785 - DNA, 25 bp, Mus musculus
agcggatgctgggtatactctctag

SEQ ID NO: 369786 - DNA, 25 bp, Mus musculus
ctgcaggggaatactcatcttgatc

SEQ ID NO: 369787 - DNA, 25 bp, Mus musculus
cgaaggcttctttctcggcaagatg

SEQ ID NO: 369788 - DNA, 25 bp, Mus musculus
ggtcttcacgccaacctgtctgagg

SEQ ID NO: 369789 - DNA, 25 bp, Mus musculus
taggcacagcattcccacgggtctt

SEQ ID NO: 369790 - DNA, 25 bp, Mus musculus
atgactttggttattgcccgcggcg

SEQ ID NO: 369791 - DNA, 25 bp, Mus musculus
tgcttccaggtacgcggcttgatac

SEQ ID NO: 369792 - DNA, 25 bp, Mus musculus
tcagagaacggcgaccgcggcccag

SEQ ID NO: 369793 - DNA, 25 bp, Mus musculus
cgctcccgcccaggctgcggcctag

SEQ ID NO: 369794 - DNA, 25 bp, Mus musculus
tgaagaacggcgtcgccccaaggaa

SEQ ID NO: 369795 - DNA, 25 bp, Mus musculus
cacgcaatgagggatgaagaacggc

SEQ ID NO: 369796 - DNA, 25 bp, Mus musculus
ggccacgcaatgagggatgaagaac

SEQ ID NO: 369797 - DNA, 25 bp, Mus musculus
gttagatctctccgcacgcggcaca

SEQ ID NO: 369798 - DNA, 25 bp, Mus musculus
taggcggccccgttagatctctccg

SEQ ID NO: 369799 - DNA, 25 bp, Mus musculus
tctcagcgcggccttgcgctcccgc

SEQ ID NO: 369800 - DNA, 25 bp, Mus musculus
actgcccaggctgatccgaagggcc

SEQ ID NO: 369801 - DNA, 25 bp, Mus musculus
cgagaactgcccaggctgatccgaa

SEQ ID NO: 369802 - DNA, 25 bp, Mus musculus
ggctcgagaactgcccaggctgatc

SEQ ID NO: 369803 - DNA, 25 bp, Mus musculus
acatcaacggcgtcctcgacccgga

SEQ ID NO: 369804 - DNA, 25 bp, Mus musculus
gctccgcggcgcgtactcccagccg

SEQ ID NO: 369805 - DNA, 25 bp, Mus musculus
aggcccggcccacacatcaacggcg

SEQ ID NO: 369806 - DNA, 25 bp, Mus musculus
tggagcgccagctattccttaaata

SEQ ID NO: 369807 - DNA, 25 bp, Mus musculus
cgcgatgttgtattgcgccaggcaa

SEQ ID NO: 369808 - DNA, 25 bp, Mus musculus
caaagcctgctcgtcgactcggatc

SEQ ID NO: 369809 - DNA, 25 bp, Mus musculus
tggcgtccgggttcattctccaaac

SEQ ID NO: 369810 - DNA, 25 bp, Mus musculus
tgcagcagttgctacaccaggagcg

SEQ ID NO: 369811 - DNA, 25 bp, Mus musculus
cggctccctcgaatctttggcaaca

SEQ ID NO: 369812 - DNA, 25 bp, Mus musculus
cccaggcttctgaatccgaggtaag

SEQ ID NO: 369813 - DNA, 25 bp, Mus musculus
tgcgaccagcgcgtctattccagac

SEQ ID NO: 369814 - DNA, 25 bp, Mus musculus
tgtgacctgcgcgaagaaaacttgc

SEQ ID NO: 369815 - DNA, 25 bp, Mus musculus
catctgcggcgtaaaggcttctccg

SEQ ID NO: 369816 - DNA, 25 bp, Mus musculus
tgaccgatctcgctcagcgccttga

SEQ ID NO: 369817 - DNA, 25 bp, Mus musculus
gcccgcaagcttcaggagaccaatc

SEQ ID NO: 369818 - DNA, 25 bp, Mus musculus
ggatccctcgaaagcctgaacactg

SEQ ID NO: 369819 - DNA, 25 bp, Mus musculus
acaatgccgctgtcgcctgcaggaa

SEQ ID NO: 369820 - DNA, 25 bp, Mus musculus
ggcgggcgttctcccattatgcaaa

SEQ ID NO: 369821 - DNA, 25 bp, Mus musculus
tgcaaacggctgtacgcctgcggct

SEQ ID NO: 369822 - DNA, 25 bp, Mus musculus
ctatgctgcctgacaggcgggcgtt

SEQ ID NO: 369823 - DNA, 25 bp, Mus musculus
ttagcaatctaatccgaacggcgtc

SEQ ID NO: 369824 - DNA, 25 bp, Mus musculus
gccggctctttgtgccttttcatta

SEQ ID NO: 369825 - DNA, 25 bp, Mus musculus
tagtctcgaaccgaggcgcacgcgg

SEQ ID NO: 369826 - DNA, 25 bp, Mus musculus
cctctggcaggcacctgaggtaagc

SEQ ID NO: 369827 - DNA, 25 bp, Mus musculus
tgcagctcaggtcgggcgcccaaga

SEQ ID NO: 369828 - DNA, 25 bp, Mus musculus
gtcacaagcttccaagatggcgcgg

SEQ ID NO: 369829 - DNA, 25 bp, Mus musculus
gggtggagctgacgtcacaagcttc

SEQ ID NO: 369830 - DNA, 25 bp, Mus musculus
ctgtcgctcgcccattcagatgtgg

SEQ ID NO: 369831 - DNA, 25 bp, Mus musculus
tgcatcgggaccctgtaggcgacct

SEQ ID NO: 369832 - DNA, 25 bp, Mus musculus
cgcccaagacgaggggcctctggca

SEQ ID NO: 369833 - DNA, 25 bp, Mus musculus
acgctttacggtttccagaactgcg

SEQ ID NO: 369834 - DNA, 25 bp, Mus musculus
gggaacttcaggatcgcggagtcta

SEQ ID NO: 369835 - DNA, 25 bp, Mus musculus
cagcccagttcttacttcccagtgg

SEQ ID NO: 369836 - DNA, 25 bp, Mus musculus
tgtgagtttcacacgggttcccaga

SEQ ID NO: 369837 - DNA, 25 bp, Mus musculus
ggcccacgcgtcttttgctcttatc

SEQ ID NO: 369838 - DNA, 25 bp, Mus musculus
atgctctttagctgttccgggccca

SEQ ID NO: 369839 - DNA, 25 bp, Mus musculus
ccctgtgtgtactctgaaagcaaaa

SEQ ID NO: 369840 - DNA, 25 bp, Mus musculus
ctaagttgcgatttggagaacgccc

SEQ ID NO: 369841 - DNA, 25 bp, Mus musculus
gcttataggaaaaggcgcgactttc

SEQ ID NO: 369842 - DNA, 25 bp, Mus musculus
tccgtccgaacctcaccaaatgatg

SEQ ID NO: 369843 - DNA, 25 bp, Mus musculus
tcgggctttgccacctgcctagagt

SEQ ID NO: 369844 - DNA, 25 bp, Mus musculus
agcccactcaggtcgtagcttcatc

SEQ ID NO: 369845 - DNA, 25 bp, Mus musculus
cttcccagtggtttccaggtccgtg

SEQ ID NO: 369846 - DNA, 25 bp, Mus musculus
cggtgcttttgatcgtcattcggta

SEQ ID NO: 369847 - DNA, 25 bp, Mus musculus
gtgtttggttctcagtctcggacta

SEQ ID NO: 369848 - DNA, 25 bp, Mus musculus
ccgctctcgctccttggggtctgtt

SEQ ID NO: 369849 - DNA, 25 bp, Mus musculus
aggtgcgaggcgaaaccaagttaga

SEQ ID NO: 369850 - DNA, 25 bp, Mus musculus
ccaagttagaggaaccgtctccagg

SEQ ID NO: 369851 - DNA, 25 bp, Mus musculus
accgtctccagggagagcctcagga

SEQ ID NO: 369852 - DNA, 25 bp, Mus musculus
tagagagaacccgaaagacttgccg

SEQ ID NO: 369853 - DNA, 25 bp, Mus musculus
cctgcctggtttaagagcctgatgc

SEQ ID NO: 369854 - DNA, 25 bp, Mus musculus
agcccggcaggactaacctcgcaga

SEQ ID NO: 369855 - DNA, 25 bp, Mus musculus
ctcgcagactgtatggcagggtcga

SEQ ID NO: 369856 - DNA, 25 bp, Mus musculus
cgccagtctggaagggttccgcata

SEQ ID NO: 369857 - DNA, 25 bp, Mus musculus
tacttcgcagatgagcccaccgagg

SEQ ID NO: 369858 - DNA, 25 bp, Mus musculus
cctcgagtaggatggtagcacgcaa

SEQ ID NO: 369859 - DNA, 25 bp, Mus musculus
tagcacgcaaccaggtggcagccga

SEQ ID NO: 369860 - DNA, 25 bp, Mus musculus
ggtggcagccgacaatgcgatctcc

SEQ ID NO: 369861 - DNA, 25 bp, Mus musculus
tccgcatacaggaacggcctacttc

SEQ ID NO: 369862 - DNA, 25 bp, Mus musculus
cgccaccaccgctttcccgccaact

SEQ ID NO: 369863 - DNA, 25 bp, Mus musculus
gcacggtaccctgcatccacacggc

SEQ ID NO: 369864 - DNA, 25 bp, Mus musculus
cctgcatccacacggccaccagctc

SEQ ID NO: 369865 - DNA, 25 bp, Mus musculus
agctgtcctgccagtaccttgagtg

SEQ ID NO: 369866 - DNA, 25 bp, Mus musculus
cctgccagtaccttgagtggcggca

SEQ ID NO: 369867 - DNA, 25 bp, Mus musculus
cagtaccttgagtggcggcaagcgc

SEQ ID NO: 369868 - DNA, 25 bp, Mus musculus
tcaagagcgcgcctgcccgaggcag

SEQ ID NO: 369869 - DNA, 25 bp, Mus musculus
gacagcgactcggacgccgcagccg

SEQ ID NO: 369870 - DNA, 25 bp, Mus musculus
tttcccgccaactctgacggacggc

SEQ ID NO: 369871 - DNA, 25 bp, Mus musculus
ggccgcgcacagagaaggctccgct

SEQ ID NO: 369872 - DNA, 25 bp, Mus musculus
gccaccggaggacagcgactcggac

SEQ ID NO: 369873 - DNA, 25 bp, Mus musculus
cgcccacgttacctgggaggaggca

SEQ ID NO: 369874 - DNA, 25 bp, Mus musculus
gaaggctccgctcgagtcgcgcagc

SEQ ID NO: 369875 - DNA, 25 bp, Mus musculus
gcacagagaaggctccgctcgagtc

SEQ ID NO: 369876 - DNA, 25 bp, Mus musculus
cccggatagcgcacttttcccagtg

SEQ ID NO: 369877 - DNA, 25 bp, Mus musculus
ggctcaggcctgagatctgaacagc

SEQ ID NO: 369878 - DNA, 25 bp, Mus musculus
cccgggttctagaaacctgcgattg

SEQ ID NO: 369879 - DNA, 25 bp, Mus musculus
ggttctagaaacctgcgattgcagt

SEQ ID NO: 369880 - DNA, 25 bp, Mus musculus
aacctgcgattgcagtcttgggcca

SEQ ID NO: 369881 - DNA, 25 bp, Mus musculus
ctgcgattgcagtcttgggccacgc

SEQ ID NO: 369882 - DNA, 25 bp, Mus musculus
gattgcagtcttgggccacgcggtc

SEQ ID NO: 369883 - DNA, 25 bp, Mus musculus
aggcctgactccaccaggctgcggg

SEQ ID NO: 369884 - DNA, 25 bp, Mus musculus
atagcgcacttttcccagtgcagta

SEQ ID NO: 369885 - DNA, 25 bp, Mus musculus
tgcagtacccagacacccggaaaag

SEQ ID NO: 369886 - DNA, 25 bp, Mus musculus
ccggaaaagttagcaccggctgctc

SEQ ID NO: 369887 - DNA, 25 bp, Mus musculus
ggaaaagttagcaccggctgctccg

SEQ ID NO: 369888 - DNA, 25 bp, Mus musculus
cttttcccagtgcagtacccagaca

SEQ ID NO: 369889 - DNA, 25 bp, Mus musculus
ggcctgagatctgaacagccgccgc

SEQ ID NO: 369890 - DNA, 25 bp, Mus musculus
gccgctgtgattccatccatcttga

SEQ ID NO: 369891 - DNA, 25 bp, Mus musculus
cctgaatgcggaatgtggagctatc

SEQ ID NO: 369892 - DNA, 25 bp, Mus musculus
gtacgcatgtggtcgcggaaagccc

SEQ ID NO: 369893 - DNA, 25 bp, Mus musculus
aggtcatcgcaagcagcgctcgtca

SEQ ID NO: 369894 - DNA, 25 bp, Mus musculus
gaatttgacgtcatcccacaccagg

SEQ ID NO: 369895 - DNA, 25 bp, Mus musculus
ctcaacggctatgctgtggccagca

SEQ ID NO: 369896 - DNA, 25 bp, Mus musculus
atgcgcagtgcttggacacgctcga

SEQ ID NO: 369897 - DNA, 25 bp, Mus musculus
acacgctcgactacgtgggagtctg

SEQ ID NO: 369898 - DNA, 25 bp, Mus musculus
cgcgcacgcgtaaaagggcccgacg

SEQ ID NO: 369899 - DNA, 25 bp, Mus musculus
acgcccgcaacccactggtggagga

SEQ ID NO: 369900 - DNA, 25 bp, Mus musculus
gaaatcacctcagagttacgtcagg

SEQ ID NO: 369901 - DNA, 25 bp, Mus musculus
tacgtcaggaaaggccgcgttttgc

SEQ ID NO: 369902 - DNA, 25 bp, Mus musculus
gcgtgacggttactcaccgctcttc

SEQ ID NO: 369903 - DNA, 25 bp, Mus musculus
ccacaccagggatgaggtcatcgca

SEQ ID NO: 369904 - DNA, 25 bp, Mus musculus
ggcgtcctctttcttcgagggtcaa

SEQ ID NO: 369905 - DNA, 25 bp, Mus musculus
ccatcttgaccacgctggggcgctg

SEQ ID NO: 369906 - DNA, 25 bp, Mus musculus
acctgggaccaaacgctgcggctca

SEQ ID NO: 369907 - DNA, 25 bp, Mus musculus
ctgaagacaaatcaagtccgcctga

SEQ ID NO: 369908 - DNA, 25 bp, Mus musculus
tcccactctatcgaaggagcaaggc

SEQ ID NO: 369909 - DNA, 25 bp, Mus musculus
gccaggcttccttgagcgcttattg

SEQ ID NO: 369910 - DNA, 25 bp, Mus musculus
tgaaacgagcgccagattttccctg

SEQ ID NO: 369911 - DNA, 25 bp, Mus musculus
cccgtcaatgcggagtgagtgttcc

SEQ ID NO: 369912 - DNA, 25 bp, Mus musculus
atccgcgcaggacatagaaccgtgg

SEQ ID NO: 369913 - DNA, 25 bp, Mus musculus
gggcagatgcccagccaagcagcct

SEQ ID NO: 369914 - DNA, 25 bp, Mus musculus
ctttgtcccaatcccgcggcggagg

SEQ ID NO: 369915 - DNA, 25 bp, Mus musculus
cgcagtcctgtgcaattagccagca

SEQ ID NO: 369916 - DNA, 25 bp, Mus musculus
gctctggtgcgaccaactggagatc

SEQ ID NO: 369917 - DNA, 25 bp, Mus musculus
gtagtgtttctcagctggcggctcc

SEQ ID NO: 369918 - DNA, 25 bp, Mus musculus
cccgcggagagatccgcatctgcag

SEQ ID NO: 369919 - DNA, 25 bp, Mus musculus
ccgcggagagatccgcatctgcaga

SEQ ID NO: 369920 - DNA, 25 bp, Mus musculus
gacggccctgagctgtctgcccgct

SEQ ID NO: 369921 - DNA, 25 bp, Mus musculus
tcacagacggccctgagctgtctgc

SEQ ID NO: 369922 - DNA, 25 bp, Mus musculus
acagacggccctgagctgtctgccc

SEQ ID NO: 369923 - DNA, 25 bp, Mus musculus
gagagatccgcatctgcagagactc

SEQ ID NO: 369924 - DNA, 25 bp, Mus musculus
ggagagatccgcatctgcagagact

SEQ ID NO: 369925 - DNA, 25 bp, Mus musculus
cacagacggccctgagctgtctgcc

SEQ ID NO: 369926 - DNA, 25 bp, Mus musculus
cagacggccctgagctgtctgcccg

SEQ ID NO: 369927 - DNA, 25 bp, Mus musculus
gatccgcatctgcagagactcgggc

SEQ ID NO: 369928 - DNA, 25 bp, Mus musculus
agatccgcatctgcagagactcggg

SEQ ID NO: 369929 - DNA, 25 bp, Mus musculus
gagatccgcatctgcagagactcgg

SEQ ID NO: 369930 - DNA, 25 bp, Mus musculus
agagatccgcatctgcagagactcg

SEQ ID NO: 369931 - DNA, 25 bp, Mus musculus
agacggccctgagctgtctgcccgc

SEQ ID NO: 369932 - DNA, 25 bp, Mus musculus
cccgctaaagttctcaaaggcactt

SEQ ID NO: 369933 - DNA, 25 bp, Mus musculus
gagtaatgtaagtcaatacccgcta

SEQ ID NO: 369934 - DNA, 25 bp, Mus musculus
tcaacagcgaggttcgtaccgcaac

SEQ ID NO: 369935 - DNA, 25 bp, Mus musculus
catggaggccgtgaagaccttcaac

SEQ ID NO: 369936 - DNA, 25 bp, Mus musculus
tctgcgcagacaacatggaggccgt

SEQ ID NO: 369937 - DNA, 25 bp, Mus musculus
aagcttgagtgtggaggccgcttcc

SEQ ID NO: 369938 - DNA, 25 bp, Mus musculus
gtcagcgcttcctcctgtgtcttcg

SEQ ID NO: 369939 - DNA, 25 bp, Mus musculus
gaccgcgtccgccatattggatgcc

SEQ ID NO: 369940 - DNA, 25 bp, Mus musculus
gccatctctatggtctggcgcggcc

SEQ ID NO: 369941 - DNA, 25 bp, Mus musculus
ttgcttgtttctagagcggcgctca

SEQ ID NO: 369942 - DNA, 25 bp, Mus musculus
gtagtttcctccattcggtctcttc

SEQ ID NO: 369943 - DNA, 25 bp, Mus musculus
gcggcaacgaagacaccgtagtttc

SEQ ID NO: 369944 - DNA, 25 bp, Mus musculus
tcccacccggaagcggcaacgaaga

SEQ ID NO: 369945 - DNA, 25 bp, Mus musculus
cacaatggtggcgatgagtaatgta

SEQ ID NO: 369946 - DNA, 25 bp, Mus musculus
cgtgtggcgctcgcagtagtcaccc

SEQ ID NO: 369947 - DNA, 25 bp, Mus musculus
aaagtttgcacctgagcggagacgg

SEQ ID NO: 369948 - DNA, 25 bp, Mus musculus
gcctgcctccttcctccgtacggca

SEQ ID NO: 369949 - DNA, 25 bp, Mus musculus
cacgaacaacaaggtgaggggcgaa

SEQ ID NO: 369950 - DNA, 25 bp, Mus musculus
cgcccgccacgaacaacaaggtgag

SEQ ID NO: 369951 - DNA, 25 bp, Mus musculus
cgcagccaccgaaccgcagaaggag

SEQ ID NO: 369952 - DNA, 25 bp, Mus musculus
ccgagagcagaactgaggcggagcc

SEQ ID NO: 369953 - DNA, 25 bp, Mus musculus
actttcaggaactgcaggcgcgggc

SEQ ID NO: 369954 - DNA, 25 bp, Mus musculus
ccgcgcagccgggactttcaggaac

SEQ ID NO: 369955 - DNA, 25 bp, Mus musculus
ctccgcaaagtttgcacctgagcgg

SEQ ID NO: 369956 - DNA, 25 bp, Mus musculus
tcccaggcgggtggctcccgtcagt

SEQ ID NO: 369957 - DNA, 25 bp, Mus musculus
tggctcccgtcagttcccggggatc

SEQ ID NO: 369958 - DNA, 25 bp, Mus musculus
ggatcaccgttctccggctcgcaga

SEQ ID NO: 369959 - DNA, 25 bp, Mus musculus
ttctccggctcgcagagagccgggc

SEQ ID NO: 369960 - DNA, 25 bp, Mus musculus
cggagattaccacttccggccggag

SEQ ID NO: 369961 - DNA, 25 bp, Mus musculus
attctccgccatgatcctaacaagc

SEQ ID NO: 369962 - DNA, 25 bp, Mus musculus
ggaagcgtccgttctttaatacagc

SEQ ID NO: 369963 - DNA, 25 bp, Mus musculus
ggttctcacgagcatcctcggctca

SEQ ID NO: 369964 - DNA, 25 bp, Mus musculus
ggctcgaaaagcaggccggagatta

SEQ ID NO: 369965 - DNA, 25 bp, Mus musculus
gccggagcaagtctcgggttctcac

SEQ ID NO: 369966 - DNA, 25 bp, Mus musculus
agctcgcagtgattctccgccatga

SEQ ID NO: 369967 - DNA, 25 bp, Mus musculus
cttggacacgccaccggggcgctga

SEQ ID NO: 369968 - DNA, 25 bp, Mus musculus
ttgagccggacccacttggacacgc

SEQ ID NO: 369969 - DNA, 25 bp, Mus musculus
gaaagacttcgggtcccggcacagc

SEQ ID NO: 369970 - DNA, 25 bp, Mus musculus
tggcacaagcggtacaggaaagact

SEQ ID NO: 369971 - DNA, 25 bp, Mus musculus
gaggccctcaccttgtccgaatcta

SEQ ID NO: 369972 - DNA, 25 bp, Mus musculus
ccgggcgccctcattgtgaagaggt

SEQ ID NO: 369973 - DNA, 25 bp, Mus musculus
gctcatgtgcaaggcggaagttccg

SEQ ID NO: 369974 - DNA, 25 bp, Mus musculus
cgccctacagcagccgcgcgctcac

SEQ ID NO: 369975 - DNA, 25 bp, Mus musculus
tcagtatagctgtcattggcggcgg

SEQ ID NO: 369976 - DNA, 25 bp, Mus musculus
ccattggtcagtatagctgtcattg

SEQ ID NO: 369977 - DNA, 25 bp, Mus musculus
ctcgcccattggtcagtatagctgt

SEQ ID NO: 369978 - DNA, 25 bp, Mus musculus
gctcctctcgcccattggtcagtat

SEQ ID NO: 369979 - DNA, 25 bp, Mus musculus
taagcaggacttccgcgacgtagcc

SEQ ID NO: 369980 - DNA, 25 bp, Mus musculus
cgcgcgacgctaagcaggacttccg

SEQ ID NO: 369981 - DNA, 25 bp, Mus musculus
cgttgcgctgctcggcgcctcctca

SEQ ID NO: 369982 - DNA, 25 bp, Mus musculus
caccagctggctggtggtcctggcc

SEQ ID NO: 369983 - DNA, 25 bp, Mus musculus
taacggaccggtgcgccctacagca

SEQ ID NO: 369984 - DNA, 25 bp, Mus musculus
ccagcagaacccaggcgaccgccac

SEQ ID NO: 369985 - DNA, 25 bp, Mus musculus
gagaggaaccctcggccggtgccaa

SEQ ID NO: 369986 - DNA, 25 bp, Mus musculus
ccggggcccgcattccctgccgcag

SEQ ID NO: 369987 - DNA, 25 bp, Mus musculus
tggtcctggccatgagccccaagtc

SEQ ID NO: 369988 - DNA, 25 bp, Mus musculus
tgccgccacgcaggatgcggcagtt

SEQ ID NO: 369989 - DNA, 25 bp, Mus musculus
acgtgactctcagctgaaggggctg

SEQ ID NO: 369990 - DNA, 25 bp, Mus musculus
gcggcagttggtgaactggagcacc

SEQ ID NO: 369991 - DNA, 25 bp, Mus musculus
gcactgcccgctacgcatcgtgagt

SEQ ID NO: 369992 - DNA, 25 bp, Mus musculus
tgcccgctacgcatcgtgagtcgcg

SEQ ID NO: 369993 - DNA, 25 bp, Mus musculus
ctacgcatcgtgagtcgcgccgaac

SEQ ID NO: 369994 - DNA, 25 bp, Mus musculus
tcgcgccgaacccagcaagctttgg

SEQ ID NO: 369995 - DNA, 25 bp, Mus musculus
ctttgggcgcaagccggcagagccc

SEQ ID NO: 369996 - DNA, 25 bp, Mus musculus
agcagccgtaatcggaagcggggcc

SEQ ID NO: 369997 - DNA, 25 bp, Mus musculus
gccaggtcgcatcacgtgactctca

SEQ ID NO: 369998 - DNA, 25 bp, Mus musculus
ggtcgcatcacgtgactctcagctg

SEQ ID NO: 369999 - DNA, 25 bp, Mus musculus
gcatcacgtgactctcagctgaagg

SEQ ID NO: 370000 - DNA, 25 bp, Mus musculus
tcacgtgactctcagctgaaggggc

SEQ ID NO: 370001 - DNA, 25 bp, Mus musculus
cgaacccagcaagctttgggcgcaa

SEQ ID NO: 370002 - DNA, 25 bp, Mus musculus
tggagcgaacgctagcccaccttca

SEQ ID NO: 370003 - DNA, 25 bp, Mus musculus
taaggcccgacacccacatagctgg

SEQ ID NO: 370004 - DNA, 25 bp, Mus musculus
ggctgcgcagaactcaccggtgttc

SEQ ID NO: 370005 - DNA, 25 bp, Mus musculus
gagccgtagcgctcatattagcata

SEQ ID NO: 370006 - DNA, 25 bp, Mus musculus
ggctccacgcagtcgtcttctcgaa

SEQ ID NO: 370007 - DNA, 25 bp, Mus musculus
aacgctcagccttgcctgggtcttc

SEQ ID NO: 370008 - DNA, 25 bp, Mus musculus
cttggacaatttatgggccctggca

SEQ ID NO: 370009 - DNA, 25 bp, Mus musculus
gccgcgctcgcgtcacatgatctgt

SEQ ID NO: 370010 - DNA, 25 bp, Mus musculus
tagagtcccgcatcgcttcggcatc

SEQ ID NO: 370011 - DNA, 25 bp, Mus musculus
cgatgctcaccgctgaagaccatgg

SEQ ID NO: 370012 - DNA, 25 bp, Mus musculus
tcaggcgctgcgctctaaataccag

SEQ ID NO: 370013 - DNA, 25 bp, Mus musculus
cacgggctgtaccactttgcgccgg

SEQ ID NO: 370014 - DNA, 25 bp, Mus musculus
taccagcaccgcaaagcaagatggc

SEQ ID NO: 370015 - DNA, 25 bp, Mus musculus
ccacatagctgggaatgacgtcaga

SEQ ID NO: 370016 - DNA, 25 bp, Mus musculus
caggacctgtgtcatggagccaaga

SEQ ID NO: 370017 - DNA, 25 bp, Mus musculus
tagatggcgatgcacgtgacacttc

SEQ ID NO: 370018 - DNA, 25 bp, Mus musculus
gtagggtatcgccaaataggtttca

SEQ ID NO: 370019 - DNA, 25 bp, Mus musculus
gggccatcatactcctctaagttgg

SEQ ID NO: 370020 - DNA, 25 bp, Mus musculus
ctccagatagctcttaggggccatc

SEQ ID NO: 370021 - DNA, 25 bp, Mus musculus
tccagcctagtgctctgatgaacgc

SEQ ID NO: 370022 - DNA, 25 bp, Mus musculus
taggcgggttcacacctttaagaga

SEQ ID NO: 370023 - DNA, 25 bp, Mus musculus
ccctgcagcggtgtacaggcaatta

SEQ ID NO: 370024 - DNA, 25 bp, Mus musculus
acgtcgctgtcttggctgtgcaatt

SEQ ID NO: 370025 - DNA, 25 bp, Mus musculus
cgccgcgcccagtgataagagagct

SEQ ID NO: 370026 - DNA, 25 bp, Mus musculus
ccatgacactggacaggggagccta

SEQ ID NO: 370027 - DNA, 25 bp, Mus musculus
tccacgcccagcttgcagattcagg

SEQ ID NO: 370028 - DNA, 25 bp, Mus musculus
ctcgacgtccagtcttgagcggata

SEQ ID NO: 370029 - DNA, 25 bp, Mus musculus
tactctttgtacattcccggctgga

SEQ ID NO: 370030 - DNA, 25 bp, Mus musculus
ttcggggcttgcacttcgcatcctc

SEQ ID NO: 370031 - DNA, 25 bp, Mus musculus
cgcacctgcggccatggatgaagag

SEQ ID NO: 370032 - DNA, 25 bp, Mus musculus
cctcattccggggatgcgcattgct

SEQ ID NO: 370033 - DNA, 25 bp, Mus musculus
cattccggggatgcgcattgctctc

SEQ ID NO: 370034 - DNA, 25 bp, Mus musculus
cgaaaacgtttccggcttgggcatg

SEQ ID NO: 370035 - DNA, 25 bp, Mus musculus
cgcgaggcgtttacctgggaggcag

SEQ ID NO: 370036 - DNA, 25 bp, Mus musculus
ccatggatgaagagcgcgccctcta

SEQ ID NO: 370037 - DNA, 25 bp, Mus musculus
gatgcgcattgctctcccccgaaaa

SEQ ID NO: 370038 - DNA, 25 bp, Mus musculus
cgccttcggggcttgcacttcgcat

SEQ ID NO: 370039 - DNA, 25 bp, Mus musculus
gcgacaaggtaaagaactctggccc

SEQ ID NO: 370040 - DNA, 25 bp, Mus musculus
cctgagggattacagcgacaaggta

SEQ ID NO: 370041 - DNA, 25 bp, Mus musculus
cgggtcctgagggattacagcgaca

SEQ ID NO: 370042 - DNA, 25 bp, Mus musculus
agcgcgccctctacatcgtccgggc

SEQ ID NO: 370043 - DNA, 25 bp, Mus musculus
ctatcgagcgggtcctgagggatta

SEQ ID NO: 370044 - DNA, 25 bp, Mus musculus
gccgtggccgctgtaagtcaaccag

SEQ ID NO: 370045 - DNA, 25 bp, Mus musculus
cctcatcatagcaggggtcggcaga

SEQ ID NO: 370046 - DNA, 25 bp, Mus musculus
cagcgttcacaaggccaggaataca

SEQ ID NO: 370047 - DNA, 25 bp, Mus musculus
tctcggcccagagcagcgttcacaa

SEQ ID NO: 370048 - DNA, 25 bp, Mus musculus
ctcgaagagagagcctagtccgcta

SEQ ID NO: 370049 - DNA, 25 bp, Mus musculus
tagtccgctactctgcgtgccgggt

SEQ ID NO: 370050 - DNA, 25 bp, Mus musculus
ccgggtctgcagtgccaagatagca

SEQ ID NO: 370051 - DNA, 25 bp, Mus musculus
caagatagcagagcaccagggcggc

SEQ ID NO: 370052 - DNA, 25 bp, Mus musculus
tgtaagtcaaccagccagcttccgc

SEQ ID NO: 370053 - DNA, 25 bp, Mus musculus
cctgaagcgttgacaggcgtcgccc

SEQ ID NO: 370054 - DNA, 25 bp, Mus musculus
agcactcacccacggagggccagga

SEQ ID NO: 370055 - DNA, 25 bp, Mus musculus
cgagtcctcctgctaggcctgaagc

SEQ ID NO: 370056 - DNA, 25 bp, Mus musculus
cgcctaacgagtctgccctcgaaga

SEQ ID NO: 370057 - DNA, 25 bp, Mus musculus
cagcacaggcccagaagtgggagca

SEQ ID NO: 370058 - DNA, 25 bp, Mus musculus
tccgttgcacgagacccaccggtga

SEQ ID NO: 370059 - DNA, 25 bp, Mus musculus
agcagcctcctggaaacgcgcaggc

SEQ ID NO: 370060 - DNA, 25 bp, Mus musculus
ccaagcatttttgccgccgccaagg

SEQ ID NO: 370061 - DNA, 25 bp, Mus musculus
tttaacaccaagcatttttgccgcc

SEQ ID NO: 370062 - DNA, 25 bp, Mus musculus
agacctgcagcagcctcctggaaac

SEQ ID NO: 370063 - DNA, 25 bp, Mus musculus
agacccaccggtgagcgcagtctgc

SEQ ID NO: 370064 - DNA, 25 bp, Mus musculus
gtccgcccaattcccttccgttgca

SEQ ID NO: 370065 - DNA, 25 bp, Mus musculus
tactatgtgagcctccgaacctcgc

SEQ ID NO: 370066 - DNA, 25 bp, Mus musculus
cctgaggacaggtactatgtgagcc

SEQ ID NO: 370067 - DNA, 25 bp, Mus musculus
tccgctaccagcctgaggacaggta

SEQ ID NO: 370068 - DNA, 25 bp, Mus musculus
tgcagctccgctaccagcctgagga

SEQ ID NO: 370069 - DNA, 25 bp, Mus musculus
gcgcaggagtccaaggcgccctgca

SEQ ID NO: 370070 - DNA, 25 bp, Mus musculus
gcaggctccgctccaactgccgctg

SEQ ID NO: 370071 - DNA, 25 bp, Mus musculus
cagtctgcgggtagtaggtagtttc

SEQ ID NO: 370072 - DNA, 25 bp, Mus musculus
ttatcgctcgtggttgacccgcctt

SEQ ID NO: 370073 - DNA, 25 bp, Mus musculus
ggcctccgttccgtatgacctatcg

SEQ ID NO: 370074 - DNA, 25 bp, Mus musculus
actgccgctttagaccgctctcaag

SEQ ID NO: 370075 - DNA, 25 bp, Mus musculus
cgccgggagctcctactggtaggac

SEQ ID NO: 370076 - DNA, 25 bp, Mus musculus
ctggtaggaccacagagttacgccc

SEQ ID NO: 370077 - DNA, 25 bp, Mus musculus
ctctgggcatttgtgattggctaca

SEQ ID NO: 370078 - DNA, 25 bp, Mus musculus
cgcagtcggggatacgtgcctaccc

SEQ ID NO: 370079 - DNA, 25 bp, Mus musculus
ttggctacaccaggacgcgaattca

SEQ ID NO: 370080 - DNA, 25 bp, Mus musculus
gcgccggcgggctatcctaaaaagc

SEQ ID NO: 370081 - DNA, 25 bp, Mus musculus
tggtcttctccctccaagacttgtc

SEQ ID NO: 370082 - DNA, 25 bp, Mus musculus
agacttgtcctaccgtccggagttg

SEQ ID NO: 370083 - DNA, 25 bp, Mus musculus
ggtcgtggcttactacctgtccctc

SEQ ID NO: 370084 - DNA, 25 bp, Mus musculus
tggctgtctattggcttatcgctcg

SEQ ID NO: 370085 - DNA, 25 bp, Mus musculus
cgcgaattcaaacgctggctgtcta

SEQ ID NO: 370086 - DNA, 25 bp, Mus musculus
ctacaagcgcttgcccactggaggt

SEQ ID NO: 370087 - DNA, 25 bp, Mus musculus
cggactgacccttcgtattgctgca

SEQ ID NO: 370088 - DNA, 25 bp, Mus musculus
aggacttgtcactcgcgcgctagct

SEQ ID NO: 370089 - DNA, 25 bp, Mus musculus
agttgtcagcttcggccgcaaccgc

SEQ ID NO: 370090 - DNA, 25 bp, Mus musculus
ggagcttcctggtgcgttcttccac

SEQ ID NO: 370091 - DNA, 25 bp, Mus musculus
atccagagcttaggcgaggctgagc

SEQ ID NO: 370092 - DNA, 25 bp, Mus musculus
gcgcagacgctgaatccagagctta

SEQ ID NO: 370093 - DNA, 25 bp, Mus musculus
ctgggcaacatgtgccaggcactgc

SEQ ID NO: 370094 - DNA, 25 bp, Mus musculus
tgagacctgcgtggagtactgcgca

SEQ ID NO: 370095 - DNA, 25 bp, Mus musculus
aacgcctactgtttgctggacgcga

SEQ ID NO: 370096 - DNA, 25 bp, Mus musculus
ggtgtagctgtcttggcgtcctcat

SEQ ID NO: 370097 - DNA, 25 bp, Mus musculus
ggggctctgagatttcccgtccttg

SEQ ID NO: 370098 - DNA, 25 bp, Mus musculus
gcgcagacgcacgatccggaatgtt

SEQ ID NO: 370099 - DNA, 25 bp, Mus musculus
tcggtgagtgtcactaggacttgtc

SEQ ID NO: 370100 - DNA, 25 bp, Mus musculus
acaaacctctggtgccggtcagcca

SEQ ID NO: 370101 - DNA, 25 bp, Mus musculus
tctcttgttttcttgtcaggctgga

SEQ ID NO: 370102 - DNA, 25 bp, Mus musculus
gagccctgccgcttctcttgttttc

SEQ ID NO: 370103 - DNA, 25 bp, Mus musculus
gcgacccgctttagcctgcaggact

SEQ ID NO: 370104 - DNA, 25 bp, Mus musculus
tcaccgacggaagggtgatcccgca

SEQ ID NO: 370105 - DNA, 25 bp, Mus musculus
ttgcgttcctcagtgcggcagaggc

SEQ ID NO: 370106 - DNA, 25 bp, Mus musculus
taggaatccggctgcatccgacctc

SEQ ID NO: 370107 - DNA, 25 bp, Mus musculus
tcacctctgacgacaaagttgcgcc

SEQ ID NO: 370108 - DNA, 25 bp, Mus musculus
attggctgagtgtgcttacgtcatc

SEQ ID NO: 370109 - DNA, 25 bp, Mus musculus
agtcctccaccgctaacttgcattg

SEQ ID NO: 370110 - DNA, 25 bp, Mus musculus
acagttgctgtcctttagtcctcca

SEQ ID NO: 370111 - DNA, 25 bp, Mus musculus
cgcgcgcttcagaatgagcaaaaca

SEQ ID NO: 370112 - DNA, 25 bp, Mus musculus
ggtcagccaatcatcgcgcgcttca

SEQ ID NO: 370113 - DNA, 25 bp, Mus musculus
cccgacctgagtagtgagtggagaa

SEQ ID NO: 370114 - DNA, 25 bp, Mus musculus
ggctacaggcctgagggacaggcta

SEQ ID NO: 370115 - DNA, 25 bp, Mus musculus
ggagactggactcccggctagcttg

SEQ ID NO: 370116 - DNA, 25 bp, Mus musculus
ctgtgagcggggtcatattttaggc

SEQ ID NO: 370117 - DNA, 25 bp, Mus musculus
tgtgagcggggtcatattttaggca

SEQ ID NO: 370118 - DNA, 25 bp, Mus musculus
tgagcggggtcatattttaggcatt

SEQ ID NO: 370119 - DNA, 25 bp, Mus musculus
agcggggtcatattttaggcattgg

SEQ ID NO: 370120 - DNA, 25 bp, Mus musculus
cggggtcatattttaggcattgggg

SEQ ID NO: 370121 - DNA, 25 bp, Mus musculus
ggcggagcgatgagcctaaggggag

SEQ ID NO: 370122 - DNA, 25 bp, Mus musculus
taaggggaggggctacaggcctgag

SEQ ID NO: 370123 - DNA, 25 bp, Mus musculus
cgcggggagctttaagcccgccgca

SEQ ID NO: 370124 - DNA, 25 bp, Mus musculus
aagcccgccgcaggtgcatccgagg

SEQ ID NO: 370125 - DNA, 25 bp, Mus musculus
atccgaggggcggagtttgtgggcg

SEQ ID NO: 370126 - DNA, 25 bp, Mus musculus
ttaagcccgccgcaggtgcatccga

SEQ ID NO: 370127 - DNA, 25 bp, Mus musculus
cggagactggactcccggctagctt

SEQ ID NO: 370128 - DNA, 25 bp, Mus musculus
gctggctctgtagtccccactgata

SEQ ID NO: 370129 - DNA, 25 bp, Mus musculus
gcgtcgccttctgctgcacgcgggt

SEQ ID NO: 370130 - DNA, 25 bp, Mus musculus
cccactgatatccaagatggcgctg

SEQ ID NO: 370131 - DNA, 25 bp, Mus musculus
agcgaagccgctggctctgtagtcc

SEQ ID NO: 370132 - DNA, 25 bp, Mus musculus
ctggctaaccttggccttgtggggc

SEQ ID NO: 370133 - DNA, 25 bp, Mus musculus
acatctcgttcatgtcctcgggctc

SEQ ID NO: 370134 - DNA, 25 bp, Mus musculus
gctgtctgcaggatcccgcctcggg

SEQ ID NO: 370135 - DNA, 25 bp, Mus musculus
ctgcggactggctaaccttggcctt

SEQ ID NO: 370136 - DNA, 25 bp, Mus musculus
ggctccgagcccacacggtctgtga

SEQ ID NO: 370137 - DNA, 25 bp, Mus musculus
gcgcgcggcgcttcgctaacaagcg

SEQ ID NO: 370138 - DNA, 25 bp, Mus musculus
gggagggccacatctcgttcatgtc

SEQ ID NO: 370139 - DNA, 25 bp, Mus musculus
cccacacggtctgtgaggtcgggct

SEQ ID NO: 370140 - DNA, 25 bp, Mus musculus
cttgctaacgtgctccgggctgtct

SEQ ID NO: 370141 - DNA, 25 bp, Mus musculus
agagtctgggcgtgcttgctaacgt

SEQ ID NO: 370142 - DNA, 25 bp, Mus musculus
ggtccctaatccctgtctgacagag

SEQ ID NO: 370143 - DNA, 25 bp, Mus musculus
cctttcgagcttggtttaagtaatg

SEQ ID NO: 370144 - DNA, 25 bp, Mus musculus
cgagcttggtttaagtaatggtaca

SEQ ID NO: 370145 - DNA, 25 bp, Mus musculus
ttaagtaatggtacaagtcggattg

SEQ ID NO: 370146 - DNA, 25 bp, Mus musculus
taatggtacaagtcggattgagcgg

SEQ ID NO: 370147 - DNA, 25 bp, Mus musculus
ggggtgttccgcacattcttggaag

SEQ ID NO: 370148 - DNA, 25 bp, Mus musculus
gggtgttccgcacattcttggaagc

SEQ ID NO: 370149 - DNA, 25 bp, Mus musculus
acattcttggaagcgttgctccacc

SEQ ID NO: 370150 - DNA, 25 bp, Mus musculus
ttggaagcgttgctccaccccgtag

SEQ ID NO: 370151 - DNA, 25 bp, Mus musculus
aggtcaggtccctaatccctgtctg

SEQ ID NO: 370152 - DNA, 25 bp, Mus musculus
ggtcaggtccctaatccctgtctga

SEQ ID NO: 370153 - DNA, 25 bp, Mus musculus
ccagctccgcccgaactaaggcccg

SEQ ID NO: 370154 - DNA, 25 bp, Mus musculus
taatccctgtctgacagagcggccc

SEQ ID NO: 370155 - DNA, 25 bp, Mus musculus
cctaatccctgtctgacagagcggc

SEQ ID NO: 370156 - DNA, 25 bp, Mus musculus
ccgagggctgcgtgtccgacaggca

SEQ ID NO: 370157 - DNA, 25 bp, Mus musculus
cgaatttgacggacaggcaaaaagg

SEQ ID NO: 370158 - DNA, 25 bp, Mus musculus
cgcaccgagggctgcgtgtccgaca

SEQ ID NO: 370159 - DNA, 25 bp, Mus musculus
aaggcggggctatgggttgcggtct

SEQ ID NO: 370160 - DNA, 25 bp, Mus musculus
agggctgcgtgtccgacaggcaggg

SEQ ID NO: 370161 - DNA, 25 bp, Mus musculus
caaaaacgaatttgacggacaggca

SEQ ID NO: 370162 - DNA, 25 bp, Mus musculus
acgaatttgacggacaggcaaaaag

SEQ ID NO: 370163 - DNA, 25 bp, Mus musculus
gggctatgggttgcggtctagcgcg

SEQ ID NO: 370164 - DNA, 25 bp, Mus musculus
aatttgacggacaggcaaaaaggcg

SEQ ID NO: 370165 - DNA, 25 bp, Mus musculus
atttgacggacaggcaaaaaggcgg

SEQ ID NO: 370166 - DNA, 25 bp, Mus musculus
tgacggacaggcaaaaaggcggggc

SEQ ID NO: 370167 - DNA, 25 bp, Mus musculus
cggacaggcaaaaaggcggggctat

SEQ ID NO: 370168 - DNA, 25 bp, Mus musculus
gacaggcaaaaaggcggggctatgg

SEQ ID NO: 370169 - DNA, 25 bp, Mus musculus
gaatttgacggacaggcaaaaaggc

SEQ ID NO: 370170 - DNA, 25 bp, Mus musculus
taccttcctcgctgaagggcgctgg

SEQ ID NO: 370171 - DNA, 25 bp, Mus musculus
caggatccgggcgagaccgtacacc

SEQ ID NO: 370172 - DNA, 25 bp, Mus musculus
atccgggcgagaccgtacaccgcag

SEQ ID NO: 370173 - DNA, 25 bp, Mus musculus
tcgtcataacaacgggccgcaccga

SEQ ID NO: 370174 - DNA, 25 bp, Mus musculus
gtaggctcgttaccttcctcgctga

SEQ ID NO: 370175 - DNA, 25 bp, Mus musculus
agcccaaggaagccgccggaggaca

SEQ ID NO: 370176 - DNA, 25 bp, Mus musculus
ttcggcccgggcttctgccgtatga

SEQ ID NO: 370177 - DNA, 25 bp, Mus musculus
ggccgtcacccgcactgccatcgcg

SEQ ID NO: 370178 - DNA, 25 bp, Mus musculus
tccatgtcgcaacgcgccacaggaa

SEQ ID NO: 370179 - DNA, 25 bp, Mus musculus
gcgccacaggaagatggcggattta

SEQ ID NO: 370180 - DNA, 25 bp, Mus musculus
atggcggatttacgaccatgtcgtc

SEQ ID NO: 370181 - DNA, 25 bp, Mus musculus
cgaccatgtcgtcataacaacgggc

SEQ ID NO: 370182 - DNA, 25 bp, Mus musculus
ttctgccgtatgagcggccgtcacc

SEQ ID NO: 370183 - DNA, 25 bp, Mus musculus
caccaggcttcggtaggctcgttac

SEQ ID NO: 370184 - DNA, 25 bp, Mus musculus
cctacgcggagaagctaaggcgctt

SEQ ID NO: 370185 - DNA, 25 bp, Mus musculus
tggacacgctgctgttcgactgcga

SEQ ID NO: 370186 - DNA, 25 bp, Mus musculus
agcagcaagactcgcacggcctacg

SEQ ID NO: 370187 - DNA, 25 bp, Mus musculus
gtttcattgcgggtccgtgcaccta

SEQ ID NO: 370188 - DNA, 25 bp, Mus musculus
acggcctattgcagcgcgctctatc

SEQ ID NO: 370189 - DNA, 25 bp, Mus musculus
tgggcttcgacccacacttcagcta

SEQ ID NO: 370190 - DNA, 25 bp, Mus musculus
tgaagctcaccaaggccgtgcggta

SEQ ID NO: 370191 - DNA, 25 bp, Mus musculus
tgcagcagcccgactgtctgctcgt

SEQ ID NO: 370192 - DNA, 25 bp, Mus musculus
ctcgtgggcaccaacatggacaacc

SEQ ID NO: 370193 - DNA, 25 bp, Mus musculus
atggacaaccggctcccgctagaga

SEQ ID NO: 370194 - DNA, 25 bp, Mus musculus
cccgctagagaacggccgtttcatt

SEQ ID NO: 370195 - DNA, 25 bp, Mus musculus
aaacggagatggattggcgcaagca

SEQ ID NO: 370196 - DNA, 25 bp, Mus musculus
ctcgctctgcaggtaccggctgtct

SEQ ID NO: 370197 - DNA, 25 bp, Mus musculus
gggcttcatcaccaacaacagcagc

SEQ ID NO: 370198 - DNA, 25 bp, Mus musculus
cggagaagagcatctaggtcgcgta

SEQ ID NO: 370199 - DNA, 25 bp, Mus musculus
ccgccctcctcaggggagaagttct

SEQ ID NO: 370200 - DNA, 25 bp, Mus musculus
cttctgagccggagaagagcatcta

SEQ ID NO: 370201 - DNA, 25 bp, Mus musculus
tcgcaccgagagtcttccgacttct

SEQ ID NO: 370202 - DNA, 25 bp, Mus musculus
ccctcgcctgctctgattgggtggc

SEQ ID NO: 370203 - DNA, 25 bp, Mus musculus
agagtcttccgacttctgagccgga

SEQ ID NO: 370204 - DNA, 25 bp, Mus musculus
cgttagttccctcgagcccggagag

SEQ ID NO: 370205 - DNA, 25 bp, Mus musculus
gcatgccgccctcctcaggggagaa

SEQ ID NO: 370206 - DNA, 25 bp, Mus musculus
atctaggtcgcgtaagccactcccg

SEQ ID NO: 370207 - DNA, 25 bp, Mus musculus
ccgcttctgctgttctccgtgccac

SEQ ID NO: 370208 - DNA, 25 bp, Mus musculus
tgtcgtcggcctgagtggccgcact

SEQ ID NO: 370209 - DNA, 25 bp, Mus musculus
tgagtggccgcactccgggcccttt

SEQ ID NO: 370210 - DNA, 25 bp, Mus musculus
ggccctttcccgttagcctcatctg

SEQ ID NO: 370211 - DNA, 25 bp, Mus musculus
ccctcgagcccggagagtggccgaa

SEQ ID NO: 370212 - DNA, 25 bp, Mus musculus
cgactaaggaaaagcccggcactgc

SEQ ID NO: 370213 - DNA, 25 bp, Mus musculus
ggcagtcacacgcagaaggccatcg

SEQ ID NO: 370214 - DNA, 25 bp, Mus musculus
gctgctgagcatgcgtagttgaccg

SEQ ID NO: 370215 - DNA, 25 bp, Mus musculus
tggctctgtgttaccggcccgatta

SEQ ID NO: 370216 - DNA, 25 bp, Mus musculus
tagccacccagtggtcggtagcagc

SEQ ID NO: 370217 - DNA, 25 bp, Mus musculus
tgcactctgccttagtccaggacgg

SEQ ID NO: 370218 - DNA, 25 bp, Mus musculus
agctagtcgatagaagccgggccga

SEQ ID NO: 370219 - DNA, 25 bp, Mus musculus
gccgagcgtagagctatcgatagta

SEQ ID NO: 370220 - DNA, 25 bp, Mus musculus
atcgatagtaactccgggcgagacc

SEQ ID NO: 370221 - DNA, 25 bp, Mus musculus
agttgaaagggataccagagttctg

SEQ ID NO: 370222 - DNA, 25 bp, Mus musculus
agaactccagaagtgatcgtgctca

SEQ ID NO: 370223 - DNA, 25 bp, Mus musculus
atcgtgctcagaatggccatcagcc

SEQ ID NO: 370224 - DNA, 25 bp, Mus musculus
cgccgtctctcgcaagggtaggcaa

SEQ ID NO: 370225 - DNA, 25 bp, Mus musculus
aacgcatgcgcatggcgactaagga

SEQ ID NO: 370226 - DNA, 25 bp, Mus musculus
tgctgcgtctgagccgccgagagca

SEQ ID NO: 370227 - DNA, 25 bp, Mus musculus
aggagcgctcagacccttggtccgc

SEQ ID NO: 370228 - DNA, 25 bp, Mus musculus
accggtggcacttgtgcccggcttc

SEQ ID NO: 370229 - DNA, 25 bp, Mus musculus
tccctgaggccgctggcgatcacat

SEQ ID NO: 370230 - DNA, 25 bp, Mus musculus
cggcaacgagcgcagaactgtccgc

SEQ ID NO: 370231 - DNA, 25 bp, Mus musculus
ccttctcgccctagctctggaggag

SEQ ID NO: 370232 - DNA, 25 bp, Mus musculus
tgacccgcgcacccaaacgtgggga

SEQ ID NO: 370233 - DNA, 25 bp, Mus musculus
ctggaaaggatgcgatcgcagacgc

SEQ ID NO: 370234 - DNA, 25 bp, Mus musculus
tccgcagaggcctagcctgacccgc

SEQ ID NO: 370235 - DNA, 25 bp, Mus musculus
gtccctggctgtcgtcttcggttcc

SEQ ID NO: 370236 - DNA, 25 bp, Mus musculus
gtcctctgtccctggctgtcgtctt

SEQ ID NO: 370237 - DNA, 25 bp, Mus musculus
tttaggcttgcgtcgccgccgtgcc

SEQ ID NO: 370238 - DNA, 25 bp, Mus musculus
cctctcctaggtttaggcttgcgtc

SEQ ID NO: 370239 - DNA, 25 bp, Mus musculus
gcagcctcgagaaacctctcctagg

SEQ ID NO: 370240 - DNA, 25 bp, Mus musculus
tgatctcgccggcagtgtggacaca

SEQ ID NO: 370241 - DNA, 25 bp, Mus musculus
tctgtgaagcacaaagaggccattg

SEQ ID NO: 370242 - DNA, 25 bp, Mus musculus
ccgtgttggcctctgtgaagcacaa

SEQ ID NO: 370243 - DNA, 25 bp, Mus musculus
tagctaccgtgttggcctctgtgaa

SEQ ID NO: 370244 - DNA, 25 bp, Mus musculus
cagaaccgggccgagtagctaccgt

SEQ ID NO: 370245 - DNA, 25 bp, Mus musculus
caaagaggccattgggcctgacggt

SEQ ID NO: 370246 - DNA, 25 bp, Mus musculus
acacaggtagtgctggcagtgtgaa

SEQ ID NO: 370247 - DNA, 25 bp, Mus musculus
cgccagtccagaaccgggccgagta

SEQ ID NO: 370248 - DNA, 25 bp, Mus musculus
agtgccaacctagccgacgagccgg

SEQ ID NO: 370249 - DNA, 25 bp, Mus musculus
aacgccgtcgggctagtgatctcgc

SEQ ID NO: 370250 - DNA, 25 bp, Mus musculus
agccggctccagacgttgaggcaga

SEQ ID NO: 370251 - DNA, 25 bp, Mus musculus
tcggccatggccagtgccaacctag

SEQ ID NO: 370252 - DNA, 25 bp, Mus musculus
gcagccatgttggagctgtcttcca

SEQ ID NO: 370253 - DNA, 25 bp, Mus musculus
gtgtgaagagcatcgcagccatgtt

SEQ ID NO: 370254 - DNA, 25 bp, Mus musculus
gctttggcgggactacagtccagca

SEQ ID NO: 370255 - DNA, 25 bp, Mus musculus
caccgcccgtgtcacccaagccgcc

SEQ ID NO: 370256 - DNA, 25 bp, Mus musculus
tcgcagagcgccagccctgtcaagc

SEQ ID NO: 370257 - DNA, 25 bp, Mus musculus
cccaagccagccaaggctttggcgg

SEQ ID NO: 370258 - DNA, 25 bp, Mus musculus
cccagtagcttcagattgtgcttca

SEQ ID NO: 370259 - DNA, 25 bp, Mus musculus
tcagattgtgcttcacccggggaca

SEQ ID NO: 370260 - DNA, 25 bp, Mus musculus
gtgctcatggcacgccaccgcccgt

SEQ ID NO: 370261 - DNA, 25 bp, Mus musculus
acccgcgctgcacgtacccgccaag

SEQ ID NO: 370262 - DNA, 25 bp, Mus musculus
tgctgcttcagtggtctccggaccc

SEQ ID NO: 370263 - DNA, 25 bp, Mus musculus
tctccagcgcgtcagccgccagcag

SEQ ID NO: 370264 - DNA, 25 bp, Mus musculus
gcagcgctcatcaagccagctagtt

SEQ ID NO: 370265 - DNA, 25 bp, Mus musculus
gctcatcaagccagctagttcgccg

SEQ ID NO: 370266 - DNA, 25 bp, Mus musculus
cctcgcgctgctgcttcagtggtct

SEQ ID NO: 370267 - DNA, 25 bp, Mus musculus
agcacccaagccagccaaggctttg

SEQ ID NO: 370268 - DNA, 25 bp, Mus musculus
taggagcagcgacttcacccaccgg

SEQ ID NO: 370269 - DNA, 25 bp, Mus musculus
tgagcttcctaaactacgacttccg

SEQ ID NO: 370270 - DNA, 25 bp, Mus musculus
gctgcttcacgctttgagcttccta

SEQ ID NO: 370271 - DNA, 25 bp, Mus musculus
tcaggaactctaggtgctgcttcac

SEQ ID NO: 370272 - DNA, 25 bp, Mus musculus
ttcacggacttcaggaactctaggt

SEQ ID NO: 370273 - DNA, 25 bp, Mus musculus
aacttgtagttcacggacttcagga

SEQ ID NO: 370274 - DNA, 25 bp, Mus musculus
gggcaggtcggaacttgtagttcac

SEQ ID NO: 370275 - DNA, 25 bp, Mus musculus
acgctttgagcttcctaaactacga

SEQ ID NO: 370276 - DNA, 25 bp, Mus musculus
tcaggatacaggagccggaagtccc

SEQ ID NO: 370277 - DNA, 25 bp, Mus musculus
ggaaaggtttcaggatacaggagcc

SEQ ID NO: 370278 - DNA, 25 bp, Mus musculus
acgaccgctcgcgacgctcccacaa

SEQ ID NO: 370279 - DNA, 25 bp, Mus musculus
aggtcttgtgctccgcgcactcact

SEQ ID NO: 370280 - DNA, 25 bp, Mus musculus
cgcactcactcacccgcccgcggct

SEQ ID NO: 370281 - DNA, 25 bp, Mus musculus
tgcctaggagcagcgacttcaccca

SEQ ID NO: 370282 - DNA, 25 bp, Mus musculus
acgcacgtagggtcgcgtgacaatg

SEQ ID NO: 370283 - DNA, 25 bp, Mus musculus
ccactgccaatggtcgctctgaggc

SEQ ID NO: 370284 - DNA, 25 bp, Mus musculus
gcagcagcatctccagcactcagtg

SEQ ID NO: 370285 - DNA, 25 bp, Mus musculus
ggttctcagtgtgctcctgctgcta

SEQ ID NO: 370286 - DNA, 25 bp, Mus musculus
cagcgtagaggtagccggctcactc

SEQ ID NO: 370287 - DNA, 25 bp, Mus musculus
acagtcctcggatgtgccagacgtg

SEQ ID NO: 370288 - DNA, 25 bp, Mus musculus
agaagtctccagtgctaccaagtga

SEQ ID NO: 370289 - DNA, 25 bp, Mus musculus
ggctcaccttgaaagcaacatcgta

SEQ ID NO: 370290 - DNA, 25 bp, Mus musculus
acctgctgcattcccatggcgggga

SEQ ID NO: 370291 - DNA, 25 bp, Mus musculus
ccagcggcagtctaggatccaacgc

SEQ ID NO: 370292 - DNA, 25 bp, Mus musculus
tgctgtgccaattcagcgccgaggg

SEQ ID NO: 370293 - DNA, 25 bp, Mus musculus
ccgtgccatctgcaaggtgctgtgc

SEQ ID NO: 370294 - DNA, 25 bp, Mus musculus
gcggagccatgcaaataagtctgtc

SEQ ID NO: 370295 - DNA, 25 bp, Mus musculus
caatgtaaggtactgccgtgccatc

SEQ ID NO: 370296 - DNA, 25 bp, Mus musculus
ggaattagtgaaggcgagcgacttc

SEQ ID NO: 370297 - DNA, 25 bp, Mus musculus
gctctaagcaaagggctgcggctgc

SEQ ID NO: 370298 - DNA, 25 bp, Mus musculus
ccactggcccgagcagcgtgctgtt

SEQ ID NO: 370299 - DNA, 25 bp, Mus musculus
gcggcgactgcctgctcttcgaggc

SEQ ID NO: 370300 - DNA, 25 bp, Mus musculus
gcctgctcttcgaggccggcgcagt

SEQ ID NO: 370301 - DNA, 25 bp, Mus musculus
cccacttgggcagcaacgccgggga

SEQ ID NO: 370302 - DNA, 25 bp, Mus musculus
cgacttcgcggagacctgagaacta

SEQ ID NO: 370303 - DNA, 25 bp, Mus musculus
ccgcgcccatggctctaagcaaagg

SEQ ID NO: 370304 - DNA, 25 bp, Mus musculus
gggacaccagagagctggcacattt

SEQ ID NO: 370305 - DNA, 25 bp, Mus musculus
agagctggcacatttggctggacta

SEQ ID NO: 370306 - DNA, 25 bp, Mus musculus
cacatttggctggactaagcgtcgc

SEQ ID NO: 370307 - DNA, 25 bp, Mus musculus
tggactaagcgtcgcgctcgcctga

SEQ ID NO: 370308 - DNA, 25 bp, Mus musculus
cccatggctctaagcaaagggctgc

SEQ ID NO: 370309 - DNA, 25 bp, Mus musculus
acctgagaactaggggcgctcggtt

SEQ ID NO: 370310 - DNA, 25 bp, Mus musculus
cggagcctgtgaaggccttctcttc

SEQ ID NO: 370311 - DNA, 25 bp, Mus musculus
tgaaggccttctcttcatccagtcc

SEQ ID NO: 370312 - DNA, 25 bp, Mus musculus
acagccaacttggaagcgcaggggc

SEQ ID NO: 370313 - DNA, 25 bp, Mus musculus
cagagcgctgagcagctgtcgcacc

SEQ ID NO: 370314 - DNA, 25 bp, Mus musculus
acgctagggccgagtctgcgcatcc

SEQ ID NO: 370315 - DNA, 25 bp, Mus musculus
gacgccaccgcgctgtgagtagctg

SEQ ID NO: 370316 - DNA, 25 bp, Mus musculus
cggcctggctagagcatcatgactg

SEQ ID NO: 370317 - DNA, 25 bp, Mus musculus
ctgaggtagatagagcccttctgga

SEQ ID NO: 370318 - DNA, 25 bp, Mus musculus
tagagcccttctggagctttgccgg

SEQ ID NO: 370319 - DNA, 25 bp, Mus musculus
cagcagggatgtcggcccgactaaa

SEQ ID NO: 370320 - DNA, 25 bp, Mus musculus
aaaaccttggacctcagccggcgtg

SEQ ID NO: 370321 - DNA, 25 bp, Mus musculus
acctcagccggcgtgacccagaaga

SEQ ID NO: 370322 - DNA, 25 bp, Mus musculus
tgacccagaagagtagccaaaaatc

SEQ ID NO: 370323 - DNA, 25 bp, Mus musculus
cccgcctactgcaggatctgcaatg

SEQ ID NO: 370324 - DNA, 25 bp, Mus musculus
cgggccgcagcatctgacctaaact

SEQ ID NO: 370325 - DNA, 25 bp, Mus musculus
cgtgaatagatgcagaggcccgctc

SEQ ID NO: 370326 - DNA, 25 bp, Mus musculus
tctgacctaaactctaggcgccgcg

SEQ ID NO: 370327 - DNA, 25 bp, Mus musculus
gctctgcgcctgcaggcgttttgga

SEQ ID NO: 370328 - DNA, 25 bp, Mus musculus
ttacagcccaggcatgaactcaggg

SEQ ID NO: 370329 - DNA, 25 bp, Mus musculus
gctgctcggaggagtagtttacagc

SEQ ID NO: 370330 - DNA, 25 bp, Mus musculus
ggaattgtagtttcgcgtgcgcgtt

SEQ ID NO: 370331 - DNA, 25 bp, Mus musculus
actatttgcgttgagctctctggga

SEQ ID NO: 370332 - DNA, 25 bp, Mus musculus
ggcgaggctttgctgactatttgcg

SEQ ID NO: 370333 - DNA, 25 bp, Mus musculus
cggaggattggaatcagaacgacca

SEQ ID NO: 370334 - DNA, 25 bp, Mus musculus
gcttgaagcgctaggacttgtcagc

SEQ ID NO: 370335 - DNA, 25 bp, Mus musculus
attcgcaatggagggcttgaagcgc

SEQ ID NO: 370336 - DNA, 25 bp, Mus musculus
aactttggctccaggcttgcgtccc

SEQ ID NO: 370337 - DNA, 25 bp, Mus musculus
gaggcccgctcacattcgcaatgga

SEQ ID NO: 370338 - DNA, 25 bp, Mus musculus
ttgacgccgttgacctcaaccaggc

SEQ ID NO: 370339 - DNA, 25 bp, Mus musculus
ggtggctcctgctcagctcgcgtcg

SEQ ID NO: 370340 - DNA, 25 bp, Mus musculus
agcgcagggacccacctggtgatgc

SEQ ID NO: 370341 - DNA, 25 bp, Mus musculus
tcgccctctacgttgacgccgttga

SEQ ID NO: 370342 - DNA, 25 bp, Mus musculus
acgcgccggatgaactggccacggc

SEQ ID NO: 370343 - DNA, 25 bp, Mus musculus
gcatcttggccagcgctgtagggac

SEQ ID NO: 370344 - DNA, 25 bp, Mus musculus
cggcggcctttctcgccatgcaggt

SEQ ID NO: 370345 - DNA, 25 bp, Mus musculus
tctcgccatgcaggtgaaagccgta

SEQ ID NO: 370346 - DNA, 25 bp, Mus musculus
gtgaaagccgtacccttgctctccg

SEQ ID NO: 370347 - DNA, 25 bp, Mus musculus
accaggcgacacaagcggggccgca

SEQ ID NO: 370348 - DNA, 25 bp, Mus musculus
cgcagcgattccagcgcggccatgg

SEQ ID NO: 370349 - DNA, 25 bp, Mus musculus
cggctcacaccacccgcaggctgga

SEQ ID NO: 370350 - DNA, 25 bp, Mus musculus
tcgtaggcatcttggccagcgctgt

SEQ ID NO: 370351 - DNA, 25 bp, Mus musculus
tggtgatgcgtctcgccctctacgt

SEQ ID NO: 370352 - DNA, 25 bp, Mus musculus
gcaggacttaccaggaggtcgcagc

SEQ ID NO: 370353 - DNA, 25 bp, Mus musculus
gccttgcgctttacccgcctagtga

SEQ ID NO: 370354 - DNA, 25 bp, Mus musculus
ccagacctaggtgaggcttcttctg

SEQ ID NO: 370355 - DNA, 25 bp, Mus musculus
aggtgaggcttcttctgctttaagg

SEQ ID NO: 370356 - DNA, 25 bp, Mus musculus
tctgctttaaggtgcgcttgaggaa

SEQ ID NO: 370357 - DNA, 25 bp, Mus musculus
ttacccgcctagtgactgtggtgga

SEQ ID NO: 370358 - DNA, 25 bp, Mus musculus
cacagactgacacgccacttgcctc

SEQ ID NO: 370359 - DNA, 25 bp, Mus musculus
cccacaccgccgagtggtcgatttg

SEQ ID NO: 370360 - DNA, 25 bp, Mus musculus
accgccgagtggtcgatttgaattg

SEQ ID NO: 370361 - DNA, 25 bp, Mus musculus
tcgatttgaattggccgccggacgg

SEQ ID NO: 370362 - DNA, 25 bp, Mus musculus
gcgcacggctgtgacgtcactgaaa

SEQ ID NO: 370363 - DNA, 25 bp, Mus musculus
cacggctgtgacgtcactgaaaacc

SEQ ID NO: 370364 - DNA, 25 bp, Mus musculus
agagagcaggacttaccaggaggtc

SEQ ID NO: 370365 - DNA, 25 bp, Mus musculus
gtcagggccgctcaccacagactga

SEQ ID NO: 370366 - DNA, 25 bp, Mus musculus
gacactagctcgcaccggtagcttc

SEQ ID NO: 370367 - DNA, 25 bp, Mus musculus
gtgctgactgaagcgctgcagcgac

SEQ ID NO: 370368 - DNA, 25 bp, Mus musculus
tgaagcgctgcagcgacagatcgcg

SEQ ID NO: 370369 - DNA, 25 bp, Mus musculus
ctgcagcgacagatcgcggccgcag

SEQ ID NO: 370370 - DNA, 25 bp, Mus musculus
gcggccgcagccgtcccttcgacat

SEQ ID NO: 370371 - DNA, 25 bp, Mus musculus
gtcccttcgacatgcgcctggccgc

SEQ ID NO: 370372 - DNA, 25 bp, Mus musculus
cgccgcgtcgaacgaggcgtacgca

SEQ ID NO: 370373 - DNA, 25 bp, Mus musculus
tcgaacgaggcgtacgcagcctcgc

SEQ ID NO: 370374 - DNA, 25 bp, Mus musculus
gcgtacgcagcctcgctggctgtct

SEQ ID NO: 370375 - DNA, 25 bp, Mus musculus
tcgctggctgtctccgagctgctga

SEQ ID NO: 370376 - DNA, 25 bp, Mus musculus
ctgctgagctgccaccagtgcggcg

SEQ ID NO: 370377 - DNA, 25 bp, Mus musculus
ccaggacgaggtactgggcaggcga

SEQ ID NO: 370378 - DNA, 25 bp, Mus musculus
tggggctgagcaccgccgacactag

SEQ ID NO: 370379 - DNA, 25 bp, Mus musculus
gctcgcaccggtagcttcgcaaacg

SEQ ID NO: 370380 - DNA, 25 bp, Mus musculus
acgacctgagttctcgcgtgggatc

SEQ ID NO: 370381 - DNA, 25 bp, Mus musculus
atccacgcgcgacgtccttcaggag

SEQ ID NO: 370382 - DNA, 25 bp, Mus musculus
ggcgccctggatgcactccttcagg

SEQ ID NO: 370383 - DNA, 25 bp, Mus musculus
cggagtccctttcggaaccagtgca

SEQ ID NO: 370384 - DNA, 25 bp, Mus musculus
tcggaaccagtgcacggcgttcacc

SEQ ID NO: 370385 - DNA, 25 bp, Mus musculus
ttcctctaccgagagcttcaaggga

SEQ ID NO: 370386 - DNA, 25 bp, Mus musculus
gggctcataaccgacacctgcgctt

SEQ ID NO: 370387 - DNA, 25 bp, Mus musculus
gcgtccggaggacacgcataccttc

SEQ ID NO: 370388 - DNA, 25 bp, Mus musculus
cacgcataccttccagggcctgaga

SEQ ID NO: 370389 - DNA, 25 bp, Mus musculus
ggaggctcgtcacggaaacctcgcc

SEQ ID NO: 370390 - DNA, 25 bp, Mus musculus
acgaacggacacgagctcacgcggc

SEQ ID NO: 370391 - DNA, 25 bp, Mus musculus
ccggcttctcattgggcggcatgca

SEQ ID NO: 370392 - DNA, 25 bp, Mus musculus
accggcacctcacgtttctgaagtg

SEQ ID NO: 370393 - DNA, 25 bp, Mus musculus
gtgtttactacactggctcagaccc

SEQ ID NO: 370394 - DNA, 25 bp, Mus musculus
ccttggagggttaggacaagaactg

SEQ ID NO: 370395 - DNA, 25 bp, Mus musculus
tgcgactacagcctttcagtggccc

SEQ ID NO: 370396 - DNA, 25 bp, Mus musculus
tcagttggtgcgactacagcctttc

SEQ ID NO: 370397 - DNA, 25 bp, Mus musculus
atggagaagaccagtcagttggtgc

SEQ ID NO: 370398 - DNA, 25 bp, Mus musculus
cgagaacgtcggagctccagaggat

SEQ ID NO: 370399 - DNA, 25 bp, Mus musculus
acaagaactgggtttatgtctccga

SEQ ID NO: 370400 - DNA, 25 bp, Mus musculus
acttctctgttagacgccagcgcgc

SEQ ID NO: 370401 - DNA, 25 bp, Mus musculus
cagcggtagcaagagcagaagcagc

SEQ ID NO: 370402 - DNA, 25 bp, Mus musculus
cacgtgcttataccaggcgctggcg

SEQ ID NO: 370403 - DNA, 25 bp, Mus musculus
gggactcgccacgtgcttataccag

SEQ ID NO: 370404 - DNA, 25 bp, Mus musculus
cccactgtgtgatagcggggactcg

SEQ ID NO: 370405 - DNA, 25 bp, Mus musculus
gaggcacgacccactgtgtgatagc

SEQ ID NO: 370406 - DNA, 25 bp, Mus musculus
atgagcagcccggaggcacgaccca

SEQ ID NO: 370407 - DNA, 25 bp, Mus musculus
tatgtctccgagaacgagaacgtcg

SEQ ID NO: 370408 - DNA, 25 bp, Mus musculus
ttaaatgactggaaaggcttgagca

SEQ ID NO: 370409 - DNA, 25 bp, Mus musculus
gcgccatgcgatcaccgggcctcct

SEQ ID NO: 370410 - DNA, 25 bp, Mus musculus
cgtttccagagcttgcgtcggcgaa

SEQ ID NO: 370411 - DNA, 25 bp, Mus musculus
ggagagactccgcatttaaatgact

SEQ ID NO: 370412 - DNA, 25 bp, Mus musculus
cttgagcagcagtcatgagcgaatg

SEQ ID NO: 370413 - DNA, 25 bp, Mus musculus
taccggtgctctaccaagatgcggg

SEQ ID NO: 370414 - DNA, 25 bp, Mus musculus
agctctgtacaacaccaggcccggg

SEQ ID NO: 370415 - DNA, 25 bp, Mus musculus
agtcgcagtgcgcacttccgccagg

SEQ ID NO: 370416 - DNA, 25 bp, Mus musculus
ctctaccaagatgcgggtgctgtgc

SEQ ID NO: 370417 - DNA, 25 bp, Mus musculus
gccgctgcgatcacccggtgtgcta

SEQ ID NO: 370418 - DNA, 25 bp, Mus musculus
cacccggtgtgctaccggtgctcta

SEQ ID NO: 370419 - DNA, 25 bp, Mus musculus
gtgtgctaccggtgctctaccaaga

SEQ ID NO: 370420 - DNA, 25 bp, Mus musculus
tcatgagcgaatggcagctctgtac

SEQ ID NO: 370421 - DNA, 25 bp, Mus musculus
cgaaggcggagagactccgcattta

SEQ ID NO: 370422 - DNA, 25 bp, Mus musculus
agcgcacgtccagcagcaagaaggc

SEQ ID NO: 370423 - DNA, 25 bp, Mus musculus
tagacctagtacgacgccgaagcgg

SEQ ID NO: 370424 - DNA, 25 bp, Mus musculus
caggctcccgcatttccgttgaaga

SEQ ID NO: 370425 - DNA, 25 bp, Mus musculus
ttccgttgaagacgcagcgcagttc

SEQ ID NO: 370426 - DNA, 25 bp, Mus musculus
cgcagcgcagttctggaccactgtc

SEQ ID NO: 370427 - DNA, 25 bp, Mus musculus
ctggaccactgtcggagttcacgta

SEQ ID NO: 370428 - DNA, 25 bp, Mus musculus
tgtcggagttcacgtagccctcgtt

SEQ ID NO: 370429 - DNA, 25 bp, Mus musculus
ccctcgttgacaatcggtccgaaca

SEQ ID NO: 370430 - DNA, 25 bp, Mus musculus
ctcggacgctgctgatctgctgaaa

SEQ ID NO: 370431 - DNA, 25 bp, Mus musculus
tcacgtagccctcgttgacaatcgg

SEQ ID NO: 370432 - DNA, 25 bp, Mus musculus
tccagtagcacagcccggcgacggt

SEQ ID NO: 370433 - DNA, 25 bp, Mus musculus
tgagaagcccaggtccagtagcaca

SEQ ID NO: 370434 - DNA, 25 bp, Mus musculus
tcaggcatcaggtcccgcaccagca

SEQ ID NO: 370435 - DNA, 25 bp, Mus musculus
tgctgatctgctgaaagcgcacgtc

SEQ ID NO: 370436 - DNA, 25 bp, Mus musculus
gctcacgggatcaaaggcagctccc

SEQ ID NO: 370437 - DNA, 25 bp, Mus musculus
tgaggctgctgatgctgtggatgct

SEQ ID NO: 370438 - DNA, 25 bp, Mus musculus
agaccgcccggggatgaagctgagg

SEQ ID NO: 370439 - DNA, 25 bp, Mus musculus
gggcactttgccttctgtccgtttg

SEQ ID NO: 370440 - DNA, 25 bp, Mus musculus
attgcgggcactttgccttctgtcc

SEQ ID NO: 370441 - DNA, 25 bp, Mus musculus
tccattgcgggcactttgccttctg

SEQ ID NO: 370442 - DNA, 25 bp, Mus musculus
tgctccctccattgcgggcactttg

SEQ ID NO: 370443 - DNA, 25 bp, Mus musculus
cacggcccgcgccaaaggatgctcc

SEQ ID NO: 370444 - DNA, 25 bp, Mus musculus
caaagctcacgggatcaaaggcagc

SEQ ID NO: 370445 - DNA, 25 bp, Mus musculus
cgcgcaaagctcacgggatcaaagg

SEQ ID NO: 370446 - DNA, 25 bp, Mus musculus
cgccgcgcaaagctcacgggatcaa

SEQ ID NO: 370447 - DNA, 25 bp, Mus musculus
ggccgccgcgcaaagctcacgggat

SEQ ID NO: 370448 - DNA, 25 bp, Mus musculus
cgacccgcaacagggtctggggccg

SEQ ID NO: 370449 - DNA, 25 bp, Mus musculus
aggatgctccctccattgcgggcac

SEQ ID NO: 370450 - DNA, 25 bp, Mus musculus
gtcagtcaccaggtcgtcggtcatc

SEQ ID NO: 370451 - DNA, 25 bp, Mus musculus
tggtgtcgtctctatgccttgcgcc

SEQ ID NO: 370452 - DNA, 25 bp, Mus musculus
ttcctccggcagatgtgaagtgtgt

SEQ ID NO: 370453 - DNA, 25 bp, Mus musculus
gtgctccaaaccttgcggcgccggg

SEQ ID NO: 370454 - DNA, 25 bp, Mus musculus
acgacttgaagtccacgcaggcccg

SEQ ID NO: 370455 - DNA, 25 bp, Mus musculus
tgggtccgcatccacgacttgaagt

SEQ ID NO: 370456 - DNA, 25 bp, Mus musculus
ctacacgcttctcggtgccttagca

SEQ ID NO: 370457 - DNA, 25 bp, Mus musculus
gggtcttcctgccttacgacgtgcc

SEQ ID NO: 370458 - DNA, 25 bp, Mus musculus
gcggcaaaatttggggtcttcctgc

SEQ ID NO: 370459 - DNA, 25 bp, Mus musculus
tcagacacctaagggcggcaaaatt

SEQ ID NO: 370460 - DNA, 25 bp, Mus musculus
actgagatgagttccgagatgcttc

SEQ ID NO: 370461 - DNA, 25 bp, Mus musculus
gctgtgctgagatcttggactgaga

SEQ ID NO: 370462 - DNA, 25 bp, Mus musculus
atctgcaccttctgctgggtccgca

SEQ ID NO: 370463 - DNA, 25 bp, Mus musculus
ctctgcgggtactcttgcgcctggt

SEQ ID NO: 370464 - DNA, 25 bp, Mus musculus
ctctgtacttcaaggcacgcggtga

SEQ ID NO: 370465 - DNA, 25 bp, Mus musculus
ggccagtgtgctactctgtacttca

SEQ ID NO: 370466 - DNA, 25 bp, Mus musculus
gaaccggccagtgtgctactctgta

SEQ ID NO: 370467 - DNA, 25 bp, Mus musculus
tacttcaaggcacgcggtgatgacg

SEQ ID NO: 370468 - DNA, 25 bp, Mus musculus
gggcagcgcctccaagttcagcagc

SEQ ID NO: 370469 - DNA, 25 bp, Mus musculus
gcaactccttgacgccatcaacatg

SEQ ID NO: 370470 - DNA, 25 bp, Mus musculus
ctcctccgaggacttacttggcttt

SEQ ID NO: 370471 - DNA, 25 bp, Mus musculus
ccgaggacttacttggctttgaagc

SEQ ID NO: 370472 - DNA, 25 bp, Mus musculus
cttggctttgaagcggcacaatccc

SEQ ID NO: 370473 - DNA, 25 bp, Mus musculus
tgaagcggcacaatcccgccgcagt

SEQ ID NO: 370474 - DNA, 25 bp, Mus musculus
atgacgtcaggagccgcaactcctt

SEQ ID NO: 370475 - DNA, 25 bp, Mus musculus
gcagtctcggccatgtcccagggca

SEQ ID NO: 370476 - DNA, 25 bp, Mus musculus
cgccatcaacatgcgcgccgggaga

SEQ ID NO: 370477 - DNA, 25 bp, Mus musculus
atgtcccagggcagcgcctccaagt

SEQ ID NO: 370478 - DNA, 25 bp, Mus musculus
ctcgcgcttcttggagcactataaa

SEQ ID NO: 370479 - DNA, 25 bp, Mus musculus
ggcggcaacgtccatatccagggga

SEQ ID NO: 370480 - DNA, 25 bp, Mus musculus
ccaggggaacctgcgaaataaatga

SEQ ID NO: 370481 - DNA, 25 bp, Mus musculus
caagccaaagccgagggtgattttc

SEQ ID NO: 370482 - DNA, 25 bp, Mus musculus
gaacgcccatttactggatcaactg

SEQ ID NO: 370483 - DNA, 25 bp, Mus musculus
tcaactgcgtaagcctggagaagcc

SEQ ID NO: 370484 - DNA, 25 bp, Mus musculus
tgaggagcgacttacccgaacacgc

SEQ ID NO: 370485 - DNA, 25 bp, Mus musculus
tttatacgtccttccggctggtgta

SEQ ID NO: 370486 - DNA, 25 bp, Mus musculus
actataaattgtcccttccgcggcg

SEQ ID NO: 370487 - DNA, 25 bp, Mus musculus
ttcttcgggagaacacgtgagtcta

SEQ ID NO: 370488 - DNA, 25 bp, Mus musculus
ggacatccggacagacacagttttg

SEQ ID NO: 370489 - DNA, 25 bp, Mus musculus
cacagttttggcaggaccgcacagc

SEQ ID NO: 370490 - DNA, 25 bp, Mus musculus
accgcacagcctagcgttctgctga

SEQ ID NO: 370491 - DNA, 25 bp, Mus musculus
cgcgggcgcgagtatttatacgtcc

SEQ ID NO: 370492 - DNA, 25 bp, Mus musculus
aaagacaaaaatccgtggtgccgcg

SEQ ID NO: 370493 - DNA, 25 bp, Mus musculus
cgcaccctttctaaggcctgtgttg

SEQ ID NO: 370494 - DNA, 25 bp, Mus musculus
cgcggcgcagtgaccaatcaagaaa

SEQ ID NO: 370495 - DNA, 25 bp, Mus musculus
gcctctgcgcgcctagaaaaaggta

SEQ ID NO: 370496 - DNA, 25 bp, Mus musculus
gcgagtcatcgggtccctccgagac

SEQ ID NO: 370497 - DNA, 25 bp, Mus musculus
agaccgcgcgaccttagtgtctgtg

SEQ ID NO: 370498 - DNA, 25 bp, Mus musculus
gtgtctgtgcaggactaccgccctc

SEQ ID NO: 370499 - DNA, 25 bp, Mus musculus
tacctgccggcgcaatgactctggc

SEQ ID NO: 370500 - DNA, 25 bp, Mus musculus
tcgcggtggactccgccggctacag

SEQ ID NO: 370501 - DNA, 25 bp, Mus musculus
tgcgccctaacccagcggcagtgag

SEQ ID NO: 370502 - DNA, 25 bp, Mus musculus
ccacctactagggtgtcgcaggcgc

SEQ ID NO: 370503 - DNA, 25 bp, Mus musculus
ccagctctggtttgttggagttgga

SEQ ID NO: 370504 - DNA, 25 bp, Mus musculus
ttggagttggaacgctgctgcctct

SEQ ID NO: 370505 - DNA, 25 bp, Mus musculus
aatgactctggcagcccggacggct

SEQ ID NO: 370506 - DNA, 25 bp, Mus musculus
tctacgcctgcgcagaaaggtgaca

SEQ ID NO: 370507 - DNA, 25 bp, Mus musculus
ggcgaaattctagaccctgtacctc

SEQ ID NO: 370508 - DNA, 25 bp, Mus musculus
ctgtacctctcacgagggtcacggg

SEQ ID NO: 370509 - DNA, 25 bp, Mus musculus
tcacgggccagtccacgacgaggtc

SEQ ID NO: 370510 - DNA, 25 bp, Mus musculus
cgacgaggtcgtaggccttcgtcaa

SEQ ID NO: 370511 - DNA, 25 bp, Mus musculus
cttcgtcaagtaggtgatggggtta

SEQ ID NO: 370512 - DNA, 25 bp, Mus musculus
ccgggtacacatccttgtcccaaga

SEQ ID NO: 370513 - DNA, 25 bp, Mus musculus
tgtcccaagaatctggcatggctta

SEQ ID NO: 370514 - DNA, 25 bp, Mus musculus
tggcatggcttaagcaaactctccc

SEQ ID NO: 370515 - DNA, 25 bp, Mus musculus
accatgggatagtggttcgcctctc

SEQ ID NO: 370516 - DNA, 25 bp, Mus musculus
gcccgctaaggacgcgggacctcta

SEQ ID NO: 370517 - DNA, 25 bp, Mus musculus
cagccgcgaggcaccatgggatagt

SEQ ID NO: 370518 - DNA, 25 bp, Mus musculus
ggatctccactaagcgggcgaaatt

SEQ ID NO: 370519 - DNA, 25 bp, Mus musculus
gtccggatccgctgggcccgctaag

SEQ ID NO: 370520 - DNA, 25 bp, Mus musculus
ccttcctgcacaggcgattcctgga

SEQ ID NO: 370521 - DNA, 25 bp, Mus musculus
cactatagccgggatgcgcacctgt

SEQ ID NO: 370522 - DNA, 25 bp, Mus musculus
aagttagctggagtcgctagtccca

SEQ ID NO: 370523 - DNA, 25 bp, Mus musculus
tcctggtcgctctggaagttagctg

SEQ ID NO: 370524 - DNA, 25 bp, Mus musculus
ctttggagccaagcgaaccggagac

SEQ ID NO: 370525 - DNA, 25 bp, Mus musculus
cgcgccacgcattcccgtagtgtaa

SEQ ID NO: 370526 - DNA, 25 bp, Mus musculus
gggattcccactcgcccagtcttgt

SEQ ID NO: 370527 - DNA, 25 bp, Mus musculus
acacggtgtcctccggtgatgaggc

SEQ ID NO: 370528 - DNA, 25 bp, Mus musculus
gcgctttcctcaggcgctcattgtg

SEQ ID NO: 370529 - DNA, 25 bp, Mus musculus
ctggcgctcgtagttctgttgctaa

SEQ ID NO: 370530 - DNA, 25 bp, Mus musculus
tgtatgcctggctccatccttcctg

SEQ ID NO: 370531 - DNA, 25 bp, Mus musculus
ccaaaggggcagagatagactttta

SEQ ID NO: 370532 - DNA, 25 bp, Mus musculus
ttcgacaggtgctatgatcgcggcc

SEQ ID NO: 370533 - DNA, 25 bp, Mus musculus
ctgcggagctcaacccagaagccgg

SEQ ID NO: 370534 - DNA, 25 bp, Mus musculus
tgtgctgttctgactctcacccggc

SEQ ID NO: 370535 - DNA, 25 bp, Mus musculus
gagaggaccagacacttttattttg

SEQ ID NO: 370536 - DNA, 25 bp, Mus musculus
agagtgccatggagatcgtactgtc

SEQ ID NO: 370537 - DNA, 25 bp, Mus musculus
agatgacttcaggttccgccgtgta

SEQ ID NO: 370538 - DNA, 25 bp, Mus musculus
agtagtgacacttgctggcaacgcc

SEQ ID NO: 370539 - DNA, 25 bp, Mus musculus
taagaagcctgtggtgcgaacgctg

SEQ ID NO: 370540 - DNA, 25 bp, Mus musculus
aagatctgacgctggactcgggtta

SEQ ID NO: 370541 - DNA, 25 bp, Mus musculus
tgcgcttcgccaagtgcaccaagta

SEQ ID NO: 370542 - DNA, 25 bp, Mus musculus
gactctgtgcgctcctccaacttgt

SEQ ID NO: 370543 - DNA, 25 bp, Mus musculus
gctggccaagctctcgatgctggta

SEQ ID NO: 370544 - DNA, 25 bp, Mus musculus
ggccgcctttagctgactccatgca

SEQ ID NO: 370545 - DNA, 25 bp, Mus musculus
atgcacagccggcacaacagctttg

SEQ ID NO: 370546 - DNA, 25 bp, Mus musculus
ccgggctctagtgcgcatcgctaaa

SEQ ID NO: 370547 - DNA, 25 bp, Mus musculus
accaagtacgagatccagagtgcca

SEQ ID NO: 370548 - DNA, 25 bp, Mus musculus
tccaaggaatgggtagtgcctctcc

SEQ ID NO: 370549 - DNA, 25 bp, Mus musculus
tccaccacctgagtccttaacaaag

SEQ ID NO: 370550 - DNA, 25 bp, Mus musculus
ggtgagccgcgacccagactgcctg

SEQ ID NO: 370551 - DNA, 25 bp, Mus musculus
ctgggtcagtacctacggccgactt

SEQ ID NO: 370552 - DNA, 25 bp, Mus musculus
gaccgcgctccggttctgagagctg

SEQ ID NO: 370553 - DNA, 25 bp, Mus musculus
agactgcctgtttcggcatccggcc

SEQ ID NO: 370554 - DNA, 25 bp, Mus musculus
caaagttctccagtccaaggaatgg

SEQ ID NO: 370555 - DNA, 25 bp, Mus musculus
ccctaaccgtgaacacgtgcgtgag

SEQ ID NO: 370556 - DNA, 25 bp, Mus musculus
tgaacacgtgcgtgagacccgcggc

SEQ ID NO: 370557 - DNA, 25 bp, Mus musculus
ccataggggcggagtccacaagcgc

SEQ ID NO: 370558 - DNA, 25 bp, Mus musculus
ctcgagctaacggtcggggactcca

SEQ ID NO: 370559 - DNA, 25 bp, Mus musculus
aaggcctagagcgtgaccggcgtca

SEQ ID NO: 370560 - DNA, 25 bp, Mus musculus
gaagtatccggtgagccgcgaccca

SEQ ID NO: 370561 - DNA, 25 bp, Mus musculus
gagtccttaacaaagttctccagtc

SEQ ID NO: 370562 - DNA, 25 bp, Mus musculus
tgacgtgatctgcatagttcctccc

SEQ ID NO: 370563 - DNA, 25 bp, Mus musculus
ctcccagaaacgagacagcggtttg

SEQ ID NO: 370564 - DNA, 25 bp, Mus musculus
cagcggtttggtggaagccatagta

SEQ ID NO: 370565 - DNA, 25 bp, Mus musculus
gctgaggtcagcgaaaggtctctgc

SEQ ID NO: 370566 - DNA, 25 bp, Mus musculus
accgagtctacaggccaaggctgct

SEQ ID NO: 370567 - DNA, 25 bp, Mus musculus
ctagggcagctagggaacattttgg

SEQ ID NO: 370568 - DNA, 25 bp, Mus musculus
ggcaggagctactactgattggcta

SEQ ID NO: 370569 - DNA, 25 bp, Mus musculus
acaggcactggttggctgtgaactc

SEQ ID NO: 370570 - DNA, 25 bp, Mus musculus
ctctatgggcggtcactgatggatt

SEQ ID NO: 370571 - DNA, 25 bp, Mus musculus
ggtgctgcgcatctctttgacgtga

SEQ ID NO: 370572 - DNA, 25 bp, Mus musculus
ttgcagtcgccaacgccagtgttga

SEQ ID NO: 370573 - DNA, 25 bp, Mus musculus
gagcccttgctgtttccaggcgcag

SEQ ID NO: 370574 - DNA, 25 bp, Mus musculus
ttgcggcagtaagcgggcattaaca

SEQ ID NO: 370575 - DNA, 25 bp, Mus musculus
cattaacaccggtgagccctcggga

SEQ ID NO: 370576 - DNA, 25 bp, Mus musculus
acccaactgctgtggagtgctgtgc

SEQ ID NO: 370577 - DNA, 25 bp, Mus musculus
actgtgtgttcttatacggcgctca

SEQ ID NO: 370578 - DNA, 25 bp, Mus musculus
gggacatctctggttcattcattgg

SEQ ID NO: 370579 - DNA, 25 bp, Mus musculus
agcctttggcgagggaagcaacctt

SEQ ID NO: 370580 - DNA, 25 bp, Mus musculus
tgcaagcctcttgacagcagtcctg

SEQ ID NO: 370581 - DNA, 25 bp, Mus musculus
gaccgctctagcgagggccaataga

SEQ ID NO: 370582 - DNA, 25 bp, Mus musculus
acgggcacggacacacttccttata

SEQ ID NO: 370583 - DNA, 25 bp, Mus musculus
aactgatgatgacgccacgggcacg

SEQ ID NO: 370584 - DNA, 25 bp, Mus musculus
aggtcccgatcctggcaactgatga

SEQ ID NO: 370585 - DNA, 25 bp, Mus musculus
tttcgcagcctttgaaccaatggtg

SEQ ID NO: 370586 - DNA, 25 bp, Mus musculus
ctactagttgcttttcgcggctctc

SEQ ID NO: 370587 - DNA, 25 bp, Mus musculus
gcagcctccattccgctactagttg

SEQ ID NO: 370588 - DNA, 25 bp, Mus musculus
gcggttcgccttcagactttcccaa

SEQ ID NO: 370589 - DNA, 25 bp, Mus musculus
cgcgacactcggctagctcagtaaa

SEQ ID NO: 370590 - DNA, 25 bp, Mus musculus
catggcgcggaagaaagtaagaccc

SEQ ID NO: 370591 - DNA, 25 bp, Mus musculus
cggggacaccttcaccgtctgagtc

SEQ ID NO: 370592 - DNA, 25 bp, Mus musculus
ttcctgtggagtaaggacactgaca

SEQ ID NO: 370593 - DNA, 25 bp, Mus musculus
gctcctgaagcgcagatttcctgtg

SEQ ID NO: 370594 - DNA, 25 bp, Mus musculus
cttccggaacgggagagctcctgaa

SEQ ID NO: 370595 - DNA, 25 bp, Mus musculus
tgcttttgttcaggacaccggccgc

SEQ ID NO: 370596 - DNA, 25 bp, Mus musculus
ggacgtacccggatgcttttgttca

SEQ ID NO: 370597 - DNA, 25 bp, Mus musculus
ctagactacgagacgctgacccggc

SEQ ID NO: 370598 - DNA, 25 bp, Mus musculus
ttcgttcctgaagcttccggacgta

SEQ ID NO: 370599 - DNA, 25 bp, Mus musculus
tccgccataagtccttcgttcctga

SEQ ID NO: 370600 - DNA, 25 bp, Mus musculus
gagaccgtgactctcccgggaccaa

SEQ ID NO: 370601 - DNA, 25 bp, Mus musculus
gcgagattcgcagctctacgcccta

SEQ ID NO: 370602 - DNA, 25 bp, Mus musculus
ccgtctgagtcggaaatctcccagg

SEQ ID NO: 370603 - DNA, 25 bp, Mus musculus
aatctcccaggtttgaggtcgccga

SEQ ID NO: 370604 - DNA, 25 bp, Mus musculus
cctgaacctggagaggactcgaatg

SEQ ID NO: 370605 - DNA, 25 bp, Mus musculus
tcctgaacctggagaggactcgaat

SEQ ID NO: 370606 - DNA, 25 bp, Mus musculus
ctcctgaacctggagaggactcgaa

SEQ ID NO: 370607 - DNA, 25 bp, Mus musculus
cgctcctgaacctggagaggactcg

SEQ ID NO: 370608 - DNA, 25 bp, Mus musculus
ccgctcctgaacctggagaggactc

SEQ ID NO: 370609 - DNA, 25 bp, Mus musculus
gccgctcctgaacctggagaggact

SEQ ID NO: 370610 - DNA, 25 bp, Mus musculus
agccgctcctgaacctggagaggac

SEQ ID NO: 370611 - DNA, 25 bp, Mus musculus
gtccaggagccgctcctgaacctgg

SEQ ID NO: 370612 - DNA, 25 bp, Mus musculus
aggagccgctcctgaacctggagag

SEQ ID NO: 370613 - DNA, 25 bp, Mus musculus
ggagccgctcctgaacctggagagg

SEQ ID NO: 370614 - DNA, 25 bp, Mus musculus
gagccgctcctgaacctggagagga

SEQ ID NO: 370615 - DNA, 25 bp, Mus musculus
gctcctgaacctggagaggactcga

SEQ ID NO: 370616 - DNA, 25 bp, Mus musculus
ctgaacctggagaggactcgaatgc

SEQ ID NO: 370617 - DNA, 25 bp, Mus musculus
tgaacctggagaggactcgaatgcg

SEQ ID NO: 370618 - DNA, 25 bp, Mus musculus
gagccatgatcctcgctgaacggca

SEQ ID NO: 370619 - DNA, 25 bp, Mus musculus
ggataccagcgtccaggagccgctc

SEQ ID NO: 370620 - DNA, 25 bp, Mus musculus
gtacccaagcacgaggaggaggcct

SEQ ID NO: 370621 - DNA, 25 bp, Mus musculus
cgaggaggaggccttcactgcgttc

SEQ ID NO: 370622 - DNA, 25 bp, Mus musculus
cttcactgcgttcactgcgaaacca

SEQ ID NO: 370623 - DNA, 25 bp, Mus musculus
gctgaacggcagaaaaacggggata

SEQ ID NO: 370624 - DNA, 25 bp, Mus musculus
aaacggggataccagcgtccaggag

SEQ ID NO: 370625 - DNA, 25 bp, Mus musculus
tatccacctctgctgcgagccatga

SEQ ID NO: 370626 - DNA, 25 bp, Mus musculus
cgaaaccagaggacagattgaattc

SEQ ID NO: 370627 - DNA, 25 bp, Mus musculus
tcgggaaatcgagcaagtcatgtac

SEQ ID NO: 370628 - DNA, 25 bp, Mus musculus
tcgagcaagtcatgtaccacgattg

SEQ ID NO: 370629 - DNA, 25 bp, Mus musculus
gcgttcactgcgaaaccagaggaca

SEQ ID NO: 370630 - DNA, 25 bp, Mus musculus
agtcatgtaccacgattggcgtttg

SEQ ID NO: 370631 - DNA, 25 bp, Mus musculus
cacgattggcgtttggtacccaagc

SEQ ID NO: 370632 - DNA, 25 bp, Mus musculus
cgtcgctttgagaggaagggcttca

SEQ ID NO: 370633 - DNA, 25 bp, Mus musculus
ataggtcgctactcctccccgtagg

SEQ ID NO: 370634 - DNA, 25 bp, Mus musculus
aacgagcgcacgttcttggcagtga

SEQ ID NO: 370635 - DNA, 25 bp, Mus musculus
agctactgcgggagcattatgtcga

SEQ ID NO: 370636 - DNA, 25 bp, Mus musculus
ccgaagagctactgcgggagcatta

SEQ ID NO: 370637 - DNA, 25 bp, Mus musculus
ccgtaggcctccgaagagctactgc

SEQ ID NO: 370638 - DNA, 25 bp, Mus musculus
cctacagcggcgtgaacgagcgcac

SEQ ID NO: 370639 - DNA, 25 bp, Mus musculus
ctgcgggagcattatgtcgagctgc

SEQ ID NO: 370640 - DNA, 25 bp, Mus musculus
ggccctggtataggtcgctactcct

SEQ ID NO: 370641 - DNA, 25 bp, Mus musculus
ggcgcacaaaggagcaggtggatcc

SEQ ID NO: 370642 - DNA, 25 bp, Mus musculus
agctagtgcaggtgtgggcgcacaa

SEQ ID NO: 370643 - DNA, 25 bp, Mus musculus
agcgcacgttcttggcagtgaagcc

SEQ ID NO: 370644 - DNA, 25 bp, Mus musculus
cttcaagctggtggcactgaagcta

SEQ ID NO: 370645 - DNA, 25 bp, Mus musculus
agctggtggcactgaagctagtgca

SEQ ID NO: 370646 - DNA, 25 bp, Mus musculus
gaccacctcctcgtcatagcagtga

SEQ ID NO: 370647 - DNA, 25 bp, Mus musculus
cgctaaaggaacgtttccggctgcg

SEQ ID NO: 370648 - DNA, 25 bp, Mus musculus
attgcgtgagcagctgctcgttgtc

SEQ ID NO: 370649 - DNA, 25 bp, Mus musculus
ttgtcctcgcgtaggagctccagct

SEQ ID NO: 370650 - DNA, 25 bp, Mus musculus
tcgtgctcctggttctcgctcagca

SEQ ID NO: 370651 - DNA, 25 bp, Mus musculus
tcgctcagcaccgagtcaaggttct

SEQ ID NO: 370652 - DNA, 25 bp, Mus musculus
agcacgttcaccaccagcggcatga

SEQ ID NO: 370653 - DNA, 25 bp, Mus musculus
agcagtgaatgaggcgctcgaactc

SEQ ID NO: 370654 - DNA, 25 bp, Mus musculus
accgagcccgagcagtagtcgtctt

SEQ ID NO: 370655 - DNA, 25 bp, Mus musculus
cagtagtcgtcttggtacaccacca

SEQ ID NO: 370656 - DNA, 25 bp, Mus musculus
tctggatctccatcatcgcggctac

SEQ ID NO: 370657 - DNA, 25 bp, Mus musculus
cccgagcgccttgacgctaaaggaa

SEQ ID NO: 370658 - DNA, 25 bp, Mus musculus
gccttctcgcgctcgtattgcgtga

SEQ ID NO: 370659 - DNA, 25 bp, Mus musculus
gagtcaaggttctccagcacgttca

SEQ ID NO: 370660 - DNA, 25 bp, Mus musculus
gcaaacagctcggagcgcccggcta

SEQ ID NO: 370661 - DNA, 25 bp, Mus musculus
cgtgggcattggttcacagctcgcc

SEQ ID NO: 370662 - DNA, 25 bp, Mus musculus
catcgcgcttacagccgattggctg

SEQ ID NO: 370663 - DNA, 25 bp, Mus musculus
ctgcagcctatcgtagagtcgtgcc

SEQ ID NO: 370664 - DNA, 25 bp, Mus musculus
gcgccaatcatgtctctgcagccta

SEQ ID NO: 370665 - DNA, 25 bp, Mus musculus
agttggacgcctctcgcgccaatca

SEQ ID NO: 370666 - DNA, 25 bp, Mus musculus
gagcgcgcacagtatcctcagggga

SEQ ID NO: 370667 - DNA, 25 bp, Mus musculus
ggaacccgacttgccagcttggctg

SEQ ID NO: 370668 - DNA, 25 bp, Mus musculus
agccttcctgcaaggccctgcggga

SEQ ID NO: 370669 - DNA, 25 bp, Mus musculus
agagccacgtgtcttaatcccgccg

SEQ ID NO: 370670 - DNA, 25 bp, Mus musculus
gcaagcacttcaggagagccacgtg

SEQ ID NO: 370671 - DNA, 25 bp, Mus musculus
agcgtctgtcctgagcaagcacttc

SEQ ID NO: 370672 - DNA, 25 bp, Mus musculus
gcctccgcatgcgaatccgcatttt

SEQ ID NO: 370673 - DNA, 25 bp, Mus musculus
ctgtccgcgccctggaacatgtcgg

SEQ ID NO: 370674 - DNA, 25 bp, Mus musculus
tggtccaggctaggctaggcgccct

SEQ ID NO: 370675 - DNA, 25 bp, Mus musculus
acagtccctcctttgctctgtcggc

SEQ ID NO: 370676 - DNA, 25 bp, Mus musculus
tgtgcagacagaaaaatcccttcta

SEQ ID NO: 370677 - DNA, 25 bp, Mus musculus
ccttctccttaattgtgcagacaga

SEQ ID NO: 370678 - DNA, 25 bp, Mus musculus
atcagaaggcgtttggctcggagcc

SEQ ID NO: 370679 - DNA, 25 bp, Mus musculus
cactccgcaggaggtgagtggtcca

SEQ ID NO: 370680 - DNA, 25 bp, Mus musculus
cgtgtgtaaaatcagaaggcgtttg

SEQ ID NO: 370681 - DNA, 25 bp, Mus musculus
cgggcgtgcgtgtgtaaaatcagaa

SEQ ID NO: 370682 - DNA, 25 bp, Mus musculus
ttcgccttttgttcgggcgtgcgag

SEQ ID NO: 370683 - DNA, 25 bp, Mus musculus
tggctggctggttcgccttttgttc

SEQ ID NO: 370684 - DNA, 25 bp, Mus musculus
acagggccgccgctaaggccgctag

SEQ ID NO: 370685 - DNA, 25 bp, Mus musculus
cccgactgatattccgggtggcggc

SEQ ID NO: 370686 - DNA, 25 bp, Mus musculus
tcacgtggcgcggtcatgtgcccac

SEQ ID NO: 370687 - DNA, 25 bp, Mus musculus
agctcgcctgtcactccgcaggagg

SEQ ID NO: 370688 - DNA, 25 bp, Mus musculus
aacatggcggccgttgtttgttcca

SEQ ID NO: 370689 - DNA, 25 bp, Mus musculus
gatcaagccgcgcacctgcctattg

SEQ ID NO: 370690 - DNA, 25 bp, Mus musculus
tgacctggcctctgcgctttgggtc

SEQ ID NO: 370691 - DNA, 25 bp, Mus musculus
ccacggaaggcacggcagcatgacc

SEQ ID NO: 370692 - DNA, 25 bp, Mus musculus
caggtagaccaacacagcccggagc

SEQ ID NO: 370693 - DNA, 25 bp, Mus musculus
acagagtgctgagcccgaccggacc

SEQ ID NO: 370694 - DNA, 25 bp, Mus musculus
tccttcctgggcctcttgctctggg

SEQ ID NO: 370695 - DNA, 25 bp, Mus musculus
caggcagaagtttaccgccggcctc

SEQ ID NO: 370696 - DNA, 25 bp, Mus musculus
ttcactgtcatcctgcggcgagaga

SEQ ID NO: 370697 - DNA, 25 bp, Mus musculus
gggtctgcccgtccctctttgtgct

SEQ ID NO: 370698 - DNA, 25 bp, Mus musculus
accttaggaaatggtgctggtcctg

SEQ ID NO: 370699 - DNA, 25 bp, Mus musculus
aaagcacagggtgcgtccttcctgg

SEQ ID NO: 370700 - DNA, 25 bp, Mus musculus
gtcgcacgctggaccttaggaaatg

SEQ ID NO: 370701 - DNA, 25 bp, Mus musculus
cgcccgagggcccacagagtgctga

SEQ ID NO: 370702 - DNA, 25 bp, Mus musculus
ggagccctcgcagagcccaagtggc

SEQ ID NO: 370703 - DNA, 25 bp, Mus musculus
tgccttccacgtcacatccatgtgg

SEQ ID NO: 370704 - DNA, 25 bp, Mus musculus
ctgggcatttcggaagctgccttcc

SEQ ID NO: 370705 - DNA, 25 bp, Mus musculus
cgtgagtcacctgggcatttcggaa

SEQ ID NO: 370706 - DNA, 25 bp, Mus musculus
gcagagggcgctctaagccgtgccc

SEQ ID NO: 370707 - DNA, 25 bp, Mus musculus
attccagtcacgtgacccgcgtggc

SEQ ID NO: 370708 - DNA, 25 bp, Mus musculus
ggatttccgatggaaattccagtca

SEQ ID NO: 370709 - DNA, 25 bp, Mus musculus
tcagttgtatgctttgccaacaggg

SEQ ID NO: 370710 - DNA, 25 bp, Mus musculus
cccttttttgcctttcagttgtatg

SEQ ID NO: 370711 - DNA, 25 bp, Mus musculus
ctccggctccgaagactacagactg

SEQ ID NO: 370712 - DNA, 25 bp, Mus musculus
acgtcacatccatgtggaaatcgcg

SEQ ID NO: 370713 - DNA, 25 bp, Mus musculus
ctacagactgggcagttcccttttt

SEQ ID NO: 370714 - DNA, 25 bp, Mus musculus
gccggagcatcgctcacctcttggg

SEQ ID NO: 370715 - DNA, 25 bp, Mus musculus
gtgcacgtctttcggcggcctggct

SEQ ID NO: 370716 - DNA, 25 bp, Mus musculus
gcgtcttttccgattggccaaccga

SEQ ID NO: 370717 - DNA, 25 bp, Mus musculus
agacgagcacgtccagcttttctgc

SEQ ID NO: 370718 - DNA, 25 bp, Mus musculus
gcccttgcggatcatgcgtcttttc

SEQ ID NO: 370719 - DNA, 25 bp, Mus musculus
gggacgccgcgctctaaacagttcc

SEQ ID NO: 370720 - DNA, 25 bp, Mus musculus
ccgacagccaataggatcagcgtgc

SEQ ID NO: 370721 - DNA, 25 bp, Mus musculus
gtggggactttgcactttgaaaaca

SEQ ID NO: 370722 - DNA, 25 bp, Mus musculus
tgcagcggtctctcgaggcatcaac

SEQ ID NO: 370723 - DNA, 25 bp, Mus musculus
ccattggtcagcaggcgttacgtgc

SEQ ID NO: 370724 - DNA, 25 bp, Mus musculus
ggtgtccggtactcagaacgttcca

SEQ ID NO: 370725 - DNA, 25 bp, Mus musculus
agtatcccagtttgcaggaggtccc

SEQ ID NO: 370726 - DNA, 25 bp, Mus musculus
aagcctctgctgagtaccgcttgca

SEQ ID NO: 370727 - DNA, 25 bp, Mus musculus
actggctaaagtgcacacggtcacc

SEQ ID NO: 370728 - DNA, 25 bp, Mus musculus
tcgccgttggctaacactggctaaa

SEQ ID NO: 370729 - DNA, 25 bp, Mus musculus
tgctcttcagcgacactcgccgttg

SEQ ID NO: 370730 - DNA, 25 bp, Mus musculus
cacgtgaaacctgcacggatattta

SEQ ID NO: 370731 - DNA, 25 bp, Mus musculus
aagaggcgtggcctaagagcctacg

SEQ ID NO: 370732 - DNA, 25 bp, Mus musculus
ctgatgaccgcagcatctgcgcctg

SEQ ID NO: 370733 - DNA, 25 bp, Mus musculus
agcggcgcgccaacgcgctgatgac

SEQ ID NO: 370734 - DNA, 25 bp, Mus musculus
caaacgcgtggctagggacgaatca

SEQ ID NO: 370735 - DNA, 25 bp, Mus musculus
tggggctgatacaaacgcgtggcta

SEQ ID NO: 370736 - DNA, 25 bp, Mus musculus
cctgcacggatatttagaatttctg

SEQ ID NO: 370737 - DNA, 25 bp, Mus musculus
taagagcctacggtgggcaaggcct

SEQ ID NO: 370738 - DNA, 25 bp, Mus musculus
agtcgcagagctcacgtgaaacctg

SEQ ID NO: 370739 - DNA, 25 bp, Mus musculus
ctgtgaattcgagtcgcagagctca

SEQ ID NO: 370740 - DNA, 25 bp, Mus musculus
cagctgagggcagctgtgaattcga

SEQ ID NO: 370741 - DNA, 25 bp, Mus musculus
ccagattcagtgtcagctgagggca

SEQ ID NO: 370742 - DNA, 25 bp, Mus musculus
aggaccacgcgccagattcagtgtc

SEQ ID NO: 370743 - DNA, 25 bp, Mus musculus
tttagaatttctggggctgatacaa

SEQ ID NO: 370744 - DNA, 25 bp, Mus musculus
gatcttgccggcctccgtcgtcagt

SEQ ID NO: 370745 - DNA, 25 bp, Mus musculus
cgccactgcttcgaaggacagggca

SEQ ID NO: 370746 - DNA, 25 bp, Mus musculus
ttggtccggccgagatcgcgatgat

SEQ ID NO: 370747 - DNA, 25 bp, Mus musculus
tctaagaaagtgtcttggtccggcc

SEQ ID NO: 370748 - DNA, 25 bp, Mus musculus
ggccatggccaacgtctctaagaaa

SEQ ID NO: 370749 - DNA, 25 bp, Mus musculus
cgtcgtcagtcacgtgggcaccgat

SEQ ID NO: 370750 - DNA, 25 bp, Mus musculus
tcctcagtgggccatggccaacgtc

SEQ ID NO: 370751 - DNA, 25 bp, Mus musculus
gttgagtttggtcctcagtgggcca

SEQ ID NO: 370752 - DNA, 25 bp, Mus musculus
ccggctgttcttgttgagtttggtc

SEQ ID NO: 370753 - DNA, 25 bp, Mus musculus
aatgctgccggtctgccggctgttc

SEQ ID NO: 370754 - DNA, 25 bp, Mus musculus
gtcacgggaatgctgccggtctgcc

SEQ ID NO: 370755 - DNA, 25 bp, Mus musculus
atagatcacgtgagacctgggcgcg

SEQ ID NO: 370756 - DNA, 25 bp, Mus musculus
gtcacgtgggcaccgatgatagatc

SEQ ID NO: 370757 - DNA, 25 bp, Mus musculus
ccgatgatagatcacgtgagacctg

SEQ ID NO: 370758 - DNA, 25 bp, Mus musculus
cgatccaattttccggcagcaaagc

SEQ ID NO: 370759 - DNA, 25 bp, Mus musculus
cctcacactcgtggctctggttgta

SEQ ID NO: 370760 - DNA, 25 bp, Mus musculus
aggcagccgtcctttcgttgttgaa

SEQ ID NO: 370761 - DNA, 25 bp, Mus musculus
gcatcatttccgttgcgccgctgga

SEQ ID NO: 370762 - DNA, 25 bp, Mus musculus
cccgtaagtcgtccagatagtgatc

SEQ ID NO: 370763 - DNA, 25 bp, Mus musculus
cgccggatcaggtctcaatggaagg

SEQ ID NO: 370764 - DNA, 25 bp, Mus musculus
cggagaaccgagtctgcttcacttt

SEQ ID NO: 370765 - DNA, 25 bp, Mus musculus
ctcgggccaagctcttcggagaacc

SEQ ID NO: 370766 - DNA, 25 bp, Mus musculus
gtccttgggcatcacactaaacagc

SEQ ID NO: 370767 - DNA, 25 bp, Mus musculus
gatgccacgggttctcaagtccttg

SEQ ID NO: 370768 - DNA, 25 bp, Mus musculus
gctaagactggaagatgcgctcatg

SEQ ID NO: 370769 - DNA, 25 bp, Mus musculus
tgtctctcttccagagcggtccggg

SEQ ID NO: 370770 - DNA, 25 bp, Mus musculus
gtcgaggtcgctatgaacagtgtcc

SEQ ID NO: 370771 - DNA, 25 bp, Mus musculus
gccgctggacccacgttttgtagtc

SEQ ID NO: 370772 - DNA, 25 bp, Mus musculus
tgggccggcagaacctgtgtgtcac

SEQ ID NO: 370773 - DNA, 25 bp, Mus musculus
ccatctggaacctatgaaggtagtc

SEQ ID NO: 370774 - DNA, 25 bp, Mus musculus
gtggcgcttgcagtccatctggaac

SEQ ID NO: 370775 - DNA, 25 bp, Mus musculus
cgcacctagagtccggtggccgctt

SEQ ID NO: 370776 - DNA, 25 bp, Mus musculus
tcgagcagtcgctgcctgaggttga

SEQ ID NO: 370777 - DNA, 25 bp, Mus musculus
acggccatccggactcgagcagtcg

SEQ ID NO: 370778 - DNA, 25 bp, Mus musculus
acagcgcctgcgttcgtagctcagg

SEQ ID NO: 370779 - DNA, 25 bp, Mus musculus
ggacttgctcctggtctccggcgac

SEQ ID NO: 370780 - DNA, 25 bp, Mus musculus
gcagcgcccagggttttcggtgacc

SEQ ID NO: 370781 - DNA, 25 bp, Mus musculus
ccactacaggtcagtgcctgggctg

SEQ ID NO: 370782 - DNA, 25 bp, Mus musculus
gacagagaaaccaacccactacagg

SEQ ID NO: 370783 - DNA, 25 bp, Mus musculus
gcgcgctgcattgttttgactgaaa

SEQ ID NO: 370784 - DNA, 25 bp, Mus musculus
ccttgcgcctgtaacttgctgccgt

SEQ ID NO: 370785 - DNA, 25 bp, Mus musculus
tttgactgaaaatgccgtcggtttc

SEQ ID NO: 370786 - DNA, 25 bp, Mus musculus
acgctggagctgaggatttcatctc

SEQ ID NO: 370787 - DNA, 25 bp, Mus musculus
acgcgcgcacgctcttgaacaaacg

SEQ ID NO: 370788 - DNA, 25 bp, Mus musculus
tcaaaaccggaagctgtgcgagcgc

SEQ ID NO: 370789 - DNA, 25 bp, Mus musculus
tcacgtgagtgacagccggaactga

SEQ ID NO: 370790 - DNA, 25 bp, Mus musculus
cgccattgctcctagggtctcacgg

SEQ ID NO: 370791 - DNA, 25 bp, Mus musculus
gcaacatcaggaagccagccagccg

SEQ ID NO: 370792 - DNA, 25 bp, Mus musculus
gtgatccgctcacccgaatgtgtta

SEQ ID NO: 370793 - DNA, 25 bp, Mus musculus
tccaggaaagagagcggtcgtgttc

SEQ ID NO: 370794 - DNA, 25 bp, Mus musculus
cacccgaatgtgttaggctcctcca

SEQ ID NO: 370795 - DNA, 25 bp, Mus musculus
ccgctctctggatgctttcgctgaa

SEQ ID NO: 370796 - DNA, 25 bp, Mus musculus
tctctccttgtagcatccgtgcagc

SEQ ID NO: 370797 - DNA, 25 bp, Mus musculus
tgccttgtgccttggctatgtggga

SEQ ID NO: 370798 - DNA, 25 bp, Mus musculus
aagaaagttgctcgcggatccagga

SEQ ID NO: 370799 - DNA, 25 bp, Mus musculus
tcatctaacattatgggccgcaaga

SEQ ID NO: 370800 - DNA, 25 bp, Mus musculus
agcaggttaagcctcgacggcagtc

SEQ ID NO: 370801 - DNA, 25 bp, Mus musculus
cctcgacggcagtctgacgacattg

SEQ ID NO: 370802 - DNA, 25 bp, Mus musculus
tgtctgtctgtgataaaaagcaggt

SEQ ID NO: 370803 - DNA, 25 bp, Mus musculus
tctgacgacattgggcaggagttac

SEQ ID NO: 370804 - DNA, 25 bp, Mus musculus
ttgggcaggagttacagcactcacc

SEQ ID NO: 370805 - DNA, 25 bp, Mus musculus
cagcactcaccgtggacagggcttc

SEQ ID NO: 370806 - DNA, 25 bp, Mus musculus
cgctggcgttgctgtcgcactagct

SEQ ID NO: 370807 - DNA, 25 bp, Mus musculus
tgtcgcactagctggggacaccgag

SEQ ID NO: 370808 - DNA, 25 bp, Mus musculus
tctctgagcacgcgcggcctcagtt

SEQ ID NO: 370809 - DNA, 25 bp, Mus musculus
agtttcccattgcctctgacgccag

SEQ ID NO: 370810 - DNA, 25 bp, Mus musculus
tgacgccagcaattcccgtgctcca

SEQ ID NO: 370811 - DNA, 25 bp, Mus musculus
tgctccacccggagcgtagtgcaga

SEQ ID NO: 370812 - DNA, 25 bp, Mus musculus
cacccggagcgtagtgcagaagcca

SEQ ID NO: 370813 - DNA, 25 bp, Mus musculus
tgtgataaaaagcaggttaagcctc

SEQ ID NO: 370814 - DNA, 25 bp, Mus musculus
agcgtctgcaaactcctcttcggga

SEQ ID NO: 370815 - DNA, 25 bp, Mus musculus
ctgaggcctaaacatcctgggaatc

SEQ ID NO: 370816 - DNA, 25 bp, Mus musculus
gagtcccgggagcaaagatcactga

SEQ ID NO: 370817 - DNA, 25 bp, Mus musculus
gctctggaggtatccttgggctcaa

SEQ ID NO: 370818 - DNA, 25 bp, Mus musculus
agcgcgtccactcgaggacacatca

SEQ ID NO: 370819 - DNA, 25 bp, Mus musculus
ctgaacggccgcactcttaaagggg

SEQ ID NO: 370820 - DNA, 25 bp, Mus musculus
tacttaaacacgagcttcccgcagc

SEQ ID NO: 370821 - DNA, 25 bp, Mus musculus
ggtggcctacgcgtctacttaaaca

SEQ ID NO: 370822 - DNA, 25 bp, Mus musculus
gcgcctcccggaagctcactgggaa

SEQ ID NO: 370823 - DNA, 25 bp, Mus musculus
ctgtattctcccgtggcacagcggc

SEQ ID NO: 370824 - DNA, 25 bp, Mus musculus
tcagattatctgttgcggggtcggc

SEQ ID NO: 370825 - DNA, 25 bp, Mus musculus
tctgatgtgactccgggtgcttaca

SEQ ID NO: 370826 - DNA, 25 bp, Mus musculus
tctcggtaacgaacgaagccttctg

SEQ ID NO: 370827 - DNA, 25 bp, Mus musculus
ttcccaagggtcatccggatgctca

SEQ ID NO: 370828 - DNA, 25 bp, Mus musculus
tgcagactggtcctaggagccgaag

SEQ ID NO: 370829 - DNA, 25 bp, Mus musculus
taaccgcgaagagacggtgcagact

SEQ ID NO: 370830 - DNA, 25 bp, Mus musculus
ctggaagcgagtacagtgggaatcc

SEQ ID NO: 370831 - DNA, 25 bp, Mus musculus
actggagagacttgtaaaggcggct

SEQ ID NO: 370832 - DNA, 25 bp, Mus musculus
cccgcgatcgttctgaaactcgagg

SEQ ID NO: 370833 - DNA, 25 bp, Mus musculus
tctgaaactcgaggagacgctccgc

SEQ ID NO: 370834 - DNA, 25 bp, Mus musculus
cctcggccaattcgcggaagaagtg

SEQ ID NO: 370835 - DNA, 25 bp, Mus musculus
ctgatccggagtaggagctaaccgc

SEQ ID NO: 370836 - DNA, 25 bp, Mus musculus
gtcatcccgatcaaaaaagaagccc

SEQ ID NO: 370837 - DNA, 25 bp, Mus musculus
aggcccgcaggtgcaagttgaccag

SEQ ID NO: 370838 - DNA, 25 bp, Mus musculus
accaggcggttcacggcagcttcca

SEQ ID NO: 370839 - DNA, 25 bp, Mus musculus
ttccacctcggtggaataattctga

SEQ ID NO: 370840 - DNA, 25 bp, Mus musculus
cgaatctgagaggtcatggctgatc

SEQ ID NO: 370841 - DNA, 25 bp, Mus musculus
agaagtggcctacgccctccagagc

SEQ ID NO: 370842 - DNA, 25 bp, Mus musculus
aacgccagtggtaagtggctctgtc

SEQ ID NO: 370843 - DNA, 25 bp, Mus musculus
tcaacaacgactcggaaatctgggg

SEQ ID NO: 370844 - DNA, 25 bp, Mus musculus
ggggctcttgcagccctaccagcac

SEQ ID NO: 370845 - DNA, 25 bp, Mus musculus
taccagcacctcatctgtgggaaga

SEQ ID NO: 370846 - DNA, 25 bp, Mus musculus
cctcatctgtgggaagaacgccagt

SEQ ID NO: 370847 - DNA, 25 bp, Mus musculus
ccaaattcaccgtggagaccctgga

SEQ ID NO: 370848 - DNA, 25 bp, Mus musculus
acgaagcgcccaaattcaccgtgga

SEQ ID NO: 370849 - DNA, 25 bp, Mus musculus
cacggtcaacaacgactcggaaatc

SEQ ID NO: 370850 - DNA, 25 bp, Mus musculus
tggagcacacggtcaacaacgactc

SEQ ID NO: 370851 - DNA, 25 bp, Mus musculus
gtggctctgtcaactccgggttcaa

SEQ ID NO: 370852 - DNA, 25 bp, Mus musculus
tcaactccgggttcaagtttgcctc

SEQ ID NO: 370853 - DNA, 25 bp, Mus musculus
tctctctggccactcgcgctctcca

SEQ ID NO: 370854 - DNA, 25 bp, Mus musculus
tccgggttcaagtttgcctctcgtc

SEQ ID NO: 370855 - DNA, 25 bp, Mus musculus
tggagaccctggagcacacggtcaa

SEQ ID NO: 370856 - DNA, 25 bp, Mus musculus
cggtggcccaacgactcagcccgcc

SEQ ID NO: 370857 - DNA, 25 bp, Mus musculus
acgactcagcccgccgcaggggtgt

SEQ ID NO: 370858 - DNA, 25 bp, Mus musculus
aagctcctgggtgggtccctgagtt

SEQ ID NO: 370859 - DNA, 25 bp, Mus musculus
ctgagtttggtctgctgtcctcggc

SEQ ID NO: 370860 - DNA, 25 bp, Mus musculus
gagtttggtctgctgtcctcggcct

SEQ ID NO: 370861 - DNA, 25 bp, Mus musculus
tttggtctgctgtcctcggcctcat

SEQ ID NO: 370862 - DNA, 25 bp, Mus musculus
ggtctgctgtcctcggcctcatcat

SEQ ID NO: 370863 - DNA, 25 bp, Mus musculus
gctgtcctcggcctcatcatccgtg

SEQ ID NO: 370864 - DNA, 25 bp, Mus musculus
gtgcgcggcccaggctgttccagct

SEQ ID NO: 370865 - DNA, 25 bp, Mus musculus
ccctcaccagagagcagggactcgc

SEQ ID NO: 370866 - DNA, 25 bp, Mus musculus
gcccaacgactcagcccgccgcagg

SEQ ID NO: 370867 - DNA, 25 bp, Mus musculus
cccacactggctgcggcgtttgagg

SEQ ID NO: 370868 - DNA, 25 bp, Mus musculus
ctgcggcgtttgaggctgggtgcgc

SEQ ID NO: 370869 - DNA, 25 bp, Mus musculus
tcctcggcctcatcatccgtgctgc

SEQ ID NO: 370870 - DNA, 25 bp, Mus musculus
tgtggcccacatacttgaggagctc

SEQ ID NO: 370871 - DNA, 25 bp, Mus musculus
aacctttcggaagatgtggcccaca

SEQ ID NO: 370872 - DNA, 25 bp, Mus musculus
ttgaggagctcctcgtagcagctgc

SEQ ID NO: 370873 - DNA, 25 bp, Mus musculus
aggcgcaggctccggcgtttaacct

SEQ ID NO: 370874 - DNA, 25 bp, Mus musculus
aacggctctgccagcgggcgtaaag

SEQ ID NO: 370875 - DNA, 25 bp, Mus musculus
tgggatctaccttcttacgccaacg

SEQ ID NO: 370876 - DNA, 25 bp, Mus musculus
ctgtcgttggacagatagcgggccc

SEQ ID NO: 370877 - DNA, 25 bp, Mus musculus
ttacgccaacggctctgccagcggg

SEQ ID NO: 370878 - DNA, 25 bp, Mus musculus
agtgctgctgggatctaccttctta

SEQ ID NO: 370879 - DNA, 25 bp, Mus musculus
ccagagtgctgtcgttggacagata

SEQ ID NO: 370880 - DNA, 25 bp, Mus musculus
gccttggccatgcagagtgctgctg

SEQ ID NO: 370881 - DNA, 25 bp, Mus musculus
ccgcctggggccttggccatgcaga

SEQ ID NO: 370882 - DNA, 25 bp, Mus musculus
agctcctcgtagcagctgccaggct

SEQ ID NO: 370883 - DNA, 25 bp, Mus musculus
gctccgagaagctggccagagtgct

SEQ ID NO: 370884 - DNA, 25 bp, Mus musculus
ggcaccagctctcgcggaagctcta

SEQ ID NO: 370885 - DNA, 25 bp, Mus musculus
tggtccgtgtttctccgtgccggta

SEQ ID NO: 370886 - DNA, 25 bp, Mus musculus
gtaagctatcccacaacatcccttg

SEQ ID NO: 370887 - DNA, 25 bp, Mus musculus
gaccctcagggaccgagatagggac

SEQ ID NO: 370888 - DNA, 25 bp, Mus musculus
cgcgcacagcgcaggaaacttcgga

SEQ ID NO: 370889 - DNA, 25 bp, Mus musculus
tcccgatgcggaaaaccgctaaatg

SEQ ID NO: 370890 - DNA, 25 bp, Mus musculus
ccagcagcagcaacggtgtcccgat

SEQ ID NO: 370891 - DNA, 25 bp, Mus musculus
cccaggcgcgcagtaagcgcgcgta

SEQ ID NO: 370892 - DNA, 25 bp, Mus musculus
agctcaagttcaaagggtcccaggc

SEQ ID NO: 370893 - DNA, 25 bp, Mus musculus
gctccgagcccatagagctcaagtt

SEQ ID NO: 370894 - DNA, 25 bp, Mus musculus
ctccttattagagacaagtgcgccc

SEQ ID NO: 370895 - DNA, 25 bp, Mus musculus
gccgggatgtctttgtctctcctta

SEQ ID NO: 370896 - DNA, 25 bp, Mus musculus
ggagctgggccagtatcgcctcctc

SEQ ID NO: 370897 - DNA, 25 bp, Mus musculus
cggcgctgtcactggggacccagtc

SEQ ID NO: 370898 - DNA, 25 bp, Mus musculus
atacggccgaggacctgcggctaca

SEQ ID NO: 370899 - DNA, 25 bp, Mus musculus
cgcccgagacgtgggccaagttcaa

SEQ ID NO: 370900 - DNA, 25 bp, Mus musculus
aagctgcagtaccaccttcgaaagg

SEQ ID NO: 370901 - DNA, 25 bp, Mus musculus
ggacgactcactccagaagctgcag

SEQ ID NO: 370902 - DNA, 25 bp, Mus musculus
ccgctgccaagagctggacgactca

SEQ ID NO: 370903 - DNA, 25 bp, Mus musculus
cggctttctcaagccgctgccaaga

SEQ ID NO: 370904 - DNA, 25 bp, Mus musculus
tgcggctacagtgcgatgcagtgaa

SEQ ID NO: 370905 - DNA, 25 bp, Mus musculus
tgactgcatcttgcgggatacggcc

SEQ ID NO: 370906 - DNA, 25 bp, Mus musculus
cctgcggaagttaattgactgcatc

SEQ ID NO: 370907 - DNA, 25 bp, Mus musculus
ctagcctcggttaacctgcggaagt

SEQ ID NO: 370908 - DNA, 25 bp, Mus musculus
cgagcggctagcctcggttaacctg

SEQ ID NO: 370909 - DNA, 25 bp, Mus musculus
acaacctgcttcgagccgagcgcga

SEQ ID NO: 370910 - DNA, 25 bp, Mus musculus
ggccaagttcaatcacgacaacctg

SEQ ID NO: 370911 - DNA, 25 bp, Mus musculus
cgatgcagtgaactcggctttctca

SEQ ID NO: 370912 - DNA, 25 bp, Mus musculus
ccgcaacaagtttctttaagccgtg

SEQ ID NO: 370913 - DNA, 25 bp, Mus musculus
ctccctccaatgtggggctcgaatc

SEQ ID NO: 370914 - DNA, 25 bp, Mus musculus
ggatgctaatccacaaggttcctga

SEQ ID NO: 370915 - DNA, 25 bp, Mus musculus
actgcccagtgcatggatctcagca

SEQ ID NO: 370916 - DNA, 25 bp, Mus musculus
agcacctgcgacacggcatcacgga

SEQ ID NO: 370917 - DNA, 25 bp, Mus musculus
gccgcagtagctcagtctcagttct

SEQ ID NO: 370918 - DNA, 25 bp, Mus musculus
tggtaactcccgcacctaggtgagc

SEQ ID NO: 370919 - DNA, 25 bp, Mus musculus
tggggctcgaatccgctattgcaac

SEQ ID NO: 370920 - DNA, 25 bp, Mus musculus
aatctttgtcctcaccgcaggggcc

SEQ ID NO: 370921 - DNA, 25 bp, Mus musculus
ctagaatccaaggttgccacgcagg

SEQ ID NO: 370922 - DNA, 25 bp, Mus musculus
ccggtcactctgtggaaggacactc

SEQ ID NO: 370923 - DNA, 25 bp, Mus musculus
gggcctcactcatgtccagcatcgg

SEQ ID NO: 370924 - DNA, 25 bp, Mus musculus
gtccgaatcctccacgtgtgacatg

SEQ ID NO: 370925 - DNA, 25 bp, Mus musculus
atctcagcagcacggcttgactttc

SEQ ID NO: 370926 - DNA, 25 bp, Mus musculus
ctctggctagagatcccgcagattc

SEQ ID NO: 370927 - DNA, 25 bp, Mus musculus
catttactgtgagtgtccggtggga

SEQ ID NO: 370928 - DNA, 25 bp, Mus musculus
tgcgggccctcgctttcatttactg

SEQ ID NO: 370929 - DNA, 25 bp, Mus musculus
tgactagaatcgtgctcctgcgggc

SEQ ID NO: 370930 - DNA, 25 bp, Mus musculus
acgggcaccttctggctgactagaa

SEQ ID NO: 370931 - DNA, 25 bp, Mus musculus
gcagattctccagctcggctgcaca

SEQ ID NO: 370932 - DNA, 25 bp, Mus musculus
agcgtcgcaaccttctctggctaga

SEQ ID NO: 370933 - DNA, 25 bp, Mus musculus
gagcacagtccagcgtcgcaacctt

SEQ ID NO: 370934 - DNA, 25 bp, Mus musculus
acagcctagtaatggctgcgcccga

SEQ ID NO: 370935 - DNA, 25 bp, Mus musculus
gctcatgcgcccagacagcctagta

SEQ ID NO: 370936 - DNA, 25 bp, Mus musculus
tcatccaggggagcttgtgtggctt

SEQ ID NO: 370937 - DNA, 25 bp, Mus musculus
accgctaggagagaccgcccagaga

SEQ ID NO: 370938 - DNA, 25 bp, Mus musculus
cggagacgcccaccgctaggagaga

SEQ ID NO: 370939 - DNA, 25 bp, Mus musculus
gctgcaagaggtccgcgtgtcatcc

SEQ ID NO: 370940 - DNA, 25 bp, Mus musculus
gtagggccagtggtgggccatgccc

SEQ ID NO: 370941 - DNA, 25 bp, Mus musculus
ccgacagatcgagtccagcggcgca

SEQ ID NO: 370942 - DNA, 25 bp, Mus musculus
acagatcgagtccagcggcgcagga

SEQ ID NO: 370943 - DNA, 25 bp, Mus musculus
cggccgacagatcgagtccagcggc

SEQ ID NO: 370944 - DNA, 25 bp, Mus musculus
agtccagcggcgcaggagccatcgc

SEQ ID NO: 370945 - DNA, 25 bp, Mus musculus
tccagcggcgcaggagccatcgctg

SEQ ID NO: 370946 - DNA, 25 bp, Mus musculus
caggagccatcgctgcgcgacgggg

SEQ ID NO: 370947 - DNA, 25 bp, Mus musculus
cggcagcagcgcaggtagggccagt

SEQ ID NO: 370948 - DNA, 25 bp, Mus musculus
cctccgcccacgtgcctgtcggcgt

SEQ ID NO: 370949 - DNA, 25 bp, Mus musculus
agatgctcccatttgtggaggaccc

SEQ ID NO: 370950 - DNA, 25 bp, Mus musculus
atgctcccatttgtggaggacccgc

SEQ ID NO: 370951 - DNA, 25 bp, Mus musculus
gctcccatttgtggaggacccgcag

SEQ ID NO: 370952 - DNA, 25 bp, Mus musculus
gcagctgatcctccgcccacgtgcc

SEQ ID NO: 370953 - DNA, 25 bp, Mus musculus
ccgcagtgcccgtgtgcgccgccgt

SEQ ID NO: 370954 - DNA, 25 bp, Mus musculus
caagggagaccgaacgctgtgctgt

SEQ ID NO: 370955 - DNA, 25 bp, Mus musculus
acttgcagcttgagtccgctgggcc

SEQ ID NO: 370956 - DNA, 25 bp, Mus musculus
acgcttttcaaagcttgttgacgga

SEQ ID NO: 370957 - DNA, 25 bp, Mus musculus
ctgtgctgtggaacttgcagcttga

SEQ ID NO: 370958 - DNA, 25 bp, Mus musculus
tgttgacggagagaaatgagcatgc

SEQ ID NO: 370959 - DNA, 25 bp, Mus musculus
agcatgcgctggaatttgcgttttc

SEQ ID NO: 370960 - DNA, 25 bp, Mus musculus
aatttgcgttttccggcagagtggc

SEQ ID NO: 370961 - DNA, 25 bp, Mus musculus
agtggcggaactgcatgtcattttg

SEQ ID NO: 370962 - DNA, 25 bp, Mus musculus
cactcggcggcagtgaggctgtcat

SEQ ID NO: 370963 - DNA, 25 bp, Mus musculus
cgtcgcccttcagtggggcactaca

SEQ ID NO: 370964 - DNA, 25 bp, Mus musculus
gggcactacagctgaccgacttgga

SEQ ID NO: 370965 - DNA, 25 bp, Mus musculus
gctgaccgacttggacgacttcatc

SEQ ID NO: 370966 - DNA, 25 bp, Mus musculus
acttcatcgggccatctcaggtggg

SEQ ID NO: 370967 - DNA, 25 bp, Mus musculus
tggccgtgcacctcgggaaacctct

SEQ ID NO: 370968 - DNA, 25 bp, Mus musculus
tgattgacagacactcagttccagg

SEQ ID NO: 370969 - DNA, 25 bp, Mus musculus
acagggtttgccacgagtgggtcta

SEQ ID NO: 370970 - DNA, 25 bp, Mus musculus
tccgaggccagtccgacattcattc

SEQ ID NO: 370971 - DNA, 25 bp, Mus musculus
taagtatccgctgcgatcagtcgcc

SEQ ID NO: 370972 - DNA, 25 bp, Mus musculus
aaccgcagccgcaactgcagaaatc

SEQ ID NO: 370973 - DNA, 25 bp, Mus musculus
gcctgagccaaactctatccgcttg

SEQ ID NO: 370974 - DNA, 25 bp, Mus musculus
cagttccaggtcctacttcccaagg

SEQ ID NO: 370975 - DNA, 25 bp, Mus musculus
gtgggtctacggtccgagacataca

SEQ ID NO: 370976 - DNA, 25 bp, Mus musculus
ctgggtcgtcctgatccatgattga

SEQ ID NO: 370977 - DNA, 25 bp, Mus musculus
tcagtcaacgcttcggctgggtcgt

SEQ ID NO: 370978 - DNA, 25 bp, Mus musculus
cgcttctcgcgtagctcagtcaacg

SEQ ID NO: 370979 - DNA, 25 bp, Mus musculus
gtatagacggccaatcccgagcctg

SEQ ID NO: 370980 - DNA, 25 bp, Mus musculus
agcagcagcgcccatatagtataga

SEQ ID NO: 370981 - DNA, 25 bp, Mus musculus
gccggtaatggaagcggttgccctc

SEQ ID NO: 370982 - DNA, 25 bp, Mus musculus
cgttggtcctcgtgcagttcaaaac

SEQ ID NO: 370983 - DNA, 25 bp, Mus musculus
aggcagcaactctgcggctgatgtc

SEQ ID NO: 370984 - DNA, 25 bp, Mus musculus
ggaccaatcgccacaagccgcagaa

SEQ ID NO: 370985 - DNA, 25 bp, Mus musculus
gggcctttgctctcggaccaatcgc

SEQ ID NO: 370986 - DNA, 25 bp, Mus musculus
ctaccagcatggttaggggacgcgc

SEQ ID NO: 370987 - DNA, 25 bp, Mus musculus
agcgcgcaaagaagcgtggctacca

SEQ ID NO: 370988 - DNA, 25 bp, Mus musculus
ctgcgtttcctcagttccaagtggg

SEQ ID NO: 370989 - DNA, 25 bp, Mus musculus
acaggacattgaagtctgcgtttcc

SEQ ID NO: 370990 - DNA, 25 bp, Mus musculus
taccaacatctgcttctactctgtg

SEQ ID NO: 370991 - DNA, 25 bp, Mus musculus
gatagcgccctcagtacagtccagg

SEQ ID NO: 370992 - DNA, 25 bp, Mus musculus
cccagctgggtacagccactcgata

SEQ ID NO: 370993 - DNA, 25 bp, Mus musculus
tacgttcagcgaagacctgggcacc

SEQ ID NO: 370994 - DNA, 25 bp, Mus musculus
gccctcggccagtagcaactctaga

SEQ ID NO: 370995 - DNA, 25 bp, Mus musculus
agattgccggtcatacgttcagcga

SEQ ID NO: 370996 - DNA, 25 bp, Mus musculus
gccgcagcttttctatggatagcga

SEQ ID NO: 370997 - DNA, 25 bp, Mus musculus
tctcatggagtggatccgagtggcc

SEQ ID NO: 370998 - DNA, 25 bp, Mus musculus
tgctgcttccgggagtggactgcga

SEQ ID NO: 370999 - DNA, 25 bp, Mus musculus
atagcgacgatgtccgccaagccgc

SEQ ID NO: 371000 - DNA, 25 bp, Mus musculus
tggatagcgacgatgtccgccaagc

SEQ ID NO: 371001 - DNA, 25 bp, Mus musculus
gcagcttttctatggatagcgacga

SEQ ID NO: 371002 - DNA, 25 bp, Mus musculus
ggccaccgccgcagcttttctatgg

SEQ ID NO: 371003 - DNA, 25 bp, Mus musculus
ccctctcatggagtggatccgagtg

SEQ ID NO: 371004 - DNA, 25 bp, Mus musculus
tcctcctgcgcaggcccttcctcgt

SEQ ID NO: 371005 - DNA, 25 bp, Mus musculus
tggcggtcctaatacatctccgcct

SEQ ID NO: 371006 - DNA, 25 bp, Mus musculus
ttccgtggcggtcctaatacatctc

SEQ ID NO: 371007 - DNA, 25 bp, Mus musculus
tctgagcagccctagttccgtggcg

SEQ ID NO: 371008 - DNA, 25 bp, Mus musculus
gatgggtctgagcagccctagttcc

SEQ ID NO: 371009 - DNA, 25 bp, Mus musculus
accgccgcagcttttctatggatag

SEQ ID NO: 371010 - DNA, 25 bp, Mus musculus
catgaatcaggaaaaggattctctg

SEQ ID NO: 371011 - DNA, 25 bp, Mus musculus
cgcctgccgcgcagcgtcggctgtt

SEQ ID NO: 371012 - DNA, 25 bp, Mus musculus
gaaggaaccttcttaacagtcattc

SEQ ID NO: 371013 - DNA, 25 bp, Mus musculus
ttaacagtcattcctaagatgcagg

SEQ ID NO: 371014 - DNA, 25 bp, Mus musculus
ttcctaagatgcaggaagatgtaca

SEQ ID NO: 371015 - DNA, 25 bp, Mus musculus
gatgcaggaagatgtacaaggccta

SEQ ID NO: 371016 - DNA, 25 bp, Mus musculus
aggcctcacaccagcccatcaaggg

SEQ ID NO: 371017 - DNA, 25 bp, Mus musculus
ggaagatgtacaaggcctaagaggc

SEQ ID NO: 371018 - DNA, 25 bp, Mus musculus
ggcctaagaggcttgctagccatca

SEQ ID NO: 371019 - DNA, 25 bp, Mus musculus
aggcttgctagccatcaaagaggta

SEQ ID NO: 371020 - DNA, 25 bp, Mus musculus
ctagccatcaaagaggtaagattta

SEQ ID NO: 371021 - DNA, 25 bp, Mus musculus
gtaagatttaggagggaagagacta

SEQ ID NO: 371022 - DNA, 25 bp, Mus musculus
cgtgggctactttgccagtggcgaa

SEQ ID NO: 371023 - DNA, 25 bp, Mus musculus
ttgcatccatgaatcaggaaaagga

SEQ ID NO: 371024 - DNA, 25 bp, Mus musculus
agcctaaatcggcacagctcttgga

SEQ ID NO: 371025 - DNA, 25 bp, Mus musculus
ctccagatcctagccaagcgggcgg

SEQ ID NO: 371026 - DNA, 25 bp, Mus musculus
gctccactgtctctggtgcagaaag

SEQ ID NO: 371027 - DNA, 25 bp, Mus musculus
cggcacagctcttggattatttctc

SEQ ID NO: 371028 - DNA, 25 bp, Mus musculus
gatcctagccaagcgggcggcttct

SEQ ID NO: 371029 - DNA, 25 bp, Mus musculus
tgggtttgccggagccaccgatcat

SEQ ID NO: 371030 - DNA, 25 bp, Mus musculus
ttttcagcctaaatcggcacagctc

SEQ ID NO: 371031 - DNA, 25 bp, Mus musculus
ctgggagcattttcagcctaaatcg

SEQ ID NO: 371032 - DNA, 25 bp, Mus musculus
gcacacccgcggctgggagcatttt

SEQ ID NO: 371033 - DNA, 25 bp, Mus musculus
gatcattcctcctccgctccactgt

SEQ ID NO: 371034 - DNA, 25 bp, Mus musculus
tccactgtctctggtgcagaaagcc

SEQ ID NO: 371035 - DNA, 25 bp, Mus musculus
agaaagcccggctgaccacattgag

SEQ ID NO: 371036 - DNA, 25 bp, Mus musculus
agcccggctgaccacattgagcgcg

SEQ ID NO: 371037 - DNA, 25 bp, Mus musculus
tttgccggagccaccgatcattcct

SEQ ID NO: 371038 - DNA, 25 bp, Mus musculus
cggggcaagctgagggaaatcccgc

SEQ ID NO: 371039 - DNA, 25 bp, Mus musculus
gccctccaccatgccacagccgccg

SEQ ID NO: 371040 - DNA, 25 bp, Mus musculus
acactcggggactttgtgcatgccc

SEQ ID NO: 371041 - DNA, 25 bp, Mus musculus
cgcacactcggggactttgtgcatg

SEQ ID NO: 371042 - DNA, 25 bp, Mus musculus
tgctcctctgctcaactgctccttc

SEQ ID NO: 371043 - DNA, 25 bp, Mus musculus
ccctcgtgcccgcactgcacgcccg

SEQ ID NO: 371044 - DNA, 25 bp, Mus musculus
ttccctgtctggggcaagaggcaga

SEQ ID NO: 371045 - DNA, 25 bp, Mus musculus
tcttccatccctgccggagcatctc

SEQ ID NO: 371046 - DNA, 25 bp, Mus musculus
gagcatctcttctccgccctgcgct

SEQ ID NO: 371047 - DNA, 25 bp, Mus musculus
ccacgccctgggcagtagcccttct

SEQ ID NO: 371048 - DNA, 25 bp, Mus musculus
gaatagcgcaggcttcccgacccgg

SEQ ID NO: 371049 - DNA, 25 bp, Mus musculus
ccgcgctgcctcgtcattgaatagc

SEQ ID NO: 371050 - DNA, 25 bp, Mus musculus
attgaatagcgcaggcttcccgacc

SEQ ID NO: 371051 - DNA, 25 bp, Mus musculus
tcgtcattgaatagcgcaggcttcc

SEQ ID NO: 371052 - DNA, 25 bp, Mus musculus
agcctcgtggattgagccagttccc

SEQ ID NO: 371053 - DNA, 25 bp, Mus musculus
gcatcagctgttggccgctaacacc

SEQ ID NO: 371054 - DNA, 25 bp, Mus musculus
tgaggcatttctagccgctgctgca

SEQ ID NO: 371055 - DNA, 25 bp, Mus musculus
ccatggtctgtcgttgaggcatttc

SEQ ID NO: 371056 - DNA, 25 bp, Mus musculus
gagcgcctgcaccaagaccctttga

SEQ ID NO: 371057 - DNA, 25 bp, Mus musculus
cgaaggaccttctgcggttgctata

SEQ ID NO: 371058 - DNA, 25 bp, Mus musculus
tgacacgctgacaccgaaggacctt

SEQ ID NO: 371059 - DNA, 25 bp, Mus musculus
gccagttcccttagctctgagaagc

SEQ ID NO: 371060 - DNA, 25 bp, Mus musculus
cactcgggctcttatcagggctgcc

SEQ ID NO: 371061 - DNA, 25 bp, Mus musculus
tgctccttgagctcttgcgcactcg

SEQ ID NO: 371062 - DNA, 25 bp, Mus musculus
tgcggcccacgaagagccggtttcc

SEQ ID NO: 371063 - DNA, 25 bp, Mus musculus
cctgtccgggatcacaaaactggga

SEQ ID NO: 371064 - DNA, 25 bp, Mus musculus
aggctgccagaaaccctgtccggga

SEQ ID NO: 371065 - DNA, 25 bp, Mus musculus
cagcggtcattgagaagtggccttc

SEQ ID NO: 371066 - DNA, 25 bp, Mus musculus
cagaaccactgcctgcgtccagctc

SEQ ID NO: 371067 - DNA, 25 bp, Mus musculus
cacacagccagagtacgcgcatatc

SEQ ID NO: 371068 - DNA, 25 bp, Mus musculus
aggggctgctctgcggaccgctccg

SEQ ID NO: 371069 - DNA, 25 bp, Mus musculus
cccgagctcagacagcgtcaccgag

SEQ ID NO: 371070 - DNA, 25 bp, Mus musculus
agcgtcaccgagatgccagcccagc

SEQ ID NO: 371071 - DNA, 25 bp, Mus musculus
accgagatgccagcccagcgcgcac

SEQ ID NO: 371072 - DNA, 25 bp, Mus musculus
agcgcgcacacagccagagtacgcg

SEQ ID NO: 371073 - DNA, 25 bp, Mus musculus
acagccagagtacgcgcatatcctg

SEQ ID NO: 371074 - DNA, 25 bp, Mus musculus
ccagagtacgcgcatatcctgcacg

SEQ ID NO: 371075 - DNA, 25 bp, Mus musculus
agtacgcgcatatcctgcacgcgca

SEQ ID NO: 371076 - DNA, 25 bp, Mus musculus
cccaactcgacgcactgcctgggta

SEQ ID NO: 371077 - DNA, 25 bp, Mus musculus
ccgaacagctcgacccagaaccact

SEQ ID NO: 371078 - DNA, 25 bp, Mus musculus
tgcgtccagctcttgcaccacgtgc

SEQ ID NO: 371079 - DNA, 25 bp, Mus musculus
tgggtagatcgtcccccaccgaaca

SEQ ID NO: 371080 - DNA, 25 bp, Mus musculus
gatggttatctcctccgcgcgggca

SEQ ID NO: 371081 - DNA, 25 bp, Mus musculus
ccgcacttcctgtcttcagtaccgc

SEQ ID NO: 371082 - DNA, 25 bp, Mus musculus
tcagtattgaatgcggagcggctgc

SEQ ID NO: 371083 - DNA, 25 bp, Mus musculus
gcccacacagcaccagctagtggtt

SEQ ID NO: 371084 - DNA, 25 bp, Mus musculus
ggatgcgaacatcgcgccgcatggc

SEQ ID NO: 371085 - DNA, 25 bp, Mus musculus
gcccagcagcaggatgcgaacatcg

SEQ ID NO: 371086 - DNA, 25 bp, Mus musculus
cagtagtcaggagcaccgccgaggt

SEQ ID NO: 371087 - DNA, 25 bp, Mus musculus
agagggaacagtagtcaggagcacc

SEQ ID NO: 371088 - DNA, 25 bp, Mus musculus
gatcagagacgtcttccccacctgg

SEQ ID NO: 371089 - DNA, 25 bp, Mus musculus
tcctcgccgaccagcgacaggatca

SEQ ID NO: 371090 - DNA, 25 bp, Mus musculus
cgcgcacctcctcgggaaactcctc

SEQ ID NO: 371091 - DNA, 25 bp, Mus musculus
tggcatccgccctaagtgcccagtc

SEQ ID NO: 371092 - DNA, 25 bp, Mus musculus
cctgcaacaggtgggtcagtattga

SEQ ID NO: 371093 - DNA, 25 bp, Mus musculus
ccagctagtggttgggctaaggcaa

SEQ ID NO: 371094 - DNA, 25 bp, Mus musculus
gcttggggctttgcggcctcgccca

SEQ ID NO: 371095 - DNA, 25 bp, Mus musculus
gggcttctgcacgaggtccagtcac

SEQ ID NO: 371096 - DNA, 25 bp, Mus musculus
acttccaccgctgttgcctcctgct

SEQ ID NO: 371097 - DNA, 25 bp, Mus musculus
cctaggtcttgcgtgggctcgccct

SEQ ID NO: 371098 - DNA, 25 bp, Mus musculus
gtggtcctgggcacctagcaggccc

SEQ ID NO: 371099 - DNA, 25 bp, Mus musculus
aacgcacaaatatcccgctgctgcg

SEQ ID NO: 371100 - DNA, 25 bp, Mus musculus
tcgccgctgcagcaacgcacaaata

SEQ ID NO: 371101 - DNA, 25 bp, Mus musculus
agcaacagcctcctggcaacgcgcg

SEQ ID NO: 371102 - DNA, 25 bp, Mus musculus
aaacacatagcacggcgcctagcaa

SEQ ID NO: 371103 - DNA, 25 bp, Mus musculus
tcttacgcaaaacacatagcacggc

SEQ ID NO: 371104 - DNA, 25 bp, Mus musculus
tcagctgacgctgtcttacgcaaaa

SEQ ID NO: 371105 - DNA, 25 bp, Mus musculus
ggccatggcgctacagctcgcgctt

SEQ ID NO: 371106 - DNA, 25 bp, Mus musculus
tccagtcactgacgcggcggggacc

SEQ ID NO: 371107 - DNA, 25 bp, Mus musculus
ctgcacgaggtccagtcactgacgc

SEQ ID NO: 371108 - DNA, 25 bp, Mus musculus
ggcggcaccggctgccggcatttca

SEQ ID NO: 371109 - DNA, 25 bp, Mus musculus
caaaggggcggagcgacccacacac

SEQ ID NO: 371110 - DNA, 25 bp, Mus musculus
ccagcttcactttgcggtcccagag

SEQ ID NO: 371111 - DNA, 25 bp, Mus musculus
tggcagcggccagatcaggcaccct

SEQ ID NO: 371112 - DNA, 25 bp, Mus musculus
gatagtgtacatggtgcgccgtccc

SEQ ID NO: 371113 - DNA, 25 bp, Mus musculus
cccttggtgatagtgtacatggtgc

SEQ ID NO: 371114 - DNA, 25 bp, Mus musculus
ctgtgcggcgctgcgcgaccagctt

SEQ ID NO: 371115 - DNA, 25 bp, Mus musculus
tgccggcatttcaggagctcgccaa

SEQ ID NO: 371116 - DNA, 25 bp, Mus musculus
ccctgagtctgtgccgagggctgca

SEQ ID NO: 371117 - DNA, 25 bp, Mus musculus
gccagggtccctgagtctgtgccga

SEQ ID NO: 371118 - DNA, 25 bp, Mus musculus
ctcaccttgcaaggggccagggtcc

SEQ ID NO: 371119 - DNA, 25 bp, Mus musculus
gcctggctcaccttgcaaggggcca

SEQ ID NO: 371120 - DNA, 25 bp, Mus musculus
cgagcagaagtgcacgagttgcctg

SEQ ID NO: 371121 - DNA, 25 bp, Mus musculus
tccacctgctgctgtgtgggacctg

SEQ ID NO: 371122 - DNA, 25 bp, Mus musculus
tcccgcagatgcaaacccttttagg

SEQ ID NO: 371123 - DNA, 25 bp, Mus musculus
gccgccggaatcagtttcccgcaga

SEQ ID NO: 371124 - DNA, 25 bp, Mus musculus
tgtccgaagtcaccgctaaatcccg

SEQ ID NO: 371125 - DNA, 25 bp, Mus musculus
tcgagccttgttccttgtccgaagt

SEQ ID NO: 371126 - DNA, 25 bp, Mus musculus
ggcgcaaacgcaacaaatgagcttt

SEQ ID NO: 371127 - DNA, 25 bp, Mus musculus
gtggaccaacgctgcctggacaggt

SEQ ID NO: 371128 - DNA, 25 bp, Mus musculus
tgctgagagaaacaaggagcccatc

SEQ ID NO: 371129 - DNA, 25 bp, Mus musculus
tcccgttcatctctgaaaaggaagg

SEQ ID NO: 371130 - DNA, 25 bp, Mus musculus
ccagtatgtggatcctgcccagcgc

SEQ ID NO: 371131 - DNA, 25 bp, Mus musculus
gacagcacgcggcacactttgcaca

SEQ ID NO: 371132 - DNA, 25 bp, Mus musculus
aggccttcccgaatgccgagtggca

SEQ ID NO: 371133 - DNA, 25 bp, Mus musculus
gttgagaggcctcctaacagttata

SEQ ID NO: 371134 - DNA, 25 bp, Mus musculus
gtatgccctacggactgcagtctcg

SEQ ID NO: 371135 - DNA, 25 bp, Mus musculus
cctgtccgtactccgccagtatgtg

SEQ ID NO: 371136 - DNA, 25 bp, Mus musculus
agtgccccacttccttcagaaacaa

SEQ ID NO: 371137 - DNA, 25 bp, Mus musculus
agtgaccaactaggatcccaagctg

SEQ ID NO: 371138 - DNA, 25 bp, Mus musculus
tgaccaactaggatcccaagctgac

SEQ ID NO: 371139 - DNA, 25 bp, Mus musculus
accaactaggatcccaagctgacta

SEQ ID NO: 371140 - DNA, 25 bp, Mus musculus
aactaggatcccaagctgactaagg

SEQ ID NO: 371141 - DNA, 25 bp, Mus musculus
ctaggatcccaagctgactaagggg

SEQ ID NO: 371142 - DNA, 25 bp, Mus musculus
aggatcccaagctgactaaggggtg

SEQ ID NO: 371143 - DNA, 25 bp, Mus musculus
tcccaagctgactaaggggtggaaa

SEQ ID NO: 371144 - DNA, 25 bp, Mus musculus
gtacagtctcatgcgcgcttagtca

SEQ ID NO: 371145 - DNA, 25 bp, Mus musculus
gtctcatgcgcgcttagtcatggga

SEQ ID NO: 371146 - DNA, 25 bp, Mus musculus
ctcatgcgcgcttagtcatgggaag

SEQ ID NO: 371147 - DNA, 25 bp, Mus musculus
catgcgcgcttagtcatgggaagga

SEQ ID NO: 371148 - DNA, 25 bp, Mus musculus
gcttagtcatgggaaggagcgaggg

SEQ ID NO: 371149 - DNA, 25 bp, Mus musculus
gatcccaagctgactaaggggtgga

SEQ ID NO: 371150 - DNA, 25 bp, Mus musculus
ttccaggccctaatggactccaaag

SEQ ID NO: 371151 - DNA, 25 bp, Mus musculus
tagctcttcactggactgccctggg

SEQ ID NO: 371152 - DNA, 25 bp, Mus musculus
agcaggtaatcgtagctcttcactg

SEQ ID NO: 371153 - DNA, 25 bp, Mus musculus
ccagcaggaacttgagcaggtaatc

SEQ ID NO: 371154 - DNA, 25 bp, Mus musculus
gcgccgtcctgaaggctctccagga

SEQ ID NO: 371155 - DNA, 25 bp, Mus musculus
tacggggattcagctgcgccgtcct

SEQ ID NO: 371156 - DNA, 25 bp, Mus musculus
ccggcctaccgttgctgtaggcgta

SEQ ID NO: 371157 - DNA, 25 bp, Mus musculus
ataccgcagcgacacgcgcagaggc

SEQ ID NO: 371158 - DNA, 25 bp, Mus musculus
tcaaggcagggccagaggataccgc

SEQ ID NO: 371159 - DNA, 25 bp, Mus musculus
cttgccgacggctcctcaaggcagg

SEQ ID NO: 371160 - DNA, 25 bp, Mus musculus
tgacttcttagtagccaccaggacc

SEQ ID NO: 371161 - DNA, 25 bp, Mus musculus
tgctgctgtgacttcttagtagcca

SEQ ID NO: 371162 - DNA, 25 bp, Mus musculus
tggactccaaagacctgctgctgtg

SEQ ID NO: 371163 - DNA, 25 bp, Mus musculus
gcggtcaggacgctgatgctcccgc

SEQ ID NO: 371164 - DNA, 25 bp, Mus musculus
tgcaggaggcgtaccgcgagctcaa

SEQ ID NO: 371165 - DNA, 25 bp, Mus musculus
gcatggacgcggagtaccctgcgtt

SEQ ID NO: 371166 - DNA, 25 bp, Mus musculus
gcaaggggccgcagctctctgtcca

SEQ ID NO: 371167 - DNA, 25 bp, Mus musculus
ctactacaggtaggcgcaaggggcc

SEQ ID NO: 371168 - DNA, 25 bp, Mus musculus
caaggatgatcgctactacaggtag

SEQ ID NO: 371169 - DNA, 25 bp, Mus musculus
cgccattcaaggatgatcgctacta

SEQ ID NO: 371170 - DNA, 25 bp, Mus musculus
aggacctcgcgccattcaaggatga

SEQ ID NO: 371171 - DNA, 25 bp, Mus musculus
gtaccgcgagctcaaggaggacctc

SEQ ID NO: 371172 - DNA, 25 bp, Mus musculus
tcaagcagctgtgccggcggctgca

SEQ ID NO: 371173 - DNA, 25 bp, Mus musculus
tgcagtggcctcaagcagctgtgcc

SEQ ID NO: 371174 - DNA, 25 bp, Mus musculus
gccgctctgcagtggcctcaagcag

SEQ ID NO: 371175 - DNA, 25 bp, Mus musculus
ggagtaccctgcgttcgagccgccg

SEQ ID NO: 371176 - DNA, 25 bp, Mus musculus
ccaatcgtgccataggctcgggtgc

SEQ ID NO: 371177 - DNA, 25 bp, Mus musculus
gctcaaggaggacctcgcgccattc

SEQ ID NO: 371178 - DNA, 25 bp, Mus musculus
aaggaactgggttgggcactgcgtt

SEQ ID NO: 371179 - DNA, 25 bp, Mus musculus
gctacctcgggatttcctcctcttc

SEQ ID NO: 371180 - DNA, 25 bp, Mus musculus
tagtgctcaccagctggtccccggg

SEQ ID NO: 371181 - DNA, 25 bp, Mus musculus
gggacatcagcaccatttccgccgg

SEQ ID NO: 371182 - DNA, 25 bp, Mus musculus
tcagcaccatttccgccggctccgc

SEQ ID NO: 371183 - DNA, 25 bp, Mus musculus
gggaggacgaccgtgcttgcggctc

SEQ ID NO: 371184 - DNA, 25 bp, Mus musculus
gcccgccgcgggacatcagcaccat

SEQ ID NO: 371185 - DNA, 25 bp, Mus musculus
atcgcctgagcccgagagttccgcg

SEQ ID NO: 371186 - DNA, 25 bp, Mus musculus
gtccatcgcctgagcccgagagttc

SEQ ID NO: 371187 - DNA, 25 bp, Mus musculus
catgcccgggctgtccatcgcctga

SEQ ID NO: 371188 - DNA, 25 bp, Mus musculus
cgcgacggtccggtccccaaacatg

SEQ ID NO: 371189 - DNA, 25 bp, Mus musculus
ctccgcggcgttgtcgcgcgacggt

SEQ ID NO: 371190 - DNA, 25 bp, Mus musculus
ttgggcactgcgttcggcgggcccg

SEQ ID NO: 371191 - DNA, 25 bp, Mus musculus
gccacccgctagtgctcaccagctg

SEQ ID NO: 371192 - DNA, 25 bp, Mus musculus
tcgcaggcgcccaccaaagttggca

SEQ ID NO: 371193 - DNA, 25 bp, Mus musculus
tccagagctagaagcggcggcaact

SEQ ID NO: 371194 - DNA, 25 bp, Mus musculus
tcctacttgcgaacaccgcggggta

SEQ ID NO: 371195 - DNA, 25 bp, Mus musculus
gggtcaaacttcctacttgcgaaca

SEQ ID NO: 371196 - DNA, 25 bp, Mus musculus
tgcgccaggcaaagggtcaaacttc

SEQ ID NO: 371197 - DNA, 25 bp, Mus musculus
cctgcggcgtctgctaaatgtgcgc

SEQ ID NO: 371198 - DNA, 25 bp, Mus musculus
aacttcgcgggaagtgccgcccgct

SEQ ID NO: 371199 - DNA, 25 bp, Mus musculus
ctgggatcacaagcagccctttcta

SEQ ID NO: 371200 - DNA, 25 bp, Mus musculus
cggcgcgagcttccaaacgcagcga

SEQ ID NO: 371201 - DNA, 25 bp, Mus musculus
agccctttctatgcatccgtccaga

SEQ ID NO: 371202 - DNA, 25 bp, Mus musculus
gcactcaccggacgcgctgggactg

SEQ ID NO: 371203 - DNA, 25 bp, Mus musculus
gggtaaccgaggtccagagctagaa

SEQ ID NO: 371204 - DNA, 25 bp, Mus musculus
cgagccctcacggtgctgggatcac

SEQ ID NO: 371205 - DNA, 25 bp, Mus musculus
acccgccacagtgccgcaagagatt

SEQ ID NO: 371206 - DNA, 25 bp, Mus musculus
ccttcgtacagtgggccaacgctta

SEQ ID NO: 371207 - DNA, 25 bp, Mus musculus
ttggtactcccaagctagtttgatg

SEQ ID NO: 371208 - DNA, 25 bp, Mus musculus
gccaggctactgctcccaggacaaa

SEQ ID NO: 371209 - DNA, 25 bp, Mus musculus
gacaaacatggagcatcccggctga

SEQ ID NO: 371210 - DNA, 25 bp, Mus musculus
agctctacgagtcctaggccgtctg

SEQ ID NO: 371211 - DNA, 25 bp, Mus musculus
taccgtggaactcaccttagcgagc

SEQ ID NO: 371212 - DNA, 25 bp, Mus musculus
ctcagtcggttgacccacaacttcg

SEQ ID NO: 371213 - DNA, 25 bp, Mus musculus
ttagcgcgttttggccgcgaagatc

SEQ ID NO: 371214 - DNA, 25 bp, Mus musculus
ttacaaacgcctccgtagctagcgc

SEQ ID NO: 371215 - DNA, 25 bp, Mus musculus
agtccatgaatggtcctaccctcta

SEQ ID NO: 371216 - DNA, 25 bp, Mus musculus
tgagatttcgccctcccaacgtgac

SEQ ID NO: 371217 - DNA, 25 bp, Mus musculus
tcgcctgcgtctgaggttcctaggc

SEQ ID NO: 371218 - DNA, 25 bp, Mus musculus
gctcagttcacggatgcagttggta

SEQ ID NO: 371219 - DNA, 25 bp, Mus musculus
caacgtgaccggagacgctcagttc

SEQ ID NO: 371220 - DNA, 25 bp, Mus musculus
gttcctccacctccttgagcaagtg

SEQ ID NO: 371221 - DNA, 25 bp, Mus musculus
cctccgtcaagaggcacggtgcgtc

SEQ ID NO: 371222 - DNA, 25 bp, Mus musculus
acaggtgagagacatcaggctcctc

SEQ ID NO: 371223 - DNA, 25 bp, Mus musculus
gcatcaggctcttctagctccttgg

SEQ ID NO: 371224 - DNA, 25 bp, Mus musculus
gagtcggattcctccagctcctctg

SEQ ID NO: 371225 - DNA, 25 bp, Mus musculus
aaacacggtgcctctgactcctggg

SEQ ID NO: 371226 - DNA, 25 bp, Mus musculus
ctctgccaagtgacaggattcatcg

SEQ ID NO: 371227 - DNA, 25 bp, Mus musculus
tgcgtcggattcctcccactttttg

SEQ ID NO: 371228 - DNA, 25 bp, Mus musculus
cagctctttggctaagtggcacggt

SEQ ID NO: 371229 - DNA, 25 bp, Mus musculus
ccttagccaagtgacaggattcgtc

SEQ ID NO: 371230 - DNA, 25 bp, Mus musculus
agtcgaggtcctccagttccttggc

SEQ ID NO: 371231 - DNA, 25 bp, Mus musculus
cagcgaagggcatcaggttcctcca

SEQ ID NO: 371232 - DNA, 25 bp, Mus musculus
caccgagggatgttgggttcctcta

SEQ ID NO: 371233 - DNA, 25 bp, Mus musculus
agctccttggccaacaaacacggtg

SEQ ID NO: 371234 - DNA, 25 bp, Mus musculus
tggctgccgcacgtgcgcaaacaaa

SEQ ID NO: 371235 - DNA, 25 bp, Mus musculus
cgcgcccgaaaaggctgcccatgtt

SEQ ID NO: 371236 - DNA, 25 bp, Mus musculus
cactgaaagcgtggcccgcacaaca

SEQ ID NO: 371237 - DNA, 25 bp, Mus musculus
ggcaacaactgctccgcggagggaa

SEQ ID NO: 371238 - DNA, 25 bp, Mus musculus
cgcaccagcaggcactgaaagcgtg

SEQ ID NO: 371239 - DNA, 25 bp, Mus musculus
actcaccggaactggggcgcaccag

SEQ ID NO: 371240 - DNA, 25 bp, Mus musculus
tactgctaaaagctctgtcccgggc

SEQ ID NO: 371241 - DNA, 25 bp, Mus musculus
cgtgcgcaaacaaaggccgcgcagc

SEQ ID NO: 371242 - DNA, 25 bp, Mus musculus
agaccaagcctttggctgccgcacg

SEQ ID NO: 371243 - DNA, 25 bp, Mus musculus
cctccgggacaagaccaagcctttg

SEQ ID NO: 371244 - DNA, 25 bp, Mus musculus
gttggacttgcactcctccgggaca

SEQ ID NO: 371245 - DNA, 25 bp, Mus musculus
cctcggctttggctttctactgcta

SEQ ID NO: 371246 - DNA, 25 bp, Mus musculus
tgctgagggttggacttgcactcct

SEQ ID NO: 371247 - DNA, 25 bp, Mus musculus
acgggcacaggactcaccggaactg

SEQ ID NO: 371248 - DNA, 25 bp, Mus musculus
acgtgacatctgtcgtctggtaccc

SEQ ID NO: 371249 - DNA, 25 bp, Mus musculus
ccaaagcgttcgacaggacccttca

SEQ ID NO: 371250 - DNA, 25 bp, Mus musculus
aaggtgacgcggtccagcatcctca

SEQ ID NO: 371251 - DNA, 25 bp, Mus musculus
tccactctggccaaggtgacgcggt

SEQ ID NO: 371252 - DNA, 25 bp, Mus musculus
ttcgcctccactctggccaaggtga

SEQ ID NO: 371253 - DNA, 25 bp, Mus musculus
tgttcgcctccactctggccaaggt

SEQ ID NO: 371254 - DNA, 25 bp, Mus musculus
atgagaccttttcggccccctgctg

SEQ ID NO: 371255 - DNA, 25 bp, Mus musculus
gtgaatccgtgtccccttccaatga

SEQ ID NO: 371256 - DNA, 25 bp, Mus musculus
ccctcaagctgagtgatccccagtg

SEQ ID NO: 371257 - DNA, 25 bp, Mus musculus
ttcgacaggacccttcatcctttgc

SEQ ID NO: 371258 - DNA, 25 bp, Mus musculus
aagcgttcgacaggacccttcatcc

SEQ ID NO: 371259 - DNA, 25 bp, Mus musculus
agcatcctcaggaacctagaccgca

SEQ ID NO: 371260 - DNA, 25 bp, Mus musculus
acgtatacgtgacatctgtcgtctg

SEQ ID NO: 371261 - DNA, 25 bp, Mus musculus
tcaggaacctagaccgcaggccggc

SEQ ID NO: 371262 - DNA, 25 bp, Mus musculus
gggcacctgtgcgttcacctggcgc

SEQ ID NO: 371263 - DNA, 25 bp, Mus musculus
ggattctaccggtccgtctctcctg

SEQ ID NO: 371264 - DNA, 25 bp, Mus musculus
ttggagcggattctaccggtccgtc

SEQ ID NO: 371265 - DNA, 25 bp, Mus musculus
tcacttggagcggattctaccggtc

SEQ ID NO: 371266 - DNA, 25 bp, Mus musculus
gcccgccgagttcgctcacttggag

SEQ ID NO: 371267 - DNA, 25 bp, Mus musculus
cctgcggggcatccgggccagaaaa

SEQ ID NO: 371268 - DNA, 25 bp, Mus musculus
caacagcaaggagagcggtgagccc

SEQ ID NO: 371269 - DNA, 25 bp, Mus musculus
cgaggttctcatcttgggttgcgcc

SEQ ID NO: 371270 - DNA, 25 bp, Mus musculus
cggcgttgaaacgaggttctcatct

SEQ ID NO: 371271 - DNA, 25 bp, Mus musculus
agcccgcgggcctacagcgccatcc

SEQ ID NO: 371272 - DNA, 25 bp, Mus musculus
acctgtgcgttcacctggcgcggcg

SEQ ID NO: 371273 - DNA, 25 bp, Mus musculus
accggtccgtctctcctgtgcttta

SEQ ID NO: 371274 - DNA, 25 bp, Mus musculus
gccgccagcaacagcaaggagagcg

SEQ ID NO: 371275 - DNA, 25 bp, Mus musculus
gcgcggcgttgaaacgaggttctca

SEQ ID NO: 371276 - DNA, 25 bp, Mus musculus
cctgtgcacctgtggcagaagctgc

SEQ ID NO: 371277 - DNA, 25 bp, Mus musculus
gtacactacaaacctcacgggacca

SEQ ID NO: 371278 - DNA, 25 bp, Mus musculus
cactggaagaagaacggacgccgac

SEQ ID NO: 371279 - DNA, 25 bp, Mus musculus
ttgcgctcactggaagaagaacgga

SEQ ID NO: 371280 - DNA, 25 bp, Mus musculus
cttgcccgcccacttcttgcgctca

SEQ ID NO: 371281 - DNA, 25 bp, Mus musculus
cacctgtggcagaagctgcggctgc

SEQ ID NO: 371282 - DNA, 25 bp, Mus musculus
acctcacgggaccaagttcaagatc

SEQ ID NO: 371283 - DNA, 25 bp, Mus musculus
tgccgctgcacaggtatcctgtgca

SEQ ID NO: 371284 - DNA, 25 bp, Mus musculus
ctcctagaagtagagggtcgcgcga

SEQ ID NO: 371285 - DNA, 25 bp, Mus musculus
cgcgctctcctagaagtagagggtc

SEQ ID NO: 371286 - DNA, 25 bp, Mus musculus
cacgttcggtgacgctattccggtt

SEQ ID NO: 371287 - DNA, 25 bp, Mus musculus
aaggcgcacgttcggtgacgctatt

SEQ ID NO: 371288 - DNA, 25 bp, Mus musculus
ccaattggcagcgagcgaaggcgca

SEQ ID NO: 371289 - DNA, 25 bp, Mus musculus
gcagggcatctgtgcgcgcttgccc

SEQ ID NO: 371290 - DNA, 25 bp, Mus musculus
cgtggactttttgtgcactgggaag

SEQ ID NO: 371291 - DNA, 25 bp, Mus musculus
tacgagtttcttacggtgatccgga

SEQ ID NO: 371292 - DNA, 25 bp, Mus musculus
ccagacaaggtgaggcctgtgtatg

SEQ ID NO: 371293 - DNA, 25 bp, Mus musculus
cgatcccatccctgagatgcacgaa

SEQ ID NO: 371294 - DNA, 25 bp, Mus musculus
cctgcgagtgacgtcagcgagcgcc

SEQ ID NO: 371295 - DNA, 25 bp, Mus musculus
aggagccacgcgatgggacctgcca

SEQ ID NO: 371296 - DNA, 25 bp, Mus musculus
gatgcacgaacacgtggactttttg

SEQ ID NO: 371297 - DNA, 25 bp, Mus musculus
ggcgtggccaaagagactccagaca

SEQ ID NO: 371298 - DNA, 25 bp, Mus musculus
agccgccaagtgacctgcgtggcct

SEQ ID NO: 371299 - DNA, 25 bp, Mus musculus
accgaagatcatgaaccgcagccgc

SEQ ID NO: 371300 - DNA, 25 bp, Mus musculus
ctgcgccgggttcaaaccgaagatc

SEQ ID NO: 371301 - DNA, 25 bp, Mus musculus
aagagtagtgtctcccagctcccag

SEQ ID NO: 371302 - DNA, 25 bp, Mus musculus
cctccgcggagctcaagagtagtgt

SEQ ID NO: 371303 - DNA, 25 bp, Mus musculus
ctgtagccatgtgaggtgtggctcc

SEQ ID NO: 371304 - DNA, 25 bp, Mus musculus
gttctgcctctacaacgagacccag

SEQ ID NO: 371305 - DNA, 25 bp, Mus musculus
cctgagatccaaggggacgttgagc

SEQ ID NO: 371306 - DNA, 25 bp, Mus musculus
gctgtttcccatggcacctttcggg

SEQ ID NO: 371307 - DNA, 25 bp, Mus musculus
ttttcagcggcactcctagttcacg

SEQ ID NO: 371308 - DNA, 25 bp, Mus musculus
cttcaccaccgcaagacagtgcttg

SEQ ID NO: 371309 - DNA, 25 bp, Mus musculus
caagacagtgcttggctcctgagta

SEQ ID NO: 371310 - DNA, 25 bp, Mus musculus
acaccgtggttctgcctctacaacg

SEQ ID NO: 371311 - DNA, 25 bp, Mus musculus
ctcaggcctgggcttcagggctctg

SEQ ID NO: 371312 - DNA, 25 bp, Mus musculus
cggcgtagggagacctgagatccaa

SEQ ID NO: 371313 - DNA, 25 bp, Mus musculus
acgtttcttttcagcggcactccta

SEQ ID NO: 371314 - DNA, 25 bp, Mus musculus
tcctccgcggctacgtttcttttca

SEQ ID NO: 371315 - DNA, 25 bp, Mus musculus
cattgggcatcctccgcggctacgt

SEQ ID NO: 371316 - DNA, 25 bp, Mus musculus
cctttcgggacgagcagtagtcgtt

SEQ ID NO: 371317 - DNA, 25 bp, Mus musculus
ttggctcctgagtacgccgcagtcc

SEQ ID NO: 371318 - DNA, 25 bp, Mus musculus
cacgcgccctaaagttgccgcgggg

SEQ ID NO: 371319 - DNA, 25 bp, Mus musculus
tggaataaagtcctacgcccggcca

SEQ ID NO: 371320 - DNA, 25 bp, Mus musculus
gaataaagtcctacgcccggccaga

SEQ ID NO: 371321 - DNA, 25 bp, Mus musculus
tacgcccggccagaatacatacacg

SEQ ID NO: 371322 - DNA, 25 bp, Mus musculus
gccagaatacatacacgccacgagg

SEQ ID NO: 371323 - DNA, 25 bp, Mus musculus
agaatacatacacgccacgaggtcc

SEQ ID NO: 371324 - DNA, 25 bp, Mus musculus
caaccgtgccgctcccttgctgccc

SEQ ID NO: 371325 - DNA, 25 bp, Mus musculus
ggccgccgcccgactcgggcgctca

SEQ ID NO: 371326 - DNA, 25 bp, Mus musculus
cgggcgctcacctcgggcgcacagc

SEQ ID NO: 371327 - DNA, 25 bp, Mus musculus
cagctcacacgcgtccaggcccagc

SEQ ID NO: 371328 - DNA, 25 bp, Mus musculus
caggcccagcatggtagccgcggcc

SEQ ID NO: 371329 - DNA, 25 bp, Mus musculus
cccagcatggtagccgcggcccgcc

SEQ ID NO: 371330 - DNA, 25 bp, Mus musculus
cggccagaatacatacacgccacga

SEQ ID NO: 371331 - DNA, 25 bp, Mus musculus
cgccctaaagttgccgcggggaatg

SEQ ID NO: 371332 - DNA, 25 bp, Mus musculus
tcccaagatgagtcacgcccgatcg

SEQ ID NO: 371333 - DNA, 25 bp, Mus musculus
gagccctagctcaggactccttgga

SEQ ID NO: 371334 - DNA, 25 bp, Mus musculus
acggagcactcctccggtgcgtgtc

SEQ ID NO: 371335 - DNA, 25 bp, Mus musculus
cgcacgtgacggcacacggagcact

SEQ ID NO: 371336 - DNA, 25 bp, Mus musculus
tctcctccttggagcgcacgtgacg

SEQ ID NO: 371337 - DNA, 25 bp, Mus musculus
gtggggactcccaagtccgcgcaca

SEQ ID NO: 371338 - DNA, 25 bp, Mus musculus
tcacgcagcggctcgagctgcactg

SEQ ID NO: 371339 - DNA, 25 bp, Mus musculus
tttcttcacaaactgggatcggccg

SEQ ID NO: 371340 - DNA, 25 bp, Mus musculus
cgcaattccgggatcttttaacact

SEQ ID NO: 371341 - DNA, 25 bp, Mus musculus
gagcgctccgcaggtttcacttcgt

SEQ ID NO: 371342 - DNA, 25 bp, Mus musculus
gcgctccgcagtcccgagtataaga

SEQ ID NO: 371343 - DNA, 25 bp, Mus musculus
ctctgaaacaggcatgcgcgtggaa

SEQ ID NO: 371344 - DNA, 25 bp, Mus musculus
gtcgccgaaatgctactcccacgtg

SEQ ID NO: 371345 - DNA, 25 bp, Mus musculus
ttcacttcgtgtagcaaccgttgcc

SEQ ID NO: 371346 - DNA, 25 bp, Mus musculus
cagaagttctgcatcttggaggatg

SEQ ID NO: 371347 - DNA, 25 bp, Mus musculus
gaatggctggttcagaagttctgca

SEQ ID NO: 371348 - DNA, 25 bp, Mus musculus
tcctggcgcagcacggctacatcta

SEQ ID NO: 371349 - DNA, 25 bp, Mus musculus
tgcgtgagtcccgagacctgacact

SEQ ID NO: 371350 - DNA, 25 bp, Mus musculus
actggcagagcgctcactttccttc

SEQ ID NO: 371351 - DNA, 25 bp, Mus musculus
agagacctcgtggaatggctggttc

SEQ ID NO: 371352 - DNA, 25 bp, Mus musculus
ttctcctgtgtaggcagagacctcg

SEQ ID NO: 371353 - DNA, 25 bp, Mus musculus
gcccacttcgcttctcctgtgtagg

SEQ ID NO: 371354 - DNA, 25 bp, Mus musculus
agccagcgccttctgatcactgtca

SEQ ID NO: 371355 - DNA, 25 bp, Mus musculus
accaaggcgtgaagatgcggagcca

SEQ ID NO: 371356 - DNA, 25 bp, Mus musculus
caggaccctgaccaaggcgtgaaga

SEQ ID NO: 371357 - DNA, 25 bp, Mus musculus
gtagtcgtgagtatgcaggaccctg

SEQ ID NO: 371358 - DNA, 25 bp, Mus musculus
cgttcgctctcagatggagcgggta

SEQ ID NO: 371359 - DNA, 25 bp, Mus musculus
cggctacatctacccactgcgtgag

SEQ ID NO: 371360 - DNA, 25 bp, Mus musculus
gcgattccgttctgttgactgagtc

SEQ ID NO: 371361 - DNA, 25 bp, Mus musculus
gccgaccttagctgtgagctgcaag

SEQ ID NO: 371362 - DNA, 25 bp, Mus musculus
tgactgagtcggttgcttagcaaca

SEQ ID NO: 371363 - DNA, 25 bp, Mus musculus
gggcgtaccacagcgattccgttct

SEQ ID NO: 371364 - DNA, 25 bp, Mus musculus
accagctcgcgcgttaagagttacc

SEQ ID NO: 371365 - DNA, 25 bp, Mus musculus
acgcagacggctttggccggaacca

SEQ ID NO: 371366 - DNA, 25 bp, Mus musculus
tagctccgggcgatcgaacgcagac

SEQ ID NO: 371367 - DNA, 25 bp, Mus musculus
ggagtacagactacgccggacagca

SEQ ID NO: 371368 - DNA, 25 bp, Mus musculus
atcctgctcctcagcaagtggtaca

SEQ ID NO: 371369 - DNA, 25 bp, Mus musculus
taagagttacctagtccgatcctga

SEQ ID NO: 371370 - DNA, 25 bp, Mus musculus
gatcctgacctgctctcggacctgt

SEQ ID NO: 371371 - DNA, 25 bp, Mus musculus
tctcggacctgtccgcgagatcctg

SEQ ID NO: 371372 - DNA, 25 bp, Mus musculus
acagcggctgaacaggagtacagac

SEQ ID NO: 371373 - DNA, 25 bp, Mus musculus
ctcaactgcggtccctggaatccgg

SEQ ID NO: 371374 - DNA, 25 bp, Mus musculus
cttcaggctgataggagcgtctttc

SEQ ID NO: 371375 - DNA, 25 bp, Mus musculus
ggccttgcatcaacgccaaagaact

SEQ ID NO: 371376 - DNA, 25 bp, Mus musculus
cgggcgttcttgctccatacggtta

SEQ ID NO: 371377 - DNA, 25 bp, Mus musculus
tggcggaatttctctgatactcttc

SEQ ID NO: 371378 - DNA, 25 bp, Mus musculus
tccttcctgagagtccgatccgacg

SEQ ID NO: 371379 - DNA, 25 bp, Mus musculus
cctttgtctgatctgcttggcctgc

SEQ ID NO: 371380 - DNA, 25 bp, Mus musculus
cctgttggaccagctcatgggcacg

SEQ ID NO: 371381 - DNA, 25 bp, Mus musculus
ccatacggttacacggggagccgca

SEQ ID NO: 371382 - DNA, 25 bp, Mus musculus
aatgagcatttctaacgtgggttcc

SEQ ID NO: 371383 - DNA, 25 bp, Mus musculus
tttgcggcttctctggtcgagttgt

SEQ ID NO: 371384 - DNA, 25 bp, Mus musculus
tcgttttccgtcatgcgagttcctc

SEQ ID NO: 371385 - DNA, 25 bp, Mus musculus
tgtacacttcccgacaggccttgca

SEQ ID NO: 371386 - DNA, 25 bp, Mus musculus
gatttgcgaccgttccactcagcga

SEQ ID NO: 371387 - DNA, 25 bp, Mus musculus
gagcgtctttcctcgtcgctgtttg

SEQ ID NO: 371388 - DNA, 25 bp, Mus musculus
ggtctccgcgtacagtccacaggcg

SEQ ID NO: 371389 - DNA, 25 bp, Mus musculus
gcgcatcgccccctagttaaaagcg

SEQ ID NO: 371390 - DNA, 25 bp, Mus musculus
agccattgctgtggggcgcatcgcc

SEQ ID NO: 371391 - DNA, 25 bp, Mus musculus
atctgagccattgctgtggggcgca

SEQ ID NO: 371392 - DNA, 25 bp, Mus musculus
gttcttggcggcgttcccacgcgcg

SEQ ID NO: 371393 - DNA, 25 bp, Mus musculus
gtgctagttcttggcggcgttccca

SEQ ID NO: 371394 - DNA, 25 bp, Mus musculus
ccggcacacgtgctagttcttggcg

SEQ ID NO: 371395 - DNA, 25 bp, Mus musculus
gggcaacacggtgcaccggaccctg

SEQ ID NO: 371396 - DNA, 25 bp, Mus musculus
agtagcgatgggcaacacggtgcac

SEQ ID NO: 371397 - DNA, 25 bp, Mus musculus
agtctcggagtagcgatgggcaaca

SEQ ID NO: 371398 - DNA, 25 bp, Mus musculus
gaccctgccaggtacgcccggagcc

SEQ ID NO: 371399 - DNA, 25 bp, Mus musculus
caagccagagcctggttgccggagc

SEQ ID NO: 371400 - DNA, 25 bp, Mus musculus
ccacgcctttgttccagccggaggt

SEQ ID NO: 371401 - DNA, 25 bp, Mus musculus
ccagccggaggtcgctaatgagcga

SEQ ID NO: 371402 - DNA, 25 bp, Mus musculus
ctcagtattgccctcagacacgatg

SEQ ID NO: 371403 - DNA, 25 bp, Mus musculus
ctgtctgccaataatcgtcatcata

SEQ ID NO: 371404 - DNA, 25 bp, Mus musculus
cgctgcctgtctgccaataatcgtc

SEQ ID NO: 371405 - DNA, 25 bp, Mus musculus
tgcctgtctgccaataatcgtcatc

SEQ ID NO: 371406 - DNA, 25 bp, Mus musculus
tattgccctcagacacgatgacatg

SEQ ID NO: 371407 - DNA, 25 bp, Mus musculus
tgtcgctgcctgtctgccaataatc

SEQ ID NO: 371408 - DNA, 25 bp, Mus musculus
ttaccctcagtattgccctcagaca

SEQ ID NO: 371409 - DNA, 25 bp, Mus musculus
gtttaccctcagtattgccctcaga

SEQ ID NO: 371410 - DNA, 25 bp, Mus musculus
cccgattagtttaccctcagtattg

SEQ ID NO: 371411 - DNA, 25 bp, Mus musculus
catagtcaatagtcaccccgattta

SEQ ID NO: 371412 - DNA, 25 bp, Mus musculus
tcgtcatcatagtcaatagtcaccc

SEQ ID NO: 371413 - DNA, 25 bp, Mus musculus
ccaataatcgtcatcatagtcaata

SEQ ID NO: 371414 - DNA, 25 bp, Mus musculus
tctgccaataatcgtcatcatagtc

SEQ ID NO: 371415 - DNA, 25 bp, Mus musculus
tgccctcagacacgatgacatgccg

SEQ ID NO: 371416 - DNA, 25 bp, Mus musculus
tgcgcttcggcttcactgcgcacga

SEQ ID NO: 371417 - DNA, 25 bp, Mus musculus
tacgcggcctggttactgggccaag

SEQ ID NO: 371418 - DNA, 25 bp, Mus musculus
tcatcgacgtctatggcatcacgga

SEQ ID NO: 371419 - DNA, 25 bp, Mus musculus
tgctggcctactgggccgatcgcca

SEQ ID NO: 371420 - DNA, 25 bp, Mus musculus
acggtcgcgtcttctacagtgtcaa

SEQ ID NO: 371421 - DNA, 25 bp, Mus musculus
acgatggtgagccagtgctgttcca

SEQ ID NO: 371422 - DNA, 25 bp, Mus musculus
ccgtctctcatgagcgcacaggata

SEQ ID NO: 371423 - DNA, 25 bp, Mus musculus
cccattcgcctgtacgagcaggtgc

SEQ ID NO: 371424 - DNA, 25 bp, Mus musculus
cagcttctgcaacggagtcaccttc

SEQ ID NO: 371425 - DNA, 25 bp, Mus musculus
ccgcgcttccatgcgcaggctaagg

SEQ ID NO: 371426 - DNA, 25 bp, Mus musculus
caggctaagggcaagaacgtgcgtc

SEQ ID NO: 371427 - DNA, 25 bp, Mus musculus
ctctgggcactcatcgacgtctatg

SEQ ID NO: 371428 - DNA, 25 bp, Mus musculus
aacgtgcgtctggacggccactcgc

SEQ ID NO: 371429 - DNA, 25 bp, Mus musculus
cacgcggcggaacagcttctgcaac

SEQ ID NO: 371430 - DNA, 25 bp, Mus musculus
ttcgacaacaacgagctggagaaca

SEQ ID NO: 371431 - DNA, 25 bp, Mus musculus
cgcggacccgacgtgagcttgtccg

SEQ ID NO: 371432 - DNA, 25 bp, Mus musculus
ctggagaacaaccaggtggtggcca

SEQ ID NO: 371433 - DNA, 25 bp, Mus musculus
tggccaagctgggtcacctggctct

SEQ ID NO: 371434 - DNA, 25 bp, Mus musculus
tgctggacgccgagctgcgcttcca

SEQ ID NO: 371435 - DNA, 25 bp, Mus musculus
agcttgtccgccgaccgcaggctag

SEQ ID NO: 371436 - DNA, 25 bp, Mus musculus
ggccttcggcatcacgtcctgcgat

SEQ ID NO: 371437 - DNA, 25 bp, Mus musculus
ggcatcacgtcctgcgatcctggcg

SEQ ID NO: 371438 - DNA, 25 bp, Mus musculus
gctgctggaccgcaaggaatactgg

SEQ ID NO: 371439 - DNA, 25 bp, Mus musculus
aggcgacgcgctcagcttcacgctg

SEQ ID NO: 371440 - DNA, 25 bp, Mus musculus
tgcgtggacacctcacaggcgctct

SEQ ID NO: 371441 - DNA, 25 bp, Mus musculus
gcgctctgggccttcttcgcggtac

SEQ ID NO: 371442 - DNA, 25 bp, Mus musculus
tgcgcctgggtcaggctcgcctcag

SEQ ID NO: 371443 - DNA, 25 bp, Mus musculus
tcgtgttctccgagcggccgctgcg

SEQ ID NO: 371444 - DNA, 25 bp, Mus musculus
cagctcagctgggtgccgatccaat

SEQ ID NO: 371445 - DNA, 25 bp, Mus musculus
tgccgatccaatcgagggccgaata

SEQ ID NO: 371446 - DNA, 25 bp, Mus musculus
tccacccagagtgttgcagctcagc

SEQ ID NO: 371447 - DNA, 25 bp, Mus musculus
gcttagagacgctccacccagagtg

SEQ ID NO: 371448 - DNA, 25 bp, Mus musculus
ccctctctgcgtgtggagaaccgca

SEQ ID NO: 371449 - DNA, 25 bp, Mus musculus
gcccggtttacagctctcctaacat

SEQ ID NO: 371450 - DNA, 25 bp, Mus musculus
ctggctcgtcatcgggccgaacgtc

SEQ ID NO: 371451 - DNA, 25 bp, Mus musculus
gaagagcgatcagccgtggcctttc

SEQ ID NO: 371452 - DNA, 25 bp, Mus musculus
tgttttcccagaagcgctggcagcc

SEQ ID NO: 371453 - DNA, 25 bp, Mus musculus
ggccggtgtcacgtgctaccacatc

SEQ ID NO: 371454 - DNA, 25 bp, Mus musculus
caaagactgagtctccggcggcgtc

SEQ ID NO: 371455 - DNA, 25 bp, Mus musculus
ggcacccaaacaaagactgagtctc

SEQ ID NO: 371456 - DNA, 25 bp, Mus musculus
gtgtggcccgaaggcacccaaacaa

SEQ ID NO: 371457 - DNA, 25 bp, Mus musculus
tcgagggccgaataatcgctccgcc

SEQ ID NO: 371458 - DNA, 25 bp, Mus musculus
acgcagttcagcgttgggcacgata

SEQ ID NO: 371459 - DNA, 25 bp, Mus musculus
ggggccactcctggtatcacgttct

SEQ ID NO: 371460 - DNA, 25 bp, Mus musculus
acgtcatcggcctaggagcctctcg

SEQ ID NO: 371461 - DNA, 25 bp, Mus musculus
tggcgccgccaaagccaaaagcaaa

SEQ ID NO: 371462 - DNA, 25 bp, Mus musculus
agcgcggttttatgtagcctctcgg

SEQ ID NO: 371463 - DNA, 25 bp, Mus musculus
ttcactgcgcgctcgtccgacggag

SEQ ID NO: 371464 - DNA, 25 bp, Mus musculus
tcctaatctggcttcaccgcgcttt

SEQ ID NO: 371465 - DNA, 25 bp, Mus musculus
tgctcgctgctcctaatctggcttc

SEQ ID NO: 371466 - DNA, 25 bp, Mus musculus
ctccagaaaaagtcggtcgatcttg

SEQ ID NO: 371467 - DNA, 25 bp, Mus musculus
gcccgttctgcggttctccagaaaa

SEQ ID NO: 371468 - DNA, 25 bp, Mus musculus
tgaaagcgaagaaggagcgacaatc

SEQ ID NO: 371469 - DNA, 25 bp, Mus musculus
cgcacgttcactgagcccgcgatgt

SEQ ID NO: 371470 - DNA, 25 bp, Mus musculus
gtatcacgttctcagctggcccggc

SEQ ID NO: 371471 - DNA, 25 bp, Mus musculus
ggcacgatatgctccaggcccatgg

SEQ ID NO: 371472 - DNA, 25 bp, Mus musculus
ctcgcactctgttttccacggcgcg

SEQ ID NO: 371473 - DNA, 25 bp, Mus musculus
gccttcccattcagcgggccctcgg

SEQ ID NO: 371474 - DNA, 25 bp, Mus musculus
ccaatgggctgcgtggagcgtcact

SEQ ID NO: 371475 - DNA, 25 bp, Mus musculus
ctgcgtggagcgtcacttcccggcg

SEQ ID NO: 371476 - DNA, 25 bp, Mus musculus
tcggcggcacgatgccctttgactt

SEQ ID NO: 371477 - DNA, 25 bp, Mus musculus
ggcacgatgccctttgacttcagga

SEQ ID NO: 371478 - DNA, 25 bp, Mus musculus
cgatgccctttgacttcaggaggtg

SEQ ID NO: 371479 - DNA, 25 bp, Mus musculus
ccctttgacttcaggaggtgagtga

SEQ ID NO: 371480 - DNA, 25 bp, Mus musculus
cccgttacgtgcaaatgcgaccctg

SEQ ID NO: 371481 - DNA, 25 bp, Mus musculus
ttacgtgcaaatgcgaccctggtgc

SEQ ID NO: 371482 - DNA, 25 bp, Mus musculus
atgcgaccctggtgcactgtgcacg

SEQ ID NO: 371483 - DNA, 25 bp, Mus musculus
tggtgcactgtgcacgcctcggcag

SEQ ID NO: 371484 - DNA, 25 bp, Mus musculus
ctggcaagccctcgcactctgtttt

SEQ ID NO: 371485 - DNA, 25 bp, Mus musculus
cacgcctcggcaggccctaggggac

SEQ ID NO: 371486 - DNA, 25 bp, Mus musculus
ccacggccttactgtgcctttgatc

SEQ ID NO: 371487 - DNA, 25 bp, Mus musculus
gggaggaccgcatgcgctcctcaga

SEQ ID NO: 371488 - DNA, 25 bp, Mus musculus
agaaggatcgtacgtggaggactac

SEQ ID NO: 371489 - DNA, 25 bp, Mus musculus
gatcacggagagaaggatcgtacgt

SEQ ID NO: 371490 - DNA, 25 bp, Mus musculus
gggcctcctcgtgccctggtttatc

SEQ ID NO: 371491 - DNA, 25 bp, Mus musculus
tgttctggggcttcgtgggcctcct

SEQ ID NO: 371492 - DNA, 25 bp, Mus musculus
tactgtgcctttgatcgtgatgagc

SEQ ID NO: 371493 - DNA, 25 bp, Mus musculus
gcaggcatggcataccacggcctta

SEQ ID NO: 371494 - DNA, 25 bp, Mus musculus
aggctccggaccgattcggctgctg

SEQ ID NO: 371495 - DNA, 25 bp, Mus musculus
acgagagcgaggctccggaccgatt

SEQ ID NO: 371496 - DNA, 25 bp, Mus musculus
cctctgttgacacttccgggtggga

SEQ ID NO: 371497 - DNA, 25 bp, Mus musculus
cgccgatcacgtgagcctctgttga

SEQ ID NO: 371498 - DNA, 25 bp, Mus musculus
ctttagcgcgccgatcacgtgagcc

SEQ ID NO: 371499 - DNA, 25 bp, Mus musculus
ctttgatcgtgatgagcgtgttctg

SEQ ID NO: 371500 - DNA, 25 bp, Mus musculus
atggagccgcacttccggtgggatc

SEQ ID NO: 371501 - DNA, 25 bp, Mus musculus
acctttcggcgtccaggcgtgtcgt

SEQ ID NO: 371502 - DNA, 25 bp, Mus musculus
tgtcgtcaccatggatggccaatca

SEQ ID NO: 371503 - DNA, 25 bp, Mus musculus
cgcgcgactaaaatagcgcagtata

SEQ ID NO: 371504 - DNA, 25 bp, Mus musculus
cagtataaaagctggcgggaggaca

SEQ ID NO: 371505 - DNA, 25 bp, Mus musculus
cggaagttgttagccgccgctgcaa

SEQ ID NO: 371506 - DNA, 25 bp, Mus musculus
actctggcggcaatttggtttgtca

SEQ ID NO: 371507 - DNA, 25 bp, Mus musculus
tgtcagtgagtaacaagcgcagaac

SEQ ID NO: 371508 - DNA, 25 bp, Mus musculus
aagcgcagaactgggctcgtgctcg

SEQ ID NO: 371509 - DNA, 25 bp, Mus musculus
tgccggaaggacgagcccttctcca

SEQ ID NO: 371510 - DNA, 25 bp, Mus musculus
catccaggccgccttgtagcgcgga

SEQ ID NO: 371511 - DNA, 25 bp, Mus musculus
tccagaaaggtaccgtggtgccgca

SEQ ID NO: 371512 - DNA, 25 bp, Mus musculus
cgttccgcaccacattccagaaagg

SEQ ID NO: 371513 - DNA, 25 bp, Mus musculus
gtaggccgccgcagccttgcgtcat

SEQ ID NO: 371514 - DNA, 25 bp, Mus musculus
cgcacgaacgcgagcttactgctcg

SEQ ID NO: 371515 - DNA, 25 bp, Mus musculus
gccgagcctctgattggccagactt

SEQ ID NO: 371516 - DNA, 25 bp, Mus musculus
gaacccgtcaggaaggacataaaca

SEQ ID NO: 371517 - DNA, 25 bp, Mus musculus
ggatccagtgcctgaaccgccttca

SEQ ID NO: 371518 - DNA, 25 bp, Mus musculus
cttcagcctcaggtgaatgccgagc

SEQ ID NO: 371519 - DNA, 25 bp, Mus musculus
ccgatgcgagccgaatcgggctgcc

SEQ ID NO: 371520 - DNA, 25 bp, Mus musculus
ccgttagggccgtgccctttgcgct

SEQ ID NO: 371521 - DNA, 25 bp, Mus musculus
ctcccgggaaccagggatcgcgact

SEQ ID NO: 371522 - DNA, 25 bp, Mus musculus
gagaccggcacagctagtgttcaga

SEQ ID NO: 371523 - DNA, 25 bp, Mus musculus
tagtgttcagaaggctccggacgga

SEQ ID NO: 371524 - DNA, 25 bp, Mus musculus
ccctctcgggatttgtttatatgtc

SEQ ID NO: 371525 - DNA, 25 bp, Mus musculus
gcgagtcacgcgatttccgggaacc

SEQ ID NO: 371526 - DNA, 25 bp, Mus musculus
ttatatgtcctctctaagcagcttg

SEQ ID NO: 371527 - DNA, 25 bp, Mus musculus
taagcagcttgaaaagcccggaggc

SEQ ID NO: 371528 - DNA, 25 bp, Mus musculus
caggatgtccacgtccggatctgta

SEQ ID NO: 371529 - DNA, 25 bp, Mus musculus
cgacctagaggtgaaggcgcttatc

SEQ ID NO: 371530 - DNA, 25 bp, Mus musculus
cctttccttggactgcagccgtgct

SEQ ID NO: 371531 - DNA, 25 bp, Mus musculus
tcgccgtagccgcatttccaacatg

SEQ ID NO: 371532 - DNA, 25 bp, Mus musculus
ccggatctgtaaccaagagattgtc

SEQ ID NO: 371533 - DNA, 25 bp, Mus musculus
ggcgcttatccaggtacaaattctt

SEQ ID NO: 371534 - DNA, 25 bp, Mus musculus
cgagatcactgaccttcaggctttt

SEQ ID NO: 371535 - DNA, 25 bp, Mus musculus
tcctaaggcaccattcggtcggttc

SEQ ID NO: 371536 - DNA, 25 bp, Mus musculus
cggttccaggatggctcctaaggca

SEQ ID NO: 371537 - DNA, 25 bp, Mus musculus
gggtctcccgcagcatcacatttga

SEQ ID NO: 371538 - DNA, 25 bp, Mus musculus
aatattcgcgcctggtccggttcca

SEQ ID NO: 371539 - DNA, 25 bp, Mus musculus
ggccgccttgacatcttccagaata

SEQ ID NO: 371540 - DNA, 25 bp, Mus musculus
gcaggagccacgtgaacgcgttcaa

SEQ ID NO: 371541 - DNA, 25 bp, Mus musculus
ttgtgaactgttggtttgcccaccc

SEQ ID NO: 371542 - DNA, 25 bp, Mus musculus
gtctcggctttgtccagctccactg

SEQ ID NO: 371543 - DNA, 25 bp, Mus musculus
gggcatagtgggagctttcccatcc

SEQ ID NO: 371544 - DNA, 25 bp, Mus musculus
tggatcggagaaaggtcccaggcct

SEQ ID NO: 371545 - DNA, 25 bp, Mus musculus
ctacgtcaataaagtgggatggatc

SEQ ID NO: 371546 - DNA, 25 bp, Mus musculus
caggtccgagacaccaggctacgtc

SEQ ID NO: 371547 - DNA, 25 bp, Mus musculus
tggaatccgtcgaaagtgcccgtga

SEQ ID NO: 371548 - DNA, 25 bp, Mus musculus
tcccgggactctgcacggtgttcaa

SEQ ID NO: 371549 - DNA, 25 bp, Mus musculus
tcccggtcctagtgtggaatccgtc

SEQ ID NO: 371550 - DNA, 25 bp, Mus musculus
cccgacgccaaagttcacgaagttg

SEQ ID NO: 371551 - DNA, 25 bp, Mus musculus
ttctgcagcgcgcacagctctgaag

SEQ ID NO: 371552 - DNA, 25 bp, Mus musculus
agacgcccgaattgccctgcggcat

SEQ ID NO: 371553 - DNA, 25 bp, Mus musculus
tgagcttcagcacgctggccagctg

SEQ ID NO: 371554 - DNA, 25 bp, Mus musculus
ttccctaccaggctcggatgccgtg

SEQ ID NO: 371555 - DNA, 25 bp, Mus musculus
tagccataggcattgagacccacgc

SEQ ID NO: 371556 - DNA, 25 bp, Mus musculus
caggatgtctttgactgagaaaggc

SEQ ID NO: 371557 - DNA, 25 bp, Mus musculus
gcctctctgccctggatgtggcgcg

SEQ ID NO: 371558 - DNA, 25 bp, Mus musculus
tggggacagcctccccgcatggtgc

SEQ ID NO: 371559 - DNA, 25 bp, Mus musculus
tagcagagagtggtgctgcccaccc

SEQ ID NO: 371560 - DNA, 25 bp, Mus musculus
tttcacagcgccaggtgggtagcag

SEQ ID NO: 371561 - DNA, 25 bp, Mus musculus
gacgcaggtttcacagcgccaggtg

SEQ ID NO: 371562 - DNA, 25 bp, Mus musculus
atgtctttgactgagaaaggcgtgg

SEQ ID NO: 371563 - DNA, 25 bp, Mus musculus
tgctccaggttcaggatgtctttga

SEQ ID NO: 371564 - DNA, 25 bp, Mus musculus
tgctgctgctccaggttcaggatgt

SEQ ID NO: 371565 - DNA, 25 bp, Mus musculus
cagacgccaggctacgctgctgctg

SEQ ID NO: 371566 - DNA, 25 bp, Mus musculus
cctcgggcttgaaggcggccagcat

SEQ ID NO: 371567 - DNA, 25 bp, Mus musculus
gcagctctgccaggccggacgctgc

SEQ ID NO: 371568 - DNA, 25 bp, Mus musculus
aacatggtggcgacgcaggtttcac

SEQ ID NO: 371569 - DNA, 25 bp, Mus musculus
ccgcctcggggccagagtaggcctc

SEQ ID NO: 371570 - DNA, 25 bp, Mus musculus
cgaggtacacctacggcttcaggta

SEQ ID NO: 371571 - DNA, 25 bp, Mus musculus
agctccagcgcatcctgcgtaaata

SEQ ID NO: 371572 - DNA, 25 bp, Mus musculus
ttgaaaagcgatcagcccggcccga

SEQ ID NO: 371573 - DNA, 25 bp, Mus musculus
ttcctgcaatcagccgcgaaaagta

SEQ ID NO: 371574 - DNA, 25 bp, Mus musculus
agctgcaactatcacccggaatgtc

SEQ ID NO: 371575 - DNA, 25 bp, Mus musculus
gaatgtcattaatgcgccggggaga

SEQ ID NO: 371576 - DNA, 25 bp, Mus musculus
ttcaggtactcagccatccggagcc

SEQ ID NO: 371577 - DNA, 25 bp, Mus musculus
ccggccagctctgcaacgaggtaca

SEQ ID NO: 371578 - DNA, 25 bp, Mus musculus
gcgactctgctcttcgtctggctga

SEQ ID NO: 371579 - DNA, 25 bp, Mus musculus
aggggccgctgtgcagcaataattg

SEQ ID NO: 371580 - DNA, 25 bp, Mus musculus
tactgtatcaacaaaggggccgctg

SEQ ID NO: 371581 - DNA, 25 bp, Mus musculus
agcactttttcggactactgtatca

SEQ ID NO: 371582 - DNA, 25 bp, Mus musculus
aggcagcgttatccgtagctttatc

SEQ ID NO: 371583 - DNA, 25 bp, Mus musculus
tccattggagacaggcagcgttatc

SEQ ID NO: 371584 - DNA, 25 bp, Mus musculus
gtccaagagtcactgcccgaacctg

SEQ ID NO: 371585 - DNA, 25 bp, Mus musculus
ggccattcgctcctagcttcgcgga

SEQ ID NO: 371586 - DNA, 25 bp, Mus musculus
tggtggctgaaacccaaccggaagc

SEQ ID NO: 371587 - DNA, 25 bp, Mus musculus
gtcgctgcacagtcccaggatcatc

SEQ ID NO: 371588 - DNA, 25 bp, Mus musculus
agaccgtgctttacagcccttaatg

SEQ ID NO: 371589 - DNA, 25 bp, Mus musculus
tgtgtcccacggaacatgccgcctt

SEQ ID NO: 371590 - DNA, 25 bp, Mus musculus
tgtcacacggggaaagcccagacta

SEQ ID NO: 371591 - DNA, 25 bp, Mus musculus
tgaacacaacactcgcggggacttt

SEQ ID NO: 371592 - DNA, 25 bp, Mus musculus
ttgcgggagcgttcacaattccgga

SEQ ID NO: 371593 - DNA, 25 bp, Mus musculus
tcaaacttcagtctctgccggtaga

SEQ ID NO: 371594 - DNA, 25 bp, Mus musculus
gtcgcctgtacaaaccctctgctgt

SEQ ID NO: 371595 - DNA, 25 bp, Mus musculus
ggacatcttttgtctctcggcaaga

SEQ ID NO: 371596 - DNA, 25 bp, Mus musculus
cgccaagctttcaaggtgcacatga

SEQ ID NO: 371597 - DNA, 25 bp, Mus musculus
ctctgcagacgctttgggcttgaga

SEQ ID NO: 371598 - DNA, 25 bp, Mus musculus
tttttgcgccaacgcaacgagcgcg

SEQ ID NO: 371599 - DNA, 25 bp, Mus musculus
tggcgagtccaaagcatcctccgga

SEQ ID NO: 371600 - DNA, 25 bp, Mus musculus
gagcctcgccctgcagcgagtctga

SEQ ID NO: 371601 - DNA, 25 bp, Mus musculus
tcgccctgcagcgagtctgaggagc

SEQ ID NO: 371602 - DNA, 25 bp, Mus musculus
gcttccagtctcgtcttcaaggtga

SEQ ID NO: 371603 - DNA, 25 bp, Mus musculus
caccggccggactgcaacagcgatg

SEQ ID NO: 371604 - DNA, 25 bp, Mus musculus
ctgcaacagcgatggcgagtccaaa

SEQ ID NO: 371605 - DNA, 25 bp, Mus musculus
gcggagacggccgtactcgtccctg

SEQ ID NO: 371606 - DNA, 25 bp, Mus musculus
ggaaaaacgcagatcggccggactg

SEQ ID NO: 371607 - DNA, 25 bp, Mus musculus
cgcagagaatggaaaaacgcagatc

SEQ ID NO: 371608 - DNA, 25 bp, Mus musculus
tgcgtgctttttcgcagagaatgga

SEQ ID NO: 371609 - DNA, 25 bp, Mus musculus
agagagtcatctgcgtgctttttcg

SEQ ID NO: 371610 - DNA, 25 bp, Mus musculus
ttcaaggtgagagagtcatctgcgt

SEQ ID NO: 371611 - DNA, 25 bp, Mus musculus
gctacgacagcttccagtctcgtct

SEQ ID NO: 371612 - DNA, 25 bp, Mus musculus
agcacagttgcctgggaagagcatg

SEQ ID NO: 371613 - DNA, 25 bp, Mus musculus
cgacgtttgcgggaccctgtcccag

SEQ ID NO: 371614 - DNA, 25 bp, Mus musculus
agcagcactgctagagaaccagttg

SEQ ID NO: 371615 - DNA, 25 bp, Mus musculus
acgtgggtcctaagcagcactgcta

SEQ ID NO: 371616 - DNA, 25 bp, Mus musculus
cacgctgagcacgtgggtcctaagc

SEQ ID NO: 371617 - DNA, 25 bp, Mus musculus
acacgtgagttccacgctgagcacg

SEQ ID NO: 371618 - DNA, 25 bp, Mus musculus
cgcattcgccgacacgtgagttcca

SEQ ID NO: 371619 - DNA, 25 bp, Mus musculus
tttcccgattttcttccgcattcgc

SEQ ID NO: 371620 - DNA, 25 bp, Mus musculus
ttgcctgggaagagcatgccacatc

SEQ ID NO: 371621 - DNA, 25 bp, Mus musculus
gcgggaccctgtcccagcacagttg

SEQ ID NO: 371622 - DNA, 25 bp, Mus musculus
gggctgcggactgctgccctctcgt

SEQ ID NO: 371623 - DNA, 25 bp, Mus musculus
ccctctcgtggccagtcaggggaac

SEQ ID NO: 371624 - DNA, 25 bp, Mus musculus
gagcatgccacatcggttttcccga

SEQ ID NO: 371625 - DNA, 25 bp, Mus musculus
agaaccagttgctggccctgcggtc

SEQ ID NO: 371626 - DNA, 25 bp, Mus musculus
agttctcttgctccggcggactaga

SEQ ID NO: 371627 - DNA, 25 bp, Mus musculus
aggcacctttgcacatgcgtattgc

SEQ ID NO: 371628 - DNA, 25 bp, Mus musculus
tgacgcaaccagaggcctagctccg

SEQ ID NO: 371629 - DNA, 25 bp, Mus musculus
aaggggtctagttctcttgctccgg

SEQ ID NO: 371630 - DNA, 25 bp, Mus musculus
gctcaggcacctttgcacatgcgta

SEQ ID NO: 371631 - DNA, 25 bp, Mus musculus
tcaaaagtgactggtgtggcggatt

SEQ ID NO: 371632 - DNA, 25 bp, Mus musculus
gcttggccgattggcctggcgaatt

SEQ ID NO: 371633 - DNA, 25 bp, Mus musculus
attggcctggcgaattggcctggct

SEQ ID NO: 371634 - DNA, 25 bp, Mus musculus
tggcgaattggcctggctccgacgt

SEQ ID NO: 371635 - DNA, 25 bp, Mus musculus
gaggacgcgggtctcgtcaccctgc

SEQ ID NO: 371636 - DNA, 25 bp, Mus musculus
tgctgcctttgcatcccttcctgtg

SEQ ID NO: 371637 - DNA, 25 bp, Mus musculus
gcctttgcatcccttcctgtgcgga

SEQ ID NO: 371638 - DNA, 25 bp, Mus musculus
cctggcgccaatagcggaggacgca

SEQ ID NO: 371639 - DNA, 25 bp, Mus musculus
agaggcctagctccgcgctccggag

SEQ ID NO: 371640 - DNA, 25 bp, Mus musculus
ggcgctcacactcagtcttcccgca

SEQ ID NO: 371641 - DNA, 25 bp, Mus musculus
tgctgctgctttggctgctgcgtca

SEQ ID NO: 371642 - DNA, 25 bp, Mus musculus
tccctccttctgtcgactcctcctg

SEQ ID NO: 371643 - DNA, 25 bp, Mus musculus
ggctagctgccaagaaggttatttc

SEQ ID NO: 371644 - DNA, 25 bp, Mus musculus
gaaggttatttcctgctgacccaga

SEQ ID NO: 371645 - DNA, 25 bp, Mus musculus
ctgcctgcccgtccctctgtcgtct

SEQ ID NO: 371646 - DNA, 25 bp, Mus musculus
gcagctaacggatgtggcatggggc

SEQ ID NO: 371647 - DNA, 25 bp, Mus musculus
ctgacctgcaggctagctgccaaga

SEQ ID NO: 371648 - DNA, 25 bp, Mus musculus
gttatttcctgctgacccagagcaa

SEQ ID NO: 371649 - DNA, 25 bp, Mus musculus
gagcaagcctcccatccgaaaaagg

SEQ ID NO: 371650 - DNA, 25 bp, Mus musculus
tcccatccgaaaaaggggctgcagg

SEQ ID NO: 371651 - DNA, 25 bp, Mus musculus
ggctgcagggatttcctcgacctcc

SEQ ID NO: 371652 - DNA, 25 bp, Mus musculus
gcagggatttcctcgacctccgcga

SEQ ID NO: 371653 - DNA, 25 bp, Mus musculus
cccaacagcgcagcgccctccgggc

SEQ ID NO: 371654 - DNA, 25 bp, Mus musculus
cggagatcggctggggcgaagtctc

SEQ ID NO: 371655 - DNA, 25 bp, Mus musculus
aaagtcggagatcggctggggcgaa

SEQ ID NO: 371656 - DNA, 25 bp, Mus musculus
ccggtgtgaagaaagtcggagatcg

SEQ ID NO: 371657 - DNA, 25 bp, Mus musculus
tgaagaaagtcggagatcggctggg

SEQ ID NO: 371658 - DNA, 25 bp, Mus musculus
tgtgaagaaagtcggagatcggctg

SEQ ID NO: 371659 - DNA, 25 bp, Mus musculus
ggtgtgaagaaagtcggagatcggc

SEQ ID NO: 371660 - DNA, 25 bp, Mus musculus
aagaaagtcggagatcggctggggc

SEQ ID NO: 371661 - DNA, 25 bp, Mus musculus
cccggtgtgaagaaagtcggagatc

SEQ ID NO: 371662 - DNA, 25 bp, Mus musculus
tgctcctcacgccgggcctcgaccg

SEQ ID NO: 371663 - DNA, 25 bp, Mus musculus
gcgacggggaagcgccttcctccat

SEQ ID NO: 371664 - DNA, 25 bp, Mus musculus
cgcgacggggaagcgccttcctcca

SEQ ID NO: 371665 - DNA, 25 bp, Mus musculus
cagctcaggcgcgacggggaagcgc

SEQ ID NO: 371666 - DNA, 25 bp, Mus musculus
agatcggctggggcgaagtctcgcg

SEQ ID NO: 371667 - DNA, 25 bp, Mus musculus
aggcgcgacggggaagcgccttcct

SEQ ID NO: 371668 - DNA, 25 bp, Mus musculus
agcgcgccacgctcgagaacgcggt

SEQ ID NO: 371669 - DNA, 25 bp, Mus musculus
ctcgagaacgcggtggcaagccacg

SEQ ID NO: 371670 - DNA, 25 bp, Mus musculus
cgcttccgctcgcagctggctgagg

SEQ ID NO: 371671 - DNA, 25 bp, Mus musculus
cttccgctcgcagctggctgaggca

SEQ ID NO: 371672 - DNA, 25 bp, Mus musculus
ttccgctcgcagctggctgaggcac

SEQ ID NO: 371673 - DNA, 25 bp, Mus musculus
ccgctcgcagctggctgaggcactt

SEQ ID NO: 371674 - DNA, 25 bp, Mus musculus
ctcgcagctggctgaggcacttggc

SEQ ID NO: 371675 - DNA, 25 bp, Mus musculus
gctgaggcacttggcggggtctcgc

SEQ ID NO: 371676 - DNA, 25 bp, Mus musculus
cggggtctcgcacggtcagcccgca

SEQ ID NO: 371677 - DNA, 25 bp, Mus musculus
cacccgctccctcggaggcggagcg

SEQ ID NO: 371678 - DNA, 25 bp, Mus musculus
cgccacgctcgagaacgcggtggca

SEQ ID NO: 371679 - DNA, 25 bp, Mus musculus
ccacgctcgagaacgcggtggcaag

SEQ ID NO: 371680 - DNA, 25 bp, Mus musculus
cacgctcgagaacgcggtggcaagc

SEQ ID NO: 371681 - DNA, 25 bp, Mus musculus
ctcgcacggtcagcccgcacccgct

SEQ ID NO: 371682 - DNA, 25 bp, Mus musculus
tggtaccctcaggtttctctcggga

SEQ ID NO: 371683 - DNA, 25 bp, Mus musculus
cccagcagcaggttgctggtaccct

SEQ ID NO: 371684 - DNA, 25 bp, Mus musculus
cagcagcaggttgctggtaccctca

SEQ ID NO: 371685 - DNA, 25 bp, Mus musculus
aggttgctggtaccctcaggtttct

SEQ ID NO: 371686 - DNA, 25 bp, Mus musculus
gttgctggtaccctcaggtttctct

SEQ ID NO: 371687 - DNA, 25 bp, Mus musculus
ttgctggtaccctcaggtttctctc

SEQ ID NO: 371688 - DNA, 25 bp, Mus musculus
gctggtaccctcaggtttctctcgg

SEQ ID NO: 371689 - DNA, 25 bp, Mus musculus
ccctcaggtttctctcgggaacgtg

SEQ ID NO: 371690 - DNA, 25 bp, Mus musculus
cctcaggtttctctcgggaacgtgg

SEQ ID NO: 371691 - DNA, 25 bp, Mus musculus
ctcaggtttctctcgggaacgtgga

SEQ ID NO: 371692 - DNA, 25 bp, Mus musculus
tcaggtttctctcgggaacgtggag

SEQ ID NO: 371693 - DNA, 25 bp, Mus musculus
tctctcgggaacgtggagggagtca

SEQ ID NO: 371694 - DNA, 25 bp, Mus musculus
tggagggagtcagttgcgcccccat

SEQ ID NO: 371695 - DNA, 25 bp, Mus musculus
tgctggtaccctcaggtttctctcg

SEQ ID NO: 371696 - DNA, 25 bp, Mus musculus
cagctttatctgaggtcgtgcgccc

SEQ ID NO: 371697 - DNA, 25 bp, Mus musculus
ccagttcatgcagcccgcgctggta

SEQ ID NO: 371698 - DNA, 25 bp, Mus musculus
gcccgcgctggtagagaaaagaaga

SEQ ID NO: 371699 - DNA, 25 bp, Mus musculus
ggccgctcattgcacggacgaagga

SEQ ID NO: 371700 - DNA, 25 bp, Mus musculus
agcggccgcctcttacctgcagtag

SEQ ID NO: 371701 - DNA, 25 bp, Mus musculus
gcagtagccacgtgacgcgaaaaca

SEQ ID NO: 371702 - DNA, 25 bp, Mus musculus
cgcgaaaacagtgtgcaccacgtga

SEQ ID NO: 371703 - DNA, 25 bp, Mus musculus
tgcaccacgtgacaggagcagccct

SEQ ID NO: 371704 - DNA, 25 bp, Mus musculus
ccgaccaatcggcagctttatctga

SEQ ID NO: 371705 - DNA, 25 bp, Mus musculus
gctccggagtgtgcctagtaacagc

SEQ ID NO: 371706 - DNA, 25 bp, Mus musculus
tttccgtgaatcctcaaccggttgc

SEQ ID NO: 371707 - DNA, 25 bp, Mus musculus
cgtcacgtgatgaggcctgtccttt

SEQ ID NO: 371708 - DNA, 25 bp, Mus musculus
tccacgtgacgtgagacctggcgac

SEQ ID NO: 371709 - DNA, 25 bp, Mus musculus
cgccctcttaagtgggcgtggcgtc

SEQ ID NO: 371710 - DNA, 25 bp, Mus musculus
cgcaccgtctctgtgccagtggagg

SEQ ID NO: 371711 - DNA, 25 bp, Mus musculus
acagggcgccctcgtccgggctgcc

SEQ ID NO: 371712 - DNA, 25 bp, Mus musculus
gatcccgatcccgaggacagggcgc

SEQ ID NO: 371713 - DNA, 25 bp, Mus musculus
gagcagccgtgatcccgatcccgat

SEQ ID NO: 371714 - DNA, 25 bp, Mus musculus
ggagagcagccgtgatcccgatccc

SEQ ID NO: 371715 - DNA, 25 bp, Mus musculus
ccacggcgagcatggtacggcggcc

SEQ ID NO: 371716 - DNA, 25 bp, Mus musculus
gacgcaccgtctctgtgccagtgga

SEQ ID NO: 371717 - DNA, 25 bp, Mus musculus
actgctgagacgcaccgtctctgtg

SEQ ID NO: 371718 - DNA, 25 bp, Mus musculus
aaacaaactgctgagacgcaccgtc

SEQ ID NO: 371719 - DNA, 25 bp, Mus musculus
agccgaaacaaactgctgagacgca

SEQ ID NO: 371720 - DNA, 25 bp, Mus musculus
gagtccagccgaaacaaactgctga

SEQ ID NO: 371721 - DNA, 25 bp, Mus musculus
ggagcgagtccagccgaaacaaact

SEQ ID NO: 371722 - DNA, 25 bp, Mus musculus
accggaggagcgagtccagccgaaa

SEQ ID NO: 371723 - DNA, 25 bp, Mus musculus
cgagcaggctcgtgccccggacagt

SEQ ID NO: 371724 - DNA, 25 bp, Mus musculus
tcaccgcgcggccgtccaggccgtc

SEQ ID NO: 371725 - DNA, 25 bp, Mus musculus
gttctcgctgcatcttccgagtggg

SEQ ID NO: 371726 - DNA, 25 bp, Mus musculus
atgttctcgctgcatcttccgagtg

SEQ ID NO: 371727 - DNA, 25 bp, Mus musculus
gcatgttctcgctgcatcttccgag

SEQ ID NO: 371728 - DNA, 25 bp, Mus musculus
cgcatgttctcgctgcatcttccga

SEQ ID NO: 371729 - DNA, 25 bp, Mus musculus
ttctcgctgcatcttccgagtgggg

SEQ ID NO: 371730 - DNA, 25 bp, Mus musculus
ggccgggcggacgaagcgcgcgcgt

SEQ ID NO: 371731 - DNA, 25 bp, Mus musculus
agggagccgttcccgcggctgtcac

SEQ ID NO: 371732 - DNA, 25 bp, Mus musculus
cggcagcagcggtcgcctagcaacg

SEQ ID NO: 371733 - DNA, 25 bp, Mus musculus
acggcagcagcggtcgcctagcaac

SEQ ID NO: 371734 - DNA, 25 bp, Mus musculus
gctcgtgacagaggcggccacggca

SEQ ID NO: 371735 - DNA, 25 bp, Mus musculus
gtctccgggcgacggggctcgtgac

SEQ ID NO: 371736 - DNA, 25 bp, Mus musculus
tcccccgtctctctcgcgctgtctc

SEQ ID NO: 371737 - DNA, 25 bp, Mus musculus
cagctgctccctccgcatgttctcg

SEQ ID NO: 371738 - DNA, 25 bp, Mus musculus
ccagaactgagggaaccgccttcca

SEQ ID NO: 371739 - DNA, 25 bp, Mus musculus
ctcactgctactccagaactgaggg

SEQ ID NO: 371740 - DNA, 25 bp, Mus musculus
acttcagacccggttgtcccgcgtg

SEQ ID NO: 371741 - DNA, 25 bp, Mus musculus
tgcgctccagacttcagacccggtt

SEQ ID NO: 371742 - DNA, 25 bp, Mus musculus
tccggcggaactgcggtagcttccg

SEQ ID NO: 371743 - DNA, 25 bp, Mus musculus
agcaagccttactgcggagcccgtg

SEQ ID NO: 371744 - DNA, 25 bp, Mus musculus
tccgtccgcacagccaatgaggaga

SEQ ID NO: 371745 - DNA, 25 bp, Mus musculus
acagccaatgaggagacggcttgta

SEQ ID NO: 371746 - DNA, 25 bp, Mus musculus
agacggcttgtaggctgccgctctc

SEQ ID NO: 371747 - DNA, 25 bp, Mus musculus
tgtaggctgccgctctcccattggc

SEQ ID NO: 371748 - DNA, 25 bp, Mus musculus
tctcccattggctgcagaactggtc

SEQ ID NO: 371749 - DNA, 25 bp, Mus musculus
ccgcattggcgtccggcggaactgc

SEQ ID NO: 371750 - DNA, 25 bp, Mus musculus
aactgcggtagcttccggccggcca

SEQ ID NO: 371751 - DNA, 25 bp, Mus musculus
cattggctgcagaactggtcccgcc

SEQ ID NO: 371752 - DNA, 25 bp, Mus musculus
ggaagaccaggaacaccgtgtctga

SEQ ID NO: 371753 - DNA, 25 bp, Mus musculus
ccgtctgtcctcgtgtgtgtggacc

SEQ ID NO: 371754 - DNA, 25 bp, Mus musculus
aactcacctgcatgttgggcacaaa

SEQ ID NO: 371755 - DNA, 25 bp, Mus musculus
gttgggcacaaagcccttcttgatc

SEQ ID NO: 371756 - DNA, 25 bp, Mus musculus
cttcttgatcctccagcagttttta

SEQ ID NO: 371757 - DNA, 25 bp, Mus musculus
gcagtttttattgatcttgtccaag

SEQ ID NO: 371758 - DNA, 25 bp, Mus musculus
tcttgtccaagaactgtagctcatc

SEQ ID NO: 371759 - DNA, 25 bp, Mus musculus
tagctcatcgttgtagttacgactc

SEQ ID NO: 371760 - DNA, 25 bp, Mus musculus
tagttacgactcatggtggcggcga

SEQ ID NO: 371761 - DNA, 25 bp, Mus musculus
cgaggccagcgatagctcctggcta

SEQ ID NO: 371762 - DNA, 25 bp, Mus musculus
cctggctacgcttagaaagagaaac

SEQ ID NO: 371763 - DNA, 25 bp, Mus musculus
tggcaagcgccgaggctcaaaactc

SEQ ID NO: 371764 - DNA, 25 bp, Mus musculus
ccgaggctcaaaactcttcgcgcga

SEQ ID NO: 371765 - DNA, 25 bp, Mus musculus
tcttcgcgcgagtcctgatcatctc

SEQ ID NO: 371766 - DNA, 25 bp, Mus musculus
gcatccaggcgcaagacggttctca

SEQ ID NO: 371767 - DNA, 25 bp, Mus musculus
ttcagggcgacctcgtcgcctcgag

SEQ ID NO: 371768 - DNA, 25 bp, Mus musculus
ctcctcgctctctggtggcagtcag

SEQ ID NO: 371769 - DNA, 25 bp, Mus musculus
gcagggtgaccgtggccaagttccc

SEQ ID NO: 371770 - DNA, 25 bp, Mus musculus
ctggtggcagtcagcctactcctgc

SEQ ID NO: 371771 - DNA, 25 bp, Mus musculus
ctagagaacgccctagagcctgggg

SEQ ID NO: 371772 - DNA, 25 bp, Mus musculus
cgagcgcgcagagacgcaggcacct

SEQ ID NO: 371773 - DNA, 25 bp, Mus musculus
cctcccaggcgggatttgcatgtgt

SEQ ID NO: 371774 - DNA, 25 bp, Mus musculus
cgctaagggcttgagcgcgcatcca

SEQ ID NO: 371775 - DNA, 25 bp, Mus musculus
cgcaagacggttctcagctgggcgc

SEQ ID NO: 371776 - DNA, 25 bp, Mus musculus
gccaagttcccggtgtgctcagcca

SEQ ID NO: 371777 - DNA, 25 bp, Mus musculus
tgtgctcagccacgcgtgggccgca

SEQ ID NO: 371778 - DNA, 25 bp, Mus musculus
tgctggtggacaagccgtctagaga

SEQ ID NO: 371779 - DNA, 25 bp, Mus musculus
agcctggcagctcgcttcagggcga

SEQ ID NO: 371780 - DNA, 25 bp, Mus musculus
cgcagaacaacgagatggggacctc

SEQ ID NO: 371781 - DNA, 25 bp, Mus musculus
acaaccgtgacctgcaagtgagcgc

SEQ ID NO: 371782 - DNA, 25 bp, Mus musculus
atgaccgcatgaagcgcgcccagca

SEQ ID NO: 371783 - DNA, 25 bp, Mus musculus
cggtgctgatcatgcggcccatcct

SEQ ID NO: 371784 - DNA, 25 bp, Mus musculus
aagtgagcgccttgctcgtccctgc

SEQ ID NO: 371785 - DNA, 25 bp, Mus musculus
tcggcttgcaccgagggcacgacat

SEQ ID NO: 371786 - DNA, 25 bp, Mus musculus
tcccgctatttgctgggcctcggct

SEQ ID NO: 371787 - DNA, 25 bp, Mus musculus
tatacagggtatggggtacctcaca

SEQ ID NO: 371788 - DNA, 25 bp, Mus musculus
ggagctccgggcagatatatacagg

SEQ ID NO: 371789 - DNA, 25 bp, Mus musculus
gctgtcaacatgagcgacctgggca

SEQ ID NO: 371790 - DNA, 25 bp, Mus musculus
caagtccacggtcgctgtcaacatg

SEQ ID NO: 371791 - DNA, 25 bp, Mus musculus
gcccagcaggagaccaagtccacgg

SEQ ID NO: 371792 - DNA, 25 bp, Mus musculus
cggagcgcttcttcaaggtgcttca

SEQ ID NO: 371793 - DNA, 25 bp, Mus musculus
ctgctgtgtgagaaccacaaccgtg

SEQ ID NO: 371794 - DNA, 25 bp, Mus musculus
tgtgaccgggtgtcaccgggccaat

SEQ ID NO: 371795 - DNA, 25 bp, Mus musculus
gccaatcagattgtgcggcaagacc

SEQ ID NO: 371796 - DNA, 25 bp, Mus musculus
cggcaagaccgaagcatggagcaga

SEQ ID NO: 371797 - DNA, 25 bp, Mus musculus
catggagcagatcgtgttcccggta

SEQ ID NO: 371798 - DNA, 25 bp, Mus musculus
atcgtgttcccggtacctgccatct

SEQ ID NO: 371799 - DNA, 25 bp, Mus musculus
ctgccagttcctgacagaggagacg

SEQ ID NO: 371800 - DNA, 25 bp, Mus musculus
ttcaccaccactgagcaggacgagc

SEQ ID NO: 371801 - DNA, 25 bp, Mus musculus
agtgagcgacttcttcgaccagtcc

SEQ ID NO: 371802 - DNA, 25 bp, Mus musculus
gtcctccttcctgcacaacgagatg

SEQ ID NO: 371803 - DNA, 25 bp, Mus musculus
gtgagggcctctgcccagtgtgacc

SEQ ID NO: 371804 - DNA, 25 bp, Mus musculus
cgccggcttcgcagtgaggaccagc

SEQ ID NO: 371805 - DNA, 25 bp, Mus musculus
agaggagacgaagcaccggctcttc

SEQ ID NO: 371806 - DNA, 25 bp, Mus musculus
cacaacgagatggagtggcagcgcc

SEQ ID NO: 371807 - DNA, 25 bp, Mus musculus
gcagggcagcaaagtgagcgacttc

SEQ ID NO: 371808 - DNA, 25 bp, Mus musculus
cgtgcgcactaaggcgcactggcct

SEQ ID NO: 371809 - DNA, 25 bp, Mus musculus
cacagagcttaaggaaacgccggta

SEQ ID NO: 371810 - DNA, 25 bp, Mus musculus
cactggccattcctcacagagctta

SEQ ID NO: 371811 - DNA, 25 bp, Mus musculus
cgtttggtctcgtccactggccatt

SEQ ID NO: 371812 - DNA, 25 bp, Mus musculus
cgctgccgcaggtaagcgcccaagt

SEQ ID NO: 371813 - DNA, 25 bp, Mus musculus
agaaggcgtcgcactccgcagctaa

SEQ ID NO: 371814 - DNA, 25 bp, Mus musculus
ctgggtgttctctccctcccggaag

SEQ ID NO: 371815 - DNA, 25 bp, Mus musculus
gccgcccatcgcttcgacgtgccca

SEQ ID NO: 371816 - DNA, 25 bp, Mus musculus
agcggccgacgcatgcgcagatccc

SEQ ID NO: 371817 - DNA, 25 bp, Mus musculus
ggtacctcgcgcacgtgcagcctgg

SEQ ID NO: 371818 - DNA, 25 bp, Mus musculus
tgcaagatgggtacctcgcgcacgt

SEQ ID NO: 371819 - DNA, 25 bp, Mus musculus
ctaactgcaagatgggtacctcgcg

SEQ ID NO: 371820 - DNA, 25 bp, Mus musculus
gtcgcactccgcagctaactgcaag

SEQ ID NO: 371821 - DNA, 25 bp, Mus musculus
ggacatgcgcagttctaccaacggc

SEQ ID NO: 371822 - DNA, 25 bp, Mus musculus
cttgttgcggtagacgttccgcgtg

SEQ ID NO: 371823 - DNA, 25 bp, Mus musculus
tgtatcctcgtcatcctccgagctg

SEQ ID NO: 371824 - DNA, 25 bp, Mus musculus
ggcgccgagggcttgcccatcttca

SEQ ID NO: 371825 - DNA, 25 bp, Mus musculus
atcttcacccacaggatggccaaga

SEQ ID NO: 371826 - DNA, 25 bp, Mus musculus
gatggccaagaagccgagcagcagc

SEQ ID NO: 371827 - DNA, 25 bp, Mus musculus
cccagagcaggagccgagacaggca

SEQ ID NO: 371828 - DNA, 25 bp, Mus musculus
gggacgtactgttgtcctccgcctc

SEQ ID NO: 371829 - DNA, 25 bp, Mus musculus
tccggcgttcgtgtatcctcgtcat

SEQ ID NO: 371830 - DNA, 25 bp, Mus musculus
gacaggccggccatggccaggacac

SEQ ID NO: 371831 - DNA, 25 bp, Mus musculus
gaagggcgaccacggacgccatatt

SEQ ID NO: 371832 - DNA, 25 bp, Mus musculus
ccacggacgccatattgggaagggc

SEQ ID NO: 371833 - DNA, 25 bp, Mus musculus
tccgccatgatgaaaggcgtctgtg

SEQ ID NO: 371834 - DNA, 25 bp, Mus musculus
cgcatggaggctatgtccgccatga

SEQ ID NO: 371835 - DNA, 25 bp, Mus musculus
aggagccgagacaggcagcgctcca

SEQ ID NO: 371836 - DNA, 25 bp, Mus musculus
ctccatagctacgtgcaagggcggt

SEQ ID NO: 371837 - DNA, 25 bp, Mus musculus
atcagaaaacaatttggcgtccgtc

SEQ ID NO: 371838 - DNA, 25 bp, Mus musculus
gcatcgcagtctccatagctacgtg

SEQ ID NO: 371839 - DNA, 25 bp, Mus musculus
gacgccgccatcagaaaacaatttg

SEQ ID NO: 371840 - DNA, 25 bp, Mus musculus
gttcaagaaaagacagacgccgcca

SEQ ID NO: 371841 - DNA, 25 bp, Mus musculus
ttggcgtccgtcaaaaggcccagtg

SEQ ID NO: 371842 - DNA, 25 bp, Mus musculus
agcatctgcggattgatccggctca

SEQ ID NO: 371843 - DNA, 25 bp, Mus musculus
gctgctttgaaaacgcaaattgagt

SEQ ID NO: 371844 - DNA, 25 bp, Mus musculus
atgcgtctattagctgctttgaaaa

SEQ ID NO: 371845 - DNA, 25 bp, Mus musculus
gaaaatggattttttaatgcgtcta

SEQ ID NO: 371846 - DNA, 25 bp, Mus musculus
attcaatcgcgagcgaaaatggatt

SEQ ID NO: 371847 - DNA, 25 bp, Mus musculus
ccggctcagtcagattcaatcgcga

SEQ ID NO: 371848 - DNA, 25 bp, Mus musculus
ggattgatccggctcagtcagattc

SEQ ID NO: 371849 - DNA, 25 bp, Mus musculus
agggcgtccagcttgggtaacacgc

SEQ ID NO: 371850 - DNA, 25 bp, Mus musculus
ctcgacccgcttagatggcggtgtc

SEQ ID NO: 371851 - DNA, 25 bp, Mus musculus
gcgtgagcagcaagtaggcattcta

SEQ ID NO: 371852 - DNA, 25 bp, Mus musculus
ggcattctattctcgcctctgtgcg

SEQ ID NO: 371853 - DNA, 25 bp, Mus musculus
gcctctgtgcgtgtatactcgctca

SEQ ID NO: 371854 - DNA, 25 bp, Mus musculus
ctcgctcagcttaagccggttttgc

SEQ ID NO: 371855 - DNA, 25 bp, Mus musculus
tgatgcggttcagcacgccgctgtt

SEQ ID NO: 371856 - DNA, 25 bp, Mus musculus
agcgtctgcaccagcaggtcgcgca

SEQ ID NO: 371857 - DNA, 25 bp, Mus musculus
cctcacgcggggaagaagacctacg

SEQ ID NO: 371858 - DNA, 25 bp, Mus musculus
cttcaggccggtgtttgggtttcat

SEQ ID NO: 371859 - DNA, 25 bp, Mus musculus
cgaggtctcagcgtgtcgtttatgg

SEQ ID NO: 371860 - DNA, 25 bp, Mus musculus
tgacgcgctctgtggcatattaaca

SEQ ID NO: 371861 - DNA, 25 bp, Mus musculus
cctgtgcgagagaagagtccacttt

SEQ ID NO: 371862 - DNA, 25 bp, Mus musculus
tggctgaacttactggctcgacccg

SEQ ID NO: 371863 - DNA, 25 bp, Mus musculus
tccaaggggttgtttctaagcgtga

SEQ ID NO: 371864 - DNA, 25 bp, Mus musculus
caggtccgagatgtcacacttgagc

SEQ ID NO: 371865 - DNA, 25 bp, Mus musculus
ccgaggccttgacgatcggagtgtc

SEQ ID NO: 371866 - DNA, 25 bp, Mus musculus
gcatagcagagaaagatgcccgcca

SEQ ID NO: 371867 - DNA, 25 bp, Mus musculus
tcttggtcagcagggccgcgtagct

SEQ ID NO: 371868 - DNA, 25 bp, Mus musculus
ccctgctcaaagatgcggtagatgc

SEQ ID NO: 371869 - DNA, 25 bp, Mus musculus
cgaccgcttgccctgctcaaagatg

SEQ ID NO: 371870 - DNA, 25 bp, Mus musculus
caactgcagcgagatgaggacgaag

SEQ ID NO: 371871 - DNA, 25 bp, Mus musculus
accacacgcagatgccaagcaactg

SEQ ID NO: 371872 - DNA, 25 bp, Mus musculus
tcggagtgtcgttgtagcgcacaaa

SEQ ID NO: 371873 - DNA, 25 bp, Mus musculus
tcaagtgtccgctggtcctggaagt

SEQ ID NO: 371874 - DNA, 25 bp, Mus musculus
atgcccgccagcaggacgtagctca

SEQ ID NO: 371875 - DNA, 25 bp, Mus musculus
tcctggaagtccaccaccgagtggg

SEQ ID NO: 371876 - DNA, 25 bp, Mus musculus
cgcgtagctgatgctcatgccaagc

SEQ ID NO: 371877 - DNA, 25 bp, Mus musculus
tagcgcacaaaagtgaccaccacga

SEQ ID NO: 371878 - DNA, 25 bp, Mus musculus
tgagggcccggacgatgtccaccat

SEQ ID NO: 371879 - DNA, 25 bp, Mus musculus
tatcactcaagtcgggagccgtgga

SEQ ID NO: 371880 - DNA, 25 bp, Mus musculus
gcggctgttatcactcaagtcggga

SEQ ID NO: 371881 - DNA, 25 bp, Mus musculus
acgatgtccaccatggcctgggcct

SEQ ID NO: 371882 - DNA, 25 bp, Mus musculus
gtcatagcggctgttatcactcaag

SEQ ID NO: 371883 - DNA, 25 bp, Mus musculus
tagttccacttgagggcccggacga

SEQ ID NO: 371884 - DNA, 25 bp, Mus musculus
acacatagttccacttgagggcccg

SEQ ID NO: 371885 - DNA, 25 bp, Mus musculus
tgaggccagcgtggacacatagttc

SEQ ID NO: 371886 - DNA, 25 bp, Mus musculus
gtagctaccctctgaggccagcgtg

SEQ ID NO: 371887 - DNA, 25 bp, Mus musculus
tccacgccgctctcgccgtagctac

SEQ ID NO: 371888 - DNA, 25 bp, Mus musculus
tggataaaggcctccacgccgctct

SEQ ID NO: 371889 - DNA, 25 bp, Mus musculus
ctcgggacttctggataaaggcctc

SEQ ID NO: 371890 - DNA, 25 bp, Mus musculus
cgttctctcgggacttctggataaa

SEQ ID NO: 371891 - DNA, 25 bp, Mus musculus
cctggtatgtgtccgagggcacgac

SEQ ID NO: 371892 - DNA, 25 bp, Mus musculus
gctccgatgacacccaccactcgtt

SEQ ID NO: 371893 - DNA, 25 bp, Mus musculus
gcctccagccggtggatacctttct

SEQ ID NO: 371894 - DNA, 25 bp, Mus musculus
tccgtgccgtccttctcgatgagcg

SEQ ID NO: 371895 - DNA, 25 bp, Mus musculus
gatacctttctccttcttcaactcg

SEQ ID NO: 371896 - DNA, 25 bp, Mus musculus
ctcgatgagcgcctgcacaaaggtc

SEQ ID NO: 371897 - DNA, 25 bp, Mus musculus
ctgcacaaaggtcagggactgctcc

SEQ ID NO: 371898 - DNA, 25 bp, Mus musculus
ctgctccagggcgtgggtatccctt

SEQ ID NO: 371899 - DNA, 25 bp, Mus musculus
tgggtatcccttgagcaggtgtcca

SEQ ID NO: 371900 - DNA, 25 bp, Mus musculus
tcccttgagcaggtgtccagaatgc

SEQ ID NO: 371901 - DNA, 25 bp, Mus musculus
ggtgtccagaatgcgggcgcccaac

SEQ ID NO: 371902 - DNA, 25 bp, Mus musculus
aatgcgggcgcccaacgtgatgttg

SEQ ID NO: 371903 - DNA, 25 bp, Mus musculus
caacgtgatgttgggcagtaggtcc

SEQ ID NO: 371904 - DNA, 25 bp, Mus musculus
tccagggcaaagagcatggcctcca

SEQ ID NO: 371905 - DNA, 25 bp, Mus musculus
accactcgttcaggcttggtgatga

SEQ ID NO: 371906 - DNA, 25 bp, Mus musculus
gagtgtgacggccttcccgctctcg

SEQ ID NO: 371907 - DNA, 25 bp, Mus musculus
agccacgcacgcgtagcagcgtcga

SEQ ID NO: 371908 - DNA, 25 bp, Mus musculus
aggttagggccgagcgcctcagcat

SEQ ID NO: 371909 - DNA, 25 bp, Mus musculus
gcctttgccctgctggctagcatct

SEQ ID NO: 371910 - DNA, 25 bp, Mus musculus
ggctagcatctccatggtaaccgta

SEQ ID NO: 371911 - DNA, 25 bp, Mus musculus
tctccatggtaaccgtacacaaacc

SEQ ID NO: 371912 - DNA, 25 bp, Mus musculus
tacacaaaccacctttcgctgcagg

SEQ ID NO: 371913 - DNA, 25 bp, Mus musculus
cctttcgctgcaggccgagcggtca

SEQ ID NO: 371914 - DNA, 25 bp, Mus musculus
gagcggtcagcctacagatccagga

SEQ ID NO: 371915 - DNA, 25 bp, Mus musculus
tacagatccaggacgccgcagagcg

SEQ ID NO: 371916 - DNA, 25 bp, Mus musculus
gggaatccgggctcgactcaaaaca

SEQ ID NO: 371917 - DNA, 25 bp, Mus musculus
ggctcgactcaaaacacctgtgaca

SEQ ID NO: 371918 - DNA, 25 bp, Mus musculus
cacctgtgacaagcgctagacactt

SEQ ID NO: 371919 - DNA, 25 bp, Mus musculus
tgacaagcgctagacacttagaccc

SEQ ID NO: 371920 - DNA, 25 bp, Mus musculus
cgggaagcttggcttgcgttaaatc

SEQ ID NO: 371921 - DNA, 25 bp, Mus musculus
tcacttccggggtttcggtcgctgc

SEQ ID NO: 371922 - DNA, 25 bp, Mus musculus
ggtccggctccgagagaccatggcc

SEQ ID NO: 371923 - DNA, 25 bp, Mus musculus
cctgtgactgtgacgctcggcagct

SEQ ID NO: 371924 - DNA, 25 bp, Mus musculus
tgtagctgcactgggcgcctgtgac

SEQ ID NO: 371925 - DNA, 25 bp, Mus musculus
tcctgctgcccacgttggggttcag

SEQ ID NO: 371926 - DNA, 25 bp, Mus musculus
agtcggagccaacgctcgggcagct

SEQ ID NO: 371927 - DNA, 25 bp, Mus musculus
acccagccgctcgaggtgccggagt

SEQ ID NO: 371928 - DNA, 25 bp, Mus musculus
tgaagctgcgcgtgcggcttcagaa

SEQ ID NO: 371929 - DNA, 25 bp, Mus musculus
cggtccgactctcgccatgaagctg

SEQ ID NO: 371930 - DNA, 25 bp, Mus musculus
gccgaccgaagcttgcggtccgact

SEQ ID NO: 371931 - DNA, 25 bp, Mus musculus
cggagctccttgctttcggtttctt

SEQ ID NO: 371932 - DNA, 25 bp, Mus musculus
gcgcctcgcctccaggtggcgatgt

SEQ ID NO: 371933 - DNA, 25 bp, Mus musculus
cgtagagactcaagtgcgcccaagc

SEQ ID NO: 371934 - DNA, 25 bp, Mus musculus
tggcgctgacgctgcggaccaaacc

SEQ ID NO: 371935 - DNA, 25 bp, Mus musculus
caactcaccgcgcatcggcgaggtg

SEQ ID NO: 371936 - DNA, 25 bp, Mus musculus
cagctcttagctgctcgcggtgccg

SEQ ID NO: 371937 - DNA, 25 bp, Mus musculus
aggcggcggccagctcttagctgct

SEQ ID NO: 371938 - DNA, 25 bp, Mus musculus
atcggcgaggtgaacgccacggcta

SEQ ID NO: 371939 - DNA, 25 bp, Mus musculus
agaggccacctcctcaaacgccggg

SEQ ID NO: 371940 - DNA, 25 bp, Mus musculus
cctggaactagggagagctcgcaga

SEQ ID NO: 371941 - DNA, 25 bp, Mus musculus
ggaccaactccacctgtcatcagtg

SEQ ID NO: 371942 - DNA, 25 bp, Mus musculus
tagcctctccgcagaggggacgcgc

SEQ ID NO: 371943 - DNA, 25 bp, Mus musculus
cagcctagcctctccgcagagggga

SEQ ID NO: 371944 - DNA, 25 bp, Mus musculus
aggaccacggcgcaaaggcgcacac

SEQ ID NO: 371945 - DNA, 25 bp, Mus musculus
ctctggccgaggaccacggcgcaaa

SEQ ID NO: 371946 - DNA, 25 bp, Mus musculus
tgacgctgcggaccaaaccgggcgc

SEQ ID NO: 371947 - DNA, 25 bp, Mus musculus
agggagagctcgcagaggccacctc

SEQ ID NO: 371948 - DNA, 25 bp, Mus musculus
tgttttcacctgaacagattccggg

SEQ ID NO: 371949 - DNA, 25 bp, Mus musculus
tgccctttgaaagagacccgtgcgg

SEQ ID NO: 371950 - DNA, 25 bp, Mus musculus
cccggtttcttgagtgggctgcgat

SEQ ID NO: 371951 - DNA, 25 bp, Mus musculus
gccactcacctgcaatgacgacaag

SEQ ID NO: 371952 - DNA, 25 bp, Mus musculus
cggcgagcagaacctgggtacgctc

SEQ ID NO: 371953 - DNA, 25 bp, Mus musculus
agaacctgggtacgctcccatcgcg

SEQ ID NO: 371954 - DNA, 25 bp, Mus musculus
cgacaaggcttttctaatccacata

SEQ ID NO: 371955 - DNA, 25 bp, Mus musculus
cgggatgcagagagttgttttcacc

SEQ ID NO: 371956 - DNA, 25 bp, Mus musculus
cctgaacagattccgggaggaggca

SEQ ID NO: 371957 - DNA, 25 bp, Mus musculus
ctgcaatgacgacaaggcttttcta

SEQ ID NO: 371958 - DNA, 25 bp, Mus musculus
taatccacatatgccctttgaaaga

SEQ ID NO: 371959 - DNA, 25 bp, Mus musculus
cctcagattcgtgcgcagccactca

SEQ ID NO: 371960 - DNA, 25 bp, Mus musculus
tggcagggcccctatttcaggacca

SEQ ID NO: 371961 - DNA, 25 bp, Mus musculus
tgggtacgctcccatcgcgggcctg

SEQ ID NO: 371962 - DNA, 25 bp, Mus musculus
tggcgttggccaagtttcacgtttg

SEQ ID NO: 371963 - DNA, 25 bp, Mus musculus
cggctccaagaaggcgtgagttcgc

SEQ ID NO: 371964 - DNA, 25 bp, Mus musculus
gccgcgagaagctccttagggtacg

SEQ ID NO: 371965 - DNA, 25 bp, Mus musculus
caagactttgttttttacgcgcctg

SEQ ID NO: 371966 - DNA, 25 bp, Mus musculus
ggctgcgctcctctaattgggactc

SEQ ID NO: 371967 - DNA, 25 bp, Mus musculus
acgccgtcacctgcttggtggcaga

SEQ ID NO: 371968 - DNA, 25 bp, Mus musculus
ttattatttattgaggccgcgcacg

SEQ ID NO: 371969 - DNA, 25 bp, Mus musculus
agcgggatccgtcagtgttccctcg

SEQ ID NO: 371970 - DNA, 25 bp, Mus musculus
cacttaaacagcagggccgccgtca

SEQ ID NO: 371971 - DNA, 25 bp, Mus musculus
cggccaatcgctcggctcctttgaa

SEQ ID NO: 371972 - DNA, 25 bp, Mus musculus
ctcctttgaagcctgcacctgggtg

SEQ ID NO: 371973 - DNA, 25 bp, Mus musculus
cacgtttgggtttcacaagactttg

SEQ ID NO: 371974 - DNA, 25 bp, Mus musculus
cccggtttcagatccgcatttgcga

SEQ ID NO: 371975 - DNA, 25 bp, Mus musculus
caggctgctcgggaactgtgagaaa

SEQ ID NO: 371976 - DNA, 25 bp, Mus musculus
gtgcagccctgacagcaacaccttg

SEQ ID NO: 371977 - DNA, 25 bp, Mus musculus
aggatcctggcgactggttgtccgc

SEQ ID NO: 371978 - DNA, 25 bp, Mus musculus
agtggtcaccgcaggatcctggcga

SEQ ID NO: 371979 - DNA, 25 bp, Mus musculus
tcctccagcgcgtgatcaaaggagc

SEQ ID NO: 371980 - DNA, 25 bp, Mus musculus
ccggaagagtcctccagcgcgtgat

SEQ ID NO: 371981 - DNA, 25 bp, Mus musculus
tgacagcaacaccttgggttggccc

SEQ ID NO: 371982 - DNA, 25 bp, Mus musculus
cgaaccagaaccgaaaaggtatgag

SEQ ID NO: 371983 - DNA, 25 bp, Mus musculus
ccgaaaaggtatgaggccactctta

SEQ ID NO: 371984 - DNA, 25 bp, Mus musculus
tgaggccactcttaggatgctgctg

SEQ ID NO: 371985 - DNA, 25 bp, Mus musculus
ctcttaggatgctgctggcccgcct

SEQ ID NO: 371986 - DNA, 25 bp, Mus musculus
tatcgaggggccgatgcccgcctag

SEQ ID NO: 371987 - DNA, 25 bp, Mus musculus
atgcccgcctagataccttgggacc

SEQ ID NO: 371988 - DNA, 25 bp, Mus musculus
gccatgccttacctcccgccgtgca

SEQ ID NO: 371989 - DNA, 25 bp, Mus musculus
ggccgagggcctcattcctttctgt

SEQ ID NO: 371990 - DNA, 25 bp, Mus musculus
ccatgcacgtgtgccgagcgccgag

SEQ ID NO: 371991 - DNA, 25 bp, Mus musculus
gcgcggctgctacgcagacagcgta

SEQ ID NO: 371992 - DNA, 25 bp, Mus musculus
tcagctgcgtaaggcacgcgggctc

SEQ ID NO: 371993 - DNA, 25 bp, Mus musculus
tggacgcgctgcgtcagctgcgtaa

SEQ ID NO: 371994 - DNA, 25 bp, Mus musculus
ccgccattttggacgcgctgcgtca

SEQ ID NO: 371995 - DNA, 25 bp, Mus musculus
tttcaggctccaaccatacggactc

SEQ ID NO: 371996 - DNA, 25 bp, Mus musculus
acggactcagcagctcaacgttaga

SEQ ID NO: 371997 - DNA, 25 bp, Mus musculus
tcggccagcagcaaccctgcgggga

SEQ ID NO: 371998 - DNA, 25 bp, Mus musculus
gtgtgtccgctacacggctccgcgg

SEQ ID NO: 371999 - DNA, 25 bp, Mus musculus
cttcttgtagccgtcgccgtcgtag

SEQ ID NO: 372000 - DNA, 25 bp, Mus musculus
aggagggtctgtgtgtccgctacac

SEQ ID NO: 372001 - DNA, 25 bp, Mus musculus
ctggttcgacttgagcttcatcatc

SEQ ID NO: 372002 - DNA, 25 bp, Mus musculus
tcgacttgagcttcatcatcctccg

SEQ ID NO: 372003 - DNA, 25 bp, Mus musculus
caacgttagaatcgaacggctggcc

SEQ ID NO: 372004 - DNA, 25 bp, Mus musculus
gaagggcgagtacggccttcgcctc

SEQ ID NO: 372005 - DNA, 25 bp, Mus musculus
gacgccggtcttcttcagtcgactc

SEQ ID NO: 372006 - DNA, 25 bp, Mus musculus
gcagagaggccggtccgcattgccc

SEQ ID NO: 372007 - DNA, 25 bp, Mus musculus
tagcccgtgagttgtgtccggagct

SEQ ID NO: 372008 - DNA, 25 bp, Mus musculus
attgctagcccgtgagttgtgtccg

SEQ ID NO: 372009 - DNA, 25 bp, Mus musculus
cccacctggagattgctagcccgtg

SEQ ID NO: 372010 - DNA, 25 bp, Mus musculus
atgtgcgagccatcccgctacgctt

SEQ ID NO: 372011 - DNA, 25 bp, Mus musculus
tgctaggacgcatgtgcgagccatc

SEQ ID NO: 372012 - DNA, 25 bp, Mus musculus
ccggacgccggaggaactcaccgcg

SEQ ID NO: 372013 - DNA, 25 bp, Mus musculus
actctgagtcgcagagctgcgtccc

SEQ ID NO: 372014 - DNA, 25 bp, Mus musculus
ggtcttcttcagtcgactctgagtc

SEQ ID NO: 372015 - DNA, 25 bp, Mus musculus
atcgggacgccggtcttcttcagtc

SEQ ID NO: 372016 - DNA, 25 bp, Mus musculus
ggcgcttcccgccacacgtggcctt

SEQ ID NO: 372017 - DNA, 25 bp, Mus musculus
acaaaagccctctgggcacggcgcg

SEQ ID NO: 372018 - DNA, 25 bp, Mus musculus
ttgtggttcgtaggtagacagcgcc

SEQ ID NO: 372019 - DNA, 25 bp, Mus musculus
gaggctcctcggaagagccatctgt

SEQ ID NO: 372020 - DNA, 25 bp, Mus musculus
atcgcccttcacacacctagaatag

SEQ ID NO: 372021 - DNA, 25 bp, Mus musculus
acctagaatagctttccgagcctgg

SEQ ID NO: 372022 - DNA, 25 bp, Mus musculus
gaatagctttccgagcctggagcgc

SEQ ID NO: 372023 - DNA, 25 bp, Mus musculus
agacagcgcctggtatgctcccaac

SEQ ID NO: 372024 - DNA, 25 bp, Mus musculus
aagagccatctgtgctgcaaggccc

SEQ ID NO: 372025 - DNA, 25 bp, Mus musculus
ctctcagcgcaggaggttgtggttc

SEQ ID NO: 372026 - DNA, 25 bp, Mus musculus
ggtatgctcccaacgcaatcgcgca

SEQ ID NO: 372027 - DNA, 25 bp, Mus musculus
tggataaggcttcgactcttctgcg

SEQ ID NO: 372028 - DNA, 25 bp, Mus musculus
catctggtgcgttggataaggcttc

SEQ ID NO: 372029 - DNA, 25 bp, Mus musculus
cgtcgtctacatctggtgcgttgga

SEQ ID NO: 372030 - DNA, 25 bp, Mus musculus
ccacgcgtgcttgcgtcgtctacat

SEQ ID NO: 372031 - DNA, 25 bp, Mus musculus
cccacacagaggctcctcggaagag

SEQ ID NO: 372032 - DNA, 25 bp, Mus musculus
tccgtcaggtgggtcagagccttag

SEQ ID NO: 372033 - DNA, 25 bp, Mus musculus
gtcagagccttagggcgtctggagg

SEQ ID NO: 372034 - DNA, 25 bp, Mus musculus
tgagagcgtgtctgtcaggtccgaa

SEQ ID NO: 372035 - DNA, 25 bp, Mus musculus
cgtgtctgtcaggtccgaagcagtt

SEQ ID NO: 372036 - DNA, 25 bp, Mus musculus
tgtctgtcaggtccgaagcagttgg

SEQ ID NO: 372037 - DNA, 25 bp, Mus musculus
ggggactgatcccttcggaaggcca

SEQ ID NO: 372038 - DNA, 25 bp, Mus musculus
gaggccaagcaatggggtcaagtca

SEQ ID NO: 372039 - DNA, 25 bp, Mus musculus
ccaagcaatggggtcaagtcagttt

SEQ ID NO: 372040 - DNA, 25 bp, Mus musculus
atggggtcaagtcagtttggtgcca

SEQ ID NO: 372041 - DNA, 25 bp, Mus musculus
ggcgtgggagcaagtccccttattg

SEQ ID NO: 372042 - DNA, 25 bp, Mus musculus
acttctgggctagggcgcagtgtga

SEQ ID NO: 372043 - DNA, 25 bp, Mus musculus
tccgaagcagttgggggactgatcc

SEQ ID NO: 372044 - DNA, 25 bp, Mus musculus
gccaggaactgaggcgtcggtgcct

SEQ ID NO: 372045 - DNA, 25 bp, Mus musculus
gactgatcccttcggaaggccaagg

SEQ ID NO: 372046 - DNA, 25 bp, Mus musculus
tgcagatgctcagtatatgatggcg

SEQ ID NO: 372047 - DNA, 25 bp, Mus musculus
agtccagggcttcagtgcgtgatgc

SEQ ID NO: 372048 - DNA, 25 bp, Mus musculus
ggcttcagtgcgtgatgcagatgct

SEQ ID NO: 372049 - DNA, 25 bp, Mus musculus
ctccggcgcccaggtaggggctcta

SEQ ID NO: 372050 - DNA, 25 bp, Mus musculus
gctcagtatatgatggcgttgaata

SEQ ID NO: 372051 - DNA, 25 bp, Mus musculus
tatatgatggcgttgaatacagccg

SEQ ID NO: 372052 - DNA, 25 bp, Mus musculus
ttgaatacagccgagggcaggtatc

SEQ ID NO: 372053 - DNA, 25 bp, Mus musculus
ctgcgctcggcggagtctctgacct

SEQ ID NO: 372054 - DNA, 25 bp, Mus musculus
atggcgttgaatacagccgagggca

SEQ ID NO: 372055 - DNA, 25 bp, Mus musculus
gaatacagccgagggcaggtatctg

SEQ ID NO: 372056 - DNA, 25 bp, Mus musculus
cgcgtcgccattggctcacggagaa

SEQ ID NO: 372057 - DNA, 25 bp, Mus musculus
taccgcggtgctgccacctgcgcag

SEQ ID NO: 372058 - DNA, 25 bp, Mus musculus
ggcggagtctctgaccttcctcctt

SEQ ID NO: 372059 - DNA, 25 bp, Mus musculus
cccgctgatggtgtccggtgctccg

SEQ ID NO: 372060 - DNA, 25 bp, Mus musculus
ctgctgtccacccagggaggacgtc

SEQ ID NO: 372061 - DNA, 25 bp, Mus musculus
ctgccacggagcaggtgaccagcca

SEQ ID NO: 372062 - DNA, 25 bp, Mus musculus
agttcgggcgctgtcgcctcccgag

SEQ ID NO: 372063 - DNA, 25 bp, Mus musculus
tggctcctgcagttcgggcgctgtc

SEQ ID NO: 372064 - DNA, 25 bp, Mus musculus
ttgccatagaaacgagcagcgggcg

SEQ ID NO: 372065 - DNA, 25 bp, Mus musculus
ttgcccggttgccatagaaacgagc

SEQ ID NO: 372066 - DNA, 25 bp, Mus musculus
cagcattgcccggttgccatagaaa

SEQ ID NO: 372067 - DNA, 25 bp, Mus musculus
gtccacccagggaggacgtctttgc

SEQ ID NO: 372068 - DNA, 25 bp, Mus musculus
atcaccgcggtgtggtgcagaaaga

SEQ ID NO: 372069 - DNA, 25 bp, Mus musculus
cgaaaattcacgagaggcgcgcctg

SEQ ID NO: 372070 - DNA, 25 bp, Mus musculus
aacccgtgccggcagcgaaaattca

SEQ ID NO: 372071 - DNA, 25 bp, Mus musculus
ggatgtcggcaaacccgtgccggca

SEQ ID NO: 372072 - DNA, 25 bp, Mus musculus
cgtccgaccctggtttggcccagcg

SEQ ID NO: 372073 - DNA, 25 bp, Mus musculus
cgtctttgcgcagcattgcccggtt

SEQ ID NO: 372074 - DNA, 25 bp, Mus musculus
ggagctcatcgttgcccaccgtgca

SEQ ID NO: 372075 - DNA, 25 bp, Mus musculus
tcgcgtgcccacaactgcattattc

SEQ ID NO: 372076 - DNA, 25 bp, Mus musculus
agccctggactctcgctcacagtgg

SEQ ID NO: 372077 - DNA, 25 bp, Mus musculus
agccgccagcgccaagaatcttctt

SEQ ID NO: 372078 - DNA, 25 bp, Mus musculus
atccttctccgggaggccactcgtt

SEQ ID NO: 372079 - DNA, 25 bp, Mus musculus
gactcgtgttccagcgacccttggc

SEQ ID NO: 372080 - DNA, 25 bp, Mus musculus
gccgggctacttggaaggcacttcc

SEQ ID NO: 372081 - DNA, 25 bp, Mus musculus
ccaccgtgcacagtgcccggttaaa

SEQ ID NO: 372082 - DNA, 25 bp, Mus musculus
cccggttaaacccagcgagtgagct

SEQ ID NO: 372083 - DNA, 25 bp, Mus musculus
cgagtgagctcggactgtagcatca

SEQ ID NO: 372084 - DNA, 25 bp, Mus musculus
gctagcgctcggcaactttgaagaa

SEQ ID NO: 372085 - DNA, 25 bp, Mus musculus
ctttgaagaaaagagcggcagtccc

SEQ ID NO: 372086 - DNA, 25 bp, Mus musculus
gcgacccttggccacttagtcctgt

SEQ ID NO: 372087 - DNA, 25 bp, Mus musculus
ttccctataaggatctgaacggtcc

SEQ ID NO: 372088 - DNA, 25 bp, Mus musculus
cgcggtcactcgctgtttggacacc

SEQ ID NO: 372089 - DNA, 25 bp, Mus musculus
actcgctgtttggacaccaggtggg

SEQ ID NO: 372090 - DNA, 25 bp, Mus musculus
caccaggtggggaactacaagcgga

SEQ ID NO: 372091 - DNA, 25 bp, Mus musculus
gtgaagcgcatcgacgatgggcacc

SEQ ID NO: 372092 - DNA, 25 bp, Mus musculus
atcgacgatgggcaccgcctgtgca

SEQ ID NO: 372093 - DNA, 25 bp, Mus musculus
accgcctgtgcaacgacctcatgag

SEQ ID NO: 372094 - DNA, 25 bp, Mus musculus
acgacctcatgagctgcgtgcagga

SEQ ID NO: 372095 - DNA, 25 bp, Mus musculus
agcgcgccaagatcgagaaggcata

SEQ ID NO: 372096 - DNA, 25 bp, Mus musculus
tcgagaaggcatacgcgcagcagct

SEQ ID NO: 372097 - DNA, 25 bp, Mus musculus
atacgcgcagcagctcaccgactgg

SEQ ID NO: 372098 - DNA, 25 bp, Mus musculus
agcagctcaccgactgggccaagcg

SEQ ID NO: 372099 - DNA, 25 bp, Mus musculus
gggccaagcgctggcgccagctcat

SEQ ID NO: 372100 - DNA, 25 bp, Mus musculus
ctggcgccagctcatcgagaaaggt

SEQ ID NO: 372101 - DNA, 25 bp, Mus musculus
cgccagctcatcgagaaaggtgccc

SEQ ID NO: 372102 - DNA, 25 bp, Mus musculus
ggggactttggcgacccagctgcta

SEQ ID NO: 372103 - DNA, 25 bp, Mus musculus
cctcggggactttggcgacccagct

SEQ ID NO: 372104 - DNA, 25 bp, Mus musculus
caatgacgggacactgctcgggctc

SEQ ID NO: 372105 - DNA, 25 bp, Mus musculus
ctggctgtcaatgacgggacactgc

SEQ ID NO: 372106 - DNA, 25 bp, Mus musculus
ccagaggcctggctgtcaatgacgg

SEQ ID NO: 372107 - DNA, 25 bp, Mus musculus
tgctcatccaacgtgctcccagagg

SEQ ID NO: 372108 - DNA, 25 bp, Mus musculus
tctagcgagtgctcatccaacgtgc

SEQ ID NO: 372109 - DNA, 25 bp, Mus musculus
tcgattgcacctgctctagcgagtg

SEQ ID NO: 372110 - DNA, 25 bp, Mus musculus
acaaccatcgattgcacctgctcta

SEQ ID NO: 372111 - DNA, 25 bp, Mus musculus
aatatctttcaggacctcgcccaca

SEQ ID NO: 372112 - DNA, 25 bp, Mus musculus
gcaggccgtctcaatatctttcagg

SEQ ID NO: 372113 - DNA, 25 bp, Mus musculus
cagaagcttgcaggccgtctcaata

SEQ ID NO: 372114 - DNA, 25 bp, Mus musculus
cctgctgtgatgttcagaagcttgc

SEQ ID NO: 372115 - DNA, 25 bp, Mus musculus
cagggacggtctcacctgctgtgat

SEQ ID NO: 372116 - DNA, 25 bp, Mus musculus
gctgaacttctgcatgagctccgga

SEQ ID NO: 372117 - DNA, 25 bp, Mus musculus
cccatgctcaggctgggaacccgaa

SEQ ID NO: 372118 - DNA, 25 bp, Mus musculus
tcacgagtctgagaggtgcttcgga

SEQ ID NO: 372119 - DNA, 25 bp, Mus musculus
cccacactgcgtgggaggagtcacg

SEQ ID NO: 372120 - DNA, 25 bp, Mus musculus
tgacctcaccgcgacagagcggagg

SEQ ID NO: 372121 - DNA, 25 bp, Mus musculus
aactcggtgacgtctctcgcgtgac

SEQ ID NO: 372122 - DNA, 25 bp, Mus musculus
cttcagtgacgtcataactcggtga

SEQ ID NO: 372123 - DNA, 25 bp, Mus musculus
tgagctccggatccaagtccacgtc

SEQ ID NO: 372124 - DNA, 25 bp, Mus musculus
agcacgtccttgtctgtggtgccca

SEQ ID NO: 372125 - DNA, 25 bp, Mus musculus
gaactcggagatgagcacgtccttg

SEQ ID NO: 372126 - DNA, 25 bp, Mus musculus
caccagttggtcatgtccaggaaga

SEQ ID NO: 372127 - DNA, 25 bp, Mus musculus
gctgccagcaggattggctccgcgt

SEQ ID NO: 372128 - DNA, 25 bp, Mus musculus
gagtactccacgagcgggctccggt

SEQ ID NO: 372129 - DNA, 25 bp, Mus musculus
cgaaagcccgccttcagtgacgtca

SEQ ID NO: 372130 - DNA, 25 bp, Mus musculus
gcacccacagcatccgtagggcaga

SEQ ID NO: 372131 - DNA, 25 bp, Mus musculus
cgcggattgaacctcagaggcaccc

SEQ ID NO: 372132 - DNA, 25 bp, Mus musculus
cacagcatccgtagggcagaggccg

SEQ ID NO: 372133 - DNA, 25 bp, Mus musculus
gtctgcatcctttgctcgcgtcggc

SEQ ID NO: 372134 - DNA, 25 bp, Mus musculus
ctttgctcgcgtcggcgcagcctgt

SEQ ID NO: 372135 - DNA, 25 bp, Mus musculus
gcgcagcctgtgtgcgtcagttcct

SEQ ID NO: 372136 - DNA, 25 bp, Mus musculus
agccaacggcttgtggagcatcatg

SEQ ID NO: 372137 - DNA, 25 bp, Mus musculus
acggcttgtggagcatcatgcccaa

SEQ ID NO: 372138 - DNA, 25 bp, Mus musculus
ttgaacctcagaggcacccacagca

SEQ ID NO: 372139 - DNA, 25 bp, Mus musculus
tcatgcccaagtgagtgtggccctg

SEQ ID NO: 372140 - DNA, 25 bp, Mus musculus
ctctccggccatcctggcagagtgg

SEQ ID NO: 372141 - DNA, 25 bp, Mus musculus
agtgggcgcggaccctcgctcagaa

SEQ ID NO: 372142 - DNA, 25 bp, Mus musculus
tcgctcagaagcctcgcattctgtc

SEQ ID NO: 372143 - DNA, 25 bp, Mus musculus
agaagcctcgcattctgtcaggacg

SEQ ID NO: 372144 - DNA, 25 bp, Mus musculus
gcgacagagagccatggcggccact

SEQ ID NO: 372145 - DNA, 25 bp, Mus musculus
gcgattcaactcttgcgggccgttg

SEQ ID NO: 372146 - DNA, 25 bp, Mus musculus
catttctggctttgccgctccgtgc

SEQ ID NO: 372147 - DNA, 25 bp, Mus musculus
cccagcgccggttcatttctggctt

SEQ ID NO: 372148 - DNA, 25 bp, Mus musculus
cggaacctggcaggccagccctgga

SEQ ID NO: 372149 - DNA, 25 bp, Mus musculus
cgttgtcggcgctgcattactccct

SEQ ID NO: 372150 - DNA, 25 bp, Mus musculus
cgctccgtgctggattacccaggtc

SEQ ID NO: 372151 - DNA, 25 bp, Mus musculus
gcggctccctgcaggcgcgattcaa

SEQ ID NO: 372152 - DNA, 25 bp, Mus musculus
tcttgaagcatctgtcccggtgaga

SEQ ID NO: 372153 - DNA, 25 bp, Mus musculus
gcatggccgggatcattaagaagca

SEQ ID NO: 372154 - DNA, 25 bp, Mus musculus
gaggacgcctcttttccacaactga

SEQ ID NO: 372155 - DNA, 25 bp, Mus musculus
cggcggaactcctggcgctgagtta

SEQ ID NO: 372156 - DNA, 25 bp, Mus musculus
tctgggttctgctccgcgggatcct

SEQ ID NO: 372157 - DNA, 25 bp, Mus musculus
tccacaactgaggaggccacggctg

SEQ ID NO: 372158 - DNA, 25 bp, Mus musculus
accaaagaggcgcttcacgctaccg

SEQ ID NO: 372159 - DNA, 25 bp, Mus musculus
gccaagaagctaagccgagctcaga

SEQ ID NO: 372160 - DNA, 25 bp, Mus musculus
gctattcacatgaccaaggacgcca

SEQ ID NO: 372161 - DNA, 25 bp, Mus musculus
aggacgccaccaaagaggcgcttca

SEQ ID NO: 372162 - DNA, 25 bp, Mus musculus
acatgaccaaggacgccaccaaaga

SEQ ID NO: 372163 - DNA, 25 bp, Mus musculus
ggggacctgtccagcgctattcaca

SEQ ID NO: 372164 - DNA, 25 bp, Mus musculus
gcccgtgcccttgaggagcattgag

SEQ ID NO: 372165 - DNA, 25 bp, Mus musculus
caaggcgagcccgtgcccttgagga

SEQ ID NO: 372166 - DNA, 25 bp, Mus musculus
acagggatgctgctctgaacggcca

SEQ ID NO: 372167 - DNA, 25 bp, Mus musculus
tccagcgctattcacatgaccaagg

SEQ ID NO: 372168 - DNA, 25 bp, Mus musculus
cggtcgagtctctccaggccaagaa

SEQ ID NO: 372169 - DNA, 25 bp, Mus musculus
gtctctccaggccaagaagctaagc

SEQ ID NO: 372170 - DNA, 25 bp, Mus musculus
aagccgagctcagagtgccaggtcc

SEQ ID NO: 372171 - DNA, 25 bp, Mus musculus
tgctgctctgaacggccaaggcgag

SEQ ID NO: 372172 - DNA, 25 bp, Mus musculus
cgggtagtcctgcagcgttatccac

SEQ ID NO: 372173 - DNA, 25 bp, Mus musculus
gtcctgcagcgttatccaccaactt

SEQ ID NO: 372174 - DNA, 25 bp, Mus musculus
tacctcgctttcctccgccgcggct

SEQ ID NO: 372175 - DNA, 25 bp, Mus musculus
ggcttctttcaagtccgcgtctcca

SEQ ID NO: 372176 - DNA, 25 bp, Mus musculus
ttcaagtccgcgtctccatccctgt

SEQ ID NO: 372177 - DNA, 25 bp, Mus musculus
catccctgtcggtttcctccgggat

SEQ ID NO: 372178 - DNA, 25 bp, Mus musculus
ggattccctcagtgtcggctgccac

SEQ ID NO: 372179 - DNA, 25 bp, Mus musculus
tcagtgtcggctgccaccaaagccc

SEQ ID NO: 372180 - DNA, 25 bp, Mus musculus
ccgcctttgtctgtgggcgactccc

SEQ ID NO: 372181 - DNA, 25 bp, Mus musculus
cccgaggttgtccatcgcgagagca

SEQ ID NO: 372182 - DNA, 25 bp, Mus musculus
ggtcagaggcgatggcagcaccgcc

SEQ ID NO: 372183 - DNA, 25 bp, Mus musculus
tcgtcgtcgcgccgcgatgacgtca

SEQ ID NO: 372184 - DNA, 25 bp, Mus musculus
gacgtcacgcccacggatcctggga

SEQ ID NO: 372185 - DNA, 25 bp, Mus musculus
cgcacccgggtagtcctgcagcgtt

SEQ ID NO: 372186 - DNA, 25 bp, Mus musculus
ggtgccagctgtcgcttctcacaaa

SEQ ID NO: 372187 - DNA, 25 bp, Mus musculus
tgcagggactcccacgccgtgcaga

SEQ ID NO: 372188 - DNA, 25 bp, Mus musculus
ttcttttgtttctacggtgccagga

SEQ ID NO: 372189 - DNA, 25 bp, Mus musculus
ctagagcacattctcggcttccttc

SEQ ID NO: 372190 - DNA, 25 bp, Mus musculus
agccgcttcagagcagaccgaattc

SEQ ID NO: 372191 - DNA, 25 bp, Mus musculus
cccgctctccagtctgctgaggtga

SEQ ID NO: 372192 - DNA, 25 bp, Mus musculus
acctcccggccgtggagaagctgct

SEQ ID NO: 372193 - DNA, 25 bp, Mus musculus
cgtgacgccggatcccggaagtgac

SEQ ID NO: 372194 - DNA, 25 bp, Mus musculus
atctccgccacctggcgaatgggcg

SEQ ID NO: 372195 - DNA, 25 bp, Mus musculus
ccaaacctttgggaaggcgagcagt

SEQ ID NO: 372196 - DNA, 25 bp, Mus musculus
ttccagtgccatgaggtcccaaacc

SEQ ID NO: 372197 - DNA, 25 bp, Mus musculus
tgaccgcatttccagtgccatgagg

SEQ ID NO: 372198 - DNA, 25 bp, Mus musculus
ggtgccaggaacaatgaccgcattt

SEQ ID NO: 372199 - DNA, 25 bp, Mus musculus
gaattcgcggaatccctctcacatc

SEQ ID NO: 372200 - DNA, 25 bp, Mus musculus
ctgattaagctcacaacgggcgtgg

SEQ ID NO: 372201 - DNA, 25 bp, Mus musculus
gagtcgcctcgaggtaaaggccctc

SEQ ID NO: 372202 - DNA, 25 bp, Mus musculus
cccactgttctctgagggcaggagt

SEQ ID NO: 372203 - DNA, 25 bp, Mus musculus
aacggcgctgattggaggcgttcac

SEQ ID NO: 372204 - DNA, 25 bp, Mus musculus
ccgactaaaggggaaaagagctctg

SEQ ID NO: 372205 - DNA, 25 bp, Mus musculus
tcgcactctggttggtcggaacgac

SEQ ID NO: 372206 - DNA, 25 bp, Mus musculus
tgccctttgtgcttgcagcccgcat

SEQ ID NO: 372207 - DNA, 25 bp, Mus musculus
ctgagcatgaagaagttcacggtgc

SEQ ID NO: 372208 - DNA, 25 bp, Mus musculus
gtgcgcaggttcttctccgtgtacc

SEQ ID NO: 372209 - DNA, 25 bp, Mus musculus
tctccgtgtacctgcgcaagaagtc

SEQ ID NO: 372210 - DNA, 25 bp, Mus musculus
caagaagtcgcgctccaagagctcc

SEQ ID NO: 372211 - DNA, 25 bp, Mus musculus
caagagctccagtctgagtcgcctc

SEQ ID NO: 372212 - DNA, 25 bp, Mus musculus
cctggagtgggcatgtagagcctca

SEQ ID NO: 372213 - DNA, 25 bp, Mus musculus
cgtgcctcaggagcgactgattaag

SEQ ID NO: 372214 - DNA, 25 bp, Mus musculus
cccgggcctcggctgccaaagtgtt

SEQ ID NO: 372215 - DNA, 25 bp, Mus musculus
agcgagcggccatttgcgacctcca

SEQ ID NO: 372216 - DNA, 25 bp, Mus musculus
cccacaccagcgagcggccatttgc

SEQ ID NO: 372217 - DNA, 25 bp, Mus musculus
gcggaaggcccaggcgcgagttctg

SEQ ID NO: 372218 - DNA, 25 bp, Mus musculus
tgactagggtcaccgcgcctatctc

SEQ ID NO: 372219 - DNA, 25 bp, Mus musculus
cgctgactagggtcaccgcgcctat

SEQ ID NO: 372220 - DNA, 25 bp, Mus musculus
ctggcgtttgaacgatgctagggcc

SEQ ID NO: 372221 - DNA, 25 bp, Mus musculus
tcttgctggcgtttgaacgatgcta

SEQ ID NO: 372222 - DNA, 25 bp, Mus musculus
gctcttgctggcgtttgaacgatgc

SEQ ID NO: 372223 - DNA, 25 bp, Mus musculus
gtgttctgatcctggaaactctgct

SEQ ID NO: 372224 - DNA, 25 bp, Mus musculus
caaagtgttctgatcctggaaactc

SEQ ID NO: 372225 - DNA, 25 bp, Mus musculus
gccaaagtgttctgatcctggaaac

SEQ ID NO: 372226 - DNA, 25 bp, Mus musculus
tgcgacctccaccaccagcatcttc

SEQ ID NO: 372227 - DNA, 25 bp, Mus musculus
cgggcctcggctgccaaagtgttct

SEQ ID NO: 372228 - DNA, 25 bp, Mus musculus
ctaggagctaggatcccaggccggc

SEQ ID NO: 372229 - DNA, 25 bp, Mus musculus
caaagcgcgcgcgttgccccccgct

SEQ ID NO: 372230 - DNA, 25 bp, Mus musculus
atcaaacaaaacatcggtccccagc

SEQ ID NO: 372231 - DNA, 25 bp, Mus musculus
caactaggagctaggatcccaggcc

SEQ ID NO: 372232 - DNA, 25 bp, Mus musculus
tcgtctgcgtatagtcgtgggaagg

SEQ ID NO: 372233 - DNA, 25 bp, Mus musculus
ctcgtctgcgtatagtcgtgggaag

SEQ ID NO: 372234 - DNA, 25 bp, Mus musculus
tctcgtctgcgtatagtcgtgggaa

SEQ ID NO: 372235 - DNA, 25 bp, Mus musculus
gcgcgttgccccccgctttccgctc

SEQ ID NO: 372236 - DNA, 25 bp, Mus musculus
aaagcgcgcgcgttgccccccgctt

SEQ ID NO: 372237 - DNA, 25 bp, Mus musculus
tcaaacaaaacatcggtccccagcc

SEQ ID NO: 372238 - DNA, 25 bp, Mus musculus
taggagctaggatcccaggccggct

SEQ ID NO: 372239 - DNA, 25 bp, Mus musculus
actaggagctaggatcccaggccgg

SEQ ID NO: 372240 - DNA, 25 bp, Mus musculus
aactaggagctaggatcccaggccg

SEQ ID NO: 372241 - DNA, 25 bp, Mus musculus
agcgcgcgcgttgccccccgctttc

SEQ ID NO: 372242 - DNA, 25 bp, Mus musculus
actttggttcctgcccgctggaggt

SEQ ID NO: 372243 - DNA, 25 bp, Mus musculus
agcgaccctgtgacctgtctccctg

SEQ ID NO: 372244 - DNA, 25 bp, Mus musculus
tactttggttcctgcccgctggagg

SEQ ID NO: 372245 - DNA, 25 bp, Mus musculus
gcgcgtgcactccgcggtacagtct

SEQ ID NO: 372246 - DNA, 25 bp, Mus musculus
gggagcgaggaaccgccgagccctc

SEQ ID NO: 372247 - DNA, 25 bp, Mus musculus
aggtgccccgctcgctggtcgcggg

SEQ ID NO: 372248 - DNA, 25 bp, Mus musculus
gctctccaccatgcccgggggcgta

SEQ ID NO: 372249 - DNA, 25 bp, Mus musculus
ggcgtaccctggtccgcctacttga

SEQ ID NO: 372250 - DNA, 25 bp, Mus musculus
gcgtaccctggtccgcctacttgaa

SEQ ID NO: 372251 - DNA, 25 bp, Mus musculus
accctggtccgcctacttgaaaatg

SEQ ID NO: 372252 - DNA, 25 bp, Mus musculus
ccctggtccgcctacttgaaaatgc

SEQ ID NO: 372253 - DNA, 25 bp, Mus musculus
cctggtccgcctacttgaaaatgct

SEQ ID NO: 372254 - DNA, 25 bp, Mus musculus
tgtactttggttcctgcccgctgga

SEQ ID NO: 372255 - DNA, 25 bp, Mus musculus
gtactttggttcctgcccgctggag

SEQ ID NO: 372256 - DNA, 25 bp, Mus musculus
gcctcaagcagatacctagcctgtg

SEQ ID NO: 372257 - DNA, 25 bp, Mus musculus
tgtccagcgtcacaggaaatccatg

SEQ ID NO: 372258 - DNA, 25 bp, Mus musculus
tccatggcaacgcttgtgcgggagc

SEQ ID NO: 372259 - DNA, 25 bp, Mus musculus
acgcttgtgcgggagcatttgaaac

SEQ ID NO: 372260 - DNA, 25 bp, Mus musculus
cttgtgcgggagcatttgaaacgag

SEQ ID NO: 372261 - DNA, 25 bp, Mus musculus
gagggaggtccggacctgcagtccc

SEQ ID NO: 372262 - DNA, 25 bp, Mus musculus
ggggaccctgcctcaagcagatacc

SEQ ID NO: 372263 - DNA, 25 bp, Mus musculus
agactaactgtccagcgtcacagga

SEQ ID NO: 372264 - DNA, 25 bp, Mus musculus
tacctagcctgtgcgagctcggggt

SEQ ID NO: 372265 - DNA, 25 bp, Mus musculus
cccacgcgtgaccgaggggagcttc

SEQ ID NO: 372266 - DNA, 25 bp, Mus musculus
gaggtcgggccagtccgcagtcctc

SEQ ID NO: 372267 - DNA, 25 bp, Mus musculus
cacgggacctcgtggcgccgtcttt

SEQ ID NO: 372268 - DNA, 25 bp, Mus musculus
caggaaatccatggcaacgcttgtg

SEQ ID NO: 372269 - DNA, 25 bp, Mus musculus
gccacagaggagagactaactgtcc

SEQ ID NO: 372270 - DNA, 25 bp, Mus musculus
acagcttaggtgtcctggcaacgag

SEQ ID NO: 372271 - DNA, 25 bp, Mus musculus
tctgccgccaccttgggtgagaccg

SEQ ID NO: 372272 - DNA, 25 bp, Mus musculus
catctgccgccaccttgggtgagac

SEQ ID NO: 372273 - DNA, 25 bp, Mus musculus
accatctgccgccaccttgggtgag

SEQ ID NO: 372274 - DNA, 25 bp, Mus musculus
caccagcatcgcgacccgccaccga

SEQ ID NO: 372275 - DNA, 25 bp, Mus musculus
caacgaggcgcgaggcgcgtggcag

SEQ ID NO: 372276 - DNA, 25 bp, Mus musculus
agcttaggtgtcctggcaacgaggc

SEQ ID NO: 372277 - DNA, 25 bp, Mus musculus
aacagcttaggtgtcctggcaacga

SEQ ID NO: 372278 - DNA, 25 bp, Mus musculus
caaacagcttaggtgtcctggcaac

SEQ ID NO: 372279 - DNA, 25 bp, Mus musculus
aacaaacagcttaggtgtcctggca

SEQ ID NO: 372280 - DNA, 25 bp, Mus musculus
gccaaacaaacagcttaggtgtcct

SEQ ID NO: 372281 - DNA, 25 bp, Mus musculus
ttgccaaacaaacagcttaggtgtc

SEQ ID NO: 372282 - DNA, 25 bp, Mus musculus
tgttgccaaacaaacagcttaggtg

SEQ ID NO: 372283 - DNA, 25 bp, Mus musculus
cttaggtgtcctggcaacgaggcgc

SEQ ID NO: 372284 - DNA, 25 bp, Mus musculus
gttcggccctcctgacgtgcgagcg

SEQ ID NO: 372285 - DNA, 25 bp, Mus musculus
cccacagggaacgagcggacgagcc

SEQ ID NO: 372286 - DNA, 25 bp, Mus musculus
ggggcttgcattgatccattgattg

SEQ ID NO: 372287 - DNA, 25 bp, Mus musculus
gatccattgattgtgcgcggtctgc

SEQ ID NO: 372288 - DNA, 25 bp, Mus musculus
attgtgcgcggtctgcgcctgacct

SEQ ID NO: 372289 - DNA, 25 bp, Mus musculus
gcctgacctccctgctcccggggaa

SEQ ID NO: 372290 - DNA, 25 bp, Mus musculus
agaaaacgaaaaggagcaaggagag

SEQ ID NO: 372291 - DNA, 25 bp, Mus musculus
gaggagaaaggcgaagaaaaacaga

SEQ ID NO: 372292 - DNA, 25 bp, Mus musculus
aagggcgtgtttaggcgctacgtct

SEQ ID NO: 372293 - DNA, 25 bp, Mus musculus
cgcccagcatggcaaagctgcgcaa

SEQ ID NO: 372294 - DNA, 25 bp, Mus musculus
catggcaaagctgcgcaaggtaagg

SEQ ID NO: 372295 - DNA, 25 bp, Mus musculus
cggggaagccgtctccatggagacc

SEQ ID NO: 372296 - DNA, 25 bp, Mus musculus
aagccgtctccatggagaccgggcc

SEQ ID NO: 372297 - DNA, 25 bp, Mus musculus
cccagcgccggattgtaaattcctg

SEQ ID NO: 372298 - DNA, 25 bp, Mus musculus
cgttgctatggcgaccgcggcttcc

SEQ ID NO: 372299 - DNA, 25 bp, Mus musculus
gtgcccaccctcctcggtccctggc

SEQ ID NO: 372300 - DNA, 25 bp, Mus musculus
gaacctggatatcgcgcgaggcaag

SEQ ID NO: 372301 - DNA, 25 bp, Mus musculus
gccctggaacctggatatcgcgcga

SEQ ID NO: 372302 - DNA, 25 bp, Mus musculus
tccgaggctcgcctgaggagactcg

SEQ ID NO: 372303 - DNA, 25 bp, Mus musculus
ccgagcagcccaccgccgctcgatt

SEQ ID NO: 372304 - DNA, 25 bp, Mus musculus
gatacctgcaatggcttcctcccga

SEQ ID NO: 372305 - DNA, 25 bp, Mus musculus
acctagagatacctgcaatggcttc

SEQ ID NO: 372306 - DNA, 25 bp, Mus musculus
gaaccacctagagatacctgcaatg

SEQ ID NO: 372307 - DNA, 25 bp, Mus musculus
cctctgcaggaaccacctagagata

SEQ ID NO: 372308 - DNA, 25 bp, Mus musculus
gtctggtcaccgtcctctgcaggaa

SEQ ID NO: 372309 - DNA, 25 bp, Mus musculus
gaggactgtccctcggagtcccatc

SEQ ID NO: 372310 - DNA, 25 bp, Mus musculus
gacgccatcccttggggcgccgttg

SEQ ID NO: 372311 - DNA, 25 bp, Mus musculus
gcggccgccctggaacctggatatc

SEQ ID NO: 372312 - DNA, 25 bp, Mus musculus
atccagactgcgatccggctgcagg

SEQ ID NO: 372313 - DNA, 25 bp, Mus musculus
cggaccgcgaaggaaagcgctgcat

SEQ ID NO: 372314 - DNA, 25 bp, Mus musculus
aagcgctgcatgttttgtgtgaaga

SEQ ID NO: 372315 - DNA, 25 bp, Mus musculus
ttttgtgtgaagactgccagccgca

SEQ ID NO: 372316 - DNA, 25 bp, Mus musculus
gtgaagactgccagccgcacctatg

SEQ ID NO: 372317 - DNA, 25 bp, Mus musculus
tgccagccgcacctatgagatgagc

SEQ ID NO: 372318 - DNA, 25 bp, Mus musculus
cctatgagatgagcgcctcagacac

SEQ ID NO: 372319 - DNA, 25 bp, Mus musculus
cggcctgggtctaactgggcctgtt

SEQ ID NO: 372320 - DNA, 25 bp, Mus musculus
tctaactgggcctgttcaccggagt

SEQ ID NO: 372321 - DNA, 25 bp, Mus musculus
tgcccttagccatccagactgcgat

SEQ ID NO: 372322 - DNA, 25 bp, Mus musculus
agaccagggctgactccgtccggct

SEQ ID NO: 372323 - DNA, 25 bp, Mus musculus
tggtgactagaccagggctgactcc

SEQ ID NO: 372324 - DNA, 25 bp, Mus musculus
tgttcaccggagtgacctttggggc

SEQ ID NO: 372325 - DNA, 25 bp, Mus musculus
ccctttgcggtggtgactagaccag

SEQ ID NO: 372326 - DNA, 25 bp, Mus musculus
ctatgctcggcttgcgcgctgagga

SEQ ID NO: 372327 - DNA, 25 bp, Mus musculus
gcctctgcggctcgtctatgctcgg

SEQ ID NO: 372328 - DNA, 25 bp, Mus musculus
accgctggggtctccaccgcaggga

SEQ ID NO: 372329 - DNA, 25 bp, Mus musculus
ggggctccgagagccgctttccgcg

SEQ ID NO: 372330 - DNA, 25 bp, Mus musculus
gcgattggctactgctatggcggaa

SEQ ID NO: 372331 - DNA, 25 bp, Mus musculus
ctcgtctatgctcggcttgcgcgct

SEQ ID NO: 372332 - DNA, 25 bp, Mus musculus
gaggagccaccgctggggtctccac

SEQ ID NO: 372333 - DNA, 25 bp, Mus musculus
tgtcaaaggagtggctccaggcggc

SEQ ID NO: 372334 - DNA, 25 bp, Mus musculus
ccgcggcggacctggggattaatgg

SEQ ID NO: 372335 - DNA, 25 bp, Mus musculus
cggcgcggcgattggctactgctat

SEQ ID NO: 372336 - DNA, 25 bp, Mus musculus
agcggcgcggtgacatcacggggct

SEQ ID NO: 372337 - DNA, 25 bp, Mus musculus
cgtctgactgcagagggcgctgcag

SEQ ID NO: 372338 - DNA, 25 bp, Mus musculus
ctgcagacgcgccagggcagctgtg

SEQ ID NO: 372339 - DNA, 25 bp, Mus musculus
gatggctgtcaaaggagtggctcca

SEQ ID NO: 372340 - DNA, 25 bp, Mus musculus
catgtcgcacaacggtgagggcgcc

SEQ ID NO: 372341 - DNA, 25 bp, Mus musculus
acaagtgtcagtactgccgcttcca

SEQ ID NO: 372342 - DNA, 25 bp, Mus musculus
gaaccgcaacaagtgtcagtactgc

SEQ ID NO: 372343 - DNA, 25 bp, Mus musculus
tccagaagaagaaccgcaacaagtg

SEQ ID NO: 372344 - DNA, 25 bp, Mus musculus
tgcgatcggatctgcaagatccaga

SEQ ID NO: 372345 - DNA, 25 bp, Mus musculus
ctcgagtatgagaagtgcgatcgga

SEQ ID NO: 372346 - DNA, 25 bp, Mus musculus
caatccgcatgaagctcgagtatga

SEQ ID NO: 372347 - DNA, 25 bp, Mus musculus
ttccgccggacaatccgcatgaagc

SEQ ID NO: 372348 - DNA, 25 bp, Mus musculus
gcagggcttcttccgccggacaatc

SEQ ID NO: 372349 - DNA, 25 bp, Mus musculus
taacgtccttggtctcgcagggctt

SEQ ID NO: 372350 - DNA, 25 bp, Mus musculus
cgcaggctaacgtccttggtctcgc

SEQ ID NO: 372351 - DNA, 25 bp, Mus musculus
ttccagaagtgcctggcactcggca

SEQ ID NO: 372352 - DNA, 25 bp, Mus musculus
gcgcagtctgtctcaggaccccaaa

SEQ ID NO: 372353 - DNA, 25 bp, Mus musculus
ggcactcggcatgtcgcacaacggt

SEQ ID NO: 372354 - DNA, 25 bp, Mus musculus
acggccgcctagagctgtgagtccc

SEQ ID NO: 372355 - DNA, 25 bp, Mus musculus
ctgggccacttagagcccgaggtgc

SEQ ID NO: 372356 - DNA, 25 bp, Mus musculus
acttcccttgggatggcttcctgga

SEQ ID NO: 372357 - DNA, 25 bp, Mus musculus
ctgcttcaggcgctacaggcagggc

SEQ ID NO: 372358 - DNA, 25 bp, Mus musculus
gtcggactccgtagcctcggccgga

SEQ ID NO: 372359 - DNA, 25 bp, Mus musculus
ctttccttggcttcgggagctttgc

SEQ ID NO: 372360 - DNA, 25 bp, Mus musculus
ccttcaggctctacagggtgctccg

SEQ ID NO: 372361 - DNA, 25 bp, Mus musculus
acaggtctggttagttgatggtccc

SEQ ID NO: 372362 - DNA, 25 bp, Mus musculus
tcctggacgctctcttacaggtctg

SEQ ID NO: 372363 - DNA, 25 bp, Mus musculus
aagttgcttcctgatgccctcgctc

SEQ ID NO: 372364 - DNA, 25 bp, Mus musculus
ctatgcagggagttaagttgcttcc

SEQ ID NO: 372365 - DNA, 25 bp, Mus musculus
ttcgcgggcttctcgtactatgcag

SEQ ID NO: 372366 - DNA, 25 bp, Mus musculus
cagattggctccagacgcaggaacc

SEQ ID NO: 372367 - DNA, 25 bp, Mus musculus
catcaagcgcggatcagattggctc

SEQ ID NO: 372368 - DNA, 25 bp, Mus musculus
ctctcgcgagaacgcgggctctatt

SEQ ID NO: 372369 - DNA, 25 bp, Mus musculus
agctccgggtaaggcttgccgctcc

SEQ ID NO: 372370 - DNA, 25 bp, Mus musculus
aagccaggctagtgttgcccagagc

SEQ ID NO: 372371 - DNA, 25 bp, Mus musculus
agggtagttcaggagccctgctgca

SEQ ID NO: 372372 - DNA, 25 bp, Mus musculus
ggacactgacgtgccagggtagttc

SEQ ID NO: 372373 - DNA, 25 bp, Mus musculus
aagttgttatcgtggcgctatccgc

SEQ ID NO: 372374 - DNA, 25 bp, Mus musculus
tgcgttcagatctagcgggatggcc

SEQ ID NO: 372375 - DNA, 25 bp, Mus musculus
cgggctctatttgagcgcatgcgca

SEQ ID NO: 372376 - DNA, 25 bp, Mus musculus
ccgtaacgggcaactctcgcgagaa

SEQ ID NO: 372377 - DNA, 25 bp, Mus musculus
aaactgcagcgcctctccggcttgg

SEQ ID NO: 372378 - DNA, 25 bp, Mus musculus
cgcagccatgaggtaagttgttatc

SEQ ID NO: 372379 - DNA, 25 bp, Mus musculus
gctccctgccatgcgttcagatcta

SEQ ID NO: 372380 - DNA, 25 bp, Mus musculus
atgcgcaaagcgctctgccttcttt

SEQ ID NO: 372381 - DNA, 25 bp, Mus musculus
caccgtcaggttggcaccgctctaa

SEQ ID NO: 372382 - DNA, 25 bp, Mus musculus
tcggctccgacatggaagatggacc

SEQ ID NO: 372383 - DNA, 25 bp, Mus musculus
cctctccgctctccgtgccggaggc

SEQ ID NO: 372384 - DNA, 25 bp, Mus musculus
cggccgtgtccaagtccctctggaa

SEQ ID NO: 372385 - DNA, 25 bp, Mus musculus
ggcaccctagacccgagaggcggac

SEQ ID NO: 372386 - DNA, 25 bp, Mus musculus
agtacagtgggcctgagcctggccc

SEQ ID NO: 372387 - DNA, 25 bp, Mus musculus
ttcctggtacttctggccgccgccc

SEQ ID NO: 372388 - DNA, 25 bp, Mus musculus
aggaggacaagaggcagctcccttg

SEQ ID NO: 372389 - DNA, 25 bp, Mus musculus
caagaggcagctcccttgagcgtcc

SEQ ID NO: 372390 - DNA, 25 bp, Mus musculus
ccaggcagtagtcaccgcagcagcg

SEQ ID NO: 372391 - DNA, 25 bp, Mus musculus
agtagtcaccgcagcagcggtggca

SEQ ID NO: 372392 - DNA, 25 bp, Mus musculus
cctctcgcctgcgattcaaggcttg

SEQ ID NO: 372393 - DNA, 25 bp, Mus musculus
gattcaaggcttgctgctccctgcc

SEQ ID NO: 372394 - DNA, 25 bp, Mus musculus
tctgccgccggtggccgaactcttt

SEQ ID NO: 372395 - DNA, 25 bp, Mus musculus
gctgcccttcggctccgacatggaa

SEQ ID NO: 372396 - DNA, 25 bp, Mus musculus
tacaattgggcagcggcttccagca

SEQ ID NO: 372397 - DNA, 25 bp, Mus musculus
ttgctcaagtgagccacgggctggc

SEQ ID NO: 372398 - DNA, 25 bp, Mus musculus
atccaaggacttgctcaagtgagcc

SEQ ID NO: 372399 - DNA, 25 bp, Mus musculus
gctttcggctgaatccaaggacttg

SEQ ID NO: 372400 - DNA, 25 bp, Mus musculus
aacatggcccggctttcggctgaat

SEQ ID NO: 372401 - DNA, 25 bp, Mus musculus
cgcccgcgctacaattgggcagcgg

SEQ ID NO: 372402 - DNA, 25 bp, Mus musculus
cggctgaagatcaacggacgcgaac

SEQ ID NO: 372403 - DNA, 25 bp, Mus musculus
cggacgcgaacgcaagaggatgcac

SEQ ID NO: 372404 - DNA, 25 bp, Mus musculus
ccatggatggtctgcgcgaggtcat

SEQ ID NO: 372405 - DNA, 25 bp, Mus musculus
cgaggtcatgccctacgctcacggg

SEQ ID NO: 372406 - DNA, 25 bp, Mus musculus
gatcgccactctgcttctggccaga

SEQ ID NO: 372407 - DNA, 25 bp, Mus musculus
actgtggggcattcggccggccacc

SEQ ID NO: 372408 - DNA, 25 bp, Mus musculus
ggcggcgcgctctcctctggcaatg

SEQ ID NO: 372409 - DNA, 25 bp, Mus musculus
cacgacctgaacctcgccatggatg

SEQ ID NO: 372410 - DNA, 25 bp, Mus musculus
gactcgcccgctgggcaagccgcca

SEQ ID NO: 372411 - DNA, 25 bp, Mus musculus
cagcccaagcctgccggcccggact

SEQ ID NO: 372412 - DNA, 25 bp, Mus musculus
ccggtctggcaagggacagagagca

SEQ ID NO: 372413 - DNA, 25 bp, Mus musculus
cagccgcactcaccgtacatcttgc

SEQ ID NO: 372414 - DNA, 25 bp, Mus musculus
gtacatcttgccctcatctgacagg

SEQ ID NO: 372415 - DNA, 25 bp, Mus musculus
tctgacaggatgatcttgcgccgtc

SEQ ID NO: 372416 - DNA, 25 bp, Mus musculus
acaggatgatcttgcgccgtccgca

SEQ ID NO: 372417 - DNA, 25 bp, Mus musculus
atcttgcgccgtccgcaaggcgggt

SEQ ID NO: 372418 - DNA, 25 bp, Mus musculus
ggtagatggccagggcctcctgaaa

SEQ ID NO: 372419 - DNA, 25 bp, Mus musculus
tgaaagctctgctcgatgtccgggc

SEQ ID NO: 372420 - DNA, 25 bp, Mus musculus
agctctgctcgatgtccgggctcca

SEQ ID NO: 372421 - DNA, 25 bp, Mus musculus
gcatcgttgtccagacccttgtcca

SEQ ID NO: 372422 - DNA, 25 bp, Mus musculus
ttgtccaggccttcggacccatctt

SEQ ID NO: 372423 - DNA, 25 bp, Mus musculus
cgaaacctccagccggcagggctag

SEQ ID NO: 372424 - DNA, 25 bp, Mus musculus
aaatccagccgcgtcccgagcgagg

SEQ ID NO: 372425 - DNA, 25 bp, Mus musculus
caaagttcccggcacccaggtcctg

SEQ ID NO: 372426 - DNA, 25 bp, Mus musculus
tcccgagcgaggctcctggagcaag

SEQ ID NO: 372427 - DNA, 25 bp, Mus musculus
tgggtgcgcacacgctccgggctca

SEQ ID NO: 372428 - DNA, 25 bp, Mus musculus
ggctcacactgtggcttccagacac

SEQ ID NO: 372429 - DNA, 25 bp, Mus musculus
cagaactgtaggggacaggcgtccc

SEQ ID NO: 372430 - DNA, 25 bp, Mus musculus
gctctcgggagtccaaagggcgccc

SEQ ID NO: 372431 - DNA, 25 bp, Mus musculus
gcgcgggctggacaatagctcagaa

SEQ ID NO: 372432 - DNA, 25 bp, Mus musculus
agaagccacccgagcagagcagtca

SEQ ID NO: 372433 - DNA, 25 bp, Mus musculus
agagcagtcacctctgcgcgcgagg

SEQ ID NO: 372434 - DNA, 25 bp, Mus musculus
cgcgcgaggcctccgagttgcattc

SEQ ID NO: 372435 - DNA, 25 bp, Mus musculus
atggccggaatgtacggaatgagcc

SEQ ID NO: 372436 - DNA, 25 bp, Mus musculus
aatgtacggaatgagcccggccgga

SEQ ID NO: 372437 - DNA, 25 bp, Mus musculus
cctggctaaggcctgcgtggagccc

SEQ ID NO: 372438 - DNA, 25 bp, Mus musculus
agaaactaccgatgcgttcagcctc

SEQ ID NO: 372439 - DNA, 25 bp, Mus musculus
caagaacgcccgtagctgtggattc

SEQ ID NO: 372440 - DNA, 25 bp, Mus musculus
agctgtggattcacactcccgcgca

SEQ ID NO: 372441 - DNA, 25 bp, Mus musculus
ttcctcgctcgtcgtctcagagttc

SEQ ID NO: 372442 - DNA, 25 bp, Mus musculus
ccttgtgggtactccgctgaatcta

SEQ ID NO: 372443 - DNA, 25 bp, Mus musculus
ccgctgaatctagagggatcaggtc

SEQ ID NO: 372444 - DNA, 25 bp, Mus musculus
ccctaggctgaactccttggaggtg

SEQ ID NO: 372445 - DNA, 25 bp, Mus musculus
ctccttggaggtgtttagggtcctg

SEQ ID NO: 372446 - DNA, 25 bp, Mus musculus
tccaaatgacccgagcgcgcacggg

SEQ ID NO: 372447 - DNA, 25 bp, Mus musculus
cccgagtggcttgtttctcgaattt

SEQ ID NO: 372448 - DNA, 25 bp, Mus musculus
ctcctccctactggcggagagtcgg

SEQ ID NO: 372449 - DNA, 25 bp, Mus musculus
tgcgcttgacgaggttccatagaac

SEQ ID NO: 372450 - DNA, 25 bp, Mus musculus
ttccatagaacagaaggggacgcgg

SEQ ID NO: 372451 - DNA, 25 bp, Mus musculus
gcaggcacctgagtttacacacatg

SEQ ID NO: 372452 - DNA, 25 bp, Mus musculus
gggtccctcaggaacttggcgtaga

SEQ ID NO: 372453 - DNA, 25 bp, Mus musculus
ttcctcaacttctgtccctgggcgg

SEQ ID NO: 372454 - DNA, 25 bp, Mus musculus
tctttttcctcaacttctgtccctg

SEQ ID NO: 372455 - DNA, 25 bp, Mus musculus
cagctttacggggtttggattccag

SEQ ID NO: 372456 - DNA, 25 bp, Mus musculus
tagggccagacctcgggctcagcag

SEQ ID NO: 372457 - DNA, 25 bp, Mus musculus
cagctagggccagacctcgggctca

SEQ ID NO: 372458 - DNA, 25 bp, Mus musculus
aacttctgtccctgggcgggtcgct

SEQ ID NO: 372459 - DNA, 25 bp, Mus musculus
cctcgtgcttcctgcgcccagctag

SEQ ID NO: 372460 - DNA, 25 bp, Mus musculus
gtctgcgggcggctcctcgtgcttc

SEQ ID NO: 372461 - DNA, 25 bp, Mus musculus
agcgcgcggctctgccgagtctgcg

SEQ ID NO: 372462 - DNA, 25 bp, Mus musculus
ttggcgtagactgtctgcgcagcgc

SEQ ID NO: 372463 - DNA, 25 bp, Mus musculus
aggaacttggcgtagactgtctgcg

SEQ ID NO: 372464 - DNA, 25 bp, Mus musculus
cctcaggaacttggcgtagactgtc

SEQ ID NO: 372465 - DNA, 25 bp, Mus musculus
ctcaacttctgtccctgggcgggtc

SEQ ID NO: 372466 - DNA, 25 bp, Mus musculus
cgtccacgccatcccggggaagccg

SEQ ID NO: 372467 - DNA, 25 bp, Mus musculus
ccgcgcgtcccgtccacgccatccc

SEQ ID NO: 372468 - DNA, 25 bp, Mus musculus
cctgcctgcccggtgcgagccggct

SEQ ID NO: 372469 - DNA, 25 bp, Mus musculus
ggccggcacgcccatcgcgcggccc

SEQ ID NO: 372470 - DNA, 25 bp, Mus musculus
gacgcggcggagcactccgttatcc

SEQ ID NO: 372471 - DNA, 25 bp, Mus musculus
gagcactccgttatccgcggggctt

SEQ ID NO: 372472 - DNA, 25 bp, Mus musculus
gcactccgttatccgcggggcttgc

SEQ ID NO: 372473 - DNA, 25 bp, Mus musculus
tgcagggctccggaaggccaagttt

SEQ ID NO: 372474 - DNA, 25 bp, Mus musculus
cgtggcggagcgacacggggctccc

SEQ ID NO: 372475 - DNA, 25 bp, Mus musculus
acctgtgggctgcgcgggaaacaaa

SEQ ID NO: 372476 - DNA, 25 bp, Mus musculus
tgcgcgggaaacaaaagccgcgcgc

SEQ ID NO: 372477 - DNA, 25 bp, Mus musculus
ccgcgctgagggagacgctggagaa

SEQ ID NO: 372478 - DNA, 25 bp, Mus musculus
tggagaagagcgccggccgctccac

SEQ ID NO: 372479 - DNA, 25 bp, Mus musculus
ggaccgcgagcacggggctggctcc

SEQ ID NO: 372480 - DNA, 25 bp, Mus musculus
cacgggaggctgcgccacagcgcaa

SEQ ID NO: 372481 - DNA, 25 bp, Mus musculus
cgctggggctggaacacaatgtccc

SEQ ID NO: 372482 - DNA, 25 bp, Mus musculus
ggaacacaatgtcccgggcgagagc

SEQ ID NO: 372483 - DNA, 25 bp, Mus musculus
gcgtgagggagaacagcctgactca

SEQ ID NO: 372484 - DNA, 25 bp, Mus musculus
gcctgactcagcagctgggtaagtg

SEQ ID NO: 372485 - DNA, 25 bp, Mus musculus
aagaagccatctccggaccctccgg

SEQ ID NO: 372486 - DNA, 25 bp, Mus musculus
taagtgggtgtgctcgcccgctccc

SEQ ID NO: 372487 - DNA, 25 bp, Mus musculus
tgcagcctgcggtcagcagccggct

SEQ ID NO: 372488 - DNA, 25 bp, Mus musculus
cggcgctgcaagaccgccacatggt

SEQ ID NO: 372489 - DNA, 25 bp, Mus musculus
tgcaagaccgccacatggtcgggta

SEQ ID NO: 372490 - DNA, 25 bp, Mus musculus
ccacatggtcgggtacgagacctcc

SEQ ID NO: 372491 - DNA, 25 bp, Mus musculus
tggtcgggtacgagacctcctcacc

SEQ ID NO: 372492 - DNA, 25 bp, Mus musculus
agcgcaagccgcgagcacaaacagg

SEQ ID NO: 372493 - DNA, 25 bp, Mus musculus
aagccgcgagcacaaacagggcgag

SEQ ID NO: 372494 - DNA, 25 bp, Mus musculus
aaagaacatcctgtgccgccgccgg

SEQ ID NO: 372495 - DNA, 25 bp, Mus musculus
ccgcgcttcgtactgcttcttctgg

SEQ ID NO: 372496 - DNA, 25 bp, Mus musculus
caccctcgacgttgtcctggtgggc

SEQ ID NO: 372497 - DNA, 25 bp, Mus musculus
ttccttaggccggagatagctaagc

SEQ ID NO: 372498 - DNA, 25 bp, Mus musculus
cttcgcgggtcatgagcttgccaga

SEQ ID NO: 372499 - DNA, 25 bp, Mus musculus
ctgcacactgatggcgagctgtccc

SEQ ID NO: 372500 - DNA, 25 bp, Mus musculus
gggacccgagcgaaagaacatcctg

SEQ ID NO: 372501 - DNA, 25 bp, Mus musculus
cttgggtcctcggaagaccaccata

SEQ ID NO: 372502 - DNA, 25 bp, Mus musculus
cttctggagactgcaggcttgggtc

SEQ ID NO: 372503 - DNA, 25 bp, Mus musculus
tttagcgtaagatcgcgagagtgcg

SEQ ID NO: 372504 - DNA, 25 bp, Mus musculus
ttgcccttggcaatttagcgtaaga

SEQ ID NO: 372505 - DNA, 25 bp, Mus musculus
acgagagagcccaccttgcgcttgc

SEQ ID NO: 372506 - DNA, 25 bp, Mus musculus
atagctaagcacaccggtctgcgcc

SEQ ID NO: 372507 - DNA, 25 bp, Mus musculus
agctttttccgctgcacactgatgg

SEQ ID NO: 372508 - DNA, 25 bp, Mus musculus
ccgcggtgctgaaacgcgtttcgca

SEQ ID NO: 372509 - DNA, 25 bp, Mus musculus
gaaggaacgtgacacacggtcggcc

SEQ ID NO: 372510 - DNA, 25 bp, Mus musculus
ggaacgtgacacacggtcggcccca

SEQ ID NO: 372511 - DNA, 25 bp, Mus musculus
cccgaactctggcgctggccgcggt

SEQ ID NO: 372512 - DNA, 25 bp, Mus musculus
tggccgcggtgctgaaacgcgtttc

SEQ ID NO: 372513 - DNA, 25 bp, Mus musculus
gccgcggtgctgaaacgcgtttcgc

SEQ ID NO: 372514 - DNA, 25 bp, Mus musculus
gcggtgctgaaacgcgtttcgcaga

SEQ ID NO: 372515 - DNA, 25 bp, Mus musculus
gtgctgaaacgcgtttcgcagagcg

SEQ ID NO: 372516 - DNA, 25 bp, Mus musculus
ctgaaacgcgtttcgcagagcgggc

SEQ ID NO: 372517 - DNA, 25 bp, Mus musculus
tgaaacgcgtttcgcagagcgggcc

SEQ ID NO: 372518 - DNA, 25 bp, Mus musculus
cgtggcctgtgagggcaagcaggag

SEQ ID NO: 372519 - DNA, 25 bp, Mus musculus
agaccctggccgacctagaggaggc

SEQ ID NO: 372520 - DNA, 25 bp, Mus musculus
ccgacctagaggaggcggcagactc

SEQ ID NO: 372521 - DNA, 25 bp, Mus musculus
aggggcgggcaaagcggaggcgcag

SEQ ID NO: 372522 - DNA, 25 bp, Mus musculus
ggagacccagctaccttccacatga

SEQ ID NO: 372523 - DNA, 25 bp, Mus musculus
agaggcaagagtgacgccgcttcag

SEQ ID NO: 372524 - DNA, 25 bp, Mus musculus
gctttgtccttcttggccttggtcc

SEQ ID NO: 372525 - DNA, 25 bp, Mus musculus
tggggtacaagactcacttcctttg

SEQ ID NO: 372526 - DNA, 25 bp, Mus musculus
cggacagacgtaggaggcaagttaa

SEQ ID NO: 372527 - DNA, 25 bp, Mus musculus
cttccacatgattcccggagggcga

SEQ ID NO: 372528 - DNA, 25 bp, Mus musculus
tttccgctccatggcgagaccggta

SEQ ID NO: 372529 - DNA, 25 bp, Mus musculus
tgcgcactcgagtgacgccgactcg

SEQ ID NO: 372530 - DNA, 25 bp, Mus musculus
gtctttccagcagacccgagcctgg

SEQ ID NO: 372531 - DNA, 25 bp, Mus musculus
ggtaatgattgccagctccggctgc

SEQ ID NO: 372532 - DNA, 25 bp, Mus musculus
attcaacaatttcccgatggcgtag

SEQ ID NO: 372533 - DNA, 25 bp, Mus musculus
agagttcacagacaggcaggtaatg

SEQ ID NO: 372534 - DNA, 25 bp, Mus musculus
cacggaaggaagagcagagttcaca

SEQ ID NO: 372535 - DNA, 25 bp, Mus musculus
gcgaatcacacagcggcccagtaac

SEQ ID NO: 372536 - DNA, 25 bp, Mus musculus
gttgctgcagaacccgcgggcgttc

SEQ ID NO: 372537 - DNA, 25 bp, Mus musculus
ccggcagttccggagccgttgctgc

SEQ ID NO: 372538 - DNA, 25 bp, Mus musculus
acgcgagcgggctgtcagctcccag

SEQ ID NO: 372539 - DNA, 25 bp, Mus musculus
agccgttgctgcagaacccgcgggc

SEQ ID NO: 372540 - DNA, 25 bp, Mus musculus
agttccggagccgttgctgcagaac

SEQ ID NO: 372541 - DNA, 25 bp, Mus musculus
tggggacagactcggctccagcctg

SEQ ID NO: 372542 - DNA, 25 bp, Mus musculus
acgctggggacagactcggctccag

SEQ ID NO: 372543 - DNA, 25 bp, Mus musculus
cagacgctggggacagactcggctc

SEQ ID NO: 372544 - DNA, 25 bp, Mus musculus
tccggtggcccgcaggagcgcagac

SEQ ID NO: 372545 - DNA, 25 bp, Mus musculus
caggctcacctggtttccggtggcc

SEQ ID NO: 372546 - DNA, 25 bp, Mus musculus
acccaggctcacctggtttccggtg

SEQ ID NO: 372547 - DNA, 25 bp, Mus musculus
cggaccgctcccgacccaggctcac

SEQ ID NO: 372548 - DNA, 25 bp, Mus musculus
gcagccagagctccggaccgctccc

SEQ ID NO: 372549 - DNA, 25 bp, Mus musculus
ttccggagccgttgctgcagaaccc

SEQ ID NO: 372550 - DNA, 25 bp, Mus musculus
tttctcgtctacgacgcgggtcacg

SEQ ID NO: 372551 - DNA, 25 bp, Mus musculus
acgcactctctgcacccaatggaga

SEQ ID NO: 372552 - DNA, 25 bp, Mus musculus
cggtagccaagacaatgcgtccttt

SEQ ID NO: 372553 - DNA, 25 bp, Mus musculus
cttccggcttctagcgaacgtttag

SEQ ID NO: 372554 - DNA, 25 bp, Mus musculus
aggcgcatagcacgtctgtccattc

SEQ ID NO: 372555 - DNA, 25 bp, Mus musculus
accgtccaatgaacgtaggcgcata

SEQ ID NO: 372556 - DNA, 25 bp, Mus musculus
ctccttgcgattgggcttgtccagc

SEQ ID NO: 372557 - DNA, 25 bp, Mus musculus
gtcgcaagtccttttcggtctcagg

SEQ ID NO: 372558 - DNA, 25 bp, Mus musculus
tcaccgaaggtcagcaggacacagc

SEQ ID NO: 372559 - DNA, 25 bp, Mus musculus
agaacgttcgagaagcggccacaca

SEQ ID NO: 372560 - DNA, 25 bp, Mus musculus
ctccttcgagggaacgagatggtcc

SEQ ID NO: 372561 - DNA, 25 bp, Mus musculus
agaggcctcagggaaagcatcatca

SEQ ID NO: 372562 - DNA, 25 bp, Mus musculus
gcaccatccgcagggtatttattta

SEQ ID NO: 372563 - DNA, 25 bp, Mus musculus
aatgcccggtctccaagtcgccttt

SEQ ID NO: 372564 - DNA, 25 bp, Mus musculus
gaagttgacggacgcgtagcccagc

SEQ ID NO: 372565 - DNA, 25 bp, Mus musculus
gccctttatcacgtcgaaattcatg

SEQ ID NO: 372566 - DNA, 25 bp, Mus musculus
tcctgtccctgtacacccggatgga

SEQ ID NO: 372567 - DNA, 25 bp, Mus musculus
ttgacggacgcgtagcccagcgagc

SEQ ID NO: 372568 - DNA, 25 bp, Mus musculus
gtcccgctgagaccacatgatgcga

SEQ ID NO: 372569 - DNA, 25 bp, Mus musculus
gtgatcctgtccctgtacacccgga

SEQ ID NO: 372570 - DNA, 25 bp, Mus musculus
accacatgatgcgaaccggcttgcc

SEQ ID NO: 372571 - DNA, 25 bp, Mus musculus
tgagaccacatgatgcgaaccggct

SEQ ID NO: 372572 - DNA, 25 bp, Mus musculus
cttgcgcagcgacgggtcccgctga

SEQ ID NO: 372573 - DNA, 25 bp, Mus musculus
ggcttgccctttatcacgtcgaaat

SEQ ID NO: 372574 - DNA, 25 bp, Mus musculus
accggcttgccctttatcacgtcga

SEQ ID NO: 372575 - DNA, 25 bp, Mus musculus
atgcgaaccggcttgccctttatca

SEQ ID NO: 372576 - DNA, 25 bp, Mus musculus
acatgatgcgaaccggcttgccctt

SEQ ID NO: 372577 - DNA, 25 bp, Mus musculus
ccgctgagaccacatgatgcgaacc

SEQ ID NO: 372578 - DNA, 25 bp, Mus musculus
actgcggtcacctgaacgaaacttg

SEQ ID NO: 372579 - DNA, 25 bp, Mus musculus
tgcgcccagcggcaggaattctcct

SEQ ID NO: 372580 - DNA, 25 bp, Mus musculus
agctgtagggcaaagcctgacccgg

SEQ ID NO: 372581 - DNA, 25 bp, Mus musculus
gtgcccgaacgataccagaacctgt

SEQ ID NO: 372582 - DNA, 25 bp, Mus musculus
cttgcaagagaaagcgctcctttcc

SEQ ID NO: 372583 - DNA, 25 bp, Mus musculus
gcaggaattctcctccgggcgtgtc

SEQ ID NO: 372584 - DNA, 25 bp, Mus musculus
ctcgccctgcatacgcaggtcgggg

SEQ ID NO: 372585 - DNA, 25 bp, Mus musculus
aagaccatctgggaggtgcccgaac

SEQ ID NO: 372586 - DNA, 25 bp, Mus musculus
tgggatgcttctctaccctgcgctc

SEQ ID NO: 372587 - DNA, 25 bp, Mus musculus
tgggatcgccgccactggagcccaa

SEQ ID NO: 372588 - DNA, 25 bp, Mus musculus
gcaccttgccgacgctcgtaggagc

SEQ ID NO: 372589 - DNA, 25 bp, Mus musculus
agaggcccacgttctaccggcagga

SEQ ID NO: 372590 - DNA, 25 bp, Mus musculus
ggcaggagctgaacaagaccatctg

SEQ ID NO: 372591 - DNA, 25 bp, Mus musculus
cctccttggagctgttctcgcgaga

SEQ ID NO: 372592 - DNA, 25 bp, Mus musculus
gcctcactcggaaaaggggcttcta

SEQ ID NO: 372593 - DNA, 25 bp, Mus musculus
ggcttctacaagcaggacatcaaca

SEQ ID NO: 372594 - DNA, 25 bp, Mus musculus
tgggagctacccaagacctacctgg

SEQ ID NO: 372595 - DNA, 25 bp, Mus musculus
ctgcctgggagctacccaagaccta

SEQ ID NO: 372596 - DNA, 25 bp, Mus musculus
aagactgcctgggagctacccaaga

SEQ ID NO: 372597 - DNA, 25 bp, Mus musculus
caacaagactgcctgggagctaccc

SEQ ID NO: 372598 - DNA, 25 bp, Mus musculus
catcaacaagactgcctgggagcta

SEQ ID NO: 372599 - DNA, 25 bp, Mus musculus
ctacaagcaggacatcaacaagact

SEQ ID NO: 372600 - DNA, 25 bp, Mus musculus
ctcactcggaaaaggggcttctaca

SEQ ID NO: 372601 - DNA, 25 bp, Mus musculus
aaggggcttctacaagcaggacatc

SEQ ID NO: 372602 - DNA, 25 bp, Mus musculus
tccgggatgagcctcactcggaaaa

SEQ ID NO: 372603 - DNA, 25 bp, Mus musculus
ccaccacggggtccgggatgagcct

SEQ ID NO: 372604 - DNA, 25 bp, Mus musculus
tcgcaggaccgccaccacggggtcc

SEQ ID NO: 372605 - DNA, 25 bp, Mus musculus
ggcagccaccgcaacctcctcgcag

SEQ ID NO: 372606 - DNA, 25 bp, Mus musculus
accgcgagcttctgctcttgaagca

SEQ ID NO: 372607 - DNA, 25 bp, Mus musculus
ccatgagaacgtaggctgcctcggg

SEQ ID NO: 372608 - DNA, 25 bp, Mus musculus
caccatgagaacgtaggctgcctcg

SEQ ID NO: 372609 - DNA, 25 bp, Mus musculus
atgcaccatgagaacgtaggctgcc

SEQ ID NO: 372610 - DNA, 25 bp, Mus musculus
acatgcaccatgagaacgtaggctg

SEQ ID NO: 372611 - DNA, 25 bp, Mus musculus
agcacatgcaccatgagaacgtagg

SEQ ID NO: 372612 - DNA, 25 bp, Mus musculus
ttgaagcacatgcaccatgagaacg

SEQ ID NO: 372613 - DNA, 25 bp, Mus musculus
tgctcttgaagcacatgcaccatga

SEQ ID NO: 372614 - DNA, 25 bp, Mus musculus
cttctgctcttgaagcacatgcacc

SEQ ID NO: 372615 - DNA, 25 bp, Mus musculus
cgcgagcttctgctcttgaagcaca

SEQ ID NO: 372616 - DNA, 25 bp, Mus musculus
gcgcttaccgcgagcttctgctctt

SEQ ID NO: 372617 - DNA, 25 bp, Mus musculus
caagcgcgcttaccgcgagcttctg

SEQ ID NO: 372618 - DNA, 25 bp, Mus musculus
ttgccaagcgcgcttaccgcgagct

SEQ ID NO: 372619 - DNA, 25 bp, Mus musculus
cgagcttctgctcttgaagcacatg

SEQ ID NO: 372620 - DNA, 25 bp, Mus musculus
tgggcggccaataagtgcttgcatc

SEQ ID NO: 372621 - DNA, 25 bp, Mus musculus
tgagccaccgctccgtggattcaga

SEQ ID NO: 372622 - DNA, 25 bp, Mus musculus
cagagtcccgccttcaggggccgcc

SEQ ID NO: 372623 - DNA, 25 bp, Mus musculus
tggcctggctagaccagagtcccgc

SEQ ID NO: 372624 - DNA, 25 bp, Mus musculus
ccctattggcctggctagaccagag

SEQ ID NO: 372625 - DNA, 25 bp, Mus musculus
gtcctggcagccaaacggctaagcc

SEQ ID NO: 372626 - DNA, 25 bp, Mus musculus
ccggtcctggcagccaaacggctaa

SEQ ID NO: 372627 - DNA, 25 bp, Mus musculus
cggatcctgcctgggggctgatccc

SEQ ID NO: 372628 - DNA, 25 bp, Mus musculus
gcgctttcgcgctcccgcttcgcgt

SEQ ID NO: 372629 - DNA, 25 bp, Mus musculus
gcgctgccgcttcgcgctcatctcc

SEQ ID NO: 372630 - DNA, 25 bp, Mus musculus
gtccgcaccgccaccgtgaggccgt

SEQ ID NO: 372631 - DNA, 25 bp, Mus musculus
ccgactagatcagctctgggacagg

SEQ ID NO: 372632 - DNA, 25 bp, Mus musculus
gccaataagtgcttgcatctccgcg

SEQ ID NO: 372633 - DNA, 25 bp, Mus musculus
gctccgtggattcagagtgggaacc

SEQ ID NO: 372634 - DNA, 25 bp, Mus musculus
acgccttctgttgcgtgtgcctgga

SEQ ID NO: 372635 - DNA, 25 bp, Mus musculus
tgcggaggtagagtacgacatggac

SEQ ID NO: 372636 - DNA, 25 bp, Mus musculus
ttgcctggctagacatggtcaacga

SEQ ID NO: 372637 - DNA, 25 bp, Mus musculus
catggtcaacgagaagcgccgagca

SEQ ID NO: 372638 - DNA, 25 bp, Mus musculus
aagcgccgagcagacggccacagct

SEQ ID NO: 372639 - DNA, 25 bp, Mus musculus
gccacagctcggtgtcggcagacac

SEQ ID NO: 372640 - DNA, 25 bp, Mus musculus
gtcggcagacaccttcgagctgctg

SEQ ID NO: 372641 - DNA, 25 bp, Mus musculus
tggaccggcttgagaaggaatccta

SEQ ID NO: 372642 - DNA, 25 bp, Mus musculus
gagaaggaatcctacctggagagcc

SEQ ID NO: 372643 - DNA, 25 bp, Mus musculus
agcagtggggcccagcagtccctaa

SEQ ID NO: 372644 - DNA, 25 bp, Mus musculus
gggcccagcagtccctaatcgacga

SEQ ID NO: 372645 - DNA, 25 bp, Mus musculus
gtccctaatcgacgaagacgccttc

SEQ ID NO: 372646 - DNA, 25 bp, Mus musculus
aatcgacgaagacgccttctgttgc

SEQ ID NO: 372647 - DNA, 25 bp, Mus musculus
acgaggaggacattgcctggctaga

SEQ ID NO: 372648 - DNA, 25 bp, Mus musculus
cacaaaggcgataggctcatctttc

SEQ ID NO: 372649 - DNA, 25 bp, Mus musculus
ctgtctgagccccttgggtgatgga

SEQ ID NO: 372650 - DNA, 25 bp, Mus musculus
tgttttgaagggccgggtgactcaa

SEQ ID NO: 372651 - DNA, 25 bp, Mus musculus
gactcaaccggggatccgcggccag

SEQ ID NO: 372652 - DNA, 25 bp, Mus musculus
gaggctgccgaccaaccacgcaggg

SEQ ID NO: 372653 - DNA, 25 bp, Mus musculus
accacgcagggccaccggtagccca

SEQ ID NO: 372654 - DNA, 25 bp, Mus musculus
aggcgataggctcatctttccgtga

SEQ ID NO: 372655 - DNA, 25 bp, Mus musculus
tgcagctcgctttcctgtctgagcc

SEQ ID NO: 372656 - DNA, 25 bp, Mus musculus
taggctcatctttccgtgagcatca

SEQ ID NO: 372657 - DNA, 25 bp, Mus musculus
atctttccgtgagcatcacgcgttc

SEQ ID NO: 372658 - DNA, 25 bp, Mus musculus
ttccgtgagcatcacgcgttccggg

SEQ ID NO: 372659 - DNA, 25 bp, Mus musculus
gagcatcacgcgttccggggcgacc

SEQ ID NO: 372660 - DNA, 25 bp, Mus musculus
agcctctttcaccttcgagcctgca

SEQ ID NO: 372661 - DNA, 25 bp, Mus musculus
gcctgcagctcgctttcctgtctga

SEQ ID NO: 372662 - DNA, 25 bp, Mus musculus
acggctacagagacggcgcagacgc

SEQ ID NO: 372663 - DNA, 25 bp, Mus musculus
gacggccgggagacactcaccagac

SEQ ID NO: 372664 - DNA, 25 bp, Mus musculus
ccgacggctacagagacggcgcaga

SEQ ID NO: 372665 - DNA, 25 bp, Mus musculus
ccctcagactgtggagaggggccgc

SEQ ID NO: 372666 - DNA, 25 bp, Mus musculus
cagacgcgacgtgcgggcggctcca

SEQ ID NO: 372667 - DNA, 25 bp, Mus musculus
cggctccagagcgaccgcgacacgc

SEQ ID NO: 372668 - DNA, 25 bp, Mus musculus
cgacacgccggggactccgaatgag

SEQ ID NO: 372669 - DNA, 25 bp, Mus musculus
gacgaggcggcaagcctgaggcgac

SEQ ID NO: 372670 - DNA, 25 bp, Mus musculus
gactccgaatgagcgcagctgccga

SEQ ID NO: 372671 - DNA, 25 bp, Mus musculus
gcagctgccgatccgcgacaggaca

SEQ ID NO: 372672 - DNA, 25 bp, Mus musculus
ccgatccgcgacaggacaggacaaa

SEQ ID NO: 372673 - DNA, 25 bp, Mus musculus
tccgcgacaggacaggacaaaagga

SEQ ID NO: 372674 - DNA, 25 bp, Mus musculus
caactgccggaaaagacggcggcgc

SEQ ID NO: 372675 - DNA, 25 bp, Mus musculus
acgccggggactccgaatgagcgca

SEQ ID NO: 372676 - DNA, 25 bp, Mus musculus
ggtaccagttaagtcgcccaagctc

SEQ ID NO: 372677 - DNA, 25 bp, Mus musculus
tttattcggctgcagcctaggcgga

SEQ ID NO: 372678 - DNA, 25 bp, Mus musculus
tttgtagcgcttacgccacagcctg

SEQ ID NO: 372679 - DNA, 25 bp, Mus musculus
cggcagagtctggacagctttattc

SEQ ID NO: 372680 - DNA, 25 bp, Mus musculus
cccgggattaatggcggcagagtct

SEQ ID NO: 372681 - DNA, 25 bp, Mus musculus
tgcagccgccatcgcccgggattaa

SEQ ID NO: 372682 - DNA, 25 bp, Mus musculus
agcaagcgtccatgtttcactctga

SEQ ID NO: 372683 - DNA, 25 bp, Mus musculus
aaggctccttagtctgcgatggatg

SEQ ID NO: 372684 - DNA, 25 bp, Mus musculus
cgggaaagcgaaagttgagcaaact

SEQ ID NO: 372685 - DNA, 25 bp, Mus musculus
agtcgcccaagctcggtgaccttga

SEQ ID NO: 372686 - DNA, 25 bp, Mus musculus
gctctaccctgcatcggggcgcaga

SEQ ID NO: 372687 - DNA, 25 bp, Mus musculus
agcaaactttgcaggctctaccctg

SEQ ID NO: 372688 - DNA, 25 bp, Mus musculus
accgcggattctcgcagggtttgta

SEQ ID NO: 372689 - DNA, 25 bp, Mus musculus
cttgagagcgactataaggctcctt

SEQ ID NO: 372690 - DNA, 25 bp, Mus musculus
cgcgcggcacagtgacctatttggc

SEQ ID NO: 372691 - DNA, 25 bp, Mus musculus
ctatttggcgggcacagtatgttcc

SEQ ID NO: 372692 - DNA, 25 bp, Mus musculus
cccgcactgtagagcggccggtatc

SEQ ID NO: 372693 - DNA, 25 bp, Mus musculus
accaagtgccctgtttcgcggtagc

SEQ ID NO: 372694 - DNA, 25 bp, Mus musculus
cagagcggttctccgatcccatggg

SEQ ID NO: 372695 - DNA, 25 bp, Mus musculus
ttacgggtgccgtacatcagacgcc

SEQ ID NO: 372696 - DNA, 25 bp, Mus musculus
caccctggtcgtgcgggaaatactt

SEQ ID NO: 372697 - DNA, 25 bp, Mus musculus
cccgggcactggattgagaccagaa

SEQ ID NO: 372698 - DNA, 25 bp, Mus musculus
cccagtgtaggaaggtgaccaggct

SEQ ID NO: 372699 - DNA, 25 bp, Mus musculus
cttcggcgagtctatctagagctta

SEQ ID NO: 372700 - DNA, 25 bp, Mus musculus
cggctcgcccaaagcgtgagaatga

SEQ ID NO: 372701 - DNA, 25 bp, Mus musculus
ccaatgtttctagggattccaggtg

SEQ ID NO: 372702 - DNA, 25 bp, Mus musculus
gctcgcttctggttgccaatgtttc

SEQ ID NO: 372703 - DNA, 25 bp, Mus musculus
ggcagccactcttccagtccttgga

SEQ ID NO: 372704 - DNA, 25 bp, Mus musculus
tcagacgtaggaactgccggcgtgc

SEQ ID NO: 372705 - DNA, 25 bp, Mus musculus
gggaaggcgactctaaaacttcgca

SEQ ID NO: 372706 - DNA, 25 bp, Mus musculus
gctcgagaacgaccgcgctcgggct

SEQ ID NO: 372707 - DNA, 25 bp, Mus musculus
ccgctgcgagagttccaagggcgtc

SEQ ID NO: 372708 - DNA, 25 bp, Mus musculus
tacatcgcaagtgctctgggccgct

SEQ ID NO: 372709 - DNA, 25 bp, Mus musculus
gttaaatctggagtgtacatcgcaa

SEQ ID NO: 372710 - DNA, 25 bp, Mus musculus
ccgccggggaagctatttcatacct

SEQ ID NO: 372711 - DNA, 25 bp, Mus musculus
gagtgcgtgtcccagcttgcgccgc

SEQ ID NO: 372712 - DNA, 25 bp, Mus musculus
ctaccacgaggcgaagaggagcacg

SEQ ID NO: 372713 - DNA, 25 bp, Mus musculus
tgaaaagctacctgtgggcgcgcta

SEQ ID NO: 372714 - DNA, 25 bp, Mus musculus
cggctgccgtggacatgaaaagcta

SEQ ID NO: 372715 - DNA, 25 bp, Mus musculus
actggcagcttagaggcagcatggc

SEQ ID NO: 372716 - DNA, 25 bp, Mus musculus
ccggcacttgctcagacgtaggaac

SEQ ID NO: 372717 - DNA, 25 bp, Mus musculus
gctatttcatacctggggattgtta

SEQ ID NO: 372718 - DNA, 25 bp, Mus musculus
tgcccaaggtctacctgagccctgg

SEQ ID NO: 372719 - DNA, 25 bp, Mus musculus
gcgttcggagcctagggctgcccaa

SEQ ID NO: 372720 - DNA, 25 bp, Mus musculus
gcaacttcgtctgggagcgcgttcg

SEQ ID NO: 372721 - DNA, 25 bp, Mus musculus
agacgccgctggagggcaacttcgt

SEQ ID NO: 372722 - DNA, 25 bp, Mus musculus
tttgacttcgtcacggagacgccgc

SEQ ID NO: 372723 - DNA, 25 bp, Mus musculus
gctgtctccaggaggcccgagaacg

SEQ ID NO: 372724 - DNA, 25 bp, Mus musculus
caggagcaaagtgtgccgttgtctc

SEQ ID NO: 372725 - DNA, 25 bp, Mus musculus
cgatgcgctcatggcgggctgtctc

SEQ ID NO: 372726 - DNA, 25 bp, Mus musculus
ttgcgccgtgattgcgatgcgctca

SEQ ID NO: 372727 - DNA, 25 bp, Mus musculus
gacagtgagcagttgcgccgtgatt

SEQ ID NO: 372728 - DNA, 25 bp, Mus musculus
tcttcggtcccgtggacagtgagca

SEQ ID NO: 372729 - DNA, 25 bp, Mus musculus
cgacctgttccgcacaggagcaaag

SEQ ID NO: 372730 - DNA, 25 bp, Mus musculus
aagtgtgccgttgtctcttcggtcc

SEQ ID NO: 372731 - DNA, 25 bp, Mus musculus
cgagaacggtggaactttgacttcg

SEQ ID NO: 372732 - DNA, 25 bp, Mus musculus
gcgtccgcgcgcgttactatagttt

SEQ ID NO: 372733 - DNA, 25 bp, Mus musculus
tcttcggtaccctacgtgattcctg

SEQ ID NO: 372734 - DNA, 25 bp, Mus musculus
cgtgattcctggacatctcggggtc

SEQ ID NO: 372735 - DNA, 25 bp, Mus musculus
acatctcggggtccgatcgggtact

SEQ ID NO: 372736 - DNA, 25 bp, Mus musculus
cgatcgggtactgcgggccacgcaa

SEQ ID NO: 372737 - DNA, 25 bp, Mus musculus
ctaccgaaaagagcccgctaagccg

SEQ ID NO: 372738 - DNA, 25 bp, Mus musculus
ttaaacgtcctgttgcttcactggg

SEQ ID NO: 372739 - DNA, 25 bp, Mus musculus
tcctgttgcttcactggggactctc

SEQ ID NO: 372740 - DNA, 25 bp, Mus musculus
tgggcgtcacgtgtccagacacgta

SEQ ID NO: 372741 - DNA, 25 bp, Mus musculus
tgtccagacacgtagccgggaggct

SEQ ID NO: 372742 - DNA, 25 bp, Mus musculus
gcgcgtcgaggactgtgaccacgcc

SEQ ID NO: 372743 - DNA, 25 bp, Mus musculus
gtgggcgcccacaccgcaagtgtct

SEQ ID NO: 372744 - DNA, 25 bp, Mus musculus
cgcgcgcgttactatagtttgggtt

SEQ ID NO: 372745 - DNA, 25 bp, Mus musculus
gggccacgcaactctaccgaaaaga

SEQ ID NO: 372746 - DNA, 25 bp, Mus musculus
cagtgaaaagcaggctcgctaagca

SEQ ID NO: 372747 - DNA, 25 bp, Mus musculus
ctggcgacagccagagacggtccca

SEQ ID NO: 372748 - DNA, 25 bp, Mus musculus
ctggactgcgggaaaatcaaatgta

SEQ ID NO: 372749 - DNA, 25 bp, Mus musculus
acgccatgtcctcgggttgctccat

SEQ ID NO: 372750 - DNA, 25 bp, Mus musculus
cgaactcgctgagcgacgccatgtc

SEQ ID NO: 372751 - DNA, 25 bp, Mus musculus
tgcccgccaaggagtcgaactcgct

SEQ ID NO: 372752 - DNA, 25 bp, Mus musculus
ctccaccttggtagccgggatgctg

SEQ ID NO: 372753 - DNA, 25 bp, Mus musculus
tccaaggggcacctgtttgggcagc

SEQ ID NO: 372754 - DNA, 25 bp, Mus musculus
cccgggagacgagaacagtgaaaag

SEQ ID NO: 372755 - DNA, 25 bp, Mus musculus
tcaaatgtaccctgagtcgccgcca

SEQ ID NO: 372756 - DNA, 25 bp, Mus musculus
ctacagagaaagagggattccggcc

SEQ ID NO: 372757 - DNA, 25 bp, Mus musculus
gcggctcacctgcatgacaccgtga

SEQ ID NO: 372758 - DNA, 25 bp, Mus musculus
tgacaccgtgatctccaccttggta

SEQ ID NO: 372759 - DNA, 25 bp, Mus musculus
agtcaatattcctgcgcgattcacg

SEQ ID NO: 372760 - DNA, 25 bp, Mus musculus
acagtgattggtctgttttggcgcg

SEQ ID NO: 372761 - DNA, 25 bp, Mus musculus
ccacgctccggaacagtgattggtc

SEQ ID NO: 372762 - DNA, 25 bp, Mus musculus
gtgcaagattctccaggggcgattc

SEQ ID NO: 372763 - DNA, 25 bp, Mus musculus
tcagtgcaggaactcagacaagtgc

SEQ ID NO: 372764 - DNA, 25 bp, Mus musculus
ggttgcaagtcgaaatgctcagtgc

SEQ ID NO: 372765 - DNA, 25 bp, Mus musculus
aggatccttctttctaggctgggaa

SEQ ID NO: 372766 - DNA, 25 bp, Mus musculus
ggacaagaatgacgaaggatccttc

SEQ ID NO: 372767 - DNA, 25 bp, Mus musculus
atttagggcgctgggacaagaatga

SEQ ID NO: 372768 - DNA, 25 bp, Mus musculus
ccgcccgtttgcttgacaggattta

SEQ ID NO: 372769 - DNA, 25 bp, Mus musculus
gcaatcactacttccggcggagtta

SEQ ID NO: 372770 - DNA, 25 bp, Mus musculus
ccgccatgctgagcgaaggtatccc

SEQ ID NO: 372771 - DNA, 25 bp, Mus musculus
ccgcagctctgtgcgtgcgggcaac

SEQ ID NO: 372772 - DNA, 25 bp, Mus musculus
tcacctagtctccaggtagacgttg

SEQ ID NO: 372773 - DNA, 25 bp, Mus musculus
aacctgcgagtcaggccggccactg

SEQ ID NO: 372774 - DNA, 25 bp, Mus musculus
ggcgcgggcccgcatgtgagtgact

SEQ ID NO: 372775 - DNA, 25 bp, Mus musculus
acactgctcgaacttggttcgcaga

SEQ ID NO: 372776 - DNA, 25 bp, Mus musculus
ccggaagcaggaagttgttggccca

SEQ ID NO: 372777 - DNA, 25 bp, Mus musculus
gtccgacactgctcgaacttggttc

SEQ ID NO: 372778 - DNA, 25 bp, Mus musculus
tgacggggtccgacactgctcgaac

SEQ ID NO: 372779 - DNA, 25 bp, Mus musculus
gacatctttcccgaggctccgcggg

SEQ ID NO: 372780 - DNA, 25 bp, Mus musculus
ggggcagatcccctctgacatcttt

SEQ ID NO: 372781 - DNA, 25 bp, Mus musculus
ccgtccgcgttctgctgactgacag

SEQ ID NO: 372782 - DNA, 25 bp, Mus musculus
caggaagttgttggcccaccctcct

SEQ ID NO: 372783 - DNA, 25 bp, Mus musculus
agcaggaagttgttggcccaccctc

SEQ ID NO: 372784 - DNA, 25 bp, Mus musculus
tcgaacttggttcgcagacgtggcg

SEQ ID NO: 372785 - DNA, 25 bp, Mus musculus
ttccgggtcgcgctgccggaagcag

SEQ ID NO: 372786 - DNA, 25 bp, Mus musculus
tggcggccgtgtccgaaagccctga

SEQ ID NO: 372787 - DNA, 25 bp, Mus musculus
tccgcgttctgctgactgacagcac

SEQ ID NO: 372788 - DNA, 25 bp, Mus musculus
tcgccaaggcctacgctcagaagtg

SEQ ID NO: 372789 - DNA, 25 bp, Mus musculus
tggggccacaacaaagaacgcgggc

SEQ ID NO: 372790 - DNA, 25 bp, Mus musculus
ccacaacaaagaacgcgggcggcgc

SEQ ID NO: 372791 - DNA, 25 bp, Mus musculus
gcgcggagagaacttgtttgccatc

SEQ ID NO: 372792 - DNA, 25 bp, Mus musculus
acttgtttgccatcacggacgaggg

SEQ ID NO: 372793 - DNA, 25 bp, Mus musculus
cggccactacactcaggtgacagtc

SEQ ID NO: 372794 - DNA, 25 bp, Mus musculus
ccatcacggacgagggcatggacgt

SEQ ID NO: 372795 - DNA, 25 bp, Mus musculus
ctggcacgaggagcatgagtattac

SEQ ID NO: 372796 - DNA, 25 bp, Mus musculus
tgagtattacaatttcagcacggcc

SEQ ID NO: 372797 - DNA, 25 bp, Mus musculus
tacaatttcagcacggccacctgcg

SEQ ID NO: 372798 - DNA, 25 bp, Mus musculus
ggccacctgcgatccgaaccagatg

SEQ ID NO: 372799 - DNA, 25 bp, Mus musculus
ctcagaagtgcgtgtggggccacaa

SEQ ID NO: 372800 - DNA, 25 bp, Mus musculus
atgtgcggccactacactcaggtga

SEQ ID NO: 372801 - DNA, 25 bp, Mus musculus
tgcgatccgaaccagatgtgcggcc

SEQ ID NO: 372802 - DNA, 25 bp, Mus musculus
ttacattaccagagggacacacccg

SEQ ID NO: 372803 - DNA, 25 bp, Mus musculus
cgcaggattcgcctccaagggtgac

SEQ ID NO: 372804 - DNA, 25 bp, Mus musculus
cagagcccatgagaaacccggaaaa

SEQ ID NO: 372805 - DNA, 25 bp, Mus musculus
gccttgccaaacagagcccatgaga

SEQ ID NO: 372806 - DNA, 25 bp, Mus musculus
ggtccgctaatgcttggccttgcca

SEQ ID NO: 372807 - DNA, 25 bp, Mus musculus
gacacacccgctgcagaggagtatg

SEQ ID NO: 372808 - DNA, 25 bp, Mus musculus
tcgcctccaagggtgaccgaggtcc

SEQ ID NO: 372809 - DNA, 25 bp, Mus musculus
gtcaatgacaagaagttacattacc

SEQ ID NO: 372810 - DNA, 25 bp, Mus musculus
ggaggagttagtcttgtcaatgaca

SEQ ID NO: 372811 - DNA, 25 bp, Mus musculus
gcagtcctctaagcggagtttgggc

SEQ ID NO: 372812 - DNA, 25 bp, Mus musculus
ctaggcagtcctctaagcggagttt

SEQ ID NO: 372813 - DNA, 25 bp, Mus musculus
cggggcctgctaggcagtcctctaa

SEQ ID NO: 372814 - DNA, 25 bp, Mus musculus
ctgcagaggagtatggctcgcgcat

SEQ ID NO: 372815 - DNA, 25 bp, Mus musculus
ccggaaaaggcgcaggattcgcctc

SEQ ID NO: 372816 - DNA, 25 bp, Mus musculus
aactctgcgacatgcgacagccggg

SEQ ID NO: 372817 - DNA, 25 bp, Mus musculus
actgttctcggggaatggtctgttt

SEQ ID NO: 372818 - DNA, 25 bp, Mus musculus
gtaccatttgcatagcaacctcctc

SEQ ID NO: 372819 - DNA, 25 bp, Mus musculus
tttccaggcgactgttctcggggaa

SEQ ID NO: 372820 - DNA, 25 bp, Mus musculus
acggcctgcgtcctttgggagcagc

SEQ ID NO: 372821 - DNA, 25 bp, Mus musculus
tcggggaatggtctgttttggcaac

SEQ ID NO: 372822 - DNA, 25 bp, Mus musculus
ctgtcacggcctgcgtcctttggga

SEQ ID NO: 372823 - DNA, 25 bp, Mus musculus
gagcaactctgcgacatgcgacagc

SEQ ID NO: 372824 - DNA, 25 bp, Mus musculus
ccacgagcaactctgcgacatgcga

SEQ ID NO: 372825 - DNA, 25 bp, Mus musculus
aggccgtaccatttgcatagcaacc

SEQ ID NO: 372826 - DNA, 25 bp, Mus musculus
cgtaggccgtaccatttgcatagca

SEQ ID NO: 372827 - DNA, 25 bp, Mus musculus
ctccgtaggccgtaccatttgcata

SEQ ID NO: 372828 - DNA, 25 bp, Mus musculus
aatggtctgttttggcaaccggagg

SEQ ID NO: 372829 - DNA, 25 bp, Mus musculus
ccgtttccaggcgactgttctcggg

SEQ ID NO: 372830 - DNA, 25 bp, Mus musculus
acgccaccaagctggcgccgggtga

SEQ ID NO: 372831 - DNA, 25 bp, Mus musculus
agtcgcagtaccaggtgggcccgct

SEQ ID NO: 372832 - DNA, 25 bp, Mus musculus
gcagcagtcacagtcagcagcagcc

SEQ ID NO: 372833 - DNA, 25 bp, Mus musculus
aacttgccggtgagtgggcaacgcc

SEQ ID NO: 372834 - DNA, 25 bp, Mus musculus
gtcccgtgcctctttcctaggcaaa

SEQ ID NO: 372835 - DNA, 25 bp, Mus musculus
gggtcttcttccaggtggccattaa

SEQ ID NO: 372836 - DNA, 25 bp, Mus musculus
caggtggccattaagcacgtggaga

SEQ ID NO: 372837 - DNA, 25 bp, Mus musculus
gcacgtggagaaggaccggatttcc

SEQ ID NO: 372838 - DNA, 25 bp, Mus musculus
ccggatttccgattggggagaactg

SEQ ID NO: 372839 - DNA, 25 bp, Mus musculus
ccagagaccctctcatgggtgggtg

SEQ ID NO: 372840 - DNA, 25 bp, Mus musculus
cacccgagtgcccatggaagtggtc

SEQ ID NO: 372841 - DNA, 25 bp, Mus musculus
cccatggaagtggtcctgttgaaga

SEQ ID NO: 372842 - DNA, 25 bp, Mus musculus
tggcatccgcgtcgccgacaacttg

SEQ ID NO: 372843 - DNA, 25 bp, Mus musculus
tcggctcggtctactctggcatccg

SEQ ID NO: 372844 - DNA, 25 bp, Mus musculus
tcagcccaccaatggcaacggtgtt

SEQ ID NO: 372845 - DNA, 25 bp, Mus musculus
ccaccaatggcaacggtgttgggcg

SEQ ID NO: 372846 - DNA, 25 bp, Mus musculus
gctggccctcagattgcggggtccc

SEQ ID NO: 372847 - DNA, 25 bp, Mus musculus
ctgacgttgccgcgggccttcagcg

SEQ ID NO: 372848 - DNA, 25 bp, Mus musculus
ggggagtgcccacatccaagatggc

SEQ ID NO: 372849 - DNA, 25 bp, Mus musculus
ttcagcggcccgcaggatccgggat

SEQ ID NO: 372850 - DNA, 25 bp, Mus musculus
gcccaccaatggcaacggtgttggg

SEQ ID NO: 372851 - DNA, 25 bp, Mus musculus
agcggcccgcaggatccgggatcct

SEQ ID NO: 372852 - DNA, 25 bp, Mus musculus
aggatccgggatcctcattggtcca

SEQ ID NO: 372853 - DNA, 25 bp, Mus musculus
gatccgggatcctcattggtccatc

SEQ ID NO: 372854 - DNA, 25 bp, Mus musculus
tccgggatcctcattggtccatccg

SEQ ID NO: 372855 - DNA, 25 bp, Mus musculus
cccggcccacctgtgtgcccagccc

SEQ ID NO: 372856 - DNA, 25 bp, Mus musculus
tgctcagcccaccaatggcaacggt

SEQ ID NO: 372857 - DNA, 25 bp, Mus musculus
tcattggtccatccgcccaccggcc

SEQ ID NO: 372858 - DNA, 25 bp, Mus musculus
tcagtgtgggactggagtccgggaa

SEQ ID NO: 372859 - DNA, 25 bp, Mus musculus
tgtgagcggctctgactagcacgct

SEQ ID NO: 372860 - DNA, 25 bp, Mus musculus
agcggctctgactagcacgctgagg

SEQ ID NO: 372861 - DNA, 25 bp, Mus musculus
ctagcacgctgaggagaagcttgag

SEQ ID NO: 372862 - DNA, 25 bp, Mus musculus
cacgctgaggagaagcttgaggacc

SEQ ID NO: 372863 - DNA, 25 bp, Mus musculus
ctgaggagaagcttgaggacctccc

SEQ ID NO: 372864 - DNA, 25 bp, Mus musculus
gagaagcttgaggacctcccggtgt

SEQ ID NO: 372865 - DNA, 25 bp, Mus musculus
tgaggacctcccggtgtaagtgaag

SEQ ID NO: 372866 - DNA, 25 bp, Mus musculus
gggtgcgaagaagtcagtgtgtgac

SEQ ID NO: 372867 - DNA, 25 bp, Mus musculus
ggctgtgacgtgaaggcagggcaag

SEQ ID NO: 372868 - DNA, 25 bp, Mus musculus
caagagcggtcgtgcgaggcggtca

SEQ ID NO: 372869 - DNA, 25 bp, Mus musculus
tggagcccgggaagggctgagacac

SEQ ID NO: 372870 - DNA, 25 bp, Mus musculus
gccatcttctcgcacctgccagtgc

SEQ ID NO: 372871 - DNA, 25 bp, Mus musculus
cacctgccagtgcgggaagacagac

SEQ ID NO: 372872 - DNA, 25 bp, Mus musculus
cgattgcttctgtcttgtgtgtaga

SEQ ID NO: 372873 - DNA, 25 bp, Mus musculus
agccgctgtaacggacgcgggcctc

SEQ ID NO: 372874 - DNA, 25 bp, Mus musculus
atgggcgagcccgaccccttggtct

SEQ ID NO: 372875 - DNA, 25 bp, Mus musculus
gttggctggttgctgaacgctgccc

SEQ ID NO: 372876 - DNA, 25 bp, Mus musculus
ccggagctcaggctagaggttggct

SEQ ID NO: 372877 - DNA, 25 bp, Mus musculus
cttgtgtgtagattaagttgcgcga

SEQ ID NO: 372878 - DNA, 25 bp, Mus musculus
ccgggcgattgcttctgtcttgtgt

SEQ ID NO: 372879 - DNA, 25 bp, Mus musculus
caacgcggtcgatccccgggcgatt

SEQ ID NO: 372880 - DNA, 25 bp, Mus musculus
gggcccgcgctctcaacgcggtcga

SEQ ID NO: 372881 - DNA, 25 bp, Mus musculus
cttcaggctcacacctgcgcacttc

SEQ ID NO: 372882 - DNA, 25 bp, Mus musculus
gttacgctcgtccttcttcaggctc

SEQ ID NO: 372883 - DNA, 25 bp, Mus musculus
acgttacgctcgtccttcttcaggc

SEQ ID NO: 372884 - DNA, 25 bp, Mus musculus
cgcagcagacgttacgctcgtcctt

SEQ ID NO: 372885 - DNA, 25 bp, Mus musculus
ttaagttgcgcgagaggaacctcgg

SEQ ID NO: 372886 - DNA, 25 bp, Mus musculus
ccagcaacctctcggagccgaggtt

SEQ ID NO: 372887 - DNA, 25 bp, Mus musculus
cgtcggggagatggcgttcccttct

SEQ ID NO: 372888 - DNA, 25 bp, Mus musculus
cgtttccaaaggagaagctccgtcg

SEQ ID NO: 372889 - DNA, 25 bp, Mus musculus
gtatcacacctgacgtttccaaagg

SEQ ID NO: 372890 - DNA, 25 bp, Mus musculus
cttagaagtgcctggtcacagcgcg

SEQ ID NO: 372891 - DNA, 25 bp, Mus musculus
cgctttcgggtagcctctctctgct

SEQ ID NO: 372892 - DNA, 25 bp, Mus musculus
tttgcccgctttcgggtagcctctc

SEQ ID NO: 372893 - DNA, 25 bp, Mus musculus
cggccctgcgaggaaaacgaaagtg

SEQ ID NO: 372894 - DNA, 25 bp, Mus musculus
tgacgttatcaagcggcgccgcccg

SEQ ID NO: 372895 - DNA, 25 bp, Mus musculus
ggttagcagcgcttagaagtgcctg

SEQ ID NO: 372896 - DNA, 25 bp, Mus musculus
cgggctcgtgacgttatcaagcggc

SEQ ID NO: 372897 - DNA, 25 bp, Mus musculus
gcgctgtgcgacctgggcagttccc

SEQ ID NO: 372898 - DNA, 25 bp, Mus musculus
acagtggcggcctggtccctcgtct

SEQ ID NO: 372899 - DNA, 25 bp, Mus musculus
tggtcgccgcgcacacagtatcaca

SEQ ID NO: 372900 - DNA, 25 bp, Mus musculus
catctttgcccgctggagcgctctg

SEQ ID NO: 372901 - DNA, 25 bp, Mus musculus
agttccatctttgcccgctggagcg

SEQ ID NO: 372902 - DNA, 25 bp, Mus musculus
acagagttccatctttgcccgctgg

SEQ ID NO: 372903 - DNA, 25 bp, Mus musculus
acacaaaagaaagaacagagttcca

SEQ ID NO: 372904 - DNA, 25 bp, Mus musculus
tcgcagttcccaggcccggaagaaa

SEQ ID NO: 372905 - DNA, 25 bp, Mus musculus
aagggacggccacacagctcctggc

SEQ ID NO: 372906 - DNA, 25 bp, Mus musculus
acccggcaaagggacggccacacag

SEQ ID NO: 372907 - DNA, 25 bp, Mus musculus
gctaatgaatgcgtgcctgcgcaca

SEQ ID NO: 372908 - DNA, 25 bp, Mus musculus
agaagctgttgtcaggagagaaaca

SEQ ID NO: 372909 - DNA, 25 bp, Mus musculus
gtgcctgcgcacagggacccgaaac

SEQ ID NO: 372910 - DNA, 25 bp, Mus musculus
ctctggagcgggtaggaatgtgcgt

SEQ ID NO: 372911 - DNA, 25 bp, Mus musculus
aggcaggggagtaactcgcccgatt

SEQ ID NO: 372912 - DNA, 25 bp, Mus musculus
cacacagctcctggcctcgcagttc

SEQ ID NO: 372913 - DNA, 25 bp, Mus musculus
tttgcccgctggagcgctctggagc

SEQ ID NO: 372914 - DNA, 25 bp, Mus musculus
ttgctgtcttttccgcgctggacca

SEQ ID NO: 372915 - DNA, 25 bp, Mus musculus
gaccagcccattaagtcgcactacg

SEQ ID NO: 372916 - DNA, 25 bp, Mus musculus
taagtcgcactacgcacgcgcagga

SEQ ID NO: 372917 - DNA, 25 bp, Mus musculus
cgcgcaggacctcgtgcttcttttt

SEQ ID NO: 372918 - DNA, 25 bp, Mus musculus
aggacctcgtgcttctttttcattg

SEQ ID NO: 372919 - DNA, 25 bp, Mus musculus
ctttttcattggtcggtgcagagga

SEQ ID NO: 372920 - DNA, 25 bp, Mus musculus
ggacttctgcgtcgccatcttgtta

SEQ ID NO: 372921 - DNA, 25 bp, Mus musculus
gccatcttgttaaggggcgcgtcca

SEQ ID NO: 372922 - DNA, 25 bp, Mus musculus
ctttttagtcatattgcttgctgtc

SEQ ID NO: 372923 - DNA, 25 bp, Mus musculus
tcctgcagcggccatgtttgtgagg

SEQ ID NO: 372924 - DNA, 25 bp, Mus musculus
tgactaaccacgtgactcgaacccg

SEQ ID NO: 372925 - DNA, 25 bp, Mus musculus
ttaaggggcgcgtccatcctgcagc

SEQ ID NO: 372926 - DNA, 25 bp, Mus musculus
acctcctgagcgacaccaagattct

SEQ ID NO: 372927 - DNA, 25 bp, Mus musculus
gagcgacaccaagattctcccgctt

SEQ ID NO: 372928 - DNA, 25 bp, Mus musculus
agcagctgtcctttgaagcgccaca

SEQ ID NO: 372929 - DNA, 25 bp, Mus musculus
tggagctgaccggacgctcaccgga

SEQ ID NO: 372930 - DNA, 25 bp, Mus musculus
tgaccggacgctcaccggagacctg

SEQ ID NO: 372931 - DNA, 25 bp, Mus musculus
tgaggactgccacgcagaagcgagc

SEQ ID NO: 372932 - DNA, 25 bp, Mus musculus
atgcgctgaggactgccacgcagaa

SEQ ID NO: 372933 - DNA, 25 bp, Mus musculus
ctttgaagcgccacacggccgaggc

SEQ ID NO: 372934 - DNA, 25 bp, Mus musculus
ctgctgtcacgggtcagggcgtcca

SEQ ID NO: 372935 - DNA, 25 bp, Mus musculus
tagttgccgctgctgtcacgggtca

SEQ ID NO: 372936 - DNA, 25 bp, Mus musculus
gcactcgtagttgccgctgctgtca

SEQ ID NO: 372937 - DNA, 25 bp, Mus musculus
ttggagacgctgcactcgtagttgc

SEQ ID NO: 372938 - DNA, 25 bp, Mus musculus
ccacgtcgttggagacgctgcactc

SEQ ID NO: 372939 - DNA, 25 bp, Mus musculus
tggctgagcccacgtcgttggagac

SEQ ID NO: 372940 - DNA, 25 bp, Mus musculus
ccacgcagaagcgagcagcgcagga

SEQ ID NO: 372941 - DNA, 25 bp, Mus musculus
ccacacggccgaggcgatgcgctga

SEQ ID NO: 372942 - DNA, 25 bp, Mus musculus
tccgccttgcagtagtagcgacctc

SEQ ID NO: 372943 - DNA, 25 bp, Mus musculus
tcccgtcagggtccagaacctcgag

SEQ ID NO: 372944 - DNA, 25 bp, Mus musculus
gggtccagaacctcgagagaccata

SEQ ID NO: 372945 - DNA, 25 bp, Mus musculus
gagagaccataactcacactgcacg

SEQ ID NO: 372946 - DNA, 25 bp, Mus musculus
cacactgcacgtccacgcggataga

SEQ ID NO: 372947 - DNA, 25 bp, Mus musculus
gcgctcgatccgcagagtctcattg

SEQ ID NO: 372948 - DNA, 25 bp, Mus musculus
gatagacttgatggccggcacgccc

SEQ ID NO: 372949 - DNA, 25 bp, Mus musculus
gtagtagcgacctccctgcgtgcgt

SEQ ID NO: 372950 - DNA, 25 bp, Mus musculus
ctgcgtgcgtgcgatgcgctcgatc

SEQ ID NO: 372951 - DNA, 25 bp, Mus musculus
gagtctcattgaagaccgacgtctc

SEQ ID NO: 372952 - DNA, 25 bp, Mus musculus
agaccgacgtctcctggaacttgtc

SEQ ID NO: 372953 - DNA, 25 bp, Mus musculus
cctggaacttgtccgatgcgctgcc

SEQ ID NO: 372954 - DNA, 25 bp, Mus musculus
atgcgctgccggcagttttggtcca

SEQ ID NO: 372955 - DNA, 25 bp, Mus musculus
cacgtccacgcggatagacttgatg

SEQ ID NO: 372956 - DNA, 25 bp, Mus musculus
agtccgcgaagttagccgagccgcc

SEQ ID NO: 372957 - DNA, 25 bp, Mus musculus
ctggctccagtcctgcagtaggtgt

SEQ ID NO: 372958 - DNA, 25 bp, Mus musculus
cgccagaagtagaagacaggtcacc

SEQ ID NO: 372959 - DNA, 25 bp, Mus musculus
gtattattctcccaagacttccgga

SEQ ID NO: 372960 - DNA, 25 bp, Mus musculus
accaatagcctaggaccgcttcttg

SEQ ID NO: 372961 - DNA, 25 bp, Mus musculus
gagacgcggccatcagtgcatccac

SEQ ID NO: 372962 - DNA, 25 bp, Mus musculus
gaggcccggactctgctttggttaa

SEQ ID NO: 372963 - DNA, 25 bp, Mus musculus
agcgcgcactttgagcaagatcttg

SEQ ID NO: 372964 - DNA, 25 bp, Mus musculus
tgctttggttaatccgctggctcca

SEQ ID NO: 372965 - DNA, 25 bp, Mus musculus
cgggacgctggctcttaccatagac

SEQ ID NO: 372966 - DNA, 25 bp, Mus musculus
ccttttccctgagtcgcgacggaga

SEQ ID NO: 372967 - DNA, 25 bp, Mus musculus
gactaggagtctgagcaagccgcga

SEQ ID NO: 372968 - DNA, 25 bp, Mus musculus
gccaccgatgcctgacaaacttgtc

SEQ ID NO: 372969 - DNA, 25 bp, Mus musculus
caagatcttgtaaagtttccgggcg

SEQ ID NO: 372970 - DNA, 25 bp, Mus musculus
ggcccacaggttgccaacaggtttg

SEQ ID NO: 372971 - DNA, 25 bp, Mus musculus
ggccaaggcgtctgcttctcctaga

SEQ ID NO: 372972 - DNA, 25 bp, Mus musculus
ttctcctagaccagagctggcgcga

SEQ ID NO: 372973 - DNA, 25 bp, Mus musculus
cgcgcttgcagcttgcagtgtccta

SEQ ID NO: 372974 - DNA, 25 bp, Mus musculus
tgcagtgtcctagctgaggcccaca

SEQ ID NO: 372975 - DNA, 25 bp, Mus musculus
ccagtgccagagctccacagggaca

SEQ ID NO: 372976 - DNA, 25 bp, Mus musculus
cccgaagctgtgaccaagatgtagt

SEQ ID NO: 372977 - DNA, 25 bp, Mus musculus
atgtagttccttccagacgcccttg

SEQ ID NO: 372978 - DNA, 25 bp, Mus musculus
aacccggtcctgctaatcttacctg

SEQ ID NO: 372979 - DNA, 25 bp, Mus musculus
ctgctccacctgtcgccgttattta

SEQ ID NO: 372980 - DNA, 25 bp, Mus musculus
cgttatttatctcggcgtgagcgca

SEQ ID NO: 372981 - DNA, 25 bp, Mus musculus
cgcagggattgtactagagcggccc

SEQ ID NO: 372982 - DNA, 25 bp, Mus musculus
gggcactggacacttaatgaatgtt

SEQ ID NO: 372983 - DNA, 25 bp, Mus musculus
tgcctacccgtgagacctcaggcgt

SEQ ID NO: 372984 - DNA, 25 bp, Mus musculus
ggaggaacgcttcgcggcactcatc

SEQ ID NO: 372985 - DNA, 25 bp, Mus musculus
aacaaagtggcacgcccggatccca

SEQ ID NO: 372986 - DNA, 25 bp, Mus musculus
cctccgaggctctgaacaaagtggc

SEQ ID NO: 372987 - DNA, 25 bp, Mus musculus
ctctcgtaaaagtcctgggaagatg

SEQ ID NO: 372988 - DNA, 25 bp, Mus musculus
gcgcaggctagctctcgtaaaagtc

SEQ ID NO: 372989 - DNA, 25 bp, Mus musculus
tggggcgtaccatttgtctcagctg

SEQ ID NO: 372990 - DNA, 25 bp, Mus musculus
ccagctctggacagactaccaggtc

SEQ ID NO: 372991 - DNA, 25 bp, Mus musculus
ggtttggaaacgctccacccagctc

SEQ ID NO: 372992 - DNA, 25 bp, Mus musculus
gcaggacacctaggcaacttccggg

SEQ ID NO: 372993 - DNA, 25 bp, Mus musculus
gccagcggtgaacgcaggacaccta

SEQ ID NO: 372994 - DNA, 25 bp, Mus musculus
cttgaagacccagacggccagcggt

SEQ ID NO: 372995 - DNA, 25 bp, Mus musculus
cgcgagaacagtggccttgaagacc

SEQ ID NO: 372996 - DNA, 25 bp, Mus musculus
ggatcccagctgatccgtcgggctc

SEQ ID NO: 372997 - DNA, 25 bp, Mus musculus
cggcactcatcaggggcgcgagaac

SEQ ID NO: 372998 - DNA, 25 bp, Mus musculus
tgcatgtcagcgctccatcaatgag

SEQ ID NO: 372999 - DNA, 25 bp, Mus musculus
ctgagcgagcgccatgcatgtcagc

SEQ ID NO: 373000 - DNA, 25 bp, Mus musculus
gctccatcactgagcgagtgccatg

SEQ ID NO: 373001 - DNA, 25 bp, Mus musculus
gtgccatgcatgttagcgctccatc

SEQ ID NO: 373002 - DNA, 25 bp, Mus musculus
catcactgagtgagcgccatgcatg

SEQ ID NO: 373003 - DNA, 25 bp, Mus musculus
atcaatgagcgccatgcatgtcagc

SEQ ID NO: 373004 - DNA, 25 bp, Mus musculus
catcagtgagtgagcgccatgcatg

SEQ ID NO: 373005 - DNA, 25 bp, Mus musculus
catgtcagcgctccatcactgagtg

SEQ ID NO: 373006 - DNA, 25 bp, Mus musculus
gccatgcatgtcagcgctccatcaa

SEQ ID NO: 373007 - DNA, 25 bp, Mus musculus
tcaatgagcgccatgcatgtcagcg

SEQ ID NO: 373008 - DNA, 25 bp, Mus musculus
atgtcagcgctccatcactgagtga

SEQ ID NO: 373009 - DNA, 25 bp, Mus musculus
tgcatgtcagcgctccatcactgag

SEQ ID NO: 373010 - DNA, 25 bp, Mus musculus
gcatgtcagcgctccatcactgagc

SEQ ID NO: 373011 - DNA, 25 bp, Mus musculus
catcactgagcgagcgccatgcatg

SEQ ID NO: 373012 - DNA, 25 bp, Mus musculus
cccagacgagcaggtgatgcattga

SEQ ID NO: 373013 - DNA, 25 bp, Mus musculus
acagcccagacgagcaggtgatgca

SEQ ID NO: 373014 - DNA, 25 bp, Mus musculus
ctgcccgcatgctaataggggtcgg

SEQ ID NO: 373015 - DNA, 25 bp, Mus musculus
cgctgcccgcatgctaataggggtc

SEQ ID NO: 373016 - DNA, 25 bp, Mus musculus
ccgcgctgcccgcatgctaataggg

SEQ ID NO: 373017 - DNA, 25 bp, Mus musculus
gcgacagcccagacgagcaggtgat

SEQ ID NO: 373018 - DNA, 25 bp, Mus musculus
gcgctgtgatcccactgcgccgccc

SEQ ID NO: 373019 - DNA, 25 bp, Mus musculus
aagcgcccagcgctgtgatcccact

SEQ ID NO: 373020 - DNA, 25 bp, Mus musculus
gagcgcggcccacaaagcgcccagc

SEQ ID NO: 373021 - DNA, 25 bp, Mus musculus
gcattgacagcgagcagatggtccc

SEQ ID NO: 373022 - DNA, 25 bp, Mus musculus
gtgatgcattgacagcgagcagatg

SEQ ID NO: 373023 - DNA, 25 bp, Mus musculus
agcaggtgatgcattgacagcgagc

SEQ ID NO: 373024 - DNA, 25 bp, Mus musculus
cagacgagcaggtgatgcattgaca

SEQ ID NO: 373025 - DNA, 25 bp, Mus musculus
gttgcccgggcgacagcccagacga

SEQ ID NO: 373026 - DNA, 25 bp, Mus musculus
aggtttgcacagtcggcgtctcagt

SEQ ID NO: 373027 - DNA, 25 bp, Mus musculus
gacgctcacgcaggcacagattcta

SEQ ID NO: 373028 - DNA, 25 bp, Mus musculus
cccatttccgcgtttgtcaggtttg

SEQ ID NO: 373029 - DNA, 25 bp, Mus musculus
tggagtccagtcacttgtccctcgg

SEQ ID NO: 373030 - DNA, 25 bp, Mus musculus
cgacgatgtccctcagcgacctaga

SEQ ID NO: 373031 - DNA, 25 bp, Mus musculus
cgctggcgtcacttagcaacggctc

SEQ ID NO: 373032 - DNA, 25 bp, Mus musculus
gcaacggctcaaccgtgggccagta

SEQ ID NO: 373033 - DNA, 25 bp, Mus musculus
tgaggcacgtcatcacacgtcactg

SEQ ID NO: 373034 - DNA, 25 bp, Mus musculus
cgtcactgaatagcgtcatcggtcg

SEQ ID NO: 373035 - DNA, 25 bp, Mus musculus
tcatcggtcgcgtcactgcgtaagg

SEQ ID NO: 373036 - DNA, 25 bp, Mus musculus
aagcctcgtctttctgcacttagtc

SEQ ID NO: 373037 - DNA, 25 bp, Mus musculus
ttagtcgcttgcctgatggacagtc

SEQ ID NO: 373038 - DNA, 25 bp, Mus musculus
agctgacggatctcttcgcggttta

SEQ ID NO: 373039 - DNA, 25 bp, Mus musculus
cccagacccgccagggtagagctga

SEQ ID NO: 373040 - DNA, 25 bp, Mus musculus
agcggtctcatcagtgaggccactg

SEQ ID NO: 373041 - DNA, 25 bp, Mus musculus
caggtcgctccagccgccgaaaagg

SEQ ID NO: 373042 - DNA, 25 bp, Mus musculus
gccagaccgggttaggattccgtca

SEQ ID NO: 373043 - DNA, 25 bp, Mus musculus
acccaccttggtgctagggtctgga

SEQ ID NO: 373044 - DNA, 25 bp, Mus musculus
gcagcagctgaaagcggtctcatca

SEQ ID NO: 373045 - DNA, 25 bp, Mus musculus
agccgccgaaaaggaggccctgtca

SEQ ID NO: 373046 - DNA, 25 bp, Mus musculus
gctgccctggagaatcaccaacctg

SEQ ID NO: 373047 - DNA, 25 bp, Mus musculus
ggagaatcaccaacctgccctagta

SEQ ID NO: 373048 - DNA, 25 bp, Mus musculus
tgccctagtagcaaacaggccagcg

SEQ ID NO: 373049 - DNA, 25 bp, Mus musculus
agcaaacaggccagcggaccacacg

SEQ ID NO: 373050 - DNA, 25 bp, Mus musculus
gtcagccggccgacatgcaagcagc

SEQ ID NO: 373051 - DNA, 25 bp, Mus musculus
taggattccgtcaggcagggccaga

SEQ ID NO: 373052 - DNA, 25 bp, Mus musculus
cgcctttgcagtcggctgagtgaca

SEQ ID NO: 373053 - DNA, 25 bp, Mus musculus
gtctggatcggagcagcagctgaaa

SEQ ID NO: 373054 - DNA, 25 bp, Mus musculus
ggcctcctgaaacccaggcggaaga

SEQ ID NO: 373055 - DNA, 25 bp, Mus musculus
cgctcctgcggctcttaaacctgag

SEQ ID NO: 373056 - DNA, 25 bp, Mus musculus
agagctagaagctccgctcctgcgg

SEQ ID NO: 373057 - DNA, 25 bp, Mus musculus
cacaggcgctcagagctagaagctc

SEQ ID NO: 373058 - DNA, 25 bp, Mus musculus
ggcgcaggcaccacaggcgctcaga

SEQ ID NO: 373059 - DNA, 25 bp, Mus musculus
tccactggtcgcagcgagctggcca

SEQ ID NO: 373060 - DNA, 25 bp, Mus musculus
cgggctccactggtcgcagcgagct

SEQ ID NO: 373061 - DNA, 25 bp, Mus musculus
tgttctgcgggcacaagagctagcg

SEQ ID NO: 373062 - DNA, 25 bp, Mus musculus
ttccgcaggtggcagctatgaccca

SEQ ID NO: 373063 - DNA, 25 bp, Mus musculus
ccgcggggagcacagcgccgaacat

SEQ ID NO: 373064 - DNA, 25 bp, Mus musculus
tggcagctatgacccagtcctgagc

SEQ ID NO: 373065 - DNA, 25 bp, Mus musculus
acgctgcggtgttctgcgggcacaa

SEQ ID NO: 373066 - DNA, 25 bp, Mus musculus
tcttaaacctgagtggagcccgcgg

SEQ ID NO: 373067 - DNA, 25 bp, Mus musculus
gagcacagcgccgaacatctcctgg

SEQ ID NO: 373068 - DNA, 25 bp, Mus musculus
ggcctggatgactaaacctgacaga

SEQ ID NO: 373069 - DNA, 25 bp, Mus musculus
ccatagcctggtccggtgtgtgcta

SEQ ID NO: 373070 - DNA, 25 bp, Mus musculus
gtcaacattaggagacgctagtccc

SEQ ID NO: 373071 - DNA, 25 bp, Mus musculus
agccacctgtcagtgtcacggcgga

SEQ ID NO: 373072 - DNA, 25 bp, Mus musculus
gtccgtgtgtggcaccacgtcacac

SEQ ID NO: 373073 - DNA, 25 bp, Mus musculus
tgccggaggcgaatcttacgggtta

SEQ ID NO: 373074 - DNA, 25 bp, Mus musculus
agtgcccgcgtaggtccttctcgac

SEQ ID NO: 373075 - DNA, 25 bp, Mus musculus
gttagctcgctgaagactgtatccc

SEQ ID NO: 373076 - DNA, 25 bp, Mus musculus
ggttaccagcgaagacagttgcagc

SEQ ID NO: 373077 - DNA, 25 bp, Mus musculus
ctagagcattaggtatgagtttcca

SEQ ID NO: 373078 - DNA, 25 bp, Mus musculus
tgagtttccaacctgccttagccaa

SEQ ID NO: 373079 - DNA, 25 bp, Mus musculus
gtgcctgccaggtacaatctctccg

SEQ ID NO: 373080 - DNA, 25 bp, Mus musculus
gccttagccaaggttagctcgctga

SEQ ID NO: 373081 - DNA, 25 bp, Mus musculus
acccgcccggtgaccatgataggta

SEQ ID NO: 373082 - DNA, 25 bp, Mus musculus
ggctggcttttatcttctaaggaaa

SEQ ID NO: 373083 - DNA, 25 bp, Mus musculus
ctgatggccgctttctcggtcggca

SEQ ID NO: 373084 - DNA, 25 bp, Mus musculus
agccgcctatgagcgcatcctccgg

SEQ ID NO: 373085 - DNA, 25 bp, Mus musculus
ccaggctggctggtcctcacaccag

SEQ ID NO: 373086 - DNA, 25 bp, Mus musculus
tctaaggaaacaggaagctcaaagc

SEQ ID NO: 373087 - DNA, 25 bp, Mus musculus
ggagcaagcgcagcctcgttcctgc

SEQ ID NO: 373088 - DNA, 25 bp, Mus musculus
gccatggtgagtcgcacatccttcg

SEQ ID NO: 373089 - DNA, 25 bp, Mus musculus
actccgggctggcttttatcttcta

SEQ ID NO: 373090 - DNA, 25 bp, Mus musculus
gagcaaaacaagagcacgcgcacct

SEQ ID NO: 373091 - DNA, 25 bp, Mus musculus
gccgcccgcagacttgtctccactg

SEQ ID NO: 373092 - DNA, 25 bp, Mus musculus
ggcatggtctgtctgatggccgctt

SEQ ID NO: 373093 - DNA, 25 bp, Mus musculus
ttctcggtcggcaccgccatggtga

SEQ ID NO: 373094 - DNA, 25 bp, Mus musculus
tcgcacatccttcgcactccgggct

SEQ ID NO: 373095 - DNA, 25 bp, Mus musculus
tccgcaacaggagcaaaacaagagc

SEQ ID NO: 373096 - DNA, 25 bp, Mus musculus
gagctgcgacgtactccagaagtcc

SEQ ID NO: 373097 - DNA, 25 bp, Mus musculus
tcccgcgtcgtcatggagacactgc

SEQ ID NO: 373098 - DNA, 25 bp, Mus musculus
tcctcagagcccaggtccgacatga

SEQ ID NO: 373099 - DNA, 25 bp, Mus musculus
tttcaagcgacttcctggactcagc

SEQ ID NO: 373100 - DNA, 25 bp, Mus musculus
tcacggcgtttcacctttcaagcga

SEQ ID NO: 373101 - DNA, 25 bp, Mus musculus
agaagtccctccctggtcaagagct

SEQ ID NO: 373102 - DNA, 25 bp, Mus musculus
tggaaactagacgtcacggcgtttc

SEQ ID NO: 373103 - DNA, 25 bp, Mus musculus
aggtccgacatgatctggtttcaga

SEQ ID NO: 373104 - DNA, 25 bp, Mus musculus
tggtttcagacaggatctcaggagc

SEQ ID NO: 373105 - DNA, 25 bp, Mus musculus
gtctctatcaagcagttaccagcca

SEQ ID NO: 373106 - DNA, 25 bp, Mus musculus
ttggctctccgcctgaaagagtggc

SEQ ID NO: 373107 - DNA, 25 bp, Mus musculus
aagagtggcggaaaacggctgcaaa

SEQ ID NO: 373108 - DNA, 25 bp, Mus musculus
ttcctggactcagcgccgccagtgt

SEQ ID NO: 373109 - DNA, 25 bp, Mus musculus
ggatctcaggagcaacgtctctatc

SEQ ID NO: 373110 - DNA, 25 bp, Mus musculus
accacccggccaagcggctgtagga

SEQ ID NO: 373111 - DNA, 25 bp, Mus musculus
ctccaggaagtcgacggcaggaagc

SEQ ID NO: 373112 - DNA, 25 bp, Mus musculus
accaagcgcttttcctagagtggga

SEQ ID NO: 373113 - DNA, 25 bp, Mus musculus
cctagagtgggacgtctttgaagta

SEQ ID NO: 373114 - DNA, 25 bp, Mus musculus
cgtctttgaagtaagggctcctaga

SEQ ID NO: 373115 - DNA, 25 bp, Mus musculus
ctagagtggccttgagagacagtgc

SEQ ID NO: 373116 - DNA, 25 bp, Mus musculus
cggtgctggtgacgttgaattcccg

SEQ ID NO: 373117 - DNA, 25 bp, Mus musculus
tggaagcaaaaggttccctgagacc

SEQ ID NO: 373118 - DNA, 25 bp, Mus musculus
tcgcctagctgtgatgctgggtccc

SEQ ID NO: 373119 - DNA, 25 bp, Mus musculus
tgacagctgtgagaagacgcctgcc

SEQ ID NO: 373120 - DNA, 25 bp, Mus musculus
ctgccggagacccagcgctttgtct

SEQ ID NO: 373121 - DNA, 25 bp, Mus musculus
agagccggggacaaaccaagcgctt

SEQ ID NO: 373122 - DNA, 25 bp, Mus musculus
tgggcgtgcctgtagccttcaccac

SEQ ID NO: 373123 - DNA, 25 bp, Mus musculus
agcgctttgtctgctgccgctcgta

SEQ ID NO: 373124 - DNA, 25 bp, Mus musculus
tcaagctgatcttggcggctcgccc

SEQ ID NO: 373125 - DNA, 25 bp, Mus musculus
ggctcctcaagctaccggcccaagg

SEQ ID NO: 373126 - DNA, 25 bp, Mus musculus
ggcccaaggccatctacctagacat

SEQ ID NO: 373127 - DNA, 25 bp, Mus musculus
tacctagacatcgatggacgcatcc

SEQ ID NO: 373128 - DNA, 25 bp, Mus musculus
tcgatggacgcatccagaaggtacc

SEQ ID NO: 373129 - DNA, 25 bp, Mus musculus
tcggagcccacggatcaagctgatc

SEQ ID NO: 373130 - DNA, 25 bp, Mus musculus
ttgactgtgccgtacgctgtcctcc

SEQ ID NO: 373131 - DNA, 25 bp, Mus musculus
gtacggcagcctgcggtgcagaccc

SEQ ID NO: 373132 - DNA, 25 bp, Mus musculus
gggatcctgcctctgcaccctgtgg

SEQ ID NO: 373133 - DNA, 25 bp, Mus musculus
tgaagggacccgcttttgactgtgc

SEQ ID NO: 373134 - DNA, 25 bp, Mus musculus
acccgcttttgactgtgccgtacgc

SEQ ID NO: 373135 - DNA, 25 bp, Mus musculus
tcccaaccaacttgagccacgtagg

SEQ ID NO: 373136 - DNA, 25 bp, Mus musculus
tgcgccctaataggcgcaggtgtcc

SEQ ID NO: 373137 - DNA, 25 bp, Mus musculus
acttgagccacgtaggagtgcggtt

SEQ ID NO: 373138 - DNA, 25 bp, Mus musculus
aatccgggaggacacagaacactgc

SEQ ID NO: 373139 - DNA, 25 bp, Mus musculus
acccacgtgacttagccctcccagc

SEQ ID NO: 373140 - DNA, 25 bp, Mus musculus
ggcgcctcagagtccggaagtaccc

SEQ ID NO: 373141 - DNA, 25 bp, Mus musculus
aggacacagaacactgccgcgccgg

SEQ ID NO: 373142 - DNA, 25 bp, Mus musculus
gggcctcttacctgcccgtagtgga

SEQ ID NO: 373143 - DNA, 25 bp, Mus musculus
tacctgcccgtagtggagaaggcta

SEQ ID NO: 373144 - DNA, 25 bp, Mus musculus
accaccagcgtctgggcgcacagtg

SEQ ID NO: 373145 - DNA, 25 bp, Mus musculus
agcgtctgggcgcacagtgccagcc

SEQ ID NO: 373146 - DNA, 25 bp, Mus musculus
gcccttcctgttggcgcttgtcagt

SEQ ID NO: 373147 - DNA, 25 bp, Mus musculus
ttggcgcttgtcagtgatgtcactc

SEQ ID NO: 373148 - DNA, 25 bp, Mus musculus
tgtcagtgatgtcactcggcgccgc

SEQ ID NO: 373149 - DNA, 25 bp, Mus musculus
aacggcgtgccgtccaggagcatgc

SEQ ID NO: 373150 - DNA, 25 bp, Mus musculus
cgcagggcgtagtctcatttgattt

SEQ ID NO: 373151 - DNA, 25 bp, Mus musculus
tagtctcatttgatttcggtgcccg

SEQ ID NO: 373152 - DNA, 25 bp, Mus musculus
gcgggactttcagcgggatctaccc

SEQ ID NO: 373153 - DNA, 25 bp, Mus musculus
atggcggtctctctcctcctgcggg

SEQ ID NO: 373154 - DNA, 25 bp, Mus musculus
ggcatttgtgccatggcggtctctc

SEQ ID NO: 373155 - DNA, 25 bp, Mus musculus
cgacctccgctcttggcatttgtgc

SEQ ID NO: 373156 - DNA, 25 bp, Mus musculus
gtcacgtacctaagtgcgacctccg

SEQ ID NO: 373157 - DNA, 25 bp, Mus musculus
tgcgtgtgcacaagtaggtcacgta

SEQ ID NO: 373158 - DNA, 25 bp, Mus musculus
ccaccatggtgtgcgattggtgaac

SEQ ID NO: 373159 - DNA, 25 bp, Mus musculus
cgcgcaaacgcttgggtccaccatg

SEQ ID NO: 373160 - DNA, 25 bp, Mus musculus
aaggagccctcccagaatgcgcgcg

SEQ ID NO: 373161 - DNA, 25 bp, Mus musculus
cgtggccttaaggagccctcccaga

SEQ ID NO: 373162 - DNA, 25 bp, Mus musculus
cccggaattggtggactcagttagg

SEQ ID NO: 373163 - DNA, 25 bp, Mus musculus
ccgaacccggaattggtggactcag

SEQ ID NO: 373164 - DNA, 25 bp, Mus musculus
ctttcagcgggatctacccagggga

SEQ ID NO: 373165 - DNA, 25 bp, Mus musculus
ttaactgcacccgtgggcccggtgc

SEQ ID NO: 373166 - DNA, 25 bp, Mus musculus
ttgaccaacttgacccggttgcgct

SEQ ID NO: 373167 - DNA, 25 bp, Mus musculus
gcttgacctgcttggccgctgactt

SEQ ID NO: 373168 - DNA, 25 bp, Mus musculus
gcgtttgcagcgcatcagttccgga

SEQ ID NO: 373169 - DNA, 25 bp, Mus musculus
aagtcagtgccgagcgcactctgcc

SEQ ID NO: 373170 - DNA, 25 bp, Mus musculus
acgcagggtgcgcagagcccttgaa

SEQ ID NO: 373171 - DNA, 25 bp, Mus musculus
gtgcctgggcgatcgtcttccctct

SEQ ID NO: 373172 - DNA, 25 bp, Mus musculus
ggaaagcagccgcaaaagtcagtgc

SEQ ID NO: 373173 - DNA, 25 bp, Mus musculus
gcactctgccaggtggagctgctcc

SEQ ID NO: 373174 - DNA, 25 bp, Mus musculus
cttgagcctgcttctgggattattt

SEQ ID NO: 373175 - DNA, 25 bp, Mus musculus
tctttctaattgctctctcgttccc

SEQ ID NO: 373176 - DNA, 25 bp, Mus musculus
ttccacgttccctggccagaagtga

SEQ ID NO: 373177 - DNA, 25 bp, Mus musculus
tcttgccagagctctccatgccggg

SEQ ID NO: 373178 - DNA, 25 bp, Mus musculus
ccgcggtcgcaaagaagcaggctgc

SEQ ID NO: 373179 - DNA, 25 bp, Mus musculus
tagccgaagccgctgaagttgagcc

SEQ ID NO: 373180 - DNA, 25 bp, Mus musculus
tccacggcccgtcggggagagcttc

SEQ ID NO: 373181 - DNA, 25 bp, Mus musculus
ctaggagcaccgagcccggcgacgt

SEQ ID NO: 373182 - DNA, 25 bp, Mus musculus
gcgcgcccggcttgttttcctgtgt

SEQ ID NO: 373183 - DNA, 25 bp, Mus musculus
cggcttgttttcctgtgtgggttca

SEQ ID NO: 373184 - DNA, 25 bp, Mus musculus
ttcaggggcgcggaaatttctcgaa

SEQ ID NO: 373185 - DNA, 25 bp, Mus musculus
gaaatttctcgaaggcggcagggcc

SEQ ID NO: 373186 - DNA, 25 bp, Mus musculus
gcgcctaaccgtcgctcacggagtg

SEQ ID NO: 373187 - DNA, 25 bp, Mus musculus
aaccgtcgctcacggagtgcagctc

SEQ ID NO: 373188 - DNA, 25 bp, Mus musculus
ctcacggagtgcagctcgcggctgc

SEQ ID NO: 373189 - DNA, 25 bp, Mus musculus
gtgacagcgtgtcgcgcgtgtccac

SEQ ID NO: 373190 - DNA, 25 bp, Mus musculus
agagcttctcgaggagcgcttggtc

SEQ ID NO: 373191 - DNA, 25 bp, Mus musculus
tgcctgctccgtgtgtatctgagaa

SEQ ID NO: 373192 - DNA, 25 bp, Mus musculus
tccgtgtgtatctgagaagggaagc

SEQ ID NO: 373193 - DNA, 25 bp, Mus musculus
gcttggtccgctgtgcctgctccgt

SEQ ID NO: 373194 - DNA, 25 bp, Mus musculus
gttttgtctctagcgcgtcacccta

SEQ ID NO: 373195 - DNA, 25 bp, Mus musculus
gctaccgaaccgcagcgaggatctc

SEQ ID NO: 373196 - DNA, 25 bp, Mus musculus
agttctgccgtctaacacgtgtttg

SEQ ID NO: 373197 - DNA, 25 bp, Mus musculus
ctctgggagttgtgctcaaaagctc

SEQ ID NO: 373198 - DNA, 25 bp, Mus musculus
agcggtctccatccaaaactgggga

SEQ ID NO: 373199 - DNA, 25 bp, Mus musculus
ctcggacaggatcccagctcagatc

SEQ ID NO: 373200 - DNA, 25 bp, Mus musculus
tccaggtacagaggaagccaagtcc

SEQ ID NO: 373201 - DNA, 25 bp, Mus musculus
aacccggctccacgttcagagacta

SEQ ID NO: 373202 - DNA, 25 bp, Mus musculus
gggaaatcgatgacccagttttgtc

SEQ ID NO: 373203 - DNA, 25 bp, Mus musculus
acaatttgcgaaacagcggtctcca

SEQ ID NO: 373204 - DNA, 25 bp, Mus musculus
tcccgcacaaggaggagaacccgct

SEQ ID NO: 373205 - DNA, 25 bp, Mus musculus
tccgcaggtgtacagccctaggtct

SEQ ID NO: 373206 - DNA, 25 bp, Mus musculus
gcagtgacgtgggaaactctccgca

SEQ ID NO: 373207 - DNA, 25 bp, Mus musculus
cacacaacaggcttcggcgattggc

SEQ ID NO: 373208 - DNA, 25 bp, Mus musculus
caggcaggaggtttattcggtcgaa

SEQ ID NO: 373209 - DNA, 25 bp, Mus musculus
cgaagagcatgaggaggctccgccc

SEQ ID NO: 373210 - DNA, 25 bp, Mus musculus
gcacacgaccacaggcgggaatatt

SEQ ID NO: 373211 - DNA, 25 bp, Mus musculus
ggtcccgcgcattgcttgcggctta

SEQ ID NO: 373212 - DNA, 25 bp, Mus musculus
tccaattgggaaaggtgctgccagc

SEQ ID NO: 373213 - DNA, 25 bp, Mus musculus
ccgtcgtagcgactctgtccaattg

SEQ ID NO: 373214 - DNA, 25 bp, Mus musculus
cattttcgagcggacgactcaggca

SEQ ID NO: 373215 - DNA, 25 bp, Mus musculus
aagaaacgtgttacttcgccacaga

SEQ ID NO: 373216 - DNA, 25 bp, Mus musculus
gggccacagcacttccgacacgata

SEQ ID NO: 373217 - DNA, 25 bp, Mus musculus
tccgccaacgcttaggcaggcagga

SEQ ID NO: 373218 - DNA, 25 bp, Mus musculus
gttggctacggaaatgcaaacctta

SEQ ID NO: 373219 - DNA, 25 bp, Mus musculus
ttcctcttaccctaacagttggcta

SEQ ID NO: 373220 - DNA, 25 bp, Mus musculus
acacgcggaaatgagtatgtgcctc

SEQ ID NO: 373221 - DNA, 25 bp, Mus musculus
ttccgacacgataactcaaagccta

SEQ ID NO: 373222 - DNA, 25 bp, Mus musculus
agcacctgttcgttgtagtcgccca

SEQ ID NO: 373223 - DNA, 25 bp, Mus musculus
aaggcagggtcatcctgctgcagga

SEQ ID NO: 373224 - DNA, 25 bp, Mus musculus
tcgcccaggttggaggtgtagcctt

SEQ ID NO: 373225 - DNA, 25 bp, Mus musculus
cacgaccagcatgcgtctgatcagc

SEQ ID NO: 373226 - DNA, 25 bp, Mus musculus
gggtccacgaccagcatgcgtctga

SEQ ID NO: 373227 - DNA, 25 bp, Mus musculus
cgcttagcggggtccacgaccagca

SEQ ID NO: 373228 - DNA, 25 bp, Mus musculus
tctgggctatggtgatgcgcttagc

SEQ ID NO: 373229 - DNA, 25 bp, Mus musculus
gggtcggcctgcatccaccggtgct

SEQ ID NO: 373230 - DNA, 25 bp, Mus musculus
gcatgtcgaaggcagggtcatcctg

SEQ ID NO: 373231 - DNA, 25 bp, Mus musculus
tggaggtgtagccttgcatgtcgaa

SEQ ID NO: 373232 - DNA, 25 bp, Mus musculus
ctgttcgttgtagtcgcccaggttg

SEQ ID NO: 373233 - DNA, 25 bp, Mus musculus
gcatgatccctagcacctgttcgtt

SEQ ID NO: 373234 - DNA, 25 bp, Mus musculus
atgccgagggcctgcatgatcccta

SEQ ID NO: 373235 - DNA, 25 bp, Mus musculus
ctgcatccaccggtgctggcggatc

SEQ ID NO: 373236 - DNA, 25 bp, Mus musculus
gcagttctaaccagatcagttcgtt

SEQ ID NO: 373237 - DNA, 25 bp, Mus musculus
ggttgaaccagaaagcagccgtgtt

SEQ ID NO: 373238 - DNA, 25 bp, Mus musculus
gaaagcagccgtgttttcttgtccc

SEQ ID NO: 373239 - DNA, 25 bp, Mus musculus
ccctgtccttcttcttcgagactga

SEQ ID NO: 373240 - DNA, 25 bp, Mus musculus
ccttcttcttcgagactgaggtaag

SEQ ID NO: 373241 - DNA, 25 bp, Mus musculus
actgaggtaagctttagcaaaaggc

SEQ ID NO: 373242 - DNA, 25 bp, Mus musculus
gctttagcaaaaggcgcagtgtttc

SEQ ID NO: 373243 - DNA, 25 bp, Mus musculus
ggcgcagtgtttcaaagaactttaa

SEQ ID NO: 373244 - DNA, 25 bp, Mus musculus
caaagaactttaagcgatctgcggg

SEQ ID NO: 373245 - DNA, 25 bp, Mus musculus
tccgggaagtctgccgtgcagttct

SEQ ID NO: 373246 - DNA, 25 bp, Mus musculus
ccgtgcagttctggctatcggcatg

SEQ ID NO: 373247 - DNA, 25 bp, Mus musculus
caggcctgcagttctaaccagatca

SEQ ID NO: 373248 - DNA, 25 bp, Mus musculus
tggctatcggcatgggcatcgagac

SEQ ID NO: 373249 - DNA, 25 bp, Mus musculus
tcagttcgttcgatcggttgaacca

SEQ ID NO: 373250 - DNA, 25 bp, Mus musculus
gtcagcgaggagtgcgctcagcacc

SEQ ID NO: 373251 - DNA, 25 bp, Mus musculus
gcacagcccattgacgtcgttttga

SEQ ID NO: 373252 - DNA, 25 bp, Mus musculus
gctcggctgctagctctgctccggt

SEQ ID NO: 373253 - DNA, 25 bp, Mus musculus
gcacctgcgggtttcggagacccga

SEQ ID NO: 373254 - DNA, 25 bp, Mus musculus
ggcgccgacccgcaacaatagggag

SEQ ID NO: 373255 - DNA, 25 bp, Mus musculus
agtgccaacgctcggctcctcagga

SEQ ID NO: 373256 - DNA, 25 bp, Mus musculus
tcgatcccaggttccctcagtgcga

SEQ ID NO: 373257 - DNA, 25 bp, Mus musculus
atacagtatctcctcggctaaagtc

SEQ ID NO: 373258 - DNA, 25 bp, Mus musculus
ctcgctcattccttgatacagtatc

SEQ ID NO: 373259 - DNA, 25 bp, Mus musculus
cactgaaactgtgtccgccaggcca

SEQ ID NO: 373260 - DNA, 25 bp, Mus musculus
gggaccgcactgaactccgacatga

SEQ ID NO: 373261 - DNA, 25 bp, Mus musculus
gccaaacccggccactgaaactgtg

SEQ ID NO: 373262 - DNA, 25 bp, Mus musculus
tcgttttgacgccagagcgacgcgc

SEQ ID NO: 373263 - DNA, 25 bp, Mus musculus
cgacatgatcaccatggcttcgggc

SEQ ID NO: 373264 - DNA, 25 bp, Mus musculus
cgccatgcagtcttccgagttccag

SEQ ID NO: 373265 - DNA, 25 bp, Mus musculus
aagctgcggcagtatctcagcgcca

SEQ ID NO: 373266 - DNA, 25 bp, Mus musculus
cgcacttcaagcagcgttgctacgg

SEQ ID NO: 373267 - DNA, 25 bp, Mus musculus
aagcagcgttgctacggcgtctacc

SEQ ID NO: 373268 - DNA, 25 bp, Mus musculus
ttgctacggcgtctacccgcacagg

SEQ ID NO: 373269 - DNA, 25 bp, Mus musculus
agcccatacgcagacgcagtccgga

SEQ ID NO: 373270 - DNA, 25 bp, Mus musculus
tacgcagacgcagtccggatcgctt

SEQ ID NO: 373271 - DNA, 25 bp, Mus musculus
atgctgaagcgagtgcgatggctct

SEQ ID NO: 373272 - DNA, 25 bp, Mus musculus
cgagtgcgatggctctcgccatgca

SEQ ID NO: 373273 - DNA, 25 bp, Mus musculus
ccagcggctggcctccagtgagaag

SEQ ID NO: 373274 - DNA, 25 bp, Mus musculus
ctccagtgagaagggcgtccgcgac

SEQ ID NO: 373275 - DNA, 25 bp, Mus musculus
ggcagtatctcagcgccaggacgca

SEQ ID NO: 373276 - DNA, 25 bp, Mus musculus
ccaggacgcagagcgacacaggtgc

SEQ ID NO: 373277 - DNA, 25 bp, Mus musculus
ttccgagttccagttcgcccagcgg

SEQ ID NO: 373278 - DNA, 25 bp, Mus musculus
ccagttgctgttacgggctgtccag

SEQ ID NO: 373279 - DNA, 25 bp, Mus musculus
tgcgaactcggagtcccgagtcccg

SEQ ID NO: 373280 - DNA, 25 bp, Mus musculus
gcgcgcccagctctcgataagaact

SEQ ID NO: 373281 - DNA, 25 bp, Mus musculus
cgagtcccgctctgcaaggtgcgag

SEQ ID NO: 373282 - DNA, 25 bp, Mus musculus
ctgggctatataagtggcggagcat

SEQ ID NO: 373283 - DNA, 25 bp, Mus musculus
ataagtggcggagcatgtacctgca

SEQ ID NO: 373284 - DNA, 25 bp, Mus musculus
ttgctggaggcccagttgctgttac

SEQ ID NO: 373285 - DNA, 25 bp, Mus musculus
ccgcaaggggacgaaggtcatcagt

SEQ ID NO: 373286 - DNA, 25 bp, Mus musculus
gcgaaccgatcgtcctgcacactag

SEQ ID NO: 373287 - DNA, 25 bp, Mus musculus
tacgggctgtccaggccacaggctc

SEQ ID NO: 373288 - DNA, 25 bp, Mus musculus
ataagaactccagggtggccgcaag

SEQ ID NO: 373289 - DNA, 25 bp, Mus musculus
atgcttggacctctgcgaactcgga

SEQ ID NO: 373290 - DNA, 25 bp, Mus musculus
ctctcgataagaactccagggtggc

SEQ ID NO: 373291 - DNA, 25 bp, Mus musculus
aaggtcatcagtccgggaggccacg

SEQ ID NO: 373292 - DNA, 25 bp, Mus musculus
gcgcctgcgtgaggcagcaccttca

SEQ ID NO: 373293 - DNA, 25 bp, Mus musculus
gcgtgaggcagcaccttcaaccctg

SEQ ID NO: 373294 - DNA, 25 bp, Mus musculus
gcgcgtgcttaaagctctggagcag

SEQ ID NO: 373295 - DNA, 25 bp, Mus musculus
tccatccagagagagctacgttgtc

SEQ ID NO: 373296 - DNA, 25 bp, Mus musculus
agagctacgttgtccgcggctacgt

SEQ ID NO: 373297 - DNA, 25 bp, Mus musculus
cccatcgagcgctgggtgctctgag

SEQ ID NO: 373298 - DNA, 25 bp, Mus musculus
ccgggttgctcgcttgcaggtctgc

SEQ ID NO: 373299 - DNA, 25 bp, Mus musculus
ggacaacagagcgaccatgttccct

SEQ ID NO: 373300 - DNA, 25 bp, Mus musculus
ctgaggacagatacgggcgcacgca

SEQ ID NO: 373301 - DNA, 25 bp, Mus musculus
cgctgggtgctctgaggacagatac

SEQ ID NO: 373302 - DNA, 25 bp, Mus musculus
ctacgtggacaacagagcgaccatg

SEQ ID NO: 373303 - DNA, 25 bp, Mus musculus
aaccgagccgggttgctcgcttgca

SEQ ID NO: 373304 - DNA, 25 bp, Mus musculus
gcgggtttgctgagtggccttttcc

SEQ ID NO: 373305 - DNA, 25 bp, Mus musculus
ttatgtaaccgagccgggttgctcg

SEQ ID NO: 373306 - DNA, 25 bp, Mus musculus
ccatgcagacaaggggcagaggcgc

SEQ ID NO: 373307 - DNA, 25 bp, Mus musculus
gaggacaagcgcagcgtggtccacg

SEQ ID NO: 373308 - DNA, 25 bp, Mus musculus
cggacagccccggaggacaagcgca

SEQ ID NO: 373309 - DNA, 25 bp, Mus musculus
tgacgccctagaaacccggcaggag

SEQ ID NO: 373310 - DNA, 25 bp, Mus musculus
tagctcctgagggtgacgccctaga

SEQ ID NO: 373311 - DNA, 25 bp, Mus musculus
cgcagctggcgttagtagctcctga

SEQ ID NO: 373312 - DNA, 25 bp, Mus musculus
actctgtacaggtaggcatgagccc

SEQ ID NO: 373313 - DNA, 25 bp, Mus musculus
ggacactctgtacaggtaggcatga

SEQ ID NO: 373314 - DNA, 25 bp, Mus musculus
gcggaagaaagggacactctgtaca

SEQ ID NO: 373315 - DNA, 25 bp, Mus musculus
cacacagcggaagaaagggacactc

SEQ ID NO: 373316 - DNA, 25 bp, Mus musculus
agcgcacacacagcggaagaaaggg

SEQ ID NO: 373317 - DNA, 25 bp, Mus musculus
gctgcggaaggggtctcacaacgcg

SEQ ID NO: 373318 - DNA, 25 bp, Mus musculus
ctcgcttggcctggcaagccgctcg

SEQ ID NO: 373319 - DNA, 25 bp, Mus musculus
ttagtagctcctgagggtgacgccc

SEQ ID NO: 373320 - DNA, 25 bp, Mus musculus
agagctcttccttgtgacctcgcga

SEQ ID NO: 373321 - DNA, 25 bp, Mus musculus
aatgcccactggaactgcgacccgg

SEQ ID NO: 373322 - DNA, 25 bp, Mus musculus
actgcgcagacaacgccactggctg

SEQ ID NO: 373323 - DNA, 25 bp, Mus musculus
cttgccgaagccctagcgtcttttt

SEQ ID NO: 373324 - DNA, 25 bp, Mus musculus
acgtcgctgtcaccgagatgcgttc

SEQ ID NO: 373325 - DNA, 25 bp, Mus musculus
agcagcagcccgaatgcccactgga

SEQ ID NO: 373326 - DNA, 25 bp, Mus musculus
cagaggtttgaatcgcctcggcgtc

SEQ ID NO: 373327 - DNA, 25 bp, Mus musculus
gcggcacgacctgggaaccaatcgc

SEQ ID NO: 373328 - DNA, 25 bp, Mus musculus
ggccacctatggtcgggagagcctt

SEQ ID NO: 373329 - DNA, 25 bp, Mus musculus
ccctgctttaggtgcgtatcgagtg

SEQ ID NO: 373330 - DNA, 25 bp, Mus musculus
gggcgcttccctgttctccagagct

SEQ ID NO: 373331 - DNA, 25 bp, Mus musculus
ggcacagaagagaccagacccacct

SEQ ID NO: 373332 - DNA, 25 bp, Mus musculus
gggatcgccagcttgtgctgcttcc

SEQ ID NO: 373333 - DNA, 25 bp, Mus musculus
gtccctttcaaatctcgcggcacga

SEQ ID NO: 373334 - DNA, 25 bp, Mus musculus
cgccttatctttaagggagacctag

SEQ ID NO: 373335 - DNA, 25 bp, Mus musculus
tatctttaagggagacctagcggac

SEQ ID NO: 373336 - DNA, 25 bp, Mus musculus
ctcgccgccttatctttaagggaga

SEQ ID NO: 373337 - DNA, 25 bp, Mus musculus
cgcctcgccgccttatctttaaggg

SEQ ID NO: 373338 - DNA, 25 bp, Mus musculus
cgggcgggttcccacgctctgcacc

SEQ ID NO: 373339 - DNA, 25 bp, Mus musculus
atcatcgccaagctgggcgcggcac

SEQ ID NO: 373340 - DNA, 25 bp, Mus musculus
tatcatcgccaagctgggcgcggca

SEQ ID NO: 373341 - DNA, 25 bp, Mus musculus
gaccacgggtatcatcgccaagctg

SEQ ID NO: 373342 - DNA, 25 bp, Mus musculus
gggaccacgggtatcatcgccaagc

SEQ ID NO: 373343 - DNA, 25 bp, Mus musculus
tggggaccacgggtatcatcgccaa

SEQ ID NO: 373344 - DNA, 25 bp, Mus musculus
agcactggggaccacgggtatcatc

SEQ ID NO: 373345 - DNA, 25 bp, Mus musculus
cagagcactggggaccacgggtatc

SEQ ID NO: 373346 - DNA, 25 bp, Mus musculus
cacgggtatcatcgccaagctgggc

SEQ ID NO: 373347 - DNA, 25 bp, Mus musculus
cggcgacgatgacacccagggaagg

SEQ ID NO: 373348 - DNA, 25 bp, Mus musculus
tgtctggcaaagaaagcgtgaggcc

SEQ ID NO: 373349 - DNA, 25 bp, Mus musculus
ctggcccttcgtgggtcccgctttg

SEQ ID NO: 373350 - DNA, 25 bp, Mus musculus
cagctctccaacatgagacgttttc

SEQ ID NO: 373351 - DNA, 25 bp, Mus musculus
tcttgcagctctccaacatgagacg

SEQ ID NO: 373352 - DNA, 25 bp, Mus musculus
gcgggcttcgcaagggctccagctc

SEQ ID NO: 373353 - DNA, 25 bp, Mus musculus
atcccggcggcctgaagagggatcg

SEQ ID NO: 373354 - DNA, 25 bp, Mus musculus
cacagagacggggtcccgagactac

SEQ ID NO: 373355 - DNA, 25 bp, Mus musculus
ggagatgagcacgtggacctcgccc

SEQ ID NO: 373356 - DNA, 25 bp, Mus musculus
tgtctagacggcgaagccattgtcc

SEQ ID NO: 373357 - DNA, 25 bp, Mus musculus
tgggtcccgctttgtctggcaaaga

SEQ ID NO: 373358 - DNA, 25 bp, Mus musculus
acatgagacgttttctccgagttca

SEQ ID NO: 373359 - DNA, 25 bp, Mus musculus
ttctcctcccggcacagagacgggg

SEQ ID NO: 373360 - DNA, 25 bp, Mus musculus
acggcgaagccattgtcccgagcgg

SEQ ID NO: 373361 - DNA, 25 bp, Mus musculus
aagctggagatgagcacgtggacct

SEQ ID NO: 373362 - DNA, 25 bp, Mus musculus
aagtacaccaggctcatcaccagcg

SEQ ID NO: 373363 - DNA, 25 bp, Mus musculus
ctggaccggtcgaggaaacagatgc

SEQ ID NO: 373364 - DNA, 25 bp, Mus musculus
cacatcacatgggtgagcgcgatgc

SEQ ID NO: 373365 - DNA, 25 bp, Mus musculus
tgagcgcgatgcagctgtagacaaa

SEQ ID NO: 373366 - DNA, 25 bp, Mus musculus
cagctgtagacaaacgcggccacca

SEQ ID NO: 373367 - DNA, 25 bp, Mus musculus
aaggcagccaagtacaccaggctca

SEQ ID NO: 373368 - DNA, 25 bp, Mus musculus
tccggcatatccttgcgctctggga

SEQ ID NO: 373369 - DNA, 25 bp, Mus musculus
gagtccactggaccggtcgaggaaa

SEQ ID NO: 373370 - DNA, 25 bp, Mus musculus
tccaccgtgctatcggagtccactg

SEQ ID NO: 373371 - DNA, 25 bp, Mus musculus
tctgggacgactacagagccgccgt

SEQ ID NO: 373372 - DNA, 25 bp, Mus musculus
gtgcgagtagcgctgtcaccacaaa

SEQ ID NO: 373373 - DNA, 25 bp, Mus musculus
tgcgaggacggcacatcacatgggt

SEQ ID NO: 373374 - DNA, 25 bp, Mus musculus
gctgtcaccacaaactccggcatat

SEQ ID NO: 373375 - DNA, 25 bp, Mus musculus
tgttttgggattccaccgtgctatc

SEQ ID NO: 373376 - DNA, 25 bp, Mus musculus
acgtctctttctgggcgctaccatt

SEQ ID NO: 373377 - DNA, 25 bp, Mus musculus
tgtgcctcaagggtaagctagtgcg

SEQ ID NO: 373378 - DNA, 25 bp, Mus musculus
attggttgctcaaatgggcccgccc

SEQ ID NO: 373379 - DNA, 25 bp, Mus musculus
caacgtgctgtctgctactggaaga

SEQ ID NO: 373380 - DNA, 25 bp, Mus musculus
gtcttagattcgctcagaacgcatg

SEQ ID NO: 373381 - DNA, 25 bp, Mus musculus
cccgccagcagatccttgtcttaga

SEQ ID NO: 373382 - DNA, 25 bp, Mus musculus
gtagccttgctccatgtctgcgacg

SEQ ID NO: 373383 - DNA, 25 bp, Mus musculus
tccggctgcaggctaagcccgaata

SEQ ID NO: 373384 - DNA, 25 bp, Mus musculus
ggaacgattgcgcagaggcccaata

SEQ ID NO: 373385 - DNA, 25 bp, Mus musculus
tgcacagtgaaagcggtccagaacg

SEQ ID NO: 373386 - DNA, 25 bp, Mus musculus
cttcagaaaagcgagcccggggaca

SEQ ID NO: 373387 - DNA, 25 bp, Mus musculus
cgcgctgcccgtaagccttcagaaa

SEQ ID NO: 373388 - DNA, 25 bp, Mus musculus
gtctcccgtggtgaagaagagccca

SEQ ID NO: 373389 - DNA, 25 bp, Mus musculus
cagccttccgggttgcaaatctaca

SEQ ID NO: 373390 - DNA, 25 bp, Mus musculus
cagcgtgagcagagacgaccgtctt

SEQ ID NO: 373391 - DNA, 25 bp, Mus musculus
gccgtggacacagaccgctactctg

SEQ ID NO: 373392 - DNA, 25 bp, Mus musculus
gtctgacgccacaacaatccctggg

SEQ ID NO: 373393 - DNA, 25 bp, Mus musculus
cgcctccttatctcattggcttctg

SEQ ID NO: 373394 - DNA, 25 bp, Mus musculus
ttggcttctgcaaacctcggacttc

SEQ ID NO: 373395 - DNA, 25 bp, Mus musculus
cctcggacttcacgcctattggttt

SEQ ID NO: 373396 - DNA, 25 bp, Mus musculus
gcctattggtttcgctacctgtcta

SEQ ID NO: 373397 - DNA, 25 bp, Mus musculus
cggagctgcatgcaacctagaggtc

SEQ ID NO: 373398 - DNA, 25 bp, Mus musculus
ccgcagagaacacccgagccgtgga

SEQ ID NO: 373399 - DNA, 25 bp, Mus musculus
cctgcgccaataggccaaggggaga

SEQ ID NO: 373400 - DNA, 25 bp, Mus musculus
acctcttcgtgacagtggttggaga

SEQ ID NO: 373401 - DNA, 25 bp, Mus musculus
cttcaccctgttgggcctacctgtg

SEQ ID NO: 373402 - DNA, 25 bp, Mus musculus
cctacctgtgtagctcatggccgca

SEQ ID NO: 373403 - DNA, 25 bp, Mus musculus
agcgagacacttgccagcgtgagca

SEQ ID NO: 373404 - DNA, 25 bp, Mus musculus
actccgaagtgaggtcttgccctgc

SEQ ID NO: 373405 - DNA, 25 bp, Mus musculus
tgcggagctagagaagccttgacct

SEQ ID NO: 373406 - DNA, 25 bp, Mus musculus
cccggctcagcgagtggagaacaaa

SEQ ID NO: 373407 - DNA, 25 bp, Mus musculus
gaaaacttcgcggagtgtgccctga

SEQ ID NO: 373408 - DNA, 25 bp, Mus musculus
gctcgaccggtcctctgtgttgaaa

SEQ ID NO: 373409 - DNA, 25 bp, Mus musculus
ctgtgttgaaacttggaccgaggta

SEQ ID NO: 373410 - DNA, 25 bp, Mus musculus
gcctcacttcggcagtgcggagcta

SEQ ID NO: 373411 - DNA, 25 bp, Mus musculus
cttggctcaaggcaggatccttttc

SEQ ID NO: 373412 - DNA, 25 bp, Mus musculus
tggcgcgggtacaattaggttcagc

SEQ ID NO: 373413 - DNA, 25 bp, Mus musculus
ttcagctgtgccatccaggttgcga

SEQ ID NO: 373414 - DNA, 25 bp, Mus musculus
cgcagcagggagaatgtgagcatcc

SEQ ID NO: 373415 - DNA, 25 bp, Mus musculus
tgtgagcatccctggcttggccatt

SEQ ID NO: 373416 - DNA, 25 bp, Mus musculus
cagcggtttcgcattctctcttgtc

SEQ ID NO: 373417 - DNA, 25 bp, Mus musculus
cagtgcccatttccttgcgtccagg

SEQ ID NO: 373418 - DNA, 25 bp, Mus musculus
agccgtgcactcacctcgccgctgg

SEQ ID NO: 373419 - DNA, 25 bp, Mus musculus
cggggagcactactgcaaaggccag

SEQ ID NO: 373420 - DNA, 25 bp, Mus musculus
cactactgcaaaggccagggtcgct

SEQ ID NO: 373421 - DNA, 25 bp, Mus musculus
gccagtggtaaatcaggtgtcgctg

SEQ ID NO: 373422 - DNA, 25 bp, Mus musculus
gagcgcactggccagtggtaaatca

SEQ ID NO: 373423 - DNA, 25 bp, Mus musculus
agccgtgcgcgcagcggccatcttg

SEQ ID NO: 373424 - DNA, 25 bp, Mus musculus
aagcttcgcatgaccgcggcgggtc

SEQ ID NO: 373425 - DNA, 25 bp, Mus musculus
tgcaccaagcttcgcatgaccgcgg

SEQ ID NO: 373426 - DNA, 25 bp, Mus musculus
tcatccgtgcaccaagcttcgcatg

SEQ ID NO: 373427 - DNA, 25 bp, Mus musculus
ccgcagctcctccatggcggctgca

SEQ ID NO: 373428 - DNA, 25 bp, Mus musculus
tggcgtctctcatccgtgcaccaag

SEQ ID NO: 373429 - DNA, 25 bp, Mus musculus
tgagggagtgactcgactccgcctc

SEQ ID NO: 373430 - DNA, 25 bp, Mus musculus
gctgggcagcactccggatccggct

SEQ ID NO: 373431 - DNA, 25 bp, Mus musculus
ctcggcgatggcgtctctcatccgt

SEQ ID NO: 373432 - DNA, 25 bp, Mus musculus
gcggacgcaccctgcggggaagcca

SEQ ID NO: 373433 - DNA, 25 bp, Mus musculus
caggatgcgcccttcgcccgtgcac

SEQ ID NO: 373434 - DNA, 25 bp, Mus musculus
cgcaacttcggagcactttggcagc

SEQ ID NO: 373435 - DNA, 25 bp, Mus musculus
aacttcggagcactttggcagcttg

SEQ ID NO: 373436 - DNA, 25 bp, Mus musculus
cttcggagcactttggcagcttggg

SEQ ID NO: 373437 - DNA, 25 bp, Mus musculus
gggctccagtccagatggtcgttcc

SEQ ID NO: 373438 - DNA, 25 bp, Mus musculus
ctcccgcaggggtcgcagaggtagg

SEQ ID NO: 373439 - DNA, 25 bp, Mus musculus
ggaccgcaacttcggagcactttgg

SEQ ID NO: 373440 - DNA, 25 bp, Mus musculus
gcaggaccgcaacttcggagcactt

SEQ ID NO: 373441 - DNA, 25 bp, Mus musculus
cccactcgggtaggcactgctggcg

SEQ ID NO: 373442 - DNA, 25 bp, Mus musculus
tccagtccagatggtcgttccctac

SEQ ID NO: 373443 - DNA, 25 bp, Mus musculus
gtgcccactcgggtaggcactgctg

SEQ ID NO: 373444 - DNA, 25 bp, Mus musculus
accgcaacttcggagcactttggca

SEQ ID NO: 373445 - DNA, 25 bp, Mus musculus
gatcgggcaggaccgcaacttcgga

SEQ ID NO: 373446 - DNA, 25 bp, Mus musculus
gacgctctgtgtgcgcagcactggc

SEQ ID NO: 373447 - DNA, 25 bp, Mus musculus
aggtagcgaggcagaagccctagtc

SEQ ID NO: 373448 - DNA, 25 bp, Mus musculus
agcgaggcagaagccctagtccagg

SEQ ID NO: 373449 - DNA, 25 bp, Mus musculus
ggcagaagccctagtccaggcccgt

SEQ ID NO: 373450 - DNA, 25 bp, Mus musculus
tagtccaggcccgtccgcaaggcgc

SEQ ID NO: 373451 - DNA, 25 bp, Mus musculus
cccatgcgtagggagcctttgggcc

SEQ ID NO: 373452 - DNA, 25 bp, Mus musculus
taccgatggcttccgaggtagcgag

SEQ ID NO: 373453 - DNA, 25 bp, Mus musculus
ttggaacctgcagaagggcgacggt

SEQ ID NO: 373454 - DNA, 25 bp, Mus musculus
ctctgtgtgcgcagcactggccgcg

SEQ ID NO: 373455 - DNA, 25 bp, Mus musculus
ctctggggccgctcctcatctggcc

SEQ ID NO: 373456 - DNA, 25 bp, Mus musculus
gctggtccatttggcgctgccatgg

SEQ ID NO: 373457 - DNA, 25 bp, Mus musculus
gctgccatggtaccgatggcttccg

SEQ ID NO: 373458 - DNA, 25 bp, Mus musculus
catggtaccgatggcttccgaggta

SEQ ID NO: 373459 - DNA, 25 bp, Mus musculus
tttgggccgcggcttggaacctgca

SEQ ID NO: 373460 - DNA, 25 bp, Mus musculus
gggtagccctttggcctcgtgcacc

SEQ ID NO: 373461 - DNA, 25 bp, Mus musculus
cttgtctgtgtagttagggcttctc

SEQ ID NO: 373462 - DNA, 25 bp, Mus musculus
aagcaccgggaaccagcgctctagg

SEQ ID NO: 373463 - DNA, 25 bp, Mus musculus
agcgctatctgtccacttgtctgtg

SEQ ID NO: 373464 - DNA, 25 bp, Mus musculus
tcgtagcacgcgcaccatggctgct

SEQ ID NO: 373465 - DNA, 25 bp, Mus musculus
tccttatagcgctccgacggcagca

SEQ ID NO: 373466 - DNA, 25 bp, Mus musculus
ccagctcctctttggcctgagcaga

SEQ ID NO: 373467 - DNA, 25 bp, Mus musculus
ggaactcggccagctccttatagcg

SEQ ID NO: 373468 - DNA, 25 bp, Mus musculus
tggctggacactgttcaggcccttc

SEQ ID NO: 373469 - DNA, 25 bp, Mus musculus
actgcgctcgtcgttcctcattggt

SEQ ID NO: 373470 - DNA, 25 bp, Mus musculus
cgcctcgaagtggaagcgttcagcc

SEQ ID NO: 373471 - DNA, 25 bp, Mus musculus
cgttcagcccagaagagttggcctg

SEQ ID NO: 373472 - DNA, 25 bp, Mus musculus
cacgcactccgggtacagttgctcg

SEQ ID NO: 373473 - DNA, 25 bp, Mus musculus
ccagcacaacttagaaagcgctatc

SEQ ID NO: 373474 - DNA, 25 bp, Mus musculus
ggccagcccatcattcagattcatg

SEQ ID NO: 373475 - DNA, 25 bp, Mus musculus
gacaggggtccatcatcatcctgga

SEQ ID NO: 373476 - DNA, 25 bp, Mus musculus
aagcatcacgttccggcgggcattc

SEQ ID NO: 373477 - DNA, 25 bp, Mus musculus
cctgagacatcaaggggtccgactg

SEQ ID NO: 373478 - DNA, 25 bp, Mus musculus
ggtccgactgggtcatcatgacgtc

SEQ ID NO: 373479 - DNA, 25 bp, Mus musculus
tctcctggatagtctgcatgggtga

SEQ ID NO: 373480 - DNA, 25 bp, Mus musculus
cgaaggtccaaacacggtactgttg

SEQ ID NO: 373481 - DNA, 25 bp, Mus musculus
gttgatgatccaccaagagctcttg

SEQ ID NO: 373482 - DNA, 25 bp, Mus musculus
aggtcgtccatgaggttctcggcca

SEQ ID NO: 373483 - DNA, 25 bp, Mus musculus
tcagccgcggaagctccacagtaca

SEQ ID NO: 373484 - DNA, 25 bp, Mus musculus
gctcttgcccgtgccttcattctga

SEQ ID NO: 373485 - DNA, 25 bp, Mus musculus
tgctgttgtccatggagaccgcacg

SEQ ID NO: 373486 - DNA, 25 bp, Mus musculus
ggacgtcatccagctccgtgcttgc

SEQ ID NO: 373487 - DNA, 25 bp, Mus musculus
cgcgatgttatccagcaggtcgtcc

SEQ ID NO: 373488 - DNA, 25 bp, Mus musculus
ccctgaggaagcacagcatcgcggt

SEQ ID NO: 373489 - DNA, 25 bp, Mus musculus
agatgatgaaggctgcggacgacca

SEQ ID NO: 373490 - DNA, 25 bp, Mus musculus
agagcaccgcgaccacgtaggagat

SEQ ID NO: 373491 - DNA, 25 bp, Mus musculus
gaagctggcttgctgcggactgcct

SEQ ID NO: 373492 - DNA, 25 bp, Mus musculus
ccacgtaggagatgatgaaggctgc

SEQ ID NO: 373493 - DNA, 25 bp, Mus musculus
cggacgaccaagtcaccaggaggaa

SEQ ID NO: 373494 - DNA, 25 bp, Mus musculus
ggcgctgagctcgtcggaccaagaa

SEQ ID NO: 373495 - DNA, 25 bp, Mus musculus
gcggtggccaagacacagacagcta

SEQ ID NO: 373496 - DNA, 25 bp, Mus musculus
gcggtcctggcttgttgcgaaaccg

SEQ ID NO: 373497 - DNA, 25 bp, Mus musculus
cttgttgcgaaaccggtgaagtcac

SEQ ID NO: 373498 - DNA, 25 bp, Mus musculus
gtgaagtcacaaagcggcagcctgg

SEQ ID NO: 373499 - DNA, 25 bp, Mus musculus
ttttgcttgatacagcgacgggtgg

SEQ ID NO: 373500 - DNA, 25 bp, Mus musculus
acacagacagctaacggcgcggcgg

SEQ ID NO: 373501 - DNA, 25 bp, Mus musculus
ccgcgaccacgtaggagatgatgaa

SEQ ID NO: 373502 - DNA, 25 bp, Mus musculus
gcagcaagttgaagagcgcgttccc

SEQ ID NO: 373503 - DNA, 25 bp, Mus musculus
cgtcggagcctaccacgaaactgcg

SEQ ID NO: 373504 - DNA, 25 bp, Mus musculus
cagccacggccctggtacagatagc

SEQ ID NO: 373505 - DNA, 25 bp, Mus musculus
tgtgtgcgcacctacccagtgccag

SEQ ID NO: 373506 - DNA, 25 bp, Mus musculus
agttgtagccgcgtgtgtgcgcacc

SEQ ID NO: 373507 - DNA, 25 bp, Mus musculus
gttgcccacgaaggccacaccgaag

SEQ ID NO: 373508 - DNA, 25 bp, Mus musculus
gtgacccagtgtagttgcccacgaa

SEQ ID NO: 373509 - DNA, 25 bp, Mus musculus
cgcagcttcgttgggcagtgaccca

SEQ ID NO: 373510 - DNA, 25 bp, Mus musculus
gcaccgtgttcagcgcagcttcgtt

SEQ ID NO: 373511 - DNA, 25 bp, Mus musculus
cctgcgcgaattgcgcagctcggga

SEQ ID NO: 373512 - DNA, 25 bp, Mus musculus
tggccgcaagagacctgcgcgaatt

SEQ ID NO: 373513 - DNA, 25 bp, Mus musculus
ccaagcagcttgtagtctggccgca

SEQ ID NO: 373514 - DNA, 25 bp, Mus musculus
cactagctggcggtggccaagcagc

SEQ ID NO: 373515 - DNA, 25 bp, Mus musculus
cctggtacagatagccgtcggagcc

SEQ ID NO: 373516 - DNA, 25 bp, Mus musculus
atctggatcgagagcggcaggctga

SEQ ID NO: 373517 - DNA, 25 bp, Mus musculus
ggcaggctgagacccgggtgagtgt

SEQ ID NO: 373518 - DNA, 25 bp, Mus musculus
tgggtccagcgactgtggccttagc

SEQ ID NO: 373519 - DNA, 25 bp, Mus musculus
tggggctgtcagactgcactgtcaa

SEQ ID NO: 373520 - DNA, 25 bp, Mus musculus
tggggctcagcccggcaggtttaaa

SEQ ID NO: 373521 - DNA, 25 bp, Mus musculus
cagcccgaagcttgtaaagggctgg

SEQ ID NO: 373522 - DNA, 25 bp, Mus musculus
gctcagcccgaagcttgtaaagggc

SEQ ID NO: 373523 - DNA, 25 bp, Mus musculus
cccggagttgtgaggcggggctcag

SEQ ID NO: 373524 - DNA, 25 bp, Mus musculus
ggcgttgccagtatgggcgtggccc

SEQ ID NO: 373525 - DNA, 25 bp, Mus musculus
gactgcactgtcaaagaagcggatc

SEQ ID NO: 373526 - DNA, 25 bp, Mus musculus
tgcactgtcaaagaagcggatctgg

SEQ ID NO: 373527 - DNA, 25 bp, Mus musculus
cactgtcaaagaagcggatctggat

SEQ ID NO: 373528 - DNA, 25 bp, Mus musculus
ggctgtcagactgcactgtcaaaga

SEQ ID NO: 373529 - DNA, 25 bp, Mus musculus
tgtcagactgcactgtcaaagaagc

SEQ ID NO: 373530 - DNA, 25 bp, Mus musculus
agaacggcctttggctcaatgtaga

SEQ ID NO: 373531 - DNA, 25 bp, Mus musculus
ttctacgcacggagaacggcctttg

SEQ ID NO: 373532 - DNA, 25 bp, Mus musculus
cttcgccatggcagagatgcgtgta

SEQ ID NO: 373533 - DNA, 25 bp, Mus musculus
atgcgtgtagtcgtggcgctgacac

SEQ ID NO: 373534 - DNA, 25 bp, Mus musculus
tcgtggcgctgacactgctgcgctt

SEQ ID NO: 373535 - DNA, 25 bp, Mus musculus
cgcttccgcctgagcgtggaccgaa

SEQ ID NO: 373536 - DNA, 25 bp, Mus musculus
tcacgggcctgagtgcgcccttgct

SEQ ID NO: 373537 - DNA, 25 bp, Mus musculus
aggaagccggagcttattctacgca

SEQ ID NO: 373538 - DNA, 25 bp, Mus musculus
atgtagagcctctaccctcacgggc

SEQ ID NO: 373539 - DNA, 25 bp, Mus musculus
ttgctccgcggatcctgggattcag

SEQ ID NO: 373540 - DNA, 25 bp, Mus musculus
tgggattcagggattcaggctccgc

SEQ ID NO: 373541 - DNA, 25 bp, Mus musculus
ctagatcacgcctccaatagcatgg

SEQ ID NO: 373542 - DNA, 25 bp, Mus musculus
cccaagatattgagggcgttgacta

SEQ ID NO: 373543 - DNA, 25 bp, Mus musculus
cgaacccacaaggtgcggaggaagc

SEQ ID NO: 373544 - DNA, 25 bp, Mus musculus
ccgcctccgcttctagcggcgccct

SEQ ID NO: 373545 - DNA, 25 bp, Mus musculus
tgccgcctccgcttctagcggcgcc

SEQ ID NO: 373546 - DNA, 25 bp, Mus musculus
tgatggcccagctccacccagaggg

SEQ ID NO: 373547 - DNA, 25 bp, Mus musculus
gaggccatggccgcagcactgagct

SEQ ID NO: 373548 - DNA, 25 bp, Mus musculus
tagggaggccatggccgcagcactg

SEQ ID NO: 373549 - DNA, 25 bp, Mus musculus
gccaccgcccaggctgcggagccgc

SEQ ID NO: 373550 - DNA, 25 bp, Mus musculus
ctagggaggccatggccgcagcact

SEQ ID NO: 373551 - DNA, 25 bp, Mus musculus
cctagggaggccatggccgcagcac

SEQ ID NO: 373552 - DNA, 25 bp, Mus musculus
cccggatgcctagggaggccatggc

SEQ ID NO: 373553 - DNA, 25 bp, Mus musculus
gccgcctccgcttctagcggcgccc

SEQ ID NO: 373554 - DNA, 25 bp, Mus musculus
tgcgggtgcccggatgcctagggag

SEQ ID NO: 373555 - DNA, 25 bp, Mus musculus
gtgcccggatgcctagggaggccat

SEQ ID NO: 373556 - DNA, 25 bp, Mus musculus
tgcccggatgcctagggaggccatg

SEQ ID NO: 373557 - DNA, 25 bp, Mus musculus
gcccggatgcctagggaggccatgg

SEQ ID NO: 373558 - DNA, 25 bp, Mus musculus
agcagagcagatgagatgcagactc

SEQ ID NO: 373559 - DNA, 25 bp, Mus musculus
ccagcagagcagatgagatgcagac

SEQ ID NO: 373560 - DNA, 25 bp, Mus musculus
cagcagagcagatgagatgcagact

SEQ ID NO: 373561 - DNA, 25 bp, Mus musculus
caaaggacaggaccgcagctctgcc

SEQ ID NO: 373562 - DNA, 25 bp, Mus musculus
cagcgcggcccagcagagcagatga

SEQ ID NO: 373563 - DNA, 25 bp, Mus musculus
aaggacaggaccgcagctctgcctg

SEQ ID NO: 373564 - DNA, 25 bp, Mus musculus
gcaaaggacaggaccgcagctctgc

SEQ ID NO: 373565 - DNA, 25 bp, Mus musculus
cccagcagagcagatgagatgcaga

SEQ ID NO: 373566 - DNA, 25 bp, Mus musculus
atgagatgcagactcagctgccctg

SEQ ID NO: 373567 - DNA, 25 bp, Mus musculus
agatgagatgcagactcagctgccc

SEQ ID NO: 373568 - DNA, 25 bp, Mus musculus
cagatgagatgcagactcagctgcc

SEQ ID NO: 373569 - DNA, 25 bp, Mus musculus
gcagatgagatgcagactcagctgc

SEQ ID NO: 373570 - DNA, 25 bp, Mus musculus
agcaaaggacaggaccgcagctctg

SEQ ID NO: 373571 - DNA, 25 bp, Mus musculus
tgagatgcagactcagctgccctgg

SEQ ID NO: 373572 - DNA, 25 bp, Mus musculus
gcgcacgcaccatttccagtcaccg

SEQ ID NO: 373573 - DNA, 25 bp, Mus musculus
gcctgcgcacgcaccatttccagtc

SEQ ID NO: 373574 - DNA, 25 bp, Mus musculus
acagtagcctcctccctacagcctg

SEQ ID NO: 373575 - DNA, 25 bp, Mus musculus
tgccgcctccgcttacagtagcctc

SEQ ID NO: 373576 - DNA, 25 bp, Mus musculus
ctctgcctgctggtccagctccatc

SEQ ID NO: 373577 - DNA, 25 bp, Mus musculus
tgcaagcgcccagctgacctgagac

SEQ ID NO: 373578 - DNA, 25 bp, Mus musculus
acgcaggctgcaagcgcccagctga

SEQ ID NO: 373579 - DNA, 25 bp, Mus musculus
cggagacgcaggctgcaagcgccca

SEQ ID NO: 373580 - DNA, 25 bp, Mus musculus
tgtccaggtgacctcctgcgattcc

SEQ ID NO: 373581 - DNA, 25 bp, Mus musculus
gctcacctcgcggttttcctacaaa

SEQ ID NO: 373582 - DNA, 25 bp, Mus musculus
acctcccagactgcggagacgcagg

SEQ ID NO: 373583 - DNA, 25 bp, Mus musculus
caccgggtgtccaggtgacctcctg

SEQ ID NO: 373584 - DNA, 25 bp, Mus musculus
tcacctcgcggttttcctacaaatc

SEQ ID NO: 373585 - DNA, 25 bp, Mus musculus
ggtgtccaggtgacctcctgcgatt

SEQ ID NO: 373586 - DNA, 25 bp, Mus musculus
tcatctggcaggatgcggaagcgca

SEQ ID NO: 373587 - DNA, 25 bp, Mus musculus
cctatgcagttcctgcgggaggacg

SEQ ID NO: 373588 - DNA, 25 bp, Mus musculus
agtctgtcctatgcagttcctgcgg

SEQ ID NO: 373589 - DNA, 25 bp, Mus musculus
ggcgaaagtctgtcctatgcagttc

SEQ ID NO: 373590 - DNA, 25 bp, Mus musculus
tcgctcatggcgaaagtctgtccta

SEQ ID NO: 373591 - DNA, 25 bp, Mus musculus
ttatctcgctcatggcgaaagtctg

SEQ ID NO: 373592 - DNA, 25 bp, Mus musculus
gctacctttatctcgctcatggcga

SEQ ID NO: 373593 - DNA, 25 bp, Mus musculus
aagcgcagcagggtcagcgccagcg

SEQ ID NO: 373594 - DNA, 25 bp, Mus musculus
gcgcggctccttgtcatctggcagg

SEQ ID NO: 373595 - DNA, 25 bp, Mus musculus
ttccggcgcggctccttgtcatctg

SEQ ID NO: 373596 - DNA, 25 bp, Mus musculus
caggatcagctctggcttccggcgc

SEQ ID NO: 373597 - DNA, 25 bp, Mus musculus
cctctgcgcgcaggatcagctctgg

SEQ ID NO: 373598 - DNA, 25 bp, Mus musculus
ggcgctcagcggctccacccgcagc

SEQ ID NO: 373599 - DNA, 25 bp, Mus musculus
agcgctacctttatctcgctcatgg

SEQ ID NO: 373600 - DNA, 25 bp, Mus musculus
cccgacgtgtgcagcaatttgagat

SEQ ID NO: 373601 - DNA, 25 bp, Mus musculus
tgcagcaatttgagatggactttgg

SEQ ID NO: 373602 - DNA, 25 bp, Mus musculus
tggactttgggagtgccgtcaaccc

SEQ ID NO: 373603 - DNA, 25 bp, Mus musculus
ccgtcaacccgggtgcacttgagtt

SEQ ID NO: 373604 - DNA, 25 bp, Mus musculus
tgcacttgagttgtatgctctgtta

SEQ ID NO: 373605 - DNA, 25 bp, Mus musculus
tatgctctgttagcggagtcccgtc

SEQ ID NO: 373606 - DNA, 25 bp, Mus musculus
tgttagcggagtcccgtcctgtccc

SEQ ID NO: 373607 - DNA, 25 bp, Mus musculus
tgtcccttccctgtgaagctgcttc

SEQ ID NO: 373608 - DNA, 25 bp, Mus musculus
aagctgcttcgtccctagtttctag

SEQ ID NO: 373609 - DNA, 25 bp, Mus musculus
ttctagtcctcccatgacgagcctg

SEQ ID NO: 373610 - DNA, 25 bp, Mus musculus
cgagcctccgctgacattgcagctg

SEQ ID NO: 373611 - DNA, 25 bp, Mus musculus
tgacattgcagctgccaagttggtg

SEQ ID NO: 373612 - DNA, 25 bp, Mus musculus
ccaagttggtgacgccgcgtccaga

SEQ ID NO: 373613 - DNA, 25 bp, Mus musculus
cgcgtccagactgcggtgaaggcac

SEQ ID NO: 373614 - DNA, 25 bp, Mus musculus
ctctgagctggtattagtggcttcc

SEQ ID NO: 373615 - DNA, 25 bp, Mus musculus
agtcaccgctgcaggacaccagagg

SEQ ID NO: 373616 - DNA, 25 bp, Mus musculus
gtcgcagctgagctctgagctggta

SEQ ID NO: 373617 - DNA, 25 bp, Mus musculus
tgacacccgtcaggcacagcagcag

SEQ ID NO: 373618 - DNA, 25 bp, Mus musculus
ttagtggcttccagcaggtagcggt

SEQ ID NO: 373619 - DNA, 25 bp, Mus musculus
agctccggtgtggtgaggttccact

SEQ ID NO: 373620 - DNA, 25 bp, Mus musculus
tggtgaggttccactcctcctcggg

SEQ ID NO: 373621 - DNA, 25 bp, Mus musculus
agcagcaggaacacgcgccgctgga

SEQ ID NO: 373622 - DNA, 25 bp, Mus musculus
accaatagtagtcgggctggctgcc

SEQ ID NO: 373623 - DNA, 25 bp, Mus musculus
tggctgcccaggaagaccacaccga

SEQ ID NO: 373624 - DNA, 25 bp, Mus musculus
accacaccgacgaagaggaaggcga

SEQ ID NO: 373625 - DNA, 25 bp, Mus musculus
aggaaggcgaaggtgacacccgtca

SEQ ID NO: 373626 - DNA, 25 bp, Mus musculus
tcagtgcctggtcgaacgtgggcat

SEQ ID NO: 373627 - DNA, 25 bp, Mus musculus
gcggcccgcgacaccaatagtagtc

SEQ ID NO: 373628 - DNA, 25 bp, Mus musculus
cagcggactagaagacactgcttca

SEQ ID NO: 373629 - DNA, 25 bp, Mus musculus
ctagaagacactgcttcagaagggg

SEQ ID NO: 373630 - DNA, 25 bp, Mus musculus
cagggccggaccgacaggaccagac

SEQ ID NO: 373631 - DNA, 25 bp, Mus musculus
cgctgcctgctctgcacggaattaa

SEQ ID NO: 373632 - DNA, 25 bp, Mus musculus
cacggaattaaaacgcacgtgggtg

SEQ ID NO: 373633 - DNA, 25 bp, Mus musculus
gcgggtgacagactcctgcacagaa

SEQ ID NO: 373634 - DNA, 25 bp, Mus musculus
tcctgcacagaatcaggcgaacgtc

SEQ ID NO: 373635 - DNA, 25 bp, Mus musculus
ggcgaacgtcagtgccgcggcacca

SEQ ID NO: 373636 - DNA, 25 bp, Mus musculus
caactcgccagcgatgcagtctgga

SEQ ID NO: 373637 - DNA, 25 bp, Mus musculus
cagggacaaagcctccgcgatgtca

SEQ ID NO: 373638 - DNA, 25 bp, Mus musculus
gcagtctggagaggcgctgtctcac

SEQ ID NO: 373639 - DNA, 25 bp, Mus musculus
aagcctccgcgatgtcaccaacgtg

SEQ ID NO: 373640 - DNA, 25 bp, Mus musculus
cccgagagcacagcggactagaaga

SEQ ID NO: 373641 - DNA, 25 bp, Mus musculus
tgccgcggcaccacacagggacaaa

SEQ ID NO: 373642 - DNA, 25 bp, Mus musculus
ccggccacgccaccgggcgcttgct

SEQ ID NO: 373643 - DNA, 25 bp, Mus musculus
tgctccctcccttcctgtgcgccgg

SEQ ID NO: 373644 - DNA, 25 bp, Mus musculus
tgagtctgtgcgtctacagcggacc

SEQ ID NO: 373645 - DNA, 25 bp, Mus musculus
cgtctacagcggaccgaaggctcca

SEQ ID NO: 373646 - DNA, 25 bp, Mus musculus
cggaccgaaggctccaggcacgcag

SEQ ID NO: 373647 - DNA, 25 bp, Mus musculus
tccaggcacgcaggtactggcgatc

SEQ ID NO: 373648 - DNA, 25 bp, Mus musculus
tactggcgatctggggacccagttg

SEQ ID NO: 373649 - DNA, 25 bp, Mus musculus
gacccagttgggcggcgcagtcacc

SEQ ID NO: 373650 - DNA, 25 bp, Mus musculus
cgcagtcaccggaatgcagtgatta

SEQ ID NO: 373651 - DNA, 25 bp, Mus musculus
ccggaatgcagtgattataagtgac

SEQ ID NO: 373652 - DNA, 25 bp, Mus musculus
tgcagtgattataagtgactttgtg

SEQ ID NO: 373653 - DNA, 25 bp, Mus musculus
agtgactttgtgtgtctcggggaca

SEQ ID NO: 373654 - DNA, 25 bp, Mus musculus
ggacaagatgtgctggacggatccc

SEQ ID NO: 373655 - DNA, 25 bp, Mus musculus
atgtgctggacggatcccgttgtgc

SEQ ID NO: 373656 - DNA, 25 bp, Mus musculus
tgctgcttaagctcctgcagagaca

SEQ ID NO: 373657 - DNA, 25 bp, Mus musculus
tatgggctctacgtctgcttcgtgg

SEQ ID NO: 373658 - DNA, 25 bp, Mus musculus
gcttcgtgggcgtcgttgtcaccat

SEQ ID NO: 373659 - DNA, 25 bp, Mus musculus
cgttgtcaccatcgtctcggctttc

SEQ ID NO: 373660 - DNA, 25 bp, Mus musculus
tcgtctcggctttccagttcggaga

SEQ ID NO: 373661 - DNA, 25 bp, Mus musculus
tttccagttcggagaggtgagtagc

SEQ ID NO: 373662 - DNA, 25 bp, Mus musculus
ggggaccagcacacggcccactagt

SEQ ID NO: 373663 - DNA, 25 bp, Mus musculus
tagtcccaggcgctgagcgtgcatc

SEQ ID NO: 373664 - DNA, 25 bp, Mus musculus
tccgggcctcgcgtgcttcagcgtg

SEQ ID NO: 373665 - DNA, 25 bp, Mus musculus
ccggggtgatgctgcttaagctcct

SEQ ID NO: 373666 - DNA, 25 bp, Mus musculus
cgccctctaggtggcgctggcgact

SEQ ID NO: 373667 - DNA, 25 bp, Mus musculus
agagacagacctatacctgcctatc

SEQ ID NO: 373668 - DNA, 25 bp, Mus musculus
gcctatcccacaggtatgggctcta

SEQ ID NO: 373669 - DNA, 25 bp, Mus musculus
ctgcagcagctggactggacgtccg

SEQ ID NO: 373670 - DNA, 25 bp, Mus musculus
actgacagggaacggtcctgccgcg

SEQ ID NO: 373671 - DNA, 25 bp, Mus musculus
aagagcagcgggactgacagggaac

SEQ ID NO: 373672 - DNA, 25 bp, Mus musculus
taactgagtagaggatggtgagcgc

SEQ ID NO: 373673 - DNA, 25 bp, Mus musculus
aaccagaggtgtaactgagtagagg

SEQ ID NO: 373674 - DNA, 25 bp, Mus musculus
cgggaaccagaggtgtaactgagta

SEQ ID NO: 373675 - DNA, 25 bp, Mus musculus
gcacgggaaccagaggtgtaactga

SEQ ID NO: 373676 - DNA, 25 bp, Mus musculus
agcctccgaaggcacgggaaccaga

SEQ ID NO: 373677 - DNA, 25 bp, Mus musculus
agagcctccgaaggcacgggaacca

SEQ ID NO: 373678 - DNA, 25 bp, Mus musculus
cgccgaggaagacgcccctgctgga

SEQ ID NO: 373679 - DNA, 25 bp, Mus musculus
gaccgtgtcgccgaggaagacgccc

SEQ ID NO: 373680 - DNA, 25 bp, Mus musculus
cgatgtgagcgagagaccgtgtcgc

SEQ ID NO: 373681 - DNA, 25 bp, Mus musculus
aatggcgccgatgtgagcgagagac

SEQ ID NO: 373682 - DNA, 25 bp, Mus musculus
ctgagaagcgggaaaatggcgccga

SEQ ID NO: 373683 - DNA, 25 bp, Mus musculus
cgcgagatctgagaagcgggaaaat

SEQ ID NO: 373684 - DNA, 25 bp, Mus musculus
gggcaccatccgatccatgcttagg

SEQ ID NO: 373685 - DNA, 25 bp, Mus musculus
tgcggccatgcgctccaggccgaag

SEQ ID NO: 373686 - DNA, 25 bp, Mus musculus
ccacacggtcaatgggtgcggccat

SEQ ID NO: 373687 - DNA, 25 bp, Mus musculus
tgcgctcaatggtttggcccacacg

SEQ ID NO: 373688 - DNA, 25 bp, Mus musculus
tacaccagagcccatgcgctcaatg

SEQ ID NO: 373689 - DNA, 25 bp, Mus musculus
aggacccatgcgctctacaccagag

SEQ ID NO: 373690 - DNA, 25 bp, Mus musculus
cgttccaggctgttggcgcccattc

SEQ ID NO: 373691 - DNA, 25 bp, Mus musculus
catgcttaggcccatgcgttcaatg

SEQ ID NO: 373692 - DNA, 25 bp, Mus musculus
tgcctgtgggcaccatccgatccat

SEQ ID NO: 373693 - DNA, 25 bp, Mus musculus
ggtggccatccgatccatcacagga

SEQ ID NO: 373694 - DNA, 25 bp, Mus musculus
atgcgctccaggttgttggcgccca

SEQ ID NO: 373695 - DNA, 25 bp, Mus musculus
actgttggctcccatacgctccagg

SEQ ID NO: 373696 - DNA, 25 bp, Mus musculus
cccatgcgctcaagactgttggctc

SEQ ID NO: 373697 - DNA, 25 bp, Mus musculus
tgcgttcaatggcaggacccatgcg

SEQ ID NO: 373698 - DNA, 25 bp, Mus musculus
ggatcaattgctgttagactactca

SEQ ID NO: 373699 - DNA, 25 bp, Mus musculus
gcgcgccatcactgctctgagaata

SEQ ID NO: 373700 - DNA, 25 bp, Mus musculus
gaacgaccagtaacgcctccttgtg

SEQ ID NO: 373701 - DNA, 25 bp, Mus musculus
cctccattttgggttctgtcgccgc

SEQ ID NO: 373702 - DNA, 25 bp, Mus musculus
tcccgatgtccgcagatacagttgg

SEQ ID NO: 373703 - DNA, 25 bp, Mus musculus
cctggctggagttagagaaggatca

SEQ ID NO: 373704 - DNA, 25 bp, Mus musculus
gtgtcgctcattcgaacttacaata

SEQ ID NO: 373705 - DNA, 25 bp, Mus musculus
taacggagctgcgaagtaacctggc

SEQ ID NO: 373706 - DNA, 25 bp, Mus musculus
aagcggcccacagacctaacggagc

SEQ ID NO: 373707 - DNA, 25 bp, Mus musculus
tctcctggcttcgtcgtcgtcacag

SEQ ID NO: 373708 - DNA, 25 bp, Mus musculus
ggcgatccattaggctctcctggct

SEQ ID NO: 373709 - DNA, 25 bp, Mus musculus
tacgagcgcacatacggacctagtc

SEQ ID NO: 373710 - DNA, 25 bp, Mus musculus
gagtcatgtcgacaccttccgggtc

SEQ ID NO: 373711 - DNA, 25 bp, Mus musculus
tgccgccattttctccgcgtctggg

SEQ ID NO: 373712 - DNA, 25 bp, Mus musculus
ccaatgaagactgcctctgagtatc

SEQ ID NO: 373713 - DNA, 25 bp, Mus musculus
ccgctcgagtactcagccggaggct

SEQ ID NO: 373714 - DNA, 25 bp, Mus musculus
tcagccggaggctcgaacccggaac

SEQ ID NO: 373715 - DNA, 25 bp, Mus musculus
ggaacctgggaaacctgcctacata

SEQ ID NO: 373716 - DNA, 25 bp, Mus musculus
tgggaaacctgcctacatactcggg

SEQ ID NO: 373717 - DNA, 25 bp, Mus musculus
ctacatactcgggtcaggcccattc

SEQ ID NO: 373718 - DNA, 25 bp, Mus musculus
gtcaggcccattcgctgttccgtgc

SEQ ID NO: 373719 - DNA, 25 bp, Mus musculus
tgcctctgagtatcatctgccaatc

SEQ ID NO: 373720 - DNA, 25 bp, Mus musculus
gcgaaccaatgaagactgcctctga

SEQ ID NO: 373721 - DNA, 25 bp, Mus musculus
tatctgtcccgctcgagtactcagc

SEQ ID NO: 373722 - DNA, 25 bp, Mus musculus
tgttccgtgcctacctgttccgcgg

SEQ ID NO: 373723 - DNA, 25 bp, Mus musculus
atcatctgccaatcagcatacacgc

SEQ ID NO: 373724 - DNA, 25 bp, Mus musculus
gagcagacagcacggcgaaccaatg

SEQ ID NO: 373725 - DNA, 25 bp, Mus musculus
attcgctgttccgtgcctacctgtt

SEQ ID NO: 373726 - DNA, 25 bp, Mus musculus
ctttcctcaccactgcgtactaggg

SEQ ID NO: 373727 - DNA, 25 bp, Mus musculus
tgtagcacggcttcggccctccagt

SEQ ID NO: 373728 - DNA, 25 bp, Mus musculus
tctctgttcctgtagcacggcttcg

SEQ ID NO: 373729 - DNA, 25 bp, Mus musculus
tgagctctctgttcctgtagcacgg

SEQ ID NO: 373730 - DNA, 25 bp, Mus musculus
gcgcacctttgaataggtaatcgta

SEQ ID NO: 373731 - DNA, 25 bp, Mus musculus
tcaccactgcgtactagggcccgaa

SEQ ID NO: 373732 - DNA, 25 bp, Mus musculus
agcggcggtctaaaggccagtcaac

SEQ ID NO: 373733 - DNA, 25 bp, Mus musculus
caacggcctctcctaccacctcggg

SEQ ID NO: 373734 - DNA, 25 bp, Mus musculus
taaaggccagtcaacggtgaaagcg

SEQ ID NO: 373735 - DNA, 25 bp, Mus musculus
cccacaaggcgcacctttgaatagg

SEQ ID NO: 373736 - DNA, 25 bp, Mus musculus
gctaccgccacctcgcctgtctgta

SEQ ID NO: 373737 - DNA, 25 bp, Mus musculus
ataggtaatcgtactcgtcgtcccg

SEQ ID NO: 373738 - DNA, 25 bp, Mus musculus
attgtcctggcgcttccggcgggat

SEQ ID NO: 373739 - DNA, 25 bp, Mus musculus
agggcccgaagcctagcgaactcca

SEQ ID NO: 373740 - DNA, 25 bp, Mus musculus
ccagcaagttcatctcgtcccagga

SEQ ID NO: 373741 - DNA, 25 bp, Mus musculus
acgggtgcgctccacgtgttcgcgc

SEQ ID NO: 373742 - DNA, 25 bp, Mus musculus
tgtcggagcgcagcgcatgattctg

SEQ ID NO: 373743 - DNA, 25 bp, Mus musculus
ccatggccgagctgtagcagcccgt

SEQ ID NO: 373744 - DNA, 25 bp, Mus musculus
ccgagctgtagcagcccgtgagcca

SEQ ID NO: 373745 - DNA, 25 bp, Mus musculus
acgtgttcgcgcagcccatggccga

SEQ ID NO: 373746 - DNA, 25 bp, Mus musculus
agcccgtgagccagcaagttcatct

SEQ ID NO: 373747 - DNA, 25 bp, Mus musculus
ctcgtcccaggatgcaaagcgcggt

SEQ ID NO: 373748 - DNA, 25 bp, Mus musculus
ccaggatgcaaagcgcggtggctct

SEQ ID NO: 373749 - DNA, 25 bp, Mus musculus
cagggcgcccttgcgcgctcaaaag

SEQ ID NO: 373750 - DNA, 25 bp, Mus musculus
cagtagccgcgcatagcaccagggc

SEQ ID NO: 373751 - DNA, 25 bp, Mus musculus
agccgcgcatagcaccagggcagcg

SEQ ID NO: 373752 - DNA, 25 bp, Mus musculus
cctgctgtcggagcgcagcgcatga

SEQ ID NO: 373753 - DNA, 25 bp, Mus musculus
ccttgggtgcagcaacgctaggact

SEQ ID NO: 373754 - DNA, 25 bp, Mus musculus
actgaggagctcctagggttgcctg

SEQ ID NO: 373755 - DNA, 25 bp, Mus musculus
gagcccaggagcttggacttccagc

SEQ ID NO: 373756 - DNA, 25 bp, Mus musculus
ggatgcccaggcagtacccgagaca

SEQ ID NO: 373757 - DNA, 25 bp, Mus musculus
caccgaagtcgtgcctgagacccga

SEQ ID NO: 373758 - DNA, 25 bp, Mus musculus
ccacctcggatcgtggagtgcgctc

SEQ ID NO: 373759 - DNA, 25 bp, Mus musculus
ccctgagaccgttgaggtggacacg

SEQ ID NO: 373760 - DNA, 25 bp, Mus musculus
caagaagtagagatcgaggcgcgcc

SEQ ID NO: 373761 - DNA, 25 bp, Mus musculus
gcgcgtgcagccagaacaagaagta

SEQ ID NO: 373762 - DNA, 25 bp, Mus musculus
tcttggagaccagccgacgactgga

SEQ ID NO: 373763 - DNA, 25 bp, Mus musculus
cgcgttgagcacacgctcttggaga

SEQ ID NO: 373764 - DNA, 25 bp, Mus musculus
ccttgtcgcgcaatccgcgcgttga

SEQ ID NO: 373765 - DNA, 25 bp, Mus musculus
ccagcgaatccctggccagtgacga

SEQ ID NO: 373766 - DNA, 25 bp, Mus musculus
tccgcaccagcttggagcatcagcg

SEQ ID NO: 373767 - DNA, 25 bp, Mus musculus
gggtgcactctctcctggtgcgttc

SEQ ID NO: 373768 - DNA, 25 bp, Mus musculus
ggatgccttttatagtcggctctga

SEQ ID NO: 373769 - DNA, 25 bp, Mus musculus
cgttatccaaaagctgcggaactgg

SEQ ID NO: 373770 - DNA, 25 bp, Mus musculus
tatagtcggctctgaccacgcctca

SEQ ID NO: 373771 - DNA, 25 bp, Mus musculus
acgcctcactttcgctctcgcgaga

SEQ ID NO: 373772 - DNA, 25 bp, Mus musculus
agaccgcacgcggtacccaggaatc

SEQ ID NO: 373773 - DNA, 25 bp, Mus musculus
acccaggaatcctcgggacagagtc

SEQ ID NO: 373774 - DNA, 25 bp, Mus musculus
gaatcctcgggacagagtcgtcacc

SEQ ID NO: 373775 - DNA, 25 bp, Mus musculus
acagagtcgtcaccagcgtccttcg

SEQ ID NO: 373776 - DNA, 25 bp, Mus musculus
agcgtccttcggagcggaaggaata

SEQ ID NO: 373777 - DNA, 25 bp, Mus musculus
cggaaggaatatggcgtccgctact

SEQ ID NO: 373778 - DNA, 25 bp, Mus musculus
ggcgtccgctactcgcgttatccaa

SEQ ID NO: 373779 - DNA, 25 bp, Mus musculus
tgcgtgtgctgttccgatccgggcc

SEQ ID NO: 373780 - DNA, 25 bp, Mus musculus
ctcgtgtccatgatggcggcgatct

SEQ ID NO: 373781 - DNA, 25 bp, Mus musculus
acgtgagcaggggatgccttttata

SEQ ID NO: 373782 - DNA, 25 bp, Mus musculus
attccgttgcaaggggaggattcca

SEQ ID NO: 373783 - DNA, 25 bp, Mus musculus
gctcagagggttccgagctatcctg

SEQ ID NO: 373784 - DNA, 25 bp, Mus musculus
agcaattccggttgtgccgtgatcc

SEQ ID NO: 373785 - DNA, 25 bp, Mus musculus
aactccaattgtgctgcgattctgg

SEQ ID NO: 373786 - DNA, 25 bp, Mus musculus
cccgttcagaggattttagcacaac

SEQ ID NO: 373787 - DNA, 25 bp, Mus musculus
cggaggatttctacacgacctgatc

SEQ ID NO: 373788 - DNA, 25 bp, Mus musculus
ggtttacgggcgatctagagcacga

SEQ ID NO: 373789 - DNA, 25 bp, Mus musculus
ccatgccgcgtcagcaagaggagaa

SEQ ID NO: 373790 - DNA, 25 bp, Mus musculus
gttctgaactacacgagggccgata

SEQ ID NO: 373791 - DNA, 25 bp, Mus musculus
ttcagcgctagggtgaagatttctg

SEQ ID NO: 373792 - DNA, 25 bp, Mus musculus
gagggctccgaccaagagttccagg

SEQ ID NO: 373793 - DNA, 25 bp, Mus musculus
tgagggttccactgatccggcagct

SEQ ID NO: 373794 - DNA, 25 bp, Mus musculus
tatcctgagggtgcgaagctgcaca

SEQ ID NO: 373795 - DNA, 25 bp, Mus musculus
tccacgcgttagaggattccgcaaa

SEQ ID NO: 373796 - DNA, 25 bp, Mus musculus
gctcctctttggtctcagaacaggc

SEQ ID NO: 373797 - DNA, 25 bp, Mus musculus
ggtacttacggtcgcaggcttgctt

SEQ ID NO: 373798 - DNA, 25 bp, Mus musculus
ggtcgcaggcttgcttgcgccactc

SEQ ID NO: 373799 - DNA, 25 bp, Mus musculus
gtgcgcgagaatcagcgcgtccttc

SEQ ID NO: 373800 - DNA, 25 bp, Mus musculus
gtccttctgactgagcggctgcggc

SEQ ID NO: 373801 - DNA, 25 bp, Mus musculus
tcagaacaggcctagaggccgctcc

SEQ ID NO: 373802 - DNA, 25 bp, Mus musculus
catacccgggtccaagtctccggtg

SEQ ID NO: 373803 - DNA, 25 bp, Mus musculus
cgggtccaagtctccggtgagtgaa

SEQ ID NO: 373804 - DNA, 25 bp, Mus musculus
gctggcatcgcctcactattggctg

SEQ ID NO: 373805 - DNA, 25 bp, Mus musculus
cgccgcccatcggtcgttgacactc

SEQ ID NO: 373806 - DNA, 25 bp, Mus musculus
tagagtggagagaatcggccctctg

SEQ ID NO: 373807 - DNA, 25 bp, Mus musculus
atcagcgcgtccttctgactgagcg

SEQ ID NO: 373808 - DNA, 25 bp, Mus musculus
cccagcacgcgtgtttggctttagc

SEQ ID NO: 373809 - DNA, 25 bp, Mus musculus
agaatcggccctctgtgcgtgcaga

SEQ ID NO: 373810 - DNA, 25 bp, Mus musculus
gactgtatttactcctgcccaaggg

SEQ ID NO: 373811 - DNA, 25 bp, Mus musculus
cggggccggactgtatttactcctg

SEQ ID NO: 373812 - DNA, 25 bp, Mus musculus
cagccaatcagcagagagcttggtc

SEQ ID NO: 373813 - DNA, 25 bp, Mus musculus
tgtacccatggcgttcagccaatca

SEQ ID NO: 373814 - DNA, 25 bp, Mus musculus
ctatacgtaagcgtgtgtgtaccca

SEQ ID NO: 373815 - DNA, 25 bp, Mus musculus
gctcccacgtgagaacgggcatgga

SEQ ID NO: 373816 - DNA, 25 bp, Mus musculus
cctgccgttggctcccacgtgagaa

SEQ ID NO: 373817 - DNA, 25 bp, Mus musculus
cctaggcagtcgagggtccggcaca

SEQ ID NO: 373818 - DNA, 25 bp, Mus musculus
aggcaggccagtcgccaaccatggc

SEQ ID NO: 373819 - DNA, 25 bp, Mus musculus
ggaaggcgccacaaccaaggcaggc

SEQ ID NO: 373820 - DNA, 25 bp, Mus musculus
tgaaagccgggtcggcttggccttc

SEQ ID NO: 373821 - DNA, 25 bp, Mus musculus
agcgacagctcaccggagccgctga

SEQ ID NO: 373822 - DNA, 25 bp, Mus musculus
tttcctcagatgcttcgagggtgtg

SEQ ID NO: 373823 - DNA, 25 bp, Mus musculus
tgcccaagggccaggtttcctcaga

SEQ ID NO: 373824 - DNA, 25 bp, Mus musculus
atcttggcgcgaggtcgtctccgcc

SEQ ID NO: 373825 - DNA, 25 bp, Mus musculus
aaggcagcaggcaggacgatgagac

SEQ ID NO: 373826 - DNA, 25 bp, Mus musculus
ccgcaaaacgccgaagccaggctgt

SEQ ID NO: 373827 - DNA, 25 bp, Mus musculus
ccgaagccaggctgtccaggagcca

SEQ ID NO: 373828 - DNA, 25 bp, Mus musculus
cttcctgaggtctctggttgcgtca

SEQ ID NO: 373829 - DNA, 25 bp, Mus musculus
tcctccgatcttggcgcgaggtcgt

SEQ ID NO: 373830 - DNA, 25 bp, Mus musculus
ctgcgtcctccgatcttggcgcgag

SEQ ID NO: 373831 - DNA, 25 bp, Mus musculus
caatacgcatgtgcctgagcggggt

SEQ ID NO: 373832 - DNA, 25 bp, Mus musculus
gagccaggccaatcagccacacccg

SEQ ID NO: 373833 - DNA, 25 bp, Mus musculus
tcttctagtccgctagagcaccaga

SEQ ID NO: 373834 - DNA, 25 bp, Mus musculus
ctagtccgctagagcaccagaacta

SEQ ID NO: 373835 - DNA, 25 bp, Mus musculus
tccgctagagcaccagaactagacc

SEQ ID NO: 373836 - DNA, 25 bp, Mus musculus
ccgagcgcggcttcctgaggtctct

SEQ ID NO: 373837 - DNA, 25 bp, Mus musculus
tgtccaggagccaggccaatcagcc

SEQ ID NO: 373838 - DNA, 25 bp, Mus musculus
tgcaaggcttacaccaacccagggc

SEQ ID NO: 373839 - DNA, 25 bp, Mus musculus
gcactgccttctgtaccggtcaaga

SEQ ID NO: 373840 - DNA, 25 bp, Mus musculus
tggtgcaaagagctccacgcctcgc

SEQ ID NO: 373841 - DNA, 25 bp, Mus musculus
ggaccggtcttacccgatgcgactc

SEQ ID NO: 373842 - DNA, 25 bp, Mus musculus
ttagctacctgcaggagattcctta

SEQ ID NO: 373843 - DNA, 25 bp, Mus musculus
ggcctgggtcccgtacagcaatatg

SEQ ID NO: 373844 - DNA, 25 bp, Mus musculus
cccagggcaggaaaagcatatcttt

SEQ ID NO: 373845 - DNA, 25 bp, Mus musculus
aggtgcacgcctcctctcgaaggaa

SEQ ID NO: 373846 - DNA, 25 bp, Mus musculus
gctcggtcataacgacagtggtgca

SEQ ID NO: 373847 - DNA, 25 bp, Mus musculus
tgcaaacccaggcagtgaagcactg

SEQ ID NO: 373848 - DNA, 25 bp, Mus musculus
gggatcctcgagagaccgtttctga

SEQ ID NO: 373849 - DNA, 25 bp, Mus musculus
tgcgaggatttgtgatccgcgctca

SEQ ID NO: 373850 - DNA, 25 bp, Mus musculus
ctccaggcggaagcgctaaggcttc

SEQ ID NO: 373851 - DNA, 25 bp, Mus musculus
ctggagccctgcacagccatagaga

SEQ ID NO: 373852 - DNA, 25 bp, Mus musculus
gttcccggaggcagatccagcgcct

SEQ ID NO: 373853 - DNA, 25 bp, Mus musculus
agcagctgctggcactgtacgtagc

SEQ ID NO: 373854 - DNA, 25 bp, Mus musculus
acgtagccgagattcggcggctgca

SEQ ID NO: 373855 - DNA, 25 bp, Mus musculus
tggacctgtcagagctggatgaccc

SEQ ID NO: 373856 - DNA, 25 bp, Mus musculus
ggatgacccagactcctcgtatttg

SEQ ID NO: 373857 - DNA, 25 bp, Mus musculus
cctcgtatttgcaggaggcccgctt

SEQ ID NO: 373858 - DNA, 25 bp, Mus musculus
gcccgcttgaagaggaagttgatcc

SEQ ID NO: 373859 - DNA, 25 bp, Mus musculus
gatccgcctcttcgggcggttgtgt

SEQ ID NO: 373860 - DNA, 25 bp, Mus musculus
tgtgagttgaaggactgctcttctc

SEQ ID NO: 373861 - DNA, 25 bp, Mus musculus
gcagcgaattccgtaccgaggcacc

SEQ ID NO: 373862 - DNA, 25 bp, Mus musculus
ccgattatggagatgtgctgagagc

SEQ ID NO: 373863 - DNA, 25 bp, Mus musculus
gtacccagaggtcaacaggcgcatt

SEQ ID NO: 373864 - DNA, 25 bp, Mus musculus
caggcgcattgaacggctcattaac

SEQ ID NO: 373865 - DNA, 25 bp, Mus musculus
ggctcattaacaagccggggctgga

SEQ ID NO: 373866 - DNA, 25 bp, Mus musculus
aagctaacgtccagagctcggggtg

SEQ ID NO: 373867 - DNA, 25 bp, Mus musculus
tgcgcctttaaggtcgcaggtccgg

SEQ ID NO: 373868 - DNA, 25 bp, Mus musculus
cggtcgacttttgcccagcggcaca

SEQ ID NO: 373869 - DNA, 25 bp, Mus musculus
gtcgctgtcggtcgacttttgccca

SEQ ID NO: 373870 - DNA, 25 bp, Mus musculus
taaaggaaaagtgtcgctgtcggtc

SEQ ID NO: 373871 - DNA, 25 bp, Mus musculus
aggcggaatgaagcgccggttcttt

SEQ ID NO: 373872 - DNA, 25 bp, Mus musculus
acctttaaggcggaatgaagcgccg

SEQ ID NO: 373873 - DNA, 25 bp, Mus musculus
agccgcagacgggacctggtacctt

SEQ ID NO: 373874 - DNA, 25 bp, Mus musculus
agtcctcagccgcagacgggacctg

SEQ ID NO: 373875 - DNA, 25 bp, Mus musculus
tttcggccaaaccaattcctgagtc

SEQ ID NO: 373876 - DNA, 25 bp, Mus musculus
caaggtaggcttgtcggattaaagg

SEQ ID NO: 373877 - DNA, 25 bp, Mus musculus
aagcggaagccagcactggtcaatg

SEQ ID NO: 373878 - DNA, 25 bp, Mus musculus
cgcgagcaagctaacgtccagagct

SEQ ID NO: 373879 - DNA, 25 bp, Mus musculus
ctggtcaatgagacaaggtaggctt

SEQ ID NO: 373880 - DNA, 25 bp, Mus musculus
ggagcctgtcgtcatcaccatggca

SEQ ID NO: 373881 - DNA, 25 bp, Mus musculus
tggatgctctctaagtcgttcacta

SEQ ID NO: 373882 - DNA, 25 bp, Mus musculus
gtcagcacatttccagtccgggcta

SEQ ID NO: 373883 - DNA, 25 bp, Mus musculus
cctcttagctcacgcagggacgctg

SEQ ID NO: 373884 - DNA, 25 bp, Mus musculus
ttcgggacttacctgcatctgtcgc

SEQ ID NO: 373885 - DNA, 25 bp, Mus musculus
ggccagatcttgacccaaagctata

SEQ ID NO: 373886 - DNA, 25 bp, Mus musculus
tgccacactgctactgcgccatgga

SEQ ID NO: 373887 - DNA, 25 bp, Mus musculus
ttccggcctgtgtgtagtcagcaca

SEQ ID NO: 373888 - DNA, 25 bp, Mus musculus
cggacatcctatggccctctggtca

SEQ ID NO: 373889 - DNA, 25 bp, Mus musculus
ctttgctagtttgtgccttccggcc

SEQ ID NO: 373890 - DNA, 25 bp, Mus musculus
gttacacccttttcggttctgcaga

SEQ ID NO: 373891 - DNA, 25 bp, Mus musculus
ccacactgcgagatgagccgcttca

SEQ ID NO: 373892 - DNA, 25 bp, Mus musculus
ggtcagcgtatccagcactctcttc

SEQ ID NO: 373893 - DNA, 25 bp, Mus musculus
tctgagtccggagcagaactgcccg

SEQ ID NO: 373894 - DNA, 25 bp, Mus musculus
gtcccaagcaagcaccgagggcttg

SEQ ID NO: 373895 - DNA, 25 bp, Mus musculus
cggcacagaaaacccggcgcggatt

SEQ ID NO: 373896 - DNA, 25 bp, Mus musculus
cggattcgctccgttgcactcgtgc

SEQ ID NO: 373897 - DNA, 25 bp, Mus musculus
tgtcattctcgagctgcagtaacgg

SEQ ID NO: 373898 - DNA, 25 bp, Mus musculus
tagggcactttcctcggcagttgca

SEQ ID NO: 373899 - DNA, 25 bp, Mus musculus
ttgcagcgccgctctggttagaaaa

SEQ ID NO: 373900 - DNA, 25 bp, Mus musculus
aaattccgtgtttgccttcctgtgg

SEQ ID NO: 373901 - DNA, 25 bp, Mus musculus
ttcagagccaccgagtggggctgca

SEQ ID NO: 373902 - DNA, 25 bp, Mus musculus
ttccctttttggctcctgctgtcgg

SEQ ID NO: 373903 - DNA, 25 bp, Mus musculus
ctgtggaggcttgagacaggaccct

SEQ ID NO: 373904 - DNA, 25 bp, Mus musculus
ccctgcggctgcttttggacacgac

SEQ ID NO: 373905 - DNA, 25 bp, Mus musculus
cagcggagtagtgcacctgcagcct

SEQ ID NO: 373906 - DNA, 25 bp, Mus musculus
acaggaccctggtctccagcgtgtc

SEQ ID NO: 373907 - DNA, 25 bp, Mus musculus
agagggccagagaccgacaagaaca

SEQ ID NO: 373908 - DNA, 25 bp, Mus musculus
ctcacttaacatggcgccggaggct

SEQ ID NO: 373909 - DNA, 25 bp, Mus musculus
gaagttttcctagaccgccgagcta

SEQ ID NO: 373910 - DNA, 25 bp, Mus musculus
ccgagctactactcaagggagtttc

SEQ ID NO: 373911 - DNA, 25 bp, Mus musculus
ttataagctgctcctcgggcgatcc

SEQ ID NO: 373912 - DNA, 25 bp, Mus musculus
cgcacgtggatcgttgttcggtctt

SEQ ID NO: 373913 - DNA, 25 bp, Mus musculus
agcgtgtgcgaaggcttttcctctg

SEQ ID NO: 373914 - DNA, 25 bp, Mus musculus
agagcgcgcacatcgcccagaagtc

SEQ ID NO: 373915 - DNA, 25 bp, Mus musculus
cagaagtcccggttctccaagaagc

SEQ ID NO: 373916 - DNA, 25 bp, Mus musculus
gaggaaccggatccatcagaatctg

SEQ ID NO: 373917 - DNA, 25 bp, Mus musculus
gattcggggctcatacatgcttttt

SEQ ID NO: 373918 - DNA, 25 bp, Mus musculus
tcatagttaacaagattcggggctc

SEQ ID NO: 373919 - DNA, 25 bp, Mus musculus
tcgttcgacctaaaagactcggctc

SEQ ID NO: 373920 - DNA, 25 bp, Mus musculus
gttctgacttgtgtgaggctcgttc

SEQ ID NO: 373921 - DNA, 25 bp, Mus musculus
cggcgccggaagttacattccgata

SEQ ID NO: 373922 - DNA, 25 bp, Mus musculus
cggtccgtccctactgtaaagcacg

SEQ ID NO: 373923 - DNA, 25 bp, Mus musculus
gtgcatttcacataggtccagccct

SEQ ID NO: 373924 - DNA, 25 bp, Mus musculus
cgacaagcggcgtgcatttcacata

SEQ ID NO: 373925 - DNA, 25 bp, Mus musculus
ctctctaggccggaagccgacaagc

SEQ ID NO: 373926 - DNA, 25 bp, Mus musculus
ccatcatgcctctctaggccggaag

SEQ ID NO: 373927 - DNA, 25 bp, Mus musculus
ctagctagcgtgcacgcggaactcc

SEQ ID NO: 373928 - DNA, 25 bp, Mus musculus
gaaggcttcgtttccctagctagcg

SEQ ID NO: 373929 - DNA, 25 bp, Mus musculus
tccagatgctgtcgtgcaatgcggc

SEQ ID NO: 373930 - DNA, 25 bp, Mus musculus
cacagatgctgttctccagatgctg

SEQ ID NO: 373931 - DNA, 25 bp, Mus musculus
gggctctggcgcatcacagatgctg

SEQ ID NO: 373932 - DNA, 25 bp, Mus musculus
taaccagctgctgctgaggagacgc

SEQ ID NO: 373933 - DNA, 25 bp, Mus musculus
ggaggacggctttaaccagctgctg

SEQ ID NO: 373934 - DNA, 25 bp, Mus musculus
cctgtgggcacagctgttagagcgt

SEQ ID NO: 373935 - DNA, 25 bp, Mus musculus
tgccgcagagacctgtgggcacagc

SEQ ID NO: 373936 - DNA, 25 bp, Mus musculus
tctctgtcgtcgtaccgttcttgtg

SEQ ID NO: 373937 - DNA, 25 bp, Mus musculus
tcctccggagtatcgtcaggttgtc

SEQ ID NO: 373938 - DNA, 25 bp, Mus musculus
ttgcttcgggaaacggactttctga

SEQ ID NO: 373939 - DNA, 25 bp, Mus musculus
ggacccttttttgctccatagaaga

SEQ ID NO: 373940 - DNA, 25 bp, Mus musculus
ggagccgatcgccttagctcaaata

SEQ ID NO: 373941 - DNA, 25 bp, Mus musculus
cgagacgttcaccttcctgtttgca

SEQ ID NO: 373942 - DNA, 25 bp, Mus musculus
ggtccacttccggaaattgcttctc

SEQ ID NO: 373943 - DNA, 25 bp, Mus musculus
gcgcggattccgctcttaccatggc

SEQ ID NO: 373944 - DNA, 25 bp, Mus musculus
ggcactctctgagtcctgacggaaa

SEQ ID NO: 373945 - DNA, 25 bp, Mus musculus
ctccatcgctccacagagggctgtg

SEQ ID NO: 373946 - DNA, 25 bp, Mus musculus
cgggaaatcgcaacctctgacaaga

SEQ ID NO: 373947 - DNA, 25 bp, Mus musculus
tctcctcaggcgtaggctccattta

SEQ ID NO: 373948 - DNA, 25 bp, Mus musculus
ccatttagacaagaggttcggagcc

SEQ ID NO: 373949 - DNA, 25 bp, Mus musculus
ctgtttgcacttgaccgaaatgatc

SEQ ID NO: 373950 - DNA, 25 bp, Mus musculus
tgcgcttgagcgcttcctaactctc

SEQ ID NO: 373951 - DNA, 25 bp, Mus musculus
ttcttcaaccgagaccagtacggtg

SEQ ID NO: 373952 - DNA, 25 bp, Mus musculus
ggtgacgcctcagagccagacctca

SEQ ID NO: 373953 - DNA, 25 bp, Mus musculus
acgagcgccaggtacctactcgagg

SEQ ID NO: 373954 - DNA, 25 bp, Mus musculus
agtcccgggtcacatgagcatcgca

SEQ ID NO: 373955 - DNA, 25 bp, Mus musculus
tgctcacgtgacgtcctcgttcagg

SEQ ID NO: 373956 - DNA, 25 bp, Mus musculus
tcgcgccaccacagcggagtcgaag

SEQ ID NO: 373957 - DNA, 25 bp, Mus musculus
cctgcacagggcgtccaagtcgacg

SEQ ID NO: 373958 - DNA, 25 bp, Mus musculus
gcccgacttatgacagccacaagtg

SEQ ID NO: 373959 - DNA, 25 bp, Mus musculus
gagtcgcacaaagccgcccgactta

SEQ ID NO: 373960 - DNA, 25 bp, Mus musculus
gcagcgggacaaaagcccagcctta

SEQ ID NO: 373961 - DNA, 25 bp, Mus musculus
cttcaatggaaacgtgcagcgggac

SEQ ID NO: 373962 - DNA, 25 bp, Mus musculus
cccacggctggaacttcaatggaaa

SEQ ID NO: 373963 - DNA, 25 bp, Mus musculus
ctggagactgcacactagaggggac

SEQ ID NO: 373964 - DNA, 25 bp, Mus musculus
cttcagcacctcttgcaaagccgta

SEQ ID NO: 373965 - DNA, 25 bp, Mus musculus
cctctgagaggctgcgcagaagcaa

SEQ ID NO: 373966 - DNA, 25 bp, Mus musculus
tggagcgcgcctcgagcctctgaga

SEQ ID NO: 373967 - DNA, 25 bp, Mus musculus
tggatccgacctggagcgcgcctcg

SEQ ID NO: 373968 - DNA, 25 bp, Mus musculus
cgtgggttacaggtggatccgacct

SEQ ID NO: 373969 - DNA, 25 bp, Mus musculus
cttagccatggcgtgggttacaggt

SEQ ID NO: 373970 - DNA, 25 bp, Mus musculus
ccttccttagccatggcgtgggtta

SEQ ID NO: 373971 - DNA, 25 bp, Mus musculus
agcagcagtgccttccttagccatg

SEQ ID NO: 373972 - DNA, 25 bp, Mus musculus
aactccagcagcagtgccttcctta

SEQ ID NO: 373973 - DNA, 25 bp, Mus musculus
gtccatgacaactccagcagcagtg

SEQ ID NO: 373974 - DNA, 25 bp, Mus musculus
gccgtattgacgtccatgacaactc

SEQ ID NO: 373975 - DNA, 25 bp, Mus musculus
agcacctcttgcaaagccgtattga

SEQ ID NO: 373976 - DNA, 25 bp, Mus musculus
gaattcctcgcgctaggccatcgtg

SEQ ID NO: 373977 - DNA, 25 bp, Mus musculus
ttgcaaagccgtattgacgtccatg

SEQ ID NO: 373978 - DNA, 25 bp, Mus musculus
ctcctcctgcgggaatgcatttaga

SEQ ID NO: 373979 - DNA, 25 bp, Mus musculus
gcattctgtgccttcgctttatcga

SEQ ID NO: 373980 - DNA, 25 bp, Mus musculus
tatcgagcttttattttccgttggc

SEQ ID NO: 373981 - DNA, 25 bp, Mus musculus
gcaagacgcgtttctaagaatttta

SEQ ID NO: 373982 - DNA, 25 bp, Mus musculus
agatgtgcaaccaccgggacgctgc

SEQ ID NO: 373983 - DNA, 25 bp, Mus musculus
tcactatcgaaaactacctaacttc

SEQ ID NO: 373984 - DNA, 25 bp, Mus musculus
tcaagttgcaggaggcaagaagttc

SEQ ID NO: 373985 - DNA, 25 bp, Mus musculus
gatcaaaaattagacacctcgggta

SEQ ID NO: 373986 - DNA, 25 bp, Mus musculus
tgcaaccagcgccagcattctgtgc

SEQ ID NO: 373987 - DNA, 25 bp, Mus musculus
aagttcccagttctgcggaggcgga

SEQ ID NO: 373988 - DNA, 25 bp, Mus musculus
ggtggccacccagagatcaaaaatt

SEQ ID NO: 373989 - DNA, 25 bp, Mus musculus
ctgcgggtgagctttctcgttatta

SEQ ID NO: 373990 - DNA, 25 bp, Mus musculus
cccgtgttggtggtatgcagtgact

SEQ ID NO: 373991 - DNA, 25 bp, Mus musculus
ttagaggaaagtggaccgcctccgc

SEQ ID NO: 373992 - DNA, 25 bp, Mus musculus
ccctcgctctggttgtaatagccgc

SEQ ID NO: 373993 - DNA, 25 bp, Mus musculus
gtccagtaatctgagctgctatgtc

SEQ ID NO: 373994 - DNA, 25 bp, Mus musculus
ctgttccagtttttgtccagtaatc

SEQ ID NO: 373995 - DNA, 25 bp, Mus musculus
ggccatcgtaggcatactgccagta

SEQ ID NO: 373996 - DNA, 25 bp, Mus musculus
acatccgctggtaagtgtgagagcc

SEQ ID NO: 373997 - DNA, 25 bp, Mus musculus
gtgttctgccggacccgaccactag

SEQ ID NO: 373998 - DNA, 25 bp, Mus musculus
tagcggacacctacaaactgaaagg

SEQ ID NO: 373999 - DNA, 25 bp, Mus musculus
gtaggccctctctctttctgcaaca

SEQ ID NO: 374000 - DNA, 25 bp, Mus musculus
accagtgctgggttgtggttctgct

SEQ ID NO: 374001 - DNA, 25 bp, Mus musculus
ccgggaactttccatctcaggtctc

SEQ ID NO: 374002 - DNA, 25 bp, Mus musculus
tctcaggtctccttgtccggacatg

SEQ ID NO: 374003 - DNA, 25 bp, Mus musculus
tgctatgtctgctgtcgtccacgtt

SEQ ID NO: 374004 - DNA, 25 bp, Mus musculus
gggttgtgacatccgaccctgggtc

SEQ ID NO: 374005 - DNA, 25 bp, Mus musculus
cactcgagaaatctgctccgtgttc

SEQ ID NO: 374006 - DNA, 25 bp, Mus musculus
cggtgacgaaatacctcagcgagtg

SEQ ID NO: 374007 - DNA, 25 bp, Mus musculus
aggtaggccctgagtctctctgctt

SEQ ID NO: 374008 - DNA, 25 bp, Mus musculus
gtttggtgatcagcgccgccatgtc

SEQ ID NO: 374009 - DNA, 25 bp, Mus musculus
gagcagggtcctcagtgtccactcg

SEQ ID NO: 374010 - DNA, 25 bp, Mus musculus
gtcctcagtgtccactcggaaactc

SEQ ID NO: 374011 - DNA, 25 bp, Mus musculus
acgtagccgacttccatgtaccggg

SEQ ID NO: 374012 - DNA, 25 bp, Mus musculus
ttcgcgacttctgagttctgcgggc

SEQ ID NO: 374013 - DNA, 25 bp, Mus musculus
cacggcggtgacgaaatacctcagc

SEQ ID NO: 374014 - DNA, 25 bp, Mus musculus
gcaggagcagcgtgcacggtaccat

SEQ ID NO: 374015 - DNA, 25 bp, Mus musculus
ctcccacttgtgtttggtgatcagc

SEQ ID NO: 374016 - DNA, 25 bp, Mus musculus
tgcacggtaccatcgcacctgtcgg

SEQ ID NO: 374017 - DNA, 25 bp, Mus musculus
catcgcacctgtcggcgattcgcga

SEQ ID NO: 374018 - DNA, 25 bp, Mus musculus
tcggcgattcgcgacttctgagttc

SEQ ID NO: 374019 - DNA, 25 bp, Mus musculus
agccgacttccatgtaccggggctc

SEQ ID NO: 374020 - DNA, 25 bp, Mus musculus
caacttctctcaagccgggcctgag

SEQ ID NO: 374021 - DNA, 25 bp, Mus musculus
atggtgacggggcacagaccctccc

SEQ ID NO: 374022 - DNA, 25 bp, Mus musculus
gctcgggacgtccagacgcaactct

SEQ ID NO: 374023 - DNA, 25 bp, Mus musculus
agacgcaactctcggccggagccag

SEQ ID NO: 374024 - DNA, 25 bp, Mus musculus
ccggagccagagactcgagaattgc

SEQ ID NO: 374025 - DNA, 25 bp, Mus musculus
cagagactcgagaattgcgtttgga

SEQ ID NO: 374026 - DNA, 25 bp, Mus musculus
tttggacaatcaggagccgcggccc

SEQ ID NO: 374027 - DNA, 25 bp, Mus musculus
tcggggagcacacgagtgaatgtct

SEQ ID NO: 374028 - DNA, 25 bp, Mus musculus
cgtgggaaagtaggcaaagccactc

SEQ ID NO: 374029 - DNA, 25 bp, Mus musculus
aagccactccgggactcggagtgaa

SEQ ID NO: 374030 - DNA, 25 bp, Mus musculus
agcagggccataccggttgagagcc

SEQ ID NO: 374031 - DNA, 25 bp, Mus musculus
agagccggttcagagtcgggaataa

SEQ ID NO: 374032 - DNA, 25 bp, Mus musculus
ttcagagtcgggaataaggggcaca

SEQ ID NO: 374033 - DNA, 25 bp, Mus musculus
agagaccgtgatgggtattcgtccc

SEQ ID NO: 374034 - DNA, 25 bp, Mus musculus
tgaaactcagacaacagggccaggg

SEQ ID NO: 374035 - DNA, 25 bp, Mus musculus
atccgcttggaaggcagcgtgcttg

SEQ ID NO: 374036 - DNA, 25 bp, Mus musculus
ggccctgagacacatccgcttggaa

SEQ ID NO: 374037 - DNA, 25 bp, Mus musculus
ccacactagtcagaggcctttggta

SEQ ID NO: 374038 - DNA, 25 bp, Mus musculus
cggacccaatagaaaccacactagt

SEQ ID NO: 374039 - DNA, 25 bp, Mus musculus
ctaggccaatctgagcacgccgggg

SEQ ID NO: 374040 - DNA, 25 bp, Mus musculus
gtgccctgagcctaggccaatctga

SEQ ID NO: 374041 - DNA, 25 bp, Mus musculus
aacctgtgaccagggccagcgcaga

SEQ ID NO: 374042 - DNA, 25 bp, Mus musculus
agacaacagggccagggactcaagg

SEQ ID NO: 374043 - DNA, 25 bp, Mus musculus
tcacggggcgcaaagttactgaaac

SEQ ID NO: 374044 - DNA, 25 bp, Mus musculus
gccgctacccgcacctgagatggga

SEQ ID NO: 374045 - DNA, 25 bp, Mus musculus
gcgcacgctgatcgcacggccgatg

SEQ ID NO: 374046 - DNA, 25 bp, Mus musculus
ctcaaggggtggctctcgctgacat

SEQ ID NO: 374047 - DNA, 25 bp, Mus musculus
tgccgctaggcgcacgctgatcgca

SEQ ID NO: 374048 - DNA, 25 bp, Mus musculus
gagcttccgcccttcaggttcgggc

SEQ ID NO: 374049 - DNA, 25 bp, Mus musculus
ttctcggtttgctgggacgtggcac

SEQ ID NO: 374050 - DNA, 25 bp, Mus musculus
ggacgtggcactcacgcctcgagct

SEQ ID NO: 374051 - DNA, 25 bp, Mus musculus
cgcgagatccggaagctccctttct

SEQ ID NO: 374052 - DNA, 25 bp, Mus musculus
cgatacctttaccaacatggcggcg

SEQ ID NO: 374053 - DNA, 25 bp, Mus musculus
ggagctcaaggcgagacttcccgtc

SEQ ID NO: 374054 - DNA, 25 bp, Mus musculus
acttcccgtctgtacaaagatggcg

SEQ ID NO: 374055 - DNA, 25 bp, Mus musculus
gccgcgccggtgctgtcatctcagt

SEQ ID NO: 374056 - DNA, 25 bp, Mus musculus
ctgtcatctcagtgccgagccgagc

SEQ ID NO: 374057 - DNA, 25 bp, Mus musculus
cggctcttgagtcgcgctgccacag

SEQ ID NO: 374058 - DNA, 25 bp, Mus musculus
gcgtcatgtcttgggccactcgtcc

SEQ ID NO: 374059 - DNA, 25 bp, Mus musculus
tggggattagaaaagagatgcattg

SEQ ID NO: 374060 - DNA, 25 bp, Mus musculus
ccggagagcagcaagccctggagcc

SEQ ID NO: 374061 - DNA, 25 bp, Mus musculus
tgtttgtaaacacgcgccctcgacg

SEQ ID NO: 374062 - DNA, 25 bp, Mus musculus
gcatttgcagattctcgcgcactta

SEQ ID NO: 374063 - DNA, 25 bp, Mus musculus
cagctctaaagatgcgaggccaccc

SEQ ID NO: 374064 - DNA, 25 bp, Mus musculus
cccgagtgtttactgtctagccagc

SEQ ID NO: 374065 - DNA, 25 bp, Mus musculus
gcagggcaatgacacagcaacttta

SEQ ID NO: 374066 - DNA, 25 bp, Mus musculus
agctcccgtcttctggaccgcaaga

SEQ ID NO: 374067 - DNA, 25 bp, Mus musculus
ctgcacttaacatggcggccaagct

SEQ ID NO: 374068 - DNA, 25 bp, Mus musculus
tcgaacctcggtcactgcacttaac

SEQ ID NO: 374069 - DNA, 25 bp, Mus musculus
ggcctaggtcctagaactgcaacca

SEQ ID NO: 374070 - DNA, 25 bp, Mus musculus
tgcacgtctgggcaagtaaattaac

SEQ ID NO: 374071 - DNA, 25 bp, Mus musculus
ccagttctcaaggtcagatggcaaa

SEQ ID NO: 374072 - DNA, 25 bp, Mus musculus
ttaagtaggaaccaccagccagttc

SEQ ID NO: 374073 - DNA, 25 bp, Mus musculus
caggagccattttgggagctgtctc

SEQ ID NO: 374074 - DNA, 25 bp, Mus musculus
agccgatctcggcaaactttcccgg

SEQ ID NO: 374075 - DNA, 25 bp, Mus musculus
aggcgtccacatgccctaaaagccg

SEQ ID NO: 374076 - DNA, 25 bp, Mus musculus
gtttcttcttcctctaaacgccagc

SEQ ID NO: 374077 - DNA, 25 bp, Mus musculus
aaacgccagcacttctagtcagctc

SEQ ID NO: 374078 - DNA, 25 bp, Mus musculus
cagctcgagcgggttcccgggactt

SEQ ID NO: 374079 - DNA, 25 bp, Mus musculus
gagactcctgtgcagcgcggacgtc

SEQ ID NO: 374080 - DNA, 25 bp, Mus musculus
gacgtcgagagtcccaggctaggac

SEQ ID NO: 374081 - DNA, 25 bp, Mus musculus
gactctggacagctcacgctcgatg

SEQ ID NO: 374082 - DNA, 25 bp, Mus musculus
cacgctcgatggctgcgcacgtctg

SEQ ID NO: 374083 - DNA, 25 bp, Mus musculus
ctgctccttctggtggactggctgc

SEQ ID NO: 374084 - DNA, 25 bp, Mus musculus
tgcggcccatgctcccgggaatctt

SEQ ID NO: 374085 - DNA, 25 bp, Mus musculus
ctcccgggaatcttctccctgttgg

SEQ ID NO: 374086 - DNA, 25 bp, Mus musculus
cttctccctgttggttcccgaggtg

SEQ ID NO: 374087 - DNA, 25 bp, Mus musculus
gtcgctgggccatcctaggactagg

SEQ ID NO: 374088 - DNA, 25 bp, Mus musculus
ccatcctaggactaggggtccgcgg

SEQ ID NO: 374089 - DNA, 25 bp, Mus musculus
cgtgtctagtgattcgaggtcggct

SEQ ID NO: 374090 - DNA, 25 bp, Mus musculus
gagaagaagcagattccagaagctc

SEQ ID NO: 374091 - DNA, 25 bp, Mus musculus
gtcccaagccatctaaggctaccga

SEQ ID NO: 374092 - DNA, 25 bp, Mus musculus
tgtcttgggtcttctgccgcttact

SEQ ID NO: 374093 - DNA, 25 bp, Mus musculus
caaacccttggcgtcatcatccggt

SEQ ID NO: 374094 - DNA, 25 bp, Mus musculus
agagttagcaggagtgcggcccatt

SEQ ID NO: 374095 - DNA, 25 bp, Mus musculus
ttttggatagaacccgagagttagc

SEQ ID NO: 374096 - DNA, 25 bp, Mus musculus
ttccagaagctctcctgagctgccg

SEQ ID NO: 374097 - DNA, 25 bp, Mus musculus
tccagtttgagaagaagcagattcc

SEQ ID NO: 374098 - DNA, 25 bp, Mus musculus
tgcgcacccaggagatccagtttga

SEQ ID NO: 374099 - DNA, 25 bp, Mus musculus
gtgaaagcgaaagccgcgggaccca

SEQ ID NO: 374100 - DNA, 25 bp, Mus musculus
gcagtgaagtgaaagcgaaagccgc

SEQ ID NO: 374101 - DNA, 25 bp, Mus musculus
agcaccgcgaccacggcagtgaagt

SEQ ID NO: 374102 - DNA, 25 bp, Mus musculus
cccgcaaattgacaggcgccatctg

SEQ ID NO: 374103 - DNA, 25 bp, Mus musculus
agccgcaggtgagttcttttggata

SEQ ID NO: 374104 - DNA, 25 bp, Mus musculus
ccagccggagatcctggagcgaacg

SEQ ID NO: 374105 - DNA, 25 bp, Mus musculus
cgcagggcatttcgtgtaccagttc

SEQ ID NO: 374106 - DNA, 25 bp, Mus musculus
cgtttgcgtttcctgaggcgtattc

SEQ ID NO: 374107 - DNA, 25 bp, Mus musculus
ctgaggcgtattcttgtgaggacga

SEQ ID NO: 374108 - DNA, 25 bp, Mus musculus
tattcttgtgaggacgagcccggtc

SEQ ID NO: 374109 - DNA, 25 bp, Mus musculus
gcggcgaaaagactgcccggcccga

SEQ ID NO: 374110 - DNA, 25 bp, Mus musculus
tgaccgcgtccgtccgcagggcatt

SEQ ID NO: 374111 - DNA, 25 bp, Mus musculus
tgtaccagttcatgggcgagtgcta

SEQ ID NO: 374112 - DNA, 25 bp, Mus musculus
ggcgagtgctacttcaccaacggga

SEQ ID NO: 374113 - DNA, 25 bp, Mus musculus
tgctacttcaccaacgggacgcagc

SEQ ID NO: 374114 - DNA, 25 bp, Mus musculus
gggacgcagcgcatacgatatgtga

SEQ ID NO: 374115 - DNA, 25 bp, Mus musculus
tgcagacacaactacgaggggccgg

SEQ ID NO: 374116 - DNA, 25 bp, Mus musculus
accagatacatctacaaccgggagg

SEQ ID NO: 374117 - DNA, 25 bp, Mus musculus
cgcatacgatatgtgaccagataca

SEQ ID NO: 374118 - DNA, 25 bp, Mus musculus
caacctggaggagaacctgcgcttc

SEQ ID NO: 374119 - DNA, 25 bp, Mus musculus
cgcgtgcggcttctggaaagatact

SEQ ID NO: 374120 - DNA, 25 bp, Mus musculus
tctcggataaattccttgtgcggcg

SEQ ID NO: 374121 - DNA, 25 bp, Mus musculus
tgagatctcggataaattccttgtg

SEQ ID NO: 374122 - DNA, 25 bp, Mus musculus
agacacaactatgagatctcggata

SEQ ID NO: 374123 - DNA, 25 bp, Mus musculus
gtgcagacacaactatgagatctcg

SEQ ID NO: 374124 - DNA, 25 bp, Mus musculus
ggaggagaacctgcgcttcgacagc

SEQ ID NO: 374125 - DNA, 25 bp, Mus musculus
gccagccggagttcctggagcaaaa

SEQ ID NO: 374126 - DNA, 25 bp, Mus musculus
tctacaacctggaggagaacctgcg

SEQ ID NO: 374127 - DNA, 25 bp, Mus musculus
tacttctacaacctggaggagaacc

SEQ ID NO: 374128 - DNA, 25 bp, Mus musculus
gaaagatacttctacaacctggagg

SEQ ID NO: 374129 - DNA, 25 bp, Mus musculus
ctggaaagatacttctacaacctgg

SEQ ID NO: 374130 - DNA, 25 bp, Mus musculus
cggcttctggaaagatacttctaca

SEQ ID NO: 374131 - DNA, 25 bp, Mus musculus
cgtgcggcttctggaaagatacttc

SEQ ID NO: 374132 - DNA, 25 bp, Mus musculus
acttggcgactagtctgcggcggac

SEQ ID NO: 374133 - DNA, 25 bp, Mus musculus
tagtctgcggcggacgtgacgccaa

SEQ ID NO: 374134 - DNA, 25 bp, Mus musculus
cgcttgcggacttggcgactagtct

SEQ ID NO: 374135 - DNA, 25 bp, Mus musculus
gcaggatgattctgctggtggtcct

SEQ ID NO: 374136 - DNA, 25 bp, Mus musculus
cggcagctggcaggatgattctgct

SEQ ID NO: 374137 - DNA, 25 bp, Mus musculus
ggtcctgatgctgtctgcgaaggtc

SEQ ID NO: 374138 - DNA, 25 bp, Mus musculus
ggagctttgacgagcactgaggatc

SEQ ID NO: 374139 - DNA, 25 bp, Mus musculus
ttgacgagcactgaggatcctgagc

SEQ ID NO: 374140 - DNA, 25 bp, Mus musculus
ggatcctgagcctccctcgggtaat

SEQ ID NO: 374141 - DNA, 25 bp, Mus musculus
ctcgggtaatctctccgagccgctg

SEQ ID NO: 374142 - DNA, 25 bp, Mus musculus
gctgggaagtccctgcgttcctgct

SEQ ID NO: 374143 - DNA, 25 bp, Mus musculus
gctccgcggtttacacgccgctttc

SEQ ID NO: 374144 - DNA, 25 bp, Mus musculus
tgacgccaaggccaggccacgggca

SEQ ID NO: 374145 - DNA, 25 bp, Mus musculus
cctgtcagaggtgtccctcgcgcag

SEQ ID NO: 374146 - DNA, 25 bp, Mus musculus
ccggcgtccgcaaggacacagcgaa

SEQ ID NO: 374147 - DNA, 25 bp, Mus musculus
gcatcctgggaaggcaacgtctccc

SEQ ID NO: 374148 - DNA, 25 bp, Mus musculus
acgccgcccgacacaacattattga

SEQ ID NO: 374149 - DNA, 25 bp, Mus musculus
ccaaattggtagaggccgcgtgctt

SEQ ID NO: 374150 - DNA, 25 bp, Mus musculus
tttatgcgaaccaacggaggtattc

SEQ ID NO: 374151 - DNA, 25 bp, Mus musculus
ggcatcgaaacagacctccgtccgg

SEQ ID NO: 374152 - DNA, 25 bp, Mus musculus
agagcctcgtggtacttctcctcgg

SEQ ID NO: 374153 - DNA, 25 bp, Mus musculus
cctcggtggcgttgagattgttcac

SEQ ID NO: 374154 - DNA, 25 bp, Mus musculus
tgctgtggtgcagctgcatgatctg

SEQ ID NO: 374155 - DNA, 25 bp, Mus musculus
atctgcgcgttaatgtgtggctcca

SEQ ID NO: 374156 - DNA, 25 bp, Mus musculus
ctccagcgcgccatagtcgtaaggc

SEQ ID NO: 374157 - DNA, 25 bp, Mus musculus
tcaagtactttcgtgaggtcctgtg

SEQ ID NO: 374158 - DNA, 25 bp, Mus musculus
attgaggtttacacgaccgctgctc

SEQ ID NO: 374159 - DNA, 25 bp, Mus musculus
cctcctgcccgtgctgagaggaaca

SEQ ID NO: 374160 - DNA, 25 bp, Mus musculus
gcatcacaggatgactggcctcgcg

SEQ ID NO: 374161 - DNA, 25 bp, Mus musculus
aacagacgccgcttttcctggcagc

SEQ ID NO: 374162 - DNA, 25 bp, Mus musculus
gctttcgggtctcctccgcaggaac

SEQ ID NO: 374163 - DNA, 25 bp, Mus musculus
caggggaatccaacaggctccaagg

SEQ ID NO: 374164 - DNA, 25 bp, Mus musculus
cccaggacagtagggtgagccacgt

SEQ ID NO: 374165 - DNA, 25 bp, Mus musculus
ctccaggctggagcggataaagatg

SEQ ID NO: 374166 - DNA, 25 bp, Mus musculus
catgacgtcaccagggcaacacttg

SEQ ID NO: 374167 - DNA, 25 bp, Mus musculus
ggggtcccaccgatccagaacaata

SEQ ID NO: 374168 - DNA, 25 bp, Mus musculus
agtcactgggacctgctaacgctgc

SEQ ID NO: 374169 - DNA, 25 bp, Mus musculus
cagctcccacgtggtaccctagaaa

SEQ ID NO: 374170 - DNA, 25 bp, Mus musculus
ggccgctgctgtgaacaacgcccga

SEQ ID NO: 374171 - DNA, 25 bp, Mus musculus
ggcaacacttgcagccgactgtcgg

SEQ ID NO: 374172 - DNA, 25 bp, Mus musculus
ttcccgcctctgaagaatccaagta

SEQ ID NO: 374173 - DNA, 25 bp, Mus musculus
aaactgcactgcactgggccgctgc

SEQ ID NO: 374174 - DNA, 25 bp, Mus musculus
gacatcggggacattctgcaacaga

SEQ ID NO: 374175 - DNA, 25 bp, Mus musculus
ccagggccctctctggatcttgcaa

SEQ ID NO: 374176 - DNA, 25 bp, Mus musculus
cgcggctcctaccacgtacctcctc

SEQ ID NO: 374177 - DNA, 25 bp, Mus musculus
ctctctccggctaccattttctccg

SEQ ID NO: 374178 - DNA, 25 bp, Mus musculus
gtctccccttcagtgccggggtgaa

SEQ ID NO: 374179 - DNA, 25 bp, Mus musculus
cccagctatggacgagcggctgctg

SEQ ID NO: 374180 - DNA, 25 bp, Mus musculus
agggaagcaagacatcggggacatt

SEQ ID NO: 374181 - DNA, 25 bp, Mus musculus
gaagcaagacatcggggacattctg

SEQ ID NO: 374182 - DNA, 25 bp, Mus musculus
gggccctctctggatcttgcaactc

SEQ ID NO: 374183 - DNA, 25 bp, Mus musculus
catcggggacattctgcaacagata

SEQ ID NO: 374184 - DNA, 25 bp, Mus musculus
ctgcaacagataatgaccatcacgg

SEQ ID NO: 374185 - DNA, 25 bp, Mus musculus
taatgaccatcacggaccagagcct

SEQ ID NO: 374186 - DNA, 25 bp, Mus musculus
cccgctcacagctctgagtcctctg

SEQ ID NO: 374187 - DNA, 25 bp, Mus musculus
cggggacattctgcaacagataatg

SEQ ID NO: 374188 - DNA, 25 bp, Mus musculus
ttacattcgaaggtcgcgctcgccc

SEQ ID NO: 374189 - DNA, 25 bp, Mus musculus
tcggattctcaccaatacaggtggc

SEQ ID NO: 374190 - DNA, 25 bp, Mus musculus
tgactcggattctcaccaatacagg

SEQ ID NO: 374191 - DNA, 25 bp, Mus musculus
tgccatggcaagttctgcttcgccc

SEQ ID NO: 374192 - DNA, 25 bp, Mus musculus
ccgctcgcgatttggcccttcgggg

SEQ ID NO: 374193 - DNA, 25 bp, Mus musculus
atattacattcgaaggtcgcgctcg

SEQ ID NO: 374194 - DNA, 25 bp, Mus musculus
tgtctccagacatatattacattcg

SEQ ID NO: 374195 - DNA, 25 bp, Mus musculus
gcgagctgtctccagacatatatta

SEQ ID NO: 374196 - DNA, 25 bp, Mus musculus
gcttcgcgagctgtctccagacata

SEQ ID NO: 374197 - DNA, 25 bp, Mus musculus
acgctgaccacagcttcgcgagctg

SEQ ID NO: 374198 - DNA, 25 bp, Mus musculus
tacaggtggccacacacgctgacca

SEQ ID NO: 374199 - DNA, 25 bp, Mus musculus
tgctgccatggcaagttctgcttcg

SEQ ID NO: 374200 - DNA, 25 bp, Mus musculus
tcaccaatacaggtggccacacacg

SEQ ID NO: 374201 - DNA, 25 bp, Mus musculus
ttcctccgctgctgccatggcaagt

SEQ ID NO: 374202 - DNA, 25 bp, Mus musculus
gcccggactctctccgcttgattgg

SEQ ID NO: 374203 - DNA, 25 bp, Mus musculus
ggaagaatgagcatgcgcaataagc

SEQ ID NO: 374204 - DNA, 25 bp, Mus musculus
ctccctctcggagaagcggggagca

SEQ ID NO: 374205 - DNA, 25 bp, Mus musculus
gggcgtggaataggccaacccagac

SEQ ID NO: 374206 - DNA, 25 bp, Mus musculus
ccaacccagacgaaggcggtgtcga

SEQ ID NO: 374207 - DNA, 25 bp, Mus musculus
ccctccgctattggcggggccttag

SEQ ID NO: 374208 - DNA, 25 bp, Mus musculus
cttaggttcaaaggcctcgactcgg

SEQ ID NO: 374209 - DNA, 25 bp, Mus musculus
ctcgactcggccttatccgggtctt

SEQ ID NO: 374210 - DNA, 25 bp, Mus musculus
ttactccgccgctgattggccgaga

SEQ ID NO: 374211 - DNA, 25 bp, Mus musculus
ctgattggccgagatctggagagac

SEQ ID NO: 374212 - DNA, 25 bp, Mus musculus
agaagtaccagggtcgcagggttca

SEQ ID NO: 374213 - DNA, 25 bp, Mus musculus
agggttcaagatggctccggcctcc

SEQ ID NO: 374214 - DNA, 25 bp, Mus musculus
tccggcctccttgggtgacgtagag

SEQ ID NO: 374215 - DNA, 25 bp, Mus musculus
ctccgcttgattgggcggtttactc

SEQ ID NO: 374216 - DNA, 25 bp, Mus musculus
gaggagatgcgggtctctgaagagg

SEQ ID NO: 374217 - DNA, 25 bp, Mus musculus
cccggcaggcatggggaggagatgc

SEQ ID NO: 374218 - DNA, 25 bp, Mus musculus
gggccagcgagaggcccggcaggca

SEQ ID NO: 374219 - DNA, 25 bp, Mus musculus
cgccactgagctccctggggcgggg

SEQ ID NO: 374220 - DNA, 25 bp, Mus musculus
cccgagcgatgaggctgaccgaggc

SEQ ID NO: 374221 - DNA, 25 bp, Mus musculus
aaccggtggcccgagcgatgaggct

SEQ ID NO: 374222 - DNA, 25 bp, Mus musculus
ttcagagagcgtgcgagcgaagcta

SEQ ID NO: 374223 - DNA, 25 bp, Mus musculus
tgctgaaaccggtggcccgagcgat

SEQ ID NO: 374224 - DNA, 25 bp, Mus musculus
tcaccggtgctgaaaccggtggccc

SEQ ID NO: 374225 - DNA, 25 bp, Mus musculus
gagccggggtcaccggtgctgaaac

SEQ ID NO: 374226 - DNA, 25 bp, Mus musculus
cagaggaatagagcagcgagggagc

SEQ ID NO: 374227 - DNA, 25 bp, Mus musculus
acggggcagaggaatagagcagcga

SEQ ID NO: 374228 - DNA, 25 bp, Mus musculus
agagagcgtgcgagcgaagctagac

SEQ ID NO: 374229 - DNA, 25 bp, Mus musculus
ctctgaagaggcgattggcgaggcc

SEQ ID NO: 374230 - DNA, 25 bp, Mus musculus
acccgacccttatctgcaggagact

SEQ ID NO: 374231 - DNA, 25 bp, Mus musculus
tcccgcgcttaggagcaggtggcct

SEQ ID NO: 374232 - DNA, 25 bp, Mus musculus
tgcggccagtgctcaacgcggtcct

SEQ ID NO: 374233 - DNA, 25 bp, Mus musculus
gccagtgctcaacgcggtccttcgt

SEQ ID NO: 374234 - DNA, 25 bp, Mus musculus
gtgctcaacgcggtccttcgtcttc

SEQ ID NO: 374235 - DNA, 25 bp, Mus musculus
accctcccgcgcttaggagcaggtg

SEQ ID NO: 374236 - DNA, 25 bp, Mus musculus
cgtcttccgccacgctaccgcggcc

SEQ ID NO: 374237 - DNA, 25 bp, Mus musculus
cgacccttatctgcaggagactcgc

SEQ ID NO: 374238 - DNA, 25 bp, Mus musculus
cccttatctgcaggagactcgcttc

SEQ ID NO: 374239 - DNA, 25 bp, Mus musculus
tatctgcaggagactcgcttcgagg

SEQ ID NO: 374240 - DNA, 25 bp, Mus musculus
gcaggagactcgcttcgagggtcca

SEQ ID NO: 374241 - DNA, 25 bp, Mus musculus
agactcgcttcgagggtccacttcc

SEQ ID NO: 374242 - DNA, 25 bp, Mus musculus
ccgggcttcgtggttcccacgcacg

SEQ ID NO: 374243 - DNA, 25 bp, Mus musculus
ggtccttcgtcttccgccacgctac

SEQ ID NO: 374244 - DNA, 25 bp, Mus musculus
gtagtcatcatcatcgccgcccagc

SEQ ID NO: 374245 - DNA, 25 bp, Mus musculus
cgccgctggacgtccagacatcata

SEQ ID NO: 374246 - DNA, 25 bp, Mus musculus
gatttggtgtctgccgagatcgctt

SEQ ID NO: 374247 - DNA, 25 bp, Mus musculus
tgtctgccgagatcgcttcacgcga

SEQ ID NO: 374248 - DNA, 25 bp, Mus musculus
gcttcacgcgaagcccggaatttct

SEQ ID NO: 374249 - DNA, 25 bp, Mus musculus
aagcccggaatttctccttcatctc

SEQ ID NO: 374250 - DNA, 25 bp, Mus musculus
atctccctggccgtgggcatcgcag

SEQ ID NO: 374251 - DNA, 25 bp, Mus musculus
cagcaccacgaaaactactgggatc

SEQ ID NO: 374252 - DNA, 25 bp, Mus musculus
tgtaccatcctcactgtagtcatca

SEQ ID NO: 374253 - DNA, 25 bp, Mus musculus
tttggcccgcggagatttggtgtct

SEQ ID NO: 374254 - DNA, 25 bp, Mus musculus
ggtgctttgtaccatcctcactgta

SEQ ID NO: 374255 - DNA, 25 bp, Mus musculus
gtgggcatcgcagccatggtgcttt

SEQ ID NO: 374256 - DNA, 25 bp, Mus musculus
gacgtccagacatcataaactccgc

SEQ ID NO: 374257 - DNA, 25 bp, Mus musculus
agttctgccgcctacccaacgcgcg

SEQ ID NO: 374258 - DNA, 25 bp, Mus musculus
aagaccttggtctcccgtgggagca

SEQ ID NO: 374259 - DNA, 25 bp, Mus musculus
gccgagcccatcctccgagggagag

SEQ ID NO: 374260 - DNA, 25 bp, Mus musculus
acaacctgctgagtccggaggactg

SEQ ID NO: 374261 - DNA, 25 bp, Mus musculus
gcttcttcaccgacaacctgctgag

SEQ ID NO: 374262 - DNA, 25 bp, Mus musculus
agtgagatcgccgacccgacgcgct

SEQ ID NO: 374263 - DNA, 25 bp, Mus musculus
ggagctgatgctcctcagtgagatc

SEQ ID NO: 374264 - DNA, 25 bp, Mus musculus
cctcagcgagctcatggatttgccg

SEQ ID NO: 374265 - DNA, 25 bp, Mus musculus
tggtcatcaggacttccgggacgcc

SEQ ID NO: 374266 - DNA, 25 bp, Mus musculus
caactaagcctctgactggtcatca

SEQ ID NO: 374267 - DNA, 25 bp, Mus musculus
cgtgtcacgtgttcaccaactaagc

SEQ ID NO: 374268 - DNA, 25 bp, Mus musculus
agtcattgctccttcgtgtcacgtg

SEQ ID NO: 374269 - DNA, 25 bp, Mus musculus
tggcccggcatgcacagtcattgct

SEQ ID NO: 374270 - DNA, 25 bp, Mus musculus
gcacagtctcgcctggatcggtaaa

SEQ ID NO: 374271 - DNA, 25 bp, Mus musculus
ggtaaagcggctgacccgtgccatt

SEQ ID NO: 374272 - DNA, 25 bp, Mus musculus
tactctggcgacgactgcagcactc

SEQ ID NO: 374273 - DNA, 25 bp, Mus musculus
tactcgggcgaagactgtagcacgc

SEQ ID NO: 374274 - DNA, 25 bp, Mus musculus
gggaatgtatctgtgacgcaggcta

SEQ ID NO: 374275 - DNA, 25 bp, Mus musculus
acgcaggctacagtggcgacgactg

SEQ ID NO: 374276 - DNA, 25 bp, Mus musculus
gactgtaaccaaaggggccactgtg

SEQ ID NO: 374277 - DNA, 25 bp, Mus musculus
cctgggtacacaggccgagactgtg

SEQ ID NO: 374278 - DNA, 25 bp, Mus musculus
gcagctgtcccagcgactgcagagg

SEQ ID NO: 374279 - DNA, 25 bp, Mus musculus
gccagtgcctgaatgggctctgcga

SEQ ID NO: 374280 - DNA, 25 bp, Mus musculus
gcttgtgcatgtgccacgcaggcta

SEQ ID NO: 374281 - DNA, 25 bp, Mus musculus
tatgcgggcgaagactgcagcattc

SEQ ID NO: 374282 - DNA, 25 bp, Mus musculus
gcatgtgccactcgaacctgtccag

SEQ ID NO: 374283 - DNA, 25 bp, Mus musculus
acctgtccagctgattgtcgtggcc

SEQ ID NO: 374284 - DNA, 25 bp, Mus musculus
gtgtgcatgtgctacgttggctaca

SEQ ID NO: 374285 - DNA, 25 bp, Mus musculus
tatactggagcggactgtagcacgc

SEQ ID NO: 374286 - DNA, 25 bp, Mus musculus
ttcacctgcagggagattccgcctc

SEQ ID NO: 374287 - DNA, 25 bp, Mus musculus
catctcggttgggtaggcggaacgg

SEQ ID NO: 374288 - DNA, 25 bp, Mus musculus
tgcatcccccatctcggttgggtag

SEQ ID NO: 374289 - DNA, 25 bp, Mus musculus
cggccttttcccctcatcctgcatc

SEQ ID NO: 374290 - DNA, 25 bp, Mus musculus
gtccggactgatcccagcccggcct

SEQ ID NO: 374291 - DNA, 25 bp, Mus musculus
tgcacccgcggggtccggactgatc

SEQ ID NO: 374292 - DNA, 25 bp, Mus musculus
cccggctcggtcctttgcacccgcg

SEQ ID NO: 374293 - DNA, 25 bp, Mus musculus
tggctcttcacctgcagggagattc

SEQ ID NO: 374294 - DNA, 25 bp, Mus musculus
ggctcttcacctgcagggagattcc

SEQ ID NO: 374295 - DNA, 25 bp, Mus musculus
gctcttcacctgcagggagattccg

SEQ ID NO: 374296 - DNA, 25 bp, Mus musculus
ctcttcacctgcagggagattccgc

SEQ ID NO: 374297 - DNA, 25 bp, Mus musculus
tcttcacctgcagggagattccgcc

SEQ ID NO: 374298 - DNA, 25 bp, Mus musculus
ccgcctcccggctcggtcctttgca

SEQ ID NO: 374299 - DNA, 25 bp, Mus musculus
acctgcagggagattccgcctcccg

SEQ ID NO: 374300 - DNA, 25 bp, Mus musculus
agctcttcgctaccttggctcttca

SEQ ID NO: 374301 - DNA, 25 bp, Mus musculus
ggggcagctcttcgctaccttggct

SEQ ID NO: 374302 - DNA, 25 bp, Mus musculus
ccggcctgtctctgaggatcggcga

SEQ ID NO: 374303 - DNA, 25 bp, Mus musculus
cgagtcccggcctgtctctgaggat

SEQ ID NO: 374304 - DNA, 25 bp, Mus musculus
tcaactaggagtcgctgccgagtcc

SEQ ID NO: 374305 - DNA, 25 bp, Mus musculus
gcggcgcccaggctcaactaggagt

SEQ ID NO: 374306 - DNA, 25 bp, Mus musculus
gcttggaggagtccgcttcggaacc

SEQ ID NO: 374307 - DNA, 25 bp, Mus musculus
ccgaccaggcttggaggagtccgct

SEQ ID NO: 374308 - DNA, 25 bp, Mus musculus
aagttgctggccgaccaggcttgga

SEQ ID NO: 374309 - DNA, 25 bp, Mus musculus
gacgcccagacctccgtgtccagcg

SEQ ID NO: 374310 - DNA, 25 bp, Mus musculus
gttgcatcgaaagcgccgacgcgga

SEQ ID NO: 374311 - DNA, 25 bp, Mus musculus
cgcctgggagttgcatcgaaagcgc

SEQ ID NO: 374312 - DNA, 25 bp, Mus musculus
tttctgctacgctcagagcgcctgg

SEQ ID NO: 374313 - DNA, 25 bp, Mus musculus
cgttcatttctgctacgctcagagc

SEQ ID NO: 374314 - DNA, 25 bp, Mus musculus
cgtggggtaacctgacgactgaact

SEQ ID NO: 374315 - DNA, 25 bp, Mus musculus
ctgaacgcactgtccgcttgccgaa

SEQ ID NO: 374316 - DNA, 25 bp, Mus musculus
ctgactgtggatggttctgaacgca

SEQ ID NO: 374317 - DNA, 25 bp, Mus musculus
cagccgacggctcactgattgtgtc

SEQ ID NO: 374318 - DNA, 25 bp, Mus musculus
cacccgaaaccggaggtgctgggca

SEQ ID NO: 374319 - DNA, 25 bp, Mus musculus
tccgatggtgcacacccggtgacta

SEQ ID NO: 374320 - DNA, 25 bp, Mus musculus
ccagaacaccaggaagcgggactcg

SEQ ID NO: 374321 - DNA, 25 bp, Mus musculus
aagcgtcatcaaacagcgggtgccc

SEQ ID NO: 374322 - DNA, 25 bp, Mus musculus
gcgcgctacatccatgagttcttga

SEQ ID NO: 374323 - DNA, 25 bp, Mus musculus
acttacgcatcggtggcgcgctaca

SEQ ID NO: 374324 - DNA, 25 bp, Mus musculus
gcatcacttgcgaacccacggctat

SEQ ID NO: 374325 - DNA, 25 bp, Mus musculus
tacaggacctggagcatcacttgcg

SEQ ID NO: 374326 - DNA, 25 bp, Mus musculus
gcttccgcggcacagtacaggacct

SEQ ID NO: 374327 - DNA, 25 bp, Mus musculus
tgacgactgaactgagccgcttccg

SEQ ID NO: 374328 - DNA, 25 bp, Mus musculus
ttccggcacgatgcgcggaagcatc

SEQ ID NO: 374329 - DNA, 25 bp, Mus musculus
aaataaaggttctcgccagcgctgc

SEQ ID NO: 374330 - DNA, 25 bp, Mus musculus
caagaacggcgacggcttctaagtc

SEQ ID NO: 374331 - DNA, 25 bp, Mus musculus
cgcttaagcatgaagccgctgtctc

SEQ ID NO: 374332 - DNA, 25 bp, Mus musculus
tttcccgttaggcagagcggtttgc

SEQ ID NO: 374333 - DNA, 25 bp, Mus musculus
agcgccattttgtggctgcgagacc

SEQ ID NO: 374334 - DNA, 25 bp, Mus musculus
catcctgagctgtgagactgcctgg

SEQ ID NO: 374335 - DNA, 25 bp, Mus musculus
tacttccgtccctgacggcagggga

SEQ ID NO: 374336 - DNA, 25 bp, Mus musculus
cctagacccggggaaatgcactccg

SEQ ID NO: 374337 - DNA, 25 bp, Mus musculus
ctgcgagacccgcaaataaaggttc

SEQ ID NO: 374338 - DNA, 25 bp, Mus musculus
tttcctccctcagcgccattttgtg

SEQ ID NO: 374339 - DNA, 25 bp, Mus musculus
tcccgagatgcctcgcgggtgacct

SEQ ID NO: 374340 - DNA, 25 bp, Mus musculus
caatcacgcgcttgtcggctcggat

SEQ ID NO: 374341 - DNA, 25 bp, Mus musculus
gactgcctggaagagccaatcacgc

SEQ ID NO: 374342 - DNA, 25 bp, Mus musculus
gggcagtccctttactgcggacaca

SEQ ID NO: 374343 - DNA, 25 bp, Mus musculus
agaccgcgtcttccggcacagaata

SEQ ID NO: 374344 - DNA, 25 bp, Mus musculus
gtttgcatccttctccggcttctga

SEQ ID NO: 374345 - DNA, 25 bp, Mus musculus
cgtcatcagaaacagcaactccgtg

SEQ ID NO: 374346 - DNA, 25 bp, Mus musculus
agtttgatgacgaaggcagcctcac

SEQ ID NO: 374347 - DNA, 25 bp, Mus musculus
cacagaataatgacgacgggccctc

SEQ ID NO: 374348 - DNA, 25 bp, Mus musculus
tgcgattcataacccggatttcagg

SEQ ID NO: 374349 - DNA, 25 bp, Mus musculus
caggagccgtctcttgcgattcata

SEQ ID NO: 374350 - DNA, 25 bp, Mus musculus
gttcttaaaggatccgctctcacgg

SEQ ID NO: 374351 - DNA, 25 bp, Mus musculus
ccatggttacctgctcttgttctta

SEQ ID NO: 374352 - DNA, 25 bp, Mus musculus
ctgacacgcagagcccaaacctgga

SEQ ID NO: 374353 - DNA, 25 bp, Mus musculus
gttgccatggttactaccctaggtc

SEQ ID NO: 374354 - DNA, 25 bp, Mus musculus
ctcgcaggacctcatggaacccaga

SEQ ID NO: 374355 - DNA, 25 bp, Mus musculus
ccggggaaacagcttcacgagctcc

SEQ ID NO: 374356 - DNA, 25 bp, Mus musculus
ccctttacgtcatcgccgcgagcca

SEQ ID NO: 374357 - DNA, 25 bp, Mus musculus
gcggaagttgaaattacttccgaca

SEQ ID NO: 374358 - DNA, 25 bp, Mus musculus
cgaagcctgactcggagccgggcaa

SEQ ID NO: 374359 - DNA, 25 bp, Mus musculus
actcatagtaaccacggagccggcc

SEQ ID NO: 374360 - DNA, 25 bp, Mus musculus
gtcactgcgactcgccgccttggtt

SEQ ID NO: 374361 - DNA, 25 bp, Mus musculus
tcaggtgagggcttcgtctcacatc

SEQ ID NO: 374362 - DNA, 25 bp, Mus musculus
gggcttcgtctcacatctttcgcgc

SEQ ID NO: 374363 - DNA, 25 bp, Mus musculus
tctggttgcccagatagcgctacgc

SEQ ID NO: 374364 - DNA, 25 bp, Mus musculus
cggtaaactcatagtaaccacggag

SEQ ID NO: 374365 - DNA, 25 bp, Mus musculus
gttgcccagatagcgctacgcgggc

SEQ ID NO: 374366 - DNA, 25 bp, Mus musculus
gtctccatcatcctggagccgcggc

SEQ ID NO: 374367 - DNA, 25 bp, Mus musculus
catcggaccccgaggttggctgacc

SEQ ID NO: 374368 - DNA, 25 bp, Mus musculus
ttggctgacctaaccccattgggca

SEQ ID NO: 374369 - DNA, 25 bp, Mus musculus
ccgggcggaagtcactgcgactcgc

SEQ ID NO: 374370 - DNA, 25 bp, Mus musculus
gaggcccgactgtccagccctttaa

SEQ ID NO: 374371 - DNA, 25 bp, Mus musculus
gcctccgacagccagagacctttgt

SEQ ID NO: 374372 - DNA, 25 bp, Mus musculus
tgcctggccacgaggccgcaacgtt

SEQ ID NO: 374373 - DNA, 25 bp, Mus musculus
ctggggtggaagtcctgcgcttcca

SEQ ID NO: 374374 - DNA, 25 bp, Mus musculus
tcccgccacaatggcctctggggtg

SEQ ID NO: 374375 - DNA, 25 bp, Mus musculus
gaccgcgcctccttggaattgggga

SEQ ID NO: 374376 - DNA, 25 bp, Mus musculus
tttatccattctcccgtgggcgcgc

SEQ ID NO: 374377 - DNA, 25 bp, Mus musculus
gagttgcaatcctctggttttttcc

SEQ ID NO: 374378 - DNA, 25 bp, Mus musculus
gaaaaatcagcacgcggaaccgggc

SEQ ID NO: 374379 - DNA, 25 bp, Mus musculus
ctgtccagccctttaaccgcgtggg

SEQ ID NO: 374380 - DNA, 25 bp, Mus musculus
gcggtgtggagcgtatttccgctct

SEQ ID NO: 374381 - DNA, 25 bp, Mus musculus
ccgctctggcggacaaataatcctg

SEQ ID NO: 374382 - DNA, 25 bp, Mus musculus
gcaacgttgcggaacatgaaccagc

SEQ ID NO: 374383 - DNA, 25 bp, Mus musculus
ccttggaacactcggcacgagctgc

SEQ ID NO: 374384 - DNA, 25 bp, Mus musculus
tcgtgcaatgctccgggggtgcaac

SEQ ID NO: 374385 - DNA, 25 bp, Mus musculus
ggaagcgcgcgctcgtgcaatgctc

SEQ ID NO: 374386 - DNA, 25 bp, Mus musculus
agcgcgcgctcgtgcaatgctccgg

SEQ ID NO: 374387 - DNA, 25 bp, Mus musculus
ggggcccgagccgaacttacagcaa

SEQ ID NO: 374388 - DNA, 25 bp, Mus musculus
gggcccgagccgaacttacagcaaa

SEQ ID NO: 374389 - DNA, 25 bp, Mus musculus
ggcccgagccgaacttacagcaaac

SEQ ID NO: 374390 - DNA, 25 bp, Mus musculus
ccgagccgaacttacagcaaaccag

SEQ ID NO: 374391 - DNA, 25 bp, Mus musculus
cgagccgaacttacagcaaaccagg

SEQ ID NO: 374392 - DNA, 25 bp, Mus musculus
gagccgaacttacagcaaaccaggg

SEQ ID NO: 374393 - DNA, 25 bp, Mus musculus
agccgaacttacagcaaaccagggg

SEQ ID NO: 374394 - DNA, 25 bp, Mus musculus
gaacttacagcaaaccagggggcca

SEQ ID NO: 374395 - DNA, 25 bp, Mus musculus
tacagcaaaccagggggccaacacc

SEQ ID NO: 374396 - DNA, 25 bp, Mus musculus
agtgggcgccgagtcgcacgtgccg

SEQ ID NO: 374397 - DNA, 25 bp, Mus musculus
aagcgcgcgctcgtgcaatgctccg

SEQ ID NO: 374398 - DNA, 25 bp, Mus musculus
ccaagaggtaagacggctcctctgc

SEQ ID NO: 374399 - DNA, 25 bp, Mus musculus
ctgtgtagaccgcatgtgcgcacgc

SEQ ID NO: 374400 - DNA, 25 bp, Mus musculus
ttcactgtgtagaccgcatgtgcgc

SEQ ID NO: 374401 - DNA, 25 bp, Mus musculus
ctcgtgcatgttcactgtgtagacc

SEQ ID NO: 374402 - DNA, 25 bp, Mus musculus
ctcggatgctcgtgcatgttcactg

SEQ ID NO: 374403 - DNA, 25 bp, Mus musculus
cacactcggatgctcgtgcatgttc

SEQ ID NO: 374404 - DNA, 25 bp, Mus musculus
ccaaggagccaagaggtaagacggc

SEQ ID NO: 374405 - DNA, 25 bp, Mus musculus
agcagcacacactcggatgctcgtg

SEQ ID NO: 374406 - DNA, 25 bp, Mus musculus
gaaacgagagcctccgagggccaag

SEQ ID NO: 374407 - DNA, 25 bp, Mus musculus
aacggcggaaacgagagcctccgag

SEQ ID NO: 374408 - DNA, 25 bp, Mus musculus
gccatctagaaaacggcggaaacga

SEQ ID NO: 374409 - DNA, 25 bp, Mus musculus
cccgtgggtgaagccatctagaaaa

SEQ ID NO: 374410 - DNA, 25 bp, Mus musculus
aagacagcccgtgggtgaagccatc

SEQ ID NO: 374411 - DNA, 25 bp, Mus musculus
ttctagtggccggcgcaaggccaag

SEQ ID NO: 374412 - DNA, 25 bp, Mus musculus
gagccagtcaaaaggctcacacaga

SEQ ID NO: 374413 - DNA, 25 bp, Mus musculus
tgctcctggtgtccgcggcggaatc

SEQ ID NO: 374414 - DNA, 25 bp, Mus musculus
cagcgatcttcctgctcctggtgtc

SEQ ID NO: 374415 - DNA, 25 bp, Mus musculus
gtcaggggctcgcagcgatcttcct

SEQ ID NO: 374416 - DNA, 25 bp, Mus musculus
agaccccggggaccgctgagctatt

SEQ ID NO: 374417 - DNA, 25 bp, Mus musculus
gccaccggtgaccagttcctggaca

SEQ ID NO: 374418 - DNA, 25 bp, Mus musculus
gacggcttgccaccggtgaccagtt

SEQ ID NO: 374419 - DNA, 25 bp, Mus musculus
ccgaggtcagctgacggcttgccac

SEQ ID NO: 374420 - DNA, 25 bp, Mus musculus
ctgatggactaattggagtcgcggc

SEQ ID NO: 374421 - DNA, 25 bp, Mus musculus
ctctgggtcacatgctgatggacta

SEQ ID NO: 374422 - DNA, 25 bp, Mus musculus
tcaaaaggctcacacagactggggc

SEQ ID NO: 374423 - DNA, 25 bp, Mus musculus
cacgttctggcgttagagccagtca

SEQ ID NO: 374424 - DNA, 25 bp, Mus musculus
cctttcgtcacgttctggcgttaga

SEQ ID NO: 374425 - DNA, 25 bp, Mus musculus
gactggggccgcctctgggtcacat

SEQ ID NO: 374426 - DNA, 25 bp, Mus musculus
cgccactgccgattttggacccggg

SEQ ID NO: 374427 - DNA, 25 bp, Mus musculus
ggtcctgacggacatagtcgtcttc

SEQ ID NO: 374428 - DNA, 25 bp, Mus musculus
accctgcccagaccggtggagaaca

SEQ ID NO: 374429 - DNA, 25 bp, Mus musculus
ctctagtctgtaaatgtgggtcatc

SEQ ID NO: 374430 - DNA, 25 bp, Mus musculus
cgtcacgtggacatcagaaactcta

SEQ ID NO: 374431 - DNA, 25 bp, Mus musculus
gtcgtcttctcatatgcctgacttg

SEQ ID NO: 374432 - DNA, 25 bp, Mus musculus
tgcctgacttgatcgcgctgacaaa

SEQ ID NO: 374433 - DNA, 25 bp, Mus musculus
tggcgtcagcgagacactcagaatc

SEQ ID NO: 374434 - DNA, 25 bp, Mus musculus
tctcgccagcatgcgcttaccattg

SEQ ID NO: 374435 - DNA, 25 bp, Mus musculus
accattgtgctactgggtacggctg

SEQ ID NO: 374436 - DNA, 25 bp, Mus musculus
ccaggaacctggaagagatcattga

SEQ ID NO: 374437 - DNA, 25 bp, Mus musculus
tgaatgagcacaggtcgtagagacc

SEQ ID NO: 374438 - DNA, 25 bp, Mus musculus
ccggcctgggtcagttacaaggagt

SEQ ID NO: 374439 - DNA, 25 bp, Mus musculus
tgcacaaagagacccgtgtgccgcc

SEQ ID NO: 374440 - DNA, 25 bp, Mus musculus
gcagcacgtttagaccggcgatcac

SEQ ID NO: 374441 - DNA, 25 bp, Mus musculus
cgcttcgcgtcgaacacggtgttct

SEQ ID NO: 374442 - DNA, 25 bp, Mus musculus
cgtcgttcaccacctggaagggcca

SEQ ID NO: 374443 - DNA, 25 bp, Mus musculus
gcccttgtagttcacctgcaccttg

SEQ ID NO: 374444 - DNA, 25 bp, Mus musculus
aacgaccggctctcgcccttgtagt

SEQ ID NO: 374445 - DNA, 25 bp, Mus musculus
ctgccgctgagagtcgttgaagtag

SEQ ID NO: 374446 - DNA, 25 bp, Mus musculus
gctcgttgatgatccgcagcacgtt

SEQ ID NO: 374447 - DNA, 25 bp, Mus musculus
tgccctcgaacagagagtcgatctc

SEQ ID NO: 374448 - DNA, 25 bp, Mus musculus
gccttgtccatcttggcgtcgcgca

SEQ ID NO: 374449 - DNA, 25 bp, Mus musculus
cagcagcttctgcaccttggggatg

SEQ ID NO: 374450 - DNA, 25 bp, Mus musculus
cgcccgttgaagaagtcctgcagca

SEQ ID NO: 374451 - DNA, 25 bp, Mus musculus
ttgatgctcttgttcaggtcgcgcc

SEQ ID NO: 374452 - DNA, 25 bp, Mus musculus
ggtcctgcacgttctccgacttgtc

SEQ ID NO: 374453 - DNA, 25 bp, Mus musculus
atggacgagatctcctccgggaaga

SEQ ID NO: 374454 - DNA, 25 bp, Mus musculus
cggtgcctgcttttcctcacgtgta

SEQ ID NO: 374455 - DNA, 25 bp, Mus musculus
cctgattgtcagtcgtgcagtttgc

SEQ ID NO: 374456 - DNA, 25 bp, Mus musculus
aagcgattccggctctgcccggact

SEQ ID NO: 374457 - DNA, 25 bp, Mus musculus
agcatgcgtgctcttcctgattgtc

SEQ ID NO: 374458 - DNA, 25 bp, Mus musculus
tcctcacgtgtagttagtgccgctg

SEQ ID NO: 374459 - DNA, 25 bp, Mus musculus
gtactctccaatgctccggtgcctg

SEQ ID NO: 374460 - DNA, 25 bp, Mus musculus
ggcactgcggaggagaaagttactc

SEQ ID NO: 374461 - DNA, 25 bp, Mus musculus
ctcaggacgacaggaagggatccgc

SEQ ID NO: 374462 - DNA, 25 bp, Mus musculus
cgaaagtggctttggcttcatggct

SEQ ID NO: 374463 - DNA, 25 bp, Mus musculus
tctcggtcttgtgcgaaagtggctt

SEQ ID NO: 374464 - DNA, 25 bp, Mus musculus
gctcacccggtatgtgttctcggtc

SEQ ID NO: 374465 - DNA, 25 bp, Mus musculus
gttaaggcgatcagctggtcaggca

SEQ ID NO: 374466 - DNA, 25 bp, Mus musculus
tctgcccggacttgcaggccctggg

SEQ ID NO: 374467 - DNA, 25 bp, Mus musculus
ccatgttggaaagccaggatgtgtg

SEQ ID NO: 374468 - DNA, 25 bp, Mus musculus
aggaagtcacggagagcggcacgtg

SEQ ID NO: 374469 - DNA, 25 bp, Mus musculus
catcgcctacggcttggataaagga

SEQ ID NO: 374470 - DNA, 25 bp, Mus musculus
atcgcctacggcttggataaaggaa

SEQ ID NO: 374471 - DNA, 25 bp, Mus musculus
tcgcctacggcttggataaaggaag

SEQ ID NO: 374472 - DNA, 25 bp, Mus musculus
cgcctacggcttggataaaggaagt

SEQ ID NO: 374473 - DNA, 25 bp, Mus musculus
taaaggaagtcacggagagcggcac

SEQ ID NO: 374474 - DNA, 25 bp, Mus musculus
gcctacggcttggataaaggaagtc

SEQ ID NO: 374475 - DNA, 25 bp, Mus musculus
cctacggcttggataaaggaagtca

SEQ ID NO: 374476 - DNA, 25 bp, Mus musculus
ctacggcttggataaaggaagtcac

SEQ ID NO: 374477 - DNA, 25 bp, Mus musculus
tacggcttggataaaggaagtcacg

SEQ ID NO: 374478 - DNA, 25 bp, Mus musculus
cggcttggataaaggaagtcacgga

SEQ ID NO: 374479 - DNA, 25 bp, Mus musculus
cgccatcgcctacggcttggataaa

SEQ ID NO: 374480 - DNA, 25 bp, Mus musculus
ttggataaaggaagtcacggagagc

SEQ ID NO: 374481 - DNA, 25 bp, Mus musculus
gcttggataaaggaagtcacggaga

SEQ ID NO: 374482 - DNA, 25 bp, Mus musculus
caaccggctggtgagccacttcgtg

SEQ ID NO: 374483 - DNA, 25 bp, Mus musculus
atcagccagaacaagcgcgcggtgc

SEQ ID NO: 374484 - DNA, 25 bp, Mus musculus
aggacatcagccagaacaagcgcgc

SEQ ID NO: 374485 - DNA, 25 bp, Mus musculus
agcacaagaaggacatcagccagaa

SEQ ID NO: 374486 - DNA, 25 bp, Mus musculus
caagaggaagcacaagaaggacatc

SEQ ID NO: 374487 - DNA, 25 bp, Mus musculus
agccacttcgtggaggagttcaaga

SEQ ID NO: 374488 - DNA, 25 bp, Mus musculus
ttcgacaaccggctggtgagccact

SEQ ID NO: 374489 - DNA, 25 bp, Mus musculus
cacggcgggcgacacgcacctggga

SEQ ID NO: 374490 - DNA, 25 bp, Mus musculus
cggcatcttcgaggtgaaggccacg

SEQ ID NO: 374491 - DNA, 25 bp, Mus musculus
tcgacgacggcatcttcgaggtgaa

SEQ ID NO: 374492 - DNA, 25 bp, Mus musculus
tcctgacgatcgacgacggcatctt

SEQ ID NO: 374493 - DNA, 25 bp, Mus musculus
gttcgacgtgtccatcctgacgatc

SEQ ID NO: 374494 - DNA, 25 bp, Mus musculus
cacgttcgacgtgtccatcctgacg

SEQ ID NO: 374495 - DNA, 25 bp, Mus musculus
tggaggagttcaagaggaagcacaa

SEQ ID NO: 374496 - DNA, 25 bp, Mus musculus
ttagataacgttgggacgcgctctc

SEQ ID NO: 374497 - DNA, 25 bp, Mus musculus
ctcagcggcgcgcaccgctataggt

SEQ ID NO: 374498 - DNA, 25 bp, Mus musculus
accgctataggtgagtgtcccgcga

SEQ ID NO: 374499 - DNA, 25 bp, Mus musculus
cccgcgaggtcacttcagcctgtga

SEQ ID NO: 374500 - DNA, 25 bp, Mus musculus
ttcccgacatgatcgcggagactcg

SEQ ID NO: 374501 - DNA, 25 bp, Mus musculus
ctcgtgctgcgattggctcctcgca

SEQ ID NO: 374502 - DNA, 25 bp, Mus musculus
ccgtggtcatcgtctcagcggcgcg

SEQ ID NO: 374503 - DNA, 25 bp, Mus musculus
ctctgccaggctcacctattagata

SEQ ID NO: 374504 - DNA, 25 bp, Mus musculus
cgctctctctcctgatcgctgattg

SEQ ID NO: 374505 - DNA, 25 bp, Mus musculus
ctgatcgctgattggtctgttcggc

SEQ ID NO: 374506 - DNA, 25 bp, Mus musculus
ccattgatcacgctgtggtgtcggg

SEQ ID NO: 374507 - DNA, 25 bp, Mus musculus
ttggctcctcgcagtagagccaccg

SEQ ID NO: 374508 - DNA, 25 bp, Mus musculus
gacaagatgaatgcgggctcagacc

SEQ ID NO: 374509 - DNA, 25 bp, Mus musculus
tgttcggcggtgcaccattgatcac

SEQ ID NO: 374510 - DNA, 25 bp, Mus musculus
ggcgctttgacttgactggaatacc

SEQ ID NO: 374511 - DNA, 25 bp, Mus musculus
gactggaatacctcctgcacctagg

SEQ ID NO: 374512 - DNA, 25 bp, Mus musculus
cctgctggggcgctttgacttgact

SEQ ID NO: 374513 - DNA, 25 bp, Mus musculus
actggaatacctcctgcacctaggg

SEQ ID NO: 374514 - DNA, 25 bp, Mus musculus
tggaatacctcctgcacctaggggc

SEQ ID NO: 374515 - DNA, 25 bp, Mus musculus
gggcgctttgacttgactggaatac

SEQ ID NO: 374516 - DNA, 25 bp, Mus musculus
gcgctttgacttgactggaatacct

SEQ ID NO: 374517 - DNA, 25 bp, Mus musculus
cgctttgacttgactggaatacctc

SEQ ID NO: 374518 - DNA, 25 bp, Mus musculus
gctttgacttgactggaatacctcc

SEQ ID NO: 374519 - DNA, 25 bp, Mus musculus
tttgacttgactggaatacctcctg

SEQ ID NO: 374520 - DNA, 25 bp, Mus musculus
tgacttgactggaatacctcctgca

SEQ ID NO: 374521 - DNA, 25 bp, Mus musculus
acttgactggaatacctcctgcacc

SEQ ID NO: 374522 - DNA, 25 bp, Mus musculus
ttgactggaatacctcctgcaccta

SEQ ID NO: 374523 - DNA, 25 bp, Mus musculus
ctggaatacctcctgcacctagggg

SEQ ID NO: 374524 - DNA, 25 bp, Mus musculus
tgaccttcgacatcgacgccaacgg

SEQ ID NO: 374525 - DNA, 25 bp, Mus musculus
ggtgaccttcgacatcgacgccaac

SEQ ID NO: 374526 - DNA, 25 bp, Mus musculus
ctgatccaggtgtacgagggcgaga

SEQ ID NO: 374527 - DNA, 25 bp, Mus musculus
catgacgcgcgacaacaacctgctg

SEQ ID NO: 374528 - DNA, 25 bp, Mus musculus
gatcgaggtgaccttcgacatcgac

SEQ ID NO: 374529 - DNA, 25 bp, Mus musculus
tcgaggtgaccttcgacatcgacgc

SEQ ID NO: 374530 - DNA, 25 bp, Mus musculus
cggcaaggccaacaagatcaccatc

SEQ ID NO: 374531 - DNA, 25 bp, Mus musculus
gaggtgaccttcgacatcgacgcca

SEQ ID NO: 374532 - DNA, 25 bp, Mus musculus
acaagatcaccatcaccaacgacaa

SEQ ID NO: 374533 - DNA, 25 bp, Mus musculus
ggcaaggccaacaagatcaccatca

SEQ ID NO: 374534 - DNA, 25 bp, Mus musculus
accggcaaggccaacaagatcacca

SEQ ID NO: 374535 - DNA, 25 bp, Mus musculus
gagcaccggcaaggccaacaagatc

SEQ ID NO: 374536 - DNA, 25 bp, Mus musculus
caagagcaccggcaaggccaacaag

SEQ ID NO: 374537 - DNA, 25 bp, Mus musculus
aggccaacaagatcaccatcaccaa

SEQ ID NO: 374538 - DNA, 25 bp, Mus musculus
gtagactacgagctaatcacgcggc

SEQ ID NO: 374539 - DNA, 25 bp, Mus musculus
tcacgcggcagagagaaaagtctca

SEQ ID NO: 374540 - DNA, 25 bp, Mus musculus
acgaactacgtccaacgcgcagctg

SEQ ID NO: 374541 - DNA, 25 bp, Mus musculus
gcaacgcaggtcctgtcactccgtg

SEQ ID NO: 374542 - DNA, 25 bp, Mus musculus
cggcccacgcatgcgcttgtgagaa

SEQ ID NO: 374543 - DNA, 25 bp, Mus musculus
agcctgaattcagccgaggttttcg

SEQ ID NO: 374544 - DNA, 25 bp, Mus musculus
cttctgtgctgttgacgaggacttt

SEQ ID NO: 374545 - DNA, 25 bp, Mus musculus
taccgtgacgtcaaaagggagcgcc

SEQ ID NO: 374546 - DNA, 25 bp, Mus musculus
tccgtgaactgcagagtcccgttta

SEQ ID NO: 374547 - DNA, 25 bp, Mus musculus
gggaagcgagccttgcacttctgtg

SEQ ID NO: 374548 - DNA, 25 bp, Mus musculus
ggaaacctttagcaagtccaagaga

SEQ ID NO: 374549 - DNA, 25 bp, Mus musculus
gccagcaccatggtgggtaccgtga

SEQ ID NO: 374550 - DNA, 25 bp, Mus musculus
cagggttttccgtacagccttactg

SEQ ID NO: 374551 - DNA, 25 bp, Mus musculus
gcctgcgtgatccagtcttgcttca

SEQ ID NO: 374552 - DNA, 25 bp, Mus musculus
tcaatctgccgggtctctcctcagg

SEQ ID NO: 374553 - DNA, 25 bp, Mus musculus
gggttcccgtctccgtgctgcacga

SEQ ID NO: 374554 - DNA, 25 bp, Mus musculus
ctgcttgacccgtccggcagcggtg

SEQ ID NO: 374555 - DNA, 25 bp, Mus musculus
ctgcgaggacccgagtccggaaacg

SEQ ID NO: 374556 - DNA, 25 bp, Mus musculus
cggaaacgtgcgctgtcacaaaggg

SEQ ID NO: 374557 - DNA, 25 bp, Mus musculus
ccgtagccggccgagtgtgatcgcc

SEQ ID NO: 374558 - DNA, 25 bp, Mus musculus
gtgatcgccgccttcagtacgtaca

SEQ ID NO: 374559 - DNA, 25 bp, Mus musculus
tcagtacgtacacgcggcgcggcct

SEQ ID NO: 374560 - DNA, 25 bp, Mus musculus
gcgcctgcgtaccttgcagcacgtg

SEQ ID NO: 374561 - DNA, 25 bp, Mus musculus
taccttgcagcacgtgctcaggtcc

SEQ ID NO: 374562 - DNA, 25 bp, Mus musculus
ttttcccgcgctctagacacgaaga

SEQ ID NO: 374563 - DNA, 25 bp, Mus musculus
tcaggtcactgcaccgcgttcggac

SEQ ID NO: 374564 - DNA, 25 bp, Mus musculus
gcgttcggaccctgcacagccatgt

SEQ ID NO: 374565 - DNA, 25 bp, Mus musculus
tcatcgctgcccgatacggggaagc

SEQ ID NO: 374566 - DNA, 25 bp, Mus musculus
agtgttcaaaattcccgccctctgc

SEQ ID NO: 374567 - DNA, 25 bp, Mus musculus
ggtctgcttagccatccaacgggaa

SEQ ID NO: 374568 - DNA, 25 bp, Mus musculus
cagccgtgtcgcagagctttgattg

SEQ ID NO: 374569 - DNA, 25 bp, Mus musculus
cttagtggctgaaagggtctgctta

SEQ ID NO: 374570 - DNA, 25 bp, Mus musculus
tggagccgccaattcgcagcacttt

SEQ ID NO: 374571 - DNA, 25 bp, Mus musculus
gagcgcgctgtcacgtcaagtctct

SEQ ID NO: 374572 - DNA, 25 bp, Mus musculus
tcctgtcactcgaagccgtgctttg

SEQ ID NO: 374573 - DNA, 25 bp, Mus musculus
tctgccgttgctaagcagccgtgtc

SEQ ID NO: 374574 - DNA, 25 bp, Mus musculus
ggcggtgctagagtgttcaaaattc

SEQ ID NO: 374575 - DNA, 25 bp, Mus musculus
ggagcagctccgagctactgtccca

SEQ ID NO: 374576 - DNA, 25 bp, Mus musculus
ctagatgtcgattggtccgtttgca

SEQ ID NO: 374577 - DNA, 25 bp, Mus musculus
cgtgctttggaagctctgacggagc

SEQ ID NO: 374578 - DNA, 25 bp, Mus musculus
ggaggtccaaaagcagcattcagca

SEQ ID NO: 374579 - DNA, 25 bp, Mus musculus
ggtcgctctgaaagccatgggctcg

SEQ ID NO: 374580 - DNA, 25 bp, Mus musculus
gtgctgcatacgtccctgcaccgga

SEQ ID NO: 374581 - DNA, 25 bp, Mus musculus
gagctatccgtctctccagcttgag

SEQ ID NO: 374582 - DNA, 25 bp, Mus musculus
aggactcagactcccatcttcatta

SEQ ID NO: 374583 - DNA, 25 bp, Mus musculus
tcttcattaactctctcctctgggg

SEQ ID NO: 374584 - DNA, 25 bp, Mus musculus
tggggccaaggctgaaatcacaagg

SEQ ID NO: 374585 - DNA, 25 bp, Mus musculus
caccggacggagtgtgcgaataacc

SEQ ID NO: 374586 - DNA, 25 bp, Mus musculus
cggggtagactttagaagatggaca

SEQ ID NO: 374587 - DNA, 25 bp, Mus musculus
agttctgaagcctggagtggctcca

SEQ ID NO: 374588 - DNA, 25 bp, Mus musculus
tccgccctccagatttcgtttaaga

SEQ ID NO: 374589 - DNA, 25 bp, Mus musculus
cagtcctccgggactaagtctggtt

SEQ ID NO: 374590 - DNA, 25 bp, Mus musculus
aagtctggtttgtactgggtcgctc

SEQ ID NO: 374591 - DNA, 25 bp, Mus musculus
gattctagttcctcgggtttgcgcc

SEQ ID NO: 374592 - DNA, 25 bp, Mus musculus
ccatcgtcgtacgtgagctcgccta

SEQ ID NO: 374593 - DNA, 25 bp, Mus musculus
cgaataacctgcacttgggcgaaga

SEQ ID NO: 374594 - DNA, 25 bp, Mus musculus
tactcgtaccctagggagaccgcga

SEQ ID NO: 374595 - DNA, 25 bp, Mus musculus
gaatcaggaccttgggatactcgta

SEQ ID NO: 374596 - DNA, 25 bp, Mus musculus
aatgctggagcacagttggggtccc

SEQ ID NO: 374597 - DNA, 25 bp, Mus musculus
taccattgtccagggaacgcaggcg

SEQ ID NO: 374598 - DNA, 25 bp, Mus musculus
gctctagccgcttgataccattgtc

SEQ ID NO: 374599 - DNA, 25 bp, Mus musculus
agcccaacgcccaggagcggaatca

SEQ ID NO: 374600 - DNA, 25 bp, Mus musculus
tctcgtggcgtcctttgcagaaaaa

SEQ ID NO: 374601 - DNA, 25 bp, Mus musculus
ctgtgcgactctcattctcgtggcg

SEQ ID NO: 374602 - DNA, 25 bp, Mus musculus
gtagatcctgcaggccggcaacctg

SEQ ID NO: 374603 - DNA, 25 bp, Mus musculus
ggcctcgacctaccgtgggtagatc

SEQ ID NO: 374604 - DNA, 25 bp, Mus musculus
gtcccgcgtgtgtgtccaaattaag

SEQ ID NO: 374605 - DNA, 25 bp, Mus musculus
tttaccgctctgtaagattccgccc

SEQ ID NO: 374606 - DNA, 25 bp, Mus musculus
caggggtacagacaatagggttcta

SEQ ID NO: 374607 - DNA, 25 bp, Mus musculus
ctcgtcgaggcccacaagatcggac

SEQ ID NO: 374608 - DNA, 25 bp, Mus musculus
cgcctcgtccagctcctgggtgagt

SEQ ID NO: 374609 - DNA, 25 bp, Mus musculus
gcgagcggatacgtgctgacgtcac

SEQ ID NO: 374610 - DNA, 25 bp, Mus musculus
tcctctcgtggcgagaacgtcaggc

SEQ ID NO: 374611 - DNA, 25 bp, Mus musculus
tacggctttggaggaactcttcctc

SEQ ID NO: 374612 - DNA, 25 bp, Mus musculus
gccgcctctctttacggctttggag

SEQ ID NO: 374613 - DNA, 25 bp, Mus musculus
gtatggtccagaccgcgctgcgctg

SEQ ID NO: 374614 - DNA, 25 bp, Mus musculus
aggcacgcacgcagcgcccaggaga

SEQ ID NO: 374615 - DNA, 25 bp, Mus musculus
agcccgcttgtcaagtggcggtcgc

SEQ ID NO: 374616 - DNA, 25 bp, Mus musculus
acgcagcgcccaggagactacgggc

SEQ ID NO: 374617 - DNA, 25 bp, Mus musculus
tatggcgaagctcctgagctgcgtc

SEQ ID NO: 374618 - DNA, 25 bp, Mus musculus
cagctcctgggtgagtcgggttccc

SEQ ID NO: 374619 - DNA, 25 bp, Mus musculus
aacgtcaggctggaccctgccacgg

SEQ ID NO: 374620 - DNA, 25 bp, Mus musculus
actgcgctgaacactcctctcgtgg

SEQ ID NO: 374621 - DNA, 25 bp, Mus musculus
cggagagcatggtatggtccagacc

SEQ ID NO: 374622 - DNA, 25 bp, Mus musculus
aggctcctactttctggaggatcca

SEQ ID NO: 374623 - DNA, 25 bp, Mus musculus
cggcccgaggctaaaaccacctgtg

SEQ ID NO: 374624 - DNA, 25 bp, Mus musculus
actcctgccgaggtctaccgttttg

SEQ ID NO: 374625 - DNA, 25 bp, Mus musculus
cggccagcagacctccaaggacttt

SEQ ID NO: 374626 - DNA, 25 bp, Mus musculus
taggcatctattacgccttcgcggg

SEQ ID NO: 374627 - DNA, 25 bp, Mus musculus
tcatctcggcggctataggcatcta

SEQ ID NO: 374628 - DNA, 25 bp, Mus musculus
tgttcgcaggcatgctgctcatctc

SEQ ID NO: 374629 - DNA, 25 bp, Mus musculus
ggaggatccacacctgcaggacgta

SEQ ID NO: 374630 - DNA, 25 bp, Mus musculus
ttggcaacaggtatttaggctccta

SEQ ID NO: 374631 - DNA, 25 bp, Mus musculus
ttccctgatccggtgattggcaaca

SEQ ID NO: 374632 - DNA, 25 bp, Mus musculus
cttaataaaacttgcgcagagcgcg

SEQ ID NO: 374633 - DNA, 25 bp, Mus musculus
gtcccagccgctgtcacttaataaa

SEQ ID NO: 374634 - DNA, 25 bp, Mus musculus
catgtttaaatggtgcgtcccagcc

SEQ ID NO: 374635 - DNA, 25 bp, Mus musculus
aggacgtacctgatctccgcgggac

SEQ ID NO: 374636 - DNA, 25 bp, Mus musculus
tcttgttaggctcgctaagctgccg

SEQ ID NO: 374637 - DNA, 25 bp, Mus musculus
tgcacgctgcgtgagaacctggacc

SEQ ID NO: 374638 - DNA, 25 bp, Mus musculus
caggccaacccacgggatcctggtt

SEQ ID NO: 374639 - DNA, 25 bp, Mus musculus
gtcctcgggctgattgtcatccctg

SEQ ID NO: 374640 - DNA, 25 bp, Mus musculus
aggacccgcgcatgactctctaagg

SEQ ID NO: 374641 - DNA, 25 bp, Mus musculus
atgaggggaagacaaactaccaatc

SEQ ID NO: 374642 - DNA, 25 bp, Mus musculus
agatgtagtcccgtcggcagagaga

SEQ ID NO: 374643 - DNA, 25 bp, Mus musculus
ggccactggaaactggtgaggattt

SEQ ID NO: 374644 - DNA, 25 bp, Mus musculus
ccaaggaaccgcagagaccactaca

SEQ ID NO: 374645 - DNA, 25 bp, Mus musculus
aaggggagctgtgcttccaaggaac

SEQ ID NO: 374646 - DNA, 25 bp, Mus musculus
cacttctgtgggtctcacgagcgtc

SEQ ID NO: 374647 - DNA, 25 bp, Mus musculus
ttggcgaaggcaccacacttctgtg

SEQ ID NO: 374648 - DNA, 25 bp, Mus musculus
cctgtcccaaggcttccgaagttca

SEQ ID NO: 374649 - DNA, 25 bp, Mus musculus
ggtgctccctcagcgttccgctttg

SEQ ID NO: 374650 - DNA, 25 bp, Mus musculus
tgtcgagtccgcctcacgggttgcg

SEQ ID NO: 374651 - DNA, 25 bp, Mus musculus
tgcgtctgcgatctccaaggacatc

SEQ ID NO: 374652 - DNA, 25 bp, Mus musculus
gtaggcctgtactgtgtcttgcgtc

SEQ ID NO: 374653 - DNA, 25 bp, Mus musculus
tgcgcgagcacccagacgcctgggt

SEQ ID NO: 374654 - DNA, 25 bp, Mus musculus
ggtacagctgcttccgggctcgcac

SEQ ID NO: 374655 - DNA, 25 bp, Mus musculus
aggtcgctctgtcgagtccgcctca

SEQ ID NO: 374656 - DNA, 25 bp, Mus musculus
tctacgcctgcgctagtgaatcgcg

SEQ ID NO: 374657 - DNA, 25 bp, Mus musculus
ttaggtggtcctctctctacgcctg

SEQ ID NO: 374658 - DNA, 25 bp, Mus musculus
gtctggtcttaggtggtcctctctc

SEQ ID NO: 374659 - DNA, 25 bp, Mus musculus
agccgaacccgggttcgtgctcagg

SEQ ID NO: 374660 - DNA, 25 bp, Mus musculus
gatctccaaggacatctctgttctg

SEQ ID NO: 374661 - DNA, 25 bp, Mus musculus
tctctgttctgaccttgcggaggcc

SEQ ID NO: 374662 - DNA, 25 bp, Mus musculus
tcgtgctcagggtctggtcttaggt

SEQ ID NO: 374663 - DNA, 25 bp, Mus musculus
tgtactgtgtcttgcgtctgcgatc

SEQ ID NO: 374664 - DNA, 25 bp, Mus musculus
agtacttagagtgtgcgcacgcgtg

SEQ ID NO: 374665 - DNA, 25 bp, Mus musculus
cgcgcgcagggaagaaacgcacata

SEQ ID NO: 374666 - DNA, 25 bp, Mus musculus
tcgcgaccggtgatgacactggcct

SEQ ID NO: 374667 - DNA, 25 bp, Mus musculus
tttcccgatctctcgggcgcttgct

SEQ ID NO: 374668 - DNA, 25 bp, Mus musculus
cgcgttgtcctaggatttcccgatc

SEQ ID NO: 374669 - DNA, 25 bp, Mus musculus
tttctctgccgagtctagcgcgacc

SEQ ID NO: 374670 - DNA, 25 bp, Mus musculus
cgtgcgcgaagccacttttctctgc

SEQ ID NO: 374671 - DNA, 25 bp, Mus musculus
agcctcccgtgagtgtccgcggtct

SEQ ID NO: 374672 - DNA, 25 bp, Mus musculus
tcgtgttgctggaataccgaggaga

SEQ ID NO: 374673 - DNA, 25 bp, Mus musculus
tcgcgtgttggttaagtcgtgttgc

SEQ ID NO: 374674 - DNA, 25 bp, Mus musculus
tttgtatgtgtttggtcgcgtgttg

SEQ ID NO: 374675 - DNA, 25 bp, Mus musculus
gggctgtggactttctcatcgtgcc

SEQ ID NO: 374676 - DNA, 25 bp, Mus musculus
cagaaactcactgttcggggctgtg

SEQ ID NO: 374677 - DNA, 25 bp, Mus musculus
tccggttgcactctggcgcgcgcag

SEQ ID NO: 374678 - DNA, 25 bp, Mus musculus
gatagctccgctctgagaccgttta

SEQ ID NO: 374679 - DNA, 25 bp, Mus musculus
gaagtcaggctcttggccacggcta

SEQ ID NO: 374680 - DNA, 25 bp, Mus musculus
gacgctgggtcaactagagacagta

SEQ ID NO: 374681 - DNA, 25 bp, Mus musculus
gcaaagctcactacggccgcagaca

SEQ ID NO: 374682 - DNA, 25 bp, Mus musculus
aggaccctccatcttcaggaaacga

SEQ ID NO: 374683 - DNA, 25 bp, Mus musculus
ccttaccattctgggagcggaccgc

SEQ ID NO: 374684 - DNA, 25 bp, Mus musculus
gggttcgcagccctctcaaccagtt

SEQ ID NO: 374685 - DNA, 25 bp, Mus musculus
cgggtccttgagacaccgaggtact

SEQ ID NO: 374686 - DNA, 25 bp, Mus musculus
gcccttgtagctttacccacagtta

SEQ ID NO: 374687 - DNA, 25 bp, Mus musculus
cccacagttaacatggctgcgacta

SEQ ID NO: 374688 - DNA, 25 bp, Mus musculus
gccgcggttctggaaatgtctgtca

SEQ ID NO: 374689 - DNA, 25 bp, Mus musculus
ttgcctgcgctctgtgcacagtacg

SEQ ID NO: 374690 - DNA, 25 bp, Mus musculus
tccgcctcaacgtctgcggtgattg

SEQ ID NO: 374691 - DNA, 25 bp, Mus musculus
cagcaccagggagcttgttagttcc

SEQ ID NO: 374692 - DNA, 25 bp, Mus musculus
ctcctcggaactctcggtaacttcg

SEQ ID NO: 374693 - DNA, 25 bp, Mus musculus
tgtctcactggcagtgcggcctcgg

SEQ ID NO: 374694 - DNA, 25 bp, Mus musculus
tcggtaacttcggaattcacggctc

SEQ ID NO: 374695 - DNA, 25 bp, Mus musculus
ggatggtttgttccgcctgaaccac

SEQ ID NO: 374696 - DNA, 25 bp, Mus musculus
cagaaggatggtttgttccgcctga

SEQ ID NO: 374697 - DNA, 25 bp, Mus musculus
tcctctggcaaaatactcgcctctg

SEQ ID NO: 374698 - DNA, 25 bp, Mus musculus
cttcggaattcacggctccgggctc

SEQ ID NO: 374699 - DNA, 25 bp, Mus musculus
gcggcgtctcttggggatttcttca

SEQ ID NO: 374700 - DNA, 25 bp, Mus musculus
cgtctcttggggatttcttcatatt

SEQ ID NO: 374701 - DNA, 25 bp, Mus musculus
tggggatttcttcatattctgaacc

SEQ ID NO: 374702 - DNA, 25 bp, Mus musculus
tcatattctgaaccctcacttcgtg

SEQ ID NO: 374703 - DNA, 25 bp, Mus musculus
gaaccctcacttcgtgtctcactgg

SEQ ID NO: 374704 - DNA, 25 bp, Mus musculus
tcacttcgtgtctcactggcagtgc

SEQ ID NO: 374705 - DNA, 25 bp, Mus musculus
atcgtctcctcggaactctcggtaa

SEQ ID NO: 374706 - DNA, 25 bp, Mus musculus
gctcttcagggctgtccctacttta

SEQ ID NO: 374707 - DNA, 25 bp, Mus musculus
tgcataaaggggagggacttacaga

SEQ ID NO: 374708 - DNA, 25 bp, Mus musculus
cagtgtgtggaggatatttgcataa

SEQ ID NO: 374709 - DNA, 25 bp, Mus musculus
tacacgacggatggtgggagaaaaa

SEQ ID NO: 374710 - DNA, 25 bp, Mus musculus
cggagaagacggaaagaactgcgac

SEQ ID NO: 374711 - DNA, 25 bp, Mus musculus
tccattcgtgagaggtaaacgcgtc

SEQ ID NO: 374712 - DNA, 25 bp, Mus musculus
ctgcgacgaatggaagggattagtt

SEQ ID NO: 374713 - DNA, 25 bp, Mus musculus
ttagttagtcgagggcggagttaca

SEQ ID NO: 374714 - DNA, 25 bp, Mus musculus
gcggagttacatagaccctggaaga

SEQ ID NO: 374715 - DNA, 25 bp, Mus musculus
atttcaggtctggtgtccattcgtg

SEQ ID NO: 374716 - DNA, 25 bp, Mus musculus
acttacagacgctaggacgccggtt

SEQ ID NO: 374717 - DNA, 25 bp, Mus musculus
cccggtcactctcagcggagaagac

SEQ ID NO: 374718 - DNA, 25 bp, Mus musculus
ccgttggggcgcagaatttacacga

SEQ ID NO: 374719 - DNA, 25 bp, Mus musculus
cgtcggcagttgagacgcgtagacc

SEQ ID NO: 374720 - DNA, 25 bp, Mus musculus
cgctgccacaggacggcgtctatta

SEQ ID NO: 374721 - DNA, 25 bp, Mus musculus
gcgcggagacagtcacacctgttgt

SEQ ID NO: 374722 - DNA, 25 bp, Mus musculus
catctgtattcattcctggaggatc

SEQ ID NO: 374723 - DNA, 25 bp, Mus musculus
cggcgagagggtctacgttaacatc

SEQ ID NO: 374724 - DNA, 25 bp, Mus musculus
cccgacatggtggactacaggagag

SEQ ID NO: 374725 - DNA, 25 bp, Mus musculus
ctacaggagagggaagaccttcttc

SEQ ID NO: 374726 - DNA, 25 bp, Mus musculus
cctctactgccacgtcgggtacagg

SEQ ID NO: 374727 - DNA, 25 bp, Mus musculus
gactgacggtgcgaatgtgtgaatc

SEQ ID NO: 374728 - DNA, 25 bp, Mus musculus
tggtggggtgacagccatctgtatt

SEQ ID NO: 374729 - DNA, 25 bp, Mus musculus
ggacggcgtctattacctctactgc

SEQ ID NO: 374730 - DNA, 25 bp, Mus musculus
tccctttctgcaggcgcttggatga

SEQ ID NO: 374731 - DNA, 25 bp, Mus musculus
gagcgctcacgcgtgtccctttctg

SEQ ID NO: 374732 - DNA, 25 bp, Mus musculus
ccgggtctccgacctagagatcacg

SEQ ID NO: 374733 - DNA, 25 bp, Mus musculus
gtgtgaatcgtgatgtccgggaccc

SEQ ID NO: 374734 - DNA, 25 bp, Mus musculus
gtaccgccggaagcgtcgctctcgg

SEQ ID NO: 374735 - DNA, 25 bp, Mus musculus
cgtcctgcagacaagtaccgccgga

SEQ ID NO: 374736 - DNA, 25 bp, Mus musculus
gcaccagccgtcctgcagacaagta

SEQ ID NO: 374737 - DNA, 25 bp, Mus musculus
catcaagcccgggatgtcgctggag

SEQ ID NO: 374738 - DNA, 25 bp, Mus musculus
gcgtccacatcaagcccgggatgtc

SEQ ID NO: 374739 - DNA, 25 bp, Mus musculus
cagcgtccacatcaagcccgggatg

SEQ ID NO: 374740 - DNA, 25 bp, Mus musculus
tgcagacaagtaccgccggaagcgt

SEQ ID NO: 374741 - DNA, 25 bp, Mus musculus
agcagcgtgcagcgccgtgtcgcca

SEQ ID NO: 374742 - DNA, 25 bp, Mus musculus
caagtaccgccggaagcgtcgctct

SEQ ID NO: 374743 - DNA, 25 bp, Mus musculus
gggggctgcccagcgtccacatcaa

SEQ ID NO: 374744 - DNA, 25 bp, Mus musculus
cctgcagacaagtaccgccggaagc

SEQ ID NO: 374745 - DNA, 25 bp, Mus musculus
tgggcagggtcagcgccgagacgca

SEQ ID NO: 374746 - DNA, 25 bp, Mus musculus
aggcacagggcaggggcatcgtggc

SEQ ID NO: 374747 - DNA, 25 bp, Mus musculus
ccgtgtcgccatggcggtcctggtg

SEQ ID NO: 374748 - DNA, 25 bp, Mus musculus
ttcgggtactacctcagtgaggttc

SEQ ID NO: 374749 - DNA, 25 bp, Mus musculus
agccgtctggtacctcggtcgcctt

SEQ ID NO: 374750 - DNA, 25 bp, Mus musculus
accgcatcaagggcccggaggagta

SEQ ID NO: 374751 - DNA, 25 bp, Mus musculus
acccagtgggagtggaggaccgcat

SEQ ID NO: 374752 - DNA, 25 bp, Mus musculus
aaacgggagcgctaagacccagtgg

SEQ ID NO: 374753 - DNA, 25 bp, Mus musculus
agactgagtgaaaacgggagcgcta

SEQ ID NO: 374754 - DNA, 25 bp, Mus musculus
acacccacccggtgcaggagactga

SEQ ID NO: 374755 - DNA, 25 bp, Mus musculus
tgacagacacccacccggtgcagga

SEQ ID NO: 374756 - DNA, 25 bp, Mus musculus
tgaggatgacagacacccacccggt

SEQ ID NO: 374757 - DNA, 25 bp, Mus musculus
catcagtgtgaggatgacagacacc

SEQ ID NO: 374758 - DNA, 25 bp, Mus musculus
agaggaggaccagtcatcagtgtga

SEQ ID NO: 374759 - DNA, 25 bp, Mus musculus
actacctcagtgaggttcgagagga

SEQ ID NO: 374760 - DNA, 25 bp, Mus musculus
gccgtttcgggtactacctcagtga

SEQ ID NO: 374761 - DNA, 25 bp, Mus musculus
ggttcgagaggaggaccagtcatca

SEQ ID NO: 374762 - DNA, 25 bp, Mus musculus
cgtagaagaacaaaatggagagctc

SEQ ID NO: 374763 - DNA, 25 bp, Mus musculus
atgcccacagagaggtgcccaggga

SEQ ID NO: 374764 - DNA, 25 bp, Mus musculus
cctgtcgcgctcttgctactggcga

SEQ ID NO: 374765 - DNA, 25 bp, Mus musculus
agaagcctggcgtggcaaacaaaac

SEQ ID NO: 374766 - DNA, 25 bp, Mus musculus
agccgctctcgggtcaccttgacta

SEQ ID NO: 374767 - DNA, 25 bp, Mus musculus
ccgaccgtcggagggtgttgcataa

SEQ ID NO: 374768 - DNA, 25 bp, Mus musculus
caccttgactacgaggctaaggacc

SEQ ID NO: 374769 - DNA, 25 bp, Mus musculus
agcagaggcccgagttagccgctct

SEQ ID NO: 374770 - DNA, 25 bp, Mus musculus
gggtgttgcataagcgtagaagaac

SEQ ID NO: 374771 - DNA, 25 bp, Mus musculus
attcgatcgcggagtcctccatgcc

SEQ ID NO: 374772 - DNA, 25 bp, Mus musculus
ctgtaatgggcgtggtcacgtgtcc

SEQ ID NO: 374773 - DNA, 25 bp, Mus musculus
ggaggcgtcgtctgaagcttcattt

SEQ ID NO: 374774 - DNA, 25 bp, Mus musculus
gaaacgcttctcattcgatcgcgga

SEQ ID NO: 374775 - DNA, 25 bp, Mus musculus
aagacgtgagtttcctgtcgcgctc

SEQ ID NO: 374776 - DNA, 25 bp, Mus musculus
ctggatgggagccaaacactgcttc

SEQ ID NO: 374777 - DNA, 25 bp, Mus musculus
gggtgggtcctacggtctctgactc

SEQ ID NO: 374778 - DNA, 25 bp, Mus musculus
tgcgacttccactggagagcgcgcc

SEQ ID NO: 374779 - DNA, 25 bp, Mus musculus
cttcccttgcgacttccactggaga

SEQ ID NO: 374780 - DNA, 25 bp, Mus musculus
ggatctacaacctccctgactaagc

SEQ ID NO: 374781 - DNA, 25 bp, Mus musculus
cgcaagctggccagcgcatcggcga

SEQ ID NO: 374782 - DNA, 25 bp, Mus musculus
cccgctggatgggagccaaacactg

SEQ ID NO: 374783 - DNA, 25 bp, Mus musculus
gagctccggagcatgcccagtcagc

SEQ ID NO: 374784 - DNA, 25 bp, Mus musculus
gagtgcatgcgctcggctcccacgg

SEQ ID NO: 374785 - DNA, 25 bp, Mus musculus
agggaagccatcctggctcgcgtcc

SEQ ID NO: 374786 - DNA, 25 bp, Mus musculus
taagcctcccgctcttcccttgcga

SEQ ID NO: 374787 - DNA, 25 bp, Mus musculus
tgggagccaaacactgcttccctga

SEQ ID NO: 374788 - DNA, 25 bp, Mus musculus
gagtcccgggaggatctacaacctc

SEQ ID NO: 374789 - DNA, 25 bp, Mus musculus
gtccggcgcaagctggccagcgcat

SEQ ID NO: 374790 - DNA, 25 bp, Mus musculus
tcgcgcacttctggggaagcttttc

SEQ ID NO: 374791 - DNA, 25 bp, Mus musculus
gccattgtgtctccgcgcttcctgg

SEQ ID NO: 374792 - DNA, 25 bp, Mus musculus
gtgttccagtgggtcctctgcccac

SEQ ID NO: 374793 - DNA, 25 bp, Mus musculus
gccttttcttgctcgcccagggatg

SEQ ID NO: 374794 - DNA, 25 bp, Mus musculus
gcccagggatgggaagatctcgctc

SEQ ID NO: 374795 - DNA, 25 bp, Mus musculus
cccgctttcgctgccttatttggag

SEQ ID NO: 374796 - DNA, 25 bp, Mus musculus
gctgccttatttggagctctctgtg

SEQ ID NO: 374797 - DNA, 25 bp, Mus musculus
gggaacgatccaaaatggtggcctc

SEQ ID NO: 374798 - DNA, 25 bp, Mus musculus
ctgtgaccttaattccttagtgcga

SEQ ID NO: 374799 - DNA, 25 bp, Mus musculus
aagcttttccgagagcactgcaagg

SEQ ID NO: 374800 - DNA, 25 bp, Mus musculus
gcactgcaaggcgttcctttctaag

SEQ ID NO: 374801 - DNA, 25 bp, Mus musculus
ggctcacactcttaatcctgcatcg

SEQ ID NO: 374802 - DNA, 25 bp, Mus musculus
tgcatcgttctcagctgtgacctta

SEQ ID NO: 374803 - DNA, 25 bp, Mus musculus
agctctctgtgaatggctgcctctg

SEQ ID NO: 374804 - DNA, 25 bp, Mus musculus
cagtggttccgagtgagcctgagga

SEQ ID NO: 374805 - DNA, 25 bp, Mus musculus
cagcagatgtctggctgtgacttgg

SEQ ID NO: 374806 - DNA, 25 bp, Mus musculus
ccagcagatgtctggctgtgacttg

SEQ ID NO: 374807 - DNA, 25 bp, Mus musculus
tctggctgtgacttggggtcggact

SEQ ID NO: 374808 - DNA, 25 bp, Mus musculus
gcgtcggaggtcaggcccctccact

SEQ ID NO: 374809 - DNA, 25 bp, Mus musculus
cgcgggactcagacacccgggatcc

SEQ ID NO: 374810 - DNA, 25 bp, Mus musculus
aagtccacgcaacccgcgggactca

SEQ ID NO: 374811 - DNA, 25 bp, Mus musculus
ccaagggccaagagcagtggttccg

SEQ ID NO: 374812 - DNA, 25 bp, Mus musculus
cgcaacccgcgggactcagacaccc

SEQ ID NO: 374813 - DNA, 25 bp, Mus musculus
gccaagggccaagagcagtggttcc

SEQ ID NO: 374814 - DNA, 25 bp, Mus musculus
agccaagggccaagagcagtggttc

SEQ ID NO: 374815 - DNA, 25 bp, Mus musculus
ctgtcggctatgtggacaacaagga

SEQ ID NO: 374816 - DNA, 25 bp, Mus musculus
tctgtcggctatgtggacaacaagg

SEQ ID NO: 374817 - DNA, 25 bp, Mus musculus
agatgtctggctgtgacttggggtc

SEQ ID NO: 374818 - DNA, 25 bp, Mus musculus
agcggctccggtgaggactcacgcc

SEQ ID NO: 374819 - DNA, 25 bp, Mus musculus
gaggactcacgcctccggcacagag

SEQ ID NO: 374820 - DNA, 25 bp, Mus musculus
gcatcctttccaggcgcgcacttgt

SEQ ID NO: 374821 - DNA, 25 bp, Mus musculus
gctggccgacatcattcaccactgg

SEQ ID NO: 374822 - DNA, 25 bp, Mus musculus
actggaacgccaaccggctggacct

SEQ ID NO: 374823 - DNA, 25 bp, Mus musculus
cacagagcgagtgcggcccgctgac

SEQ ID NO: 374824 - DNA, 25 bp, Mus musculus
aaccggctggacctgttcgagatca

SEQ ID NO: 374825 - DNA, 25 bp, Mus musculus
gacctgttcgagatcagccagccga

SEQ ID NO: 374826 - DNA, 25 bp, Mus musculus
atcagccagccgaccgaggtgagcg

SEQ ID NO: 374827 - DNA, 25 bp, Mus musculus
ctaggggcgctcgtccttgtcgcct

SEQ ID NO: 374828 - DNA, 25 bp, Mus musculus
cggagacacacctggacgtgcactt

SEQ ID NO: 374829 - DNA, 25 bp, Mus musculus
acacctggacgtgcacttgtgtccc

SEQ ID NO: 374830 - DNA, 25 bp, Mus musculus
aggcgcgcacttgtgtcctcaggcc

SEQ ID NO: 374831 - DNA, 25 bp, Mus musculus
gccgacatcattcaccactggaacg

SEQ ID NO: 374832 - DNA, 25 bp, Mus musculus
tcaagtcccaggttcaggagcagaa

SEQ ID NO: 374833 - DNA, 25 bp, Mus musculus
agagattccaagagagcctgagcac

SEQ ID NO: 374834 - DNA, 25 bp, Mus musculus
gccagagacctcctgcttctcaagt

SEQ ID NO: 374835 - DNA, 25 bp, Mus musculus
agagcctgagcaccctgctcagcta

SEQ ID NO: 374836 - DNA, 25 bp, Mus musculus
ttccaagagagcctgagcaccctgc

SEQ ID NO: 374837 - DNA, 25 bp, Mus musculus
acacacggagagtcaagggcagtga

SEQ ID NO: 374838 - DNA, 25 bp, Mus musculus
cggaacacacggagagtcaagggca

SEQ ID NO: 374839 - DNA, 25 bp, Mus musculus
tgggaacggaacacacggagagtca

SEQ ID NO: 374840 - DNA, 25 bp, Mus musculus
gagtattgggaacggaacacacgga

SEQ ID NO: 374841 - DNA, 25 bp, Mus musculus
gtccgaagagaaacgggctctgaga

SEQ ID NO: 374842 - DNA, 25 bp, Mus musculus
attccctttcagttctgtggagtcg

SEQ ID NO: 374843 - DNA, 25 bp, Mus musculus
ctgcttctcaagtcccaggttcagg

SEQ ID NO: 374844 - DNA, 25 bp, Mus musculus
tctcgggaggaggtccgagtttcac

SEQ ID NO: 374845 - DNA, 25 bp, Mus musculus
acaggggccagagacctcctgcttc

SEQ ID NO: 374846 - DNA, 25 bp, Mus musculus
tgagcagtctgcctacgatggccgc

SEQ ID NO: 374847 - DNA, 25 bp, Mus musculus
tgaggatctgataacgtggacagcg

SEQ ID NO: 374848 - DNA, 25 bp, Mus musculus
ttacctcgccctgaatgaggatctg

SEQ ID NO: 374849 - DNA, 25 bp, Mus musculus
cctactccgagggtatgagcagtct

SEQ ID NO: 374850 - DNA, 25 bp, Mus musculus
ggggccagacggaagcctactccga

SEQ ID NO: 374851 - DNA, 25 bp, Mus musculus
ggctctcacactctccagtggttgg

SEQ ID NO: 374852 - DNA, 25 bp, Mus musculus
tgaccacgggatcccgtaggctctc

SEQ ID NO: 374853 - DNA, 25 bp, Mus musculus
cacctggaatcggtttccctttcag

SEQ ID NO: 374854 - DNA, 25 bp, Mus musculus
tcgggagcagaacccacctggaatc

SEQ ID NO: 374855 - DNA, 25 bp, Mus musculus
ccgcatcccaagtccaaggttcggg

SEQ ID NO: 374856 - DNA, 25 bp, Mus musculus
acacacaggtctccaaggaaaatga

SEQ ID NO: 374857 - DNA, 25 bp, Mus musculus
attgggagcggaacacacaggtctc

SEQ ID NO: 374858 - DNA, 25 bp, Mus musculus
ggccgccctgaaactgactgagaca

SEQ ID NO: 374859 - DNA, 25 bp, Mus musculus
ttcagtttggttgagcccacaggtg

SEQ ID NO: 374860 - DNA, 25 bp, Mus musculus
cccaagtcccagattcagaagcaga

SEQ ID NO: 374861 - DNA, 25 bp, Mus musculus
ctcgatgaggtatttcgagaccgtg

SEQ ID NO: 374862 - DNA, 25 bp, Mus musculus
tttcgagaccgtggtgtcctggtca

SEQ ID NO: 374863 - DNA, 25 bp, Mus musculus
accgtggtgtcctggtcaggcctca

SEQ ID NO: 374864 - DNA, 25 bp, Mus musculus
caggcctcagggagcccgggttcat

SEQ ID NO: 374865 - DNA, 25 bp, Mus musculus
ggccgaagtattgggagcagaccac

SEQ ID NO: 374866 - DNA, 25 bp, Mus musculus
cgcagatcaacaagcgcagtgagca

SEQ ID NO: 374867 - DNA, 25 bp, Mus musculus
tttcctttcagttcggaggagtcgc

SEQ ID NO: 374868 - DNA, 25 bp, Mus musculus
ccagattcagaagcagaacagaccc

SEQ ID NO: 374869 - DNA, 25 bp, Mus musculus
tagggtcccaagtcccagattcaga

SEQ ID NO: 374870 - DNA, 25 bp, Mus musculus
tggcaacctgggacgctgcgtcccg

SEQ ID NO: 374871 - DNA, 25 bp, Mus musculus
tgggagcagaccacgcagatcaaca

SEQ ID NO: 374872 - DNA, 25 bp, Mus musculus
gccagagacgtctagggtcccaagt

SEQ ID NO: 374873 - DNA, 25 bp, Mus musculus
cgcagtgagcagatattccgaggga

SEQ ID NO: 374874 - DNA, 25 bp, Mus musculus
cccgccagagtcagatgcccagaat

SEQ ID NO: 374875 - DNA, 25 bp, Mus musculus
cagagaaaagcaaggcctacctgga

SEQ ID NO: 374876 - DNA, 25 bp, Mus musculus
gcaggctggtgctacagagaaaagc

SEQ ID NO: 374877 - DNA, 25 bp, Mus musculus
ttctgagcagaacggacgcgggact

SEQ ID NO: 374878 - DNA, 25 bp, Mus musculus
cccaagttcgaggttctgagcagaa

SEQ ID NO: 374879 - DNA, 25 bp, Mus musculus
tgagttatttctacacctccgtgtc

SEQ ID NO: 374880 - DNA, 25 bp, Mus musculus
gcccacacttgctgagttatttcta

SEQ ID NO: 374881 - DNA, 25 bp, Mus musculus
ctccaggcccacacttgctgagtta

SEQ ID NO: 374882 - DNA, 25 bp, Mus musculus
gcagtcgcccagaccctgatcgaga

SEQ ID NO: 374883 - DNA, 25 bp, Mus musculus
ttctgctggtggcagtcgcccagac

SEQ ID NO: 374884 - DNA, 25 bp, Mus musculus
gcgtcaacaatgctgcttctgctgg

SEQ ID NO: 374885 - DNA, 25 bp, Mus musculus
caatggcgtcaacaatgctgcttct

SEQ ID NO: 374886 - DNA, 25 bp, Mus musculus
agtcagatgcccagaatcccagagg

SEQ ID NO: 374887 - DNA, 25 bp, Mus musculus
aatcccagaggggagcaatggcgtc

SEQ ID NO: 374888 - DNA, 25 bp, Mus musculus
ttgtaaagtccacgctgcccacagg

SEQ ID NO: 374889 - DNA, 25 bp, Mus musculus
gtaaagtccacgctgcccacaggag

SEQ ID NO: 374890 - DNA, 25 bp, Mus musculus
aaagtccacgctgcccacaggagtc

SEQ ID NO: 374891 - DNA, 25 bp, Mus musculus
gtccacgctgcccacaggagtcagt

SEQ ID NO: 374892 - DNA, 25 bp, Mus musculus
acgctgcccacaggagtcagtcgac

SEQ ID NO: 374893 - DNA, 25 bp, Mus musculus
aacctgggtcagttcattctgccag

SEQ ID NO: 374894 - DNA, 25 bp, Mus musculus
tgggtcagttcattctgccaggaca

SEQ ID NO: 374895 - DNA, 25 bp, Mus musculus
ggttgtaaagtccacgctgcccaca

SEQ ID NO: 374896 - DNA, 25 bp, Mus musculus
tgtaacagttctcacccctattggg

SEQ ID NO: 374897 - DNA, 25 bp, Mus musculus
cgggttgtaaagtccacgctgccca

SEQ ID NO: 374898 - DNA, 25 bp, Mus musculus
ggtcagttcattctgccaggacact

SEQ ID NO: 374899 - DNA, 25 bp, Mus musculus
agttcattctgccaggacactgatg

SEQ ID NO: 374900 - DNA, 25 bp, Mus musculus
ttcattctgccaggacactgatgac

SEQ ID NO: 374901 - DNA, 25 bp, Mus musculus
agcgggttgtaaagtccacgctgcc

SEQ ID NO: 374902 - DNA, 25 bp, Mus musculus
cggggagacccgtagcccgcaagct

SEQ ID NO: 374903 - DNA, 25 bp, Mus musculus
cggagatctccacggcggaaacccg

SEQ ID NO: 374904 - DNA, 25 bp, Mus musculus
ggggactctcccagcagcagaatga

SEQ ID NO: 374905 - DNA, 25 bp, Mus musculus
tcccagcagcagaatgacccaggca

SEQ ID NO: 374906 - DNA, 25 bp, Mus musculus
gaatgacccaggcagcggggctccc

SEQ ID NO: 374907 - DNA, 25 bp, Mus musculus
gcttctcgctacctggatccggctt

SEQ ID NO: 374908 - DNA, 25 bp, Mus musculus
cactaggcaacagtagcagccggga

SEQ ID NO: 374909 - DNA, 25 bp, Mus musculus
gcaagctggccgcagacccaggtcg

SEQ ID NO: 374910 - DNA, 25 bp, Mus musculus
aggtcactcacctcgcagccggcta

SEQ ID NO: 374911 - DNA, 25 bp, Mus musculus
aagagcaccgaaagacctgcccgct

SEQ ID NO: 374912 - DNA, 25 bp, Mus musculus
ctgctgacagccgtacctgtgactc

SEQ ID NO: 374913 - DNA, 25 bp, Mus musculus
gccgtacctgtgactctgatcacta

SEQ ID NO: 374914 - DNA, 25 bp, Mus musculus
gtgactctgatcactagtcttcgcg

SEQ ID NO: 374915 - DNA, 25 bp, Mus musculus
cggcccgtcactaggcaacagtagc

SEQ ID NO: 374916 - DNA, 25 bp, Mus musculus
cactccatgaggtatttcgaaacct

SEQ ID NO: 374917 - DNA, 25 bp, Mus musculus
ctcacactccatgaggtatttcgaa

SEQ ID NO: 374918 - DNA, 25 bp, Mus musculus
cacagcccgagggactcagacgccc

SEQ ID NO: 374919 - DNA, 25 bp, Mus musculus
gtacctgcaatacgcatacgacggc

SEQ ID NO: 374920 - DNA, 25 bp, Mus musculus
catgaggtatttcgaaacctccgtt

SEQ ID NO: 374921 - DNA, 25 bp, Mus musculus
gcgggtacctgcaatacgcatacga

SEQ ID NO: 374922 - DNA, 25 bp, Mus musculus
ccgcgggtacctgcaatacgcatac

SEQ ID NO: 374923 - DNA, 25 bp, Mus musculus
cggacactgattgaggctatcaggt

SEQ ID NO: 374924 - DNA, 25 bp, Mus musculus
tgattgaggctatcaggtctcaccc

SEQ ID NO: 374925 - DNA, 25 bp, Mus musculus
aggggctgactgcaggatcccgcag

SEQ ID NO: 374926 - DNA, 25 bp, Mus musculus
acccccatgagtggcgcgttcctgg

SEQ ID NO: 374927 - DNA, 25 bp, Mus musculus
cagagtttccatgtgagcctgagga

SEQ ID NO: 374928 - DNA, 25 bp, Mus musculus
accaaccagcgtcgccgcgccactg

SEQ ID NO: 374929 - DNA, 25 bp, Mus musculus
gtccacacagcccgagggactcaga

SEQ ID NO: 374930 - DNA, 25 bp, Mus musculus
ttcgctcgcggggtaaactgaggaa

SEQ ID NO: 374931 - DNA, 25 bp, Mus musculus
gctcccgccgaggtttgacagccaa

SEQ ID NO: 374932 - DNA, 25 bp, Mus musculus
tgcgcagactcctccttcggaattc

SEQ ID NO: 374933 - DNA, 25 bp, Mus musculus
cttctgattggccatctgagttgca

SEQ ID NO: 374934 - DNA, 25 bp, Mus musculus
atctgagttgcacccatttgctcta

SEQ ID NO: 374935 - DNA, 25 bp, Mus musculus
ctgaggaagggattccgtaccctgc

SEQ ID NO: 374936 - DNA, 25 bp, Mus musculus
catttgctctattggccgatgcgca

SEQ ID NO: 374937 - DNA, 25 bp, Mus musculus
ccacttctgattggccggcacgttt

SEQ ID NO: 374938 - DNA, 25 bp, Mus musculus
agggtgcctgcttgcacctttcttc

SEQ ID NO: 374939 - DNA, 25 bp, Mus musculus
atttccggtagggagaaatggagct

SEQ ID NO: 374940 - DNA, 25 bp, Mus musculus
aaatggagctgtagagcagcccgcc

SEQ ID NO: 374941 - DNA, 25 bp, Mus musculus
cgtctagactgggtgctaggtgtaa

SEQ ID NO: 374942 - DNA, 25 bp, Mus musculus
gcgcagacgggtccctaattctgta

SEQ ID NO: 374943 - DNA, 25 bp, Mus musculus
attctgtaacaaagtggatctcacc

SEQ ID NO: 374944 - DNA, 25 bp, Mus musculus
catctgagttggaaagctgcccgcc

SEQ ID NO: 374945 - DNA, 25 bp, Mus musculus
ggccatgcgcctctaactcgaacgt

SEQ ID NO: 374946 - DNA, 25 bp, Mus musculus
cgtcccggcgaactcagagccgata

SEQ ID NO: 374947 - DNA, 25 bp, Mus musculus
caggcgcatgcgtaaaagactctcg

SEQ ID NO: 374948 - DNA, 25 bp, Mus musculus
tggaatcactgaaaccagggcgtcc

SEQ ID NO: 374949 - DNA, 25 bp, Mus musculus
gctcctccggctttctggctagaag

SEQ ID NO: 374950 - DNA, 25 bp, Mus musculus
ggctagaagcgggtatcactgcgtt

SEQ ID NO: 374951 - DNA, 25 bp, Mus musculus
gagttctcgaacacaagcacgccca

SEQ ID NO: 374952 - DNA, 25 bp, Mus musculus
cagacgtctgaagccgcgtagattt

SEQ ID NO: 374953 - DNA, 25 bp, Mus musculus
cactgacgcggacacgaaaggttgg

SEQ ID NO: 374954 - DNA, 25 bp, Mus musculus
aggagctgtgcttctgccgcttcca

SEQ ID NO: 374955 - DNA, 25 bp, Mus musculus
cttccagaagcgcttgacgtcgctg

SEQ ID NO: 374956 - DNA, 25 bp, Mus musculus
accatcagccgcttggccgagttct

SEQ ID NO: 374957 - DNA, 25 bp, Mus musculus
tcactgcgttgggtagggaaacgcc

SEQ ID NO: 374958 - DNA, 25 bp, Mus musculus
gggagagttggcgccgtccctcctc

SEQ ID NO: 374959 - DNA, 25 bp, Mus musculus
agcgcgtagcctccactaggtgatc

SEQ ID NO: 374960 - DNA, 25 bp, Mus musculus
tagcctccactaggtgatccgcacg

SEQ ID NO: 374961 - DNA, 25 bp, Mus musculus
ccactaggtgatccgcacgcccatc

SEQ ID NO: 374962 - DNA, 25 bp, Mus musculus
cccgatgctggggtacagcagcacc

SEQ ID NO: 374963 - DNA, 25 bp, Mus musculus
atgctggggtacagcagcaccatca

SEQ ID NO: 374964 - DNA, 25 bp, Mus musculus
gcagcaccatcaggggcccgctaag

SEQ ID NO: 374965 - DNA, 25 bp, Mus musculus
agagaagcacggagaagcggcccca

SEQ ID NO: 374966 - DNA, 25 bp, Mus musculus
gcacgcaggaaggaacgggttccca

SEQ ID NO: 374967 - DNA, 25 bp, Mus musculus
cgcaggaaggaacgggttcccacag

SEQ ID NO: 374968 - DNA, 25 bp, Mus musculus
gcccagcaccggagcgagagctgca

SEQ ID NO: 374969 - DNA, 25 bp, Mus musculus
cgctcctctcctagtgcggtacccg

SEQ ID NO: 374970 - DNA, 25 bp, Mus musculus
gggtacagcagcaccatcaggggcc

SEQ ID NO: 374971 - DNA, 25 bp, Mus musculus
tagtgcggtacccgccctgcaagtg

SEQ ID NO: 374972 - DNA, 25 bp, Mus musculus
tacctggtgcgagagaacgtatccc

SEQ ID NO: 374973 - DNA, 25 bp, Mus musculus
aaacgcagccgaagggtgctctacc

SEQ ID NO: 374974 - DNA, 25 bp, Mus musculus
taccctcgagtggtgagtatcgccc

SEQ ID NO: 374975 - DNA, 25 bp, Mus musculus
gcagggaccttcgatctgacgtttc

SEQ ID NO: 374976 - DNA, 25 bp, Mus musculus
tcttttatctgctcaggtccggcgc

SEQ ID NO: 374977 - DNA, 25 bp, Mus musculus
agagggtcctctttctcctgttcgc

SEQ ID NO: 374978 - DNA, 25 bp, Mus musculus
agcgccgtgacacctgagcccattt

SEQ ID NO: 374979 - DNA, 25 bp, Mus musculus
tgtccaccgcgcgtttgaacacttc

SEQ ID NO: 374980 - DNA, 25 bp, Mus musculus
gagcccatttctgcgcccattactg

SEQ ID NO: 374981 - DNA, 25 bp, Mus musculus
agcctttgaacctgacctcggagtc

SEQ ID NO: 374982 - DNA, 25 bp, Mus musculus
tcctcggactatgcgctggatctta

SEQ ID NO: 374983 - DNA, 25 bp, Mus musculus
cggccttctaaacgcgatgggtcac

SEQ ID NO: 374984 - DNA, 25 bp, Mus musculus
cgatgggtcacagtccgaagaaaca

SEQ ID NO: 374985 - DNA, 25 bp, Mus musculus
ctgggatttctaaggcaacgctaac

SEQ ID NO: 374986 - DNA, 25 bp, Mus musculus
gcgggtagatgagaaagcgccacta

SEQ ID NO: 374987 - DNA, 25 bp, Mus musculus
caccaaggttgtgtccgccgcagag

SEQ ID NO: 374988 - DNA, 25 bp, Mus musculus
acagcctgtgtctagccagacttgc

SEQ ID NO: 374989 - DNA, 25 bp, Mus musculus
acctgctcccgggatgaggtcagta

SEQ ID NO: 374990 - DNA, 25 bp, Mus musculus
cgcataccggaggacactcgtctta

SEQ ID NO: 374991 - DNA, 25 bp, Mus musculus
atcaggtgacgtgcaatcttggaga

SEQ ID NO: 374992 - DNA, 25 bp, Mus musculus
gcagtgtagccggatgacctgctcc

SEQ ID NO: 374993 - DNA, 25 bp, Mus musculus
acgcagtgtagccacgcagtgtagc

SEQ ID NO: 374994 - DNA, 25 bp, Mus musculus
ctgtggctcaagttcacgcagtgta

SEQ ID NO: 374995 - DNA, 25 bp, Mus musculus
tgacccaagcaaacccagtacagtg

SEQ ID NO: 374996 - DNA, 25 bp, Mus musculus
ctcagcgggcaagactcctcaatga

SEQ ID NO: 374997 - DNA, 25 bp, Mus musculus
atcttggagacgatcctcagcgggc

SEQ ID NO: 374998 - DNA, 25 bp, Mus musculus
tcgcttaggtgggttgggacctatc

SEQ ID NO: 374999 - DNA, 25 bp, Mus musculus
aggtcagtatgtgcgcagactcctg

SEQ ID NO: 375000 - DNA, 25 bp, Mus musculus
gggcggagcttccacgccaatgctt

SEQ ID NO: 375001 - DNA, 25 bp, Mus musculus
ccgagaactgtagtgctgcggaccc

SEQ ID NO: 375002 - DNA, 25 bp, Mus musculus
aactgtagtgctgcggacccgagcg

SEQ ID NO: 375003 - DNA, 25 bp, Mus musculus
tctgttgctgcaacagggtgcggcc

SEQ ID NO: 375004 - DNA, 25 bp, Mus musculus
ggggcgcaagtgcagcttccactaa

SEQ ID NO: 375005 - DNA, 25 bp, Mus musculus
agtgcagcttccactaagccgggtg

SEQ ID NO: 375006 - DNA, 25 bp, Mus musculus
agcttccactaagccgggtgtccga

SEQ ID NO: 375007 - DNA, 25 bp, Mus musculus
ccactaagccgggtgtccgagcagt

SEQ ID NO: 375008 - DNA, 25 bp, Mus musculus
ctaagccgggtgtccgagcagtccc

SEQ ID NO: 375009 - DNA, 25 bp, Mus musculus
cgcgcttctcaagaccccggtgggg

SEQ ID NO: 375010 - DNA, 25 bp, Mus musculus
ctgggctgccgagaactgtagtgct

SEQ ID NO: 375011 - DNA, 25 bp, Mus musculus
cgggtattcaggaaccagagtggaa

SEQ ID NO: 375012 - DNA, 25 bp, Mus musculus
gagaatgtctggcatccccctgggc

SEQ ID NO: 375013 - DNA, 25 bp, Mus musculus
tattcaggaaccagagtggaagggc

SEQ ID NO: 375014 - DNA, 25 bp, Mus musculus
cgtccacggaagacggcggcaactg

SEQ ID NO: 375015 - DNA, 25 bp, Mus musculus
gccgagacgagatggttcaggtctc

SEQ ID NO: 375016 - DNA, 25 bp, Mus musculus
acgccgctcatggtggccgagacga

SEQ ID NO: 375017 - DNA, 25 bp, Mus musculus
cagccagctttcgaaggtcagcatt

SEQ ID NO: 375018 - DNA, 25 bp, Mus musculus
cagcattaagctggcccgggaaacg

SEQ ID NO: 375019 - DNA, 25 bp, Mus musculus
tttcgaaggtcagcattaagctggc

SEQ ID NO: 375020 - DNA, 25 bp, Mus musculus
tactgctggcttccacggctggtga

SEQ ID NO: 375021 - DNA, 25 bp, Mus musculus
ttcaggcacagtgagggcccggtac

SEQ ID NO: 375022 - DNA, 25 bp, Mus musculus
ctgctgggtaagttcaggcacagtg

SEQ ID NO: 375023 - DNA, 25 bp, Mus musculus
catcgaagacctgctgggtaagttc

SEQ ID NO: 375024 - DNA, 25 bp, Mus musculus
ttggcatcgaagacctgctgggtaa

SEQ ID NO: 375025 - DNA, 25 bp, Mus musculus
aagacggcggcaactgtgaggtacc

SEQ ID NO: 375026 - DNA, 25 bp, Mus musculus
cgagatggttcaggtctccgtaggt

SEQ ID NO: 375027 - DNA, 25 bp, Mus musculus
agggcccggtactgctggcttccac

SEQ ID NO: 375028 - DNA, 25 bp, Mus musculus
taggggccgcattgtccctgcgcgc

SEQ ID NO: 375029 - DNA, 25 bp, Mus musculus
cacccttcggctacaatttagcggc

SEQ ID NO: 375030 - DNA, 25 bp, Mus musculus
ccacccttcggctacaatttagcgg

SEQ ID NO: 375031 - DNA, 25 bp, Mus musculus
ggccactgcagtcgcccacccctta

SEQ ID NO: 375032 - DNA, 25 bp, Mus musculus
ccttacgtgctccacgtgactgcgg

SEQ ID NO: 375033 - DNA, 25 bp, Mus musculus
ttacgtgctccacgtgactgcggtg

SEQ ID NO: 375034 - DNA, 25 bp, Mus musculus
gcgggccgctcctccagcaaaccac

SEQ ID NO: 375035 - DNA, 25 bp, Mus musculus
tcctccagcaaaccacaaaggcggg

SEQ ID NO: 375036 - DNA, 25 bp, Mus musculus
cctccagcaaaccacaaaggcggga

SEQ ID NO: 375037 - DNA, 25 bp, Mus musculus
tccagcaaaccacaaaggcgggagc

SEQ ID NO: 375038 - DNA, 25 bp, Mus musculus
ccagcaaaccacaaaggcgggagca

SEQ ID NO: 375039 - DNA, 25 bp, Mus musculus
cccttcggctacaatttagcggccg

SEQ ID NO: 375040 - DNA, 25 bp, Mus musculus
gcaaaccacaaaggcgggagcagcg

SEQ ID NO: 375041 - DNA, 25 bp, Mus musculus
agcaaaccacaaaggcgggagcagc

SEQ ID NO: 375042 - DNA, 25 bp, Mus musculus
ctgcagcagcgagatgcaagcacga

SEQ ID NO: 375043 - DNA, 25 bp, Mus musculus
cgagatgcaagcacgaccgcaggaa

SEQ ID NO: 375044 - DNA, 25 bp, Mus musculus
atgcaagcacgaccgcaggaaggtt

SEQ ID NO: 375045 - DNA, 25 bp, Mus musculus
caggaaggttctaagaggcagaaga

SEQ ID NO: 375046 - DNA, 25 bp, Mus musculus
aaggttctaagaggcagaagaggcc

SEQ ID NO: 375047 - DNA, 25 bp, Mus musculus
gtcttagacaaagcctacccaacca

SEQ ID NO: 375048 - DNA, 25 bp, Mus musculus
accagtcgctgattagaccaaccga

SEQ ID NO: 375049 - DNA, 25 bp, Mus musculus
ttagaccaaccgatcacgtgccagg

SEQ ID NO: 375050 - DNA, 25 bp, Mus musculus
ccaggcggccattggtttctgagcc

SEQ ID NO: 375051 - DNA, 25 bp, Mus musculus
gcggccattggtttctgagccagtg

SEQ ID NO: 375052 - DNA, 25 bp, Mus musculus
attggtttctgagccagtggcgagc

SEQ ID NO: 375053 - DNA, 25 bp, Mus musculus
gctgattagaccaaccgatcacgtg

SEQ ID NO: 375054 - DNA, 25 bp, Mus musculus
agcctacccaaccagtcgctgatta

SEQ ID NO: 375055 - DNA, 25 bp, Mus musculus
aaccgatcacgtgccaggcggccat

SEQ ID NO: 375056 - DNA, 25 bp, Mus musculus
caacaggtcgggaagcgccaaatct

SEQ ID NO: 375057 - DNA, 25 bp, Mus musculus
ggccaggtcagacaacacaccactg

SEQ ID NO: 375058 - DNA, 25 bp, Mus musculus
cagggagcctcaacctaggatgacg

SEQ ID NO: 375059 - DNA, 25 bp, Mus musculus
gttatagccactcacagggagcctc

SEQ ID NO: 375060 - DNA, 25 bp, Mus musculus
ccgcggcagcagcacaaagttatag

SEQ ID NO: 375061 - DNA, 25 bp, Mus musculus
gaggaaccgcctgtcagcctgtgct

SEQ ID NO: 375062 - DNA, 25 bp, Mus musculus
tcggctccttcccttcaggaacgag

SEQ ID NO: 375063 - DNA, 25 bp, Mus musculus
atccggagtcactggaaaggcggcc

SEQ ID NO: 375064 - DNA, 25 bp, Mus musculus
gctctcagccttgggccctgcgttt

SEQ ID NO: 375065 - DNA, 25 bp, Mus musculus
gcctggcccagctcggaaacagatc

SEQ ID NO: 375066 - DNA, 25 bp, Mus musculus
cctttaaagacactagcgggagaga

SEQ ID NO: 375067 - DNA, 25 bp, Mus musculus
gcgccaaatctctcggactgcatga

SEQ ID NO: 375068 - DNA, 25 bp, Mus musculus
cccgcaggactaagaagatctgaga

SEQ ID NO: 375069 - DNA, 25 bp, Mus musculus
ggactgcatgaaaacccggaccagc

SEQ ID NO: 375070 - DNA, 25 bp, Mus musculus
accgattttggcgttgtaagctcca

SEQ ID NO: 375071 - DNA, 25 bp, Mus musculus
tacgtgtcctgtccctcgggaacga

SEQ ID NO: 375072 - DNA, 25 bp, Mus musculus
atggcgtctgtggatcacgcaaatc

SEQ ID NO: 375073 - DNA, 25 bp, Mus musculus
cgcaaatcggaaagcatagtctgtc

SEQ ID NO: 375074 - DNA, 25 bp, Mus musculus
tcgggaacgacgaccacttacgaga

SEQ ID NO: 375075 - DNA, 25 bp, Mus musculus
tgtcaagttaaaaggcgtacgtgtc

SEQ ID NO: 375076 - DNA, 25 bp, Mus musculus
actgtcatggctgtaaccgattttg

SEQ ID NO: 375077 - DNA, 25 bp, Mus musculus
tccattatccagaactagggtcgtc

SEQ ID NO: 375078 - DNA, 25 bp, Mus musculus
agggtcgtcatttcggcacgcacca

SEQ ID NO: 375079 - DNA, 25 bp, Mus musculus
cggagtcgctttcccactgtttgaa

SEQ ID NO: 375080 - DNA, 25 bp, Mus musculus
actgtttgaatctcctctgctcagg

SEQ ID NO: 375081 - DNA, 25 bp, Mus musculus
aggcttcttccggtactctatggtc

SEQ ID NO: 375082 - DNA, 25 bp, Mus musculus
gcagcccttcctgtgcttgtatcca

SEQ ID NO: 375083 - DNA, 25 bp, Mus musculus
tcgattttcggtggcagcgacattc

SEQ ID NO: 375084 - DNA, 25 bp, Mus musculus
agactctctggtaggcgtttggaaa

SEQ ID NO: 375085 - DNA, 25 bp, Mus musculus
ggtaactggcgccagactctctggt

SEQ ID NO: 375086 - DNA, 25 bp, Mus musculus
cgccacctggtagcggccgttactg

SEQ ID NO: 375087 - DNA, 25 bp, Mus musculus
taaaagacagttccaggagccaatc

SEQ ID NO: 375088 - DNA, 25 bp, Mus musculus
ggcgcgcttccagcagtaaaagaca

SEQ ID NO: 375089 - DNA, 25 bp, Mus musculus
cgacttgaatcaatcggcgcgcttc

SEQ ID NO: 375090 - DNA, 25 bp, Mus musculus
gcggggcttccgacttgaatcaatc

SEQ ID NO: 375091 - DNA, 25 bp, Mus musculus
gccggtagccgcacatttgagctgt

SEQ ID NO: 375092 - DNA, 25 bp, Mus musculus
agcgttttcttcagcctgtttcccg

SEQ ID NO: 375093 - DNA, 25 bp, Mus musculus
gccacaccctcctgattagcgtttt

SEQ ID NO: 375094 - DNA, 25 bp, Mus musculus
acccaatcacggtgcgggattctca

SEQ ID NO: 375095 - DNA, 25 bp, Mus musculus
tggcctagggcactacccaatcacg

SEQ ID NO: 375096 - DNA, 25 bp, Mus musculus
agtagtccgtggatgacgtagcgac

SEQ ID NO: 375097 - DNA, 25 bp, Mus musculus
cgtttggaaatctgcgcgggaagta

SEQ ID NO: 375098 - DNA, 25 bp, Mus musculus
gattcttgttctttgcagtgatgaa

SEQ ID NO: 375099 - DNA, 25 bp, Mus musculus
tgttctttgcagtgatgaagaggtc

SEQ ID NO: 375100 - DNA, 25 bp, Mus musculus
ccggagggctgtaacactcgggagt

SEQ ID NO: 375101 - DNA, 25 bp, Mus musculus
agtgaggtggtctctatccaggaca

SEQ ID NO: 375102 - DNA, 25 bp, Mus musculus
tgaggtggtctctatccaggacata

SEQ ID NO: 375103 - DNA, 25 bp, Mus musculus
ggtctctatccaggacatactttct

SEQ ID NO: 375104 - DNA, 25 bp, Mus musculus
cactgatgaagaacaaggtcagcaa

SEQ ID NO: 375105 - DNA, 25 bp, Mus musculus
cagcgacactgatgaagaacaaggt

SEQ ID NO: 375106 - DNA, 25 bp, Mus musculus
tgggcagcgacactgatgaagaaca

SEQ ID NO: 375107 - DNA, 25 bp, Mus musculus
gcttgggcagcgacactgatgaaga

SEQ ID NO: 375108 - DNA, 25 bp, Mus musculus
ctttggcttgggcagcgacactgat

SEQ ID NO: 375109 - DNA, 25 bp, Mus musculus
accctttggcttgggcagcgacact

SEQ ID NO: 375110 - DNA, 25 bp, Mus musculus
tcaccctttggcttgggcagcgaca

SEQ ID NO: 375111 - DNA, 25 bp, Mus musculus
aggtggtctctatccaggacatact

SEQ ID NO: 375112 - DNA, 25 bp, Mus musculus
agcagtcgcgggaaccctgagcccg

SEQ ID NO: 375113 - DNA, 25 bp, Mus musculus
tgacagcgctgagattcgacccaca

SEQ ID NO: 375114 - DNA, 25 bp, Mus musculus
cctttggcaccggagtggaattcgt

SEQ ID NO: 375115 - DNA, 25 bp, Mus musculus
aagctccgcgctgctcgccatggca

SEQ ID NO: 375116 - DNA, 25 bp, Mus musculus
caccggagtggaattcgtgcgtttc

SEQ ID NO: 375117 - DNA, 25 bp, Mus musculus
gggattccaactccgcgctgtgacg

SEQ ID NO: 375118 - DNA, 25 bp, Mus musculus
attcgtgcgtttcacctccctgagg

SEQ ID NO: 375119 - DNA, 25 bp, Mus musculus
ctgacgacgcctgggattccaactc

SEQ ID NO: 375120 - DNA, 25 bp, Mus musculus
cagctgccctgacgacgcctgggat

SEQ ID NO: 375121 - DNA, 25 bp, Mus musculus
ggtagccgcagaccagctgccctga

SEQ ID NO: 375122 - DNA, 25 bp, Mus musculus
acccacaagggtagccgcagaccag

SEQ ID NO: 375123 - DNA, 25 bp, Mus musculus
cgctgagattcgacccacaagggta

SEQ ID NO: 375124 - DNA, 25 bp, Mus musculus
cgagaacactgacagcgctgagatt

SEQ ID NO: 375125 - DNA, 25 bp, Mus musculus
cttcatcctggcctttggcaccgga

SEQ ID NO: 375126 - DNA, 25 bp, Mus musculus
aggagcggcgagagatgggaagggc

SEQ ID NO: 375127 - DNA, 25 bp, Mus musculus
aagggcgggtccgactccaagcagc

SEQ ID NO: 375128 - DNA, 25 bp, Mus musculus
ctccaagcagctgccgcttcctccc

SEQ ID NO: 375129 - DNA, 25 bp, Mus musculus
agggcgggtccgactccaagcagct

SEQ ID NO: 375130 - DNA, 25 bp, Mus musculus
ccatgtccctcagggggcctgagtc

SEQ ID NO: 375131 - DNA, 25 bp, Mus musculus
gggcctgagtcacgggccgccgccc

SEQ ID NO: 375132 - DNA, 25 bp, Mus musculus
cccgggtcggccagctggagaagtg

SEQ ID NO: 375133 - DNA, 25 bp, Mus musculus
agaagtgggtctggacaccccgctt

SEQ ID NO: 375134 - DNA, 25 bp, Mus musculus
tgggtctggacaccccgcttcttcg

SEQ ID NO: 375135 - DNA, 25 bp, Mus musculus
cttcttcggggctgcaaggaaggaa

SEQ ID NO: 375136 - DNA, 25 bp, Mus musculus
tgcaaggaaggaagcgggtgaaggt

SEQ ID NO: 375137 - DNA, 25 bp, Mus musculus
aaggaagcgggtgaaggtctctgga

SEQ ID NO: 375138 - DNA, 25 bp, Mus musculus
ggcgggtccgactccaagcagctgc

SEQ ID NO: 375139 - DNA, 25 bp, Mus musculus
tccgactccaagcagctgccgcttc

SEQ ID NO: 375140 - DNA, 25 bp, Mus musculus
agtcttgactgaatccgctcacttc

SEQ ID NO: 375141 - DNA, 25 bp, Mus musculus
tcttgactgaatccgctcacttctc

SEQ ID NO: 375142 - DNA, 25 bp, Mus musculus
gggaggcagtcttgactgaatccgc

SEQ ID NO: 375143 - DNA, 25 bp, Mus musculus
gcagtcttgactgaatccgctcact

SEQ ID NO: 375144 - DNA, 25 bp, Mus musculus
aggcagtcttgactgaatccgctca

SEQ ID NO: 375145 - DNA, 25 bp, Mus musculus
aagaggcgccggcgcccttgcctgt

SEQ ID NO: 375146 - DNA, 25 bp, Mus musculus
gcgcccttgcctgtttcccggtctc

SEQ ID NO: 375147 - DNA, 25 bp, Mus musculus
tggacctctgccctctacatctgtc

SEQ ID NO: 375148 - DNA, 25 bp, Mus musculus
ctctacatctgtcctcacctcctca

SEQ ID NO: 375149 - DNA, 25 bp, Mus musculus
acctcctcacctcctgcccgatctc

SEQ ID NO: 375150 - DNA, 25 bp, Mus musculus
gcccgatctcctcgcccttcgccgt

SEQ ID NO: 375151 - DNA, 25 bp, Mus musculus
cttcgccgtctggttccctgttctt

SEQ ID NO: 375152 - DNA, 25 bp, Mus musculus
ttcgccgtctggttccctgttcttc

SEQ ID NO: 375153 - DNA, 25 bp, Mus musculus
tgactgaatccgctcacttctcagc

SEQ ID NO: 375154 - DNA, 25 bp, Mus musculus
ggcaggccactcacagccgaattgg

SEQ ID NO: 375155 - DNA, 25 bp, Mus musculus
ccctgaagctctggagcaaggtgtg

SEQ ID NO: 375156 - DNA, 25 bp, Mus musculus
cgggacttcgccctgaagctctgga

SEQ ID NO: 375157 - DNA, 25 bp, Mus musculus
cgcctccgccgaggagttcgtgcag

SEQ ID NO: 375158 - DNA, 25 bp, Mus musculus
gcagttcctgatcggcaccgcacag

SEQ ID NO: 375159 - DNA, 25 bp, Mus musculus
agcgagcggcacgtcgcgcagttcc

SEQ ID NO: 375160 - DNA, 25 bp, Mus musculus
gcggtagtaccgcaggctctgtccc

SEQ ID NO: 375161 - DNA, 25 bp, Mus musculus
aattggagtctctacggcagccgga

SEQ ID NO: 375162 - DNA, 25 bp, Mus musculus
cggtctgtggaattggagtctctac

SEQ ID NO: 375163 - DNA, 25 bp, Mus musculus
caccgtcgatccctggccggaagag

SEQ ID NO: 375164 - DNA, 25 bp, Mus musculus
aggctgtgcatgaaagcctcttgca

SEQ ID NO: 375165 - DNA, 25 bp, Mus musculus
gagcgcgactctttccgggtttcgc

SEQ ID NO: 375166 - DNA, 25 bp, Mus musculus
gcctcttgcacttagcgtcgggaaa

SEQ ID NO: 375167 - DNA, 25 bp, Mus musculus
aagaggctgcgcgatttgaacccgc

SEQ ID NO: 375168 - DNA, 25 bp, Mus musculus
taaagcgcgcgggaaacatctcccg

SEQ ID NO: 375169 - DNA, 25 bp, Mus musculus
gcccgcaaagcggtcgaccagtcgt

SEQ ID NO: 375170 - DNA, 25 bp, Mus musculus
aggagcagcgcttgactgacagccg

SEQ ID NO: 375171 - DNA, 25 bp, Mus musculus
gagacccgggcgaactgacgactca

SEQ ID NO: 375172 - DNA, 25 bp, Mus musculus
gaactgacgactcagccacctgtca

SEQ ID NO: 375173 - DNA, 25 bp, Mus musculus
ctgtcagcctcaagtccaggaggaa

SEQ ID NO: 375174 - DNA, 25 bp, Mus musculus
ccaggaggaaattctgggaaagctg

SEQ ID NO: 375175 - DNA, 25 bp, Mus musculus
ggaaagctgtttcaccgctcgcagt

SEQ ID NO: 375176 - DNA, 25 bp, Mus musculus
cgctcgcagtccgaacaacttaatg

SEQ ID NO: 375177 - DNA, 25 bp, Mus musculus
aacttaatgatctcccgaatggtgg

SEQ ID NO: 375178 - DNA, 25 bp, Mus musculus
gaaggcggaaagtgccgagcttccc

SEQ ID NO: 375179 - DNA, 25 bp, Mus musculus
tgagagacccacatacacagccacg

SEQ ID NO: 375180 - DNA, 25 bp, Mus musculus
cacagccacgcgcagcggctggaaa

SEQ ID NO: 375181 - DNA, 25 bp, Mus musculus
gagaggcaggttggcgcatcataaa

SEQ ID NO: 375182 - DNA, 25 bp, Mus musculus
cgctcgcccgcacgttcgcacaccg

SEQ ID NO: 375183 - DNA, 25 bp, Mus musculus
agttctcagcgctcacggtaagtcc

SEQ ID NO: 375184 - DNA, 25 bp, Mus musculus
tgccgctgctcgctgccttgctgcc

SEQ ID NO: 375185 - DNA, 25 bp, Mus musculus
tgctgccgccacagctgtgctggct

SEQ ID NO: 375186 - DNA, 25 bp, Mus musculus
ctccagcgtcaccatgctgccgcca

SEQ ID NO: 375187 - DNA, 25 bp, Mus musculus
tcgcacaccggatcttcgccgagtg

SEQ ID NO: 375188 - DNA, 25 bp, Mus musculus
gcagaagttctcagcgctcacggta

SEQ ID NO: 375189 - DNA, 25 bp, Mus musculus
gaccgcggagcagttctagcccgct

SEQ ID NO: 375190 - DNA, 25 bp, Mus musculus
accagcggccataggaccgcggagc

SEQ ID NO: 375191 - DNA, 25 bp, Mus musculus
ggccgtgcggtctccaccagcggcc

SEQ ID NO: 375192 - DNA, 25 bp, Mus musculus
aaactagggcgggttgacagcagca

SEQ ID NO: 375193 - DNA, 25 bp, Mus musculus
tcagcgctcacggtaagtcccggga

SEQ ID NO: 375194 - DNA, 25 bp, Mus musculus
cgctcacggtaagtcccgggacgcg

SEQ ID NO: 375195 - DNA, 25 bp, Mus musculus
acaccggatcttcgccgagtgccag

SEQ ID NO: 375196 - DNA, 25 bp, Mus musculus
gaaaacggagagaccgtgcgcctgc

SEQ ID NO: 375197 - DNA, 25 bp, Mus musculus
cgcgtcccgtctccgtctcctcgcc

SEQ ID NO: 375198 - DNA, 25 bp, Mus musculus
cggtacatggtgttccgggagtgaa

SEQ ID NO: 375199 - DNA, 25 bp, Mus musculus
ccggctctgaggagggtctccgccc

SEQ ID NO: 375200 - DNA, 25 bp, Mus musculus
tcacacgtgcagcacacgggtggtc

SEQ ID NO: 375201 - DNA, 25 bp, Mus musculus
ctccaggcacaggtaagaacggcgg

SEQ ID NO: 375202 - DNA, 25 bp, Mus musculus
tcacctccaggcacaggtaagaacg

SEQ ID NO: 375203 - DNA, 25 bp, Mus musculus
ttcaagtcacctccaggcacaggta

SEQ ID NO: 375204 - DNA, 25 bp, Mus musculus
aggcccgcagttccggcctctctgc

SEQ ID NO: 375205 - DNA, 25 bp, Mus musculus
accgttctgcaggtgcaccacaggc

SEQ ID NO: 375206 - DNA, 25 bp, Mus musculus
aggaccgttctgcaggtgcaccaca

SEQ ID NO: 375207 - DNA, 25 bp, Mus musculus
agcctttcgggcaggaccgttctgc

SEQ ID NO: 375208 - DNA, 25 bp, Mus musculus
cagcggccagcctttcgggcaggac

SEQ ID NO: 375209 - DNA, 25 bp, Mus musculus
aacggagagaccgtgcgcctgcgca

SEQ ID NO: 375210 - DNA, 25 bp, Mus musculus
ccgggaacagcgcatccacatcgaa

SEQ ID NO: 375211 - DNA, 25 bp, Mus musculus
acacaacgtcacttccgctaagagg

SEQ ID NO: 375212 - DNA, 25 bp, Mus musculus
gcgcatccacatcgaacgggaactc

SEQ ID NO: 375213 - DNA, 25 bp, Mus musculus
taagtctttatctctaggacccgcc

SEQ ID NO: 375214 - DNA, 25 bp, Mus musculus
tcacttccgctaagagggccggtaa

SEQ ID NO: 375215 - DNA, 25 bp, Mus musculus
atggcccattgtgcgggaccagaca

SEQ ID NO: 375216 - DNA, 25 bp, Mus musculus
ctccatggcccattgtgcgggacca

SEQ ID NO: 375217 - DNA, 25 bp, Mus musculus
acgggaactccatggcccattgtgc

SEQ ID NO: 375218 - DNA, 25 bp, Mus musculus
tcgaacgggaactccatggcccatt

SEQ ID NO: 375219 - DNA, 25 bp, Mus musculus
atccacatcgaacgggaactccatg

SEQ ID NO: 375220 - DNA, 25 bp, Mus musculus
gaacagcgcatccacatcgaacggg

SEQ ID NO: 375221 - DNA, 25 bp, Mus musculus
cacggtgatccgctccgggaacagc

SEQ ID NO: 375222 - DNA, 25 bp, Mus musculus
caggtgctggtccagcacggtgatc

SEQ ID NO: 375223 - DNA, 25 bp, Mus musculus
gagggccggtaagtctttatctcta

SEQ ID NO: 375224 - DNA, 25 bp, Mus musculus
gtgtgccagtgaaacgttaaccttg

SEQ ID NO: 375225 - DNA, 25 bp, Mus musculus
cgggcaccatggctgggatcatcaa

SEQ ID NO: 375226 - DNA, 25 bp, Mus musculus
ccaggccctcgagtctcttctgaga

SEQ ID NO: 375227 - DNA, 25 bp, Mus musculus
gagagtgatctctccggcgcttctc

SEQ ID NO: 375228 - DNA, 25 bp, Mus musculus
cctgagcgtcatgcttcgggctctc

SEQ ID NO: 375229 - DNA, 25 bp, Mus musculus
gaagcacctctccaggtcagcgagc

SEQ ID NO: 375230 - DNA, 25 bp, Mus musculus
gctgcagagttttccgattttgttc

SEQ ID NO: 375231 - DNA, 25 bp, Mus musculus
taggggaaattaagcaggacttctc

SEQ ID NO: 375232 - DNA, 25 bp, Mus musculus
aggacttctccgcttcggccagttc

SEQ ID NO: 375233 - DNA, 25 bp, Mus musculus
cagttctccgtggaagtcgttttca

SEQ ID NO: 375234 - DNA, 25 bp, Mus musculus
gtcgttttcagtcccgcatcgcgtt

SEQ ID NO: 375235 - DNA, 25 bp, Mus musculus
gcatcgcgttcgttcttgctgcaga

SEQ ID NO: 375236 - DNA, 25 bp, Mus musculus
gtctcttaggtgatgctgcagccaa

SEQ ID NO: 375237 - DNA, 25 bp, Mus musculus
taaccttgggattgttctcggtgcc

SEQ ID NO: 375238 - DNA, 25 bp, Mus musculus
accagctttagaagcgtgtgccgca

SEQ ID NO: 375239 - DNA, 25 bp, Mus musculus
gccatcttgacgcacaccggacgta

SEQ ID NO: 375240 - DNA, 25 bp, Mus musculus
tccaacgttttacctgagctacata

SEQ ID NO: 375241 - DNA, 25 bp, Mus musculus
tcacatgtctaagggcggaagcgtc

SEQ ID NO: 375242 - DNA, 25 bp, Mus musculus
gcggggtccacagacgcgaatttaa

SEQ ID NO: 375243 - DNA, 25 bp, Mus musculus
tgcgtcacaatcgaaccagccttca

SEQ ID NO: 375244 - DNA, 25 bp, Mus musculus
cccggaccagtcacgatgaatccta

SEQ ID NO: 375245 - DNA, 25 bp, Mus musculus
ttaaccagggtgctcccagtgcgca

SEQ ID NO: 375246 - DNA, 25 bp, Mus musculus
ggccaatcagagttcgcctcgcgca

SEQ ID NO: 375247 - DNA, 25 bp, Mus musculus
ggcggttctccatcacgttagggtg

SEQ ID NO: 375248 - DNA, 25 bp, Mus musculus
cgccattctggggttcgtttagagg

SEQ ID NO: 375249 - DNA, 25 bp, Mus musculus
gggcagccacgtttttccctaatgc

SEQ ID NO: 375250 - DNA, 25 bp, Mus musculus
cggtagttagaaatcgcgcgccgta

SEQ ID NO: 375251 - DNA, 25 bp, Mus musculus
tgcagggctgacacgtagacatgtg

SEQ ID NO: 375252 - DNA, 25 bp, Mus musculus
cgtcccaacgcctaagcagctgatg

SEQ ID NO: 375253 - DNA, 25 bp, Mus musculus
gggcagcgcgtcatgaccgtcccaa

SEQ ID NO: 375254 - DNA, 25 bp, Mus musculus
cacctacttgactggagtgggcagc

SEQ ID NO: 375255 - DNA, 25 bp, Mus musculus
tgtggccagagacgtcacctacttg

SEQ ID NO: 375256 - DNA, 25 bp, Mus musculus
ggcgggctctccatgtaggctccgc

SEQ ID NO: 375257 - DNA, 25 bp, Mus musculus
cagttaagagtcctccagcggcgcc

SEQ ID NO: 375258 - DNA, 25 bp, Mus musculus
catcgcggcggcagttaagagtcct

SEQ ID NO: 375259 - DNA, 25 bp, Mus musculus
gctgttgcttgggacccttcggcat

SEQ ID NO: 375260 - DNA, 25 bp, Mus musculus
atgcgcaggacccacgctccatgga

SEQ ID NO: 375261 - DNA, 25 bp, Mus musculus
gtccgcctctctgggctctaggacg

SEQ ID NO: 375262 - DNA, 25 bp, Mus musculus
tgacatatggtcttcccgtctcccg

SEQ ID NO: 375263 - DNA, 25 bp, Mus musculus
gtccctccctcggtgacatatggtc

SEQ ID NO: 375264 - DNA, 25 bp, Mus musculus
aattctagttcctgtcctgccgtcc

SEQ ID NO: 375265 - DNA, 25 bp, Mus musculus
caccgcggtaggaaagaagtcaaca

SEQ ID NO: 375266 - DNA, 25 bp, Mus musculus
caaaagtccttgtcccgctcgcttt

SEQ ID NO: 375267 - DNA, 25 bp, Mus musculus
actgccacttggtagcgcccgtgac

SEQ ID NO: 375268 - DNA, 25 bp, Mus musculus
taccgagtcctgttgccgcaggcca

SEQ ID NO: 375269 - DNA, 25 bp, Mus musculus
gcaatctccttaccgagtcctgttg

SEQ ID NO: 375270 - DNA, 25 bp, Mus musculus
agtgaacctgcctcttccgcaatct

SEQ ID NO: 375271 - DNA, 25 bp, Mus musculus
gctcgcacgtgtggccagtgaacct

SEQ ID NO: 375272 - DNA, 25 bp, Mus musculus
gcatcctaaggtcgccacatccggg

SEQ ID NO: 375273 - DNA, 25 bp, Mus musculus
acgcgagaggcctgtcgcatcctaa

SEQ ID NO: 375274 - DNA, 25 bp, Mus musculus
acaccggacaggcttcgggactctg

SEQ ID NO: 375275 - DNA, 25 bp, Mus musculus
ttcctctccacgtgggaaagcacca

SEQ ID NO: 375276 - DNA, 25 bp, Mus musculus
ttgtgcagttcctctccacgtggga

SEQ ID NO: 375277 - DNA, 25 bp, Mus musculus
gccatgccgaggaagaagcccttca

SEQ ID NO: 375278 - DNA, 25 bp, Mus musculus
aagcccttcagcgtgaagcagaaga

SEQ ID NO: 375279 - DNA, 25 bp, Mus musculus
gttcgctcctacaaggtgcctcgct

SEQ ID NO: 375280 - DNA, 25 bp, Mus musculus
catctcgatctcgagcgggagtgcg

SEQ ID NO: 375281 - DNA, 25 bp, Mus musculus
gcaggacctgcatgtcgtccacata

SEQ ID NO: 375282 - DNA, 25 bp, Mus musculus
aggacctgcatgtcgtccacatagc

SEQ ID NO: 375283 - DNA, 25 bp, Mus musculus
acctgcatgtcgtccacatagccga

SEQ ID NO: 375284 - DNA, 25 bp, Mus musculus
atgtcgtccacatagccgacgatta

SEQ ID NO: 375285 - DNA, 25 bp, Mus musculus
ccacatagccgacgattatgaacca

SEQ ID NO: 375286 - DNA, 25 bp, Mus musculus
catagccgacgattatgaaccaggg

SEQ ID NO: 375287 - DNA, 25 bp, Mus musculus
ggacacagcggtgtagaaataccta

SEQ ID NO: 375288 - DNA, 25 bp, Mus musculus
cacagcggtgtagaaatacctaagc

SEQ ID NO: 375289 - DNA, 25 bp, Mus musculus
cggtgtagaaatacctaagcgagtg

SEQ ID NO: 375290 - DNA, 25 bp, Mus musculus
aaatacctaagcgagtgtgaacctg

SEQ ID NO: 375291 - DNA, 25 bp, Mus musculus
atacctaagcgagtgtgaacctggg

SEQ ID NO: 375292 - DNA, 25 bp, Mus musculus
acctaagcgagtgtgaacctgggag

SEQ ID NO: 375293 - DNA, 25 bp, Mus musculus
cccatctcgatctcgagcgggagtg

SEQ ID NO: 375294 - DNA, 25 bp, Mus musculus
ccctggctttccgagtctcccgctc

SEQ ID NO: 375295 - DNA, 25 bp, Mus musculus
gtcaagatgacccaggcccgtctca

SEQ ID NO: 375296 - DNA, 25 bp, Mus musculus
gacaatgatgaaccggggctctccg

SEQ ID NO: 375297 - DNA, 25 bp, Mus musculus
ccatgtccctggctttccgagtctc

SEQ ID NO: 375298 - DNA, 25 bp, Mus musculus
atcccagccgcagtcactcaccgtc

SEQ ID NO: 375299 - DNA, 25 bp, Mus musculus
agctgtgatcccagccgcagtcact

SEQ ID NO: 375300 - DNA, 25 bp, Mus musculus
tgatcatagctgtgatcccagccgc

SEQ ID NO: 375301 - DNA, 25 bp, Mus musculus
catggagtgatcatagctgtgatcc

SEQ ID NO: 375302 - DNA, 25 bp, Mus musculus
tctcaggggacatggagtgatcata

SEQ ID NO: 375303 - DNA, 25 bp, Mus musculus
cccgtctcaggggacatggagtgat

SEQ ID NO: 375304 - DNA, 25 bp, Mus musculus
gacccaggcccgtctcaggggacat

SEQ ID NO: 375305 - DNA, 25 bp, Mus musculus
caagatgacccaggcccgtctcagg

SEQ ID NO: 375306 - DNA, 25 bp, Mus musculus
catagctgtgatcccagccgcagtc

SEQ ID NO: 375307 - DNA, 25 bp, Mus musculus
gccgggatacgacggtgtggaaata

SEQ ID NO: 375308 - DNA, 25 bp, Mus musculus
gacttgcacttagagatatgcgagg

SEQ ID NO: 375309 - DNA, 25 bp, Mus musculus
ttgcacttagagatatgcgaggcta

SEQ ID NO: 375310 - DNA, 25 bp, Mus musculus
acttgcacttagagatatgcgaggc

SEQ ID NO: 375311 - DNA, 25 bp, Mus musculus
ctgacttgcacttagagatatgcga

SEQ ID NO: 375312 - DNA, 25 bp, Mus musculus
tctgacttgcacttagagatatgcg

SEQ ID NO: 375313 - DNA, 25 bp, Mus musculus
ctctgacttgcacttagagatatgc

SEQ ID NO: 375314 - DNA, 25 bp, Mus musculus
cctctgacttgcacttagagatatg

SEQ ID NO: 375315 - DNA, 25 bp, Mus musculus
gaccgcctctgacttgcacttagag

SEQ ID NO: 375316 - DNA, 25 bp, Mus musculus
tgcacttagagatatgcgaggctaa

SEQ ID NO: 375317 - DNA, 25 bp, Mus musculus
gcacttagagatatgcgaggctaag

SEQ ID NO: 375318 - DNA, 25 bp, Mus musculus
acttagagatatgcgaggctaagtt

SEQ ID NO: 375319 - DNA, 25 bp, Mus musculus
gcgaggctaagttggtcgcggtcca

SEQ ID NO: 375320 - DNA, 25 bp, Mus musculus
aagttggtcgcggtccaggagcgca

SEQ ID NO: 375321 - DNA, 25 bp, Mus musculus
cgaccgcctctgacttgcacttaga

SEQ ID NO: 375322 - DNA, 25 bp, Mus musculus
ccctgtctagggacatttcgagctc

SEQ ID NO: 375323 - DNA, 25 bp, Mus musculus
cgacagagatgaatcggggttcccg

SEQ ID NO: 375324 - DNA, 25 bp, Mus musculus
gtccaccagcggactcctccaaagt

SEQ ID NO: 375325 - DNA, 25 bp, Mus musculus
agccgaacaacagctggaacgtgtg

SEQ ID NO: 375326 - DNA, 25 bp, Mus musculus
gagcagcattcgctgcgccattgtc

SEQ ID NO: 375327 - DNA, 25 bp, Mus musculus
accgccttcactctggttgtagtag

SEQ ID NO: 375328 - DNA, 25 bp, Mus musculus
actcaccgccttcactctggttgta

SEQ ID NO: 375329 - DNA, 25 bp, Mus musculus
gacatttcgagctcgtgacctccca

SEQ ID NO: 375330 - DNA, 25 bp, Mus musculus
acttgggattggagatctccggccc

SEQ ID NO: 375331 - DNA, 25 bp, Mus musculus
gctcgccctggcctagtccaccagc

SEQ ID NO: 375332 - DNA, 25 bp, Mus musculus
gggatcccaaggtcagcgccgctca

SEQ ID NO: 375333 - DNA, 25 bp, Mus musculus
acgtgtgaaggcctgcgggatccca

SEQ ID NO: 375334 - DNA, 25 bp, Mus musculus
acagctggaacgtgtgaaggcctgc

SEQ ID NO: 375335 - DNA, 25 bp, Mus musculus
attcgctgcgccattgtcccatctg

SEQ ID NO: 375336 - DNA, 25 bp, Mus musculus
tcgggccaacacaaccgcggccact

SEQ ID NO: 375337 - DNA, 25 bp, Mus musculus
tggttgaccgctctaagtttgtctc

SEQ ID NO: 375338 - DNA, 25 bp, Mus musculus
gaccgctctaagtttgtctctctta

SEQ ID NO: 375339 - DNA, 25 bp, Mus musculus
aagtttgtctctcttagttgcagta

SEQ ID NO: 375340 - DNA, 25 bp, Mus musculus
tctctcttagttgcagtactggcta

SEQ ID NO: 375341 - DNA, 25 bp, Mus musculus
cttagttgcagtactggctacgcca

SEQ ID NO: 375342 - DNA, 25 bp, Mus musculus
tgcagtactggctacgccaaggcgc

SEQ ID NO: 375343 - DNA, 25 bp, Mus musculus
tactggctacgccaaggcgcgaggt

SEQ ID NO: 375344 - DNA, 25 bp, Mus musculus
caaggcgcgaggtgaggtgccaaaa

SEQ ID NO: 375345 - DNA, 25 bp, Mus musculus
aggtgccaaaagccgcgctgtggat

SEQ ID NO: 375346 - DNA, 25 bp, Mus musculus
gcgcgtccacctcgggccaacacaa

SEQ ID NO: 375347 - DNA, 25 bp, Mus musculus
actcctgcgggctggtgtctgcaga

SEQ ID NO: 375348 - DNA, 25 bp, Mus musculus
tggcactgtggttgaccgctctaag

SEQ ID NO: 375349 - DNA, 25 bp, Mus musculus
cactgtggttgaccgctctaagttt

SEQ ID NO: 375350 - DNA, 25 bp, Mus musculus
tggttgcaggaggcaccattggagc

SEQ ID NO: 375351 - DNA, 25 bp, Mus musculus
gctgctggttgcaggaggcaccatt

SEQ ID NO: 375352 - DNA, 25 bp, Mus musculus
gcactgaagcggcccagcgagttcg

SEQ ID NO: 375353 - DNA, 25 bp, Mus musculus
ggcactgaagcggcccagcgagttc

SEQ ID NO: 375354 - DNA, 25 bp, Mus musculus
cggcactgaagcggcccagcgagtt

SEQ ID NO: 375355 - DNA, 25 bp, Mus musculus
ggcggcactgaagcggcccagcgag

SEQ ID NO: 375356 - DNA, 25 bp, Mus musculus
gggcggcactgaagcggcccagcga

SEQ ID NO: 375357 - DNA, 25 bp, Mus musculus
gttgcaggaggcaccattggagccg

SEQ ID NO: 375358 - DNA, 25 bp, Mus musculus
ttgcaggaggcaccattggagccgg

SEQ ID NO: 375359 - DNA, 25 bp, Mus musculus
ggttgcaggaggcaccattggagcc

SEQ ID NO: 375360 - DNA, 25 bp, Mus musculus
ctggttgcaggaggcaccattggag

SEQ ID NO: 375361 - DNA, 25 bp, Mus musculus
gctggttgcaggaggcaccattgga

SEQ ID NO: 375362 - DNA, 25 bp, Mus musculus
tgctggttgcaggaggcaccattgg

SEQ ID NO: 375363 - DNA, 25 bp, Mus musculus
ctgctggttgcaggaggcaccattg

SEQ ID NO: 375364 - DNA, 25 bp, Mus musculus
tccaggctgggcgtttgtacgcacg

SEQ ID NO: 375365 - DNA, 25 bp, Mus musculus
agggctcggcgttctctgagctcag

SEQ ID NO: 375366 - DNA, 25 bp, Mus musculus
cagcgccggagcatcctgctcaggg

SEQ ID NO: 375367 - DNA, 25 bp, Mus musculus
tcatcagcctcagagcgctccttga

SEQ ID NO: 375368 - DNA, 25 bp, Mus musculus
gctcgactcgctccctcctcatcag

SEQ ID NO: 375369 - DNA, 25 bp, Mus musculus
ggttcgataccctctagctctgggg

SEQ ID NO: 375370 - DNA, 25 bp, Mus musculus
tgagctcagcatcctccttccgttc

SEQ ID NO: 375371 - DNA, 25 bp, Mus musculus
cgtttgtacgcacgggcctccgctg

SEQ ID NO: 375372 - DNA, 25 bp, Mus musculus
gcatcctgctcagggctcggcgttc

SEQ ID NO: 375373 - DNA, 25 bp, Mus musculus
cgcggaacccaggtggatccaggct

SEQ ID NO: 375374 - DNA, 25 bp, Mus musculus
gctgccgtggttcgataccctctag

SEQ ID NO: 375375 - DNA, 25 bp, Mus musculus
ccattgtagaagctgcgcggagaga

SEQ ID NO: 375376 - DNA, 25 bp, Mus musculus
cctctgcccaaacacaggctgctcc

SEQ ID NO: 375377 - DNA, 25 bp, Mus musculus
ttgagctcctcagtgccggagcatc

SEQ ID NO: 375378 - DNA, 25 bp, Mus musculus
ttgtagtagccaagcagggtacttc

SEQ ID NO: 375379 - DNA, 25 bp, Mus musculus
caggccagggcggtcgcctgcagca

SEQ ID NO: 375380 - DNA, 25 bp, Mus musculus
cccgtgcgcgtctgggtccaggcca

SEQ ID NO: 375381 - DNA, 25 bp, Mus musculus
cgcacccacccgtgcgcgtctgggt

SEQ ID NO: 375382 - DNA, 25 bp, Mus musculus
ccggtcttgcgacgtggctggagaa

SEQ ID NO: 375383 - DNA, 25 bp, Mus musculus
cccgggcttgtgagcgggtctggaa

SEQ ID NO: 375384 - DNA, 25 bp, Mus musculus
gcggcgcgcagtgaaaccctgacct

SEQ ID NO: 375385 - DNA, 25 bp, Mus musculus
aactgcgtgtagtccacgtcgccgg

SEQ ID NO: 375386 - DNA, 25 bp, Mus musculus
cagggtacttcacttggaaactctt

SEQ ID NO: 375387 - DNA, 25 bp, Mus musculus
gcagggtacttcacttggaaactct

SEQ ID NO: 375388 - DNA, 25 bp, Mus musculus
caagcagggtacttcacttggaaac

SEQ ID NO: 375389 - DNA, 25 bp, Mus musculus
agccaagcagggtacttcacttgga

SEQ ID NO: 375390 - DNA, 25 bp, Mus musculus
ccttctggcaatcaggaagggtctg

SEQ ID NO: 375391 - DNA, 25 bp, Mus musculus
agtagccaagcagggtacttcactt

SEQ ID NO: 375392 - DNA, 25 bp, Mus musculus
cctggagcttcatccatggcgcacg

SEQ ID NO: 375393 - DNA, 25 bp, Mus musculus
aacatggggtcactcaccacccttg

SEQ ID NO: 375394 - DNA, 25 bp, Mus musculus
cccaagatcttgctatctaatgggg

SEQ ID NO: 375395 - DNA, 25 bp, Mus musculus
tggaaactcttctcatggccctctg

SEQ ID NO: 375396 - DNA, 25 bp, Mus musculus
cgacttttgtctgtagctcccagta

SEQ ID NO: 375397 - DNA, 25 bp, Mus musculus
ccaaggtggctggtttcccaagatc

SEQ ID NO: 375398 - DNA, 25 bp, Mus musculus
gggttgtgacttccaacatggggtc

SEQ ID NO: 375399 - DNA, 25 bp, Mus musculus
tcatccatggcgcacgcggctcata

SEQ ID NO: 375400 - DNA, 25 bp, Mus musculus
gcagaagcagctttcgctgcacttg

SEQ ID NO: 375401 - DNA, 25 bp, Mus musculus
ctgagttctgagatctgccaggact

SEQ ID NO: 375402 - DNA, 25 bp, Mus musculus
tctgccaggacttcacaaccagagc

SEQ ID NO: 375403 - DNA, 25 bp, Mus musculus
accagagcccttggccaaggtggct

SEQ ID NO: 375404 - DNA, 25 bp, Mus musculus
tggctggtttcccaagatcttgcta

SEQ ID NO: 375405 - DNA, 25 bp, Mus musculus
tggccctctgcgacttttgtctgta

SEQ ID NO: 375406 - DNA, 25 bp, Mus musculus
tcctcccgggaccttcggtggctgc

SEQ ID NO: 375407 - DNA, 25 bp, Mus musculus
acctggcgaagtcgtgacctccgac

SEQ ID NO: 375408 - DNA, 25 bp, Mus musculus
tagacttgggactggagatctctgt

SEQ ID NO: 375409 - DNA, 25 bp, Mus musculus
acagccgtacatcctctgaaatgtg

SEQ ID NO: 375410 - DNA, 25 bp, Mus musculus
taggccctgagcgtctctgcaacac

SEQ ID NO: 375411 - DNA, 25 bp, Mus musculus
gagcgtctctgcaacaccaccctgc

SEQ ID NO: 375412 - DNA, 25 bp, Mus musculus
ccctgctcccacctgcgtcgagtga

SEQ ID NO: 375413 - DNA, 25 bp, Mus musculus
tcgctgccgtcgtaagcgaactgcc

SEQ ID NO: 375414 - DNA, 25 bp, Mus musculus
gccgtcgtaagcgaactgccagtac

SEQ ID NO: 375415 - DNA, 25 bp, Mus musculus
agcctgcgggatcccagtgtgaacc

SEQ ID NO: 375416 - DNA, 25 bp, Mus musculus
gtcgtaagcgaactgccagtacccg

SEQ ID NO: 375417 - DNA, 25 bp, Mus musculus
tcctctgaaatgtgtgagagcctgc

SEQ ID NO: 375418 - DNA, 25 bp, Mus musculus
caggtcacagccgtacatcctctga

SEQ ID NO: 375419 - DNA, 25 bp, Mus musculus
acttgggactggagatctctgtccc

SEQ ID NO: 375420 - DNA, 25 bp, Mus musculus
tccaggtgctttctggatgaagaag

SEQ ID NO: 375421 - DNA, 25 bp, Mus musculus
agaaagtcagccttcctcctcggca

SEQ ID NO: 375422 - DNA, 25 bp, Mus musculus
ttagaagtacttcagaaagtcagcc

SEQ ID NO: 375423 - DNA, 25 bp, Mus musculus
ccagagatggagacatttagaagta

SEQ ID NO: 375424 - DNA, 25 bp, Mus musculus
agcgtcgccttccaactcccgagca

SEQ ID NO: 375425 - DNA, 25 bp, Mus musculus
tcctggacctaagaaacacttattg

SEQ ID NO: 375426 - DNA, 25 bp, Mus musculus
tgttcaaagaattaagagttcaggg

SEQ ID NO: 375427 - DNA, 25 bp, Mus musculus
tcagatgaggacattaggagaaaca

SEQ ID NO: 375428 - DNA, 25 bp, Mus musculus
tggaacagtgcactctcagatgagg

SEQ ID NO: 375429 - DNA, 25 bp, Mus musculus
ttcatttgtggaacagtgcactctc

SEQ ID NO: 375430 - DNA, 25 bp, Mus musculus
agtagccttcatttgtggaacagtg

SEQ ID NO: 375431 - DNA, 25 bp, Mus musculus
tgtttaaggacacaaaatcagtgta

SEQ ID NO: 375432 - DNA, 25 bp, Mus musculus
gaaacacttattgtttaaggacaca

SEQ ID NO: 375433 - DNA, 25 bp, Mus musculus
tggatgaagaaggaccagcccactt

SEQ ID NO: 375434 - DNA, 25 bp, Mus musculus
ccagcagggtccttagatgcacttg

SEQ ID NO: 375435 - DNA, 25 bp, Mus musculus
agggtccttagatgcacttggaaac

SEQ ID NO: 375436 - DNA, 25 bp, Mus musculus
gtagtagcccagcagggtccttaga

SEQ ID NO: 375437 - DNA, 25 bp, Mus musculus
agtagcccagcagggtccttagatg

SEQ ID NO: 375438 - DNA, 25 bp, Mus musculus
tagcccagcagggtccttagatgca

SEQ ID NO: 375439 - DNA, 25 bp, Mus musculus
gcccagcagggtccttagatgcact

SEQ ID NO: 375440 - DNA, 25 bp, Mus musculus
cccagcagggtccttagatgcactt

SEQ ID NO: 375441 - DNA, 25 bp, Mus musculus
agcagggtccttagatgcacttgga

SEQ ID NO: 375442 - DNA, 25 bp, Mus musculus
ggtccttagatgcacttggaaactc

SEQ ID NO: 375443 - DNA, 25 bp, Mus musculus
tccttagatgcacttggaaactctt

SEQ ID NO: 375444 - DNA, 25 bp, Mus musculus
ctcaggacgcgggtcgagaaggggc

SEQ ID NO: 375445 - DNA, 25 bp, Mus musculus
cccatctggcaatcagggcgggtct

SEQ ID NO: 375446 - DNA, 25 bp, Mus musculus
ccatctggcaatcagggcgggtctg

SEQ ID NO: 375447 - DNA, 25 bp, Mus musculus
cagggtccttagatgcacttggaaa

SEQ ID NO: 375448 - DNA, 25 bp, Mus musculus
ttctcatggccctctgcgacttttg

SEQ ID NO: 375449 - DNA, 25 bp, Mus musculus
gccgggacatggcagtggagaaata

SEQ ID NO: 375450 - DNA, 25 bp, Mus musculus
tcatccatggcgcacgcggctcata

SEQ ID NO: 375451 - DNA, 25 bp, Mus musculus
agcttcatccatggcgcacgcggct

SEQ ID NO: 375452 - DNA, 25 bp, Mus musculus
cctggagcttcatccatggcgcacg

SEQ ID NO: 375453 - DNA, 25 bp, Mus musculus
cgacttttgtctgtagctcccagta

SEQ ID NO: 375454 - DNA, 25 bp, Mus musculus
cctctgcgacttttgtctgtagctc

SEQ ID NO: 375455 - DNA, 25 bp, Mus musculus
gcagaagcagctttcgctgcacttg

SEQ ID NO: 375456 - DNA, 25 bp, Mus musculus
tcatggccctctgcgacttttgtct

SEQ ID NO: 375457 - DNA, 25 bp, Mus musculus
aaactcttctcatggccctctgcga

SEQ ID NO: 375458 - DNA, 25 bp, Mus musculus
tggaaactcttctcatggccctctg

SEQ ID NO: 375459 - DNA, 25 bp, Mus musculus
gacttccaacatggggtcactcacc

SEQ ID NO: 375460 - DNA, 25 bp, Mus musculus
aacatggggtcactcaccacccttg

SEQ ID NO: 375461 - DNA, 25 bp, Mus musculus
tggccctctgcgacttttgtctgta

SEQ ID NO: 375462 - DNA, 25 bp, Mus musculus
ggcgaggacacagagatgaagaaaa

SEQ ID NO: 375463 - DNA, 25 bp, Mus musculus
cgaggacacagagatgaagaaaagc

SEQ ID NO: 375464 - DNA, 25 bp, Mus musculus
cacagagatgaagaaaagccaaggc

SEQ ID NO: 375465 - DNA, 25 bp, Mus musculus
tcgcgtcggcacacgaaagccgcgg

SEQ ID NO: 375466 - DNA, 25 bp, Mus musculus
accgcccgggcgaggacacagagat

SEQ ID NO: 375467 - DNA, 25 bp, Mus musculus
taccgcccgggcgaggacacagaga

SEQ ID NO: 375468 - DNA, 25 bp, Mus musculus
gtcggcacacgaaagccgcggcgtc

SEQ ID NO: 375469 - DNA, 25 bp, Mus musculus
gactcgcgtcggcacacgaaagccg

SEQ ID NO: 375470 - DNA, 25 bp, Mus musculus
ggtgactcgcgtcggcacacgaaag

SEQ ID NO: 375471 - DNA, 25 bp, Mus musculus
gggtgactcgcgtcggcacacgaaa

SEQ ID NO: 375472 - DNA, 25 bp, Mus musculus
gcacaatccacagacgacgggtccc

SEQ ID NO: 375473 - DNA, 25 bp, Mus musculus
acgcacaatccacagacgacgggtc

SEQ ID NO: 375474 - DNA, 25 bp, Mus musculus
ggacgcacaatccacagacgacggg

SEQ ID NO: 375475 - DNA, 25 bp, Mus musculus
cgggacgcacaatccacagacgacg

SEQ ID NO: 375476 - DNA, 25 bp, Mus musculus
aggaggtcgccttcctagtagaccg

SEQ ID NO: 375477 - DNA, 25 bp, Mus musculus
ggccgcgcccttaaacatggccatt

SEQ ID NO: 375478 - DNA, 25 bp, Mus musculus
ctgctcccgtctgagcgcctgccag

SEQ ID NO: 375479 - DNA, 25 bp, Mus musculus
ccaggcggtcccatgtccctgctcc

SEQ ID NO: 375480 - DNA, 25 bp, Mus musculus
agcccgtgactgaggcccgggccag

SEQ ID NO: 375481 - DNA, 25 bp, Mus musculus
ccgggtcaggccctgagcccgtgac

SEQ ID NO: 375482 - DNA, 25 bp, Mus musculus
aattcggcttgcacggcattccggc

SEQ ID NO: 375483 - DNA, 25 bp, Mus musculus
ggtcaaattcggcttgcacggcatt

SEQ ID NO: 375484 - DNA, 25 bp, Mus musculus
ggcattcacggtcaaattcggcttg

SEQ ID NO: 375485 - DNA, 25 bp, Mus musculus
gcggcgggcattcacggtcaaattc

SEQ ID NO: 375486 - DNA, 25 bp, Mus musculus
cgtgagtggacactttggacgttga

SEQ ID NO: 375487 - DNA, 25 bp, Mus musculus
tcgccttcctagtagaccgtgagtg

SEQ ID NO: 375488 - DNA, 25 bp, Mus musculus
ttattgggaggaggtcgccttccta

SEQ ID NO: 375489 - DNA, 25 bp, Mus musculus
cctagtagaccgtgagtggacactt

SEQ ID NO: 375490 - DNA, 25 bp, Mus musculus
gagcgcgtctcacctggtacaggaa

SEQ ID NO: 375491 - DNA, 25 bp, Mus musculus
aggacggccatccaggttactctgc

SEQ ID NO: 375492 - DNA, 25 bp, Mus musculus
cactgggcccgccatgagtgtctgc

SEQ ID NO: 375493 - DNA, 25 bp, Mus musculus
cacctggtacaggaagctgagtctc

SEQ ID NO: 375494 - DNA, 25 bp, Mus musculus
atccaggttactctgcggccgcaac

SEQ ID NO: 375495 - DNA, 25 bp, Mus musculus
caccctgtgccttactgccggagga

SEQ ID NO: 375496 - DNA, 25 bp, Mus musculus
cttactgccggaggaccagccgctt

SEQ ID NO: 375497 - DNA, 25 bp, Mus musculus
ggaccagccgcttcgcgatggtttt

SEQ ID NO: 375498 - DNA, 25 bp, Mus musculus
ccgcttcgcgatggttttctctgtg

SEQ ID NO: 375499 - DNA, 25 bp, Mus musculus
tctctgtgtggcagtaaaacctagc

SEQ ID NO: 375500 - DNA, 25 bp, Mus musculus
ggcagtaaaacctagccagcgcctg

SEQ ID NO: 375501 - DNA, 25 bp, Mus musculus
cagcgcctggttctcggggttctga

SEQ ID NO: 375502 - DNA, 25 bp, Mus musculus
agcctgggaacaaggacggccatcc

SEQ ID NO: 375503 - DNA, 25 bp, Mus musculus
agctgagtctctggaaggcttcccg

SEQ ID NO: 375504 - DNA, 25 bp, Mus musculus
ttcacccggggagaccaaaggcagc

SEQ ID NO: 375505 - DNA, 25 bp, Mus musculus
cgccgcttcccgtggctgaggtgct

SEQ ID NO: 375506 - DNA, 25 bp, Mus musculus
cgtggccgacctgagagtctatgct

SEQ ID NO: 375507 - DNA, 25 bp, Mus musculus
cggcggtgtattacgtggccgacct

SEQ ID NO: 375508 - DNA, 25 bp, Mus musculus
gttgtgggcgttgggccacactttc

SEQ ID NO: 375509 - DNA, 25 bp, Mus musculus
ccgcagaggctcaagctggtcctcg

SEQ ID NO: 375510 - DNA, 25 bp, Mus musculus
caagcaacgccggacgcgctgacgt

SEQ ID NO: 375511 - DNA, 25 bp, Mus musculus
cctgcgcggctagtttaccgggcga

SEQ ID NO: 375512 - DNA, 25 bp, Mus musculus
ggcgcgacacacaatactcgccgga

SEQ ID NO: 375513 - DNA, 25 bp, Mus musculus
ccggctgacgtactcgccgggcgta

SEQ ID NO: 375514 - DNA, 25 bp, Mus musculus
atgtcgcagcccagacccgcgatga

SEQ ID NO: 375515 - DNA, 25 bp, Mus musculus
agtctatgctggcacgtcacttccg

SEQ ID NO: 375516 - DNA, 25 bp, Mus musculus
gcgtcagtttcacccggggagacca

SEQ ID NO: 375517 - DNA, 25 bp, Mus musculus
acccgcgatgactgcgtcagtttca

SEQ ID NO: 375518 - DNA, 25 bp, Mus musculus
cgcttcacctctttggccgctgcct

SEQ ID NO: 375519 - DNA, 25 bp, Mus musculus
gcactggccgcttccgatttcactt

SEQ ID NO: 375520 - DNA, 25 bp, Mus musculus
tggaagacaaccgtgacgcactggc

SEQ ID NO: 375521 - DNA, 25 bp, Mus musculus
cctcagcagctggaagacaaccgtg

SEQ ID NO: 375522 - DNA, 25 bp, Mus musculus
ctcgcgcgacctcagcagctggaag

SEQ ID NO: 375523 - DNA, 25 bp, Mus musculus
ttggcaagagccaatcccagggctg

SEQ ID NO: 375524 - DNA, 25 bp, Mus musculus
atggagtttggcaagagccaatccc

SEQ ID NO: 375525 - DNA, 25 bp, Mus musculus
cctgaagttcccattggaggatgga

SEQ ID NO: 375526 - DNA, 25 bp, Mus musculus
tgacgtcaagaatcctgaagttccc

SEQ ID NO: 375527 - DNA, 25 bp, Mus musculus
tgcccagtgatcagtgacgtcaaga

SEQ ID NO: 375528 - DNA, 25 bp, Mus musculus
ctgcctggggatttgcccagtgatc

SEQ ID NO: 375529 - DNA, 25 bp, Mus musculus
tgccggctgcttgctcaggacctac

SEQ ID NO: 375530 - DNA, 25 bp, Mus musculus
cccagggctggtcccagagaaatct

SEQ ID NO: 375531 - DNA, 25 bp, Mus musculus
ccagagaaatctcggcggagggccc

SEQ ID NO: 375532 - DNA, 25 bp, Mus musculus
gggaattacagctacttgcggttga

SEQ ID NO: 375533 - DNA, 25 bp, Mus musculus
gcggccaggatgtggtctctatacc

SEQ ID NO: 375534 - DNA, 25 bp, Mus musculus
agctgcagtctgtcacttgcggcca

SEQ ID NO: 375535 - DNA, 25 bp, Mus musculus
tgtacgtgtcggacagcactccgca

SEQ ID NO: 375536 - DNA, 25 bp, Mus musculus
ggccaaataggagccgggaattaca

SEQ ID NO: 375537 - DNA, 25 bp, Mus musculus
ctgcacgtggtccagggccaaatag

SEQ ID NO: 375538 - DNA, 25 bp, Mus musculus
ccctgttgatgatcctggcgtccca

SEQ ID NO: 375539 - DNA, 25 bp, Mus musculus
cttcccagcacagcgactgcagatg

SEQ ID NO: 375540 - DNA, 25 bp, Mus musculus
acccaggtgcacgaatcttggtctg

SEQ ID NO: 375541 - DNA, 25 bp, Mus musculus
tggcgacctcgctattctccagaca

SEQ ID NO: 375542 - DNA, 25 bp, Mus musculus
cgagagcctggcgttacctcacttc

SEQ ID NO: 375543 - DNA, 25 bp, Mus musculus
ggaaagctgctctattctcgcgaga

SEQ ID NO: 375544 - DNA, 25 bp, Mus musculus
gcttgtcgcaagctgcaatccctgg

SEQ ID NO: 375545 - DNA, 25 bp, Mus musculus
cgcacccgagcttcgacgactatga

SEQ ID NO: 375546 - DNA, 25 bp, Mus musculus
caccgctggacttggcagcactgta

SEQ ID NO: 375547 - DNA, 25 bp, Mus musculus
tttaaaggcgatgctgctgtcctgc

SEQ ID NO: 375548 - DNA, 25 bp, Mus musculus
tctggaagctgtgcgtttaaaggcg

SEQ ID NO: 375549 - DNA, 25 bp, Mus musculus
ctgtcaagtgagtctggaagctgtg

SEQ ID NO: 375550 - DNA, 25 bp, Mus musculus
agcccgcaacggtcacaaggccgtg

SEQ ID NO: 375551 - DNA, 25 bp, Mus musculus
atgagctgtaacacccggaagcaca

SEQ ID NO: 375552 - DNA, 25 bp, Mus musculus
ctgagggtggtgaagatgatcatca

SEQ ID NO: 375553 - DNA, 25 bp, Mus musculus
cccacgattaggaacagcaaactcg

SEQ ID NO: 375554 - DNA, 25 bp, Mus musculus
gttgcggttctcctagaggaactca

SEQ ID NO: 375555 - DNA, 25 bp, Mus musculus
cactcggaagtagttgcggttctcc

SEQ ID NO: 375556 - DNA, 25 bp, Mus musculus
agcgcaatacggacactcggaagta

SEQ ID NO: 375557 - DNA, 25 bp, Mus musculus
cctccactgtgcagcgcaatacgga

SEQ ID NO: 375558 - DNA, 25 bp, Mus musculus
cgccttaactagaacaacgagaacg

SEQ ID NO: 375559 - DNA, 25 bp, Mus musculus
tgatcatcagcgcacacccaaactt

SEQ ID NO: 375560 - DNA, 25 bp, Mus musculus
acagcttctgccgtgcgtgcttggc

SEQ ID NO: 375561 - DNA, 25 bp, Mus musculus
ccagacgcagcctgaggtccaacgt

SEQ ID NO: 375562 - DNA, 25 bp, Mus musculus
cgctctgagtccgatctgggtaacc

SEQ ID NO: 375563 - DNA, 25 bp, Mus musculus
ggcgtcaagtcagcacgcagcgggc

SEQ ID NO: 375564 - DNA, 25 bp, Mus musculus
gcgtggtccgccacttgcgagctcg

SEQ ID NO: 375565 - DNA, 25 bp, Mus musculus
gctttccatggaggctcccgagctg

SEQ ID NO: 375566 - DNA, 25 bp, Mus musculus
agcagctggcgacatgtccgctgtg

SEQ ID NO: 375567 - DNA, 25 bp, Mus musculus
ttcgaggacccagtcctgctggcgt

SEQ ID NO: 375568 - DNA, 25 bp, Mus musculus
tgctggcgtgcgaacacagcttctg

SEQ ID NO: 375569 - DNA, 25 bp, Mus musculus
tcctgcccgtgctgtggccagccat

SEQ ID NO: 375570 - DNA, 25 bp, Mus musculus
tgaggagacgctctgagtccgatct

SEQ ID NO: 375571 - DNA, 25 bp, Mus musculus
tgaggtccaacgtgcgactggcagt

SEQ ID NO: 375572 - DNA, 25 bp, Mus musculus
acccagtcctgctggcgtgcgaaca

SEQ ID NO: 375573 - DNA, 25 bp, Mus musculus
ccgatctgggtaaccgaggcagccc

SEQ ID NO: 375574 - DNA, 25 bp, Mus musculus
tgtggccttctatgacggccgctca

SEQ ID NO: 375575 - DNA, 25 bp, Mus musculus
ggccgctcattggacttgctcttcg

SEQ ID NO: 375576 - DNA, 25 bp, Mus musculus
cagcgcattcgcgtggacttggact

SEQ ID NO: 375577 - DNA, 25 bp, Mus musculus
cagagcccaccctgctaggtggtgc

SEQ ID NO: 375578 - DNA, 25 bp, Mus musculus
cccatcggaggctatatgggccgtg

SEQ ID NO: 375579 - DNA, 25 bp, Mus musculus
gcctcatcaagctgtgcccatcgga

SEQ ID NO: 375580 - DNA, 25 bp, Mus musculus
cgtgacccgcaagggcctcatcaag

SEQ ID NO: 375581 - DNA, 25 bp, Mus musculus
aggcgcgtccttcagagactctaca

SEQ ID NO: 375582 - DNA, 25 bp, Mus musculus
cgcgctttgatcagctcccggcggt

SEQ ID NO: 375583 - DNA, 25 bp, Mus musculus
gtgagtctggctccacccggaacgc

SEQ ID NO: 375584 - DNA, 25 bp, Mus musculus
ctcctctgactaccgcggcgtgagt

SEQ ID NO: 375585 - DNA, 25 bp, Mus musculus
accgtgatctgctcatctcctctga

SEQ ID NO: 375586 - DNA, 25 bp, Mus musculus
ctctacagctcaggatgagaacgcg

SEQ ID NO: 375587 - DNA, 25 bp, Mus musculus
ctgctctgcacttgtgacccgcgta

SEQ ID NO: 375588 - DNA, 25 bp, Mus musculus
gagggctagagcgtcttcgcgtcct

SEQ ID NO: 375589 - DNA, 25 bp, Mus musculus
gtagccagagttaggccgtccgcta

SEQ ID NO: 375590 - DNA, 25 bp, Mus musculus
tcgactaagttaaggcgagtagcca

SEQ ID NO: 375591 - DNA, 25 bp, Mus musculus
cagtatggtactatgacgtcgacta

SEQ ID NO: 375592 - DNA, 25 bp, Mus musculus
atttacagcggcacgcagtatggta

SEQ ID NO: 375593 - DNA, 25 bp, Mus musculus
cctctggcggaagggaatttacagc

SEQ ID NO: 375594 - DNA, 25 bp, Mus musculus
cagtttaagccgaacctctggcgga

SEQ ID NO: 375595 - DNA, 25 bp, Mus musculus
ggcgcacatattggaggcagtttaa

SEQ ID NO: 375596 - DNA, 25 bp, Mus musculus
ccgttgggtcgtgacgtcataatca

SEQ ID NO: 375597 - DNA, 25 bp, Mus musculus
agacgcgggctagagcgcccgatcc

SEQ ID NO: 375598 - DNA, 25 bp, Mus musculus
acgtaggcggaaaactgatagagtc

SEQ ID NO: 375599 - DNA, 25 bp, Mus musculus
tgatagagtcccgatcccagacgcg

SEQ ID NO: 375600 - DNA, 25 bp, Mus musculus
gacgtcataatcaatggcgcacata

SEQ ID NO: 375601 - DNA, 25 bp, Mus musculus
gatcccaaggcgtcgggcaacgagt

SEQ ID NO: 375602 - DNA, 25 bp, Mus musculus
ggccaaacctcgggagctgaggacc

SEQ ID NO: 375603 - DNA, 25 bp, Mus musculus
cagggtctcctcaagtctggcaacc

SEQ ID NO: 375604 - DNA, 25 bp, Mus musculus
gctgtgtcgcctgcgacccaggagt

SEQ ID NO: 375605 - DNA, 25 bp, Mus musculus
ccgtcgtatgcgtgcttctcatgcc

SEQ ID NO: 375606 - DNA, 25 bp, Mus musculus
actgaaagacgtgagagcctggccc

SEQ ID NO: 375607 - DNA, 25 bp, Mus musculus
ttctcatgcccacggaggaagagtc

SEQ ID NO: 375608 - DNA, 25 bp, Mus musculus
ttcgcagccatacacacactgaaag

SEQ ID NO: 375609 - DNA, 25 bp, Mus musculus
cgtgatctgcgcagctgtgtcgcct

SEQ ID NO: 375610 - DNA, 25 bp, Mus musculus
ccggttcagggtctcctcaagtctg

SEQ ID NO: 375611 - DNA, 25 bp, Mus musculus
tgcacgaaaccggttcagggtctcc

SEQ ID NO: 375612 - DNA, 25 bp, Mus musculus
tggaccacaaccttgcacgaaaccg

SEQ ID NO: 375613 - DNA, 25 bp, Mus musculus
cggtcgtatttggaccacaaccttg

SEQ ID NO: 375614 - DNA, 25 bp, Mus musculus
cacggaggaagagtccatctggccc

SEQ ID NO: 375615 - DNA, 25 bp, Mus musculus
acccaggagtgcaggtccgggctta

SEQ ID NO: 375616 - DNA, 25 bp, Mus musculus
ttcttgtcagattgtgcgtgagagc

SEQ ID NO: 375617 - DNA, 25 bp, Mus musculus
ggaacgcgcgcccagccctttgtgt

SEQ ID NO: 375618 - DNA, 25 bp, Mus musculus
cgcgcccagccctttgtgtggctgt

SEQ ID NO: 375619 - DNA, 25 bp, Mus musculus
tgtggtccgaggctacggctcagaa

SEQ ID NO: 375620 - DNA, 25 bp, Mus musculus
ctacggctcagaagccgagcgctgg

SEQ ID NO: 375621 - DNA, 25 bp, Mus musculus
ggaacggcaggactgccgagcctca

SEQ ID NO: 375622 - DNA, 25 bp, Mus musculus
cgagcctcaagtagggctgtcgagc

SEQ ID NO: 375623 - DNA, 25 bp, Mus musculus
gtggagccacgagggcccgacacct

SEQ ID NO: 375624 - DNA, 25 bp, Mus musculus
cccgacacctgggtgggagaagccg

SEQ ID NO: 375625 - DNA, 25 bp, Mus musculus
aggctcacgtggctgaaacctcggg

SEQ ID NO: 375626 - DNA, 25 bp, Mus musculus
aaagccggcgggcatttcttgtcag

SEQ ID NO: 375627 - DNA, 25 bp, Mus musculus
cggcgggcatttcttgtcagattgt

SEQ ID NO: 375628 - DNA, 25 bp, Mus musculus
cagattttagagagccggacagacg

SEQ ID NO: 375629 - DNA, 25 bp, Mus musculus
gcggggccacagattttagagagcc

SEQ ID NO: 375630 - DNA, 25 bp, Mus musculus
ccctgagcgtgggtaagctgggcta

SEQ ID NO: 375631 - DNA, 25 bp, Mus musculus
cacgaccggggcttggcaaggaggc

SEQ ID NO: 375632 - DNA, 25 bp, Mus musculus
cctggattcctgtggaagaagaaca

SEQ ID NO: 375633 - DNA, 25 bp, Mus musculus
gagcctggattcctgtggaagaaga

SEQ ID NO: 375634 - DNA, 25 bp, Mus musculus
ctggagcctggattcctgtggaaga

SEQ ID NO: 375635 - DNA, 25 bp, Mus musculus
gctagcgctagccacaggggctgct

SEQ ID NO: 375636 - DNA, 25 bp, Mus musculus
tagcgatcgcgaaggggagagaccc

SEQ ID NO: 375637 - DNA, 25 bp, Mus musculus
gtaagctgggctagcgctagccaca

SEQ ID NO: 375638 - DNA, 25 bp, Mus musculus
ggctgctgagaggaggtggagtccc

SEQ ID NO: 375639 - DNA, 25 bp, Mus musculus
ccgaaccgcgcggttggagcccgtg

SEQ ID NO: 375640 - DNA, 25 bp, Mus musculus
agcccgtgaggtgcgcggagcgaga

SEQ ID NO: 375641 - DNA, 25 bp, Mus musculus
agcgagacctgtccgtcggctggcc

SEQ ID NO: 375642 - DNA, 25 bp, Mus musculus
tagcgctagccacaggggctgctga

SEQ ID NO: 375643 - DNA, 25 bp, Mus musculus
agacctgtccgtcggctggcccagg

SEQ ID NO: 375644 - DNA, 25 bp, Mus musculus
atggcgctggaggacgttaacagcc

SEQ ID NO: 375645 - DNA, 25 bp, Mus musculus
gagctcaagcttatccaccacgaca

SEQ ID NO: 375646 - DNA, 25 bp, Mus musculus
gcttatccaccacgacagcaaggta

SEQ ID NO: 375647 - DNA, 25 bp, Mus musculus
atcctgccggactacgagctcaagc

SEQ ID NO: 375648 - DNA, 25 bp, Mus musculus
gacatcctgccggactacgagctca

SEQ ID NO: 375649 - DNA, 25 bp, Mus musculus
gagcgagcgtctcttggccctagga

SEQ ID NO: 375650 - DNA, 25 bp, Mus musculus
tggaggacgttaacagccgcagaga

SEQ ID NO: 375651 - DNA, 25 bp, Mus musculus
tgcagtatacatcggggcgctgttt

SEQ ID NO: 375652 - DNA, 25 bp, Mus musculus
ccctcctcagaacggcgtgcagtat

SEQ ID NO: 375653 - DNA, 25 bp, Mus musculus
ggccgctgcctcttctgctggtgat

SEQ ID NO: 375654 - DNA, 25 bp, Mus musculus
ccaccacgacagcaaggtagtcggg

SEQ ID NO: 375655 - DNA, 25 bp, Mus musculus
aacggcgtgcagtatacatcggggc

SEQ ID NO: 375656 - DNA, 25 bp, Mus musculus
cgttaacagccgcagagacatcctg

SEQ ID NO: 375657 - DNA, 25 bp, Mus musculus
gcctcttctgctggtgatggcggct

SEQ ID NO: 375658 - DNA, 25 bp, Mus musculus
ggccaggccaccgagccaggagact

SEQ ID NO: 375659 - DNA, 25 bp, Mus musculus
ccggcaactcgcagatgaaatggtc

SEQ ID NO: 375660 - DNA, 25 bp, Mus musculus
agagccacatgtgctcgccgctttc

SEQ ID NO: 375661 - DNA, 25 bp, Mus musculus
tgagcacagctgagccatgcaccca

SEQ ID NO: 375662 - DNA, 25 bp, Mus musculus
tcgcgaatggccagcagcaccaacg

SEQ ID NO: 375663 - DNA, 25 bp, Mus musculus
accgccgaaggcaccaacaggatga

SEQ ID NO: 375664 - DNA, 25 bp, Mus musculus
cgcggtcaagtgagagccacatgtg

SEQ ID NO: 375665 - DNA, 25 bp, Mus musculus
aggatgaccacacgcgcggcgaaca

SEQ ID NO: 375666 - DNA, 25 bp, Mus musculus
tagcgcagagggttgcataccgcag

SEQ ID NO: 375667 - DNA, 25 bp, Mus musculus
acccagcgcgcggtagctgcagcat

SEQ ID NO: 375668 - DNA, 25 bp, Mus musculus
gctgcagcattgagccgcgcaggct

SEQ ID NO: 375669 - DNA, 25 bp, Mus musculus
cagcagcggtggcaccacactagtg

SEQ ID NO: 375670 - DNA, 25 bp, Mus musculus
agtggtgaaacccacatccaccaga

SEQ ID NO: 375671 - DNA, 25 bp, Mus musculus
atccaccagagccaagtggcaaagg

SEQ ID NO: 375672 - DNA, 25 bp, Mus musculus
ggaaggttctcgctgtccaccagcc

SEQ ID NO: 375673 - DNA, 25 bp, Mus musculus
cgaaaggtgactgcggtcacagaac

SEQ ID NO: 375674 - DNA, 25 bp, Mus musculus
tcgtagtggtctccaatcgtcgggg

SEQ ID NO: 375675 - DNA, 25 bp, Mus musculus
ttccgtttggaatcgtagtggtctc

SEQ ID NO: 375676 - DNA, 25 bp, Mus musculus
gcgcctgcgggaaagctttggtttc

SEQ ID NO: 375677 - DNA, 25 bp, Mus musculus
tggcaatgcgcctgcgggaaagctt

SEQ ID NO: 375678 - DNA, 25 bp, Mus musculus
acgacccgcaccaacagggacctgg

SEQ ID NO: 375679 - DNA, 25 bp, Mus musculus
acctcctgtgtcacctggtaatcca

SEQ ID NO: 375680 - DNA, 25 bp, Mus musculus
cagcacctcctgtgtcacctggtaa

SEQ ID NO: 375681 - DNA, 25 bp, Mus musculus
atgcggtccacagcacctcctgtgt

SEQ ID NO: 375682 - DNA, 25 bp, Mus musculus
ttggtccatgcggtccacagcacct

SEQ ID NO: 375683 - DNA, 25 bp, Mus musculus
gctcctcggtcctcgtggtcatact

SEQ ID NO: 375684 - DNA, 25 bp, Mus musculus
tgcggtcacagaacgctcctcggtc

SEQ ID NO: 375685 - DNA, 25 bp, Mus musculus
tgtccaccagccctgcgcaagcaga

SEQ ID NO: 375686 - DNA, 25 bp, Mus musculus
ctccagccagagtcttggagatcgc

SEQ ID NO: 375687 - DNA, 25 bp, Mus musculus
tcgcggcacaggaacacagagccca

SEQ ID NO: 375688 - DNA, 25 bp, Mus musculus
agatcgcggcacaggaacacagagc

SEQ ID NO: 375689 - DNA, 25 bp, Mus musculus
gagatcgcggcacaggaacacagag

SEQ ID NO: 375690 - DNA, 25 bp, Mus musculus
ggagatcgcggcacaggaacacaga

SEQ ID NO: 375691 - DNA, 25 bp, Mus musculus
gatcgcggcacaggaacacagagcc

SEQ ID NO: 375692 - DNA, 25 bp, Mus musculus
tggagatcgcggcacaggaacacag

SEQ ID NO: 375693 - DNA, 25 bp, Mus musculus
cagagtcttggagatcgcggcacag

SEQ ID NO: 375694 - DNA, 25 bp, Mus musculus
agccagagtcttggagatcgcggca

SEQ ID NO: 375695 - DNA, 25 bp, Mus musculus
tccagccagagtcttggagatcgcg

SEQ ID NO: 375696 - DNA, 25 bp, Mus musculus
agtcttggagatcgcggcacaggaa

SEQ ID NO: 375697 - DNA, 25 bp, Mus musculus
gcggcacaggaacacagagcccagc

SEQ ID NO: 375698 - DNA, 25 bp, Mus musculus
cagccagagtcttggagatcgcggc

SEQ ID NO: 375699 - DNA, 25 bp, Mus musculus
ccagagtcttggagatcgcggcaca

SEQ ID NO: 375700 - DNA, 25 bp, Mus musculus
ttgctgttccaggagcccgtcctgg

SEQ ID NO: 375701 - DNA, 25 bp, Mus musculus
cttattctgagttgctgttccagga

SEQ ID NO: 375702 - DNA, 25 bp, Mus musculus
gcgtcccatcccttattctgagttg

SEQ ID NO: 375703 - DNA, 25 bp, Mus musculus
ggagcgctgcgtcccatcccttatt

SEQ ID NO: 375704 - DNA, 25 bp, Mus musculus
agtaatcagagagcgccgcgacccg

SEQ ID NO: 375705 - DNA, 25 bp, Mus musculus
cgcgtgagtaatcagagagcgccgc

SEQ ID NO: 375706 - DNA, 25 bp, Mus musculus
gaagagaggcacgtgagtcatcaga

SEQ ID NO: 375707 - DNA, 25 bp, Mus musculus
tcagatgccgcggagcacagggctc

SEQ ID NO: 375708 - DNA, 25 bp, Mus musculus
aacggccctgctcagatgccgcgga

SEQ ID NO: 375709 - DNA, 25 bp, Mus musculus
gccctccgccgtgtaactgcccaac

SEQ ID NO: 375710 - DNA, 25 bp, Mus musculus
atcttgatcggctcaccgggacgcc

SEQ ID NO: 375711 - DNA, 25 bp, Mus musculus
ggtgggcgtcttcgccattcggcct

SEQ ID NO: 375712 - DNA, 25 bp, Mus musculus
aggcccgcagcgcaatactgtcacg

SEQ ID NO: 375713 - DNA, 25 bp, Mus musculus
gctccatcttgatcggctcaccggg

SEQ ID NO: 375714 - DNA, 25 bp, Mus musculus
cgactcttcacagttgcttcacgga

SEQ ID NO: 375715 - DNA, 25 bp, Mus musculus
gctttatcgcttcctcgactcttca

SEQ ID NO: 375716 - DNA, 25 bp, Mus musculus
cgtctgggttcggttctgaagtccg

SEQ ID NO: 375717 - DNA, 25 bp, Mus musculus
ttcacggattcaaaaggcgcgcttc

SEQ ID NO: 375718 - DNA, 25 bp, Mus musculus
aaaggcgcgcttctgacttaatccg

SEQ ID NO: 375719 - DNA, 25 bp, Mus musculus
gacggagaacttccaggatctggga

SEQ ID NO: 375720 - DNA, 25 bp, Mus musculus
atctgggaaccggaagcgtcagtga

SEQ ID NO: 375721 - DNA, 25 bp, Mus musculus
tgaggaacgcaaacacacttgtgta

SEQ ID NO: 375722 - DNA, 25 bp, Mus musculus
acttgtgtagagaaggccggcctgc

SEQ ID NO: 375723 - DNA, 25 bp, Mus musculus
ggcctgcggagcgtatgtctttacg

SEQ ID NO: 375724 - DNA, 25 bp, Mus musculus
tgtctttacgtcatcagacgcgcgc

SEQ ID NO: 375725 - DNA, 25 bp, Mus musculus
cgcccgcaatgtccggattggattg

SEQ ID NO: 375726 - DNA, 25 bp, Mus musculus
ccctgatttgattggctgccgagct

SEQ ID NO: 375727 - DNA, 25 bp, Mus musculus
cccaaacactgtgagtaagcccgtg

SEQ ID NO: 375728 - DNA, 25 bp, Mus musculus
cccagcgcttacacatgtcacatgt

SEQ ID NO: 375729 - DNA, 25 bp, Mus musculus
cgcgaggcacatggtcccagttaga

SEQ ID NO: 375730 - DNA, 25 bp, Mus musculus
tcgagaccgagaggaaatccacatc

SEQ ID NO: 375731 - DNA, 25 bp, Mus musculus
atccacatctgtgggacgctcggca

SEQ ID NO: 375732 - DNA, 25 bp, Mus musculus
gcagcagcgacatgaaaaagggcta

SEQ ID NO: 375733 - DNA, 25 bp, Mus musculus
ggtctttttcctcaccgtgccggca

SEQ ID NO: 375734 - DNA, 25 bp, Mus musculus
tttgaaagagtagtaagagcgcatg

SEQ ID NO: 375735 - DNA, 25 bp, Mus musculus
tgctttttaagacggccgggagcgc

SEQ ID NO: 375736 - DNA, 25 bp, Mus musculus
cttcgcagagggctccagtcattct

SEQ ID NO: 375737 - DNA, 25 bp, Mus musculus
gctccagtcattctgccacaggctg

SEQ ID NO: 375738 - DNA, 25 bp, Mus musculus
ccacggggcacatgtctgcttctta

SEQ ID NO: 375739 - DNA, 25 bp, Mus musculus
cacaggctgggcttatgcgtgagcc

SEQ ID NO: 375740 - DNA, 25 bp, Mus musculus
tctgcttcttacaacaccgcgaggc

SEQ ID NO: 375741 - DNA, 25 bp, Mus musculus
gacttgccggccttgctgcaacttg

SEQ ID NO: 375742 - DNA, 25 bp, Mus musculus
gagagcccgattggagccgacccgc

SEQ ID NO: 375743 - DNA, 25 bp, Mus musculus
tctcgcgagaacgatctgggattcc

SEQ ID NO: 375744 - DNA, 25 bp, Mus musculus
tgtcccgcacaaggaccgacgaggg

SEQ ID NO: 375745 - DNA, 25 bp, Mus musculus
caccatcctccaggtgtggcgggct

SEQ ID NO: 375746 - DNA, 25 bp, Mus musculus
aacgatctgggattcccggccacgc

SEQ ID NO: 375747 - DNA, 25 bp, Mus musculus
acccggctggggcgaaatctcgcga

SEQ ID NO: 375748 - DNA, 25 bp, Mus musculus
cccagtgtgaagagagtcgggaccc

SEQ ID NO: 375749 - DNA, 25 bp, Mus musculus
aagccacgggcccagtgtgaagaga

SEQ ID NO: 375750 - DNA, 25 bp, Mus musculus
tgagcacagggcgcactcagccacg

SEQ ID NO: 375751 - DNA, 25 bp, Mus musculus
gtagtgcttacccatgctgcggctc

SEQ ID NO: 375752 - DNA, 25 bp, Mus musculus
cggcgcggtagtgcttacccatgct

SEQ ID NO: 375753 - DNA, 25 bp, Mus musculus
ccgattggagccgacccgcgtgcga

SEQ ID NO: 375754 - DNA, 25 bp, Mus musculus
cccatggaagtcaggggctcccaga

SEQ ID NO: 375755 - DNA, 25 bp, Mus musculus
cgccacccaggctccggcagctggt

SEQ ID NO: 375756 - DNA, 25 bp, Mus musculus
cgaggtcctgcgcatttttgggttt

SEQ ID NO: 375757 - DNA, 25 bp, Mus musculus
tgcaatgtcatgtccggatgctacc

SEQ ID NO: 375758 - DNA, 25 bp, Mus musculus
gcccgagtagtcctgtcagtagcca

SEQ ID NO: 375759 - DNA, 25 bp, Mus musculus
tgcaatctggctgcttgaaggaggc

SEQ ID NO: 375760 - DNA, 25 bp, Mus musculus
gaggactcctactagatcgtgtgtg

SEQ ID NO: 375761 - DNA, 25 bp, Mus musculus
ttacaaggcaatagccagaccgagg

SEQ ID NO: 375762 - DNA, 25 bp, Mus musculus
ggctctcttctcctggtgagcgata

SEQ ID NO: 375763 - DNA, 25 bp, Mus musculus
accaattccagctgccgtggggccg

SEQ ID NO: 375764 - DNA, 25 bp, Mus musculus
ctgctgcagtgcacatgggctgctg

SEQ ID NO: 375765 - DNA, 25 bp, Mus musculus
tcgctctttagcactgtcgcggcta

SEQ ID NO: 375766 - DNA, 25 bp, Mus musculus
cttcgctatgggaagtcgctcttta

SEQ ID NO: 375767 - DNA, 25 bp, Mus musculus
ttgatagtggctggaagcttcgcta

SEQ ID NO: 375768 - DNA, 25 bp, Mus musculus
ccaagtcggagccacgatggtcgcc

SEQ ID NO: 375769 - DNA, 25 bp, Mus musculus
ggccgctcctttgtcgctactgcaa

SEQ ID NO: 375770 - DNA, 25 bp, Mus musculus
agaggcgatccttcgtccaggcgcc

SEQ ID NO: 375771 - DNA, 25 bp, Mus musculus
tggaagaactcgctacgccctggcg

SEQ ID NO: 375772 - DNA, 25 bp, Mus musculus
atggtgcggccctcatccagcagga

SEQ ID NO: 375773 - DNA, 25 bp, Mus musculus
tccagcaggaagacgcggctgtctt

SEQ ID NO: 375774 - DNA, 25 bp, Mus musculus
tgaccacgcggcagcggtgccacat

SEQ ID NO: 375775 - DNA, 25 bp, Mus musculus
cacagctgcactgggatcacctcgg

SEQ ID NO: 375776 - DNA, 25 bp, Mus musculus
atcacctcgggatgcacgtccacga

SEQ ID NO: 375777 - DNA, 25 bp, Mus musculus
acgtccacgaaggacacccgcaggg

SEQ ID NO: 375778 - DNA, 25 bp, Mus musculus
gagtcgaactcatggctgcggccaa

SEQ ID NO: 375779 - DNA, 25 bp, Mus musculus
aaggacgcccggagaggcgatcctt

SEQ ID NO: 375780 - DNA, 25 bp, Mus musculus
acagtgcctcgcaggctcagatagc

SEQ ID NO: 375781 - DNA, 25 bp, Mus musculus
atagcgcgtggctgcctgccttctc

SEQ ID NO: 375782 - DNA, 25 bp, Mus musculus
ttcaaggcgaccaaggggtggcttc

SEQ ID NO: 375783 - DNA, 25 bp, Mus musculus
tgcggccaaccgagagctgctccga

SEQ ID NO: 375784 - DNA, 25 bp, Mus musculus
cgatgccgcagccactcgctgggga

SEQ ID NO: 375785 - DNA, 25 bp, Mus musculus
cagcaagtcaggaccactgggcacc

SEQ ID NO: 375786 - DNA, 25 bp, Mus musculus
gcgcagccggacagtaggaacttgc

SEQ ID NO: 375787 - DNA, 25 bp, Mus musculus
cgcccgctgcaaacagctagtttac

SEQ ID NO: 375788 - DNA, 25 bp, Mus musculus
cggtacctagctcggccacggttgc

SEQ ID NO: 375789 - DNA, 25 bp, Mus musculus
taggaacttgctcgtccggggccat

SEQ ID NO: 375790 - DNA, 25 bp, Mus musculus
gccatctctgcgtgagcggcagcag

SEQ ID NO: 375791 - DNA, 25 bp, Mus musculus
agcagcttctcctcctcggcgatag

SEQ ID NO: 375792 - DNA, 25 bp, Mus musculus
ggcgataggcattcagcagcaagtc

SEQ ID NO: 375793 - DNA, 25 bp, Mus musculus
cttttcagcccgagagaggtcaggt

SEQ ID NO: 375794 - DNA, 25 bp, Mus musculus
tcaggaccatgtgcctttattacgc

SEQ ID NO: 375795 - DNA, 25 bp, Mus musculus
ctcaggtgctgaaaaacaaagccgc

SEQ ID NO: 375796 - DNA, 25 bp, Mus musculus
agccgcacccaagaggcttctggga

SEQ ID NO: 375797 - DNA, 25 bp, Mus musculus
ttctctgattggctggtagctaggc

SEQ ID NO: 375798 - DNA, 25 bp, Mus musculus
ccgtcaggtgaacaggcagagccgc

SEQ ID NO: 375799 - DNA, 25 bp, Mus musculus
atctccactggcttggtcgagagcc

SEQ ID NO: 375800 - DNA, 25 bp, Mus musculus
ccactggcttggtcgagagccgccg

SEQ ID NO: 375801 - DNA, 25 bp, Mus musculus
tgcgggagcaccatcaggaggcaca

SEQ ID NO: 375802 - DNA, 25 bp, Mus musculus
cccacgacccggagagcgggaggcg

SEQ ID NO: 375803 - DNA, 25 bp, Mus musculus
cgctcagtgcgcacggctccacgcc

SEQ ID NO: 375804 - DNA, 25 bp, Mus musculus
gctccacgcccaggcccgcgggctc

SEQ ID NO: 375805 - DNA, 25 bp, Mus musculus
gcccatctccactggcttggtcgag

SEQ ID NO: 375806 - DNA, 25 bp, Mus musculus
tgcaggtcggttacgtaacggcgca

SEQ ID NO: 375807 - DNA, 25 bp, Mus musculus
gtgaacaggcagagccgcgcccgca

SEQ ID NO: 375808 - DNA, 25 bp, Mus musculus
acagcggcgcatcgcagacgtcctg

SEQ ID NO: 375809 - DNA, 25 bp, Mus musculus
tcgcagacgtcctgcaggtcggtta

SEQ ID NO: 375810 - DNA, 25 bp, Mus musculus
cgtcctgcaggtcggttacgtaacg

SEQ ID NO: 375811 - DNA, 25 bp, Mus musculus
cccggccgtcaggtgaacaggcaga

SEQ ID NO: 375812 - DNA, 25 bp, Mus musculus
cttacgccttgaccctgaccctgac

SEQ ID NO: 375813 - DNA, 25 bp, Mus musculus
tacccggattggatgcccgagcccg

SEQ ID NO: 375814 - DNA, 25 bp, Mus musculus
acgcgtacccggattggatgcccga

SEQ ID NO: 375815 - DNA, 25 bp, Mus musculus
accgccgagtgtgagacgcgtaccc

SEQ ID NO: 375816 - DNA, 25 bp, Mus musculus
cggaggctcccagtgcgcagctgct

SEQ ID NO: 375817 - DNA, 25 bp, Mus musculus
tcccggccactatctggtcggcgga

SEQ ID NO: 375818 - DNA, 25 bp, Mus musculus
cgcgcggaactcagcgctagcggaa

SEQ ID NO: 375819 - DNA, 25 bp, Mus musculus
ggagtggcatttccctccgggactc

SEQ ID NO: 375820 - DNA, 25 bp, Mus musculus
gaaccagaagctctcaccgtctcta

SEQ ID NO: 375821 - DNA, 25 bp, Mus musculus
gaaggaaccagaagctctcaccgtc

SEQ ID NO: 375822 - DNA, 25 bp, Mus musculus
cgcgcgtctccactagcggaaccga

SEQ ID NO: 375823 - DNA, 25 bp, Mus musculus
taacgccacagttgacatccacctg

SEQ ID NO: 375824 - DNA, 25 bp, Mus musculus
gttgacatccacctgccgccgtatg

SEQ ID NO: 375825 - DNA, 25 bp, Mus musculus
cgccacttcggtctggcgcgcggaa

SEQ ID NO: 375826 - DNA, 25 bp, Mus musculus
ctttccgcgtgacacctgggactct

SEQ ID NO: 375827 - DNA, 25 bp, Mus musculus
tcttcgtgaaggtaggtcggcattc

SEQ ID NO: 375828 - DNA, 25 bp, Mus musculus
cccgagatcgagctcttcgtgaagg

SEQ ID NO: 375829 - DNA, 25 bp, Mus musculus
ggcatgacggactcagcgacaacta

SEQ ID NO: 375830 - DNA, 25 bp, Mus musculus
cccgctgtgagcaggagcctgaagt

SEQ ID NO: 375831 - DNA, 25 bp, Mus musculus
taaacaccgtgcaaaagagaggccc

SEQ ID NO: 375832 - DNA, 25 bp, Mus musculus
gatctctcaggcatcgctgtccttg

SEQ ID NO: 375833 - DNA, 25 bp, Mus musculus
gctggctcttggagtcctctctttc

SEQ ID NO: 375834 - DNA, 25 bp, Mus musculus
tgttgtcaatcccttagctcgcttt

SEQ ID NO: 375835 - DNA, 25 bp, Mus musculus
cacttgttgctcttgggacctgttg

SEQ ID NO: 375836 - DNA, 25 bp, Mus musculus
cctcccagcagtcaggcacttgttg

SEQ ID NO: 375837 - DNA, 25 bp, Mus musculus
tcgctgacagtctcggatcctgtga

SEQ ID NO: 375838 - DNA, 25 bp, Mus musculus
gccgtggtctattttgggcgcaccc

SEQ ID NO: 375839 - DNA, 25 bp, Mus musculus
cgctgtccttgcttggagaaattga

SEQ ID NO: 375840 - DNA, 25 bp, Mus musculus
agctcctgagcgcaccaagacggca

SEQ ID NO: 375841 - DNA, 25 bp, Mus musculus
agcgcaccaagacggcagagccagc

SEQ ID NO: 375842 - DNA, 25 bp, Mus musculus
gtgctggcgaaagagcagatgacca

SEQ ID NO: 375843 - DNA, 25 bp, Mus musculus
acatactgtgcggtgagaggcccgt

SEQ ID NO: 375844 - DNA, 25 bp, Mus musculus
tgagaggcccgtgctccgtgtccgc

SEQ ID NO: 375845 - DNA, 25 bp, Mus musculus
gctcgccttctggatcagcaccagg

SEQ ID NO: 375846 - DNA, 25 bp, Mus musculus
ccttctggatcagcaccaggtaggc

SEQ ID NO: 375847 - DNA, 25 bp, Mus musculus
caccaggtaggctgcgtgcaccaat

SEQ ID NO: 375848 - DNA, 25 bp, Mus musculus
gctgcgtgcaccaatacagccagca

SEQ ID NO: 375849 - DNA, 25 bp, Mus musculus
atacagccagcacgcccgttacgta

SEQ ID NO: 375850 - DNA, 25 bp, Mus musculus
agcacgcccgttacgtacccaatgg

SEQ ID NO: 375851 - DNA, 25 bp, Mus musculus
cgtacccaatggggtcgcccgtcag

SEQ ID NO: 375852 - DNA, 25 bp, Mus musculus
cggagacggcgatcacatactgtgc

SEQ ID NO: 375853 - DNA, 25 bp, Mus musculus
cgcccgtcaggtcgccagctcctga

SEQ ID NO: 375854 - DNA, 25 bp, Mus musculus
tacaggaatacgcatcacaacagcc

SEQ ID NO: 375855 - DNA, 25 bp, Mus musculus
tatgtagatcagagccacctcggtc

SEQ ID NO: 375856 - DNA, 25 bp, Mus musculus
agttaacagcttgcagtaggggccc

SEQ ID NO: 375857 - DNA, 25 bp, Mus musculus
gccgccgcaagggacttgaagttaa

SEQ ID NO: 375858 - DNA, 25 bp, Mus musculus
atctccaccgggaggcttgggagtc

SEQ ID NO: 375859 - DNA, 25 bp, Mus musculus
aatcaagttcgaggaagccgtgtgc

SEQ ID NO: 375860 - DNA, 25 bp, Mus musculus
acaacagccacaagttagcgaagtg

SEQ ID NO: 375861 - DNA, 25 bp, Mus musculus
acagaggaggtgagaaatcaagttc

SEQ ID NO: 375862 - DNA, 25 bp, Mus musculus
gctggtgctcggatctacaggaata

SEQ ID NO: 375863 - DNA, 25 bp, Mus musculus
tctccaccatggtgcggttgtcgtg

SEQ ID NO: 375864 - DNA, 25 bp, Mus musculus
gtggtccgcgatgatctccaccatg

SEQ ID NO: 375865 - DNA, 25 bp, Mus musculus
ggggtgaccagtctcttaccttgaa

SEQ ID NO: 375866 - DNA, 25 bp, Mus musculus
gaggacacccatgggcaccgagacc

SEQ ID NO: 375867 - DNA, 25 bp, Mus musculus
ggctggagtcttggaggacacccat

SEQ ID NO: 375868 - DNA, 25 bp, Mus musculus
ggggcgcttcgtctcaagcactctt

SEQ ID NO: 375869 - DNA, 25 bp, Mus musculus
cgttctgccaactcgggaccccgag

SEQ ID NO: 375870 - DNA, 25 bp, Mus musculus
cccgagcgcacgtcccgctcagcgt

SEQ ID NO: 375871 - DNA, 25 bp, Mus musculus
caacttttccgactttcccaggctg

SEQ ID NO: 375872 - DNA, 25 bp, Mus musculus
gggcgcttcgtctcaagcactcttc

SEQ ID NO: 375873 - DNA, 25 bp, Mus musculus
ttcgtctcaagcactcttcccgagt

SEQ ID NO: 375874 - DNA, 25 bp, Mus musculus
cagctattcccggacaacttcccac

SEQ ID NO: 375875 - DNA, 25 bp, Mus musculus
tctccccgacgtccgcgcccactgt

SEQ ID NO: 375876 - DNA, 25 bp, Mus musculus
gtctcctcttctctcccgagcccgg

SEQ ID NO: 375877 - DNA, 25 bp, Mus musculus
cttctctcccgagcccggcctgggc

SEQ ID NO: 375878 - DNA, 25 bp, Mus musculus
agcgcgctccgctcacctttgggga

SEQ ID NO: 375879 - DNA, 25 bp, Mus musculus
gcgctccgctcacctttggggactg

SEQ ID NO: 375880 - DNA, 25 bp, Mus musculus
tcacctttggggactgcgctccggg

SEQ ID NO: 375881 - DNA, 25 bp, Mus musculus
tgagatccccaaggccgccaacttt

SEQ ID NO: 375882 - DNA, 25 bp, Mus musculus
ttccctttctacaatctctggttcc

SEQ ID NO: 375883 - DNA, 25 bp, Mus musculus
ccacgtgtcttaagcagaggttgtg

SEQ ID NO: 375884 - DNA, 25 bp, Mus musculus
gcagccgtgcctccacgtgtcttaa

SEQ ID NO: 375885 - DNA, 25 bp, Mus musculus
tcctccccgttgtcggtgggcgtga

SEQ ID NO: 375886 - DNA, 25 bp, Mus musculus
gcagccaaatgcctggcccggggct

SEQ ID NO: 375887 - DNA, 25 bp, Mus musculus
aacttgagggacgtcgtggcagcca

SEQ ID NO: 375888 - DNA, 25 bp, Mus musculus
cgtgcctccacgtgtcttaagcaga

SEQ ID NO: 375889 - DNA, 25 bp, Mus musculus
tctcattctccacgcgggacgcgca

SEQ ID NO: 375890 - DNA, 25 bp, Mus musculus
agctcagtcaccttttccctttcta

SEQ ID NO: 375891 - DNA, 25 bp, Mus musculus
tcatagtggcgctctcgccatctta

SEQ ID NO: 375892 - DNA, 25 bp, Mus musculus
acggcttggcccgtccctctagtca

SEQ ID NO: 375893 - DNA, 25 bp, Mus musculus
tggcggaagtagaagaagcaggccc

SEQ ID NO: 375894 - DNA, 25 bp, Mus musculus
tcgactcatcacaactcccgctctg

SEQ ID NO: 375895 - DNA, 25 bp, Mus musculus
cgtcgtggcagccaaatgcctggcc

SEQ ID NO: 375896 - DNA, 25 bp, Mus musculus
ctgtttgtttaacggagcgctgcgc

SEQ ID NO: 375897 - DNA, 25 bp, Mus musculus
ccctttgatcataatccggggcatc

SEQ ID NO: 375898 - DNA, 25 bp, Mus musculus
ttcgagaaagtagtaacggcgctcc

SEQ ID NO: 375899 - DNA, 25 bp, Mus musculus
ggcacgggacgcaaaaggccacttc

SEQ ID NO: 375900 - DNA, 25 bp, Mus musculus
agagcgaccttctgctttgaagagc

SEQ ID NO: 375901 - DNA, 25 bp, Mus musculus
cgcgagatcttagcggccgaaggca

SEQ ID NO: 375902 - DNA, 25 bp, Mus musculus
gcggccaggctgcaaccttaagact

SEQ ID NO: 375903 - DNA, 25 bp, Mus musculus
tggagactaatcaaaccgcaggtgc

SEQ ID NO: 375904 - DNA, 25 bp, Mus musculus
cccagggagcgctgtttgtttgttt

SEQ ID NO: 375905 - DNA, 25 bp, Mus musculus
tcctcggggagatgcaaacgagtcc

SEQ ID NO: 375906 - DNA, 25 bp, Mus musculus
acgagtccgttctctttctaggagc

SEQ ID NO: 375907 - DNA, 25 bp, Mus musculus
ttctaggagctccaactcgcagcgc

SEQ ID NO: 375908 - DNA, 25 bp, Mus musculus
gatgccggacggactcaagatccta

SEQ ID NO: 375909 - DNA, 25 bp, Mus musculus
ctcgcgagatgccagagttggaact

SEQ ID NO: 375910 - DNA, 25 bp, Mus musculus
acgccttcctgagcttcttccgaga

SEQ ID NO: 375911 - DNA, 25 bp, Mus musculus
gagcttcttccgagatcgccacggc

SEQ ID NO: 375912 - DNA, 25 bp, Mus musculus
cccagcctgcttttcgtcaatgcag

SEQ ID NO: 375913 - DNA, 25 bp, Mus musculus
tgcttttcgtcaatgcaggcatgaa

SEQ ID NO: 375914 - DNA, 25 bp, Mus musculus
caatgcaggcatgaaccaggtaggg

SEQ ID NO: 375915 - DNA, 25 bp, Mus musculus
aggtcgtgcccatggcagcctttct

SEQ ID NO: 375916 - DNA, 25 bp, Mus musculus
gccgctgtaggaaacactaggcgtc

SEQ ID NO: 375917 - DNA, 25 bp, Mus musculus
acactaggcgtcctttcgaacgtca

SEQ ID NO: 375918 - DNA, 25 bp, Mus musculus
cgtcctttcgaacgtcactctttga

SEQ ID NO: 375919 - DNA, 25 bp, Mus musculus
ccgcgaagccgttgcccggagctaa

SEQ ID NO: 375920 - DNA, 25 bp, Mus musculus
agccgttgcccggagctaagatggc

SEQ ID NO: 375921 - DNA, 25 bp, Mus musculus
agccggtaagctgcggcgagccatt

SEQ ID NO: 375922 - DNA, 25 bp, Mus musculus
cgagccattgggaggtcgtgcccat

SEQ ID NO: 375923 - DNA, 25 bp, Mus musculus
gcagcctttctcaaccgagcccggt

SEQ ID NO: 375924 - DNA, 25 bp, Mus musculus
ctctgcaggaactacgtgcgccgca

SEQ ID NO: 375925 - DNA, 25 bp, Mus musculus
ctccagggagaggaacagtcggact

SEQ ID NO: 375926 - DNA, 25 bp, Mus musculus
tacgtgcgccgcattcatgtggacc

SEQ ID NO: 375927 - DNA, 25 bp, Mus musculus
ctgaagctattcatcccggggacca

SEQ ID NO: 375928 - DNA, 25 bp, Mus musculus
gcgtatgttcttcgagagacacctg

SEQ ID NO: 375929 - DNA, 25 bp, Mus musculus
gcggcagctggaagcgtatgttctt

SEQ ID NO: 375930 - DNA, 25 bp, Mus musculus
tccgtgtgccacgtgtccaggcacg

SEQ ID NO: 375931 - DNA, 25 bp, Mus musculus
catcaagcgctggtccgtgtgccac

SEQ ID NO: 375932 - DNA, 25 bp, Mus musculus
tggcaccgctgctgcatcaagcgct

SEQ ID NO: 375933 - DNA, 25 bp, Mus musculus
cgatgagaattactggcaccgctgc

SEQ ID NO: 375934 - DNA, 25 bp, Mus musculus
ccgctaacttgattgacgatgagaa

SEQ ID NO: 375935 - DNA, 25 bp, Mus musculus
tgacggtgaccgctaacttgattga

SEQ ID NO: 375936 - DNA, 25 bp, Mus musculus
agctgcctttgacggtgaccgctaa

SEQ ID NO: 375937 - DNA, 25 bp, Mus musculus
cattcatgtggaccagttcctccca

SEQ ID NO: 375938 - DNA, 25 bp, Mus musculus
cgagaagatggacgagctgctgacc

SEQ ID NO: 375939 - DNA, 25 bp, Mus musculus
taccagctgctgattagaacggatg

SEQ ID NO: 375940 - DNA, 25 bp, Mus musculus
tgagcccagctcgaccaggtccata

SEQ ID NO: 375941 - DNA, 25 bp, Mus musculus
ctggcgcagatactcagcgcgctgc

SEQ ID NO: 375942 - DNA, 25 bp, Mus musculus
ctggcacaggtacgcgttctcagcc

SEQ ID NO: 375943 - DNA, 25 bp, Mus musculus
ggtccataagcaacacctccgagta

SEQ ID NO: 375944 - DNA, 25 bp, Mus musculus
tgccactcgagttccgtgctgtcca

SEQ ID NO: 375945 - DNA, 25 bp, Mus musculus
ttccacgtgatagtgcgcatacgcc

SEQ ID NO: 375946 - DNA, 25 bp, Mus musculus
tcggggaaagccaccatgaactcgc

SEQ ID NO: 375947 - DNA, 25 bp, Mus musculus
aactcgcgaaagtccacgttcttga

SEQ ID NO: 375948 - DNA, 25 bp, Mus musculus
acgttcttgagatgcatgccctctc

SEQ ID NO: 375949 - DNA, 25 bp, Mus musculus
tcgcgcctccatgtagtcatccaag

SEQ ID NO: 375950 - DNA, 25 bp, Mus musculus
tccaagccctcgttctcggcgaaga

SEQ ID NO: 375951 - DNA, 25 bp, Mus musculus
ctccgtagcgacacctgggcacgta

SEQ ID NO: 375952 - DNA, 25 bp, Mus musculus
gttcgtcggacgtagtgataactga

SEQ ID NO: 375953 - DNA, 25 bp, Mus musculus
tgtcgtggtacatgaggctattgcc

SEQ ID NO: 375954 - DNA, 25 bp, Mus musculus
cgcgtagagcatcagcaggaaggcc

SEQ ID NO: 375955 - DNA, 25 bp, Mus musculus
tccaccaggtagaccgcgtagagca

SEQ ID NO: 375956 - DNA, 25 bp, Mus musculus
ggcagtgccaacactccaccaggta

SEQ ID NO: 375957 - DNA, 25 bp, Mus musculus
tggcgggcttggcagtgccaacact

SEQ ID NO: 375958 - DNA, 25 bp, Mus musculus
cggtatcgggtgacctgtcgagttc

SEQ ID NO: 375959 - DNA, 25 bp, Mus musculus
catccacacggtgctgcagctcgtg

SEQ ID NO: 375960 - DNA, 25 bp, Mus musculus
gaacgctactcacatccacacggtg

SEQ ID NO: 375961 - DNA, 25 bp, Mus musculus
tccaccagatgcaaggggtggcctg

SEQ ID NO: 375962 - DNA, 25 bp, Mus musculus
tgatggccttccaccagatgcaagg

SEQ ID NO: 375963 - DNA, 25 bp, Mus musculus
cgtagtgataactgatggccttcca

SEQ ID NO: 375964 - DNA, 25 bp, Mus musculus
tgacctgtcgagttcgtcggacgta

SEQ ID NO: 375965 - DNA, 25 bp, Mus musculus
tattgccctggtaggcgctgctgaa

SEQ ID NO: 375966 - DNA, 25 bp, Mus musculus
ccaggtcggggcaatgctgctggac

SEQ ID NO: 375967 - DNA, 25 bp, Mus musculus
ttgtctgagccgagctggagccagc

SEQ ID NO: 375968 - DNA, 25 bp, Mus musculus
tttgtctgagccgagctggagccag

SEQ ID NO: 375969 - DNA, 25 bp, Mus musculus
ccttttgtctgagccgagctggagc

SEQ ID NO: 375970 - DNA, 25 bp, Mus musculus
gccttttgtctgagccgagctggag

SEQ ID NO: 375971 - DNA, 25 bp, Mus musculus
ccgccttttgtctgagccgagctgg

SEQ ID NO: 375972 - DNA, 25 bp, Mus musculus
cgccgccttttgtctgagccgagct

SEQ ID NO: 375973 - DNA, 25 bp, Mus musculus
gccgccgccttttgtctgagccgag

SEQ ID NO: 375974 - DNA, 25 bp, Mus musculus
gtgtcaccttgaggccctcgcggcg

SEQ ID NO: 375975 - DNA, 25 bp, Mus musculus
ggtgtcaccttgaggccctcgcggc

SEQ ID NO: 375976 - DNA, 25 bp, Mus musculus
gcgggtgtcaccttgaggccctcgc

SEQ ID NO: 375977 - DNA, 25 bp, Mus musculus
cgctctgcggcggaaccggcgggga

SEQ ID NO: 375978 - DNA, 25 bp, Mus musculus
ttcctagccacagcggactgcgcgg

SEQ ID NO: 375979 - DNA, 25 bp, Mus musculus
ctagccacagcggactgcgcgggca

SEQ ID NO: 375980 - DNA, 25 bp, Mus musculus
cccgcgcctgcacaggcaggtaatg

SEQ ID NO: 375981 - DNA, 25 bp, Mus musculus
gagacccgaagccaaggatccaagc

SEQ ID NO: 375982 - DNA, 25 bp, Mus musculus
aaagctcgcttttgcacacctcaga

SEQ ID NO: 375983 - DNA, 25 bp, Mus musculus
gccgctcggagagtgactctggttc

SEQ ID NO: 375984 - DNA, 25 bp, Mus musculus
actagggaccgttcagctgcccaaa

SEQ ID NO: 375985 - DNA, 25 bp, Mus musculus
actctggttctgttaggcggtcaca

SEQ ID NO: 375986 - DNA, 25 bp, Mus musculus
agcgagcggactccacttatgcctc

SEQ ID NO: 375987 - DNA, 25 bp, Mus musculus
gggctctacccggaagctcctttga

SEQ ID NO: 375988 - DNA, 25 bp, Mus musculus
atgctccggagacccacaaggaacc

SEQ ID NO: 375989 - DNA, 25 bp, Mus musculus
cacagccttggagacatgctccgga

SEQ ID NO: 375990 - DNA, 25 bp, Mus musculus
gctccggatcatcccaaagcggctg

SEQ ID NO: 375991 - DNA, 25 bp, Mus musculus
tctggcatagagtcgctgcgctctc

SEQ ID NO: 375992 - DNA, 25 bp, Mus musculus
aggcggatgatagccagtgtgactc

SEQ ID NO: 375993 - DNA, 25 bp, Mus musculus
cctcagagttagatcccgctggacc

SEQ ID NO: 375994 - DNA, 25 bp, Mus musculus
cgctggcgaagatgcgcctctgaga

SEQ ID NO: 375995 - DNA, 25 bp, Mus musculus
accgagctagttggtggtcacctgg

SEQ ID NO: 375996 - DNA, 25 bp, Mus musculus
ccagcggtgtctccaagcgcaagaa

SEQ ID NO: 375997 - DNA, 25 bp, Mus musculus
gcggaggcgcaagatatccatagta

SEQ ID NO: 375998 - DNA, 25 bp, Mus musculus
tccatagtaaccgaggatgctaggg

SEQ ID NO: 375999 - DNA, 25 bp, Mus musculus
ctccgcggccgcagaacaatggaga

SEQ ID NO: 376000 - DNA, 25 bp, Mus musculus
gcctctgagaagtgcggctgcagcc

SEQ ID NO: 376001 - DNA, 25 bp, Mus musculus
gcagaacaatggagagcgccgcccg

SEQ ID NO: 376002 - DNA, 25 bp, Mus musculus
cgcgccgcgaggaaccagagcacta

SEQ ID NO: 376003 - DNA, 25 bp, Mus musculus
aaccagagcactagcgagggcgcgc

SEQ ID NO: 376004 - DNA, 25 bp, Mus musculus
ctcgcttgctcacgttcactggagg

SEQ ID NO: 376005 - DNA, 25 bp, Mus musculus
gaagatgcttagaggcgacggctaa

SEQ ID NO: 376006 - DNA, 25 bp, Mus musculus
gagcgaacgagcaaggttcggtttc

SEQ ID NO: 376007 - DNA, 25 bp, Mus musculus
cgtagtgaccgtggctcttgccatc

SEQ ID NO: 376008 - DNA, 25 bp, Mus musculus
cccgagaagggaggaggttctgcct

SEQ ID NO: 376009 - DNA, 25 bp, Mus musculus
ctgcccgcgcgctgaagggaacaga

SEQ ID NO: 376010 - DNA, 25 bp, Mus musculus
gcatgtggcctacgctcctcgcggg

SEQ ID NO: 376011 - DNA, 25 bp, Mus musculus
gtggcctacgctcctcgcggggctt

SEQ ID NO: 376012 - DNA, 25 bp, Mus musculus
ggcacgcggcatgtggcctacgctc

SEQ ID NO: 376013 - DNA, 25 bp, Mus musculus
ccgcagatccgcgtggcactgttgg

SEQ ID NO: 376014 - DNA, 25 bp, Mus musculus
tggggggtcctccagccgcagatcc

SEQ ID NO: 376015 - DNA, 25 bp, Mus musculus
gctcgggcagccatggcccacgtga

SEQ ID NO: 376016 - DNA, 25 bp, Mus musculus
cgggaagagcgcagcacttccgctg

SEQ ID NO: 376017 - DNA, 25 bp, Mus musculus
acagaggcgacctatgtggctggac

SEQ ID NO: 376018 - DNA, 25 bp, Mus musculus
tgaagggaacagaggcgacctatgt

SEQ ID NO: 376019 - DNA, 25 bp, Mus musculus
cgctgaagggaacagaggcgaccta

SEQ ID NO: 376020 - DNA, 25 bp, Mus musculus
atgagggacagtggcgcttcggaga

SEQ ID NO: 376021 - DNA, 25 bp, Mus musculus
gcagccatggcccacgtgaccgaga

SEQ ID NO: 376022 - DNA, 25 bp, Mus musculus
cgggaaagccgagtagtagtacaga

SEQ ID NO: 376023 - DNA, 25 bp, Mus musculus
tccctccgccttaaaggagtggctg

SEQ ID NO: 376024 - DNA, 25 bp, Mus musculus
tgctgtttcacgcagagcagcccgc

SEQ ID NO: 376025 - DNA, 25 bp, Mus musculus
tgacgtcatggtagcagatcgtgga

SEQ ID NO: 376026 - DNA, 25 bp, Mus musculus
cccagccttgctgtttcacgcagag

SEQ ID NO: 376027 - DNA, 25 bp, Mus musculus
cgcccaccttgacgtcatggtagca

SEQ ID NO: 376028 - DNA, 25 bp, Mus musculus
tataaggcgaagcacagcccgggcc

SEQ ID NO: 376029 - DNA, 25 bp, Mus musculus
cccgaccgccctatataaggcgaag

SEQ ID NO: 376030 - DNA, 25 bp, Mus musculus
gtgactcaagagagctcccgaacgc

SEQ ID NO: 376031 - DNA, 25 bp, Mus musculus
ggaccaagtccgactcgcacggcaa

SEQ ID NO: 376032 - DNA, 25 bp, Mus musculus
gaacctctaacctctagacacgtta

SEQ ID NO: 376033 - DNA, 25 bp, Mus musculus
agacacgttatctccacaggctgcc

SEQ ID NO: 376034 - DNA, 25 bp, Mus musculus
aaacatggcagcgtcccgggtcggc

SEQ ID NO: 376035 - DNA, 25 bp, Mus musculus
gactcgcacggcaagcctaggctgc

SEQ ID NO: 376036 - DNA, 25 bp, Mus musculus
cgggtctgtgggtgtgaaaccacgt

SEQ ID NO: 376037 - DNA, 25 bp, Mus musculus
ggccgggtctgtgggtgtgaaacca

SEQ ID NO: 376038 - DNA, 25 bp, Mus musculus
gctggccgggtctgtgggtgtgaaa

SEQ ID NO: 376039 - DNA, 25 bp, Mus musculus
ctggccgggtctgtgggtgtgaaac

SEQ ID NO: 376040 - DNA, 25 bp, Mus musculus
acctcggctggccgggtctgtgggt

SEQ ID NO: 376041 - DNA, 25 bp, Mus musculus
cacctcggctggccgggtctgtggg

SEQ ID NO: 376042 - DNA, 25 bp, Mus musculus
gtctgtgggtgtgaaaccacgttct

SEQ ID NO: 376043 - DNA, 25 bp, Mus musculus
ctgtgggtgtgaaaccacgttctgc

SEQ ID NO: 376044 - DNA, 25 bp, Mus musculus
tctgtgggtgtgaaaccacgttctg

SEQ ID NO: 376045 - DNA, 25 bp, Mus musculus
ggtctgtgggtgtgaaaccacgttc

SEQ ID NO: 376046 - DNA, 25 bp, Mus musculus
tggccgggtctgtgggtgtgaaacc

SEQ ID NO: 376047 - DNA, 25 bp, Mus musculus
cgtggcgggggccacctcggctggc

SEQ ID NO: 376048 - DNA, 25 bp, Mus musculus
ccacctcggctggccgggtctgtgg

SEQ ID NO: 376049 - DNA, 25 bp, Mus musculus
ccgggtctgtgggtgtgaaaccacg

SEQ ID NO: 376050 - DNA, 25 bp, Mus musculus
gtcagagaccctacgcctagggccg

SEQ ID NO: 376051 - DNA, 25 bp, Mus musculus
caggtgttccgttatccctctccga

SEQ ID NO: 376052 - DNA, 25 bp, Mus musculus
acgtgctggcgctgctctgcacgcg

SEQ ID NO: 376053 - DNA, 25 bp, Mus musculus
caaagtccctgtcgcggcctcggag

SEQ ID NO: 376054 - DNA, 25 bp, Mus musculus
cgagcacctgctggagaaggacacc

SEQ ID NO: 376055 - DNA, 25 bp, Mus musculus
agaaggacacctccggcgacgaaat

SEQ ID NO: 376056 - DNA, 25 bp, Mus musculus
gcgacgaaatctgcgcgcttggcca

SEQ ID NO: 376057 - DNA, 25 bp, Mus musculus
cagttcaccggctcccagtcagaga

SEQ ID NO: 376058 - DNA, 25 bp, Mus musculus
atggcggagcacgtctttggaccct

SEQ ID NO: 376059 - DNA, 25 bp, Mus musculus
gtcacccggacacgcgagcctggga

SEQ ID NO: 376060 - DNA, 25 bp, Mus musculus
taactcctacacattccacggcggg

SEQ ID NO: 376061 - DNA, 25 bp, Mus musculus
gtctttggacccttcccaactgtca

SEQ ID NO: 376062 - DNA, 25 bp, Mus musculus
acgctccacctcaggtgttccgtta

SEQ ID NO: 376063 - DNA, 25 bp, Mus musculus
ccacggcgggactcttgcacagaca

SEQ ID NO: 376064 - DNA, 25 bp, Mus musculus
ccggatcaggggaccagagtaaaca

SEQ ID NO: 376065 - DNA, 25 bp, Mus musculus
gggaccagagtaaacactgtgcctg

SEQ ID NO: 376066 - DNA, 25 bp, Mus musculus
taaacactgtgcctggggcactgga

SEQ ID NO: 376067 - DNA, 25 bp, Mus musculus
gagcgagagcgacaaggagcatcca

SEQ ID NO: 376068 - DNA, 25 bp, Mus musculus
ttggtgttccggtcagcccggatca

SEQ ID NO: 376069 - DNA, 25 bp, Mus musculus
atccaccatcctggccggagcagga

SEQ ID NO: 376070 - DNA, 25 bp, Mus musculus
cgcgggaacacttaagctgaagatt

SEQ ID NO: 376071 - DNA, 25 bp, Mus musculus
aggagcatccaccatcctggccgga

SEQ ID NO: 376072 - DNA, 25 bp, Mus musculus
ttagtctaaatacggcgtgagagtg

SEQ ID NO: 376073 - DNA, 25 bp, Mus musculus
ggcggagaatccacctcatttttag

SEQ ID NO: 376074 - DNA, 25 bp, Mus musculus
gaaaaactggcggagaatccacctc

SEQ ID NO: 376075 - DNA, 25 bp, Mus musculus
gattgccttcgccagagaaaaactg

SEQ ID NO: 376076 - DNA, 25 bp, Mus musculus
gctgaagattgccttcgccagagaa

SEQ ID NO: 376077 - DNA, 25 bp, Mus musculus
tgagttgacagcacgcgggaacact

SEQ ID NO: 376078 - DNA, 25 bp, Mus musculus
cgcacacgtagaaagtgcgcgcgca

SEQ ID NO: 376079 - DNA, 25 bp, Mus musculus
attcccaggctgttaacgcggtacg

SEQ ID NO: 376080 - DNA, 25 bp, Mus musculus
tcccggtttcttctctgcaataagg

SEQ ID NO: 376081 - DNA, 25 bp, Mus musculus
ggcattggacttggcgaccctagaa

SEQ ID NO: 376082 - DNA, 25 bp, Mus musculus
agcaggtggaactagagtggcactc

SEQ ID NO: 376083 - DNA, 25 bp, Mus musculus
tggcgaccctagaatgcaaaactcg

SEQ ID NO: 376084 - DNA, 25 bp, Mus musculus
gtcccacgccttggaatattcctga

SEQ ID NO: 376085 - DNA, 25 bp, Mus musculus
tctggtgctaacacctcgagccctg

SEQ ID NO: 376086 - DNA, 25 bp, Mus musculus
gcagctactcgtctggtgctaacac

SEQ ID NO: 376087 - DNA, 25 bp, Mus musculus
gtggtgagatcctatgagccaagta

SEQ ID NO: 376088 - DNA, 25 bp, Mus musculus
gacaaagcgtgcctccgttgggtcc

SEQ ID NO: 376089 - DNA, 25 bp, Mus musculus
agaggacggcgcacatctggagccc

SEQ ID NO: 376090 - DNA, 25 bp, Mus musculus
cttctctgcaataagggaggcgctg

SEQ ID NO: 376091 - DNA, 25 bp, Mus musculus
actcacatctggcagggacggtgcg

SEQ ID NO: 376092 - DNA, 25 bp, Mus musculus
tcgccagcgggtcagctgctccgga

SEQ ID NO: 376093 - DNA, 25 bp, Mus musculus
ggggcacaatatcccgcgcacgttg

SEQ ID NO: 376094 - DNA, 25 bp, Mus musculus
cgcaacttggccgatcgccagcggg

SEQ ID NO: 376095 - DNA, 25 bp, Mus musculus
ttggccgatcgccagcgggtcagct

SEQ ID NO: 376096 - DNA, 25 bp, Mus musculus
tcagctgctccggaccgcgcgggag

SEQ ID NO: 376097 - DNA, 25 bp, Mus musculus
gcgggaggctgtcggccagagtccc

SEQ ID NO: 376098 - DNA, 25 bp, Mus musculus
tcgcgttgtggccgaggacacaccc

SEQ ID NO: 376099 - DNA, 25 bp, Mus musculus
gcctggttagggctctgtcctccgg

SEQ ID NO: 376100 - DNA, 25 bp, Mus musculus
cccgttatgggaatggcttctcgct

SEQ ID NO: 376101 - DNA, 25 bp, Mus musculus
tgggaatggcttctcgctgccgaaa

SEQ ID NO: 376102 - DNA, 25 bp, Mus musculus
ggaatggcttctcgctgccgaaata

SEQ ID NO: 376103 - DNA, 25 bp, Mus musculus
atggcttctcgctgccgaaatagcg

SEQ ID NO: 376104 - DNA, 25 bp, Mus musculus
aacttggccgatcgccagcgggtca

SEQ ID NO: 376105 - DNA, 25 bp, Mus musculus
ctgcctgcccgcgtcgcgttgtggc

SEQ ID NO: 376106 - DNA, 25 bp, Mus musculus
ggcaagtgcattgcagttcctccta

SEQ ID NO: 376107 - DNA, 25 bp, Mus musculus
ttagccagattagcccgcattaatg

SEQ ID NO: 376108 - DNA, 25 bp, Mus musculus
gaggggagtttatttattagccaga

SEQ ID NO: 376109 - DNA, 25 bp, Mus musculus
tctggcccagctctgaatcaattcg

SEQ ID NO: 376110 - DNA, 25 bp, Mus musculus
gttcctcctaggctgggatgcgaca

SEQ ID NO: 376111 - DNA, 25 bp, Mus musculus
ttgccacccgaaggcaggtgcactg

SEQ ID NO: 376112 - DNA, 25 bp, Mus musculus
accttcggaatcgacgcagggacgc

SEQ ID NO: 376113 - DNA, 25 bp, Mus musculus
tgctccgccgtgagtcaccttcgga

SEQ ID NO: 376114 - DNA, 25 bp, Mus musculus
ctcccttttcatgcgctctggtgtg

SEQ ID NO: 376115 - DNA, 25 bp, Mus musculus
ccagcgtcctgtaatttctcccttt

SEQ ID NO: 376116 - DNA, 25 bp, Mus musculus
tagaacgcatcagccgtggcccagc

SEQ ID NO: 376117 - DNA, 25 bp, Mus musculus
cggcggtgggtaattagaacgcatc

SEQ ID NO: 376118 - DNA, 25 bp, Mus musculus
ggacatagctggcatagctggcata

SEQ ID NO: 376119 - DNA, 25 bp, Mus musculus
tgcgacaggtgtcaagtcacagtgc

SEQ ID NO: 376120 - DNA, 25 bp, Mus musculus
ctggagcactgtctgcgcacacggc

SEQ ID NO: 376121 - DNA, 25 bp, Mus musculus
cagaaagttcatggtttcggaggcc

SEQ ID NO: 376122 - DNA, 25 bp, Mus musculus
ggtttgtctcctgcggcgcagacca

SEQ ID NO: 376123 - DNA, 25 bp, Mus musculus
agcagacgggcacgaccgcttacct

SEQ ID NO: 376124 - DNA, 25 bp, Mus musculus
acttctcccagctccgatcggtttg

SEQ ID NO: 376125 - DNA, 25 bp, Mus musculus
accgcttaccttggcatggtggagg

SEQ ID NO: 376126 - DNA, 25 bp, Mus musculus
ggtacagcagtaaagccagggtcca

SEQ ID NO: 376127 - DNA, 25 bp, Mus musculus
ccacggctactacggagcgagaaga

SEQ ID NO: 376128 - DNA, 25 bp, Mus musculus
cgagaagagcccagaagttggacga

SEQ ID NO: 376129 - DNA, 25 bp, Mus musculus
gaaaagtttccgtgcaatcccgcga

SEQ ID NO: 376130 - DNA, 25 bp, Mus musculus
gcgactggtccgatgcaagatccca

SEQ ID NO: 376131 - DNA, 25 bp, Mus musculus
cccagatcgtacgtgcggtgactct

SEQ ID NO: 376132 - DNA, 25 bp, Mus musculus
ccgtccatgagctcggctcctgaga

SEQ ID NO: 376133 - DNA, 25 bp, Mus musculus
agggtccagtgcacccaagagagca

SEQ ID NO: 376134 - DNA, 25 bp, Mus musculus
tctgagacccgggaggtgcgatccc

SEQ ID NO: 376135 - DNA, 25 bp, Mus musculus
taaaggctttacagacgctggcggg

SEQ ID NO: 376136 - DNA, 25 bp, Mus musculus
gcggcagctccaagcgttcctggca

SEQ ID NO: 376137 - DNA, 25 bp, Mus musculus
ctctcagcgactctgagacccggga

SEQ ID NO: 376138 - DNA, 25 bp, Mus musculus
ttgagagaaggtgagtcccaggacc

SEQ ID NO: 376139 - DNA, 25 bp, Mus musculus
aggtgagtcccaggacccagcgacc

SEQ ID NO: 376140 - DNA, 25 bp, Mus musculus
ttgaggagagcgtcgtgacacttca

SEQ ID NO: 376141 - DNA, 25 bp, Mus musculus
tgacacttcagccagccgcgatgtg

SEQ ID NO: 376142 - DNA, 25 bp, Mus musculus
gtggcttcacctcccggttctcagt

SEQ ID NO: 376143 - DNA, 25 bp, Mus musculus
ttcacctcccggttctcagtgtctt

SEQ ID NO: 376144 - DNA, 25 bp, Mus musculus
gctggttatggcttccagctcgcgg

SEQ ID NO: 376145 - DNA, 25 bp, Mus musculus
cccgctgccactggctggttatggc

SEQ ID NO: 376146 - DNA, 25 bp, Mus musculus
acacgcggtcaggtgcgttccaaga

SEQ ID NO: 376147 - DNA, 25 bp, Mus musculus
cgcgggccgcttaaaggctttacag

SEQ ID NO: 376148 - DNA, 25 bp, Mus musculus
ggcgacggccatccctagggagcct

SEQ ID NO: 376149 - DNA, 25 bp, Mus musculus
cccgtcctcgcggtgccttgctcgc

SEQ ID NO: 376150 - DNA, 25 bp, Mus musculus
cggtgccttgctcgcccagcagtcc

SEQ ID NO: 376151 - DNA, 25 bp, Mus musculus
cgcagcaggctctccttcgcgcctc

SEQ ID NO: 376152 - DNA, 25 bp, Mus musculus
ttcgcgcctccgtgtccacccgccc

SEQ ID NO: 376153 - DNA, 25 bp, Mus musculus
cccgggaggaagactgctccagctc

SEQ ID NO: 376154 - DNA, 25 bp, Mus musculus
gaggaagactgctccagctcgcgtg

SEQ ID NO: 376155 - DNA, 25 bp, Mus musculus
agcgagactttgacgccccttagag

SEQ ID NO: 376156 - DNA, 25 bp, Mus musculus
tcgcgtggcctcgtcacgggcggaa

SEQ ID NO: 376157 - DNA, 25 bp, Mus musculus
gacggccatccctagggagccttct

SEQ ID NO: 376158 - DNA, 25 bp, Mus musculus
tagggagccttctgccagcgagact

SEQ ID NO: 376159 - DNA, 25 bp, Mus musculus
gagccttctgccagcgagactttga

SEQ ID NO: 376160 - DNA, 25 bp, Mus musculus
ttctgccagcgagactttgacgccc

SEQ ID NO: 376161 - DNA, 25 bp, Mus musculus
aagactgctccagctcgcgtggcct

SEQ ID NO: 376162 - DNA, 25 bp, Mus musculus
cccttagtctttgcgctcaaggcgc

SEQ ID NO: 376163 - DNA, 25 bp, Mus musculus
gggaattgtagttcgaactcgcatt

SEQ ID NO: 376164 - DNA, 25 bp, Mus musculus
ctttgcgctcaaggcgcgcttgctg

SEQ ID NO: 376165 - DNA, 25 bp, Mus musculus
ccacctgtgactctcgcatagcgat

SEQ ID NO: 376166 - DNA, 25 bp, Mus musculus
gactctcgcatagcgatgcctcttg

SEQ ID NO: 376167 - DNA, 25 bp, Mus musculus
cgaactcgcattctttagcactaaa

SEQ ID NO: 376168 - DNA, 25 bp, Mus musculus
atagctgcggactcagtatcccttg

SEQ ID NO: 376169 - DNA, 25 bp, Mus musculus
tcagtatcccttgatgccctgcggc

SEQ ID NO: 376170 - DNA, 25 bp, Mus musculus
gatgccctgcggctttttctgacgc

SEQ ID NO: 376171 - DNA, 25 bp, Mus musculus
cggctttttctgacgcgactaggag

SEQ ID NO: 376172 - DNA, 25 bp, Mus musculus
tttctgacgcgactaggaggacagg

SEQ ID NO: 376173 - DNA, 25 bp, Mus musculus
ggcgtggcctacagtgggccacacc

SEQ ID NO: 376174 - DNA, 25 bp, Mus musculus
ggaaactgggtgccgactacaactc

SEQ ID NO: 376175 - DNA, 25 bp, Mus musculus
ttagcactaaatctcatagctgcgg

SEQ ID NO: 376176 - DNA, 25 bp, Mus musculus
cgatatagcgatcccgagccgtgtt

SEQ ID NO: 376177 - DNA, 25 bp, Mus musculus
gggaactgtgcgtaacctcgtgctc

SEQ ID NO: 376178 - DNA, 25 bp, Mus musculus
ccggtatcaacgtgtggtcccgcca

SEQ ID NO: 376179 - DNA, 25 bp, Mus musculus
agctccaacttctgggactcacgct

SEQ ID NO: 376180 - DNA, 25 bp, Mus musculus
aaatttggagttcagcaccgcgcgc

SEQ ID NO: 376181 - DNA, 25 bp, Mus musculus
ccacagcaagcccagaggaaatttg

SEQ ID NO: 376182 - DNA, 25 bp, Mus musculus
agcccttccagcctgcaggtttacg

SEQ ID NO: 376183 - DNA, 25 bp, Mus musculus
acacagatccgagtaggtagcccta

SEQ ID NO: 376184 - DNA, 25 bp, Mus musculus
ttcccaggagcaagtgagtgtaatc

SEQ ID NO: 376185 - DNA, 25 bp, Mus musculus
gcgtctagatgtcgtcgtcgccttc

SEQ ID NO: 376186 - DNA, 25 bp, Mus musculus
ctgccaagagcgaagctgcgggctc

SEQ ID NO: 376187 - DNA, 25 bp, Mus musculus
gcgacacctgtcaaaactgccaaga

SEQ ID NO: 376188 - DNA, 25 bp, Mus musculus
ttcccggctctagccatggagatgg

SEQ ID NO: 376189 - DNA, 25 bp, Mus musculus
gagccgtgttttaatgtccttacca

SEQ ID NO: 376190 - DNA, 25 bp, Mus musculus
gctgttctctctcgcggggcctaga

SEQ ID NO: 376191 - DNA, 25 bp, Mus musculus
gtcggctccgctgaaacgcagcctg

SEQ ID NO: 376192 - DNA, 25 bp, Mus musculus
gtgtagctcttgtgctggcgtgaaa

SEQ ID NO: 376193 - DNA, 25 bp, Mus musculus
gcgtgaaagggacaaactagggctc

SEQ ID NO: 376194 - DNA, 25 bp, Mus musculus
tggggaggcttcgaagaaaacatcc

SEQ ID NO: 376195 - DNA, 25 bp, Mus musculus
tccgaaatggtgctggcccggaatg

SEQ ID NO: 376196 - DNA, 25 bp, Mus musculus
aagcctcgagggacatggcgactcc

SEQ ID NO: 376197 - DNA, 25 bp, Mus musculus
cggacgtcaagtggggccaaacatc

SEQ ID NO: 376198 - DNA, 25 bp, Mus musculus
cgtccttcacttccggacgtcaagt

SEQ ID NO: 376199 - DNA, 25 bp, Mus musculus
aatcttgaatgtcgcgagatcttgc

SEQ ID NO: 376200 - DNA, 25 bp, Mus musculus
tcgggctcccgcaatcttgaatgtc

SEQ ID NO: 376201 - DNA, 25 bp, Mus musculus
tcgctgtaaaaggaggcgagtccgc

SEQ ID NO: 376202 - DNA, 25 bp, Mus musculus
acatccaggtatggagcgcgcctgc

SEQ ID NO: 376203 - DNA, 25 bp, Mus musculus
atcttccgccactcgctgtaaaagg

SEQ ID NO: 376204 - DNA, 25 bp, Mus musculus
accacgccgccgtgtcctccccact

SEQ ID NO: 376205 - DNA, 25 bp, Mus musculus
tgagggtccctaccgcgcggtatcc

SEQ ID NO: 376206 - DNA, 25 bp, Mus musculus
agctgagggtccctaccgcgcggta

SEQ ID NO: 376207 - DNA, 25 bp, Mus musculus
cttagctgagggtccctaccgcgcg

SEQ ID NO: 376208 - DNA, 25 bp, Mus musculus
gcaccttagctgagggtccctaccg

SEQ ID NO: 376209 - DNA, 25 bp, Mus musculus
tcccgatcatcagcaccttagctga

SEQ ID NO: 376210 - DNA, 25 bp, Mus musculus
taccgcgcggtatcctcccaccaac

SEQ ID NO: 376211 - DNA, 25 bp, Mus musculus
accacgcttgttctccaatccctcc

SEQ ID NO: 376212 - DNA, 25 bp, Mus musculus
gtcttcaccacgcttgttctccaat

SEQ ID NO: 376213 - DNA, 25 bp, Mus musculus
cctcaaagatgtgtcttcaccacgc

SEQ ID NO: 376214 - DNA, 25 bp, Mus musculus
ccctcaaagatgtgtcttcaccacg

SEQ ID NO: 376215 - DNA, 25 bp, Mus musculus
tcagtcggcggtgcctgccttgtcc

SEQ ID NO: 376216 - DNA, 25 bp, Mus musculus
cctcagtcggcggtgcctgccttgt

SEQ ID NO: 376217 - DNA, 25 bp, Mus musculus
agcaccttagctgagggtccctacc

SEQ ID NO: 376218 - DNA, 25 bp, Mus musculus
atagacacctcacccgggcggaagc

SEQ ID NO: 376219 - DNA, 25 bp, Mus musculus
cggggcaggccagtttctagatcct

SEQ ID NO: 376220 - DNA, 25 bp, Mus musculus
ctagatcctggtacttacgttcacc

SEQ ID NO: 376221 - DNA, 25 bp, Mus musculus
gtctcccgcacttggaaacctaagc

SEQ ID NO: 376222 - DNA, 25 bp, Mus musculus
acctaagcgcctttgagctgtttta

SEQ ID NO: 376223 - DNA, 25 bp, Mus musculus
cgccacgatgctagggccctctaga

SEQ ID NO: 376224 - DNA, 25 bp, Mus musculus
cctgttaacgggtgctgttcgcagt

SEQ ID NO: 376225 - DNA, 25 bp, Mus musculus
atgctctaacgcgtgccagcctctg

SEQ ID NO: 376226 - DNA, 25 bp, Mus musculus
cgcgatggtgtttgcgcacgtttct

SEQ ID NO: 376227 - DNA, 25 bp, Mus musculus
acgtttctgtcttttggcttgcgca

SEQ ID NO: 376228 - DNA, 25 bp, Mus musculus
cccagtcctgtccttgtgcaaattc

SEQ ID NO: 376229 - DNA, 25 bp, Mus musculus
tcattaagaccctggcacgtggagc

SEQ ID NO: 376230 - DNA, 25 bp, Mus musculus
ctagagcccgcccattcttgaggta

SEQ ID NO: 376231 - DNA, 25 bp, Mus musculus
tgcttccgcttcgagctagagcccg

SEQ ID NO: 376232 - DNA, 25 bp, Mus musculus
ttccgaggcagcattcgaggcgagt

SEQ ID NO: 376233 - DNA, 25 bp, Mus musculus
ctcgccggtcgccattttgcgcggg

SEQ ID NO: 376234 - DNA, 25 bp, Mus musculus
ggtagccatgtaccgcagtggctcc

SEQ ID NO: 376235 - DNA, 25 bp, Mus musculus
tccgtctcttcgcaccggtcgaaag

SEQ ID NO: 376236 - DNA, 25 bp, Mus musculus
caccggtcgaaagacggcagcgcga

SEQ ID NO: 376237 - DNA, 25 bp, Mus musculus
cctgggtggcttccgaggcagcatt

SEQ ID NO: 376238 - DNA, 25 bp, Mus musculus
attcgaggcgagtcccgcgccgact

SEQ ID NO: 376239 - DNA, 25 bp, Mus musculus
ggccctcaggccagagtccgaatgt

SEQ ID NO: 376240 - DNA, 25 bp, Mus musculus
cagagtccgaatgtccgagtcttcc

SEQ ID NO: 376241 - DNA, 25 bp, Mus musculus
gacagtcctgggtgcctcctttaca

SEQ ID NO: 376242 - DNA, 25 bp, Mus musculus
ctcccggtagccatgtaccgcagtg

SEQ ID NO: 376243 - DNA, 25 bp, Mus musculus
gagaggggtggtctctctgcatcac

SEQ ID NO: 376244 - DNA, 25 bp, Mus musculus
gtaatcccacccttcgcccatgttg

SEQ ID NO: 376245 - DNA, 25 bp, Mus musculus
tctctctgcatcacgtggtctccgg

SEQ ID NO: 376246 - DNA, 25 bp, Mus musculus
cgggcttggagacttgggcgcgacc

SEQ ID NO: 376247 - DNA, 25 bp, Mus musculus
cccggctcgcggactgtttgggacg

SEQ ID NO: 376248 - DNA, 25 bp, Mus musculus
gagctctctttacgggacagggact

SEQ ID NO: 376249 - DNA, 25 bp, Mus musculus
aggagctctctttacgggacaggga

SEQ ID NO: 376250 - DNA, 25 bp, Mus musculus
tgagatctgacttggaggacccccc

SEQ ID NO: 376251 - DNA, 25 bp, Mus musculus
gaggcctccggctgagatctgactt

SEQ ID NO: 376252 - DNA, 25 bp, Mus musculus
cgcgctgagtctgcagttgtttccc

SEQ ID NO: 376253 - DNA, 25 bp, Mus musculus
ctgcgcgctgagtctgcagttgttt

SEQ ID NO: 376254 - DNA, 25 bp, Mus musculus
gcccggcctttggttgctgcgcgct

SEQ ID NO: 376255 - DNA, 25 bp, Mus musculus
tctctttacgggacagggactggct

SEQ ID NO: 376256 - DNA, 25 bp, Mus musculus
cgggtgggtgtcattatctggcccc

SEQ ID NO: 376257 - DNA, 25 bp, Mus musculus
gctggaagcggctccagtgtggccg

SEQ ID NO: 376258 - DNA, 25 bp, Mus musculus
cgtaaggctgtgctggaagcggctc

SEQ ID NO: 376259 - DNA, 25 bp, Mus musculus
ctttacgggacagggactggctccg

SEQ ID NO: 376260 - DNA, 25 bp, Mus musculus
caaaagaactttagcagcaggcagc

SEQ ID NO: 376261 - DNA, 25 bp, Mus musculus
actttagcagcaggcagcttggcgg

SEQ ID NO: 376262 - DNA, 25 bp, Mus musculus
gggcacgccaagtagcagttggtta

SEQ ID NO: 376263 - DNA, 25 bp, Mus musculus
cgccaagtagcagttggttaaaaag

SEQ ID NO: 376264 - DNA, 25 bp, Mus musculus
tccggcggtaccaggggcacgccaa

SEQ ID NO: 376265 - DNA, 25 bp, Mus musculus
tttgggatgctaagtttgcgggtcc

SEQ ID NO: 376266 - DNA, 25 bp, Mus musculus
agaacatacattcgtgttagtgatg

SEQ ID NO: 376267 - DNA, 25 bp, Mus musculus
tctcgagtacgacgctccgggtttg

SEQ ID NO: 376268 - DNA, 25 bp, Mus musculus
acctgcgacagggtctcgagtacga

SEQ ID NO: 376269 - DNA, 25 bp, Mus musculus
ccttaacagttagaaacctgcgaca

SEQ ID NO: 376270 - DNA, 25 bp, Mus musculus
tgagcaacaagggtccttaacagtt

SEQ ID NO: 376271 - DNA, 25 bp, Mus musculus
ggttaaaaagacagaacatacattc

SEQ ID NO: 376272 - DNA, 25 bp, Mus musculus
ctccgggtttgggatgctaagtttg

SEQ ID NO: 376273 - DNA, 25 bp, Mus musculus
ggttcagggctggagtgagcaacaa

SEQ ID NO: 376274 - DNA, 25 bp, Mus musculus
cgctgaatgagggaaccggaggagc

SEQ ID NO: 376275 - DNA, 25 bp, Mus musculus
gtgagggtagtgctccgtctccagc

SEQ ID NO: 376276 - DNA, 25 bp, Mus musculus
gagggtagtgctccgtctccagcgt

SEQ ID NO: 376277 - DNA, 25 bp, Mus musculus
gtagtgctccgtctccagcgtggag

SEQ ID NO: 376278 - DNA, 25 bp, Mus musculus
agtgctccgtctccagcgtggagga

SEQ ID NO: 376279 - DNA, 25 bp, Mus musculus
tctccagcgtggaggaggagaacac

SEQ ID NO: 376280 - DNA, 25 bp, Mus musculus
cgtggaggaggagaacacggaggaa

SEQ ID NO: 376281 - DNA, 25 bp, Mus musculus
acacggaggaagccagtcgtcgcag

SEQ ID NO: 376282 - DNA, 25 bp, Mus musculus
ccgggctgctctcagcggagcggct

SEQ ID NO: 376283 - DNA, 25 bp, Mus musculus
acgcaccgggctgctctcagcggag

SEQ ID NO: 376284 - DNA, 25 bp, Mus musculus
acgagtctgtggttgccggctgcca

SEQ ID NO: 376285 - DNA, 25 bp, Mus musculus
cgcgagatgcggagcaccgagggca

SEQ ID NO: 376286 - DNA, 25 bp, Mus musculus
agcggctgcgctgaatgagggaacc

SEQ ID NO: 376287 - DNA, 25 bp, Mus musculus
agcaccgagggcacgagtctgtggt

SEQ ID NO: 376288 - DNA, 25 bp, Mus musculus
cgtcccggctcctagcggcagcggc

SEQ ID NO: 376289 - DNA, 25 bp, Mus musculus
tggggagctgcccacaatgcactgc

SEQ ID NO: 376290 - DNA, 25 bp, Mus musculus
cgaagtggggagctgcccacaatgc

SEQ ID NO: 376291 - DNA, 25 bp, Mus musculus
ctgcgaagtggggagctgcccacaa

SEQ ID NO: 376292 - DNA, 25 bp, Mus musculus
cccgatcctcctcgggcgacggcgg

SEQ ID NO: 376293 - DNA, 25 bp, Mus musculus
acctgctcggtgtccgctgcggctg

SEQ ID NO: 376294 - DNA, 25 bp, Mus musculus
gaggcccgatgtaccccaggaggga

SEQ ID NO: 376295 - DNA, 25 bp, Mus musculus
ccgagccctgggaggtgagcccggc

SEQ ID NO: 376296 - DNA, 25 bp, Mus musculus
cagcggcgacgaccgctgcgggaca

SEQ ID NO: 376297 - DNA, 25 bp, Mus musculus
gcccagggagtgtaggccggcgtcc

SEQ ID NO: 376298 - DNA, 25 bp, Mus musculus
caggcctcgggctgtggcccaggga

SEQ ID NO: 376299 - DNA, 25 bp, Mus musculus
ggctgggagccgctccaggcctcgg

SEQ ID NO: 376300 - DNA, 25 bp, Mus musculus
accgctgcgggacaggagccgagcc

SEQ ID NO: 376301 - DNA, 25 bp, Mus musculus
ggcggcctcccgaccgcgaccatcc

SEQ ID NO: 376302 - DNA, 25 bp, Mus musculus
tcaggaccgcggagcactcaaacac

SEQ ID NO: 376303 - DNA, 25 bp, Mus musculus
agactcagtcgggtagcggaatcca

SEQ ID NO: 376304 - DNA, 25 bp, Mus musculus
ctcagcctgctgtctctggcgatga

SEQ ID NO: 376305 - DNA, 25 bp, Mus musculus
ccgaagtgaagagccgaaagaagcc

SEQ ID NO: 376306 - DNA, 25 bp, Mus musculus
tcttcagggatccagacatgtccga

SEQ ID NO: 376307 - DNA, 25 bp, Mus musculus
agccatcctggcttcaagatcttca

SEQ ID NO: 376308 - DNA, 25 bp, Mus musculus
tggccttccgaagctgctctgcagc

SEQ ID NO: 376309 - DNA, 25 bp, Mus musculus
cgagcttgggtctcccgcagactca

SEQ ID NO: 376310 - DNA, 25 bp, Mus musculus
gcccagctagacgtggcactctcgg

SEQ ID NO: 376311 - DNA, 25 bp, Mus musculus
ggcacgcaaattcactcgcccaggg

SEQ ID NO: 376312 - DNA, 25 bp, Mus musculus
tgagacgtctgctcctctagctgcc

SEQ ID NO: 376313 - DNA, 25 bp, Mus musculus
aaagccgctgcgactgtctcagatc

SEQ ID NO: 376314 - DNA, 25 bp, Mus musculus
gggacccagggcacaaaagcacggc

SEQ ID NO: 376315 - DNA, 25 bp, Mus musculus
aagccctggttgagcgttctcgcat

SEQ ID NO: 376316 - DNA, 25 bp, Mus musculus
ccaagctctgtattcgcggatcgta

SEQ ID NO: 376317 - DNA, 25 bp, Mus musculus
tatccgggaagagagcgagcttgaa

SEQ ID NO: 376318 - DNA, 25 bp, Mus musculus
ctcgggaagagcctatccgggaaga

SEQ ID NO: 376319 - DNA, 25 bp, Mus musculus
tgggagtcgctttcccaggtcacgt

SEQ ID NO: 376320 - DNA, 25 bp, Mus musculus
cttacctctgggagtcgctttccca

SEQ ID NO: 376321 - DNA, 25 bp, Mus musculus
gggagctggttccatgctctgtgta

SEQ ID NO: 376322 - DNA, 25 bp, Mus musculus
ccatgctctgtgtacttctgcggga

SEQ ID NO: 376323 - DNA, 25 bp, Mus musculus
ctctgtgtacttctgcgggagcatc

SEQ ID NO: 376324 - DNA, 25 bp, Mus musculus
atccggggagctggttccatgctct

SEQ ID NO: 376325 - DNA, 25 bp, Mus musculus
ggcgggaagaccaagctctgtattc

SEQ ID NO: 376326 - DNA, 25 bp, Mus musculus
tattcgcggatcgtatcccggctgc

SEQ ID NO: 376327 - DNA, 25 bp, Mus musculus
ctatgggaaggtgctcactgagcac

SEQ ID NO: 376328 - DNA, 25 bp, Mus musculus
tgctcactgagcacgtggctgatgc

SEQ ID NO: 376329 - DNA, 25 bp, Mus musculus
gtacttctgcgggagcatccgcggc

SEQ ID NO: 376330 - DNA, 25 bp, Mus musculus
ccaagctagactccagagaggtggc

SEQ ID NO: 376331 - DNA, 25 bp, Mus musculus
gaaagcagcacgatcgcgtccaagc

SEQ ID NO: 376332 - DNA, 25 bp, Mus musculus
cccactgcgagcgtggcaaagcggc

SEQ ID NO: 376333 - DNA, 25 bp, Mus musculus
cctacggtggcccactgcgagcgtg

SEQ ID NO: 376334 - DNA, 25 bp, Mus musculus
acaccaagcggggaataatggcctg

SEQ ID NO: 376335 - DNA, 25 bp, Mus musculus
ccgggactgagaacagaaagcagca

SEQ ID NO: 376336 - DNA, 25 bp, Mus musculus
tcgcgtccaagctagactccagaga

SEQ ID NO: 376337 - DNA, 25 bp, Mus musculus
ggaggagcccgctcaacaccaagcg

SEQ ID NO: 376338 - DNA, 25 bp, Mus musculus
tcgcgagctgacaggacctgcttcc

SEQ ID NO: 376339 - DNA, 25 bp, Mus musculus
gctcggtgcagagctttcttctcac

SEQ ID NO: 376340 - DNA, 25 bp, Mus musculus
tgcagagctttcttctcacctctca

SEQ ID NO: 376341 - DNA, 25 bp, Mus musculus
gcctcctccacagctcttttccggg

SEQ ID NO: 376342 - DNA, 25 bp, Mus musculus
ttttccgggtcacacgccgggcgca

SEQ ID NO: 376343 - DNA, 25 bp, Mus musculus
cctgactgccgggactgagaacaga

SEQ ID NO: 376344 - DNA, 25 bp, Mus musculus
tactaaagccgctcttgctgccgcg

SEQ ID NO: 376345 - DNA, 25 bp, Mus musculus
accacgcgctggctgcggaggtatc

SEQ ID NO: 376346 - DNA, 25 bp, Mus musculus
ccggcactcgcgctgttactaaagc

SEQ ID NO: 376347 - DNA, 25 bp, Mus musculus
gttgtcgatgaactccatcttgatc

SEQ ID NO: 376348 - DNA, 25 bp, Mus musculus
ctcttgctgaaggtcgtgtagcgcc

SEQ ID NO: 376349 - DNA, 25 bp, Mus musculus
tcggctctgtctcgctccggggcta

SEQ ID NO: 376350 - DNA, 25 bp, Mus musculus
gctccggggctaccttagagcgcac

SEQ ID NO: 376351 - DNA, 25 bp, Mus musculus
cggctccggtaccttcttcatgatg

SEQ ID NO: 376352 - DNA, 25 bp, Mus musculus
atgatgcccgtcttcctcttgctga

SEQ ID NO: 376353 - DNA, 25 bp, Mus musculus
ctgacgggcaagtcagcgaggaatc

SEQ ID NO: 376354 - DNA, 25 bp, Mus musculus
cccagcttggctcggtaacatggcg

SEQ ID NO: 376355 - DNA, 25 bp, Mus musculus
gctcggtaacatggcgctcagtgca

SEQ ID NO: 376356 - DNA, 25 bp, Mus musculus
agctgccgccatcggcttctcggtt

SEQ ID NO: 376357 - DNA, 25 bp, Mus musculus
tagcgccgcagcttgttgtcgatga

SEQ ID NO: 376358 - DNA, 25 bp, Mus musculus
ggacggctccttgataaagacgata

SEQ ID NO: 376359 - DNA, 25 bp, Mus musculus
ccattgagcagccagtacacgtgca

SEQ ID NO: 376360 - DNA, 25 bp, Mus musculus
gcagccagtacacgtgcaccgggtc

SEQ ID NO: 376361 - DNA, 25 bp, Mus musculus
cagtacacgtgcaccgggtccggag

SEQ ID NO: 376362 - DNA, 25 bp, Mus musculus
ggagcctccacttcacaacggagca

SEQ ID NO: 376363 - DNA, 25 bp, Mus musculus
ggcgcccttgaagtgcatcctggga

SEQ ID NO: 376364 - DNA, 25 bp, Mus musculus
ctgggaggacggctccttgataaag

SEQ ID NO: 376365 - DNA, 25 bp, Mus musculus
cgtcgctccgtgtcctggacaggca

SEQ ID NO: 376366 - DNA, 25 bp, Mus musculus
ccttgataaagacgatagcggcttg

SEQ ID NO: 376367 - DNA, 25 bp, Mus musculus
agacgatagcggcttgggcacctgc

SEQ ID NO: 376368 - DNA, 25 bp, Mus musculus
acctgcggacgcagacgtgggagaa

SEQ ID NO: 376369 - DNA, 25 bp, Mus musculus
gtcaggaggagctgatgcctccatc

SEQ ID NO: 376370 - DNA, 25 bp, Mus musculus
ctgatgcctccatcctaacacgggg

SEQ ID NO: 376371 - DNA, 25 bp, Mus musculus
cccttgaagtgcatcctgggaggac

SEQ ID NO: 376372 - DNA, 25 bp, Mus musculus
cccagggatgccaggaaagtctata

SEQ ID NO: 376373 - DNA, 25 bp, Mus musculus
cccaatctggcgagagctgtcacaa

SEQ ID NO: 376374 - DNA, 25 bp, Mus musculus
ccggccgctcgcataactaatgaga

SEQ ID NO: 376375 - DNA, 25 bp, Mus musculus
tgccatgcgagaacacacaccgagg

SEQ ID NO: 376376 - DNA, 25 bp, Mus musculus
gcctcgcgtcttcctcaagaattca

SEQ ID NO: 376377 - DNA, 25 bp, Mus musculus
gaccggtatctcttgcactatcgcc

SEQ ID NO: 376378 - DNA, 25 bp, Mus musculus
tcccagagtgttctagaccggtatc

SEQ ID NO: 376379 - DNA, 25 bp, Mus musculus
atcccaccggtgaggcgataatccg

SEQ ID NO: 376380 - DNA, 25 bp, Mus musculus
tggcttccttcgcaggcctattagg

SEQ ID NO: 376381 - DNA, 25 bp, Mus musculus
tcccaagagagcttgcagtggcttc

SEQ ID NO: 376382 - DNA, 25 bp, Mus musculus
gcccagatgttcagcttaattccca

SEQ ID NO: 376383 - DNA, 25 bp, Mus musculus
cggcaagagctctacgaggcactga

SEQ ID NO: 376384 - DNA, 25 bp, Mus musculus
tggacgcccttgctctcctagagta

SEQ ID NO: 376385 - DNA, 25 bp, Mus musculus
cggtttcctcttcgtctggctttca

SEQ ID NO: 376386 - DNA, 25 bp, Mus musculus
tccgggcaacgctcgagcaaactct

SEQ ID NO: 376387 - DNA, 25 bp, Mus musculus
tcgggccggcataggtaacaaagct

SEQ ID NO: 376388 - DNA, 25 bp, Mus musculus
cgcttctcaaagcacagctcggatc

SEQ ID NO: 376389 - DNA, 25 bp, Mus musculus
cagaagcagggctctgagcagagtc

SEQ ID NO: 376390 - DNA, 25 bp, Mus musculus
tcgggcggagagaactcacagcaaa

SEQ ID NO: 376391 - DNA, 25 bp, Mus musculus
acgagcagcgaggttcaaggcacac

SEQ ID NO: 376392 - DNA, 25 bp, Mus musculus
agcaaactctcggatcgggcggaga

SEQ ID NO: 376393 - DNA, 25 bp, Mus musculus
gagggcactgcttctccaaaaggga

SEQ ID NO: 376394 - DNA, 25 bp, Mus musculus
cgtccgcaccttttcacgggatggg

SEQ ID NO: 376395 - DNA, 25 bp, Mus musculus
atctgggctccaaggcccggggcat

SEQ ID NO: 376396 - DNA, 25 bp, Mus musculus
cccatgtcagctcggacgggatcgg

SEQ ID NO: 376397 - DNA, 25 bp, Mus musculus
aggtaacaaagctccgcgccaggcg

SEQ ID NO: 376398 - DNA, 25 bp, Mus musculus
agctcggatcctcccggttctcggg

SEQ ID NO: 376399 - DNA, 25 bp, Mus musculus
agatcttagcagagcttgggagcca

SEQ ID NO: 376400 - DNA, 25 bp, Mus musculus
tcccgcaaggctaggcgagatcacg

SEQ ID NO: 376401 - DNA, 25 bp, Mus musculus
tggctgccgctcgaggcaattgttt

SEQ ID NO: 376402 - DNA, 25 bp, Mus musculus
ggcaattgttttgacggctccaagg

SEQ ID NO: 376403 - DNA, 25 bp, Mus musculus
ccgatgattggctgagaacttgttc

SEQ ID NO: 376404 - DNA, 25 bp, Mus musculus
caagaaagcgtgtatcctgcggcgc

SEQ ID NO: 376405 - DNA, 25 bp, Mus musculus
cgcctctctcgcgtcattggaaagc

SEQ ID NO: 376406 - DNA, 25 bp, Mus musculus
cgggaccggaacgtcatcccagagc

SEQ ID NO: 376407 - DNA, 25 bp, Mus musculus
gcgccaggctctggatgaaggtaaa

SEQ ID NO: 376408 - DNA, 25 bp, Mus musculus
ctctgcgctctttgagcctggcatc

SEQ ID NO: 376409 - DNA, 25 bp, Mus musculus
taggattggttctttccgcctgggc

SEQ ID NO: 376410 - DNA, 25 bp, Mus musculus
gatcacgtgaccttcgttctccgtc

SEQ ID NO: 376411 - DNA, 25 bp, Mus musculus
tttaaatttatcatggctgccgctc

SEQ ID NO: 376412 - DNA, 25 bp, Mus musculus
gttctccgtcaatcccgatctcaga

SEQ ID NO: 376413 - DNA, 25 bp, Mus musculus
ccgcttacctgggaactaggattgg

SEQ ID NO: 376414 - DNA, 25 bp, Mus musculus
aggctccaccctgcagcaggcagtg

SEQ ID NO: 376415 - DNA, 25 bp, Mus musculus
cccagctttccgctaaatcaggcgg

SEQ ID NO: 376416 - DNA, 25 bp, Mus musculus
aggactaggctccaccctgcagcag

SEQ ID NO: 376417 - DNA, 25 bp, Mus musculus
gcctcggaggcctctgctggtcacg

SEQ ID NO: 376418 - DNA, 25 bp, Mus musculus
cgcgtccctagctctgcaaaggaca

SEQ ID NO: 376419 - DNA, 25 bp, Mus musculus
caaaggacaggcctcgcgccaggat

SEQ ID NO: 376420 - DNA, 25 bp, Mus musculus
cctattctgggcttccgatcgaccg

SEQ ID NO: 376421 - DNA, 25 bp, Mus musculus
gggcttccgatcgaccgcggagcct

SEQ ID NO: 376422 - DNA, 25 bp, Mus musculus
ttcccaaccgtgcttcgggactatc

SEQ ID NO: 376423 - DNA, 25 bp, Mus musculus
tcgggactatcctttactgggccta

SEQ ID NO: 376424 - DNA, 25 bp, Mus musculus
tccggaccttctcgggtcttgattc

SEQ ID NO: 376425 - DNA, 25 bp, Mus musculus
cgggtcttgattcccatccaccaag

SEQ ID NO: 376426 - DNA, 25 bp, Mus musculus
agcctcgcgccgcttatccatcgga

SEQ ID NO: 376427 - DNA, 25 bp, Mus musculus
tccgctaaatcaggcggaagcgagc

SEQ ID NO: 376428 - DNA, 25 bp, Mus musculus
cgtttgccagttttaatacctatgc

SEQ ID NO: 376429 - DNA, 25 bp, Mus musculus
agaattacgaggagatcgctgctgg

SEQ ID NO: 376430 - DNA, 25 bp, Mus musculus
cgtgcctcgtttgccagttttaata

SEQ ID NO: 376431 - DNA, 25 bp, Mus musculus
tttcaggaggtcgaggcggtttcgc

SEQ ID NO: 376432 - DNA, 25 bp, Mus musculus
acctatgccttgtatgtgcgggaca

SEQ ID NO: 376433 - DNA, 25 bp, Mus musculus
ttccgacagagcaatgatggcgttc

SEQ ID NO: 376434 - DNA, 25 bp, Mus musculus
tgccagttttaatacctatgccttg

SEQ ID NO: 376435 - DNA, 25 bp, Mus musculus
ggccagttccgacagagcaatgatg

SEQ ID NO: 376436 - DNA, 25 bp, Mus musculus
tatgccttgtatgtgcgggacacgc

SEQ ID NO: 376437 - DNA, 25 bp, Mus musculus
tgccttgtatgtgcgggacacgctg

SEQ ID NO: 376438 - DNA, 25 bp, Mus musculus
atgagggccagttccgacagagcaa

SEQ ID NO: 376439 - DNA, 25 bp, Mus musculus
gatgcgggtacggatgctggagaat

SEQ ID NO: 376440 - DNA, 25 bp, Mus musculus
tgctggagaattacgaggagatcgc

SEQ ID NO: 376441 - DNA, 25 bp, Mus musculus
ccgacagagcaatgatggcgttccc

SEQ ID NO: 376442 - DNA, 25 bp, Mus musculus
attgaaccgcggcactcgggcggct

SEQ ID NO: 376443 - DNA, 25 bp, Mus musculus
agccaatgtgctgagggttctgcca

SEQ ID NO: 376444 - DNA, 25 bp, Mus musculus
tgagggttctgccagaagcaccgcc

SEQ ID NO: 376445 - DNA, 25 bp, Mus musculus
tttccggaagcctgagccaatgtgc

SEQ ID NO: 376446 - DNA, 25 bp, Mus musculus
taaagcgggaagcacccgctcctct

SEQ ID NO: 376447 - DNA, 25 bp, Mus musculus
ggcggcttctgttcccgcagccaaa

SEQ ID NO: 376448 - DNA, 25 bp, Mus musculus
taggtcctcacccttcagccggtcg

SEQ ID NO: 376449 - DNA, 25 bp, Mus musculus
ccgcagccgtagaacttcacgtctg

SEQ ID NO: 376450 - DNA, 25 bp, Mus musculus
ctccatagcacggtgaggaccttcg

SEQ ID NO: 376451 - DNA, 25 bp, Mus musculus
ttccgcatgtcttccgtagtccggg

SEQ ID NO: 376452 - DNA, 25 bp, Mus musculus
ccgtagtccgggctgaaaacttgca

SEQ ID NO: 376453 - DNA, 25 bp, Mus musculus
ccgggctgaaaacttgcacgacttc

SEQ ID NO: 376454 - DNA, 25 bp, Mus musculus
gcacgacttccgctcacgacgaggt

SEQ ID NO: 376455 - DNA, 25 bp, Mus musculus
tcccaaagtcgtaaagcgggaagca

SEQ ID NO: 376456 - DNA, 25 bp, Mus musculus
tacggtggaaaatataggtgatctc

SEQ ID NO: 376457 - DNA, 25 bp, Mus musculus
aattgactcggtcgcacagaggctg

SEQ ID NO: 376458 - DNA, 25 bp, Mus musculus
gcgaaaatgcgaaaagaattgactc

SEQ ID NO: 376459 - DNA, 25 bp, Mus musculus
tccgaaagacggcaagcgaaaatgc

SEQ ID NO: 376460 - DNA, 25 bp, Mus musculus
ggtttagtaactgaagtcgaatcac

SEQ ID NO: 376461 - DNA, 25 bp, Mus musculus
atcggcactccgaaagacggcaagc

SEQ ID NO: 376462 - DNA, 25 bp, Mus musculus
cgagcagcatcgaccgaacatcggc

SEQ ID NO: 376463 - DNA, 25 bp, Mus musculus
aggtgatctcctctcgagcagcatc

SEQ ID NO: 376464 - DNA, 25 bp, Mus musculus
tagagacggctacggtggaaaatat

SEQ ID NO: 376465 - DNA, 25 bp, Mus musculus
agtcaaaaaagtagagacggctacg

SEQ ID NO: 376466 - DNA, 25 bp, Mus musculus
cgtgcaagccctggggaataaagtc

SEQ ID NO: 376467 - DNA, 25 bp, Mus musculus
gtcgaatcactaacagatgccgtgc

SEQ ID NO: 376468 - DNA, 25 bp, Mus musculus
cgtgaaaacagacgtacggcggatt

SEQ ID NO: 376469 - DNA, 25 bp, Mus musculus
taacagatgccgtgcaagccctggg

SEQ ID NO: 376470 - DNA, 25 bp, Mus musculus
ccgacagcttcagggacttgtagtc

SEQ ID NO: 376471 - DNA, 25 bp, Mus musculus
cgaggaaataccaacgccgagaatc

SEQ ID NO: 376472 - DNA, 25 bp, Mus musculus
ttgtcctcgcttgcgtcagtctcgg

SEQ ID NO: 376473 - DNA, 25 bp, Mus musculus
gcaagaggcggacttgtcctcgctt

SEQ ID NO: 376474 - DNA, 25 bp, Mus musculus
aatgtagttctttgtggtccgggca

SEQ ID NO: 376475 - DNA, 25 bp, Mus musculus
cctgagggtcactgggtaatgtagt

SEQ ID NO: 376476 - DNA, 25 bp, Mus musculus
tgcagtgagaattgccggcccgaca

SEQ ID NO: 376477 - DNA, 25 bp, Mus musculus
gacgcgcacgtgcagtgagaattgc

SEQ ID NO: 376478 - DNA, 25 bp, Mus musculus
cagacttcgtccttccggcgggcag

SEQ ID NO: 376479 - DNA, 25 bp, Mus musculus
aacgagataaacactgccagacttc

SEQ ID NO: 376480 - DNA, 25 bp, Mus musculus
gctgccagcagcctagaacccgttg

SEQ ID NO: 376481 - DNA, 25 bp, Mus musculus
cagccgtaggcaatgggcgtcgcct

SEQ ID NO: 376482 - DNA, 25 bp, Mus musculus
ccggtttgtgcgcatgcgcagaaca

SEQ ID NO: 376483 - DNA, 25 bp, Mus musculus
accagttcacgtcgcacgcctgagg

SEQ ID NO: 376484 - DNA, 25 bp, Mus musculus
cagagggtcagtctgaggctgtccc

SEQ ID NO: 376485 - DNA, 25 bp, Mus musculus
cccgagcttggctagcagatctgtt

SEQ ID NO: 376486 - DNA, 25 bp, Mus musculus
ggggaaaggccacgctcaccttatc

SEQ ID NO: 376487 - DNA, 25 bp, Mus musculus
tcagtttataggacatctcggccgg

SEQ ID NO: 376488 - DNA, 25 bp, Mus musculus
tggctgcgcttccaattggcccgaa

SEQ ID NO: 376489 - DNA, 25 bp, Mus musculus
ttggcccgaactcttacaaacctgc

SEQ ID NO: 376490 - DNA, 25 bp, Mus musculus
ttacaaacctgcctgagaaccagga

SEQ ID NO: 376491 - DNA, 25 bp, Mus musculus
tcctcggattggtcattggagccaa

SEQ ID NO: 376492 - DNA, 25 bp, Mus musculus
accgccagggttcggctcccagaat

SEQ ID NO: 376493 - DNA, 25 bp, Mus musculus
tcggctcccagaattggctggagtg

SEQ ID NO: 376494 - DNA, 25 bp, Mus musculus
gctcaccttatccttcttcagttta

SEQ ID NO: 376495 - DNA, 25 bp, Mus musculus
cggagccatggggaaacccgagctt

SEQ ID NO: 376496 - DNA, 25 bp, Mus musculus
tagcagatctgttctccggcgtcgc

SEQ ID NO: 376497 - DNA, 25 bp, Mus musculus
tggagtggaaggtcccgccctgaaa

SEQ ID NO: 376498 - DNA, 25 bp, Mus musculus
tagtgtcgtcctttgcagcttccca

SEQ ID NO: 376499 - DNA, 25 bp, Mus musculus
gagctgtctccggagtctcggactc

SEQ ID NO: 376500 - DNA, 25 bp, Mus musculus
tctagaaccgcgctgggagctgtct

SEQ ID NO: 376501 - DNA, 25 bp, Mus musculus
cgcgtgcgtcgacaacaacggaggc

SEQ ID NO: 376502 - DNA, 25 bp, Mus musculus
tgtctgagagactgggacccaactc

SEQ ID NO: 376503 - DNA, 25 bp, Mus musculus
acacggctggccgtgactgagctcc

SEQ ID NO: 376504 - DNA, 25 bp, Mus musculus
aggagagtcgggatcacagccatcc

SEQ ID NO: 376505 - DNA, 25 bp, Mus musculus
gtggtttccttctccttcgccatgg

SEQ ID NO: 376506 - DNA, 25 bp, Mus musculus
tggcccaggtcgcagagttacccaa

SEQ ID NO: 376507 - DNA, 25 bp, Mus musculus
tgtgcatcttctcaggggccgactt

SEQ ID NO: 376508 - DNA, 25 bp, Mus musculus
accggaagcggaaacgcctctcttg

SEQ ID NO: 376509 - DNA, 25 bp, Mus musculus
tggctcaagtccaggttctagaacc

SEQ ID NO: 376510 - DNA, 25 bp, Mus musculus
cgacggagacaccaccgttggcggt

SEQ ID NO: 376511 - DNA, 25 bp, Mus musculus
tctcggactcttccagggcgaatgg

SEQ ID NO: 376512 - DNA, 25 bp, Mus musculus
cacgccttgtactctgcggtacggc

SEQ ID NO: 376513 - DNA, 25 bp, Mus musculus
gcctggctctcaggccacgcgatcc

SEQ ID NO: 376514 - DNA, 25 bp, Mus musculus
tgtccaccatcctgaccggcgcctg

SEQ ID NO: 376515 - DNA, 25 bp, Mus musculus
gggtacggtacacgctgtccaccat

SEQ ID NO: 376516 - DNA, 25 bp, Mus musculus
gagcgggtacggtacacgctgtcca

SEQ ID NO: 376517 - DNA, 25 bp, Mus musculus
ctgcatactggtccgggagcccttc

SEQ ID NO: 376518 - DNA, 25 bp, Mus musculus
catctgcatactggtccgggagccc

SEQ ID NO: 376519 - DNA, 25 bp, Mus musculus
agctgccacacacgtgcggcctccc

SEQ ID NO: 376520 - DNA, 25 bp, Mus musculus
tgtacagctgccacacacgtgcggc

SEQ ID NO: 376521 - DNA, 25 bp, Mus musculus
gccttgtactctgcggtacggctgc

SEQ ID NO: 376522 - DNA, 25 bp, Mus musculus
caaccacgccttgtactctgcggta

SEQ ID NO: 376523 - DNA, 25 bp, Mus musculus
aagcaaccacgccttgtactctgcg

SEQ ID NO: 376524 - DNA, 25 bp, Mus musculus
cgtgctggcgcaacagcccaagcaa

SEQ ID NO: 376525 - DNA, 25 bp, Mus musculus
ccgatgtacagctgccacacacgtg

SEQ ID NO: 376526 - DNA, 25 bp, Mus musculus
gactgcgcacgtgcctctgggtaac

SEQ ID NO: 376527 - DNA, 25 bp, Mus musculus
tagcggcttgcgaaaccgaccaagg

SEQ ID NO: 376528 - DNA, 25 bp, Mus musculus
agccggacccagagcagagcggacc

SEQ ID NO: 376529 - DNA, 25 bp, Mus musculus
gacgcaaccaatgggttcgctcggc

SEQ ID NO: 376530 - DNA, 25 bp, Mus musculus
aggcccgcgggcgacgcaaccaatg

SEQ ID NO: 376531 - DNA, 25 bp, Mus musculus
taaccacggcaacggcgagctccgg

SEQ ID NO: 376532 - DNA, 25 bp, Mus musculus
tgcctctgggtaaccacggcaacgg

SEQ ID NO: 376533 - DNA, 25 bp, Mus musculus
ttcgcatttgctgggcaatcgcacc

SEQ ID NO: 376534 - DNA, 25 bp, Mus musculus
tgggcaatcgcacccagtcggtctc

SEQ ID NO: 376535 - DNA, 25 bp, Mus musculus
ggcgcgagctcagacatggactcca

SEQ ID NO: 376536 - DNA, 25 bp, Mus musculus
acatggactccatggcccagccgga

SEQ ID NO: 376537 - DNA, 25 bp, Mus musculus
atggcccagccggacccagagcaga

SEQ ID NO: 376538 - DNA, 25 bp, Mus musculus
cctcaccttcgcatttgctgggcaa

SEQ ID NO: 376539 - DNA, 25 bp, Mus musculus
ccggtagcctctagcggcttgcgaa

SEQ ID NO: 376540 - DNA, 25 bp, Mus musculus
gctgccgcgcagatgacagatcgcc

SEQ ID NO: 376541 - DNA, 25 bp, Mus musculus
ccgaagagagtcacgcgtgcacctc

SEQ ID NO: 376542 - DNA, 25 bp, Mus musculus
acgcgtgcacctcgctcggaacttt

SEQ ID NO: 376543 - DNA, 25 bp, Mus musculus
atcctagcagctgctcgtggccagc

SEQ ID NO: 376544 - DNA, 25 bp, Mus musculus
atcagattatcctagcagctgctcg

SEQ ID NO: 376545 - DNA, 25 bp, Mus musculus
gcctttgtcccaggatcagattatc

SEQ ID NO: 376546 - DNA, 25 bp, Mus musculus
tctccttcctcggaatcgtgggttg

SEQ ID NO: 376547 - DNA, 25 bp, Mus musculus
gcgggcctttgtcccaggatcagat

SEQ ID NO: 376548 - DNA, 25 bp, Mus musculus
gcgtgtttacctgcggctgcagccc

SEQ ID NO: 376549 - DNA, 25 bp, Mus musculus
aagcgcgtgtttacctgcggctgca

SEQ ID NO: 376550 - DNA, 25 bp, Mus musculus
tgatttccataacaaagcgcgtgtt

SEQ ID NO: 376551 - DNA, 25 bp, Mus musculus
ggctgtcctgcgctgatttccataa

SEQ ID NO: 376552 - DNA, 25 bp, Mus musculus
tcggaatcgtgggttgtctgctccg

SEQ ID NO: 376553 - DNA, 25 bp, Mus musculus
tcgtggccagccgaagagagtcacg

SEQ ID NO: 376554 - DNA, 25 bp, Mus musculus
ccagtccgagcggtgcactggcgtc

SEQ ID NO: 376555 - DNA, 25 bp, Mus musculus
ctcggtgaccctggcggagctcctg

SEQ ID NO: 376556 - DNA, 25 bp, Mus musculus
cggagctcctgcacctggtacagaa

SEQ ID NO: 376557 - DNA, 25 bp, Mus musculus
tcctgcacctggtacagaagggcca

SEQ ID NO: 376558 - DNA, 25 bp, Mus musculus
tcccgggcctggagaaacgccacat

SEQ ID NO: 376559 - DNA, 25 bp, Mus musculus
tggagaaacgccacatcactgcgac

SEQ ID NO: 376560 - DNA, 25 bp, Mus musculus
atcactgcgacccacggtgaaccca

SEQ ID NO: 376561 - DNA, 25 bp, Mus musculus
caccgcgtctctgctccctcggagg

SEQ ID NO: 376562 - DNA, 25 bp, Mus musculus
tgcaccatcgccctagacacgagga

SEQ ID NO: 376563 - DNA, 25 bp, Mus musculus
atcgccctagacacgaggacgcagc

SEQ ID NO: 376564 - DNA, 25 bp, Mus musculus
aggacgcagcctccgaccatcgagg

SEQ ID NO: 376565 - DNA, 25 bp, Mus musculus
atcccggggcagtccagccgcccaa

SEQ ID NO: 376566 - DNA, 25 bp, Mus musculus
tccgaccatcgaggagcgatcccgg

SEQ ID NO: 376567 - DNA, 25 bp, Mus musculus
tgcactggcgtctgccgagccagct

SEQ ID NO: 376568 - DNA, 25 bp, Mus musculus
aggatgccacccgagtcctcggcgg

SEQ ID NO: 376569 - DNA, 25 bp, Mus musculus
ctgaaggcagcacgcgaggatgcca

SEQ ID NO: 376570 - DNA, 25 bp, Mus musculus
cacctcgggttggtctggactttag

SEQ ID NO: 376571 - DNA, 25 bp, Mus musculus
cagtaactgcccacggggacccaga

SEQ ID NO: 376572 - DNA, 25 bp, Mus musculus
cggtgatttgcgctttcttcccgcc

SEQ ID NO: 376573 - DNA, 25 bp, Mus musculus
agtctttcccatagcggtgatttgc

SEQ ID NO: 376574 - DNA, 25 bp, Mus musculus
cgctccagcgaggaacccagtcttt

SEQ ID NO: 376575 - DNA, 25 bp, Mus musculus
caccacctctagaaataatgtaccg

SEQ ID NO: 376576 - DNA, 25 bp, Mus musculus
ctccgactgcagcaattggccatta

SEQ ID NO: 376577 - DNA, 25 bp, Mus musculus
gaccgccggccctatagggagaagc

SEQ ID NO: 376578 - DNA, 25 bp, Mus musculus
aggctcgttcacttccggtgacaaa

SEQ ID NO: 376579 - DNA, 25 bp, Mus musculus
ctggactttaggctaggctcgttca

SEQ ID NO: 376580 - DNA, 25 bp, Mus musculus
gactgcacggtcttggctgcccact

SEQ ID NO: 376581 - DNA, 25 bp, Mus musculus
tgccaccgcgtcagggagcaagacg

SEQ ID NO: 376582 - DNA, 25 bp, Mus musculus
ccgagcgacttcagaggcgcgaaca

SEQ ID NO: 376583 - DNA, 25 bp, Mus musculus
agcgacttcagaggcgcgaacagga

SEQ ID NO: 376584 - DNA, 25 bp, Mus musculus
agcctggtgcccgagcgacttcaga

SEQ ID NO: 376585 - DNA, 25 bp, Mus musculus
gacctgagcctggtgcccgagcgac

SEQ ID NO: 376586 - DNA, 25 bp, Mus musculus
atggctctggccgacgctgccgctg

SEQ ID NO: 376587 - DNA, 25 bp, Mus musculus
tgctccatggctctggccgacgctg

SEQ ID NO: 376588 - DNA, 25 bp, Mus musculus
caagatggagggtgtggactgctcc

SEQ ID NO: 376589 - DNA, 25 bp, Mus musculus
cagctggccaatcacagcgcgcgtt

SEQ ID NO: 376590 - DNA, 25 bp, Mus musculus
tatggagggagctgacgtcaccgca

SEQ ID NO: 376591 - DNA, 25 bp, Mus musculus
gaatatggagggagctgacgtcacc

SEQ ID NO: 376592 - DNA, 25 bp, Mus musculus
aaccaataggcgaggagaatatgga

SEQ ID NO: 376593 - DNA, 25 bp, Mus musculus
tccaacgcgaagaaaccaataggcg

SEQ ID NO: 376594 - DNA, 25 bp, Mus musculus
ccctccaacgcgaagaaaccaatag

SEQ ID NO: 376595 - DNA, 25 bp, Mus musculus
tggccaatcacagcgcgcgttggtg

SEQ ID NO: 376596 - DNA, 25 bp, Mus musculus
ctgcaggctgtcctaacggaacgtc

SEQ ID NO: 376597 - DNA, 25 bp, Mus musculus
ggagaagagcggcttcttcgccgcc

SEQ ID NO: 376598 - DNA, 25 bp, Mus musculus
gacgcaagcagaagcggcaggacca

SEQ ID NO: 376599 - DNA, 25 bp, Mus musculus
ccagggcctgcggaagctcctgaac

SEQ ID NO: 376600 - DNA, 25 bp, Mus musculus
tgcggaagctcctgaacgactcggt

SEQ ID NO: 376601 - DNA, 25 bp, Mus musculus
gctcctgaacgactcggtgctcttc

SEQ ID NO: 376602 - DNA, 25 bp, Mus musculus
ttggcgcagctgcaggctgtcctaa

SEQ ID NO: 376603 - DNA, 25 bp, Mus musculus
ctaacggaacgtcgccaggagttgc

SEQ ID NO: 376604 - DNA, 25 bp, Mus musculus
tcgccaggagttgcagcccaagaag

SEQ ID NO: 376605 - DNA, 25 bp, Mus musculus
ggagttgcagcccaagaagcgcttc

SEQ ID NO: 376606 - DNA, 25 bp, Mus musculus
caagaagcgcttcgccttcaaggca

SEQ ID NO: 376607 - DNA, 25 bp, Mus musculus
cgcttcgccttcaaggcacggaaga

SEQ ID NO: 376608 - DNA, 25 bp, Mus musculus
tcaaggcacggaagaaggatgctgc

SEQ ID NO: 376609 - DNA, 25 bp, Mus musculus
tgaacgactcggtgctcttcctcgc

SEQ ID NO: 376610 - DNA, 25 bp, Mus musculus
ttgccagcagctccgtgtgcacact

SEQ ID NO: 376611 - DNA, 25 bp, Mus musculus
attgtcgagattgcgtcctggctgt

SEQ ID NO: 376612 - DNA, 25 bp, Mus musculus
tgtgcacactaccaaagacacgcgc

SEQ ID NO: 376613 - DNA, 25 bp, Mus musculus
tctggaggattgtcgagattgcgtc

SEQ ID NO: 376614 - DNA, 25 bp, Mus musculus
ccacctctgtgtttctggaggattg

SEQ ID NO: 376615 - DNA, 25 bp, Mus musculus
cggcccagtgaccacctctgtgttt

SEQ ID NO: 376616 - DNA, 25 bp, Mus musculus
aaggcccgcggctgcaaggtgctct

SEQ ID NO: 376617 - DNA, 25 bp, Mus musculus
aacaccttgcggcttgcgaaggccc

SEQ ID NO: 376618 - DNA, 25 bp, Mus musculus
tgtggcaatcccaacaccttgcggc

SEQ ID NO: 376619 - DNA, 25 bp, Mus musculus
ctgtcaaactgtgtggcaatcccaa

SEQ ID NO: 376620 - DNA, 25 bp, Mus musculus
actgcactgtcaaactgtgtggcaa

SEQ ID NO: 376621 - DNA, 25 bp, Mus musculus
tgagcgacctgaccaactgcactgt

SEQ ID NO: 376622 - DNA, 25 bp, Mus musculus
cgcgacgtccttttgagcgacctga

SEQ ID NO: 376623 - DNA, 25 bp, Mus musculus
tcctggctgtggcttgccagcagct

SEQ ID NO: 376624 - DNA, 25 bp, Mus musculus
cccagaagacgcgacggagcagccg

SEQ ID NO: 376625 - DNA, 25 bp, Mus musculus
ttattgtaacccagaagacgcgacg

SEQ ID NO: 376626 - DNA, 25 bp, Mus musculus
ggcccgctcgtgacacggtcactga

SEQ ID NO: 376627 - DNA, 25 bp, Mus musculus
tcactgacctttccacaggggtttc

SEQ ID NO: 376628 - DNA, 25 bp, Mus musculus
gcagagtaaccaagggcgaccagga

SEQ ID NO: 376629 - DNA, 25 bp, Mus musculus
gaggccgccatcttgagctccgtac

SEQ ID NO: 376630 - DNA, 25 bp, Mus musculus
ctccaggaggccacgcctgaaaatg

SEQ ID NO: 376631 - DNA, 25 bp, Mus musculus
cctgaaaatgagagagcgttaaaga

SEQ ID NO: 376632 - DNA, 25 bp, Mus musculus
gagatgacctcaagcttagaaaggc

SEQ ID NO: 376633 - DNA, 25 bp, Mus musculus
tagaaaggctgcaacgcctgccctt

SEQ ID NO: 376634 - DNA, 25 bp, Mus musculus
tgtcctgacagtcgcgggtgcgccc

SEQ ID NO: 376635 - DNA, 25 bp, Mus musculus
tcacgccttccggtgggccttggga

SEQ ID NO: 376636 - DNA, 25 bp, Mus musculus
actacaagtcccgagaggcctcgcg

SEQ ID NO: 376637 - DNA, 25 bp, Mus musculus
tgagctccgtacagggaggaaaact

SEQ ID NO: 376638 - DNA, 25 bp, Mus musculus
gtgcgctacggacgagaacatcctc

SEQ ID NO: 376639 - DNA, 25 bp, Mus musculus
catttgcggagaggagcgcagaacc

SEQ ID NO: 376640 - DNA, 25 bp, Mus musculus
gccacgcgcctctcatttgcggaga

SEQ ID NO: 376641 - DNA, 25 bp, Mus musculus
gtcaccgtgacgcacgcagagcgtc

SEQ ID NO: 376642 - DNA, 25 bp, Mus musculus
tgcggctcacagaggccgaatgtcc

SEQ ID NO: 376643 - DNA, 25 bp, Mus musculus
cccaaccgctcgctgggcaaggttg

SEQ ID NO: 376644 - DNA, 25 bp, Mus musculus
ctgctagtgcgcaggaggattccta

SEQ ID NO: 376645 - DNA, 25 bp, Mus musculus
gcctaagatggcgaacacccaaccg

SEQ ID NO: 376646 - DNA, 25 bp, Mus musculus
ccggtcgcgctcacttgcctaagat

SEQ ID NO: 376647 - DNA, 25 bp, Mus musculus
cccttgaggaggtcacagcttcttc

SEQ ID NO: 376648 - DNA, 25 bp, Mus musculus
gacaggccatcgtgcaccagctgca

SEQ ID NO: 376649 - DNA, 25 bp, Mus musculus
atgtaaccagcgctcccacagggca

SEQ ID NO: 376650 - DNA, 25 bp, Mus musculus
cgcagaacctggacgtcatcgcgtc

SEQ ID NO: 376651 - DNA, 25 bp, Mus musculus
gcggccacaagggactcaaggctcc

SEQ ID NO: 376652 - DNA, 25 bp, Mus musculus
aacaacggacatgcgaggatctcgc

SEQ ID NO: 376653 - DNA, 25 bp, Mus musculus
tgcggtgaagaactggacagacaga

SEQ ID NO: 376654 - DNA, 25 bp, Mus musculus
acagacagagcagtcaccgacactg

SEQ ID NO: 376655 - DNA, 25 bp, Mus musculus
ccgctcgtgatcatcctccataaaa

SEQ ID NO: 376656 - DNA, 25 bp, Mus musculus
atccctctgcaactgccggtaattc

SEQ ID NO: 376657 - DNA, 25 bp, Mus musculus
gccaccgagagctgcgtcaataggc

SEQ ID NO: 376658 - DNA, 25 bp, Mus musculus
tgccggtaattctaaacaacaagcg

SEQ ID NO: 376659 - DNA, 25 bp, Mus musculus
agagctgcgtcaataggctcttccg

SEQ ID NO: 376660 - DNA, 25 bp, Mus musculus
acaacaagcgggagattcacctcta

SEQ ID NO: 376661 - DNA, 25 bp, Mus musculus
ggagattcacctctaatccacagcg

SEQ ID NO: 376662 - DNA, 25 bp, Mus musculus
atccacagcgagcacacggttaggg

SEQ ID NO: 376663 - DNA, 25 bp, Mus musculus
agaggcgggcactactcaccagcgt

SEQ ID NO: 376664 - DNA, 25 bp, Mus musculus
gggaactgaagaacaacggacatgc

SEQ ID NO: 376665 - DNA, 25 bp, Mus musculus
caccagcgtcggtgcggtgaagaac

SEQ ID NO: 376666 - DNA, 25 bp, Mus musculus
cgtataaggaggatctgagcaccga

SEQ ID NO: 376667 - DNA, 25 bp, Mus musculus
ttagccgaagtcagtggcgggctcc

SEQ ID NO: 376668 - DNA, 25 bp, Mus musculus
atctgagcaccgaaggcgcggagca

SEQ ID NO: 376669 - DNA, 25 bp, Mus musculus
cgcggagcaggctcgatggcctcct

SEQ ID NO: 376670 - DNA, 25 bp, Mus musculus
aggctcgatggcctcctgggtcctt

SEQ ID NO: 376671 - DNA, 25 bp, Mus musculus
acgggacatggccagcgccgctgtt

SEQ ID NO: 376672 - DNA, 25 bp, Mus musculus
cagcgccgctgttagccgaagtcag

SEQ ID NO: 376673 - DNA, 25 bp, Mus musculus
ggctccgggattcccaggactctgt

SEQ ID NO: 376674 - DNA, 25 bp, Mus musculus
cctgcgatctcttcggcagaacatt

SEQ ID NO: 376675 - DNA, 25 bp, Mus musculus
ttcggcagaacattccagcaaactg

SEQ ID NO: 376676 - DNA, 25 bp, Mus musculus
ttccagcaaactgcggtcgatggcc

SEQ ID NO: 376677 - DNA, 25 bp, Mus musculus
cggtcgatggcctgcacctcgggct

SEQ ID NO: 376678 - DNA, 25 bp, Mus musculus
tccggacagccactaccgcgttcaa

SEQ ID NO: 376679 - DNA, 25 bp, Mus musculus
gctcggcgcccagaagtcaagtcgc

SEQ ID NO: 376680 - DNA, 25 bp, Mus musculus
caataaccgcgactgcgacgcagga

SEQ ID NO: 376681 - DNA, 25 bp, Mus musculus
tgcaacgcgccttttacaataaccg

SEQ ID NO: 376682 - DNA, 25 bp, Mus musculus
cgagtcgttagatttgcaacgcgcc

SEQ ID NO: 376683 - DNA, 25 bp, Mus musculus
cgactgcgacgcaggaagcaatcct

SEQ ID NO: 376684 - DNA, 25 bp, Mus musculus
ttagatttgcaacgcgccttttaca

SEQ ID NO: 376685 - DNA, 25 bp, Mus musculus
gccttttacaataaccgcgactgcg

SEQ ID NO: 376686 - DNA, 25 bp, Mus musculus
cttttacaataaccgcgactgcgac

SEQ ID NO: 376687 - DNA, 25 bp, Mus musculus
aaccgcgactgcgacgcaggaagca

SEQ ID NO: 376688 - DNA, 25 bp, Mus musculus
ctgcgacgcaggaagcaatcctgca

SEQ ID NO: 376689 - DNA, 25 bp, Mus musculus
aggaagcaatcctgcaatgggtccg

SEQ ID NO: 376690 - DNA, 25 bp, Mus musculus
gaagcaatcctgcaatgggtccgga

SEQ ID NO: 376691 - DNA, 25 bp, Mus musculus
caatcctgcaatgggtccggagtgg

SEQ ID NO: 376692 - DNA, 25 bp, Mus musculus
aaggcggcagcttcccggccaccaa

SEQ ID NO: 376693 - DNA, 25 bp, Mus musculus
cgttagatttgcaacgcgcctttta

SEQ ID NO: 376694 - DNA, 25 bp, Mus musculus
ggtgcaagctcacgtatacactacg

SEQ ID NO: 376695 - DNA, 25 bp, Mus musculus
aaaagtcgtccgtgcaccggctagg

SEQ ID NO: 376696 - DNA, 25 bp, Mus musculus
acgtatacactacgcggagcgcgga

SEQ ID NO: 376697 - DNA, 25 bp, Mus musculus
cttacaaaaggtgcaagctcacgta

SEQ ID NO: 376698 - DNA, 25 bp, Mus musculus
tcgccagcttacaaaaggtgcaagc

SEQ ID NO: 376699 - DNA, 25 bp, Mus musculus
gagactcgccagcttacaaaaggtg

SEQ ID NO: 376700 - DNA, 25 bp, Mus musculus
ggtcccatcctctccagttcagaga

SEQ ID NO: 376701 - DNA, 25 bp, Mus musculus
gtggtcccatcctctccagttcaga

SEQ ID NO: 376702 - DNA, 25 bp, Mus musculus
acaggtcctaggctcgtggtcccat

SEQ ID NO: 376703 - DNA, 25 bp, Mus musculus
actgacaggtcctaggctcgtggtc

SEQ ID NO: 376704 - DNA, 25 bp, Mus musculus
acactccggggactgacaggtccta

SEQ ID NO: 376705 - DNA, 25 bp, Mus musculus
cggggatccgagtctctgctacact

SEQ ID NO: 376706 - DNA, 25 bp, Mus musculus
acactacgcggagcgcggaaaagaa

SEQ ID NO: 376707 - DNA, 25 bp, Mus musculus
agtctctgctacactccggggactg

SEQ ID NO: 376708 - DNA, 25 bp, Mus musculus
agcaaacgctgggtcacataaagcc

SEQ ID NO: 376709 - DNA, 25 bp, Mus musculus
agagccctccctccacggtagagag

SEQ ID NO: 376710 - DNA, 25 bp, Mus musculus
ccacggtagagagggccatggaaac

SEQ ID NO: 376711 - DNA, 25 bp, Mus musculus
cgtgagctcagagaagacaacgctg

SEQ ID NO: 376712 - DNA, 25 bp, Mus musculus
caacgctggtctcggattcttagga

SEQ ID NO: 376713 - DNA, 25 bp, Mus musculus
tcttaggaaccgagccagcaaacgc

SEQ ID NO: 376714 - DNA, 25 bp, Mus musculus
tggttcgcgaacaatgctgtgaccc

SEQ ID NO: 376715 - DNA, 25 bp, Mus musculus
ggcgccgtcatcgtcgagtctcgct

SEQ ID NO: 376716 - DNA, 25 bp, Mus musculus
cctgggcgatcagggcaccaagatg

SEQ ID NO: 376717 - DNA, 25 bp, Mus musculus
acccgtacggagtcatcctccgttg

SEQ ID NO: 376718 - DNA, 25 bp, Mus musculus
tcctccgttggaggaagttattaga

SEQ ID NO: 376719 - DNA, 25 bp, Mus musculus
tcgagggaccctacataaattggca

SEQ ID NO: 376720 - DNA, 25 bp, Mus musculus
cgggagcgagaaccgtaagacgtca

SEQ ID NO: 376721 - DNA, 25 bp, Mus musculus
tgaggaaaacgcgttcagagccctc

SEQ ID NO: 376722 - DNA, 25 bp, Mus musculus
gaagttttgaggactcggcccgagc

SEQ ID NO: 376723 - DNA, 25 bp, Mus musculus
cttcgagcagtttctgctgcccgtc

SEQ ID NO: 376724 - DNA, 25 bp, Mus musculus
tctgctgcccgtcatccacgagatg

SEQ ID NO: 376725 - DNA, 25 bp, Mus musculus
catccacgagatgcgcgaggacatc

SEQ ID NO: 376726 - DNA, 25 bp, Mus musculus
atgcgcgaggacatcgcgtcgctga

SEQ ID NO: 376727 - DNA, 25 bp, Mus musculus
acatcgcgtcgctgacgcgcgagcg

SEQ ID NO: 376728 - DNA, 25 bp, Mus musculus
ggacaatatgctgatccagatcaag

SEQ ID NO: 376729 - DNA, 25 bp, Mus musculus
tgatccagatcaagacgcaggtcga

SEQ ID NO: 376730 - DNA, 25 bp, Mus musculus
atcaagacgcaggtcgaggcctccg

SEQ ID NO: 376731 - DNA, 25 bp, Mus musculus
aggcctccgaggagagcgccctcaa

SEQ ID NO: 376732 - DNA, 25 bp, Mus musculus
gagagcgccctcaaccacctgcagg

SEQ ID NO: 376733 - DNA, 25 bp, Mus musculus
cggatagagaagagcgagtcttcgt

SEQ ID NO: 376734 - DNA, 25 bp, Mus musculus
caagctgtgggagatggacaatatg

SEQ ID NO: 376735 - DNA, 25 bp, Mus musculus
cgtggcttctccgaggcggaaagtt

SEQ ID NO: 376736 - DNA, 25 bp, Mus musculus
cgtgccggtagggaacccgcggcag

SEQ ID NO: 376737 - DNA, 25 bp, Mus musculus
gtagctcgcatttccaggcgagcgg

SEQ ID NO: 376738 - DNA, 25 bp, Mus musculus
ccaggtagctcgcatttccaggcga

SEQ ID NO: 376739 - DNA, 25 bp, Mus musculus
tgtccaggtagctcgcatttccagg

SEQ ID NO: 376740 - DNA, 25 bp, Mus musculus
cctgtccaggtagctcgcatttcca

SEQ ID NO: 376741 - DNA, 25 bp, Mus musculus
cggcagcctcttacctgtccaggta

SEQ ID NO: 376742 - DNA, 25 bp, Mus musculus
aggcaggaatgtggcccggggagtt

SEQ ID NO: 376743 - DNA, 25 bp, Mus musculus
ccaacaataggctgttgtggaagga

SEQ ID NO: 376744 - DNA, 25 bp, Mus musculus
acggtgccaacaataggctgttgtg

SEQ ID NO: 376745 - DNA, 25 bp, Mus musculus
gcgcagcgcacggtgccaacaatag

SEQ ID NO: 376746 - DNA, 25 bp, Mus musculus
cgcaccacctgtcgccgggtgcgcg

SEQ ID NO: 376747 - DNA, 25 bp, Mus musculus
tacctgtccaggtagctcgcatttc

SEQ ID NO: 376748 - DNA, 25 bp, Mus musculus
cgcacggtgccaacaataggctgtt

SEQ ID NO: 376749 - DNA, 25 bp, Mus musculus
gggcggcagcctcttacctgtccag

SEQ ID NO: 376750 - DNA, 25 bp, Mus musculus
tgctaggcaacgggttaaagcttcc

SEQ ID NO: 376751 - DNA, 25 bp, Mus musculus
cgtgcaggcgtcctaggctattccc

SEQ ID NO: 376752 - DNA, 25 bp, Mus musculus
ccagacacttctccgggcggaagtt

SEQ ID NO: 376753 - DNA, 25 bp, Mus musculus
gcggaagttcaataacggaagcgga

SEQ ID NO: 376754 - DNA, 25 bp, Mus musculus
acaagcttcactttgtctaaccaga

SEQ ID NO: 376755 - DNA, 25 bp, Mus musculus
atataagcacaagcttcactttgtc

SEQ ID NO: 376756 - DNA, 25 bp, Mus musculus
tacttccagttatataagcacaagc

SEQ ID NO: 376757 - DNA, 25 bp, Mus musculus
tcttcgtcctttacttccagttata

SEQ ID NO: 376758 - DNA, 25 bp, Mus musculus
tcgtctcttcgtcctttacttccag

SEQ ID NO: 376759 - DNA, 25 bp, Mus musculus
tctaaccagacacttctccgggcgg

SEQ ID NO: 376760 - DNA, 25 bp, Mus musculus
gtactacatccctttcgtctcttcg

SEQ ID NO: 376761 - DNA, 25 bp, Mus musculus
gcgcttgcgtactacatccctttcg

SEQ ID NO: 376762 - DNA, 25 bp, Mus musculus
cgctctagcgcttgcgtactacatc

SEQ ID NO: 376763 - DNA, 25 bp, Mus musculus
ggtgccacccacttcgcctcccgct

SEQ ID NO: 376764 - DNA, 25 bp, Mus musculus
gacctgagatgcgacgggtcaactc

SEQ ID NO: 376765 - DNA, 25 bp, Mus musculus
gccgccagagttcagcaacgatcct

SEQ ID NO: 376766 - DNA, 25 bp, Mus musculus
taactgcttcggaccgcagccagga

SEQ ID NO: 376767 - DNA, 25 bp, Mus musculus
tggctctactggtcgcagcctgagc

SEQ ID NO: 376768 - DNA, 25 bp, Mus musculus
tgtacgtcggggagtcccatcgcaa

SEQ ID NO: 376769 - DNA, 25 bp, Mus musculus
tcgctcatcaagaaacgcttgtacg

SEQ ID NO: 376770 - DNA, 25 bp, Mus musculus
tcaggcagcggacgatcgctcatca

SEQ ID NO: 376771 - DNA, 25 bp, Mus musculus
gggcctagatcgcttctcaggcagc

SEQ ID NO: 376772 - DNA, 25 bp, Mus musculus
ctgacttagggcagtcctggggccc

SEQ ID NO: 376773 - DNA, 25 bp, Mus musculus
ggaacaacttctctgacttagggca

SEQ ID NO: 376774 - DNA, 25 bp, Mus musculus
cctgggcagcagcatcagggtcgtc

SEQ ID NO: 376775 - DNA, 25 bp, Mus musculus
ggtgccaccgaggtcaagttcaagg

SEQ ID NO: 376776 - DNA, 25 bp, Mus musculus
ttcagcaacgatcctgagcctccgg

SEQ ID NO: 376777 - DNA, 25 bp, Mus musculus
tctgcacgcacggaggctgtcgctg

SEQ ID NO: 376778 - DNA, 25 bp, Mus musculus
cggccgccgtgtcagccatcttgct

SEQ ID NO: 376779 - DNA, 25 bp, Mus musculus
gcctacggccagagatactctccag

SEQ ID NO: 376780 - DNA, 25 bp, Mus musculus
ccatcttgctcttgcgtagtgtgcg

SEQ ID NO: 376781 - DNA, 25 bp, Mus musculus
cttatagaaaagctctacgaacacg

SEQ ID NO: 376782 - DNA, 25 bp, Mus musculus
cccgccttatagaaaagctctacga

SEQ ID NO: 376783 - DNA, 25 bp, Mus musculus
gcacgatgggacttgtagttgcggg

SEQ ID NO: 376784 - DNA, 25 bp, Mus musculus
ggggaccgcctacggccagagatac

SEQ ID NO: 376785 - DNA, 25 bp, Mus musculus
ggcctgggcttctcggttcgagacc

SEQ ID NO: 376786 - DNA, 25 bp, Mus musculus
tctcggttcgagaccgtggcccaaa

SEQ ID NO: 376787 - DNA, 25 bp, Mus musculus
gtggcccaaaccgtgggagagatcc

SEQ ID NO: 376788 - DNA, 25 bp, Mus musculus
ggagagatccagaagacccaaactc

SEQ ID NO: 376789 - DNA, 25 bp, Mus musculus
cgccgcgcctctccacccttaccgt

SEQ ID NO: 376790 - DNA, 25 bp, Mus musculus
ttgctcttgcgtagtgtgcgtgagc

SEQ ID NO: 376791 - DNA, 25 bp, Mus musculus
agacccaaactctttcggcttcacg

SEQ ID NO: 376792 - DNA, 25 bp, Mus musculus
cctacttccagtgcgtgcaaaagga

SEQ ID NO: 376793 - DNA, 25 bp, Mus musculus
ccttagaacgttgtgacgtaggagc

SEQ ID NO: 376794 - DNA, 25 bp, Mus musculus
aacgttgtgacgtaggagcattcca

SEQ ID NO: 376795 - DNA, 25 bp, Mus musculus
acgtaggagcattccacggttgcta

SEQ ID NO: 376796 - DNA, 25 bp, Mus musculus
tatagcgcccgccagccctttccga

SEQ ID NO: 376797 - DNA, 25 bp, Mus musculus
cacggttgctacatcgtcgcgaggg

SEQ ID NO: 376798 - DNA, 25 bp, Mus musculus
gcgctctccctcacgcgcgtcgctt

SEQ ID NO: 376799 - DNA, 25 bp, Mus musculus
acgcgcgtcgcttctcctaggactc

SEQ ID NO: 376800 - DNA, 25 bp, Mus musculus
acccgcactcttgctctcacccgtg

SEQ ID NO: 376801 - DNA, 25 bp, Mus musculus
tgcttggggaccagcgtgtcctgca

SEQ ID NO: 376802 - DNA, 25 bp, Mus musculus
gcgagcctcctacttccagtgcgtg

SEQ ID NO: 376803 - DNA, 25 bp, Mus musculus
gcctcctacttccagtgcgtgcaaa

SEQ ID NO: 376804 - DNA, 25 bp, Mus musculus
cggagcccagcggaccaatggggct

SEQ ID NO: 376805 - DNA, 25 bp, Mus musculus
cattccacggttgctacatcgtcgc

SEQ ID NO: 376806 - DNA, 25 bp, Mus musculus
agcgtcacgttgttggcgaccaact

SEQ ID NO: 376807 - DNA, 25 bp, Mus musculus
tgctgcaggtagagctgcacgtaca

SEQ ID NO: 376808 - DNA, 25 bp, Mus musculus
tgcacgtacacgtccttgcgctgct

SEQ ID NO: 376809 - DNA, 25 bp, Mus musculus
tcgcgctcctcgtcgctcgagaagt

SEQ ID NO: 376810 - DNA, 25 bp, Mus musculus
ggagaagcctcgtcccggcctcgat

SEQ ID NO: 376811 - DNA, 25 bp, Mus musculus
gcgaccaactcgctcttcaacttgt

SEQ ID NO: 376812 - DNA, 25 bp, Mus musculus
tcaacttgtctttggtcaggaccga

SEQ ID NO: 376813 - DNA, 25 bp, Mus musculus
gggtcctctaggaactccggcatct

SEQ ID NO: 376814 - DNA, 25 bp, Mus musculus
actgggtttgcacgctgtttccctc

SEQ ID NO: 376815 - DNA, 25 bp, Mus musculus
ggcacggcacagaactcgggacaca

SEQ ID NO: 376816 - DNA, 25 bp, Mus musculus
actggggagcaagtgcagccgaacc

SEQ ID NO: 376817 - DNA, 25 bp, Mus musculus
ccatacacaagctagtgcgtggggt

SEQ ID NO: 376818 - DNA, 25 bp, Mus musculus
aggaagcgcgccacccattggctgg

SEQ ID NO: 376819 - DNA, 25 bp, Mus musculus
acgcagtttaaaaggcgctcgggcg

SEQ ID NO: 376820 - DNA, 25 bp, Mus musculus
caggctgtggctccatggcagttgc

SEQ ID NO: 376821 - DNA, 25 bp, Mus musculus
accaggctgtggctccatggcagtt

SEQ ID NO: 376822 - DNA, 25 bp, Mus musculus
gactattgagaagctttgcatctat

SEQ ID NO: 376823 - DNA, 25 bp, Mus musculus
tgactattgagaagctttgcatcta

SEQ ID NO: 376824 - DNA, 25 bp, Mus musculus
cctgactattgagaagctttgcatc

SEQ ID NO: 376825 - DNA, 25 bp, Mus musculus
gaaaccacgcccctgactattgaga

SEQ ID NO: 376826 - DNA, 25 bp, Mus musculus
ggcctccaagctgcgcgaaaccacg

SEQ ID NO: 376827 - DNA, 25 bp, Mus musculus
ggcgcaattgcagcttctaggtacc

SEQ ID NO: 376828 - DNA, 25 bp, Mus musculus
aggcgcaattgcagcttctaggtac

SEQ ID NO: 376829 - DNA, 25 bp, Mus musculus
aaggcgcaattgcagcttctaggta

SEQ ID NO: 376830 - DNA, 25 bp, Mus musculus
gaaaggcgcaattgcagcttctagg

SEQ ID NO: 376831 - DNA, 25 bp, Mus musculus
ccgaaaggcgcaattgcagcttcta

SEQ ID NO: 376832 - DNA, 25 bp, Mus musculus
acccgaaaggcgcaattgcagcttc

SEQ ID NO: 376833 - DNA, 25 bp, Mus musculus
cctgtcctgcgtccccacccgaaag

SEQ ID NO: 376834 - DNA, 25 bp, Mus musculus
gatgtccaagtcacccttttccaga

SEQ ID NO: 376835 - DNA, 25 bp, Mus musculus
gcttgctgcaaaatccgtctgctta

SEQ ID NO: 376836 - DNA, 25 bp, Mus musculus
cttagccggggtcccacatactctt

SEQ ID NO: 376837 - DNA, 25 bp, Mus musculus
aggtgcatgcttctcccgattgctg

SEQ ID NO: 376838 - DNA, 25 bp, Mus musculus
attgcccaccaggttcacacgtgtg

SEQ ID NO: 376839 - DNA, 25 bp, Mus musculus
gcgctgtgtgttccgatcgccaaga

SEQ ID NO: 376840 - DNA, 25 bp, Mus musculus
tcgccaagaggccactgagagatca

SEQ ID NO: 376841 - DNA, 25 bp, Mus musculus
ctcaggaagagcttcgggacctata

SEQ ID NO: 376842 - DNA, 25 bp, Mus musculus
ggagccgagtcgatgacgttctaga

SEQ ID NO: 376843 - DNA, 25 bp, Mus musculus
gttctagaaatgtcaccactgggta

SEQ ID NO: 376844 - DNA, 25 bp, Mus musculus
ccgcggcgctcagtatttgcgcatt

SEQ ID NO: 376845 - DNA, 25 bp, Mus musculus
tccggcggtcgatcaacgactgctt

SEQ ID NO: 376846 - DNA, 25 bp, Mus musculus
gccaccttttgatccttcgctatgg

SEQ ID NO: 376847 - DNA, 25 bp, Mus musculus
ggccggaagttcctcatctattact

SEQ ID NO: 376848 - DNA, 25 bp, Mus musculus
cgcagatattcggaggcggggacac

SEQ ID NO: 376849 - DNA, 25 bp, Mus musculus
cgtgctgatgatggcggtaaataga

SEQ ID NO: 376850 - DNA, 25 bp, Mus musculus
acagctcgcgcgtgctgatgatggc

SEQ ID NO: 376851 - DNA, 25 bp, Mus musculus
tcttgcgcccgggtgacagctcgcg

SEQ ID NO: 376852 - DNA, 25 bp, Mus musculus
gcctgctcgtcttgcgcccgggtga

SEQ ID NO: 376853 - DNA, 25 bp, Mus musculus
cgccgcgtcttagcctctcacaccg

SEQ ID NO: 376854 - DNA, 25 bp, Mus musculus
ggcgtggtccgcctgctcgtcttgc

SEQ ID NO: 376855 - DNA, 25 bp, Mus musculus
tggctgggagttcgcgcagatattc

SEQ ID NO: 376856 - DNA, 25 bp, Mus musculus
tagcctctcacaccggcccgccaca

SEQ ID NO: 376857 - DNA, 25 bp, Mus musculus
cacagccgctgacccgaaacttggt

SEQ ID NO: 376858 - DNA, 25 bp, Mus musculus
tgacccgaaacttggtgcccacggc

SEQ ID NO: 376859 - DNA, 25 bp, Mus musculus
ggtgcccacggcacaaacctgcgta

SEQ ID NO: 376860 - DNA, 25 bp, Mus musculus
cacggcacaaacctgcgtaaagggc

SEQ ID NO: 376861 - DNA, 25 bp, Mus musculus
cacaaacctgcgtaaagggcgcggg

SEQ ID NO: 376862 - DNA, 25 bp, Mus musculus
ggtcccgccacagcgcactcctcag

SEQ ID NO: 376863 - DNA, 25 bp, Mus musculus
gcgcttgtccgcagctgccctcaat

SEQ ID NO: 376864 - DNA, 25 bp, Mus musculus
accctcgctacctcccggcgcttgt

SEQ ID NO: 376865 - DNA, 25 bp, Mus musculus
cgcggaagagtgcgcgcctgctcct

SEQ ID NO: 376866 - DNA, 25 bp, Mus musculus
ttccagaagagctcccgcggccggg

SEQ ID NO: 376867 - DNA, 25 bp, Mus musculus
ctctggttccagaagagctcccgcg

SEQ ID NO: 376868 - DNA, 25 bp, Mus musculus
tgcggctctggttccagaagagctc

SEQ ID NO: 376869 - DNA, 25 bp, Mus musculus
cgccagcgcctgctggccaagacgc

SEQ ID NO: 376870 - DNA, 25 bp, Mus musculus
gacgctgcggtccacagctgcgggc

SEQ ID NO: 376871 - DNA, 25 bp, Mus musculus
cactcctcagggacagccgcagatg

SEQ ID NO: 376872 - DNA, 25 bp, Mus musculus
agctgccctcaatccgcgccgccag

SEQ ID NO: 376873 - DNA, 25 bp, Mus musculus
tcacggctctgtggtaccggcgcca

SEQ ID NO: 376874 - DNA, 25 bp, Mus musculus
cagccgcagatgctcacggctctgt

SEQ ID NO: 376875 - DNA, 25 bp, Mus musculus
tcctcagggacagccgcagatgctc

SEQ ID NO: 376876 - DNA, 25 bp, Mus musculus
ccggtctttacacagcacagccttg

SEQ ID NO: 376877 - DNA, 25 bp, Mus musculus
cctctgcggataggggttagctcac

SEQ ID NO: 376878 - DNA, 25 bp, Mus musculus
ctttcaggtcagagagcgtgcagta

SEQ ID NO: 376879 - DNA, 25 bp, Mus musculus
ctgccttctgtgtccggtctttaca

SEQ ID NO: 376880 - DNA, 25 bp, Mus musculus
ggcgctggccaaagaaaaagccttc

SEQ ID NO: 376881 - DNA, 25 bp, Mus musculus
ggccgtctctatcctgccgtttgga

SEQ ID NO: 376882 - DNA, 25 bp, Mus musculus
cccattcagggtttccagggtgaga

SEQ ID NO: 376883 - DNA, 25 bp, Mus musculus
agctcgggaggtgatcttgtcatcc

SEQ ID NO: 376884 - DNA, 25 bp, Mus musculus
tcgggtccttcttcctctgttccaa

SEQ ID NO: 376885 - DNA, 25 bp, Mus musculus
gtcggttcccagtgctgctctacaa

SEQ ID NO: 376886 - DNA, 25 bp, Mus musculus
agccgattgcgcaacttccgatctc

SEQ ID NO: 376887 - DNA, 25 bp, Mus musculus
cgcacttccgccgatcagcgtaaga

SEQ ID NO: 376888 - DNA, 25 bp, Mus musculus
cctcctccaggagttcgtagagcca

SEQ ID NO: 376889 - DNA, 25 bp, Mus musculus
agcgtgcagtaccaatgggattatc

SEQ ID NO: 376890 - DNA, 25 bp, Mus musculus
tgcagcaaagtcctccaaagggacc

SEQ ID NO: 376891 - DNA, 25 bp, Mus musculus
cgcagcacaggagagatctgccgtc

SEQ ID NO: 376892 - DNA, 25 bp, Mus musculus
gggaggctcaatacgtgcttaccga

SEQ ID NO: 376893 - DNA, 25 bp, Mus musculus
tgcttaccgagttcgcttggggtcc

SEQ ID NO: 376894 - DNA, 25 bp, Mus musculus
ggtccctgtctagctgctggtttag

SEQ ID NO: 376895 - DNA, 25 bp, Mus musculus
tcaagaatccgaaagggtctctgcg

SEQ ID NO: 376896 - DNA, 25 bp, Mus musculus
cgtggctaagcaccagcgcagcaca

SEQ ID NO: 376897 - DNA, 25 bp, Mus musculus
cttcagaccgaggaaagcgcttgtg

SEQ ID NO: 376898 - DNA, 25 bp, Mus musculus
acttggctacgcgatgcacggacgc

SEQ ID NO: 376899 - DNA, 25 bp, Mus musculus
caagctgcgaactgtccggactctc

SEQ ID NO: 376900 - DNA, 25 bp, Mus musculus
tccgagtcttgaccagtcttctctg

SEQ ID NO: 376901 - DNA, 25 bp, Mus musculus
gctatggtgactctcttctgcttga

SEQ ID NO: 376902 - DNA, 25 bp, Mus musculus
ctagaaagctccaagcgggcgggct

SEQ ID NO: 376903 - DNA, 25 bp, Mus musculus
gtcttctctgatccgctttgctatg

SEQ ID NO: 376904 - DNA, 25 bp, Mus musculus
ccggcggcggacagattgaccttca

SEQ ID NO: 376905 - DNA, 25 bp, Mus musculus
cccttcaggtcagtgctttcgtctc

SEQ ID NO: 376906 - DNA, 25 bp, Mus musculus
cccatcctgtgggtgtctgagacag

SEQ ID NO: 376907 - DNA, 25 bp, Mus musculus
tggtcctcaattccggaaaatacgc

SEQ ID NO: 376908 - DNA, 25 bp, Mus musculus
gagccacactcttggtcctcaattc

SEQ ID NO: 376909 - DNA, 25 bp, Mus musculus
ctcggtgcaccttgctttctgcttc

SEQ ID NO: 376910 - DNA, 25 bp, Mus musculus
ggcaaacttctcctcttgcactatc

SEQ ID NO: 376911 - DNA, 25 bp, Mus musculus
tctctcctgaacctcttgcagaaga

SEQ ID NO: 376912 - DNA, 25 bp, Mus musculus
tgcaagaagttttgagggactcccg

SEQ ID NO: 376913 - DNA, 25 bp, Mus musculus
tgcaggagtgaacttgcaagaagtt

SEQ ID NO: 376914 - DNA, 25 bp, Mus musculus
gtggcccgagcgatgcagctcgcca

SEQ ID NO: 376915 - DNA, 25 bp, Mus musculus
attgaccttcagagcgaggtgagcg

SEQ ID NO: 376916 - DNA, 25 bp, Mus musculus
cttgggacaagttgccggaacctca

SEQ ID NO: 376917 - DNA, 25 bp, Mus musculus
cgggtagtgtggacgtcccatcact

SEQ ID NO: 376918 - DNA, 25 bp, Mus musculus
ctgttctaaatctggaggcggctgc

SEQ ID NO: 376919 - DNA, 25 bp, Mus musculus
cccggctgacgtcagtttgatttta

SEQ ID NO: 376920 - DNA, 25 bp, Mus musculus
ggcggctgcgtatctatttcagtga

SEQ ID NO: 376921 - DNA, 25 bp, Mus musculus
tccaggctttcgtgaagtagtcatc

SEQ ID NO: 376922 - DNA, 25 bp, Mus musculus
gtatgagcgacctgaaccgtctctg

SEQ ID NO: 376923 - DNA, 25 bp, Mus musculus
tgccaggacctgaagatgtatgagc

SEQ ID NO: 376924 - DNA, 25 bp, Mus musculus
aaagccatgtctgcggttgccagga

SEQ ID NO: 376925 - DNA, 25 bp, Mus musculus
atcacacggcgtggcttaaaggccc

SEQ ID NO: 376926 - DNA, 25 bp, Mus musculus
ggaatgttccttcccggctgcgagc

SEQ ID NO: 376927 - DNA, 25 bp, Mus musculus
cgaggcttatttgtgtggcacgatc

SEQ ID NO: 376928 - DNA, 25 bp, Mus musculus
cggcaaagggcatccgaggcttatt

SEQ ID NO: 376929 - DNA, 25 bp, Mus musculus
cggagacgcgccctgaaaatggccc

SEQ ID NO: 376930 - DNA, 25 bp, Mus musculus
acaagacttttagcggctccggaga

SEQ ID NO: 376931 - DNA, 25 bp, Mus musculus
gacaactattcgagcgtgcggagca

SEQ ID NO: 376932 - DNA, 25 bp, Mus musculus
ttgaaggcataaggcgaaaaccgca

SEQ ID NO: 376933 - DNA, 25 bp, Mus musculus
gtccggctagcgcacaacctggatc

SEQ ID NO: 376934 - DNA, 25 bp, Mus musculus
aggtctacgcctgcgtccggctagc

SEQ ID NO: 376935 - DNA, 25 bp, Mus musculus
tcgttgctcttggaggtctacgcct

SEQ ID NO: 376936 - DNA, 25 bp, Mus musculus
gcctgcactcgtcgttgctcttgga

SEQ ID NO: 376937 - DNA, 25 bp, Mus musculus
ttaccctccgttgaaggcataaggc

SEQ ID NO: 376938 - DNA, 25 bp, Mus musculus
tgtctcacggcaaaatggccgccgg

SEQ ID NO: 376939 - DNA, 25 bp, Mus musculus
actcctgctgtctcacggcaaaatg

SEQ ID NO: 376940 - DNA, 25 bp, Mus musculus
aaagcatcgcgcctaactcctgctg

SEQ ID NO: 376941 - DNA, 25 bp, Mus musculus
gcagcagtggaaagcatcgcgccta

SEQ ID NO: 376942 - DNA, 25 bp, Mus musculus
ttccacgtctcggtaagcagcagtg

SEQ ID NO: 376943 - DNA, 25 bp, Mus musculus
cagctctcgttccacgtctcggtaa

SEQ ID NO: 376944 - DNA, 25 bp, Mus musculus
ggcagcaggcccaggcttttaccct

SEQ ID NO: 376945 - DNA, 25 bp, Mus musculus
cgaaaaccgcagctgcacagggccg

SEQ ID NO: 376946 - DNA, 25 bp, Mus musculus
cctcggaataaatttgcccgcatta

SEQ ID NO: 376947 - DNA, 25 bp, Mus musculus
caaagggcctaatcacgccggggct

SEQ ID NO: 376948 - DNA, 25 bp, Mus musculus
gactcgcttgctaacccacgaggga

SEQ ID NO: 376949 - DNA, 25 bp, Mus musculus
cggagcgataattacaaagggccta

SEQ ID NO: 376950 - DNA, 25 bp, Mus musculus
cggggctcctgcctcggaataaatt

SEQ ID NO: 376951 - DNA, 25 bp, Mus musculus
acgctgaaacattaacggcaattta

SEQ ID NO: 376952 - DNA, 25 bp, Mus musculus
cgagagactaattcgttacgctgaa

SEQ ID NO: 376953 - DNA, 25 bp, Mus musculus
aagcctgattcgtgacgagagacta

SEQ ID NO: 376954 - DNA, 25 bp, Mus musculus
tttccctcgtttcgaagcctgattc

SEQ ID NO: 376955 - DNA, 25 bp, Mus musculus
caatttccgagggtggcctcgccgg

SEQ ID NO: 376956 - DNA, 25 bp, Mus musculus
tccgctttgcaaatgagaatgaccc

SEQ ID NO: 376957 - DNA, 25 bp, Mus musculus
tggagtggaatctcacggagcgata

SEQ ID NO: 376958 - DNA, 25 bp, Mus musculus
tccgatcctccgctttgcaaatgag

SEQ ID NO: 376959 - DNA, 25 bp, Mus musculus
ttgcccgcattacggggctccgatc

SEQ ID NO: 376960 - DNA, 25 bp, Mus musculus
agcactaggcgttttctctcgaaga

SEQ ID NO: 376961 - DNA, 25 bp, Mus musculus
gactagttcccgtctaagccgctca

SEQ ID NO: 376962 - DNA, 25 bp, Mus musculus
ccgactgtcgctctccgtctaggtt

SEQ ID NO: 376963 - DNA, 25 bp, Mus musculus
cctgtcactcgggagctggcgtaac

SEQ ID NO: 376964 - DNA, 25 bp, Mus musculus
tgctgcacctatttcctgcctgtca

SEQ ID NO: 376965 - DNA, 25 bp, Mus musculus
tggcgacctccctttgtaatctggc

SEQ ID NO: 376966 - DNA, 25 bp, Mus musculus
tctctcgaagagacaagttttcgtc

SEQ ID NO: 376967 - DNA, 25 bp, Mus musculus
tcttaggagtccgaaaacatggcgg

SEQ ID NO: 376968 - DNA, 25 bp, Mus musculus
taatctggcgggattccactgcgca

SEQ ID NO: 376969 - DNA, 25 bp, Mus musculus
cgcgctgccagagccaaaagcacta

SEQ ID NO: 376970 - DNA, 25 bp, Mus musculus
ccgctcagccgagtcgaaggaaacc

SEQ ID NO: 376971 - DNA, 25 bp, Mus musculus
ggcgctcgaatcaccagggtttgtc

SEQ ID NO: 376972 - DNA, 25 bp, Mus musculus
gcccgtgccaaatggcgctcgaatc

SEQ ID NO: 376973 - DNA, 25 bp, Mus musculus
atggcggttaaaggctgcctgctgc

SEQ ID NO: 376974 - DNA, 25 bp, Mus musculus
agactccaccatcattgccgctcaa

SEQ ID NO: 376975 - DNA, 25 bp, Mus musculus
cagacggagccgacctgattgtctc

SEQ ID NO: 376976 - DNA, 25 bp, Mus musculus
ccgacctgattgtctccgatgcaga

SEQ ID NO: 376977 - DNA, 25 bp, Mus musculus
cggggctcatctcgccattgctgtc

SEQ ID NO: 376978 - DNA, 25 bp, Mus musculus
gagccgacctgattgtctccgatgc

SEQ ID NO: 376979 - DNA, 25 bp, Mus musculus
tgaccagacggagccgacctgattg

SEQ ID NO: 376980 - DNA, 25 bp, Mus musculus
cgccgttctgaccagacggagccga

SEQ ID NO: 376981 - DNA, 25 bp, Mus musculus
agcctgcgcagagaggctgcccacg

SEQ ID NO: 376982 - DNA, 25 bp, Mus musculus
cgccatcagcctgcgcagagaggct

SEQ ID NO: 376983 - DNA, 25 bp, Mus musculus
tgaggcatccctaccggcagccggg

SEQ ID NO: 376984 - DNA, 25 bp, Mus musculus
tgcttccctgcctgaggcatcccta

SEQ ID NO: 376985 - DNA, 25 bp, Mus musculus
attgctgtcggctcctccgctggct

SEQ ID NO: 376986 - DNA, 25 bp, Mus musculus
gctcatctcgccattgctgtcggct

SEQ ID NO: 376987 - DNA, 25 bp, Mus musculus
gattgtctccgatgcagactccacc

SEQ ID NO: 376988 - DNA, 25 bp, Mus musculus
attaacagactgatggatgcccgga

SEQ ID NO: 376989 - DNA, 25 bp, Mus musculus
cagcacggatctcagggcgctcgtc

SEQ ID NO: 376990 - DNA, 25 bp, Mus musculus
atggatgcccggagtttacccgcgg

SEQ ID NO: 376991 - DNA, 25 bp, Mus musculus
cgcttaatctgagccgtaacatttg

SEQ ID NO: 376992 - DNA, 25 bp, Mus musculus
ccgcgatctctaattagtgcaatta

SEQ ID NO: 376993 - DNA, 25 bp, Mus musculus
ttttccaattaacacctccgcgatc

SEQ ID NO: 376994 - DNA, 25 bp, Mus musculus
cccaaacaggcacaataccagggtt

SEQ ID NO: 376995 - DNA, 25 bp, Mus musculus
cgccctgccaactcatcaattaatt

SEQ ID NO: 376996 - DNA, 25 bp, Mus musculus
gtaacatttgccacgacaccctgcg

SEQ ID NO: 376997 - DNA, 25 bp, Mus musculus
taacagtcgcttaatctgagccgta

SEQ ID NO: 376998 - DNA, 25 bp, Mus musculus
cgtggggagtattaattaccattgc

SEQ ID NO: 376999 - DNA, 25 bp, Mus musculus
gcccatatggcgtggggagtattaa

SEQ ID NO: 377000 - DNA, 25 bp, Mus musculus
cagagcggcttcagcacggatctca

SEQ ID NO: 377001 - DNA, 25 bp, Mus musculus
ccattgcgttttaattaacagtcgc

SEQ ID NO: 377002 - DNA, 25 bp, Mus musculus
gtacctaggccatggggccaaccca

SEQ ID NO: 377003 - DNA, 25 bp, Mus musculus
tcttctgggattgctccggaaccgc

SEQ ID NO: 377004 - DNA, 25 bp, Mus musculus
cgatggctcggaatcaggtttgttc

SEQ ID NO: 377005 - DNA, 25 bp, Mus musculus
agtccactacccagctcggatcaga

SEQ ID NO: 377006 - DNA, 25 bp, Mus musculus
ctgcaacccgggcaaagacgcttta

SEQ ID NO: 377007 - DNA, 25 bp, Mus musculus
aatctaggcgggtgctctgcaaccc

SEQ ID NO: 377008 - DNA, 25 bp, Mus musculus
aacaccgtcggttgccaatctaggc

SEQ ID NO: 377009 - DNA, 25 bp, Mus musculus
cgactgtcgctgaaactgcattctc

SEQ ID NO: 377010 - DNA, 25 bp, Mus musculus
ctcgggcaaaccacagcgactgtcg

SEQ ID NO: 377011 - DNA, 25 bp, Mus musculus
cttttttcatgggacactcgggcaa

SEQ ID NO: 377012 - DNA, 25 bp, Mus musculus
cccgcattagtcaaaattcttctgg

SEQ ID NO: 377013 - DNA, 25 bp, Mus musculus
gggccaacccactgagattcacgtg

SEQ ID NO: 377014 - DNA, 25 bp, Mus musculus
tgagatcaaccaggggcttaaaatg

SEQ ID NO: 377015 - DNA, 25 bp, Mus musculus
gcggaacagcgtggaccacccgttc

SEQ ID NO: 377016 - DNA, 25 bp, Mus musculus
gggccgggaagtattctttgtctca

SEQ ID NO: 377017 - DNA, 25 bp, Mus musculus
tattctttgtctcactccggagggg

SEQ ID NO: 377018 - DNA, 25 bp, Mus musculus
gggcctcagtggcttctccaagccg

SEQ ID NO: 377019 - DNA, 25 bp, Mus musculus
tctcaactcaccagggtcagtgctc

SEQ ID NO: 377020 - DNA, 25 bp, Mus musculus
gccggcccagctggaacaaagtgct

SEQ ID NO: 377021 - DNA, 25 bp, Mus musculus
tcgggcgggcagtttgcaaacacaa

SEQ ID NO: 377022 - DNA, 25 bp, Mus musculus
atcgcactttggaggatggcttggc

SEQ ID NO: 377023 - DNA, 25 bp, Mus musculus
tggggtccctgaatcggccacctac

SEQ ID NO: 377024 - DNA, 25 bp, Mus musculus
cctgcgctccgaagcgatctttcta

SEQ ID NO: 377025 - DNA, 25 bp, Mus musculus
cgaagcgatctttctagcgccgatc

SEQ ID NO: 377026 - DNA, 25 bp, Mus musculus
tttggaggatggcttggctctctcc

SEQ ID NO: 377027 - DNA, 25 bp, Mus musculus
tgcgccgcgccctgatcgcgtgttg

SEQ ID NO: 377028 - DNA, 25 bp, Mus musculus
tccgtcccggcagctggtggcactg

SEQ ID NO: 377029 - DNA, 25 bp, Mus musculus
agctggtggcactgtccggtccgta

SEQ ID NO: 377030 - DNA, 25 bp, Mus musculus
gcacagcatcagcaagatcagtggc

SEQ ID NO: 377031 - DNA, 25 bp, Mus musculus
tcagaacggcaactagagcaagctg

SEQ ID NO: 377032 - DNA, 25 bp, Mus musculus
ctcagaacggcaactagagcaagct

SEQ ID NO: 377033 - DNA, 25 bp, Mus musculus
tggcgctcagaacggcaactagagc

SEQ ID NO: 377034 - DNA, 25 bp, Mus musculus
agtggcgctcagaacggcaactaga

SEQ ID NO: 377035 - DNA, 25 bp, Mus musculus
atcagtggcgctcagaacggcaact

SEQ ID NO: 377036 - DNA, 25 bp, Mus musculus
agatcagtggcgctcagaacggcaa

SEQ ID NO: 377037 - DNA, 25 bp, Mus musculus
agcaagatcagtggcgctcagaacg

SEQ ID NO: 377038 - DNA, 25 bp, Mus musculus
cagcaagatcagtggcgctcagaac

SEQ ID NO: 377039 - DNA, 25 bp, Mus musculus
atcagcaagatcagtggcgctcaga

SEQ ID NO: 377040 - DNA, 25 bp, Mus musculus
gcatcagcaagatcagtggcgctca

SEQ ID NO: 377041 - DNA, 25 bp, Mus musculus
acagcatcagcaagatcagtggcgc

SEQ ID NO: 377042 - DNA, 25 bp, Mus musculus
gcggcacgaacgacccctgcgaccc

SEQ ID NO: 377043 - DNA, 25 bp, Mus musculus
agcatcagcaagatcagtggcgctc

SEQ ID NO: 377044 - DNA, 25 bp, Mus musculus
gcagcgcaattccagatgccgcgtc

SEQ ID NO: 377045 - DNA, 25 bp, Mus musculus
agcgcaattccagatgccgcgtcgc

SEQ ID NO: 377046 - DNA, 25 bp, Mus musculus
ccagcaggcccgtctggccgcggct

SEQ ID NO: 377047 - DNA, 25 bp, Mus musculus
ggctccagatgtggggccaccgcgc

SEQ ID NO: 377048 - DNA, 25 bp, Mus musculus
gccgtgagcgcagcgcaattccaga

SEQ ID NO: 377049 - DNA, 25 bp, Mus musculus
ccttggccgtgagcgcagcgcaatt

SEQ ID NO: 377050 - DNA, 25 bp, Mus musculus
agactaaacaatcggccttggccgt

SEQ ID NO: 377051 - DNA, 25 bp, Mus musculus
gcagactaaacaatcggccttggcc

SEQ ID NO: 377052 - DNA, 25 bp, Mus musculus
ccagatgccgcgtcgcccgcgccga

SEQ ID NO: 377053 - DNA, 25 bp, Mus musculus
tgagcgcagcgcaattccagatgcc

SEQ ID NO: 377054 - DNA, 25 bp, Mus musculus
ccgcgccgagcgctaattgggccgc

SEQ ID NO: 377055 - DNA, 25 bp, Mus musculus
cagcttggccctgcccgggacggcc

SEQ ID NO: 377056 - DNA, 25 bp, Mus musculus
cgggacggccttggcacgacgccgg

SEQ ID NO: 377057 - DNA, 25 bp, Mus musculus
gacgccggcccgctgggctacctag

SEQ ID NO: 377058 - DNA, 25 bp, Mus musculus
tcttaaatctgggaggcccgaattc

SEQ ID NO: 377059 - DNA, 25 bp, Mus musculus
gaggcccgaattcctgccggattcc

SEQ ID NO: 377060 - DNA, 25 bp, Mus musculus
ccctctctgacaatctttcctttgt

SEQ ID NO: 377061 - DNA, 25 bp, Mus musculus
gaatggcaggttcttcccggaggaa

SEQ ID NO: 377062 - DNA, 25 bp, Mus musculus
ttcctgccggattccgtaggtttca

SEQ ID NO: 377063 - DNA, 25 bp, Mus musculus
ctgccggattccgtaggtttcactc

SEQ ID NO: 377064 - DNA, 25 bp, Mus musculus
ggtttcactcaggaaggaggcgccc

SEQ ID NO: 377065 - DNA, 25 bp, Mus musculus
gccggattccgtaggtttcactcag

SEQ ID NO: 377066 - DNA, 25 bp, Mus musculus
cggattccgtaggtttcactcagga

SEQ ID NO: 377067 - DNA, 25 bp, Mus musculus
ttccgtaggtttcactcaggaagga

SEQ ID NO: 377068 - DNA, 25 bp, Mus musculus
cgtaggtttcactcaggaaggaggc

SEQ ID NO: 377069 - DNA, 25 bp, Mus musculus
gcccgaattcctgccggattccgta

SEQ ID NO: 377070 - DNA, 25 bp, Mus musculus
aatggcaggttcttcccggaggaag

SEQ ID NO: 377071 - DNA, 25 bp, Mus musculus
ggcaggcggaatcccgggcgccctg

SEQ ID NO: 377072 - DNA, 25 bp, Mus musculus
gtgcgccatttgtccgcctttgaaa

SEQ ID NO: 377073 - DNA, 25 bp, Mus musculus
cacagaggggttgcgcgagccctcc

SEQ ID NO: 377074 - DNA, 25 bp, Mus musculus
ggctcaggttacacggagtcgaaga

SEQ ID NO: 377075 - DNA, 25 bp, Mus musculus
caggacgcccgggtgaattatcgcc

SEQ ID NO: 377076 - DNA, 25 bp, Mus musculus
tccgcctttgaaaccggaggctgcg

SEQ ID NO: 377077 - DNA, 25 bp, Mus musculus
ccacggggaccctgcattgcacaga

SEQ ID NO: 377078 - DNA, 25 bp, Mus musculus
tgttttgctatgtgttaatttgccc

SEQ ID NO: 377079 - DNA, 25 bp, Mus musculus
gctggggtgttttgctatgtgttaa

SEQ ID NO: 377080 - DNA, 25 bp, Mus musculus
agcccggctcctgtttctccaggtg

SEQ ID NO: 377081 - DNA, 25 bp, Mus musculus
cgggtgaattatcgcccgctcgggc

SEQ ID NO: 377082 - DNA, 25 bp, Mus musculus
tcacagccgcacagtgcgccatttg

SEQ ID NO: 377083 - DNA, 25 bp, Mus musculus
agggagcctcacagccgcacagtgc

SEQ ID NO: 377084 - DNA, 25 bp, Mus musculus
cacggagtcgaagacaggaagattt

SEQ ID NO: 377085 - DNA, 25 bp, Mus musculus
ggaagatttagcgagggagcctcac

SEQ ID NO: 377086 - DNA, 25 bp, Mus musculus
ctttctggagcacgtagatcccacg

SEQ ID NO: 377087 - DNA, 25 bp, Mus musculus
gcgccctaactttctggagcacgta

SEQ ID NO: 377088 - DNA, 25 bp, Mus musculus
ccttttgcgccctaactttctggag

SEQ ID NO: 377089 - DNA, 25 bp, Mus musculus
gtgtgcgaagttaccgtatttctcc

SEQ ID NO: 377090 - DNA, 25 bp, Mus musculus
gcagagtgtgcgaagttaccgtatt

SEQ ID NO: 377091 - DNA, 25 bp, Mus musculus
cctcagctccggaggcagagtgtgc

SEQ ID NO: 377092 - DNA, 25 bp, Mus musculus
gagctccctcagctccggaggcaga

SEQ ID NO: 377093 - DNA, 25 bp, Mus musculus
ggcctagtcgttgagctccctcagc

SEQ ID NO: 377094 - DNA, 25 bp, Mus musculus
caggcgccggcctagtcgttgagct

SEQ ID NO: 377095 - DNA, 25 bp, Mus musculus
ccgcagataactcgcagggtgcagg

SEQ ID NO: 377096 - DNA, 25 bp, Mus musculus
ttcccgcagataactcgcagggtgc

SEQ ID NO: 377097 - DNA, 25 bp, Mus musculus
acttcgcccaagttcccgcagataa

SEQ ID NO: 377098 - DNA, 25 bp, Mus musculus
agctactcccgcaaggcacgcggag

SEQ ID NO: 377099 - DNA, 25 bp, Mus musculus
agaaaccgcagctactcccgcaagg

SEQ ID NO: 377100 - DNA, 25 bp, Mus musculus
agtctctggaccatcgcctcggcgg

SEQ ID NO: 377101 - DNA, 25 bp, Mus musculus
tcggactgcagtcaagagcgcaact

SEQ ID NO: 377102 - DNA, 25 bp, Mus musculus
caagagcgcaactggcggaagtgac

SEQ ID NO: 377103 - DNA, 25 bp, Mus musculus
ggcatcagatgtgcgtcaggcgttc

SEQ ID NO: 377104 - DNA, 25 bp, Mus musculus
ggctaggtttctgcggtcgcgtcat

SEQ ID NO: 377105 - DNA, 25 bp, Mus musculus
gtcgcgtcattttctccgcagtgcc

SEQ ID NO: 377106 - DNA, 25 bp, Mus musculus
ttcccagtgtctcacagcttaagca

SEQ ID NO: 377107 - DNA, 25 bp, Mus musculus
cgcagtgcccaggtaacggtccttt

SEQ ID NO: 377108 - DNA, 25 bp, Mus musculus
tctctgcttggaggccttaataaag

SEQ ID NO: 377109 - DNA, 25 bp, Mus musculus
cggctccgcgagtaaccagtctctg

SEQ ID NO: 377110 - DNA, 25 bp, Mus musculus
gagagttttacccaggcctgcagcc

SEQ ID NO: 377111 - DNA, 25 bp, Mus musculus
cagtaccaagggtgagcgtctccga

SEQ ID NO: 377112 - DNA, 25 bp, Mus musculus
agcttaagcacaacaaatcggactg

SEQ ID NO: 377113 - DNA, 25 bp, Mus musculus
ataaaggcgacttctgcagcgggtc

SEQ ID NO: 377114 - DNA, 25 bp, Mus musculus
gcagcttggcccttaaatccggggc

SEQ ID NO: 377115 - DNA, 25 bp, Mus musculus
agctccacccgttcctcgctgcgct

SEQ ID NO: 377116 - DNA, 25 bp, Mus musculus
gaacctcacctctcaagcgtggggc

SEQ ID NO: 377117 - DNA, 25 bp, Mus musculus
ggcggaacctcacctctcaagcgtg

SEQ ID NO: 377118 - DNA, 25 bp, Mus musculus
gtcaggcggaacctcacctctcaag

SEQ ID NO: 377119 - DNA, 25 bp, Mus musculus
cacagagcctccctgtcaggcggaa

SEQ ID NO: 377120 - DNA, 25 bp, Mus musculus
acgcaggaccgaagaggctgacctc

SEQ ID NO: 377121 - DNA, 25 bp, Mus musculus
gcctgcgctcagcagctacgggcga

SEQ ID NO: 377122 - DNA, 25 bp, Mus musculus
ccgcgacccggtcctgtcctgtcct

SEQ ID NO: 377123 - DNA, 25 bp, Mus musculus
ctggactgttaaacttgggcggccg

SEQ ID NO: 377124 - DNA, 25 bp, Mus musculus
gctcccgcctggactgttaaacttg

SEQ ID NO: 377125 - DNA, 25 bp, Mus musculus
ctcggggcagcttggcccttaaatc

SEQ ID NO: 377126 - DNA, 25 bp, Mus musculus
tgccgcccaacgcaggaccgaagag

SEQ ID NO: 377127 - DNA, 25 bp, Mus musculus
agtcccgcctcgcatgacgtcacgg

SEQ ID NO: 377128 - DNA, 25 bp, Mus musculus
cgctttgtctgcacggcccgttaaa

SEQ ID NO: 377129 - DNA, 25 bp, Mus musculus
tcgagggtctgaccggtcaaacgcg

SEQ ID NO: 377130 - DNA, 25 bp, Mus musculus
aaagcgtcgagggtctgaccggtca

SEQ ID NO: 377131 - DNA, 25 bp, Mus musculus
gtctgtgctaggctgcgcccggctt

SEQ ID NO: 377132 - DNA, 25 bp, Mus musculus
ttgctccgaggatagacgctttgtc

SEQ ID NO: 377133 - DNA, 25 bp, Mus musculus
tgcacggcccgttaaagacacgcgg

SEQ ID NO: 377134 - DNA, 25 bp, Mus musculus
taaagacacgcggtcccttctcaac

SEQ ID NO: 377135 - DNA, 25 bp, Mus musculus
ccagcccggcctacattgcaattta

SEQ ID NO: 377136 - DNA, 25 bp, Mus musculus
ttgcaatttaactgtcagccgcgtc

SEQ ID NO: 377137 - DNA, 25 bp, Mus musculus
tcagccgcgtcctcgctcagagatt

SEQ ID NO: 377138 - DNA, 25 bp, Mus musculus
cgctcagagattgagcgccagggca

SEQ ID NO: 377139 - DNA, 25 bp, Mus musculus
gccggacttagaggaaaagcgtcga

SEQ ID NO: 377140 - DNA, 25 bp, Mus musculus
gagacacgctgacaggtctgtgcta

SEQ ID NO: 377141 - DNA, 25 bp, Mus musculus
cccggcttctcttgctccgaggata

SEQ ID NO: 377142 - DNA, 25 bp, Mus musculus
cgccgagaaggaattcgaacgatgc

SEQ ID NO: 377143 - DNA, 25 bp, Mus musculus
gcgagatcgctaggcccacgcagcg

SEQ ID NO: 377144 - DNA, 25 bp, Mus musculus
tctacgacagacaggcgagatcgct

SEQ ID NO: 377145 - DNA, 25 bp, Mus musculus
tgctaagattccaggttctcaactc

SEQ ID NO: 377146 - DNA, 25 bp, Mus musculus
ggatcccacggtgcctctacgacag

SEQ ID NO: 377147 - DNA, 25 bp, Mus musculus
cgaagagctccaacggtagccctta

SEQ ID NO: 377148 - DNA, 25 bp, Mus musculus
taggccttgaggttccgaagagctc

SEQ ID NO: 377149 - DNA, 25 bp, Mus musculus
gaattcgaacgatgcgggcgcaccg

SEQ ID NO: 377150 - DNA, 25 bp, Mus musculus
gactctctcatcctctaggccttga

SEQ ID NO: 377151 - DNA, 25 bp, Mus musculus
tgactccatcctgctaagattccag

SEQ ID NO: 377152 - DNA, 25 bp, Mus musculus
agtgttcacgcacgtgcagcggctg

SEQ ID NO: 377153 - DNA, 25 bp, Mus musculus
ccaagacaaacgagggtggcgctgt

SEQ ID NO: 377154 - DNA, 25 bp, Mus musculus
tttcccggagtaggtgactccatcc

SEQ ID NO: 377155 - DNA, 25 bp, Mus musculus
cacgcagcgcggcatttcccggagt

SEQ ID NO: 377156 - DNA, 25 bp, Mus musculus
cggagctcggcttgaaagaaatggc

SEQ ID NO: 377157 - DNA, 25 bp, Mus musculus
tctgggcgcctgacagtgctggcca

SEQ ID NO: 377158 - DNA, 25 bp, Mus musculus
acagacgaccccgtgagccaggcga

SEQ ID NO: 377159 - DNA, 25 bp, Mus musculus
aactagccagtgcacacagacgacc

SEQ ID NO: 377160 - DNA, 25 bp, Mus musculus
ttcttaactagccagtgcacacaga

SEQ ID NO: 377161 - DNA, 25 bp, Mus musculus
tttatttttcttaactagccagtgc

SEQ ID NO: 377162 - DNA, 25 bp, Mus musculus
gctcggcttgaaagaaatggcctta

SEQ ID NO: 377163 - DNA, 25 bp, Mus musculus
aggcgaccggaccaggccgatcctg

SEQ ID NO: 377164 - DNA, 25 bp, Mus musculus
atttctctggcaggcggcggagctc

SEQ ID NO: 377165 - DNA, 25 bp, Mus musculus
ccctcccacccgcagcttcgctcgc

SEQ ID NO: 377166 - DNA, 25 bp, Mus musculus
cggaggctcaggttacccggcccag

SEQ ID NO: 377167 - DNA, 25 bp, Mus musculus
aagagggcaactctgggcgcctgac

SEQ ID NO: 377168 - DNA, 25 bp, Mus musculus
tgtttgcatttctctggcaggcggc

SEQ ID NO: 377169 - DNA, 25 bp, Mus musculus
cttgaaagaaatggccttagttcgg

SEQ ID NO: 377170 - DNA, 25 bp, Mus musculus
aaggcctacgcaggcgcctttcaca

SEQ ID NO: 377171 - DNA, 25 bp, Mus musculus
ggcctctcctgagtggtcagcgaga

SEQ ID NO: 377172 - DNA, 25 bp, Mus musculus
ggccgctggatattggctcctcata

SEQ ID NO: 377173 - DNA, 25 bp, Mus musculus
cgctgattggctccagtaccggacc

SEQ ID NO: 377174 - DNA, 25 bp, Mus musculus
tggcgaatctgaacaaaggggaatc

SEQ ID NO: 377175 - DNA, 25 bp, Mus musculus
acacgctccgtacgctgctgcttaa

SEQ ID NO: 377176 - DNA, 25 bp, Mus musculus
gctgcttaaacacctccctgaatta

SEQ ID NO: 377177 - DNA, 25 bp, Mus musculus
tgaattatataccacgcaggcgctg

SEQ ID NO: 377178 - DNA, 25 bp, Mus musculus
acctatttctaagcgtccactggga

SEQ ID NO: 377179 - DNA, 25 bp, Mus musculus
gggccgaatgcgcaagcgctcttct

SEQ ID NO: 377180 - DNA, 25 bp, Mus musculus
ggctactggctacccagctcgggca

SEQ ID NO: 377181 - DNA, 25 bp, Mus musculus
agacatccagatcccgaaaagcctg

SEQ ID NO: 377182 - DNA, 25 bp, Mus musculus
gttggcaacatttggactccttaca

SEQ ID NO: 377183 - DNA, 25 bp, Mus musculus
ccgctgcctcgcaaaatggcgaatc

SEQ ID NO: 377184 - DNA, 25 bp, Mus musculus
ggacggatgctgcatttagggctca

SEQ ID NO: 377185 - DNA, 25 bp, Mus musculus
gagtcccacacatctacaatgcagt

SEQ ID NO: 377186 - DNA, 25 bp, Mus musculus
gcgtttcctgcaacgggacggatgc

SEQ ID NO: 377187 - DNA, 25 bp, Mus musculus
cggatgctgcatttagggctcatca

SEQ ID NO: 377188 - DNA, 25 bp, Mus musculus
gcatttagggctcatcaccttcctg

SEQ ID NO: 377189 - DNA, 25 bp, Mus musculus
gggctcatcaccttcctgttcaatc

SEQ ID NO: 377190 - DNA, 25 bp, Mus musculus
caatgcagtatgagccgcgggaact

SEQ ID NO: 377191 - DNA, 25 bp, Mus musculus
ccacgccatattcagtcgcaaatct

SEQ ID NO: 377192 - DNA, 25 bp, Mus musculus
agtcgcaaatctcagcgcccatttg

SEQ ID NO: 377193 - DNA, 25 bp, Mus musculus
atctcagcgcccatttgttaaaagg

SEQ ID NO: 377194 - DNA, 25 bp, Mus musculus
cccatttgttaaaaggcctctctgc

SEQ ID NO: 377195 - DNA, 25 bp, Mus musculus
tgttaaaaggcctctctgccttgcc

SEQ ID NO: 377196 - DNA, 25 bp, Mus musculus
ccacgcgtttcctgcaacgggacgg

SEQ ID NO: 377197 - DNA, 25 bp, Mus musculus
tctacaatgcagtatgagccgcggg

SEQ ID NO: 377198 - DNA, 25 bp, Mus musculus
atcaagcgggtcctcggggttctca

SEQ ID NO: 377199 - DNA, 25 bp, Mus musculus
acgctgctagaaccgaggatcctcc

SEQ ID NO: 377200 - DNA, 25 bp, Mus musculus
ctgggctgcagttccaacccattta

SEQ ID NO: 377201 - DNA, 25 bp, Mus musculus
gataaccgtgcgcaggagctgtcgt

SEQ ID NO: 377202 - DNA, 25 bp, Mus musculus
gcagtacggactcgacctggccgcg

SEQ ID NO: 377203 - DNA, 25 bp, Mus musculus
tagctgtgtgcaaggcgtactctgc

SEQ ID NO: 377204 - DNA, 25 bp, Mus musculus
ccaattttcctccagcaggcggcgg

SEQ ID NO: 377205 - DNA, 25 bp, Mus musculus
cgagccaacgcggtccaattttcct

SEQ ID NO: 377206 - DNA, 25 bp, Mus musculus
atcctccggggctgtggatcccggc

SEQ ID NO: 377207 - DNA, 25 bp, Mus musculus
tactctgcacgagaggcggcagtac

SEQ ID NO: 377208 - DNA, 25 bp, Mus musculus
tttactccgaaccaacgctgctaga

SEQ ID NO: 377209 - DNA, 25 bp, Mus musculus
atctggggtccggagctactgcagc

SEQ ID NO: 377210 - DNA, 25 bp, Mus musculus
tttctaaggctgtctgcaccgctgg

SEQ ID NO: 377211 - DNA, 25 bp, Mus musculus
agagcgcttcgctctgcctcggagt

SEQ ID NO: 377212 - DNA, 25 bp, Mus musculus
ctgctgctgcgtcttggcgacgctg

SEQ ID NO: 377213 - DNA, 25 bp, Mus musculus
tccgcgggagatgggcgcagggatg

SEQ ID NO: 377214 - DNA, 25 bp, Mus musculus
gcccaggtgagtggctgtcgctgct

SEQ ID NO: 377215 - DNA, 25 bp, Mus musculus
tgtcgctgctgctgcgtcttggcga

SEQ ID NO: 377216 - DNA, 25 bp, Mus musculus
cgctgctgctgcgtcttggcgacgc

SEQ ID NO: 377217 - DNA, 25 bp, Mus musculus
ctgctgcgtcttggcgacgctgggt

SEQ ID NO: 377218 - DNA, 25 bp, Mus musculus
ctgcgtcttggcgacgctgggtgtc

SEQ ID NO: 377219 - DNA, 25 bp, Mus musculus
tgcgtcttggcgacgctgggtgtcc

SEQ ID NO: 377220 - DNA, 25 bp, Mus musculus
gcgtcttggcgacgctgggtgtccg

SEQ ID NO: 377221 - DNA, 25 bp, Mus musculus
tcttggcgacgctgggtgtccgcgg

SEQ ID NO: 377222 - DNA, 25 bp, Mus musculus
gcgacgctgggtgtccgcgggagat

SEQ ID NO: 377223 - DNA, 25 bp, Mus musculus
gacgctgggtgtccgcgggagatgg

SEQ ID NO: 377224 - DNA, 25 bp, Mus musculus
gtccgcgggagatgggcgcagggat

SEQ ID NO: 377225 - DNA, 25 bp, Mus musculus
gtcgctgctgctgcgtcttggcgac

SEQ ID NO: 377226 - DNA, 25 bp, Mus musculus
tggatggtccgaggccaccatctgc

SEQ ID NO: 377227 - DNA, 25 bp, Mus musculus
caggaaggatgcgtggccgagccaa

SEQ ID NO: 377228 - DNA, 25 bp, Mus musculus
tagcgtgagcctgtctccggccagg

SEQ ID NO: 377229 - DNA, 25 bp, Mus musculus
cttagcgtgagcctgtctccggcca

SEQ ID NO: 377230 - DNA, 25 bp, Mus musculus
agcgcttagcgtgagcctgtctccg

SEQ ID NO: 377231 - DNA, 25 bp, Mus musculus
cagctggagcgcttagcgtgagcct

SEQ ID NO: 377232 - DNA, 25 bp, Mus musculus
tcgctgcagctggagcgcttagcgt

SEQ ID NO: 377233 - DNA, 25 bp, Mus musculus
gatcgctgcagctggagcgcttagc

SEQ ID NO: 377234 - DNA, 25 bp, Mus musculus
ccttcgctggatcgctgcagctgga

SEQ ID NO: 377235 - DNA, 25 bp, Mus musculus
ctgccttcgctggatcgctgcagct

SEQ ID NO: 377236 - DNA, 25 bp, Mus musculus
tgcctgccttcgctggatcgctgca

SEQ ID NO: 377237 - DNA, 25 bp, Mus musculus
tccgaggccaccatctgcctgcctt

SEQ ID NO: 377238 - DNA, 25 bp, Mus musculus
atggtccgaggccaccatctgcctg

SEQ ID NO: 377239 - DNA, 25 bp, Mus musculus
cgccacgggtagatgccgccttgcc

SEQ ID NO: 377240 - DNA, 25 bp, Mus musculus
ggcagctcctgaggtccaatgctcg

SEQ ID NO: 377241 - DNA, 25 bp, Mus musculus
aggtccaatgctcggggttgcagct

SEQ ID NO: 377242 - DNA, 25 bp, Mus musculus
ggcggaacgcgtggactacaacttc

SEQ ID NO: 377243 - DNA, 25 bp, Mus musculus
ggcaatgcggagaggcaccctcgct

SEQ ID NO: 377244 - DNA, 25 bp, Mus musculus
accctcgctgattggctacttgggc

SEQ ID NO: 377245 - DNA, 25 bp, Mus musculus
tgattggctacttgggcgccgccct

SEQ ID NO: 377246 - DNA, 25 bp, Mus musculus
ccctccgaaatgactctgttccagg

SEQ ID NO: 377247 - DNA, 25 bp, Mus musculus
ctctgttccaggtcccgggctagag

SEQ ID NO: 377248 - DNA, 25 bp, Mus musculus
ggctagagtgctctggaggcccact

SEQ ID NO: 377249 - DNA, 25 bp, Mus musculus
tggaggcccacttcaggccgggtac

SEQ ID NO: 377250 - DNA, 25 bp, Mus musculus
gccgggtacttcctttgctgacttc

SEQ ID NO: 377251 - DNA, 25 bp, Mus musculus
ttcctttgctgacttcatggcggcg

SEQ ID NO: 377252 - DNA, 25 bp, Mus musculus
ctacaacttccagagggcaatgcgg

SEQ ID NO: 377253 - DNA, 25 bp, Mus musculus
cgttcggaatagtgcggcagctcct

SEQ ID NO: 377254 - DNA, 25 bp, Mus musculus
agtctccgctggtgatggtgaagca

SEQ ID NO: 377255 - DNA, 25 bp, Mus musculus
gtgagcacactctagcacactcgtg

SEQ ID NO: 377256 - DNA, 25 bp, Mus musculus
ccgtacacgtgagcacactctagca

SEQ ID NO: 377257 - DNA, 25 bp, Mus musculus
cagcagcaaggggtacggaccatcg

SEQ ID NO: 377258 - DNA, 25 bp, Mus musculus
tgaagcccaccgtgcggaagcagca

SEQ ID NO: 377259 - DNA, 25 bp, Mus musculus
tttcgctagggtgaagcccaccgtg

SEQ ID NO: 377260 - DNA, 25 bp, Mus musculus
ggtgaagcagacgatccagattttc

SEQ ID NO: 377261 - DNA, 25 bp, Mus musculus
tcaagggtcagtgcggagtctccgc

SEQ ID NO: 377262 - DNA, 25 bp, Mus musculus
ctttggttactgttgctagggcagc

SEQ ID NO: 377263 - DNA, 25 bp, Mus musculus
gctgcttgggtagcatctttggtta

SEQ ID NO: 377264 - DNA, 25 bp, Mus musculus
ccacgaccaattagggataggaggc

SEQ ID NO: 377265 - DNA, 25 bp, Mus musculus
ctccttttagtccacgaccaattag

SEQ ID NO: 377266 - DNA, 25 bp, Mus musculus
gacatgcgcggcgatccctgctcgg

SEQ ID NO: 377267 - DNA, 25 bp, Mus musculus
cagacgatccagattttcgctaggg

SEQ ID NO: 377268 - DNA, 25 bp, Mus musculus
ctgaactcatgtgcaaaatatgctg

SEQ ID NO: 377269 - DNA, 25 bp, Mus musculus
tcgtctgtccctccggcgctggccg

SEQ ID NO: 377270 - DNA, 25 bp, Mus musculus
tgtgcaaaatatgctgtgctgcatc

SEQ ID NO: 377271 - DNA, 25 bp, Mus musculus
ccgtgcgtcgccagcgccgcgcaac

SEQ ID NO: 377272 - DNA, 25 bp, Mus musculus
ggcagccccgcacgagagacccgtc

SEQ ID NO: 377273 - DNA, 25 bp, Mus musculus
aaaatatgctgtgctgcatcttctt

SEQ ID NO: 377274 - DNA, 25 bp, Mus musculus
gcaaaatatgctgtgctgcatcttc

SEQ ID NO: 377275 - DNA, 25 bp, Mus musculus
ctcatgtgcaaaatatgctgtgctg

SEQ ID NO: 377276 - DNA, 25 bp, Mus musculus
cctctgaactcatgtgcaaaatatg

SEQ ID NO: 377277 - DNA, 25 bp, Mus musculus
ctccagagccagtggccgccgcgct

SEQ ID NO: 377278 - DNA, 25 bp, Mus musculus
aggtacctctccagagccagtggcc

SEQ ID NO: 377279 - DNA, 25 bp, Mus musculus
acaggtacctctccagagccagtgg

SEQ ID NO: 377280 - DNA, 25 bp, Mus musculus
gcacaggtacctctccagagccagt

SEQ ID NO: 377281 - DNA, 25 bp, Mus musculus
tggccgcacaggtacctctccagag

SEQ ID NO: 377282 - DNA, 25 bp, Mus musculus
cccgcacttgctggtgagttggcag

SEQ ID NO: 377283 - DNA, 25 bp, Mus musculus
gccgctggttggatcgtttcaataa

SEQ ID NO: 377284 - DNA, 25 bp, Mus musculus
gttcgcagccgatcgaggcttcctg

SEQ ID NO: 377285 - DNA, 25 bp, Mus musculus
ccgctgagagttcgcagccgatcga

SEQ ID NO: 377286 - DNA, 25 bp, Mus musculus
ggatcttgtcggtcgcatgtccacg

SEQ ID NO: 377287 - DNA, 25 bp, Mus musculus
accggacctgcatccgctcgctcgc

SEQ ID NO: 377288 - DNA, 25 bp, Mus musculus
agtactgggccgtccgcgaggctcc

SEQ ID NO: 377289 - DNA, 25 bp, Mus musculus
cactcagacgaacgagagcggcggc

SEQ ID NO: 377290 - DNA, 25 bp, Mus musculus
tggttggatcgtttcaataaaagtc

SEQ ID NO: 377291 - DNA, 25 bp, Mus musculus
aagcaacgcgcactcagacgaacga

SEQ ID NO: 377292 - DNA, 25 bp, Mus musculus
ctccgagcgagagaaagcaacgcgc

SEQ ID NO: 377293 - DNA, 25 bp, Mus musculus
aagccgcagcctccgagcgagagaa

SEQ ID NO: 377294 - DNA, 25 bp, Mus musculus
gctctcgctcgctccggggaacagg

SEQ ID NO: 377295 - DNA, 25 bp, Mus musculus
tcggtcgcatgtccacgcgcggcgt

SEQ ID NO: 377296 - DNA, 25 bp, Mus musculus
gcctcctcggcgaagcccaactcca

SEQ ID NO: 377297 - DNA, 25 bp, Mus musculus
tgctgggaaactgctcgctgcgcag

SEQ ID NO: 377298 - DNA, 25 bp, Mus musculus
cactttgctgggaaactgctcgctg

SEQ ID NO: 377299 - DNA, 25 bp, Mus musculus
caactccacaggaccaggggcggct

SEQ ID NO: 377300 - DNA, 25 bp, Mus musculus
gcggtgcgtacacctgcagcaggaa

SEQ ID NO: 377301 - DNA, 25 bp, Mus musculus
ggctgcagccatgctcgcagcagga

SEQ ID NO: 377302 - DNA, 25 bp, Mus musculus
agccatgctcgcagcaggactctgc

SEQ ID NO: 377303 - DNA, 25 bp, Mus musculus
aggactctgccaccaggccggaaga

SEQ ID NO: 377304 - DNA, 25 bp, Mus musculus
gcggctcgcgacagcagaagagaaa

SEQ ID NO: 377305 - DNA, 25 bp, Mus musculus
ctcgcgacagcagaagagaaagagg

SEQ ID NO: 377306 - DNA, 25 bp, Mus musculus
gcccgcccactttgctgggaaactg

SEQ ID NO: 377307 - DNA, 25 bp, Mus musculus
ggcagctccgccaagcccaaccacg

SEQ ID NO: 377308 - DNA, 25 bp, Mus musculus
atcgtcctacgtccagggttcagcc

SEQ ID NO: 377309 - DNA, 25 bp, Mus musculus
caaccgatcgtcctacgtccagggt

SEQ ID NO: 377310 - DNA, 25 bp, Mus musculus
ctacagccaataggcggcagcgcta

SEQ ID NO: 377311 - DNA, 25 bp, Mus musculus
gtgctacaccagaaaaggccgattt

SEQ ID NO: 377312 - DNA, 25 bp, Mus musculus
gaggaacccagaaccggaaatatga

SEQ ID NO: 377313 - DNA, 25 bp, Mus musculus
gcccaaaggcgggaaagagccgtca

SEQ ID NO: 377314 - DNA, 25 bp, Mus musculus
actcaccatgatggcggccagagtt

SEQ ID NO: 377315 - DNA, 25 bp, Mus musculus
gcaaaggcagcaaggccgccactct

SEQ ID NO: 377316 - DNA, 25 bp, Mus musculus
gcctcgtgacgtgctacagccaata

SEQ ID NO: 377317 - DNA, 25 bp, Mus musculus
tgaaaggaccctctttatgccctct

SEQ ID NO: 377318 - DNA, 25 bp, Mus musculus
tccgcgtaaggaatcgcggcctccg

SEQ ID NO: 377319 - DNA, 25 bp, Mus musculus
aaaacctcgaaggtggagcagaagc

SEQ ID NO: 377320 - DNA, 25 bp, Mus musculus
cagctacgtgaggtggctgcctagc

SEQ ID NO: 377321 - DNA, 25 bp, Mus musculus
tgcctagccggccaacgggcaaaaa

SEQ ID NO: 377322 - DNA, 25 bp, Mus musculus
gccacggagacagcggagtcccgaa

SEQ ID NO: 377323 - DNA, 25 bp, Mus musculus
cctcagtgctggtgtaggccgcaaa

SEQ ID NO: 377324 - DNA, 25 bp, Mus musculus
cggggtttccaacggagactgcagc

SEQ ID NO: 377325 - DNA, 25 bp, Mus musculus
ccaagggcgccctgaaagccggagc

SEQ ID NO: 377326 - DNA, 25 bp, Mus musculus
gcacgcgccacatcccaaccaaaaa

SEQ ID NO: 377327 - DNA, 25 bp, Mus musculus
aggcgagctcgctgcacgcgccaca

SEQ ID NO: 377328 - DNA, 25 bp, Mus musculus
tgcacgacgtccttcgcgccggagg

SEQ ID NO: 377329 - DNA, 25 bp, Mus musculus
gtaattccgcctgcacgacgtcctt

SEQ ID NO: 377330 - DNA, 25 bp, Mus musculus
cccagaggtaattccgcctgcacga

SEQ ID NO: 377331 - DNA, 25 bp, Mus musculus
gccgcccaagctgactcctctctcc

SEQ ID NO: 377332 - DNA, 25 bp, Mus musculus
cgcgttatttttggcgcccgcagcg

SEQ ID NO: 377333 - DNA, 25 bp, Mus musculus
gcgcgcgttatttttggcgcccgca

SEQ ID NO: 377334 - DNA, 25 bp, Mus musculus
cctgggcctcggctgagccctgaag

SEQ ID NO: 377335 - DNA, 25 bp, Mus musculus
ggggccatcagaagccgccctgggc

SEQ ID NO: 377336 - DNA, 25 bp, Mus musculus
taggagagcgaccacaaccgcaacg

SEQ ID NO: 377337 - DNA, 25 bp, Mus musculus
ttccaacggagactgcagcctcggc

SEQ ID NO: 377338 - DNA, 25 bp, Mus musculus
gcgaggcgctttttcaccgttagca

SEQ ID NO: 377339 - DNA, 25 bp, Mus musculus
ctgagagaggctgcctcgcccgtgt

SEQ ID NO: 377340 - DNA, 25 bp, Mus musculus
gcttcccgagctcgtccgggagcga

SEQ ID NO: 377341 - DNA, 25 bp, Mus musculus
atgcccggtagctgcttcccgagct

SEQ ID NO: 377342 - DNA, 25 bp, Mus musculus
tgagcagctcggcaatgcccggtag

SEQ ID NO: 377343 - DNA, 25 bp, Mus musculus
caccgttagcatcgttatgttattt

SEQ ID NO: 377344 - DNA, 25 bp, Mus musculus
agccgcctgacttccggcctgggaa

SEQ ID NO: 377345 - DNA, 25 bp, Mus musculus
cagtctgccgggctctcgtggaaca

SEQ ID NO: 377346 - DNA, 25 bp, Mus musculus
cagcccagggctgaaagaaacaggg

SEQ ID NO: 377347 - DNA, 25 bp, Mus musculus
accaatggagctgcctgggccatgc

SEQ ID NO: 377348 - DNA, 25 bp, Mus musculus
tctcgtggaacacgccgggcctggc

SEQ ID NO: 377349 - DNA, 25 bp, Mus musculus
ctgggccatgccgatgcgcatgcgc

SEQ ID NO: 377350 - DNA, 25 bp, Mus musculus
ttacctgtagcgcagcagggctccc

SEQ ID NO: 377351 - DNA, 25 bp, Mus musculus
gcctggcccgaccagcaagagaatg

SEQ ID NO: 377352 - DNA, 25 bp, Mus musculus
tctgcgcgctcgtgtgagcgtagct

SEQ ID NO: 377353 - DNA, 25 bp, Mus musculus
gccgctgtggctgccgcttcttcct

SEQ ID NO: 377354 - DNA, 25 bp, Mus musculus
ggccggccgagtgtacacaatgccc

SEQ ID NO: 377355 - DNA, 25 bp, Mus musculus
catccgtaatgagccgcgagcgaga

SEQ ID NO: 377356 - DNA, 25 bp, Mus musculus
ccgggcgcgcgagcatccgtaatga

SEQ ID NO: 377357 - DNA, 25 bp, Mus musculus
attttaatgcgaggcaccggctggc

SEQ ID NO: 377358 - DNA, 25 bp, Mus musculus
cttcctcctcctcattttaatgcga

SEQ ID NO: 377359 - DNA, 25 bp, Mus musculus
agtgtacacaatgcccggcggccgg

SEQ ID NO: 377360 - DNA, 25 bp, Mus musculus
cccaaaactgatgcagagttgcgcg

SEQ ID NO: 377361 - DNA, 25 bp, Mus musculus
gaggtcgacaatggcagtgagactt

SEQ ID NO: 377362 - DNA, 25 bp, Mus musculus
acaaggaggtcgacaatggcagtga

SEQ ID NO: 377363 - DNA, 25 bp, Mus musculus
tcggaggtaaacaaggaggtcgaca

SEQ ID NO: 377364 - DNA, 25 bp, Mus musculus
ccattaaaccaagagttgaatcatc

SEQ ID NO: 377365 - DNA, 25 bp, Mus musculus
aaccaagagttgaatcatcccggcc

SEQ ID NO: 377366 - DNA, 25 bp, Mus musculus
ctgagaagtttggatcggttccgca

SEQ ID NO: 377367 - DNA, 25 bp, Mus musculus
ctctcgggatagagaagttgccaca

SEQ ID NO: 377368 - DNA, 25 bp, Mus musculus
tccgctcgccaccagcaaagtaggg

SEQ ID NO: 377369 - DNA, 25 bp, Mus musculus
tgctaagtgaactccagatctggcg

SEQ ID NO: 377370 - DNA, 25 bp, Mus musculus
ttcgtcctctaaagcgggccatgcc

SEQ ID NO: 377371 - DNA, 25 bp, Mus musculus
gggccatgcccacgacctggactaa

SEQ ID NO: 377372 - DNA, 25 bp, Mus musculus
aagtgtctaacgagggactcctgcc

SEQ ID NO: 377373 - DNA, 25 bp, Mus musculus
ggcaaagacgccaagtaagtccgca

SEQ ID NO: 377374 - DNA, 25 bp, Mus musculus
aagtaagtccgcatcccggccatga

SEQ ID NO: 377375 - DNA, 25 bp, Mus musculus
cgctcgagagaagggccagcaagac

SEQ ID NO: 377376 - DNA, 25 bp, Mus musculus
atcggttccgcatccgcagaaaacg

SEQ ID NO: 377377 - DNA, 25 bp, Mus musculus
cgagcgctgttcttcggctctcaaa

SEQ ID NO: 377378 - DNA, 25 bp, Mus musculus
aaactctgggctccaacttgagcgc

SEQ ID NO: 377379 - DNA, 25 bp, Mus musculus
cccgaatgtctgagcgcgctcgaga

SEQ ID NO: 377380 - DNA, 25 bp, Mus musculus
tgtgtgccagcggaggaggaagtca

SEQ ID NO: 377381 - DNA, 25 bp, Mus musculus
cctcttgtcgttgtttgcctgggct

SEQ ID NO: 377382 - DNA, 25 bp, Mus musculus
tcctcttgtcgttgtttgcctgggc

SEQ ID NO: 377383 - DNA, 25 bp, Mus musculus
cttcctcttgtcgttgtttgcctgg

SEQ ID NO: 377384 - DNA, 25 bp, Mus musculus
gcttcctcttgtcgttgtttgcctg

SEQ ID NO: 377385 - DNA, 25 bp, Mus musculus
ccgcttcctcttgtcgttgtttgcc

SEQ ID NO: 377386 - DNA, 25 bp, Mus musculus
gccgcttcctcttgtcgttgtttgc

SEQ ID NO: 377387 - DNA, 25 bp, Mus musculus
cgccgcttcctcttgtcgttgtttg

SEQ ID NO: 377388 - DNA, 25 bp, Mus musculus
ccgccgcttcctcttgtcgttgttt

SEQ ID NO: 377389 - DNA, 25 bp, Mus musculus
cggccgccagggtaagtgtgggcga

SEQ ID NO: 377390 - DNA, 25 bp, Mus musculus
tcttgtcgttgtttgcctgggcttt

SEQ ID NO: 377391 - DNA, 25 bp, Mus musculus
cagagcgcggggcattggtgtgtgt

SEQ ID NO: 377392 - DNA, 25 bp, Mus musculus
agcgccgcccgggtgcagggtcgct

SEQ ID NO: 377393 - DNA, 25 bp, Mus musculus
ttgtcgttgtttgcctgggctttgg

SEQ ID NO: 377394 - DNA, 25 bp, Mus musculus
gtgttgctctggctcgcgtttctct

SEQ ID NO: 377395 - DNA, 25 bp, Mus musculus
tcctcagcgtccctgggggtactcg

SEQ ID NO: 377396 - DNA, 25 bp, Mus musculus
ggctcgcgtttctctgttcctcagc

SEQ ID NO: 377397 - DNA, 25 bp, Mus musculus
aacggcggaggacgcctggaacgag

SEQ ID NO: 377398 - DNA, 25 bp, Mus musculus
tactcgaggcttagcgccgcagtct

SEQ ID NO: 377399 - DNA, 25 bp, Mus musculus
ttagcgccgcagtctccccagatgg

SEQ ID NO: 377400 - DNA, 25 bp, Mus musculus
agaccctaggggtgtctgtgcagaa

SEQ ID NO: 377401 - DNA, 25 bp, Mus musculus
atggggcgccgtcctccacgaccct

SEQ ID NO: 377402 - DNA, 25 bp, Mus musculus
ccacgaccctagagcgcgggtcagg

SEQ ID NO: 377403 - DNA, 25 bp, Mus musculus
cgtgagctctcgaaggctctacgga

SEQ ID NO: 377404 - DNA, 25 bp, Mus musculus
tcgcgtttctctgttcctcagcgtc

SEQ ID NO: 377405 - DNA, 25 bp, Mus musculus
aaggctctacggagagaccctaggg

SEQ ID NO: 377406 - DNA, 25 bp, Mus musculus
ggccaccgtgagctctcgaaggctc

SEQ ID NO: 377407 - DNA, 25 bp, Mus musculus
tctcgaaggctctacggagagaccc

SEQ ID NO: 377408 - DNA, 25 bp, Mus musculus
ctggagcccgagtgtttgtgttttg

SEQ ID NO: 377409 - DNA, 25 bp, Mus musculus
gactcattcttctagcagcttcggg

SEQ ID NO: 377410 - DNA, 25 bp, Mus musculus
cgtcacggcgttcttcgctgcgtgc

SEQ ID NO: 377411 - DNA, 25 bp, Mus musculus
ccttgcagccggagcccaaagatgt

SEQ ID NO: 377412 - DNA, 25 bp, Mus musculus
tctttggggctctgtcccggctact

SEQ ID NO: 377413 - DNA, 25 bp, Mus musculus
ggccctcagcgcttagtgactcatt

SEQ ID NO: 377414 - DNA, 25 bp, Mus musculus
tcctcggaactcgagcgcggcgact

SEQ ID NO: 377415 - DNA, 25 bp, Mus musculus
gaagcagttcctgcgctggagcccg

SEQ ID NO: 377416 - DNA, 25 bp, Mus musculus
ttaggaagccgctgccggcctcctg

SEQ ID NO: 377417 - DNA, 25 bp, Mus musculus
cacccggggatgtcacgtgacttcg

SEQ ID NO: 377418 - DNA, 25 bp, Mus musculus
ggccgaactattctcccttagcgca

SEQ ID NO: 377419 - DNA, 25 bp, Mus musculus
aggcgttagagagggccgaactatt

SEQ ID NO: 377420 - DNA, 25 bp, Mus musculus
agcccaaagatgtcggttcagatca

SEQ ID NO: 377421 - DNA, 25 bp, Mus musculus
gctactgagccggatcgcatccggg

SEQ ID NO: 377422 - DNA, 25 bp, Mus musculus
atcgccgtgaagaaggcgcagttgc

SEQ ID NO: 377423 - DNA, 25 bp, Mus musculus
gcactggggctttttctgctctgta

SEQ ID NO: 377424 - DNA, 25 bp, Mus musculus
tgtcctggaatcctggcgctctacg

SEQ ID NO: 377425 - DNA, 25 bp, Mus musculus
ttgtggagcacccagaagtgtcctg

SEQ ID NO: 377426 - DNA, 25 bp, Mus musculus
aactgtgcttggtgtggcagatctg

SEQ ID NO: 377427 - DNA, 25 bp, Mus musculus
cgggagtcctttcacagggagtgta

SEQ ID NO: 377428 - DNA, 25 bp, Mus musculus
ttctgctctgtaggagctcgcggga

SEQ ID NO: 377429 - DNA, 25 bp, Mus musculus
tctgggaaggatgagtcttggcttc

SEQ ID NO: 377430 - DNA, 25 bp, Mus musculus
ggtcttctagatctgccggtgtccc

SEQ ID NO: 377431 - DNA, 25 bp, Mus musculus
cggcttgcacagcatctcactggga

SEQ ID NO: 377432 - DNA, 25 bp, Mus musculus
tacccgctgggatgagcacaatcgc

SEQ ID NO: 377433 - DNA, 25 bp, Mus musculus
agctggagaaactcggcgtgtactc

SEQ ID NO: 377434 - DNA, 25 bp, Mus musculus
ctacgctcgcagcagcatgccggag

SEQ ID NO: 377435 - DNA, 25 bp, Mus musculus
gtgtactccgcctgcaaggtacccg

SEQ ID NO: 377436 - DNA, 25 bp, Mus musculus
agcccgcttcgaccactatccctaa

SEQ ID NO: 377437 - DNA, 25 bp, Mus musculus
gactagccgactcggccggctttta

SEQ ID NO: 377438 - DNA, 25 bp, Mus musculus
tcggccggcttttaaatgtccatta

SEQ ID NO: 377439 - DNA, 25 bp, Mus musculus
atgtccattagactgggcgtgcgcc

SEQ ID NO: 377440 - DNA, 25 bp, Mus musculus
gaatccgaacactcgcgcctcggtg

SEQ ID NO: 377441 - DNA, 25 bp, Mus musculus
atcctgaagggatccggaccgcaac

SEQ ID NO: 377442 - DNA, 25 bp, Mus musculus
ccggctggaggtcagtgacaatcca

SEQ ID NO: 377443 - DNA, 25 bp, Mus musculus
cgaatctggactagccgactcggcc

SEQ ID NO: 377444 - DNA, 25 bp, Mus musculus
tggcggtggcgacgcacagcatcct

SEQ ID NO: 377445 - DNA, 25 bp, Mus musculus
cccggagcctcgctgcagggataca

SEQ ID NO: 377446 - DNA, 25 bp, Mus musculus
cctcgctgcagggatacaggagttt

SEQ ID NO: 377447 - DNA, 25 bp, Mus musculus
agtttgcactcagggtgtctcctcc

SEQ ID NO: 377448 - DNA, 25 bp, Mus musculus
tctcctccgggcttcgcagtgcaga

SEQ ID NO: 377449 - DNA, 25 bp, Mus musculus
ggtcagtgacaatccagcctccagc

SEQ ID NO: 377450 - DNA, 25 bp, Mus musculus
ctcgctttcgcgagcggaacgcgtc

SEQ ID NO: 377451 - DNA, 25 bp, Mus musculus
gaatggcatcacgtggcgcgcctgc

SEQ ID NO: 377452 - DNA, 25 bp, Mus musculus
cgcgtatccattggctggccggaca

SEQ ID NO: 377453 - DNA, 25 bp, Mus musculus
ctgcgttacgcgtatccattggctg

SEQ ID NO: 377454 - DNA, 25 bp, Mus musculus
cattcgaaattctgcgttacgcgta

SEQ ID NO: 377455 - DNA, 25 bp, Mus musculus
agctaccgccgccacattcgaaatt

SEQ ID NO: 377456 - DNA, 25 bp, Mus musculus
ggacgagcagatgcaacctcccgct

SEQ ID NO: 377457 - DNA, 25 bp, Mus musculus
tccggtcggagagatacctccagtc

SEQ ID NO: 377458 - DNA, 25 bp, Mus musculus
aagccctgtcgatttcggggtgctc

SEQ ID NO: 377459 - DNA, 25 bp, Mus musculus
ctttgattgagcaaaagccctgtcg

SEQ ID NO: 377460 - DNA, 25 bp, Mus musculus
gacagtgcaagtcggcgagaacacc

SEQ ID NO: 377461 - DNA, 25 bp, Mus musculus
gccttgtgcgtgctagacagtgcaa

SEQ ID NO: 377462 - DNA, 25 bp, Mus musculus
cacagtgggatggaaatcgggcctt

SEQ ID NO: 377463 - DNA, 25 bp, Mus musculus
tcggccactcaggtccggacgagca

SEQ ID NO: 377464 - DNA, 25 bp, Mus musculus
gtctctgacagagcaactccgaagc

SEQ ID NO: 377465 - DNA, 25 bp, Mus musculus
gtggtccagtcgaggtcccgacctc

SEQ ID NO: 377466 - DNA, 25 bp, Mus musculus
ccaagtccgccgctacagccagccc

SEQ ID NO: 377467 - DNA, 25 bp, Mus musculus
tcctccgcgaggatactcagccttt

SEQ ID NO: 377468 - DNA, 25 bp, Mus musculus
tccgcgaggatactcagcctttctc

SEQ ID NO: 377469 - DNA, 25 bp, Mus musculus
cgaggatactcagcctttctctgtc

SEQ ID NO: 377470 - DNA, 25 bp, Mus musculus
acagtggtccagtcgaggtcccgac

SEQ ID NO: 377471 - DNA, 25 bp, Mus musculus
tgctcgcggtctctgacagagcaac

SEQ ID NO: 377472 - DNA, 25 bp, Mus musculus
agagcaactccgaagccaagtccgc

SEQ ID NO: 377473 - DNA, 25 bp, Mus musculus
tggtcctgctgctcccggaatcccg

SEQ ID NO: 377474 - DNA, 25 bp, Mus musculus
ccatcatccgggcttgtccgtccca

SEQ ID NO: 377475 - DNA, 25 bp, Mus musculus
gcttgtccgtcccacctgcgtccca

SEQ ID NO: 377476 - DNA, 25 bp, Mus musculus
ctcctgagcgcctcttctctccctt

SEQ ID NO: 377477 - DNA, 25 bp, Mus musculus
cggccacagtggtccagtcgaggtc

SEQ ID NO: 377478 - DNA, 25 bp, Mus musculus
ttacctttgcgtcacccggagctgc

SEQ ID NO: 377479 - DNA, 25 bp, Mus musculus
cgatcgtcagagctctggagaagga

SEQ ID NO: 377480 - DNA, 25 bp, Mus musculus
agtctctttataagggcggaaggcg

SEQ ID NO: 377481 - DNA, 25 bp, Mus musculus
atctgggtattggaaaaagtctctt

SEQ ID NO: 377482 - DNA, 25 bp, Mus musculus
aagcgatcgatctgggtattggaaa

SEQ ID NO: 377483 - DNA, 25 bp, Mus musculus
caaggagcccgatgaggactccgag

SEQ ID NO: 377484 - DNA, 25 bp, Mus musculus
tggccctagctcttgttcccgtagg

SEQ ID NO: 377485 - DNA, 25 bp, Mus musculus
cacccggagctgctttaggggtcca

SEQ ID NO: 377486 - DNA, 25 bp, Mus musculus
ggctcttacctttgcgtcacccgga

SEQ ID NO: 377487 - DNA, 25 bp, Mus musculus
ccgtagggctcttacctttgcgtca

SEQ ID NO: 377488 - DNA, 25 bp, Mus musculus
ctctggagaaggacgtcagaacaaa

SEQ ID NO: 377489 - DNA, 25 bp, Mus musculus
acgtcagaacaaagtggtgctgggc

SEQ ID NO: 377490 - DNA, 25 bp, Mus musculus
agggtgtggccctagctcttgttcc

SEQ ID NO: 377491 - DNA, 25 bp, Mus musculus
ctccggcaaggagcccgatgaggac

SEQ ID NO: 377492 - DNA, 25 bp, Mus musculus
cggctgggattagcacgccttttta

SEQ ID NO: 377493 - DNA, 25 bp, Mus musculus
ttccagaggccaccaccgggacatt

SEQ ID NO: 377494 - DNA, 25 bp, Mus musculus
agcagaagccattcggggagccctt

SEQ ID NO: 377495 - DNA, 25 bp, Mus musculus
actgccacgcggattggaacaatga

SEQ ID NO: 377496 - DNA, 25 bp, Mus musculus
cggagtctgcaatcgctgtacgaca

SEQ ID NO: 377497 - DNA, 25 bp, Mus musculus
tcgctgtacgacaggcaggctctgc

SEQ ID NO: 377498 - DNA, 25 bp, Mus musculus
cagcgcctagccagcaggtaagctc

SEQ ID NO: 377499 - DNA, 25 bp, Mus musculus
gtaagctcgggctgtagatcggaac

SEQ ID NO: 377500 - DNA, 25 bp, Mus musculus
gagctgagcgcagccacgcactgct

SEQ ID NO: 377501 - DNA, 25 bp, Mus musculus
gcaacgcggtcatgccttgtcggaa

SEQ ID NO: 377502 - DNA, 25 bp, Mus musculus
ccttgtcggaaaggagacggctcct

SEQ ID NO: 377503 - DNA, 25 bp, Mus musculus
acggctcctacacagggtcgcctga

SEQ ID NO: 377504 - DNA, 25 bp, Mus musculus
tgccaggtacttggagcagaagcca

SEQ ID NO: 377505 - DNA, 25 bp, Mus musculus
acgcactgctgagaggccaagctgc

SEQ ID NO: 377506 - DNA, 25 bp, Mus musculus
ctgctgtgtgagatgcgcagacgtg

SEQ ID NO: 377507 - DNA, 25 bp, Mus musculus
ggcggcctctggtaccaggtgtacc

SEQ ID NO: 377508 - DNA, 25 bp, Mus musculus
gtgaagctacacgtacagggccgga

SEQ ID NO: 377509 - DNA, 25 bp, Mus musculus
cgcgcctgcagaaggccatgcgtta

SEQ ID NO: 377510 - DNA, 25 bp, Mus musculus
tgcacccgcgcggtctgagcagctg

SEQ ID NO: 377511 - DNA, 25 bp, Mus musculus
caggtgtacctctgagccagttgca

SEQ ID NO: 377512 - DNA, 25 bp, Mus musculus
ttggacggcagagaggcgcccttct

SEQ ID NO: 377513 - DNA, 25 bp, Mus musculus
gctacacgtacagggccggagctgc

SEQ ID NO: 377514 - DNA, 25 bp, Mus musculus
gggtcggcgtgaagctacacgtaca

SEQ ID NO: 377515 - DNA, 25 bp, Mus musculus
aacaagcatggtgtgcgcttccgca

SEQ ID NO: 377516 - DNA, 25 bp, Mus musculus
atgtccttcaacaagcatggtgtgc

SEQ ID NO: 377517 - DNA, 25 bp, Mus musculus
gccatgcgttactacatgtccttca

SEQ ID NO: 377518 - DNA, 25 bp, Mus musculus
ctgcagaaggccatgcgttactaca

SEQ ID NO: 377519 - DNA, 25 bp, Mus musculus
tgagccagttgcacccgcgcggtct

SEQ ID NO: 377520 - DNA, 25 bp, Mus musculus
aacacagcgggttatcgctgccgcc

SEQ ID NO: 377521 - DNA, 25 bp, Mus musculus
agacgcgacttcgacttccggagcc

SEQ ID NO: 377522 - DNA, 25 bp, Mus musculus
tcccataacaaaagcgaaaggcagg

SEQ ID NO: 377523 - DNA, 25 bp, Mus musculus
ttgctcgtgcttcccataacaaaag

SEQ ID NO: 377524 - DNA, 25 bp, Mus musculus
ttccgcccgctttttgctcgtgctt

SEQ ID NO: 377525 - DNA, 25 bp, Mus musculus
ttccggagccgtgggacacacgcat

SEQ ID NO: 377526 - DNA, 25 bp, Mus musculus
ctttttcaacctgcagagacgcgac

SEQ ID NO: 377527 - DNA, 25 bp, Mus musculus
gatcccggcaactttttcaacctgc

SEQ ID NO: 377528 - DNA, 25 bp, Mus musculus
tcacagaacaccgaggatcccggca

SEQ ID NO: 377529 - DNA, 25 bp, Mus musculus
accctagcgttcagtacctcacaga

SEQ ID NO: 377530 - DNA, 25 bp, Mus musculus
aactccaacaccctagcgttcagta

SEQ ID NO: 377531 - DNA, 25 bp, Mus musculus
gcatagcgcactttctctacaacta

SEQ ID NO: 377532 - DNA, 25 bp, Mus musculus
cgacctccagcgattacaccaagaa

SEQ ID NO: 377533 - DNA, 25 bp, Mus musculus
agcgattacaccaagaactccaaca

SEQ ID NO: 377534 - DNA, 25 bp, Mus musculus
caaacgcaatcacgccgggcggcga

SEQ ID NO: 377535 - DNA, 25 bp, Mus musculus
gcctccctcagacccgagcccgaac

SEQ ID NO: 377536 - DNA, 25 bp, Mus musculus
tcaggtgaacaaacgcaatcacgcc

SEQ ID NO: 377537 - DNA, 25 bp, Mus musculus
ggacctcaggtgaacaaacgcaatc

SEQ ID NO: 377538 - DNA, 25 bp, Mus musculus
tgcagggacctcaggtgaacaaacg

SEQ ID NO: 377539 - DNA, 25 bp, Mus musculus
ttccgctccggaggtgcagggacct

SEQ ID NO: 377540 - DNA, 25 bp, Mus musculus
cagcccgggatcgaagtcagacgtc

SEQ ID NO: 377541 - DNA, 25 bp, Mus musculus
gcgcagcccgggatcgaagtcagac

SEQ ID NO: 377542 - DNA, 25 bp, Mus musculus
catggcgtggagaccgagctcgccc

SEQ ID NO: 377543 - DNA, 25 bp, Mus musculus
tgaacaaacgcaatcacgccgggcg

SEQ ID NO: 377544 - DNA, 25 bp, Mus musculus
gctcaccatggcgtggagaccgagc

SEQ ID NO: 377545 - DNA, 25 bp, Mus musculus
tattagggaacggaagtgctctccc

SEQ ID NO: 377546 - DNA, 25 bp, Mus musculus
tgctctccccattctggctagcgga

SEQ ID NO: 377547 - DNA, 25 bp, Mus musculus
ttagtattagggaacggaagtgctc

SEQ ID NO: 377548 - DNA, 25 bp, Mus musculus
ggggcgagctcggtctccacgccat

SEQ ID NO: 377549 - DNA, 25 bp, Mus musculus
gtctgacttcgatcccgggctgcgc

SEQ ID NO: 377550 - DNA, 25 bp, Mus musculus
gacgtctgacttcgatcccgggctg

SEQ ID NO: 377551 - DNA, 25 bp, Mus musculus
aggtccctgcacctccggagcggaa

SEQ ID NO: 377552 - DNA, 25 bp, Mus musculus
ttgttcacctgaggtccctgcacct

SEQ ID NO: 377553 - DNA, 25 bp, Mus musculus
cgtttgttcacctgaggtccctgca

SEQ ID NO: 377554 - DNA, 25 bp, Mus musculus
tgattgcgtttgttcacctgaggtc

SEQ ID NO: 377555 - DNA, 25 bp, Mus musculus
attgcgtttgttcacctgaggtccc

SEQ ID NO: 377556 - DNA, 25 bp, Mus musculus
ggcgtgattgcgtttgttcacctga

SEQ ID NO: 377557 - DNA, 25 bp, Mus musculus
cccggcgtgattgcgtttgttcacc

SEQ ID NO: 377558 - DNA, 25 bp, Mus musculus
tcgccgcccggcgtgattgcgtttg

SEQ ID NO: 377559 - DNA, 25 bp, Mus musculus
gctcggtctccacgccatggtgagc

SEQ ID NO: 377560 - DNA, 25 bp, Mus musculus
gcgagctcggtctccacgccatggt

SEQ ID NO: 377561 - DNA, 25 bp, Mus musculus
tgcgtttgttcacctgaggtccctg

SEQ ID NO: 377562 - DNA, 25 bp, Mus musculus
ccgctccggaggtgcagggacctca

SEQ ID NO: 377563 - DNA, 25 bp, Mus musculus
gcgcagcccgggatcgaagtcagac

SEQ ID NO: 377564 - DNA, 25 bp, Mus musculus
catggcgtggagaccgagctcgccc

SEQ ID NO: 377565 - DNA, 25 bp, Mus musculus
tcaccatggcgtggagaccgagctc

SEQ ID NO: 377566 - DNA, 25 bp, Mus musculus
gctcaccatggcgtggagaccgagc

SEQ ID NO: 377567 - DNA, 25 bp, Mus musculus
caaacgcaatcacgccgggcggcga

SEQ ID NO: 377568 - DNA, 25 bp, Mus musculus
tgaacaaacgcaatcacgccgggcg

SEQ ID NO: 377569 - DNA, 25 bp, Mus musculus
ggacctcaggtgaacaaacgcaatc

SEQ ID NO: 377570 - DNA, 25 bp, Mus musculus
cagggacctcaggtgaacaaacgca

SEQ ID NO: 377571 - DNA, 25 bp, Mus musculus
tgcagggacctcaggtgaacaaacg

SEQ ID NO: 377572 - DNA, 25 bp, Mus musculus
aggtgcagggacctcaggtgaacaa

SEQ ID NO: 377573 - DNA, 25 bp, Mus musculus
cttccgctccggaggtgcagggacc

SEQ ID NO: 377574 - DNA, 25 bp, Mus musculus
tcaggtgaacaaacgcaatcacgcc

SEQ ID NO: 377575 - DNA, 25 bp, Mus musculus
cagcccgggatcgaagtcagacgtc

SEQ ID NO: 377576 - DNA, 25 bp, Mus musculus
tcccggacatcttctctctcaagta

SEQ ID NO: 377577 - DNA, 25 bp, Mus musculus
ctaccggcgccgaggagcctctcac

SEQ ID NO: 377578 - DNA, 25 bp, Mus musculus
ggacatcttctctctcaagtaccga

SEQ ID NO: 377579 - DNA, 25 bp, Mus musculus
ggagcctctcacttccgccaggtga

SEQ ID NO: 377580 - DNA, 25 bp, Mus musculus
gcttcctggcccttcccggacatct

SEQ ID NO: 377581 - DNA, 25 bp, Mus musculus
gtgctctggcatccccctgcttcct

SEQ ID NO: 377582 - DNA, 25 bp, Mus musculus
cagtcaagccggaccctccggaagg

SEQ ID NO: 377583 - DNA, 25 bp, Mus musculus
ggtcctgctcccaccagtcaagccg

SEQ ID NO: 377584 - DNA, 25 bp, Mus musculus
tctctctcaagtaccgactccgcta

SEQ ID NO: 377585 - DNA, 25 bp, Mus musculus
aggagcctctcacttccgccaggtg

SEQ ID NO: 377586 - DNA, 25 bp, Mus musculus
taccgactccgctaccggcgccgag

SEQ ID NO: 377587 - DNA, 25 bp, Mus musculus
gaggagcctctcacttccgccaggt

SEQ ID NO: 377588 - DNA, 25 bp, Mus musculus
acatcttctctctcaagtaccgact

SEQ ID NO: 377589 - DNA, 25 bp, Mus musculus
tcaagtaccgactccgctaccggcg

SEQ ID NO: 377590 - DNA, 25 bp, Mus musculus
aggcaccaaccagtgagccggctta

SEQ ID NO: 377591 - DNA, 25 bp, Mus musculus
tcgctggacaggaagcgaaaatgtc

SEQ ID NO: 377592 - DNA, 25 bp, Mus musculus
cgcttcttcgcttgttcgctggaca

SEQ ID NO: 377593 - DNA, 25 bp, Mus musculus
ccgtagactgaggaccgcttcttcg

SEQ ID NO: 377594 - DNA, 25 bp, Mus musculus
ctgaggcgctgaatcggagaaactc

SEQ ID NO: 377595 - DNA, 25 bp, Mus musculus
ccggcttaggaagtggcgacactga

SEQ ID NO: 377596 - DNA, 25 bp, Mus musculus
ttccggtcatttccttttgcaagcc

SEQ ID NO: 377597 - DNA, 25 bp, Mus musculus
tcccgactcggatcgacaaagattg

SEQ ID NO: 377598 - DNA, 25 bp, Mus musculus
gcgaggcgtgcttccttccggtcat

SEQ ID NO: 377599 - DNA, 25 bp, Mus musculus
gctcagagtctaaatgttcctacag

SEQ ID NO: 377600 - DNA, 25 bp, Mus musculus
gttttaaacgtaagtgctcagagtc

SEQ ID NO: 377601 - DNA, 25 bp, Mus musculus
acgatgaagcgggtaggcaccaacc

SEQ ID NO: 377602 - DNA, 25 bp, Mus musculus
aagattgcagccaatgagaacgatg

SEQ ID NO: 377603 - DNA, 25 bp, Mus musculus
ggaacggaagcgcactcccgactcg

SEQ ID NO: 377604 - DNA, 25 bp, Mus musculus
ccggagccacagaaggtctgaggtc

SEQ ID NO: 377605 - DNA, 25 bp, Mus musculus
cgcccaatccctgcccggccctggt

SEQ ID NO: 377606 - DNA, 25 bp, Mus musculus
tcgcccggcacaaagcgacggacgg

SEQ ID NO: 377607 - DNA, 25 bp, Mus musculus
cacaaagcgacggacggacgcagcg

SEQ ID NO: 377608 - DNA, 25 bp, Mus musculus
agcggtgacggacgacgcctcccgc

SEQ ID NO: 377609 - DNA, 25 bp, Mus musculus
gatgctcgggcctctcgcccaatcc

SEQ ID NO: 377610 - DNA, 25 bp, Mus musculus
ggtctgtccgcaaggcgggacccaa

SEQ ID NO: 377611 - DNA, 25 bp, Mus musculus
agggtccgagtcctgctgtctccac

SEQ ID NO: 377612 - DNA, 25 bp, Mus musculus
acagaaggtctgaggtctgcaggtc

SEQ ID NO: 377613 - DNA, 25 bp, Mus musculus
ctgaggtctgcaggtctgtccgcaa

SEQ ID NO: 377614 - DNA, 25 bp, Mus musculus
cggccctggtcccaagggcaactcg

SEQ ID NO: 377615 - DNA, 25 bp, Mus musculus
ctccgggatcctccagggtccgagt

SEQ ID NO: 377616 - DNA, 25 bp, Mus musculus
tccgcaaggcgggacccaatgggac

SEQ ID NO: 377617 - DNA, 25 bp, Mus musculus
gacccaatgggacgcgggtgttctc

SEQ ID NO: 377618 - DNA, 25 bp, Mus musculus
atggtccagaatcccgcggctctga

SEQ ID NO: 377619 - DNA, 25 bp, Mus musculus
aggtttcgcctgcactcatggtcca

SEQ ID NO: 377620 - DNA, 25 bp, Mus musculus
ctcgctggtcctgaaggtttcgcct

SEQ ID NO: 377621 - DNA, 25 bp, Mus musculus
gcctagaaagcctcgctggtcctga

SEQ ID NO: 377622 - DNA, 25 bp, Mus musculus
ctgcacgaatcaggtagtggccagc

SEQ ID NO: 377623 - DNA, 25 bp, Mus musculus
acacttgttctctgtgcggcgtccg

SEQ ID NO: 377624 - DNA, 25 bp, Mus musculus
gggtctcacgggctgagcctagaaa

SEQ ID NO: 377625 - DNA, 25 bp, Mus musculus
cgttcgtccctctgaggagttccga

SEQ ID NO: 377626 - DNA, 25 bp, Mus musculus
gtccgaatctaatttaggggatatg

SEQ ID NO: 377627 - DNA, 25 bp, Mus musculus
agttcccgagaagctgaggtgaccg

SEQ ID NO: 377628 - DNA, 25 bp, Mus musculus
ggtgcaattcctgcccgtggctttc

SEQ ID NO: 377629 - DNA, 25 bp, Mus musculus
ctgcctgtcagtcagggtgcaattc

SEQ ID NO: 377630 - DNA, 25 bp, Mus musculus
gaatccgccaattgacagacagctg

SEQ ID NO: 377631 - DNA, 25 bp, Mus musculus
tccgaggctgactgacaggagaatc

SEQ ID NO: 377632 - DNA, 25 bp, Mus musculus
agcaggttcccgcactctgggtagc

SEQ ID NO: 377633 - DNA, 25 bp, Mus musculus
gcactctgggtagcgctccaggagc

SEQ ID NO: 377634 - DNA, 25 bp, Mus musculus
tcagaggccacacaccggccaccgc

SEQ ID NO: 377635 - DNA, 25 bp, Mus musculus
gcccacactgtactaggcctcagag

SEQ ID NO: 377636 - DNA, 25 bp, Mus musculus
gagagccacgcaggcccacactgta

SEQ ID NO: 377637 - DNA, 25 bp, Mus musculus
atggagagagccacgcaggcccaca

SEQ ID NO: 377638 - DNA, 25 bp, Mus musculus
acctgggcgaccacgcacgggagat

SEQ ID NO: 377639 - DNA, 25 bp, Mus musculus
aagaaagcacctgggcgaccacgca

SEQ ID NO: 377640 - DNA, 25 bp, Mus musculus
acctgaagaaagcacctgggcgacc

SEQ ID NO: 377641 - DNA, 25 bp, Mus musculus
gccaggccgcagaagcaggttcccg

SEQ ID NO: 377642 - DNA, 25 bp, Mus musculus
gcctcgagcctgctcacctgaagaa

SEQ ID NO: 377643 - DNA, 25 bp, Mus musculus
cgcagaagcaggttcccgcactctg

SEQ ID NO: 377644 - DNA, 25 bp, Mus musculus
aggttcccgcactctgggtagcgct

SEQ ID NO: 377645 - DNA, 25 bp, Mus musculus
ctgctcacctgaagaaagcacctgg

SEQ ID NO: 377646 - DNA, 25 bp, Mus musculus
gagtctctgtctcccggggccacgg

SEQ ID NO: 377647 - DNA, 25 bp, Mus musculus
cgggtgctgctcaaagacgagctgc

SEQ ID NO: 377648 - DNA, 25 bp, Mus musculus
ggggtgctatccatctactacctgg

SEQ ID NO: 377649 - DNA, 25 bp, Mus musculus
gccagttgctatttcgctgcagctc

SEQ ID NO: 377650 - DNA, 25 bp, Mus musculus
aaattgcaccggatcgctccaactc

SEQ ID NO: 377651 - DNA, 25 bp, Mus musculus
ggatcgctccaactccagtgcaagc

SEQ ID NO: 377652 - DNA, 25 bp, Mus musculus
tccatctactacctggtgagcgacc

SEQ ID NO: 377653 - DNA, 25 bp, Mus musculus
gctgtgccgggacacagcgtccatg

SEQ ID NO: 377654 - DNA, 25 bp, Mus musculus
agtaaccaatagactgctgtgtccc

SEQ ID NO: 377655 - DNA, 25 bp, Mus musculus
cccgttcactcggaggaggctgtgc

SEQ ID NO: 377656 - DNA, 25 bp, Mus musculus
tatttcgctgcagctcccgagtctc

SEQ ID NO: 377657 - DNA, 25 bp, Mus musculus
acgcgacctctgcagccagttgcta

SEQ ID NO: 377658 - DNA, 25 bp, Mus musculus
cacagcgtccatggcaggtaggatg

SEQ ID NO: 377659 - DNA, 25 bp, Mus musculus
cccacccattttcagtaaccaatag

SEQ ID NO: 377660 - DNA, 25 bp, Mus musculus
gctcgccttgtagaactgcttcttc

SEQ ID NO: 377661 - DNA, 25 bp, Mus musculus
ctagcccaagggaagccagctcggc

SEQ ID NO: 377662 - DNA, 25 bp, Mus musculus
aagccagctcggctcgtctgcggtc

SEQ ID NO: 377663 - DNA, 25 bp, Mus musculus
aaaggcaggcccgagaccagatcgc

SEQ ID NO: 377664 - DNA, 25 bp, Mus musculus
gcctcacctggctcgccttgtagaa

SEQ ID NO: 377665 - DNA, 25 bp, Mus musculus
aaccgacttctttcctccgcgcgca

SEQ ID NO: 377666 - DNA, 25 bp, Mus musculus
cgcggccgggatattacatggcaac

SEQ ID NO: 377667 - DNA, 25 bp, Mus musculus
cgggatattacatggcaaccgcaca

SEQ ID NO: 377668 - DNA, 25 bp, Mus musculus
tggcaaccgcacacttccggtgacg

SEQ ID NO: 377669 - DNA, 25 bp, Mus musculus
gaaaccctcccacaccaacgagatg

SEQ ID NO: 377670 - DNA, 25 bp, Mus musculus
ggcgcctagagaggccagaaatctg

SEQ ID NO: 377671 - DNA, 25 bp, Mus musculus
ccagaaatctgtgtacgtgcgcgtg

SEQ ID NO: 377672 - DNA, 25 bp, Mus musculus
cggtgtccctcttcaaagcacgggg

SEQ ID NO: 377673 - DNA, 25 bp, Mus musculus
gccaccgccaaatcagcttgccagc

SEQ ID NO: 377674 - DNA, 25 bp, Mus musculus
ctcccgcgggattttctagcacata

SEQ ID NO: 377675 - DNA, 25 bp, Mus musculus
aggagcggatccaagcctaagtggc

SEQ ID NO: 377676 - DNA, 25 bp, Mus musculus
tgaaactgcctaaaggagcggatcc

SEQ ID NO: 377677 - DNA, 25 bp, Mus musculus
ttcccgccaaatacgagcgcggcgg

SEQ ID NO: 377678 - DNA, 25 bp, Mus musculus
tggttgccgcggttcccgccaaata

SEQ ID NO: 377679 - DNA, 25 bp, Mus musculus
aaggagccttcatccgcctcccgcg

SEQ ID NO: 377680 - DNA, 25 bp, Mus musculus
gtgacgcaagctcctccaatcggcg

SEQ ID NO: 377681 - DNA, 25 bp, Mus musculus
aggtgtcacgtgacgcaagctcctc

SEQ ID NO: 377682 - DNA, 25 bp, Mus musculus
ctctttttccggaggctgaggtgtc

SEQ ID NO: 377683 - DNA, 25 bp, Mus musculus
tgagtgcacctctttttccggaggc

SEQ ID NO: 377684 - DNA, 25 bp, Mus musculus
tcgcgaggacgtactgagtgcacct

SEQ ID NO: 377685 - DNA, 25 bp, Mus musculus
cgaagttctcgcgaggacgtactga

SEQ ID NO: 377686 - DNA, 25 bp, Mus musculus
atccaagcctaagtggcctcggggc

SEQ ID NO: 377687 - DNA, 25 bp, Mus musculus
ttctagcacataaaccgaagttctc

SEQ ID NO: 377688 - DNA, 25 bp, Mus musculus
cctgcggaatccgtaagcttctggc

SEQ ID NO: 377689 - DNA, 25 bp, Mus musculus
caccaatctactcctgctaagcata

SEQ ID NO: 377690 - DNA, 25 bp, Mus musculus
aaccagcgtcacataccctgcggaa

SEQ ID NO: 377691 - DNA, 25 bp, Mus musculus
gctcttgaacttgatgtcagccttg

SEQ ID NO: 377692 - DNA, 25 bp, Mus musculus
cttgatttcctggaagaacttcttc

SEQ ID NO: 377693 - DNA, 25 bp, Mus musculus
gaagaacttcttcatggcggcagcg

SEQ ID NO: 377694 - DNA, 25 bp, Mus musculus
agcaggcggccaaccaccggaaaga

SEQ ID NO: 377695 - DNA, 25 bp, Mus musculus
aatatcgcggcgacggaagtcccgc

SEQ ID NO: 377696 - DNA, 25 bp, Mus musculus
gaagtcccgcctggttcacgtgaca

SEQ ID NO: 377697 - DNA, 25 bp, Mus musculus
ttcacgtgacaatcgccttgcagca

SEQ ID NO: 377698 - DNA, 25 bp, Mus musculus
gggcgccatcttcctgtctgcggac

SEQ ID NO: 377699 - DNA, 25 bp, Mus musculus
gggcgacaggctcgcctcccttaag

SEQ ID NO: 377700 - DNA, 25 bp, Mus musculus
caaccaccggaaagaaaatatcgcg

SEQ ID NO: 377701 - DNA, 25 bp, Mus musculus
agcatagcctagaaagaccctgaca

SEQ ID NO: 377702 - DNA, 25 bp, Mus musculus
cgtctaattcgtctaatgcccttca

SEQ ID NO: 377703 - DNA, 25 bp, Mus musculus
cccaataagtagacgccggccggcg

SEQ ID NO: 377704 - DNA, 25 bp, Mus musculus
ccggtcgtgctgaacccaataagta

SEQ ID NO: 377705 - DNA, 25 bp, Mus musculus
ggacttccggtcgtgctgaacccaa

SEQ ID NO: 377706 - DNA, 25 bp, Mus musculus
cgcgtctctgtggtcatgagcgacg

SEQ ID NO: 377707 - DNA, 25 bp, Mus musculus
atcccgttaactagctctgatccaa

SEQ ID NO: 377708 - DNA, 25 bp, Mus musculus
tctgctccgttatccaatcccgtta

SEQ ID NO: 377709 - DNA, 25 bp, Mus musculus
actggctcctagtccacgcccttgg

SEQ ID NO: 377710 - DNA, 25 bp, Mus musculus
taggctccacccagtagccgcttaa

SEQ ID NO: 377711 - DNA, 25 bp, Mus musculus
cgttttgcgtctaattcgtctaatg

SEQ ID NO: 377712 - DNA, 25 bp, Mus musculus
tcaagcccggggacttggtgtttgc

SEQ ID NO: 377713 - DNA, 25 bp, Mus musculus
gggacttggtgtttgccaagatgaa

SEQ ID NO: 377714 - DNA, 25 bp, Mus musculus
cagtagccgcttaaacctttcgtct

SEQ ID NO: 377715 - DNA, 25 bp, Mus musculus
gacagcatgccgcacgccttcaagc

SEQ ID NO: 377716 - DNA, 25 bp, Mus musculus
ccgaccaactggttgtcattcagga

SEQ ID NO: 377717 - DNA, 25 bp, Mus musculus
aacatcttgtttcggttggcgacca

SEQ ID NO: 377718 - DNA, 25 bp, Mus musculus
aggtccgccaggttcttgtcacaga

SEQ ID NO: 377719 - DNA, 25 bp, Mus musculus
agatccaacatatccaggtgctgta

SEQ ID NO: 377720 - DNA, 25 bp, Mus musculus
cagcgcgtgtcgttctgtgagaaca

SEQ ID NO: 377721 - DNA, 25 bp, Mus musculus
tcattcaggaacaggacgcgcagga

SEQ ID NO: 377722 - DNA, 25 bp, Mus musculus
agcgactccagcaggttgtacccaa

SEQ ID NO: 377723 - DNA, 25 bp, Mus musculus
agggcagcgaactcagctggttctc

SEQ ID NO: 377724 - DNA, 25 bp, Mus musculus
ctggttctccgccaggtccaagtgg

SEQ ID NO: 377725 - DNA, 25 bp, Mus musculus
aggccctgaagccattgcgcgctca

SEQ ID NO: 377726 - DNA, 25 bp, Mus musculus
ttctccctcaggaccagggtgctca

SEQ ID NO: 377727 - DNA, 25 bp, Mus musculus
cagctgcgtcaggttggagaattcc

SEQ ID NO: 377728 - DNA, 25 bp, Mus musculus
attccaccgacagatggacagtgtc

SEQ ID NO: 377729 - DNA, 25 bp, Mus musculus
atgtcgaagccgtcctgcatgtcgc

SEQ ID NO: 377730 - DNA, 25 bp, Mus musculus
ttcgccttccacgtatgacggtctc

SEQ ID NO: 377731 - DNA, 25 bp, Mus musculus
gtgcggcggatctcccacaaccatg

SEQ ID NO: 377732 - DNA, 25 bp, Mus musculus
acaaccatgcccgaggtcgcggata

SEQ ID NO: 377733 - DNA, 25 bp, Mus musculus
gtcgcggatacttgctccttggctt

SEQ ID NO: 377734 - DNA, 25 bp, Mus musculus
tccatcttcgctgcagcgtcgactt

SEQ ID NO: 377735 - DNA, 25 bp, Mus musculus
ttcgctgcagcgtcgacttcgctcg

SEQ ID NO: 377736 - DNA, 25 bp, Mus musculus
ttcgctcgccggacgctgaccggga

SEQ ID NO: 377737 - DNA, 25 bp, Mus musculus
cgctcacggtccagtcacaggagga

SEQ ID NO: 377738 - DNA, 25 bp, Mus musculus
tcacaggaggagaatctgcgcagcc

SEQ ID NO: 377739 - DNA, 25 bp, Mus musculus
gggcgtctgtgcagcgccgcttctc

SEQ ID NO: 377740 - DNA, 25 bp, Mus musculus
cgcgagccctgagatcgctggcctt

SEQ ID NO: 377741 - DNA, 25 bp, Mus musculus
agatcgctggccttccctcttgtac

SEQ ID NO: 377742 - DNA, 25 bp, Mus musculus
ttttacatcagcactctctccttcg

SEQ ID NO: 377743 - DNA, 25 bp, Mus musculus
ccgctctcgggctcgcggtgaaagt

SEQ ID NO: 377744 - DNA, 25 bp, Mus musculus
cgaaccagcctacactgaagccgga

SEQ ID NO: 377745 - DNA, 25 bp, Mus musculus
ccacgcgcgtgggtgaggaacaaac

SEQ ID NO: 377746 - DNA, 25 bp, Mus musculus
ccactcggcgccagtagggctcggt

SEQ ID NO: 377747 - DNA, 25 bp, Mus musculus
cctcgccgctgttgaatgtgtgtgt

SEQ ID NO: 377748 - DNA, 25 bp, Mus musculus
tccaggtcgtgagggccaccatgca

SEQ ID NO: 377749 - DNA, 25 bp, Mus musculus
caccatgcagcagcgctgcctttgt

SEQ ID NO: 377750 - DNA, 25 bp, Mus musculus
tgcctttgtccagccattctgcata

SEQ ID NO: 377751 - DNA, 25 bp, Mus musculus
ccattctgcataagcggggccagca

SEQ ID NO: 377752 - DNA, 25 bp, Mus musculus
tcgcctagtcggctcacgctcagaa

SEQ ID NO: 377753 - DNA, 25 bp, Mus musculus
agtcggctcacgctcagaactgcct

SEQ ID NO: 377754 - DNA, 25 bp, Mus musculus
acgctgccaccgaggacgtcactag

SEQ ID NO: 377755 - DNA, 25 bp, Mus musculus
cgtgcgccagaatggcctccttgtc

SEQ ID NO: 377756 - DNA, 25 bp, Mus musculus
cggacaccacggcacccaccacgaa

SEQ ID NO: 377757 - DNA, 25 bp, Mus musculus
acgaacgctgccaccgaggacgtca

SEQ ID NO: 377758 - DNA, 25 bp, Mus musculus
gcagaccaccaaggagcggagcacg

SEQ ID NO: 377759 - DNA, 25 bp, Mus musculus
caataattcgaagccactgtcagtg

SEQ ID NO: 377760 - DNA, 25 bp, Mus musculus
accacgaaaggtcgcggctatgtgt

SEQ ID NO: 377761 - DNA, 25 bp, Mus musculus
agaccagccggtacccaagagcttg

SEQ ID NO: 377762 - DNA, 25 bp, Mus musculus
cccatgtcagttgcgcggccggcga

SEQ ID NO: 377763 - DNA, 25 bp, Mus musculus
cccagcttagggctgtgctgcagcg

SEQ ID NO: 377764 - DNA, 25 bp, Mus musculus
ggctgccagagacgctcctttgtcc

SEQ ID NO: 377765 - DNA, 25 bp, Mus musculus
atgagccggggccttggctgcaatc

SEQ ID NO: 377766 - DNA, 25 bp, Mus musculus
tccagggaccaatcagcaccgcggt

SEQ ID NO: 377767 - DNA, 25 bp, Mus musculus
cgcccgagctcggagcttcgcaaaa

SEQ ID NO: 377768 - DNA, 25 bp, Mus musculus
ccgtgcatctgtccaaggtgcgtcc

SEQ ID NO: 377769 - DNA, 25 bp, Mus musculus
tgcgtgcatgcccactgcatctgtc

SEQ ID NO: 377770 - DNA, 25 bp, Mus musculus
aagccagtgccgctgcacgaggcgc

SEQ ID NO: 377771 - DNA, 25 bp, Mus musculus
ggagcttcgcaaaacccggagcaga

SEQ ID NO: 377772 - DNA, 25 bp, Mus musculus
ttctcgccctgctccaggcggtaga

SEQ ID NO: 377773 - DNA, 25 bp, Mus musculus
aggctaccgacaccttgtgcacggc

SEQ ID NO: 377774 - DNA, 25 bp, Mus musculus
ccttgtgcacggccggtttgcggcc

SEQ ID NO: 377775 - DNA, 25 bp, Mus musculus
gagattccagtacggattttgggga

SEQ ID NO: 377776 - DNA, 25 bp, Mus musculus
tccaggcggtagagattccagtacg

SEQ ID NO: 377777 - DNA, 25 bp, Mus musculus
ggtccgggcacagcgaagaagactc

SEQ ID NO: 377778 - DNA, 25 bp, Mus musculus
accgcaggagggacagtcggcctca

SEQ ID NO: 377779 - DNA, 25 bp, Mus musculus
caggagggacagtcggcctcaaaga

SEQ ID NO: 377780 - DNA, 25 bp, Mus musculus
gggacagtcggcctcaaagactctg

SEQ ID NO: 377781 - DNA, 25 bp, Mus musculus
gacagtcggcctcaaagactctgga

SEQ ID NO: 377782 - DNA, 25 bp, Mus musculus
agtcggcctcaaagactctggacgg

SEQ ID NO: 377783 - DNA, 25 bp, Mus musculus
caggcggtagagattccagtacgga

SEQ ID NO: 377784 - DNA, 25 bp, Mus musculus
tcggcctcaaagactctggacgggg

SEQ ID NO: 377785 - DNA, 25 bp, Mus musculus
cggtagagattccagtacggatttt

SEQ ID NO: 377786 - DNA, 25 bp, Mus musculus
ggaaagcgcctaggcgagtgaactt

SEQ ID NO: 377787 - DNA, 25 bp, Mus musculus
ctcagcgcagactttgcggagagga

SEQ ID NO: 377788 - DNA, 25 bp, Mus musculus
actttctcagcgcagactttgcgga

SEQ ID NO: 377789 - DNA, 25 bp, Mus musculus
gtgaactttctcagcgcagactttg

SEQ ID NO: 377790 - DNA, 25 bp, Mus musculus
cgagtgaactttctcagcgcagact

SEQ ID NO: 377791 - DNA, 25 bp, Mus musculus
taggcgagtgaactttctcagcgca

SEQ ID NO: 377792 - DNA, 25 bp, Mus musculus
gcgcctaggcgagtgaactttctca

SEQ ID NO: 377793 - DNA, 25 bp, Mus musculus
gagaggaaggtgaaagggaaagcgc

SEQ ID NO: 377794 - DNA, 25 bp, Mus musculus
aagccatcttgaggggcgagaggaa

SEQ ID NO: 377795 - DNA, 25 bp, Mus musculus
cagcggacggggaaagccatcttga

SEQ ID NO: 377796 - DNA, 25 bp, Mus musculus
aagtccagcggacggggaaagccat

SEQ ID NO: 377797 - DNA, 25 bp, Mus musculus
gctcggaggagaacttagggccgga

SEQ ID NO: 377798 - DNA, 25 bp, Mus musculus
agtccgggcgctcggaggagaactt

SEQ ID NO: 377799 - DNA, 25 bp, Mus musculus
gcctaggcgagtgaactttctcagc

SEQ ID NO: 377800 - DNA, 25 bp, Mus musculus
ctcccggtgtccttacagaaacgcg

SEQ ID NO: 377801 - DNA, 25 bp, Mus musculus
gccggatcacccaggacccaccaca

SEQ ID NO: 377802 - DNA, 25 bp, Mus musculus
taggatcggccggatcacccaggac

SEQ ID NO: 377803 - DNA, 25 bp, Mus musculus
cttccgactaggatcggccggatca

SEQ ID NO: 377804 - DNA, 25 bp, Mus musculus
gtgccacttcccttccgactaggat

SEQ ID NO: 377805 - DNA, 25 bp, Mus musculus
tttagctcatgtcccgtgccacttc

SEQ ID NO: 377806 - DNA, 25 bp, Mus musculus
ggccgtatttttagctcatgtcccg

SEQ ID NO: 377807 - DNA, 25 bp, Mus musculus
cagctgtggccgtatttttagctca

SEQ ID NO: 377808 - DNA, 25 bp, Mus musculus
ggagtcagctgtggccgtattttta

SEQ ID NO: 377809 - DNA, 25 bp, Mus musculus
ctttccaccgcaggagtcagctgtg

SEQ ID NO: 377810 - DNA, 25 bp, Mus musculus
gtccttacagaaacgcgacaacgtc

SEQ ID NO: 377811 - DNA, 25 bp, Mus musculus
gcagtcttagtgaaccgggtcaccc

SEQ ID NO: 377812 - DNA, 25 bp, Mus musculus
cggcagtcttagtgaaccgggtcac

SEQ ID NO: 377813 - DNA, 25 bp, Mus musculus
aacgcgacaacgtcccgggcctcag

SEQ ID NO: 377814 - DNA, 25 bp, Mus musculus
catttgctgagccagtgagcgttta

SEQ ID NO: 377815 - DNA, 25 bp, Mus musculus
gcgctaccatttgctgagccagtga

SEQ ID NO: 377816 - DNA, 25 bp, Mus musculus
actgcctgtgcgctaccatttgctg

SEQ ID NO: 377817 - DNA, 25 bp, Mus musculus
ttggctccttcgtacactgcctgtg

SEQ ID NO: 377818 - DNA, 25 bp, Mus musculus
tgccattggctccttcgtacactgc

SEQ ID NO: 377819 - DNA, 25 bp, Mus musculus
tcctggcagaggcttgctgccattg

SEQ ID NO: 377820 - DNA, 25 bp, Mus musculus
tccggaggaatctcccggccgcaga

SEQ ID NO: 377821 - DNA, 25 bp, Mus musculus
cactttcccgccacggcatcccttg

SEQ ID NO: 377822 - DNA, 25 bp, Mus musculus
gcatcccttgcgctgggcacccagc

SEQ ID NO: 377823 - DNA, 25 bp, Mus musculus
ttcgctttggcctctcagatctctg

SEQ ID NO: 377824 - DNA, 25 bp, Mus musculus
ctctcagatctctgtcgcgcggtgc

SEQ ID NO: 377825 - DNA, 25 bp, Mus musculus
tctgtcgcgcggtgcacgtataccc

SEQ ID NO: 377826 - DNA, 25 bp, Mus musculus
tcctagccagcggccgggctcagat

SEQ ID NO: 377827 - DNA, 25 bp, Mus musculus
ccagcgccggcgctattccggagga

SEQ ID NO: 377828 - DNA, 25 bp, Mus musculus
tccgggcctcacgtcaaatggcacg

SEQ ID NO: 377829 - DNA, 25 bp, Mus musculus
ataggcatcgattcccgggcaggag

SEQ ID NO: 377830 - DNA, 25 bp, Mus musculus
cgggcaggaggcttagcacgtaccc

SEQ ID NO: 377831 - DNA, 25 bp, Mus musculus
tcctgggagaacgaatgcacgaccc

SEQ ID NO: 377832 - DNA, 25 bp, Mus musculus
ctcacgtcaaatggcacggtggtgg

SEQ ID NO: 377833 - DNA, 25 bp, Mus musculus
cggcggccaatttcagcgctgcggc

SEQ ID NO: 377834 - DNA, 25 bp, Mus musculus
cgctcgcgaacgtggagtgacacgc

SEQ ID NO: 377835 - DNA, 25 bp, Mus musculus
acgcgcgggacacgtcagcgccgaa

SEQ ID NO: 377836 - DNA, 25 bp, Mus musculus
gtcagcgccgaacggtgacaacgtc

SEQ ID NO: 377837 - DNA, 25 bp, Mus musculus
acgtgatgcactacagcgcctctga

SEQ ID NO: 377838 - DNA, 25 bp, Mus musculus
cgcctctgattgacgctcgcggatg

SEQ ID NO: 377839 - DNA, 25 bp, Mus musculus
cggaagtccataggcatcgattccc

SEQ ID NO: 377840 - DNA, 25 bp, Mus musculus
gtcctacgtcctgggagaacgaatg

SEQ ID NO: 377841 - DNA, 25 bp, Mus musculus
cccgcccgatttggctgccatggtg

SEQ ID NO: 377842 - DNA, 25 bp, Mus musculus
aaatgtagtccgcaaaggaggcgga

SEQ ID NO: 377843 - DNA, 25 bp, Mus musculus
acgctaccctgggtcgtccgcaagg

SEQ ID NO: 377844 - DNA, 25 bp, Mus musculus
cctgctggtcagcaagcctttcgta

SEQ ID NO: 377845 - DNA, 25 bp, Mus musculus
agcaagcctttcgtagaagcccttc

SEQ ID NO: 377846 - DNA, 25 bp, Mus musculus
agcctttcgtagaagcccttcgcct

SEQ ID NO: 377847 - DNA, 25 bp, Mus musculus
ttccacctcgctccggattggctgg

SEQ ID NO: 377848 - DNA, 25 bp, Mus musculus
acctcgctccggattggctgggagt

SEQ ID NO: 377849 - DNA, 25 bp, Mus musculus
attggctgggagttgcctttgttgc

SEQ ID NO: 377850 - DNA, 25 bp, Mus musculus
gttgcctttgttgcccgctgggaaa

SEQ ID NO: 377851 - DNA, 25 bp, Mus musculus
gaggcggaggcccattcatttcctg

SEQ ID NO: 377852 - DNA, 25 bp, Mus musculus
tgcgcgacctcgaaaaccggaagta

SEQ ID NO: 377853 - DNA, 25 bp, Mus musculus
ctcgaaaaccggaagtacagcacca

SEQ ID NO: 377854 - DNA, 25 bp, Mus musculus
cattcatttcctgcctgcgcgacct

SEQ ID NO: 377855 - DNA, 25 bp, Mus musculus
agtacagcaccacgctaccctgggt

SEQ ID NO: 377856 - DNA, 25 bp, Mus musculus
gcagaagctgctggccggccgtggg

SEQ ID NO: 377857 - DNA, 25 bp, Mus musculus
ttccagtatcattcggcgggcgatc

SEQ ID NO: 377858 - DNA, 25 bp, Mus musculus
tccagtatcattcggcgggcgatcg

SEQ ID NO: 377859 - DNA, 25 bp, Mus musculus
ccagtatcattcggcgggcgatcgc

SEQ ID NO: 377860 - DNA, 25 bp, Mus musculus
cgggcgatcgctcataggactccat

SEQ ID NO: 377861 - DNA, 25 bp, Mus musculus
gggcgatcgctcataggactccatt

SEQ ID NO: 377862 - DNA, 25 bp, Mus musculus
ggcgatcgctcataggactccattt

SEQ ID NO: 377863 - DNA, 25 bp, Mus musculus
gcgatcgctcataggactccatttc

SEQ ID NO: 377864 - DNA, 25 bp, Mus musculus
cgatcgctcataggactccatttcc

SEQ ID NO: 377865 - DNA, 25 bp, Mus musculus
gatcgctcataggactccatttccc

SEQ ID NO: 377866 - DNA, 25 bp, Mus musculus
agcatgcctgtgcacactctgtcct

SEQ ID NO: 377867 - DNA, 25 bp, Mus musculus
gcggccattttattcctcccggaga

SEQ ID NO: 377868 - DNA, 25 bp, Mus musculus
tgctgcagaagctgctggccggccg

SEQ ID NO: 377869 - DNA, 25 bp, Mus musculus
attccagtatcattcggcgggcgat

SEQ ID NO: 377870 - DNA, 25 bp, Mus musculus
actgctaatcgcagcgcgccgtgga

SEQ ID NO: 377871 - DNA, 25 bp, Mus musculus
acacctagacgtggtggagtatctg

SEQ ID NO: 377872 - DNA, 25 bp, Mus musculus
tcgtggagtacctcatccaggaaca

SEQ ID NO: 377873 - DNA, 25 bp, Mus musculus
aatctggcagcctggagatcctaca

SEQ ID NO: 377874 - DNA, 25 bp, Mus musculus
ccggctagatccagcagcgaggctt

SEQ ID NO: 377875 - DNA, 25 bp, Mus musculus
gcagcgaggcttccagcatggatct

SEQ ID NO: 377876 - DNA, 25 bp, Mus musculus
agtatctggtggaccactgcggcgc

SEQ ID NO: 377877 - DNA, 25 bp, Mus musculus
cacagcggtgtacaatgcggcgcac

SEQ ID NO: 377878 - DNA, 25 bp, Mus musculus
gtgcacttcgatggcgagaccatcg

SEQ ID NO: 377879 - DNA, 25 bp, Mus musculus
tcacctggccgtggtgcgtagcctt

SEQ ID NO: 377880 - DNA, 25 bp, Mus musculus
gccacacgtgccttatgatctcctg

SEQ ID NO: 377881 - DNA, 25 bp, Mus musculus
tgatctcctgctacaagggccaccg

SEQ ID NO: 377882 - DNA, 25 bp, Mus musculus
gcacgactgtgcagaatctggcagc

SEQ ID NO: 377883 - DNA, 25 bp, Mus musculus
gcatggatctgcacacagcggtgta

SEQ ID NO: 377884 - DNA, 25 bp, Mus musculus
gggcattgcacagccactgcgcatg

SEQ ID NO: 377885 - DNA, 25 bp, Mus musculus
gcgtctccgaggtcatctaggccaa

SEQ ID NO: 377886 - DNA, 25 bp, Mus musculus
gagattcaattgtcgcgcccgagtc

SEQ ID NO: 377887 - DNA, 25 bp, Mus musculus
ctgcatccgttgaggggcaacttga

SEQ ID NO: 377888 - DNA, 25 bp, Mus musculus
gccctgtgcacacggttagacccga

SEQ ID NO: 377889 - DNA, 25 bp, Mus musculus
aatccgagttgtgtcctccacgctg

SEQ ID NO: 377890 - DNA, 25 bp, Mus musculus
cgtgggttccacacctcttgtaaga

SEQ ID NO: 377891 - DNA, 25 bp, Mus musculus
ctttgcaaaactttcccgcgcgtgg

SEQ ID NO: 377892 - DNA, 25 bp, Mus musculus
atccgatgggtgtcttctacgctta

SEQ ID NO: 377893 - DNA, 25 bp, Mus musculus
cggggcaccacgcaaaactgaaagg

SEQ ID NO: 377894 - DNA, 25 bp, Mus musculus
agagcgcgttctatgcacacagtgg

SEQ ID NO: 377895 - DNA, 25 bp, Mus musculus
gaacccgcgctctagtgctcacttg

SEQ ID NO: 377896 - DNA, 25 bp, Mus musculus
gccctcttactggtcaggcgcacta

SEQ ID NO: 377897 - DNA, 25 bp, Mus musculus
tgcacctggtttttcactctcctgg

SEQ ID NO: 377898 - DNA, 25 bp, Mus musculus
attgtcgctctagccgctggcgggc

SEQ ID NO: 377899 - DNA, 25 bp, Mus musculus
cccagctactggctactcacgtgcc

SEQ ID NO: 377900 - DNA, 25 bp, Mus musculus
actcacgtgcccaccaccacgctgg

SEQ ID NO: 377901 - DNA, 25 bp, Mus musculus
acgctggcgccctccagcaccgcca

SEQ ID NO: 377902 - DNA, 25 bp, Mus musculus
tgcgcagcgcagacccggtcaggaa

SEQ ID NO: 377903 - DNA, 25 bp, Mus musculus
cgcgggcacacaccagcaccacttg

SEQ ID NO: 377904 - DNA, 25 bp, Mus musculus
agcaccacttgctgtgcgttctcca

SEQ ID NO: 377905 - DNA, 25 bp, Mus musculus
gcaccacttgctgtgcgttctccag

SEQ ID NO: 377906 - DNA, 25 bp, Mus musculus
gtggctgctcgtcattgtcgctcta

SEQ ID NO: 377907 - DNA, 25 bp, Mus musculus
ggctgctcgtcattgtcgctctagc

SEQ ID NO: 377908 - DNA, 25 bp, Mus musculus
tgctcgtcattgtcgctctagccgc

SEQ ID NO: 377909 - DNA, 25 bp, Mus musculus
tcgtcattgtcgctctagccgctgg

SEQ ID NO: 377910 - DNA, 25 bp, Mus musculus
gtcattgtcgctctagccgctggcg

SEQ ID NO: 377911 - DNA, 25 bp, Mus musculus
gctccggaaccccatctcgcctgtc

SEQ ID NO: 377912 - DNA, 25 bp, Mus musculus
cgaagctgctgtttgttgatcgaca

SEQ ID NO: 377913 - DNA, 25 bp, Mus musculus
tccgcgtttgtctcagtaaagtctg

SEQ ID NO: 377914 - DNA, 25 bp, Mus musculus
cacgtcctcggggttggaccaatga

SEQ ID NO: 377915 - DNA, 25 bp, Mus musculus
gtcgcaaccattcggcacccagaga

SEQ ID NO: 377916 - DNA, 25 bp, Mus musculus
tctggagcagcaagacagcgattga

SEQ ID NO: 377917 - DNA, 25 bp, Mus musculus
gccgcccgatcacagggtggagtct

SEQ ID NO: 377918 - DNA, 25 bp, Mus musculus
tctgagaacgcgcttgtcaatctgc

SEQ ID NO: 377919 - DNA, 25 bp, Mus musculus
tcaatctgcgtgagctcggggctat

SEQ ID NO: 377920 - DNA, 25 bp, Mus musculus
ccggattggctgtgtgcatcttgac

SEQ ID NO: 377921 - DNA, 25 bp, Mus musculus
gacgggcatgcttcgtacccactga

SEQ ID NO: 377922 - DNA, 25 bp, Mus musculus
gaagaaatcgagtgcctgctcccgc

SEQ ID NO: 377923 - DNA, 25 bp, Mus musculus
gtggagctgtcagccgccaccaatc

SEQ ID NO: 377924 - DNA, 25 bp, Mus musculus
ctgaatgcccaatggcggccgagta

SEQ ID NO: 377925 - DNA, 25 bp, Mus musculus
cgagcgagcgaaccatcgaaggagc

SEQ ID NO: 377926 - DNA, 25 bp, Mus musculus
cacatccacggtcttctctgtcttg

SEQ ID NO: 377927 - DNA, 25 bp, Mus musculus
ccacctgggccagcttctggatgta

SEQ ID NO: 377928 - DNA, 25 bp, Mus musculus
actcaagctccatgcccgtgacgtg

SEQ ID NO: 377929 - DNA, 25 bp, Mus musculus
atgcccgtgacgtgctcgccaggct

SEQ ID NO: 377930 - DNA, 25 bp, Mus musculus
gcagtcaccttgaactcaagctcca

SEQ ID NO: 377931 - DNA, 25 bp, Mus musculus
agggacctcggtattgccgcagccc

SEQ ID NO: 377932 - DNA, 25 bp, Mus musculus
cagcgcctcgtggatgaagccatac

SEQ ID NO: 377933 - DNA, 25 bp, Mus musculus
gaagccatactgatcctctgtctgc

SEQ ID NO: 377934 - DNA, 25 bp, Mus musculus
caccatgtagttgcgctgcgaccgc

SEQ ID NO: 377935 - DNA, 25 bp, Mus musculus
gtcacatgtccatacacatccacgg

SEQ ID NO: 377936 - DNA, 25 bp, Mus musculus
ttctctgtcttgatgcgctctagca

SEQ ID NO: 377937 - DNA, 25 bp, Mus musculus
gcgctctagcatggcgtcaattacg

SEQ ID NO: 377938 - DNA, 25 bp, Mus musculus
gtcaattacgatgaagcagccagtg

SEQ ID NO: 377939 - DNA, 25 bp, Mus musculus
tgcgaccgcatgagtgtcacatgtc

SEQ ID NO: 377940 - DNA, 25 bp, Mus musculus
ggtgacctctgtacctccatttcta

SEQ ID NO: 377941 - DNA, 25 bp, Mus musculus
tccacatatccatagagcaagccac

SEQ ID NO: 377942 - DNA, 25 bp, Mus musculus
tacaggctcattcttctgcaacaca

SEQ ID NO: 377943 - DNA, 25 bp, Mus musculus
agagcaagccaccaggtgacctctg

SEQ ID NO: 377944 - DNA, 25 bp, Mus musculus
ttctgcaacacagcaagcacaaaga

SEQ ID NO: 377945 - DNA, 25 bp, Mus musculus
tgtacctccatttctatcctgtctc

SEQ ID NO: 377946 - DNA, 25 bp, Mus musculus
ttctatcctgtctccaggctggtgg

SEQ ID NO: 377947 - DNA, 25 bp, Mus musculus
tatcctgtctccaggctggtgggga

SEQ ID NO: 377948 - DNA, 25 bp, Mus musculus
agctaggatgtaggcagacgctgcc

SEQ ID NO: 377949 - DNA, 25 bp, Mus musculus
tgtaggcagacgctgccgaggactt

SEQ ID NO: 377950 - DNA, 25 bp, Mus musculus
acgctgccgaggacttacaggctca

SEQ ID NO: 377951 - DNA, 25 bp, Mus musculus
gccgaggacttacaggctcattctt

SEQ ID NO: 377952 - DNA, 25 bp, Mus musculus
ggacttacaggctcattcttctgca

SEQ ID NO: 377953 - DNA, 25 bp, Mus musculus
tatccatagagcaagccaccaggtg

SEQ ID NO: 377954 - DNA, 25 bp, Mus musculus
gtgcgcgcacgcgtaactcgtaggc

SEQ ID NO: 377955 - DNA, 25 bp, Mus musculus
cttcgcgcccaaactgcaggcggta

SEQ ID NO: 377956 - DNA, 25 bp, Mus musculus
cgcccttgtgtgcaggcgccgcgaa

SEQ ID NO: 377957 - DNA, 25 bp, Mus musculus
ccggaacacataggtggcgcccttg

SEQ ID NO: 377958 - DNA, 25 bp, Mus musculus
cgctgccagccggaacacataggtg

SEQ ID NO: 377959 - DNA, 25 bp, Mus musculus
cgcccaagatctgcgggaagccgcg

SEQ ID NO: 377960 - DNA, 25 bp, Mus musculus
ccgcggcgcccaagatctgcgggaa

SEQ ID NO: 377961 - DNA, 25 bp, Mus musculus
aaactgcaggcggtagccaagcacc

SEQ ID NO: 377962 - DNA, 25 bp, Mus musculus
ccgtgtacttgatgatggcgccgtt

SEQ ID NO: 377963 - DNA, 25 bp, Mus musculus
acgcgtaactcgtaggccgtctccg

SEQ ID NO: 377964 - DNA, 25 bp, Mus musculus
agtctggaggccgagacttacctgt

SEQ ID NO: 377965 - DNA, 25 bp, Mus musculus
ccctgttgtccctgtggtccgctgt

SEQ ID NO: 377966 - DNA, 25 bp, Mus musculus
gcagccagcgcagtagcacggagcc

SEQ ID NO: 377967 - DNA, 25 bp, Mus musculus
tcccgcacggacaccgtgtacttga

SEQ ID NO: 377968 - DNA, 25 bp, Mus musculus
ccaagccaccgtcaatgtgagctac

SEQ ID NO: 377969 - DNA, 25 bp, Mus musculus
ccaccgtcaatgtgagctacaagga

SEQ ID NO: 377970 - DNA, 25 bp, Mus musculus
caaggaggatgaagaaatgaaaacc

SEQ ID NO: 377971 - DNA, 25 bp, Mus musculus
aatgaaaaccgactccgatgacctg

SEQ ID NO: 377972 - DNA, 25 bp, Mus musculus
aaaccgactccgatgacctgctgga

SEQ ID NO: 377973 - DNA, 25 bp, Mus musculus
cgaggacgtccctcagcctgaggac

SEQ ID NO: 377974 - DNA, 25 bp, Mus musculus
cctgaggacgaggagtttgagacaa

SEQ ID NO: 377975 - DNA, 25 bp, Mus musculus
gtttgagacaatagagagggttatg

SEQ ID NO: 377976 - DNA, 25 bp, Mus musculus
actattcacagcgtaaacgaccgcg

SEQ ID NO: 377977 - DNA, 25 bp, Mus musculus
tgcttgttcaactattcacagcgta

SEQ ID NO: 377978 - DNA, 25 bp, Mus musculus
cagtgttcagtacgtgcttgttcaa

SEQ ID NO: 377979 - DNA, 25 bp, Mus musculus
aatagagagggttatggattgcaga

SEQ ID NO: 377980 - DNA, 25 bp, Mus musculus
gaggtacggctgcaagcagtgttca

SEQ ID NO: 377981 - DNA, 25 bp, Mus musculus
tcaatgtgagctacaaggaggatga

SEQ ID NO: 377982 - DNA, 25 bp, Mus musculus
cacatagtggacctggtagccgcgg

SEQ ID NO: 377983 - DNA, 25 bp, Mus musculus
catagtggacctggtagccgcggat

SEQ ID NO: 377984 - DNA, 25 bp, Mus musculus
cgcacatagtggacctggtagccgc

SEQ ID NO: 377985 - DNA, 25 bp, Mus musculus
gctgtggcgttgagcgcctccgcct

SEQ ID NO: 377986 - DNA, 25 bp, Mus musculus
ggcaccctccatgcgcacatagtgg

SEQ ID NO: 377987 - DNA, 25 bp, Mus musculus
atgcgcacatagtggacctggtagc

SEQ ID NO: 377988 - DNA, 25 bp, Mus musculus
tagtggacctggtagccgcggatct

SEQ ID NO: 377989 - DNA, 25 bp, Mus musculus
ggatctgcccgtgctgccggccggg

SEQ ID NO: 377990 - DNA, 25 bp, Mus musculus
tgggcgagcgccacagcactcggat

SEQ ID NO: 377991 - DNA, 25 bp, Mus musculus
gcgagcgccacagcactcggatggc

SEQ ID NO: 377992 - DNA, 25 bp, Mus musculus
gagcgccacagcactcggatggctg

SEQ ID NO: 377993 - DNA, 25 bp, Mus musculus
gcgccacagcactcggatggctgtg

SEQ ID NO: 377994 - DNA, 25 bp, Mus musculus
acagcactcggatggctgtggcgtt

SEQ ID NO: 377995 - DNA, 25 bp, Mus musculus
tgcgcacatagtggacctggtagcc

SEQ ID NO: 377996 - DNA, 25 bp, Mus musculus
tctccaaagcttccagaaggatctg

SEQ ID NO: 377997 - DNA, 25 bp, Mus musculus
gtcctcatcggtgcggacgaccacg

SEQ ID NO: 377998 - DNA, 25 bp, Mus musculus
agctggtgcacttaacgtcttgagg

SEQ ID NO: 377999 - DNA, 25 bp, Mus musculus
ggtactccgtccatttctccaaagc

SEQ ID NO: 378000 - DNA, 25 bp, Mus musculus
gcggtgacacggtactccgtccatt

SEQ ID NO: 378001 - DNA, 25 bp, Mus musculus
ttgggctggtgcttaccgtcctcat

SEQ ID NO: 378002 - DNA, 25 bp, Mus musculus
ggccctggtcccacctctgtgtaag

SEQ ID NO: 378003 - DNA, 25 bp, Mus musculus
ctctgtgtaagccacggcggtgaca

SEQ ID NO: 378004 - DNA, 25 bp, Mus musculus
cggtagcggacgctgtagcccacga

SEQ ID NO: 378005 - DNA, 25 bp, Mus musculus
ccaatatggccgtggagcgcaagct

SEQ ID NO: 378006 - DNA, 25 bp, Mus musculus
ttggggtccgggtcctctgagccca

SEQ ID NO: 378007 - DNA, 25 bp, Mus musculus
cttccagaaggatctgagtggtggt

SEQ ID NO: 378008 - DNA, 25 bp, Mus musculus
gtatgttgttcacctccttggggtc

SEQ ID NO: 378009 - DNA, 25 bp, Mus musculus
tggcgggcgccaacttaccaatatg

SEQ ID NO: 378010 - DNA, 25 bp, Mus musculus
gctctgcaggggacaccagtatggt

SEQ ID NO: 378011 - DNA, 25 bp, Mus musculus
gatcgcgcccgagtatctccgaggt

SEQ ID NO: 378012 - DNA, 25 bp, Mus musculus
agatccgagaggctccggttgcacc

SEQ ID NO: 378013 - DNA, 25 bp, Mus musculus
taacggtcccgagctcagccaagtg

SEQ ID NO: 378014 - DNA, 25 bp, Mus musculus
aaagtttctgtgctcccggcgactc

SEQ ID NO: 378015 - DNA, 25 bp, Mus musculus
cagtgtagacttggcgcaggcaata

SEQ ID NO: 378016 - DNA, 25 bp, Mus musculus
ttcctctgtggtccatggactccgc

SEQ ID NO: 378017 - DNA, 25 bp, Mus musculus
aaggccaggcgagaacgcacccagc

SEQ ID NO: 378018 - DNA, 25 bp, Mus musculus
tgctattatggaagaccagccgggg

SEQ ID NO: 378019 - DNA, 25 bp, Mus musculus
tccgcctgtctaaaagcatagcttc

SEQ ID NO: 378020 - DNA, 25 bp, Mus musculus
ctatgcccgcccagcacagtgtaga

SEQ ID NO: 378021 - DNA, 25 bp, Mus musculus
tttgtccgtgggtctgtctatgccc

SEQ ID NO: 378022 - DNA, 25 bp, Mus musculus
actcaccacggctgcgaagtccagg

SEQ ID NO: 378023 - DNA, 25 bp, Mus musculus
tccacggtaagcgtactgaggttgg

SEQ ID NO: 378024 - DNA, 25 bp, Mus musculus
ggatgtcaccctccagggcgcgata

SEQ ID NO: 378025 - DNA, 25 bp, Mus musculus
gaactttctcgatgctccctccttt

SEQ ID NO: 378026 - DNA, 25 bp, Mus musculus
caggtggggacatcagcgaagccac

SEQ ID NO: 378027 - DNA, 25 bp, Mus musculus
cagcgaagccacaggtccgcggaca

SEQ ID NO: 378028 - DNA, 25 bp, Mus musculus
ccgcggacaccgagagacacacaga

SEQ ID NO: 378029 - DNA, 25 bp, Mus musculus
cacacagagtcaacgcagcagggga

SEQ ID NO: 378030 - DNA, 25 bp, Mus musculus
accaagaggcacttggccgcctttg

SEQ ID NO: 378031 - DNA, 25 bp, Mus musculus
gccgcctttgagtccacgagggaca

SEQ ID NO: 378032 - DNA, 25 bp, Mus musculus
gaggctctgagactaatccagtgtg

SEQ ID NO: 378033 - DNA, 25 bp, Mus musculus
actaatccagtgtgcggagggtcac

SEQ ID NO: 378034 - DNA, 25 bp, Mus musculus
tgtgaacctgccacacaccaagagc

SEQ ID NO: 378035 - DNA, 25 bp, Mus musculus
atcctccggggacacggatgtcacc

SEQ ID NO: 378036 - DNA, 25 bp, Mus musculus
cgacagacagggctcagcgctgcta

SEQ ID NO: 378037 - DNA, 25 bp, Mus musculus
ccggcgggtttataaatatctatct

SEQ ID NO: 378038 - DNA, 25 bp, Mus musculus
ctctccttcttgcagaatccgatta

SEQ ID NO: 378039 - DNA, 25 bp, Mus musculus
tgaccctgggtacgggccaagtcgc

SEQ ID NO: 378040 - DNA, 25 bp, Mus musculus
gggtggatgagcagtcccaatccca

SEQ ID NO: 378041 - DNA, 25 bp, Mus musculus
ctgtctctaccggttcccgtttctg

SEQ ID NO: 378042 - DNA, 25 bp, Mus musculus
ttcccgtttctgtgggtctctgtcc

SEQ ID NO: 378043 - DNA, 25 bp, Mus musculus
agaatccgattacggctgcagcccg

SEQ ID NO: 378044 - DNA, 25 bp, Mus musculus
caaaggcggagaagcttggaagcac

SEQ ID NO: 378045 - DNA, 25 bp, Mus musculus
ccaggtgatctgaggcgcctggccc

SEQ ID NO: 378046 - DNA, 25 bp, Mus musculus
ttggaagcacaaagccggcgccgcc

SEQ ID NO: 378047 - DNA, 25 bp, Mus musculus
tggccgtgtacagtactgcgcctgc

SEQ ID NO: 378048 - DNA, 25 bp, Mus musculus
cgctgctgggtcacgtgcttcagga

SEQ ID NO: 378049 - DNA, 25 bp, Mus musculus
tgcttcaggagcctgtagaaggccc

SEQ ID NO: 378050 - DNA, 25 bp, Mus musculus
cggtctgcagctccagacgctgaca

SEQ ID NO: 378051 - DNA, 25 bp, Mus musculus
cccttcggagcacaaaggcggagaa

SEQ ID NO: 378052 - DNA, 25 bp, Mus musculus
tacacctcaggctccgggacaaaca

SEQ ID NO: 378053 - DNA, 25 bp, Mus musculus
tacaaccaagcgacccgcgctaaga

SEQ ID NO: 378054 - DNA, 25 bp, Mus musculus
cactgcggagcgtgctaggtagaaa

SEQ ID NO: 378055 - DNA, 25 bp, Mus musculus
ccctgtgagcccaaactaggctaca

SEQ ID NO: 378056 - DNA, 25 bp, Mus musculus
gacaaaagcggcctgacctttcacc

SEQ ID NO: 378057 - DNA, 25 bp, Mus musculus
cccgcgctaagagaaatggccgaca

SEQ ID NO: 378058 - DNA, 25 bp, Mus musculus
agcggctgccgctacaaccaagcga

SEQ ID NO: 378059 - DNA, 25 bp, Mus musculus
ttaccatcgcgaccaccggcgagcg

SEQ ID NO: 378060 - DNA, 25 bp, Mus musculus
gcggcgctcatcgtccttaccatcg

SEQ ID NO: 378061 - DNA, 25 bp, Mus musculus
aaggcctccgacgtcgggagcagga

SEQ ID NO: 378062 - DNA, 25 bp, Mus musculus
aaacaacacgcggaaaggtggctgg

SEQ ID NO: 378063 - DNA, 25 bp, Mus musculus
ctaggctacacctcaggctccggga

SEQ ID NO: 378064 - DNA, 25 bp, Mus musculus
gagcgtgctaggtagaaatggaaaa

SEQ ID NO: 378065 - DNA, 25 bp, Mus musculus
tggccgacaaaagcggcctgacctt

SEQ ID NO: 378066 - DNA, 25 bp, Mus musculus
tgccctcttggggtccacaggaacc

SEQ ID NO: 378067 - DNA, 25 bp, Mus musculus
agaaccaggggtcgatgcagcgaca

SEQ ID NO: 378068 - DNA, 25 bp, Mus musculus
gagtgctggccactgactgtttgca

SEQ ID NO: 378069 - DNA, 25 bp, Mus musculus
caaggcaggatcttgagccgttccc

SEQ ID NO: 378070 - DNA, 25 bp, Mus musculus
ctcctcgtagtcgtccaggcagatg

SEQ ID NO: 378071 - DNA, 25 bp, Mus musculus
aacgtgcgcacctgtgccttctggc

SEQ ID NO: 378072 - DNA, 25 bp, Mus musculus
gccttctggcatgtctgcgtcttca

SEQ ID NO: 378073 - DNA, 25 bp, Mus musculus
caagttaacctgagcgtccgtgggc

SEQ ID NO: 378074 - DNA, 25 bp, Mus musculus
tgccgcagcacgaacagcgtagatg

SEQ ID NO: 378075 - DNA, 25 bp, Mus musculus
gcgcccaggatgcaaccactacagg

SEQ ID NO: 378076 - DNA, 25 bp, Mus musculus
ggtcgcagcgtacggtcacctccaa

SEQ ID NO: 378077 - DNA, 25 bp, Mus musculus
aggtccaagaagtccacagagctca

SEQ ID NO: 378078 - DNA, 25 bp, Mus musculus
cagtggtacgcatgtgcgcaaggca

SEQ ID NO: 378079 - DNA, 25 bp, Mus musculus
ccactacagggtgacactcggggtc

SEQ ID NO: 378080 - DNA, 25 bp, Mus musculus
ttctcccgtcgctcctggaaggcat

SEQ ID NO: 378081 - DNA, 25 bp, Mus musculus
gcgcctttcacgctccactctcatg

SEQ ID NO: 378082 - DNA, 25 bp, Mus musculus
gcagctgttcttgctgccgccgcag

SEQ ID NO: 378083 - DNA, 25 bp, Mus musculus
tcgctcctggaaggcatccagacgc

SEQ ID NO: 378084 - DNA, 25 bp, Mus musculus
tggcactggagctgcatccgttccc

SEQ ID NO: 378085 - DNA, 25 bp, Mus musculus
gttcctgctcagcacgcagctgttc

SEQ ID NO: 378086 - DNA, 25 bp, Mus musculus
ccgctgcaagcgagccttctcccgt

SEQ ID NO: 378087 - DNA, 25 bp, Mus musculus
cagctcctcccgctcacgcataatg

SEQ ID NO: 378088 - DNA, 25 bp, Mus musculus
atccagacgctgctcccgctctcgc

SEQ ID NO: 378089 - DNA, 25 bp, Mus musculus
acgcataatgcgctgctgttccttg

SEQ ID NO: 378090 - DNA, 25 bp, Mus musculus
gcgctgctgttccttgcgcctttca

SEQ ID NO: 378091 - DNA, 25 bp, Mus musculus
aaccgctgccgctggcactggagct

SEQ ID NO: 378092 - DNA, 25 bp, Mus musculus
gagctgcatccgttcccgctgcaag

SEQ ID NO: 378093 - DNA, 25 bp, Mus musculus
tagggtctgcgcagtgcccgccgtt

SEQ ID NO: 378094 - DNA, 25 bp, Mus musculus
aggctgaagcggttccctctcaggc

SEQ ID NO: 378095 - DNA, 25 bp, Mus musculus
cacactgcgcttgggtaaaggcgtc

SEQ ID NO: 378096 - DNA, 25 bp, Mus musculus
cggaggtagtacaaaatggcgctgc

SEQ ID NO: 378097 - DNA, 25 bp, Mus musculus
cgctgccgaagaggaaaacgcactc

SEQ ID NO: 378098 - DNA, 25 bp, Mus musculus
ctcctaggtcgcacgccaaagcagt

SEQ ID NO: 378099 - DNA, 25 bp, Mus musculus
gccaaagcagtctcgagcctcgcgg

SEQ ID NO: 378100 - DNA, 25 bp, Mus musculus
cctcgcgggtacaagtgcacatgcg

SEQ ID NO: 378101 - DNA, 25 bp, Mus musculus
tgcacatgcgcaaccggtcgtaagc

SEQ ID NO: 378102 - DNA, 25 bp, Mus musculus
accctctttttaatgcgcacgcgca

SEQ ID NO: 378103 - DNA, 25 bp, Mus musculus
ccactgacccggttctgtgtgaagt

SEQ ID NO: 378104 - DNA, 25 bp, Mus musculus
gcacgacctgtagcacgcatgcgtc

SEQ ID NO: 378105 - DNA, 25 bp, Mus musculus
ctcaggcggcgccattttgtggtaa

SEQ ID NO: 378106 - DNA, 25 bp, Mus musculus
actctgtcgggtttaggagacgcga

SEQ ID NO: 378107 - DNA, 25 bp, Mus musculus
ctacggccagcgctccgacagtgat

SEQ ID NO: 378108 - DNA, 25 bp, Mus musculus
gtgagcgcttggcattccaccgcca

SEQ ID NO: 378109 - DNA, 25 bp, Mus musculus
gcgtcagcaggagctgcgctatgaa

SEQ ID NO: 378110 - DNA, 25 bp, Mus musculus
gattgctcgtgagcgcttggcattc

SEQ ID NO: 378111 - DNA, 25 bp, Mus musculus
gcgagagcggctggagattgctcgt

SEQ ID NO: 378112 - DNA, 25 bp, Mus musculus
agcgggagcggatgcatgtagaaca

SEQ ID NO: 378113 - DNA, 25 bp, Mus musculus
ccatcggctagagcgtgaacgcatg

SEQ ID NO: 378114 - DNA, 25 bp, Mus musculus
caccgccatcggctagagcgtgaac

SEQ ID NO: 378115 - DNA, 25 bp, Mus musculus
atgtagaacaggagcggaggcgtga

SEQ ID NO: 378116 - DNA, 25 bp, Mus musculus
ggcgtgagcaagagcgcattcaccg

SEQ ID NO: 378117 - DNA, 25 bp, Mus musculus
gagcaagagcgcattcaccgagagc

SEQ ID NO: 378118 - DNA, 25 bp, Mus musculus
ttcaccgagagcgagaggagcttcg

SEQ ID NO: 378119 - DNA, 25 bp, Mus musculus
caggagctgcgctatgaacaggagc

SEQ ID NO: 378120 - DNA, 25 bp, Mus musculus
cgctatgaacaggagcgccggcctg

SEQ ID NO: 378121 - DNA, 25 bp, Mus musculus
agcgcattcaccgagagcgagagga

SEQ ID NO: 378122 - DNA, 25 bp, Mus musculus
cgctgtcagccgcaatggagttaga

SEQ ID NO: 378123 - DNA, 25 bp, Mus musculus
tttctcagggcctccacgattgtcc

SEQ ID NO: 378124 - DNA, 25 bp, Mus musculus
ccctcggaagacactggtcggattc

SEQ ID NO: 378125 - DNA, 25 bp, Mus musculus
gcacgacagagacgagccctcggaa

SEQ ID NO: 378126 - DNA, 25 bp, Mus musculus
ggctgccgcaattctttctgggaaa

SEQ ID NO: 378127 - DNA, 25 bp, Mus musculus
ttagactcttgtaggtcgaggtccg

SEQ ID NO: 378128 - DNA, 25 bp, Mus musculus
tcgctgctgagactcctgggaaatg

SEQ ID NO: 378129 - DNA, 25 bp, Mus musculus
ggaaatgtagtggtcgctgtcagcc

SEQ ID NO: 378130 - DNA, 25 bp, Mus musculus
ctcgccgcgcaaggacaagtaattc

SEQ ID NO: 378131 - DNA, 25 bp, Mus musculus
ccaccatggttagtctctcgcttca

SEQ ID NO: 378132 - DNA, 25 bp, Mus musculus
gaccacactcgagccaccatggtta

SEQ ID NO: 378133 - DNA, 25 bp, Mus musculus
gattgtccacgcacctcattagcga

SEQ ID NO: 378134 - DNA, 25 bp, Mus musculus
taacaaccggaagtgagccgtcgca

SEQ ID NO: 378135 - DNA, 25 bp, Mus musculus
tcgcaggaccctaagccacgaggca

SEQ ID NO: 378136 - DNA, 25 bp, Mus musculus
ctgctgagagcaataaaggcccggg

SEQ ID NO: 378137 - DNA, 25 bp, Mus musculus
gcctacctgcgtggagcagcccaag

SEQ ID NO: 378138 - DNA, 25 bp, Mus musculus
tacaaagaccgtgagcgagcgccga

SEQ ID NO: 378139 - DNA, 25 bp, Mus musculus
caacagggcgcagagacatcgagac

SEQ ID NO: 378140 - DNA, 25 bp, Mus musculus
ctcctttcaggccagcgttcgaggc

SEQ ID NO: 378141 - DNA, 25 bp, Mus musculus
catgcccgtccatgcaggtctcgtg

SEQ ID NO: 378142 - DNA, 25 bp, Mus musculus
aggaaggtgctgctctcacgcccat

SEQ ID NO: 378143 - DNA, 25 bp, Mus musculus
gatcggaaggacctcaccagccgga

SEQ ID NO: 378144 - DNA, 25 bp, Mus musculus
caggaacgtgaacccgagacggtga

SEQ ID NO: 378145 - DNA, 25 bp, Mus musculus
ccagtaaacactcctgctgagagca

SEQ ID NO: 378146 - DNA, 25 bp, Mus musculus
gagaaacagcacagggctcccagtc

SEQ ID NO: 378147 - DNA, 25 bp, Mus musculus
tctttgcaccgtgtgcgattccggg

SEQ ID NO: 378148 - DNA, 25 bp, Mus musculus
ggcctgcgcggtcaatcaatctcag

SEQ ID NO: 378149 - DNA, 25 bp, Mus musculus
tggcgttccggacccagaacaaagc

SEQ ID NO: 378150 - DNA, 25 bp, Mus musculus
acgcgaccgcctcgtcagagatggg

SEQ ID NO: 378151 - DNA, 25 bp, Mus musculus
tgaagaagtgaatatcgacacctgc

SEQ ID NO: 378152 - DNA, 25 bp, Mus musculus
tgggtgacatgcgactactcctcgc

SEQ ID NO: 378153 - DNA, 25 bp, Mus musculus
cagtggccctgggtgacatgcgact

SEQ ID NO: 378154 - DNA, 25 bp, Mus musculus
tcggggctgtgctcgcagcgcctca

SEQ ID NO: 378155 - DNA, 25 bp, Mus musculus
tactcctcgcaggtgggcacgcaca

SEQ ID NO: 378156 - DNA, 25 bp, Mus musculus
tcgacacctgcgtagattctgtgtc

SEQ ID NO: 378157 - DNA, 25 bp, Mus musculus
agtggcatatatcccaggattctgc

SEQ ID NO: 378158 - DNA, 25 bp, Mus musculus
aggcctgcaagtggcatatatccca

SEQ ID NO: 378159 - DNA, 25 bp, Mus musculus
ctctagccggaaaggcctgcaagtg

SEQ ID NO: 378160 - DNA, 25 bp, Mus musculus
gcgcctgtctctctagccggaaagg

SEQ ID NO: 378161 - DNA, 25 bp, Mus musculus
ggtctcacgggtgccgtagaacctc

SEQ ID NO: 378162 - DNA, 25 bp, Mus musculus
ctgcgtagattctgtgtcgttggaa

SEQ ID NO: 378163 - DNA, 25 bp, Mus musculus
gattctgcgcggtgccgttcttcct

SEQ ID NO: 378164 - DNA, 25 bp, Mus musculus
agagccgcacgtagcctgtgctcgc

SEQ ID NO: 378165 - DNA, 25 bp, Mus musculus
cctccacgatcttgataaagcgcgg

SEQ ID NO: 378166 - DNA, 25 bp, Mus musculus
ggggctctggttacctccacgatct

SEQ ID NO: 378167 - DNA, 25 bp, Mus musculus
ataaagcgcgggaacacagggttgc

SEQ ID NO: 378168 - DNA, 25 bp, Mus musculus
gagcgctgtgacgaccgggccttcc

SEQ ID NO: 378169 - DNA, 25 bp, Mus musculus
gagctgacatgtcgcaggcccgaca

SEQ ID NO: 378170 - DNA, 25 bp, Mus musculus
gtgaggaaacacatccgggacggtc

SEQ ID NO: 378171 - DNA, 25 bp, Mus musculus
tgctcgccgccatggaacagccata

SEQ ID NO: 378172 - DNA, 25 bp, Mus musculus
atactgacggcgcaccgcacttacg

SEQ ID NO: 378173 - DNA, 25 bp, Mus musculus
gagaccactcggtcccgctagcaga

SEQ ID NO: 378174 - DNA, 25 bp, Mus musculus
cgtttgcgcacgtgatgacgctcgc

SEQ ID NO: 378175 - DNA, 25 bp, Mus musculus
cacgtgatgacgctcgcgtgcttcg

SEQ ID NO: 378176 - DNA, 25 bp, Mus musculus
agggagctgagagaccactcggtcc

SEQ ID NO: 378177 - DNA, 25 bp, Mus musculus
aggtctcgtcgctgccaccgcggtt

SEQ ID NO: 378178 - DNA, 25 bp, Mus musculus
taaaatggcggacctggcgaacgaa

SEQ ID NO: 378179 - DNA, 25 bp, Mus musculus
ggctctccttcatcccgcgaaggtg

SEQ ID NO: 378180 - DNA, 25 bp, Mus musculus
atagcctcaggctcaggtccggctc

SEQ ID NO: 378181 - DNA, 25 bp, Mus musculus
agcccaacgggccttgagacgcggc

SEQ ID NO: 378182 - DNA, 25 bp, Mus musculus
ttcaggttgtgggagttcggcctca

SEQ ID NO: 378183 - DNA, 25 bp, Mus musculus
cagcagaaagccctcggagcccggg

SEQ ID NO: 378184 - DNA, 25 bp, Mus musculus
gcgcagaactctcccagcagaaagc

SEQ ID NO: 378185 - DNA, 25 bp, Mus musculus
ttcatcccgcgaaggtgctcggcca

SEQ ID NO: 378186 - DNA, 25 bp, Mus musculus
tgggagttcggcctcacccggtctg

SEQ ID NO: 378187 - DNA, 25 bp, Mus musculus
gcaggcgcagaactctcccagcaga

SEQ ID NO: 378188 - DNA, 25 bp, Mus musculus
tcacaccggcgctggcttatgggat

SEQ ID NO: 378189 - DNA, 25 bp, Mus musculus
cgtgccacgctagccacaccctctt

SEQ ID NO: 378190 - DNA, 25 bp, Mus musculus
agctctagcgggtgcgagcttccct

SEQ ID NO: 378191 - DNA, 25 bp, Mus musculus
cccagagtcgaagggcgagcgcttc

SEQ ID NO: 378192 - DNA, 25 bp, Mus musculus
cccaaatagttacacgcggtcctga

SEQ ID NO: 378193 - DNA, 25 bp, Mus musculus
caggctgccgctgcattaatttaaa

SEQ ID NO: 378194 - DNA, 25 bp, Mus musculus
cacgtttctaccaggggcaggacta

SEQ ID NO: 378195 - DNA, 25 bp, Mus musculus
tgcgtccaaggcgttcaataaagtt

SEQ ID NO: 378196 - DNA, 25 bp, Mus musculus
gccaatgttcacgtccctttcagga

SEQ ID NO: 378197 - DNA, 25 bp, Mus musculus
tcacgggcgtctctgtccagattca

SEQ ID NO: 378198 - DNA, 25 bp, Mus musculus
tggaccgagcacgacacagatcttg

SEQ ID NO: 378199 - DNA, 25 bp, Mus musculus
gatccctgacgagccaaccgctttt

SEQ ID NO: 378200 - DNA, 25 bp, Mus musculus
gctccggctaactagggtatcacta

SEQ ID NO: 378201 - DNA, 25 bp, Mus musculus
gccctgcgattgtcctaccttctgt

SEQ ID NO: 378202 - DNA, 25 bp, Mus musculus
gatcgctgacctgcctgacagtgta

SEQ ID NO: 378203 - DNA, 25 bp, Mus musculus
tgcgacctgtcaatcccatccttgg

SEQ ID NO: 378204 - DNA, 25 bp, Mus musculus
aaacctcgtcttcgctagggctgga

SEQ ID NO: 378205 - DNA, 25 bp, Mus musculus
tgggcctggtctccgtcaattataa

SEQ ID NO: 378206 - DNA, 25 bp, Mus musculus
cagaatctgaatgacgcctacgggc

SEQ ID NO: 378207 - DNA, 25 bp, Mus musculus
gctcatcaccaagccgcagaatctg

SEQ ID NO: 378208 - DNA, 25 bp, Mus musculus
gaccagctcgctggctccggtagaa

SEQ ID NO: 378209 - DNA, 25 bp, Mus musculus
tcgctctccgtggacagtttgtatg

SEQ ID NO: 378210 - DNA, 25 bp, Mus musculus
tgagccagggtttcgctcgctctcc

SEQ ID NO: 378211 - DNA, 25 bp, Mus musculus
agcaacttcctcgagatcgacgtga

SEQ ID NO: 378212 - DNA, 25 bp, Mus musculus
gagcttcgcgcggaacgaacgccca

SEQ ID NO: 378213 - DNA, 25 bp, Mus musculus
gtcagctgtttctccctgggcagag

SEQ ID NO: 378214 - DNA, 25 bp, Mus musculus
cgcccgaggcattgtggttattgta

SEQ ID NO: 378215 - DNA, 25 bp, Mus musculus
cgcagagaagctgggtcagaaaagc

SEQ ID NO: 378216 - DNA, 25 bp, Mus musculus
tgcgccagaacagctaaaatcgttt

SEQ ID NO: 378217 - DNA, 25 bp, Mus musculus
aacgactgccttcactgcgccagaa

SEQ ID NO: 378218 - DNA, 25 bp, Mus musculus
acgtgctcgttcgtctccgttcgct

SEQ ID NO: 378219 - DNA, 25 bp, Mus musculus
ggggccgcttcaccacctacgagat

SEQ ID NO: 378220 - DNA, 25 bp, Mus musculus
acggtgcccactgagcgagcctggc

SEQ ID NO: 378221 - DNA, 25 bp, Mus musculus
gacaatgaccggacccgcgcgtctg

SEQ ID NO: 378222 - DNA, 25 bp, Mus musculus
cgcggtgtcggtgcaataaaaatgc

SEQ ID NO: 378223 - DNA, 25 bp, Mus musculus
cggtgcaataaaaatgcatcccatg

SEQ ID NO: 378224 - DNA, 25 bp, Mus musculus
tgcatcccatggaactgcccatgga

SEQ ID NO: 378225 - DNA, 25 bp, Mus musculus
actgcccatggagaaggacgggacc

SEQ ID NO: 378226 - DNA, 25 bp, Mus musculus
tcggcggccacagaaggtgggaaaa

SEQ ID NO: 378227 - DNA, 25 bp, Mus musculus
gccgggaagtgaaaggtctcgcaaa

SEQ ID NO: 378228 - DNA, 25 bp, Mus musculus
agtgaaaggtctcgcaaagttcagc

SEQ ID NO: 378229 - DNA, 25 bp, Mus musculus
tctcgcaaagttcagcgtcggctgc

SEQ ID NO: 378230 - DNA, 25 bp, Mus musculus
ccaggccggctatgatcccggggct

SEQ ID NO: 378231 - DNA, 25 bp, Mus musculus
gtgctcccgaggaccactgccgctt

SEQ ID NO: 378232 - DNA, 25 bp, Mus musculus
actgccgcttcatcccacccgctcc

SEQ ID NO: 378233 - DNA, 25 bp, Mus musculus
gcgcacccgccctcagggccgctca

SEQ ID NO: 378234 - DNA, 25 bp, Mus musculus
cgccgaaggcccaggtcgtagatgc

SEQ ID NO: 378235 - DNA, 25 bp, Mus musculus
acagcacggtctcatccgacgtgta

SEQ ID NO: 378236 - DNA, 25 bp, Mus musculus
aaggacacctcgtcctcataggccg

SEQ ID NO: 378237 - DNA, 25 bp, Mus musculus
agttctcgaagctccaccgcgtcgg

SEQ ID NO: 378238 - DNA, 25 bp, Mus musculus
gtctcatccgacgtgtagcccaggc

SEQ ID NO: 378239 - DNA, 25 bp, Mus musculus
agtagcggaacagcacggtctcatc

SEQ ID NO: 378240 - DNA, 25 bp, Mus musculus
gtagatgcggatggccgcctcgcac

SEQ ID NO: 378241 - DNA, 25 bp, Mus musculus
cctcataggccgtcgggcgacaaca

SEQ ID NO: 378242 - DNA, 25 bp, Mus musculus
tgcacgtccaggaaggacacctcgt

SEQ ID NO: 378243 - DNA, 25 bp, Mus musculus
acagctcttgcagcgtgtggtagcg

SEQ ID NO: 378244 - DNA, 25 bp, Mus musculus
cgcgccgacagctcttgcagcgtgt

SEQ ID NO: 378245 - DNA, 25 bp, Mus musculus
tgaggtagcatcacacgcacgcgca

SEQ ID NO: 378246 - DNA, 25 bp, Mus musculus
cggctgtgcacgtccaggaaggaca

SEQ ID NO: 378247 - DNA, 25 bp, Mus musculus
cccagggagaaagttctcgaagctc

SEQ ID NO: 378248 - DNA, 25 bp, Mus musculus
gtcgtgtacggagcccggcactgac

SEQ ID NO: 378249 - DNA, 25 bp, Mus musculus
gtcctgcccacagctgtaggggcgc

SEQ ID NO: 378250 - DNA, 25 bp, Mus musculus
actgcgtgcgccatccggatcgcgg

SEQ ID NO: 378251 - DNA, 25 bp, Mus musculus
atgacccggtcagtggtgactcctc

SEQ ID NO: 378252 - DNA, 25 bp, Mus musculus
cgggctccagatgacccggtcagtg

SEQ ID NO: 378253 - DNA, 25 bp, Mus musculus
gcttacctgccacgggctccagatg

SEQ ID NO: 378254 - DNA, 25 bp, Mus musculus
cggcactgacctggtaggggaaatt

SEQ ID NO: 378255 - DNA, 25 bp, Mus musculus
agagtcgtaggagcccagagcgcac

SEQ ID NO: 378256 - DNA, 25 bp, Mus musculus
gcatcgagagtcgtaggagcccaga

SEQ ID NO: 378257 - DNA, 25 bp, Mus musculus
ccttccacaggcatcgagagtcgta

SEQ ID NO: 378258 - DNA, 25 bp, Mus musculus
tggtccagcagccttccacaggcat

SEQ ID NO: 378259 - DNA, 25 bp, Mus musculus
cagggtttcctgtgaccacgaagta

SEQ ID NO: 378260 - DNA, 25 bp, Mus musculus
tgactgtttacttctgtgcgccgca

SEQ ID NO: 378261 - DNA, 25 bp, Mus musculus
ggactctgcttacctgccacgggct

SEQ ID NO: 378262 - DNA, 25 bp, Mus musculus
cgccagctgctgtaacgctgagctc

SEQ ID NO: 378263 - DNA, 25 bp, Mus musculus
catcaggcgggccacctgggcagcg

SEQ ID NO: 378264 - DNA, 25 bp, Mus musculus
cgcaggctgtgttgcgcacgcgcac

SEQ ID NO: 378265 - DNA, 25 bp, Mus musculus
tgctcgcaggctgtgttgcgcacgc

SEQ ID NO: 378266 - DNA, 25 bp, Mus musculus
cgccgccagctgctgtaacgctgag

SEQ ID NO: 378267 - DNA, 25 bp, Mus musculus
cttgctcgcaggctgtgttgcgcac

SEQ ID NO: 378268 - DNA, 25 bp, Mus musculus
ggaaacgcatcaggcgggccacctg

SEQ ID NO: 378269 - DNA, 25 bp, Mus musculus
tgggaaacgcatcaggcgggccacc

SEQ ID NO: 378270 - DNA, 25 bp, Mus musculus
aggtcaggaaggtgggaaacgcatc

SEQ ID NO: 378271 - DNA, 25 bp, Mus musculus
gccgcctccgaggtcaggaaggtgg

SEQ ID NO: 378272 - DNA, 25 bp, Mus musculus
atgggcgggacctagctcagtgggc

SEQ ID NO: 378273 - DNA, 25 bp, Mus musculus
caggcttgctcgcaggctgtgttgc

SEQ ID NO: 378274 - DNA, 25 bp, Mus musculus
cagctgctgtaacgctgagctctcc

SEQ ID NO: 378275 - DNA, 25 bp, Mus musculus
cacgcgcactcttgcggcgccgcca

SEQ ID NO: 378276 - DNA, 25 bp, Mus musculus
gaagactttcctgccacactccaga

SEQ ID NO: 378277 - DNA, 25 bp, Mus musculus
cgcgcgccttagcagcattgctgta

SEQ ID NO: 378278 - DNA, 25 bp, Mus musculus
acttccgtttcctgcgcagccttgg

SEQ ID NO: 378279 - DNA, 25 bp, Mus musculus
ctgatgtggccttcccggcgtccgt

SEQ ID NO: 378280 - DNA, 25 bp, Mus musculus
cattgctgtagtctgagcgtgcgca

SEQ ID NO: 378281 - DNA, 25 bp, Mus musculus
tttctttctgtaggctccagaggac

SEQ ID NO: 378282 - DNA, 25 bp, Mus musculus
acgagcgacccggaagactttcctg

SEQ ID NO: 378283 - DNA, 25 bp, Mus musculus
ttcctgccacactccagagctggtg

SEQ ID NO: 378284 - DNA, 25 bp, Mus musculus
ggtggcgcccattaaagctcagtga

SEQ ID NO: 378285 - DNA, 25 bp, Mus musculus
aaagctcagtgagtcgctggcgccc

SEQ ID NO: 378286 - DNA, 25 bp, Mus musculus
tggcgcccgtcagcgaagctgatgt

SEQ ID NO: 378287 - DNA, 25 bp, Mus musculus
tcagcgaagctgatgtggccttccc

SEQ ID NO: 378288 - DNA, 25 bp, Mus musculus
ctgagcgtgcgcatttctttctgta

SEQ ID NO: 378289 - DNA, 25 bp, Mus musculus
ctccagaggacacgagcgacccgga

SEQ ID NO: 378290 - DNA, 25 bp, Mus musculus
ccaaacgcagcggtgtcgggttcca

SEQ ID NO: 378291 - DNA, 25 bp, Mus musculus
ggcctcctggatcttcctacaaacg

SEQ ID NO: 378292 - DNA, 25 bp, Mus musculus
tgcgaactcggatatgacccatgga

SEQ ID NO: 378293 - DNA, 25 bp, Mus musculus
agccctagcgaatcccaactgcgaa

SEQ ID NO: 378294 - DNA, 25 bp, Mus musculus
gtccaaggaaacaaccgcagcccta

SEQ ID NO: 378295 - DNA, 25 bp, Mus musculus
ccgagctctctagggtccaaggaaa

SEQ ID NO: 378296 - DNA, 25 bp, Mus musculus
gctctgtccggaaccgagctctcta

SEQ ID NO: 378297 - DNA, 25 bp, Mus musculus
gttcacacaatattttccttcggga

SEQ ID NO: 378298 - DNA, 25 bp, Mus musculus
agttttctagattggggatctcggc

SEQ ID NO: 378299 - DNA, 25 bp, Mus musculus
ggatctcggcaaagaggacgctatg

SEQ ID NO: 378300 - DNA, 25 bp, Mus musculus
gacgctatgggtgcgcttgagcttc

SEQ ID NO: 378301 - DNA, 25 bp, Mus musculus
ttcccggagcggcatggtaaaggac

SEQ ID NO: 378302 - DNA, 25 bp, Mus musculus
atccggtgttttgggatgtgctgcc

SEQ ID NO: 378303 - DNA, 25 bp, Mus musculus
gcgaggaagacaatccggtgttttg

SEQ ID NO: 378304 - DNA, 25 bp, Mus musculus
cgtgttttgcggagttacggtgatt

SEQ ID NO: 378305 - DNA, 25 bp, Mus musculus
ggagttacggtgattccgctagacc

SEQ ID NO: 378306 - DNA, 25 bp, Mus musculus
cccactggtggcagtgcgtgttttg

SEQ ID NO: 378307 - DNA, 25 bp, Mus musculus
tccttgggtagaataccagccaatc

SEQ ID NO: 378308 - DNA, 25 bp, Mus musculus
gggcaggtccttgggtagaatacca

SEQ ID NO: 378309 - DNA, 25 bp, Mus musculus
tcatagtgcccgtcagaggtgaagg

SEQ ID NO: 378310 - DNA, 25 bp, Mus musculus
cccattggctttcatagtgcccgtc

SEQ ID NO: 378311 - DNA, 25 bp, Mus musculus
tgcgcccggcaacggttaccaagct

SEQ ID NO: 378312 - DNA, 25 bp, Mus musculus
cacggctacagtctctatggcggcg

SEQ ID NO: 378313 - DNA, 25 bp, Mus musculus
agtaacagtctccacggctacagtc

SEQ ID NO: 378314 - DNA, 25 bp, Mus musculus
tccgcgttggtaagtaacagtctcc

SEQ ID NO: 378315 - DNA, 25 bp, Mus musculus
tgtcgctccgcgttggtaagtaaca

SEQ ID NO: 378316 - DNA, 25 bp, Mus musculus
ggcaacggttaccaagctgcacgcc

SEQ ID NO: 378317 - DNA, 25 bp, Mus musculus
gattccgctagaccggaggcgctca

SEQ ID NO: 378318 - DNA, 25 bp, Mus musculus
ataaacaactcaccacaggcattcc

SEQ ID NO: 378319 - DNA, 25 bp, Mus musculus
gggctctgcctgttgtcagccggac

SEQ ID NO: 378320 - DNA, 25 bp, Mus musculus
cggctcatcacggtcctgctgcggg

SEQ ID NO: 378321 - DNA, 25 bp, Mus musculus
ccggcttgcacaaaggcgcctttca

SEQ ID NO: 378322 - DNA, 25 bp, Mus musculus
ctacacaccggcttgcacaaaggcg

SEQ ID NO: 378323 - DNA, 25 bp, Mus musculus
gcagggagcgtggtacgcctctccc

SEQ ID NO: 378324 - DNA, 25 bp, Mus musculus
ggggcagtgcttgcaccctgccagc

SEQ ID NO: 378325 - DNA, 25 bp, Mus musculus
ctgggaaaataagccgcaagccacg

SEQ ID NO: 378326 - DNA, 25 bp, Mus musculus
aggcattcccttgtctgcagcgcga

SEQ ID NO: 378327 - DNA, 25 bp, Mus musculus
gcccaccgcaaacttcaacaaaata

SEQ ID NO: 378328 - DNA, 25 bp, Mus musculus
gacgcgtgcggtgttcgcactccgc

SEQ ID NO: 378329 - DNA, 25 bp, Mus musculus
ctctaccctactgtcctgctggaga

SEQ ID NO: 378330 - DNA, 25 bp, Mus musculus
gcgacgcttgccagctgggaaaata

SEQ ID NO: 378331 - DNA, 25 bp, Mus musculus
ctccagatgccggttcccgagtgag

SEQ ID NO: 378332 - DNA, 25 bp, Mus musculus
tgacagcgccggtggttagtttacc

SEQ ID NO: 378333 - DNA, 25 bp, Mus musculus
atgttcggtgctcctgcgtgacagc

SEQ ID NO: 378334 - DNA, 25 bp, Mus musculus
tgggcgcgcgcaaactcggtgccca

SEQ ID NO: 378335 - DNA, 25 bp, Mus musculus
ggcggaggcttcttacctgattgtc

SEQ ID NO: 378336 - DNA, 25 bp, Mus musculus
tgattgtccatgactggcgcccgcc

SEQ ID NO: 378337 - DNA, 25 bp, Mus musculus
ccgccgctctcattgtctgtcgggg

SEQ ID NO: 378338 - DNA, 25 bp, Mus musculus
cctccgagcctgtcagaaggccaga

SEQ ID NO: 378339 - DNA, 25 bp, Mus musculus
gtcagaaggccagagacccgcgcgt

SEQ ID NO: 378340 - DNA, 25 bp, Mus musculus
cgggcgacagtcagaacgacgaagc

SEQ ID NO: 378341 - DNA, 25 bp, Mus musculus
cgacgaagccgtcagccaatagaaa

SEQ ID NO: 378342 - DNA, 25 bp, Mus musculus
tcagccaatagaaagccggcgccgc

SEQ ID NO: 378343 - DNA, 25 bp, Mus musculus
cctaagagtttaagttcgagccctg

SEQ ID NO: 378344 - DNA, 25 bp, Mus musculus
agtttaagttcgagccctgcggagg

SEQ ID NO: 378345 - DNA, 25 bp, Mus musculus
agcggctctagaggggacgtcccta

SEQ ID NO: 378346 - DNA, 25 bp, Mus musculus
cccatagtggtggagcagacggtac

SEQ ID NO: 378347 - DNA, 25 bp, Mus musculus
gggaacagcgcaacctcgtccgaga

SEQ ID NO: 378348 - DNA, 25 bp, Mus musculus
tccgagaacttccatgggactaata

SEQ ID NO: 378349 - DNA, 25 bp, Mus musculus
ttcgaacgcctacctctaacgagga

SEQ ID NO: 378350 - DNA, 25 bp, Mus musculus
gccttcttcagttccgcttattctg

SEQ ID NO: 378351 - DNA, 25 bp, Mus musculus
cgcttattctgttctcggaagtgga

SEQ ID NO: 378352 - DNA, 25 bp, Mus musculus
tggatgagccagtgactcccgcaaa

SEQ ID NO: 378353 - DNA, 25 bp, Mus musculus
ctcccgcaaagcacgccgggtgttg

SEQ ID NO: 378354 - DNA, 25 bp, Mus musculus
ggtgttgtagttccggaagccaagc

SEQ ID NO: 378355 - DNA, 25 bp, Mus musculus
gttgtctcgccttgccgtgcatttc

SEQ ID NO: 378356 - DNA, 25 bp, Mus musculus
ggcgagcgcgcttatgacatatact

SEQ ID NO: 378357 - DNA, 25 bp, Mus musculus
cctgcatggaactgcgacgcgagct

SEQ ID NO: 378358 - DNA, 25 bp, Mus musculus
gccatggactgctgtgagctgctca

SEQ ID NO: 378359 - DNA, 25 bp, Mus musculus
agggaggatgacctttcacatcttc

SEQ ID NO: 378360 - DNA, 25 bp, Mus musculus
cggctcagactctgccgtgctgggc

SEQ ID NO: 378361 - DNA, 25 bp, Mus musculus
tgcgcggctcagactctgccgtgct

SEQ ID NO: 378362 - DNA, 25 bp, Mus musculus
agactctgccgtgctgggccgcctg

SEQ ID NO: 378363 - DNA, 25 bp, Mus musculus
tgggccgcctgcgtgatgaggccgt

SEQ ID NO: 378364 - DNA, 25 bp, Mus musculus
atgaggccgtggtgcatccaggctt

SEQ ID NO: 378365 - DNA, 25 bp, Mus musculus
cgtggtgcatccaggcttcctgagc

SEQ ID NO: 378366 - DNA, 25 bp, Mus musculus
ggaggacacgctaacacgcgaactg

SEQ ID NO: 378367 - DNA, 25 bp, Mus musculus
gacacgctaacacgcgaactggagc

SEQ ID NO: 378368 - DNA, 25 bp, Mus musculus
aacacgcgaactggagccccagctg

SEQ ID NO: 378369 - DNA, 25 bp, Mus musculus
ggcgccggcgctacgagtacgacca

SEQ ID NO: 378370 - DNA, 25 bp, Mus musculus
cgctacgagtacgaccactgggacg

SEQ ID NO: 378371 - DNA, 25 bp, Mus musculus
acgagtacgaccactgggacgcggt

SEQ ID NO: 378372 - DNA, 25 bp, Mus musculus
taaggggacgcccactgggacatag

SEQ ID NO: 378373 - DNA, 25 bp, Mus musculus
atgcggttgctttctgggtgcgcct

SEQ ID NO: 378374 - DNA, 25 bp, Mus musculus
cggggcacgctgtgagcgctaaaat

SEQ ID NO: 378375 - DNA, 25 bp, Mus musculus
tggtctggcttctccgctgacgtag

SEQ ID NO: 378376 - DNA, 25 bp, Mus musculus
ctccgctgacactggacagccaagg

SEQ ID NO: 378377 - DNA, 25 bp, Mus musculus
tggcacttgccttccctacggcggt

SEQ ID NO: 378378 - DNA, 25 bp, Mus musculus
tgagcgctaaaatggctgctcgggc

SEQ ID NO: 378379 - DNA, 25 bp, Mus musculus
ctgacggagttttcccgcccgcagg

SEQ ID NO: 378380 - DNA, 25 bp, Mus musculus
agaggcaccggcgaacttagaattg

SEQ ID NO: 378381 - DNA, 25 bp, Mus musculus
cgaacttagaattggcgcctctgga

SEQ ID NO: 378382 - DNA, 25 bp, Mus musculus
cctctggaaagtctcggtgcgtctt

SEQ ID NO: 378383 - DNA, 25 bp, Mus musculus
gcgtcttgcggtcctgcagcccgga

SEQ ID NO: 378384 - DNA, 25 bp, Mus musculus
tcccggagatgcttcaggtggaccg

SEQ ID NO: 378385 - DNA, 25 bp, Mus musculus
gggtgcgagcaccagggacatccca

SEQ ID NO: 378386 - DNA, 25 bp, Mus musculus
gccgctggctctctgatcgccggga

SEQ ID NO: 378387 - DNA, 25 bp, Mus musculus
cgccgatcccgggttgtgttgtccg

SEQ ID NO: 378388 - DNA, 25 bp, Mus musculus
gcttcggagagaaagccaccttttg

SEQ ID NO: 378389 - DNA, 25 bp, Mus musculus
tgcgcaagcgtaaatgtgtccaaga

SEQ ID NO: 378390 - DNA, 25 bp, Mus musculus
acgacgtactcggtgacattctggc

SEQ ID NO: 378391 - DNA, 25 bp, Mus musculus
ggatcccgaggatcttgcaaaatga

SEQ ID NO: 378392 - DNA, 25 bp, Mus musculus
ggcggcgttctctgtttatatacca

SEQ ID NO: 378393 - DNA, 25 bp, Mus musculus
gcgcagccgctgtaactactctaga

SEQ ID NO: 378394 - DNA, 25 bp, Mus musculus
tgacccggaagttgagctgccacac

SEQ ID NO: 378395 - DNA, 25 bp, Mus musculus
gcatgcgttagagcctgacccggaa

SEQ ID NO: 378396 - DNA, 25 bp, Mus musculus
gtgatgctgtgctttggatttccaa

SEQ ID NO: 378397 - DNA, 25 bp, Mus musculus
ggcacctttcctggttgtcacgtta

SEQ ID NO: 378398 - DNA, 25 bp, Mus musculus
tgaacttcgttgtgtccctcggctc

SEQ ID NO: 378399 - DNA, 25 bp, Mus musculus
tcggcctgacgggatgaacttcgtt

SEQ ID NO: 378400 - DNA, 25 bp, Mus musculus
ggtctgttctgcgacacctctgtcc

SEQ ID NO: 378401 - DNA, 25 bp, Mus musculus
ggtagacgcgaactcgatcctcttg

SEQ ID NO: 378402 - DNA, 25 bp, Mus musculus
acccactaaggcaggatggacggtg

SEQ ID NO: 378403 - DNA, 25 bp, Mus musculus
acccgacaacgtcgcacgacagtgg

SEQ ID NO: 378404 - DNA, 25 bp, Mus musculus
acgtcgcacgacagtggctactgga

SEQ ID NO: 378405 - DNA, 25 bp, Mus musculus
cacgacagtggctactggaggagcc

SEQ ID NO: 378406 - DNA, 25 bp, Mus musculus
cagtggctactggaggagcctcttc

SEQ ID NO: 378407 - DNA, 25 bp, Mus musculus
ggctactggaggagcctcttccgta

SEQ ID NO: 378408 - DNA, 25 bp, Mus musculus
tggaggagcctcttccgtaagcctc

SEQ ID NO: 378409 - DNA, 25 bp, Mus musculus
ggagcctcttccgtaagcctctgca

SEQ ID NO: 378410 - DNA, 25 bp, Mus musculus
cgtaagcctctgcacccatcgagcg

SEQ ID NO: 378411 - DNA, 25 bp, Mus musculus
tgcacccatcgagcgcttcccagcg

SEQ ID NO: 378412 - DNA, 25 bp, Mus musculus
agactctggccacgagcccgaggct

SEQ ID NO: 378413 - DNA, 25 bp, Mus musculus
cgaggctggcatcaagggcacaccc

SEQ ID NO: 378414 - DNA, 25 bp, Mus musculus
tttccggcgctacccactaaggcag

SEQ ID NO: 378415 - DNA, 25 bp, Mus musculus
cggcgctacccactaaggcaggatg

SEQ ID NO: 378416 - DNA, 25 bp, Mus musculus
gggcggagcctatgaaaattctctg

SEQ ID NO: 378417 - DNA, 25 bp, Mus musculus
gctctgatcagtcacgtggccttga

SEQ ID NO: 378418 - DNA, 25 bp, Mus musculus
ctctaggatgagagtgacggctctg

SEQ ID NO: 378419 - DNA, 25 bp, Mus musculus
cgagttccaccttctcggggcggct

SEQ ID NO: 378420 - DNA, 25 bp, Mus musculus
gaggcccaatgaagcgcgagttcca

SEQ ID NO: 378421 - DNA, 25 bp, Mus musculus
tcacgcgagaagtcaggaggcccaa

SEQ ID NO: 378422 - DNA, 25 bp, Mus musculus
cgggcaattggaagtcacgcgagaa

SEQ ID NO: 378423 - DNA, 25 bp, Mus musculus
taggactcaataagcccagggctgc

SEQ ID NO: 378424 - DNA, 25 bp, Mus musculus
gaccagtcagagcttcggaagatgc

SEQ ID NO: 378425 - DNA, 25 bp, Mus musculus
gtaaatccgggcgaccagtcagagc

SEQ ID NO: 378426 - DNA, 25 bp, Mus musculus
gcccgccaatcgtgggccgtaaatc

SEQ ID NO: 378427 - DNA, 25 bp, Mus musculus
acgccgaggaacagccagtagtata

SEQ ID NO: 378428 - DNA, 25 bp, Mus musculus
tcaacgcgggaacaaggcctcgctc

SEQ ID NO: 378429 - DNA, 25 bp, Mus musculus
acctccggtgttgtagtccgacatg

SEQ ID NO: 378430 - DNA, 25 bp, Mus musculus
gctgctctttgcagacctgcctgga

SEQ ID NO: 378431 - DNA, 25 bp, Mus musculus
tcagactctctgaaggctgctcttt

SEQ ID NO: 378432 - DNA, 25 bp, Mus musculus
gctccggcacttgctggaagtgata

SEQ ID NO: 378433 - DNA, 25 bp, Mus musculus
tcgcagcccgctaggcattcttaaa

SEQ ID NO: 378434 - DNA, 25 bp, Mus musculus
ttattggtcaatgcgccctagctgc

SEQ ID NO: 378435 - DNA, 25 bp, Mus musculus
gcgcggctgcaaagttaaatcctta

SEQ ID NO: 378436 - DNA, 25 bp, Mus musculus
gcgcgcctccttttcttggtgacac

SEQ ID NO: 378437 - DNA, 25 bp, Mus musculus
tcaacaaagaggtgtgggctccctc

SEQ ID NO: 378438 - DNA, 25 bp, Mus musculus
tcgcccgcctgctctagttagattc

SEQ ID NO: 378439 - DNA, 25 bp, Mus musculus
cccaggtctacgcaaagaattctga

SEQ ID NO: 378440 - DNA, 25 bp, Mus musculus
ttcaagtttttgcttctcccaggtc

SEQ ID NO: 378441 - DNA, 25 bp, Mus musculus
ctgacagcgcattcctgggacggta

SEQ ID NO: 378442 - DNA, 25 bp, Mus musculus
aggctctggttttgcacatctgaca

SEQ ID NO: 378443 - DNA, 25 bp, Mus musculus
gccgtccttgttgctgtctagttcc

SEQ ID NO: 378444 - DNA, 25 bp, Mus musculus
tgtgcttacacctgctcatttccgc

SEQ ID NO: 378445 - DNA, 25 bp, Mus musculus
ctcgacccaagatgcggtaggaatt

SEQ ID NO: 378446 - DNA, 25 bp, Mus musculus
cgcaatggggttcccgttacaggtg

SEQ ID NO: 378447 - DNA, 25 bp, Mus musculus
tgaactcagaagtgccgggcatttg

SEQ ID NO: 378448 - DNA, 25 bp, Mus musculus
taacaggtaggtactgtccggggca

SEQ ID NO: 378449 - DNA, 25 bp, Mus musculus
ccctccggctggagcctaacaggta

SEQ ID NO: 378450 - DNA, 25 bp, Mus musculus
ctcttggcgtttggtttgccgatgc

SEQ ID NO: 378451 - DNA, 25 bp, Mus musculus
gaagtcctgtccttggcgtcaccaa

SEQ ID NO: 378452 - DNA, 25 bp, Mus musculus
ccctctcagacgctggagtcaggta

SEQ ID NO: 378453 - DNA, 25 bp, Mus musculus
tcagccaggctcaggtgcacaagcc

SEQ ID NO: 378454 - DNA, 25 bp, Mus musculus
gggaacctgagcgaagtccctctca

SEQ ID NO: 378455 - DNA, 25 bp, Mus musculus
tttaatctctgacccttggcgccga

SEQ ID NO: 378456 - DNA, 25 bp, Mus musculus
ctccaagattgggttgcctgtcgct

SEQ ID NO: 378457 - DNA, 25 bp, Mus musculus
tgactaaactttccgggtcacgtga

SEQ ID NO: 378458 - DNA, 25 bp, Mus musculus
tggctgcggagctctgtctctgcgc

SEQ ID NO: 378459 - DNA, 25 bp, Mus musculus
cccgatctggttaccgcattgaccg

SEQ ID NO: 378460 - DNA, 25 bp, Mus musculus
gtcacccgcgtgctccgcctcctgg

SEQ ID NO: 378461 - DNA, 25 bp, Mus musculus
cagtactcacgtcaccgctgggtca

SEQ ID NO: 378462 - DNA, 25 bp, Mus musculus
tttgcggagcagtactcacgtcacc

SEQ ID NO: 378463 - DNA, 25 bp, Mus musculus
cccgggcgtctctatatttgcggag

SEQ ID NO: 378464 - DNA, 25 bp, Mus musculus
tctagctctggacgagatggctgcg

SEQ ID NO: 378465 - DNA, 25 bp, Mus musculus
tggctctagctctggacgagatggc

SEQ ID NO: 378466 - DNA, 25 bp, Mus musculus
tcgaccggccgctgtggctctagct

SEQ ID NO: 378467 - DNA, 25 bp, Mus musculus
acgatttcccgcatggtggtggcgc

SEQ ID NO: 378468 - DNA, 25 bp, Mus musculus
caggtgcacgatttcccgcatggtg

SEQ ID NO: 378469 - DNA, 25 bp, Mus musculus
ttgaccggcttgcaggtgcacgatt

SEQ ID NO: 378470 - DNA, 25 bp, Mus musculus
gttaccgcattgaccggcttgcagg

SEQ ID NO: 378471 - DNA, 25 bp, Mus musculus
gcgtctctatatttgcggagcagta

SEQ ID NO: 378472 - DNA, 25 bp, Mus musculus
cgtgcactgaccgaccgtggtaatg

SEQ ID NO: 378473 - DNA, 25 bp, Mus musculus
atgcggcgctcctcagagataccgg

SEQ ID NO: 378474 - DNA, 25 bp, Mus musculus
gtagcctataaagcacgggcactgg

SEQ ID NO: 378475 - DNA, 25 bp, Mus musculus
gtaatggaccagcacacacttgatg

SEQ ID NO: 378476 - DNA, 25 bp, Mus musculus
cacttgatgtggaggataccgcgga

SEQ ID NO: 378477 - DNA, 25 bp, Mus musculus
tgccagacatccagcaggtacttcg

SEQ ID NO: 378478 - DNA, 25 bp, Mus musculus
ggaaaaggcgcctcggtagcctata

SEQ ID NO: 378479 - DNA, 25 bp, Mus musculus
cacggatgctgcctaccctgcggtt

SEQ ID NO: 378480 - DNA, 25 bp, Mus musculus
ccctgcggttaatgttcgggatcgc

SEQ ID NO: 378481 - DNA, 25 bp, Mus musculus
acccaaagctctatggcctagtcgc

SEQ ID NO: 378482 - DNA, 25 bp, Mus musculus
atcgccgcctgtgttcctatcttca

SEQ ID NO: 378483 - DNA, 25 bp, Mus musculus
ttttgctgcttctgatcgccgcctg

SEQ ID NO: 378484 - DNA, 25 bp, Mus musculus
gctgcgctcctctcagatactgtgc

SEQ ID NO: 378485 - DNA, 25 bp, Mus musculus
ggcctagtcgctttggttttgctgc

SEQ ID NO: 378486 - DNA, 25 bp, Mus musculus
ggccgctggggtccgaaaccagcaa

SEQ ID NO: 378487 - DNA, 25 bp, Mus musculus
ttctctctggcgaagcagtggctgt

SEQ ID NO: 378488 - DNA, 25 bp, Mus musculus
tctctggcgaagcagtggctgttga

SEQ ID NO: 378489 - DNA, 25 bp, Mus musculus
aagcagtggctgttgaggatccgct

SEQ ID NO: 378490 - DNA, 25 bp, Mus musculus
aggatccgctgcagggaggatttca

SEQ ID NO: 378491 - DNA, 25 bp, Mus musculus
atccgctgcagggaggatttcacca

SEQ ID NO: 378492 - DNA, 25 bp, Mus musculus
cgctgcagggaggatttcaccatcc

SEQ ID NO: 378493 - DNA, 25 bp, Mus musculus
tgcagggaggatttcaccatccggc

SEQ ID NO: 378494 - DNA, 25 bp, Mus musculus
gaaaccagcaaaaacctccgctgca

SEQ ID NO: 378495 - DNA, 25 bp, Mus musculus
ggatttcaccatccggccgctgggg

SEQ ID NO: 378496 - DNA, 25 bp, Mus musculus
tggcgctgcgtttgtccccttcctt

SEQ ID NO: 378497 - DNA, 25 bp, Mus musculus
tgaagcgtggcgctgcgtttgtccc

SEQ ID NO: 378498 - DNA, 25 bp, Mus musculus
gaggatttcaccatccggccgctgg

SEQ ID NO: 378499 - DNA, 25 bp, Mus musculus
cttccttctctctggcgaagcagtg

SEQ ID NO: 378500 - DNA, 25 bp, Mus musculus
tgctccatccaccggcggagctatg

SEQ ID NO: 378501 - DNA, 25 bp, Mus musculus
ggcctacccacttttcagccaatag

SEQ ID NO: 378502 - DNA, 25 bp, Mus musculus
cttttcagccaatagtcgcacgacg

SEQ ID NO: 378503 - DNA, 25 bp, Mus musculus
gcctgataaggcctacccacttttc

SEQ ID NO: 378504 - DNA, 25 bp, Mus musculus
acacagcctctgacgcctgataagg

SEQ ID NO: 378505 - DNA, 25 bp, Mus musculus
cactgccatctctggggctgcgact

SEQ ID NO: 378506 - DNA, 25 bp, Mus musculus
tgcgttgggctctcgccgctgagcc

SEQ ID NO: 378507 - DNA, 25 bp, Mus musculus
catcggcactgcgttgggctctcgc

SEQ ID NO: 378508 - DNA, 25 bp, Mus musculus
agcagcgacaagtatccccatcggc

SEQ ID NO: 378509 - DNA, 25 bp, Mus musculus
tggatacggcctgagcagccgctca

SEQ ID NO: 378510 - DNA, 25 bp, Mus musculus
tcagccggtggatacggcctgagca

SEQ ID NO: 378511 - DNA, 25 bp, Mus musculus
cctgcggggctcactgtgagagtca

SEQ ID NO: 378512 - DNA, 25 bp, Mus musculus
gacgagaccactagcggcctgcagt

SEQ ID NO: 378513 - DNA, 25 bp, Mus musculus
caacgaggccaagcctgcggggctc

SEQ ID NO: 378514 - DNA, 25 bp, Mus musculus
agagtagaggcgtggaaaggcacga

SEQ ID NO: 378515 - DNA, 25 bp, Mus musculus
cggggcatcatctggactccgccct

SEQ ID NO: 378516 - DNA, 25 bp, Mus musculus
gcatcatctggactccgccctcaga

SEQ ID NO: 378517 - DNA, 25 bp, Mus musculus
cccgctgggggctcggcagagtaga

SEQ ID NO: 378518 - DNA, 25 bp, Mus musculus
tagaggcgtggaaaggcacgaaggg

SEQ ID NO: 378519 - DNA, 25 bp, Mus musculus
cgtactttgaggtggcgcatggccc

SEQ ID NO: 378520 - DNA, 25 bp, Mus musculus
acgaaggggcgttgtaatctaggct

SEQ ID NO: 378521 - DNA, 25 bp, Mus musculus
cgttgtaatctaggctggtgggcgt

SEQ ID NO: 378522 - DNA, 25 bp, Mus musculus
tgtaatctaggctggtgggcgtggc

SEQ ID NO: 378523 - DNA, 25 bp, Mus musculus
cggggcgaggttgggcacactgccc

SEQ ID NO: 378524 - DNA, 25 bp, Mus musculus
gcacactgccctggggctgagtgta

SEQ ID NO: 378525 - DNA, 25 bp, Mus musculus
actgccctggggctgagtgtacggt

SEQ ID NO: 378526 - DNA, 25 bp, Mus musculus
cgcatggccctttaatggggggcgg

SEQ ID NO: 378527 - DNA, 25 bp, Mus musculus
cacgaaggggcgttgtaatctaggc

SEQ ID NO: 378528 - DNA, 25 bp, Mus musculus
cgcagccggagacctgaagtcacta

SEQ ID NO: 378529 - DNA, 25 bp, Mus musculus
ggcggccacaatcgaaatcgtgcca

SEQ ID NO: 378530 - DNA, 25 bp, Mus musculus
cacctccgcggaagagtttacgctt

SEQ ID NO: 378531 - DNA, 25 bp, Mus musculus
aaagccgagctggaaagcacacctc

SEQ ID NO: 378532 - DNA, 25 bp, Mus musculus
ttggagcagcagatgaaagccgagc

SEQ ID NO: 378533 - DNA, 25 bp, Mus musculus
acttggttcgaacagtcagcaattg

SEQ ID NO: 378534 - DNA, 25 bp, Mus musculus
ggtgctcatggggaaagcctttcga

SEQ ID NO: 378535 - DNA, 25 bp, Mus musculus
tgcccggaaacgaggatccaacgtg

SEQ ID NO: 378536 - DNA, 25 bp, Mus musculus
cgtgtttactccttactcgacggca

SEQ ID NO: 378537 - DNA, 25 bp, Mus musculus
tgttctaaacgataacgcagccgga

SEQ ID NO: 378538 - DNA, 25 bp, Mus musculus
gactcggttttacatcctgtggatg

SEQ ID NO: 378539 - DNA, 25 bp, Mus musculus
ttgccttcgaggtgaacgacatgta

SEQ ID NO: 378540 - DNA, 25 bp, Mus musculus
gtttacgcttacaaggctcctcgga

SEQ ID NO: 378541 - DNA, 25 bp, Mus musculus
ctgtggatgcacaggaccgtgttta

SEQ ID NO: 378542 - DNA, 25 bp, Mus musculus
ggacaaatacgtgaagttcgtgaaa

SEQ ID NO: 378543 - DNA, 25 bp, Mus musculus
tggaaccgctaagccccgagagatt

SEQ ID NO: 378544 - DNA, 25 bp, Mus musculus
acctccgctgttccgggtcgctggg

SEQ ID NO: 378545 - DNA, 25 bp, Mus musculus
cgctgttccgggtcgctgggatttc

SEQ ID NO: 378546 - DNA, 25 bp, Mus musculus
ctgggatttcggtgcctcctaccca

SEQ ID NO: 378547 - DNA, 25 bp, Mus musculus
tttcggtgcctcctacccaggtgac

SEQ ID NO: 378548 - DNA, 25 bp, Mus musculus
gtgcctcctacccaggtgaccctaa

SEQ ID NO: 378549 - DNA, 25 bp, Mus musculus
caatcgcgctcctgcaatcaggatc

SEQ ID NO: 378550 - DNA, 25 bp, Mus musculus
cgcgctcctgcaatcaggatcagtt

SEQ ID NO: 378551 - DNA, 25 bp, Mus musculus
caggatcagtttgaggtgctggaac

SEQ ID NO: 378552 - DNA, 25 bp, Mus musculus
cagtttgaggtgctggaacgccaca

SEQ ID NO: 378553 - DNA, 25 bp, Mus musculus
gaggtgctggaacgccacacgcagt

SEQ ID NO: 378554 - DNA, 25 bp, Mus musculus
gccagcccttgctggaaccgctaag

SEQ ID NO: 378555 - DNA, 25 bp, Mus musculus
tttgttggacaaatacgtgaagttc

SEQ ID NO: 378556 - DNA, 25 bp, Mus musculus
gccaagagtatttccgcagagagca

SEQ ID NO: 378557 - DNA, 25 bp, Mus musculus
gcgcccgcagactgtcttggataga

SEQ ID NO: 378558 - DNA, 25 bp, Mus musculus
tgcgcgagggccacctaagacacgc

SEQ ID NO: 378559 - DNA, 25 bp, Mus musculus
cggatttgcgatggcgtacacgaaa

SEQ ID NO: 378560 - DNA, 25 bp, Mus musculus
taagacacgcctgggttcccggaca

SEQ ID NO: 378561 - DNA, 25 bp, Mus musculus
cgcatgacgcgtggctattcacttg

SEQ ID NO: 378562 - DNA, 25 bp, Mus musculus
ctattcacttggagagctattccgg

SEQ ID NO: 378563 - DNA, 25 bp, Mus musculus
tggatagatcctccggttctcccta

SEQ ID NO: 378564 - DNA, 25 bp, Mus musculus
tctccctaagggctgatggctccac

SEQ ID NO: 378565 - DNA, 25 bp, Mus musculus
atggctccaccctgaccagtaggga

SEQ ID NO: 378566 - DNA, 25 bp, Mus musculus
ggagcccgggatcttacaacgacca

SEQ ID NO: 378567 - DNA, 25 bp, Mus musculus
tcctcacttacctggaggggactcg

SEQ ID NO: 378568 - DNA, 25 bp, Mus musculus
tcagccgctgagcagcgaaatgccc

SEQ ID NO: 378569 - DNA, 25 bp, Mus musculus
cgacgggactcaacctgaaggctca

SEQ ID NO: 378570 - DNA, 25 bp, Mus musculus
gagggacgccctggacgactcgtcc

SEQ ID NO: 378571 - DNA, 25 bp, Mus musculus
tcgtcctcgaacatacccgggccaa

SEQ ID NO: 378572 - DNA, 25 bp, Mus musculus
atacccgggccaactagcgctacta

SEQ ID NO: 378573 - DNA, 25 bp, Mus musculus
ggccaactagcgctactaacccaag

SEQ ID NO: 378574 - DNA, 25 bp, Mus musculus
ctagcgctactaacccaagggatta

SEQ ID NO: 378575 - DNA, 25 bp, Mus musculus
ctactaacccaagggattatgaagg

SEQ ID NO: 378576 - DNA, 25 bp, Mus musculus
ttatgaaggaaagaaaccaggattg

SEQ ID NO: 378577 - DNA, 25 bp, Mus musculus
aaccaggattgcgacggaagactcc

SEQ ID NO: 378578 - DNA, 25 bp, Mus musculus
gacggaagactcctcggcaaactta

SEQ ID NO: 378579 - DNA, 25 bp, Mus musculus
agactcctcggcaaacttagttgtc

SEQ ID NO: 378580 - DNA, 25 bp, Mus musculus
cctcggcaaacttagttgtcagttt

SEQ ID NO: 378581 - DNA, 25 bp, Mus musculus
tttcccggcgttggagtcagccttc

SEQ ID NO: 378582 - DNA, 25 bp, Mus musculus
ttggagtcagccttccggacttccg

SEQ ID NO: 378583 - DNA, 25 bp, Mus musculus
gcgttggagtcagccttccggactt

SEQ ID NO: 378584 - DNA, 25 bp, Mus musculus
agcccgcaggctttggggtcgccta

SEQ ID NO: 378585 - DNA, 25 bp, Mus musculus
cccgcaggctttggggtcgcctaga

SEQ ID NO: 378586 - DNA, 25 bp, Mus musculus
gcaggctttggggtcgcctagacgc

SEQ ID NO: 378587 - DNA, 25 bp, Mus musculus
atcgcagggtggctgcggcaagcta

SEQ ID NO: 378588 - DNA, 25 bp, Mus musculus
caagctagggcccagagcgtgcgct

SEQ ID NO: 378589 - DNA, 25 bp, Mus musculus
aagctagggcccagagcgtgcgcta

SEQ ID NO: 378590 - DNA, 25 bp, Mus musculus
agctagggcccagagcgtgcgctaa

SEQ ID NO: 378591 - DNA, 25 bp, Mus musculus
ccagagcgtgcgctaaggaagtccc

SEQ ID NO: 378592 - DNA, 25 bp, Mus musculus
agcgtgcgctaaggaagtccccggc

SEQ ID NO: 378593 - DNA, 25 bp, Mus musculus
gtgcgctaaggaagtccccggcgcc

SEQ ID NO: 378594 - DNA, 25 bp, Mus musculus
ccagcctcccgccaagcccgcaggc

SEQ ID NO: 378595 - DNA, 25 bp, Mus musculus
caagcccgcaggctttggggtcgcc

SEQ ID NO: 378596 - DNA, 25 bp, Mus musculus
aagcccgcaggctttggggtcgcct

SEQ ID NO: 378597 - DNA, 25 bp, Mus musculus
cggggtccaggatcgcagggtggct

SEQ ID NO: 378598 - DNA, 25 bp, Mus musculus
gcctagacgctgtcgcaggtaacca

SEQ ID NO: 378599 - DNA, 25 bp, Mus musculus
ggctcgctctgcactcgtgacgtaa

SEQ ID NO: 378600 - DNA, 25 bp, Mus musculus
cactcgtgacgtaacccggcattcg

SEQ ID NO: 378601 - DNA, 25 bp, Mus musculus
tgcactcgtgacgtaacccggcatt

SEQ ID NO: 378602 - DNA, 25 bp, Mus musculus
tctgcactcgtgacgtaacccggca

SEQ ID NO: 378603 - DNA, 25 bp, Mus musculus
gctctgcactcgtgacgtaacccgg

SEQ ID NO: 378604 - DNA, 25 bp, Mus musculus
gctcgctctgcactcgtgacgtaac

SEQ ID NO: 378605 - DNA, 25 bp, Mus musculus
accttccggcttgccaactccagcg

SEQ ID NO: 378606 - DNA, 25 bp, Mus musculus
gcgtccctccagctgcacagcgcca

SEQ ID NO: 378607 - DNA, 25 bp, Mus musculus
cgcaggtaaccacgcgcgtccctcc

SEQ ID NO: 378608 - DNA, 25 bp, Mus musculus
gctgtcgcaggtaaccacgcgcgtc

SEQ ID NO: 378609 - DNA, 25 bp, Mus musculus
tagacgctgtcgcaggtaaccacgc

SEQ ID NO: 378610 - DNA, 25 bp, Mus musculus
gtcgcctagacgctgtcgcaggtaa

SEQ ID NO: 378611 - DNA, 25 bp, Mus musculus
acgctgtcgcaggtaaccacgcgcg

SEQ ID NO: 378612 - DNA, 25 bp, Mus musculus
ggctcttcacgtcttccagcaggtc

SEQ ID NO: 378613 - DNA, 25 bp, Mus musculus
ccaaaggagtccgaccgcagaggca

SEQ ID NO: 378614 - DNA, 25 bp, Mus musculus
cggggatttctcctgctagcttgtc

SEQ ID NO: 378615 - DNA, 25 bp, Mus musculus
gcagaggttgtgaaccagccagcca

SEQ ID NO: 378616 - DNA, 25 bp, Mus musculus
ccaactgccgggctgagaagcgaga

SEQ ID NO: 378617 - DNA, 25 bp, Mus musculus
agcgagaggggaaacaatcactttc

SEQ ID NO: 378618 - DNA, 25 bp, Mus musculus
aatcactttcggatggagccctcca

SEQ ID NO: 378619 - DNA, 25 bp, Mus musculus
gatctggatccgcaagcccggctct

SEQ ID NO: 378620 - DNA, 25 bp, Mus musculus
ccggagtcctggaactgcccaaagc

SEQ ID NO: 378621 - DNA, 25 bp, Mus musculus
ggtcttgcttcggaaaaggctccaa

SEQ ID NO: 378622 - DNA, 25 bp, Mus musculus
ggctccaagaaaagtttggctcttc

SEQ ID NO: 378623 - DNA, 25 bp, Mus musculus
caggagtcctgtggactgcggtacc

SEQ ID NO: 378624 - DNA, 25 bp, Mus musculus
atcacaagacggagagacgcgtgcg

SEQ ID NO: 378625 - DNA, 25 bp, Mus musculus
tccaagttactttggcggccggaga

SEQ ID NO: 378626 - DNA, 25 bp, Mus musculus
gcccagacccaccttaagcaggatg

SEQ ID NO: 378627 - DNA, 25 bp, Mus musculus
ccgcgccaagtgctgcgaggagacg

SEQ ID NO: 378628 - DNA, 25 bp, Mus musculus
ccagggccgcgtagcgccgcgccaa

SEQ ID NO: 378629 - DNA, 25 bp, Mus musculus
gccagcggtcccaggaagcgcacgg

SEQ ID NO: 378630 - DNA, 25 bp, Mus musculus
gcccggaagagctgcacggcggcca

SEQ ID NO: 378631 - DNA, 25 bp, Mus musculus
tgcaagccatctcgagggccgtggc

SEQ ID NO: 378632 - DNA, 25 bp, Mus musculus
cttgcaagccatctcgagggccgtg

SEQ ID NO: 378633 - DNA, 25 bp, Mus musculus
tttccgcttgcaagccatctcgagg

SEQ ID NO: 378634 - DNA, 25 bp, Mus musculus
ccacgatgggggcacactctgaggc

SEQ ID NO: 378635 - DNA, 25 bp, Mus musculus
gctcctgacagtccgcgtcgccgct

SEQ ID NO: 378636 - DNA, 25 bp, Mus musculus
ccctgtgacagtcgcaggggttttc

SEQ ID NO: 378637 - DNA, 25 bp, Mus musculus
accttaagcaggatggacggcggca

SEQ ID NO: 378638 - DNA, 25 bp, Mus musculus
gggagtgagcatccctgcgcctcct

SEQ ID NO: 378639 - DNA, 25 bp, Mus musculus
gcagttggttgatgtctgggatctc

SEQ ID NO: 378640 - DNA, 25 bp, Mus musculus
ctgcttagggctgggccggcctctt

SEQ ID NO: 378641 - DNA, 25 bp, Mus musculus
ggtttctgctctcgctgcttagggc

SEQ ID NO: 378642 - DNA, 25 bp, Mus musculus
catgcttggaccaggccacggagat

SEQ ID NO: 378643 - DNA, 25 bp, Mus musculus
ggacgctaaagggtttctgctctcg

SEQ ID NO: 378644 - DNA, 25 bp, Mus musculus
cgctctaggacgctaaagggtttct

SEQ ID NO: 378645 - DNA, 25 bp, Mus musculus
gctatggccgctctaggacgctaaa

SEQ ID NO: 378646 - DNA, 25 bp, Mus musculus
ctccgcccatttccgcaccacgcta

SEQ ID NO: 378647 - DNA, 25 bp, Mus musculus
ctgagcatgcttggaccaggccacg

SEQ ID NO: 378648 - DNA, 25 bp, Mus musculus
cagggcactgagcatgcttggacca

SEQ ID NO: 378649 - DNA, 25 bp, Mus musculus
ccaccagccgagtcagggcactgag

SEQ ID NO: 378650 - DNA, 25 bp, Mus musculus
gggtgtggagactcccgacccacca

SEQ ID NO: 378651 - DNA, 25 bp, Mus musculus
tgtgtccacgcgttagaatcccggt

SEQ ID NO: 378652 - DNA, 25 bp, Mus musculus
cgggcgtggacagcactgtgtccac

SEQ ID NO: 378653 - DNA, 25 bp, Mus musculus
gcaccacgctatggccgctctagga

SEQ ID NO: 378654 - DNA, 25 bp, Mus musculus
gcgagagaccgcaagaacaagcttc

SEQ ID NO: 378655 - DNA, 25 bp, Mus musculus
caggttctaggtaggtgcgtttcac

SEQ ID NO: 378656 - DNA, 25 bp, Mus musculus
gtctccggagtttcctgtcaggctc

SEQ ID NO: 378657 - DNA, 25 bp, Mus musculus
gaaggtagagttcgctgcacagcca

SEQ ID NO: 378658 - DNA, 25 bp, Mus musculus
ggctgcggggtcacactcgcctcat

SEQ ID NO: 378659 - DNA, 25 bp, Mus musculus
aggggcttctgcttgtcaggttcta

SEQ ID NO: 378660 - DNA, 25 bp, Mus musculus
attggctgtcgagcctcgcaacggt

SEQ ID NO: 378661 - DNA, 25 bp, Mus musculus
ctcattggctaaactctcggggtgc

SEQ ID NO: 378662 - DNA, 25 bp, Mus musculus
cccttgctccttctcattggctaaa

SEQ ID NO: 378663 - DNA, 25 bp, Mus musculus
aaacagcacgcagggcggtggccac

SEQ ID NO: 378664 - DNA, 25 bp, Mus musculus
ggcctcagcttatcacccggacagg

SEQ ID NO: 378665 - DNA, 25 bp, Mus musculus
ccggacaggctacttcccggctttg

SEQ ID NO: 378666 - DNA, 25 bp, Mus musculus
aagcgggatcttctacgcgagagac

SEQ ID NO: 378667 - DNA, 25 bp, Mus musculus
aagcttcgacgggaaacagcacgca

SEQ ID NO: 378668 - DNA, 25 bp, Mus musculus
agccgcaacatggaggcgccaagga

SEQ ID NO: 378669 - DNA, 25 bp, Mus musculus
gctaaaccagttccagcagccgcag

SEQ ID NO: 378670 - DNA, 25 bp, Mus musculus
ctacagcagcagctaaaccagttcc

SEQ ID NO: 378671 - DNA, 25 bp, Mus musculus
accacaaactgaaagccgttggcga

SEQ ID NO: 378672 - DNA, 25 bp, Mus musculus
gctcgaccatggagaccgggctgct

SEQ ID NO: 378673 - DNA, 25 bp, Mus musculus
ccctgcagaactcccacgaagggta

SEQ ID NO: 378674 - DNA, 25 bp, Mus musculus
atggggatgatgcactccgcctctg

SEQ ID NO: 378675 - DNA, 25 bp, Mus musculus
cttgctttgatcaacatggcggaca

SEQ ID NO: 378676 - DNA, 25 bp, Mus musculus
gcgctgggccttgctttgatcaaca

SEQ ID NO: 378677 - DNA, 25 bp, Mus musculus
taataattactatggcagcgctgcc

SEQ ID NO: 378678 - DNA, 25 bp, Mus musculus
cagcggccgtctcggagtttaataa

SEQ ID NO: 378679 - DNA, 25 bp, Mus musculus
agcctctgctgagcaaaccgggcga

SEQ ID NO: 378680 - DNA, 25 bp, Mus musculus
acagccagtacaaccattatccggg

SEQ ID NO: 378681 - DNA, 25 bp, Mus musculus
tacaaccattatccgggctacagcc

SEQ ID NO: 378682 - DNA, 25 bp, Mus musculus
taagcactgttgcatgcggaagtcc

SEQ ID NO: 378683 - DNA, 25 bp, Mus musculus
ccctctcgtgacgtaagcactgttg

SEQ ID NO: 378684 - DNA, 25 bp, Mus musculus
tggctcggaacgaataaaacacgcc

SEQ ID NO: 378685 - DNA, 25 bp, Mus musculus
ggcgtggctcggaacgaataaaaca

SEQ ID NO: 378686 - DNA, 25 bp, Mus musculus
gcacagttgctgcactaaaagtggg

SEQ ID NO: 378687 - DNA, 25 bp, Mus musculus
ccctgactttacagtgcacagttgc

SEQ ID NO: 378688 - DNA, 25 bp, Mus musculus
ttactcatttccctccctgacttta

SEQ ID NO: 378689 - DNA, 25 bp, Mus musculus
caccctttcagtggttttgctggcc

SEQ ID NO: 378690 - DNA, 25 bp, Mus musculus
cggctctgtggccaccctttcagtg

SEQ ID NO: 378691 - DNA, 25 bp, Mus musculus
tcctaacccgtcctgggatcagcgt

SEQ ID NO: 378692 - DNA, 25 bp, Mus musculus
gtacgtacagaagctcctcctaacc

SEQ ID NO: 378693 - DNA, 25 bp, Mus musculus
cactggatagtacgtacagaagctc

SEQ ID NO: 378694 - DNA, 25 bp, Mus musculus
ctttggaagcgagcactggatagta

SEQ ID NO: 378695 - DNA, 25 bp, Mus musculus
cgcgctttctttggaagcgagcact

SEQ ID NO: 378696 - DNA, 25 bp, Mus musculus
gaggactctgcagcacgcggtctaa

SEQ ID NO: 378697 - DNA, 25 bp, Mus musculus
ctggatccaggtcgccattcaggtg

SEQ ID NO: 378698 - DNA, 25 bp, Mus musculus
aggttccctcttccctgtcgtctgg

SEQ ID NO: 378699 - DNA, 25 bp, Mus musculus
gtcttttcttcttggcggcttcctc

SEQ ID NO: 378700 - DNA, 25 bp, Mus musculus
ggacggcgaaagcacgactccttta

SEQ ID NO: 378701 - DNA, 25 bp, Mus musculus
agccaagtcattcggccatgccggg

SEQ ID NO: 378702 - DNA, 25 bp, Mus musculus
tccgccaggcctgacgattgaacga

SEQ ID NO: 378703 - DNA, 25 bp, Mus musculus
accattaccgaggagccgtggcacg

SEQ ID NO: 378704 - DNA, 25 bp, Mus musculus
tcgctagcgctaccattcgggaagc

SEQ ID NO: 378705 - DNA, 25 bp, Mus musculus
gccactgtctgcgtgggagctgaaa

SEQ ID NO: 378706 - DNA, 25 bp, Mus musculus
gcccgccatgttgcccgagaaagag

SEQ ID NO: 378707 - DNA, 25 bp, Mus musculus
tggagctgaatcctgtgcatgtttc

SEQ ID NO: 378708 - DNA, 25 bp, Mus musculus
aaacccgcgccgaagatggtggagc

SEQ ID NO: 378709 - DNA, 25 bp, Mus musculus
tgcatgtttcaggtccgtgccactg

SEQ ID NO: 378710 - DNA, 25 bp, Mus musculus
cagcagacagccaacgggagcgagc

SEQ ID NO: 378711 - DNA, 25 bp, Mus musculus
gccgggtccttgaccagggcaccaa

SEQ ID NO: 378712 - DNA, 25 bp, Mus musculus
cgcaaatccgggaggcagggatgga

SEQ ID NO: 378713 - DNA, 25 bp, Mus musculus
gcagggatggaaggcgtgccgtgcc

SEQ ID NO: 378714 - DNA, 25 bp, Mus musculus
cccgcaggcctagtgcgccacggtc

SEQ ID NO: 378715 - DNA, 25 bp, Mus musculus
tagtgcgccacggtcctccgcggcg

SEQ ID NO: 378716 - DNA, 25 bp, Mus musculus
cgcgaggggcaaggcgccgggtcct

SEQ ID NO: 378717 - DNA, 25 bp, Mus musculus
ccgggtccttgaccagggcaccaag

SEQ ID NO: 378718 - DNA, 25 bp, Mus musculus
gggtccttgaccagggcaccaagga

SEQ ID NO: 378719 - DNA, 25 bp, Mus musculus
cttgaccagggcaccaaggacagca

SEQ ID NO: 378720 - DNA, 25 bp, Mus musculus
accaaggacagcagacagccaacgg

SEQ ID NO: 378721 - DNA, 25 bp, Mus musculus
caaggacagcagacagccaacggga

SEQ ID NO: 378722 - DNA, 25 bp, Mus musculus
acagcagacagccaacgggagcgag

SEQ ID NO: 378723 - DNA, 25 bp, Mus musculus
aggacagcagacagccaacgggagc

SEQ ID NO: 378724 - DNA, 25 bp, Mus musculus
gggaaaagcacgcatccaatcgcag

SEQ ID NO: 378725 - DNA, 25 bp, Mus musculus
agtggagacgcgcttggctccgccc

SEQ ID NO: 378726 - DNA, 25 bp, Mus musculus
ctcccaggcccttcgcggattggcc

SEQ ID NO: 378727 - DNA, 25 bp, Mus musculus
tggcgcctgcaagctctctcccagg

SEQ ID NO: 378728 - DNA, 25 bp, Mus musculus
gggaaaataactggggctgtctctc

SEQ ID NO: 378729 - DNA, 25 bp, Mus musculus
gaagtaggcctacgtcatggttgga

SEQ ID NO: 378730 - DNA, 25 bp, Mus musculus
gcacgcatccaatcgcagtcctaga

SEQ ID NO: 378731 - DNA, 25 bp, Mus musculus
acgtcatggttggacgtggcagaaa

SEQ ID NO: 378732 - DNA, 25 bp, Mus musculus
acggccctctgcagggggaaaagca

SEQ ID NO: 378733 - DNA, 25 bp, Mus musculus
caatagacttcacggccctctgcag

SEQ ID NO: 378734 - DNA, 25 bp, Mus musculus
agggcgcagccaatagacttcacgg

SEQ ID NO: 378735 - DNA, 25 bp, Mus musculus
ccctgagggcgcagccaatagactt

SEQ ID NO: 378736 - DNA, 25 bp, Mus musculus
gcatccaatcgcagtcctagaagta

SEQ ID NO: 378737 - DNA, 25 bp, Mus musculus
cagtcctagaagtaggcctacgtca

SEQ ID NO: 378738 - DNA, 25 bp, Mus musculus
cgcctgcccttgtcgagaaaacttt

SEQ ID NO: 378739 - DNA, 25 bp, Mus musculus
gagggctcctttccgcaggtaagca

SEQ ID NO: 378740 - DNA, 25 bp, Mus musculus
tcactctacctgatgctggacaggg

SEQ ID NO: 378741 - DNA, 25 bp, Mus musculus
cagcgcgatcttctgcgtcgtaatc

SEQ ID NO: 378742 - DNA, 25 bp, Mus musculus
ttaagtcgccagttcaccgtgtttg

SEQ ID NO: 378743 - DNA, 25 bp, Mus musculus
cccgagtccatcgaggaaaatgaag

SEQ ID NO: 378744 - DNA, 25 bp, Mus musculus
gacgcacacgccgaggaaagtcctg

SEQ ID NO: 378745 - DNA, 25 bp, Mus musculus
aaagtcctggattgcagcgctccgg

SEQ ID NO: 378746 - DNA, 25 bp, Mus musculus
acttttcctgccgactcagtcgtgc

SEQ ID NO: 378747 - DNA, 25 bp, Mus musculus
tgctctccaggagtctgccttgcag

SEQ ID NO: 378748 - DNA, 25 bp, Mus musculus
gaagtcgggcagagacctctcctct

SEQ ID NO: 378749 - DNA, 25 bp, Mus musculus
cgggtagcgctatcctgcaggaaag

SEQ ID NO: 378750 - DNA, 25 bp, Mus musculus
tggacaggggtcacttggactaccc

SEQ ID NO: 378751 - DNA, 25 bp, Mus musculus
cttctgcctccttcgggtgaggacc

SEQ ID NO: 378752 - DNA, 25 bp, Mus musculus
gcctacctttgaatttgaggtctga

SEQ ID NO: 378753 - DNA, 25 bp, Mus musculus
tcaatctccgtattgcacgctcggg

SEQ ID NO: 378754 - DNA, 25 bp, Mus musculus
cgcgccgctgtcaatctccgtattg

SEQ ID NO: 378755 - DNA, 25 bp, Mus musculus
cacgcgcactgcgatcctcggcgcc

SEQ ID NO: 378756 - DNA, 25 bp, Mus musculus
tccgggtgtcacaactgactcaacc

SEQ ID NO: 378757 - DNA, 25 bp, Mus musculus
cagcagctccgggtgtcacaactga

SEQ ID NO: 378758 - DNA, 25 bp, Mus musculus
agggcagcctgtccgctcagcagct

SEQ ID NO: 378759 - DNA, 25 bp, Mus musculus
ggccaggctcacgattcccgaagct

SEQ ID NO: 378760 - DNA, 25 bp, Mus musculus
aggaccaggatctgctcgtgcttcg

SEQ ID NO: 378761 - DNA, 25 bp, Mus musculus
gcgtcccagccagcctacctttgaa

SEQ ID NO: 378762 - DNA, 25 bp, Mus musculus
ggaaggggacacagtccagtcaccc

SEQ ID NO: 378763 - DNA, 25 bp, Mus musculus
gccataggagacagcgcagcgcaga

SEQ ID NO: 378764 - DNA, 25 bp, Mus musculus
cggacgccataggagacagcgcagc

SEQ ID NO: 378765 - DNA, 25 bp, Mus musculus
gatctgctcgtgcttcgccatggcc

SEQ ID NO: 378766 - DNA, 25 bp, Mus musculus
aatggcgcacagaagccgggatccc

SEQ ID NO: 378767 - DNA, 25 bp, Mus musculus
cccgtaggatggctccaggacttac

SEQ ID NO: 378768 - DNA, 25 bp, Mus musculus
cccgagaagacacactttgagctcc

SEQ ID NO: 378769 - DNA, 25 bp, Mus musculus
tttgagctcccgtatcgccatcatg

SEQ ID NO: 378770 - DNA, 25 bp, Mus musculus
atcgccatcatgtgctctgggtcgg

SEQ ID NO: 378771 - DNA, 25 bp, Mus musculus
caaggttgccagatacccggccgca

SEQ ID NO: 378772 - DNA, 25 bp, Mus musculus
gccaaggcggctatttctgggcctc

SEQ ID NO: 378773 - DNA, 25 bp, Mus musculus
tcccgtcacgtctagtctagcctgg

SEQ ID NO: 378774 - DNA, 25 bp, Mus musculus
cagtgaccacccaacatctgacttg

SEQ ID NO: 378775 - DNA, 25 bp, Mus musculus
catctgacttgtgggcaaatcatcc

SEQ ID NO: 378776 - DNA, 25 bp, Mus musculus
tctgagcccggtcgggcaccacttg

SEQ ID NO: 378777 - DNA, 25 bp, Mus musculus
ggcagcgcagagacaatggcgcaca

SEQ ID NO: 378778 - DNA, 25 bp, Mus musculus
atacccggccgcagatgcagcgatc

SEQ ID NO: 378779 - DNA, 25 bp, Mus musculus
gggctcagcagcatcgtccgggcca

SEQ ID NO: 378780 - DNA, 25 bp, Mus musculus
gggctttaacgtgccgcgccgcacg

SEQ ID NO: 378781 - DNA, 25 bp, Mus musculus
accggctctctacttgagcggctcg

SEQ ID NO: 378782 - DNA, 25 bp, Mus musculus
agcacccgcgtggtcggacctcggc

SEQ ID NO: 378783 - DNA, 25 bp, Mus musculus
cctgctccaggaggacctgccggag

SEQ ID NO: 378784 - DNA, 25 bp, Mus musculus
cgctgacccggcctttcttctctcc

SEQ ID NO: 378785 - DNA, 25 bp, Mus musculus
acaagatggcgggtacgtggcccca

SEQ ID NO: 378786 - DNA, 25 bp, Mus musculus
gctctctacttgagcggctcgcgga

SEQ ID NO: 378787 - DNA, 25 bp, Mus musculus
gtgacccaacagagctgcgggccgc

SEQ ID NO: 378788 - DNA, 25 bp, Mus musculus
cgaggccggtgacccaacagagctg

SEQ ID NO: 378789 - DNA, 25 bp, Mus musculus
aggcggcgcttcctccactcggagg

SEQ ID NO: 378790 - DNA, 25 bp, Mus musculus
tcagtcactcgcgaggcctgggcgc

SEQ ID NO: 378791 - DNA, 25 bp, Mus musculus
gctttgttcagtcactcgcgaggcc

SEQ ID NO: 378792 - DNA, 25 bp, Mus musculus
ggccggcggaacttttgtcattcaa

SEQ ID NO: 378793 - DNA, 25 bp, Mus musculus
tttgtcattcaaaccgtcgtccggc

SEQ ID NO: 378794 - DNA, 25 bp, Mus musculus
gcacctcgaggacaccgtcacaggg

SEQ ID NO: 378795 - DNA, 25 bp, Mus musculus
gggcgtctccttccggtctttgctg

SEQ ID NO: 378796 - DNA, 25 bp, Mus musculus
tccggtctttgctgggcgaggcctt

SEQ ID NO: 378797 - DNA, 25 bp, Mus musculus
gccttcgcctgctccttggctaccc

SEQ ID NO: 378798 - DNA, 25 bp, Mus musculus
ccgcagctcagatgggcgtctcctt

SEQ ID NO: 378799 - DNA, 25 bp, Mus musculus
gctccttggctacccgcacctcgag

SEQ ID NO: 378800 - DNA, 25 bp, Mus musculus
ctcgaggacaccgtcacagggcggt

SEQ ID NO: 378801 - DNA, 25 bp, Mus musculus
ctgctcagacttggctcgctgcatc

SEQ ID NO: 378802 - DNA, 25 bp, Mus musculus
gacttggctcgctgcatctggagca

SEQ ID NO: 378803 - DNA, 25 bp, Mus musculus
ttggctcgctgcatctggagcagcc

SEQ ID NO: 378804 - DNA, 25 bp, Mus musculus
agatgggcgtctccttccggtcttt

SEQ ID NO: 378805 - DNA, 25 bp, Mus musculus
ctgcactcggagctcgatgatggcc

SEQ ID NO: 378806 - DNA, 25 bp, Mus musculus
gcagccggagctgcactcggagctc

SEQ ID NO: 378807 - DNA, 25 bp, Mus musculus
ctcggagctcgatgatggcctcccg

SEQ ID NO: 378808 - DNA, 25 bp, Mus musculus
gcgcctcccgagctggaactcgtta

SEQ ID NO: 378809 - DNA, 25 bp, Mus musculus
cacgggcgacaacaggagctgttcc

SEQ ID NO: 378810 - DNA, 25 bp, Mus musculus
tctacccggcaaacacggagacagg

SEQ ID NO: 378811 - DNA, 25 bp, Mus musculus
gcgcgaggcagatgcgacccataaa

SEQ ID NO: 378812 - DNA, 25 bp, Mus musculus
tgcgacccataaaccggaaggcttg

SEQ ID NO: 378813 - DNA, 25 bp, Mus musculus
ggaagcagctggactcccaactagc

SEQ ID NO: 378814 - DNA, 25 bp, Mus musculus
ctgggtcccagagcaacacaggaca

SEQ ID NO: 378815 - DNA, 25 bp, Mus musculus
gacacacccgggtgctcccaaggag

SEQ ID NO: 378816 - DNA, 25 bp, Mus musculus
ctccggggtgaagctttcacggaca

SEQ ID NO: 378817 - DNA, 25 bp, Mus musculus
agccttcgcctgtttacaatgattg

SEQ ID NO: 378818 - DNA, 25 bp, Mus musculus
gtagggcccttgtctccgacataaa

SEQ ID NO: 378819 - DNA, 25 bp, Mus musculus
aacccgcgagaggatgcgccaaacg

SEQ ID NO: 378820 - DNA, 25 bp, Mus musculus
caaacgctaaggctctgcaggcgcc

SEQ ID NO: 378821 - DNA, 25 bp, Mus musculus
tgattgggacagaacaggacgagcc

SEQ ID NO: 378822 - DNA, 25 bp, Mus musculus
atcccattttctcgcccgctccctg

SEQ ID NO: 378823 - DNA, 25 bp, Mus musculus
ttgggcggcttacctctgctgccag

SEQ ID NO: 378824 - DNA, 25 bp, Mus musculus
ctgccacctgttgggcggcttacct

SEQ ID NO: 378825 - DNA, 25 bp, Mus musculus
agccgtctggtctgctgccacctgt

SEQ ID NO: 378826 - DNA, 25 bp, Mus musculus
gtgcgctccggcctctcgcggagcc

SEQ ID NO: 378827 - DNA, 25 bp, Mus musculus
gctgggcacgccctcggccacgccc

SEQ ID NO: 378828 - DNA, 25 bp, Mus musculus
cgagcctccaagcagctcccgcgaa

SEQ ID NO: 378829 - DNA, 25 bp, Mus musculus
gcctggcttcctagatgccgcccgc

SEQ ID NO: 378830 - DNA, 25 bp, Mus musculus
cgttcgggcctctcggcgcccgcat

SEQ ID NO: 378831 - DNA, 25 bp, Mus musculus
cctccgggaatccaggtgaccgcgg

SEQ ID NO: 378832 - DNA, 25 bp, Mus musculus
gccgtcctccgggaatccaggtgac

SEQ ID NO: 378833 - DNA, 25 bp, Mus musculus
catcctgcccacagccggtgcggcc

SEQ ID NO: 378834 - DNA, 25 bp, Mus musculus
cgctccctgcggacccagccggctc

SEQ ID NO: 378835 - DNA, 25 bp, Mus musculus
tacctctgctgccagccgctgtgcc

SEQ ID NO: 378836 - DNA, 25 bp, Mus musculus
aacgcacatatttttgcagggtttg

SEQ ID NO: 378837 - DNA, 25 bp, Mus musculus
tttgagttgggacggcaaaaccagc

SEQ ID NO: 378838 - DNA, 25 bp, Mus musculus
ccatgttccggtaagcggcggccaa

SEQ ID NO: 378839 - DNA, 25 bp, Mus musculus
tcagcgggcgcagaagggttcaccc

SEQ ID NO: 378840 - DNA, 25 bp, Mus musculus
gccaggcttaaaaacatctccggtc

SEQ ID NO: 378841 - DNA, 25 bp, Mus musculus
atctccggtcttggtcggtctctca

SEQ ID NO: 378842 - DNA, 25 bp, Mus musculus
gtcttggtcggtctctcaccacagc

SEQ ID NO: 378843 - DNA, 25 bp, Mus musculus
ttgctcctggacagcgttctccgcg

SEQ ID NO: 378844 - DNA, 25 bp, Mus musculus
tggacagcgttctccgcgattggct

SEQ ID NO: 378845 - DNA, 25 bp, Mus musculus
gcggacacgtgactcctgcaggcac

SEQ ID NO: 378846 - DNA, 25 bp, Mus musculus
gcgcagtcaccaccaccggagatgt

SEQ ID NO: 378847 - DNA, 25 bp, Mus musculus
caccggagatgtgcaaaaggcggca

SEQ ID NO: 378848 - DNA, 25 bp, Mus musculus
ggctgagggtctcctccctggtacc

SEQ ID NO: 378849 - DNA, 25 bp, Mus musculus
cccggcggaggaaacgcacatattt

SEQ ID NO: 378850 - DNA, 25 bp, Mus musculus
ctcgctcttcctttagtccttcgga

SEQ ID NO: 378851 - DNA, 25 bp, Mus musculus
tcggaaacaaagacggtccacactc

SEQ ID NO: 378852 - DNA, 25 bp, Mus musculus
ctcttcgtcaaactccggtgtcatc

SEQ ID NO: 378853 - DNA, 25 bp, Mus musculus
cccgcctcagcacgatgggaaatga

SEQ ID NO: 378854 - DNA, 25 bp, Mus musculus
tttccgacctgcttattggagaaga

SEQ ID NO: 378855 - DNA, 25 bp, Mus musculus
cgggcgttccagagctcctattgga

SEQ ID NO: 378856 - DNA, 25 bp, Mus musculus
agcgcggatttttctctcaagttga

SEQ ID NO: 378857 - DNA, 25 bp, Mus musculus
ctatacctgtcaggcggctgcagca

SEQ ID NO: 378858 - DNA, 25 bp, Mus musculus
cggggacttttgtcttctgctcaaa

SEQ ID NO: 378859 - DNA, 25 bp, Mus musculus
tcctattggagagagctatggcttt

SEQ ID NO: 378860 - DNA, 25 bp, Mus musculus
cagtcatgacttctgccgcgggtaa

SEQ ID NO: 378861 - DNA, 25 bp, Mus musculus
cgtccgtcctttgtgaggcgctcag

SEQ ID NO: 378862 - DNA, 25 bp, Mus musculus
ggcagaggccaaccacgccaggatc

SEQ ID NO: 378863 - DNA, 25 bp, Mus musculus
gaagccgctgcgatctcctctcgtg

SEQ ID NO: 378864 - DNA, 25 bp, Mus musculus
ccggttcagacaactggtacaccta

SEQ ID NO: 378865 - DNA, 25 bp, Mus musculus
tcgggctagccactcaccattggta

SEQ ID NO: 378866 - DNA, 25 bp, Mus musculus
cctgggaaacccttggcagggatgc

SEQ ID NO: 378867 - DNA, 25 bp, Mus musculus
accattggtaaaggactccatcttc

SEQ ID NO: 378868 - DNA, 25 bp, Mus musculus
aagcggtcctgacgactgagcatgc

SEQ ID NO: 378869 - DNA, 25 bp, Mus musculus
tccgggttttcgcaactgctgcaaa

SEQ ID NO: 378870 - DNA, 25 bp, Mus musculus
tgctgcaaaagacccactgaggcgt

SEQ ID NO: 378871 - DNA, 25 bp, Mus musculus
gtctgtgccgcagagctgtagtacc

SEQ ID NO: 378872 - DNA, 25 bp, Mus musculus
ctgggcttagaactgcgagcagatc

SEQ ID NO: 378873 - DNA, 25 bp, Mus musculus
ctactactgcatccggccgtgtttc

SEQ ID NO: 378874 - DNA, 25 bp, Mus musculus
gtcgcccttcgcgttctgaaagcaa

SEQ ID NO: 378875 - DNA, 25 bp, Mus musculus
ggcgctcttcttaaccgccggagca

SEQ ID NO: 378876 - DNA, 25 bp, Mus musculus
tcgatcggtgccctttgcttagggc

SEQ ID NO: 378877 - DNA, 25 bp, Mus musculus
ggacgctaagcatcgctcaacccta

SEQ ID NO: 378878 - DNA, 25 bp, Mus musculus
cagctgacctgtccagcgcctaggg

SEQ ID NO: 378879 - DNA, 25 bp, Mus musculus
ggctcgccttctcgaggctcttgtg

SEQ ID NO: 378880 - DNA, 25 bp, Mus musculus
gccctgaggacgaggctcgccttct

SEQ ID NO: 378881 - DNA, 25 bp, Mus musculus
tgggcgggcccgaaacagcccagtc

SEQ ID NO: 378882 - DNA, 25 bp, Mus musculus
aacggtacgccgttcctgacgcagc

SEQ ID NO: 378883 - DNA, 25 bp, Mus musculus
ctgactgggaacgaacgagcccgga

SEQ ID NO: 378884 - DNA, 25 bp, Mus musculus
ccgctctaggctgactgggaacgaa

SEQ ID NO: 378885 - DNA, 25 bp, Mus musculus
aacatggcggggtacgcgatgctcc

SEQ ID NO: 378886 - DNA, 25 bp, Mus musculus
ggcccgcagcgccaaggagaacatg

SEQ ID NO: 378887 - DNA, 25 bp, Mus musculus
tcttacccactgagcagcgaggccg

SEQ ID NO: 378888 - DNA, 25 bp, Mus musculus
aaaagctaagggaggcacgaagagc

SEQ ID NO: 378889 - DNA, 25 bp, Mus musculus
tctccgaggactaaaagctaaggga

SEQ ID NO: 378890 - DNA, 25 bp, Mus musculus
gcgcctaggggtctccgaggactaa

SEQ ID NO: 378891 - DNA, 25 bp, Mus musculus
ctcttgtgtttgttgaggacgaggc

SEQ ID NO: 378892 - DNA, 25 bp, Mus musculus
ccgagcttacagtggtggacgctag

SEQ ID NO: 378893 - DNA, 25 bp, Mus musculus
gccgagcttacagtggtggacgcta

SEQ ID NO: 378894 - DNA, 25 bp, Mus musculus
ccggagagccggaagtcggagagcc

SEQ ID NO: 378895 - DNA, 25 bp, Mus musculus
aggcgatgtagggatccggcctgcc

SEQ ID NO: 378896 - DNA, 25 bp, Mus musculus
gaccgggaaggcgatgtagggatcc

SEQ ID NO: 378897 - DNA, 25 bp, Mus musculus
gacgctcacgtgaggacgccgcctt

SEQ ID NO: 378898 - DNA, 25 bp, Mus musculus
agcttacagtggtggacgctaggac

SEQ ID NO: 378899 - DNA, 25 bp, Mus musculus
ggacgccgccttggggtaagtgtgc

SEQ ID NO: 378900 - DNA, 25 bp, Mus musculus
cgctcacgtgaggacgccgccttgg

SEQ ID NO: 378901 - DNA, 25 bp, Mus musculus
cttacagtggtggacgctaggacct

SEQ ID NO: 378902 - DNA, 25 bp, Mus musculus
ttacagtggtggacgctaggacctg

SEQ ID NO: 378903 - DNA, 25 bp, Mus musculus
ctaggacctgggagtgcgggtcacc

SEQ ID NO: 378904 - DNA, 25 bp, Mus musculus
ccggctggaggcgagtgagggctcc

SEQ ID NO: 378905 - DNA, 25 bp, Mus musculus
ggacgctcacgtgaggacgccgcct

SEQ ID NO: 378906 - DNA, 25 bp, Mus musculus
gccacgtggagggttttctgcgtgc

SEQ ID NO: 378907 - DNA, 25 bp, Mus musculus
actgcagtttaaattcagccgcggc

SEQ ID NO: 378908 - DNA, 25 bp, Mus musculus
gctccttcagtgaaactgcagttta

SEQ ID NO: 378909 - DNA, 25 bp, Mus musculus
cgcgcatgctccttcagtgaaactg

SEQ ID NO: 378910 - DNA, 25 bp, Mus musculus
tgcgcgcatgctccttcagtgaaac

SEQ ID NO: 378911 - DNA, 25 bp, Mus musculus
attggagcgagtggcagcccaagta

SEQ ID NO: 378912 - DNA, 25 bp, Mus musculus
agtttaaattcagccgcggcggcca

SEQ ID NO: 378913 - DNA, 25 bp, Mus musculus
cggccaggctcgcttgccggcctca

SEQ ID NO: 378914 - DNA, 25 bp, Mus musculus
cccaagtatagtggcgccttcggtg

SEQ ID NO: 378915 - DNA, 25 bp, Mus musculus
cgagtggcagcccaagtatagtggc

SEQ ID NO: 378916 - DNA, 25 bp, Mus musculus
gcagggttagccgagcgcgccctac

SEQ ID NO: 378917 - DNA, 25 bp, Mus musculus
cacactcgagcggaggcggaagccg

SEQ ID NO: 378918 - DNA, 25 bp, Mus musculus
gaagcgctgcgaccgaaggcagaga

SEQ ID NO: 378919 - DNA, 25 bp, Mus musculus
gcagcccaagtatagtggcgccttc

SEQ ID NO: 378920 - DNA, 25 bp, Mus musculus
aacagggccttctcgctttggctgg

SEQ ID NO: 378921 - DNA, 25 bp, Mus musculus
acccttagcagctctgccgggcatg

SEQ ID NO: 378922 - DNA, 25 bp, Mus musculus
cttagcagctctgccgggcatggct

SEQ ID NO: 378923 - DNA, 25 bp, Mus musculus
ggcatggctcactagcctccgacgg

SEQ ID NO: 378924 - DNA, 25 bp, Mus musculus
tccgacggctttccgcttccgaagc

SEQ ID NO: 378925 - DNA, 25 bp, Mus musculus
ttccgaagcccgaggtcttctcaaa

SEQ ID NO: 378926 - DNA, 25 bp, Mus musculus
agcccgaggtcttctcaaacatgtc

SEQ ID NO: 378927 - DNA, 25 bp, Mus musculus
caccaacagggccttctcgctttgg

SEQ ID NO: 378928 - DNA, 25 bp, Mus musculus
ggtatcctcccggacccttagcagc

SEQ ID NO: 378929 - DNA, 25 bp, Mus musculus
ccttctcgctttggctggggaaggc

SEQ ID NO: 378930 - DNA, 25 bp, Mus musculus
tttcttgcccgcgtcactctcggca

SEQ ID NO: 378931 - DNA, 25 bp, Mus musculus
actctcggcatcactgtcccggggg

SEQ ID NO: 378932 - DNA, 25 bp, Mus musculus
ggtcttctcaaacatgtcctccgag

SEQ ID NO: 378933 - DNA, 25 bp, Mus musculus
tctcaaacatgtcctccgagtcgct

SEQ ID NO: 378934 - DNA, 25 bp, Mus musculus
cagtcggcctcccaacccgggacag

SEQ ID NO: 378935 - DNA, 25 bp, Mus musculus
acatcctcctgagaaccgggtcccg

SEQ ID NO: 378936 - DNA, 25 bp, Mus musculus
tgctccgcgtatgggttcccggtca

SEQ ID NO: 378937 - DNA, 25 bp, Mus musculus
tatgggttcccggtcactggagccg

SEQ ID NO: 378938 - DNA, 25 bp, Mus musculus
tcactggagccggtgcccgactcag

SEQ ID NO: 378939 - DNA, 25 bp, Mus musculus
ggagtaggcgctgctcatcagacaa

SEQ ID NO: 378940 - DNA, 25 bp, Mus musculus
gctgctcatcagacaagggttcgga

SEQ ID NO: 378941 - DNA, 25 bp, Mus musculus
catcagacaagggttcggaggcgca

SEQ ID NO: 378942 - DNA, 25 bp, Mus musculus
agtcggagagatccgagctgctgtc

SEQ ID NO: 378943 - DNA, 25 bp, Mus musculus
agctgctgtccgtgtggttgatacg

SEQ ID NO: 378944 - DNA, 25 bp, Mus musculus
cgtgtggttgatacgacagccagcc

SEQ ID NO: 378945 - DNA, 25 bp, Mus musculus
ggttttgcgacccttcgcgacggca

SEQ ID NO: 378946 - DNA, 25 bp, Mus musculus
ctcctctcggccagcgggtgcaggt

SEQ ID NO: 378947 - DNA, 25 bp, Mus musculus
gacagccagccaccgaggtcacaga

SEQ ID NO: 378948 - DNA, 25 bp, Mus musculus
tcgtggtttatcctcatcgtgcacc

SEQ ID NO: 378949 - DNA, 25 bp, Mus musculus
ccgatgatgatgacctgcagcttga

SEQ ID NO: 378950 - DNA, 25 bp, Mus musculus
ggcgctgggatccatgcacgcatac

SEQ ID NO: 378951 - DNA, 25 bp, Mus musculus
agggaagcagcttctccgcagcagc

SEQ ID NO: 378952 - DNA, 25 bp, Mus musculus
tatgttatgtgtgggtcgctctccg

SEQ ID NO: 378953 - DNA, 25 bp, Mus musculus
tcggcgcactttcactcgtggttta

SEQ ID NO: 378954 - DNA, 25 bp, Mus musculus
tcgcagaacgtgtcgtcggtgaagc

SEQ ID NO: 378955 - DNA, 25 bp, Mus musculus
gtacccacggtggacttgcaggcct

SEQ ID NO: 378956 - DNA, 25 bp, Mus musculus
cagagcttccatggggacagggacc

SEQ ID NO: 378957 - DNA, 25 bp, Mus musculus
tccgtaggatgattcgttgaggccc

SEQ ID NO: 378958 - DNA, 25 bp, Mus musculus
aaaggccacggaaaagctcggtctg

SEQ ID NO: 378959 - DNA, 25 bp, Mus musculus
gaagcgctccatcaggctggtcttg

SEQ ID NO: 378960 - DNA, 25 bp, Mus musculus
gagtttccgcggatgcatcacccgg

SEQ ID NO: 378961 - DNA, 25 bp, Mus musculus
cggacctcatgactggtgaaggctc

SEQ ID NO: 378962 - DNA, 25 bp, Mus musculus
ccaaatcctcgctgggatccggtga

SEQ ID NO: 378963 - DNA, 25 bp, Mus musculus
aagggagacccgagcctaagctgca

SEQ ID NO: 378964 - DNA, 25 bp, Mus musculus
agatggaggtccctgtttctgcgcc

SEQ ID NO: 378965 - DNA, 25 bp, Mus musculus
ctcctgcgtgtactgtacgggctcc

SEQ ID NO: 378966 - DNA, 25 bp, Mus musculus
gacgcgacagcagcgaaacaccaga

SEQ ID NO: 378967 - DNA, 25 bp, Mus musculus
gtcctcatggtgctgagtacgcgcc

SEQ ID NO: 378968 - DNA, 25 bp, Mus musculus
aggcaagtcccaagtgtcctcatgg

SEQ ID NO: 378969 - DNA, 25 bp, Mus musculus
tccagctaaagtcaccaggcaagtc

SEQ ID NO: 378970 - DNA, 25 bp, Mus musculus
tctccggccgcagttagcaaaagtc

SEQ ID NO: 378971 - DNA, 25 bp, Mus musculus
tgaaaatgtttctccggccgcagtt

SEQ ID NO: 378972 - DNA, 25 bp, Mus musculus
gtggtgtctcgcttacctgaaaatg

SEQ ID NO: 378973 - DNA, 25 bp, Mus musculus
tggctccacagctgttttcctccgg

SEQ ID NO: 378974 - DNA, 25 bp, Mus musculus
gatccggtgatgagcccgcctaagc

SEQ ID NO: 378975 - DNA, 25 bp, Mus musculus
gtgacaacagttgcacaagtccgaa

SEQ ID NO: 378976 - DNA, 25 bp, Mus musculus
ccttgagatccaggagtacagtggg

SEQ ID NO: 378977 - DNA, 25 bp, Mus musculus
tcgagctgggaagagcacactcgcg

SEQ ID NO: 378978 - DNA, 25 bp, Mus musculus
cacactcgcgcagtgcctgtgagcg

SEQ ID NO: 378979 - DNA, 25 bp, Mus musculus
ctgaccctccgactggcgagcggga

SEQ ID NO: 378980 - DNA, 25 bp, Mus musculus
gaagccgcctccctgaggacgctgg

SEQ ID NO: 378981 - DNA, 25 bp, Mus musculus
ctgctccctggagctctaggctctg

SEQ ID NO: 378982 - DNA, 25 bp, Mus musculus
ggctctggtttcctctgactctagg

SEQ ID NO: 378983 - DNA, 25 bp, Mus musculus
ccggcacgtgagaagggacactgac

SEQ ID NO: 378984 - DNA, 25 bp, Mus musculus
tgactccgtacccaacgcctgagtg

SEQ ID NO: 378985 - DNA, 25 bp, Mus musculus
agaccgccgggttggttgattgtat

SEQ ID NO: 378986 - DNA, 25 bp, Mus musculus
gttgattgtatgcagcgctcccgca

SEQ ID NO: 378987 - DNA, 25 bp, Mus musculus
gcagcgctcccgcaatgaatgggaa

SEQ ID NO: 378988 - DNA, 25 bp, Mus musculus
ctagcttagtgggaccttgagatcc

SEQ ID NO: 378989 - DNA, 25 bp, Mus musculus
taggggtcacctgctttctagctta

SEQ ID NO: 378990 - DNA, 25 bp, Mus musculus
cgcgctaacccagaacaaagaccga

SEQ ID NO: 378991 - DNA, 25 bp, Mus musculus
tccgtacctgctgagcggatggctg

SEQ ID NO: 378992 - DNA, 25 bp, Mus musculus
acaccgggccgattaacaaacactg

SEQ ID NO: 378993 - DNA, 25 bp, Mus musculus
caaagaccgagaccaacgtggacta

SEQ ID NO: 378994 - DNA, 25 bp, Mus musculus
accaacgtggactagctccgggagc

SEQ ID NO: 378995 - DNA, 25 bp, Mus musculus
ccaaggctctgcgactaggacggcc

SEQ ID NO: 378996 - DNA, 25 bp, Mus musculus
gcccacagagtacagcggcagatta

SEQ ID NO: 378997 - DNA, 25 bp, Mus musculus
attagcatacaacgcgggccacgcc

SEQ ID NO: 378998 - DNA, 25 bp, Mus musculus
caaggcgcaccgattagcataacta

SEQ ID NO: 378999 - DNA, 25 bp, Mus musculus
agcataactaagagccacgcccaca

SEQ ID NO: 379000 - DNA, 25 bp, Mus musculus
gcccacagagtacaacagacagatt

SEQ ID NO: 379001 - DNA, 25 bp, Mus musculus
ttagcttaatacaccgagggcacgc

SEQ ID NO: 379002 - DNA, 25 bp, Mus musculus
agggcacgcccacagagtacaccgg

SEQ ID NO: 379003 - DNA, 25 bp, Mus musculus
attaacaaacactgagggccacgcc

SEQ ID NO: 379004 - DNA, 25 bp, Mus musculus
attgcccaaagccttgggaggccgg

SEQ ID NO: 379005 - DNA, 25 bp, Mus musculus
acctacagggggcaatcgacttcca

SEQ ID NO: 379006 - DNA, 25 bp, Mus musculus
cgacttccagaaccgccgctggact

SEQ ID NO: 379007 - DNA, 25 bp, Mus musculus
cggcttcgcccagggaacgtcacca

SEQ ID NO: 379008 - DNA, 25 bp, Mus musculus
cgctaatgcgcaggcgccaagagca

SEQ ID NO: 379009 - DNA, 25 bp, Mus musculus
agagcaccacgcaccgccaagccga

SEQ ID NO: 379010 - DNA, 25 bp, Mus musculus
gagcgcccgtgtccctgagtgtccc

SEQ ID NO: 379011 - DNA, 25 bp, Mus musculus
tgagtgtcccagctcccggttaccg

SEQ ID NO: 379012 - DNA, 25 bp, Mus musculus
cggttaccggagagccggacattag

SEQ ID NO: 379013 - DNA, 25 bp, Mus musculus
cattagcggattgcccaaagccttg

SEQ ID NO: 379014 - DNA, 25 bp, Mus musculus
gaacgcttccgtctcggcgccgctt

SEQ ID NO: 379015 - DNA, 25 bp, Mus musculus
cgcaggaccggagggaccatgtacc

SEQ ID NO: 379016 - DNA, 25 bp, Mus musculus
gggctacgggatgacacctcctccg

SEQ ID NO: 379017 - DNA, 25 bp, Mus musculus
gagccggacattagcggattgccca

SEQ ID NO: 379018 - DNA, 25 bp, Mus musculus
cgctcggggcaaggggcggtggcat

SEQ ID NO: 379019 - DNA, 25 bp, Mus musculus
gtagagccaggcaggtgcggcagga

SEQ ID NO: 379020 - DNA, 25 bp, Mus musculus
cggcaggagcatgcgcgtgcgcggt

SEQ ID NO: 379021 - DNA, 25 bp, Mus musculus
ccggtgcacctcacccgcggcagct

SEQ ID NO: 379022 - DNA, 25 bp, Mus musculus
ctgctgcgggacactggggtaagca

SEQ ID NO: 379023 - DNA, 25 bp, Mus musculus
agctcctcgcttctctctcgttgcg

SEQ ID NO: 379024 - DNA, 25 bp, Mus musculus
ggtaagcagggtgcgcgcccgagtg

SEQ ID NO: 379025 - DNA, 25 bp, Mus musculus
gcggtggcatgagctcctcgcttct

SEQ ID NO: 379026 - DNA, 25 bp, Mus musculus
ggtggcatgagctcctcgcttctct

SEQ ID NO: 379027 - DNA, 25 bp, Mus musculus
tggcatgagctcctcgcttctctct

SEQ ID NO: 379028 - DNA, 25 bp, Mus musculus
cggactgaatgccacgcggtggggc

SEQ ID NO: 379029 - DNA, 25 bp, Mus musculus
tgagctcctcgcttctctctcgttg

SEQ ID NO: 379030 - DNA, 25 bp, Mus musculus
aatgccacgcggtggggcgtagagc

SEQ ID NO: 379031 - DNA, 25 bp, Mus musculus
acactggggtaagcagggtgcgcgc

SEQ ID NO: 379032 - DNA, 25 bp, Mus musculus
ctccctagggctggatggaattttt

SEQ ID NO: 379033 - DNA, 25 bp, Mus musculus
cttctggcttggatagcgaagtggt

SEQ ID NO: 379034 - DNA, 25 bp, Mus musculus
tctggcttctggcttggatagcgaa

SEQ ID NO: 379035 - DNA, 25 bp, Mus musculus
tgggcctggaattctggcttctggc

SEQ ID NO: 379036 - DNA, 25 bp, Mus musculus
gcctgggcctggaattctggcttct

SEQ ID NO: 379037 - DNA, 25 bp, Mus musculus
agcctgggcctggaattctggcttc

SEQ ID NO: 379038 - DNA, 25 bp, Mus musculus
gagcggtgagtctgcggaaccggag

SEQ ID NO: 379039 - DNA, 25 bp, Mus musculus
cactgggtctcagcgacgctggagc

SEQ ID NO: 379040 - DNA, 25 bp, Mus musculus
acactgggtctcagcgacgctggag

SEQ ID NO: 379041 - DNA, 25 bp, Mus musculus
tcctccctagggctggatggaattt

SEQ ID NO: 379042 - DNA, 25 bp, Mus musculus
gctggatggaattttttcccctgga

SEQ ID NO: 379043 - DNA, 25 bp, Mus musculus
gaggacactgggtctcagcgacgct

SEQ ID NO: 379044 - DNA, 25 bp, Mus musculus
tgctcctcctccctagggctggatg

SEQ ID NO: 379045 - DNA, 25 bp, Mus musculus
tcctcctccctagggctggatggaa

SEQ ID NO: 379046 - DNA, 25 bp, Mus musculus
acaagtcgctgtcgaagggacggac

SEQ ID NO: 379047 - DNA, 25 bp, Mus musculus
cgtttcagctgcgttcagaaccttg

SEQ ID NO: 379048 - DNA, 25 bp, Mus musculus
cttcttggaaactcttggaaatggc

SEQ ID NO: 379049 - DNA, 25 bp, Mus musculus
cgacctggttcaagcacgcggtgca

SEQ ID NO: 379050 - DNA, 25 bp, Mus musculus
ttggaaatggcttccgccaccgcgc

SEQ ID NO: 379051 - DNA, 25 bp, Mus musculus
gggccgggtacctactgccatcctg

SEQ ID NO: 379052 - DNA, 25 bp, Mus musculus
atcctgccgcaatttccctgtgtca

SEQ ID NO: 379053 - DNA, 25 bp, Mus musculus
atttccctgtgtcatggctccggtc

SEQ ID NO: 379054 - DNA, 25 bp, Mus musculus
tcatggctccggtctcttagcaaca

SEQ ID NO: 379055 - DNA, 25 bp, Mus musculus
ggtctcttagcaacagccgccagtc

SEQ ID NO: 379056 - DNA, 25 bp, Mus musculus
gcgcgccgcagccacacaaaagagg

SEQ ID NO: 379057 - DNA, 25 bp, Mus musculus
gccacacaaaagaggcgcagggctg

SEQ ID NO: 379058 - DNA, 25 bp, Mus musculus
gcggaggacctgacacttcttggaa

SEQ ID NO: 379059 - DNA, 25 bp, Mus musculus
cagaaccttgccttacacgatcgcg

SEQ ID NO: 379060 - DNA, 25 bp, Mus musculus
cctcgagcgcagagaacctggactc

SEQ ID NO: 379061 - DNA, 25 bp, Mus musculus
cttcgccctgttgcccttgcaaggg

SEQ ID NO: 379062 - DNA, 25 bp, Mus musculus
gcagcgccgctcaatggctttctca

SEQ ID NO: 379063 - DNA, 25 bp, Mus musculus
agcaccagtgggctcccggactatc

SEQ ID NO: 379064 - DNA, 25 bp, Mus musculus
agctgcagctggcatagacctcccg

SEQ ID NO: 379065 - DNA, 25 bp, Mus musculus
gccctgcagcccaaccgggagttgg

SEQ ID NO: 379066 - DNA, 25 bp, Mus musculus
atcgccggaccacagttgccgcggt

SEQ ID NO: 379067 - DNA, 25 bp, Mus musculus
agcatctaccgcgagcgctccagta

SEQ ID NO: 379068 - DNA, 25 bp, Mus musculus
tgacagaggccgtgtacagcatcta

SEQ ID NO: 379069 - DNA, 25 bp, Mus musculus
ggacctggcttcatctccgcgctgt

SEQ ID NO: 379070 - DNA, 25 bp, Mus musculus
acgcctttggggctgctgcaatgct

SEQ ID NO: 379071 - DNA, 25 bp, Mus musculus
caatctcgaggcctggagctgaagc

SEQ ID NO: 379072 - DNA, 25 bp, Mus musculus
ggctttctcagctacgtgcaatctc

SEQ ID NO: 379073 - DNA, 25 bp, Mus musculus
gagaactggacctgagcctgaccga

SEQ ID NO: 379074 - DNA, 25 bp, Mus musculus
aggctacctgctagcgcccttctgg

SEQ ID NO: 379075 - DNA, 25 bp, Mus musculus
gcccttctggaatgcgtaggttcta

SEQ ID NO: 379076 - DNA, 25 bp, Mus musculus
tggagattccgtgccagtgccaacg

SEQ ID NO: 379077 - DNA, 25 bp, Mus musculus
cctagccagcggattcggaggattt

SEQ ID NO: 379078 - DNA, 25 bp, Mus musculus
aggacgtcatccctctctgctcagg

SEQ ID NO: 379079 - DNA, 25 bp, Mus musculus
gccagaggctctagaggacgtcatc

SEQ ID NO: 379080 - DNA, 25 bp, Mus musculus
agctcgcgaatctctgtccctagga

SEQ ID NO: 379081 - DNA, 25 bp, Mus musculus
cgctccctgttccaaggccgaagta

SEQ ID NO: 379082 - DNA, 25 bp, Mus musculus
gtgagcacctttccacccgagtgtc

SEQ ID NO: 379083 - DNA, 25 bp, Mus musculus
gagcaaggcttctgctatccaggtg

SEQ ID NO: 379084 - DNA, 25 bp, Mus musculus
gcgctactttgttttctccgaggaa

SEQ ID NO: 379085 - DNA, 25 bp, Mus musculus
ggcaacctcttgcagccaccgtgag

SEQ ID NO: 379086 - DNA, 25 bp, Mus musculus
accgctgcaagagaagcccgggtct

SEQ ID NO: 379087 - DNA, 25 bp, Mus musculus
atagcctgcgggcttgcactctagc

SEQ ID NO: 379088 - DNA, 25 bp, Mus musculus
ccagaggccctgcaataatccaagt

SEQ ID NO: 379089 - DNA, 25 bp, Mus musculus
cccagagctaggttctagaggactg

SEQ ID NO: 379090 - DNA, 25 bp, Mus musculus
gctaggttctagaggactgctcaac

SEQ ID NO: 379091 - DNA, 25 bp, Mus musculus
tcagcagctgactcggtcgcggtcc

SEQ ID NO: 379092 - DNA, 25 bp, Mus musculus
aacctaggtgtcctgaagaactgca

SEQ ID NO: 379093 - DNA, 25 bp, Mus musculus
tgctctcagcagctgactcggtcgc

SEQ ID NO: 379094 - DNA, 25 bp, Mus musculus
gagcctccgtgcctcctgcaaaggg

SEQ ID NO: 379095 - DNA, 25 bp, Mus musculus
tccaaaggctactgctctcagcagc

SEQ ID NO: 379096 - DNA, 25 bp, Mus musculus
ccaagtgtaaatccaaaggctactg

SEQ ID NO: 379097 - DNA, 25 bp, Mus musculus
ggccctgcaataatccaagtgtaaa

SEQ ID NO: 379098 - DNA, 25 bp, Mus musculus
tagaggactgctcaacctaggtgtc

SEQ ID NO: 379099 - DNA, 25 bp, Mus musculus
ctgctcaacctaggtgtcctgaaga

SEQ ID NO: 379100 - DNA, 25 bp, Mus musculus
accgccgagcaggacgccagcgcca

SEQ ID NO: 379101 - DNA, 25 bp, Mus musculus
gagtctcctgcgcaccgccgagcag

SEQ ID NO: 379102 - DNA, 25 bp, Mus musculus
cgcaggactccggtccctgctagtt

SEQ ID NO: 379103 - DNA, 25 bp, Mus musculus
cgggtctcggagcatcctggctcca

SEQ ID NO: 379104 - DNA, 25 bp, Mus musculus
ggtctcggagcatcctggctccacg

SEQ ID NO: 379105 - DNA, 25 bp, Mus musculus
tcggagcatcctggctccacggcga

SEQ ID NO: 379106 - DNA, 25 bp, Mus musculus
agcatcctggctccacggcgaggcg

SEQ ID NO: 379107 - DNA, 25 bp, Mus musculus
gccgcttttacgtaacttgcctctc

SEQ ID NO: 379108 - DNA, 25 bp, Mus musculus
tttacgtaacttgcctctccctcga

SEQ ID NO: 379109 - DNA, 25 bp, Mus musculus
acgtaacttgcctctccctcgagtg

SEQ ID NO: 379110 - DNA, 25 bp, Mus musculus
gtaacttgcctctccctcgagtggc

SEQ ID NO: 379111 - DNA, 25 bp, Mus musculus
ctctccctcgagtggccggcgacct

SEQ ID NO: 379112 - DNA, 25 bp, Mus musculus
tactggccagccaggttgccccggg

SEQ ID NO: 379113 - DNA, 25 bp, Mus musculus
agagccgagcactcggccgggcgcg

SEQ ID NO: 379114 - DNA, 25 bp, Mus musculus
caggactccggtccctgctagttgc

SEQ ID NO: 379115 - DNA, 25 bp, Mus musculus
gcctgcagagccgagcactcggccg

SEQ ID NO: 379116 - DNA, 25 bp, Mus musculus
ccgagcgagggagcccacagcgaca

SEQ ID NO: 379117 - DNA, 25 bp, Mus musculus
cggccgagttcatggccgcctggct

SEQ ID NO: 379118 - DNA, 25 bp, Mus musculus
tagcggtgccaagctgcaggtaagc

SEQ ID NO: 379119 - DNA, 25 bp, Mus musculus
cgcgctctctctccgcggccgagtt

SEQ ID NO: 379120 - DNA, 25 bp, Mus musculus
cccacagcgacagcgagcgtctgta

SEQ ID NO: 379121 - DNA, 25 bp, Mus musculus
cgtccatcccgtccctggcttgcgc

SEQ ID NO: 379122 - DNA, 25 bp, Mus musculus
gaaccggccgcatgcccgctcccga

SEQ ID NO: 379123 - DNA, 25 bp, Mus musculus
atccaaaacactgccacccaccgtg

SEQ ID NO: 379124 - DNA, 25 bp, Mus musculus
gccaccaccagggacgtgcacgatt

SEQ ID NO: 379125 - DNA, 25 bp, Mus musculus
agccagttccgtgcctgcgcaagcg

SEQ ID NO: 379126 - DNA, 25 bp, Mus musculus
ttcctcgctcgctcacgagggaggc

SEQ ID NO: 379127 - DNA, 25 bp, Mus musculus
cccagattaaccctttcctcgctcg

SEQ ID NO: 379128 - DNA, 25 bp, Mus musculus
ctcgcagctgtggtttcccccggag

SEQ ID NO: 379129 - DNA, 25 bp, Mus musculus
acagcgagcgtctgtagcggtgcca

SEQ ID NO: 379130 - DNA, 25 bp, Mus musculus
tcaacttgatgatgtcgtccgggca

SEQ ID NO: 379131 - DNA, 25 bp, Mus musculus
cggccagtcgaagagtaagtattgc

SEQ ID NO: 379132 - DNA, 25 bp, Mus musculus
tccggatgaaagtaacggccagtcg

SEQ ID NO: 379133 - DNA, 25 bp, Mus musculus
cgcgatgtgtctagtccggatgaaa

SEQ ID NO: 379134 - DNA, 25 bp, Mus musculus
cgggcagattctcggtatccggttt

SEQ ID NO: 379135 - DNA, 25 bp, Mus musculus
cgcctggagggagaattctgcgaca

SEQ ID NO: 379136 - DNA, 25 bp, Mus musculus
gatttcctccgctctgacatatttg

SEQ ID NO: 379137 - DNA, 25 bp, Mus musculus
tcgtccgtcatagagatagatttcc

SEQ ID NO: 379138 - DNA, 25 bp, Mus musculus
gctagaagtagacagctcgtccgtc

SEQ ID NO: 379139 - DNA, 25 bp, Mus musculus
ccgcctgcagcacgtactttaagaa

SEQ ID NO: 379140 - DNA, 25 bp, Mus musculus
gaagatgtaaagttccgagcccacc

SEQ ID NO: 379141 - DNA, 25 bp, Mus musculus
gcgacatcgccatcgtggttgaaga

SEQ ID NO: 379142 - DNA, 25 bp, Mus musculus
catgtacaccgccaagatttccgtg

SEQ ID NO: 379143 - DNA, 25 bp, Mus musculus
tgtgttctcagaagcgcgatgtgtc

SEQ ID NO: 379144 - DNA, 25 bp, Mus musculus
gcgccgggtctctgagatttagtga

SEQ ID NO: 379145 - DNA, 25 bp, Mus musculus
ggtcaccaccggaagtgcgtcacta

SEQ ID NO: 379146 - DNA, 25 bp, Mus musculus
cacagtgcacggctgggaacccgat

SEQ ID NO: 379147 - DNA, 25 bp, Mus musculus
tgcaggaattcgctgtcctcccagc

SEQ ID NO: 379148 - DNA, 25 bp, Mus musculus
tggtctggcggattctatccatttc

SEQ ID NO: 379149 - DNA, 25 bp, Mus musculus
atttagtgaccgaactgcccgcgcg

SEQ ID NO: 379150 - DNA, 25 bp, Mus musculus
tgccgtacgtgctttgccctaattg

SEQ ID NO: 379151 - DNA, 25 bp, Mus musculus
tccatttccgcccaggacggtaaga

SEQ ID NO: 379152 - DNA, 25 bp, Mus musculus
gggcttctgtgggttctaatgattc

SEQ ID NO: 379153 - DNA, 25 bp, Mus musculus
gggatagcgggtatttccgaagcca

SEQ ID NO: 379154 - DNA, 25 bp, Mus musculus
gcaagagcaggaaacccacgggacc

SEQ ID NO: 379155 - DNA, 25 bp, Mus musculus
ccctgacgttttcagtgcccgcgga

SEQ ID NO: 379156 - DNA, 25 bp, Mus musculus
actgttttgtcaagtccgcgttggc

SEQ ID NO: 379157 - DNA, 25 bp, Mus musculus
ttggctccaagagagaccttccctg

SEQ ID NO: 379158 - DNA, 25 bp, Mus musculus
cgtgcagcaggtcaccggccacggc

SEQ ID NO: 379159 - DNA, 25 bp, Mus musculus
tgagaatggagctggtggaggtcct

SEQ ID NO: 379160 - DNA, 25 bp, Mus musculus
ttgacgagcaggaacctccaaacgg

SEQ ID NO: 379161 - DNA, 25 bp, Mus musculus
gccggttgacgagcaggaacctcca

SEQ ID NO: 379162 - DNA, 25 bp, Mus musculus
ctctgcgcctgcgtagaacgacctc

SEQ ID NO: 379163 - DNA, 25 bp, Mus musculus
cgagcaggaacctccaaacggtggc

SEQ ID NO: 379164 - DNA, 25 bp, Mus musculus
tgcgtagaacgacctccgcggccgg

SEQ ID NO: 379165 - DNA, 25 bp, Mus musculus
aacctccaaacggtggcgccttgag

SEQ ID NO: 379166 - DNA, 25 bp, Mus musculus
ggcggaccatgcagatgagaatgga

SEQ ID NO: 379167 - DNA, 25 bp, Mus musculus
ccgaacacggaaggggcggaccatg

SEQ ID NO: 379168 - DNA, 25 bp, Mus musculus
agtatctcgtcttccgcccggcggg

SEQ ID NO: 379169 - DNA, 25 bp, Mus musculus
cttgagtatctcgtcttccgcccgg

SEQ ID NO: 379170 - DNA, 25 bp, Mus musculus
gtggcgccttgagtatctcgtcttc

SEQ ID NO: 379171 - DNA, 25 bp, Mus musculus
aacggtggcgccttgagtatctcgt

SEQ ID NO: 379172 - DNA, 25 bp, Mus musculus
agcgctagccctatggatttggatc

SEQ ID NO: 379173 - DNA, 25 bp, Mus musculus
aaccgggcaattacctttctgtctg

SEQ ID NO: 379174 - DNA, 25 bp, Mus musculus
cttccttagaagtggcaaagtgccc

SEQ ID NO: 379175 - DNA, 25 bp, Mus musculus
cttctttttccgcagacgtccaggc

SEQ ID NO: 379176 - DNA, 25 bp, Mus musculus
acccggagtgagcaccgacaccttg

SEQ ID NO: 379177 - DNA, 25 bp, Mus musculus
tctgaaactctgtcgggactgcagc

SEQ ID NO: 379178 - DNA, 25 bp, Mus musculus
cttccgtccttcctgcttcggtgga

SEQ ID NO: 379179 - DNA, 25 bp, Mus musculus
ctccttctgtgggagtctctgtcgc

SEQ ID NO: 379180 - DNA, 25 bp, Mus musculus
aagtggcccactcgccagcatcgga

SEQ ID NO: 379181 - DNA, 25 bp, Mus musculus
tccctatgcgtgctttggagttgca

SEQ ID NO: 379182 - DNA, 25 bp, Mus musculus
ttcggcggtgaatcgccaagctggc

SEQ ID NO: 379183 - DNA, 25 bp, Mus musculus
gaagtcatggtgttcgctccaggta

SEQ ID NO: 379184 - DNA, 25 bp, Mus musculus
aaacccaagggtgtagcggctgaag

SEQ ID NO: 379185 - DNA, 25 bp, Mus musculus
tctgtccacctctagaaacccaagg

SEQ ID NO: 379186 - DNA, 25 bp, Mus musculus
ggcagccctcgcatcctagggactg

SEQ ID NO: 379187 - DNA, 25 bp, Mus musculus
ataggtcacgcccactagcgggtgg

SEQ ID NO: 379188 - DNA, 25 bp, Mus musculus
acatacttgcggacggaggctgagc

SEQ ID NO: 379189 - DNA, 25 bp, Mus musculus
gggttcactgctctggtcctcgctc

SEQ ID NO: 379190 - DNA, 25 bp, Mus musculus
cggccacttcgtagcagccggagcg

SEQ ID NO: 379191 - DNA, 25 bp, Mus musculus
ccgccgtattaacatgcacccaggg

SEQ ID NO: 379192 - DNA, 25 bp, Mus musculus
actgacagacggacggagcagcgac

SEQ ID NO: 379193 - DNA, 25 bp, Mus musculus
cgcaagggtacgcataggtcacgcc

SEQ ID NO: 379194 - DNA, 25 bp, Mus musculus
tcacctcgctgagaaacgtcccgta

SEQ ID NO: 379195 - DNA, 25 bp, Mus musculus
aacatgcacccaggggcgggtgacc

SEQ ID NO: 379196 - DNA, 25 bp, Mus musculus
cgctcccgggaaggcgcggacatac

SEQ ID NO: 379197 - DNA, 25 bp, Mus musculus
gtcctcgctccgaggctcgtgggac

SEQ ID NO: 379198 - DNA, 25 bp, Mus musculus
aacgtcccgtactgcgggttcactg

SEQ ID NO: 379199 - DNA, 25 bp, Mus musculus
aggaccaaggccagcggccacttcg

SEQ ID NO: 379200 - DNA, 25 bp, Mus musculus
tccgcctgaggacactgagctccag

SEQ ID NO: 379201 - DNA, 25 bp, Mus musculus
tacgtacttccgtgatatgccgggg

SEQ ID NO: 379202 - DNA, 25 bp, Mus musculus
ctcacgggtacctggcacgaatacg

SEQ ID NO: 379203 - DNA, 25 bp, Mus musculus
acgaatacggccagtgcaacccaaa

SEQ ID NO: 379204 - DNA, 25 bp, Mus musculus
ccagtgcaacccaaacacggtggga

SEQ ID NO: 379205 - DNA, 25 bp, Mus musculus
acggtgggaccttttcctgcgtgat

SEQ ID NO: 379206 - DNA, 25 bp, Mus musculus
ttcctgcgtgatcctgcacgaccag

SEQ ID NO: 379207 - DNA, 25 bp, Mus musculus
tccgggaagtgatgaatcggacgcc

SEQ ID NO: 379208 - DNA, 25 bp, Mus musculus
agctctggcagtgacgggccctcct

SEQ ID NO: 379209 - DNA, 25 bp, Mus musculus
tgagctccaggtcacgttccgggaa

SEQ ID NO: 379210 - DNA, 25 bp, Mus musculus
ggacgttacgtacttccgtgatatg

SEQ ID NO: 379211 - DNA, 25 bp, Mus musculus
ctggcgcggctctacttttatctga

SEQ ID NO: 379212 - DNA, 25 bp, Mus musculus
cggagctccgctctctaacttgtga

SEQ ID NO: 379213 - DNA, 25 bp, Mus musculus
ctctaacttgtgagctctggcagtg

SEQ ID NO: 379214 - DNA, 25 bp, Mus musculus
cgggttgagccagataacaaattgc

SEQ ID NO: 379215 - DNA, 25 bp, Mus musculus
tccctgctccgggttgagccagata

SEQ ID NO: 379216 - DNA, 25 bp, Mus musculus
aacaaattgcactttcatggagggg

SEQ ID NO: 379217 - DNA, 25 bp, Mus musculus
ctgcagctgtgaggaggaccttaag

SEQ ID NO: 379218 - DNA, 25 bp, Mus musculus
ggaccaatgggaacctctccctgct

SEQ ID NO: 379219 - DNA, 25 bp, Mus musculus
aggaggaccttaagggctatgaaga

SEQ ID NO: 379220 - DNA, 25 bp, Mus musculus
gagccgggaccaatgggaacctctc

SEQ ID NO: 379221 - DNA, 25 bp, Mus musculus
ctgcattcaggacccgcagagagcg

SEQ ID NO: 379222 - DNA, 25 bp, Mus musculus
agagcgagcggttctggtcttcacg

SEQ ID NO: 379223 - DNA, 25 bp, Mus musculus
gcggttctggtcttcacgttgttca

SEQ ID NO: 379224 - DNA, 25 bp, Mus musculus
ctggtcttcacgttgttcatgaggc

SEQ ID NO: 379225 - DNA, 25 bp, Mus musculus
cacgttgttcatgaggccgtgggaa

SEQ ID NO: 379226 - DNA, 25 bp, Mus musculus
cagaggcactgagcgcctgtgcccg

SEQ ID NO: 379227 - DNA, 25 bp, Mus musculus
gggctatgaagaccctgcattcagg

SEQ ID NO: 379228 - DNA, 25 bp, Mus musculus
acgagagtgccctggtaccacgcac

SEQ ID NO: 379229 - DNA, 25 bp, Mus musculus
gtagggcccttcagcgacccgctgg

SEQ ID NO: 379230 - DNA, 25 bp, Mus musculus
ggatcagtttgagaggcagctgccc

SEQ ID NO: 379231 - DNA, 25 bp, Mus musculus
gaattctttccaggccgagtgcgta

SEQ ID NO: 379232 - DNA, 25 bp, Mus musculus
cgctacagtacaagcgcaccgctgt

SEQ ID NO: 379233 - DNA, 25 bp, Mus musculus
ctgaaggacgagagtgccctggtac

SEQ ID NO: 379234 - DNA, 25 bp, Mus musculus
accgctgtggagcatcgcagcgata

SEQ ID NO: 379235 - DNA, 25 bp, Mus musculus
cctggccaccaaggcgaatcgtctc

SEQ ID NO: 379236 - DNA, 25 bp, Mus musculus
tacacctcgcagcaggagctgaagg

SEQ ID NO: 379237 - DNA, 25 bp, Mus musculus
gcaggcactacacctcgcagcagga

SEQ ID NO: 379238 - DNA, 25 bp, Mus musculus
caggccgagtgcgtagggcccttca

SEQ ID NO: 379239 - DNA, 25 bp, Mus musculus
cccaccaacctgctggatcagtttg

SEQ ID NO: 379240 - DNA, 25 bp, Mus musculus
gggatggctatcacacgctacagta

SEQ ID NO: 379241 - DNA, 25 bp, Mus musculus
cctcagccgggatggctatcacacg

SEQ ID NO: 379242 - DNA, 25 bp, Mus musculus
aaaagtgcagcctgatgctgcgggt

SEQ ID NO: 379243 - DNA, 25 bp, Mus musculus
gtcggcaaaaagtgcagcctgatgc

SEQ ID NO: 379244 - DNA, 25 bp, Mus musculus
cattggcggagtcggcaaaaagtgc

SEQ ID NO: 379245 - DNA, 25 bp, Mus musculus
cagcgcgtagaccattggcggagtc

SEQ ID NO: 379246 - DNA, 25 bp, Mus musculus
gcggtggtctcagcgcgtagaccat

SEQ ID NO: 379247 - DNA, 25 bp, Mus musculus
ccacgcgctgtaatcagggaggaag

SEQ ID NO: 379248 - DNA, 25 bp, Mus musculus
tgcgggtgggccactcgttcatccc

SEQ ID NO: 379249 - DNA, 25 bp, Mus musculus
tgcgcgccatgagcaccataagtca

SEQ ID NO: 379250 - DNA, 25 bp, Mus musculus
cgtggccacgcgctgtaatcaggga

SEQ ID NO: 379251 - DNA, 25 bp, Mus musculus
ccgctccagaaacgagagctacatg

SEQ ID NO: 379252 - DNA, 25 bp, Mus musculus
aaacgagagctacatgcgcgccatg

SEQ ID NO: 379253 - DNA, 25 bp, Mus musculus
cgtcaccaaagttccgctccagaaa

SEQ ID NO: 379254 - DNA, 25 bp, Mus musculus
tgagagccctcagagcctccgtggc

SEQ ID NO: 379255 - DNA, 25 bp, Mus musculus
accataagtcaggtgagagccctca

SEQ ID NO: 379256 - DNA, 25 bp, Mus musculus
gttcagcgagctggagtcgcaggcg

SEQ ID NO: 379257 - DNA, 25 bp, Mus musculus
aatgcgtgtcgctgcggtcgtcctc

SEQ ID NO: 379258 - DNA, 25 bp, Mus musculus
acgacgaatgcgtgtcgctgcggtc

SEQ ID NO: 379259 - DNA, 25 bp, Mus musculus
gctcccaggacgacgaatgcgtgtc

SEQ ID NO: 379260 - DNA, 25 bp, Mus musculus
gaggtgaacggccagttcgaatccg

SEQ ID NO: 379261 - DNA, 25 bp, Mus musculus
tgaacggccagttcgaatccgtgtg

SEQ ID NO: 379262 - DNA, 25 bp, Mus musculus
gttcgaatccgtgtgcgagtctgtg

SEQ ID NO: 379263 - DNA, 25 bp, Mus musculus
gctgctcccaggacgacgaatgcgt

SEQ ID NO: 379264 - DNA, 25 bp, Mus musculus
cggtggaagcgctggacctgcccct

SEQ ID NO: 379265 - DNA, 25 bp, Mus musculus
cggagccacagctatgtgcgggcca

SEQ ID NO: 379266 - DNA, 25 bp, Mus musculus
ccacagctatgtgcgggccatcgaa

SEQ ID NO: 379267 - DNA, 25 bp, Mus musculus
ctatgtgcgggccatcgaaaagggc

SEQ ID NO: 379268 - DNA, 25 bp, Mus musculus
gggccatcgaaaagggctgctccca

SEQ ID NO: 379269 - DNA, 25 bp, Mus musculus
gccagttcgaatccgtgtgcgagtc

SEQ ID NO: 379270 - DNA, 25 bp, Mus musculus
gccgaggaccgtcccgcatccctgc

SEQ ID NO: 379271 - DNA, 25 bp, Mus musculus
tgagctcagtgacagccaccgccgt

SEQ ID NO: 379272 - DNA, 25 bp, Mus musculus
gctcgctggagagctcgcagcgcca

SEQ ID NO: 379273 - DNA, 25 bp, Mus musculus
cagccaccgccgtggcgtagttgtc

SEQ ID NO: 379274 - DNA, 25 bp, Mus musculus
cgtagttgtccacctcgcaggagcc

SEQ ID NO: 379275 - DNA, 25 bp, Mus musculus
ccgtggcgtagttgtccacctcgca

SEQ ID NO: 379276 - DNA, 25 bp, Mus musculus
tccgtctctgagctcagtgacagcc

SEQ ID NO: 379277 - DNA, 25 bp, Mus musculus
ttcctggaccactttgcccatcttc

SEQ ID NO: 379278 - DNA, 25 bp, Mus musculus
acccggctctgaacgccgccgagga

SEQ ID NO: 379279 - DNA, 25 bp, Mus musculus
cccgcgccgctgatccgggagcgct

SEQ ID NO: 379280 - DNA, 25 bp, Mus musculus
gtccgccagaactcggccaccgaga

SEQ ID NO: 379281 - DNA, 25 bp, Mus musculus
gcaagcgcctgatggccgccaagcg

SEQ ID NO: 379282 - DNA, 25 bp, Mus musculus
ccaggaggcccgcaagcgcctgatg

SEQ ID NO: 379283 - DNA, 25 bp, Mus musculus
gcccatcttctccaccgagcttcgc

SEQ ID NO: 379284 - DNA, 25 bp, Mus musculus
tgagcacgttgatcaaaggtccctt

SEQ ID NO: 379285 - DNA, 25 bp, Mus musculus
cacctgcctgggaagagcagcgcca

SEQ ID NO: 379286 - DNA, 25 bp, Mus musculus
ctcaaattaacagggagctggcgag

SEQ ID NO: 379287 - DNA, 25 bp, Mus musculus
ctttgcgggctcaaattaacaggga

SEQ ID NO: 379288 - DNA, 25 bp, Mus musculus
caaaggtccctttgcgggctcaaat

SEQ ID NO: 379289 - DNA, 25 bp, Mus musculus
ctgcaggctgtgagcacgttgatca

SEQ ID NO: 379290 - DNA, 25 bp, Mus musculus
tacagctcttttgaagtcgccggga

SEQ ID NO: 379291 - DNA, 25 bp, Mus musculus
acagtcggttttacagctcttttga

SEQ ID NO: 379292 - DNA, 25 bp, Mus musculus
agagcagcgccacagcaaaccggct

SEQ ID NO: 379293 - DNA, 25 bp, Mus musculus
cctcagaaacaggaaggccgagatt

SEQ ID NO: 379294 - DNA, 25 bp, Mus musculus
aagcttggcgtttgtgtgcggaccc

SEQ ID NO: 379295 - DNA, 25 bp, Mus musculus
acaatagtccggtgcgaagcttggc

SEQ ID NO: 379296 - DNA, 25 bp, Mus musculus
agccagctcgggaagcctgcaggct

SEQ ID NO: 379297 - DNA, 25 bp, Mus musculus
ggccgagattacagtcggttttaca

SEQ ID NO: 379298 - DNA, 25 bp, Mus musculus
aggcagacatagtcaccgtgggcaa

SEQ ID NO: 379299 - DNA, 25 bp, Mus musculus
ctgccattgacacgcgggcgcggca

SEQ ID NO: 379300 - DNA, 25 bp, Mus musculus
tcctcgtggactcttctgccaacag

SEQ ID NO: 379301 - DNA, 25 bp, Mus musculus
gtggactcttctgccaacagcgaca

SEQ ID NO: 379302 - DNA, 25 bp, Mus musculus
tcttctgccaacagcgacagtgggg

SEQ ID NO: 379303 - DNA, 25 bp, Mus musculus
gtcaccgtgggcaaatgtctattcc

SEQ ID NO: 379304 - DNA, 25 bp, Mus musculus
ctaaagctctgagttccggattgga

SEQ ID NO: 379305 - DNA, 25 bp, Mus musculus
ccggattggattgcaaggcagtttc

SEQ ID NO: 379306 - DNA, 25 bp, Mus musculus
tgcaaggcagtttcgaaatctaaca

SEQ ID NO: 379307 - DNA, 25 bp, Mus musculus
ggcagtttcgaaatctaacacgttg

SEQ ID NO: 379308 - DNA, 25 bp, Mus musculus
ctaacacgttgcgaatagacacttg

SEQ ID NO: 379309 - DNA, 25 bp, Mus musculus
atagacacttgtcatgctcacatgc

SEQ ID NO: 379310 - DNA, 25 bp, Mus musculus
cgcagctgccattgacacgcgggcg

SEQ ID NO: 379311 - DNA, 25 bp, Mus musculus
ccgggctaaagctctgagttccgga

SEQ ID NO: 379312 - DNA, 25 bp, Mus musculus
agcgcttttgaactcagaaacttta

SEQ ID NO: 379313 - DNA, 25 bp, Mus musculus
ggaatccgaagcacctcaagccaaa

SEQ ID NO: 379314 - DNA, 25 bp, Mus musculus
tcggccagggcctgggaatttagcc

SEQ ID NO: 379315 - DNA, 25 bp, Mus musculus
tctccgcgcacaggtcagtgcttcg

SEQ ID NO: 379316 - DNA, 25 bp, Mus musculus
ggtgtgtttccgcagaggttcctgc

SEQ ID NO: 379317 - DNA, 25 bp, Mus musculus
ggacggtcacgtgtcccagcttgcc

SEQ ID NO: 379318 - DNA, 25 bp, Mus musculus
aactttatttggtggtctggccagg

SEQ ID NO: 379319 - DNA, 25 bp, Mus musculus
tccagaaaggaagcgttggagcttt

SEQ ID NO: 379320 - DNA, 25 bp, Mus musculus
cactcaactggcgtcgcccggggtt

SEQ ID NO: 379321 - DNA, 25 bp, Mus musculus
aaacgccggggactcggccatcaca

SEQ ID NO: 379322 - DNA, 25 bp, Mus musculus
acatgggttttttctcccaagagcg

SEQ ID NO: 379323 - DNA, 25 bp, Mus musculus
agcttcctcacccaacatgggtttt

SEQ ID NO: 379324 - DNA, 25 bp, Mus musculus
gggactcgaactctcagcttgagga

SEQ ID NO: 379325 - DNA, 25 bp, Mus musculus
ttccggctacgcgagcggaagccct

SEQ ID NO: 379326 - DNA, 25 bp, Mus musculus
caggatgacccgctagactttggaa

SEQ ID NO: 379327 - DNA, 25 bp, Mus musculus
gaaattaaagcaagcctccgccgcg

SEQ ID NO: 379328 - DNA, 25 bp, Mus musculus
tgttggaaattaaagcaagcctccg

SEQ ID NO: 379329 - DNA, 25 bp, Mus musculus
cctgtttatgattatgttggaaatt

SEQ ID NO: 379330 - DNA, 25 bp, Mus musculus
ggaacctgtttatgattatgttgga

SEQ ID NO: 379331 - DNA, 25 bp, Mus musculus
ttaaagccgagccacagtaaggcgg

SEQ ID NO: 379332 - DNA, 25 bp, Mus musculus
agactttggaacctgtttatgatta

SEQ ID NO: 379333 - DNA, 25 bp, Mus musculus
cgctagactttggaacctgtttatg

SEQ ID NO: 379334 - DNA, 25 bp, Mus musculus
ggatgacccgctagactttggaacc

SEQ ID NO: 379335 - DNA, 25 bp, Mus musculus
ggccacaggatgacccgctagactt

SEQ ID NO: 379336 - DNA, 25 bp, Mus musculus
cagtaaggcggccacaggatgaccc

SEQ ID NO: 379337 - DNA, 25 bp, Mus musculus
aaggttaaagccgagccacagtaag

SEQ ID NO: 379338 - DNA, 25 bp, Mus musculus
tgacccgctagactttggaacctgt

SEQ ID NO: 379339 - DNA, 25 bp, Mus musculus
cgagccacagtaaggcggccacagg

SEQ ID NO: 379340 - DNA, 25 bp, Mus musculus
agcctggctaatgaatgcgattctc

SEQ ID NO: 379341 - DNA, 25 bp, Mus musculus
ggctcgaggccagagcgttctttcc

SEQ ID NO: 379342 - DNA, 25 bp, Mus musculus
agggcgtctccgtgtaactgattca

SEQ ID NO: 379343 - DNA, 25 bp, Mus musculus
gccacgcggtggctctcattatgta

SEQ ID NO: 379344 - DNA, 25 bp, Mus musculus
ctgcgcggcggaaaaacaaggttca

SEQ ID NO: 379345 - DNA, 25 bp, Mus musculus
gcgcgagttcataacatccgcaata

SEQ ID NO: 379346 - DNA, 25 bp, Mus musculus
ttctccggccgcactgatggaaacc

SEQ ID NO: 379347 - DNA, 25 bp, Mus musculus
aactcaccgtgacgcgaaggccagc

SEQ ID NO: 379348 - DNA, 25 bp, Mus musculus
gtgcacaccttctgctcgcataaat

SEQ ID NO: 379349 - DNA, 25 bp, Mus musculus
cgcataaatcttttcgaggcagtta

SEQ ID NO: 379350 - DNA, 25 bp, Mus musculus
cgcgctggcggaattctgagatcag

SEQ ID NO: 379351 - DNA, 25 bp, Mus musculus
aagctcggtagcagccttgcgttcc

SEQ ID NO: 379352 - DNA, 25 bp, Mus musculus
ggtgcacccgggctttacaactcca

SEQ ID NO: 379353 - DNA, 25 bp, Mus musculus
cttttctcccaagtcagcctggcta

SEQ ID NO: 379354 - DNA, 25 bp, Mus musculus
ccctgtagccgcgagtacatattcc

SEQ ID NO: 379355 - DNA, 25 bp, Mus musculus
cgcagttgcgctaacacacagcttg

SEQ ID NO: 379356 - DNA, 25 bp, Mus musculus
agcgccagcgctggaatttgacccg

SEQ ID NO: 379357 - DNA, 25 bp, Mus musculus
gcggcggaaactagcctggctgcac

SEQ ID NO: 379358 - DNA, 25 bp, Mus musculus
aagacccggaggacccaggcagcca

SEQ ID NO: 379359 - DNA, 25 bp, Mus musculus
gctgcaagcgtttcgaagacccgga

SEQ ID NO: 379360 - DNA, 25 bp, Mus musculus
ctgatgctgcacacccgagaggatc

SEQ ID NO: 379361 - DNA, 25 bp, Mus musculus
gagccactcacctgacctgatgctg

SEQ ID NO: 379362 - DNA, 25 bp, Mus musculus
gttgcgcagcactagggacagatgc

SEQ ID NO: 379363 - DNA, 25 bp, Mus musculus
ttcgccagcacaggaaccgcgtagg

SEQ ID NO: 379364 - DNA, 25 bp, Mus musculus
tcagtcatcggatgtcgcaggccca

SEQ ID NO: 379365 - DNA, 25 bp, Mus musculus
acacagcttggacctgcagcctgca

SEQ ID NO: 379366 - DNA, 25 bp, Mus musculus
cgtctagaacagatgcacgcagttg

SEQ ID NO: 379367 - DNA, 25 bp, Mus musculus
agccgggcaccaggtgtcagtcatc

SEQ ID NO: 379368 - DNA, 25 bp, Mus musculus
gtctccgagtagcatctggagcgcg

SEQ ID NO: 379369 - DNA, 25 bp, Mus musculus
aggagggcgtctccgagtagcatct

SEQ ID NO: 379370 - DNA, 25 bp, Mus musculus
tggctcaaccaacgaaggaaggagg

SEQ ID NO: 379371 - DNA, 25 bp, Mus musculus
ccagcgggtctgttggctcaaccaa

SEQ ID NO: 379372 - DNA, 25 bp, Mus musculus
gaagtaagatttggaccagcgggtc

SEQ ID NO: 379373 - DNA, 25 bp, Mus musculus
cactctcggaagtaagatttggacc

SEQ ID NO: 379374 - DNA, 25 bp, Mus musculus
cattgtatagccactctcggaagta

SEQ ID NO: 379375 - DNA, 25 bp, Mus musculus
cttcataggtcatccatgcgtggtg

SEQ ID NO: 379376 - DNA, 25 bp, Mus musculus
gggcgccctgcatagaagagcctca

SEQ ID NO: 379377 - DNA, 25 bp, Mus musculus
gccaccacagagcattgtatagcca

SEQ ID NO: 379378 - DNA, 25 bp, Mus musculus
cgagaccaccgcttcataggtcatc

SEQ ID NO: 379379 - DNA, 25 bp, Mus musculus
agaagagcctcaacaccgtggcagc

SEQ ID NO: 379380 - DNA, 25 bp, Mus musculus
tcatccatgcgtggtggcgatgcca

SEQ ID NO: 379381 - DNA, 25 bp, Mus musculus
ggcgatgccaccacagagcattgta

SEQ ID NO: 379382 - DNA, 25 bp, Mus musculus
cttaaagaatcctgtggagggtctc

SEQ ID NO: 379383 - DNA, 25 bp, Mus musculus
tcactgtctaggtcagcgcctctgg

SEQ ID NO: 379384 - DNA, 25 bp, Mus musculus
caggaagctagggtgactcactgtc

SEQ ID NO: 379385 - DNA, 25 bp, Mus musculus
cgtctaagtccttttagggcaattg

SEQ ID NO: 379386 - DNA, 25 bp, Mus musculus
tggagggtctctcggtctaatcacc

SEQ ID NO: 379387 - DNA, 25 bp, Mus musculus
gaaggaagcctagcggccatgctcc

SEQ ID NO: 379388 - DNA, 25 bp, Mus musculus
tccgctcgcgaaccggaaggaagcc

SEQ ID NO: 379389 - DNA, 25 bp, Mus musculus
taactttccagactccgcagtacgg

SEQ ID NO: 379390 - DNA, 25 bp, Mus musculus
cgcgagaaccgagagtgagcgtctc

SEQ ID NO: 379391 - DNA, 25 bp, Mus musculus
ccaagttcctagtgtgggaagcaga

SEQ ID NO: 379392 - DNA, 25 bp, Mus musculus
gcgccggcgagctaagcaacatttc

SEQ ID NO: 379393 - DNA, 25 bp, Mus musculus
gttagcaactcaacagagctccgga

SEQ ID NO: 379394 - DNA, 25 bp, Mus musculus
gctatcttacggttttatccgcaca

SEQ ID NO: 379395 - DNA, 25 bp, Mus musculus
tagaattgtgattctgcgccctccc

SEQ ID NO: 379396 - DNA, 25 bp, Mus musculus
ttacgcggggacaccattatgcagc

SEQ ID NO: 379397 - DNA, 25 bp, Mus musculus
tagctggactctgaagcccgacgca

SEQ ID NO: 379398 - DNA, 25 bp, Mus musculus
gcactcttttttggtagctggactc

SEQ ID NO: 379399 - DNA, 25 bp, Mus musculus
gcagcagaccgtttgcactcttttt

SEQ ID NO: 379400 - DNA, 25 bp, Mus musculus
ctcgcagctgcagccgttaaagtgc

SEQ ID NO: 379401 - DNA, 25 bp, Mus musculus
gtgttatcaccgagctccaagggta

SEQ ID NO: 379402 - DNA, 25 bp, Mus musculus
tacgggttctgcagtgatcccatga

SEQ ID NO: 379403 - DNA, 25 bp, Mus musculus
ctctgaggcccagttttgagcgccg

SEQ ID NO: 379404 - DNA, 25 bp, Mus musculus
cgcggacctggtttagatgtgagta

SEQ ID NO: 379405 - DNA, 25 bp, Mus musculus
gttattccctcaggccgttggcttg

SEQ ID NO: 379406 - DNA, 25 bp, Mus musculus
actggcgaggtgcagttattccctc

SEQ ID NO: 379407 - DNA, 25 bp, Mus musculus
ggctgcacaacagtccgccgagtga

SEQ ID NO: 379408 - DNA, 25 bp, Mus musculus
tttaaagcgcccttctgaggccggc

SEQ ID NO: 379409 - DNA, 25 bp, Mus musculus
atcccatgatggtgcactcgcgtta

SEQ ID NO: 379410 - DNA, 25 bp, Mus musculus
tcgcttcaggatgcttggggcgcct

SEQ ID NO: 379411 - DNA, 25 bp, Mus musculus
cttggttacagacttttcaattaca

SEQ ID NO: 379412 - DNA, 25 bp, Mus musculus
aattcacttccctctccgaaacgtg

SEQ ID NO: 379413 - DNA, 25 bp, Mus musculus
gcggtccctcaatgacgcacaggtc

SEQ ID NO: 379414 - DNA, 25 bp, Mus musculus
cggggtctcctgacacatcttgagc

SEQ ID NO: 379415 - DNA, 25 bp, Mus musculus
cactcttacttgttcctggcactgg

SEQ ID NO: 379416 - DNA, 25 bp, Mus musculus
gggcgagcataagggacacactctt

SEQ ID NO: 379417 - DNA, 25 bp, Mus musculus
gcagatcccgtagttctgccgaaca

SEQ ID NO: 379418 - DNA, 25 bp, Mus musculus
aagcctatggggctctctctgctac

SEQ ID NO: 379419 - DNA, 25 bp, Mus musculus
cccattgcccgggttcgcttcagga

SEQ ID NO: 379420 - DNA, 25 bp, Mus musculus
aagtgcagcaagcttcgggcggtcc

SEQ ID NO: 379421 - DNA, 25 bp, Mus musculus
gaaacgtgactcttcccttcaccat

SEQ ID NO: 379422 - DNA, 25 bp, Mus musculus
tgaccgcctaggatctgggactcta

SEQ ID NO: 379423 - DNA, 25 bp, Mus musculus
cgggtgccgccctctttaattcact

SEQ ID NO: 379424 - DNA, 25 bp, Mus musculus
ggaagctggcttccagcgccttagg

SEQ ID NO: 379425 - DNA, 25 bp, Mus musculus
acactagctaaaacaccgggcaccg

SEQ ID NO: 379426 - DNA, 25 bp, Mus musculus
cggtgcggtggacactagctaaaac

SEQ ID NO: 379427 - DNA, 25 bp, Mus musculus
cggcggctggaagcttgcaccacct

SEQ ID NO: 379428 - DNA, 25 bp, Mus musculus
catgcggtctccagggcgctaccaa

SEQ ID NO: 379429 - DNA, 25 bp, Mus musculus
gggcgcaactcgcaagcgtgtcgcc

SEQ ID NO: 379430 - DNA, 25 bp, Mus musculus
agacccggctagtccagcaggccgt

SEQ ID NO: 379431 - DNA, 25 bp, Mus musculus
agcctccttccgtgacctgagagcg

SEQ ID NO: 379432 - DNA, 25 bp, Mus musculus
acccgcgaacacagggacgcgctga

SEQ ID NO: 379433 - DNA, 25 bp, Mus musculus
ggggtgccgtacgtcacttccgcga

SEQ ID NO: 379434 - DNA, 25 bp, Mus musculus
aagtacaccgtcctacagccgtcga

SEQ ID NO: 379435 - DNA, 25 bp, Mus musculus
ttcccgcgccggtcaaacaagtaca

SEQ ID NO: 379436 - DNA, 25 bp, Mus musculus
tagtccgcgtgctccgagacctgca

SEQ ID NO: 379437 - DNA, 25 bp, Mus musculus
agggtctatgcaggctcccgctgca

SEQ ID NO: 379438 - DNA, 25 bp, Mus musculus
aaagcgcgggtttgtctccgatagg

SEQ ID NO: 379439 - DNA, 25 bp, Mus musculus
ggctcttcccaggtcgtcgttagcg

SEQ ID NO: 379440 - DNA, 25 bp, Mus musculus
acacagagctgatcccatctcagca

SEQ ID NO: 379441 - DNA, 25 bp, Mus musculus
gtaaaccgcacgactgcacacgaaa

SEQ ID NO: 379442 - DNA, 25 bp, Mus musculus
gcgagctctgggctcttcccaggtc

SEQ ID NO: 379443 - DNA, 25 bp, Mus musculus
cagctttccgtaaaccgcacgactg

SEQ ID NO: 379444 - DNA, 25 bp, Mus musculus
cgtcgttagcgtcggtgacccgaag

SEQ ID NO: 379445 - DNA, 25 bp, Mus musculus
gagtcccgccctgtccgggaagctg

SEQ ID NO: 379446 - DNA, 25 bp, Mus musculus
ccctgtccgggaagctggcatctag

SEQ ID NO: 379447 - DNA, 25 bp, Mus musculus
gcatctaggacgagtagggctgtcc

SEQ ID NO: 379448 - DNA, 25 bp, Mus musculus
tggctgcgtcctggaagtagaaagc

SEQ ID NO: 379449 - DNA, 25 bp, Mus musculus
tggaggccaggacccaagcctatga

SEQ ID NO: 379450 - DNA, 25 bp, Mus musculus
gacccaagcctatgaggcggcgtga

SEQ ID NO: 379451 - DNA, 25 bp, Mus musculus
acggcgagtacgcatgcgcgctcgc

SEQ ID NO: 379452 - DNA, 25 bp, Mus musculus
gcacgcaaccgcctgaggtagatcg

SEQ ID NO: 379453 - DNA, 25 bp, Mus musculus
ctcccgggctggagttctgagctgt

SEQ ID NO: 379454 - DNA, 25 bp, Mus musculus
agggatgagtcctgccgctgtgtcc

SEQ ID NO: 379455 - DNA, 25 bp, Mus musculus
tcgctcccacagtcctgcgtgagga

SEQ ID NO: 379456 - DNA, 25 bp, Mus musculus
tgggtgtcgactgtgccctccctct

SEQ ID NO: 379457 - DNA, 25 bp, Mus musculus
aaccgcctgaggtagatcgctgagg

SEQ ID NO: 379458 - DNA, 25 bp, Mus musculus
gttttgcggcctgcggctagcgacc

SEQ ID NO: 379459 - DNA, 25 bp, Mus musculus
ttcttaggcgggttttgcggcctgc

SEQ ID NO: 379460 - DNA, 25 bp, Mus musculus
cggccctccgcttgaggttcttagg

SEQ ID NO: 379461 - DNA, 25 bp, Mus musculus
tacagagagctggagcggaataacg

SEQ ID NO: 379462 - DNA, 25 bp, Mus musculus
agttctgagctgtcgcgtctcatcg

SEQ ID NO: 379463 - DNA, 25 bp, Mus musculus
cgttcgagggaaagcgcgaccgcat

SEQ ID NO: 379464 - DNA, 25 bp, Mus musculus
gcgcgaccgcatcaagatacagaga

SEQ ID NO: 379465 - DNA, 25 bp, Mus musculus
ctccgcacagccagcgttcgaggga

SEQ ID NO: 379466 - DNA, 25 bp, Mus musculus
tcctgggtcagaaggatgctctgcg

SEQ ID NO: 379467 - DNA, 25 bp, Mus musculus
ccagagagtgagactggactgcagc

SEQ ID NO: 379468 - DNA, 25 bp, Mus musculus
actgcagcgtggagagcacggcaac

SEQ ID NO: 379469 - DNA, 25 bp, Mus musculus
ccctgcacagctaaagacggtatta

SEQ ID NO: 379470 - DNA, 25 bp, Mus musculus
ctccagcactgagcaccgttcattg

SEQ ID NO: 379471 - DNA, 25 bp, Mus musculus
atccctgatgagctgtgtcccgtgt

SEQ ID NO: 379472 - DNA, 25 bp, Mus musculus
cttggaagtaggtgaggatccctga

SEQ ID NO: 379473 - DNA, 25 bp, Mus musculus
accgttcattggtcgcaacaagtga

SEQ ID NO: 379474 - DNA, 25 bp, Mus musculus
gggaatcctagagaccgcgacttgg

SEQ ID NO: 379475 - DNA, 25 bp, Mus musculus
atgaggaacttgagcaggatgttga

SEQ ID NO: 379476 - DNA, 25 bp, Mus musculus
actggtagcggctgatgaggaactt

SEQ ID NO: 379477 - DNA, 25 bp, Mus musculus
gatgttgagggagccagaaaagacc

SEQ ID NO: 379478 - DNA, 25 bp, Mus musculus
tggagctggtcaggcactgcaccag

SEQ ID NO: 379479 - DNA, 25 bp, Mus musculus
cggtattagaaacaacgctccagca

SEQ ID NO: 379480 - DNA, 25 bp, Mus musculus
tcggtagccactcgtgtccagcacg

SEQ ID NO: 379481 - DNA, 25 bp, Mus musculus
aatgagctcgctcacgaggcaccga

SEQ ID NO: 379482 - DNA, 25 bp, Mus musculus
ggcaccgacccaaagtcaagcagga

SEQ ID NO: 379483 - DNA, 25 bp, Mus musculus
gcaggaatgaatcggctctgagctc

SEQ ID NO: 379484 - DNA, 25 bp, Mus musculus
gctctgagctctgatcgcctctcgg

SEQ ID NO: 379485 - DNA, 25 bp, Mus musculus
gggcgcctcaacctcacaaggaaga

SEQ ID NO: 379486 - DNA, 25 bp, Mus musculus
accacgtcgtccttagagagcctga

SEQ ID NO: 379487 - DNA, 25 bp, Mus musculus
tcgcacacgtgtgacgtagccaccg

SEQ ID NO: 379488 - DNA, 25 bp, Mus musculus
ttggcctccgggctaaaatcctggc

SEQ ID NO: 379489 - DNA, 25 bp, Mus musculus
ccagcacgcgatcctcggagtcata

SEQ ID NO: 379490 - DNA, 25 bp, Mus musculus
cggagtcatatcctgtagggtctca

SEQ ID NO: 379491 - DNA, 25 bp, Mus musculus
acatactagagacaaccgggtcccg

SEQ ID NO: 379492 - DNA, 25 bp, Mus musculus
agcccgagcctttccacatactaga

SEQ ID NO: 379493 - DNA, 25 bp, Mus musculus
acagagtgcgtcaccgccttggcgt

SEQ ID NO: 379494 - DNA, 25 bp, Mus musculus
tctgcctctaggttgtgggattcgt

SEQ ID NO: 379495 - DNA, 25 bp, Mus musculus
actttaggaccgtctcgcgcttccg

SEQ ID NO: 379496 - DNA, 25 bp, Mus musculus
acacgtgttcccttctgcctctagg

SEQ ID NO: 379497 - DNA, 25 bp, Mus musculus
gcgcacgtctaggttaagttccttc

SEQ ID NO: 379498 - DNA, 25 bp, Mus musculus
ctcggctcggatgcgtgttcaacac

SEQ ID NO: 379499 - DNA, 25 bp, Mus musculus
tgcgtcacgaccagccacttcttgg

SEQ ID NO: 379500 - DNA, 25 bp, Mus musculus
ttcgctttagcctctagtgacggtc

SEQ ID NO: 379501 - DNA, 25 bp, Mus musculus
cggctaaacgctggcctgcgtcacg

SEQ ID NO: 379502 - DNA, 25 bp, Mus musculus
atgggagaccgccaacaaccggctg

SEQ ID NO: 379503 - DNA, 25 bp, Mus musculus
cggctgcaccaggagtacgtgcctt

SEQ ID NO: 379504 - DNA, 25 bp, Mus musculus
gccgccatgttcatcgaagcctctg

SEQ ID NO: 379505 - DNA, 25 bp, Mus musculus
cagagctacccggtgcgcactttag

SEQ ID NO: 379506 - DNA, 25 bp, Mus musculus
tttgggcacttggaatgcgcacgtc

SEQ ID NO: 379507 - DNA, 25 bp, Mus musculus
tctcgccggacagtcaagcctactt

SEQ ID NO: 379508 - DNA, 25 bp, Mus musculus
ggctcatcatgttctcattcgcatc

SEQ ID NO: 379509 - DNA, 25 bp, Mus musculus
cgcctcgccttgctgctctgagatt

SEQ ID NO: 379510 - DNA, 25 bp, Mus musculus
cgtggccatgcgtgttccaaactga

SEQ ID NO: 379511 - DNA, 25 bp, Mus musculus
ttagatcattaagaaacccgtggcc

SEQ ID NO: 379512 - DNA, 25 bp, Mus musculus
gcatcctcctccgacttagatcatt

SEQ ID NO: 379513 - DNA, 25 bp, Mus musculus
gggttctcataagcttggctcatca

SEQ ID NO: 379514 - DNA, 25 bp, Mus musculus
ctgcgcaccctggtgggttctcata

SEQ ID NO: 379515 - DNA, 25 bp, Mus musculus
tatctcccacgcgtggggctgcgca

SEQ ID NO: 379516 - DNA, 25 bp, Mus musculus
tttgggcacagcaggtgcagccgcc

SEQ ID NO: 379517 - DNA, 25 bp, Mus musculus
ccactggactgtgagtttgggcaca

SEQ ID NO: 379518 - DNA, 25 bp, Mus musculus
agagcctggttgtgcctctctggac

SEQ ID NO: 379519 - DNA, 25 bp, Mus musculus
gctgctctgagattccttcatacta

SEQ ID NO: 379520 - DNA, 25 bp, Mus musculus
cccatttgtgcatggcaccgcaggg

SEQ ID NO: 379521 - DNA, 25 bp, Mus musculus
tccaaactgaactggcttcgcctcg

SEQ ID NO: 379522 - DNA, 25 bp, Mus musculus
ggcttcttcaccgatgggcctggtg

SEQ ID NO: 379523 - DNA, 25 bp, Mus musculus
ggatgggtctttttggcaggcttct

SEQ ID NO: 379524 - DNA, 25 bp, Mus musculus
gagagaaagccatgttcacgtggcc

SEQ ID NO: 379525 - DNA, 25 bp, Mus musculus
tttttggcaggcttctcggtgaacc

SEQ ID NO: 379526 - DNA, 25 bp, Mus musculus
ttgggctgagagaaagccatgttca

SEQ ID NO: 379527 - DNA, 25 bp, Mus musculus
atcccgggcctttgtgcagctccgg

SEQ ID NO: 379528 - DNA, 25 bp, Mus musculus
cggcttgtttctggatcccgggcct

SEQ ID NO: 379529 - DNA, 25 bp, Mus musculus
caggctggtcggcttgtttctggat

SEQ ID NO: 379530 - DNA, 25 bp, Mus musculus
cacgagccgtaggtggggttccaca

SEQ ID NO: 379531 - DNA, 25 bp, Mus musculus
ttctcggtgaaccacgagccgtagg

SEQ ID NO: 379532 - DNA, 25 bp, Mus musculus
ctgaacagcggcacctccttcatgg

SEQ ID NO: 379533 - DNA, 25 bp, Mus musculus
ctcagcgccgatggctctagcagca

SEQ ID NO: 379534 - DNA, 25 bp, Mus musculus
tcaccgatgggcctggtgccgtcag

SEQ ID NO: 379535 - DNA, 25 bp, Mus musculus
tggctctagcagcagcgctgcctcg

SEQ ID NO: 379536 - DNA, 25 bp, Mus musculus
tacagatcctcagcgcggttgccgt

SEQ ID NO: 379537 - DNA, 25 bp, Mus musculus
aagcgggatcctcttggtaggctga

SEQ ID NO: 379538 - DNA, 25 bp, Mus musculus
acgcgtaacctcgtgtgcgggtaca

SEQ ID NO: 379539 - DNA, 25 bp, Mus musculus
cacccttcggtgctccaggtaagcg

SEQ ID NO: 379540 - DNA, 25 bp, Mus musculus
gtccaccatgtacagatcctcagcg

SEQ ID NO: 379541 - DNA, 25 bp, Mus musculus
gacttctcggaacatgtccaccatg

SEQ ID NO: 379542 - DNA, 25 bp, Mus musculus
gtcctcatcggcgaagacttctcgg

SEQ ID NO: 379543 - DNA, 25 bp, Mus musculus
ccacacataagtggcggggtcctca

SEQ ID NO: 379544 - DNA, 25 bp, Mus musculus
ggtagttgccatcccacacataagt

SEQ ID NO: 379545 - DNA, 25 bp, Mus musculus
ttcccagggctgatggtagttgcca

SEQ ID NO: 379546 - DNA, 25 bp, Mus musculus
agctgtgtacatgacctcacgtttg

SEQ ID NO: 379547 - DNA, 25 bp, Mus musculus
cgcccagtgccttgaaagctgtgta

SEQ ID NO: 379548 - DNA, 25 bp, Mus musculus
cgtagtccacggagtcgcccagtgc

SEQ ID NO: 379549 - DNA, 25 bp, Mus musculus
aggtcaagcactggcgcaggtaagc

SEQ ID NO: 379550 - DNA, 25 bp, Mus musculus
gaggctggggaacccgcgcgctgat

SEQ ID NO: 379551 - DNA, 25 bp, Mus musculus
accgtggctgcggtagcagcaggtc

SEQ ID NO: 379552 - DNA, 25 bp, Mus musculus
ctcgggcatagacgcggaagagcga

SEQ ID NO: 379553 - DNA, 25 bp, Mus musculus
gaagagcgagggtacaacgaagtcc

SEQ ID NO: 379554 - DNA, 25 bp, Mus musculus
gagcgagggtacaacgaagtccact

SEQ ID NO: 379555 - DNA, 25 bp, Mus musculus
cgagggtacaacgaagtccactgcc

SEQ ID NO: 379556 - DNA, 25 bp, Mus musculus
gggtacaacgaagtccactgccaga

SEQ ID NO: 379557 - DNA, 25 bp, Mus musculus
aacgaagtccactgccagactcttc

SEQ ID NO: 379558 - DNA, 25 bp, Mus musculus
ctcttcctctgcaggcgcgaataac

SEQ ID NO: 379559 - DNA, 25 bp, Mus musculus
ctctgcaggcgcgaataactgagcg

SEQ ID NO: 379560 - DNA, 25 bp, Mus musculus
caggcgcgaataactgagcggctcc

SEQ ID NO: 379561 - DNA, 25 bp, Mus musculus
tagcagcaggtctcgggcatagacg

SEQ ID NO: 379562 - DNA, 25 bp, Mus musculus
ggctgcagaggaggccctgaggctg

SEQ ID NO: 379563 - DNA, 25 bp, Mus musculus
cgcgaataactgagcggctcccggg

SEQ ID NO: 379564 - DNA, 25 bp, Mus musculus
ttcccaggtctaggcaaggaccacc

SEQ ID NO: 379565 - DNA, 25 bp, Mus musculus
ccacttgcagctggcagtgccgcga

SEQ ID NO: 379566 - DNA, 25 bp, Mus musculus
acctccgctgcaggaagtcttcgga

SEQ ID NO: 379567 - DNA, 25 bp, Mus musculus
cccgctgaacttctgggcgtgaaca

SEQ ID NO: 379568 - DNA, 25 bp, Mus musculus
gaacacgagctctgcgttgcggaga

SEQ ID NO: 379569 - DNA, 25 bp, Mus musculus
cgcgcgcaagtttgcagcgtccttg

SEQ ID NO: 379570 - DNA, 25 bp, Mus musculus
gtccttgccgtcaccgacgtcttgg

SEQ ID NO: 379571 - DNA, 25 bp, Mus musculus
cgtcttggttcctcggagttcactc

SEQ ID NO: 379572 - DNA, 25 bp, Mus musculus
gccgctggcgactagtgaaaacatt

SEQ ID NO: 379573 - DNA, 25 bp, Mus musculus
agaggagcccgcaatgtagccagcc

SEQ ID NO: 379574 - DNA, 25 bp, Mus musculus
gcccgcggttttgttgactggccag

SEQ ID NO: 379575 - DNA, 25 bp, Mus musculus
cccgagaaccgctggacagaatcag

SEQ ID NO: 379576 - DNA, 25 bp, Mus musculus
aagtcttcggatcgatcaccctgcc

SEQ ID NO: 379577 - DNA, 25 bp, Mus musculus
caaagccgctggatcgcatctgcct

SEQ ID NO: 379578 - DNA, 25 bp, Mus musculus
ccgtaaggatgcaaggtgtcgaatt

SEQ ID NO: 379579 - DNA, 25 bp, Mus musculus
gcaatgagtcccagctgccgcaatt

SEQ ID NO: 379580 - DNA, 25 bp, Mus musculus
ctgccgcaattaccaaggctgaggc

SEQ ID NO: 379581 - DNA, 25 bp, Mus musculus
caattaccaaggctgaggcgtctcc

SEQ ID NO: 379582 - DNA, 25 bp, Mus musculus
tgaggcgtctcctttaagaagctga

SEQ ID NO: 379583 - DNA, 25 bp, Mus musculus
aagaagctgactcacgtggatgctg

SEQ ID NO: 379584 - DNA, 25 bp, Mus musculus
ctcacgtggatgctgtgttgtgtgc

SEQ ID NO: 379585 - DNA, 25 bp, Mus musculus
atgctgtgttgtgtgcgctcagctg

SEQ ID NO: 379586 - DNA, 25 bp, Mus musculus
gcgggtcctcactctcactacattg

SEQ ID NO: 379587 - DNA, 25 bp, Mus musculus
tacattggccgcctcggccgaggag

SEQ ID NO: 379588 - DNA, 25 bp, Mus musculus
cggccgaggaggcagacttagcctc

SEQ ID NO: 379589 - DNA, 25 bp, Mus musculus
ggcagacttagcctccttgattggc

SEQ ID NO: 379590 - DNA, 25 bp, Mus musculus
tagcctccttgattggccgtaagga

SEQ ID NO: 379591 - DNA, 25 bp, Mus musculus
tgacgccgatgacgggcaatgagtc

SEQ ID NO: 379592 - DNA, 25 bp, Mus musculus
ccgggcggtccttctttgtgaggct

SEQ ID NO: 379593 - DNA, 25 bp, Mus musculus
tccttctttgtgaggctgtggcgcg

SEQ ID NO: 379594 - DNA, 25 bp, Mus musculus
cgggcggtcggcttggcgcagaccc

SEQ ID NO: 379595 - DNA, 25 bp, Mus musculus
tgtgtttgttgtgccgaggaggccc

SEQ ID NO: 379596 - DNA, 25 bp, Mus musculus
tgcccacgttccgcctgtgtttgtt

SEQ ID NO: 379597 - DNA, 25 bp, Mus musculus
gcagacagctctctccgtgacaccc

SEQ ID NO: 379598 - DNA, 25 bp, Mus musculus
ggtccgcagacagctctctccgtga

SEQ ID NO: 379599 - DNA, 25 bp, Mus musculus
cctcggcgcctgtcgcctgggccgc

SEQ ID NO: 379600 - DNA, 25 bp, Mus musculus
cggtccttctttgtgaggctgtggc

SEQ ID NO: 379601 - DNA, 25 bp, Mus musculus
agggagtcacgtgggcgcgatcagc

SEQ ID NO: 379602 - DNA, 25 bp, Mus musculus
cccggtgctgctcggggagcggacc

SEQ ID NO: 379603 - DNA, 25 bp, Mus musculus
agcggaccgggaggctctttcctgc

SEQ ID NO: 379604 - DNA, 25 bp, Mus musculus
cggaccgggaggctctttcctgctg

SEQ ID NO: 379605 - DNA, 25 bp, Mus musculus
tccgccttgcgccgggcgattggct

SEQ ID NO: 379606 - DNA, 25 bp, Mus musculus
ggggccaaggcctgactaaacctga

SEQ ID NO: 379607 - DNA, 25 bp, Mus musculus
ttgggccggcggcttcgaagccttc

SEQ ID NO: 379608 - DNA, 25 bp, Mus musculus
ggccacgcccggtgattgacgccga

SEQ ID NO: 379609 - DNA, 25 bp, Mus musculus
cttctccactcgtccagggtcctgg

SEQ ID NO: 379610 - DNA, 25 bp, Mus musculus
tcctggccgggccaccagggcaatt

SEQ ID NO: 379611 - DNA, 25 bp, Mus musculus
tgattgacgccgaggcccgaccgag

SEQ ID NO: 379612 - DNA, 25 bp, Mus musculus
caccagggcaattctcaggactgtg

SEQ ID NO: 379613 - DNA, 25 bp, Mus musculus
taaacctgaagacttgggaggccga

SEQ ID NO: 379614 - DNA, 25 bp, Mus musculus
ggcttcgacccagctgaggagcgaa

SEQ ID NO: 379615 - DNA, 25 bp, Mus musculus
agagctgctggcagcgccgattccc

SEQ ID NO: 379616 - DNA, 25 bp, Mus musculus
gccgattcccagcacgccggtgagt

SEQ ID NO: 379617 - DNA, 25 bp, Mus musculus
cgattcccagcacgccggtgagtac

SEQ ID NO: 379618 - DNA, 25 bp, Mus musculus
ggcctgactaaacctgaagacttgg

SEQ ID NO: 379619 - DNA, 25 bp, Mus musculus
ctcgaagcccttgggccggcggctt

SEQ ID NO: 379620 - DNA, 25 bp, Mus musculus
ggagagcttggtctgcactgcctac

SEQ ID NO: 379621 - DNA, 25 bp, Mus musculus
gagctatgagcgctgaagccattca

SEQ ID NO: 379622 - DNA, 25 bp, Mus musculus
ctcgtagctgctgggagccagctca

SEQ ID NO: 379623 - DNA, 25 bp, Mus musculus
actgcctacgccgttggcagcgagg

SEQ ID NO: 379624 - DNA, 25 bp, Mus musculus
ttgaactccagctcgggaacacgcg

SEQ ID NO: 379625 - DNA, 25 bp, Mus musculus
gaagctgcgttgacattgaactcca

SEQ ID NO: 379626 - DNA, 25 bp, Mus musculus
tggtgacgttattctaagagtgggc

SEQ ID NO: 379627 - DNA, 25 bp, Mus musculus
tgcggatttatggtcaggaagctgc

SEQ ID NO: 379628 - DNA, 25 bp, Mus musculus
agcccttagagtccctgtgttcaga

SEQ ID NO: 379629 - DNA, 25 bp, Mus musculus
gcgatctgtctcttcccgcgtgggc

SEQ ID NO: 379630 - DNA, 25 bp, Mus musculus
cgctcggatggaagaatggcgccct

SEQ ID NO: 379631 - DNA, 25 bp, Mus musculus
cttataaatgctgcttcccgggctc

SEQ ID NO: 379632 - DNA, 25 bp, Mus musculus
ctctttgtgggacccggagatcggt

SEQ ID NO: 379633 - DNA, 25 bp, Mus musculus
tcgggaacacgcgtgtgtgtcaacg

SEQ ID NO: 379634 - DNA, 25 bp, Mus musculus
ggcctcagtgtacgcggagtcgccc

SEQ ID NO: 379635 - DNA, 25 bp, Mus musculus
ggtatcggcggctcctgcagtgatc

SEQ ID NO: 379636 - DNA, 25 bp, Mus musculus
tcctgcagtgatcggaggagaactc

SEQ ID NO: 379637 - DNA, 25 bp, Mus musculus
tgatcggaggagaactccaggctga

SEQ ID NO: 379638 - DNA, 25 bp, Mus musculus
gctagaactttctcccactgggctc

SEQ ID NO: 379639 - DNA, 25 bp, Mus musculus
tccaggctgaggctagagccgaagc

SEQ ID NO: 379640 - DNA, 25 bp, Mus musculus
cgctcgctcgcagctagaactttct

SEQ ID NO: 379641 - DNA, 25 bp, Mus musculus
ccgaagcaagaagagccgagtgcgc

SEQ ID NO: 379642 - DNA, 25 bp, Mus musculus
gcgcggtttgaaacggccaccacaa

SEQ ID NO: 379643 - DNA, 25 bp, Mus musculus
atggtcgcagcgaagtagcccgcga

SEQ ID NO: 379644 - DNA, 25 bp, Mus musculus
ccgtctcgatcctggcctcagtgta

SEQ ID NO: 379645 - DNA, 25 bp, Mus musculus
agtgtgcctccctggtgtaagcaag

SEQ ID NO: 379646 - DNA, 25 bp, Mus musculus
actttctcccactgggctccgggag

SEQ ID NO: 379647 - DNA, 25 bp, Mus musculus
ttgaaacggccaccacaaccactgt

SEQ ID NO: 379648 - DNA, 25 bp, Mus musculus
ctgaaagttcgtgtttctcagttta

SEQ ID NO: 379649 - DNA, 25 bp, Mus musculus
ccaatgcaaggtctgaacccgggga

SEQ ID NO: 379650 - DNA, 25 bp, Mus musculus
gaacagacgccgctacaggagacga

SEQ ID NO: 379651 - DNA, 25 bp, Mus musculus
cgcgccacagttccaaaaaggaaca

SEQ ID NO: 379652 - DNA, 25 bp, Mus musculus
ttgggcccgcgccacagttccaaaa

SEQ ID NO: 379653 - DNA, 25 bp, Mus musculus
gcgctacagggaggcgagcacccgt

SEQ ID NO: 379654 - DNA, 25 bp, Mus musculus
ctattctgcttagcccaggaactct

SEQ ID NO: 379655 - DNA, 25 bp, Mus musculus
ggcgctattctgcttagcccaggaa

SEQ ID NO: 379656 - DNA, 25 bp, Mus musculus
gagcggcgctattctgcttagccca

SEQ ID NO: 379657 - DNA, 25 bp, Mus musculus
aacccggggagagcggcgctattct

SEQ ID NO: 379658 - DNA, 25 bp, Mus musculus
cttccttcctgctgtggtgtagagg

SEQ ID NO: 379659 - DNA, 25 bp, Mus musculus
cccgggtccaatgcaaggtctgaac

SEQ ID NO: 379660 - DNA, 25 bp, Mus musculus
gcccgcgccacagttccaaaaagga

SEQ ID NO: 379661 - DNA, 25 bp, Mus musculus
caggaactctgaaagttcgtgtttc

SEQ ID NO: 379662 - DNA, 25 bp, Mus musculus
aattagcggcgggttcttctcccag

SEQ ID NO: 379663 - DNA, 25 bp, Mus musculus
acacctcggtgaaacccgggagctg

SEQ ID NO: 379664 - DNA, 25 bp, Mus musculus
cctccagagctgatcaggatgcggg

SEQ ID NO: 379665 - DNA, 25 bp, Mus musculus
aggccgaagcctccagagctgatca

SEQ ID NO: 379666 - DNA, 25 bp, Mus musculus
catggcggcagccaagggatttttt

SEQ ID NO: 379667 - DNA, 25 bp, Mus musculus
gcgggttcttctcccaggttgtgac

SEQ ID NO: 379668 - DNA, 25 bp, Mus musculus
cattactaaggcgacggggctcgac

SEQ ID NO: 379669 - DNA, 25 bp, Mus musculus
ggagcccggagggacgcattactaa

SEQ ID NO: 379670 - DNA, 25 bp, Mus musculus
ccaggagccaatcagggtggagccc

SEQ ID NO: 379671 - DNA, 25 bp, Mus musculus
agacgccttgcgtcactgcgccagg

SEQ ID NO: 379672 - DNA, 25 bp, Mus musculus
aagggcttcccacgcagccggagac

SEQ ID NO: 379673 - DNA, 25 bp, Mus musculus
tcctttaaaggagcttagacgacgc

SEQ ID NO: 379674 - DNA, 25 bp, Mus musculus
gagcgcccggttcaagggcttccca

SEQ ID NO: 379675 - DNA, 25 bp, Mus musculus
cccgcttcgggatgaattagcggcg

SEQ ID NO: 379676 - DNA, 25 bp, Mus musculus
tttgaaccctcaatcccagtgcgtg

SEQ ID NO: 379677 - DNA, 25 bp, Mus musculus
ctctgcctgcttctcttggtggcga

SEQ ID NO: 379678 - DNA, 25 bp, Mus musculus
cctcgctctaggagaaacgctgctc

SEQ ID NO: 379679 - DNA, 25 bp, Mus musculus
accgccagtcccaaagtagctagtc

SEQ ID NO: 379680 - DNA, 25 bp, Mus musculus
ttggtgacccagaagaacagcagta

SEQ ID NO: 379681 - DNA, 25 bp, Mus musculus
ctgctcctgggatcccgatgttgga

SEQ ID NO: 379682 - DNA, 25 bp, Mus musculus
gctgccgcgagggaaactgactcga

SEQ ID NO: 379683 - DNA, 25 bp, Mus musculus
aacagcagtacggtgatccagagca

SEQ ID NO: 379684 - DNA, 25 bp, Mus musculus
gtgcgccacgaaacggcataccttg

SEQ ID NO: 379685 - DNA, 25 bp, Mus musculus
gccacttacacacgccaaagatatg

SEQ ID NO: 379686 - DNA, 25 bp, Mus musculus
gctagttaagttgggagcccggctc

SEQ ID NO: 379687 - DNA, 25 bp, Mus musculus
tggccaccggactgctagttaagtt

SEQ ID NO: 379688 - DNA, 25 bp, Mus musculus
gcccgcttcggagagaagccacagc

SEQ ID NO: 379689 - DNA, 25 bp, Mus musculus
ggcacctccaacttcctcttggtga

SEQ ID NO: 379690 - DNA, 25 bp, Mus musculus
cctccttggcttcgcgtcgccctga

SEQ ID NO: 379691 - DNA, 25 bp, Mus musculus
cgcagagcgcctgcccatagacatg

SEQ ID NO: 379692 - DNA, 25 bp, Mus musculus
catagacatggcggcgccctccttg

SEQ ID NO: 379693 - DNA, 25 bp, Mus musculus
agctggccgggttttgccagttctc

SEQ ID NO: 379694 - DNA, 25 bp, Mus musculus
tttgccagttctcggggacttcctg

SEQ ID NO: 379695 - DNA, 25 bp, Mus musculus
cagttctcggggacttcctgcacgt

SEQ ID NO: 379696 - DNA, 25 bp, Mus musculus
ggacttcctgcacgtctggcattta

SEQ ID NO: 379697 - DNA, 25 bp, Mus musculus
tgcacgtctggcatttaaacgcgcg

SEQ ID NO: 379698 - DNA, 25 bp, Mus musculus
tctggcatttaaacgcgcgccgggg

SEQ ID NO: 379699 - DNA, 25 bp, Mus musculus
cggagctgtgtgagccgctgcctac

SEQ ID NO: 379700 - DNA, 25 bp, Mus musculus
tgtgtgagccgctgcctacccggcg

SEQ ID NO: 379701 - DNA, 25 bp, Mus musculus
cctgggctccgcagtagcggagctc

SEQ ID NO: 379702 - DNA, 25 bp, Mus musculus
tcctgcacgtctggcatttaaacgc

SEQ ID NO: 379703 - DNA, 25 bp, Mus musculus
agcgcctgcccatagacatggcggc

SEQ ID NO: 379704 - DNA, 25 bp, Mus musculus
tcgacgttagtccacgcgctggagc

SEQ ID NO: 379705 - DNA, 25 bp, Mus musculus
aatgtggcgctacctgccagcaccg

SEQ ID NO: 379706 - DNA, 25 bp, Mus musculus
cccatggtggccaatgtggcgctac

SEQ ID NO: 379707 - DNA, 25 bp, Mus musculus
taactggcgggtttcccaaagcaca

SEQ ID NO: 379708 - DNA, 25 bp, Mus musculus
tctcgctgtgtttcccgtaactggc

SEQ ID NO: 379709 - DNA, 25 bp, Mus musculus
aggggaactcccgacgacacactct

SEQ ID NO: 379710 - DNA, 25 bp, Mus musculus
ggagaagagacccagcagcacattc

SEQ ID NO: 379711 - DNA, 25 bp, Mus musculus
tgctctgtggagaaaaacgctaacc

SEQ ID NO: 379712 - DNA, 25 bp, Mus musculus
caccgggacctgatggcacacaatc

SEQ ID NO: 379713 - DNA, 25 bp, Mus musculus
cagctcctgcaggaaccaggctatg

SEQ ID NO: 379714 - DNA, 25 bp, Mus musculus
acgctaacctgtggaagtaatgtgc

SEQ ID NO: 379715 - DNA, 25 bp, Mus musculus
gtaatgtgcggagaagagacccagc

SEQ ID NO: 379716 - DNA, 25 bp, Mus musculus
tgttcacagctggtagctgctgccc

SEQ ID NO: 379717 - DNA, 25 bp, Mus musculus
tcggcatctcgcctgtgttcacagc

SEQ ID NO: 379718 - DNA, 25 bp, Mus musculus
ccctctgctacgctgaggctgggca

SEQ ID NO: 379719 - DNA, 25 bp, Mus musculus
gaccgtcaccttcgatccacatccg

SEQ ID NO: 379720 - DNA, 25 bp, Mus musculus
gctagagcccgaccgtcaccttcga

SEQ ID NO: 379721 - DNA, 25 bp, Mus musculus
gagctaagagcaacggctccatagg

SEQ ID NO: 379722 - DNA, 25 bp, Mus musculus
gagagctaagagcaacggctccata

SEQ ID NO: 379723 - DNA, 25 bp, Mus musculus
cctctgctacgctgaggctgggcat

SEQ ID NO: 379724 - DNA, 25 bp, Mus musculus
ttctgtcgtggggttgatgagagct

SEQ ID NO: 379725 - DNA, 25 bp, Mus musculus
ttgatgagagctaagagcaacggct

SEQ ID NO: 379726 - DNA, 25 bp, Mus musculus
cgtcctctatagctcgacagttcgg

SEQ ID NO: 379727 - DNA, 25 bp, Mus musculus
ccgtcctctatagctcgacagttcg

SEQ ID NO: 379728 - DNA, 25 bp, Mus musculus
gcccgtcctctatagctcgacagtt

SEQ ID NO: 379729 - DNA, 25 bp, Mus musculus
ggcccgtcctctatagctcgacagt

SEQ ID NO: 379730 - DNA, 25 bp, Mus musculus
gatgagagctaagagcaacggctcc

SEQ ID NO: 379731 - DNA, 25 bp, Mus musculus
gcaccagtcccgcggccggattccg

SEQ ID NO: 379732 - DNA, 25 bp, Mus musculus
gcacggatgatgctcgcaccagtcc

SEQ ID NO: 379733 - DNA, 25 bp, Mus musculus
cgacatcacaggctcggtgcgtgtg

SEQ ID NO: 379734 - DNA, 25 bp, Mus musculus
gtggacgacatcacaggctcggtgc

SEQ ID NO: 379735 - DNA, 25 bp, Mus musculus
tagacttggccacgcgccagactgt

SEQ ID NO: 379736 - DNA, 25 bp, Mus musculus
cacgcgccagactgtggggtagacc

SEQ ID NO: 379737 - DNA, 25 bp, Mus musculus
gcagcacggatgatgctcgcaccag

SEQ ID NO: 379738 - DNA, 25 bp, Mus musculus
agcgtgtggacgacatcacaggctc

SEQ ID NO: 379739 - DNA, 25 bp, Mus musculus
gcgctgcggttgtgagccttctgtc

SEQ ID NO: 379740 - DNA, 25 bp, Mus musculus
ctgcggttgtgagccttctgtcgtg

SEQ ID NO: 379741 - DNA, 25 bp, Mus musculus
gctgaggctgggcattgggcgccct

SEQ ID NO: 379742 - DNA, 25 bp, Mus musculus
cggagtgtctgaccccgcctacggt

SEQ ID NO: 379743 - DNA, 25 bp, Mus musculus
aggctcttgctacggagtgtctgac

SEQ ID NO: 379744 - DNA, 25 bp, Mus musculus
gctcttgctacggagtgtctgaccc

SEQ ID NO: 379745 - DNA, 25 bp, Mus musculus
accaagggtcgaaagtgactcggag

SEQ ID NO: 379746 - DNA, 25 bp, Mus musculus
cctgaacccgggaaaggcagagcct

SEQ ID NO: 379747 - DNA, 25 bp, Mus musculus
cttactcgccgctctaccggggccg

SEQ ID NO: 379748 - DNA, 25 bp, Mus musculus
agtctggggccacgccgcgaagttt

SEQ ID NO: 379749 - DNA, 25 bp, Mus musculus
caggaatgcaagtctggggccacgc

SEQ ID NO: 379750 - DNA, 25 bp, Mus musculus
cggggtatcgcccaggaatgcaagt

SEQ ID NO: 379751 - DNA, 25 bp, Mus musculus
gggagcccacgcgtccttactcgcc

SEQ ID NO: 379752 - DNA, 25 bp, Mus musculus
accctcggggtatcgcccaggaatg

SEQ ID NO: 379753 - DNA, 25 bp, Mus musculus
gcgaagtttcgctggcagagacatc

SEQ ID NO: 379754 - DNA, 25 bp, Mus musculus
ctgcctgccgagtcccgtcggggtt

SEQ ID NO: 379755 - DNA, 25 bp, Mus musculus
acacaacacacacgcgatcgctgcc

SEQ ID NO: 379756 - DNA, 25 bp, Mus musculus
tgcgccgctggctcagcacacacaa

SEQ ID NO: 379757 - DNA, 25 bp, Mus musculus
acgctccgctctccggggtttagcg

SEQ ID NO: 379758 - DNA, 25 bp, Mus musculus
cgctggcagagacatcgcgctgcga

SEQ ID NO: 379759 - DNA, 25 bp, Mus musculus
tgcacgctccgctctccggggttta

SEQ ID NO: 379760 - DNA, 25 bp, Mus musculus
tgtgtctgtccctccagcatctgct

SEQ ID NO: 379761 - DNA, 25 bp, Mus musculus
ccagggcctcctggtacctgtgtct

SEQ ID NO: 379762 - DNA, 25 bp, Mus musculus
cgcaatcaaccggataccagtcttg

SEQ ID NO: 379763 - DNA, 25 bp, Mus musculus
tcctcgtcgcatcgcgaggctcgga

SEQ ID NO: 379764 - DNA, 25 bp, Mus musculus
agacagtccttcgtggcacctggaa

SEQ ID NO: 379765 - DNA, 25 bp, Mus musculus
gccgtagatctttctcctttagaca

SEQ ID NO: 379766 - DNA, 25 bp, Mus musculus
cagaagtgcccgagcccgcctaagt

SEQ ID NO: 379767 - DNA, 25 bp, Mus musculus
agcgcgaaccgcttcggccgtaagt

SEQ ID NO: 379768 - DNA, 25 bp, Mus musculus
ggaagctgattacccgcgccaaggc

SEQ ID NO: 379769 - DNA, 25 bp, Mus musculus
gcatctgctccgactccatggcgga

SEQ ID NO: 379770 - DNA, 25 bp, Mus musculus
tttcaagtggaagacgccaggaccc

SEQ ID NO: 379771 - DNA, 25 bp, Mus musculus
agaagagccgcgagttagttacccg

SEQ ID NO: 379772 - DNA, 25 bp, Mus musculus
ctgtcggttcctaagtgccctgcac

SEQ ID NO: 379773 - DNA, 25 bp, Mus musculus
tggcggaccctgcaaaccgcaatca

SEQ ID NO: 379774 - DNA, 25 bp, Mus musculus
gaagaacctgcggagcgacgaaccc

SEQ ID NO: 379775 - DNA, 25 bp, Mus musculus
caggccttcgagtgcatctgcattg

SEQ ID NO: 379776 - DNA, 25 bp, Mus musculus
gcgtgttgcacaagcaggccttcga

SEQ ID NO: 379777 - DNA, 25 bp, Mus musculus
tgaatgagttctccggccggacgac

SEQ ID NO: 379778 - DNA, 25 bp, Mus musculus
cagtgggagctgtgaatgagttctc

SEQ ID NO: 379779 - DNA, 25 bp, Mus musculus
attcaccgaggacgtgcgcgtgccc

SEQ ID NO: 379780 - DNA, 25 bp, Mus musculus
gcgcaccagagccattcaccgagga

SEQ ID NO: 379781 - DNA, 25 bp, Mus musculus
ccaggtcaacaaagacggcggcgta

SEQ ID NO: 379782 - DNA, 25 bp, Mus musculus
atgcgcacaagctcccaggtcaaca

SEQ ID NO: 379783 - DNA, 25 bp, Mus musculus
ttcccagagaaaggggcatagcagg

SEQ ID NO: 379784 - DNA, 25 bp, Mus musculus
tgcatctgcattgccctgcgcatcg

SEQ ID NO: 379785 - DNA, 25 bp, Mus musculus
tgggaccatcgcaagccgaaccgcg

SEQ ID NO: 379786 - DNA, 25 bp, Mus musculus
tcttcaaaagtcgaagaacctgcgg

SEQ ID NO: 379787 - DNA, 25 bp, Mus musculus
cgcgcctacagaactgaggttccca

SEQ ID NO: 379788 - DNA, 25 bp, Mus musculus
acctagggtacatgcgcagtcccgc

SEQ ID NO: 379789 - DNA, 25 bp, Mus musculus
tccttaccatggtgagttggccgtg

SEQ ID NO: 379790 - DNA, 25 bp, Mus musculus
gctgtacggctccttaccatggtga

SEQ ID NO: 379791 - DNA, 25 bp, Mus musculus
tcttccggcgggagctgtacggctc

SEQ ID NO: 379792 - DNA, 25 bp, Mus musculus
tgcgacttctcagagcgtcttccgg

SEQ ID NO: 379793 - DNA, 25 bp, Mus musculus
ccttccgcttgagaaatgcgacttc

SEQ ID NO: 379794 - DNA, 25 bp, Mus musculus
tgctgtaccgcagctgctcggaacc

SEQ ID NO: 379795 - DNA, 25 bp, Mus musculus
accaatcggattctgaaggcccgcc

SEQ ID NO: 379796 - DNA, 25 bp, Mus musculus
tcgccctgcaaccaatcggattctg

SEQ ID NO: 379797 - DNA, 25 bp, Mus musculus
cgcagctgctcggaaccgcgtggtc

SEQ ID NO: 379798 - DNA, 25 bp, Mus musculus
tgcgggattcttgcgggatgtttcc

SEQ ID NO: 379799 - DNA, 25 bp, Mus musculus
tcccaggcggcggagaacaaaaaga

SEQ ID NO: 379800 - DNA, 25 bp, Mus musculus
aaagacggcgacctagggtacatgc

SEQ ID NO: 379801 - DNA, 25 bp, Mus musculus
tgcgggatgtttccctcctgcttcc

SEQ ID NO: 379802 - DNA, 25 bp, Mus musculus
atggacacatgcctgggattaaagg

SEQ ID NO: 379803 - DNA, 25 bp, Mus musculus
gctccagctgcgtgaccgctgtgaa

SEQ ID NO: 379804 - DNA, 25 bp, Mus musculus
cattgtcttccttgtgtccacggaa

SEQ ID NO: 379805 - DNA, 25 bp, Mus musculus
gtccacggaagtagagagccacctg

SEQ ID NO: 379806 - DNA, 25 bp, Mus musculus
gtagagagccacctgtttgcggatg

SEQ ID NO: 379807 - DNA, 25 bp, Mus musculus
cacctgtttgcggatggtggacgtc

SEQ ID NO: 379808 - DNA, 25 bp, Mus musculus
cgctcgtgctgcacggctacagaga

SEQ ID NO: 379809 - DNA, 25 bp, Mus musculus
acagatggacacatgcctgggatta

SEQ ID NO: 379810 - DNA, 25 bp, Mus musculus
gtggcagacacagcggccaactcca

SEQ ID NO: 379811 - DNA, 25 bp, Mus musculus
ttaaaggcgcggtgacacttggatg

SEQ ID NO: 379812 - DNA, 25 bp, Mus musculus
ctgcggctccatcgtcacttataga

SEQ ID NO: 379813 - DNA, 25 bp, Mus musculus
tctgccgttcaggagtggcagacac

SEQ ID NO: 379814 - DNA, 25 bp, Mus musculus
tgctgcacggctacagagacaaaca

SEQ ID NO: 379815 - DNA, 25 bp, Mus musculus
ctgcgtgaccgctgtgaagaaagca

SEQ ID NO: 379816 - DNA, 25 bp, Mus musculus
ccggaggacgcaaagttgtcagtct

SEQ ID NO: 379817 - DNA, 25 bp, Mus musculus
gcaaagttgtcagtctaagcgcaga

SEQ ID NO: 379818 - DNA, 25 bp, Mus musculus
tctaagcgcagacatgccgggcagc

SEQ ID NO: 379819 - DNA, 25 bp, Mus musculus
cgtgcagagcgggtgccttcgccac

SEQ ID NO: 379820 - DNA, 25 bp, Mus musculus
gacacggcgctcaccgtggaccgga

SEQ ID NO: 379821 - DNA, 25 bp, Mus musculus
ctcggaggctcagcaccgtagaacc

SEQ ID NO: 379822 - DNA, 25 bp, Mus musculus
cccaggtcaaaagtcgatctcggca

SEQ ID NO: 379823 - DNA, 25 bp, Mus musculus
ctgcagggctctgcattgctgctgc

SEQ ID NO: 379824 - DNA, 25 bp, Mus musculus
acgcgctgcccaggtcaaaagtcga

SEQ ID NO: 379825 - DNA, 25 bp, Mus musculus
ccaccgctggaatcggaggctagcc

SEQ ID NO: 379826 - DNA, 25 bp, Mus musculus
gaggctagccagtcctattccacga

SEQ ID NO: 379827 - DNA, 25 bp, Mus musculus
gccagtcctattccacgacggtgtc

SEQ ID NO: 379828 - DNA, 25 bp, Mus musculus
tattccacgacggtgtcgccgggct

SEQ ID NO: 379829 - DNA, 25 bp, Mus musculus
atctcggcatggacgctccggagtt

SEQ ID NO: 379830 - DNA, 25 bp, Mus musculus
gggacttcacctttgtgtcttcggc

SEQ ID NO: 379831 - DNA, 25 bp, Mus musculus
ttacaaacagccaatcccggcggcg

SEQ ID NO: 379832 - DNA, 25 bp, Mus musculus
tgtcctggttcaccagggaacccgc

SEQ ID NO: 379833 - DNA, 25 bp, Mus musculus
caacggggacttcacctttgtgtct

SEQ ID NO: 379834 - DNA, 25 bp, Mus musculus
atgcgcctgccaacggggacttcac

SEQ ID NO: 379835 - DNA, 25 bp, Mus musculus
cggcctatgcgcctgccaacgggga

SEQ ID NO: 379836 - DNA, 25 bp, Mus musculus
ggcccagccgctcgtcagcaccgag

SEQ ID NO: 379837 - DNA, 25 bp, Mus musculus
cagaggctgcgcttagctcgcgcgt

SEQ ID NO: 379838 - DNA, 25 bp, Mus musculus
ttgggtgctcgccaccggctggcct

SEQ ID NO: 379839 - DNA, 25 bp, Mus musculus
cactgttatggtcctgtcagggccc

SEQ ID NO: 379840 - DNA, 25 bp, Mus musculus
gcggcgctgtcactgttatggtcct

SEQ ID NO: 379841 - DNA, 25 bp, Mus musculus
atagtcgagcagattacaaacagcc

SEQ ID NO: 379842 - DNA, 25 bp, Mus musculus
cgggagccaatagtcgagcagatta

SEQ ID NO: 379843 - DNA, 25 bp, Mus musculus
cgctgtcactgttatggtcctgtca

SEQ ID NO: 379844 - DNA, 25 bp, Mus musculus
ttttgcatctgaaccggcctggtcc

SEQ ID NO: 379845 - DNA, 25 bp, Mus musculus
ctctgctctggctagatcggcactc

SEQ ID NO: 379846 - DNA, 25 bp, Mus musculus
ggcgcttgacttcacttccggctaa

SEQ ID NO: 379847 - DNA, 25 bp, Mus musculus
cgagttgcttttcgggccttttgca

SEQ ID NO: 379848 - DNA, 25 bp, Mus musculus
acctcccgggactgtcactgagcgg

SEQ ID NO: 379849 - DNA, 25 bp, Mus musculus
tcccagtgtgattgtgctgagcgca

SEQ ID NO: 379850 - DNA, 25 bp, Mus musculus
ggaccttcggactcggaaagcagca

SEQ ID NO: 379851 - DNA, 25 bp, Mus musculus
cagccgcgggaccatcaaagtcatc

SEQ ID NO: 379852 - DNA, 25 bp, Mus musculus
tcaaagtcatcgacggcacgtccgg

SEQ ID NO: 379853 - DNA, 25 bp, Mus musculus
accacgcatgctccgcgcttgaaaa

SEQ ID NO: 379854 - DNA, 25 bp, Mus musculus
tgcgcatgcttactaggccaggtcc

SEQ ID NO: 379855 - DNA, 25 bp, Mus musculus
ctggtggaggaagcctcccagcctc

SEQ ID NO: 379856 - DNA, 25 bp, Mus musculus
cccgccttttctgtgccttcggaag

SEQ ID NO: 379857 - DNA, 25 bp, Mus musculus
aagttccttattagcttccctctgc

SEQ ID NO: 379858 - DNA, 25 bp, Mus musculus
cgacacctcgtctgagccaggggac

SEQ ID NO: 379859 - DNA, 25 bp, Mus musculus
agccaggggaccctcaccttgagca

SEQ ID NO: 379860 - DNA, 25 bp, Mus musculus
ccagactgcaggttcagcagaagca

SEQ ID NO: 379861 - DNA, 25 bp, Mus musculus
caggggtaagcccacgctctgcctg

SEQ ID NO: 379862 - DNA, 25 bp, Mus musculus
tccttgctcaccctcgcggggttgg

SEQ ID NO: 379863 - DNA, 25 bp, Mus musculus
tcccaagtgcagcaggacgctcaga

SEQ ID NO: 379864 - DNA, 25 bp, Mus musculus
acgggctctccgcagagtccttggg

SEQ ID NO: 379865 - DNA, 25 bp, Mus musculus
cgcggaccttcaacgtcgcactgga

SEQ ID NO: 379866 - DNA, 25 bp, Mus musculus
cgtcgcactggacgccaggtacagc

SEQ ID NO: 379867 - DNA, 25 bp, Mus musculus
caggtacagccggagctcaacagcc

SEQ ID NO: 379868 - DNA, 25 bp, Mus musculus
agctccactctaaggcgggtgctca

SEQ ID NO: 379869 - DNA, 25 bp, Mus musculus
gcggtcactcgcttcgccaaacatg

SEQ ID NO: 379870 - DNA, 25 bp, Mus musculus
cgccaaacatggcaggcaagtcgtg

SEQ ID NO: 379871 - DNA, 25 bp, Mus musculus
gcaagtcgtgcgctcccaagtgcag

SEQ ID NO: 379872 - DNA, 25 bp, Mus musculus
ggtcacactccatgctactgtggta

SEQ ID NO: 379873 - DNA, 25 bp, Mus musculus
aacgcgtaccctagcgcatgcgctc

SEQ ID NO: 379874 - DNA, 25 bp, Mus musculus
tgtcagtctccatgaggtcacactc

SEQ ID NO: 379875 - DNA, 25 bp, Mus musculus
tttccgagtcgtcaggctgccctct

SEQ ID NO: 379876 - DNA, 25 bp, Mus musculus
gctactgtggtattcaaatttccga

SEQ ID NO: 379877 - DNA, 25 bp, Mus musculus
cccggaacttccaagtcgacagctg

SEQ ID NO: 379878 - DNA, 25 bp, Mus musculus
gcaagcagtttggttccgcccactg

SEQ ID NO: 379879 - DNA, 25 bp, Mus musculus
gagcgtgcgcaagcagtttggttcc

SEQ ID NO: 379880 - DNA, 25 bp, Mus musculus
ccaagtcgacagctggcgcctcagt

SEQ ID NO: 379881 - DNA, 25 bp, Mus musculus
ggggctctagcagagtggactttca

SEQ ID NO: 379882 - DNA, 25 bp, Mus musculus
cgtcttaccctagatcttccaacga

SEQ ID NO: 379883 - DNA, 25 bp, Mus musculus
cttccaacgactccaagatgtcagt

SEQ ID NO: 379884 - DNA, 25 bp, Mus musculus
ccaagatgtcagtctccatgaggtc

SEQ ID NO: 379885 - DNA, 25 bp, Mus musculus
tcaaatttccgagtcgtcaggctgc

SEQ ID NO: 379886 - DNA, 25 bp, Mus musculus
ggctcgcgtcgctacgactgtctca

SEQ ID NO: 379887 - DNA, 25 bp, Mus musculus
caaagctagccctcgtggcccggtg

SEQ ID NO: 379888 - DNA, 25 bp, Mus musculus
tgcggaaattccacgcgttcgcttc

SEQ ID NO: 379889 - DNA, 25 bp, Mus musculus
cacgcgttcgcttccctttcctggg

SEQ ID NO: 379890 - DNA, 25 bp, Mus musculus
cccgagcccggatgatcggcagcag

SEQ ID NO: 379891 - DNA, 25 bp, Mus musculus
gcgtcgctacgactgtctcagatcc

SEQ ID NO: 379892 - DNA, 25 bp, Mus musculus
taccacccggaggtgcagccgtccc

SEQ ID NO: 379893 - DNA, 25 bp, Mus musculus
tctgaactcaaaactaccacccgga

SEQ ID NO: 379894 - DNA, 25 bp, Mus musculus
tgcagcaacagctccggctaggatc

SEQ ID NO: 379895 - DNA, 25 bp, Mus musculus
ctttcctggggttcgatccggccag

SEQ ID NO: 379896 - DNA, 25 bp, Mus musculus
cagtgcccagcctaggctgcagcaa

SEQ ID NO: 379897 - DNA, 25 bp, Mus musculus
tcctggggttcgatccggccagtgc

SEQ ID NO: 379898 - DNA, 25 bp, Mus musculus
gtccagtttgcggaaattccacgcg

SEQ ID NO: 379899 - DNA, 25 bp, Mus musculus
taggctgcagcaacagctccggcta

SEQ ID NO: 379900 - DNA, 25 bp, Mus musculus
acacaggtgcggtgattagggctta

SEQ ID NO: 379901 - DNA, 25 bp, Mus musculus
tctgcgaaggtacggctgccctgct

SEQ ID NO: 379902 - DNA, 25 bp, Mus musculus
cgggcgcggaacaaagtttgcttga

SEQ ID NO: 379903 - DNA, 25 bp, Mus musculus
tgcttgagacttttcccagaggaga

SEQ ID NO: 379904 - DNA, 25 bp, Mus musculus
tgggtgagctccgaacacgcataga

SEQ ID NO: 379905 - DNA, 25 bp, Mus musculus
tcaccgagtacgaagtgggcgtctg

SEQ ID NO: 379906 - DNA, 25 bp, Mus musculus
tcaatggcgactccatcaccgagta

SEQ ID NO: 379907 - DNA, 25 bp, Mus musculus
tagggcttacactgggtggcctttc

SEQ ID NO: 379908 - DNA, 25 bp, Mus musculus
tgcctgccctgtgacgagtccaagt

SEQ ID NO: 379909 - DNA, 25 bp, Mus musculus
gacgagtccaagtgcgaggagcctc

SEQ ID NO: 379910 - DNA, 25 bp, Mus musculus
agctgcccaggaagcatcgtgcagg

SEQ ID NO: 379911 - DNA, 25 bp, Mus musculus
tgctgctacatgtgcgcccgccaga

SEQ ID NO: 379912 - DNA, 25 bp, Mus musculus
cgcccgccagaggaacgagagctgc

SEQ ID NO: 379913 - DNA, 25 bp, Mus musculus
agggtgccctagatgcctgcccagg

SEQ ID NO: 379914 - DNA, 25 bp, Mus musculus
ggcaagcctcgagggtcctacctga

SEQ ID NO: 379915 - DNA, 25 bp, Mus musculus
ggtcactaagatacttcacttccgg

SEQ ID NO: 379916 - DNA, 25 bp, Mus musculus
ggcggactcagaatggctctttgta

SEQ ID NO: 379917 - DNA, 25 bp, Mus musculus
gtccttcgggaaaaacatctcattc

SEQ ID NO: 379918 - DNA, 25 bp, Mus musculus
tccggccaatggtgaatgagaagta

SEQ ID NO: 379919 - DNA, 25 bp, Mus musculus
ttcagaccaaacagacgcgagcttg

SEQ ID NO: 379920 - DNA, 25 bp, Mus musculus
gccgacggtgacgattcgctctatc

SEQ ID NO: 379921 - DNA, 25 bp, Mus musculus
gctctatcctattgcggtgctcata

SEQ ID NO: 379922 - DNA, 25 bp, Mus musculus
gtgctcatagatgaactccgcaatg

SEQ ID NO: 379923 - DNA, 25 bp, Mus musculus
acggggatccttccgttagagtgtg

SEQ ID NO: 379924 - DNA, 25 bp, Mus musculus
aggttcgatgagatggcagccttca

SEQ ID NO: 379925 - DNA, 25 bp, Mus musculus
agccttcattgggtgcccggccaag

SEQ ID NO: 379926 - DNA, 25 bp, Mus musculus
taggcgggcacaatcttggtcacta

SEQ ID NO: 379927 - DNA, 25 bp, Mus musculus
ctcgctgctgcctgatagaaacgcc

SEQ ID NO: 379928 - DNA, 25 bp, Mus musculus
tgcactccgtgatgggccgcacggc

SEQ ID NO: 379929 - DNA, 25 bp, Mus musculus
cccggtcagacagccacgccctgtc

SEQ ID NO: 379930 - DNA, 25 bp, Mus musculus
gggctcagagcgaccgaggaagaag

SEQ ID NO: 379931 - DNA, 25 bp, Mus musculus
ttgcaggaggctgcactccgtgatg

SEQ ID NO: 379932 - DNA, 25 bp, Mus musculus
acgccctgtcgcttccaggccacgc

SEQ ID NO: 379933 - DNA, 25 bp, Mus musculus
gggcggaagcacaggctcagcttct

SEQ ID NO: 379934 - DNA, 25 bp, Mus musculus
aagccagcgccgggaagctgtcgcc

SEQ ID NO: 379935 - DNA, 25 bp, Mus musculus
cagcctccgggctcgcgttacagtt

SEQ ID NO: 379936 - DNA, 25 bp, Mus musculus
ggctcgcgttacagttctcctgttc

SEQ ID NO: 379937 - DNA, 25 bp, Mus musculus
gcgttacagttctcctgttcctgga

SEQ ID NO: 379938 - DNA, 25 bp, Mus musculus
acagttctcctgttcctggacactc

SEQ ID NO: 379939 - DNA, 25 bp, Mus musculus
ccggccggctcctggaactcataga

SEQ ID NO: 379940 - DNA, 25 bp, Mus musculus
ggaactcatagaaatcctgccagtc

SEQ ID NO: 379941 - DNA, 25 bp, Mus musculus
tcactcgtccccttgcaggaggctg

SEQ ID NO: 379942 - DNA, 25 bp, Mus musculus
cgagcagcggctcgaatttgggttc

SEQ ID NO: 379943 - DNA, 25 bp, Mus musculus
gcacggtcctgcagttcgtggccaa

SEQ ID NO: 379944 - DNA, 25 bp, Mus musculus
gcagtacacctacgagcagcggctc

SEQ ID NO: 379945 - DNA, 25 bp, Mus musculus
gggccgtgcagtacacctacgagca

SEQ ID NO: 379946 - DNA, 25 bp, Mus musculus
tttcagacaccgacacacgcgtcgg

SEQ ID NO: 379947 - DNA, 25 bp, Mus musculus
gcaaggagtttgagatttcagacac

SEQ ID NO: 379948 - DNA, 25 bp, Mus musculus
tcgtggccaacctcagcaaggagtt

SEQ ID NO: 379949 - DNA, 25 bp, Mus musculus
gacaagcaacttccgcacggtcctg

SEQ ID NO: 379950 - DNA, 25 bp, Mus musculus
tagcagcatggggacaagcaacttc

SEQ ID NO: 379951 - DNA, 25 bp, Mus musculus
tgtcatcgatgggtctagcagcatg

SEQ ID NO: 379952 - DNA, 25 bp, Mus musculus
tctgcggacataggctttgtcatcg

SEQ ID NO: 379953 - DNA, 25 bp, Mus musculus
gacctgtttaaactctgcggacata

SEQ ID NO: 379954 - DNA, 25 bp, Mus musculus
gggtctgcgacacggaccgcctagc

SEQ ID NO: 379955 - DNA, 25 bp, Mus musculus
cctagcctgcagcaagacctgttta

SEQ ID NO: 379956 - DNA, 25 bp, Mus musculus
ctagctccacttagtttagggcttc

SEQ ID NO: 379957 - DNA, 25 bp, Mus musculus
tgggctctctccacctcgaagcggg

SEQ ID NO: 379958 - DNA, 25 bp, Mus musculus
cggggttcatcaaagcctcgacacc

SEQ ID NO: 379959 - DNA, 25 bp, Mus musculus
tcgtcgcccttttcggggttcatca

SEQ ID NO: 379960 - DNA, 25 bp, Mus musculus
ttttgttaagaaataggcgctgggc

SEQ ID NO: 379961 - DNA, 25 bp, Mus musculus
gcggaagttatcacgccaagtacca

SEQ ID NO: 379962 - DNA, 25 bp, Mus musculus
gttgcatattcgcacgcggaagtta

SEQ ID NO: 379963 - DNA, 25 bp, Mus musculus
tgggcaagccatccggtcgtctgcc

SEQ ID NO: 379964 - DNA, 25 bp, Mus musculus
cggcgctccctgttgcatattcgca

SEQ ID NO: 379965 - DNA, 25 bp, Mus musculus
gcaggctcccttcatgcggaagttc

SEQ ID NO: 379966 - DNA, 25 bp, Mus musculus
tttcctcttcggcagtgcggccagc

SEQ ID NO: 379967 - DNA, 25 bp, Mus musculus
cagctcccgggtggttgttgctgaa

SEQ ID NO: 379968 - DNA, 25 bp, Mus musculus
tcgtgctgcaggaagtgcaagatcc

SEQ ID NO: 379969 - DNA, 25 bp, Mus musculus
tcgaagcgggcccattcgtgctgca

SEQ ID NO: 379970 - DNA, 25 bp, Mus musculus
cccagagtggcatcctcactttttt

SEQ ID NO: 379971 - DNA, 25 bp, Mus musculus
ccctccgagaaggaagtgtgacaag

SEQ ID NO: 379972 - DNA, 25 bp, Mus musculus
cgtccaagccctccgagaaggaagt

SEQ ID NO: 379973 - DNA, 25 bp, Mus musculus
atccgcccagcaggcacgatgacaa

SEQ ID NO: 379974 - DNA, 25 bp, Mus musculus
gtgtgacaagggcacagagtccctc

SEQ ID NO: 379975 - DNA, 25 bp, Mus musculus
tctcaccaacggctcggaccttggg

SEQ ID NO: 379976 - DNA, 25 bp, Mus musculus
gcggcccacagggacgtcccagagt

SEQ ID NO: 379977 - DNA, 25 bp, Mus musculus
ctttcccgaggcgtgggtgccctcg

SEQ ID NO: 379978 - DNA, 25 bp, Mus musculus
acagcggcaacagctacccgcgtaa

SEQ ID NO: 379979 - DNA, 25 bp, Mus musculus
ccgtgtgtgagtttggtaagtcacc

SEQ ID NO: 379980 - DNA, 25 bp, Mus musculus
aagtcacctctcttctttttaggcg

SEQ ID NO: 379981 - DNA, 25 bp, Mus musculus
ttctttttaggcgtgctgggcgtct

SEQ ID NO: 379982 - DNA, 25 bp, Mus musculus
cgtctgcttggaagcctgcggcact

SEQ ID NO: 379983 - DNA, 25 bp, Mus musculus
gcgtgaggtgacatctgccgttccc

SEQ ID NO: 379984 - DNA, 25 bp, Mus musculus
tcgccaccgggacccagaagagtga

SEQ ID NO: 379985 - DNA, 25 bp, Mus musculus
tgtcagcctcccgtcgtaggagtcc

SEQ ID NO: 379986 - DNA, 25 bp, Mus musculus
cgtaggagtcctcgagctgtcaacc

SEQ ID NO: 379987 - DNA, 25 bp, Mus musculus
ctgagagtctgctggaaacgcaaac

SEQ ID NO: 379988 - DNA, 25 bp, Mus musculus
cctcagccctcggaaaatgtcctgg

SEQ ID NO: 379989 - DNA, 25 bp, Mus musculus
tgggacccagggatgtcacagcctg

SEQ ID NO: 379990 - DNA, 25 bp, Mus musculus
acctcctggtctagtccgagccgag

SEQ ID NO: 379991 - DNA, 25 bp, Mus musculus
gacgcatgcgcgagacacaggtcct

SEQ ID NO: 379992 - DNA, 25 bp, Mus musculus
cccaagtttcgaagcgaatcggctg

SEQ ID NO: 379993 - DNA, 25 bp, Mus musculus
tgggtcctgcgccaattgcacggcg

SEQ ID NO: 379994 - DNA, 25 bp, Mus musculus
ctggttccgggcagtaaagctccgg

SEQ ID NO: 379995 - DNA, 25 bp, Mus musculus
tgcaagttggctgtgactgcctatc

SEQ ID NO: 379996 - DNA, 25 bp, Mus musculus
actgcctatcacagcgtcagctacg

SEQ ID NO: 379997 - DNA, 25 bp, Mus musculus
agctcaggcgtctggggagctttct

SEQ ID NO: 379998 - DNA, 25 bp, Mus musculus
tcgctgttggatccttgcagggcag

SEQ ID NO: 379999 - DNA, 25 bp, Mus musculus
gctgggtgctcgctgttggatcctt

SEQ ID NO: 380000 - DNA, 25 bp, Mus musculus
agcgcgagcgtttccgggtcgccga

SEQ ID NO: 380001 - DNA, 25 bp, Mus musculus
tggggaacactcgagcgagcccgcc

SEQ ID NO: 380002 - DNA, 25 bp, Mus musculus
attcttgggtgtggggaacactcga

SEQ ID NO: 380003 - DNA, 25 bp, Mus musculus
acattcttgggtgtggggaacactc

SEQ ID NO: 380004 - DNA, 25 bp, Mus musculus
cgcgtggggtctgtgacattcttgg

SEQ ID NO: 380005 - DNA, 25 bp, Mus musculus
tctgttccccaatgtgtggcgcgtg

SEQ ID NO: 380006 - DNA, 25 bp, Mus musculus
agtgtttcttgtcctctgttcccca

SEQ ID NO: 380007 - DNA, 25 bp, Mus musculus
taaggaccgggcagtgtttcttgtc

SEQ ID NO: 380008 - DNA, 25 bp, Mus musculus
cctcaggtaaggaccgggcagtgtt

SEQ ID NO: 380009 - DNA, 25 bp, Mus musculus
cgcagtcgggttgcggaggcctcag

SEQ ID NO: 380010 - DNA, 25 bp, Mus musculus
ggcgctaagaccgtgcgcttgcgca

SEQ ID NO: 380011 - DNA, 25 bp, Mus musculus
cgtggcgctaagaccgtgcgcttgc

SEQ ID NO: 380012 - DNA, 25 bp, Mus musculus
gagaagccattcttgccctcatcgc

SEQ ID NO: 380013 - DNA, 25 bp, Mus musculus
cggtcgtgttcaaaacatttgccca

SEQ ID NO: 380014 - DNA, 25 bp, Mus musculus
ctcggggtgtaggaatgaatgcttt

SEQ ID NO: 380015 - DNA, 25 bp, Mus musculus
ttgcccacgtggttagaatccgatc

SEQ ID NO: 380016 - DNA, 25 bp, Mus musculus
gaatccgatcgcctacattttaacg

SEQ ID NO: 380017 - DNA, 25 bp, Mus musculus
tttttcccactgaagcgcggtaaca

SEQ ID NO: 380018 - DNA, 25 bp, Mus musculus
ccttacctttgtgcctccgaggcgt

SEQ ID NO: 380019 - DNA, 25 bp, Mus musculus
tgcttggcaaggaacgccacaggtt

SEQ ID NO: 380020 - DNA, 25 bp, Mus musculus
gcacttcctattgcgagggcgattc

SEQ ID NO: 380021 - DNA, 25 bp, Mus musculus
tggaaaccgtatggcgcggctcctt

SEQ ID NO: 380022 - DNA, 25 bp, Mus musculus
ccgctttacggtgacgcacttccta

SEQ ID NO: 380023 - DNA, 25 bp, Mus musculus
cagcccggagcttacttccgcttta

SEQ ID NO: 380024 - DNA, 25 bp, Mus musculus
cggatcttctgtcacctgtttggga

SEQ ID NO: 380025 - DNA, 25 bp, Mus musculus
acagtaaatgcgtgggaagctctca

SEQ ID NO: 380026 - DNA, 25 bp, Mus musculus
ggtgaccacctgaacgcagcgtcca

SEQ ID NO: 380027 - DNA, 25 bp, Mus musculus
ctcggctgttctggagaaagtcggc

SEQ ID NO: 380028 - DNA, 25 bp, Mus musculus
ttcaccggcgccacagcaaaacttg

SEQ ID NO: 380029 - DNA, 25 bp, Mus musculus
gcgtccagagtggaggaccctcctt

SEQ ID NO: 380030 - DNA, 25 bp, Mus musculus
cgactacttacagaggcgggctcgg

SEQ ID NO: 380031 - DNA, 25 bp, Mus musculus
tcagcccgacgggtcgggagaacaa

SEQ ID NO: 380032 - DNA, 25 bp, Mus musculus
cggcgcgaacttttttcggtgtctg

SEQ ID NO: 380033 - DNA, 25 bp, Mus musculus
cgcggaggctctgcaaacccgcaga

SEQ ID NO: 380034 - DNA, 25 bp, Mus musculus
tccctccagcgactacttacagagg

SEQ ID NO: 380035 - DNA, 25 bp, Mus musculus
cagtcggtgacaagaggtgaccacc

SEQ ID NO: 380036 - DNA, 25 bp, Mus musculus
caggagccagcgaggcttcacgcgc

SEQ ID NO: 380037 - DNA, 25 bp, Mus musculus
cgcgactggaaggacgcgctgtact

SEQ ID NO: 380038 - DNA, 25 bp, Mus musculus
ttttttcggtgtctgctccgcgctc

SEQ ID NO: 380039 - DNA, 25 bp, Mus musculus
gcgctgtactcgaacctctcacttt

SEQ ID NO: 380040 - DNA, 25 bp, Mus musculus
ggccactgctgcgttctgaacttga

SEQ ID NO: 380041 - DNA, 25 bp, Mus musculus
accttctcttggactagcgggaggc

SEQ ID NO: 380042 - DNA, 25 bp, Mus musculus
tctccgctgcctggacgcaggagaa

SEQ ID NO: 380043 - DNA, 25 bp, Mus musculus
tgagtgatgtcacccgcctcccttt

SEQ ID NO: 380044 - DNA, 25 bp, Mus musculus
gggactcggccaccttctcttggac

SEQ ID NO: 380045 - DNA, 25 bp, Mus musculus
ctgataggcacaggaagtatgtctc

SEQ ID NO: 380046 - DNA, 25 bp, Mus musculus
atgtctcgctggctgtgcaagaaca

SEQ ID NO: 380047 - DNA, 25 bp, Mus musculus
ttgctcctggatgcctagaccgcgc

SEQ ID NO: 380048 - DNA, 25 bp, Mus musculus
aactcctgggaaccagtgctctctc

SEQ ID NO: 380049 - DNA, 25 bp, Mus musculus
ctgtctctgacagctgggaatctga

SEQ ID NO: 380050 - DNA, 25 bp, Mus musculus
cacactcttgcagagatggcaggca

SEQ ID NO: 380051 - DNA, 25 bp, Mus musculus
atggcaggcagcgaagacaagctcg

SEQ ID NO: 380052 - DNA, 25 bp, Mus musculus
agacaagctcgtcgtgggcactctc

SEQ ID NO: 380053 - DNA, 25 bp, Mus musculus
tgctgctactgcaggcgaccgtcct

SEQ ID NO: 380054 - DNA, 25 bp, Mus musculus
cagctgtagctctcgggagggaaaa

SEQ ID NO: 380055 - DNA, 25 bp, Mus musculus
cggcaacggttcaccgcagaatctg

SEQ ID NO: 380056 - DNA, 25 bp, Mus musculus
gctgtgctcccagcggcagttggaa

SEQ ID NO: 380057 - DNA, 25 bp, Mus musculus
tcttggaggacaaaggctacccact

SEQ ID NO: 380058 - DNA, 25 bp, Mus musculus
ggctccctcaggcacaaagaaaagt

SEQ ID NO: 380059 - DNA, 25 bp, Mus musculus
ctaaggctcctagcttctgcccgga

SEQ ID NO: 380060 - DNA, 25 bp, Mus musculus
aacccacctagcagtgcggggcttc

SEQ ID NO: 380061 - DNA, 25 bp, Mus musculus
ctaagtcttccaaggccaccatctg

SEQ ID NO: 380062 - DNA, 25 bp, Mus musculus
gtgctgtcaacgtgcagccggctcc

SEQ ID NO: 380063 - DNA, 25 bp, Mus musculus
tcggacagtcttacaggtggagaga

SEQ ID NO: 380064 - DNA, 25 bp, Mus musculus
ccaccatctgcactagctggaaggg

SEQ ID NO: 380065 - DNA, 25 bp, Mus musculus
ccttgcaagctgtcgccaaaacctg

SEQ ID NO: 380066 - DNA, 25 bp, Mus musculus
tcaccagcagtctctaaggctccta

SEQ ID NO: 380067 - DNA, 25 bp, Mus musculus
ctgtccgtacggtgcgggagaacaa

SEQ ID NO: 380068 - DNA, 25 bp, Mus musculus
ccctggagaggtggcttcctgaccc

SEQ ID NO: 380069 - DNA, 25 bp, Mus musculus
tttccgggtcgagagaagcaggccc

SEQ ID NO: 380070 - DNA, 25 bp, Mus musculus
gcgcctccgttatctgggtcagaca

SEQ ID NO: 380071 - DNA, 25 bp, Mus musculus
cctagaggagcctgcgccctggaga

SEQ ID NO: 380072 - DNA, 25 bp, Mus musculus
tcctggcaccatcctagaggagcct

SEQ ID NO: 380073 - DNA, 25 bp, Mus musculus
gggcactcctggcaccatcctagag

SEQ ID NO: 380074 - DNA, 25 bp, Mus musculus
tccgggtgcgtacctagccagggaa

SEQ ID NO: 380075 - DNA, 25 bp, Mus musculus
tgcgcaacgactccgggtgcgtacc

SEQ ID NO: 380076 - DNA, 25 bp, Mus musculus
agccccagagaagcctgcgcaacga

SEQ ID NO: 380077 - DNA, 25 bp, Mus musculus
gcacagggttccactcggccatcct

SEQ ID NO: 380078 - DNA, 25 bp, Mus musculus
aggccaccacgcaggaccttgggac

SEQ ID NO: 380079 - DNA, 25 bp, Mus musculus
acgaaggccaccacgcaggaccttg

SEQ ID NO: 380080 - DNA, 25 bp, Mus musculus
ttatctgggtcagacacgaaggcca

SEQ ID NO: 380081 - DNA, 25 bp, Mus musculus
tcagctttccgggtcgagagaagca

SEQ ID NO: 380082 - DNA, 25 bp, Mus musculus
cagtgccaggtgatgcggtactaga

SEQ ID NO: 380083 - DNA, 25 bp, Mus musculus
tgacagaatagcagaggagcagctt

SEQ ID NO: 380084 - DNA, 25 bp, Mus musculus
tgacgcggagagctgcgagactgag

SEQ ID NO: 380085 - DNA, 25 bp, Mus musculus
aatagcagaggagcagcttgccgcg

SEQ ID NO: 380086 - DNA, 25 bp, Mus musculus
tgatgcggtactagagagtgccgcg

SEQ ID NO: 380087 - DNA, 25 bp, Mus musculus
actatcgtttgtgcgggcagtgcca

SEQ ID NO: 380088 - DNA, 25 bp, Mus musculus
gacatgactatcgtttgtgcgggca

SEQ ID NO: 380089 - DNA, 25 bp, Mus musculus
ggaggagacatgactatcgtttgtg

SEQ ID NO: 380090 - DNA, 25 bp, Mus musculus
ttcaaaagcttcagcggtcggggag

SEQ ID NO: 380091 - DNA, 25 bp, Mus musculus
cacggattcaaaagcttcagcggtc

SEQ ID NO: 380092 - DNA, 25 bp, Mus musculus
ggggcacggattcaaaagcttcagc

SEQ ID NO: 380093 - DNA, 25 bp, Mus musculus
ggagagagagatggcagcggagcca

SEQ ID NO: 380094 - DNA, 25 bp, Mus musculus
actgaggaagtaggaacgtgggaga

SEQ ID NO: 380095 - DNA, 25 bp, Mus musculus
agtgccgcgggtgacagaatagcag

SEQ ID NO: 380096 - DNA, 25 bp, Mus musculus
tcctcattgtggctgagcagctcta

SEQ ID NO: 380097 - DNA, 25 bp, Mus musculus
tccgtcatgtctcgaggagcagccc

SEQ ID NO: 380098 - DNA, 25 bp, Mus musculus
gcggtgcctcaggaacttgtccaga

SEQ ID NO: 380099 - DNA, 25 bp, Mus musculus
ccgggttgggaaatagctgcagcca

SEQ ID NO: 380100 - DNA, 25 bp, Mus musculus
actgtgcgcccgaactcctcattgt

SEQ ID NO: 380101 - DNA, 25 bp, Mus musculus
ggaactccgcatcgtcgtggttgta

SEQ ID NO: 380102 - DNA, 25 bp, Mus musculus
acagcgctcatgacgttggccaccg

SEQ ID NO: 380103 - DNA, 25 bp, Mus musculus
acaatgaccggctgcgttggatcga

SEQ ID NO: 380104 - DNA, 25 bp, Mus musculus
gctgcgtcttccagtgctcagagta

SEQ ID NO: 380105 - DNA, 25 bp, Mus musculus
ctcagagtagtgaccgaacgccaga

SEQ ID NO: 380106 - DNA, 25 bp, Mus musculus
cgccgcgtttccgatcagtggccaa

SEQ ID NO: 380107 - DNA, 25 bp, Mus musculus
ggtttccgttgccactgtcgcagca

SEQ ID NO: 380108 - DNA, 25 bp, Mus musculus
ccagacgctttcttttcggcagaga

SEQ ID NO: 380109 - DNA, 25 bp, Mus musculus
tggttgtaccgacagccgaagcaca

SEQ ID NO: 380110 - DNA, 25 bp, Mus musculus
aggaggcggctctgtacgccaacaa

SEQ ID NO: 380111 - DNA, 25 bp, Mus musculus
cgcgttgaaacgacaggaactctgc

SEQ ID NO: 380112 - DNA, 25 bp, Mus musculus
atgctcgatcgcagccaactggtcg

SEQ ID NO: 380113 - DNA, 25 bp, Mus musculus
cctgccctgaggatgctcgatcgca

SEQ ID NO: 380114 - DNA, 25 bp, Mus musculus
cttgggcaccagagacagtcctgga

SEQ ID NO: 380115 - DNA, 25 bp, Mus musculus
gacagtcctggagcgccagacccga

SEQ ID NO: 380116 - DNA, 25 bp, Mus musculus
ggctctgtacgccaacaaacggttg

SEQ ID NO: 380117 - DNA, 25 bp, Mus musculus
tgaaaagtttctgctgtcgcctccc

SEQ ID NO: 380118 - DNA, 25 bp, Mus musculus
gacaggaactctgccacctgctgga

SEQ ID NO: 380119 - DNA, 25 bp, Mus musculus
gctgtgccttgcgtgcgccgcttct

SEQ ID NO: 380120 - DNA, 25 bp, Mus musculus
ctgggaagtcggctccagtcatctc

SEQ ID NO: 380121 - DNA, 25 bp, Mus musculus
agtcggctccagtcatctccctggg

SEQ ID NO: 380122 - DNA, 25 bp, Mus musculus
tccaagcttgggcaccagagacagt

SEQ ID NO: 380123 - DNA, 25 bp, Mus musculus
gacacgcgtgacagctcaggtcgcc

SEQ ID NO: 380124 - DNA, 25 bp, Mus musculus
tgcgcttgtgcgtttcactttccca

SEQ ID NO: 380125 - DNA, 25 bp, Mus musculus
gtcttcctccgggagacctccatgg

SEQ ID NO: 380126 - DNA, 25 bp, Mus musculus
acatgacaccacctcggtgccgttg

SEQ ID NO: 380127 - DNA, 25 bp, Mus musculus
cagcagataggcgatcaggggcaac

SEQ ID NO: 380128 - DNA, 25 bp, Mus musculus
cgaaccctgcgggtgacatgacacc

SEQ ID NO: 380129 - DNA, 25 bp, Mus musculus
ctgtagtccagctggtccaggcagc

SEQ ID NO: 380130 - DNA, 25 bp, Mus musculus
cctcccttcttgattcggtgagatc

SEQ ID NO: 380131 - DNA, 25 bp, Mus musculus
ttgtgaaagtgggatgcaactggcc

SEQ ID NO: 380132 - DNA, 25 bp, Mus musculus
ccttcgccggagagttcctctgtgc

SEQ ID NO: 380133 - DNA, 25 bp, Mus musculus
agttgcccgcttggtcccggtatag

SEQ ID NO: 380134 - DNA, 25 bp, Mus musculus
ccggtataggcgagagagcctgttc

SEQ ID NO: 380135 - DNA, 25 bp, Mus musculus
agcctgttcttcaggctgtagtcca

SEQ ID NO: 380136 - DNA, 25 bp, Mus musculus
tagcttgctgaagctgctcccgggc

SEQ ID NO: 380137 - DNA, 25 bp, Mus musculus
tggctccgatggcttgctcagatcg

SEQ ID NO: 380138 - DNA, 25 bp, Mus musculus
tacctagggaggtcgtagacgagac

SEQ ID NO: 380139 - DNA, 25 bp, Mus musculus
cgccatcttgtaccgatttaaaatt

SEQ ID NO: 380140 - DNA, 25 bp, Mus musculus
agtcgctggtctgtcgccggcgcct

SEQ ID NO: 380141 - DNA, 25 bp, Mus musculus
aactccgacgctcgagtcgctggtc

SEQ ID NO: 380142 - DNA, 25 bp, Mus musculus
tcgtagacgagacgtggttaactcc

SEQ ID NO: 380143 - DNA, 25 bp, Mus musculus
ccgcgtcaggcacccagggcagtga

SEQ ID NO: 380144 - DNA, 25 bp, Mus musculus
ctggcagccaggtgccagcggttcc

SEQ ID NO: 380145 - DNA, 25 bp, Mus musculus
agagagctctgcgacctggcagcca

SEQ ID NO: 380146 - DNA, 25 bp, Mus musculus
gactgcggctcccatcgggaaggaa

SEQ ID NO: 380147 - DNA, 25 bp, Mus musculus
tgaagctgaagctgagcccgggccc

SEQ ID NO: 380148 - DNA, 25 bp, Mus musculus
agccaagagctggtgaagctgaagc

SEQ ID NO: 380149 - DNA, 25 bp, Mus musculus
cacaactcgtgcgaatgggttcggc

SEQ ID NO: 380150 - DNA, 25 bp, Mus musculus
gtctgacaaccggagccaacacttg

SEQ ID NO: 380151 - DNA, 25 bp, Mus musculus
agacgtggttaactccgacgctcga

SEQ ID NO: 380152 - DNA, 25 bp, Mus musculus
ggggacgcttccctttatctctcag

SEQ ID NO: 380153 - DNA, 25 bp, Mus musculus
gatccagggcccgagagtttccgcc

SEQ ID NO: 380154 - DNA, 25 bp, Mus musculus
agacgggcctcagatgtcgctgatc

SEQ ID NO: 380155 - DNA, 25 bp, Mus musculus
ttggcctggctctcgaactcccggt

SEQ ID NO: 380156 - DNA, 25 bp, Mus musculus
tccctcctcggtcttgaggcgcttg

SEQ ID NO: 380157 - DNA, 25 bp, Mus musculus
ctcctcggccgagtagacgatctct

SEQ ID NO: 380158 - DNA, 25 bp, Mus musculus
aggcgtcgcttcctggcgattctcg

SEQ ID NO: 380159 - DNA, 25 bp, Mus musculus
acaggggcatgctccgagggccacc

SEQ ID NO: 380160 - DNA, 25 bp, Mus musculus
cgccgcgctttgttaccgtggacag

SEQ ID NO: 380161 - DNA, 25 bp, Mus musculus
cgctcggcgtgcacgcagcggcaaa

SEQ ID NO: 380162 - DNA, 25 bp, Mus musculus
gagtcgccagctacgcgctcggcgt

SEQ ID NO: 380163 - DNA, 25 bp, Mus musculus
gaaagaatcagtccgagtcgccagc

SEQ ID NO: 380164 - DNA, 25 bp, Mus musculus
acccaaagccggcattcgggattcg

SEQ ID NO: 380165 - DNA, 25 bp, Mus musculus
gcctcctattggaagagcgaaagtc

SEQ ID NO: 380166 - DNA, 25 bp, Mus musculus
gaggaaatgcgccaccacggtcatc

SEQ ID NO: 380167 - DNA, 25 bp, Mus musculus
gcttcggcctgtccaggagagacca

SEQ ID NO: 380168 - DNA, 25 bp, Mus musculus
cacggtcatcaatgtgctcaaaatg

SEQ ID NO: 380169 - DNA, 25 bp, Mus musculus
gagccgccattacgcacgcggaata

SEQ ID NO: 380170 - DNA, 25 bp, Mus musculus
gctgccggtttcgttccgtctccag

SEQ ID NO: 380171 - DNA, 25 bp, Mus musculus
ccgtgtactcggctctagcttggaa

SEQ ID NO: 380172 - DNA, 25 bp, Mus musculus
gctactcctcatgccgaccaattgt

SEQ ID NO: 380173 - DNA, 25 bp, Mus musculus
tcccggcggcactacaaggaagagg

SEQ ID NO: 380174 - DNA, 25 bp, Mus musculus
ccggagtcgcgcttatataggcggc

SEQ ID NO: 380175 - DNA, 25 bp, Mus musculus
gaccaattgttggacgacgcgcagc

SEQ ID NO: 380176 - DNA, 25 bp, Mus musculus
ttctgcgcatgcgttgtgtcaacgt

SEQ ID NO: 380177 - DNA, 25 bp, Mus musculus
gtgtcaacgttctgcgcggcacaaa

SEQ ID NO: 380178 - DNA, 25 bp, Mus musculus
ataccgcccgtagcgtgacatgatg

SEQ ID NO: 380179 - DNA, 25 bp, Mus musculus
gcttggaatgctcacagcgcgagta

SEQ ID NO: 380180 - DNA, 25 bp, Mus musculus
acatgccacgtcaggccgtacctgg

SEQ ID NO: 380181 - DNA, 25 bp, Mus musculus
tcaggccgtacctggctcgtagcgt

SEQ ID NO: 380182 - DNA, 25 bp, Mus musculus
tacctggctcgtagcgttgctggct

SEQ ID NO: 380183 - DNA, 25 bp, Mus musculus
gtccgggctgggttcagcttccctc

SEQ ID NO: 380184 - DNA, 25 bp, Mus musculus
ggttcagcttccctcttggacctca

SEQ ID NO: 380185 - DNA, 25 bp, Mus musculus
tgcacttttgcttccgggtgagagg

SEQ ID NO: 380186 - DNA, 25 bp, Mus musculus
ctaggggaatcgcagagtcgcgaaa

SEQ ID NO: 380187 - DNA, 25 bp, Mus musculus
cagagtcgcgaaagcctgtccttca

SEQ ID NO: 380188 - DNA, 25 bp, Mus musculus
ctgtccttcacgtctccatcaagtg

SEQ ID NO: 380189 - DNA, 25 bp, Mus musculus
tctccatcaagtgagtgcgcttcct

SEQ ID NO: 380190 - DNA, 25 bp, Mus musculus
cttcctctcgggagctgatggaccc

SEQ ID NO: 380191 - DNA, 25 bp, Mus musculus
gtgcctatcactccggatttgtttc

SEQ ID NO: 380192 - DNA, 25 bp, Mus musculus
tctgtgggttcgctgtgcctatcac

SEQ ID NO: 380193 - DNA, 25 bp, Mus musculus
tctgattggcttcttgcacttttgc

SEQ ID NO: 380194 - DNA, 25 bp, Mus musculus
ctctgcaggccatcccggagatgga

SEQ ID NO: 380195 - DNA, 25 bp, Mus musculus
agatggacttcgagccgtcttccgc

SEQ ID NO: 380196 - DNA, 25 bp, Mus musculus
agccgctaggcaacgtggagcgctc

SEQ ID NO: 380197 - DNA, 25 bp, Mus musculus
agtacggcggcgagatcttcgcgct

SEQ ID NO: 380198 - DNA, 25 bp, Mus musculus
ctacgacgaggagcccttccaggcg

SEQ ID NO: 380199 - DNA, 25 bp, Mus musculus
agcctggacatctgcttcctgcggc

SEQ ID NO: 380200 - DNA, 25 bp, Mus musculus
tcagcttcgccatggaggccgagag

SEQ ID NO: 380201 - DNA, 25 bp, Mus musculus
cgcctacaagctggaggccgcgcag

SEQ ID NO: 380202 - DNA, 25 bp, Mus musculus
gcacggcaaggccaagcctctgagc

SEQ ID NO: 380203 - DNA, 25 bp, Mus musculus
ctgagccgctcgctcaaggagttcc

SEQ ID NO: 380204 - DNA, 25 bp, Mus musculus
ggctaccacgccgagaacacgaagg

SEQ ID NO: 380205 - DNA, 25 bp, Mus musculus
gcctctacagcacgcgaagcagcag

SEQ ID NO: 380206 - DNA, 25 bp, Mus musculus
cagaggtcccaaagcgaaaaacaga

SEQ ID NO: 380207 - DNA, 25 bp, Mus musculus
ggagccagcacacgcgtggttacag

SEQ ID NO: 380208 - DNA, 25 bp, Mus musculus
gcttggatgatccagaccaaccctc

SEQ ID NO: 380209 - DNA, 25 bp, Mus musculus
tgaacctgctcgcaactgagcatgc

SEQ ID NO: 380210 - DNA, 25 bp, Mus musculus
gcttcctactagcaaactgaacctg

SEQ ID NO: 380211 - DNA, 25 bp, Mus musculus
gcgccggagcttcctactagcaaac

SEQ ID NO: 380212 - DNA, 25 bp, Mus musculus
actcaagcgagaggcccagaacggg

SEQ ID NO: 380213 - DNA, 25 bp, Mus musculus
tcgccagcggggaactcaagcgaga

SEQ ID NO: 380214 - DNA, 25 bp, Mus musculus
cggagaagggccacagcccgtgcac

SEQ ID NO: 380215 - DNA, 25 bp, Mus musculus
agctgctgcgcctgcatggtgcccg

SEQ ID NO: 380216 - DNA, 25 bp, Mus musculus
tgaaaaactcgtaaggcagctgctg

SEQ ID NO: 380217 - DNA, 25 bp, Mus musculus
gggcgcgttctcctcgctgaaaaac

SEQ ID NO: 380218 - DNA, 25 bp, Mus musculus
ctttttcagcgcaggcaccagcagc

SEQ ID NO: 380219 - DNA, 25 bp, Mus musculus
tgtcaacagctggagcagcggacgc

SEQ ID NO: 380220 - DNA, 25 bp, Mus musculus
gcctccgcgcttggatgatccagac

SEQ ID NO: 380221 - DNA, 25 bp, Mus musculus
tccgagaccgggaagaaagacgaca

SEQ ID NO: 380222 - DNA, 25 bp, Mus musculus
ttgtagcggagttccgagctcatcc

SEQ ID NO: 380223 - DNA, 25 bp, Mus musculus
acggtgctaggcagcctcactgcca

SEQ ID NO: 380224 - DNA, 25 bp, Mus musculus
gcctcactgccagaacggaggtgac

SEQ ID NO: 380225 - DNA, 25 bp, Mus musculus
actgccagaacggaggtgacgcacg

SEQ ID NO: 380226 - DNA, 25 bp, Mus musculus
ggggcgcgtctgtactccctcgtcg

SEQ ID NO: 380227 - DNA, 25 bp, Mus musculus
actggcggcgcaagcgcagacgctc

SEQ ID NO: 380228 - DNA, 25 bp, Mus musculus
ccctcgtcgcatcccaaagcaagag

SEQ ID NO: 380229 - DNA, 25 bp, Mus musculus
catccgacctggagcgtcaagggaa

SEQ ID NO: 380230 - DNA, 25 bp, Mus musculus
cgcccaggcattgtagcggagttcc

SEQ ID NO: 380231 - DNA, 25 bp, Mus musculus
gagttccgagctcatccgacctgga

SEQ ID NO: 380232 - DNA, 25 bp, Mus musculus
cttggcgccactccacggtgctagg

SEQ ID NO: 380233 - DNA, 25 bp, Mus musculus
caaacgcgtccttctcgcgcagagg

SEQ ID NO: 380234 - DNA, 25 bp, Mus musculus
cttctcgcgcagagggcctccgact

SEQ ID NO: 380235 - DNA, 25 bp, Mus musculus
cccaaagcaagagcgcccaggcatt

SEQ ID NO: 380236 - DNA, 25 bp, Mus musculus
ttttcccggccagagtggctgaccc

SEQ ID NO: 380237 - DNA, 25 bp, Mus musculus
cacgtctacagaggaaccgtacttc

SEQ ID NO: 380238 - DNA, 25 bp, Mus musculus
gctgacccgtcaggagctctgcaaa

SEQ ID NO: 380239 - DNA, 25 bp, Mus musculus
cgtgtctcccacgagaagttcgggg

SEQ ID NO: 380240 - DNA, 25 bp, Mus musculus
gctctgcaaaaacacagccgacggc

SEQ ID NO: 380241 - DNA, 25 bp, Mus musculus
cgacggcccacacgtctacagagga

SEQ ID NO: 380242 - DNA, 25 bp, Mus musculus
agcaatgtgcttctcgctttccttg

SEQ ID NO: 380243 - DNA, 25 bp, Mus musculus
tctcgctttccttgcggtatctatc

SEQ ID NO: 380244 - DNA, 25 bp, Mus musculus
gcggtatctatcatacggatgctac

SEQ ID NO: 380245 - DNA, 25 bp, Mus musculus
cggatgctacaacgaacacaaaagc

SEQ ID NO: 380246 - DNA, 25 bp, Mus musculus
tcctacccaacgtcctgatgatcag

SEQ ID NO: 380247 - DNA, 25 bp, Mus musculus
tgatcaggtaaagctggtccacgtc

SEQ ID NO: 380248 - DNA, 25 bp, Mus musculus
gaggaaccgtacttcgtgtctccca

SEQ ID NO: 380249 - DNA, 25 bp, Mus musculus
tccacgtcggattttcccggccaga

SEQ ID NO: 380250 - DNA, 25 bp, Mus musculus
ttggcgactcctttagtggcctctg

SEQ ID NO: 380251 - DNA, 25 bp, Mus musculus
gcgactcctttagtggcctctgcca

SEQ ID NO: 380252 - DNA, 25 bp, Mus musculus
cccaaggaaaggtgtttgcacgcta

SEQ ID NO: 380253 - DNA, 25 bp, Mus musculus
gaaaggtgtttgcacgctaagcaga

SEQ ID NO: 380254 - DNA, 25 bp, Mus musculus
tttgcacgctaagcagaaccggggc

SEQ ID NO: 380255 - DNA, 25 bp, Mus musculus
cgctaagcagaaccggggccgttct

SEQ ID NO: 380256 - DNA, 25 bp, Mus musculus
ttgagccccgcatctctgaagcaga

SEQ ID NO: 380257 - DNA, 25 bp, Mus musculus
tgcgcgccttttttggcgactcctt

SEQ ID NO: 380258 - DNA, 25 bp, Mus musculus
gcggtgcgcgccttttttggcgact

SEQ ID NO: 380259 - DNA, 25 bp, Mus musculus
tggattttaacccactgttgagccc

SEQ ID NO: 380260 - DNA, 25 bp, Mus musculus
acctggattttaacccactgttgag

SEQ ID NO: 380261 - DNA, 25 bp, Mus musculus
gcaccatgccgtgtggagccactct

SEQ ID NO: 380262 - DNA, 25 bp, Mus musculus
aactttggacgctggcgcaccatgc

SEQ ID NO: 380263 - DNA, 25 bp, Mus musculus
gtcttgggcccaactttggacgctg

SEQ ID NO: 380264 - DNA, 25 bp, Mus musculus
ttgctcgctctctctattcgattcg

SEQ ID NO: 380265 - DNA, 25 bp, Mus musculus
acacaacttgctcgctctctctatt

SEQ ID NO: 380266 - DNA, 25 bp, Mus musculus
ggctgcgcagcttccacacaacttg

SEQ ID NO: 380267 - DNA, 25 bp, Mus musculus
aaccaggacgcgcaggctgcgcagc

SEQ ID NO: 380268 - DNA, 25 bp, Mus musculus
tctccagggcaaccaggacgcgcag

SEQ ID NO: 380269 - DNA, 25 bp, Mus musculus
agcctctgcggtgtctccagggcaa

SEQ ID NO: 380270 - DNA, 25 bp, Mus musculus
gaactcccgagagaccgagcctctg

SEQ ID NO: 380271 - DNA, 25 bp, Mus musculus
tgctgccaccacagaactcccgaga

SEQ ID NO: 380272 - DNA, 25 bp, Mus musculus
cagcccgcgcagtctgctgccacca

SEQ ID NO: 380273 - DNA, 25 bp, Mus musculus
acaatggtgttcagcttcggggagc

SEQ ID NO: 380274 - DNA, 25 bp, Mus musculus
cgacggtgacacaatggtgttcagc

SEQ ID NO: 380275 - DNA, 25 bp, Mus musculus
ggaacctgcacttacacggcacagc

SEQ ID NO: 380276 - DNA, 25 bp, Mus musculus
cgccagggaacctgcacttacacgg

SEQ ID NO: 380277 - DNA, 25 bp, Mus musculus
cacgagaccacgggtggcccgttct

SEQ ID NO: 380278 - DNA, 25 bp, Mus musculus
cacacaagcgggacgtcggatccca

SEQ ID NO: 380279 - DNA, 25 bp, Mus musculus
tgaatgagctcaggtcgctagtgtg

SEQ ID NO: 380280 - DNA, 25 bp, Mus musculus
gcacgcatgcatgggacactgaatg

SEQ ID NO: 380281 - DNA, 25 bp, Mus musculus
cagttagagctaccgacgattttca

SEQ ID NO: 380282 - DNA, 25 bp, Mus musculus
cagtagggccgtgagcacgcatgca

SEQ ID NO: 380283 - DNA, 25 bp, Mus musculus
gtaaaaagttccctgtctcggcagc

SEQ ID NO: 380284 - DNA, 25 bp, Mus musculus
aagccgtggttgtggcacagttaga

SEQ ID NO: 380285 - DNA, 25 bp, Mus musculus
ttgctcgcgatcttccgccaaatcg

SEQ ID NO: 380286 - DNA, 25 bp, Mus musculus
tcttccgccaaatcgggaggtggca

SEQ ID NO: 380287 - DNA, 25 bp, Mus musculus
ttggcagcgtgtttccatttggaac

SEQ ID NO: 380288 - DNA, 25 bp, Mus musculus
tctcggcagctgaaagccgtggttg

SEQ ID NO: 380289 - DNA, 25 bp, Mus musculus
ggagtcatcttacttacgtctgcga

SEQ ID NO: 380290 - DNA, 25 bp, Mus musculus
ccgcagactgtcctctcggaggaaa

SEQ ID NO: 380291 - DNA, 25 bp, Mus musculus
tcacggtaaatgaagccgcagactg

SEQ ID NO: 380292 - DNA, 25 bp, Mus musculus
cttcccgggactgcacgcaggagag

SEQ ID NO: 380293 - DNA, 25 bp, Mus musculus
ggacagatcgaagcccgggttcatg

SEQ ID NO: 380294 - DNA, 25 bp, Mus musculus
gttccggcgggacagatcgaagccc

SEQ ID NO: 380295 - DNA, 25 bp, Mus musculus
tcagctcgaagtcctcctgcgggtt

SEQ ID NO: 380296 - DNA, 25 bp, Mus musculus
ccctcaccttgtagacgtcgccgta

SEQ ID NO: 380297 - DNA, 25 bp, Mus musculus
gccctcccaggaacgcagcggctcc

SEQ ID NO: 380298 - DNA, 25 bp, Mus musculus
accggggttcgtcacacagaccctg

SEQ ID NO: 380299 - DNA, 25 bp, Mus musculus
ccagcaccggggttcgtcacacaga

SEQ ID NO: 380300 - DNA, 25 bp, Mus musculus
cgtaggtttgtcaagcgccaagccc

SEQ ID NO: 380301 - DNA, 25 bp, Mus musculus
ccggagaggcacgtaggtttgtcaa

SEQ ID NO: 380302 - DNA, 25 bp, Mus musculus
ctatgatcccaggtcccggagaggc

SEQ ID NO: 380303 - DNA, 25 bp, Mus musculus
agccaccggggcctatgatcccagg

SEQ ID NO: 380304 - DNA, 25 bp, Mus musculus
gcggacagtagctcccagccaccgg

SEQ ID NO: 380305 - DNA, 25 bp, Mus musculus
tgcgctggatcagctcgaagtcctc

SEQ ID NO: 380306 - DNA, 25 bp, Mus musculus
ctactttctgggcatcgaccgggac

SEQ ID NO: 380307 - DNA, 25 bp, Mus musculus
cgccgaggccaagtgcattgtgtct

SEQ ID NO: 380308 - DNA, 25 bp, Mus musculus
tcacggcgctaagcctcggcctcag

SEQ ID NO: 380309 - DNA, 25 bp, Mus musculus
gggctgctcgtcacggccatcttca

SEQ ID NO: 380310 - DNA, 25 bp, Mus musculus
ttcaccgaccactggtacgagaccg

SEQ ID NO: 380311 - DNA, 25 bp, Mus musculus
cccggatcagaagaaccgcctgatg

SEQ ID NO: 380312 - DNA, 25 bp, Mus musculus
agaaccgcctgatgccgctgtcgca

SEQ ID NO: 380313 - DNA, 25 bp, Mus musculus
agtcctggcgctcgcttctggggct

SEQ ID NO: 380314 - DNA, 25 bp, Mus musculus
agtgtggccggccactgttcgccac

SEQ ID NO: 380315 - DNA, 25 bp, Mus musculus
ctctggaggaagtgctactttctgg

SEQ ID NO: 380316 - DNA, 25 bp, Mus musculus
tctgggcatcgaccgggacatcgac

SEQ ID NO: 380317 - DNA, 25 bp, Mus musculus
gggacatcgacaccctcatcctgaa

SEQ ID NO: 380318 - DNA, 25 bp, Mus musculus
tcgacaccctcatcctgaaaggtga

SEQ ID NO: 380319 - DNA, 25 bp, Mus musculus
ccacctactcgggcctctggaggaa

SEQ ID NO: 380320 - DNA, 25 bp, Mus musculus
tctatggggcgtcccggaaactaca

SEQ ID NO: 380321 - DNA, 25 bp, Mus musculus
tgcaggcccgccctctatggggcgt

SEQ ID NO: 380322 - DNA, 25 bp, Mus musculus
gcaccggagcgtcgcctttgcaggc

SEQ ID NO: 380323 - DNA, 25 bp, Mus musculus
gaacgcgcaccggagcgtcgccttt

SEQ ID NO: 380324 - DNA, 25 bp, Mus musculus
cgcctgggagccttcagtggaacgc

SEQ ID NO: 380325 - DNA, 25 bp, Mus musculus
cccgagacccggtcacgtgagctcg

SEQ ID NO: 380326 - DNA, 25 bp, Mus musculus
gcctgggctacagccatggcgctca

SEQ ID NO: 380327 - DNA, 25 bp, Mus musculus
tcagaacccgggtctgcctgggcta

SEQ ID NO: 380328 - DNA, 25 bp, Mus musculus
ccgcggtgcagaagaaccgggcgcc

SEQ ID NO: 380329 - DNA, 25 bp, Mus musculus
atcaagaacggctccaggccgcggc

SEQ ID NO: 380330 - DNA, 25 bp, Mus musculus
gcgcgcgcacctcccgcatcaagaa

SEQ ID NO: 380331 - DNA, 25 bp, Mus musculus
tgagcccgactcacctgcgtggctt

SEQ ID NO: 380332 - DNA, 25 bp, Mus musculus
acggtgagcccgactcacctgcgtg

SEQ ID NO: 380333 - DNA, 25 bp, Mus musculus
agccttcagtggaacgcgcaccgga

SEQ ID NO: 380334 - DNA, 25 bp, Mus musculus
cttttgagacagctctggatcagga

SEQ ID NO: 380335 - DNA, 25 bp, Mus musculus
tggatcaggaggaggtcgctcccat

SEQ ID NO: 380336 - DNA, 25 bp, Mus musculus
ggtcgctcccatcctctgctggtaa

SEQ ID NO: 380337 - DNA, 25 bp, Mus musculus
ctggatttccctgactgtggggccc

SEQ ID NO: 380338 - DNA, 25 bp, Mus musculus
gggcgcgctcactcccttttgagac

SEQ ID NO: 380339 - DNA, 25 bp, Mus musculus
tcctctgctggtaacacaaagccgg

SEQ ID NO: 380340 - DNA, 25 bp, Mus musculus
ctggtaacacaaagccggcggcggc

SEQ ID NO: 380341 - DNA, 25 bp, Mus musculus
gcagcctcgcactggctcgcacgag

SEQ ID NO: 380342 - DNA, 25 bp, Mus musculus
gtgacaaccaccggggtctcctctg

SEQ ID NO: 380343 - DNA, 25 bp, Mus musculus
tgcgtacaaaccacacaagccagcg

SEQ ID NO: 380344 - DNA, 25 bp, Mus musculus
ggtctcctctgctctgccagtggct

SEQ ID NO: 380345 - DNA, 25 bp, Mus musculus
tcactcccttttgagacagctctgg

SEQ ID NO: 380346 - DNA, 25 bp, Mus musculus
tctgccagtggctggatttccctga

SEQ ID NO: 380347 - DNA, 25 bp, Mus musculus
ccgcagtgcgtacaaaccacacaag

SEQ ID NO: 380348 - DNA, 25 bp, Mus musculus
atcacaccctgaacccgggctgtcc

SEQ ID NO: 380349 - DNA, 25 bp, Mus musculus
cgctctcgcaggtgcggggcagcct

SEQ ID NO: 380350 - DNA, 25 bp, Mus musculus
ttcatcacaccctgaacccgggctg

SEQ ID NO: 380351 - DNA, 25 bp, Mus musculus
cagcctcacccgcagaaggaggaac

SEQ ID NO: 380352 - DNA, 25 bp, Mus musculus
agcctcacccgcagaaggaggaacc

SEQ ID NO: 380353 - DNA, 25 bp, Mus musculus
ggaggaacccctgcgcactgcactg

SEQ ID NO: 380354 - DNA, 25 bp, Mus musculus
gaggcagcgtgtacccctgagatcc

SEQ ID NO: 380355 - DNA, 25 bp, Mus musculus
gcggcttgccccttggagcccgtta

SEQ ID NO: 380356 - DNA, 25 bp, Mus musculus
caccaggtcggccagctccgctttc

SEQ ID NO: 380357 - DNA, 25 bp, Mus musculus
cggccagctccgctttcggcctccg

SEQ ID NO: 380358 - DNA, 25 bp, Mus musculus
cctccgggtcccgttatccagcctg

SEQ ID NO: 380359 - DNA, 25 bp, Mus musculus
gtcccgttatccagcctggcctcgg

SEQ ID NO: 380360 - DNA, 25 bp, Mus musculus
cctcgggcttggaagccctgcgcgc

SEQ ID NO: 380361 - DNA, 25 bp, Mus musculus
cccagtgcgccgcccttcatcacac

SEQ ID NO: 380362 - DNA, 25 bp, Mus musculus
taaggctgtgtaccgggtccgcctg

SEQ ID NO: 380363 - DNA, 25 bp, Mus musculus
ccgcaacgtgtctggcgcgcagtac

SEQ ID NO: 380364 - DNA, 25 bp, Mus musculus
cggtggcgcttaaagcagtggactt

SEQ ID NO: 380365 - DNA, 25 bp, Mus musculus
caacgtgctgcaggtacgacagtgg

SEQ ID NO: 380366 - DNA, 25 bp, Mus musculus
cccaacgtgctgcaggtacgacagt

SEQ ID NO: 380367 - DNA, 25 bp, Mus musculus
gctgctcaaagagatggtgctgctg

SEQ ID NO: 380368 - DNA, 25 bp, Mus musculus
ggcccacaagctgctcaaagagatg

SEQ ID NO: 380369 - DNA, 25 bp, Mus musculus
tggcggcccacaagctgctcaaaga

SEQ ID NO: 380370 - DNA, 25 bp, Mus musculus
cagtggacttcagcggccacgatct

SEQ ID NO: 380371 - DNA, 25 bp, Mus musculus
cttaaagcagtggacttcagcggcc

SEQ ID NO: 380372 - DNA, 25 bp, Mus musculus
tgggctcaggctacactaaggctgt

SEQ ID NO: 380373 - DNA, 25 bp, Mus musculus
cccgcgcataggctgcgccgcgctc

SEQ ID NO: 380374 - DNA, 25 bp, Mus musculus
cagtacgtgggctcaggctacacta

SEQ ID NO: 380375 - DNA, 25 bp, Mus musculus
acactaaggctgtgtaccgggtccg

SEQ ID NO: 380376 - DNA, 25 bp, Mus musculus
agcctgagacctgtaccgctgtgcc

SEQ ID NO: 380377 - DNA, 25 bp, Mus musculus
ctgagcacccacacgctggcgggga

SEQ ID NO: 380378 - DNA, 25 bp, Mus musculus
cgcgggaggaatcccagctatttcc

SEQ ID NO: 380379 - DNA, 25 bp, Mus musculus
gaggaatcccagctatttcctctgc

SEQ ID NO: 380380 - DNA, 25 bp, Mus musculus
tcgcctccctccgagtgagcgagcg

SEQ ID NO: 380381 - DNA, 25 bp, Mus musculus
gaaaccggcctttccagcagcctga

SEQ ID NO: 380382 - DNA, 25 bp, Mus musculus
ttccagcagcctgagacctgtaccg

SEQ ID NO: 380383 - DNA, 25 bp, Mus musculus
ctgagacctgtaccgctgtgccagc

SEQ ID NO: 380384 - DNA, 25 bp, Mus musculus
gacctgtaccgctgtgccagccaga

SEQ ID NO: 380385 - DNA, 25 bp, Mus musculus
taccgctgtgccagccagaacctgt

SEQ ID NO: 380386 - DNA, 25 bp, Mus musculus
aaagccgggcggacattagcgccca

SEQ ID NO: 380387 - DNA, 25 bp, Mus musculus
cattagcgcccacgcgagtgtcatg

SEQ ID NO: 380388 - DNA, 25 bp, Mus musculus
ggcctttccagcagcctgagacctg

SEQ ID NO: 380389 - DNA, 25 bp, Mus musculus
gccgcgggaggaatcccagctattt

SEQ ID NO: 380390 - DNA, 25 bp, Mus musculus
ggggcgctgaatgaagcgcccgccc

SEQ ID NO: 380391 - DNA, 25 bp, Mus musculus
gatggacggtttcgccggcagcctc

SEQ ID NO: 380392 - DNA, 25 bp, Mus musculus
cccgcaagatggacggtttcgccgg

SEQ ID NO: 380393 - DNA, 25 bp, Mus musculus
ggatcggaagcgtgacggcgtgcgc

SEQ ID NO: 380394 - DNA, 25 bp, Mus musculus
ccgccgcacggtcggggcgctgaat

SEQ ID NO: 380395 - DNA, 25 bp, Mus musculus
cgccgggcgacgctgagaaccggcg

SEQ ID NO: 380396 - DNA, 25 bp, Mus musculus
accgactgaccctcggggctgacgg

SEQ ID NO: 380397 - DNA, 25 bp, Mus musculus
tgattgaccgactgaccctcggggc

SEQ ID NO: 380398 - DNA, 25 bp, Mus musculus
tcaacctgattgaccgactgaccct

SEQ ID NO: 380399 - DNA, 25 bp, Mus musculus
ggctctcaacctgattgaccgactg

SEQ ID NO: 380400 - DNA, 25 bp, Mus musculus
gcgcggctctcaacctgattgaccg

SEQ ID NO: 380401 - DNA, 25 bp, Mus musculus
acggctgcggcttaggagagagaga

SEQ ID NO: 380402 - DNA, 25 bp, Mus musculus
cggcgctcacggctgcggcttagga

SEQ ID NO: 380403 - DNA, 25 bp, Mus musculus
caagatggacggtttcgccggcagc

SEQ ID NO: 380404 - DNA, 25 bp, Mus musculus
gactgtctagagaacgcctgactta

SEQ ID NO: 380405 - DNA, 25 bp, Mus musculus
accgctccaagcctgcgtggttaag

SEQ ID NO: 380406 - DNA, 25 bp, Mus musculus
cggcagaaacccttcacggctcgaa

SEQ ID NO: 380407 - DNA, 25 bp, Mus musculus
tctgcgtgaaactgctaaacttgta

SEQ ID NO: 380408 - DNA, 25 bp, Mus musculus
cttgtagtacatgttggcggaggcc

SEQ ID NO: 380409 - DNA, 25 bp, Mus musculus
tgtgcgaccgccctagaaaaggacc

SEQ ID NO: 380410 - DNA, 25 bp, Mus musculus
aaagctcagcgcaaggaccttaatc

SEQ ID NO: 380411 - DNA, 25 bp, Mus musculus
aaaccgcgctttctcaagacctaga

SEQ ID NO: 380412 - DNA, 25 bp, Mus musculus
agaggctgtgttcaggcttcccgaa

SEQ ID NO: 380413 - DNA, 25 bp, Mus musculus
ggcttcccgaaaactcaggcttctc

SEQ ID NO: 380414 - DNA, 25 bp, Mus musculus
aggcttctctgtaccactcacttgg

SEQ ID NO: 380415 - DNA, 25 bp, Mus musculus
ctcacttggatgtgggcagtgccaa

SEQ ID NO: 380416 - DNA, 25 bp, Mus musculus
cgacacagtcggtcagagcgagttc

SEQ ID NO: 380417 - DNA, 25 bp, Mus musculus
acatagcctcctacgcaacgtcggg

SEQ ID NO: 380418 - DNA, 25 bp, Mus musculus
aggcctggccatcgagccacggtcg

SEQ ID NO: 380419 - DNA, 25 bp, Mus musculus
ctctgcctgtccctggagaggagtg

SEQ ID NO: 380420 - DNA, 25 bp, Mus musculus
gcggtgctcccagtttctccgaaac

SEQ ID NO: 380421 - DNA, 25 bp, Mus musculus
ggcggtgctcccagtttctccgaaa

SEQ ID NO: 380422 - DNA, 25 bp, Mus musculus
agtttctgctgacgcagccgcgctc

SEQ ID NO: 380423 - DNA, 25 bp, Mus musculus
aaagtttctgctgacgcagccgcgc

SEQ ID NO: 380424 - DNA, 25 bp, Mus musculus
tcccaaagtttctgctgacgcagcc

SEQ ID NO: 380425 - DNA, 25 bp, Mus musculus
cactcccaaagtttctgctgacgca

SEQ ID NO: 380426 - DNA, 25 bp, Mus musculus
ggctcactcccaaagtttctgctga

SEQ ID NO: 380427 - DNA, 25 bp, Mus musculus
gggctcactcccaaagtttctgctg

SEQ ID NO: 380428 - DNA, 25 bp, Mus musculus
agagggctcactcccaaagtttctg

SEQ ID NO: 380429 - DNA, 25 bp, Mus musculus
cccagagggctcactcccaaagttt

SEQ ID NO: 380430 - DNA, 25 bp, Mus musculus
atcgagccacggtcggggctgtgca

SEQ ID NO: 380431 - DNA, 25 bp, Mus musculus
ctgcctgtccctggagaggagtgcc

SEQ ID NO: 380432 - DNA, 25 bp, Mus musculus
tgggtaaacagacacgtggaaaatc

SEQ ID NO: 380433 - DNA, 25 bp, Mus musculus
caagacactaaagttggccggagta

SEQ ID NO: 380434 - DNA, 25 bp, Mus musculus
cgcctgcgtgttctgtaccatttaa

SEQ ID NO: 380435 - DNA, 25 bp, Mus musculus
gccatcaactgggactgaggtctta

SEQ ID NO: 380436 - DNA, 25 bp, Mus musculus
tttcccgccgaagaactgtgtgctg

SEQ ID NO: 380437 - DNA, 25 bp, Mus musculus
ggaattacacacaggcagcccagga

SEQ ID NO: 380438 - DNA, 25 bp, Mus musculus
tccggatggataggcctttgtcatg

SEQ ID NO: 380439 - DNA, 25 bp, Mus musculus
ggcagttctctgcacttggcatttc

SEQ ID NO: 380440 - DNA, 25 bp, Mus musculus
ggatgcatccggcaaaacctggttc

SEQ ID NO: 380441 - DNA, 25 bp, Mus musculus
aaaatcccagggatcgtcgcctagc

SEQ ID NO: 380442 - DNA, 25 bp, Mus musculus
accgagtttttctgcgccaaaggca

SEQ ID NO: 380443 - DNA, 25 bp, Mus musculus
cgctcagtaaaagcaaccgagtttt

SEQ ID NO: 380444 - DNA, 25 bp, Mus musculus
gatgcaatcggctctgcgctcagta

SEQ ID NO: 380445 - DNA, 25 bp, Mus musculus
cgccctgcccaactctggggaaaga

SEQ ID NO: 380446 - DNA, 25 bp, Mus musculus
gcgccgcggcgggaacagcagcctg

SEQ ID NO: 380447 - DNA, 25 bp, Mus musculus
cgcgtttccggcctagggtctgcac

SEQ ID NO: 380448 - DNA, 25 bp, Mus musculus
cctagggtctgcactgtgtggagtc

SEQ ID NO: 380449 - DNA, 25 bp, Mus musculus
tctgcactgtgtggagtcgcgtggt

SEQ ID NO: 380450 - DNA, 25 bp, Mus musculus
agtcgcgtggtgcagacttgcctgc

SEQ ID NO: 380451 - DNA, 25 bp, Mus musculus
cgcgtggtgcagacttgcctgcaga

SEQ ID NO: 380452 - DNA, 25 bp, Mus musculus
gtggtgcagacttgcctgcagagca

SEQ ID NO: 380453 - DNA, 25 bp, Mus musculus
tgcagacttgcctgcagagcacacg

SEQ ID NO: 380454 - DNA, 25 bp, Mus musculus
cagacttgcctgcagagcacacggc

SEQ ID NO: 380455 - DNA, 25 bp, Mus musculus
acttgcctgcagagcacacggccgg

SEQ ID NO: 380456 - DNA, 25 bp, Mus musculus
ctgcagagcacacggccggggtctc

SEQ ID NO: 380457 - DNA, 25 bp, Mus musculus
ccgtgaacccccaaagctacaggtg

SEQ ID NO: 380458 - DNA, 25 bp, Mus musculus
ttccggcctagggtctgcactgtgt

SEQ ID NO: 380459 - DNA, 25 bp, Mus musculus
cccaaagctacaggtgccaggcggg

SEQ ID NO: 380460 - DNA, 25 bp, Mus musculus
ttgtagaaggagagctcgcacatcc

SEQ ID NO: 380461 - DNA, 25 bp, Mus musculus
cagcgggaagtccttgagcagctcc

SEQ ID NO: 380462 - DNA, 25 bp, Mus musculus
gtcgtcgcacacttcgagcacgtcg

SEQ ID NO: 380463 - DNA, 25 bp, Mus musculus
aagaagtactcgttgcgctcccggt

SEQ ID NO: 380464 - DNA, 25 bp, Mus musculus
atccagactgcggttgtcagcaacc

SEQ ID NO: 380465 - DNA, 25 bp, Mus musculus
ccgcgcacgtacagcaggatgaagc

SEQ ID NO: 380466 - DNA, 25 bp, Mus musculus
ctcccagagggcgaacgttagccga

SEQ ID NO: 380467 - DNA, 25 bp, Mus musculus
ccgtccagaggcgaaaggcaaagtg

SEQ ID NO: 380468 - DNA, 25 bp, Mus musculus
cagtagatcatctcgttgtagaagg

SEQ ID NO: 380469 - DNA, 25 bp, Mus musculus
ggcagcagtactccaggtgcgcacc

SEQ ID NO: 380470 - DNA, 25 bp, Mus musculus
tggcggagtacctgctccggtcatc

SEQ ID NO: 380471 - DNA, 25 bp, Mus musculus
tggacacgatcacgaacaccacgga

SEQ ID NO: 380472 - DNA, 25 bp, Mus musculus
tgctggcgcacagcaccaccatgga

SEQ ID NO: 380473 - DNA, 25 bp, Mus musculus
ctccgagtgtcggtcgaagaagtac

SEQ ID NO: 380474 - DNA, 25 bp, Mus musculus
cttctggggacacgcatcggacacc

SEQ ID NO: 380475 - DNA, 25 bp, Mus musculus
catgtaccgggtcggaggtaggaag

SEQ ID NO: 380476 - DNA, 25 bp, Mus musculus
agagacgctcggagtggctgaacct

SEQ ID NO: 380477 - DNA, 25 bp, Mus musculus
tcggggccaggcctcttctggggac

SEQ ID NO: 380478 - DNA, 25 bp, Mus musculus
gggcagcgcacgcttactgccagca

SEQ ID NO: 380479 - DNA, 25 bp, Mus musculus
gggcacagccccctccctcggtgtc

SEQ ID NO: 380480 - DNA, 25 bp, Mus musculus
cccgctcggcgtcgctctgccggcg

SEQ ID NO: 380481 - DNA, 25 bp, Mus musculus
cctggtgtgctaccccgaggctagt

SEQ ID NO: 380482 - DNA, 25 bp, Mus musculus
ctgaccctggtgtgctaccccgagg

SEQ ID NO: 380483 - DNA, 25 bp, Mus musculus
accctggttcttccacagcccctga

SEQ ID NO: 380484 - DNA, 25 bp, Mus musculus
ctcggagtggctgaacctctgtccc

SEQ ID NO: 380485 - DNA, 25 bp, Mus musculus
cgctcggagtggctgaacctctgtc

SEQ ID NO: 380486 - DNA, 25 bp, Mus musculus
agacgctcggagtggctgaacctct

SEQ ID NO: 380487 - DNA, 25 bp, Mus musculus
cgcacgcttactgccagcagcccgg

SEQ ID NO: 380488 - DNA, 25 bp, Mus musculus
tggcagatgcgcatgctccaccgac

SEQ ID NO: 380489 - DNA, 25 bp, Mus musculus
tagagccttcgcaaggccgccacag

SEQ ID NO: 380490 - DNA, 25 bp, Mus musculus
gccgggtctgatagagccttcgcaa

SEQ ID NO: 380491 - DNA, 25 bp, Mus musculus
caccgacgccttgccgggtctgata

SEQ ID NO: 380492 - DNA, 25 bp, Mus musculus
ccacaggtggcagatgcgcatgctc

SEQ ID NO: 380493 - DNA, 25 bp, Mus musculus
ccctgagtccggtccgcagttgcgg

SEQ ID NO: 380494 - DNA, 25 bp, Mus musculus
gcactggcttgttgccctgagtccg

SEQ ID NO: 380495 - DNA, 25 bp, Mus musculus
acgggagccgcacggtcgctctgtc

SEQ ID NO: 380496 - DNA, 25 bp, Mus musculus
ttcctcgagcggacgggagccgcac

SEQ ID NO: 380497 - DNA, 25 bp, Mus musculus
atccgggttcgcttcctcgagcgga

SEQ ID NO: 380498 - DNA, 25 bp, Mus musculus
gctgcccaccctcgcgccatcggaa

SEQ ID NO: 380499 - DNA, 25 bp, Mus musculus
gagaagcccagccaggttccgctgc

SEQ ID NO: 380500 - DNA, 25 bp, Mus musculus
tcgggatgagaagcccagccaggtt

SEQ ID NO: 380501 - DNA, 25 bp, Mus musculus
gaggaccctcgggatgagaagccca

SEQ ID NO: 380502 - DNA, 25 bp, Mus musculus
cgagccgcactgaggggctttcttc

SEQ ID NO: 380503 - DNA, 25 bp, Mus musculus
tggcagaagacgctgaatcgccctc

SEQ ID NO: 380504 - DNA, 25 bp, Mus musculus
cgcaaagatgggtcgtgaggtcacc

SEQ ID NO: 380505 - DNA, 25 bp, Mus musculus
cttaattagctggattagggcggga

SEQ ID NO: 380506 - DNA, 25 bp, Mus musculus
ctgcggaccttaattagctggatta

SEQ ID NO: 380507 - DNA, 25 bp, Mus musculus
gccctgcggaccttaattagctgga

SEQ ID NO: 380508 - DNA, 25 bp, Mus musculus
ctttcttcacggccgtgggaaagtg

SEQ ID NO: 380509 - DNA, 25 bp, Mus musculus
tctgttctccgagccgcactgaggg

SEQ ID NO: 380510 - DNA, 25 bp, Mus musculus
ttgcccgcgcaaagatgggtcgtga

SEQ ID NO: 380511 - DNA, 25 bp, Mus musculus
ccacggtggcagaagacgctgaatc

SEQ ID NO: 380512 - DNA, 25 bp, Mus musculus
gaagacgctgaatcgccctctgttc

SEQ ID NO: 380513 - DNA, 25 bp, Mus musculus
gctgaatcgccctctgttctccgag

SEQ ID NO: 380514 - DNA, 25 bp, Mus musculus
gactgccctgcggaccttaattagc

SEQ ID NO: 380515 - DNA, 25 bp, Mus musculus
cggcagaagacacggaggcccacgg

SEQ ID NO: 380516 - DNA, 25 bp, Mus musculus
aattgccgggctgctaatgctcagc

SEQ ID NO: 380517 - DNA, 25 bp, Mus musculus
cgcagggtctcttttgcgggctaca

SEQ ID NO: 380518 - DNA, 25 bp, Mus musculus
gagaacggaccgaccgcacctagga

SEQ ID NO: 380519 - DNA, 25 bp, Mus musculus
aacgtcagcgccatgggagaacgga

SEQ ID NO: 380520 - DNA, 25 bp, Mus musculus
gggacaaaggcgctcattcacccgc

SEQ ID NO: 380521 - DNA, 25 bp, Mus musculus
tcggccttcacagggtcggggacaa

SEQ ID NO: 380522 - DNA, 25 bp, Mus musculus
gcgcataattaatcggccttcacag

SEQ ID NO: 380523 - DNA, 25 bp, Mus musculus
caaggacacgtccaaaacgctgggt

SEQ ID NO: 380524 - DNA, 25 bp, Mus musculus
aatgctcagccctttgtgcgtccgc

SEQ ID NO: 380525 - DNA, 25 bp, Mus musculus
ccgatacgttcgagctgtggaaatg

SEQ ID NO: 380526 - DNA, 25 bp, Mus musculus
tgctgaaagcgtcgaggtttctgtc

SEQ ID NO: 380527 - DNA, 25 bp, Mus musculus
caaaacgctgggtaattgccgggct

SEQ ID NO: 380528 - DNA, 25 bp, Mus musculus
gcgcggtgtcaacgagacaaggaca

SEQ ID NO: 380529 - DNA, 25 bp, Mus musculus
tcccgcgctccgaggcgcataatta

SEQ ID NO: 380530 - DNA, 25 bp, Mus musculus
agtcggggctaactgcagagtgaac

SEQ ID NO: 380531 - DNA, 25 bp, Mus musculus
agggatttctccgtctgccaaaggg

SEQ ID NO: 380532 - DNA, 25 bp, Mus musculus
attgaggtttgccagggatttctcc

SEQ ID NO: 380533 - DNA, 25 bp, Mus musculus
tccagcatgttgttcagattgaggt

SEQ ID NO: 380534 - DNA, 25 bp, Mus musculus
taccgccttcttgtccagcatgttg

SEQ ID NO: 380535 - DNA, 25 bp, Mus musculus
aacttcggcgagcagctgcccggac

SEQ ID NO: 380536 - DNA, 25 bp, Mus musculus
ctggccgtaggaggccagaccgcct

SEQ ID NO: 380537 - DNA, 25 bp, Mus musculus
aaggctccttgagctggccgtagga

SEQ ID NO: 380538 - DNA, 25 bp, Mus musculus
tgctctccttggtgaccagcgccgt

SEQ ID NO: 380539 - DNA, 25 bp, Mus musculus
gcggtcccgaaatttgctctccttg

SEQ ID NO: 380540 - DNA, 25 bp, Mus musculus
gttctcgctgaacgagcggtcccga

SEQ ID NO: 380541 - DNA, 25 bp, Mus musculus
gtcttgtagcgcgtggagttgatct

SEQ ID NO: 380542 - DNA, 25 bp, Mus musculus
actggcacttctcgccgtacttgca

SEQ ID NO: 380543 - DNA, 25 bp, Mus musculus
ggctgcctgcttaccttgcacaaga

SEQ ID NO: 380544 - DNA, 25 bp, Mus musculus
gctgccctcacaccgggatctggta

SEQ ID NO: 380545 - DNA, 25 bp, Mus musculus
tcacaccgggatctggtaaccgctg

SEQ ID NO: 380546 - DNA, 25 bp, Mus musculus
gtaaccgctgccctcacacggggat

SEQ ID NO: 380547 - DNA, 25 bp, Mus musculus
ggatctggtaaatgctgccctcaca

SEQ ID NO: 380548 - DNA, 25 bp, Mus musculus
gggatctggtaaatgctgccctcac

SEQ ID NO: 380549 - DNA, 25 bp, Mus musculus
cgggatctggtaaatgctgccctca

SEQ ID NO: 380550 - DNA, 25 bp, Mus musculus
ccctcacaccgggatctggtaaatg

SEQ ID NO: 380551 - DNA, 25 bp, Mus musculus
gggatctggtaaccgctgccctcac

SEQ ID NO: 380552 - DNA, 25 bp, Mus musculus
cgggatctggtaaccgctgccctca

SEQ ID NO: 380553 - DNA, 25 bp, Mus musculus
acaccgggatctggtaaccgctgcc

SEQ ID NO: 380554 - DNA, 25 bp, Mus musculus
ggatctggtaactgctgccctcaca

SEQ ID NO: 380555 - DNA, 25 bp, Mus musculus
cacaccgggatctggtaaccgctgc

SEQ ID NO: 380556 - DNA, 25 bp, Mus musculus
ggggatctggtaaccgctgccctca

SEQ ID NO: 380557 - DNA, 25 bp, Mus musculus
gctgccctcacacggggatctggta

SEQ ID NO: 380558 - DNA, 25 bp, Mus musculus
ggaagcccgtcaagtctaccgcgtc

SEQ ID NO: 380559 - DNA, 25 bp, Mus musculus
tctgcgcgttctaagggtaaacgtg

SEQ ID NO: 380560 - DNA, 25 bp, Mus musculus
tgtgacgtcatcaaagagggcgttt

SEQ ID NO: 380561 - DNA, 25 bp, Mus musculus
agtgccgctcctccaatcagaagtg

SEQ ID NO: 380562 - DNA, 25 bp, Mus musculus
tggtgcgcgatccaaaaaccggtcc

SEQ ID NO: 380563 - DNA, 25 bp, Mus musculus
aaagcgtcgccacctctggacgaga

SEQ ID NO: 380564 - DNA, 25 bp, Mus musculus
tgcccgaggacgtctgcaaagcgtc

SEQ ID NO: 380565 - DNA, 25 bp, Mus musculus
tccatggagacctcagcgcccggaa

SEQ ID NO: 380566 - DNA, 25 bp, Mus musculus
aaacgtggttcaagggctgtctgtc

SEQ ID NO: 380567 - DNA, 25 bp, Mus musculus
cctcccacgtggagtccaaagactg

SEQ ID NO: 380568 - DNA, 25 bp, Mus musculus
ggcatctgcccataggtgccacttg

SEQ ID NO: 380569 - DNA, 25 bp, Mus musculus
ccggttcagcctgatgggcatctgc

SEQ ID NO: 380570 - DNA, 25 bp, Mus musculus
gcccagagccgaaaatcccggttca

SEQ ID NO: 380571 - DNA, 25 bp, Mus musculus
ctggaagctggcacggaaatatcgc

SEQ ID NO: 380572 - DNA, 25 bp, Mus musculus
atttttaacacctctgcttgcccga

SEQ ID NO: 380573 - DNA, 25 bp, Mus musculus
gtcttccgattagctactccggccg

SEQ ID NO: 380574 - DNA, 25 bp, Mus musculus
actggcgagccggaacatcaggcgc

SEQ ID NO: 380575 - DNA, 25 bp, Mus musculus
ggacggctctacgttcctcgggctc

SEQ ID NO: 380576 - DNA, 25 bp, Mus musculus
gggctcctgtgacgttctgttagaa

SEQ ID NO: 380577 - DNA, 25 bp, Mus musculus
gacgttctgttagaaaagcagggcc

SEQ ID NO: 380578 - DNA, 25 bp, Mus musculus
cgccagagcgccctaaggtgacata

SEQ ID NO: 380579 - DNA, 25 bp, Mus musculus
gccttgggtcccatcggcgatgcaa

SEQ ID NO: 380580 - DNA, 25 bp, Mus musculus
cccatcggcgatgcaacagttcggc

SEQ ID NO: 380581 - DNA, 25 bp, Mus musculus
cgatgcaacagttcggcctgcgctt

SEQ ID NO: 380582 - DNA, 25 bp, Mus musculus
gcgcttctgatgagccgtgctttga

SEQ ID NO: 380583 - DNA, 25 bp, Mus musculus
ccgggaccacagttctccagctttt

SEQ ID NO: 380584 - DNA, 25 bp, Mus musculus
accacagttctccagcttttcattt

SEQ ID NO: 380585 - DNA, 25 bp, Mus musculus
gtcggctgcgtcttccgattagcta

SEQ ID NO: 380586 - DNA, 25 bp, Mus musculus
tccaacgacagacattaaagccctc

SEQ ID NO: 380587 - DNA, 25 bp, Mus musculus
gtcctgcctccaacgacagacatta

SEQ ID NO: 380588 - DNA, 25 bp, Mus musculus
aggaagggcgcaaccacacgccggc

SEQ ID NO: 380589 - DNA, 25 bp, Mus musculus
agcctggggacaccggcagcctcgt

SEQ ID NO: 380590 - DNA, 25 bp, Mus musculus
ctgggtcctaaaggcgccgtccagc

SEQ ID NO: 380591 - DNA, 25 bp, Mus musculus
aaagccctcaatgcctacggacaag

SEQ ID NO: 380592 - DNA, 25 bp, Mus musculus
tacggacaagccttccgggcctgta

SEQ ID NO: 380593 - DNA, 25 bp, Mus musculus
gggcagcggtacctccacggctact

SEQ ID NO: 380594 - DNA, 25 bp, Mus musculus
gcgctcgccatcttgcttcaatctg

SEQ ID NO: 380595 - DNA, 25 bp, Mus musculus
cttcaatctgggtcctaaaggcgcc

SEQ ID NO: 380596 - DNA, 25 bp, Mus musculus
acacgccggcccttctgcaagatgg

SEQ ID NO: 380597 - DNA, 25 bp, Mus musculus
cgcatgcacgccgaggtgtgctaca

SEQ ID NO: 380598 - DNA, 25 bp, Mus musculus
gtgtgctacaggaagggcgcaacca

SEQ ID NO: 380599 - DNA, 25 bp, Mus musculus
ccggcccttctgcaagatggagcct

SEQ ID NO: 380600 - DNA, 25 bp, Mus musculus
ccacctgcaggacgtaggagaagca

SEQ ID NO: 380601 - DNA, 25 bp, Mus musculus
cagagggccagcatcgctgtgtatc

SEQ ID NO: 380602 - DNA, 25 bp, Mus musculus
gcatcgctgtgtatcgcaacgtctc

SEQ ID NO: 380603 - DNA, 25 bp, Mus musculus
gtatcgcaacgtctcgcgcacagtg

SEQ ID NO: 380604 - DNA, 25 bp, Mus musculus
gtctcgcgcacagtgaggctgctca

SEQ ID NO: 380605 - DNA, 25 bp, Mus musculus
ggctgctcagaaaaacgtcgctctg

SEQ ID NO: 380606 - DNA, 25 bp, Mus musculus
gaaaaacgtcgctctgcaggaaagg

SEQ ID NO: 380607 - DNA, 25 bp, Mus musculus
gcagcctcccggagatggcgtccag

SEQ ID NO: 380608 - DNA, 25 bp, Mus musculus
catcagggtcgtcgaaatcccgggg

SEQ ID NO: 380609 - DNA, 25 bp, Mus musculus
tgcaggacgtaggagaagcagtctt

SEQ ID NO: 380610 - DNA, 25 bp, Mus musculus
ggagaagcagtcttggaactggtcc

SEQ ID NO: 380611 - DNA, 25 bp, Mus musculus
cttggaactggtccctgcgcagctc

SEQ ID NO: 380612 - DNA, 25 bp, Mus musculus
tgcgcagctcgcagccattcacaaa

SEQ ID NO: 380613 - DNA, 25 bp, Mus musculus
ggggacatcagggtcgtcgaaatcc

SEQ ID NO: 380614 - DNA, 25 bp, Mus musculus
gcggctcacccaggcgcgtttctct

SEQ ID NO: 380615 - DNA, 25 bp, Mus musculus
agcggcgcacacaagggtccacggc

SEQ ID NO: 380616 - DNA, 25 bp, Mus musculus
ccctagaatggtctaagactcccgc

SEQ ID NO: 380617 - DNA, 25 bp, Mus musculus
tcccgggcctaggtgctggtgtccc

SEQ ID NO: 380618 - DNA, 25 bp, Mus musculus
ctaggtgctggtgtcccgcagctgc

SEQ ID NO: 380619 - DNA, 25 bp, Mus musculus
ccagtcactccgctggggagcctac

SEQ ID NO: 380620 - DNA, 25 bp, Mus musculus
gagtggcaccgctccgctttgcgca

SEQ ID NO: 380621 - DNA, 25 bp, Mus musculus
cgattcgctactttagggagcctga

SEQ ID NO: 380622 - DNA, 25 bp, Mus musculus
ctccgctttgcgcaggcagaggaga

SEQ ID NO: 380623 - DNA, 25 bp, Mus musculus
agaggagcccagttactcggcgcca

SEQ ID NO: 380624 - DNA, 25 bp, Mus musculus
ttactcggcgccagccaacaagatg

SEQ ID NO: 380625 - DNA, 25 bp, Mus musculus
cggcggggcacaaagaatctgaccc

SEQ ID NO: 380626 - DNA, 25 bp, Mus musculus
gggcacaaagaatctgacccgaccc

SEQ ID NO: 380627 - DNA, 25 bp, Mus musculus
ccaacaagatgctgtggtgcgcccg

SEQ ID NO: 380628 - DNA, 25 bp, Mus musculus
agtgtccctgttcccttgtccagcg

SEQ ID NO: 380629 - DNA, 25 bp, Mus musculus
atggctcagcgtacccaaggcagga

SEQ ID NO: 380630 - DNA, 25 bp, Mus musculus
gatgcacgctcctgcagaggacctg

SEQ ID NO: 380631 - DNA, 25 bp, Mus musculus
gcaagccgagttcgcgggataccct

SEQ ID NO: 380632 - DNA, 25 bp, Mus musculus
ttgtcttccgttcacagtgtccctg

SEQ ID NO: 380633 - DNA, 25 bp, Mus musculus
tccactttgaagttggtagagccca

SEQ ID NO: 380634 - DNA, 25 bp, Mus musculus
ccaactaggagcgacaccgagggtt

SEQ ID NO: 380635 - DNA, 25 bp, Mus musculus
ggtgcctacgacgttccagccttgc

SEQ ID NO: 380636 - DNA, 25 bp, Mus musculus
agccttgcgcctcggttgctaccga

SEQ ID NO: 380637 - DNA, 25 bp, Mus musculus
gctgccctagctgctcagtgacgta

SEQ ID NO: 380638 - DNA, 25 bp, Mus musculus
gtagttcctgccgtagctctcagaa

SEQ ID NO: 380639 - DNA, 25 bp, Mus musculus
cctggatccgccttctgttttacta

SEQ ID NO: 380640 - DNA, 25 bp, Mus musculus
aagggtccggtactcaccctgcagc

SEQ ID NO: 380641 - DNA, 25 bp, Mus musculus
accacggaattggagcaaacgagca

SEQ ID NO: 380642 - DNA, 25 bp, Mus musculus
tttcggtgtggctctctctcccggt

SEQ ID NO: 380643 - DNA, 25 bp, Mus musculus
cgcgagacctccctttctaccttcg

SEQ ID NO: 380644 - DNA, 25 bp, Mus musculus
tgtggctctctctcccggtcgcttt

SEQ ID NO: 380645 - DNA, 25 bp, Mus musculus
acacctttcggtgtggctctctctc

SEQ ID NO: 380646 - DNA, 25 bp, Mus musculus
gaaaacacctttcggtgtggctctc

SEQ ID NO: 380647 - DNA, 25 bp, Mus musculus
gcggctcacccagtcctgcccgccg

SEQ ID NO: 380648 - DNA, 25 bp, Mus musculus
cggcgtgcaggcagcgcccatgggc

SEQ ID NO: 380649 - DNA, 25 bp, Mus musculus
gccgcctccgcttgcgcgcgaggct

SEQ ID NO: 380650 - DNA, 25 bp, Mus musculus
agcaccgggctaggcccagggcctg

SEQ ID NO: 380651 - DNA, 25 bp, Mus musculus
agcctgctctcggagcaccgggcta

SEQ ID NO: 380652 - DNA, 25 bp, Mus musculus
tccgtccgtccagcctgctctcgga

SEQ ID NO: 380653 - DNA, 25 bp, Mus musculus
ccaggtaaggccgctttgcgcccag

SEQ ID NO: 380654 - DNA, 25 bp, Mus musculus
tctcccggtcgctttctgccctccc

SEQ ID NO: 380655 - DNA, 25 bp, Mus musculus
tgctctcggagcaccgggctaggcc

SEQ ID NO: 380656 - DNA, 25 bp, Mus musculus
ccgggaacgcccatcacttactatg

SEQ ID NO: 380657 - DNA, 25 bp, Mus musculus
tcccactgctgttcgcattgctgtc

SEQ ID NO: 380658 - DNA, 25 bp, Mus musculus
gaccggagactcctcggctgacttc

SEQ ID NO: 380659 - DNA, 25 bp, Mus musculus
gactcctcggctgacttctcgagta

SEQ ID NO: 380660 - DNA, 25 bp, Mus musculus
ttctcgagtagggagtgagtatgtc

SEQ ID NO: 380661 - DNA, 25 bp, Mus musculus
tgagtatgtcaacgccatgcacatg

SEQ ID NO: 380662 - DNA, 25 bp, Mus musculus
atgctcctgttcacactcccgggaa

SEQ ID NO: 380663 - DNA, 25 bp, Mus musculus
cagctttttagttgcgggccaccgc

SEQ ID NO: 380664 - DNA, 25 bp, Mus musculus
gtaagtatgataaaagcgcagcttt

SEQ ID NO: 380665 - DNA, 25 bp, Mus musculus
tcacttactatggagaggaaatcgg

SEQ ID NO: 380666 - DNA, 25 bp, Mus musculus
cgagagctatgatagtgtaagtatg

SEQ ID NO: 380667 - DNA, 25 bp, Mus musculus
gttacaaatttcaacgagagctatg

SEQ ID NO: 380668 - DNA, 25 bp, Mus musculus
cgggatgggagacatttccgttaca

SEQ ID NO: 380669 - DNA, 25 bp, Mus musculus
aacgccatgcacatgctcctgttca

SEQ ID NO: 380670 - DNA, 25 bp, Mus musculus
ccgtttgtcgggagccaagcgagaa

SEQ ID NO: 380671 - DNA, 25 bp, Mus musculus
aagcgtcccgcgatgggcagtgcca

SEQ ID NO: 380672 - DNA, 25 bp, Mus musculus
acgccgctgctttggttgccaagga

SEQ ID NO: 380673 - DNA, 25 bp, Mus musculus
cctcgcaggtagcaggcagcccgtt

SEQ ID NO: 380674 - DNA, 25 bp, Mus musculus
agggctcgctggtctcggcgcccaa

SEQ ID NO: 380675 - DNA, 25 bp, Mus musculus
gcagcccgtttgtcgggagccaagc

SEQ ID NO: 380676 - DNA, 25 bp, Mus musculus
agtcagctctggagatggagtcgca

SEQ ID NO: 380677 - DNA, 25 bp, Mus musculus
acctccgggtccagtcagctctgga

SEQ ID NO: 380678 - DNA, 25 bp, Mus musculus
agagccgtggcggacgcaacctccg

SEQ ID NO: 380679 - DNA, 25 bp, Mus musculus
acaggtcctgacagggaagaagttg

SEQ ID NO: 380680 - DNA, 25 bp, Mus musculus
gcgtcacaggtcctgacagggaaga

SEQ ID NO: 380681 - DNA, 25 bp, Mus musculus
cgctaataccggaaatgcggaattc

SEQ ID NO: 380682 - DNA, 25 bp, Mus musculus
gttgccaaggagacgctaataccgg

SEQ ID NO: 380683 - DNA, 25 bp, Mus musculus
taagggcgagcgctcgcctgccctg

SEQ ID NO: 380684 - DNA, 25 bp, Mus musculus
aattcgacgaggctggcgtgtttca

SEQ ID NO: 380685 - DNA, 25 bp, Mus musculus
tgctaagggttaagtgcgccgatcg

SEQ ID NO: 380686 - DNA, 25 bp, Mus musculus
cacccggcgtgctaagggttaagtg

SEQ ID NO: 380687 - DNA, 25 bp, Mus musculus
gggcgacttgccctgtcctggacac

SEQ ID NO: 380688 - DNA, 25 bp, Mus musculus
ctgagctccttagaaagcttcgggg

SEQ ID NO: 380689 - DNA, 25 bp, Mus musculus
tgtttcaggggctgagctccttaga

SEQ ID NO: 380690 - DNA, 25 bp, Mus musculus
aagttttcaattcgacgaggctggc

SEQ ID NO: 380691 - DNA, 25 bp, Mus musculus
cacgctaattacaaggattcggttt

SEQ ID NO: 380692 - DNA, 25 bp, Mus musculus
cgagccaaccgagaaagttttcaat

SEQ ID NO: 380693 - DNA, 25 bp, Mus musculus
atttccaggcccaccgagccaaccg

SEQ ID NO: 380694 - DNA, 25 bp, Mus musculus
taagtgcgccgatcgcggctctctc

SEQ ID NO: 380695 - DNA, 25 bp, Mus musculus
cctgtcctggacacgctaattacaa

SEQ ID NO: 380696 - DNA, 25 bp, Mus musculus
tccctctgtgaagacgcccgcaggg

SEQ ID NO: 380697 - DNA, 25 bp, Mus musculus
acgccggcgtccctctgtgaagacg

SEQ ID NO: 380698 - DNA, 25 bp, Mus musculus
atgctgcggagcacaaagctggacc

SEQ ID NO: 380699 - DNA, 25 bp, Mus musculus
actatacaagtggacaccgcgggca

SEQ ID NO: 380700 - DNA, 25 bp, Mus musculus
ccaggggactatacaagtggacacc

SEQ ID NO: 380701 - DNA, 25 bp, Mus musculus
ggccaacggccaggggactatacaa

SEQ ID NO: 380702 - DNA, 25 bp, Mus musculus
cgatgataggaagggccaacggcca

SEQ ID NO: 380703 - DNA, 25 bp, Mus musculus
ctcccgatgataggaagggccaacg

SEQ ID NO: 380704 - DNA, 25 bp, Mus musculus
agacactgggctcccgatgatagga

SEQ ID NO: 380705 - DNA, 25 bp, Mus musculus
cctagaagctggaaggtgagccttc

SEQ ID NO: 380706 - DNA, 25 bp, Mus musculus
ggaccagagcgcctagaagctggaa

SEQ ID NO: 380707 - DNA, 25 bp, Mus musculus
tggaccctcgttctgcaagcgctca

SEQ ID NO: 380708 - DNA, 25 bp, Mus musculus
caaagctggaccctcgttctgcaag

SEQ ID NO: 380709 - DNA, 25 bp, Mus musculus
cggagcacaaagctggaccctcgtt

SEQ ID NO: 380710 - DNA, 25 bp, Mus musculus
tacaagtggacaccgcgggcaggct

SEQ ID NO: 380711 - DNA, 25 bp, Mus musculus
cctcgttctgcaagcgctcaggggc

SEQ ID NO: 380712 - DNA, 25 bp, Mus musculus
gctccgccagcgcacaccaggtgct

SEQ ID NO: 380713 - DNA, 25 bp, Mus musculus
accaggtgctccgagccaccgttgt

SEQ ID NO: 380714 - DNA, 25 bp, Mus musculus
caggtgctccgagccaccgttgtcg

SEQ ID NO: 380715 - DNA, 25 bp, Mus musculus
ctccgagccaccgttgtcgccgccg

SEQ ID NO: 380716 - DNA, 25 bp, Mus musculus
cgccgctccatcgtctgctctcccg

SEQ ID NO: 380717 - DNA, 25 bp, Mus musculus
tgctctcccgcagactccatggaga

SEQ ID NO: 380718 - DNA, 25 bp, Mus musculus
agactccatggagacccagcgggca

SEQ ID NO: 380719 - DNA, 25 bp, Mus musculus
aggcgcgatggccagaacagcagac

SEQ ID NO: 380720 - DNA, 25 bp, Mus musculus
cgcgatggccagaacagcagacaac

SEQ ID NO: 380721 - DNA, 25 bp, Mus musculus
tggccagaacagcagacaacgaagc

SEQ ID NO: 380722 - DNA, 25 bp, Mus musculus
ggctcccgggcctctactctgagcg

SEQ ID NO: 380723 - DNA, 25 bp, Mus musculus
tctactctgagcgggccgcgcagct

SEQ ID NO: 380724 - DNA, 25 bp, Mus musculus
gaacagcagacaacgaagcctcatc

SEQ ID NO: 380725 - DNA, 25 bp, Mus musculus
aacgaagcctcatcccactacggaa

SEQ ID NO: 380726 - DNA, 25 bp, Mus musculus
gcgactaacttcaggtagtgcattc

SEQ ID NO: 380727 - DNA, 25 bp, Mus musculus
tcaggtagtgcattcttaagggacg

SEQ ID NO: 380728 - DNA, 25 bp, Mus musculus
gtgcattcttaagggacgagtatta

SEQ ID NO: 380729 - DNA, 25 bp, Mus musculus
gatgacttgcgactaacttcaggta

SEQ ID NO: 380730 - DNA, 25 bp, Mus musculus
cgaagcttctagatgtgaggatttt

SEQ ID NO: 380731 - DNA, 25 bp, Mus musculus
cctcgattgaagatgacttgcgact

SEQ ID NO: 380732 - DNA, 25 bp, Mus musculus
gtctatgagtttttcctgcgcgttg

SEQ ID NO: 380733 - DNA, 25 bp, Mus musculus
agagaagggtgtgcgcgaacatgtt

SEQ ID NO: 380734 - DNA, 25 bp, Mus musculus
tccgactgtcgtctatgagtttttc

SEQ ID NO: 380735 - DNA, 25 bp, Mus musculus
ttggaagtggcttcggcgaagcttc

SEQ ID NO: 380736 - DNA, 25 bp, Mus musculus
tttttcctttcctcgattgaagatg

SEQ ID NO: 380737 - DNA, 25 bp, Mus musculus
agggacgagtattagtccgactgtc

SEQ ID NO: 380738 - DNA, 25 bp, Mus musculus
acatgttcgcgtgctgttggaagtg

SEQ ID NO: 380739 - DNA, 25 bp, Mus musculus
gcttcggcgaagcttctagatgtga

SEQ ID NO: 380740 - DNA, 25 bp, Mus musculus
cgcgtcctagcagggactacatttc

SEQ ID NO: 380741 - DNA, 25 bp, Mus musculus
ccacggggttctgccggcgacagca

SEQ ID NO: 380742 - DNA, 25 bp, Mus musculus
ctctgaacgccggacaagcgggacg

SEQ ID NO: 380743 - DNA, 25 bp, Mus musculus
aggcctctctaaggcatcgcggaga

SEQ ID NO: 380744 - DNA, 25 bp, Mus musculus
tcatcaaggtaaccgcccaggcggg

SEQ ID NO: 380745 - DNA, 25 bp, Mus musculus
cccgcaggatcatcaaggtaaccgc

SEQ ID NO: 380746 - DNA, 25 bp, Mus musculus
gatctgacaagatggccgggctgcc

SEQ ID NO: 380747 - DNA, 25 bp, Mus musculus
ggacttccactcgagcgtgaggaga

SEQ ID NO: 380748 - DNA, 25 bp, Mus musculus
aaggctgtcggaagcccgcgtccta

SEQ ID NO: 380749 - DNA, 25 bp, Mus musculus
tgccgattctgccacgggccaagaa

SEQ ID NO: 380750 - DNA, 25 bp, Mus musculus
cggccgcccagtgttgccgattctg

SEQ ID NO: 380751 - DNA, 25 bp, Mus musculus
cacgtacagcgctcgctcgtggacg

SEQ ID NO: 380752 - DNA, 25 bp, Mus musculus
cgacgcaggcgtggtcgcacgtaca

SEQ ID NO: 380753 - DNA, 25 bp, Mus musculus
cagaggccgaactcgggatctgaca

SEQ ID NO: 380754 - DNA, 25 bp, Mus musculus
cccttcggggtcagtgcgctaccag

SEQ ID NO: 380755 - DNA, 25 bp, Mus musculus
cacagggccgcacgcctctcctgct

SEQ ID NO: 380756 - DNA, 25 bp, Mus musculus
ttcggggtcagtgcgctaccagcac

SEQ ID NO: 380757 - DNA, 25 bp, Mus musculus
cgcttcttattcttgtgcctcggcc

SEQ ID NO: 380758 - DNA, 25 bp, Mus musculus
agccgcttcttattcttgtgcctcg

SEQ ID NO: 380759 - DNA, 25 bp, Mus musculus
gtcagtgcgctaccagcacagggcc

SEQ ID NO: 380760 - DNA, 25 bp, Mus musculus
ctcctgctagccgtgtggctcttaa

SEQ ID NO: 380761 - DNA, 25 bp, Mus musculus
tgctagccgtgtggctcttaaagag

SEQ ID NO: 380762 - DNA, 25 bp, Mus musculus
ccgctcctcgcagcctttcacgctg

SEQ ID NO: 380763 - DNA, 25 bp, Mus musculus
gacccaatgcccgtggactcccaac

SEQ ID NO: 380764 - DNA, 25 bp, Mus musculus
tgcagccgcttcttattcttgtgcc

SEQ ID NO: 380765 - DNA, 25 bp, Mus musculus
tcgcagcctttcacgctgcagccgc

SEQ ID NO: 380766 - DNA, 25 bp, Mus musculus
gctgcagccgcttcttattcttgtg

SEQ ID NO: 380767 - DNA, 25 bp, Mus musculus
cacgccgtcgcctgaagtccctgct

SEQ ID NO: 380768 - DNA, 25 bp, Mus musculus
gggatccagtcctacaaaacgcatc

SEQ ID NO: 380769 - DNA, 25 bp, Mus musculus
gttgaacacaatattcggaaaccca

SEQ ID NO: 380770 - DNA, 25 bp, Mus musculus
cggggtcacgagctgctttcaaaaa

SEQ ID NO: 380771 - DNA, 25 bp, Mus musculus
tcgatttcagcgctgtcggcacagc

SEQ ID NO: 380772 - DNA, 25 bp, Mus musculus
ttcttcatgagtggcgagggttttc

SEQ ID NO: 380773 - DNA, 25 bp, Mus musculus
gatccttttgcctcagttcttcatg

SEQ ID NO: 380774 - DNA, 25 bp, Mus musculus
cccgagcagcatctgtgatcctttt

SEQ ID NO: 380775 - DNA, 25 bp, Mus musculus
gcggccgccagagaactgcagagcc

SEQ ID NO: 380776 - DNA, 25 bp, Mus musculus
tagcgcttacaaggcgcggccgcca

SEQ ID NO: 380777 - DNA, 25 bp, Mus musculus
tcctcccggcttagcgcttacaagg

SEQ ID NO: 380778 - DNA, 25 bp, Mus musculus
cagcatagggcttccggcctgggct

SEQ ID NO: 380779 - DNA, 25 bp, Mus musculus
aacttaccggcttcgggaggcagca

SEQ ID NO: 380780 - DNA, 25 bp, Mus musculus
gctttcaggactctcaacttaccgg

SEQ ID NO: 380781 - DNA, 25 bp, Mus musculus
tacaaaacgcatcaggaaccacccg

SEQ ID NO: 380782 - DNA, 25 bp, Mus musculus
cgtctcggcctcaatgctcatggtt

SEQ ID NO: 380783 - DNA, 25 bp, Mus musculus
gccatctgggctgccactacattcg

SEQ ID NO: 380784 - DNA, 25 bp, Mus musculus
aggccatctgggctgccactacatt

SEQ ID NO: 380785 - DNA, 25 bp, Mus musculus
atgtgaggccatctgggctgccact

SEQ ID NO: 380786 - DNA, 25 bp, Mus musculus
atctgggctgccactacattcgctg

SEQ ID NO: 380787 - DNA, 25 bp, Mus musculus
ctgggctgccactacattcgctgct

SEQ ID NO: 380788 - DNA, 25 bp, Mus musculus
tgccactacattcgctgctgcctgt

SEQ ID NO: 380789 - DNA, 25 bp, Mus musculus
ctgcgtctcggcctcaatgctcatg

SEQ ID NO: 380790 - DNA, 25 bp, Mus musculus
gggcggcaacagctgtggctcctcc

SEQ ID NO: 380791 - DNA, 25 bp, Mus musculus
tgtgatggtgattaggcctgcggag

SEQ ID NO: 380792 - DNA, 25 bp, Mus musculus
ccgatgtgaggccatctgggctgcc

SEQ ID NO: 380793 - DNA, 25 bp, Mus musculus
ttttgtccctgccggcgggcgtcgc

SEQ ID NO: 380794 - DNA, 25 bp, Mus musculus
ttgcgatgacctttttgtccctgcc

SEQ ID NO: 380795 - DNA, 25 bp, Mus musculus
cgctgctgcctgtggagcagggctt

SEQ ID NO: 380796 - DNA, 25 bp, Mus musculus
caagtaccgcgtgcgcaagaagttc

SEQ ID NO: 380797 - DNA, 25 bp, Mus musculus
caagttcactaaggagtctcacggc

SEQ ID NO: 380798 - DNA, 25 bp, Mus musculus
aaacacgagtcgatcctgcgcgcgc

SEQ ID NO: 380799 - DNA, 25 bp, Mus musculus
tggcgagcagaagacccattgcttc

SEQ ID NO: 380800 - DNA, 25 bp, Mus musculus
atcctggagaaccacaagttcacta

SEQ ID NO: 380801 - DNA, 25 bp, Mus musculus
cccacacaagtaggcaactggttta

SEQ ID NO: 380802 - DNA, 25 bp, Mus musculus
gtctcacggcaagctgcaagccatg

SEQ ID NO: 380803 - DNA, 25 bp, Mus musculus
caagccatgtggctcgaggcgcact

SEQ ID NO: 380804 - DNA, 25 bp, Mus musculus
gctcggcccggtggacaagtaccgc

SEQ ID NO: 380805 - DNA, 25 bp, Mus musculus
tctgccgcgcaccatctgggatggc

SEQ ID NO: 380806 - DNA, 25 bp, Mus musculus
cttcaaggagcggactcggagcctg

SEQ ID NO: 380807 - DNA, 25 bp, Mus musculus
ggagtggtacctgcaggatccctac

SEQ ID NO: 380808 - DNA, 25 bp, Mus musculus
gaaacgcgaactggcgcaggccacc

SEQ ID NO: 380809 - DNA, 25 bp, Mus musculus
cgcgacctgtaccacatcctggaga

SEQ ID NO: 380810 - DNA, 25 bp, Mus musculus
gggcgggcatggctctcttgttccc

SEQ ID NO: 380811 - DNA, 25 bp, Mus musculus
aggccgctgttgtaggggagtgcgg

SEQ ID NO: 380812 - DNA, 25 bp, Mus musculus
acggctcaagcagagtcaccgtcca

SEQ ID NO: 380813 - DNA, 25 bp, Mus musculus
ttgtaggggagtgcgggtccagtcg

SEQ ID NO: 380814 - DNA, 25 bp, Mus musculus
gccaggctccccgcggtatgagcga

SEQ ID NO: 380815 - DNA, 25 bp, Mus musculus
cgggccaccgagtcagggcgggcat

SEQ ID NO: 380816 - DNA, 25 bp, Mus musculus
atggctctcttgttccccgcaggct

SEQ ID NO: 380817 - DNA, 25 bp, Mus musculus
cagcatcaggccatcgggccgagcg

SEQ ID NO: 380818 - DNA, 25 bp, Mus musculus
ccatcgggccgagcgggatgcgctc

SEQ ID NO: 380819 - DNA, 25 bp, Mus musculus
gccgagcgggatgcgctcgctggcc

SEQ ID NO: 380820 - DNA, 25 bp, Mus musculus
ggccgagcccggctgccccacgcac

SEQ ID NO: 380821 - DNA, 25 bp, Mus musculus
gcacggctcaagcagagtcaccgtc

SEQ ID NO: 380822 - DNA, 25 bp, Mus musculus
ggctcaagcagagtcaccgtccacg

SEQ ID NO: 380823 - DNA, 25 bp, Mus musculus
acgcacggctcaagcagagtcaccg

SEQ ID NO: 380824 - DNA, 25 bp, Mus musculus
tcctgcaggctgtggtgatgctgca

SEQ ID NO: 380825 - DNA, 25 bp, Mus musculus
tcatcaagcacggaaagcaagcgcc

SEQ ID NO: 380826 - DNA, 25 bp, Mus musculus
cacaccgcttcatcaagcacggaaa

SEQ ID NO: 380827 - DNA, 25 bp, Mus musculus
cgcggcacagactccagaatctatc

SEQ ID NO: 380828 - DNA, 25 bp, Mus musculus
gcagtcttccagtacgcggcacaga

SEQ ID NO: 380829 - DNA, 25 bp, Mus musculus
tccagcgtggcagggcagtcttcca

SEQ ID NO: 380830 - DNA, 25 bp, Mus musculus
cggttctgccgctccagcgtggcag

SEQ ID NO: 380831 - DNA, 25 bp, Mus musculus
ctgccattgagcgaggaagccagcg

SEQ ID NO: 380832 - DNA, 25 bp, Mus musculus
ccaccgggcactggtacgggtactg

SEQ ID NO: 380833 - DNA, 25 bp, Mus musculus
accgacttgccactgccattgagcg

SEQ ID NO: 380834 - DNA, 25 bp, Mus musculus
cccaggtccacaaggttggccgaca

SEQ ID NO: 380835 - DNA, 25 bp, Mus musculus
tcggaactgcctagcaccgacttgc

SEQ ID NO: 380836 - DNA, 25 bp, Mus musculus
acagagctctaggagcccaggtcca

SEQ ID NO: 380837 - DNA, 25 bp, Mus musculus
gacggcgtcttctcatcctcggaac

SEQ ID NO: 380838 - DNA, 25 bp, Mus musculus
cagcttctccgcctcgatgtagtgc

SEQ ID NO: 380839 - DNA, 25 bp, Mus musculus
gaacttgcgccgcacgcggtacttg

SEQ ID NO: 380840 - DNA, 25 bp, Mus musculus
tgcggctcttctccttgaagcagta

SEQ ID NO: 380841 - DNA, 25 bp, Mus musculus
gctcacttactcgtacctttccttg

SEQ ID NO: 380842 - DNA, 25 bp, Mus musculus
agccggcgcagatgctcacttactc

SEQ ID NO: 380843 - DNA, 25 bp, Mus musculus
ttgagcacgctttcattcttgtgga

SEQ ID NO: 380844 - DNA, 25 bp, Mus musculus
tttcattcttgtggaggtgctcgca

SEQ ID NO: 380845 - DNA, 25 bp, Mus musculus
cttgctcctgcgtgaagccgaaggt

SEQ ID NO: 380846 - DNA, 25 bp, Mus musculus
ccgagcgactcctgagtcacaacga

SEQ ID NO: 380847 - DNA, 25 bp, Mus musculus
tgagtcacaacgatccgtcctcgct

SEQ ID NO: 380848 - DNA, 25 bp, Mus musculus
atattattctaagcgggcatgaggc

SEQ ID NO: 380849 - DNA, 25 bp, Mus musculus
tgtagtgcgccttgagccacaactg

SEQ ID NO: 380850 - DNA, 25 bp, Mus musculus
tcccgtctagctcgcttgcagcttt

SEQ ID NO: 380851 - DNA, 25 bp, Mus musculus
acaactgctgcagcttggcgtggtt

SEQ ID NO: 380852 - DNA, 25 bp, Mus musculus
tgtagggtaattgtcgcacttcccg

SEQ ID NO: 380853 - DNA, 25 bp, Mus musculus
gggagcccgcatagacccgcagact

SEQ ID NO: 380854 - DNA, 25 bp, Mus musculus
agcgtgtgtagggtaattgtcgcac

SEQ ID NO: 380855 - DNA, 25 bp, Mus musculus
gcgacacaaaacaggggagcccgca

SEQ ID NO: 380856 - DNA, 25 bp, Mus musculus
tgaatcttgcaagggcggcgacaca

SEQ ID NO: 380857 - DNA, 25 bp, Mus musculus
ggcctttacggaagttgaatcttgc

SEQ ID NO: 380858 - DNA, 25 bp, Mus musculus
gcagtctcgtgtggcctttacggaa

SEQ ID NO: 380859 - DNA, 25 bp, Mus musculus
agaaactcccggcagtctcgtgtgg

SEQ ID NO: 380860 - DNA, 25 bp, Mus musculus
caggacccgagaaactcccggcagt

SEQ ID NO: 380861 - DNA, 25 bp, Mus musculus
gccaggcggggactcagacttaacc

SEQ ID NO: 380862 - DNA, 25 bp, Mus musculus
tgctcctcgccaggcggggactcag

SEQ ID NO: 380863 - DNA, 25 bp, Mus musculus
tttccttcctttcgcagcaggctgc

SEQ ID NO: 380864 - DNA, 25 bp, Mus musculus
ctgagaatcaacttcccggaggatc

SEQ ID NO: 380865 - DNA, 25 bp, Mus musculus
gcagctggacgcctgagaatcaact

SEQ ID NO: 380866 - DNA, 25 bp, Mus musculus
ttggaggcactcaaagcagctgatc

SEQ ID NO: 380867 - DNA, 25 bp, Mus musculus
tatgatgctctgcacccgacgctta

SEQ ID NO: 380868 - DNA, 25 bp, Mus musculus
cctgagcagtgcgtttcgttgaatg

SEQ ID NO: 380869 - DNA, 25 bp, Mus musculus
tagaaactggcttgctctgcgtccc

SEQ ID NO: 380870 - DNA, 25 bp, Mus musculus
gtgctccgagcatttgcaaaatctg

SEQ ID NO: 380871 - DNA, 25 bp, Mus musculus
gtgttgctcaacgtgcgagaccgca

SEQ ID NO: 380872 - DNA, 25 bp, Mus musculus
tccagttctcagagcggttcccaga

SEQ ID NO: 380873 - DNA, 25 bp, Mus musculus
cagggccctggactccgtgaaaagt

SEQ ID NO: 380874 - DNA, 25 bp, Mus musculus
aaatcgtgttgtcgcctgtgacgca

SEQ ID NO: 380875 - DNA, 25 bp, Mus musculus
cacacccgggatcttgtgcaaacga

SEQ ID NO: 380876 - DNA, 25 bp, Mus musculus
aggcgacgtttcaggtgactaccaa

SEQ ID NO: 380877 - DNA, 25 bp, Mus musculus
atctgcaacctgtgaggggcctctt

SEQ ID NO: 380878 - DNA, 25 bp, Mus musculus
gccgctcgctgcttgatctatgatg

SEQ ID NO: 380879 - DNA, 25 bp, Mus musculus
tgatctgcgagcctttagcctgtgg

SEQ ID NO: 380880 - DNA, 25 bp, Mus musculus
agtccgcctggcgcacgtggctctg

SEQ ID NO: 380881 - DNA, 25 bp, Mus musculus
ggagagatcggaggccggggatctg

SEQ ID NO: 380882 - DNA, 25 bp, Mus musculus
ctgcaggagagatcggaggccgggg

SEQ ID NO: 380883 - DNA, 25 bp, Mus musculus
acgtggctctgggtcggctgcagga

SEQ ID NO: 380884 - DNA, 25 bp, Mus musculus
cgcacgtggctctgggtcggctgca

SEQ ID NO: 380885 - DNA, 25 bp, Mus musculus
ccgcctggcgcacgtggctctgggt

SEQ ID NO: 380886 - DNA, 25 bp, Mus musculus
gagtccgcctggcgcacgtggctct

SEQ ID NO: 380887 - DNA, 25 bp, Mus musculus
ccgtagggtgtggagtccgcctggc

SEQ ID NO: 380888 - DNA, 25 bp, Mus musculus
acccgtagggtgtggagtccgcctg

SEQ ID NO: 380889 - DNA, 25 bp, Mus musculus
cacccgtagggtgtggagtccgcct

SEQ ID NO: 380890 - DNA, 25 bp, Mus musculus
ggcagcggggcacggcacccgtagg

SEQ ID NO: 380891 - DNA, 25 bp, Mus musculus
gcgagcaggcgaggtgggtgcaggt

SEQ ID NO: 380892 - DNA, 25 bp, Mus musculus
agatcggaggccggggatctgccgc

SEQ ID NO: 380893 - DNA, 25 bp, Mus musculus
ggggcagcggggcacggcacccgta

SEQ ID NO: 380894 - DNA, 25 bp, Mus musculus
ctgttcccagtgtttgtacagctgg

SEQ ID NO: 380895 - DNA, 25 bp, Mus musculus
acgaaggcggtgaaactcgtgctgg

SEQ ID NO: 380896 - DNA, 25 bp, Mus musculus
tgctggaggcagtcaccgactctag

SEQ ID NO: 380897 - DNA, 25 bp, Mus musculus
gaggcagtcaccgactctagggtcg

SEQ ID NO: 380898 - DNA, 25 bp, Mus musculus
cagtcaccgactctagggtcgggcc

SEQ ID NO: 380899 - DNA, 25 bp, Mus musculus
tggtacaaggttctgtggcggacga

SEQ ID NO: 380900 - DNA, 25 bp, Mus musculus
gagggctgttcccagtgtttgtaca

SEQ ID NO: 380901 - DNA, 25 bp, Mus musculus
ccagtgtttgtacagctgggatctc

SEQ ID NO: 380902 - DNA, 25 bp, Mus musculus
ttgtacagctgggatctcggccacc

SEQ ID NO: 380903 - DNA, 25 bp, Mus musculus
aggctgagggcgacagagatgcacc

SEQ ID NO: 380904 - DNA, 25 bp, Mus musculus
atctgccgcagtgggtgcctccggt

SEQ ID NO: 380905 - DNA, 25 bp, Mus musculus
acgagggctgttcccagtgtttgta

SEQ ID NO: 380906 - DNA, 25 bp, Mus musculus
gcagtgggtgcctccggtccgatcc

SEQ ID NO: 380907 - DNA, 25 bp, Mus musculus
cgacagagatgcaccgggcgccggc

SEQ ID NO: 380908 - DNA, 25 bp, Mus musculus
aagcggagtccgctttgcaaaagga

SEQ ID NO: 380909 - DNA, 25 bp, Mus musculus
gtcacaccgcagaacagccttgaga

SEQ ID NO: 380910 - DNA, 25 bp, Mus musculus
gccgggctgaaaagggcaacttcgc

SEQ ID NO: 380911 - DNA, 25 bp, Mus musculus
tcctggcctatcttgtcccttctgg

SEQ ID NO: 380912 - DNA, 25 bp, Mus musculus
cgctggccatctttcggtcgtcaga

SEQ ID NO: 380913 - DNA, 25 bp, Mus musculus
ctttgcaaaaggaggtatctacgta

SEQ ID NO: 380914 - DNA, 25 bp, Mus musculus
tctacgtaatgaagccaacagcttg

SEQ ID NO: 380915 - DNA, 25 bp, Mus musculus
caacagcttgcgacctaatgggagg

SEQ ID NO: 380916 - DNA, 25 bp, Mus musculus
gtctaaaaggcaggctggcgaaccc

SEQ ID NO: 380917 - DNA, 25 bp, Mus musculus
atgaagcccggtcgccagcctttgt

SEQ ID NO: 380918 - DNA, 25 bp, Mus musculus
ctggttgggcttgaacttcatccta

SEQ ID NO: 380919 - DNA, 25 bp, Mus musculus
gaacttcatcctagagccgggctcc

SEQ ID NO: 380920 - DNA, 25 bp, Mus musculus
ttcgcccgcatttaagcggggctcc

SEQ ID NO: 380921 - DNA, 25 bp, Mus musculus
ggcgtcattccacatctctcgctgg

SEQ ID NO: 380922 - DNA, 25 bp, Mus musculus
cagtctcgctgtcaggctccacgtt

SEQ ID NO: 380923 - DNA, 25 bp, Mus musculus
tcggagactggtcgccctgaccctg

SEQ ID NO: 380924 - DNA, 25 bp, Mus musculus
tttctgcaagccctccggctgagga

SEQ ID NO: 380925 - DNA, 25 bp, Mus musculus
cctccggctgaggacccgaggtagt

SEQ ID NO: 380926 - DNA, 25 bp, Mus musculus
tcccacggtttctggccgctgggca

SEQ ID NO: 380927 - DNA, 25 bp, Mus musculus
tttctggccgctgggcagtttcttt

SEQ ID NO: 380928 - DNA, 25 bp, Mus musculus
gggcagtttctttgcgcccagccgc

SEQ ID NO: 380929 - DNA, 25 bp, Mus musculus
cacctcttggtagcctggggctcac

SEQ ID NO: 380930 - DNA, 25 bp, Mus musculus
gtagcctggggctcacaaaattcag

SEQ ID NO: 380931 - DNA, 25 bp, Mus musculus
ggctcacaaaattcaggacaccgtc

SEQ ID NO: 380932 - DNA, 25 bp, Mus musculus
gtcatccgttctgcagtctcgctgt

SEQ ID NO: 380933 - DNA, 25 bp, Mus musculus
ctccacgttggagtggctcggagac

SEQ ID NO: 380934 - DNA, 25 bp, Mus musculus
ggacaccgtcatccgttctgcagtc

SEQ ID NO: 380935 - DNA, 25 bp, Mus musculus
tcccttctcccagtttttctgcaag

SEQ ID NO: 380936 - DNA, 25 bp, Mus musculus
ggcgcgccacgactgacagcgattc

SEQ ID NO: 380937 - DNA, 25 bp, Mus musculus
tctgctgaggaatcttccggttccc

SEQ ID NO: 380938 - DNA, 25 bp, Mus musculus
aaagctcaccttcgggcttggcgaa

SEQ ID NO: 380939 - DNA, 25 bp, Mus musculus
gccgctacggtggacacaaagctca

SEQ ID NO: 380940 - DNA, 25 bp, Mus musculus
cggcccggaagcattgccgctacgg

SEQ ID NO: 380941 - DNA, 25 bp, Mus musculus
gctccgattcttcggggtgaaaaca

SEQ ID NO: 380942 - DNA, 25 bp, Mus musculus
tcagaggacgcgctatggtgacagt

SEQ ID NO: 380943 - DNA, 25 bp, Mus musculus
ttctttcccacacgagcactcataa

SEQ ID NO: 380944 - DNA, 25 bp, Mus musculus
cagaccgctggtgctaaaagacaga

SEQ ID NO: 380945 - DNA, 25 bp, Mus musculus
gtgtagactgtgtgacagaccgctg

SEQ ID NO: 380946 - DNA, 25 bp, Mus musculus
cagtgctgagaatgtacagtgtaga

SEQ ID NO: 380947 - DNA, 25 bp, Mus musculus
acaaagtggccctggctttctcacg

SEQ ID NO: 380948 - DNA, 25 bp, Mus musculus
atgcgcgctaccagccggttcagag

SEQ ID NO: 380949 - DNA, 25 bp, Mus musculus
gcactcataaataccgcggccgaaa

SEQ ID NO: 380950 - DNA, 25 bp, Mus musculus
ctgccgcccgccttcccggtcctgg

SEQ ID NO: 380951 - DNA, 25 bp, Mus musculus
cggctgcttccagagagtttaaagg

SEQ ID NO: 380952 - DNA, 25 bp, Mus musculus
tcgcggctgcttccagagagtttaa

SEQ ID NO: 380953 - DNA, 25 bp, Mus musculus
cctcacgtgaccagccgccgtcgcg

SEQ ID NO: 380954 - DNA, 25 bp, Mus musculus
cagcccagggctcgcctcacgtgac

SEQ ID NO: 380955 - DNA, 25 bp, Mus musculus
tggcccaggaaattcttccccagca

SEQ ID NO: 380956 - DNA, 25 bp, Mus musculus
cgcaggctggaagttcccgctgcgc

SEQ ID NO: 380957 - DNA, 25 bp, Mus musculus
tttccactcacacggcggagagctg

SEQ ID NO: 380958 - DNA, 25 bp, Mus musculus
tttctttttccactcacacggcgga

SEQ ID NO: 380959 - DNA, 25 bp, Mus musculus
cggacttgccttggcactcgggtga

SEQ ID NO: 380960 - DNA, 25 bp, Mus musculus
tgcttccagagagtttaaaggttac

SEQ ID NO: 380961 - DNA, 25 bp, Mus musculus
aacgaacagccggacttgccttggc

SEQ ID NO: 380962 - DNA, 25 bp, Mus musculus
aacagccggacttgccttggcactc

SEQ ID NO: 380963 - DNA, 25 bp, Mus musculus
cacagagccattccctgccgcccgc

SEQ ID NO: 380964 - DNA, 25 bp, Mus musculus
gagtagagacaacttggctccaaca

SEQ ID NO: 380965 - DNA, 25 bp, Mus musculus
cccgcagtgggagtagagacaactt

SEQ ID NO: 380966 - DNA, 25 bp, Mus musculus
accaggccagggtaagtcgcccgca

SEQ ID NO: 380967 - DNA, 25 bp, Mus musculus
cggccttcgaaaagaaccaggccag

SEQ ID NO: 380968 - DNA, 25 bp, Mus musculus
gactctcccaggtcagcacaggaaa

SEQ ID NO: 380969 - DNA, 25 bp, Mus musculus
aaggggacgcggttcccagtctctg

SEQ ID NO: 380970 - DNA, 25 bp, Mus musculus
tggctccaacaggtacctaagggga

SEQ ID NO: 380971 - DNA, 25 bp, Mus musculus
ccagtctctggccacgatctttgga

SEQ ID NO: 380972 - DNA, 25 bp, Mus musculus
ggccacgatctttggagcggctccc

SEQ ID NO: 380973 - DNA, 25 bp, Mus musculus
ggacaccacggttccggtcacgtga

SEQ ID NO: 380974 - DNA, 25 bp, Mus musculus
ttccggtcacgtgacagcgctaacg

SEQ ID NO: 380975 - DNA, 25 bp, Mus musculus
caggaaaccgcatctgaggagagtt

SEQ ID NO: 380976 - DNA, 25 bp, Mus musculus
ccaggtcagcacaggaaaccgcatc

SEQ ID NO: 380977 - DNA, 25 bp, Mus musculus
cgcggctgatggctgactctcccag

SEQ ID NO: 380978 - DNA, 25 bp, Mus musculus
ggaggaccatttcctctcgacatgc

SEQ ID NO: 380979 - DNA, 25 bp, Mus musculus
cagcgccacaaggtgtagcgagtga

SEQ ID NO: 380980 - DNA, 25 bp, Mus musculus
tccggatagactgcacatccctcag

SEQ ID NO: 380981 - DNA, 25 bp, Mus musculus
aggatccgggttgaaatctgtgccc

SEQ ID NO: 380982 - DNA, 25 bp, Mus musculus
ttatgtttcggaaaggtaggtgagc

SEQ ID NO: 380983 - DNA, 25 bp, Mus musculus
cacggacccgaagaaccagcgaggc

SEQ ID NO: 380984 - DNA, 25 bp, Mus musculus
atccggcgaggaaatacatgcactc

SEQ ID NO: 380985 - DNA, 25 bp, Mus musculus
catgcactcgctgagaatcggcggc

SEQ ID NO: 380986 - DNA, 25 bp, Mus musculus
cgacagctcgtctcctgccgtggag

SEQ ID NO: 380987 - DNA, 25 bp, Mus musculus
cgcgactctgcttaacccgggaggt

SEQ ID NO: 380988 - DNA, 25 bp, Mus musculus
gatcgccggctacggcgcgactctg

SEQ ID NO: 380989 - DNA, 25 bp, Mus musculus
aagcccgcgcggatgtgagatccca

SEQ ID NO: 380990 - DNA, 25 bp, Mus musculus
tcgtgcggcttgtggattttttaaa

SEQ ID NO: 380991 - DNA, 25 bp, Mus musculus
ctcgacatgcatccctccggataga

SEQ ID NO: 380992 - DNA, 25 bp, Mus musculus
tcctgcagcagtggtagaaggccca

SEQ ID NO: 380993 - DNA, 25 bp, Mus musculus
gcaaccatgtagagtgccgtgcggg

SEQ ID NO: 380994 - DNA, 25 bp, Mus musculus
ctgagcttggggcaaccatgtagag

SEQ ID NO: 380995 - DNA, 25 bp, Mus musculus
ctgggaacttgagctgggtaatatc

SEQ ID NO: 380996 - DNA, 25 bp, Mus musculus
aacttgagctgggtaatatcttacc

SEQ ID NO: 380997 - DNA, 25 bp, Mus musculus
gggtaatatcttaccacagctcctg

SEQ ID NO: 380998 - DNA, 25 bp, Mus musculus
taccacagctcctgtcacggagatc

SEQ ID NO: 380999 - DNA, 25 bp, Mus musculus
ctgtcacggagatcttggaaggttc

SEQ ID NO: 381000 - DNA, 25 bp, Mus musculus
ttaactgagcttggggcaaccatgt

SEQ ID NO: 381001 - DNA, 25 bp, Mus musculus
tcacggagatcttggaaggttctgc

SEQ ID NO: 381002 - DNA, 25 bp, Mus musculus
aaggttctgcgtcttggatggtctc

SEQ ID NO: 381003 - DNA, 25 bp, Mus musculus
ctgcgtcttggatggtctcctcctt

SEQ ID NO: 381004 - DNA, 25 bp, Mus musculus
caggaggctggttttctgggaactt

SEQ ID NO: 381005 - DNA, 25 bp, Mus musculus
tcctccttcctgcagcagtggtaga

SEQ ID NO: 381006 - DNA, 25 bp, Mus musculus
ttccacctgattgagcgggactctc

SEQ ID NO: 381007 - DNA, 25 bp, Mus musculus
cggatagttccgagaccttgagaca

SEQ ID NO: 381008 - DNA, 25 bp, Mus musculus
tggagcagtagacacgcctttcttt

SEQ ID NO: 381009 - DNA, 25 bp, Mus musculus
cgactcttagggtttccatgctgga

SEQ ID NO: 381010 - DNA, 25 bp, Mus musculus
ccaagcttccctagcgagtgttttg

SEQ ID NO: 381011 - DNA, 25 bp, Mus musculus
aaagtctgtcgtccctggagcacca

SEQ ID NO: 381012 - DNA, 25 bp, Mus musculus
ccttgagacacggagagatggccct

SEQ ID NO: 381013 - DNA, 25 bp, Mus musculus
cgagtcggtgatgcctttagggaca

SEQ ID NO: 381014 - DNA, 25 bp, Mus musculus
gaacactgtcaagggtcctgctcca

SEQ ID NO: 381015 - DNA, 25 bp, Mus musculus
gacctgcgagcactaaagacctttc

SEQ ID NO: 381016 - DNA, 25 bp, Mus musculus
ggtctttccgagagcgttcctatgc

SEQ ID NO: 381017 - DNA, 25 bp, Mus musculus
ggaactccaggtcccttgtcgctgc

SEQ ID NO: 381018 - DNA, 25 bp, Mus musculus
agtgactcctgttcggggctaaacg

SEQ ID NO: 381019 - DNA, 25 bp, Mus musculus
gcgaccgacttggtcccaggcattg

SEQ ID NO: 381020 - DNA, 25 bp, Mus musculus
caagacgtgcctgctcatgagctat

SEQ ID NO: 381021 - DNA, 25 bp, Mus musculus
aaggccttcacgtctcctccgggca

SEQ ID NO: 381022 - DNA, 25 bp, Mus musculus
acgcttccgggctttggccgcactt

SEQ ID NO: 381023 - DNA, 25 bp, Mus musculus
tggccgcactttcgcgaggagccct

SEQ ID NO: 381024 - DNA, 25 bp, Mus musculus
catcctcccggatacagggcgcctc

SEQ ID NO: 381025 - DNA, 25 bp, Mus musculus
agtacgtgcccactgtcttcgacca

SEQ ID NO: 381026 - DNA, 25 bp, Mus musculus
ctcccagggagtcaagcttgggtga

SEQ ID NO: 381027 - DNA, 25 bp, Mus musculus
ccctggggccggacggtcttatgat

SEQ ID NO: 381028 - DNA, 25 bp, Mus musculus
gcaccttctcctccggtcaggggaa

SEQ ID NO: 381029 - DNA, 25 bp, Mus musculus
gacggtcttatgatccggcggatcc

SEQ ID NO: 381030 - DNA, 25 bp, Mus musculus
cccgaggagtacgtgcccactgtct

SEQ ID NO: 381031 - DNA, 25 bp, Mus musculus
tgtcttcgaccactacgcaggtacg

SEQ ID NO: 381032 - DNA, 25 bp, Mus musculus
ctcatgagctatgccaacgacgcct

SEQ ID NO: 381033 - DNA, 25 bp, Mus musculus
ctccggtcaggggaaccgctgcatg

SEQ ID NO: 381034 - DNA, 25 bp, Mus musculus
tatacgacagcataaccagaagcac

SEQ ID NO: 381035 - DNA, 25 bp, Mus musculus
cagaagcacccgctgtctatacgac

SEQ ID NO: 381036 - DNA, 25 bp, Mus musculus
tgtctatacgacagcataaccagaa

SEQ ID NO: 381037 - DNA, 25 bp, Mus musculus
gcataaccagaagcacccgctgtct

SEQ ID NO: 381038 - DNA, 25 bp, Mus musculus
ctatacgacagcataaccagaagca

SEQ ID NO: 381039 - DNA, 25 bp, Mus musculus
gaagcacccgctgtctatacgacag

SEQ ID NO: 381040 - DNA, 25 bp, Mus musculus
agcataaccagaagcacccgctgtc

SEQ ID NO: 381041 - DNA, 25 bp, Mus musculus
tacgacagcataaccagaagcaccc

SEQ ID NO: 381042 - DNA, 25 bp, Mus musculus
cacccgctgtctatacgacagcata

SEQ ID NO: 381043 - DNA, 25 bp, Mus musculus
cataaccagaagcacccgctgtcta

SEQ ID NO: 381044 - DNA, 25 bp, Mus musculus
acagcataaccagaagcacccgctg

SEQ ID NO: 381045 - DNA, 25 bp, Mus musculus
tctatacgacagcataaccagaagc

SEQ ID NO: 381046 - DNA, 25 bp, Mus musculus
agaagcacccgctgtctatacgaca

SEQ ID NO: 381047 - DNA, 25 bp, Mus musculus
cccgctgtctatacgacagcataac

SEQ ID NO: 381048 - DNA, 25 bp, Mus musculus
tgtctatacgacagcataaccagaa

SEQ ID NO: 381049 - DNA, 25 bp, Mus musculus
tatacgacagcataaccagaagcac

SEQ ID NO: 381050 - DNA, 25 bp, Mus musculus
cccgctgtctatacgacagcataac

SEQ ID NO: 381051 - DNA, 25 bp, Mus musculus
cagaagcacccgctgtctatacgac

SEQ ID NO: 381052 - DNA, 25 bp, Mus musculus
gcataaccagaagcacccgctgtct

SEQ ID NO: 381053 - DNA, 25 bp, Mus musculus
ctatacgacagcataaccagaagca

SEQ ID NO: 381054 - DNA, 25 bp, Mus musculus
gaagcacccgctgtctatacgacag

SEQ ID NO: 381055 - DNA, 25 bp, Mus musculus
agcataaccagaagcacccgctgtc

SEQ ID NO: 381056 - DNA, 25 bp, Mus musculus
tacgacagcataaccagaagcaccc

SEQ ID NO: 381057 - DNA, 25 bp, Mus musculus
cacccgctgtctatacgacagcata

SEQ ID NO: 381058 - DNA, 25 bp, Mus musculus
cataaccagaagcacccgctgtcta

SEQ ID NO: 381059 - DNA, 25 bp, Mus musculus
acagcataaccagaagcacccgctg

SEQ ID NO: 381060 - DNA, 25 bp, Mus musculus
agaagcacccgctgtctatacgaca

SEQ ID NO: 381061 - DNA, 25 bp, Mus musculus
tctatacgacagcataaccagaagc

SEQ ID NO: 381062 - DNA, 25 bp, Mus musculus
gcctctcgccgcctgtggggaagtc

SEQ ID NO: 381063 - DNA, 25 bp, Mus musculus
cagagctccgctaggcccggtgaca

SEQ ID NO: 381064 - DNA, 25 bp, Mus musculus
gaaaccgtccttccggcagcacgtg

SEQ ID NO: 381065 - DNA, 25 bp, Mus musculus
cagagggtaagagtgaaaccgtcct

SEQ ID NO: 381066 - DNA, 25 bp, Mus musculus
tcgaaggatcttgcagagggtaaga

SEQ ID NO: 381067 - DNA, 25 bp, Mus musculus
accatgtttcgaaggatcttgcaga

SEQ ID NO: 381068 - DNA, 25 bp, Mus musculus
gcggccggccaaaccatgtttcgaa

SEQ ID NO: 381069 - DNA, 25 bp, Mus musculus
taacccgcataagggcgcggagagt

SEQ ID NO: 381070 - DNA, 25 bp, Mus musculus
agtcgtgagtaacccgcataagggc

SEQ ID NO: 381071 - DNA, 25 bp, Mus musculus
ttccgattggtcgaagcctcgggcc

SEQ ID NO: 381072 - DNA, 25 bp, Mus musculus
gccaaagccgcgtccaccgccgcct

SEQ ID NO: 381073 - DNA, 25 bp, Mus musculus
tggctcgtgctcgtgagcctctcgc

SEQ ID NO: 381074 - DNA, 25 bp, Mus musculus
cctccagtcgtgagtaacccgcata

SEQ ID NO: 381075 - DNA, 25 bp, Mus musculus
tcctcgctggctcgtgctcgtgagc

SEQ ID NO: 381076 - DNA, 25 bp, Mus musculus
agaagcacccgctgtctatacgaca

SEQ ID NO: 381077 - DNA, 25 bp, Mus musculus
tgtctatacgacagcataaccagaa

SEQ ID NO: 381078 - DNA, 25 bp, Mus musculus
tctatacgacagcataaccagaagc

SEQ ID NO: 381079 - DNA, 25 bp, Mus musculus
acagcataaccagaagcacccgctg

SEQ ID NO: 381080 - DNA, 25 bp, Mus musculus
cataaccagaagcacccgctgtcta

SEQ ID NO: 381081 - DNA, 25 bp, Mus musculus
cacccgctgtctatacgacagcata

SEQ ID NO: 381082 - DNA, 25 bp, Mus musculus
tacgacagcataaccagaagcaccc

SEQ ID NO: 381083 - DNA, 25 bp, Mus musculus
gaagcacccgctgtctatacgacag

SEQ ID NO: 381084 - DNA, 25 bp, Mus musculus
ctatacgacagcataaccagaagca

SEQ ID NO: 381085 - DNA, 25 bp, Mus musculus
gcataaccagaagcacccgctgtct

SEQ ID NO: 381086 - DNA, 25 bp, Mus musculus
cagaagcacccgctgtctatacgac

SEQ ID NO: 381087 - DNA, 25 bp, Mus musculus
cccgctgtctatacgacagcataac

SEQ ID NO: 381088 - DNA, 25 bp, Mus musculus
agcataaccagaagcacccgctgtc

SEQ ID NO: 381089 - DNA, 25 bp, Mus musculus
tatacgacagcataaccagaagcac

SEQ ID NO: 381090 - DNA, 25 bp, Mus musculus
ggcaggaagcgcgatcagaaatcca

SEQ ID NO: 381091 - DNA, 25 bp, Mus musculus
cgcgactttctaggtacgggatagg

SEQ ID NO: 381092 - DNA, 25 bp, Mus musculus
agcgcacagccaatcgttgacgaga

SEQ ID NO: 381093 - DNA, 25 bp, Mus musculus
caccctcaggtgctacaggctggca

SEQ ID NO: 381094 - DNA, 25 bp, Mus musculus
agtgtgagaagcaacccgccaccgg

SEQ ID NO: 381095 - DNA, 25 bp, Mus musculus
gcatcctctggtccgccggaagcgt

SEQ ID NO: 381096 - DNA, 25 bp, Mus musculus
agactgtgatagacgccggcatctc

SEQ ID NO: 381097 - DNA, 25 bp, Mus musculus
tcgccatcatagagagagcccgtgc

SEQ ID NO: 381098 - DNA, 25 bp, Mus musculus
tgggcaactggaggtcgccatcata

SEQ ID NO: 381099 - DNA, 25 bp, Mus musculus
agcagcctttgctcaggtgcggacc

SEQ ID NO: 381100 - DNA, 25 bp, Mus musculus
ctcgcgatcccgtgagaacggggtc

SEQ ID NO: 381101 - DNA, 25 bp, Mus musculus
cgagcggtacccaaacgcaaaggtg

SEQ ID NO: 381102 - DNA, 25 bp, Mus musculus
ggcaaacacccatctaacacggcga

SEQ ID NO: 381103 - DNA, 25 bp, Mus musculus
agaaatccatcctaggccaccggca

SEQ ID NO: 381104 - DNA, 25 bp, Mus musculus
ctgcccttcagagaggcgtggccca

SEQ ID NO: 381105 - DNA, 25 bp, Mus musculus
ggccttcacctacccgcctctggat

SEQ ID NO: 381106 - DNA, 25 bp, Mus musculus
tctcagctgcccgactccaaaatgg

SEQ ID NO: 381107 - DNA, 25 bp, Mus musculus
tcggtgcccactgccaagggtagag

SEQ ID NO: 381108 - DNA, 25 bp, Mus musculus
gtcacggtaggctgcccttcagaga

SEQ ID NO: 381109 - DNA, 25 bp, Mus musculus
ttgcctggccgcaggtgccctggat

SEQ ID NO: 381110 - DNA, 25 bp, Mus musculus
cgcgcgtagtgggagcttactcgca

SEQ ID NO: 381111 - DNA, 25 bp, Mus musculus
gcttactcgcagtaggctctcggta

SEQ ID NO: 381112 - DNA, 25 bp, Mus musculus
gctctcggtacgtctcggaggaatt

SEQ ID NO: 381113 - DNA, 25 bp, Mus musculus
tacgtctcggaggaattgcttttcg

SEQ ID NO: 381114 - DNA, 25 bp, Mus musculus
ccgataggagggcattcgtcatcgg

SEQ ID NO: 381115 - DNA, 25 bp, Mus musculus
ggaggtcgtcggtgcccactgccaa

SEQ ID NO: 381116 - DNA, 25 bp, Mus musculus
actggctcctccctcttcggccgaa

SEQ ID NO: 381117 - DNA, 25 bp, Mus musculus
cccgcctgccattggtcacggtagg

SEQ ID NO: 381118 - DNA, 25 bp, Mus musculus
ggtagaactcgaagcggccttcaga

SEQ ID NO: 381119 - DNA, 25 bp, Mus musculus
aaagacagtgactcgggtgccaccc

SEQ ID NO: 381120 - DNA, 25 bp, Mus musculus
ggagagactcctactcgcggcacgc

SEQ ID NO: 381121 - DNA, 25 bp, Mus musculus
ggaaagaagaaacattcctgttcca

SEQ ID NO: 381122 - DNA, 25 bp, Mus musculus
tcctgttccacaaagacccagagtt

SEQ ID NO: 381123 - DNA, 25 bp, Mus musculus
agacccagagttcattggataccga

SEQ ID NO: 381124 - DNA, 25 bp, Mus musculus
agagcggcgctatggagtcagctcc

SEQ ID NO: 381125 - DNA, 25 bp, Mus musculus
tggagtcagctccatgcaggacatg

SEQ ID NO: 381126 - DNA, 25 bp, Mus musculus
atgcaggacatggacagcgtttcta

SEQ ID NO: 381127 - DNA, 25 bp, Mus musculus
acatggacagcgtttctagccgcgc

SEQ ID NO: 381128 - DNA, 25 bp, Mus musculus
acagcgtttctagccgcgcggtcgg

SEQ ID NO: 381129 - DNA, 25 bp, Mus musculus
tttggtagaactcgaagcggccttc

SEQ ID NO: 381130 - DNA, 25 bp, Mus musculus
ttgcacggagagactcctactcgcg

SEQ ID NO: 381131 - DNA, 25 bp, Mus musculus
tcattggataccgagaaaaagtttg

SEQ ID NO: 381132 - DNA, 25 bp, Mus musculus
attacgttggtagagtccgtccagc

SEQ ID NO: 381133 - DNA, 25 bp, Mus musculus
tggtagagtccgtccagctgcgttc

SEQ ID NO: 381134 - DNA, 25 bp, Mus musculus
ttggtagagtccgtccagctgcgtt

SEQ ID NO: 381135 - DNA, 25 bp, Mus musculus
gtagagtccgtccagctgcgttctc

SEQ ID NO: 381136 - DNA, 25 bp, Mus musculus
acgttggtagagtccgtccagctgc

SEQ ID NO: 381137 - DNA, 25 bp, Mus musculus
tacgttggtagagtccgtccagctg

SEQ ID NO: 381138 - DNA, 25 bp, Mus musculus
ttacgttggtagagtccgtccagct

SEQ ID NO: 381139 - DNA, 25 bp, Mus musculus
taattacgttggtagagtccgtcca

SEQ ID NO: 381140 - DNA, 25 bp, Mus musculus
cacttccttaattacgttggtagag

SEQ ID NO: 381141 - DNA, 25 bp, Mus musculus
tcacttccttaattacgttggtaga

SEQ ID NO: 381142 - DNA, 25 bp, Mus musculus
cgctttcacttccttaattacgttg

SEQ ID NO: 381143 - DNA, 25 bp, Mus musculus
gtgacagcgctaacgccttcaggcc

SEQ ID NO: 381144 - DNA, 25 bp, Mus musculus
ggtagagtccgtccagctgcgttct

SEQ ID NO: 381145 - DNA, 25 bp, Mus musculus
cgccgctttcacttccttaattacg

SEQ ID NO: 381146 - DNA, 25 bp, Mus musculus
ctgcagtatatctgccgcgcagtga

SEQ ID NO: 381147 - DNA, 25 bp, Mus musculus
ccgttgctaacgatatcactgaata

SEQ ID NO: 381148 - DNA, 25 bp, Mus musculus
ccagctcttgcatgttttttgaacc

SEQ ID NO: 381149 - DNA, 25 bp, Mus musculus
gtcacggggcttctcgaacactata

SEQ ID NO: 381150 - DNA, 25 bp, Mus musculus
acaacttcagcttcgatgcccatga

SEQ ID NO: 381151 - DNA, 25 bp, Mus musculus
cccggatcgagcagtggaaccacaa

SEQ ID NO: 381152 - DNA, 25 bp, Mus musculus
acagccacgcgcacgttagcagaca

SEQ ID NO: 381153 - DNA, 25 bp, Mus musculus
gagcttccgccgctacaacaggtct

SEQ ID NO: 381154 - DNA, 25 bp, Mus musculus
ggaggactacctcttctctgtgagc

SEQ ID NO: 381155 - DNA, 25 bp, Mus musculus
aaggcacgttcttgctcagggactc

SEQ ID NO: 381156 - DNA, 25 bp, Mus musculus
gatacgaggccgaagcccttctaga

SEQ ID NO: 381157 - DNA, 25 bp, Mus musculus
tgcttcagatcacagggaatccctg

SEQ ID NO: 381158 - DNA, 25 bp, Mus musculus
tgcctcgtgccagatttgcttcaga

SEQ ID NO: 381159 - DNA, 25 bp, Mus musculus
cgcgcagtgatctgcagatgcacta

SEQ ID NO: 381160 - DNA, 25 bp, Mus musculus
ccgtgggttcgctcaccccgataat

SEQ ID NO: 381161 - DNA, 25 bp, Mus musculus
tgctcagccgggcagacacgtctgg

SEQ ID NO: 381162 - DNA, 25 bp, Mus musculus
ccgaaaccctctcggaagacaggct

SEQ ID NO: 381163 - DNA, 25 bp, Mus musculus
aaaccctctcggaagacaggctgcc

SEQ ID NO: 381164 - DNA, 25 bp, Mus musculus
tctcggaagacaggctgcctccgtg

SEQ ID NO: 381165 - DNA, 25 bp, Mus musculus
caaacaacagcgcggtgctcagccg

SEQ ID NO: 381166 - DNA, 25 bp, Mus musculus
ccacccgggcctcccattctcgagc

SEQ ID NO: 381167 - DNA, 25 bp, Mus musculus
gacgcagtcgcgaagcactccaacg

SEQ ID NO: 381168 - DNA, 25 bp, Mus musculus
gtcgcgaagcactccaacgtgaacc

SEQ ID NO: 381169 - DNA, 25 bp, Mus musculus
gcgaagcactccaacgtgaaccttg

SEQ ID NO: 381170 - DNA, 25 bp, Mus musculus
actccaacgtgaaccttgccagctg

SEQ ID NO: 381171 - DNA, 25 bp, Mus musculus
aacgtgaaccttgccagctgccgtc

SEQ ID NO: 381172 - DNA, 25 bp, Mus musculus
accttgccagctgccgtccctggga

SEQ ID NO: 381173 - DNA, 25 bp, Mus musculus
acaggtcccgctgcgccctgaaggt

SEQ ID NO: 381174 - DNA, 25 bp, Mus musculus
ggatgccgtctgcactcccgtcaag

SEQ ID NO: 381175 - DNA, 25 bp, Mus musculus
gcctcgtccaggaagcgcgactcaa

SEQ ID NO: 381176 - DNA, 25 bp, Mus musculus
gagcgcgcgaaaagcaccgcctcgt

SEQ ID NO: 381177 - DNA, 25 bp, Mus musculus
agcggcaggttcaccactctggaca

SEQ ID NO: 381178 - DNA, 25 bp, Mus musculus
ggcggcagtagcaaccggcgaaaca

SEQ ID NO: 381179 - DNA, 25 bp, Mus musculus
gcatctgcagatgctgggcatttcc

SEQ ID NO: 381180 - DNA, 25 bp, Mus musculus
agctcctgctcgaagatggctgcga

SEQ ID NO: 381181 - DNA, 25 bp, Mus musculus
ctgcacaggaggagacagcagcgtc

SEQ ID NO: 381182 - DNA, 25 bp, Mus musculus
ttaaagtgagcacccagtcagcggc

SEQ ID NO: 381183 - DNA, 25 bp, Mus musculus
tgacggggccaccacacaaagccgg

SEQ ID NO: 381184 - DNA, 25 bp, Mus musculus
gctcctcggatttgtgacgtgcctc

SEQ ID NO: 381185 - DNA, 25 bp, Mus musculus
agcccgggaccaggactgtcctgtc

SEQ ID NO: 381186 - DNA, 25 bp, Mus musculus
gcgcacggcacccacctgaaggtgg

SEQ ID NO: 381187 - DNA, 25 bp, Mus musculus
ccaggccaagagtcctgacgggatg

SEQ ID NO: 381188 - DNA, 25 bp, Mus musculus
cgcctcatccagataacggaaccta

SEQ ID NO: 381189 - DNA, 25 bp, Mus musculus
cgactcatctaaaagggaacccaag

SEQ ID NO: 381190 - DNA, 25 bp, Mus musculus
gtccctctggcgaggacagttctga

SEQ ID NO: 381191 - DNA, 25 bp, Mus musculus
cctctttagtcaatccgcttcagca

SEQ ID NO: 381192 - DNA, 25 bp, Mus musculus
tttccgagacgcgaccagacaaccg

SEQ ID NO: 381193 - DNA, 25 bp, Mus musculus
gaacctagcgaacgagtcccggcca

SEQ ID NO: 381194 - DNA, 25 bp, Mus musculus
tcactgggcagacacgcaagagaga

SEQ ID NO: 381195 - DNA, 25 bp, Mus musculus
cggatgacgtaagtgggttccactc

SEQ ID NO: 381196 - DNA, 25 bp, Mus musculus
ggttccactcccaggcaagccgtta

SEQ ID NO: 381197 - DNA, 25 bp, Mus musculus
aaccgcgcctggcaggagctacttt

SEQ ID NO: 381198 - DNA, 25 bp, Mus musculus
cgaacctcgttgagcttgctgctga

SEQ ID NO: 381199 - DNA, 25 bp, Mus musculus
tttgtacctgcaatgcgtcactttc

SEQ ID NO: 381200 - DNA, 25 bp, Mus musculus
gtcactttctctcgcagccggaacg

SEQ ID NO: 381201 - DNA, 25 bp, Mus musculus
cgcactcaccatgctgcaagggcta

SEQ ID NO: 381202 - DNA, 25 bp, Mus musculus
tcacgtccagtctcgtccgtgtgtc

SEQ ID NO: 381203 - DNA, 25 bp, Mus musculus
agtctcgtccgtgtgtccgcgacat

SEQ ID NO: 381204 - DNA, 25 bp, Mus musculus
gtgtgtccgcgacatccggtccttc

SEQ ID NO: 381205 - DNA, 25 bp, Mus musculus
agcgcgactgtcctccgagccgtcc

SEQ ID NO: 381206 - DNA, 25 bp, Mus musculus
gcgcacagcgctcagtccgtccgcc

SEQ ID NO: 381207 - DNA, 25 bp, Mus musculus
tctggtccgggacagcgcacacctg

SEQ ID NO: 381208 - DNA, 25 bp, Mus musculus
ctttcggctttcacgtccagtctcg

SEQ ID NO: 381209 - DNA, 25 bp, Mus musculus
gacttggtatccctttcggctttca

SEQ ID NO: 381210 - DNA, 25 bp, Mus musculus
gaagttctcggtttgacttggtatc

SEQ ID NO: 381211 - DNA, 25 bp, Mus musculus
tgtctttcgtccaggaagttctcgg

SEQ ID NO: 381212 - DNA, 25 bp, Mus musculus
attgtctattgtctttcgtccagga

SEQ ID NO: 381213 - DNA, 25 bp, Mus musculus
gcgcaaagtcaagtattgtctattg

SEQ ID NO: 381214 - DNA, 25 bp, Mus musculus
cgcagcgcaaagtcaagtattgtct

SEQ ID NO: 381215 - DNA, 25 bp, Mus musculus
tccgggacagcgcacacctggagag

SEQ ID NO: 381216 - DNA, 25 bp, Mus musculus
aggagcgccaccgacaagagctagg

SEQ ID NO: 381217 - DNA, 25 bp, Mus musculus
gcgccaccgacaagagctaggagcg

SEQ ID NO: 381218 - DNA, 25 bp, Mus musculus
caacaagagctatgagcgccccaac

SEQ ID NO: 381219 - DNA, 25 bp, Mus musculus
gccaccgacaagagctaggagcgcc

SEQ ID NO: 381220 - DNA, 25 bp, Mus musculus
ggagcgccaccgacaagagctagga

SEQ ID NO: 381221 - DNA, 25 bp, Mus musculus
ccaacgagagctaggagcgccaccg

SEQ ID NO: 381222 - DNA, 25 bp, Mus musculus
caagagctatgagcgccccaacgag

SEQ ID NO: 381223 - DNA, 25 bp, Mus musculus
gctaggagcgccaccgacaagagct

SEQ ID NO: 381224 - DNA, 25 bp, Mus musculus
cgccaccgacaagagctaggagcgc

SEQ ID NO: 381225 - DNA, 25 bp, Mus musculus
ctaggagcgccaccgacaagagcta

SEQ ID NO: 381226 - DNA, 25 bp, Mus musculus
caacgagagctaggagcgccaccga

SEQ ID NO: 381227 - DNA, 25 bp, Mus musculus
acaagagctatgagcgccccaacga

SEQ ID NO: 381228 - DNA, 25 bp, Mus musculus
tatgagcgccccaacaagagctatg

SEQ ID NO: 381229 - DNA, 25 bp, Mus musculus
tgagcgccccaacaagagctatgag

SEQ ID NO: 381230 - DNA, 25 bp, Mus musculus
tggcgactccaacttggggttccaa

SEQ ID NO: 381231 - DNA, 25 bp, Mus musculus
cccagtctggcgactccaacttggg

SEQ ID NO: 381232 - DNA, 25 bp, Mus musculus
cttcgttgctgcgacctaccagtca

SEQ ID NO: 381233 - DNA, 25 bp, Mus musculus
tcgttgctgcgacctaccagtcagc

SEQ ID NO: 381234 - DNA, 25 bp, Mus musculus
gacctaccagtcagccctccctccc

SEQ ID NO: 381235 - DNA, 25 bp, Mus musculus
gaggccgctatgcacctgcgcgtcg

SEQ ID NO: 381236 - DNA, 25 bp, Mus musculus
cggccgggatggatgagcggccacc

SEQ ID NO: 381237 - DNA, 25 bp, Mus musculus
gccgctatgcacctgcgcgtcggag

SEQ ID NO: 381238 - DNA, 25 bp, Mus musculus
agttccaaggcgctggccttcgttg

SEQ ID NO: 381239 - DNA, 25 bp, Mus musculus
tggggttccaagttccaaggcgctg

SEQ ID NO: 381240 - DNA, 25 bp, Mus musculus
ttccaagttccaaggcgctggcctt

SEQ ID NO: 381241 - DNA, 25 bp, Mus musculus
gtctggcgactccaacttggggttc

SEQ ID NO: 381242 - DNA, 25 bp, Mus musculus
aggcgggcccgctgggacttactgg

SEQ ID NO: 381243 - DNA, 25 bp, Mus musculus
ggccttcgttgctgcgacctaccag

SEQ ID NO: 381244 - DNA, 25 bp, Mus musculus
gcgacttttacacggcgcacggaga

SEQ ID NO: 381245 - DNA, 25 bp, Mus musculus
aaatggcggtgcagcctaaggagac

SEQ ID NO: 381246 - DNA, 25 bp, Mus musculus
tcgaccgcggcgacttttacacggc

SEQ ID NO: 381247 - DNA, 25 bp, Mus musculus
cccgcgaggtgttcaagacccaggg

SEQ ID NO: 381248 - DNA, 25 bp, Mus musculus
ttgccggaaacctgggcgcatgcag

SEQ ID NO: 381249 - DNA, 25 bp, Mus musculus
cgggccacgcgtttagcatcttgtt

SEQ ID NO: 381250 - DNA, 25 bp, Mus musculus
tgttttggttcgcttccgcacagtg

SEQ ID NO: 381251 - DNA, 25 bp, Mus musculus
catgccggagaagccgagcaccacg

SEQ ID NO: 381252 - DNA, 25 bp, Mus musculus
catgcgcagtagctagagtcctaga

SEQ ID NO: 381253 - DNA, 25 bp, Mus musculus
tagagtcctagagttcgcgggaagc

SEQ ID NO: 381254 - DNA, 25 bp, Mus musculus
gacccagggcgtgatcaagtacatg

SEQ ID NO: 381255 - DNA, 25 bp, Mus musculus
ttggctactgcggtagactcccacc

SEQ ID NO: 381256 - DNA, 25 bp, Mus musculus
tcgtgcgcttctttgagggcatgcc

SEQ ID NO: 381257 - DNA, 25 bp, Mus musculus
ctgggaccttgctcgcttatgattg

SEQ ID NO: 381258 - DNA, 25 bp, Mus musculus
aagatggagagagagccggctaagc

SEQ ID NO: 381259 - DNA, 25 bp, Mus musculus
agatggagagagagccggctaagcg

SEQ ID NO: 381260 - DNA, 25 bp, Mus musculus
cggctaagcgtgtaaggtggagaga

SEQ ID NO: 381261 - DNA, 25 bp, Mus musculus
gagagagccggctaagcgtgtaaga

SEQ ID NO: 381262 - DNA, 25 bp, Mus musculus
aagcgtgtaaggtggagagagagcc

SEQ ID NO: 381263 - DNA, 25 bp, Mus musculus
cggctaagcgtgtaaggtggagagc

SEQ ID NO: 381264 - DNA, 25 bp, Mus musculus
ggtggagagagagccggctaagcgt

SEQ ID NO: 381265 - DNA, 25 bp, Mus musculus
taagatggagagagagccggctaag

SEQ ID NO: 381266 - DNA, 25 bp, Mus musculus
agagcgagccggctaagcgtgtaag

SEQ ID NO: 381267 - DNA, 25 bp, Mus musculus
agcgagccggctaagcgtgtaaggt

SEQ ID NO: 381268 - DNA, 25 bp, Mus musculus
gagcgagccggctaagcgtgtaagg

SEQ ID NO: 381269 - DNA, 25 bp, Mus musculus
agagccggctaagcgtgtaaggtgg

SEQ ID NO: 381270 - DNA, 25 bp, Mus musculus
taagcgtgtaaggtggagagagagc

SEQ ID NO: 381271 - DNA, 25 bp, Mus musculus
gtaaggtggagagcgagccggctaa

SEQ ID NO: 381272 - DNA, 25 bp, Mus musculus
agcgacaccttgttggacgccgtga

SEQ ID NO: 381273 - DNA, 25 bp, Mus musculus
cttccacgctggtgtacatggccga

SEQ ID NO: 381274 - DNA, 25 bp, Mus musculus
atagagatgagctcgcccgacaggc

SEQ ID NO: 381275 - DNA, 25 bp, Mus musculus
gccagcagcgagatgatgcgctcta

SEQ ID NO: 381276 - DNA, 25 bp, Mus musculus
caggcgcgcatgatgaaggccagca

SEQ ID NO: 381277 - DNA, 25 bp, Mus musculus
cccaggatgagcagcacgtggtaca

SEQ ID NO: 381278 - DNA, 25 bp, Mus musculus
agcagaagtagagcgagtccacgta

SEQ ID NO: 381279 - DNA, 25 bp, Mus musculus
cagcacacgccgagcaggatgaaga

SEQ ID NO: 381280 - DNA, 25 bp, Mus musculus
cgttgaagagcgagtagatgcagca

SEQ ID NO: 381281 - DNA, 25 bp, Mus musculus
gctcagcttgcgcagcatccagttg

SEQ ID NO: 381282 - DNA, 25 bp, Mus musculus
acgccgtgaggtcgcgcatagagat

SEQ ID NO: 381283 - DNA, 25 bp, Mus musculus
ccgtctcggacagctgcttctgcag

SEQ ID NO: 381284 - DNA, 25 bp, Mus musculus
aagccgttctgtcgcgtgttgacgc

SEQ ID NO: 381285 - DNA, 25 bp, Mus musculus
gtggtacaccgagggcttccagccc

SEQ ID NO: 381286 - DNA, 25 bp, Mus musculus
agccgaacccgactttcgattctcg

SEQ ID NO: 381287 - DNA, 25 bp, Mus musculus
tgccagctcgctaaaaaacctcgtc

SEQ ID NO: 381288 - DNA, 25 bp, Mus musculus
ttcaacttggtgctttgaggtctca

SEQ ID NO: 381289 - DNA, 25 bp, Mus musculus
cgcttgggctccgaaatgtcttcct

SEQ ID NO: 381290 - DNA, 25 bp, Mus musculus
actgccgttctggatgccagctcgc

SEQ ID NO: 381291 - DNA, 25 bp, Mus musculus
cagagcaggtgtcccactgccgttc

SEQ ID NO: 381292 - DNA, 25 bp, Mus musculus
aacagtgcgtcccaccagagcaggt

SEQ ID NO: 381293 - DNA, 25 bp, Mus musculus
tccaggtcgttctggccgcaacagt

SEQ ID NO: 381294 - DNA, 25 bp, Mus musculus
ttcctttccctgctaccgctgaaga

SEQ ID NO: 381295 - DNA, 25 bp, Mus musculus
agcccagccttgtcctccggggaag

SEQ ID NO: 381296 - DNA, 25 bp, Mus musculus
ctctggagcgttccatgaggctgct

SEQ ID NO: 381297 - DNA, 25 bp, Mus musculus
gtgaaccgtagagtccggacgccta

SEQ ID NO: 381298 - DNA, 25 bp, Mus musculus
ggccgcatactccactctggacagg

SEQ ID NO: 381299 - DNA, 25 bp, Mus musculus
tttctcaagccactgggaaactttg

SEQ ID NO: 381300 - DNA, 25 bp, Mus musculus
ggcaagggctctggcctcgctgccc

SEQ ID NO: 381301 - DNA, 25 bp, Mus musculus
catcatctctctgcccttgcagggg

SEQ ID NO: 381302 - DNA, 25 bp, Mus musculus
atctctctgcccttgcaggggggtt

SEQ ID NO: 381303 - DNA, 25 bp, Mus musculus
cgggcaacgggttcaacctcgcgtg

SEQ ID NO: 381304 - DNA, 25 bp, Mus musculus
gcaacgggttcaacctcgcgtgggc

SEQ ID NO: 381305 - DNA, 25 bp, Mus musculus
gttcaacctcgcgtgggccggagta

SEQ ID NO: 381306 - DNA, 25 bp, Mus musculus
ttcaacctcgcgtgggccggagtag

SEQ ID NO: 381307 - DNA, 25 bp, Mus musculus
tgggccggagtaggagcctcgcagc

SEQ ID NO: 381308 - DNA, 25 bp, Mus musculus
cgcacccagggaggctggcgggtgc

SEQ ID NO: 381309 - DNA, 25 bp, Mus musculus
cgctcgggtacgccctctcctctcc

SEQ ID NO: 381310 - DNA, 25 bp, Mus musculus
ctcgctgcccccaacaccatgcccg

SEQ ID NO: 381311 - DNA, 25 bp, Mus musculus
cactccgcggcactgggggtgtgct

SEQ ID NO: 381312 - DNA, 25 bp, Mus musculus
tcccactggcgaaggggaggcttcc

SEQ ID NO: 381313 - DNA, 25 bp, Mus musculus
tgccggcaagggctctggcctcgct

SEQ ID NO: 381314 - DNA, 25 bp, Mus musculus
ctgctttgcaaaggctcagtctcaa

SEQ ID NO: 381315 - DNA, 25 bp, Mus musculus
cgcaggccgacacgccttcggattg

SEQ ID NO: 381316 - DNA, 25 bp, Mus musculus
gatgcgatccttgtaggcgctcgga

SEQ ID NO: 381317 - DNA, 25 bp, Mus musculus
gaggcctcacgccaaggtgccgctg

SEQ ID NO: 381318 - DNA, 25 bp, Mus musculus
ggtctgcccgtcagccttcatcatg

SEQ ID NO: 381319 - DNA, 25 bp, Mus musculus
tggtgcatacttgcccgggtagcca

SEQ ID NO: 381320 - DNA, 25 bp, Mus musculus
tcatgtcccgacaaagcaccttgta

SEQ ID NO: 381321 - DNA, 25 bp, Mus musculus
ccggcactcggcgacaccaagaagg

SEQ ID NO: 381322 - DNA, 25 bp, Mus musculus
agcaagcgagcgcactcccactgtg

SEQ ID NO: 381323 - DNA, 25 bp, Mus musculus
caaaggatctcaacggagggctgcg

SEQ ID NO: 381324 - DNA, 25 bp, Mus musculus
cctcgtcgccggaggcaaaggatct

SEQ ID NO: 381325 - DNA, 25 bp, Mus musculus
caggtgtttccgcagcgagctcgac

SEQ ID NO: 381326 - DNA, 25 bp, Mus musculus
gccacttccgtcttcttggtgcata

SEQ ID NO: 381327 - DNA, 25 bp, Mus musculus
accgcgagctccactgctttgcaaa

SEQ ID NO: 381328 - DNA, 25 bp, Mus musculus
cttttcgcggcgttgttccaatcct

SEQ ID NO: 381329 - DNA, 25 bp, Mus musculus
ggcaaactgtgcagcaaagatgttg

SEQ ID NO: 381330 - DNA, 25 bp, Mus musculus
cagcaaagatgttgtggtcgagaga

SEQ ID NO: 381331 - DNA, 25 bp, Mus musculus
ctaccacgagaaagggggagcccag

SEQ ID NO: 381332 - DNA, 25 bp, Mus musculus
ccagatcgagccaggcgcagaaagg

SEQ ID NO: 381333 - DNA, 25 bp, Mus musculus
cgaaaccaaacaaagcgcggcctga

SEQ ID NO: 381334 - DNA, 25 bp, Mus musculus
gcggatcgcgcagccgcggcttttc

SEQ ID NO: 381335 - DNA, 25 bp, Mus musculus
ttctgtaactaaaggcaaactgtgc

SEQ ID NO: 381336 - DNA, 25 bp, Mus musculus
aacactgcggcacggtgggacccgc

SEQ ID NO: 381337 - DNA, 25 bp, Mus musculus
gttgttccaatcctgaggcggcggc

SEQ ID NO: 381338 - DNA, 25 bp, Mus musculus
gcgacactcgcctgggtctccggtt

SEQ ID NO: 381339 - DNA, 25 bp, Mus musculus
tcggacggagttcatttgccgggct

SEQ ID NO: 381340 - DNA, 25 bp, Mus musculus
ttggcggctcggacggagttcattt

SEQ ID NO: 381341 - DNA, 25 bp, Mus musculus
gcccaggcgaacactgcggcacggt

SEQ ID NO: 381342 - DNA, 25 bp, Mus musculus
attcccaggattccagcccgggaga

SEQ ID NO: 381343 - DNA, 25 bp, Mus musculus
cctgggaaaatgtccggagctgagc

SEQ ID NO: 381344 - DNA, 25 bp, Mus musculus
tcggacttagctcggcaaggcaaac

SEQ ID NO: 381345 - DNA, 25 bp, Mus musculus
ggacgattttgagcccagccacagg

SEQ ID NO: 381346 - DNA, 25 bp, Mus musculus
cgcagcccttggtgtagggagaatt

SEQ ID NO: 381347 - DNA, 25 bp, Mus musculus
ttccttgggcttccacttcccagga

SEQ ID NO: 381348 - DNA, 25 bp, Mus musculus
agcagctctcttgtcattccttggg

SEQ ID NO: 381349 - DNA, 25 bp, Mus musculus
ttagacatgacgaaggcgacctgga

SEQ ID NO: 381350 - DNA, 25 bp, Mus musculus
ccggcagcgtatcgggagttagaca

SEQ ID NO: 381351 - DNA, 25 bp, Mus musculus
aggcattttgtctgcttcgccggca

SEQ ID NO: 381352 - DNA, 25 bp, Mus musculus
ttcgcaaccgaggaaggaacttcca

SEQ ID NO: 381353 - DNA, 25 bp, Mus musculus
tcgggtggcatagatggttcgcaac

SEQ ID NO: 381354 - DNA, 25 bp, Mus musculus
caatccagctggaaagacccgctcg

SEQ ID NO: 381355 - DNA, 25 bp, Mus musculus
cagccacaggccttgggccagtatc

SEQ ID NO: 381356 - DNA, 25 bp, Mus musculus
agcagctgcggtgctctgccatatt

SEQ ID NO: 381357 - DNA, 25 bp, Mus musculus
tgccatattgtgtctggcccggccc

SEQ ID NO: 381358 - DNA, 25 bp, Mus musculus
ctcgcctctggttcgcggcggctga

SEQ ID NO: 381359 - DNA, 25 bp, Mus musculus
gaggactcgcgtaaacttcgggcgc

SEQ ID NO: 381360 - DNA, 25 bp, Mus musculus
gccaagcgccttggcgccgcgttgt

SEQ ID NO: 381361 - DNA, 25 bp, Mus musculus
taatggtggttatttgcggccgcca

SEQ ID NO: 381362 - DNA, 25 bp, Mus musculus
tgacgcgccgggacatttttgtgtc

SEQ ID NO: 381363 - DNA, 25 bp, Mus musculus
tttgtgtcccgggaagaattggcgc

SEQ ID NO: 381364 - DNA, 25 bp, Mus musculus
gagtgaggagttaggagttttctcc

SEQ ID NO: 381365 - DNA, 25 bp, Mus musculus
taggagttttctcccgaggtaatga

SEQ ID NO: 381366 - DNA, 25 bp, Mus musculus
agccacagagggcagaggacgccca

SEQ ID NO: 381367 - DNA, 25 bp, Mus musculus
gacgcccaggcggaaacttgcgacc

SEQ ID NO: 381368 - DNA, 25 bp, Mus musculus
ccgggagttgctgctctaagagtcc

SEQ ID NO: 381369 - DNA, 25 bp, Mus musculus
tgcccaggaggactcgcgtaaactt

SEQ ID NO: 381370 - DNA, 25 bp, Mus musculus
cgtcaaaaagagtagcatgggaatt

SEQ ID NO: 381371 - DNA, 25 bp, Mus musculus
gaggtcggtaaggacccggctcagc

SEQ ID NO: 381372 - DNA, 25 bp, Mus musculus
aggcgcctgaggtggcttgcactcc

SEQ ID NO: 381373 - DNA, 25 bp, Mus musculus
gcacctgcctatagagccaccagtg

SEQ ID NO: 381374 - DNA, 25 bp, Mus musculus
tgcctatagagccaccagtgacccg

SEQ ID NO: 381375 - DNA, 25 bp, Mus musculus
ctatagagccaccagtgacccgtca

SEQ ID NO: 381376 - DNA, 25 bp, Mus musculus
gagccaccagtgacccgtcaaaaag

SEQ ID NO: 381377 - DNA, 25 bp, Mus musculus
tgacccgtcaaaaagagtagcatgg

SEQ ID NO: 381378 - DNA, 25 bp, Mus musculus
aaagagtagcatgggaattcggacg

SEQ ID NO: 381379 - DNA, 25 bp, Mus musculus
agcatgggaattcggacggcgacaa

SEQ ID NO: 381380 - DNA, 25 bp, Mus musculus
aattcggacggcgacaaaggctggc

SEQ ID NO: 381381 - DNA, 25 bp, Mus musculus
gcgttcggcgttgcggccaccgcct

SEQ ID NO: 381382 - DNA, 25 bp, Mus musculus
gtggcttgcactccgggctctggcc

SEQ ID NO: 381383 - DNA, 25 bp, Mus musculus
ccagtgacccgtcaaaaagagtagc

SEQ ID NO: 381384 - DNA, 25 bp, Mus musculus
agactttcagccagagcctgcagga

SEQ ID NO: 381385 - DNA, 25 bp, Mus musculus
ggagctttcacacgcgcctccttgg

SEQ ID NO: 381386 - DNA, 25 bp, Mus musculus
tacaagcagattacgtcagctcctc

SEQ ID NO: 381387 - DNA, 25 bp, Mus musculus
cccgaatctgcctgcgtcacaatgg

SEQ ID NO: 381388 - DNA, 25 bp, Mus musculus
tcacaatggtgcgatctccggattg

SEQ ID NO: 381389 - DNA, 25 bp, Mus musculus
ttcctttccgcagccctataaaatg

SEQ ID NO: 381390 - DNA, 25 bp, Mus musculus
ctataaaatgagctgcacggcggcg

SEQ ID NO: 381391 - DNA, 25 bp, Mus musculus
caactctcgggatcctcggaggcta

SEQ ID NO: 381392 - DNA, 25 bp, Mus musculus
aagttcctccgcaccaaggggctca

SEQ ID NO: 381393 - DNA, 25 bp, Mus musculus
cgcggtgtccttcatctccaagttc

SEQ ID NO: 381394 - DNA, 25 bp, Mus musculus
gccaccatgataggcgagatcgccg

SEQ ID NO: 381395 - DNA, 25 bp, Mus musculus
ctgccgcctcctggcttgaaaataa

SEQ ID NO: 381396 - DNA, 25 bp, Mus musculus
ccgagcgatgtgaccaggccgccat

SEQ ID NO: 381397 - DNA, 25 bp, Mus musculus
cctcggagctggaaatgcaactctc

SEQ ID NO: 381398 - DNA, 25 bp, Mus musculus
cgactgcaggagagcccgtctccaa

SEQ ID NO: 381399 - DNA, 25 bp, Mus musculus
gtatgaattcatcccaaagagcagc

SEQ ID NO: 381400 - DNA, 25 bp, Mus musculus
aggatcctctgggagacagtggcta

SEQ ID NO: 381401 - DNA, 25 bp, Mus musculus
aaggcttccacagcgacgaggagac

SEQ ID NO: 381402 - DNA, 25 bp, Mus musculus
agcgacggtagcgaaggcttccaca

SEQ ID NO: 381403 - DNA, 25 bp, Mus musculus
tcatcccaaagagcagccacggcgg

SEQ ID NO: 381404 - DNA, 25 bp, Mus musculus
acagtggctacgcaccgcaagctcg

SEQ ID NO: 381405 - DNA, 25 bp, Mus musculus
ctctggggatgaggtgtatgaattc

SEQ ID NO: 381406 - DNA, 25 bp, Mus musculus
tgtcttctctgtcctctggggatga

SEQ ID NO: 381407 - DNA, 25 bp, Mus musculus
cagggcgagcatgtcttctctgtcc

SEQ ID NO: 381408 - DNA, 25 bp, Mus musculus
gcatccagggcgagcatgtcttctc

SEQ ID NO: 381409 - DNA, 25 bp, Mus musculus
taactacagtgccaacagcgtggcg

SEQ ID NO: 381410 - DNA, 25 bp, Mus musculus
ggcatcgacccaaaagccgaccata

SEQ ID NO: 381411 - DNA, 25 bp, Mus musculus
gccgaccataactacagtgccaaca

SEQ ID NO: 381412 - DNA, 25 bp, Mus musculus
aacatggcgtctagggtctcaggag

SEQ ID NO: 381413 - DNA, 25 bp, Mus musculus
ttgattctggctcgcccggaaacgg

SEQ ID NO: 381414 - DNA, 25 bp, Mus musculus
tggctcgcccggaaacgggtcgcca

SEQ ID NO: 381415 - DNA, 25 bp, Mus musculus
catcttcccgcctcttccaacatgg

SEQ ID NO: 381416 - DNA, 25 bp, Mus musculus
ttccaacatggcgtctagggtctca

SEQ ID NO: 381417 - DNA, 25 bp, Mus musculus
tccaacatggcgtctagggtctcag

SEQ ID NO: 381418 - DNA, 25 bp, Mus musculus
gcttgattctggctcgcccggaaac

SEQ ID NO: 381419 - DNA, 25 bp, Mus musculus
tctcaggaggggcaaaagcaccgca

SEQ ID NO: 381420 - DNA, 25 bp, Mus musculus
caggaggggcaaaagcaccgcacag

SEQ ID NO: 381421 - DNA, 25 bp, Mus musculus
gcaaaagcaccgcacaggcgggtcc

SEQ ID NO: 381422 - DNA, 25 bp, Mus musculus
aagcaccgcacaggcgggtccgtcg

SEQ ID NO: 381423 - DNA, 25 bp, Mus musculus
tcgggccgcacatgcgcgaaccgga

SEQ ID NO: 381424 - DNA, 25 bp, Mus musculus
ggtgatgtcaagacgtcgccccgcc

SEQ ID NO: 381425 - DNA, 25 bp, Mus musculus
cacatgcgcgaaccggagcaccaga

SEQ ID NO: 381426 - DNA, 25 bp, Mus musculus
cagggctccaggttctccagagata

SEQ ID NO: 381427 - DNA, 25 bp, Mus musculus
ctggagtctgcagtgccctacaaca

SEQ ID NO: 381428 - DNA, 25 bp, Mus musculus
ccggagggtcttcacttctacatga

SEQ ID NO: 381429 - DNA, 25 bp, Mus musculus
cgggaatccactaggtaaatccatt

SEQ ID NO: 381430 - DNA, 25 bp, Mus musculus
ccatttagcattgtgcgcggggaac

SEQ ID NO: 381431 - DNA, 25 bp, Mus musculus
actgggagaccacttcgccggtcca

SEQ ID NO: 381432 - DNA, 25 bp, Mus musculus
ctgctccagaggcaatctccgagtc

SEQ ID NO: 381433 - DNA, 25 bp, Mus musculus
gacttgtccggaaaagcagacccga

SEQ ID NO: 381434 - DNA, 25 bp, Mus musculus
tccttcggacagtcttctcagggtc

SEQ ID NO: 381435 - DNA, 25 bp, Mus musculus
cactacgcccgacgatgggttcaga

SEQ ID NO: 381436 - DNA, 25 bp, Mus musculus
gcaccgaagcatcctctggtacatg

SEQ ID NO: 381437 - DNA, 25 bp, Mus musculus
aagtgggcaccctcgtgaagacagc

SEQ ID NO: 381438 - DNA, 25 bp, Mus musculus
ttctacatgacagccatccaccggg

SEQ ID NO: 381439 - DNA, 25 bp, Mus musculus
ctgcttccaggtttgcagggctcca

SEQ ID NO: 381440 - DNA, 25 bp, Mus musculus
gaagagcccgctgaacaccgtcatg

SEQ ID NO: 381441 - DNA, 25 bp, Mus musculus
acaccgtcatgtccctgcgcttgga

SEQ ID NO: 381442 - DNA, 25 bp, Mus musculus
ttggacttgacctccacccacttgg

SEQ ID NO: 381443 - DNA, 25 bp, Mus musculus
cctgtgacgagttgacccggacgtc

SEQ ID NO: 381444 - DNA, 25 bp, Mus musculus
gaggctcgtcgtccagcttgacctc

SEQ ID NO: 381445 - DNA, 25 bp, Mus musculus
ggacgtcacggatccagcccttgaa

SEQ ID NO: 381446 - DNA, 25 bp, Mus musculus
tcgggcaggccttaccttggctgca

SEQ ID NO: 381447 - DNA, 25 bp, Mus musculus
tgcagtccttgccacggaagccggt

SEQ ID NO: 381448 - DNA, 25 bp, Mus musculus
aagccggtcctcgagcagtcgcata

SEQ ID NO: 381449 - DNA, 25 bp, Mus musculus
agcagtcgcatacggcctggtcgtc

SEQ ID NO: 381450 - DNA, 25 bp, Mus musculus
cgcaccgaggccagcgtgagcttga

SEQ ID NO: 381451 - DNA, 25 bp, Mus musculus
ccgccaccgctgttgggaggctcgt

SEQ ID NO: 381452 - DNA, 25 bp, Mus musculus
cgtccaccggcagggcctgtgacga

SEQ ID NO: 381453 - DNA, 25 bp, Mus musculus
ctggtcgtcgaccacggagcacacg

SEQ ID NO: 381454 - DNA, 25 bp, Mus musculus
tcgaaaagtcttggaccagctgtcc

SEQ ID NO: 381455 - DNA, 25 bp, Mus musculus
ccagctgtccgccaggaagtacctg

SEQ ID NO: 381456 - DNA, 25 bp, Mus musculus
acacgccttggtgggtgcccgtgta

SEQ ID NO: 381457 - DNA, 25 bp, Mus musculus
ccttcgaatgatgcacacgccttgg

SEQ ID NO: 381458 - DNA, 25 bp, Mus musculus
ttgtgaaagagttaaccttcgaatg

SEQ ID NO: 381459 - DNA, 25 bp, Mus musculus
cacgaaatccttaacgaagcctatc

SEQ ID NO: 381460 - DNA, 25 bp, Mus musculus
gatgtcgcccacgaaatccttaacg

SEQ ID NO: 381461 - DNA, 25 bp, Mus musculus
cgtcgcattctttgtttccccatta

SEQ ID NO: 381462 - DNA, 25 bp, Mus musculus
cttttacgtttgtgcgcgcccaagc

SEQ ID NO: 381463 - DNA, 25 bp, Mus musculus
cccattagagatgtcgcccacgaaa

SEQ ID NO: 381464 - DNA, 25 bp, Mus musculus
agctggggcagcttttacgtttgtg

SEQ ID NO: 381465 - DNA, 25 bp, Mus musculus
aagtacctgcagtcggtcgtggcca

SEQ ID NO: 381466 - DNA, 25 bp, Mus musculus
cgaagcctatcgaaaagtcttggac

SEQ ID NO: 381467 - DNA, 25 bp, Mus musculus
tgtccgccaggaagtacctgcagtc

SEQ ID NO: 381468 - DNA, 25 bp, Mus musculus
atggctgggagctgatcttacaaca

SEQ ID NO: 381469 - DNA, 25 bp, Mus musculus
gatcttacaacattcaggcaccatg

SEQ ID NO: 381470 - DNA, 25 bp, Mus musculus
tcaggcaccatggaaacattgaaaa

SEQ ID NO: 381471 - DNA, 25 bp, Mus musculus
ggaaacattgaaaagcccaagagtg

SEQ ID NO: 381472 - DNA, 25 bp, Mus musculus
agcccaagagtgcttcctgtcccgg

SEQ ID NO: 381473 - DNA, 25 bp, Mus musculus
gcccaagagtaactcactgtttatg

SEQ ID NO: 381474 - DNA, 25 bp, Mus musculus
tcaatttattttacctcttcacatc

SEQ ID NO: 381475 - DNA, 25 bp, Mus musculus
ctagcaacttgtccctaaacttttg

SEQ ID NO: 381476 - DNA, 25 bp, Mus musculus
caggtcctacctctcaatttatttt

SEQ ID NO: 381477 - DNA, 25 bp, Mus musculus
gtttatgaaaacaaaagactctagc

SEQ ID NO: 381478 - DNA, 25 bp, Mus musculus
ttgagggcacaagaccaatgaccta

SEQ ID NO: 381479 - DNA, 25 bp, Mus musculus
gaccaatgacctaaaatctcccatc

SEQ ID NO: 381480 - DNA, 25 bp, Mus musculus
ctcttcacatcagcaatggctggga

SEQ ID NO: 381481 - DNA, 25 bp, Mus musculus
taaaatctcccatcaggtcctacct

SEQ ID NO: 381482 - DNA, 25 bp, Mus musculus
acaatgcagtttcatggtggacggc

SEQ ID NO: 381483 - DNA, 25 bp, Mus musculus
atagaccatcgtccttcgggaaagg

SEQ ID NO: 381484 - DNA, 25 bp, Mus musculus
gccagcgagtttgtgtgaacaatgc

SEQ ID NO: 381485 - DNA, 25 bp, Mus musculus
cgttcggcaagggatccagtgtcct

SEQ ID NO: 381486 - DNA, 25 bp, Mus musculus
agttccgaaacgctcaagacaggtc

SEQ ID NO: 381487 - DNA, 25 bp, Mus musculus
tggacggcggctcagaaattttgtc

SEQ ID NO: 381488 - DNA, 25 bp, Mus musculus
gctttgaaaacgcatgctcgccatg

SEQ ID NO: 381489 - DNA, 25 bp, Mus musculus
ggttcttccgaagcccacagcttag

SEQ ID NO: 381490 - DNA, 25 bp, Mus musculus
agactctgcctagaagacccgcgca

SEQ ID NO: 381491 - DNA, 25 bp, Mus musculus
ccgcagatcctgtaccttggccaaa

SEQ ID NO: 381492 - DNA, 25 bp, Mus musculus
gtcgtccgggagagccatagaaccc

SEQ ID NO: 381493 - DNA, 25 bp, Mus musculus
atgagagcttcctgacacgccagtc

SEQ ID NO: 381494 - DNA, 25 bp, Mus musculus
tttgtcccaggtagagccaagtcta

SEQ ID NO: 381495 - DNA, 25 bp, Mus musculus
ttagattctggaaccgatcgggccc

SEQ ID NO: 381496 - DNA, 25 bp, Mus musculus
gcaatatggccgtgtcctggaacta

SEQ ID NO: 381497 - DNA, 25 bp, Mus musculus
cgcccagggtcggaactacaagcag

SEQ ID NO: 381498 - DNA, 25 bp, Mus musculus
tgcctcaagtgctgtggactaccgc

SEQ ID NO: 381499 - DNA, 25 bp, Mus musculus
ggatatttatcgtcaggctgcctca

SEQ ID NO: 381500 - DNA, 25 bp, Mus musculus
cgtgacgtttcctgacggtaggaga

SEQ ID NO: 381501 - DNA, 25 bp, Mus musculus
tgagtgttgtttccacgtggcgagc

SEQ ID NO: 381502 - DNA, 25 bp, Mus musculus
ggccaggacctgttttagatgagtg

SEQ ID NO: 381503 - DNA, 25 bp, Mus musculus
atcctatccgggaagctggcgtcta

SEQ ID NO: 381504 - DNA, 25 bp, Mus musculus
gcgacctgaagggagttccatccta

SEQ ID NO: 381505 - DNA, 25 bp, Mus musculus
gctcctcccaggtcatcgtcggtgt

SEQ ID NO: 381506 - DNA, 25 bp, Mus musculus
aagtgtccgcatcggcggctcaacg

SEQ ID NO: 381507 - DNA, 25 bp, Mus musculus
gcgagtatgcatgcgcaaacgctca

SEQ ID NO: 381508 - DNA, 25 bp, Mus musculus
ctacaagcaggcgttgccagttccc

SEQ ID NO: 381509 - DNA, 25 bp, Mus musculus
gacccagcgcccagttttcagtaaa

SEQ ID NO: 381510 - DNA, 25 bp, Mus musculus
ccaggtaggcgctccggctaaagct

SEQ ID NO: 381511 - DNA, 25 bp, Mus musculus
ctcttgccacattcggaacaggaga

SEQ ID NO: 381512 - DNA, 25 bp, Mus musculus
taagttctgaaactggcgcctgtga

SEQ ID NO: 381513 - DNA, 25 bp, Mus musculus
gggcttctccgccaataagttctga

SEQ ID NO: 381514 - DNA, 25 bp, Mus musculus
gcacacgcctgtggtctagcaggta

SEQ ID NO: 381515 - DNA, 25 bp, Mus musculus
attcggaacaggagaagggcttctc

SEQ ID NO: 381516 - DNA, 25 bp, Mus musculus
cacactcgctgcagctgaagggctt

SEQ ID NO: 381517 - DNA, 25 bp, Mus musculus
gccctggtggcgcactaggtcagaa

SEQ ID NO: 381518 - DNA, 25 bp, Mus musculus
ctaggtcagaagagctgcggaagct

SEQ ID NO: 381519 - DNA, 25 bp, Mus musculus
cggaagctcttgtcgcattcagggc

SEQ ID NO: 381520 - DNA, 25 bp, Mus musculus
attcagggcacttgtgtggcttctc

SEQ ID NO: 381521 - DNA, 25 bp, Mus musculus
ctggtgcctggcgaggtctgaaccc

SEQ ID NO: 381522 - DNA, 25 bp, Mus musculus
agctgtggggcttctccgccaataa

SEQ ID NO: 381523 - DNA, 25 bp, Mus musculus
agcgcagtgcgaagctcttgccaca

SEQ ID NO: 381524 - DNA, 25 bp, Mus musculus
aacctatacgcttccgtggcacggg

SEQ ID NO: 381525 - DNA, 25 bp, Mus musculus
aggaacttgtcctctcccgcaggcg

SEQ ID NO: 381526 - DNA, 25 bp, Mus musculus
gcctcgagcgccgaatccgcaggat

SEQ ID NO: 381527 - DNA, 25 bp, Mus musculus
cgcaggatccggtctgcgcaacgcg

SEQ ID NO: 381528 - DNA, 25 bp, Mus musculus
tttcttcgaaagtgaacctatacgc

SEQ ID NO: 381529 - DNA, 25 bp, Mus musculus
ggcacggggtacttcagtttctcaa

SEQ ID NO: 381530 - DNA, 25 bp, Mus musculus
agtttctcaaccaacccaagtgatg

SEQ ID NO: 381531 - DNA, 25 bp, Mus musculus
ccaagtgatgcatacgggcggtttc

SEQ ID NO: 381532 - DNA, 25 bp, Mus musculus
ggcggtttccatttcttctccacta

SEQ ID NO: 381533 - DNA, 25 bp, Mus musculus
tcgtttacgcttctcttctcgagcc

SEQ ID NO: 381534 - DNA, 25 bp, Mus musculus
gagccttctgccttatcctccagtg

SEQ ID NO: 381535 - DNA, 25 bp, Mus musculus
cctccagtgaccgaggaggtgtcct

SEQ ID NO: 381536 - DNA, 25 bp, Mus musculus
actcaccagggtcgctcggcaggac

SEQ ID NO: 381537 - DNA, 25 bp, Mus musculus
ctgggaaaccagctggcgcatgcgc

SEQ ID NO: 381538 - DNA, 25 bp, Mus musculus
cgggattcctgttttggcggctcaa

SEQ ID NO: 381539 - DNA, 25 bp, Mus musculus
ttttggcggctcaaccggtcagtac

SEQ ID NO: 381540 - DNA, 25 bp, Mus musculus
tcaaccggtcagtacccggacagtg

SEQ ID NO: 381541 - DNA, 25 bp, Mus musculus
tacccggacagtgtttgccacagtg

SEQ ID NO: 381542 - DNA, 25 bp, Mus musculus
tgccacagtgtctttgctttctcta

SEQ ID NO: 381543 - DNA, 25 bp, Mus musculus
gctttctctattctgtctcacgaca

SEQ ID NO: 381544 - DNA, 25 bp, Mus musculus
tgtctcacgacagcgaattcggtcc

SEQ ID NO: 381545 - DNA, 25 bp, Mus musculus
acagcgaattcggtcccggacattt

SEQ ID NO: 381546 - DNA, 25 bp, Mus musculus
ctacggtacggctgcgttgactacc

SEQ ID NO: 381547 - DNA, 25 bp, Mus musculus
catttgtgaaagttggtggttttca

SEQ ID NO: 381548 - DNA, 25 bp, Mus musculus
cggtcccggacatttgtgaaagttg

SEQ ID NO: 381549 - DNA, 25 bp, Mus musculus
cttcgctaagaagctagcagcagga

SEQ ID NO: 381550 - DNA, 25 bp, Mus musculus
ttttcattttcgcttcgctaagaag

SEQ ID NO: 381551 - DNA, 25 bp, Mus musculus
aggaaagtacgctacggtacggctg

SEQ ID NO: 381552 - DNA, 25 bp, Mus musculus
cggtcgcacacgtagggcttctcac

SEQ ID NO: 381553 - DNA, 25 bp, Mus musculus
gtgtcaccaggtgcgagtgccaact

SEQ ID NO: 381554 - DNA, 25 bp, Mus musculus
agctcttgccgcaaagtgggcagga

SEQ ID NO: 381555 - DNA, 25 bp, Mus musculus
gtatgtcttcttgcccgtgtcaccg

SEQ ID NO: 381556 - DNA, 25 bp, Mus musculus
ttgccacactgctcgcacttgtatg

SEQ ID NO: 381557 - DNA, 25 bp, Mus musculus
cgagtgccaactgaagcccttgcca

SEQ ID NO: 381558 - DNA, 25 bp, Mus musculus
gtccgtgcaggtataaggcttctcg

SEQ ID NO: 381559 - DNA, 25 bp, Mus musculus
tggagtggtggctgaagctcttcca

SEQ ID NO: 381560 - DNA, 25 bp, Mus musculus
aagcgcttggcacagcggtcgcaca

SEQ ID NO: 381561 - DNA, 25 bp, Mus musculus
tgccctggtgtgtgactaggtccga

SEQ ID NO: 381562 - DNA, 25 bp, Mus musculus
cgattatgtgcgatgagattggagc

SEQ ID NO: 381563 - DNA, 25 bp, Mus musculus
tcttgccacagtcgaggcagtggta

SEQ ID NO: 381564 - DNA, 25 bp, Mus musculus
ggcctcacgccacggtgagtgcgtt

SEQ ID NO: 381565 - DNA, 25 bp, Mus musculus
gcttgccacagtccgtgcaggtata

SEQ ID NO: 381566 - DNA, 25 bp, Mus musculus
catcacgagcatccggagagaaagc

SEQ ID NO: 381567 - DNA, 25 bp, Mus musculus
ttctgctgcatcacgagcatccgga

SEQ ID NO: 381568 - DNA, 25 bp, Mus musculus
ctgggaaagctgattctgctgcatc

SEQ ID NO: 381569 - DNA, 25 bp, Mus musculus
ggtgctgatcctgggaaagctgatt

SEQ ID NO: 381570 - DNA, 25 bp, Mus musculus
gatgtccaaacacccgggcttggtg

SEQ ID NO: 381571 - DNA, 25 bp, Mus musculus
agagatgtccaaacacccgggcttg

SEQ ID NO: 381572 - DNA, 25 bp, Mus musculus
tgcctggcaacgacgcagagatgtc

SEQ ID NO: 381573 - DNA, 25 bp, Mus musculus
ggagcttgtctttcgtgcctggcaa

SEQ ID NO: 381574 - DNA, 25 bp, Mus musculus
aacatcgtgcggagcttgtctttcg

SEQ ID NO: 381575 - DNA, 25 bp, Mus musculus
tgtcgaacatcgtgcggagcttgtc

SEQ ID NO: 381576 - DNA, 25 bp, Mus musculus
gcgctgcatctgtgtgtcgaacatc

SEQ ID NO: 381577 - DNA, 25 bp, Mus musculus
actggccaagcgctgcatctgtgtg

SEQ ID NO: 381578 - DNA, 25 bp, Mus musculus
gctgtgcaccatcgcgcactggcag

SEQ ID NO: 381579 - DNA, 25 bp, Mus musculus
cgcactggcaggactcactggccaa

SEQ ID NO: 381580 - DNA, 25 bp, Mus musculus
atctttctcgggttcaccattctcg

SEQ ID NO: 381581 - DNA, 25 bp, Mus musculus
tttcccatctttctcgggttcacca

SEQ ID NO: 381582 - DNA, 25 bp, Mus musculus
cggctgccaccgcaacttccggttt

SEQ ID NO: 381583 - DNA, 25 bp, Mus musculus
ccgcatttccagtccggctgccacc

SEQ ID NO: 381584 - DNA, 25 bp, Mus musculus
tagcagctaactctctccggtgtcc

SEQ ID NO: 381585 - DNA, 25 bp, Mus musculus
tcctagcagctaactctctccggtg

SEQ ID NO: 381586 - DNA, 25 bp, Mus musculus
gcagccttgtcctagcagctaactc

SEQ ID NO: 381587 - DNA, 25 bp, Mus musculus
tgggcagccttgtcctagcagctaa

SEQ ID NO: 381588 - DNA, 25 bp, Mus musculus
gcagtctttgggcagccttgtccta

SEQ ID NO: 381589 - DNA, 25 bp, Mus musculus
ctctttcgcgcgcagtctttgggca

SEQ ID NO: 381590 - DNA, 25 bp, Mus musculus
caaggttggctataacctggaggcc

SEQ ID NO: 381591 - DNA, 25 bp, Mus musculus
cgcgcccaaggttggctataacctg

SEQ ID NO: 381592 - DNA, 25 bp, Mus musculus
agcgcgcgcccaaggttggctataa

SEQ ID NO: 381593 - DNA, 25 bp, Mus musculus
actcgccacgcccacgcttcgcagc

SEQ ID NO: 381594 - DNA, 25 bp, Mus musculus
ccgctttcgtaacagctccaacttg

SEQ ID NO: 381595 - DNA, 25 bp, Mus musculus
gtggtcaccgctttcgtaacagctc

SEQ ID NO: 381596 - DNA, 25 bp, Mus musculus
cccacgcctgtgacatctgtggtca

SEQ ID NO: 381597 - DNA, 25 bp, Mus musculus
acgccaccaacgcatccacacgggg

SEQ ID NO: 381598 - DNA, 25 bp, Mus musculus
agccacactggcgaacggccctata

SEQ ID NO: 381599 - DNA, 25 bp, Mus musculus
aacctgtggccgcagtttccggcgc

SEQ ID NO: 381600 - DNA, 25 bp, Mus musculus
gcgaacggccctatagctgtccaac

SEQ ID NO: 381601 - DNA, 25 bp, Mus musculus
aatgcgagacctaacccgccacgta

SEQ ID NO: 381602 - DNA, 25 bp, Mus musculus
acgtacgctgccacacgggggagaa

SEQ ID NO: 381603 - DNA, 25 bp, Mus musculus
agaagccctgccgatgcaacgaatg

SEQ ID NO: 381604 - DNA, 25 bp, Mus musculus
cctgccgatgcaacgaatgtggaga

SEQ ID NO: 381605 - DNA, 25 bp, Mus musculus
acgaatgtggagaggggttcaccca

SEQ ID NO: 381606 - DNA, 25 bp, Mus musculus
ggggttcacccagaatgcccacctg

SEQ ID NO: 381607 - DNA, 25 bp, Mus musculus
gtttccggcgcaatgcgcacctgca

SEQ ID NO: 381608 - DNA, 25 bp, Mus musculus
cggggctcacccagagaagcgttaa

SEQ ID NO: 381609 - DNA, 25 bp, Mus musculus
atccatgctctgtcgcagggctctc

SEQ ID NO: 381610 - DNA, 25 bp, Mus musculus
acgtcagtgtccaagaggagggtca

SEQ ID NO: 381611 - DNA, 25 bp, Mus musculus
cgcagggactctcctatgagcttaa

SEQ ID NO: 381612 - DNA, 25 bp, Mus musculus
ggcaagccggctgacaagtcctcta

SEQ ID NO: 381613 - DNA, 25 bp, Mus musculus
ccgccgtctcagtctaaaagtttct

SEQ ID NO: 381614 - DNA, 25 bp, Mus musculus
ccgtagcttcctttcgccgcgggat

SEQ ID NO: 381615 - DNA, 25 bp, Mus musculus
gctcacgaccttcgcatcgggattc

SEQ ID NO: 381616 - DNA, 25 bp, Mus musculus
agccggcagcctcaagatgcgttca

SEQ ID NO: 381617 - DNA, 25 bp, Mus musculus
aagatgcgttcagcttggacggacc

SEQ ID NO: 381618 - DNA, 25 bp, Mus musculus
cagatccagggagccgacacaaggt

SEQ ID NO: 381619 - DNA, 25 bp, Mus musculus
atctgggatcctgggaagcacatca

SEQ ID NO: 381620 - DNA, 25 bp, Mus musculus
catcacgggctgaacggcgataatc

SEQ ID NO: 381621 - DNA, 25 bp, Mus musculus
gcgccaactgcccaatatgctagtg

SEQ ID NO: 381622 - DNA, 25 bp, Mus musculus
agcttcctgctgacagctggacgga

SEQ ID NO: 381623 - DNA, 25 bp, Mus musculus
ctgctgacagctggacggatctgta

SEQ ID NO: 381624 - DNA, 25 bp, Mus musculus
gctggacggatctgtatgacctgca

SEQ ID NO: 381625 - DNA, 25 bp, Mus musculus
cggatctgtatgacctgcagctgga

SEQ ID NO: 381626 - DNA, 25 bp, Mus musculus
tgtatgacctgcagctggaacgcgc

SEQ ID NO: 381627 - DNA, 25 bp, Mus musculus
atgacctgcagctggaacgcgcccg

SEQ ID NO: 381628 - DNA, 25 bp, Mus musculus
ctggagaggcgctgagaacgctgag

SEQ ID NO: 381629 - DNA, 25 bp, Mus musculus
ggcgcctccctgcagaccgagctcg

SEQ ID NO: 381630 - DNA, 25 bp, Mus musculus
ggaggagtcgcgactccaagacacc

SEQ ID NO: 381631 - DNA, 25 bp, Mus musculus
accgcagagggccagcttcctgctg

SEQ ID NO: 381632 - DNA, 25 bp, Mus musculus
gtcgcgactccaagacaccgagata

SEQ ID NO: 381633 - DNA, 25 bp, Mus musculus
cgactccaagacaccgagatatcgg

SEQ ID NO: 381634 - DNA, 25 bp, Mus musculus
agacaccgagatatcgggcgcctcc

SEQ ID NO: 381635 - DNA, 25 bp, Mus musculus
tgcagacccgggcatagccctcggg

SEQ ID NO: 381636 - DNA, 25 bp, Mus musculus
aaaagcgcccagaactatccagcca

SEQ ID NO: 381637 - DNA, 25 bp, Mus musculus
tgatggtggctcttctcgttacgcc

SEQ ID NO: 381638 - DNA, 25 bp, Mus musculus
cccagcaactaaggcggcaggtccg

SEQ ID NO: 381639 - DNA, 25 bp, Mus musculus
gcaggtccgtgctgtctcgaaccac

SEQ ID NO: 381640 - DNA, 25 bp, Mus musculus
tgtctcgaaccacagaaacctagga

SEQ ID NO: 381641 - DNA, 25 bp, Mus musculus
gcggcatgctccatcttgagaacta

SEQ ID NO: 381642 - DNA, 25 bp, Mus musculus
gcacccttatgctaaaaagcgccca

SEQ ID NO: 381643 - DNA, 25 bp, Mus musculus
tctaacctctaacctgattcctgtc

SEQ ID NO: 381644 - DNA, 25 bp, Mus musculus
aacctctcgattccggacgtgcctg

SEQ ID NO: 381645 - DNA, 25 bp, Mus musculus
tgtgacacaatctctcgacgcacga

SEQ ID NO: 381646 - DNA, 25 bp, Mus musculus
gattcctgtcttccgcgcctgcgta

SEQ ID NO: 381647 - DNA, 25 bp, Mus musculus
ccagagggctctacgtgtgacacaa

SEQ ID NO: 381648 - DNA, 25 bp, Mus musculus
gcgcctgcgtaaaacgtctccagtg

SEQ ID NO: 381649 - DNA, 25 bp, Mus musculus
gagaactacacgaagcacccttatg

SEQ ID NO: 381650 - DNA, 25 bp, Mus musculus
cggtcccgaggcaagaactgtctgc

SEQ ID NO: 381651 - DNA, 25 bp, Mus musculus
ctgaagctcggactgcggataaaac

SEQ ID NO: 381652 - DNA, 25 bp, Mus musculus
ccgaagccatgattgccggtcccga

SEQ ID NO: 381653 - DNA, 25 bp, Mus musculus
tctgagccgtgcatacctggtgctt

SEQ ID NO: 381654 - DNA, 25 bp, Mus musculus
ccgggttctccaggcactcaaattc

SEQ ID NO: 381655 - DNA, 25 bp, Mus musculus
gcaaatcctcgtgtcttcccggttc

SEQ ID NO: 381656 - DNA, 25 bp, Mus musculus
ccacttggaacttgctgcctgaaga

SEQ ID NO: 381657 - DNA, 25 bp, Mus musculus
tacagaccagtttgaggacgtgccc

SEQ ID NO: 381658 - DNA, 25 bp, Mus musculus
ccacatggtatagagggcaaagtcc

SEQ ID NO: 381659 - DNA, 25 bp, Mus musculus
cgcataactgggcattgaagtcacc

SEQ ID NO: 381660 - DNA, 25 bp, Mus musculus
agtgtgactcactcctgggcaccgg

SEQ ID NO: 381661 - DNA, 25 bp, Mus musculus
aggtgaccgcatcgcctgacccaaa

SEQ ID NO: 381662 - DNA, 25 bp, Mus musculus
agtccatgcacttgtcgaggtccgc

SEQ ID NO: 381663 - DNA, 25 bp, Mus musculus
tcagtcggctcgaataacgtgagtc

SEQ ID NO: 381664 - DNA, 25 bp, Mus musculus
ggtctcgcactcctaggctcggata

SEQ ID NO: 381665 - DNA, 25 bp, Mus musculus
ctttgatcctggtggcggccacctg

SEQ ID NO: 381666 - DNA, 25 bp, Mus musculus
ctcctaggctcggatatcaggggtg

SEQ ID NO: 381667 - DNA, 25 bp, Mus musculus
cggactggacgtccgcagacaaagc

SEQ ID NO: 381668 - DNA, 25 bp, Mus musculus
tggccgaaccggactggacgtccgc

SEQ ID NO: 381669 - DNA, 25 bp, Mus musculus
cgcactcctaggctcggatatcagg

SEQ ID NO: 381670 - DNA, 25 bp, Mus musculus
cacctgcttggccactttggggcgg

SEQ ID NO: 381671 - DNA, 25 bp, Mus musculus
ctccacctgcttggccactttgggg

SEQ ID NO: 381672 - DNA, 25 bp, Mus musculus
caaaggcaccgaaacctgtgacgcc

SEQ ID NO: 381673 - DNA, 25 bp, Mus musculus
acctgcggtggccacctaggcagga

SEQ ID NO: 381674 - DNA, 25 bp, Mus musculus
gcagacaaagctgaccgagcactcg

SEQ ID NO: 381675 - DNA, 25 bp, Mus musculus
aaatgctggagctttgatcctggtg

SEQ ID NO: 381676 - DNA, 25 bp, Mus musculus
ggcgtgagttaaatgctggagcttt

SEQ ID NO: 381677 - DNA, 25 bp, Mus musculus
ctgggacaaaggcaccgaaacctgt

SEQ ID NO: 381678 - DNA, 25 bp, Mus musculus
ctaagccgagagtgcaagcggccgc

SEQ ID NO: 381679 - DNA, 25 bp, Mus musculus
gcagctcagctagggccagcgccga

SEQ ID NO: 381680 - DNA, 25 bp, Mus musculus
cgagatcggctaagccgagagtgca

SEQ ID NO: 381681 - DNA, 25 bp, Mus musculus
cgccgccagcttggccgatgctgcc

SEQ ID NO: 381682 - DNA, 25 bp, Mus musculus
gccaagggctgctaggtcctcccgg

SEQ ID NO: 381683 - DNA, 25 bp, Mus musculus
ttgcaacgcgttccagccaaacaca

SEQ ID NO: 381684 - DNA, 25 bp, Mus musculus
gctgctaggtcctcccggccaattg

SEQ ID NO: 381685 - DNA, 25 bp, Mus musculus
agccaaacacaagctggtgcgcttg

SEQ ID NO: 381686 - DNA, 25 bp, Mus musculus
gctggtgcgcttgctgcctcggcac

SEQ ID NO: 381687 - DNA, 25 bp, Mus musculus
caaccaatcatcgtgtcctgccatg

SEQ ID NO: 381688 - DNA, 25 bp, Mus musculus
cgtgtcctgccatgctactggtgca

SEQ ID NO: 381689 - DNA, 25 bp, Mus musculus
ctgccatgctactggtgcatacgcg

SEQ ID NO: 381690 - DNA, 25 bp, Mus musculus
cggccaattgcagtcgcttgcaacg

SEQ ID NO: 381691 - DNA, 25 bp, Mus musculus
gcagtcgcttgcaacgcgttccagc

SEQ ID NO: 381692 - DNA, 25 bp, Mus musculus
ctcggaaaaaatggttcccgctgcg

SEQ ID NO: 381693 - DNA, 25 bp, Mus musculus
ggtctcgcgggtcacccggtgcaca

SEQ ID NO: 381694 - DNA, 25 bp, Mus musculus
cgggaagcgccagtcccggtccgag

SEQ ID NO: 381695 - DNA, 25 bp, Mus musculus
acccgcctagctttccttgattctt

SEQ ID NO: 381696 - DNA, 25 bp, Mus musculus
tggacgccgagtctctgggctccgc

SEQ ID NO: 381697 - DNA, 25 bp, Mus musculus
cccggctggtggacgccgagtctct

SEQ ID NO: 381698 - DNA, 25 bp, Mus musculus
cctcctcgcggtgcagcgtgagtag

SEQ ID NO: 381699 - DNA, 25 bp, Mus musculus
agcggcgctacctccgctcgtgcgc

SEQ ID NO: 381700 - DNA, 25 bp, Mus musculus
cacaccgcgcgctgcaagttctgat

SEQ ID NO: 381701 - DNA, 25 bp, Mus musculus
tacaggccaccctttccacaccgcg

SEQ ID NO: 381702 - DNA, 25 bp, Mus musculus
agctccgcgtctgcggaccggtgtc

SEQ ID NO: 381703 - DNA, 25 bp, Mus musculus
cgcgagcatccgcagcggtggcaga

SEQ ID NO: 381704 - DNA, 25 bp, Mus musculus
tgaccgcgcccagccaaggcggcag

SEQ ID NO: 381705 - DNA, 25 bp, Mus musculus
cttgagctccgcgtctgcggaccgg

SEQ ID NO: 381706 - DNA, 25 bp, Mus musculus
atgactccaggtcagcgctgtcgcc

SEQ ID NO: 381707 - DNA, 25 bp, Mus musculus
cggactagccctcggatgactccag

SEQ ID NO: 381708 - DNA, 25 bp, Mus musculus
tccgtgtctgtcacgggccggacta

SEQ ID NO: 381709 - DNA, 25 bp, Mus musculus
tgagatctcccggttgcgccgctct

SEQ ID NO: 381710 - DNA, 25 bp, Mus musculus
tcgaagagttgcgtctgcgcagtga

SEQ ID NO: 381711 - DNA, 25 bp, Mus musculus
ccaaggatcgttcccgccgcaatag

SEQ ID NO: 381712 - DNA, 25 bp, Mus musculus
acagagaggggccaaggatcgttcc

SEQ ID NO: 381713 - DNA, 25 bp, Mus musculus
ggaacctgggacctcgctgctgcgc

SEQ ID NO: 381714 - DNA, 25 bp, Mus musculus
ccttcttggagggtgcttcgtcccg

SEQ ID NO: 381715 - DNA, 25 bp, Mus musculus
tttggaatttttggcgcgagctggc

SEQ ID NO: 381716 - DNA, 25 bp, Mus musculus
acctcggtgcgcacgcaagacgcga

SEQ ID NO: 381717 - DNA, 25 bp, Mus musculus
cagtgagagcgctccggcaaacttc

SEQ ID NO: 381718 - DNA, 25 bp, Mus musculus
gccgcaataggcctcgaagagttgc

SEQ ID NO: 381719 - DNA, 25 bp, Mus musculus
ggtgagcccacacccgggtgagatc

SEQ ID NO: 381720 - DNA, 25 bp, Mus musculus
gccgcgagtgcaagaagcgtgaatc

SEQ ID NO: 381721 - DNA, 25 bp, Mus musculus
agcgctgggaagctcatcccgattc

SEQ ID NO: 381722 - DNA, 25 bp, Mus musculus
aatgccatggcctcacgcactgcgg

SEQ ID NO: 381723 - DNA, 25 bp, Mus musculus
accgtgtgtgtagatgttgcccagc

SEQ ID NO: 381724 - DNA, 25 bp, Mus musculus
caggtcggagctcagtgcattcagc

SEQ ID NO: 381725 - DNA, 25 bp, Mus musculus
tacgaacttattgaactgcaggtgc

SEQ ID NO: 381726 - DNA, 25 bp, Mus musculus
ttccttctcagtggagctgcagcgc

SEQ ID NO: 381727 - DNA, 25 bp, Mus musculus
ccgcaagggagagaaagctggcaac

SEQ ID NO: 381728 - DNA, 25 bp, Mus musculus
tggattcctgacgttcttgttgcag

SEQ ID NO: 381729 - DNA, 25 bp, Mus musculus
accaatgggctctgcggacggagat

SEQ ID NO: 381730 - DNA, 25 bp, Mus musculus
gaccgcccatgccttctctttttaa

SEQ ID NO: 381731 - DNA, 25 bp, Mus musculus
gtgcattcagctccaccgtagcaga

SEQ ID NO: 381732 - DNA, 25 bp, Mus musculus
cccagctcgttgtgtaggtagaaaa

SEQ ID NO: 381733 - DNA, 25 bp, Mus musculus
gcggttccagccttctttgcgtgga

SEQ ID NO: 381734 - DNA, 25 bp, Mus musculus
gcaccgagggcaacgacctgatttc

SEQ ID NO: 381735 - DNA, 25 bp, Mus musculus
aaccacctggtcgaggcgcagaagt

SEQ ID NO: 381736 - DNA, 25 bp, Mus musculus
tgggagaatccgtcaccgggaaaga

SEQ ID NO: 381737 - DNA, 25 bp, Mus musculus
gtttgcagctctctctcctgggaga

SEQ ID NO: 381738 - DNA, 25 bp, Mus musculus
tcctgacagaagaacgcgcgtggct

SEQ ID NO: 381739 - DNA, 25 bp, Mus musculus
gcaagaacggtttttcgactggtca

SEQ ID NO: 381740 - DNA, 25 bp, Mus musculus
gctagggttgtcttctccggacaga

SEQ ID NO: 381741 - DNA, 25 bp, Mus musculus
acctgatttctcctagggtgaagga

SEQ ID NO: 381742 - DNA, 25 bp, Mus musculus
ctggaagccacggagaaccgctgcc

SEQ ID NO: 381743 - DNA, 25 bp, Mus musculus
ggctcctacagagcagctcctgaca

SEQ ID NO: 381744 - DNA, 25 bp, Mus musculus
tggcagctgagaccgggaataatcc

SEQ ID NO: 381745 - DNA, 25 bp, Mus musculus
actggtcatgagaatgcgagtgtcc

SEQ ID NO: 381746 - DNA, 25 bp, Mus musculus
ggtgcccaggcttcactggcaagga

SEQ ID NO: 381747 - DNA, 25 bp, Mus musculus
ccggggctgagccttgcaaacaagt

SEQ ID NO: 381748 - DNA, 25 bp, Mus musculus
gccggtctcgagaatcagccaactc

SEQ ID NO: 381749 - DNA, 25 bp, Mus musculus
caccgtcgacgcagcaaacgcagta

SEQ ID NO: 381750 - DNA, 25 bp, Mus musculus
ccggacgagacgtcgcgtagctcca

SEQ ID NO: 381751 - DNA, 25 bp, Mus musculus
atggcctcttgcgtcgctgcggaag

SEQ ID NO: 381752 - DNA, 25 bp, Mus musculus
agcgcgaagccttgagcatggcctc

SEQ ID NO: 381753 - DNA, 25 bp, Mus musculus
aatcctctggagatgctctgccctc

SEQ ID NO: 381754 - DNA, 25 bp, Mus musculus
ctgcgagactctcagttgaatcctc

SEQ ID NO: 381755 - DNA, 25 bp, Mus musculus
tatcgaagcctgtgcagctccgggc

SEQ ID NO: 381756 - DNA, 25 bp, Mus musculus
aaggccgtcacggtggagaagactc

SEQ ID NO: 381757 - DNA, 25 bp, Mus musculus
tgtaaatcagcctcaccacctatcg

SEQ ID NO: 381758 - DNA, 25 bp, Mus musculus
aggcctccgaaaagccactccttgt

SEQ ID NO: 381759 - DNA, 25 bp, Mus musculus
aaacgcagtagggacaggagcaaca

SEQ ID NO: 381760 - DNA, 25 bp, Mus musculus
agcagcagcacagagaaggccgtca

SEQ ID NO: 381761 - DNA, 25 bp, Mus musculus
cacacccgaggcacgaggcatcagg

SEQ ID NO: 381762 - DNA, 25 bp, Mus musculus
ttttcccggaatcctcacgcttctg

SEQ ID NO: 381763 - DNA, 25 bp, Mus musculus
tccattcattcattgtaagacgctc

SEQ ID NO: 381764 - DNA, 25 bp, Mus musculus
tgtaagacgctcacacgcacatttt

SEQ ID NO: 381765 - DNA, 25 bp, Mus musculus
cccgccgcggctggcttgaataaga

SEQ ID NO: 381766 - DNA, 25 bp, Mus musculus
ttgaataagaaaacgccactccctg

SEQ ID NO: 381767 - DNA, 25 bp, Mus musculus
tccctgaccctgatcgcgggagaca

SEQ ID NO: 381768 - DNA, 25 bp, Mus musculus
cctgaccctgatcgcgggagacaga

SEQ ID NO: 381769 - DNA, 25 bp, Mus musculus
ccctgatcgcgggagacagacagga

SEQ ID NO: 381770 - DNA, 25 bp, Mus musculus
gacagacaggaatcgtggacgctta

SEQ ID NO: 381771 - DNA, 25 bp, Mus musculus
gacaggaatcgtggacgcttagtcc

SEQ ID NO: 381772 - DNA, 25 bp, Mus musculus
ggacgcttagtccacgacaggcagg

SEQ ID NO: 381773 - DNA, 25 bp, Mus musculus
cgcttagtccacgacaggcaggggc

SEQ ID NO: 381774 - DNA, 25 bp, Mus musculus
aggaaggcagctgcgcccccggttc

SEQ ID NO: 381775 - DNA, 25 bp, Mus musculus
tcattcattgtaagacgctcacacg

SEQ ID NO: 381776 - DNA, 25 bp, Mus musculus
gacagagctggatggacatgcaatg

SEQ ID NO: 381777 - DNA, 25 bp, Mus musculus
acatgcaatgggtggacacggttca

SEQ ID NO: 381778 - DNA, 25 bp, Mus musculus
gcgaatgtgtggtcccggatttaga

SEQ ID NO: 381779 - DNA, 25 bp, Mus musculus
aggtgttaagatcggtacaggagtc

SEQ ID NO: 381780 - DNA, 25 bp, Mus musculus
atcaggtagaaaggaggcgcatcgt

SEQ ID NO: 381781 - DNA, 25 bp, Mus musculus
gcgcatcgtggatgtccgacaaaga

SEQ ID NO: 381782 - DNA, 25 bp, Mus musculus
cccatgcccgagctacagagctggg

SEQ ID NO: 381783 - DNA, 25 bp, Mus musculus
atccttcgtgtgagtgtccgccaac

SEQ ID NO: 381784 - DNA, 25 bp, Mus musculus
ggggctgctctaggaaccacgaccc

SEQ ID NO: 381785 - DNA, 25 bp, Mus musculus
tgcttgggaagcctagaaactacta

SEQ ID NO: 381786 - DNA, 25 bp, Mus musculus
gaaactactagcgagcatgcgcagc

SEQ ID NO: 381787 - DNA, 25 bp, Mus musculus
agccattcctgaggcggataccact

SEQ ID NO: 381788 - DNA, 25 bp, Mus musculus
ggataccacttctccgggtcttctc

SEQ ID NO: 381789 - DNA, 25 bp, Mus musculus
aggatagccggaccaggcatcgctc

SEQ ID NO: 381790 - DNA, 25 bp, Mus musculus
cccagacctctaggctaggagtcgc

SEQ ID NO: 381791 - DNA, 25 bp, Mus musculus
ttgaacgctcgatgaataggcgtga

SEQ ID NO: 381792 - DNA, 25 bp, Mus musculus
cgacaagttgaacgctcgatgaata

SEQ ID NO: 381793 - DNA, 25 bp, Mus musculus
accttcgcagcgacaagttgaacgc

SEQ ID NO: 381794 - DNA, 25 bp, Mus musculus
ccggatattaccttcgcagcgacaa

SEQ ID NO: 381795 - DNA, 25 bp, Mus musculus
tcgaattccgtctatccggatatta

SEQ ID NO: 381796 - DNA, 25 bp, Mus musculus
ccattcctttgtcgaattccgtcta

SEQ ID NO: 381797 - DNA, 25 bp, Mus musculus
cacctcaagctagggtcacggggcg

SEQ ID NO: 381798 - DNA, 25 bp, Mus musculus
gccgtcacctcaagctagggtcacg

SEQ ID NO: 381799 - DNA, 25 bp, Mus musculus
ggtccctcagcctcagtgctttggg

SEQ ID NO: 381800 - DNA, 25 bp, Mus musculus
aggccctgcctctcggacgacggag

SEQ ID NO: 381801 - DNA, 25 bp, Mus musculus
acctctaggctaggagtcgcttctg

SEQ ID NO: 381802 - DNA, 25 bp, Mus musculus
gccgacaagaaagcggccagaatct

SEQ ID NO: 381803 - DNA, 25 bp, Mus musculus
agtcgcttctggagccaggaccctc

SEQ ID NO: 381804 - DNA, 25 bp, Mus musculus
ttggtgttcccgttcgcagagcggc

SEQ ID NO: 381805 - DNA, 25 bp, Mus musculus
caggtccactgtttgagagccgagg

SEQ ID NO: 381806 - DNA, 25 bp, Mus musculus
tccctgaggcgactgcgggagccct

SEQ ID NO: 381807 - DNA, 25 bp, Mus musculus
gagccgagggccattcagctccggc

SEQ ID NO: 381808 - DNA, 25 bp, Mus musculus
tttgagagccgagggccattcagct

SEQ ID NO: 381809 - DNA, 25 bp, Mus musculus
cactgtttgagagccgagggccatt

SEQ ID NO: 381810 - DNA, 25 bp, Mus musculus
gagccctgggcttccgctaagcgtt

SEQ ID NO: 381811 - DNA, 25 bp, Mus musculus
tgcccaggtccactgtttgagagcc

SEQ ID NO: 381812 - DNA, 25 bp, Mus musculus
cctgggcttccgctaagcgttggag

SEQ ID NO: 381813 - DNA, 25 bp, Mus musculus
tctgagtgcccaggtccactgtttg

SEQ ID NO: 381814 - DNA, 25 bp, Mus musculus
cctttgttctgagtgcccaggtcca

SEQ ID NO: 381815 - DNA, 25 bp, Mus musculus
cagctggagcagctgtgcctttgtt

SEQ ID NO: 381816 - DNA, 25 bp, Mus musculus
ccgcagcttggtgttcccgttcgca

SEQ ID NO: 381817 - DNA, 25 bp, Mus musculus
ctggagcagctgtgcctttgttctg

SEQ ID NO: 381818 - DNA, 25 bp, Mus musculus
agcggctctcatgattgcgtgctga

SEQ ID NO: 381819 - DNA, 25 bp, Mus musculus
cgtctgagctactcccgggtgttgt

SEQ ID NO: 381820 - DNA, 25 bp, Mus musculus
accttgcagcttcggtacggagcca

SEQ ID NO: 381821 - DNA, 25 bp, Mus musculus
tttcgacttttcagtagcacgtccc

SEQ ID NO: 381822 - DNA, 25 bp, Mus musculus
gtagcacgtcccttcgcctaaggtc

SEQ ID NO: 381823 - DNA, 25 bp, Mus musculus
gcctaaggtcctccttgtggcttca

SEQ ID NO: 381824 - DNA, 25 bp, Mus musculus
ttgtggcttcaacgcctgcgcacga

SEQ ID NO: 381825 - DNA, 25 bp, Mus musculus
acgcactaggtcgtgctgacgcgca

SEQ ID NO: 381826 - DNA, 25 bp, Mus musculus
tccgagggatacgaaaacttaagca

SEQ ID NO: 381827 - DNA, 25 bp, Mus musculus
gcgggacctccctgtttgacagtcg

SEQ ID NO: 381828 - DNA, 25 bp, Mus musculus
acagcattgcgcgaggctctgcttc

SEQ ID NO: 381829 - DNA, 25 bp, Mus musculus
tctcctttgctctacctggggctga

SEQ ID NO: 381830 - DNA, 25 bp, Mus musculus
agcttcggacctgctggtacctctc

SEQ ID NO: 381831 - DNA, 25 bp, Mus musculus
ctgctaggggcctgagaaacggcca

SEQ ID NO: 381832 - DNA, 25 bp, Mus musculus
gcacagggccatgtacaacgggatc

SEQ ID NO: 381833 - DNA, 25 bp, Mus musculus
atgtacaacgggatcgggctgccga

SEQ ID NO: 381834 - DNA, 25 bp, Mus musculus
gcagcggcaccaacggctacgttca

SEQ ID NO: 381835 - DNA, 25 bp, Mus musculus
ggcaccaacggctacgttcagcgaa

SEQ ID NO: 381836 - DNA, 25 bp, Mus musculus
acggctacgttcagcgaaacctgtc

SEQ ID NO: 381837 - DNA, 25 bp, Mus musculus
atcctggaccacgagcgcaagcggc

SEQ ID NO: 381838 - DNA, 25 bp, Mus musculus
atcctgacatcctggaccacgagcg

SEQ ID NO: 381839 - DNA, 25 bp, Mus musculus
agcgacctaatcctgacatcctgga

SEQ ID NO: 381840 - DNA, 25 bp, Mus musculus
ggtgaagcgacctaatcctgacatc

SEQ ID NO: 381841 - DNA, 25 bp, Mus musculus
ctgccctggtgaagcgacctaatcc

SEQ ID NO: 381842 - DNA, 25 bp, Mus musculus
cacctggaggctgccctggtgaagc

SEQ ID NO: 381843 - DNA, 25 bp, Mus musculus
agcggcctgactacaagggagagga

SEQ ID NO: 381844 - DNA, 25 bp, Mus musculus
ccgccgtggtgagcggcctgactac

SEQ ID NO: 381845 - DNA, 25 bp, Mus musculus
ctacgttcagcgaaacctgtccctg

SEQ ID NO: 381846 - DNA, 25 bp, Mus musculus
gtgagcgctgctcccggagagatcc

SEQ ID NO: 381847 - DNA, 25 bp, Mus musculus
cctctcagccgggttgtaatgccca

SEQ ID NO: 381848 - DNA, 25 bp, Mus musculus
atcaccagggaggtttaaagagcgc

SEQ ID NO: 381849 - DNA, 25 bp, Mus musculus
gcgcgcctgcgtcagaatcaccagg

SEQ ID NO: 381850 - DNA, 25 bp, Mus musculus
ggttgtaatgcccacgcctctctcg

SEQ ID NO: 381851 - DNA, 25 bp, Mus musculus
caggcaacgttgacgtctgatgtcg

SEQ ID NO: 381852 - DNA, 25 bp, Mus musculus
tcctgattgcatcgatcaccgactc

SEQ ID NO: 381853 - DNA, 25 bp, Mus musculus
ggtagtccgctacctccgaagctcg

SEQ ID NO: 381854 - DNA, 25 bp, Mus musculus
attgggccgccgttgttgtagtgac

SEQ ID NO: 381855 - DNA, 25 bp, Mus musculus
aggcttcggcgagcatctgcagctc

SEQ ID NO: 381856 - DNA, 25 bp, Mus musculus
cgcactccagtctgacggttccggg

SEQ ID NO: 381857 - DNA, 25 bp, Mus musculus
taccggagccgatcatccttgggcg

SEQ ID NO: 381858 - DNA, 25 bp, Mus musculus
aaccacgccgagtctggcaggcctg

SEQ ID NO: 381859 - DNA, 25 bp, Mus musculus
tgggcgccgttctctttaaggtgta

SEQ ID NO: 381860 - DNA, 25 bp, Mus musculus
tccagccattcgtaggcggtctgca

SEQ ID NO: 381861 - DNA, 25 bp, Mus musculus
ggcaagcggtccttaacaagatctc

SEQ ID NO: 381862 - DNA, 25 bp, Mus musculus
cgccgttctaggtctcgtactccta

SEQ ID NO: 381863 - DNA, 25 bp, Mus musculus
tctaggtctcggacaccactgttgc

SEQ ID NO: 381864 - DNA, 25 bp, Mus musculus
ccgccagcaattcgaagacgatcta

SEQ ID NO: 381865 - DNA, 25 bp, Mus musculus
ccaccagtaaccaggaggcgatcta

SEQ ID NO: 381866 - DNA, 25 bp, Mus musculus
taggactcctccagtgactcgcaga

SEQ ID NO: 381867 - DNA, 25 bp, Mus musculus
actcgccgtcgttctcgttctagga

SEQ ID NO: 381868 - DNA, 25 bp, Mus musculus
tcgaaggcgatccaggtccagaaca

SEQ ID NO: 381869 - DNA, 25 bp, Mus musculus
agatctcggacctcacctgtgagta

SEQ ID NO: 381870 - DNA, 25 bp, Mus musculus
gcggtccaggtccagaacaccactg

SEQ ID NO: 381871 - DNA, 25 bp, Mus musculus
cagctccttggaagcgctctagatc

SEQ ID NO: 381872 - DNA, 25 bp, Mus musculus
cttgaccagtcggaagcgatctcga

SEQ ID NO: 381873 - DNA, 25 bp, Mus musculus
agccggtctagatcacgagttactc

SEQ ID NO: 381874 - DNA, 25 bp, Mus musculus
gctcgtcgcaccttgtaaagccgct

SEQ ID NO: 381875 - DNA, 25 bp, Mus musculus
tggcgccggatcatgagaaacacgt

SEQ ID NO: 381876 - DNA, 25 bp, Mus musculus
ttggcgtccgtaaagatggtggtct

SEQ ID NO: 381877 - DNA, 25 bp, Mus musculus
tcatgagaaacacgtcctgaggacg

SEQ ID NO: 381878 - DNA, 25 bp, Mus musculus
tgctcgactccttggcgtccgtaaa

SEQ ID NO: 381879 - DNA, 25 bp, Mus musculus
tcagttcgaacacggtgctcgactc

SEQ ID NO: 381880 - DNA, 25 bp, Mus musculus
cttgttaagtgtcctgtctggaccc

SEQ ID NO: 381881 - DNA, 25 bp, Mus musculus
agacctccttgttaagtgtcctgtc

SEQ ID NO: 381882 - DNA, 25 bp, Mus musculus
gcacgatcaagagacctccttgtta

SEQ ID NO: 381883 - DNA, 25 bp, Mus musculus
tgccggctcttcagcacgatcaaga

SEQ ID NO: 381884 - DNA, 25 bp, Mus musculus
gagacctgatgctgccggctcttca

SEQ ID NO: 381885 - DNA, 25 bp, Mus musculus
aaccgctgagcaagacggcctggca

SEQ ID NO: 381886 - DNA, 25 bp, Mus musculus
gcgtaagattatcgaggcctcggtt

SEQ ID NO: 381887 - DNA, 25 bp, Mus musculus
cgaccttcggctgcgtaagattatc

SEQ ID NO: 381888 - DNA, 25 bp, Mus musculus
cgtgtggaacgaatgcagcagcttg

SEQ ID NO: 381889 - DNA, 25 bp, Mus musculus
ggagccgcaataatggcgtgcaccc

SEQ ID NO: 381890 - DNA, 25 bp, Mus musculus
tggaccagtgtctctggctgcgggc

SEQ ID NO: 381891 - DNA, 25 bp, Mus musculus
gcttgcagcctgaagagaacagatc

SEQ ID NO: 381892 - DNA, 25 bp, Mus musculus
gcagcctgaagagaacagatcacta

SEQ ID NO: 381893 - DNA, 25 bp, Mus musculus
agagaacagatcactaggagccgca

SEQ ID NO: 381894 - DNA, 25 bp, Mus musculus
cagatcactaggagccgcaataatg

SEQ ID NO: 381895 - DNA, 25 bp, Mus musculus
aatgcagcagcttgcagcctgaaga

SEQ ID NO: 381896 - DNA, 25 bp, Mus musculus
ttctgtggcgctcacggctgggaca

SEQ ID NO: 381897 - DNA, 25 bp, Mus musculus
tcacggctgggacacaggcaagtag

SEQ ID NO: 381898 - DNA, 25 bp, Mus musculus
aggcaagtagggcagagcttcctcc

SEQ ID NO: 381899 - DNA, 25 bp, Mus musculus
gggcagagcttcctcctagtaacca

SEQ ID NO: 381900 - DNA, 25 bp, Mus musculus
tcctcctagtaaccagaagccctgg

SEQ ID NO: 381901 - DNA, 25 bp, Mus musculus
ctcagcggcggcgacagtgtcaagc

SEQ ID NO: 381902 - DNA, 25 bp, Mus musculus
cctgagcagggcttacgtaatcgca

SEQ ID NO: 381903 - DNA, 25 bp, Mus musculus
gatgggacactcgaagctgctcttc

SEQ ID NO: 381904 - DNA, 25 bp, Mus musculus
ggcacatagggccagttgcatctgc

SEQ ID NO: 381905 - DNA, 25 bp, Mus musculus
ttgcatctgcgcaggatccggaacc

SEQ ID NO: 381906 - DNA, 25 bp, Mus musculus
ggaccgcaattctcctcagctggca

SEQ ID NO: 381907 - DNA, 25 bp, Mus musculus
tcagctggcaagattctgggtcgcc

SEQ ID NO: 381908 - DNA, 25 bp, Mus musculus
ctgggtcgccaccactttgtgcaga

SEQ ID NO: 381909 - DNA, 25 bp, Mus musculus
gcctacggggtttgttattgtgcga

SEQ ID NO: 381910 - DNA, 25 bp, Mus musculus
ttattgtgcgaacaccggccgctga

SEQ ID NO: 381911 - DNA, 25 bp, Mus musculus
ttggggattctcgacacctcagcct

SEQ ID NO: 381912 - DNA, 25 bp, Mus musculus
tcagcctggctctagaacccggatt

SEQ ID NO: 381913 - DNA, 25 bp, Mus musculus
gttccctgcaaagcggccttattta

SEQ ID NO: 381914 - DNA, 25 bp, Mus musculus
actgcctccgcgaaggctacaatga

SEQ ID NO: 381915 - DNA, 25 bp, Mus musculus
cggccttatttatctgggcacagcc

SEQ ID NO: 381916 - DNA, 25 bp, Mus musculus
aaagtgacaaccgcgctcccgctcg

SEQ ID NO: 381917 - DNA, 25 bp, Mus musculus
aaaagtgacaaccgcgctcccgctc

SEQ ID NO: 381918 - DNA, 25 bp, Mus musculus
aaaaagtgacaaccgcgctcccgct

SEQ ID NO: 381919 - DNA, 25 bp, Mus musculus
cacaggttcctctcaaaaaaaagtg

SEQ ID NO: 381920 - DNA, 25 bp, Mus musculus
cagcacaggttcctctcaaaaaaaa

SEQ ID NO: 381921 - DNA, 25 bp, Mus musculus
acagcacaggttcctctcaaaaaaa

SEQ ID NO: 381922 - DNA, 25 bp, Mus musculus
aacagcacaggttcctctcaaaaaa

SEQ ID NO: 381923 - DNA, 25 bp, Mus musculus
aaacagcacaggttcctctcaaaaa

SEQ ID NO: 381924 - DNA, 25 bp, Mus musculus
aaaacagcacaggttcctctcaaaa

SEQ ID NO: 381925 - DNA, 25 bp, Mus musculus
caaaacagcacaggttcctctcaaa

SEQ ID NO: 381926 - DNA, 25 bp, Mus musculus
ccaaaacagcacaggttcctctcaa

SEQ ID NO: 381927 - DNA, 25 bp, Mus musculus
gtctgtccctccgccccaaaacagc

SEQ ID NO: 381928 - DNA, 25 bp, Mus musculus
agcacaggttcctctcaaaaaaaag

SEQ ID NO: 381929 - DNA, 25 bp, Mus musculus
tcgtctgtccctccgccccaaaaca

SEQ ID NO: 381930 - DNA, 25 bp, Mus musculus
ggcccagaatctggcgtcccatcga

SEQ ID NO: 381931 - DNA, 25 bp, Mus musculus
aaaagttggcccagaatctggcgtc

SEQ ID NO: 381932 - DNA, 25 bp, Mus musculus
ttctagcagacctccgcctgcgaag

SEQ ID NO: 381933 - DNA, 25 bp, Mus musculus
aatctggcgtcccatcgatctgtcc

SEQ ID NO: 381934 - DNA, 25 bp, Mus musculus
tgccacgaggagctgtcgcctgctc

SEQ ID NO: 381935 - DNA, 25 bp, Mus musculus
ggagctgtcgcctgctcacccggat

SEQ ID NO: 381936 - DNA, 25 bp, Mus musculus
ggggctcgcctaacagctccggagc

SEQ ID NO: 381937 - DNA, 25 bp, Mus musculus
ccgccgcacgcccacctaccttagg

SEQ ID NO: 381938 - DNA, 25 bp, Mus musculus
cctaccttaggggaccagcagcggt

SEQ ID NO: 381939 - DNA, 25 bp, Mus musculus
ccttaggggaccagcagcggtgacc

SEQ ID NO: 381940 - DNA, 25 bp, Mus musculus
acagcgtgctgtgtcccgggatgaa

SEQ ID NO: 381941 - DNA, 25 bp, Mus musculus
tgtcccgggatgaaagtttgtgcca

SEQ ID NO: 381942 - DNA, 25 bp, Mus musculus
aagtttgtgccatgcagagcagggc

SEQ ID NO: 381943 - DNA, 25 bp, Mus musculus
agcgacccaggcctctgcgcgccac

SEQ ID NO: 381944 - DNA, 25 bp, Mus musculus
gcctgctgctcagggcggcactgct

SEQ ID NO: 381945 - DNA, 25 bp, Mus musculus
ttgctctgcgttcctctcactgcgg

SEQ ID NO: 381946 - DNA, 25 bp, Mus musculus
ccgcctcgtggggtctcatcgcgag

SEQ ID NO: 381947 - DNA, 25 bp, Mus musculus
gcatctaaaaggagctgcgggcagc

SEQ ID NO: 381948 - DNA, 25 bp, Mus musculus
tgcaccgccgctcgcacaggacacc

SEQ ID NO: 381949 - DNA, 25 bp, Mus musculus
acaggacaccggacacccagccacg

SEQ ID NO: 381950 - DNA, 25 bp, Mus musculus
taccggtggctacctcagcaggacc

SEQ ID NO: 381951 - DNA, 25 bp, Mus musculus
acggcgttgctctgcgttcctctca

SEQ ID NO: 381952 - DNA, 25 bp, Mus musculus
gccctgccagccacctacgctcggt

SEQ ID NO: 381953 - DNA, 25 bp, Mus musculus
gcgcatcccgggcttccgatggccc

SEQ ID NO: 381954 - DNA, 25 bp, Mus musculus
gcgcccgagcgcatctaaaaggagc

SEQ ID NO: 381955 - DNA, 25 bp, Mus musculus
tgctaccggtggctacctcagcagg

SEQ ID NO: 381956 - DNA, 25 bp, Mus musculus
gtacgcgcacgcctgactctgcggt

SEQ ID NO: 381957 - DNA, 25 bp, Mus musculus
acgggcacccgacggcgttgctctg

SEQ ID NO: 381958 - DNA, 25 bp, Mus musculus
atccagattcaccagcagtggggcg

SEQ ID NO: 381959 - DNA, 25 bp, Mus musculus
ggcactttgtctccagcgttcagca

SEQ ID NO: 381960 - DNA, 25 bp, Mus musculus
tttgtctccagcgttcagcagtctg

SEQ ID NO: 381961 - DNA, 25 bp, Mus musculus
ctccagcgttcagcagtctgcgata

SEQ ID NO: 381962 - DNA, 25 bp, Mus musculus
tcagcagtctgcgatagccgcagcc

SEQ ID NO: 381963 - DNA, 25 bp, Mus musculus
tggcaagcccttgccagcgtgcgct

SEQ ID NO: 381964 - DNA, 25 bp, Mus musculus
ctcggaggtgcgatccaggcgacat

SEQ ID NO: 381965 - DNA, 25 bp, Mus musculus
tgcgatccaggcgacatccagattc

SEQ ID NO: 381966 - DNA, 25 bp, Mus musculus
gcgacatccagattcaccagcagtg

SEQ ID NO: 381967 - DNA, 25 bp, Mus musculus
gcgaatgtcgggcactttgtctcca

SEQ ID NO: 381968 - DNA, 25 bp, Mus musculus
attcaccagcagtggggcggctgct

SEQ ID NO: 381969 - DNA, 25 bp, Mus musculus
ccctgcgaatgtcgggcactttgtc

SEQ ID NO: 381970 - DNA, 25 bp, Mus musculus
gatccaggcgacatccagattcacc

SEQ ID NO: 381971 - DNA, 25 bp, Mus musculus
aatgtcgggcactttgtctccagcg

SEQ ID NO: 381972 - DNA, 25 bp, Mus musculus
agcaaggcctgacggcgcaggtaac

SEQ ID NO: 381973 - DNA, 25 bp, Mus musculus
ggaagtgacgtaatcaggcccgccc

SEQ ID NO: 381974 - DNA, 25 bp, Mus musculus
cccagcagattaaagagcaaggagg

SEQ ID NO: 381975 - DNA, 25 bp, Mus musculus
ttaaagagcaaggaggtgcgcatgc

SEQ ID NO: 381976 - DNA, 25 bp, Mus musculus
tgcgcatgcttgaaggaagcggaag

SEQ ID NO: 381977 - DNA, 25 bp, Mus musculus
tccggatttccggccggcgcttgaa

SEQ ID NO: 381978 - DNA, 25 bp, Mus musculus
ccggcgcttgaaggtgcggattccg

SEQ ID NO: 381979 - DNA, 25 bp, Mus musculus
tcttgagcggccaggacgacgagga

SEQ ID NO: 381980 - DNA, 25 bp, Mus musculus
cctgacggcgcaggtaacgtcctcg

SEQ ID NO: 381981 - DNA, 25 bp, Mus musculus
caggtaacgtcctcggccgcggcga

SEQ ID NO: 381982 - DNA, 25 bp, Mus musculus
gaccgcgaaccgctctcggggagtc

SEQ ID NO: 381983 - DNA, 25 bp, Mus musculus
gcttctctgccatggcctttctctg

SEQ ID NO: 381984 - DNA, 25 bp, Mus musculus
cctcctgcaccaagttccgccgccc

SEQ ID NO: 381985 - DNA, 25 bp, Mus musculus
ggcaagaggacagggctatggagaa

SEQ ID NO: 381986 - DNA, 25 bp, Mus musculus
aagtcagccgaggagtctccggtcc

SEQ ID NO: 381987 - DNA, 25 bp, Mus musculus
actccctactcgagaagtcagccga

SEQ ID NO: 381988 - DNA, 25 bp, Mus musculus
atggcgttgacatactcactcccta

SEQ ID NO: 381989 - DNA, 25 bp, Mus musculus
caggagcatgtgcatggcgttgaca

SEQ ID NO: 381990 - DNA, 25 bp, Mus musculus
ttcccgggagtgtgaacaggagcat

SEQ ID NO: 381991 - DNA, 25 bp, Mus musculus
tccatagtaagtgatgggcgttccc

SEQ ID NO: 381992 - DNA, 25 bp, Mus musculus
cccgatttcctctccatagtaagtg

SEQ ID NO: 381993 - DNA, 25 bp, Mus musculus
acggaaatgtctcccatcccgattt

SEQ ID NO: 381994 - DNA, 25 bp, Mus musculus
tttgtaacggaaatgtctcccatcc

SEQ ID NO: 381995 - DNA, 25 bp, Mus musculus
catagctctcgttgaaatttgtaac

SEQ ID NO: 381996 - DNA, 25 bp, Mus musculus
acttacactatcatagctctcgttg

SEQ ID NO: 381997 - DNA, 25 bp, Mus musculus
aagctgcgcttttatcatacttaca

SEQ ID NO: 381998 - DNA, 25 bp, Mus musculus
cggtggcccgcaactaaaaagctgc

SEQ ID NO: 381999 - DNA, 25 bp, Mus musculus
cgagacagcaatgcgaacagcagtg

SEQ ID NO: 382000 - DNA, 25 bp, Mus musculus
cgagccagcccgacacgaagtgaag

SEQ ID NO: 382001 - DNA, 25 bp, Mus musculus
cgccgcctggggactgctctggcaa

SEQ ID NO: 382002 - DNA, 25 bp, Mus musculus
tcctgtcaatgaacagcagccgccg

SEQ ID NO: 382003 - DNA, 25 bp, Mus musculus
gagcctctgctcctgtcaatgaaca

SEQ ID NO: 382004 - DNA, 25 bp, Mus musculus
gtccgagcctctgctcctgtcaatg

SEQ ID NO: 382005 - DNA, 25 bp, Mus musculus
ggtccggctgctgacgtccgagcct

SEQ ID NO: 382006 - DNA, 25 bp, Mus musculus
agcagcgtcgccaaggtccggctgc

SEQ ID NO: 382007 - DNA, 25 bp, Mus musculus
gtggctttgatttcactccctcctc

SEQ ID NO: 382008 - DNA, 25 bp, Mus musculus
ccgctcctccgtggctttgatttca

SEQ ID NO: 382009 - DNA, 25 bp, Mus musculus
acaaagagggcagatccgagtcacc

SEQ ID NO: 382010 - DNA, 25 bp, Mus musculus
actatttatatacgccggggctcca

SEQ ID NO: 382011 - DNA, 25 bp, Mus musculus
ctggctggagactgtactatttata

SEQ ID NO: 382012 - DNA, 25 bp, Mus musculus
tgcaagtctggctggagactgtact

SEQ ID NO: 382013 - DNA, 25 bp, Mus musculus
actgctctggcaacgaggctgcaga

SEQ ID NO: 382014 - DNA, 25 bp, Mus musculus
ggctgaccgagagaatgtatccatt

SEQ ID NO: 382015 - DNA, 25 bp, Mus musculus
tgacaaggttttgggtgcttacacc

SEQ ID NO: 382016 - DNA, 25 bp, Mus musculus
tccgctgccgccaagaaagttgaga

SEQ ID NO: 382017 - DNA, 25 bp, Mus musculus
gggcgcttctggttttctggacaac

SEQ ID NO: 382018 - DNA, 25 bp, Mus musculus
taacacttcgttgggtcgctaaagc

SEQ ID NO: 382019 - DNA, 25 bp, Mus musculus
gcgggcttggatctagcgttaaaga

SEQ ID NO: 382020 - DNA, 25 bp, Mus musculus
tagtgccctggtttatgtgccctgc

SEQ ID NO: 382021 - DNA, 25 bp, Mus musculus
cagcttgtttgcactggggcttatc

SEQ ID NO: 382022 - DNA, 25 bp, Mus musculus
tctccggaacaatggctcagaatgc

SEQ ID NO: 382023 - DNA, 25 bp, Mus musculus
gacgctggctgtttgtatccattga

SEQ ID NO: 382024 - DNA, 25 bp, Mus musculus
atccattgaggagctgcctcgcaca

SEQ ID NO: 382025 - DNA, 25 bp, Mus musculus
agtcctagggactgtgagcaaaccc

SEQ ID NO: 382026 - DNA, 25 bp, Mus musculus
cccagtcttgaataatccggcgaga

SEQ ID NO: 382027 - DNA, 25 bp, Mus musculus
gagcccgcagttgcagcttgtttgc

SEQ ID NO: 382028 - DNA, 25 bp, Mus musculus
actagggtcgctatctgttcgtcta

SEQ ID NO: 382029 - DNA, 25 bp, Mus musculus
cgcgcgcagcatgcgttccaacaat

SEQ ID NO: 382030 - DNA, 25 bp, Mus musculus
cgaagtccctctcaggtgcgcgcag

SEQ ID NO: 382031 - DNA, 25 bp, Mus musculus
gggagacgccgatccgccgaagtcc

SEQ ID NO: 382032 - DNA, 25 bp, Mus musculus
ccaaagctgccacacctggggaggc

SEQ ID NO: 382033 - DNA, 25 bp, Mus musculus
cctctccacgcaggtgaaggtcgtg

SEQ ID NO: 382034 - DNA, 25 bp, Mus musculus
gacagatccgcattgagcttccctc

SEQ ID NO: 382035 - DNA, 25 bp, Mus musculus
ctgttcgtctatttccctctctgga

SEQ ID NO: 382036 - DNA, 25 bp, Mus musculus
gcgaggacacctcctactagggtcg

SEQ ID NO: 382037 - DNA, 25 bp, Mus musculus
cttttatgtgggacgcgaggacacc

SEQ ID NO: 382038 - DNA, 25 bp, Mus musculus
gcatccaccgtcaaagtccagcttt

SEQ ID NO: 382039 - DNA, 25 bp, Mus musculus
gccacattcggtgcaggcgcatcca

SEQ ID NO: 382040 - DNA, 25 bp, Mus musculus
cagcgtggacactccgcggggcaaa

SEQ ID NO: 382041 - DNA, 25 bp, Mus musculus
ccggcgcaaagagaccagggactcc

SEQ ID NO: 382042 - DNA, 25 bp, Mus musculus
cttaaggtgtcgctgctcaatgaga

SEQ ID NO: 382043 - DNA, 25 bp, Mus musculus
ccagaagccatcctggtcatccaga

SEQ ID NO: 382044 - DNA, 25 bp, Mus musculus
ttccaggacactgatgctccgcttg

SEQ ID NO: 382045 - DNA, 25 bp, Mus musculus
actgatgctccgcttgctcggcaga

SEQ ID NO: 382046 - DNA, 25 bp, Mus musculus
cttgctcggcagagtcatgtcattc

SEQ ID NO: 382047 - DNA, 25 bp, Mus musculus
gtcatgtcattcctgcctatgccgc

SEQ ID NO: 382048 - DNA, 25 bp, Mus musculus
aggaggccgcccgagatgctgctct

SEQ ID NO: 382049 - DNA, 25 bp, Mus musculus
tggtcatccagaggcgccacctgga

SEQ ID NO: 382050 - DNA, 25 bp, Mus musculus
cgccacctggagaagcagttgctgg

SEQ ID NO: 382051 - DNA, 25 bp, Mus musculus
cggaccagggcttcgaccctgcgga

SEQ ID NO: 382052 - DNA, 25 bp, Mus musculus
tctggctgtggctgtcagcagccgc

SEQ ID NO: 382053 - DNA, 25 bp, Mus musculus
ctcaatgagaagcacaagtacgatg

SEQ ID NO: 382054 - DNA, 25 bp, Mus musculus
agcctgcgcccagtgcttaaggtgt

SEQ ID NO: 382055 - DNA, 25 bp, Mus musculus
ctgccaggaggtctgcaggccactc

SEQ ID NO: 382056 - DNA, 25 bp, Mus musculus
caggactcaggggacgtagctccca

SEQ ID NO: 382057 - DNA, 25 bp, Mus musculus
ctctgcggtctagcgcgttctcatt

SEQ ID NO: 382058 - DNA, 25 bp, Mus musculus
ggttactgagggtacagcgctcttg

SEQ ID NO: 382059 - DNA, 25 bp, Mus musculus
cttgactgaaagacgcggtgtgact

SEQ ID NO: 382060 - DNA, 25 bp, Mus musculus
gcgctcccacccgtgactgagagga

SEQ ID NO: 382061 - DNA, 25 bp, Mus musculus
cccgcgaactgaaagacatggtgtg

SEQ ID NO: 382062 - DNA, 25 bp, Mus musculus
cagcgctcttggttaaggcgaccta

SEQ ID NO: 382063 - DNA, 25 bp, Mus musculus
tgacctaagggaccgcaggttactg

SEQ ID NO: 382064 - DNA, 25 bp, Mus musculus
tcacacccgtgcctgaagggacagc

SEQ ID NO: 382065 - DNA, 25 bp, Mus musculus
cgctcccgagggtacagcaagtgac

SEQ ID NO: 382066 - DNA, 25 bp, Mus musculus
cttccgggactatctcatgaggtga

SEQ ID NO: 382067 - DNA, 25 bp, Mus musculus
actatgtccggagcaaggacttccg

SEQ ID NO: 382068 - DNA, 25 bp, Mus musculus
gtcatctgtctaggtagcggcttca

SEQ ID NO: 382069 - DNA, 25 bp, Mus musculus
cagccgagtccacagcggtgtcatc

SEQ ID NO: 382070 - DNA, 25 bp, Mus musculus
cagcggttaccagatcccggtgtga

SEQ ID NO: 382071 - DNA, 25 bp, Mus musculus
catttaccagatcccggtgtgaggg

SEQ ID NO: 382072 - DNA, 25 bp, Mus musculus
tgtgagggcagcatttaccagatcc

SEQ ID NO: 382073 - DNA, 25 bp, Mus musculus
ggcagcatttaccagatcccggtgt

SEQ ID NO: 382074 - DNA, 25 bp, Mus musculus
gtgtgagggcagcatttaccagatc

SEQ ID NO: 382075 - DNA, 25 bp, Mus musculus
gtgagggcagcatttaccagatccc

SEQ ID NO: 382076 - DNA, 25 bp, Mus musculus
agcatttaccagatcccggtgtgag

SEQ ID NO: 382077 - DNA, 25 bp, Mus musculus
agcggttaccagatcccggtgtgag

SEQ ID NO: 382078 - DNA, 25 bp, Mus musculus
gtgagggcagcggttaccagatccc

SEQ ID NO: 382079 - DNA, 25 bp, Mus musculus
taccagatcccggtgtgagggcagc

SEQ ID NO: 382080 - DNA, 25 bp, Mus musculus
agggcagcggttaccagatcccggt

SEQ ID NO: 382081 - DNA, 25 bp, Mus musculus
gcagcggttaccagatcccggtgtg

SEQ ID NO: 382082 - DNA, 25 bp, Mus musculus
gttaccagatcccggtgtgagggca

SEQ ID NO: 382083 - DNA, 25 bp, Mus musculus
gtgagggcagcagttaccagatccc

SEQ ID NO: 382084 - DNA, 25 bp, Mus musculus
gctctcggagaaacgggcggagcgc

SEQ ID NO: 382085 - DNA, 25 bp, Mus musculus
cgccgctctcggagaaacgggcgga

SEQ ID NO: 382086 - DNA, 25 bp, Mus musculus
gcgcgagggggacagttgcgccccc

SEQ ID NO: 382087 - DNA, 25 bp, Mus musculus
cgctctcggagaaacgggcggagcg

SEQ ID NO: 382088 - DNA, 25 bp, Mus musculus
agcgcgagggggacagttgcgcccc

SEQ ID NO: 382089 - DNA, 25 bp, Mus musculus
gagcgcgagggggacagttgcgccc

SEQ ID NO: 382090 - DNA, 25 bp, Mus musculus
cggagcgcgagggggacagttgcgc

SEQ ID NO: 382091 - DNA, 25 bp, Mus musculus
tcggagaaacgggcggagcgcgagg

SEQ ID NO: 382092 - DNA, 25 bp, Mus musculus
ctcggagaaacgggcggagcgcgag

SEQ ID NO: 382093 - DNA, 25 bp, Mus musculus
tctcggagaaacgggcggagcgcga

SEQ ID NO: 382094 - DNA, 25 bp, Mus musculus
ctctcggagaaacgggcggagcgcg

SEQ ID NO: 382095 - DNA, 25 bp, Mus musculus
ccgctctcggagaaacgggcggagc

SEQ ID NO: 382096 - DNA, 25 bp, Mus musculus
gccgctctcggagaaacgggcggag

SEQ ID NO: 382097 - DNA, 25 bp, Mus musculus
cgcgagggggacagttgcgccccca

SEQ ID NO: 382098 - DNA, 25 bp, Mus musculus
ccctccggtgaaggtgggctctgaa

SEQ ID NO: 382099 - DNA, 25 bp, Mus musculus
aataggtgtagaggcctgaggcctc

SEQ ID NO: 382100 - DNA, 25 bp, Mus musculus
aactccaggcagttccggccagctg

SEQ ID NO: 382101 - DNA, 25 bp, Mus musculus
cgtcgtagtcggagacttgtaagta

SEQ ID NO: 382102 - DNA, 25 bp, Mus musculus
ccgctaactggcgtggattgccacg

SEQ ID NO: 382103 - DNA, 25 bp, Mus musculus
tttcctcctccgctaactggcgtgg

SEQ ID NO: 382104 - DNA, 25 bp, Mus musculus
gtgacacgcccttggcagcctggct

SEQ ID NO: 382105 - DNA, 25 bp, Mus musculus
aggcccatgtgctcctgatctttca

SEQ ID NO: 382106 - DNA, 25 bp, Mus musculus
caacccgaggttccgcctggaggca

SEQ ID NO: 382107 - DNA, 25 bp, Mus musculus
tcggttgccgagcaacccgaggttc

SEQ ID NO: 382108 - DNA, 25 bp, Mus musculus
atgctgcgacccgagaggacgccgc

SEQ ID NO: 382109 - DNA, 25 bp, Mus musculus
acttgtaagtagtgccaagggcagg

SEQ ID NO: 382110 - DNA, 25 bp, Mus musculus
ctaaggagtcgtcgtagtcggagac

SEQ ID NO: 382111 - DNA, 25 bp, Mus musculus
atgtgctcctgatctttcaagggcc

SEQ ID NO: 382112 - DNA, 25 bp, Mus musculus
ccttgcgggagttcaagtggagcca

SEQ ID NO: 382113 - DNA, 25 bp, Mus musculus
ctgctcggtacttcaaagggtgtcc

SEQ ID NO: 382114 - DNA, 25 bp, Mus musculus
tggctgcgcttcaaggagctaacta

SEQ ID NO: 382115 - DNA, 25 bp, Mus musculus
tgcgaggccacctcggctgtattta

SEQ ID NO: 382116 - DNA, 25 bp, Mus musculus
agagacttactcttgtcgcgccttg

SEQ ID NO: 382117 - DNA, 25 bp, Mus musculus
gccagtctgatatggccgcgcaccg

SEQ ID NO: 382118 - DNA, 25 bp, Mus musculus
ccgatctcggtgctcctttggcgaa

SEQ ID NO: 382119 - DNA, 25 bp, Mus musculus
tcctttggcgaatgtgcagggaccc

SEQ ID NO: 382120 - DNA, 25 bp, Mus musculus
aggtgtaatctttgggctccgcaga

SEQ ID NO: 382121 - DNA, 25 bp, Mus musculus
tccgcagagtgaccctttttcttgg

SEQ ID NO: 382122 - DNA, 25 bp, Mus musculus
ctgttgggtagggagtcaagactcc

SEQ ID NO: 382123 - DNA, 25 bp, Mus musculus
agagcctgcagtaccgagtggacca

SEQ ID NO: 382124 - DNA, 25 bp, Mus musculus
cgcctcggggagagcatcttttctt

SEQ ID NO: 382125 - DNA, 25 bp, Mus musculus
cgagatgattgtgaccaagaacggc

SEQ ID NO: 382126 - DNA, 25 bp, Mus musculus
gctgtgcaacgcatcgtcatttttt

SEQ ID NO: 382127 - DNA, 25 bp, Mus musculus
agcggacctcgtcactgattacgga

SEQ ID NO: 382128 - DNA, 25 bp, Mus musculus
tgcagaggtgacaatccaacaatta

SEQ ID NO: 382129 - DNA, 25 bp, Mus musculus
cacgccgatcgcctctctaagggga

SEQ ID NO: 382130 - DNA, 25 bp, Mus musculus
ggcctctctgccgacgcgaacagaa

SEQ ID NO: 382131 - DNA, 25 bp, Mus musculus
ccacgtcagctctgatgcggttgtc

SEQ ID NO: 382132 - DNA, 25 bp, Mus musculus
gacgccttgttgaggcagatgacta

SEQ ID NO: 382133 - DNA, 25 bp, Mus musculus
gctctctgacggtaggctttctcgt

SEQ ID NO: 382134 - DNA, 25 bp, Mus musculus
gacgcccttttcctgtcacactgag

SEQ ID NO: 382135 - DNA, 25 bp, Mus musculus
cactgcgaacgcaacgctgggacga

SEQ ID NO: 382136 - DNA, 25 bp, Mus musculus
ggggcacgttattttctatctacac

SEQ ID NO: 382137 - DNA, 25 bp, Mus musculus
cgcacctccagctctatattgtgtg

SEQ ID NO: 382138 - DNA, 25 bp, Mus musculus
gtgcgctcgaagtgtccgtattctc

SEQ ID NO: 382139 - DNA, 25 bp, Mus musculus
ccttctggaagaaatggggcacgtt

SEQ ID NO: 382140 - DNA, 25 bp, Mus musculus
cttcccttcccggcgaatggtggcg

SEQ ID NO: 382141 - DNA, 25 bp, Mus musculus
cggcattgttttactaggctccctc

SEQ ID NO: 382142 - DNA, 25 bp, Mus musculus
gtgtcccgcaaagcccagagctccg

SEQ ID NO: 382143 - DNA, 25 bp, Mus musculus
cagagctccggaggacgacagcctc

SEQ ID NO: 382144 - DNA, 25 bp, Mus musculus
gagccagctacctgcccgtcctcct

SEQ ID NO: 382145 - DNA, 25 bp, Mus musculus
gtcctcctcccttgacctcctcgcg

SEQ ID NO: 382146 - DNA, 25 bp, Mus musculus
tggccgcagcggcattgttttacta

SEQ ID NO: 382147 - DNA, 25 bp, Mus musculus
gttttactaggctccctcgggagca

SEQ ID NO: 382148 - DNA, 25 bp, Mus musculus
cggcctcggcgcacagtaatggcag

SEQ ID NO: 382149 - DNA, 25 bp, Mus musculus
cacagtaatggcagcgctgtgagcc

SEQ ID NO: 382150 - DNA, 25 bp, Mus musculus
gcttcgtccttcacgcctgcgggtt

SEQ ID NO: 382151 - DNA, 25 bp, Mus musculus
tgccctcgccctgcttctgcagaag

SEQ ID NO: 382152 - DNA, 25 bp, Mus musculus
gcttctgcagaaggtaaccccattg

SEQ ID NO: 382153 - DNA, 25 bp, Mus musculus
tgtgggtgcagggaaacttcccttc

SEQ ID NO: 382154 - DNA, 25 bp, Mus musculus
accgtattaaatcggcagtggcatc

SEQ ID NO: 382155 - DNA, 25 bp, Mus musculus
cctgtaggtaattaggccctgctcc

SEQ ID NO: 382156 - DNA, 25 bp, Mus musculus
ctagccactgttccctgggcgtgca

SEQ ID NO: 382157 - DNA, 25 bp, Mus musculus
gcgcacagtctacaactcagccttt

SEQ ID NO: 382158 - DNA, 25 bp, Mus musculus
cctttcaattaggagactgagctga

SEQ ID NO: 382159 - DNA, 25 bp, Mus musculus
actgagctgagaaaagtcctctttt

SEQ ID NO: 382160 - DNA, 25 bp, Mus musculus
gtcaggttatgacctctcaaccgta

SEQ ID NO: 382161 - DNA, 25 bp, Mus musculus
cagtggcatccatattcatgagggc

SEQ ID NO: 382162 - DNA, 25 bp, Mus musculus
taattaactctgaaaggcgcggcgg

SEQ ID NO: 382163 - DNA, 25 bp, Mus musculus
accagcggggcgagaagaattagcc

SEQ ID NO: 382164 - DNA, 25 bp, Mus musculus
agccgcgttatttgtcgccagccta

SEQ ID NO: 382165 - DNA, 25 bp, Mus musculus
gccagcctagcaacacgtgcttatt

SEQ ID NO: 382166 - DNA, 25 bp, Mus musculus
tgcttatttagcctgatcgccgcgc

SEQ ID NO: 382167 - DNA, 25 bp, Mus musculus
ttctttcgccgaggtcaggttatga

SEQ ID NO: 382168 - DNA, 25 bp, Mus musculus
ttctgggaagttgagcgcgattctt

SEQ ID NO: 382169 - DNA, 25 bp, Mus musculus
taccagggaatagacacggctttta

SEQ ID NO: 382170 - DNA, 25 bp, Mus musculus
ggagcttccggtccaggaaggtcta

SEQ ID NO: 382171 - DNA, 25 bp, Mus musculus
atccatgccctggtgaagtcccttc

SEQ ID NO: 382172 - DNA, 25 bp, Mus musculus
aagagctctccgtcggggcccagca

SEQ ID NO: 382173 - DNA, 25 bp, Mus musculus
actcggagtactacagcggggacca

SEQ ID NO: 382174 - DNA, 25 bp, Mus musculus
gattcttggttttgccggccggtga

SEQ ID NO: 382175 - DNA, 25 bp, Mus musculus
gccgtgggtagacgccattttggcc

SEQ ID NO: 382176 - DNA, 25 bp, Mus musculus
tgcgcattgcatttctctgagggcc

SEQ ID NO: 382177 - DNA, 25 bp, Mus musculus
agcgtatcctgattggccgacagca

SEQ ID NO: 382178 - DNA, 25 bp, Mus musculus
ggtgccatggcgtcatattaccata

SEQ ID NO: 382179 - DNA, 25 bp, Mus musculus
taactagagccgaacttcccgcgtc

SEQ ID NO: 382180 - DNA, 25 bp, Mus musculus
gccgaggccggtatttaactagagc

SEQ ID NO: 382181 - DNA, 25 bp, Mus musculus
ccgcctgccatggactcggagtact

SEQ ID NO: 382182 - DNA, 25 bp, Mus musculus
aaaccgccgatgcaggctacgcttc

SEQ ID NO: 382183 - DNA, 25 bp, Mus musculus
gttgctcagcggcatccgagactcc

SEQ ID NO: 382184 - DNA, 25 bp, Mus musculus
gctcgatcggtccaacctctgggaa

SEQ ID NO: 382185 - DNA, 25 bp, Mus musculus
cttcatttgctgtctgtcaccggga

SEQ ID NO: 382186 - DNA, 25 bp, Mus musculus
gctgcgttcgagctacccaatgctg

SEQ ID NO: 382187 - DNA, 25 bp, Mus musculus
ctgctggtgcaatatgctggagctc

SEQ ID NO: 382188 - DNA, 25 bp, Mus musculus
ccagaacagctaaacggagtcgcca

SEQ ID NO: 382189 - DNA, 25 bp, Mus musculus
gcagcgctgcctttccttatgaaga

SEQ ID NO: 382190 - DNA, 25 bp, Mus musculus
ttgaagctgtcagtggcaaaccgcc

SEQ ID NO: 382191 - DNA, 25 bp, Mus musculus
tccgcctgggtgttggagttatcac

SEQ ID NO: 382192 - DNA, 25 bp, Mus musculus
cagggcagctactgcaggttgctca

SEQ ID NO: 382193 - DNA, 25 bp, Mus musculus
ttcggggagattatgaaacagcttc

SEQ ID NO: 382194 - DNA, 25 bp, Mus musculus
gctttccaagaaaatcgctccggga

SEQ ID NO: 382195 - DNA, 25 bp, Mus musculus
gctcgctctcgcaggcagatttatc

SEQ ID NO: 382196 - DNA, 25 bp, Mus musculus
ggcgacaaagacgacccacagtgga

SEQ ID NO: 382197 - DNA, 25 bp, Mus musculus
cgcgtctctctgacagtccacattg

SEQ ID NO: 382198 - DNA, 25 bp, Mus musculus
ggggcttccttttcatcggcccagc

SEQ ID NO: 382199 - DNA, 25 bp, Mus musculus
ccagcggccggtaagtgcttctggt

SEQ ID NO: 382200 - DNA, 25 bp, Mus musculus
ccgctgtcccatgtgaagcaggttg

SEQ ID NO: 382201 - DNA, 25 bp, Mus musculus
tgcagctacccagaagcggcgaaga

SEQ ID NO: 382202 - DNA, 25 bp, Mus musculus
tcatcggcccagcttattccgcggg

SEQ ID NO: 382203 - DNA, 25 bp, Mus musculus
ccacagtggacgatccagcggcaga

SEQ ID NO: 382204 - DNA, 25 bp, Mus musculus
acatcacgggtctgtgtacagtggc

SEQ ID NO: 382205 - DNA, 25 bp, Mus musculus
cgtgctacgccagacatcacgggtc

SEQ ID NO: 382206 - DNA, 25 bp, Mus musculus
acgttgcgccgagcagagactgcgc

SEQ ID NO: 382207 - DNA, 25 bp, Mus musculus
cgtctgaagccctggaaacggcgca

SEQ ID NO: 382208 - DNA, 25 bp, Mus musculus
gcgcatgcgcaaaactcagtggccc

SEQ ID NO: 382209 - DNA, 25 bp, Mus musculus
agtccacattgtgcgcatgcgcaaa

SEQ ID NO: 382210 - DNA, 25 bp, Mus musculus
ctcaaggctcctagaagtacgtaag

SEQ ID NO: 382211 - DNA, 25 bp, Mus musculus
cgtaaggctcaaaacaaatcgtaga

SEQ ID NO: 382212 - DNA, 25 bp, Mus musculus
tcgtagagcggaaagtaaacactcc

SEQ ID NO: 382213 - DNA, 25 bp, Mus musculus
aaacactccaggcaagcgcagctcg

SEQ ID NO: 382214 - DNA, 25 bp, Mus musculus
tccgctcttccggtttaagacttca

SEQ ID NO: 382215 - DNA, 25 bp, Mus musculus
tttaagacttcagaggcgggacttc

SEQ ID NO: 382216 - DNA, 25 bp, Mus musculus
tccgaccgtctggtgctgtatttcc

SEQ ID NO: 382217 - DNA, 25 bp, Mus musculus
tgtaccggaagttcattagcaagta

SEQ ID NO: 382218 - DNA, 25 bp, Mus musculus
cctgcatctagagctgttatgggca

SEQ ID NO: 382219 - DNA, 25 bp, Mus musculus
tggaccgcggtaagcactacttgta

SEQ ID NO: 382220 - DNA, 25 bp, Mus musculus
taactgtcattgtcgtggggttttc

SEQ ID NO: 382221 - DNA, 25 bp, Mus musculus
tgtccgggagatgcggaacttagcc

SEQ ID NO: 382222 - DNA, 25 bp, Mus musculus
tcccgcccgatctatagggcaaata

SEQ ID NO: 382223 - DNA, 25 bp, Mus musculus
gttttctctggcctgttgtgtccgg

SEQ ID NO: 382224 - DNA, 25 bp, Mus musculus
agctggtcacttccggaggatcacc

SEQ ID NO: 382225 - DNA, 25 bp, Mus musculus
cctgagctgttctagtgcgcggcgt

SEQ ID NO: 382226 - DNA, 25 bp, Mus musculus
attatccgcgctcgcttcgggcgag

SEQ ID NO: 382227 - DNA, 25 bp, Mus musculus
atcgccagcaacgtacagaagaagc

SEQ ID NO: 382228 - DNA, 25 bp, Mus musculus
agaagaagctgacccgagcgcagga

SEQ ID NO: 382229 - DNA, 25 bp, Mus musculus
ccctgggatctagctggtcacttcc

SEQ ID NO: 382230 - DNA, 25 bp, Mus musculus
tccggaggatcaccgccaaggaatc

SEQ ID NO: 382231 - DNA, 25 bp, Mus musculus
cccgggtttgatcttcttgcagcta

SEQ ID NO: 382232 - DNA, 25 bp, Mus musculus
tgatcttcttgcagctaaggtgccc

SEQ ID NO: 382233 - DNA, 25 bp, Mus musculus
caatcgttttgtaccttcgtggctc

SEQ ID NO: 382234 - DNA, 25 bp, Mus musculus
taccttcgtggctcttctgcagaga

SEQ ID NO: 382235 - DNA, 25 bp, Mus musculus
ttctgcagagaagtggaggcccacg

SEQ ID NO: 382236 - DNA, 25 bp, Mus musculus
cacgctccggtttggtcctcggacg

SEQ ID NO: 382237 - DNA, 25 bp, Mus musculus
gtgaacggtaaacctgccacacctc

SEQ ID NO: 382238 - DNA, 25 bp, Mus musculus
ccatcgcggggctgatggcctctct

SEQ ID NO: 382239 - DNA, 25 bp, Mus musculus
gccacagtaggacccgcgtctggca

SEQ ID NO: 382240 - DNA, 25 bp, Mus musculus
ggggacatctatcagaccagtgtgc

SEQ ID NO: 382241 - DNA, 25 bp, Mus musculus
tctatcagaccagtgtgcgggcttg

SEQ ID NO: 382242 - DNA, 25 bp, Mus musculus
tcagaccagtgtgcgggcttgtccc

SEQ ID NO: 382243 - DNA, 25 bp, Mus musculus
cgcacgctctgtgcgccacagtagg

SEQ ID NO: 382244 - DNA, 25 bp, Mus musculus
ctgtgcgccacagtaggacccgcgt

SEQ ID NO: 382245 - DNA, 25 bp, Mus musculus
ccggtactcaccgaggagctcggga

SEQ ID NO: 382246 - DNA, 25 bp, Mus musculus
gcggcttgctgaccgggctgctcat

SEQ ID NO: 382247 - DNA, 25 bp, Mus musculus
tgctgaccgggctgctcattgccac

SEQ ID NO: 382248 - DNA, 25 bp, Mus musculus
gaccgggctgctcattgccacgcgg

SEQ ID NO: 382249 - DNA, 25 bp, Mus musculus
ccgtgaacccggcttctccgttgca

SEQ ID NO: 382250 - DNA, 25 bp, Mus musculus
ggcttctccgttgcacctggggctc

SEQ ID NO: 382251 - DNA, 25 bp, Mus musculus
cgtctggcagggattgggacatccc

SEQ ID NO: 382252 - DNA, 25 bp, Mus musculus
ggtacagcgcgctcaagcgccgctt

SEQ ID NO: 382253 - DNA, 25 bp, Mus musculus
gggagctcgttttgtgttacaccga

SEQ ID NO: 382254 - DNA, 25 bp, Mus musculus
cgaaggcggtccgttcctgtaccat

SEQ ID NO: 382255 - DNA, 25 bp, Mus musculus
gttcctgtaccatcggctccggatc

SEQ ID NO: 382256 - DNA, 25 bp, Mus musculus
cgagctgagtggaatcccgtctatg

SEQ ID NO: 382257 - DNA, 25 bp, Mus musculus
gaatcccgtctatggcggagatgga

SEQ ID NO: 382258 - DNA, 25 bp, Mus musculus
aggccgcacggccagcgtgctgttc

SEQ ID NO: 382259 - DNA, 25 bp, Mus musculus
gaggttccacacgtggtgcggtaca

SEQ ID NO: 382260 - DNA, 25 bp, Mus musculus
tcaagcgccgcttctacgtgacgac

SEQ ID NO: 382261 - DNA, 25 bp, Mus musculus
tctacgtgacgacttgcgtgggcaa

SEQ ID NO: 382262 - DNA, 25 bp, Mus musculus
gcgtgggcaagagcttccacacata

SEQ ID NO: 382263 - DNA, 25 bp, Mus musculus
gcttccacacatatgacgtgagtga

SEQ ID NO: 382264 - DNA, 25 bp, Mus musculus
tatgacgtgagtgatttcctccacc

SEQ ID NO: 382265 - DNA, 25 bp, Mus musculus
ggctgttcagcaacgaggttccaca

SEQ ID NO: 382266 - DNA, 25 bp, Mus musculus
tcccggattactggatcgacggctc

SEQ ID NO: 382267 - DNA, 25 bp, Mus musculus
cccgcggcgaagatgctcaaagtca

SEQ ID NO: 382268 - DNA, 25 bp, Mus musculus
gtgcgcgctgaaggacgcctcctct

SEQ ID NO: 382269 - DNA, 25 bp, Mus musculus
tgctcaaagtcacggtgccctcctg

SEQ ID NO: 382270 - DNA, 25 bp, Mus musculus
tcggtcaccgccagtactgagaacc

SEQ ID NO: 382271 - DNA, 25 bp, Mus musculus
gtactgagaacctcgtcccggatta

SEQ ID NO: 382272 - DNA, 25 bp, Mus musculus
gtgctcgcggtctcgggcatctccg

SEQ ID NO: 382273 - DNA, 25 bp, Mus musculus
tggatcgacggctctaaccgagatc

SEQ ID NO: 382274 - DNA, 25 bp, Mus musculus
taaccgagatcctctgggcgatttc

SEQ ID NO: 382275 - DNA, 25 bp, Mus musculus
ctctgggcgatttcttcgaggtgga

SEQ ID NO: 382276 - DNA, 25 bp, Mus musculus
atttcttcgaggtggagtcagagct

SEQ ID NO: 382277 - DNA, 25 bp, Mus musculus
ctgggaacgcctgcagcgtgcacgc

SEQ ID NO: 382278 - DNA, 25 bp, Mus musculus
agctctgcggttccctgcctggtct

SEQ ID NO: 382279 - DNA, 25 bp, Mus musculus
agcgtgcacgctagttgtccctcta

SEQ ID NO: 382280 - DNA, 25 bp, Mus musculus
caggcggtcaacaactccaggaaaa

SEQ ID NO: 382281 - DNA, 25 bp, Mus musculus
agccaatcagaaggcagaaggctgc

SEQ ID NO: 382282 - DNA, 25 bp, Mus musculus
gaaaaggtagctcgccactcctgca

SEQ ID NO: 382283 - DNA, 25 bp, Mus musculus
cccgcgcgtttcagcaagatatttt

SEQ ID NO: 382284 - DNA, 25 bp, Mus musculus
aagatattttccagcccgcccagcg

SEQ ID NO: 382285 - DNA, 25 bp, Mus musculus
tccaggaaaaggtagctcgccactc

SEQ ID NO: 382286 - DNA, 25 bp, Mus musculus
ttggtgaaggcgagcaacgcccttc

SEQ ID NO: 382287 - DNA, 25 bp, Mus musculus
gccctgcccgaatcctcggagggga

SEQ ID NO: 382288 - DNA, 25 bp, Mus musculus
ttcgctgggattggctggtgcctca

SEQ ID NO: 382289 - DNA, 25 bp, Mus musculus
tgcctcagcgtgaagggagccgatt

SEQ ID NO: 382290 - DNA, 25 bp, Mus musculus
ccttcctgtcccgtaccagaggatg

SEQ ID NO: 382291 - DNA, 25 bp, Mus musculus
ccagaggatgtcaggcggtcaacaa

SEQ ID NO: 382292 - DNA, 25 bp, Mus musculus
ctccgaggatggaccgattccgcgt

SEQ ID NO: 382293 - DNA, 25 bp, Mus musculus
agccgattggcctccgaggatggac

SEQ ID NO: 382294 - DNA, 25 bp, Mus musculus
caggaggacgcacacgcgcacggtc

SEQ ID NO: 382295 - DNA, 25 bp, Mus musculus
gcacggtcgcgtgcacaatcacacg

SEQ ID NO: 382296 - DNA, 25 bp, Mus musculus
cttatcctagctggttcgggctccc

SEQ ID NO: 382297 - DNA, 25 bp, Mus musculus
tcggaggcccttatcctagctggtt

SEQ ID NO: 382298 - DNA, 25 bp, Mus musculus
aaatggtgcccacggcagcatcagg

SEQ ID NO: 382299 - DNA, 25 bp, Mus musculus
cctgagcatagcagaaaatggtgcc

SEQ ID NO: 382300 - DNA, 25 bp, Mus musculus
tcccttttatgtgcctgtcctgagc

SEQ ID NO: 382301 - DNA, 25 bp, Mus musculus
catctgagggaaccgggacaaccac

SEQ ID NO: 382302 - DNA, 25 bp, Mus musculus
ctgtaataataaacctgcggccggg

SEQ ID NO: 382303 - DNA, 25 bp, Mus musculus
gcggcgcagccctactgtaataata

SEQ ID NO: 382304 - DNA, 25 bp, Mus musculus
gcgcggcggctttgcagacaaataa

SEQ ID NO: 382305 - DNA, 25 bp, Mus musculus
actctggcgggctcgcagcctagct

SEQ ID NO: 382306 - DNA, 25 bp, Mus musculus
ccagactgcttactcggcaggaatc

SEQ ID NO: 382307 - DNA, 25 bp, Mus musculus
tgccgccttcccttttatgtgcctg

SEQ ID NO: 382308 - DNA, 25 bp, Mus musculus
tggatgtagatcttcgccgtaggcc

SEQ ID NO: 382309 - DNA, 25 bp, Mus musculus
cgaagacccaggtcacacggtagga

SEQ ID NO: 382310 - DNA, 25 bp, Mus musculus
tctttctaggaaaccgacgccgcag

SEQ ID NO: 382311 - DNA, 25 bp, Mus musculus
cagccgtggtacagtccgttccggc

SEQ ID NO: 382312 - DNA, 25 bp, Mus musculus
acagtgggctcttccggccgtagaa

SEQ ID NO: 382313 - DNA, 25 bp, Mus musculus
cttccggccgtagaaaagcattgtg

SEQ ID NO: 382314 - DNA, 25 bp, Mus musculus
agcattgtgggagcgcagttcctcc

SEQ ID NO: 382315 - DNA, 25 bp, Mus musculus
tgggcgggaataaagcgaagaccca

SEQ ID NO: 382316 - DNA, 25 bp, Mus musculus
agttcctcctttctatgctcgcacg

SEQ ID NO: 382317 - DNA, 25 bp, Mus musculus
tgcgggacagaaccggtcccacaaa

SEQ ID NO: 382318 - DNA, 25 bp, Mus musculus
ccgagcgccgtttggatgtagatct

SEQ ID NO: 382319 - DNA, 25 bp, Mus musculus
atcttcgccgtaggcccagaactgg

SEQ ID NO: 382320 - DNA, 25 bp, Mus musculus
tcacacggtaggattgatggcccgc

SEQ ID NO: 382321 - DNA, 25 bp, Mus musculus
tttctatgctcgcacgcagcgcgga

SEQ ID NO: 382322 - DNA, 25 bp, Mus musculus
cgcggccaacacagcgactgcgaga

SEQ ID NO: 382323 - DNA, 25 bp, Mus musculus
ccctgcaaggcagagctgcatgatc

SEQ ID NO: 382324 - DNA, 25 bp, Mus musculus
gctgcatgatcctcgcaaacttaca

SEQ ID NO: 382325 - DNA, 25 bp, Mus musculus
cagttttcctactgcgtacgcgtca

SEQ ID NO: 382326 - DNA, 25 bp, Mus musculus
tcatgggtcgacttcaacgaggtca

SEQ ID NO: 382327 - DNA, 25 bp, Mus musculus
tgcgcgcaagcgcatacggccaact

SEQ ID NO: 382328 - DNA, 25 bp, Mus musculus
ttaggcggccactcttcaccatctt

SEQ ID NO: 382329 - DNA, 25 bp, Mus musculus
ggcacctttcccatggtcctttgcg

SEQ ID NO: 382330 - DNA, 25 bp, Mus musculus
agagacactgttctccgccggggtc

SEQ ID NO: 382331 - DNA, 25 bp, Mus musculus
gctacgcgtttggtaagagacactg

SEQ ID NO: 382332 - DNA, 25 bp, Mus musculus
agggagagacctcgggaacaaatca

SEQ ID NO: 382333 - DNA, 25 bp, Mus musculus
cgcagctcccgtgtaacccgaggtt

SEQ ID NO: 382334 - DNA, 25 bp, Mus musculus
cgctgtctcacttctgcccggataa

SEQ ID NO: 382335 - DNA, 25 bp, Mus musculus
gccagacacgcccacgaagagtaga

SEQ ID NO: 382336 - DNA, 25 bp, Mus musculus
ggactccgcagaaaacacagtcata

SEQ ID NO: 382337 - DNA, 25 bp, Mus musculus
tgtcgttcacaggatcgtaatcccg

SEQ ID NO: 382338 - DNA, 25 bp, Mus musculus
ccaggagacggttcaggaaagcttc

SEQ ID NO: 382339 - DNA, 25 bp, Mus musculus
agactcccgcattgcacgccgggaa

SEQ ID NO: 382340 - DNA, 25 bp, Mus musculus
cccaaaaacttccaatcccaggatg

SEQ ID NO: 382341 - DNA, 25 bp, Mus musculus
gccgaactgcactctgggacgtaga

SEQ ID NO: 382342 - DNA, 25 bp, Mus musculus
ggacgtagagtcctcatctcacggc

SEQ ID NO: 382343 - DNA, 25 bp, Mus musculus
atagagccgtaaagctttttccagg

SEQ ID NO: 382344 - DNA, 25 bp, Mus musculus
tccagggtcgtgaaatgtagtcttc

SEQ ID NO: 382345 - DNA, 25 bp, Mus musculus
atgtagtcttcccaggtatcccggg

SEQ ID NO: 382346 - DNA, 25 bp, Mus musculus
gcctagttccggtcttggcaggctg

SEQ ID NO: 382347 - DNA, 25 bp, Mus musculus
gtcgctgtagatgagtgactgctgc

SEQ ID NO: 382348 - DNA, 25 bp, Mus musculus
gagccgcttagtgtcgttcacagga

SEQ ID NO: 382349 - DNA, 25 bp, Mus musculus
cctcatccacagtaaggagggcttg

SEQ ID NO: 382350 - DNA, 25 bp, Mus musculus
cggcaaaaggcctcgaaactgaagt

SEQ ID NO: 382351 - DNA, 25 bp, Mus musculus
aacaagagtcgcctggctaaggtca

SEQ ID NO: 382352 - DNA, 25 bp, Mus musculus
gtcagccggccggagacacgaaaag

SEQ ID NO: 382353 - DNA, 25 bp, Mus musculus
ggcgggacgaatcctccagaccctg

SEQ ID NO: 382354 - DNA, 25 bp, Mus musculus
cgctaacactagagcgaacctcctg

SEQ ID NO: 382355 - DNA, 25 bp, Mus musculus
acccttacagggaaggcagagcgca

SEQ ID NO: 382356 - DNA, 25 bp, Mus musculus
ctgcttctcttttgtgaccacgatc

SEQ ID NO: 382357 - DNA, 25 bp, Mus musculus
gagctcctcaccgaaaccaactggg

SEQ ID NO: 382358 - DNA, 25 bp, Mus musculus
catcctgcggagatggccaagttca

SEQ ID NO: 382359 - DNA, 25 bp, Mus musculus
tctgtggctccagggaaagttcttg

SEQ ID NO: 382360 - DNA, 25 bp, Mus musculus
tcagtctggctaggtgcttgcaggt

SEQ ID NO: 382361 - DNA, 25 bp, Mus musculus
cttgcaggtcctggagagaacgcct

SEQ ID NO: 382362 - DNA, 25 bp, Mus musculus
tgtcgcgaggtcaccgcgttcgttt

SEQ ID NO: 382363 - DNA, 25 bp, Mus musculus
tggccaagttcaagcttcctttccc

SEQ ID NO: 382364 - DNA, 25 bp, Mus musculus
cgaaataccgcagaggcagggcata

SEQ ID NO: 382365 - DNA, 25 bp, Mus musculus
ttcccgcctccaacaagatggcgaa

SEQ ID NO: 382366 - DNA, 25 bp, Mus musculus
acaagatggcgaaggccctgtgctg

SEQ ID NO: 382367 - DNA, 25 bp, Mus musculus
gtggctgccggaaacccggccgcta

SEQ ID NO: 382368 - DNA, 25 bp, Mus musculus
agcgcagtcggctaccgttgaggaa

SEQ ID NO: 382369 - DNA, 25 bp, Mus musculus
ctatgtacgccttcctgcgctcggg

SEQ ID NO: 382370 - DNA, 25 bp, Mus musculus
tggccacgggctcgcaggtttccct

SEQ ID NO: 382371 - DNA, 25 bp, Mus musculus
ttccttacctcgcaggcagcctcgc

SEQ ID NO: 382372 - DNA, 25 bp, Mus musculus
tcgcccttactagcagtcttctgtc

SEQ ID NO: 382373 - DNA, 25 bp, Mus musculus
agcagtcttctgtccgctctaggtg

SEQ ID NO: 382374 - DNA, 25 bp, Mus musculus
tctgtccgctctaggtgcgtgggtc

SEQ ID NO: 382375 - DNA, 25 bp, Mus musculus
gcgtgggtcgtccagcccatttctt

SEQ ID NO: 382376 - DNA, 25 bp, Mus musculus
tccctcattccggagcagcgggacg

SEQ ID NO: 382377 - DNA, 25 bp, Mus musculus
agtccaatccctcattccggagcag

SEQ ID NO: 382378 - DNA, 25 bp, Mus musculus
catcattgggctcggggctcttccc

SEQ ID NO: 382379 - DNA, 25 bp, Mus musculus
gggaagaccgtctacatgccacgtc

SEQ ID NO: 382380 - DNA, 25 bp, Mus musculus
ggccacggaactcttctcgcgggaa

SEQ ID NO: 382381 - DNA, 25 bp, Mus musculus
cgttccagagtacagagactccgtc

SEQ ID NO: 382382 - DNA, 25 bp, Mus musculus
cgctttggaggtaggacttccgccg

SEQ ID NO: 382383 - DNA, 25 bp, Mus musculus
tccgagtcaacttccggctggtgcg

SEQ ID NO: 382384 - DNA, 25 bp, Mus musculus
tgccggaaccaacctgcgagggaaa

SEQ ID NO: 382385 - DNA, 25 bp, Mus musculus
gaccggaccttagcgaacagtcacg

SEQ ID NO: 382386 - DNA, 25 bp, Mus musculus
cacgccgcgagaagcgcgttctaca

SEQ ID NO: 382387 - DNA, 25 bp, Mus musculus
gcgttctacattcgtgttgcgatca

SEQ ID NO: 382388 - DNA, 25 bp, Mus musculus
ttgcgatcagagaggctcgcccggt

SEQ ID NO: 382389 - DNA, 25 bp, Mus musculus
gcccggtgtcctctgagtttctcct

SEQ ID NO: 382390 - DNA, 25 bp, Mus musculus
tcctttccgtgtaagagcgcgctcc

SEQ ID NO: 382391 - DNA, 25 bp, Mus musculus
gggcgctctctgtagtccgagtcaa

SEQ ID NO: 382392 - DNA, 25 bp, Mus musculus
ctcgagcttggcgaggagatcagtc

SEQ ID NO: 382393 - DNA, 25 bp, Mus musculus
gatcagtcatgcagttcttctcgtg

SEQ ID NO: 382394 - DNA, 25 bp, Mus musculus
ttcttctcgtgcaggaaccggtcga

SEQ ID NO: 382395 - DNA, 25 bp, Mus musculus
gtgcaggaaccggtcgaacctctcc

SEQ ID NO: 382396 - DNA, 25 bp, Mus musculus
tctccctcatggctgcggacatggc

SEQ ID NO: 382397 - DNA, 25 bp, Mus musculus
ggcgaggagatcagtcatgcagttc

SEQ ID NO: 382398 - DNA, 25 bp, Mus musculus
ttcactccggtcttggcctcgagct

SEQ ID NO: 382399 - DNA, 25 bp, Mus musculus
gaagctccggttcactccggtcttg

SEQ ID NO: 382400 - DNA, 25 bp, Mus musculus
ccgagcgcgatgaagctccggttca

SEQ ID NO: 382401 - DNA, 25 bp, Mus musculus
aggcgacacgtcagcgtccgcgcgt

SEQ ID NO: 382402 - DNA, 25 bp, Mus musculus
ccggcagaggcgacacgtcagcgtc

SEQ ID NO: 382403 - DNA, 25 bp, Mus musculus
acactgcgcccaaagctgtgggtcc

SEQ ID NO: 382404 - DNA, 25 bp, Mus musculus
tctgggacgtgaaggcgagcttcac

SEQ ID NO: 382405 - DNA, 25 bp, Mus musculus
ctggacgcggaacccagctgaccgg

SEQ ID NO: 382406 - DNA, 25 bp, Mus musculus
cactctgaggcactactgcgcaggc

SEQ ID NO: 382407 - DNA, 25 bp, Mus musculus
taagacaaaagggagggctgacacg

SEQ ID NO: 382408 - DNA, 25 bp, Mus musculus
tgctccgcgatgtctgaggcgactt

SEQ ID NO: 382409 - DNA, 25 bp, Mus musculus
aacggaccgtgtggtatgctccgcg

SEQ ID NO: 382410 - DNA, 25 bp, Mus musculus
cagaacgggcatagtggaacggacc

SEQ ID NO: 382411 - DNA, 25 bp, Mus musculus
ggctgacacgttttttggccactca

SEQ ID NO: 382412 - DNA, 25 bp, Mus musculus
tggccactcatgttaatactgcagg

SEQ ID NO: 382413 - DNA, 25 bp, Mus musculus
agttgctccgttagcactctgaggc

SEQ ID NO: 382414 - DNA, 25 bp, Mus musculus
cgcgagcgctaacttggttccttta

SEQ ID NO: 382415 - DNA, 25 bp, Mus musculus
ctataaataaacctccagctgcgca

SEQ ID NO: 382416 - DNA, 25 bp, Mus musculus
gcaactctcaggaggtgaagcgcga

SEQ ID NO: 382417 - DNA, 25 bp, Mus musculus
aagcgcgagccttggcggtgcccta

SEQ ID NO: 382418 - DNA, 25 bp, Mus musculus
gcggtgccctatctgcgcaggcgca

SEQ ID NO: 382419 - DNA, 25 bp, Mus musculus
cacacagggcaagcgcagttgctcc

SEQ ID NO: 382420 - DNA, 25 bp, Mus musculus
tcgacgaggcgagaactgaggccct

SEQ ID NO: 382421 - DNA, 25 bp, Mus musculus
gaacccttggcgacgtcgacgaggc

SEQ ID NO: 382422 - DNA, 25 bp, Mus musculus
cgggctgcctagcagccgcagagtc

SEQ ID NO: 382423 - DNA, 25 bp, Mus musculus
tggccgcttttccagaacccttggc

SEQ ID NO: 382424 - DNA, 25 bp, Mus musculus
ggtctcctcctgaagcggcctctag

SEQ ID NO: 382425 - DNA, 25 bp, Mus musculus
tttccagaacccttggcgacgtcga

SEQ ID NO: 382426 - DNA, 25 bp, Mus musculus
aactgaggccctaagtggcacggcg

SEQ ID NO: 382427 - DNA, 25 bp, Mus musculus
aagcggcctctagcgcgaggctgaa

SEQ ID NO: 382428 - DNA, 25 bp, Mus musculus
ctagcgcgaggctgaagcgactgca

SEQ ID NO: 382429 - DNA, 25 bp, Mus musculus
gcggctgaggcgcagagcctcccta

SEQ ID NO: 382430 - DNA, 25 bp, Mus musculus
ccggtcaacccggattcggcgctgg

SEQ ID NO: 382431 - DNA, 25 bp, Mus musculus
tcaacccggattcggcgctggactg

SEQ ID NO: 382432 - DNA, 25 bp, Mus musculus
ctccggcccgcccacttgtgggtgc

SEQ ID NO: 382433 - DNA, 25 bp, Mus musculus
agagcctccctaacggcgagcggga

SEQ ID NO: 382434 - DNA, 25 bp, Mus musculus
gactgccggcctactactttgcata

SEQ ID NO: 382435 - DNA, 25 bp, Mus musculus
cgacgtcttcaacgttggcgacaga

SEQ ID NO: 382436 - DNA, 25 bp, Mus musculus
tcgccatcttggcttcgacgtcttc

SEQ ID NO: 382437 - DNA, 25 bp, Mus musculus
ttgggatgctagtctcaactctaca

SEQ ID NO: 382438 - DNA, 25 bp, Mus musculus
ccacgcctttcacgcctgagaattg

SEQ ID NO: 382439 - DNA, 25 bp, Mus musculus
gatctctgagctctgcgctctccga

SEQ ID NO: 382440 - DNA, 25 bp, Mus musculus
ccgaaagcgacaggaaaggcagatc

SEQ ID NO: 382441 - DNA, 25 bp, Mus musculus
tccgttttaccctaggcagcgccta

SEQ ID NO: 382442 - DNA, 25 bp, Mus musculus
ccctgcggcaggaaaagcctacagc

SEQ ID NO: 382443 - DNA, 25 bp, Mus musculus
ccgtcggatatagagcggttccctg

SEQ ID NO: 382444 - DNA, 25 bp, Mus musculus
gctgaactccgggagacgcgttttc

SEQ ID NO: 382445 - DNA, 25 bp, Mus musculus
tgggaaacacagtgcgaatccgttc

SEQ ID NO: 382446 - DNA, 25 bp, Mus musculus
gcaggcttatttcccacgattccca

SEQ ID NO: 382447 - DNA, 25 bp, Mus musculus
gactgctcctcaccgctcggttaga

SEQ ID NO: 382448 - DNA, 25 bp, Mus musculus
ctagccttgcacgaagcaaccaatc

SEQ ID NO: 382449 - DNA, 25 bp, Mus musculus
ttcctgcaagtctgaaaaatccgcg

SEQ ID NO: 382450 - DNA, 25 bp, Mus musculus
atccgcgacagtggatacgcccggc

SEQ ID NO: 382451 - DNA, 25 bp, Mus musculus
ctgccaccgagactaccgaagaatt

SEQ ID NO: 382452 - DNA, 25 bp, Mus musculus
gcagcagctgctttttaatttcctg

SEQ ID NO: 382453 - DNA, 25 bp, Mus musculus
agccaaccagcagcaagaatacttg

SEQ ID NO: 382454 - DNA, 25 bp, Mus musculus
acggtgcccttacctctgtcagagg

SEQ ID NO: 382455 - DNA, 25 bp, Mus musculus
cttgctcagccgaaccgaaaaactc

SEQ ID NO: 382456 - DNA, 25 bp, Mus musculus
tcggcctttcattggcctagccttg

SEQ ID NO: 382457 - DNA, 25 bp, Mus musculus
tccgcagacctggaacaccacataa

SEQ ID NO: 382458 - DNA, 25 bp, Mus musculus
gggcagagagaaggccaactccgca

SEQ ID NO: 382459 - DNA, 25 bp, Mus musculus
gcggctgcagctccgacaaaggcaa

SEQ ID NO: 382460 - DNA, 25 bp, Mus musculus
gatcgccactgtaacggtgccctta

SEQ ID NO: 382461 - DNA, 25 bp, Mus musculus
ccgaagaattcgcagccattttcct

SEQ ID NO: 382462 - DNA, 25 bp, Mus musculus
tcggccgacacctcccaccgccgcc

SEQ ID NO: 382463 - DNA, 25 bp, Mus musculus
catcgggcggctattactccgggac

SEQ ID NO: 382464 - DNA, 25 bp, Mus musculus
ggacccagagtaggacgagacttca

SEQ ID NO: 382465 - DNA, 25 bp, Mus musculus
tactccgggacccagagtaggacga

SEQ ID NO: 382466 - DNA, 25 bp, Mus musculus
ggcggctattactccgggacccaga

SEQ ID NO: 382467 - DNA, 25 bp, Mus musculus
taactctgaagtgccgggcagcatc

SEQ ID NO: 382468 - DNA, 25 bp, Mus musculus
ctctaactctgaagtgccgggcagc

SEQ ID NO: 382469 - DNA, 25 bp, Mus musculus
gggcaccgccctctaactctgaagt

SEQ ID NO: 382470 - DNA, 25 bp, Mus musculus
gccactctcccactagggtcgtggg

SEQ ID NO: 382471 - DNA, 25 bp, Mus musculus
cagagtaggacgagacttcaaggcc

SEQ ID NO: 382472 - DNA, 25 bp, Mus musculus
gacgcccgggatgcgacagcgctct

SEQ ID NO: 382473 - DNA, 25 bp, Mus musculus
cgggatgcgacagcgctctgcctgc

SEQ ID NO: 382474 - DNA, 25 bp, Mus musculus
cctgccttggtgcacaggactcgga

SEQ ID NO: 382475 - DNA, 25 bp, Mus musculus
tagggtcgtgggcaccgccctctaa

SEQ ID NO: 382476 - DNA, 25 bp, Mus musculus
caaagaccggttggttcttgccagc

SEQ ID NO: 382477 - DNA, 25 bp, Mus musculus
cgacggcgctattctgaaaaagatt

SEQ ID NO: 382478 - DNA, 25 bp, Mus musculus
tctgaaaaagattaagggagacacc

SEQ ID NO: 382479 - DNA, 25 bp, Mus musculus
taagggagacaccacgtagggcttg

SEQ ID NO: 382480 - DNA, 25 bp, Mus musculus
agacaccacgtagggcttgggcctc

SEQ ID NO: 382481 - DNA, 25 bp, Mus musculus
cttgggcctcttcggcaggttccgg

SEQ ID NO: 382482 - DNA, 25 bp, Mus musculus
ccatactctcctcaaagaccggttg

SEQ ID NO: 382483 - DNA, 25 bp, Mus musculus
tggttcttgccagcgccttttaagg

SEQ ID NO: 382484 - DNA, 25 bp, Mus musculus
cagcgccttttaagggcaccgtggg

SEQ ID NO: 382485 - DNA, 25 bp, Mus musculus
gcgaacggagcgctcagagctgctc

SEQ ID NO: 382486 - DNA, 25 bp, Mus musculus
ctcctaggccgtctcggcgggagaa

SEQ ID NO: 382487 - DNA, 25 bp, Mus musculus
tggcggagtgcatgtcccagaccct

SEQ ID NO: 382488 - DNA, 25 bp, Mus musculus
ccctgcgtcctgagttcgcttcccg

SEQ ID NO: 382489 - DNA, 25 bp, Mus musculus
ggggattctgtgaatagacgcgatc

SEQ ID NO: 382490 - DNA, 25 bp, Mus musculus
ttcatgttgcccacgcgcaacctgt

SEQ ID NO: 382491 - DNA, 25 bp, Mus musculus
gtgcgaccgcgaggctacagagcat

SEQ ID NO: 382492 - DNA, 25 bp, Mus musculus
gctacagagcatgcgcctccacatg

SEQ ID NO: 382493 - DNA, 25 bp, Mus musculus
cgaccgcctagtcgcggtgcattct

SEQ ID NO: 382494 - DNA, 25 bp, Mus musculus
gcggggactcactaccggaagcgac

SEQ ID NO: 382495 - DNA, 25 bp, Mus musculus
accaaggtccactccggagagaggc

SEQ ID NO: 382496 - DNA, 25 bp, Mus musculus
gaagatcctaactgcaccaccaagg

SEQ ID NO: 382497 - DNA, 25 bp, Mus musculus
caccagccagaagatcctaactgca

SEQ ID NO: 382498 - DNA, 25 bp, Mus musculus
gtctgcagaaatgagctagaatcca

SEQ ID NO: 382499 - DNA, 25 bp, Mus musculus
gggtacctgatgctcccgcttggct

SEQ ID NO: 382500 - DNA, 25 bp, Mus musculus
agcgcagcactggaggagccgccca

SEQ ID NO: 382501 - DNA, 25 bp, Mus musculus
tctgggaattgtagtgcgaccgcga

SEQ ID NO: 382502 - DNA, 25 bp, Mus musculus
tagaatccaaacaccagccagaaga

SEQ ID NO: 382503 - DNA, 25 bp, Mus musculus
tcactaccggaagcgaccgcctagt

SEQ ID NO: 382504 - DNA, 25 bp, Mus musculus
ggaagttgttacctgggcccaatgc

SEQ ID NO: 382505 - DNA, 25 bp, Mus musculus
tacctgggcccaatgcgccagcaga

SEQ ID NO: 382506 - DNA, 25 bp, Mus musculus
gttatgtcttacctgcctctgcgcc

SEQ ID NO: 382507 - DNA, 25 bp, Mus musculus
tgcgcctcgctttggttctttcggt

SEQ ID NO: 382508 - DNA, 25 bp, Mus musculus
tgtgcatgcgcctcgctttggttct

SEQ ID NO: 382509 - DNA, 25 bp, Mus musculus
atagcacagacaggtcgggacgccc

SEQ ID NO: 382510 - DNA, 25 bp, Mus musculus
ctgcgggccgggaaatagcacagac

SEQ ID NO: 382511 - DNA, 25 bp, Mus musculus
tggctcctagctgctgccacggggc

SEQ ID NO: 382512 - DNA, 25 bp, Mus musculus
ggcacgctctagtggctcctagctg

SEQ ID NO: 382513 - DNA, 25 bp, Mus musculus
ggctgttgcttctttccgcactttc

SEQ ID NO: 382514 - DNA, 25 bp, Mus musculus
ccggggaccgttagctgcgccgcat

SEQ ID NO: 382515 - DNA, 25 bp, Mus musculus
acccgcggcgcaataacggtgagtg

SEQ ID NO: 382516 - DNA, 25 bp, Mus musculus
ccagcagaggacagataatggagct

SEQ ID NO: 382517 - DNA, 25 bp, Mus musculus
ctgctggactggaccgttatgtctt

SEQ ID NO: 382518 - DNA, 25 bp, Mus musculus
tacacgccctcggagcaggctctgg

SEQ ID NO: 382519 - DNA, 25 bp, Mus musculus
ctagaagacgcggacctgcggatcc

SEQ ID NO: 382520 - DNA, 25 bp, Mus musculus
aattcggctagaagacgcggacctg

SEQ ID NO: 382521 - DNA, 25 bp, Mus musculus
gttgcttctgttcgcggaccctacg

SEQ ID NO: 382522 - DNA, 25 bp, Mus musculus
ggtcccgcaaaattcggctagaaga

SEQ ID NO: 382523 - DNA, 25 bp, Mus musculus
agacgcggacctgcggatcccaggt

SEQ ID NO: 382524 - DNA, 25 bp, Mus musculus
acgccctcggagcaggctctggaac

SEQ ID NO: 382525 - DNA, 25 bp, Mus musculus
gtgcagccctggttgagcctccgct

SEQ ID NO: 382526 - DNA, 25 bp, Mus musculus
tgttgctgctgcttgccggcaggcc

SEQ ID NO: 382527 - DNA, 25 bp, Mus musculus
gggtgcgcgccccagtttctcctgg

SEQ ID NO: 382528 - DNA, 25 bp, Mus musculus
tcgcggaccctacggcctcagcttc

SEQ ID NO: 382529 - DNA, 25 bp, Mus musculus
gctgttgcttctgttcgcggaccct

SEQ ID NO: 382530 - DNA, 25 bp, Mus musculus
ctctgaccggcgtggcttccgcgtt

SEQ ID NO: 382531 - DNA, 25 bp, Mus musculus
tcctgggcgaccctgctcagcgcac

SEQ ID NO: 382532 - DNA, 25 bp, Mus musculus
ctggtggtgtgagtgcagaggctgc

SEQ ID NO: 382533 - DNA, 25 bp, Mus musculus
tctctcgcctggtggtgtgagtgca

SEQ ID NO: 382534 - DNA, 25 bp, Mus musculus
atctctcgcctggtggtgtgagtgc

SEQ ID NO: 382535 - DNA, 25 bp, Mus musculus
tcatctctcgcctggtggtgtgagt

SEQ ID NO: 382536 - DNA, 25 bp, Mus musculus
catggtgtcctggatcatctctcgc

SEQ ID NO: 382537 - DNA, 25 bp, Mus musculus
ccatggtgtcctggatcatctctcg

SEQ ID NO: 382538 - DNA, 25 bp, Mus musculus
gccggcctcgggcagctgcatccat

SEQ ID NO: 382539 - DNA, 25 bp, Mus musculus
ccgctgctaacagcggctcctgctg

SEQ ID NO: 382540 - DNA, 25 bp, Mus musculus
ccgctgccgctgctaacagcggctc

SEQ ID NO: 382541 - DNA, 25 bp, Mus musculus
ggcggcaactccacgctccgctgac

SEQ ID NO: 382542 - DNA, 25 bp, Mus musculus
gctgcggcagggacctcccctttaa

SEQ ID NO: 382543 - DNA, 25 bp, Mus musculus
ccaccgcccacggaccgccgctgcg

SEQ ID NO: 382544 - DNA, 25 bp, Mus musculus
tttaagaggcgccaccgcccacgga

SEQ ID NO: 382545 - DNA, 25 bp, Mus musculus
gcctcgggcagctgcatccataccc

SEQ ID NO: 382546 - DNA, 25 bp, Mus musculus
tgcgtctaaggctctcccggcctgg

SEQ ID NO: 382547 - DNA, 25 bp, Mus musculus
ggcgacggaagagcccgtcgcgcct

SEQ ID NO: 382548 - DNA, 25 bp, Mus musculus
cgctttggcagtggcggttccctcg

SEQ ID NO: 382549 - DNA, 25 bp, Mus musculus
cctcgggactgcggggaaggcccag

SEQ ID NO: 382550 - DNA, 25 bp, Mus musculus
cgcctgctcagttctccctcactgc

SEQ ID NO: 382551 - DNA, 25 bp, Mus musculus
tcagttctccctcactgcgtctaag

SEQ ID NO: 382552 - DNA, 25 bp, Mus musculus
cagttctccctcactgcgtctaagg

SEQ ID NO: 382553 - DNA, 25 bp, Mus musculus
agttctccctcactgcgtctaaggc

SEQ ID NO: 382554 - DNA, 25 bp, Mus musculus
ccgcgcccagcccagactacgggag

SEQ ID NO: 382555 - DNA, 25 bp, Mus musculus
ctccctcactgcgtctaaggctctc

SEQ ID NO: 382556 - DNA, 25 bp, Mus musculus
gtctaaggctctcccggcctggctc

SEQ ID NO: 382557 - DNA, 25 bp, Mus musculus
gaacgtggaggcgacggaagagccc

SEQ ID NO: 382558 - DNA, 25 bp, Mus musculus
cgcccagcccagactacgggagggg

SEQ ID NO: 382559 - DNA, 25 bp, Mus musculus
gttctccctcactgcgtctaaggct

SEQ ID NO: 382560 - DNA, 25 bp, Mus musculus
cctacagagggcagcaccgagccgt

SEQ ID NO: 382561 - DNA, 25 bp, Mus musculus
tacagagggcagcaccgagccgtaa

SEQ ID NO: 382562 - DNA, 25 bp, Mus musculus
tcgcgcctggggctcccgaaataca

SEQ ID NO: 382563 - DNA, 25 bp, Mus musculus
gcgcctggggctcccgaaatacaac

SEQ ID NO: 382564 - DNA, 25 bp, Mus musculus
ctggggctcccgaaatacaaccaga

SEQ ID NO: 382565 - DNA, 25 bp, Mus musculus
ggggctcccgaaatacaaccagaga

SEQ ID NO: 382566 - DNA, 25 bp, Mus musculus
ggctcccgaaatacaaccagagacc

SEQ ID NO: 382567 - DNA, 25 bp, Mus musculus
cccgaaatacaaccagagacctaca

SEQ ID NO: 382568 - DNA, 25 bp, Mus musculus
atacaaccagagacctacagagggc

SEQ ID NO: 382569 - DNA, 25 bp, Mus musculus
caaccagagacctacagagggcagc

SEQ ID NO: 382570 - DNA, 25 bp, Mus musculus
ccagagacctacagagggcagcacc

SEQ ID NO: 382571 - DNA, 25 bp, Mus musculus
cagagggcagcaccgagccgtaaac

SEQ ID NO: 382572 - DNA, 25 bp, Mus musculus
agagacctacagagggcagcaccga

SEQ ID NO: 382573 - DNA, 25 bp, Mus musculus
cagcaccgagccgtaaacgggtcct

SEQ ID NO: 382574 - DNA, 25 bp, Mus musculus
acccttgaaatagaggccgattcgg

SEQ ID NO: 382575 - DNA, 25 bp, Mus musculus
gcgccttatatggagtggcccaata

SEQ ID NO: 382576 - DNA, 25 bp, Mus musculus
gtggcccaatatggccctgccgctt

SEQ ID NO: 382577 - DNA, 25 bp, Mus musculus
ggaggccactgctgctgttccaata

SEQ ID NO: 382578 - DNA, 25 bp, Mus musculus
tgttccaatactaggctttccagga

SEQ ID NO: 382579 - DNA, 25 bp, Mus musculus
accactcttggatgggagggcttca

SEQ ID NO: 382580 - DNA, 25 bp, Mus musculus
agggcttcacgtcactccgggtcct

SEQ ID NO: 382581 - DNA, 25 bp, Mus musculus
gccggtccttccatattagggcttc

SEQ ID NO: 382582 - DNA, 25 bp, Mus musculus
tcaggctcccagttgggaaccaagg

SEQ ID NO: 382583 - DNA, 25 bp, Mus musculus
tgcgccgacccggaaacgccatata

SEQ ID NO: 382584 - DNA, 25 bp, Mus musculus
cgccatataaggagcaggaaggatc

SEQ ID NO: 382585 - DNA, 25 bp, Mus musculus
cagaccttatttgggcagcgcctta

SEQ ID NO: 382586 - DNA, 25 bp, Mus musculus
cccatatatggccatgtacgtcacg

SEQ ID NO: 382587 - DNA, 25 bp, Mus musculus
gcccgtgctgttccagacccttgaa

SEQ ID NO: 382588 - DNA, 25 bp, Mus musculus
ctggagcacggcctccgagagcagc

SEQ ID NO: 382589 - DNA, 25 bp, Mus musculus
gtcagaggcgctcatcatcgccatc

SEQ ID NO: 382590 - DNA, 25 bp, Mus musculus
gctggacatcctttagccgctcgcg

SEQ ID NO: 382591 - DNA, 25 bp, Mus musculus
ttgctggacatcctttagccgctcg

SEQ ID NO: 382592 - DNA, 25 bp, Mus musculus
ccttgctggacatcctttagccgct

SEQ ID NO: 382593 - DNA, 25 bp, Mus musculus
cggcccatacatggcgcttccttcc

SEQ ID NO: 382594 - DNA, 25 bp, Mus musculus
aggcgctcatcatcgccatccattt

SEQ ID NO: 382595 - DNA, 25 bp, Mus musculus
aggtcagaggcgctcatcatcgcca

SEQ ID NO: 382596 - DNA, 25 bp, Mus musculus
tgcaaggtcagaggcgctcatcatc

SEQ ID NO: 382597 - DNA, 25 bp, Mus musculus
cctgcaaggtcagaggcgctcatca

SEQ ID NO: 382598 - DNA, 25 bp, Mus musculus
cgcctcgaaacagcgccgccttcca

SEQ ID NO: 382599 - DNA, 25 bp, Mus musculus
ctccggagcgcctcgaaacagcgcc

SEQ ID NO: 382600 - DNA, 25 bp, Mus musculus
tgaccctgccaaggaggggaacgcc

SEQ ID NO: 382601 - DNA, 25 bp, Mus musculus
tcatcatcgccatccatttcatctg

SEQ ID NO: 382602 - DNA, 25 bp, Mus musculus
ccaggcagctgcatgtgttgcaatc

SEQ ID NO: 382603 - DNA, 25 bp, Mus musculus
gatctccacgttcctatcggcagca

SEQ ID NO: 382604 - DNA, 25 bp, Mus musculus
tccgcttacaagaggcaatctgatt

SEQ ID NO: 382605 - DNA, 25 bp, Mus musculus
atggggcctctgatctcacttcctc

SEQ ID NO: 382606 - DNA, 25 bp, Mus musculus
ttgcaatccgctcacatggggcctc

SEQ ID NO: 382607 - DNA, 25 bp, Mus musculus
gggccgcctccaagctcttaatgag

SEQ ID NO: 382608 - DNA, 25 bp, Mus musculus
gaggttcaactttatggctcgctga

SEQ ID NO: 382609 - DNA, 25 bp, Mus musculus
tggaggaaacgtcgcaacgaggttc

SEQ ID NO: 382610 - DNA, 25 bp, Mus musculus
cgctttacctaagggcccagtcctg

SEQ ID NO: 382611 - DNA, 25 bp, Mus musculus
agcatctgaagctctgcggcgcaaa

SEQ ID NO: 382612 - DNA, 25 bp, Mus musculus
cccttgatctgaatgagcatctgaa

SEQ ID NO: 382613 - DNA, 25 bp, Mus musculus
gcgtggtcgttgtctttcgttcttc

SEQ ID NO: 382614 - DNA, 25 bp, Mus musculus
agctccgtggctctcgcgagcattt

SEQ ID NO: 382615 - DNA, 25 bp, Mus musculus
cgggagacaccaagaccacagagtt

SEQ ID NO: 382616 - DNA, 25 bp, Mus musculus
cggggacctttgttctccatcgctg

SEQ ID NO: 382617 - DNA, 25 bp, Mus musculus
cgctgcagcaatgaagcccgctctt

SEQ ID NO: 382618 - DNA, 25 bp, Mus musculus
gcgcttatcatggtggctggacaga

SEQ ID NO: 382619 - DNA, 25 bp, Mus musculus
tggtggctacgcttctggaaacctc

SEQ ID NO: 382620 - DNA, 25 bp, Mus musculus
ccgacgtgctgcctgactagagact

SEQ ID NO: 382621 - DNA, 25 bp, Mus musculus
gcacgcctctcagcattaatcgttg

SEQ ID NO: 382622 - DNA, 25 bp, Mus musculus
tcgcttcggacagtcccggtcctta

SEQ ID NO: 382623 - DNA, 25 bp, Mus musculus
gactcaaggtcacacgggataaatt

SEQ ID NO: 382624 - DNA, 25 bp, Mus musculus
ggatgctccagtgcacgcgaatttg

SEQ ID NO: 382625 - DNA, 25 bp, Mus musculus
ccatcgctgtttgttcgccgcttga

SEQ ID NO: 382626 - DNA, 25 bp, Mus musculus
cgccgcttgaaatgtgcacacctga

SEQ ID NO: 382627 - DNA, 25 bp, Mus musculus
tgcgcggtctcacacaaatttgggc

SEQ ID NO: 382628 - DNA, 25 bp, Mus musculus
gctctagggcagcatcggattcacg

SEQ ID NO: 382629 - DNA, 25 bp, Mus musculus
gattacagtctccttgcgtcagttg

SEQ ID NO: 382630 - DNA, 25 bp, Mus musculus
ttccctggatttgttccggccactc

SEQ ID NO: 382631 - DNA, 25 bp, Mus musculus
cgctgcaggtaactcttcgtacctc

SEQ ID NO: 382632 - DNA, 25 bp, Mus musculus
gctcttgtccttaaggtgcgccaca

SEQ ID NO: 382633 - DNA, 25 bp, Mus musculus
tgttctccagcgctcttgtccttaa

SEQ ID NO: 382634 - DNA, 25 bp, Mus musculus
atgggagtcgtagcttcctgttctc

SEQ ID NO: 382635 - DNA, 25 bp, Mus musculus
tcccgctgctgaaacttgggcgttt

SEQ ID NO: 382636 - DNA, 25 bp, Mus musculus
gctcgcccagttcgctgcaggtaac

SEQ ID NO: 382637 - DNA, 25 bp, Mus musculus
cagggcggcccatttcctcctggga

SEQ ID NO: 382638 - DNA, 25 bp, Mus musculus
gggacgcgattgttccctggatttg

SEQ ID NO: 382639 - DNA, 25 bp, Mus musculus
ggctctccctagaaagcgccggctg

SEQ ID NO: 382640 - DNA, 25 bp, Mus musculus
agcgccctgagactcacctgagctg

SEQ ID NO: 382641 - DNA, 25 bp, Mus musculus
ctggagttgccaggctaccttccgg

SEQ ID NO: 382642 - DNA, 25 bp, Mus musculus
cctcactgagggacaaccgcggcgt

SEQ ID NO: 382643 - DNA, 25 bp, Mus musculus
tgcgtgcccggaggccaaaccaaaa

SEQ ID NO: 382644 - DNA, 25 bp, Mus musculus
cacggcagccgaggggcagacacaa

SEQ ID NO: 382645 - DNA, 25 bp, Mus musculus
cgcgaggcactgaggtggatgtggc

SEQ ID NO: 382646 - DNA, 25 bp, Mus musculus
tggatgtggcgggacccggaacact

SEQ ID NO: 382647 - DNA, 25 bp, Mus musculus
acccggaacactgtgggaaggtgcg

SEQ ID NO: 382648 - DNA, 25 bp, Mus musculus
aggaggccgctaacggcaggaggcc

SEQ ID NO: 382649 - DNA, 25 bp, Mus musculus
ctttccacggcagccgaggggcaga

SEQ ID NO: 382650 - DNA, 25 bp, Mus musculus
gcagccgaggggcagacacaatccc

SEQ ID NO: 382651 - DNA, 25 bp, Mus musculus
ggggcagacacaatccccacaattc

SEQ ID NO: 382652 - DNA, 25 bp, Mus musculus
cggctgcagcggcaaccagctcctc

SEQ ID NO: 382653 - DNA, 25 bp, Mus musculus
gcaaccagctcctcgtgcgcaaacg

SEQ ID NO: 382654 - DNA, 25 bp, Mus musculus
tcctcgtgcgcaaacgccgtccagc

SEQ ID NO: 382655 - DNA, 25 bp, Mus musculus
cagcggctgccgaaggctgaaggcg

SEQ ID NO: 382656 - DNA, 25 bp, Mus musculus
aaggctgaaggcgcgtggctattac

SEQ ID NO: 382657 - DNA, 25 bp, Mus musculus
cttcggctttccacggcagccgagg

SEQ ID NO: 382658 - DNA, 25 bp, Mus musculus
cgcgcctcctgtgcccatgtaaaag

SEQ ID NO: 382659 - DNA, 25 bp, Mus musculus
cataatcctggaaaggctgtccgcg

SEQ ID NO: 382660 - DNA, 25 bp, Mus musculus
ctcgctcagaaactccataatcctg

SEQ ID NO: 382661 - DNA, 25 bp, Mus musculus
gtcactgtttttacttggcgggctc

SEQ ID NO: 382662 - DNA, 25 bp, Mus musculus
tgtccagcgtctccataacgtgctc

SEQ ID NO: 382663 - DNA, 25 bp, Mus musculus
ctttgccgtaaaaggactcattgtc

SEQ ID NO: 382664 - DNA, 25 bp, Mus musculus
ccgtacctcacttcggggaaggatg

SEQ ID NO: 382665 - DNA, 25 bp, Mus musculus
ggctcttcagggcaaacttctcgct

SEQ ID NO: 382666 - DNA, 25 bp, Mus musculus
tgccacatttctttacttcgacccg

SEQ ID NO: 382667 - DNA, 25 bp, Mus musculus
tgccagccgtcgctttgccgtaaaa

SEQ ID NO: 382668 - DNA, 25 bp, Mus musculus
gctggtgacttaccgctgctgtcct

SEQ ID NO: 382669 - DNA, 25 bp, Mus musculus
tgctgtcctgacagggcgaagtcct

SEQ ID NO: 382670 - DNA, 25 bp, Mus musculus
cgaagtcctgtccaggcgcacgtga

SEQ ID NO: 382671 - DNA, 25 bp, Mus musculus
cgaaggcctgcacgcatttgccagc

SEQ ID NO: 382672 - DNA, 25 bp, Mus musculus
tcccgctcgctgagagaggtatctc

SEQ ID NO: 382673 - DNA, 25 bp, Mus musculus
tgtttctttctcaggcgtcagtcgc

SEQ ID NO: 382674 - DNA, 25 bp, Mus musculus
gcgtgttctgaccaatgtttctttc

SEQ ID NO: 382675 - DNA, 25 bp, Mus musculus
taggatgtgagaagcttgcgtgttc

SEQ ID NO: 382676 - DNA, 25 bp, Mus musculus
tctagcgcctttgcgggttttcctc

SEQ ID NO: 382677 - DNA, 25 bp, Mus musculus
cctgccattcgaggagggtggttaa

SEQ ID NO: 382678 - DNA, 25 bp, Mus musculus
aagcctgagggacagaccgcgcgtc

SEQ ID NO: 382679 - DNA, 25 bp, Mus musculus
aggtgtgcttgtccgccaagcgtcc

SEQ ID NO: 382680 - DNA, 25 bp, Mus musculus
ttggcgcgtgccgaactagaactgg

SEQ ID NO: 382681 - DNA, 25 bp, Mus musculus
ggactccctgcgtctgttcagagcg

SEQ ID NO: 382682 - DNA, 25 bp, Mus musculus
ctctcgcgagattcatctctggttc

SEQ ID NO: 382683 - DNA, 25 bp, Mus musculus
gcgcgcgattttcgccagacatctg

SEQ ID NO: 382684 - DNA, 25 bp, Mus musculus
cctcctcggtcgctgcgtatgtgag

SEQ ID NO: 382685 - DNA, 25 bp, Mus musculus
gagaacaacgctggccggccgcgta

SEQ ID NO: 382686 - DNA, 25 bp, Mus musculus
gccgagcgactaagagaccgcctga

SEQ ID NO: 382687 - DNA, 25 bp, Mus musculus
ggcctctttaccaagggtcgcagac

SEQ ID NO: 382688 - DNA, 25 bp, Mus musculus
tagtaaccacgtgataagcggaggc

SEQ ID NO: 382689 - DNA, 25 bp, Mus musculus
caaatggttgggagcacgtgacaga

SEQ ID NO: 382690 - DNA, 25 bp, Mus musculus
cggggcaatggctcttgtgagctac

SEQ ID NO: 382691 - DNA, 25 bp, Mus musculus
aagagcgctcactcggccgcaacta

SEQ ID NO: 382692 - DNA, 25 bp, Mus musculus
gaccgcctgaagagcgctcactcgg

SEQ ID NO: 382693 - DNA, 25 bp, Mus musculus
taagttccagggcacgtcgaagcgc

SEQ ID NO: 382694 - DNA, 25 bp, Mus musculus
gctcttgtgagctacgggaggctca

SEQ ID NO: 382695 - DNA, 25 bp, Mus musculus
ctcatccaatgctgtggccgagcga

SEQ ID NO: 382696 - DNA, 25 bp, Mus musculus
agagcgcgccgttcacatccacggt

SEQ ID NO: 382697 - DNA, 25 bp, Mus musculus
cggcccagatagcaggtgtgcccac

SEQ ID NO: 382698 - DNA, 25 bp, Mus musculus
caggtgtgcccaccagcagcagatg

SEQ ID NO: 382699 - DNA, 25 bp, Mus musculus
agcgcctttgtgctttccgcgggaa

SEQ ID NO: 382700 - DNA, 25 bp, Mus musculus
gcaggctccatctatctccgaaatg

SEQ ID NO: 382701 - DNA, 25 bp, Mus musculus
agtcagccgtctgtccgggtctttt

SEQ ID NO: 382702 - DNA, 25 bp, Mus musculus
cctctattggcctagctgggaagca

SEQ ID NO: 382703 - DNA, 25 bp, Mus musculus
ccgacaggattcgttggctaccgtc

SEQ ID NO: 382704 - DNA, 25 bp, Mus musculus
ctgtgggccttcgagtaggctttga

SEQ ID NO: 382705 - DNA, 25 bp, Mus musculus
ttgacctcggttgttcctggcccat

SEQ ID NO: 382706 - DNA, 25 bp, Mus musculus
cctggcccatttctacggagtttga

SEQ ID NO: 382707 - DNA, 25 bp, Mus musculus
gcgttctctcttgcgccctctattg

SEQ ID NO: 382708 - DNA, 25 bp, Mus musculus
gatttcgattgcacagtcagccgtc

SEQ ID NO: 382709 - DNA, 25 bp, Mus musculus
tgttgccgggatagcactttcttgc

SEQ ID NO: 382710 - DNA, 25 bp, Mus musculus
cttgcgttcttcagtcagttgtttc

SEQ ID NO: 382711 - DNA, 25 bp, Mus musculus
gccacttgggcaacaaagctcattg

SEQ ID NO: 382712 - DNA, 25 bp, Mus musculus
gggagcactctgtaacggtcgaacg

SEQ ID NO: 382713 - DNA, 25 bp, Mus musculus
ggccgtcgttcatttttctcatttc

SEQ ID NO: 382714 - DNA, 25 bp, Mus musculus
ggctgttccggtgtatccacatctg

SEQ ID NO: 382715 - DNA, 25 bp, Mus musculus
ggattcctgtttgtaagcctgatga

SEQ ID NO: 382716 - DNA, 25 bp, Mus musculus
ctgggcctcacaaccctactgggaa

SEQ ID NO: 382717 - DNA, 25 bp, Mus musculus
tgggcacacatcgtcgtccagagtg

SEQ ID NO: 382718 - DNA, 25 bp, Mus musculus
aagcattccgattttcccacgcaga

SEQ ID NO: 382719 - DNA, 25 bp, Mus musculus
aaggggtccttctgctgacgacttc

SEQ ID NO: 382720 - DNA, 25 bp, Mus musculus
tagcttcctgatgcagtgccgtcga

SEQ ID NO: 382721 - DNA, 25 bp, Mus musculus
cagctcctgggttagaccgttcata

SEQ ID NO: 382722 - DNA, 25 bp, Mus musculus
tccacatctggagaccgttgaccgc

SEQ ID NO: 382723 - DNA, 25 bp, Mus musculus
ggccgagacttagcctcttccagga

SEQ ID NO: 382724 - DNA, 25 bp, Mus musculus
tccagagtgcttgtgaggtgacttc

SEQ ID NO: 382725 - DNA, 25 bp, Mus musculus
cggcacggttctatcaggagtctca

SEQ ID NO: 382726 - DNA, 25 bp, Mus musculus
gcgatacccgcattttccagtgaga

SEQ ID NO: 382727 - DNA, 25 bp, Mus musculus
gggctgctccgtctccaaacaatct

SEQ ID NO: 382728 - DNA, 25 bp, Mus musculus
tccgtcgccggccaatgagaatgcg

SEQ ID NO: 382729 - DNA, 25 bp, Mus musculus
cgtcccgcagttgatcgaaggcgag

SEQ ID NO: 382730 - DNA, 25 bp, Mus musculus
cgcagttgatcgaaggcgagacaca

SEQ ID NO: 382731 - DNA, 25 bp, Mus musculus
cgaaggcgagacacactgatccaga

SEQ ID NO: 382732 - DNA, 25 bp, Mus musculus
ggcgagacacactgatccagagccc

SEQ ID NO: 382733 - DNA, 25 bp, Mus musculus
acccaaggggcgtcgccatcttttg

SEQ ID NO: 382734 - DNA, 25 bp, Mus musculus
ccgctggctcgttggaaatggcctc

SEQ ID NO: 382735 - DNA, 25 bp, Mus musculus
gttggaaatggcctcctgctgcgcg

SEQ ID NO: 382736 - DNA, 25 bp, Mus musculus
cggccaatgagaatgcgacgccaca

SEQ ID NO: 382737 - DNA, 25 bp, Mus musculus
agaatgcgacgccacagagcaccct

SEQ ID NO: 382738 - DNA, 25 bp, Mus musculus
acagagcaccctggcaaccggggcg

SEQ ID NO: 382739 - DNA, 25 bp, Mus musculus
ggggacttcctctgttcgcaaggcc

SEQ ID NO: 382740 - DNA, 25 bp, Mus musculus
ttcctctgttcgcaaggccgaggcc

SEQ ID NO: 382741 - DNA, 25 bp, Mus musculus
ctcgttggaaatggcctcctgctgc

SEQ ID NO: 382742 - DNA, 25 bp, Mus musculus
gcccgcgcgactcactctgagccgc

SEQ ID NO: 382743 - DNA, 25 bp, Mus musculus
cacgctggtcattgtagtttaatac

SEQ ID NO: 382744 - DNA, 25 bp, Mus musculus
tgtaggctgcgcttctacgcgacta

SEQ ID NO: 382745 - DNA, 25 bp, Mus musculus
ccgctgcccagagtggtcgccatat

SEQ ID NO: 382746 - DNA, 25 bp, Mus musculus
gtttaatacgtgtaggctgcgcttc

SEQ ID NO: 382747 - DNA, 25 bp, Mus musculus
gggcacgctggtcattgtagtttaa

SEQ ID NO: 382748 - DNA, 25 bp, Mus musculus
tcaagtcccggaggctgaaagagaa

SEQ ID NO: 382749 - DNA, 25 bp, Mus musculus
tgagcctctcaagtcccggaggctg

SEQ ID NO: 382750 - DNA, 25 bp, Mus musculus
gcagatcgactgagcctctcaagtc

SEQ ID NO: 382751 - DNA, 25 bp, Mus musculus
tctgtcagcagatcgactgagcctc

SEQ ID NO: 382752 - DNA, 25 bp, Mus musculus
gccatatcggttttctgtcagcaga

SEQ ID NO: 382753 - DNA, 25 bp, Mus musculus
tggtcgccatatcggttttctgtca

SEQ ID NO: 382754 - DNA, 25 bp, Mus musculus
cagagtggtcgccatatcggttttc

SEQ ID NO: 382755 - DNA, 25 bp, Mus musculus
gctgcgcttctacgcgactacaagt

SEQ ID NO: 382756 - DNA, 25 bp, Mus musculus
ctcccactgcctcgcgacgtcatcc

SEQ ID NO: 382757 - DNA, 25 bp, Mus musculus
ccctgaataggctgcggcctgcact

SEQ ID NO: 382758 - DNA, 25 bp, Mus musculus
tcgcgagatttcctcccactgcctc

SEQ ID NO: 382759 - DNA, 25 bp, Mus musculus
actcgcggcgtctggttccttctgc

SEQ ID NO: 382760 - DNA, 25 bp, Mus musculus
gtctggttccttctgccggcgccgg

SEQ ID NO: 382761 - DNA, 25 bp, Mus musculus
cgctcccagagatggcgcccaggaa

SEQ ID NO: 382762 - DNA, 25 bp, Mus musculus
acttcccgcgatcgcctccgctgga

SEQ ID NO: 382763 - DNA, 25 bp, Mus musculus
agaatccacaaggtaagcggccagg

SEQ ID NO: 382764 - DNA, 25 bp, Mus musculus
agagaatccacaaggtaagcggcca

SEQ ID NO: 382765 - DNA, 25 bp, Mus musculus
tcggcctgggcccaccctgcgctcc

SEQ ID NO: 382766 - DNA, 25 bp, Mus musculus
tggcccgccaatcccggcgcctccc

SEQ ID NO: 382767 - DNA, 25 bp, Mus musculus
gtcatcccctctgcggctgtgcttg

SEQ ID NO: 382768 - DNA, 25 bp, Mus musculus
ctccgctggactcgcggcgtctggt

SEQ ID NO: 382769 - DNA, 25 bp, Mus musculus
cggcccgtatccctccgccgctggc

SEQ ID NO: 382770 - DNA, 25 bp, Mus musculus
ccactcgctgccctgtgtataggga

SEQ ID NO: 382771 - DNA, 25 bp, Mus musculus
cgaagccttcccaagccgcagtatg

SEQ ID NO: 382772 - DNA, 25 bp, Mus musculus
gtggccgctcctataccgaagcctt

SEQ ID NO: 382773 - DNA, 25 bp, Mus musculus
cccgaagttcaggtgcggagagcca

SEQ ID NO: 382774 - DNA, 25 bp, Mus musculus
ggagttcgccgcaagtccgcggaaa

SEQ ID NO: 382775 - DNA, 25 bp, Mus musculus
ccgcagtatgctcggtcgcagatca

SEQ ID NO: 382776 - DNA, 25 bp, Mus musculus
ccgccgcgagaggaatgtgttaatt

SEQ ID NO: 382777 - DNA, 25 bp, Mus musculus
ggtgtttgttcctcagctgcaggtc

SEQ ID NO: 382778 - DNA, 25 bp, Mus musculus
tctcttctgtccttttcggccttgg

SEQ ID NO: 382779 - DNA, 25 bp, Mus musculus
tttcccgtcaaagtatatcacctcc

SEQ ID NO: 382780 - DNA, 25 bp, Mus musculus
tgtatagggacgttcataactgccc

SEQ ID NO: 382781 - DNA, 25 bp, Mus musculus
caatcattgtagcttgcgggcgccg

SEQ ID NO: 382782 - DNA, 25 bp, Mus musculus
ggggacgcttccttcccaatcattg

SEQ ID NO: 382783 - DNA, 25 bp, Mus musculus
ggcgggctgatcaagtttgaccttt

SEQ ID NO: 382784 - DNA, 25 bp, Mus musculus
ttcgggcgaagacaaacggatgcac

SEQ ID NO: 382785 - DNA, 25 bp, Mus musculus
gagatgaccggaactcttcggggta

SEQ ID NO: 382786 - DNA, 25 bp, Mus musculus
gtaactgcccgtgcgttctccatgc

SEQ ID NO: 382787 - DNA, 25 bp, Mus musculus
ctccgtcattgagccggccacgggg

SEQ ID NO: 382788 - DNA, 25 bp, Mus musculus
ggggagcatcttgcaccaggcccac

SEQ ID NO: 382789 - DNA, 25 bp, Mus musculus
gggaccctgactgaactctctcctt

SEQ ID NO: 382790 - DNA, 25 bp, Mus musculus
tgactgaactctctccttgtttttg

SEQ ID NO: 382791 - DNA, 25 bp, Mus musculus
cccgccagaaggtgatgcttccgtc

SEQ ID NO: 382792 - DNA, 25 bp, Mus musculus
agccgccttccggtggtttcagtga

SEQ ID NO: 382793 - DNA, 25 bp, Mus musculus
ttcagtgatttcagtgacggccggg

SEQ ID NO: 382794 - DNA, 25 bp, Mus musculus
tgacggccgggaacccaaagctgcc

SEQ ID NO: 382795 - DNA, 25 bp, Mus musculus
aaagctgccctctccgtgcaatgtc

SEQ ID NO: 382796 - DNA, 25 bp, Mus musculus
actgcccgcgtggtctccggcaagg

SEQ ID NO: 382797 - DNA, 25 bp, Mus musculus
tccgtgcaatgtcactgcccgcgtg

SEQ ID NO: 382798 - DNA, 25 bp, Mus musculus
acgaggcgagtgcaactgggcctcc

SEQ ID NO: 382799 - DNA, 25 bp, Mus musculus
ctccttcccacagaaccgtggaggg

SEQ ID NO: 382800 - DNA, 25 bp, Mus musculus
tcggcacgatcacacgggcaagacg

SEQ ID NO: 382801 - DNA, 25 bp, Mus musculus
ggcactaatgtctttcccacatggc

SEQ ID NO: 382802 - DNA, 25 bp, Mus musculus
gcggccggcactaatgtctttccca

SEQ ID NO: 382803 - DNA, 25 bp, Mus musculus
tgagtcaccgtttctgggccaggca

SEQ ID NO: 382804 - DNA, 25 bp, Mus musculus
aacgcggagcgtgtgagtcaccgtt

SEQ ID NO: 382805 - DNA, 25 bp, Mus musculus
ctcaagcagccgaagcagggaggct

SEQ ID NO: 382806 - DNA, 25 bp, Mus musculus
ttgcgggccctcaagcagccgaagc

SEQ ID NO: 382807 - DNA, 25 bp, Mus musculus
tgtagctcctgatttcccgactcct

SEQ ID NO: 382808 - DNA, 25 bp, Mus musculus
ccctggaggaactttgtagctcctg

SEQ ID NO: 382809 - DNA, 25 bp, Mus musculus
gattcttggccagtctcagtccacc

SEQ ID NO: 382810 - DNA, 25 bp, Mus musculus
cgggactcccatggattcttggcca

SEQ ID NO: 382811 - DNA, 25 bp, Mus musculus
tgccaggcacactgggagccacgga

SEQ ID NO: 382812 - DNA, 25 bp, Mus musculus
acgcagcactagctggttgggcacg

SEQ ID NO: 382813 - DNA, 25 bp, Mus musculus
cactagctggttgggcacgtgggag

SEQ ID NO: 382814 - DNA, 25 bp, Mus musculus
cgcagcactagctggttgggcacgt

SEQ ID NO: 382815 - DNA, 25 bp, Mus musculus
cgccgcgggcctagctctgtgcgct

SEQ ID NO: 382816 - DNA, 25 bp, Mus musculus
tgcagacctggctcgatccttggcg

SEQ ID NO: 382817 - DNA, 25 bp, Mus musculus
ctgcagacctggctcgatccttggc

SEQ ID NO: 382818 - DNA, 25 bp, Mus musculus
gcggctcccagcctgcagacctggc

SEQ ID NO: 382819 - DNA, 25 bp, Mus musculus
atgggtgatgggagaggcggctccc

SEQ ID NO: 382820 - DNA, 25 bp, Mus musculus
actctgcgtcatgggtgatgggaga

SEQ ID NO: 382821 - DNA, 25 bp, Mus musculus
ccgcagtggactctgcgtcatgggt

SEQ ID NO: 382822 - DNA, 25 bp, Mus musculus
agccgcagtggactctgcgtcatgg

SEQ ID NO: 382823 - DNA, 25 bp, Mus musculus
cagccgcagtggactctgcgtcatg

SEQ ID NO: 382824 - DNA, 25 bp, Mus musculus
ggcagccgcagtggactctgcgtca

SEQ ID NO: 382825 - DNA, 25 bp, Mus musculus
tagctctgtgcgctgggaggacgca

SEQ ID NO: 382826 - DNA, 25 bp, Mus musculus
gctgggaccctaagtcagataggca

SEQ ID NO: 382827 - DNA, 25 bp, Mus musculus
tacaggaccattttgctgatgagca

SEQ ID NO: 382828 - DNA, 25 bp, Mus musculus
acctgccgcctttgcgcctaggaaa

SEQ ID NO: 382829 - DNA, 25 bp, Mus musculus
agccttcaaagctgagtgcgctgtc

SEQ ID NO: 382830 - DNA, 25 bp, Mus musculus
tgcgctgtcctaatcaggacctttg

SEQ ID NO: 382831 - DNA, 25 bp, Mus musculus
ctttgccttagcttttccgaactgg

SEQ ID NO: 382832 - DNA, 25 bp, Mus musculus
taggcacgtgttacatggcgcagtc

SEQ ID NO: 382833 - DNA, 25 bp, Mus musculus
aggacacatttttcgggaccacttg

SEQ ID NO: 382834 - DNA, 25 bp, Mus musculus
ccatggtgaccgtgcactataaata

SEQ ID NO: 382835 - DNA, 25 bp, Mus musculus
gcaggcctaggctctgactccagaa

SEQ ID NO: 382836 - DNA, 25 bp, Mus musculus
gcacatgttccctagcttggttata

SEQ ID NO: 382837 - DNA, 25 bp, Mus musculus
ccctcggcaagagcggcacatgttc

SEQ ID NO: 382838 - DNA, 25 bp, Mus musculus
ccagggcatccgttaagtgcggaga

SEQ ID NO: 382839 - DNA, 25 bp, Mus musculus
ggcctgtggagttgtggaccaaata

SEQ ID NO: 382840 - DNA, 25 bp, Mus musculus
ccgcactccaggggaaaccgaggcg

SEQ ID NO: 382841 - DNA, 25 bp, Mus musculus
taggaccgccgcacagcgggctgca

SEQ ID NO: 382842 - DNA, 25 bp, Mus musculus
atatctgcccgctggactgatgtgc

SEQ ID NO: 382843 - DNA, 25 bp, Mus musculus
atgtgcggacgaggcagctcgactg

SEQ ID NO: 382844 - DNA, 25 bp, Mus musculus
ctctgtagcagagcgacagctgcgc

SEQ ID NO: 382845 - DNA, 25 bp, Mus musculus
ctgcccgctggactgatgtgcggac

SEQ ID NO: 382846 - DNA, 25 bp, Mus musculus
ctgggaaggatcgatatctgcccgc

SEQ ID NO: 382847 - DNA, 25 bp, Mus musculus
acgcggagatctagggcgcggctac

SEQ ID NO: 382848 - DNA, 25 bp, Mus musculus
cagagcgacagctgcgcagcgtacc

SEQ ID NO: 382849 - DNA, 25 bp, Mus musculus
gcggaggcgtcctggaaaaccagcc

SEQ ID NO: 382850 - DNA, 25 bp, Mus musculus
aggatcgatatctgcccgctggact

SEQ ID NO: 382851 - DNA, 25 bp, Mus musculus
tctagcaccgaatctccgcggaggc

SEQ ID NO: 382852 - DNA, 25 bp, Mus musculus
aatctccgcggaggcgtcctggaaa

SEQ ID NO: 382853 - DNA, 25 bp, Mus musculus
tccttctttgtaggaccgccgcaca

SEQ ID NO: 382854 - DNA, 25 bp, Mus musculus
ccatctttctggaagccgggaccgc

SEQ ID NO: 382855 - DNA, 25 bp, Mus musculus
atcatcaccgtgtcttctccctgga

SEQ ID NO: 382856 - DNA, 25 bp, Mus musculus
ctggcgagcggctccttcttttctt

SEQ ID NO: 382857 - DNA, 25 bp, Mus musculus
tcgcggagtctcctgaacactgctc

SEQ ID NO: 382858 - DNA, 25 bp, Mus musculus
cgaagttcacttccgctccatcatg

SEQ ID NO: 382859 - DNA, 25 bp, Mus musculus
cttcaagccgctcagtcttggggta

SEQ ID NO: 382860 - DNA, 25 bp, Mus musculus
ggcgatgcccagcagccaatccttg

SEQ ID NO: 382861 - DNA, 25 bp, Mus musculus
cactttgatgttgcactccgccggg

SEQ ID NO: 382862 - DNA, 25 bp, Mus musculus
ggtctgaagcgacacatcactttga

SEQ ID NO: 382863 - DNA, 25 bp, Mus musculus
ccgcggttcacttcagattcgttga

SEQ ID NO: 382864 - DNA, 25 bp, Mus musculus
gcgacgtacttatcgccgcggttca

SEQ ID NO: 382865 - DNA, 25 bp, Mus musculus
tccctggaatttggcgacgtactta

SEQ ID NO: 382866 - DNA, 25 bp, Mus musculus
tcttttcgggaaggacagccgaggc

SEQ ID NO: 382867 - DNA, 25 bp, Mus musculus
ccgggcagctagaccgaagcgctgt

SEQ ID NO: 382868 - DNA, 25 bp, Mus musculus
gacccaatttatctcgccgccaaag

SEQ ID NO: 382869 - DNA, 25 bp, Mus musculus
acaggggcctttgaacaagtgtgca

SEQ ID NO: 382870 - DNA, 25 bp, Mus musculus
gaaggtctgcggacacaaatgcaca

SEQ ID NO: 382871 - DNA, 25 bp, Mus musculus
gtaatgaggtcaccgtcaccgcgcc

SEQ ID NO: 382872 - DNA, 25 bp, Mus musculus
ttagagcagccaaatgcggaggcgc

SEQ ID NO: 382873 - DNA, 25 bp, Mus musculus
gcaggccgttcccatcactttagag

SEQ ID NO: 382874 - DNA, 25 bp, Mus musculus
cgagcgagccgaccctgaattttaa

SEQ ID NO: 382875 - DNA, 25 bp, Mus musculus
gtgcacgcccgtctttgaacacgtc

SEQ ID NO: 382876 - DNA, 25 bp, Mus musculus
tttccaatacgacggcatcgcgact

SEQ ID NO: 382877 - DNA, 25 bp, Mus musculus
ccagcgcggggatgttttccaatac

SEQ ID NO: 382878 - DNA, 25 bp, Mus musculus
gccgccaaagtttcacagccatctg

SEQ ID NO: 382879 - DNA, 25 bp, Mus musculus
gagaatcccgcccatctgtgagccg

SEQ ID NO: 382880 - DNA, 25 bp, Mus musculus
caggcagccctctaacgcgagcgag

SEQ ID NO: 382881 - DNA, 25 bp, Mus musculus
ccatctgctcgagtggaacggcttc

SEQ ID NO: 382882 - DNA, 25 bp, Mus musculus
gccgcggtaatttccgagtcggcga

SEQ ID NO: 382883 - DNA, 25 bp, Mus musculus
ggtcattaacaacggcccggactgc

SEQ ID NO: 382884 - DNA, 25 bp, Mus musculus
ctctggtcacgctgcgctacgctga

SEQ ID NO: 382885 - DNA, 25 bp, Mus musculus
cgctgagccgcggtaatttccgagt

SEQ ID NO: 382886 - DNA, 25 bp, Mus musculus
agtcggcgaccgctttgtgtgcacc

SEQ ID NO: 382887 - DNA, 25 bp, Mus musculus
ccaatcaggtttgcggctcggaggc

SEQ ID NO: 382888 - DNA, 25 bp, Mus musculus
gcgctacgctgagccgcggtaattt

SEQ ID NO: 382889 - DNA, 25 bp, Mus musculus
ccctctttcatgtctgccgcgcctc

SEQ ID NO: 382890 - DNA, 25 bp, Mus musculus
tgggcaccagcggtgcgtttccctc

SEQ ID NO: 382891 - DNA, 25 bp, Mus musculus
cgggcaatgcttcccagctctgggc

SEQ ID NO: 382892 - DNA, 25 bp, Mus musculus
attcgatgccaatcaggtttgcggc

SEQ ID NO: 382893 - DNA, 25 bp, Mus musculus
gcgccgtaattcgatgccaatcagg

SEQ ID NO: 382894 - DNA, 25 bp, Mus musculus
ccgcgcgccgtaattcgatgccaat

SEQ ID NO: 382895 - DNA, 25 bp, Mus musculus
gcctttatctccctctgccgcgcgc

SEQ ID NO: 382896 - DNA, 25 bp, Mus musculus
gtcgggacgcaccatatatcatgtc

SEQ ID NO: 382897 - DNA, 25 bp, Mus musculus
actgagttaatctgcagtggctgga

SEQ ID NO: 382898 - DNA, 25 bp, Mus musculus
tcgtccttttccaaggcggatgaca

SEQ ID NO: 382899 - DNA, 25 bp, Mus musculus
gaccttctggagacggcgattaatc

SEQ ID NO: 382900 - DNA, 25 bp, Mus musculus
cgggctccctgacgaaatcgtcctt

SEQ ID NO: 382901 - DNA, 25 bp, Mus musculus
acggcgattaatcacgggccgtggc

SEQ ID NO: 382902 - DNA, 25 bp, Mus musculus
tatcatgtctgcagccaggaggggc

SEQ ID NO: 382903 - DNA, 25 bp, Mus musculus
acagcctacttgtgcttgccgaagc

SEQ ID NO: 382904 - DNA, 25 bp, Mus musculus
cggatgacaggttgtgggaacaaca

SEQ ID NO: 382905 - DNA, 25 bp, Mus musculus
tgggaacaacagcttgaattacgga

SEQ ID NO: 382906 - DNA, 25 bp, Mus musculus
gcgactgactgcattgcacaccgca

SEQ ID NO: 382907 - DNA, 25 bp, Mus musculus
attgcacaccgcagatcgcagctgc

SEQ ID NO: 382908 - DNA, 25 bp, Mus musculus
acccgtgtcgggacgcaccatatat

SEQ ID NO: 382909 - DNA, 25 bp, Mus musculus
gctgcctctggacgctgaaaaatcc

SEQ ID NO: 382910 - DNA, 25 bp, Mus musculus
cccgttgccaggagcagtcaggatg

SEQ ID NO: 382911 - DNA, 25 bp, Mus musculus
tccatggcaacgcggcatctcgagc

SEQ ID NO: 382912 - DNA, 25 bp, Mus musculus
tctccatggcaacgcggcatctcga

SEQ ID NO: 382913 - DNA, 25 bp, Mus musculus
agtcaggatgcggcagcgtctccat

SEQ ID NO: 382914 - DNA, 25 bp, Mus musculus
ccgttgccaggagcagtcaggatgc

SEQ ID NO: 382915 - DNA, 25 bp, Mus musculus
ctgcgggaccccgttgccaggagca

SEQ ID NO: 382916 - DNA, 25 bp, Mus musculus
tctggcggcgccgtgggcagcctgg

SEQ ID NO: 382917 - DNA, 25 bp, Mus musculus
tgtgtgctcctgagagcgggagtga

SEQ ID NO: 382918 - DNA, 25 bp, Mus musculus
taaatgtgtgtgctcctgagagcgg

SEQ ID NO: 382919 - DNA, 25 bp, Mus musculus
cgtaaatgtgtgtgctcctgagagc

SEQ ID NO: 382920 - DNA, 25 bp, Mus musculus
cacgtaaatgtgtgtgctcctgaga

SEQ ID NO: 382921 - DNA, 25 bp, Mus musculus
cgcacgtaaatgtgtgtgctcctga

SEQ ID NO: 382922 - DNA, 25 bp, Mus musculus
cgcgcacgtaaatgtgtgtgctcct

SEQ ID NO: 382923 - DNA, 25 bp, Mus musculus
agcagtcaggatgcggcagcgtctc

SEQ ID NO: 382924 - DNA, 25 bp, Mus musculus
cgacgctgaatccacgcctaagggt

SEQ ID NO: 382925 - DNA, 25 bp, Mus musculus
gcctcctttgcggggcccagaaaca

SEQ ID NO: 382926 - DNA, 25 bp, Mus musculus
acaccgtcgtggtttgagctctgag

SEQ ID NO: 382927 - DNA, 25 bp, Mus musculus
cgcacgaacagtcgcccggaggtca

SEQ ID NO: 382928 - DNA, 25 bp, Mus musculus
acagtcgcccggaggtcacagagca

SEQ ID NO: 382929 - DNA, 25 bp, Mus musculus
tgaagtgccgttgtaccgacgctga

SEQ ID NO: 382930 - DNA, 25 bp, Mus musculus
caggccgtagagctagcgaaggcca

SEQ ID NO: 382931 - DNA, 25 bp, Mus musculus
tgccgttgtaccgacgctgaatcca

SEQ ID NO: 382932 - DNA, 25 bp, Mus musculus
gaagttgctgcaccttctacgccgc

SEQ ID NO: 382933 - DNA, 25 bp, Mus musculus
cccagaaacaccgtcgtggtttgag

SEQ ID NO: 382934 - DNA, 25 bp, Mus musculus
ccacgcctaagggtggggctgcatc

SEQ ID NO: 382935 - DNA, 25 bp, Mus musculus
gtattctttccgaagttgctgcacc

SEQ ID NO: 382936 - DNA, 25 bp, Mus musculus
gcatcctaggggtattctttccgaa

SEQ ID NO: 382937 - DNA, 25 bp, Mus musculus
ggctgcatcctaggggtattctttc

SEQ ID NO: 382938 - DNA, 25 bp, Mus musculus
caaggtcgggcgcttgtgcccaggc

SEQ ID NO: 382939 - DNA, 25 bp, Mus musculus
cggggagctccaacaggcggcggca

SEQ ID NO: 382940 - DNA, 25 bp, Mus musculus
tgcccagcctctccacagccgaggc

SEQ ID NO: 382941 - DNA, 25 bp, Mus musculus
cccaccgtgagaggggacccagcgg

SEQ ID NO: 382942 - DNA, 25 bp, Mus musculus
tccaggggtggcctccgcatggccc

SEQ ID NO: 382943 - DNA, 25 bp, Mus musculus
gacccagcggctgggacacgagcgg

SEQ ID NO: 382944 - DNA, 25 bp, Mus musculus
cgaagcgaacgcggggagctccaac

SEQ ID NO: 382945 - DNA, 25 bp, Mus musculus
ctgaggggacagaagcgaagcgaac

SEQ ID NO: 382946 - DNA, 25 bp, Mus musculus
gaggctccaacacctgaggggacag

SEQ ID NO: 382947 - DNA, 25 bp, Mus musculus
ccgaggctccaacacctgaggggac

SEQ ID NO: 382948 - DNA, 25 bp, Mus musculus
acagccgaggctccaacacctgagg

SEQ ID NO: 382949 - DNA, 25 bp, Mus musculus
cgcccttcttgtccttcccgctcct

SEQ ID NO: 382950 - DNA, 25 bp, Mus musculus
cccgcacaaggtcgggcgcttgtgc

SEQ ID NO: 382951 - DNA, 25 bp, Mus musculus
tccgcatggccccaccgtgagaggg

SEQ ID NO: 382952 - DNA, 25 bp, Mus musculus
tgctcaatgacagcgagtcccgcgc

SEQ ID NO: 382953 - DNA, 25 bp, Mus musculus
ccgcagggtagtagtagctgtcgta

SEQ ID NO: 382954 - DNA, 25 bp, Mus musculus
tggtctcgtactcgtcgtcctccgg

SEQ ID NO: 382955 - DNA, 25 bp, Mus musculus
tggccagcgagtagtggaagtccac

SEQ ID NO: 382956 - DNA, 25 bp, Mus musculus
tcgaaagtcggcacctgcgtggcca

SEQ ID NO: 382957 - DNA, 25 bp, Mus musculus
ggcgacgtgatctcgaaagtcggca

SEQ ID NO: 382958 - DNA, 25 bp, Mus musculus
tagctgtcgtagctgcgctgcatgt

SEQ ID NO: 382959 - DNA, 25 bp, Mus musculus
agcccgaaccgctgctcaatgacag

SEQ ID NO: 382960 - DNA, 25 bp, Mus musculus
aggaatggcgtgctctcggccgcca

SEQ ID NO: 382961 - DNA, 25 bp, Mus musculus
cgagtccgagcgcaacgcgtcgtgc

SEQ ID NO: 382962 - DNA, 25 bp, Mus musculus
ccagggagtagtaagtcctgctgtc

SEQ ID NO: 382963 - DNA, 25 bp, Mus musculus
gcgcactcctgcgtggtctcgtact

SEQ ID NO: 382964 - DNA, 25 bp, Mus musculus
tggctgtccagggagtagtaagtcc

SEQ ID NO: 382965 - DNA, 25 bp, Mus musculus
ggtctccgctctccttggagacgtg

SEQ ID NO: 382966 - DNA, 25 bp, Mus musculus
gcagccaggcaactccggggagtcc

SEQ ID NO: 382967 - DNA, 25 bp, Mus musculus
agaccgacagacctgcggaagtccc

SEQ ID NO: 382968 - DNA, 25 bp, Mus musculus
gctgatccacgtagaggccgctcgt

SEQ ID NO: 382969 - DNA, 25 bp, Mus musculus
cggccggagcgaagatagaagcacc

SEQ ID NO: 382970 - DNA, 25 bp, Mus musculus
agcaccgaaagctcgcagcctggta

SEQ ID NO: 382971 - DNA, 25 bp, Mus musculus
cgctcgtgccatggccacaagggga

SEQ ID NO: 382972 - DNA, 25 bp, Mus musculus
ccgctccgtcgtccggagtggatag

SEQ ID NO: 382973 - DNA, 25 bp, Mus musculus
gtggataggctgcttcaggactttc

SEQ ID NO: 382974 - DNA, 25 bp, Mus musculus
gcttcaggactttcgccggcagcta

SEQ ID NO: 382975 - DNA, 25 bp, Mus musculus
gggcggtgcccgataccatcatccg

SEQ ID NO: 382976 - DNA, 25 bp, Mus musculus
cacccaggattccatcgcggcggga

SEQ ID NO: 382977 - DNA, 25 bp, Mus musculus
gctacctgttcaactgcacggcgcg

SEQ ID NO: 382978 - DNA, 25 bp, Mus musculus
cccggccaggtaagcgacgccagga

SEQ ID NO: 382979 - DNA, 25 bp, Mus musculus
gcagcgtctgcaagttcgcgccact

SEQ ID NO: 382980 - DNA, 25 bp, Mus musculus
agcgcggaaacagtctcgaggtaga

SEQ ID NO: 382981 - DNA, 25 bp, Mus musculus
tcctagattttgattgggctacata

SEQ ID NO: 382982 - DNA, 25 bp, Mus musculus
agaactcggccgcatagccgtggcg

SEQ ID NO: 382983 - DNA, 25 bp, Mus musculus
gctcacccgcgatgccgtagtgctg

SEQ ID NO: 382984 - DNA, 25 bp, Mus musculus
tttgattgggctacatagaaaaggg

SEQ ID NO: 382985 - DNA, 25 bp, Mus musculus
cgcccggaatcctagattttgattg

SEQ ID NO: 382986 - DNA, 25 bp, Mus musculus
cgccgacgcccggaatcctagattt

SEQ ID NO: 382987 - DNA, 25 bp, Mus musculus
ctcactgaaagtccaggaaggccgg

SEQ ID NO: 382988 - DNA, 25 bp, Mus musculus
ccactgcggctcactgaaagtccag

SEQ ID NO: 382989 - DNA, 25 bp, Mus musculus
aaacagtctcgaggtagaagtgccc

SEQ ID NO: 382990 - DNA, 25 bp, Mus musculus
ggcccgagcgcggaaacagtctcga

SEQ ID NO: 382991 - DNA, 25 bp, Mus musculus
caggtacggagagaactcggccgca

SEQ ID NO: 382992 - DNA, 25 bp, Mus musculus
tgccgtagtgctgcgccgcggcaca

SEQ ID NO: 382993 - DNA, 25 bp, Mus musculus
catagaaaagggaactgacgccgcg

SEQ ID NO: 382994 - DNA, 25 bp, Mus musculus
tgccgtgcggatccgctcgagccga

SEQ ID NO: 382995 - DNA, 25 bp, Mus musculus
ttctctcagcgaaacggggtttctg

SEQ ID NO: 382996 - DNA, 25 bp, Mus musculus
tccgctcgagccgatcgcaagagag

SEQ ID NO: 382997 - DNA, 25 bp, Mus musculus
gggatcgggctctcgctcccgcttt

SEQ ID NO: 382998 - DNA, 25 bp, Mus musculus
tctctgccaccaagggagacgcgcg

SEQ ID NO: 382999 - DNA, 25 bp, Mus musculus
gggtgtgctagaccgcagtctccct

SEQ ID NO: 383000 - DNA, 25 bp, Mus musculus
gagccgatcgcaagagagcgcaccc

SEQ ID NO: 383001 - DNA, 25 bp, Mus musculus
ggagggacgccctcggatctccgct

SEQ ID NO: 383002 - DNA, 25 bp, Mus musculus
ctagcgcggcgcctttcttataggc

SEQ ID NO: 383003 - DNA, 25 bp, Mus musculus
cttataggcggtcacaccctccggg

SEQ ID NO: 383004 - DNA, 25 bp, Mus musculus
ggagcggcgagccttaactcttccc

SEQ ID NO: 383005 - DNA, 25 bp, Mus musculus
ctctcggtgtttcttgccgcggccg

SEQ ID NO: 383006 - DNA, 25 bp, Mus musculus
gggcccaccgagacagccaggtcgt

SEQ ID NO: 383007 - DNA, 25 bp, Mus musculus
ggcggcaggtttctctcagcgaaac

SEQ ID NO: 383008 - DNA, 25 bp, Mus musculus
tgcaccgagccttctccagtggcgg

SEQ ID NO: 383009 - DNA, 25 bp, Mus musculus
ggaagcttggaactgcactgcttta

SEQ ID NO: 383010 - DNA, 25 bp, Mus musculus
cgctggttcctttcgagcggcgcac

SEQ ID NO: 383011 - DNA, 25 bp, Mus musculus
tgcactgctttagtgcccgccttca

SEQ ID NO: 383012 - DNA, 25 bp, Mus musculus
tatcccggacctagtcaggagcgtg

SEQ ID NO: 383013 - DNA, 25 bp, Mus musculus
tgagcagcaaacctgccgcatctgg

SEQ ID NO: 383014 - DNA, 25 bp, Mus musculus
tgtagctgtagctgctgcaccgagc

SEQ ID NO: 383015 - DNA, 25 bp, Mus musculus
tgctgtcgctgtaactgtagctgta

SEQ ID NO: 383016 - DNA, 25 bp, Mus musculus
accgaagagcagcatcgagaagccg

SEQ ID NO: 383017 - DNA, 25 bp, Mus musculus
tagcaggcgagtgacacaccgaaga

SEQ ID NO: 383018 - DNA, 25 bp, Mus musculus
tacgcctggtcctgcaccgacttga

SEQ ID NO: 383019 - DNA, 25 bp, Mus musculus
accacgggtgccttgtacgcctggt

SEQ ID NO: 383020 - DNA, 25 bp, Mus musculus
tctcgggtgctgttagagctggaac

SEQ ID NO: 383021 - DNA, 25 bp, Mus musculus
agcgtaacgttagcgcctcgaagcc

SEQ ID NO: 383022 - DNA, 25 bp, Mus musculus
gccaaggtgagaccctccccggaga

SEQ ID NO: 383023 - DNA, 25 bp, Mus musculus
cccttaacgcagagctggcgcaggc

SEQ ID NO: 383024 - DNA, 25 bp, Mus musculus
ctcacctgcggcaggacagcgcccg

SEQ ID NO: 383025 - DNA, 25 bp, Mus musculus
ctcgcgcgccgtccagaacaggtgt

SEQ ID NO: 383026 - DNA, 25 bp, Mus musculus
tgaaaggctcgctgcctctgagcca

SEQ ID NO: 383027 - DNA, 25 bp, Mus musculus
cgcgccgtccagaacaggtgtgcgc

SEQ ID NO: 383028 - DNA, 25 bp, Mus musculus
cccggagatgaaaggctcgctgcct

SEQ ID NO: 383029 - DNA, 25 bp, Mus musculus
gttacgcgccgacgtctggctgcca

SEQ ID NO: 383030 - DNA, 25 bp, Mus musculus
agcgccgggttacgcgccgacgtct

SEQ ID NO: 383031 - DNA, 25 bp, Mus musculus
agtcacgcacggagcgccgggttac

SEQ ID NO: 383032 - DNA, 25 bp, Mus musculus
ttcccgcgtgtgaggcagcaacgag

SEQ ID NO: 383033 - DNA, 25 bp, Mus musculus
ctgcggtgttgacgcgccaacggca

SEQ ID NO: 383034 - DNA, 25 bp, Mus musculus
acgcggaggcccttaacgcagagct

SEQ ID NO: 383035 - DNA, 25 bp, Mus musculus
cagcaacgaggagcgcgctccgcta

SEQ ID NO: 383036 - DNA, 25 bp, Mus musculus
ttccctctccggatgtgcacaaggc

SEQ ID NO: 383037 - DNA, 25 bp, Mus musculus
tcgggcagatcctcacagcggaaga

SEQ ID NO: 383038 - DNA, 25 bp, Mus musculus
cccggtttatcgaggcgtattcgtg

SEQ ID NO: 383039 - DNA, 25 bp, Mus musculus
gccattttgtgtgggtctgctgctc

SEQ ID NO: 383040 - DNA, 25 bp, Mus musculus
acccaggtaccagtggccgaggacg

SEQ ID NO: 383041 - DNA, 25 bp, Mus musculus
agaactgagaccacaaaatggctgc

SEQ ID NO: 383042 - DNA, 25 bp, Mus musculus
tgcacaaggcccaacccaagaactg

SEQ ID NO: 383043 - DNA, 25 bp, Mus musculus
tggcggacattaaaactccactgtg

SEQ ID NO: 383044 - DNA, 25 bp, Mus musculus
actcgctctcttcaatacgccatgg

SEQ ID NO: 383045 - DNA, 25 bp, Mus musculus
ggagtttcggtctccactcgcctgc

SEQ ID NO: 383046 - DNA, 25 bp, Mus musculus
cgggatcatggagaaccggagtttc

SEQ ID NO: 383047 - DNA, 25 bp, Mus musculus
agcagatacctctccgctctgggga

SEQ ID NO: 383048 - DNA, 25 bp, Mus musculus
gtttactcatctcaggcgcagcaga

SEQ ID NO: 383049 - DNA, 25 bp, Mus musculus
cgcgcccgaaacgacagtttactca

SEQ ID NO: 383050 - DNA, 25 bp, Mus musculus
ccctctccatgtctgtggccgtgga

SEQ ID NO: 383051 - DNA, 25 bp, Mus musculus
tggccgtggagttccgcgactacct

SEQ ID NO: 383052 - DNA, 25 bp, Mus musculus
ttgcgctgcccgcacagggtctcat

SEQ ID NO: 383053 - DNA, 25 bp, Mus musculus
aaaccgcaagtactacatggatctc

SEQ ID NO: 383054 - DNA, 25 bp, Mus musculus
gcatccgccagacagtcaaccgggg

SEQ ID NO: 383055 - DNA, 25 bp, Mus musculus
acgcagggccagaccattgcgctgc

SEQ ID NO: 383056 - DNA, 25 bp, Mus musculus
agggccgtttcctgaagatcgcaga

SEQ ID NO: 383057 - DNA, 25 bp, Mus musculus
cgcttcttcttcgatgtgggttcca

SEQ ID NO: 383058 - DNA, 25 bp, Mus musculus
tctcatcgagttccgtgacgctctg

SEQ ID NO: 383059 - DNA, 25 bp, Mus musculus
tgtgggttccaacaagtacggcgtg

SEQ ID NO: 383060 - DNA, 25 bp, Mus musculus
gactgtggacaacaagcgcttcttc

SEQ ID NO: 383061 - DNA, 25 bp, Mus musculus
ggcacctccttgactgtggacaaca

SEQ ID NO: 383062 - DNA, 25 bp, Mus musculus
ctcatcgacgactatggagtggagg

SEQ ID NO: 383063 - DNA, 25 bp, Mus musculus
tgacgctctggccaagctcatcgac

SEQ ID NO: 383064 - DNA, 25 bp, Mus musculus
agccgaggacgctggaatgtcagga

SEQ ID NO: 383065 - DNA, 25 bp, Mus musculus
cgcgcacctgttagcgcgggcctcc

SEQ ID NO: 383066 - DNA, 25 bp, Mus musculus
tcattccgctgcgaagacggccgcg

SEQ ID NO: 383067 - DNA, 25 bp, Mus musculus
gcgccagattctggcgtgacctcgg

SEQ ID NO: 383068 - DNA, 25 bp, Mus musculus
cgttgctggcggctctgcggctctc

SEQ ID NO: 383069 - DNA, 25 bp, Mus musculus
ccagtgctgctgtggacagctcatt

SEQ ID NO: 383070 - DNA, 25 bp, Mus musculus
tggacagctcattccgctgcgaaga

SEQ ID NO: 383071 - DNA, 25 bp, Mus musculus
tccggcggggtaagacgctgccttc

SEQ ID NO: 383072 - DNA, 25 bp, Mus musculus
gtaagacgctgccttcggcgacctc

SEQ ID NO: 383073 - DNA, 25 bp, Mus musculus
cctcaggcgcgcctcattgcttggg

SEQ ID NO: 383074 - DNA, 25 bp, Mus musculus
gcctcattgcttggggctcccaggc

SEQ ID NO: 383075 - DNA, 25 bp, Mus musculus
acacctcgaagccggaggccgagta

SEQ ID NO: 383076 - DNA, 25 bp, Mus musculus
gtgaagaaagacgcagcttgcaccc

SEQ ID NO: 383077 - DNA, 25 bp, Mus musculus
agagcgggctcttggcgctacctcc

SEQ ID NO: 383078 - DNA, 25 bp, Mus musculus
gccgcttgctaagggcgcaggatcc

SEQ ID NO: 383079 - DNA, 25 bp, Mus musculus
ccttaggctgcggtttctgtagctc

SEQ ID NO: 383080 - DNA, 25 bp, Mus musculus
tgactccgggcttccagcgcaggag

SEQ ID NO: 383081 - DNA, 25 bp, Mus musculus
cacaaggagctaagggacaggctta

SEQ ID NO: 383082 - DNA, 25 bp, Mus musculus
ctatagatacagatcggggaccaca

SEQ ID NO: 383083 - DNA, 25 bp, Mus musculus
cgcaaggacccggagtgaaactata

SEQ ID NO: 383084 - DNA, 25 bp, Mus musculus
gacctgtgtagggtcgagcttgctt

SEQ ID NO: 383085 - DNA, 25 bp, Mus musculus
gttgccagggagatcaggtgactcc

SEQ ID NO: 383086 - DNA, 25 bp, Mus musculus
tgtagctccgcgaccgacctgtgta

SEQ ID NO: 383087 - DNA, 25 bp, Mus musculus
tagtccggtccagtcttcttcagtc

SEQ ID NO: 383088 - DNA, 25 bp, Mus musculus
gtcttcttcagtcgggacggggtca

SEQ ID NO: 383089 - DNA, 25 bp, Mus musculus
gcggactgagtgtctcccgcagtct

SEQ ID NO: 383090 - DNA, 25 bp, Mus musculus
ctgtctccagggatgtcggccggaa

SEQ ID NO: 383091 - DNA, 25 bp, Mus musculus
tgctggatttcttcgccttaggctg

SEQ ID NO: 383092 - DNA, 25 bp, Mus musculus
ccaacgcggacaacactggacaaga

SEQ ID NO: 383093 - DNA, 25 bp, Mus musculus
ttttttgggaccaggccagagcagc

SEQ ID NO: 383094 - DNA, 25 bp, Mus musculus
ccggaggcgctcacattttttggga

SEQ ID NO: 383095 - DNA, 25 bp, Mus musculus
agcccttgaaggtctgtcaggccga

SEQ ID NO: 383096 - DNA, 25 bp, Mus musculus
tctgtctgttcagagtcggtccgcg

SEQ ID NO: 383097 - DNA, 25 bp, Mus musculus
gtgagatcctgtctgggaaccttgc

SEQ ID NO: 383098 - DNA, 25 bp, Mus musculus
agcgaggttccactaaggcactgtc

SEQ ID NO: 383099 - DNA, 25 bp, Mus musculus
cgatcactttggatgcggcggccac

SEQ ID NO: 383100 - DNA, 25 bp, Mus musculus
gacggcagcagcttcatggtcccga

SEQ ID NO: 383101 - DNA, 25 bp, Mus musculus
aagagcttcagcatcaccgacggca

SEQ ID NO: 383102 - DNA, 25 bp, Mus musculus
cttacctgcggccagaaagagcttc

SEQ ID NO: 383103 - DNA, 25 bp, Mus musculus
ccgacctcggagacatgagctctta

SEQ ID NO: 383104 - DNA, 25 bp, Mus musculus
gccgcaataagaccctttgcttaga

SEQ ID NO: 383105 - DNA, 25 bp, Mus musculus
tggcgaagaccggatcctacctttc

SEQ ID NO: 383106 - DNA, 25 bp, Mus musculus
cgacaggtgggagctacttttgcta

SEQ ID NO: 383107 - DNA, 25 bp, Mus musculus
cgacagatccctgcggccaatgatt

SEQ ID NO: 383108 - DNA, 25 bp, Mus musculus
acgcctcttgcatcttggacgcaca

SEQ ID NO: 383109 - DNA, 25 bp, Mus musculus
ccaagagcagggttaggtctacttc

SEQ ID NO: 383110 - DNA, 25 bp, Mus musculus
tttgttccttcttgcggggttctca

SEQ ID NO: 383111 - DNA, 25 bp, Mus musculus
caggccaattgtaccacgcgacgtc

SEQ ID NO: 383112 - DNA, 25 bp, Mus musculus
cgcgacgtcccgtgacaaaatgacc

SEQ ID NO: 383113 - DNA, 25 bp, Mus musculus
tgaccgacaatctctggcgccaatg

SEQ ID NO: 383114 - DNA, 25 bp, Mus musculus
tgttcattttgactgaccgccaggc

SEQ ID NO: 383115 - DNA, 25 bp, Mus musculus
cgccaggccagcgaatagactgtaa

SEQ ID NO: 383116 - DNA, 25 bp, Mus musculus
cgctagtcacagaggctggccaata

SEQ ID NO: 383117 - DNA, 25 bp, Mus musculus
gaagtcgcaaccagtgatgagtcta

SEQ ID NO: 383118 - DNA, 25 bp, Mus musculus
ggaatccgcaccgtgaggctctttg

SEQ ID NO: 383119 - DNA, 25 bp, Mus musculus
ttcgctgagacggattgcttctttc

SEQ ID NO: 383120 - DNA, 25 bp, Mus musculus
gttccagccgcgttccttgttgcct

SEQ ID NO: 383121 - DNA, 25 bp, Mus musculus
aggacgagtaccaccagcccgccgg

SEQ ID NO: 383122 - DNA, 25 bp, Mus musculus
ctaacggaggatacactggggttga

SEQ ID NO: 383123 - DNA, 25 bp, Mus musculus
ccaacagactaacggaggatacact

SEQ ID NO: 383124 - DNA, 25 bp, Mus musculus
cggagcccaacagactaacggagga

SEQ ID NO: 383125 - DNA, 25 bp, Mus musculus
tgtgtgaaacgaggcccggagccca

SEQ ID NO: 383126 - DNA, 25 bp, Mus musculus
tccttgttgcctgcgaaggcgagga

SEQ ID NO: 383127 - DNA, 25 bp, Mus musculus
gggcttcacgtacagctccgccatc

SEQ ID NO: 383128 - DNA, 25 bp, Mus musculus
aattgtggcgggtcgttccagccgc

SEQ ID NO: 383129 - DNA, 25 bp, Mus musculus
cgccatctccacttccgcaccgcca

SEQ ID NO: 383130 - DNA, 25 bp, Mus musculus
ccgccagcggggcagcgcatcattt

SEQ ID NO: 383131 - DNA, 25 bp, Mus musculus
agcgcatcatttccggggcggtagc

SEQ ID NO: 383132 - DNA, 25 bp, Mus musculus
agccgcgttccttgttgcctgcgaa

SEQ ID NO: 383133 - DNA, 25 bp, Mus musculus
ggccgtgctcaccgggcttcacgta

SEQ ID NO: 383134 - DNA, 25 bp, Mus musculus
gactccggggccgttcgcagcaact

SEQ ID NO: 383135 - DNA, 25 bp, Mus musculus
cccacttacctgtcatcgtagcaga

SEQ ID NO: 383136 - DNA, 25 bp, Mus musculus
tcccggctgtttgctttaggtgtta

SEQ ID NO: 383137 - DNA, 25 bp, Mus musculus
tccgtgtcgcctaaaccttcaggtg

SEQ ID NO: 383138 - DNA, 25 bp, Mus musculus
accttcaggtgcagatacctgtccc

SEQ ID NO: 383139 - DNA, 25 bp, Mus musculus
caagacgcgcttcagcctgacagca

SEQ ID NO: 383140 - DNA, 25 bp, Mus musculus
cagcaagcagtaccagagccaccga

SEQ ID NO: 383141 - DNA, 25 bp, Mus musculus
tcgtagcagaaatcagcactcaggg

SEQ ID NO: 383142 - DNA, 25 bp, Mus musculus
cactcagggtgttgagatacaaggc

SEQ ID NO: 383143 - DNA, 25 bp, Mus musculus
gagcgctgctcaccaactctgcaat

SEQ ID NO: 383144 - DNA, 25 bp, Mus musculus
aggcaagcggcgatcggcttcacgc

SEQ ID NO: 383145 - DNA, 25 bp, Mus musculus
taaggtaaaggactgcggagataga

SEQ ID NO: 383146 - DNA, 25 bp, Mus musculus
ggctgcggcacattcactctttatt

SEQ ID NO: 383147 - DNA, 25 bp, Mus musculus
cccatggcactttgggacgccctaa

SEQ ID NO: 383148 - DNA, 25 bp, Mus musculus
gcgtactgacactacgaactccgca

SEQ ID NO: 383149 - DNA, 25 bp, Mus musculus
ggccaactggcaccgcgcaaacaaa

SEQ ID NO: 383150 - DNA, 25 bp, Mus musculus
gtctgctttcccgagtcctcgcgtg

SEQ ID NO: 383151 - DNA, 25 bp, Mus musculus
cgtgctgtcctacgaagcgtactga

SEQ ID NO: 383152 - DNA, 25 bp, Mus musculus
aactccgcacaggttagtaactatg

SEQ ID NO: 383153 - DNA, 25 bp, Mus musculus
aactatgagttcctcggacggcgga

SEQ ID NO: 383154 - DNA, 25 bp, Mus musculus
cgaggagatcctgcacacggtgcac

SEQ ID NO: 383155 - DNA, 25 bp, Mus musculus
tgagatcatcacgttccgaccttta

SEQ ID NO: 383156 - DNA, 25 bp, Mus musculus
cgcgcacacggcaaaagatcagatg

SEQ ID NO: 383157 - DNA, 25 bp, Mus musculus
tgctgccttaaatgccacagccgtc

SEQ ID NO: 383158 - DNA, 25 bp, Mus musculus
ccggaagtgcctctaaaattggaag

SEQ ID NO: 383159 - DNA, 25 bp, Mus musculus
ttggaagtagcctttgccctgagga

SEQ ID NO: 383160 - DNA, 25 bp, Mus musculus
tcatcgcgtggagcatgagatcatc

SEQ ID NO: 383161 - DNA, 25 bp, Mus musculus
gtcctcgcgtgtttcggtacgtgct

SEQ ID NO: 383162 - DNA, 25 bp, Mus musculus
cgcggacctgttcgcaggaaaagtt

SEQ ID NO: 383163 - DNA, 25 bp, Mus musculus
acgcagcgctaaaacttggagggtc

SEQ ID NO: 383164 - DNA, 25 bp, Mus musculus
ctcagtaccttgagtccaggcttta

SEQ ID NO: 383165 - DNA, 25 bp, Mus musculus
caggctttagccactgctgcagttc

SEQ ID NO: 383166 - DNA, 25 bp, Mus musculus
gtgtgcttgggcaatactcagtacc

SEQ ID NO: 383167 - DNA, 25 bp, Mus musculus
agttctgcgagccaggcatcccttg

SEQ ID NO: 383168 - DNA, 25 bp, Mus musculus
cccacgacacgttgcggaggttcaa

SEQ ID NO: 383169 - DNA, 25 bp, Mus musculus
gccggttacctcgagattttcaaga

SEQ ID NO: 383170 - DNA, 25 bp, Mus musculus
tcagttcctggaggccggaaatccc

SEQ ID NO: 383171 - DNA, 25 bp, Mus musculus
acgcagggctccgaatagaatccga

SEQ ID NO: 383172 - DNA, 25 bp, Mus musculus
tagaatccgactaggaatccgcgcg

SEQ ID NO: 383173 - DNA, 25 bp, Mus musculus
ccgctttaaggacagagacttgata

SEQ ID NO: 383174 - DNA, 25 bp, Mus musculus
cgtgtccacacgctttagaaggtat

SEQ ID NO: 383175 - DNA, 25 bp, Mus musculus
ttagaaggtattccaggctgcggcc

SEQ ID NO: 383176 - DNA, 25 bp, Mus musculus
gcttctcatccttaaccgagccgtt

SEQ ID NO: 383177 - DNA, 25 bp, Mus musculus
gtgctcccgagcttctcatccttaa

SEQ ID NO: 383178 - DNA, 25 bp, Mus musculus
ctctgagccgagtgtgtgctcccga

SEQ ID NO: 383179 - DNA, 25 bp, Mus musculus
gaatagggaagaggctcctggctct

SEQ ID NO: 383180 - DNA, 25 bp, Mus musculus
aaatgcacatgtggcggttgggaat

SEQ ID NO: 383181 - DNA, 25 bp, Mus musculus
acgaggaagccaggggaaatgcaca

SEQ ID NO: 383182 - DNA, 25 bp, Mus musculus
tttggctgcaagatgtggaatcggc

SEQ ID NO: 383183 - DNA, 25 bp, Mus musculus
cgcgacgtagctttggctgcaagat

SEQ ID NO: 383184 - DNA, 25 bp, Mus musculus
cctgcgcagtcccaaccttcctcgg

SEQ ID NO: 383185 - DNA, 25 bp, Mus musculus
ctcccggttttgtttagcgcctgcg

SEQ ID NO: 383186 - DNA, 25 bp, Mus musculus
tgcgggcagtagactgtttttgttt

SEQ ID NO: 383187 - DNA, 25 bp, Mus musculus
cctgttgcgggcagtagactgtttt

SEQ ID NO: 383188 - DNA, 25 bp, Mus musculus
aaattctggcttgaccacgccctcg

SEQ ID NO: 383189 - DNA, 25 bp, Mus musculus
cggcctaccaacttcgaaattctgg

SEQ ID NO: 383190 - DNA, 25 bp, Mus musculus
ggcgaccagtactcaccatagcggg

SEQ ID NO: 383191 - DNA, 25 bp, Mus musculus
aggctcgtcgagtttgctgaattta

SEQ ID NO: 383192 - DNA, 25 bp, Mus musculus
ggctcgagtcgaccactctttcctg

SEQ ID NO: 383193 - DNA, 25 bp, Mus musculus
ggccgctgccaaaatgccagaacga

SEQ ID NO: 383194 - DNA, 25 bp, Mus musculus
tggataaaagtttgtcgccgctgtc

SEQ ID NO: 383195 - DNA, 25 bp, Mus musculus
ccagtcttcgccgtcgattggatga

SEQ ID NO: 383196 - DNA, 25 bp, Mus musculus
tcaatcggaccaatagcgggccctc

SEQ ID NO: 383197 - DNA, 25 bp, Mus musculus
aggagcgcccaatcacgacctttca

SEQ ID NO: 383198 - DNA, 25 bp, Mus musculus
gcagccgccatctttgttagcaaag

SEQ ID NO: 383199 - DNA, 25 bp, Mus musculus
gctggcataagtgaacgcgaatctc

SEQ ID NO: 383200 - DNA, 25 bp, Mus musculus
aggtcaaggtcatagctccagcttc

SEQ ID NO: 383201 - DNA, 25 bp, Mus musculus
ccgctagcgggcaaaggtacacagc

SEQ ID NO: 383202 - DNA, 25 bp, Mus musculus
ccacgtaccgttgcacgatgaaatc

SEQ ID NO: 383203 - DNA, 25 bp, Mus musculus
ccaaagcttgggctgcacctccgag

SEQ ID NO: 383204 - DNA, 25 bp, Mus musculus
gcacaacaatggcagcgaccgcgtc

SEQ ID NO: 383205 - DNA, 25 bp, Mus musculus
gcaggcgcggggttaacaactctgc

SEQ ID NO: 383206 - DNA, 25 bp, Mus musculus
cggggttaacaactctgcgctggcg

SEQ ID NO: 383207 - DNA, 25 bp, Mus musculus
cctcccgcagctcggaaagaatgca

SEQ ID NO: 383208 - DNA, 25 bp, Mus musculus
ctcggaaagaatgcacgactgtgcc

SEQ ID NO: 383209 - DNA, 25 bp, Mus musculus
acgactgtgccattttacaccgggc

SEQ ID NO: 383210 - DNA, 25 bp, Mus musculus
tttacaccgggctctggagagtgca

SEQ ID NO: 383211 - DNA, 25 bp, Mus musculus
gtgacagtgactagcacaacaatgg

SEQ ID NO: 383212 - DNA, 25 bp, Mus musculus
agcgaccgcgtcctcggagcatctg

SEQ ID NO: 383213 - DNA, 25 bp, Mus musculus
ggagcatctgggcacgcccttgcgc

SEQ ID NO: 383214 - DNA, 25 bp, Mus musculus
agcttcacgggagacagcgtccgta

SEQ ID NO: 383215 - DNA, 25 bp, Mus musculus
tgtgacgttccgagggcctcctata

SEQ ID NO: 383216 - DNA, 25 bp, Mus musculus
gttccgagggcctcctatagccgcg

SEQ ID NO: 383217 - DNA, 25 bp, Mus musculus
ggagtaggtgacagtgactagcaca

SEQ ID NO: 383218 - DNA, 25 bp, Mus musculus
ccctgtccatgaagttggtcccaag

SEQ ID NO: 383219 - DNA, 25 bp, Mus musculus
aattcgcatcagctgcggcaggccc

SEQ ID NO: 383220 - DNA, 25 bp, Mus musculus
tgaaatcctcccagtgcacttccga

SEQ ID NO: 383221 - DNA, 25 bp, Mus musculus
ggaagcaactgcttaggccacgccc

SEQ ID NO: 383222 - DNA, 25 bp, Mus musculus
atccgactcgagatctgctggcagc

SEQ ID NO: 383223 - DNA, 25 bp, Mus musculus
aagttggtcccaagcgcgcgtggat

SEQ ID NO: 383224 - DNA, 25 bp, Mus musculus
cccacgtgtgaagagagtcctgcag

SEQ ID NO: 383225 - DNA, 25 bp, Mus musculus
gtcctgcagaggactcaaacaatga

SEQ ID NO: 383226 - DNA, 25 bp, Mus musculus
acaatgaagaggaagaccttgactc

SEQ ID NO: 383227 - DNA, 25 bp, Mus musculus
ggaagaccttgactccacgaaggca

SEQ ID NO: 383228 - DNA, 25 bp, Mus musculus
ccagaagacatcgtgctggaagccc

SEQ ID NO: 383229 - DNA, 25 bp, Mus musculus
cgctgcgctcgcttaattcgcatca

SEQ ID NO: 383230 - DNA, 25 bp, Mus musculus
cctggcgttccatccgactcgagat

SEQ ID NO: 383231 - DNA, 25 bp, Mus musculus
ctcctcccggaagcaactgcttagg

SEQ ID NO: 383232 - DNA, 25 bp, Mus musculus
cgatatacacctcggaccctgacgg

SEQ ID NO: 383233 - DNA, 25 bp, Mus musculus
ggtttaagctaagaggcagcccgtc

SEQ ID NO: 383234 - DNA, 25 bp, Mus musculus
aggtcatcattaggcggaactcata

SEQ ID NO: 383235 - DNA, 25 bp, Mus musculus
gtcagctcgcacttctcggtgcttc

SEQ ID NO: 383236 - DNA, 25 bp, Mus musculus
cgagcagtaacgctcggcggtttaa

SEQ ID NO: 383237 - DNA, 25 bp, Mus musculus
ccgcgagctgtagcgcgcataggca

SEQ ID NO: 383238 - DNA, 25 bp, Mus musculus
cgcataggcaaagccgcggttcaaa

SEQ ID NO: 383239 - DNA, 25 bp, Mus musculus
gcggttcaaaccactgaaggtcatc

SEQ ID NO: 383240 - DNA, 25 bp, Mus musculus
tcctgcggaagtcgtccgatataca

SEQ ID NO: 383241 - DNA, 25 bp, Mus musculus
tgctcgtacacgtcctgcggaagtc

SEQ ID NO: 383242 - DNA, 25 bp, Mus musculus
agtgggattagctggtgctcgtaca

SEQ ID NO: 383243 - DNA, 25 bp, Mus musculus
accaggagctggcaagaaggccgca

SEQ ID NO: 383244 - DNA, 25 bp, Mus musculus
tcggtgcttcggcacaccaggagct

SEQ ID NO: 383245 - DNA, 25 bp, Mus musculus
cccacgcgctggaagagtgggatta

SEQ ID NO: 383246 - DNA, 25 bp, Mus musculus
agaaatcggactggcctcgttccca

SEQ ID NO: 383247 - DNA, 25 bp, Mus musculus
ttcagttccagaaagccggcgtcct

SEQ ID NO: 383248 - DNA, 25 bp, Mus musculus
gccagcaggaactgacggctgtcta

SEQ ID NO: 383249 - DNA, 25 bp, Mus musculus
gctctcggtagctttccagaaatcg

SEQ ID NO: 383250 - DNA, 25 bp, Mus musculus
tctcaggtgtttccagctctcggta

SEQ ID NO: 383251 - DNA, 25 bp, Mus musculus
tccgaactaactccgatctcaggtg

SEQ ID NO: 383252 - DNA, 25 bp, Mus musculus
ctttcgtgcctagagcgtgtctggc

SEQ ID NO: 383253 - DNA, 25 bp, Mus musculus
tcagcctaggttcggatgacttccg

SEQ ID NO: 383254 - DNA, 25 bp, Mus musculus
taaaacccgccttggtggactcagc

SEQ ID NO: 383255 - DNA, 25 bp, Mus musculus
gagtcgcacctacctgctcagcgga

SEQ ID NO: 383256 - DNA, 25 bp, Mus musculus
agcggacgctttctgctccttaagg

SEQ ID NO: 383257 - DNA, 25 bp, Mus musculus
ctcacatgcgctccctggagtcgta

SEQ ID NO: 383258 - DNA, 25 bp, Mus musculus
agcgtgagatcctcggtgttcaatc

SEQ ID NO: 383259 - DNA, 25 bp, Mus musculus
acccgcggctgtcatagccaggtga

SEQ ID NO: 383260 - DNA, 25 bp, Mus musculus
tactgcactttacggcttcccattc

SEQ ID NO: 383261 - DNA, 25 bp, Mus musculus
tgcgccatctccctggagcagaggg

SEQ ID NO: 383262 - DNA, 25 bp, Mus musculus
cggggccaacaggactgccttagaa

SEQ ID NO: 383263 - DNA, 25 bp, Mus musculus
ctgccttagaatcgctccagtccta

SEQ ID NO: 383264 - DNA, 25 bp, Mus musculus
ctccagtcctaacgcagtcagaatg

SEQ ID NO: 383265 - DNA, 25 bp, Mus musculus
gtcagaatgagaggctcggatctta

SEQ ID NO: 383266 - DNA, 25 bp, Mus musculus
ctcggatcttattggagcgtgatct

SEQ ID NO: 383267 - DNA, 25 bp, Mus musculus
acggcttcccattcacttcgctgtg

SEQ ID NO: 383268 - DNA, 25 bp, Mus musculus
ccagggcgcgttttactgcacttta

SEQ ID NO: 383269 - DNA, 25 bp, Mus musculus
gtgtagcttcacactccctttgcgc

SEQ ID NO: 383270 - DNA, 25 bp, Mus musculus
tgatcttgccttctggctccagggc

SEQ ID NO: 383271 - DNA, 25 bp, Mus musculus
tggcccgtgcccttacttccgtgta

SEQ ID NO: 383272 - DNA, 25 bp, Mus musculus
cttcgctgtgaagatggcgtctggc

SEQ ID NO: 383273 - DNA, 25 bp, Mus musculus
gcccttacttccgtgtagcttcaca

SEQ ID NO: 383274 - DNA, 25 bp, Mus musculus
ggtctgtcatctcagaactttcaaa

SEQ ID NO: 383275 - DNA, 25 bp, Mus musculus
aacgggacccgattggtctgtcatc

SEQ ID NO: 383276 - DNA, 25 bp, Mus musculus
tccaggaagagatagacgggccagc

SEQ ID NO: 383277 - DNA, 25 bp, Mus musculus
catccaaatgacgtatgtttctctc

SEQ ID NO: 383278 - DNA, 25 bp, Mus musculus
tcacagtcatgtaaatatatccagg

SEQ ID NO: 383279 - DNA, 25 bp, Mus musculus
tagacgggccagctttagctcagcg

SEQ ID NO: 383280 - DNA, 25 bp, Mus musculus
cttcgacagtggttcagttcattac

SEQ ID NO: 383281 - DNA, 25 bp, Mus musculus
ggttcagttcattaccagctattcg

SEQ ID NO: 383282 - DNA, 25 bp, Mus musculus
cagctattcgtagcaggttcgaaca

SEQ ID NO: 383283 - DNA, 25 bp, Mus musculus
ttcgaacaacacaaccaaccactta

SEQ ID NO: 383284 - DNA, 25 bp, Mus musculus
caaccacttacctaacccgtgagtg

SEQ ID NO: 383285 - DNA, 25 bp, Mus musculus
ccgtgagtgtttggttcgagacccg

SEQ ID NO: 383286 - DNA, 25 bp, Mus musculus
acggaggttacacccggactggatg

SEQ ID NO: 383287 - DNA, 25 bp, Mus musculus
tagctcagcggttacttcgacagtg

SEQ ID NO: 383288 - DNA, 25 bp, Mus musculus
tttaggagagagttttccgaggcca

SEQ ID NO: 383289 - DNA, 25 bp, Mus musculus
ggcctgttgaagagccagggaagca

SEQ ID NO: 383290 - DNA, 25 bp, Mus musculus
cacgccgtgacggtcgacattaata

SEQ ID NO: 383291 - DNA, 25 bp, Mus musculus
aatattagtggaaagacgcgtgccc

SEQ ID NO: 383292 - DNA, 25 bp, Mus musculus
ttaatattagtggaaagacgcgtgc

SEQ ID NO: 383293 - DNA, 25 bp, Mus musculus
cggtcgacattaatattagtggaaa

SEQ ID NO: 383294 - DNA, 25 bp, Mus musculus
tgacggtcgacattaatattagtgg

SEQ ID NO: 383295 - DNA, 25 bp, Mus musculus
cgtgacggtcgacattaatattagt

SEQ ID NO: 383296 - DNA, 25 bp, Mus musculus
gccgtgacggtcgacattaatatta

SEQ ID NO: 383297 - DNA, 25 bp, Mus musculus
aggccacgccgtgacggtcgacatt

SEQ ID NO: 383298 - DNA, 25 bp, Mus musculus
aagcagcgtttaggagagagttttc

SEQ ID NO: 383299 - DNA, 25 bp, Mus musculus
gatggaagggcctgttgaagagcca

SEQ ID NO: 383300 - DNA, 25 bp, Mus musculus
gcgtgagctgaattgggatggaagg

SEQ ID NO: 383301 - DNA, 25 bp, Mus musculus
cagcgtttaggagagagttttccga

SEQ ID NO: 383302 - DNA, 25 bp, Mus musculus
tgacaatccacccacactgctgggg

SEQ ID NO: 383303 - DNA, 25 bp, Mus musculus
tggctgtcctatgaactacaacctc

SEQ ID NO: 383304 - DNA, 25 bp, Mus musculus
gaactacaacctcctacaggtggtg

SEQ ID NO: 383305 - DNA, 25 bp, Mus musculus
acctcctacaggtggtgcgcgcaac

SEQ ID NO: 383306 - DNA, 25 bp, Mus musculus
tgcgcgcaacccgtttcgcgtgggt

SEQ ID NO: 383307 - DNA, 25 bp, Mus musculus
cgcaacccgtttcgcgtgggtctgt

SEQ ID NO: 383308 - DNA, 25 bp, Mus musculus
cactggtgagattagcaccacacgc

SEQ ID NO: 383309 - DNA, 25 bp, Mus musculus
tgagattagcaccacacgctcctta

SEQ ID NO: 383310 - DNA, 25 bp, Mus musculus
agcaccacacgctccttagatgagg

SEQ ID NO: 383311 - DNA, 25 bp, Mus musculus
cgctccttagatgaggtcgatgttc

SEQ ID NO: 383312 - DNA, 25 bp, Mus musculus
ccttagatgaggtcgatgttccacg

SEQ ID NO: 383313 - DNA, 25 bp, Mus musculus
atgaggtcgatgttccacgacagcg

SEQ ID NO: 383314 - DNA, 25 bp, Mus musculus
caatgcgtggctgtcctatgaacta

SEQ ID NO: 383315 - DNA, 25 bp, Mus musculus
ggacgagaatgacaatccacccaca

SEQ ID NO: 383316 - DNA, 25 bp, Mus musculus
ggtaaatctgcagaatggcattttg

SEQ ID NO: 383317 - DNA, 25 bp, Mus musculus
cgctgcaggttttccacgtggaggt

SEQ ID NO: 383318 - DNA, 25 bp, Mus musculus
acaggccgctgcaggttttccacgt

SEQ ID NO: 383319 - DNA, 25 bp, Mus musculus
tggacaggccgctgcaggttttcca

SEQ ID NO: 383320 - DNA, 25 bp, Mus musculus
tccacctggaggtgatcgtggacag

SEQ ID NO: 383321 - DNA, 25 bp, Mus musculus
gcatccacctggaggtgatcgtgga

SEQ ID NO: 383322 - DNA, 25 bp, Mus musculus
attctcggatcgaccgggaggagct

SEQ ID NO: 383323 - DNA, 25 bp, Mus musculus
tgaattctcggatcgaccgggagga

SEQ ID NO: 383324 - DNA, 25 bp, Mus musculus
tttgtgaattctcggatcgaccggg

SEQ ID NO: 383325 - DNA, 25 bp, Mus musculus
ttgtttgtgaattctcggatcgacc

SEQ ID NO: 383326 - DNA, 25 bp, Mus musculus
ggcattttgtttgtgaattctcgga

SEQ ID NO: 383327 - DNA, 25 bp, Mus musculus
ctgcagaatggcattttgtttgtga

SEQ ID NO: 383328 - DNA, 25 bp, Mus musculus
ctggaggtaaatctgcagaatggca

SEQ ID NO: 383329 - DNA, 25 bp, Mus musculus
gaccttctggaggtaaatctgcaga

SEQ ID NO: 383330 - DNA, 25 bp, Mus musculus
ccttggaccgggaagccacagctga

SEQ ID NO: 383331 - DNA, 25 bp, Mus musculus
gacagcgccttggaccgggaagcca

SEQ ID NO: 383332 - DNA, 25 bp, Mus musculus
ggaccgggaagccacagctgactat

SEQ ID NO: 383333 - DNA, 25 bp, Mus musculus
tcaggtgactgcgagggatgctggt

SEQ ID NO: 383334 - DNA, 25 bp, Mus musculus
actcgggagtcaatgggcaggtgac

SEQ ID NO: 383335 - DNA, 25 bp, Mus musculus
cagcgccttggaccgggaagccaca

SEQ ID NO: 383336 - DNA, 25 bp, Mus musculus
ttggaccgggaagccacagctgact

SEQ ID NO: 383337 - DNA, 25 bp, Mus musculus
gaccgggaagccacagctgactata

SEQ ID NO: 383338 - DNA, 25 bp, Mus musculus
tgtgaaggagaacaatccaccagga

SEQ ID NO: 383339 - DNA, 25 bp, Mus musculus
tgaaggagaacaatccaccaggagc

SEQ ID NO: 383340 - DNA, 25 bp, Mus musculus
gaaggagaacaatccaccaggagcg

SEQ ID NO: 383341 - DNA, 25 bp, Mus musculus
gctgcagtttcaggtgactgcgagg

SEQ ID NO: 383342 - DNA, 25 bp, Mus musculus
agtttcaggtgactgcgagggatgc

SEQ ID NO: 383343 - DNA, 25 bp, Mus musculus
aatgcacccttgctgctgcctcagg

SEQ ID NO: 383344 - DNA, 25 bp, Mus musculus
ccacacgtgtcctggatgaaacaga

SEQ ID NO: 383345 - DNA, 25 bp, Mus musculus
caccacacgtgtcctggatgaaaca

SEQ ID NO: 383346 - DNA, 25 bp, Mus musculus
atgtggtgacgaaggtgcgtgctgt

SEQ ID NO: 383347 - DNA, 25 bp, Mus musculus
ctcttatgagctgcagtcagcagcg

SEQ ID NO: 383348 - DNA, 25 bp, Mus musculus
tatgagctgcagtcagcagcgggca

SEQ ID NO: 383349 - DNA, 25 bp, Mus musculus
cagcgggcagtggacgtcttccctt

SEQ ID NO: 383350 - DNA, 25 bp, Mus musculus
gcagtggacgtcttcccttccgcgt

SEQ ID NO: 383351 - DNA, 25 bp, Mus musculus
agtggacgtcttcccttccgcgtgg

SEQ ID NO: 383352 - DNA, 25 bp, Mus musculus
gagatcagcaccacacgtgtcctgg

SEQ ID NO: 383353 - DNA, 25 bp, Mus musculus
tcagcaccacacgtgtcctggatga

SEQ ID NO: 383354 - DNA, 25 bp, Mus musculus
gatgaaacagatgccccgcgacagc

SEQ ID NO: 383355 - DNA, 25 bp, Mus musculus
agcaccacacgtgtcctggatgaaa

SEQ ID NO: 383356 - DNA, 25 bp, Mus musculus
acacgtgtcctggatgaaacagatg

SEQ ID NO: 383357 - DNA, 25 bp, Mus musculus
cccgcgacagcgcctattggtattg

SEQ ID NO: 383358 - DNA, 25 bp, Mus musculus
ctctggctataatgcatggctctct

SEQ ID NO: 383359 - DNA, 25 bp, Mus musculus
atgaagcagattcgccacgtcagcg

SEQ ID NO: 383360 - DNA, 25 bp, Mus musculus
gcgagattagtactacgcgcatact

SEQ ID NO: 383361 - DNA, 25 bp, Mus musculus
tccgcgtaggtttgtatacgggcga

SEQ ID NO: 383362 - DNA, 25 bp, Mus musculus
cagaaggcaattcccgtagcctttt

SEQ ID NO: 383363 - DNA, 25 bp, Mus musculus
agctgcaatcgtcagaaggcaattc

SEQ ID NO: 383364 - DNA, 25 bp, Mus musculus
ctcttatgagctgcaatcgtcagaa

SEQ ID NO: 383365 - DNA, 25 bp, Mus musculus
ggatgcagactctggctataatgca

SEQ ID NO: 383366 - DNA, 25 bp, Mus musculus
tatacgggcgagattagtactacgc

SEQ ID NO: 383367 - DNA, 25 bp, Mus musculus
gcccacactgctggaacctgaggca

SEQ ID NO: 383368 - DNA, 25 bp, Mus musculus
tctctggtggaatcgtgagccggtt

SEQ ID NO: 383369 - DNA, 25 bp, Mus musculus
tgagccggttggtgtccagatcagt

SEQ ID NO: 383370 - DNA, 25 bp, Mus musculus
ccagatcagtgggtgcaggccatgt

SEQ ID NO: 383371 - DNA, 25 bp, Mus musculus
cgcgcatactggatgaagcagattc

SEQ ID NO: 383372 - DNA, 25 bp, Mus musculus
ctgaagatactcatcatcggcgaga

SEQ ID NO: 383373 - DNA, 25 bp, Mus musculus
cctcgcagcagggtttctcactact

SEQ ID NO: 383374 - DNA, 25 bp, Mus musculus
tctcactactgggagtctaggctct

SEQ ID NO: 383375 - DNA, 25 bp, Mus musculus
agtctaggctctggcctggtgcgac

SEQ ID NO: 383376 - DNA, 25 bp, Mus musculus
ggacgtgctgaccactctgaagata

SEQ ID NO: 383377 - DNA, 25 bp, Mus musculus
ctttgccgacacagggcagcgctga

SEQ ID NO: 383378 - DNA, 25 bp, Mus musculus
accagacgctctgtagcctcagctg

SEQ ID NO: 383379 - DNA, 25 bp, Mus musculus
agagccacttctgggcggaaccaga

SEQ ID NO: 383380 - DNA, 25 bp, Mus musculus
ggagtacgcagacgcagagccactt

SEQ ID NO: 383381 - DNA, 25 bp, Mus musculus
aaacgcctgcgctccagggagtacg

SEQ ID NO: 383382 - DNA, 25 bp, Mus musculus
aggagccacgcggaaaaacgcctgc

SEQ ID NO: 383383 - DNA, 25 bp, Mus musculus
cgcacaccaggagccacgcggaaaa

SEQ ID NO: 383384 - DNA, 25 bp, Mus musculus
taggaggatttacagcagctctgcc

SEQ ID NO: 383385 - DNA, 25 bp, Mus musculus
ctggaaggccgtaggaggatttaca

SEQ ID NO: 383386 - DNA, 25 bp, Mus musculus
ttccagcgaggaagtccgggatttc

SEQ ID NO: 383387 - DNA, 25 bp, Mus musculus
ccagactcgcggtttccggtagagg

SEQ ID NO: 383388 - DNA, 25 bp, Mus musculus
cgatggtatatttccagcgaggaag

SEQ ID NO: 383389 - DNA, 25 bp, Mus musculus
gaagtccgggatttcggcgcctgct

SEQ ID NO: 383390 - DNA, 25 bp, Mus musculus
ggcgcctgctgatctcctttgtgct

SEQ ID NO: 383391 - DNA, 25 bp, Mus musculus
gctgatctcctttgtgcttctcgca

SEQ ID NO: 383392 - DNA, 25 bp, Mus musculus
tctcctttgtgcttctcgcagcctg

SEQ ID NO: 383393 - DNA, 25 bp, Mus musculus
ctttgtgcttctcgcagcctgggag

SEQ ID NO: 383394 - DNA, 25 bp, Mus musculus
cgcctaaattctcacgacctgaaca

SEQ ID NO: 383395 - DNA, 25 bp, Mus musculus
ctcacgacctgaacaaagattattt

SEQ ID NO: 383396 - DNA, 25 bp, Mus musculus
tatttattttagagtcaagaatgcc

SEQ ID NO: 383397 - DNA, 25 bp, Mus musculus
tcaagaatgccagactcgcggtttc

SEQ ID NO: 383398 - DNA, 25 bp, Mus musculus
gatttcggcgcctgctgatctcctt

SEQ ID NO: 383399 - DNA, 25 bp, Mus musculus
gaatgccagactcgcggtttccggt

SEQ ID NO: 383400 - DNA, 25 bp, Mus musculus
acccacgctgctggggcctcagggt

SEQ ID NO: 383401 - DNA, 25 bp, Mus musculus
aactattgagttgttgtccaggtca

SEQ ID NO: 383402 - DNA, 25 bp, Mus musculus
gagactatcgctaactacgacgttg

SEQ ID NO: 383403 - DNA, 25 bp, Mus musculus
tacgacgttgttgtgaccgctcgcg

SEQ ID NO: 383404 - DNA, 25 bp, Mus musculus
cgtgaacgacaacgtgcctgcgttt

SEQ ID NO: 383405 - DNA, 25 bp, Mus musculus
ggacatgccgcgtcaacgcttgttg

SEQ ID NO: 383406 - DNA, 25 bp, Mus musculus
actcgtgttctggatgaagcggaca

SEQ ID NO: 383407 - DNA, 25 bp, Mus musculus
ggtgagatcagcacaactcgtgttc

SEQ ID NO: 383408 - DNA, 25 bp, Mus musculus
cgtggggctatacactggtgagatc

SEQ ID NO: 383409 - DNA, 25 bp, Mus musculus
agcccgttccgcgtggggctataca

SEQ ID NO: 383410 - DNA, 25 bp, Mus musculus
cagcctgcgacaggtgctgtgcgca

SEQ ID NO: 383411 - DNA, 25 bp, Mus musculus
tccaggtcagtgagttctggccatg

SEQ ID NO: 383412 - DNA, 25 bp, Mus musculus
ctcagggtagcggaggaactattga

SEQ ID NO: 383413 - DNA, 25 bp, Mus musculus
cgcgatggaggctcgccctccttgt

SEQ ID NO: 383414 - DNA, 25 bp, Mus musculus
gagcggccagcttcattactccgtc

SEQ ID NO: 383415 - DNA, 25 bp, Mus musculus
tcgctcctgctcctcgcagcctggg

SEQ ID NO: 383416 - DNA, 25 bp, Mus musculus
gtgtatgctgctctcgctcctgctc

SEQ ID NO: 383417 - DNA, 25 bp, Mus musculus
gccagcttcattactccgtcccaga

SEQ ID NO: 383418 - DNA, 25 bp, Mus musculus
ggtgtatgctgctctcgctcctgct

SEQ ID NO: 383419 - DNA, 25 bp, Mus musculus
acggtgtatgctgctctcgctcctg

SEQ ID NO: 383420 - DNA, 25 bp, Mus musculus
acacggtgtatgctgctctcgctcc

SEQ ID NO: 383421 - DNA, 25 bp, Mus musculus
aacacggtgtatgctgctctcgctc

SEQ ID NO: 383422 - DNA, 25 bp, Mus musculus
gaacacggtgtatgctgctctcgct

SEQ ID NO: 383423 - DNA, 25 bp, Mus musculus
ggaacacggtgtatgctgctctcgc

SEQ ID NO: 383424 - DNA, 25 bp, Mus musculus
gggaacacggtgtatgctgctctcg

SEQ ID NO: 383425 - DNA, 25 bp, Mus musculus
tgggaacacggtgtatgctgctctc

SEQ ID NO: 383426 - DNA, 25 bp, Mus musculus
actgggaacacggtgtatgctgctc

SEQ ID NO: 383427 - DNA, 25 bp, Mus musculus
cgactgggaacacggtgtatgctgc

SEQ ID NO: 383428 - DNA, 25 bp, Mus musculus
cattttgtttgtgaattctcggatc

SEQ ID NO: 383429 - DNA, 25 bp, Mus musculus
attctcggatcgaccgggaggagct

SEQ ID NO: 383430 - DNA, 25 bp, Mus musculus
tgaattctcggatcgaccgggagga

SEQ ID NO: 383431 - DNA, 25 bp, Mus musculus
tttgtgaattctcggatcgaccggg

SEQ ID NO: 383432 - DNA, 25 bp, Mus musculus
ttgtttgtgaattctcggatcgacc

SEQ ID NO: 383433 - DNA, 25 bp, Mus musculus
ggcattttgtttgtgaattctcgga

SEQ ID NO: 383434 - DNA, 25 bp, Mus musculus
aatggcattttgtttgtgaattctc

SEQ ID NO: 383435 - DNA, 25 bp, Mus musculus
ctgcagaatggcattttgtttgtga

SEQ ID NO: 383436 - DNA, 25 bp, Mus musculus
ggtaaatctgcagaatggcattttg

SEQ ID NO: 383437 - DNA, 25 bp, Mus musculus
ggaggtaaatctgcagaatggcatt

SEQ ID NO: 383438 - DNA, 25 bp, Mus musculus
tctggaggtaaatctgcagaatggc

SEQ ID NO: 383439 - DNA, 25 bp, Mus musculus
gaccttctggaggtaaatctgcaga

SEQ ID NO: 383440 - DNA, 25 bp, Mus musculus
ggctggagctgacggagctggtgcc

SEQ ID NO: 383441 - DNA, 25 bp, Mus musculus
tgtttgtgaattctcggatcgaccg

SEQ ID NO: 383442 - DNA, 25 bp, Mus musculus
gcgccttcatttgcgcagcctgatt

SEQ ID NO: 383443 - DNA, 25 bp, Mus musculus
cacgctgcttggaccttggacacca

SEQ ID NO: 383444 - DNA, 25 bp, Mus musculus
gagcgaacttgtgtcaccttcagtg

SEQ ID NO: 383445 - DNA, 25 bp, Mus musculus
ccaggtggtcacaaaggtgcgtgca

SEQ ID NO: 383446 - DNA, 25 bp, Mus musculus
gcagtagatgcggattctggctata

SEQ ID NO: 383447 - DNA, 25 bp, Mus musculus
actctggatccaacgggcaggtgac

SEQ ID NO: 383448 - DNA, 25 bp, Mus musculus
tatgagctgcatcctttagcaggtg

SEQ ID NO: 383449 - DNA, 25 bp, Mus musculus
tgcctgttcgagaggacgctgcact

SEQ ID NO: 383450 - DNA, 25 bp, Mus musculus
ttctggctataatgcctggctgtct

SEQ ID NO: 383451 - DNA, 25 bp, Mus musculus
acgctgcactgagtactgtcattgc

SEQ ID NO: 383452 - DNA, 25 bp, Mus musculus
tgacttccttatccctgcctgttcg

SEQ ID NO: 383453 - DNA, 25 bp, Mus musculus
tgtgcctcagatcactttgacttcc

SEQ ID NO: 383454 - DNA, 25 bp, Mus musculus
gatggtgggccattgcactgtttta

SEQ ID NO: 383455 - DNA, 25 bp, Mus musculus
tagcgtttcggatctggactctgga

SEQ ID NO: 383456 - DNA, 25 bp, Mus musculus
gcggaggcagcacgcacaaggctta

SEQ ID NO: 383457 - DNA, 25 bp, Mus musculus
cacggaagcggaggcagcatgcaca

SEQ ID NO: 383458 - DNA, 25 bp, Mus musculus
catgcacaaggcttacacggaagcg

SEQ ID NO: 383459 - DNA, 25 bp, Mus musculus
acacggaagcggaggcagcatgcac

SEQ ID NO: 383460 - DNA, 25 bp, Mus musculus
catgcacaaggcttacacggaaacg

SEQ ID NO: 383461 - DNA, 25 bp, Mus musculus
cggaggcagcatgccaaggcttaca

SEQ ID NO: 383462 - DNA, 25 bp, Mus musculus
cacggaaacggaggcagcatgcaca

SEQ ID NO: 383463 - DNA, 25 bp, Mus musculus
tgcacaaggcttacacggaaacgga

SEQ ID NO: 383464 - DNA, 25 bp, Mus musculus
acacggaaacggaggcagcatgcac

SEQ ID NO: 383465 - DNA, 25 bp, Mus musculus
cacggaagcggaggcagcatgccaa

SEQ ID NO: 383466 - DNA, 25 bp, Mus musculus
gcatgccaaggcttacacggaaacg

SEQ ID NO: 383467 - DNA, 25 bp, Mus musculus
acaaggcttacacggaagcggaggc

SEQ ID NO: 383468 - DNA, 25 bp, Mus musculus
cagcacgcacaaggcttacacggaa

SEQ ID NO: 383469 - DNA, 25 bp, Mus musculus
ggaggcagcacgcacaaggcttaca

SEQ ID NO: 383470 - DNA, 25 bp, Mus musculus
gtcaacctggaagagtcgtcacttt

SEQ ID NO: 383471 - DNA, 25 bp, Mus musculus
tcccagtatccgaggacagtcaacc

SEQ ID NO: 383472 - DNA, 25 bp, Mus musculus
ggaagagtcgtcactttaattagcg

SEQ ID NO: 383473 - DNA, 25 bp, Mus musculus
ctctcccagtatccgaggacagtca

SEQ ID NO: 383474 - DNA, 25 bp, Mus musculus
gcgatggcggttcgccctccctgtg

SEQ ID NO: 383475 - DNA, 25 bp, Mus musculus
agtatccgaggacagtcaacctgga

SEQ ID NO: 383476 - DNA, 25 bp, Mus musculus
cgaggacagtcaacctggaagagtc

SEQ ID NO: 383477 - DNA, 25 bp, Mus musculus
cctggaagagtcgtcactttaatta

SEQ ID NO: 383478 - DNA, 25 bp, Mus musculus
gtcgtcactttaattagcgtatttg

SEQ ID NO: 383479 - DNA, 25 bp, Mus musculus
ctttaattagcgtatttgaccgtga

SEQ ID NO: 383480 - DNA, 25 bp, Mus musculus
ttagcgtatttgaccgtgattccgg

SEQ ID NO: 383481 - DNA, 25 bp, Mus musculus
cgctaactatgatgtgattgtgacc

SEQ ID NO: 383482 - DNA, 25 bp, Mus musculus
taactatgatgtgattgtgaccgct

SEQ ID NO: 383483 - DNA, 25 bp, Mus musculus
tttgaccgtgattccggtgccaatg

SEQ ID NO: 383484 - DNA, 25 bp, Mus musculus
atctagactcaggtatcaacgggca

SEQ ID NO: 383485 - DNA, 25 bp, Mus musculus
atgtgccgatgttgcttggatctgg

SEQ ID NO: 383486 - DNA, 25 bp, Mus musculus
tgcacaactggggaaaattattgcc

SEQ ID NO: 383487 - DNA, 25 bp, Mus musculus
gggaaaattattgccctgatcagtg

SEQ ID NO: 383488 - DNA, 25 bp, Mus musculus
tgccctgatcagtgtgattgatcta

SEQ ID NO: 383489 - DNA, 25 bp, Mus musculus
gaacgacaatgtgccgatgttgctt

SEQ ID NO: 383490 - DNA, 25 bp, Mus musculus
tgtgattgatctagactcaggtatc

SEQ ID NO: 383491 - DNA, 25 bp, Mus musculus
acaatgtgccgatgttgcttggatc

SEQ ID NO: 383492 - DNA, 25 bp, Mus musculus
ccctgttaaagaagatgcacaactg

SEQ ID NO: 383493 - DNA, 25 bp, Mus musculus
ctctaactatgacgtgattgtgact

SEQ ID NO: 383494 - DNA, 25 bp, Mus musculus
taactatgacgtgattgtgactgcc

SEQ ID NO: 383495 - DNA, 25 bp, Mus musculus
ctcgctgctggctacagccagcgtg

SEQ ID NO: 383496 - DNA, 25 bp, Mus musculus
gctggctacagccagcgtgtccgtg

SEQ ID NO: 383497 - DNA, 25 bp, Mus musculus
tcagtgtgattgatctagactcagg

SEQ ID NO: 383498 - DNA, 25 bp, Mus musculus
tcggacatcagtcaggtggacctgc

SEQ ID NO: 383499 - DNA, 25 bp, Mus musculus
ccacgctgctcggacatcagtcagg

SEQ ID NO: 383500 - DNA, 25 bp, Mus musculus
gtcttatgagctccacccaactgtg

SEQ ID NO: 383501 - DNA, 25 bp, Mus musculus
gaacctatgttgatcgccactgcca

SEQ ID NO: 383502 - DNA, 25 bp, Mus musculus
aaggaccacggcgaacctatgttga

SEQ ID NO: 383503 - DNA, 25 bp, Mus musculus
tttaccgcgccagcgcctattggtg

SEQ ID NO: 383504 - DNA, 25 bp, Mus musculus
tgaatctgatttaccgcgccagcgc

SEQ ID NO: 383505 - DNA, 25 bp, Mus musculus
ccgagccctggatgaatctgattta

SEQ ID NO: 383506 - DNA, 25 bp, Mus musculus
tgtcggtctctacacgggtgagatc

SEQ ID NO: 383507 - DNA, 25 bp, Mus musculus
gcagccctttccgtgtcggtctcta

SEQ ID NO: 383508 - DNA, 25 bp, Mus musculus
ggtggacctgctggcgaatttagcc

SEQ ID NO: 383509 - DNA, 25 bp, Mus musculus
ttagccagcttgtttcgcggtcagt

SEQ ID NO: 383510 - DNA, 25 bp, Mus musculus
ggtggatgcggactccggttacaac

SEQ ID NO: 383511 - DNA, 25 bp, Mus musculus
tgagatcagcatgacccgagccctg

SEQ ID NO: 383512 - DNA, 25 bp, Mus musculus
ccaggtaactgcgaaggatgctggt

SEQ ID NO: 383513 - DNA, 25 bp, Mus musculus
cgcacagtcggaatacacggtgttc

SEQ ID NO: 383514 - DNA, 25 bp, Mus musculus
gcattcgcacagtcggaatacacgg

SEQ ID NO: 383515 - DNA, 25 bp, Mus musculus
tcctgcattcgcacagtcggaatac

SEQ ID NO: 383516 - DNA, 25 bp, Mus musculus
gactctacagtcaacgggcaagtga

SEQ ID NO: 383517 - DNA, 25 bp, Mus musculus
gctgcagttccaggtaactgcgaag

SEQ ID NO: 383518 - DNA, 25 bp, Mus musculus
ttccaggtaactgcgaaggatgctg

SEQ ID NO: 383519 - DNA, 25 bp, Mus musculus
ttggatcgagagacaacagctgact

SEQ ID NO: 383520 - DNA, 25 bp, Mus musculus
ctttggatcgagagacaacagctga

SEQ ID NO: 383521 - DNA, 25 bp, Mus musculus
cagtgctttggatcgagagacaaca

SEQ ID NO: 383522 - DNA, 25 bp, Mus musculus
ggacagtgctttggatcgagagaca

SEQ ID NO: 383523 - DNA, 25 bp, Mus musculus
cagtcaacgggcaagtgacctgctc

SEQ ID NO: 383524 - DNA, 25 bp, Mus musculus
ctctacagtcaacgggcaagtgacc

SEQ ID NO: 383525 - DNA, 25 bp, Mus musculus
gctgtgggccacagccagtgtgtcc

SEQ ID NO: 383526 - DNA, 25 bp, Mus musculus
tagcgggtccgcacccgggccataa

SEQ ID NO: 383527 - DNA, 25 bp, Mus musculus
gagtccaccaggagctccgcagcag

SEQ ID NO: 383528 - DNA, 25 bp, Mus musculus
ggcagagcctcggagtccaccagga

SEQ ID NO: 383529 - DNA, 25 bp, Mus musculus
cccgagcttgttgaagacgatggtg

SEQ ID NO: 383530 - DNA, 25 bp, Mus musculus
tcggtcttcaaaaagcacggctccc

SEQ ID NO: 383531 - DNA, 25 bp, Mus musculus
gatctggagtgcctcggtcttcaaa

SEQ ID NO: 383532 - DNA, 25 bp, Mus musculus
ggctgccacgttcccgatctggagt

SEQ ID NO: 383533 - DNA, 25 bp, Mus musculus
ctagaagatcaagacgcagcctgtt

SEQ ID NO: 383534 - DNA, 25 bp, Mus musculus
gaaaccactgaacgtccggctgcca

SEQ ID NO: 383535 - DNA, 25 bp, Mus musculus
ctgtgtgtggattgtccaggaaacc

SEQ ID NO: 383536 - DNA, 25 bp, Mus musculus
tctcaggctgaggttgtccttgagg

SEQ ID NO: 383537 - DNA, 25 bp, Mus musculus
agacgcagcctgttatttccgaccg

SEQ ID NO: 383538 - DNA, 25 bp, Mus musculus
taagcataccctgtcctccggtgtc

SEQ ID NO: 383539 - DNA, 25 bp, Mus musculus
cagggctcgggttctagaagatcaa

SEQ ID NO: 383540 - DNA, 25 bp, Mus musculus
gtgacctgctctcttacacccaatg

SEQ ID NO: 383541 - DNA, 25 bp, Mus musculus
cactgtcagcgtgtccgtggaagtg

SEQ ID NO: 383542 - DNA, 25 bp, Mus musculus
tggccaagtgacctgctctcttaca

SEQ ID NO: 383543 - DNA, 25 bp, Mus musculus
atcaatggccaagtgacctgctctc

SEQ ID NO: 383544 - DNA, 25 bp, Mus musculus
tgattctggaatcaatggccaagtg

SEQ ID NO: 383545 - DNA, 25 bp, Mus musculus
tgcgcccacgctgctgcctcatgga

SEQ ID NO: 383546 - DNA, 25 bp, Mus musculus
tattattctctggtactggatagca

SEQ ID NO: 383547 - DNA, 25 bp, Mus musculus
ctctggtactggatagcagtctgga

SEQ ID NO: 383548 - DNA, 25 bp, Mus musculus
ctggatagcagtctggaccgcgaga

SEQ ID NO: 383549 - DNA, 25 bp, Mus musculus
accgcgagagagtgtcaacttatga

SEQ ID NO: 383550 - DNA, 25 bp, Mus musculus
ttcactgtctgccactgtcagcgtg

SEQ ID NO: 383551 - DNA, 25 bp, Mus musculus
tgtctgccactgtcagcgtgtccgt

SEQ ID NO: 383552 - DNA, 25 bp, Mus musculus
cccttcaagattgtatccaccttta

SEQ ID NO: 383553 - DNA, 25 bp, Mus musculus
caacttatgatttggttgtgatagc

SEQ ID NO: 383554 - DNA, 25 bp, Mus musculus
gctttggacacgcaaaacaatcgtg

SEQ ID NO: 383555 - DNA, 25 bp, Mus musculus
cgattatttcgctttggacacgcaa

SEQ ID NO: 383556 - DNA, 25 bp, Mus musculus
ccgattggatcccagcgattatttc

SEQ ID NO: 383557 - DNA, 25 bp, Mus musculus
tccgccttgacctaccgattggatc

SEQ ID NO: 383558 - DNA, 25 bp, Mus musculus
tcggagtcaattccgccttgaccta

SEQ ID NO: 383559 - DNA, 25 bp, Mus musculus
tggcgcatccgatgcagatatcgga

SEQ ID NO: 383560 - DNA, 25 bp, Mus musculus
gggacattaatgacaatccacctgt

SEQ ID NO: 383561 - DNA, 25 bp, Mus musculus
tagatttccactagatggcgcatcc

SEQ ID NO: 383562 - DNA, 25 bp, Mus musculus
gtcgagacctccagaaactagattt

SEQ ID NO: 383563 - DNA, 25 bp, Mus musculus
cgtgattgccgagtcgagacctcca

SEQ ID NO: 383564 - DNA, 25 bp, Mus musculus
accaacaaaaacatcgtgattgccg

SEQ ID NO: 383565 - DNA, 25 bp, Mus musculus
cacctgtgttccctgaaaccaacaa

SEQ ID NO: 383566 - DNA, 25 bp, Mus musculus
gacaatccacctgtgttccctgaaa

SEQ ID NO: 383567 - DNA, 25 bp, Mus musculus
aaacaatcgtgagcgaacttcttcg

SEQ ID NO: 383568 - DNA, 25 bp, Mus musculus
ttatgagcttcagttggcagcaggg

SEQ ID NO: 383569 - DNA, 25 bp, Mus musculus
gcgaaaccaccgctgactataaggt

SEQ ID NO: 383570 - DNA, 25 bp, Mus musculus
tggaccgcgaaaccaccgctgacta

SEQ ID NO: 383571 - DNA, 25 bp, Mus musculus
tgacagcccgagacaggggctcacc

SEQ ID NO: 383572 - DNA, 25 bp, Mus musculus
gacaggggctcaccctcgctgtggt

SEQ ID NO: 383573 - DNA, 25 bp, Mus musculus
tgcgcccacgctattgcctcacaga

SEQ ID NO: 383574 - DNA, 25 bp, Mus musculus
cctcacagagccgttggagctgtcg

SEQ ID NO: 383575 - DNA, 25 bp, Mus musculus
gctgtcttatgagcttcagttggca

SEQ ID NO: 383576 - DNA, 25 bp, Mus musculus
aaggaccacggcgagcccgcactga

SEQ ID NO: 383577 - DNA, 25 bp, Mus musculus
agcacgacgcgctccctagacgaag

SEQ ID NO: 383578 - DNA, 25 bp, Mus musculus
cgcgctccctagacgaagcagatgc

SEQ ID NO: 383579 - DNA, 25 bp, Mus musculus
tagacgaagcagatgcgccacgcca

SEQ ID NO: 383580 - DNA, 25 bp, Mus musculus
cgccacgccagcgtctgttggtgtt

SEQ ID NO: 383581 - DNA, 25 bp, Mus musculus
ctgtcgggacagtgagcgaacttgt

SEQ ID NO: 383582 - DNA, 25 bp, Mus musculus
accagaatgggaagcgcaggacttg

SEQ ID NO: 383583 - DNA, 25 bp, Mus musculus
agggatctctcaggtcagattcgga

SEQ ID NO: 383584 - DNA, 25 bp, Mus musculus
gtccgagagcttctcagtcctttga

SEQ ID NO: 383585 - DNA, 25 bp, Mus musculus
aagccctgtaacttgtcgtgcagcg

SEQ ID NO: 383586 - DNA, 25 bp, Mus musculus
gcgattgattgcttccgcctcgtga

SEQ ID NO: 383587 - DNA, 25 bp, Mus musculus
cttccgcctcgtgacgtgttaggtc

SEQ ID NO: 383588 - DNA, 25 bp, Mus musculus
caccgtggaaaaagatggcgccttc

SEQ ID NO: 383589 - DNA, 25 bp, Mus musculus
tctaagcgaagacacggggcgtcta

SEQ ID NO: 383590 - DNA, 25 bp, Mus musculus
agtgatttaacgcagatctcaggtc

SEQ ID NO: 383591 - DNA, 25 bp, Mus musculus
ggtgcggtcagcttcagtgatttaa

SEQ ID NO: 383592 - DNA, 25 bp, Mus musculus
cctttgactgagaaccggacggtgc

SEQ ID NO: 383593 - DNA, 25 bp, Mus musculus
aagccgttcctaagctcgccaagtc

SEQ ID NO: 383594 - DNA, 25 bp, Mus musculus
gctcctgccagaccgacttggtgta

SEQ ID NO: 383595 - DNA, 25 bp, Mus musculus
gcgttccaggaactcccaccgtgga

SEQ ID NO: 383596 - DNA, 25 bp, Mus musculus
tccatcagccttgcaggggcggaac

SEQ ID NO: 383597 - DNA, 25 bp, Mus musculus
tcctacttcggggtcgacctgggca

SEQ ID NO: 383598 - DNA, 25 bp, Mus musculus
ctacagagagtcctacttcggggtc

SEQ ID NO: 383599 - DNA, 25 bp, Mus musculus
tcgcttcctttccaactacagagag

SEQ ID NO: 383600 - DNA, 25 bp, Mus musculus
tctgtccttgcggaactttcgcttc

SEQ ID NO: 383601 - DNA, 25 bp, Mus musculus
cagcagctgttctgtccttgcggaa

SEQ ID NO: 383602 - DNA, 25 bp, Mus musculus
atatcgcctcggacttgaagctgtc

SEQ ID NO: 383603 - DNA, 25 bp, Mus musculus
accgggagttactgtaggcaatatc

SEQ ID NO: 383604 - DNA, 25 bp, Mus musculus
tctccaggagttcggagcatggtcc

SEQ ID NO: 383605 - DNA, 25 bp, Mus musculus
aacagctcgtgcgttttccagtctc

SEQ ID NO: 383606 - DNA, 25 bp, Mus musculus
ttgcaatgcaagcaggcggaacagc

SEQ ID NO: 383607 - DNA, 25 bp, Mus musculus
ggccgcaacacttggagcttgcaat

SEQ ID NO: 383608 - DNA, 25 bp, Mus musculus
cggaacgccagtggccgcaacactt

SEQ ID NO: 383609 - DNA, 25 bp, Mus musculus
tggttcaagagctagcggaccgcga

SEQ ID NO: 383610 - DNA, 25 bp, Mus musculus
ctctccttagagcatcagcggcggc

SEQ ID NO: 383611 - DNA, 25 bp, Mus musculus
cccgcgctacctggaactggacttg

SEQ ID NO: 383612 - DNA, 25 bp, Mus musculus
ggctgtctgcgcatcaaccatttgg

SEQ ID NO: 383613 - DNA, 25 bp, Mus musculus
ggctgctgcttctgtctttccgact

SEQ ID NO: 383614 - DNA, 25 bp, Mus musculus
ccggagcccttgagaacgcttggga

SEQ ID NO: 383615 - DNA, 25 bp, Mus musculus
cttcaggtaagcgaatccgtggcac

SEQ ID NO: 383616 - DNA, 25 bp, Mus musculus
tgagcgcgatcgaggtggaaatact

SEQ ID NO: 383617 - DNA, 25 bp, Mus musculus
gcggccggattatcagcttcaggta

SEQ ID NO: 383618 - DNA, 25 bp, Mus musculus
gcctcgctgcctgctcagcttggaa

SEQ ID NO: 383619 - DNA, 25 bp, Mus musculus
gccgccacttgggtgcggaatccga

SEQ ID NO: 383620 - DNA, 25 bp, Mus musculus
ctcttcgtcaacgagcggatagatc

SEQ ID NO: 383621 - DNA, 25 bp, Mus musculus
gcagctggcagtcgcagaaaatcga

SEQ ID NO: 383622 - DNA, 25 bp, Mus musculus
ggacttgaccaatggagcgctcttc

SEQ ID NO: 383623 - DNA, 25 bp, Mus musculus
ggaagtgctggctcacaaccctgtg

SEQ ID NO: 383624 - DNA, 25 bp, Mus musculus
ggcattggattatgaggccctgcag

SEQ ID NO: 383625 - DNA, 25 bp, Mus musculus
cttcgtgctctacccactgcagaat

SEQ ID NO: 383626 - DNA, 25 bp, Mus musculus
ctcagggcattggattatgaggccc

SEQ ID NO: 383627 - DNA, 25 bp, Mus musculus
gggcattggattatgaggccctgca

SEQ ID NO: 383628 - DNA, 25 bp, Mus musculus
cgctcagggcattggattatgaggc

SEQ ID NO: 383629 - DNA, 25 bp, Mus musculus
ttgcgctcagggcattggattatga

SEQ ID NO: 383630 - DNA, 25 bp, Mus musculus
tcgtgctctacccactgcagaatgc

SEQ ID NO: 383631 - DNA, 25 bp, Mus musculus
actgcagaatgcttctgcgccctac

SEQ ID NO: 383632 - DNA, 25 bp, Mus musculus
cactgcagaatgcttctgcgcccta

SEQ ID NO: 383633 - DNA, 25 bp, Mus musculus
tacccactgcagaatgcttctgcgc

SEQ ID NO: 383634 - DNA, 25 bp, Mus musculus
tctacccactgcagaatgcttctgc

SEQ ID NO: 383635 - DNA, 25 bp, Mus musculus
ctctacccactgcagaatgcttctg

SEQ ID NO: 383636 - DNA, 25 bp, Mus musculus
tgctctacccactgcagaatgcttc

SEQ ID NO: 383637 - DNA, 25 bp, Mus musculus
cgtgctctacccactgcagaatgct

SEQ ID NO: 383638 - DNA, 25 bp, Mus musculus
ctacctttctctgcctgaggtggca

SEQ ID NO: 383639 - DNA, 25 bp, Mus musculus
acagctggcccttgcctcgctaatc

SEQ ID NO: 383640 - DNA, 25 bp, Mus musculus
gtaggcgccacagaccaaggctctc

SEQ ID NO: 383641 - DNA, 25 bp, Mus musculus
gcagctgttcgtactcagggcactg

SEQ ID NO: 383642 - DNA, 25 bp, Mus musculus
tactcagggcactggactatgaatc

SEQ ID NO: 383643 - DNA, 25 bp, Mus musculus
actggactatgaatccctgcaggcc

SEQ ID NO: 383644 - DNA, 25 bp, Mus musculus
cgagttccgcgtaggcgccacagac

SEQ ID NO: 383645 - DNA, 25 bp, Mus musculus
aaggacaatggcgagcctcagctct

SEQ ID NO: 383646 - DNA, 25 bp, Mus musculus
acaatggcgagcctcagctctctgc

SEQ ID NO: 383647 - DNA, 25 bp, Mus musculus
tgccagtgtcacacttcaagtgcta

SEQ ID NO: 383648 - DNA, 25 bp, Mus musculus
acacttcaagtgctactggtgaata

SEQ ID NO: 383649 - DNA, 25 bp, Mus musculus
aagtgctactggtgaatagtttttc

SEQ ID NO: 383650 - DNA, 25 bp, Mus musculus
tgaatagtttttctcagccctacct

SEQ ID NO: 383651 - DNA, 25 bp, Mus musculus
tctctgcctgaggtggcacaggacc

SEQ ID NO: 383652 - DNA, 25 bp, Mus musculus
acaatggagaacctccacactctgc

SEQ ID NO: 383653 - DNA, 25 bp, Mus musculus
ggacaatggagaacctccacactct

SEQ ID NO: 383654 - DNA, 25 bp, Mus musculus
caaggacaatggagaacctccacac

SEQ ID NO: 383655 - DNA, 25 bp, Mus musculus
aactgctcaagaccacggagcctgg

SEQ ID NO: 383656 - DNA, 25 bp, Mus musculus
gctgcctccccatgacccacaactg

SEQ ID NO: 383657 - DNA, 25 bp, Mus musculus
caactgctcaagaccacggagcctg

SEQ ID NO: 383658 - DNA, 25 bp, Mus musculus
ttccaactgctcaagaccacggagc

SEQ ID NO: 383659 - DNA, 25 bp, Mus musculus
cattccaactgctcaagaccacgga

SEQ ID NO: 383660 - DNA, 25 bp, Mus musculus
tcattccaactgctcaagaccacgg

SEQ ID NO: 383661 - DNA, 25 bp, Mus musculus
gtcattccaactgctcaagaccacg

SEQ ID NO: 383662 - DNA, 25 bp, Mus musculus
acaactggccctcaactcgctcatc

SEQ ID NO: 383663 - DNA, 25 bp, Mus musculus
tgacccacaactggccctcaactcg

SEQ ID NO: 383664 - DNA, 25 bp, Mus musculus
attccaactgctcaagaccacggag

SEQ ID NO: 383665 - DNA, 25 bp, Mus musculus
ctgtcattccaactgctcaagacca

SEQ ID NO: 383666 - DNA, 25 bp, Mus musculus
atcaccatcacagtcaccgacatgg

SEQ ID NO: 383667 - DNA, 25 bp, Mus musculus
tcacagtcaccgacatgggcatacc

SEQ ID NO: 383668 - DNA, 25 bp, Mus musculus
agtcaccgacatgggcatacccagg

SEQ ID NO: 383669 - DNA, 25 bp, Mus musculus
catcacctactcgttgcggctgcct

SEQ ID NO: 383670 - DNA, 25 bp, Mus musculus
tgcggctgcctcacgacccgcagct

SEQ ID NO: 383671 - DNA, 25 bp, Mus musculus
agaacgcctctgcaccctacactga

SEQ ID NO: 383672 - DNA, 25 bp, Mus musculus
ctctgcaccctacactgagctgctg

SEQ ID NO: 383673 - DNA, 25 bp, Mus musculus
gcagttgaccgtgattctggccaga

SEQ ID NO: 383674 - DNA, 25 bp, Mus musculus
tgaccgtgattctggccagaacgcc

SEQ ID NO: 383675 - DNA, 25 bp, Mus musculus
tgattctggccagaacgcctggctg

SEQ ID NO: 383676 - DNA, 25 bp, Mus musculus
tttcagttgcttaaggccacagagc

SEQ ID NO: 383677 - DNA, 25 bp, Mus musculus
tcagttgcttaaggccacagagccc

SEQ ID NO: 383678 - DNA, 25 bp, Mus musculus
cacagagcccggactgtttagtgtg

SEQ ID NO: 383679 - DNA, 25 bp, Mus musculus
gatagagaatcaaacactgaataca

SEQ ID NO: 383680 - DNA, 25 bp, Mus musculus
caatcccgcgcacgatgaggacgct

SEQ ID NO: 383681 - DNA, 25 bp, Mus musculus
tggttattccgtgcctgagggccac

SEQ ID NO: 383682 - DNA, 25 bp, Mus musculus
ctctgagtggttattccgtgcctga

SEQ ID NO: 383683 - DNA, 25 bp, Mus musculus
ttcccacatcagctactcgctgttg

SEQ ID NO: 383684 - DNA, 25 bp, Mus musculus
gctactcgctgttgccttcccacga

SEQ ID NO: 383685 - DNA, 25 bp, Mus musculus
ttccgtgcctgagggccacattcct

SEQ ID NO: 383686 - DNA, 25 bp, Mus musculus
cccgcgcacgatgaggacgctctaa

SEQ ID NO: 383687 - DNA, 25 bp, Mus musculus
cgcgcacgatgaggacgctctaaca

SEQ ID NO: 383688 - DNA, 25 bp, Mus musculus
gcacgatgaggacgctctaacactg

SEQ ID NO: 383689 - DNA, 25 bp, Mus musculus
tgaggacgctctaacactgtatctg

SEQ ID NO: 383690 - DNA, 25 bp, Mus musculus
ggacgctctaacactgtatctggtc

SEQ ID NO: 383691 - DNA, 25 bp, Mus musculus
ctctaacactgtatctggtcatagc

SEQ ID NO: 383692 - DNA, 25 bp, Mus musculus
ggcctctctgagtggttattccgtg

SEQ ID NO: 383693 - DNA, 25 bp, Mus musculus
acatcagctactcgctgttgccttc

SEQ ID NO: 383694 - DNA, 25 bp, Mus musculus
ccaggaacaggaataccgaagcctt

SEQ ID NO: 383695 - DNA, 25 bp, Mus musculus
agcggctgacactcctgtctctgga

SEQ ID NO: 383696 - DNA, 25 bp, Mus musculus
cttctcatgtttcccgactgtccgg

SEQ ID NO: 383697 - DNA, 25 bp, Mus musculus
cggtatccatgttcccgggcggcga

SEQ ID NO: 383698 - DNA, 25 bp, Mus musculus
acatcccgcggacgcggtatccatg

SEQ ID NO: 383699 - DNA, 25 bp, Mus musculus
gactgtccggcccagcctacgaaca

SEQ ID NO: 383700 - DNA, 25 bp, Mus musculus
gaagccttctcatgtttcccgactg

SEQ ID NO: 383701 - DNA, 25 bp, Mus musculus
cgcggcccaggaacaggaataccga

SEQ ID NO: 383702 - DNA, 25 bp, Mus musculus
tttacccagactgatgcgcgcggcc

SEQ ID NO: 383703 - DNA, 25 bp, Mus musculus
ctgctttatttacccagactgatgc

SEQ ID NO: 383704 - DNA, 25 bp, Mus musculus
gagtcgtctctgctttatttaccca

SEQ ID NO: 383705 - DNA, 25 bp, Mus musculus
cggggccaccggagtcgtctctgct

SEQ ID NO: 383706 - DNA, 25 bp, Mus musculus
gcatgttctcggctcaggctccgac

SEQ ID NO: 383707 - DNA, 25 bp, Mus musculus
tgtctctggactaggcacactccca

SEQ ID NO: 383708 - DNA, 25 bp, Mus musculus
ctcacctcgctggtctctatcaatg

SEQ ID NO: 383709 - DNA, 25 bp, Mus musculus
gacaacgggcaactgtttgcaatca

SEQ ID NO: 383710 - DNA, 25 bp, Mus musculus
cgctggtctctatcaatgctgacaa

SEQ ID NO: 383711 - DNA, 25 bp, Mus musculus
cctcgctggtctctatcaatgctga

SEQ ID NO: 383712 - DNA, 25 bp, Mus musculus
tggtctctatcaatgctgacaacgg

SEQ ID NO: 383713 - DNA, 25 bp, Mus musculus
gggcaactgtttgcaatcaaggctc

SEQ ID NO: 383714 - DNA, 25 bp, Mus musculus
tgcaatcaaggctctggactatgaa

SEQ ID NO: 383715 - DNA, 25 bp, Mus musculus
aatcaaggctctggactatgaagcc

SEQ ID NO: 383716 - DNA, 25 bp, Mus musculus
ctctggactatgaagccttacaggc

SEQ ID NO: 383717 - DNA, 25 bp, Mus musculus
ccaggaccgcagagcccggctacct

SEQ ID NO: 383718 - DNA, 25 bp, Mus musculus
cagaggtggcgcacaatcccactca

SEQ ID NO: 383719 - DNA, 25 bp, Mus musculus
gtggcgcacaatcccactcaagggg

SEQ ID NO: 383720 - DNA, 25 bp, Mus musculus
tatcaatgctgacaacgggcaactg

SEQ ID NO: 383721 - DNA, 25 bp, Mus musculus
ctctatcaatgctgacaacgggcaa

SEQ ID NO: 383722 - DNA, 25 bp, Mus musculus
gccctaacactctacctagtcactg

SEQ ID NO: 383723 - DNA, 25 bp, Mus musculus
taccatgtttttccatgagaacaac

SEQ ID NO: 383724 - DNA, 25 bp, Mus musculus
tcacctactcgctgatgtctgctca

SEQ ID NO: 383725 - DNA, 25 bp, Mus musculus
cctactcgctgatgtctgctcagga

SEQ ID NO: 383726 - DNA, 25 bp, Mus musculus
gatgtctgctcaggaccttcaaatg

SEQ ID NO: 383727 - DNA, 25 bp, Mus musculus
caatccagcgcacgaagaggacgcc

SEQ ID NO: 383728 - DNA, 25 bp, Mus musculus
tccagcgcacgaagaggacgcccta

SEQ ID NO: 383729 - DNA, 25 bp, Mus musculus
acctcctataccatgtttttccatg

SEQ ID NO: 383730 - DNA, 25 bp, Mus musculus
gaggacgccctaacactctacctag

SEQ ID NO: 383731 - DNA, 25 bp, Mus musculus
cgctgatgtctgctcaggaccttca

SEQ ID NO: 383732 - DNA, 25 bp, Mus musculus
ttcctcctctctgtaatgctgtttg

SEQ ID NO: 383733 - DNA, 25 bp, Mus musculus
cctctctgtaatgctgtttgtggga

SEQ ID NO: 383734 - DNA, 25 bp, Mus musculus
gcacgaagaggacgccctaacactc

SEQ ID NO: 383735 - DNA, 25 bp, Mus musculus
ggaccttcaaatggccctctcctcg

SEQ ID NO: 383736 - DNA, 25 bp, Mus musculus
ggtccagccgcttactctggacaga

SEQ ID NO: 383737 - DNA, 25 bp, Mus musculus
tcccacggcagacatggcgacattg

SEQ ID NO: 383738 - DNA, 25 bp, Mus musculus
ggcagagaaagctctcccagccaga

SEQ ID NO: 383739 - DNA, 25 bp, Mus musculus
atgtttcagctgacagtctcggtcc

SEQ ID NO: 383740 - DNA, 25 bp, Mus musculus
cttgccagggctcgaatgtttcagc

SEQ ID NO: 383741 - DNA, 25 bp, Mus musculus
atcagcccaggagggtttcgcgccc

SEQ ID NO: 383742 - DNA, 25 bp, Mus musculus
gcaaccttcgctggctcagggacac

SEQ ID NO: 383743 - DNA, 25 bp, Mus musculus
ggctggtccgtcaggccacacagtc

SEQ ID NO: 383744 - DNA, 25 bp, Mus musculus
tggcgacattgacagtggtccagcc

SEQ ID NO: 383745 - DNA, 25 bp, Mus musculus
tcagggacaccgcatccggagccga

SEQ ID NO: 383746 - DNA, 25 bp, Mus musculus
ccagccagagcttgctaagggacca

SEQ ID NO: 383747 - DNA, 25 bp, Mus musculus
gaagctagctgccaactgccggcgc

SEQ ID NO: 383748 - DNA, 25 bp, Mus musculus
cagctgttgtgactgggagatcgcc

SEQ ID NO: 383749 - DNA, 25 bp, Mus musculus
gcagagcagagctcgggcaaccttc

SEQ ID NO: 383750 - DNA, 25 bp, Mus musculus
tgcccagggtggcagaacctggcta

SEQ ID NO: 383751 - DNA, 25 bp, Mus musculus
agtgccacagacaaagactcaggct

SEQ ID NO: 383752 - DNA, 25 bp, Mus musculus
tactcgctgctaccggctcaggacc

SEQ ID NO: 383753 - DNA, 25 bp, Mus musculus
cagtgccacagacaaagactcaggc

SEQ ID NO: 383754 - DNA, 25 bp, Mus musculus
cccagggtggcagaacctggctacc

SEQ ID NO: 383755 - DNA, 25 bp, Mus musculus
cagggtggcagaacctggctacctg

SEQ ID NO: 383756 - DNA, 25 bp, Mus musculus
acctactcgctgctaccggctcagg

SEQ ID NO: 383757 - DNA, 25 bp, Mus musculus
ctacaccatgttcatctacgagaac

SEQ ID NO: 383758 - DNA, 25 bp, Mus musculus
caccatgttcatctacgagaacaac

SEQ ID NO: 383759 - DNA, 25 bp, Mus musculus
catgttcatctacgagaacaacagc

SEQ ID NO: 383760 - DNA, 25 bp, Mus musculus
gttcatctacgagaacaacagccct

SEQ ID NO: 383761 - DNA, 25 bp, Mus musculus
tcagtgccacagacaaagactcagg

SEQ ID NO: 383762 - DNA, 25 bp, Mus musculus
ggtggcagaacctggctacctggtc

SEQ ID NO: 383763 - DNA, 25 bp, Mus musculus
tcctacaccatgttcatctacgaga

SEQ ID NO: 383764 - DNA, 25 bp, Mus musculus
agcggctggccctcacctcgctaat

SEQ ID NO: 383765 - DNA, 25 bp, Mus musculus
ctgccagaggttgcgcacgactcta

SEQ ID NO: 383766 - DNA, 25 bp, Mus musculus
cacgctgcacctgttggtggtggat

SEQ ID NO: 383767 - DNA, 25 bp, Mus musculus
agcgtcacgctgcacctgttggtgg

SEQ ID NO: 383768 - DNA, 25 bp, Mus musculus
agaggtgcgcactaccagattgctg

SEQ ID NO: 383769 - DNA, 25 bp, Mus musculus
acggaccgaggctcacccgcgctca

SEQ ID NO: 383770 - DNA, 25 bp, Mus musculus
ggcgctggactatgaaaccctacag

SEQ ID NO: 383771 - DNA, 25 bp, Mus musculus
ggttgcgcacgactctacccaagtg

SEQ ID NO: 383772 - DNA, 25 bp, Mus musculus
cgctggactatgaaaccctacaggc

SEQ ID NO: 383773 - DNA, 25 bp, Mus musculus
ctacccaagtggatgaggaagcgct

SEQ ID NO: 383774 - DNA, 25 bp, Mus musculus
aggaagcgctcacactctatttggt

SEQ ID NO: 383775 - DNA, 25 bp, Mus musculus
gctcacactctatttggtcattgcc

SEQ ID NO: 383776 - DNA, 25 bp, Mus musculus
cgcacgactctacccaagtggatga

SEQ ID NO: 383777 - DNA, 25 bp, Mus musculus
cctctgccagaggttgcgcacgact

SEQ ID NO: 383778 - DNA, 25 bp, Mus musculus
cggcgcgaaagctccctctcagaga

SEQ ID NO: 383779 - DNA, 25 bp, Mus musculus
tgcgtccgccttccggtttcttggc

SEQ ID NO: 383780 - DNA, 25 bp, Mus musculus
ggtacttacagttcaccagcgactg

SEQ ID NO: 383781 - DNA, 25 bp, Mus musculus
ttttcgcggcttgagcaaagcagca

SEQ ID NO: 383782 - DNA, 25 bp, Mus musculus
agggcgacctatgcgctaacaatga

SEQ ID NO: 383783 - DNA, 25 bp, Mus musculus
ctaacaatgagacggctaaggaccc

SEQ ID NO: 383784 - DNA, 25 bp, Mus musculus
ctgaagaaaacgaaagtgctccgtc

SEQ ID NO: 383785 - DNA, 25 bp, Mus musculus
cggcgctacgtcacagaccggaagc

SEQ ID NO: 383786 - DNA, 25 bp, Mus musculus
gccgccgctcttccggaagtactag

SEQ ID NO: 383787 - DNA, 25 bp, Mus musculus
cgcaggcgcacttcgtaattacgtc

SEQ ID NO: 383788 - DNA, 25 bp, Mus musculus
cgtcgttccgtgactacgtcttctc

SEQ ID NO: 383789 - DNA, 25 bp, Mus musculus
ccagcgactgtgaacttagcttttc

SEQ ID NO: 383790 - DNA, 25 bp, Mus musculus
ctcagagaaccgaacaccggagaca

SEQ ID NO: 383791 - DNA, 25 bp, Mus musculus
gaactcttcgactccggtacttaca

SEQ ID NO: 383792 - DNA, 25 bp, Mus musculus
tgcaaacgataacgctcctgctttt

SEQ ID NO: 383793 - DNA, 25 bp, Mus musculus
cagagctggtgctcgaacgtgcctt

SEQ ID NO: 383794 - DNA, 25 bp, Mus musculus
cgaacgtgccttggaccgcgaggaa

SEQ ID NO: 383795 - DNA, 25 bp, Mus musculus
accgcgaggaagaggctgttcatca

SEQ ID NO: 383796 - DNA, 25 bp, Mus musculus
ggctgttcatcatctggttctagtc

SEQ ID NO: 383797 - DNA, 25 bp, Mus musculus
atctggttctagtcgcctctgacgg

SEQ ID NO: 383798 - DNA, 25 bp, Mus musculus
aatccagtgcgatctggcacctgcc

SEQ ID NO: 383799 - DNA, 25 bp, Mus musculus
actggagcggatgggaacaagtacc

SEQ ID NO: 383800 - DNA, 25 bp, Mus musculus
gtgaaggtcttggatgcaaacgata

SEQ ID NO: 383801 - DNA, 25 bp, Mus musculus
ctcctgcttttacacaggctgagta

SEQ ID NO: 383802 - DNA, 25 bp, Mus musculus
caggctgagtatcgtgtgagagttc

SEQ ID NO: 383803 - DNA, 25 bp, Mus musculus
gagagttcctgaaaatacgcccgta

SEQ ID NO: 383804 - DNA, 25 bp, Mus musculus
gtaggcacccggatactcacagtga

SEQ ID NO: 383805 - DNA, 25 bp, Mus musculus
cctgccgcatccgtgtgaaggtctt

SEQ ID NO: 383806 - DNA, 25 bp, Mus musculus
ctccagaggtaaatctcagcttttc

SEQ ID NO: 383807 - DNA, 25 bp, Mus musculus
tgtgtgctcagagcgcgccctgtct

SEQ ID NO: 383808 - DNA, 25 bp, Mus musculus
aagagctgtgtgctcagagcgcgcc

SEQ ID NO: 383809 - DNA, 25 bp, Mus musculus
cagcttggtcaccaggggcaggata

SEQ ID NO: 383810 - DNA, 25 bp, Mus musculus
gtaaatctcagcttttctctctgga

SEQ ID NO: 383811 - DNA, 25 bp, Mus musculus
ccgcatcatctccagaggtaaatct

SEQ ID NO: 383812 - DNA, 25 bp, Mus musculus
ctcggtgccggaggaactggacaaa

SEQ ID NO: 383813 - DNA, 25 bp, Mus musculus
gctggtttcaggcagatccgctact

SEQ ID NO: 383814 - DNA, 25 bp, Mus musculus
cgcggctggtttcaggcagatccgc

SEQ ID NO: 383815 - DNA, 25 bp, Mus musculus
ttgtgcgcgctcctgggaacgctgt

SEQ ID NO: 383816 - DNA, 25 bp, Mus musculus
gcaggagctttgttgtgcgcgctcc

SEQ ID NO: 383817 - DNA, 25 bp, Mus musculus
aggaaccgcaggagctttgttgtgc

SEQ ID NO: 383818 - DNA, 25 bp, Mus musculus
ctgggacaaggaaccgcaggagctt

SEQ ID NO: 383819 - DNA, 25 bp, Mus musculus
aaatctcagcttttctctctggacc

SEQ ID NO: 383820 - DNA, 25 bp, Mus musculus
gagccaagggcactatcgtccttcg

SEQ ID NO: 383821 - DNA, 25 bp, Mus musculus
agccaagggcactatcgtccttcgt

SEQ ID NO: 383822 - DNA, 25 bp, Mus musculus
gccaagggcactatcgtccttcgtg

SEQ ID NO: 383823 - DNA, 25 bp, Mus musculus
aagggcactatcgtccttcgtgtcc

SEQ ID NO: 383824 - DNA, 25 bp, Mus musculus
agagccaagggcactatcgtccttc

SEQ ID NO: 383825 - DNA, 25 bp, Mus musculus
tagagccaagggcactatcgtcctt

SEQ ID NO: 383826 - DNA, 25 bp, Mus musculus
ccaagggcactatcgtccttcgtgt

SEQ ID NO: 383827 - DNA, 25 bp, Mus musculus
caagggcactatcgtccttcgtgtc

SEQ ID NO: 383828 - DNA, 25 bp, Mus musculus
tctaccatctgaccctcagagtgag

SEQ ID NO: 383829 - DNA, 25 bp, Mus musculus
gtgattctggctattgccctgcgtc

SEQ ID NO: 383830 - DNA, 25 bp, Mus musculus
ggtgattctggctattgccctgcgt

SEQ ID NO: 383831 - DNA, 25 bp, Mus musculus
cggtgattctggctattgccctgcg

SEQ ID NO: 383832 - DNA, 25 bp, Mus musculus
ctctaccatctgaccctcagagtga

SEQ ID NO: 383833 - DNA, 25 bp, Mus musculus
tcagcgatgaccctctaccatctga

SEQ ID NO: 383834 - DNA, 25 bp, Mus musculus
ctctgtgcgggaggagctggacaaa

SEQ ID NO: 383835 - DNA, 25 bp, Mus musculus
cgaggcgctggatctgcaacgactt

SEQ ID NO: 383836 - DNA, 25 bp, Mus musculus
cgctggatctgcaacgacttgctga

SEQ ID NO: 383837 - DNA, 25 bp, Mus musculus
ggatctgcaacgacttgctgacgtt

SEQ ID NO: 383838 - DNA, 25 bp, Mus musculus
ctgcaacgacttgctgacgttcttc

SEQ ID NO: 383839 - DNA, 25 bp, Mus musculus
cgacttgctgacgttcttcatgctg

SEQ ID NO: 383840 - DNA, 25 bp, Mus musculus
ctgacgttcttcatgctgctgggga

SEQ ID NO: 383841 - DNA, 25 bp, Mus musculus
atccgctactctgtgcgggaggagc

SEQ ID NO: 383842 - DNA, 25 bp, Mus musculus
ttgctgacgttcttcatgctgctgg

SEQ ID NO: 383843 - DNA, 25 bp, Mus musculus
tccgcattatctccagaggtaggtc

SEQ ID NO: 383844 - DNA, 25 bp, Mus musculus
cattatctccagaggtaggtcgcag

SEQ ID NO: 383845 - DNA, 25 bp, Mus musculus
ccagaggtaggtcgcagcttttctc

SEQ ID NO: 383846 - DNA, 25 bp, Mus musculus
cttcatgctgctggggacgctgtgc

SEQ ID NO: 383847 - DNA, 25 bp, Mus musculus
acgttcttcatgctgctggggacgc

SEQ ID NO: 383848 - DNA, 25 bp, Mus musculus
cccgggcatggtcactgttcgtgag

SEQ ID NO: 383849 - DNA, 25 bp, Mus musculus
cagtgagggtctcgtagcaaactcc

SEQ ID NO: 383850 - DNA, 25 bp, Mus musculus
cggcaaccgaagtatggccactgtc

SEQ ID NO: 383851 - DNA, 25 bp, Mus musculus
actacggcatagctactctctctgg

SEQ ID NO: 383852 - DNA, 25 bp, Mus musculus
tggatcgccactccagctacttctt

SEQ ID NO: 383853 - DNA, 25 bp, Mus musculus
gactactgagagtgtggcgtccctt

SEQ ID NO: 383854 - DNA, 25 bp, Mus musculus
tcttggagacatgggtatgatcacc

SEQ ID NO: 383855 - DNA, 25 bp, Mus musculus
gcaaactccgaacctatctagaaga

SEQ ID NO: 383856 - DNA, 25 bp, Mus musculus
ctctgcgacgcatatgaggctgttc

SEQ ID NO: 383857 - DNA, 25 bp, Mus musculus
gccgtgtccacagtgctacttgcca

SEQ ID NO: 383858 - DNA, 25 bp, Mus musculus
tgtaggcgttgctctctgtggttac

SEQ ID NO: 383859 - DNA, 25 bp, Mus musculus
tctgtggttacgtccagttcccgtc

SEQ ID NO: 383860 - DNA, 25 bp, Mus musculus
tcttagtcccgctcaatgcttcggc

SEQ ID NO: 383861 - DNA, 25 bp, Mus musculus
gggactctgggacatgactactgag

SEQ ID NO: 383862 - DNA, 25 bp, Mus musculus
ctcaggatcacaactgaggacaatc

SEQ ID NO: 383863 - DNA, 25 bp, Mus musculus
ctcagcaggatgaactagccggttg

SEQ ID NO: 383864 - DNA, 25 bp, Mus musculus
atgaactagccggttgcacccgcca

SEQ ID NO: 383865 - DNA, 25 bp, Mus musculus
ccggaggcagatcggatcaactaca

SEQ ID NO: 383866 - DNA, 25 bp, Mus musculus
tcacaactgaggacaatccggaggc

SEQ ID NO: 383867 - DNA, 25 bp, Mus musculus
gctccacagctcaggatcacaactg

SEQ ID NO: 383868 - DNA, 25 bp, Mus musculus
gccacttagctccacagctcaggat

SEQ ID NO: 383869 - DNA, 25 bp, Mus musculus
agccgcagtccaagcgccacttagc

SEQ ID NO: 383870 - DNA, 25 bp, Mus musculus
ctcgtacctactcggcagccgcagt

SEQ ID NO: 383871 - DNA, 25 bp, Mus musculus
cctctgccctcctctaagcaaggtg

SEQ ID NO: 383872 - DNA, 25 bp, Mus musculus
tcggatcaactacagctcagcagga

SEQ ID NO: 383873 - DNA, 25 bp, Mus musculus
gcacccgccacaactcctgccttgg

SEQ ID NO: 383874 - DNA, 25 bp, Mus musculus
tctaagcaaggtgctacggcgaggc

SEQ ID NO: 383875 - DNA, 25 bp, Mus musculus
actgaggacaatccggaggcagatc

SEQ ID NO: 383876 - DNA, 25 bp, Mus musculus
agcggcgacacggacgaggtcctca

SEQ ID NO: 383877 - DNA, 25 bp, Mus musculus
aagttcgacgatggcgccgtcttcc

SEQ ID NO: 383878 - DNA, 25 bp, Mus musculus
gcgccagaagaccaaggtgaagttc

SEQ ID NO: 383879 - DNA, 25 bp, Mus musculus
tacgccaatgtggacggactcaccg

SEQ ID NO: 383880 - DNA, 25 bp, Mus musculus
gaggtcctcaagctgctgcaccgcg

SEQ ID NO: 383881 - DNA, 25 bp, Mus musculus
agccgcccgtggtgaagcgccagaa

SEQ ID NO: 383882 - DNA, 25 bp, Mus musculus
gcagctgaagcgctggatcggctcc

SEQ ID NO: 383883 - DNA, 25 bp, Mus musculus
cagaagcggaacgagcagctgaagc

SEQ ID NO: 383884 - DNA, 25 bp, Mus musculus
ccagctcgcgataagaggagccggc

SEQ ID NO: 383885 - DNA, 25 bp, Mus musculus
ctttctgtcgccgacgcggtcgcat

SEQ ID NO: 383886 - DNA, 25 bp, Mus musculus
tactggaagtctcgagcgtctcctc

SEQ ID NO: 383887 - DNA, 25 bp, Mus musculus
ccgcgatctcgcgaagttacgctca

SEQ ID NO: 383888 - DNA, 25 bp, Mus musculus
aatcacgcagccaataggaaaaccc

SEQ ID NO: 383889 - DNA, 25 bp, Mus musculus
ggcgccgacatcaattacgccaatg

SEQ ID NO: 383890 - DNA, 25 bp, Mus musculus
acgcgcaaagcggagtgctgttcgc

SEQ ID NO: 383891 - DNA, 25 bp, Mus musculus
cgtgaccataaacgcgcaaagcgga

SEQ ID NO: 383892 - DNA, 25 bp, Mus musculus
accataaacgcgcaaagcggagtgc

SEQ ID NO: 383893 - DNA, 25 bp, Mus musculus
ccataaacgcgcaaagcggagtgct

SEQ ID NO: 383894 - DNA, 25 bp, Mus musculus
cataaacgcgcaaagcggagtgctg

SEQ ID NO: 383895 - DNA, 25 bp, Mus musculus
ataaacgcgcaaagcggagtgctgt

SEQ ID NO: 383896 - DNA, 25 bp, Mus musculus
aaacgcgcaaagcggagtgctgttc

SEQ ID NO: 383897 - DNA, 25 bp, Mus musculus
cgcgcaaagcggagtgctgttcgca

SEQ ID NO: 383898 - DNA, 25 bp, Mus musculus
gcaggccagtgaccctgggctcttc

SEQ ID NO: 383899 - DNA, 25 bp, Mus musculus
aggccagtgaccctgggctcttcag

SEQ ID NO: 383900 - DNA, 25 bp, Mus musculus
cagtgaccctgggctcttcagcctg

SEQ ID NO: 383901 - DNA, 25 bp, Mus musculus
gccagtgaccctgggctcttcagcc

SEQ ID NO: 383902 - DNA, 25 bp, Mus musculus
ggccagtgaccctgggctcttcagc

SEQ ID NO: 383903 - DNA, 25 bp, Mus musculus
taaacgcgcaaagcggagtgctgtt

SEQ ID NO: 383904 - DNA, 25 bp, Mus musculus
ccctctcggccaccgccacgctgct

SEQ ID NO: 383905 - DNA, 25 bp, Mus musculus
ggtcctacgtgaccgtgaatgcgca

SEQ ID NO: 383906 - DNA, 25 bp, Mus musculus
ccttgggcgaaaaggatgctgcgcg

SEQ ID NO: 383907 - DNA, 25 bp, Mus musculus
gcgcctgttggttggtgttcgcgat

SEQ ID NO: 383908 - DNA, 25 bp, Mus musculus
cggcagcgcctgttggttggtgttc

SEQ ID NO: 383909 - DNA, 25 bp, Mus musculus
cgaaaaggatgctgcgcggcagcgc

SEQ ID NO: 383910 - DNA, 25 bp, Mus musculus
tggtgttcgcgatggtggacagcca

SEQ ID NO: 383911 - DNA, 25 bp, Mus musculus
cgtgccttgggcgaaaaggatgctg

SEQ ID NO: 383912 - DNA, 25 bp, Mus musculus
gtgaccgtgaatgcgcagagcggag

SEQ ID NO: 383913 - DNA, 25 bp, Mus musculus
tacgtgaccgtgaatgcgcagagcg

SEQ ID NO: 383914 - DNA, 25 bp, Mus musculus
tcctacgtgaccgtgaatgcgcaga

SEQ ID NO: 383915 - DNA, 25 bp, Mus musculus
tggtcctacgtgaccgtgaatgcgc

SEQ ID NO: 383916 - DNA, 25 bp, Mus musculus
accgccacgctgcttctagtattcg

SEQ ID NO: 383917 - DNA, 25 bp, Mus musculus
ctacgtgaccgtgaatgcgcagagc

SEQ ID NO: 383918 - DNA, 25 bp, Mus musculus
ggggctcagtgtcctggaagtgtcg

SEQ ID NO: 383919 - DNA, 25 bp, Mus musculus
ttactggtgaaggaccgcatagatc

SEQ ID NO: 383920 - DNA, 25 bp, Mus musculus
actggtgaaggaccgcatagatcgc

SEQ ID NO: 383921 - DNA, 25 bp, Mus musculus
acttactggtgaaggaccgcataga

SEQ ID NO: 383922 - DNA, 25 bp, Mus musculus
ggacttactggtgaaggaccgcata

SEQ ID NO: 383923 - DNA, 25 bp, Mus musculus
tggattcggagagcggggacttact

SEQ ID NO: 383924 - DNA, 25 bp, Mus musculus
cacttcagcgtggattcggagagcg

SEQ ID NO: 383925 - DNA, 25 bp, Mus musculus
ctgcacttcagcgtggattcggaga

SEQ ID NO: 383926 - DNA, 25 bp, Mus musculus
agaagctgcacttcagcgtggattc

SEQ ID NO: 383927 - DNA, 25 bp, Mus musculus
gcgctgagaagctgcacttcagcgt

SEQ ID NO: 383928 - DNA, 25 bp, Mus musculus
acctggggctcagtgtcctggaagt

SEQ ID NO: 383929 - DNA, 25 bp, Mus musculus
ctgctgctgcctttgttctgtcccg

SEQ ID NO: 383930 - DNA, 25 bp, Mus musculus
ctgagaagctgcacttcagcgtgga

SEQ ID NO: 383931 - DNA, 25 bp, Mus musculus
agctgcacttcagcgtggattcgga

SEQ ID NO: 383932 - DNA, 25 bp, Mus musculus
aggatgcagctcgtcagcgccttct

SEQ ID NO: 383933 - DNA, 25 bp, Mus musculus
atggtaccccgtgccgctgagcctg

SEQ ID NO: 383934 - DNA, 25 bp, Mus musculus
ctctgcactcttcgacatggtaccc

SEQ ID NO: 383935 - DNA, 25 bp, Mus musculus
ctggagcccgatggctctgcactct

SEQ ID NO: 383936 - DNA, 25 bp, Mus musculus
acctagaaccaaaagcgctgtcgtc

SEQ ID NO: 383937 - DNA, 25 bp, Mus musculus
aaaagcgctgtcgtccttcgtgtcc

SEQ ID NO: 383938 - DNA, 25 bp, Mus musculus
tagtgtacgcgcagcgtgcctttga

SEQ ID NO: 383939 - DNA, 25 bp, Mus musculus
cgcagcgtgcctttgaccatgagca

SEQ ID NO: 383940 - DNA, 25 bp, Mus musculus
cgtgcctttgaccatgagcagattc

SEQ ID NO: 383941 - DNA, 25 bp, Mus musculus
tgagcagattcgctccttccagctg

SEQ ID NO: 383942 - DNA, 25 bp, Mus musculus
ccttccagctgactttacaagcgcg

SEQ ID NO: 383943 - DNA, 25 bp, Mus musculus
ttacaagcgcgagaccaggggtcgc

SEQ ID NO: 383944 - DNA, 25 bp, Mus musculus
agctgactttacaagcgcgagacca

SEQ ID NO: 383945 - DNA, 25 bp, Mus musculus
gccttgagcgacaaggatgcagctc

SEQ ID NO: 383946 - DNA, 25 bp, Mus musculus
cagcttggtcactgcaggtaggatc

SEQ ID NO: 383947 - DNA, 25 bp, Mus musculus
ggatactcacgcatctcaactctgg

SEQ ID NO: 383948 - DNA, 25 bp, Mus musculus
gccgctgttgaccaatcggggaacg

SEQ ID NO: 383949 - DNA, 25 bp, Mus musculus
atctccaggggacaatcgcagcttt

SEQ ID NO: 383950 - DNA, 25 bp, Mus musculus
tccgatactcggttccagaagaaac

SEQ ID NO: 383951 - DNA, 25 bp, Mus musculus
ccttgctgacctttgggacaggaca

SEQ ID NO: 383952 - DNA, 25 bp, Mus musculus
cattttcctggggaccttgctgacc

SEQ ID NO: 383953 - DNA, 25 bp, Mus musculus
taaaggcttcttcgtaggcaacatc

SEQ ID NO: 383954 - DNA, 25 bp, Mus musculus
cccagccatggcgaatcagtctcag

SEQ ID NO: 383955 - DNA, 25 bp, Mus musculus
cctccgttcgctttggaatatgttt

SEQ ID NO: 383956 - DNA, 25 bp, Mus musculus
ttttggatgcgggatacctggaacc

SEQ ID NO: 383957 - DNA, 25 bp, Mus musculus
tggaacctcgtagacacaaaagctg

SEQ ID NO: 383958 - DNA, 25 bp, Mus musculus
ggaataacgctcacacccagccatg

SEQ ID NO: 383959 - DNA, 25 bp, Mus musculus
cgctgatcccgctgtgcattttcct

SEQ ID NO: 383960 - DNA, 25 bp, Mus musculus
tttgggatccaatggtttcatctcc

SEQ ID NO: 383961 - DNA, 25 bp, Mus musculus
acctcctatttgatccaagtggctg

SEQ ID NO: 383962 - DNA, 25 bp, Mus musculus
tttgatccaagtggctgagaacaac

SEQ ID NO: 383963 - DNA, 25 bp, Mus musculus
aggtcagcgccttcgacccggattt

SEQ ID NO: 383964 - DNA, 25 bp, Mus musculus
cttttcgttgtgatcctggccattg

SEQ ID NO: 383965 - DNA, 25 bp, Mus musculus
gtctcagtgctctttcttttcgttg

SEQ ID NO: 383966 - DNA, 25 bp, Mus musculus
gccttggtctcagtgctctttcttt

SEQ ID NO: 383967 - DNA, 25 bp, Mus musculus
tgctgtctgactcccaaagtgagct

SEQ ID NO: 383968 - DNA, 25 bp, Mus musculus
atgaacctttgctgtctgactccca

SEQ ID NO: 383969 - DNA, 25 bp, Mus musculus
cagacctcagagatgaacctttgct

SEQ ID NO: 383970 - DNA, 25 bp, Mus musculus
tcctacgtgtcggtgaaccaggata

SEQ ID NO: 383971 - DNA, 25 bp, Mus musculus
taaatcactgtggtcctacgtgtcg

SEQ ID NO: 383972 - DNA, 25 bp, Mus musculus
aatggtttcatctcctactccatca

SEQ ID NO: 383973 - DNA, 25 bp, Mus musculus
ttccattgctcaggtcagcgccttc

SEQ ID NO: 383974 - DNA, 25 bp, Mus musculus
aacgctccctacttccgtgaaagtg

SEQ ID NO: 383975 - DNA, 25 bp, Mus musculus
cgtctccagaggtagggctcaactt

SEQ ID NO: 383976 - DNA, 25 bp, Mus musculus
tggggtccatcaagtgtcagttaaa

SEQ ID NO: 383977 - DNA, 25 bp, Mus musculus
cccacgcttgggatccagatatcgg

SEQ ID NO: 383978 - DNA, 25 bp, Mus musculus
tcgggaagaactcgcttcagagcta

SEQ ID NO: 383979 - DNA, 25 bp, Mus musculus
gcccgaatgctcacttctcactgga

SEQ ID NO: 383980 - DNA, 25 bp, Mus musculus
acccagaattggtgctggagagctc

SEQ ID NO: 383981 - DNA, 25 bp, Mus musculus
ggaaaaggccgctcatctcctagtc

SEQ ID NO: 383982 - DNA, 25 bp, Mus musculus
tggatgcgaacgacaacgcacctgc

SEQ ID NO: 383983 - DNA, 25 bp, Mus musculus
acctgcgtttgctcggtccgagtac

SEQ ID NO: 383984 - DNA, 25 bp, Mus musculus
agctgctgctggtcaacgccaccga

SEQ ID NO: 383985 - DNA, 25 bp, Mus musculus
ggcgccaatgcggaagtgatctatt

SEQ ID NO: 383986 - DNA, 25 bp, Mus musculus
tattccttccggtacgtggacgaca

SEQ ID NO: 383987 - DNA, 25 bp, Mus musculus
tttcgctctaaaccctcgaagcggc

SEQ ID NO: 383988 - DNA, 25 bp, Mus musculus
cgtagacggagtgcaagctttcttg

SEQ ID NO: 383989 - DNA, 25 bp, Mus musculus
agcctcttttaccatcgggtgattc

SEQ ID NO: 383990 - DNA, 25 bp, Mus musculus
gctgcgagaaaaccgagcctctttt

SEQ ID NO: 383991 - DNA, 25 bp, Mus musculus
gcagacacgctcatcagccaggaga

SEQ ID NO: 383992 - DNA, 25 bp, Mus musculus
agtcacttgattttcccgcagccca

SEQ ID NO: 383993 - DNA, 25 bp, Mus musculus
gacttattcgcacgaggtctcgctc

SEQ ID NO: 383994 - DNA, 25 bp, Mus musculus
cctggctgtcctaccgtctgctaaa

SEQ ID NO: 383995 - DNA, 25 bp, Mus musculus
cagcctctcactttgtgggcgtaga

SEQ ID NO: 383996 - DNA, 25 bp, Mus musculus
gtctccaccgtcttcctggtctttg

SEQ ID NO: 383997 - DNA, 25 bp, Mus musculus
tccgaaacttcagggctcactctct

SEQ ID NO: 383998 - DNA, 25 bp, Mus musculus
cgtcctggcagatctagacaatcta

SEQ ID NO: 383999 - DNA, 25 bp, Mus musculus
tgctctcaaacagaacctcgtagtg

SEQ ID NO: 384000 - DNA, 25 bp, Mus musculus
cacacgggcgagataagcacggctc

SEQ ID NO: 384001 - DNA, 25 bp, Mus musculus
ctgcgggctcccgaaagagtcactt

SEQ ID NO: 384002 - DNA, 25 bp, Mus musculus
ccttgcagagcgtcggtccggcagc

SEQ ID NO: 384003 - DNA, 25 bp, Mus musculus
aggacgagtgccctagcgccgctgc

SEQ ID NO: 384004 - DNA, 25 bp, Mus musculus
cccgtctcggaatggaggcgtctgc

SEQ ID NO: 384005 - DNA, 25 bp, Mus musculus
gggtggggcccatctcttcctctct

SEQ ID NO: 384006 - DNA, 25 bp, Mus musculus
gtgcttccttgcagagcgtcggtcc

SEQ ID NO: 384007 - DNA, 25 bp, Mus musculus
tgaactgcgctcacggctcgtccac

SEQ ID NO: 384008 - DNA, 25 bp, Mus musculus
ggtgcaccgcagaggtacgtcctgc

SEQ ID NO: 384009 - DNA, 25 bp, Mus musculus
cagaggtacgtcctgcgaacttggc

SEQ ID NO: 384010 - DNA, 25 bp, Mus musculus
ggtcgcgggaacctcggagctcaac

SEQ ID NO: 384011 - DNA, 25 bp, Mus musculus
agcgcgagaagatgcgcgccaagca

SEQ ID NO: 384012 - DNA, 25 bp, Mus musculus
tacgtcctgcgaacttggcggctgg

SEQ ID NO: 384013 - DNA, 25 bp, Mus musculus
tccgcgtcccgtctcggaatggagg

SEQ ID NO: 384014 - DNA, 25 bp, Mus musculus
agcgcattctcgcttcccgggcagg

SEQ ID NO: 384015 - DNA, 25 bp, Mus musculus
gcaccaccacggacttcctggagga

SEQ ID NO: 384016 - DNA, 25 bp, Mus musculus
aggttgtagtttgccgaatgcttcc

SEQ ID NO: 384017 - DNA, 25 bp, Mus musculus
ggtatctctgcttcttctcgcgctt

SEQ ID NO: 384018 - DNA, 25 bp, Mus musculus
cgcggttctcatcccggcggatggc

SEQ ID NO: 384019 - DNA, 25 bp, Mus musculus
gtttgccgaatgcttccttctcagg

SEQ ID NO: 384020 - DNA, 25 bp, Mus musculus
ctcccgcgcggaaggttgtagtttg

SEQ ID NO: 384021 - DNA, 25 bp, Mus musculus
gcagacgtagaacccggtggctccc

SEQ ID NO: 384022 - DNA, 25 bp, Mus musculus
ttcttggcagacgtagaacccggtg

SEQ ID NO: 384023 - DNA, 25 bp, Mus musculus
tcttcccggcgcgaaccttcttggc

SEQ ID NO: 384024 - DNA, 25 bp, Mus musculus
aggcggccgacccagccgcgaagct

SEQ ID NO: 384025 - DNA, 25 bp, Mus musculus
ctcgtggagaaggagcgaccgctcc

SEQ ID NO: 384026 - DNA, 25 bp, Mus musculus
ccgctgcgctgagcggacgcgacga

SEQ ID NO: 384027 - DNA, 25 bp, Mus musculus
gaccagccgtgtgcgccgctgcgct

SEQ ID NO: 384028 - DNA, 25 bp, Mus musculus
atggcgccgcggtatctctgcttct

SEQ ID NO: 384029 - DNA, 25 bp, Mus musculus
gccgaatgcttccttctcaggacag

SEQ ID NO: 384030 - DNA, 25 bp, Mus musculus
tgtccggagctagccgtaggttctt

SEQ ID NO: 384031 - DNA, 25 bp, Mus musculus
cgctaacccgctgaaagtttctctg

SEQ ID NO: 384032 - DNA, 25 bp, Mus musculus
gctgtcggccaatgaagatgctgga

SEQ ID NO: 384033 - DNA, 25 bp, Mus musculus
aagtttctctgccagacctccggga

SEQ ID NO: 384034 - DNA, 25 bp, Mus musculus
aacggtgggagttttgcttctgcta

SEQ ID NO: 384035 - DNA, 25 bp, Mus musculus
tgctagctgccttaaccgaggcttc

SEQ ID NO: 384036 - DNA, 25 bp, Mus musculus
gaggcttccaccatcattcactatg

SEQ ID NO: 384037 - DNA, 25 bp, Mus musculus
tgttcgtcaacgatcgactggaccg

SEQ ID NO: 384038 - DNA, 25 bp, Mus musculus
tgccctcctgcactgtaactctgga

SEQ ID NO: 384039 - DNA, 25 bp, Mus musculus
cccgatgtggggagcaactctttac

SEQ ID NO: 384040 - DNA, 25 bp, Mus musculus
tgagctgagccacaatgagtacttt

SEQ ID NO: 384041 - DNA, 25 bp, Mus musculus
gagtactttgcgctccgcgtgcaga

SEQ ID NO: 384042 - DNA, 25 bp, Mus musculus
cgctagcgcattcttcgtgcagtta

SEQ ID NO: 384043 - DNA, 25 bp, Mus musculus
gtcctgctcaaagaacccggcgcta

SEQ ID NO: 384044 - DNA, 25 bp, Mus musculus
tctgccaggccacagcggggagtac

SEQ ID NO: 384045 - DNA, 25 bp, Mus musculus
atatacaacggtgacgcctcgctcc

SEQ ID NO: 384046 - DNA, 25 bp, Mus musculus
cggacggctccatgtcctggttagc

SEQ ID NO: 384047 - DNA, 25 bp, Mus musculus
aaatttcttatgtttgccgccgtcg

SEQ ID NO: 384048 - DNA, 25 bp, Mus musculus
gggagggacactcacaaatttctta

SEQ ID NO: 384049 - DNA, 25 bp, Mus musculus
ggccactccgccaggctgaagagca

SEQ ID NO: 384050 - DNA, 25 bp, Mus musculus
caggagccagcaaaaccaggaaggg

SEQ ID NO: 384051 - DNA, 25 bp, Mus musculus
gactgaacagcgagggaagctccaa

SEQ ID NO: 384052 - DNA, 25 bp, Mus musculus
catgtcctggttagcgccggcaagt

SEQ ID NO: 384053 - DNA, 25 bp, Mus musculus
tgcccggcgggcctaaccattcgga

SEQ ID NO: 384054 - DNA, 25 bp, Mus musculus
ctaaccattcggacccacgtgtggg

SEQ ID NO: 384055 - DNA, 25 bp, Mus musculus
tgcgcgcgcctcatgaatatacaac

SEQ ID NO: 384056 - DNA, 25 bp, Mus musculus
tcattaacatgctgggctgcgcgcg

SEQ ID NO: 384057 - DNA, 25 bp, Mus musculus
cccgcctcattaacatgctgggctg

SEQ ID NO: 384058 - DNA, 25 bp, Mus musculus
agtgcaggacctttgccagacgtga

SEQ ID NO: 384059 - DNA, 25 bp, Mus musculus
cggagccggagacagaaccaaacca

SEQ ID NO: 384060 - DNA, 25 bp, Mus musculus
gcctactactgcagaaccggaaacc

SEQ ID NO: 384061 - DNA, 25 bp, Mus musculus
ctggtccagattccgaggcttgaga

SEQ ID NO: 384062 - DNA, 25 bp, Mus musculus
gggacccgtggcaccattcatagaa

SEQ ID NO: 384063 - DNA, 25 bp, Mus musculus
ctgctagcctcaaacaggtcttgga

SEQ ID NO: 384064 - DNA, 25 bp, Mus musculus
gtcttggactcgtggttcctctcta

SEQ ID NO: 384065 - DNA, 25 bp, Mus musculus
gaacctcggaggatctggccaccct

SEQ ID NO: 384066 - DNA, 25 bp, Mus musculus
tctcaggtgcagaaagccaaatttc

SEQ ID NO: 384067 - DNA, 25 bp, Mus musculus
ttcccactcgtctgggcaatctgag

SEQ ID NO: 384068 - DNA, 25 bp, Mus musculus
gactggtggtcaaagcctctcctga

SEQ ID NO: 384069 - DNA, 25 bp, Mus musculus
ttgcgttcacacacgcgtaaggctc

SEQ ID NO: 384070 - DNA, 25 bp, Mus musculus
acgcgagtaggcatttgggaaccca

SEQ ID NO: 384071 - DNA, 25 bp, Mus musculus
tcccgcagtgagctaggaagattgc

SEQ ID NO: 384072 - DNA, 25 bp, Mus musculus
cgcggctccagcaaaggctgccaga

SEQ ID NO: 384073 - DNA, 25 bp, Mus musculus
gctccgcccactctcgtcaagctgc

SEQ ID NO: 384074 - DNA, 25 bp, Mus musculus
ctgcgcgccggcgcggaagaacaca

SEQ ID NO: 384075 - DNA, 25 bp, Mus musculus
aacacaggggcagcagcagtggaac

SEQ ID NO: 384076 - DNA, 25 bp, Mus musculus
ggcagcagcagtggaactcaacctg

SEQ ID NO: 384077 - DNA, 25 bp, Mus musculus
agcagtggaactcaacctgttattg

SEQ ID NO: 384078 - DNA, 25 bp, Mus musculus
tggaactcaacctgttattgctttg

SEQ ID NO: 384079 - DNA, 25 bp, Mus musculus
ctcaacctgttattgctttgctact

SEQ ID NO: 384080 - DNA, 25 bp, Mus musculus
cactctactccggaactcggggagg

SEQ ID NO: 384081 - DNA, 25 bp, Mus musculus
cagacactctactccggaactcggg

SEQ ID NO: 384082 - DNA, 25 bp, Mus musculus
tgctttgctacttgtaccccggaaa

SEQ ID NO: 384083 - DNA, 25 bp, Mus musculus
ctgcatcgcggctccagcaaaggct

SEQ ID NO: 384084 - DNA, 25 bp, Mus musculus
ggctgccagacactctactccggaa

SEQ ID NO: 384085 - DNA, 25 bp, Mus musculus
ccagcaaaggctgccagacactcta

SEQ ID NO: 384086 - DNA, 25 bp, Mus musculus
gttacaaatcaacgggattgtgctc

SEQ ID NO: 384087 - DNA, 25 bp, Mus musculus
accctcccacccgacacacgagaga

SEQ ID NO: 384088 - DNA, 25 bp, Mus musculus
ccgaagtgggcacccgacgcgccca

SEQ ID NO: 384089 - DNA, 25 bp, Mus musculus
ctgagagaaacacgaccccgaagtg

SEQ ID NO: 384090 - DNA, 25 bp, Mus musculus
gaagtggcacgaactgagagaaaca

SEQ ID NO: 384091 - DNA, 25 bp, Mus musculus
ggaagtggcacgaactgagagaaac

SEQ ID NO: 384092 - DNA, 25 bp, Mus musculus
gacagaaaagacagaaatcgttaca

SEQ ID NO: 384093 - DNA, 25 bp, Mus musculus
tcgttacaaatcaacgggattgtgc

SEQ ID NO: 384094 - DNA, 25 bp, Mus musculus
acaaatcaacgggattgtgctcgca

SEQ ID NO: 384095 - DNA, 25 bp, Mus musculus
aaatcaacgggattgtgctcgcagc

SEQ ID NO: 384096 - DNA, 25 bp, Mus musculus
atcaacgggattgtgctcgcagcgc

SEQ ID NO: 384097 - DNA, 25 bp, Mus musculus
ccacccgacacacgagagagacacg

SEQ ID NO: 384098 - DNA, 25 bp, Mus musculus
caacgggattgtgctcgcagcgccg

SEQ ID NO: 384099 - DNA, 25 bp, Mus musculus
cagaaatcgttacaaatcaacggga

SEQ ID NO: 384100 - DNA, 25 bp, Mus musculus
tgccctcctcggtcctggtaaggca

SEQ ID NO: 384101 - DNA, 25 bp, Mus musculus
catggctactgtgggagaaggcact

SEQ ID NO: 384102 - DNA, 25 bp, Mus musculus
gtccttgcaggagtcatggctactg

SEQ ID NO: 384103 - DNA, 25 bp, Mus musculus
ccaaggtggccgagtccttgcagga

SEQ ID NO: 384104 - DNA, 25 bp, Mus musculus
tcaagggaatttcctccaaggtggc

SEQ ID NO: 384105 - DNA, 25 bp, Mus musculus
gggctcacaggtagatctcacgctt

SEQ ID NO: 384106 - DNA, 25 bp, Mus musculus
ctcggtcctggtaaggcacgaaggt

SEQ ID NO: 384107 - DNA, 25 bp, Mus musculus
ctgggagacgactggccaggcatcc

SEQ ID NO: 384108 - DNA, 25 bp, Mus musculus
ccaggcatccagcatgtgtcagagt

SEQ ID NO: 384109 - DNA, 25 bp, Mus musculus
tgtgtcagagtgaccaaactcgctg

SEQ ID NO: 384110 - DNA, 25 bp, Mus musculus
aaactcgctgcactcccgggtacat

SEQ ID NO: 384111 - DNA, 25 bp, Mus musculus
tcccgggtacatgtgcccgtcatgg

SEQ ID NO: 384112 - DNA, 25 bp, Mus musculus
cccgtcatggcgacgtcgggcaaag

SEQ ID NO: 384113 - DNA, 25 bp, Mus musculus
tagatctcacgcttggcggcggtct

SEQ ID NO: 384114 - DNA, 25 bp, Mus musculus
ggttggctaaggtctcgttgacgta

SEQ ID NO: 384115 - DNA, 25 bp, Mus musculus
cgtaaaggtggactaaggctgtgcc

SEQ ID NO: 384116 - DNA, 25 bp, Mus musculus
acggtcactgaccttcaccacgagg

SEQ ID NO: 384117 - DNA, 25 bp, Mus musculus
agagaatgttgccacgctgcttgga

SEQ ID NO: 384118 - DNA, 25 bp, Mus musculus
ctatggacgaggagggtctctagca

SEQ ID NO: 384119 - DNA, 25 bp, Mus musculus
tggcgccgttcaatttctttttcca

SEQ ID NO: 384120 - DNA, 25 bp, Mus musculus
cgatgtcaatatccaggggcgtgtc

SEQ ID NO: 384121 - DNA, 25 bp, Mus musculus
tctttttccagcgtgatggctcccg

SEQ ID NO: 384122 - DNA, 25 bp, Mus musculus
cacgctgcttggaacgctcgtattc

SEQ ID NO: 384123 - DNA, 25 bp, Mus musculus
tctctagcagcgtgcggttggctaa

SEQ ID NO: 384124 - DNA, 25 bp, Mus musculus
gcgcactagtactgccagggctatg

SEQ ID NO: 384125 - DNA, 25 bp, Mus musculus
ctgccggcagtagcgcactagtact

SEQ ID NO: 384126 - DNA, 25 bp, Mus musculus
caccacgaggcggtgtaacccgtgg

SEQ ID NO: 384127 - DNA, 25 bp, Mus musculus
ctgccagggctatgagtaaggcgac

SEQ ID NO: 384128 - DNA, 25 bp, Mus musculus
agtcacaactacctgggcacgggca

SEQ ID NO: 384129 - DNA, 25 bp, Mus musculus
ctacgacacaggtgacggctgcgtt

SEQ ID NO: 384130 - DNA, 25 bp, Mus musculus
agccacgtcctctgatatgttagcc

SEQ ID NO: 384131 - DNA, 25 bp, Mus musculus
tatgttagccattccgtcttgatga

SEQ ID NO: 384132 - DNA, 25 bp, Mus musculus
gtcttgatgagtcaccagccctatg

SEQ ID NO: 384133 - DNA, 25 bp, Mus musculus
ggcattgtcgttcatgtctttcaca

SEQ ID NO: 384134 - DNA, 25 bp, Mus musculus
agggcacatcgcctgctacgacaca

SEQ ID NO: 384135 - DNA, 25 bp, Mus musculus
tcggtccttggcgagcactgagaaa

SEQ ID NO: 384136 - DNA, 25 bp, Mus musculus
tgcttaaatcctctcggtccacggg

SEQ ID NO: 384137 - DNA, 25 bp, Mus musculus
cggtgataagtccagtgtttcggtc

SEQ ID NO: 384138 - DNA, 25 bp, Mus musculus
tgtttcggtctagtcgcaaaaggcg

SEQ ID NO: 384139 - DNA, 25 bp, Mus musculus
cagccctatgcctcggatctcgatg

SEQ ID NO: 384140 - DNA, 25 bp, Mus musculus
cctggcgtagctggaagggcacatc

SEQ ID NO: 384141 - DNA, 25 bp, Mus musculus
tctcgatcagacacctgcaccaagg

SEQ ID NO: 384142 - DNA, 25 bp, Mus musculus
cggggacattctcataaaaccgatc

SEQ ID NO: 384143 - DNA, 25 bp, Mus musculus
aagccggcgccggaatcacaaagcc

SEQ ID NO: 384144 - DNA, 25 bp, Mus musculus
tcataaaaccgatcctctcaaggcg

SEQ ID NO: 384145 - DNA, 25 bp, Mus musculus
tcgccttcaggaccgccgcggggaa

SEQ ID NO: 384146 - DNA, 25 bp, Mus musculus
actctcttaggccaggaggccactt

SEQ ID NO: 384147 - DNA, 25 bp, Mus musculus
gcgcagtatagtaagaactctctta

SEQ ID NO: 384148 - DNA, 25 bp, Mus musculus
ctaggtgaggcgcagtatagtaaga

SEQ ID NO: 384149 - DNA, 25 bp, Mus musculus
cctcctggagcccaaggtgagacta

SEQ ID NO: 384150 - DNA, 25 bp, Mus musculus
ccagggtgacgcctggcctcctgga

SEQ ID NO: 384151 - DNA, 25 bp, Mus musculus
cgctcctaaggttttggtcgctgtc

SEQ ID NO: 384152 - DNA, 25 bp, Mus musculus
agtgggaggcgacgaccgctcctaa

SEQ ID NO: 384153 - DNA, 25 bp, Mus musculus
cctcccacaggaggcctagtgtgtg

SEQ ID NO: 384154 - DNA, 25 bp, Mus musculus
tcacaaagccgcgagcctggccggg

SEQ ID NO: 384155 - DNA, 25 bp, Mus musculus
gccgggcggggacattctcataaaa

SEQ ID NO: 384156 - DNA, 25 bp, Mus musculus
agcatcccgcgcgtgcggatcgttt

SEQ ID NO: 384157 - DNA, 25 bp, Mus musculus
tgttttagcggggaccgcgatccag

SEQ ID NO: 384158 - DNA, 25 bp, Mus musculus
cagcccaggtgctaaccagggttca

SEQ ID NO: 384159 - DNA, 25 bp, Mus musculus
catcgcgcagcgacagtaaggaagc

SEQ ID NO: 384160 - DNA, 25 bp, Mus musculus
ggccgctgagatctacacgctctgc

SEQ ID NO: 384161 - DNA, 25 bp, Mus musculus
agacgctgtcgctacgcggacaccg

SEQ ID NO: 384162 - DNA, 25 bp, Mus musculus
ggagagaccctccatcgcgcagcga

SEQ ID NO: 384163 - DNA, 25 bp, Mus musculus
ctcaaggcgccagaggaggtgtttt

SEQ ID NO: 384164 - DNA, 25 bp, Mus musculus
tgctcaaattcagtctcaaggcgcc

SEQ ID NO: 384165 - DNA, 25 bp, Mus musculus
cgccgcgcattggtgaatgctcaaa

SEQ ID NO: 384166 - DNA, 25 bp, Mus musculus
ggttcacgtgtcacctggcggcgcc

SEQ ID NO: 384167 - DNA, 25 bp, Mus musculus
gtgccatctgctcgcagcccaggtg

SEQ ID NO: 384168 - DNA, 25 bp, Mus musculus
gttcccagggctaacgggcgtgcca

SEQ ID NO: 384169 - DNA, 25 bp, Mus musculus
gaggatctgcgagccttgccctgcc

SEQ ID NO: 384170 - DNA, 25 bp, Mus musculus
gctagatccttacccgcctcggggc

SEQ ID NO: 384171 - DNA, 25 bp, Mus musculus
cgaaaccttctccattccgcgcgct

SEQ ID NO: 384172 - DNA, 25 bp, Mus musculus
gctgagggccttgcgctttcccgaa

SEQ ID NO: 384173 - DNA, 25 bp, Mus musculus
gataacgttcctagcttccctggtc

SEQ ID NO: 384174 - DNA, 25 bp, Mus musculus
tgtcgtggataacgttcctagcttc

SEQ ID NO: 384175 - DNA, 25 bp, Mus musculus
ccaacaagtgtgtgtgtcgtggata

SEQ ID NO: 384176 - DNA, 25 bp, Mus musculus
agctgagcaaatcgcccaacaagtg

SEQ ID NO: 384177 - DNA, 25 bp, Mus musculus
agtgagctgagcaaatcgcccaaca

SEQ ID NO: 384178 - DNA, 25 bp, Mus musculus
agcgcctgagtgagctgagcaaatc

SEQ ID NO: 384179 - DNA, 25 bp, Mus musculus
tggagtctctcatccccgcggcttg

SEQ ID NO: 384180 - DNA, 25 bp, Mus musculus
cttctctcggcttctcgcagtggac

SEQ ID NO: 384181 - DNA, 25 bp, Mus musculus
ctcggcttctcgcagtggaccttgg

SEQ ID NO: 384182 - DNA, 25 bp, Mus musculus
cattccgcgcgctcctggagtctct

SEQ ID NO: 384183 - DNA, 25 bp, Mus musculus
gagccgccaccgctagatccttacc

SEQ ID NO: 384184 - DNA, 25 bp, Mus musculus
cgtccttatcgggagctggccgcgc

SEQ ID NO: 384185 - DNA, 25 bp, Mus musculus
catttagtccgagatggcgtccctc

SEQ ID NO: 384186 - DNA, 25 bp, Mus musculus
ggctccggagcacgattacccctaa

SEQ ID NO: 384187 - DNA, 25 bp, Mus musculus
attcgcgagcgaggaaagcagcaac

SEQ ID NO: 384188 - DNA, 25 bp, Mus musculus
aagcagcaaccggaagggcttgacg

SEQ ID NO: 384189 - DNA, 25 bp, Mus musculus
gtcgaaggcggcgttctcgagcctc

SEQ ID NO: 384190 - DNA, 25 bp, Mus musculus
tgtggcggaaactgccgagctttcc

SEQ ID NO: 384191 - DNA, 25 bp, Mus musculus
agctttcccgaaggcggctgcgtcc

SEQ ID NO: 384192 - DNA, 25 bp, Mus musculus
tgttaaccctgatcgggatcggtcg

SEQ ID NO: 384193 - DNA, 25 bp, Mus musculus
ccagccggccctaagcggtggtgac

SEQ ID NO: 384194 - DNA, 25 bp, Mus musculus
gccgctccgcatttagtccgagatg

SEQ ID NO: 384195 - DNA, 25 bp, Mus musculus
tcagtgatgggtaaatcgtcttttc

SEQ ID NO: 384196 - DNA, 25 bp, Mus musculus
tgcgtccgagttgcccggatgtagt

SEQ ID NO: 384197 - DNA, 25 bp, Mus musculus
ccatttttgttgttaaccctgatcg

SEQ ID NO: 384198 - DNA, 25 bp, Mus musculus
catcccacgcgggtggaagcccagg

SEQ ID NO: 384199 - DNA, 25 bp, Mus musculus
aggccagtgattctgtgacagcttc

SEQ ID NO: 384200 - DNA, 25 bp, Mus musculus
tgacctgcggtcgagatggtcgccc

SEQ ID NO: 384201 - DNA, 25 bp, Mus musculus
tatccctgacctgcggtcgagatgg

SEQ ID NO: 384202 - DNA, 25 bp, Mus musculus
gagcttatccctgacctgcggtcga

SEQ ID NO: 384203 - DNA, 25 bp, Mus musculus
cgccggggagcttatccctgacctg

SEQ ID NO: 384204 - DNA, 25 bp, Mus musculus
gacagcttctccaggcgatcaaccc

SEQ ID NO: 384205 - DNA, 25 bp, Mus musculus
taaatcagaaacgaaagcccgcttc

SEQ ID NO: 384206 - DNA, 25 bp, Mus musculus
gagcttgggaccgagagccccctgc

SEQ ID NO: 384207 - DNA, 25 bp, Mus musculus
tgccaccggaccagggcagctcgcg

SEQ ID NO: 384208 - DNA, 25 bp, Mus musculus
cgtgcacgcgcactaacgccctccg

SEQ ID NO: 384209 - DNA, 25 bp, Mus musculus
gcactaacgccctccgcactgcggt

SEQ ID NO: 384210 - DNA, 25 bp, Mus musculus
actgcggtcgcatcccacgcgggtg

SEQ ID NO: 384211 - DNA, 25 bp, Mus musculus
gaagcccaggccagtgattctgtga

SEQ ID NO: 384212 - DNA, 25 bp, Mus musculus
gtcccgcaggcgatggactcatacc

SEQ ID NO: 384213 - DNA, 25 bp, Mus musculus
tggccacgacatgtggcgcctgaca

SEQ ID NO: 384214 - DNA, 25 bp, Mus musculus
tcgcagctcctgcaatggcgacaga

SEQ ID NO: 384215 - DNA, 25 bp, Mus musculus
cgatccgcgggaaggccgccatagc

SEQ ID NO: 384216 - DNA, 25 bp, Mus musculus
gactcatacctgcagtgcgccgcga

SEQ ID NO: 384217 - DNA, 25 bp, Mus musculus
aggctctatggtgctggccacgaca

SEQ ID NO: 384218 - DNA, 25 bp, Mus musculus
ctccattcaggcgtccggagccgtt

SEQ ID NO: 384219 - DNA, 25 bp, Mus musculus
tttgggcctcgatccctcggctgca

SEQ ID NO: 384220 - DNA, 25 bp, Mus musculus
agagcgtcatccttccggcagggct

SEQ ID NO: 384221 - DNA, 25 bp, Mus musculus
ggccacttccttcctagagcgtcat

SEQ ID NO: 384222 - DNA, 25 bp, Mus musculus
atccgatggccacttccttcctaga

SEQ ID NO: 384223 - DNA, 25 bp, Mus musculus
agtttggagctctcacctcgccagc

SEQ ID NO: 384224 - DNA, 25 bp, Mus musculus
cgccgcttcaagtttggagctctca

SEQ ID NO: 384225 - DNA, 25 bp, Mus musculus
tggcgacagaggacaccttggccgt

SEQ ID NO: 384226 - DNA, 25 bp, Mus musculus
ggtcccggtccaactgtcttgccga

SEQ ID NO: 384227 - DNA, 25 bp, Mus musculus
tcggttcctctgacgttgtagcatc

SEQ ID NO: 384228 - DNA, 25 bp, Mus musculus
ggttctcggttcctctgacgttgta

SEQ ID NO: 384229 - DNA, 25 bp, Mus musculus
cttgccgaatgtctggaaggttctc

SEQ ID NO: 384230 - DNA, 25 bp, Mus musculus
gtccaactgtcttgccgaatgtctg

SEQ ID NO: 384231 - DNA, 25 bp, Mus musculus
gagagcctccgcaaagccgcggacg

SEQ ID NO: 384232 - DNA, 25 bp, Mus musculus
gcctgttgggctcagctcgggtccc

SEQ ID NO: 384233 - DNA, 25 bp, Mus musculus
tccgagacgaaagtgctggccaggc

SEQ ID NO: 384234 - DNA, 25 bp, Mus musculus
tcatctccgagacgaaagtgctggc

SEQ ID NO: 384235 - DNA, 25 bp, Mus musculus
tttccagcagagagctcatctccga

SEQ ID NO: 384236 - DNA, 25 bp, Mus musculus
gcttccactggtaccgtgtgctgcc

SEQ ID NO: 384237 - DNA, 25 bp, Mus musculus
acgcagcttccactggtaccgtgtg

SEQ ID NO: 384238 - DNA, 25 bp, Mus musculus
aagccgcggacgcagcttccactgg

SEQ ID NO: 384239 - DNA, 25 bp, Mus musculus
cccaacaacatttccagcagagagc

SEQ ID NO: 384240 - DNA, 25 bp, Mus musculus
agtgaccgggcttgccctgtggaca

SEQ ID NO: 384241 - DNA, 25 bp, Mus musculus
ctgccgaggcccagtcaagggcatc

SEQ ID NO: 384242 - DNA, 25 bp, Mus musculus
cctctcagctgacagctctggagac

SEQ ID NO: 384243 - DNA, 25 bp, Mus musculus
gtcaagggcatcctgcggaacttta

SEQ ID NO: 384244 - DNA, 25 bp, Mus musculus
cagagccgagtgaccgggcttgccc

SEQ ID NO: 384245 - DNA, 25 bp, Mus musculus
ggccgggaagatgaatcggattttc

SEQ ID NO: 384246 - DNA, 25 bp, Mus musculus
gcttgccctgtggacaccgggctct

SEQ ID NO: 384247 - DNA, 25 bp, Mus musculus
gaccgttcctccacgccgttgctag

SEQ ID NO: 384248 - DNA, 25 bp, Mus musculus
cccgggcctgtagccctgcccgatc

SEQ ID NO: 384249 - DNA, 25 bp, Mus musculus
tgcccgatcctgtccgctgttgctg

SEQ ID NO: 384250 - DNA, 25 bp, Mus musculus
ggcggcgtacaaacacgtctgcatg

SEQ ID NO: 384251 - DNA, 25 bp, Mus musculus
aaacacgtctgcatggcgattggca

SEQ ID NO: 384252 - DNA, 25 bp, Mus musculus
tgaatcggattttcccaagctagga

SEQ ID NO: 384253 - DNA, 25 bp, Mus musculus
ctgcggaactttagggcccggctcg

SEQ ID NO: 384254 - DNA, 25 bp, Mus musculus
cgccatgacctaggatcgagggtcg

SEQ ID NO: 384255 - DNA, 25 bp, Mus musculus
tcagggcggtcctacgcgccctggc

SEQ ID NO: 384256 - DNA, 25 bp, Mus musculus
cagggagggcaacgattcgccgtcc

SEQ ID NO: 384257 - DNA, 25 bp, Mus musculus
ggagggcaacgattcgccgtccacc

SEQ ID NO: 384258 - DNA, 25 bp, Mus musculus
acgattcgccgtccacccgcgcagc

SEQ ID NO: 384259 - DNA, 25 bp, Mus musculus
cccacccagactgcgctcgcgtcgc

SEQ ID NO: 384260 - DNA, 25 bp, Mus musculus
caggcccgccatgacctaggatcga

SEQ ID NO: 384261 - DNA, 25 bp, Mus musculus
gcccgccatgacctaggatcgaggg

SEQ ID NO: 384262 - DNA, 25 bp, Mus musculus
ggtcgctcccacttactcgcaggct

SEQ ID NO: 384263 - DNA, 25 bp, Mus musculus
ccacttactcgcaggcttcccgcgg

SEQ ID NO: 384264 - DNA, 25 bp, Mus musculus
ggcccgcgagcgtcacgtggccacc

SEQ ID NO: 384265 - DNA, 25 bp, Mus musculus
agcgtcacgtggccaccggtcacgg

SEQ ID NO: 384266 - DNA, 25 bp, Mus musculus
gccagctgactcagggcggtcctac

SEQ ID NO: 384267 - DNA, 25 bp, Mus musculus
gatcccgccgggtcgctcccactta

SEQ ID NO: 384268 - DNA, 25 bp, Mus musculus
ctcgctcgccctccttccctgaggc

SEQ ID NO: 384269 - DNA, 25 bp, Mus musculus
cgcccgatcagctctctcgctcgcc

SEQ ID NO: 384270 - DNA, 25 bp, Mus musculus
aactcgtggcgctctaggggctgcg

SEQ ID NO: 384271 - DNA, 25 bp, Mus musculus
gcgctcgcgcccgatcagctctctc

SEQ ID NO: 384272 - DNA, 25 bp, Mus musculus
cggcagcgtccgtccacacacgccc

SEQ ID NO: 384273 - DNA, 25 bp, Mus musculus
acgtctcagcgtcggcagcgtccgt

SEQ ID NO: 384274 - DNA, 25 bp, Mus musculus
cggaggctgaactcgtggcgctcta

SEQ ID NO: 384275 - DNA, 25 bp, Mus musculus
aggagaacgtctcagcgtcggcagc

SEQ ID NO: 384276 - DNA, 25 bp, Mus musculus
tgccggaggagaacgtctcagcgtc

SEQ ID NO: 384277 - DNA, 25 bp, Mus musculus
ctcagtgccggaggagaacgtctca

SEQ ID NO: 384278 - DNA, 25 bp, Mus musculus
cctgggcctgtcgtggctcgggcca

SEQ ID NO: 384279 - DNA, 25 bp, Mus musculus
agccttggcggacgcgctcagtgcc

SEQ ID NO: 384280 - DNA, 25 bp, Mus musculus
tgcggcagcgggtaccagcaggtga

SEQ ID NO: 384281 - DNA, 25 bp, Mus musculus
ccgctgcgccatggccttggcgttg

SEQ ID NO: 384282 - DNA, 25 bp, Mus musculus
gttgcaacccttgcctgggaaaatg

SEQ ID NO: 384283 - DNA, 25 bp, Mus musculus
cgctacgtcgagcataggccgctaa

SEQ ID NO: 384284 - DNA, 25 bp, Mus musculus
ctcaaagggcttccagagtcgcaca

SEQ ID NO: 384285 - DNA, 25 bp, Mus musculus
cttggcaatgcctggggtcgaaaac

SEQ ID NO: 384286 - DNA, 25 bp, Mus musculus
acggcagtgccatgctgtgaacacc

SEQ ID NO: 384287 - DNA, 25 bp, Mus musculus
agcggatcgaaatagtgcaccattg

SEQ ID NO: 384288 - DNA, 25 bp, Mus musculus
accggctgtagacttactttgagga

SEQ ID NO: 384289 - DNA, 25 bp, Mus musculus
aagcatcgctccacgtctgtgtaaa

SEQ ID NO: 384290 - DNA, 25 bp, Mus musculus
gtcgccgttgaagtcgcagacgtca

SEQ ID NO: 384291 - DNA, 25 bp, Mus musculus
tgcctcagcggcgatgttgcaaccc

SEQ ID NO: 384292 - DNA, 25 bp, Mus musculus
cgcgccgctcacgattctatgaatg

SEQ ID NO: 384293 - DNA, 25 bp, Mus musculus
cgctaggctccgttttttatgaatg

SEQ ID NO: 384294 - DNA, 25 bp, Mus musculus
cttaacccgtgattgctggggccgg

SEQ ID NO: 384295 - DNA, 25 bp, Mus musculus
agctccgcgctgtcagctctgttcg

SEQ ID NO: 384296 - DNA, 25 bp, Mus musculus
ttcatcaaggagctcatcaaggacg

SEQ ID NO: 384297 - DNA, 25 bp, Mus musculus
caggctccgccttcagaaatatctg

SEQ ID NO: 384298 - DNA, 25 bp, Mus musculus
tcgggccgaggcaagcttattgatt

SEQ ID NO: 384299 - DNA, 25 bp, Mus musculus
caagcttattgattggccctgcagg

SEQ ID NO: 384300 - DNA, 25 bp, Mus musculus
ccctgcaggggattaggtcatcgct

SEQ ID NO: 384301 - DNA, 25 bp, Mus musculus
ttaggtcatcgctagcaggttcggg

SEQ ID NO: 384302 - DNA, 25 bp, Mus musculus
cacgaagcggagctggacaagacca

SEQ ID NO: 384303 - DNA, 25 bp, Mus musculus
catcaaggacgggaagtcgctcatc

SEQ ID NO: 384304 - DNA, 25 bp, Mus musculus
aagtcgctcatcagcgcgctcaaga

SEQ ID NO: 384305 - DNA, 25 bp, Mus musculus
ctcaagagtgagtgtccggagcagc

SEQ ID NO: 384306 - DNA, 25 bp, Mus musculus
gagtgaccggtgtctatgctcctgc

SEQ ID NO: 384307 - DNA, 25 bp, Mus musculus
tcctgcgaggcaagaaggatatgta

SEQ ID NO: 384308 - DNA, 25 bp, Mus musculus
tgcctcgtaggaatctggtcgctca

SEQ ID NO: 384309 - DNA, 25 bp, Mus musculus
ttccgagagacgctcaagtcacacg

SEQ ID NO: 384310 - DNA, 25 bp, Mus musculus
ctgcggattccagaagccgggattc

SEQ ID NO: 384311 - DNA, 25 bp, Mus musculus
tttaaaagcgggcacacgcgctccc

SEQ ID NO: 384312 - DNA, 25 bp, Mus musculus
ggccacgcccaacataagtctttaa

SEQ ID NO: 384313 - DNA, 25 bp, Mus musculus
ggcgaacaaggccacgcccaacata

SEQ ID NO: 384314 - DNA, 25 bp, Mus musculus
ctcccactcgggtgagtcctaggaa

SEQ ID NO: 384315 - DNA, 25 bp, Mus musculus
tccggtcttttgtctcggggccaga

SEQ ID NO: 384316 - DNA, 25 bp, Mus musculus
gccgatcctgagtgctccggacgtc

SEQ ID NO: 384317 - DNA, 25 bp, Mus musculus
gggcgacaccggatctcgctggctc

SEQ ID NO: 384318 - DNA, 25 bp, Mus musculus
catatggcgtttgtgcagtaaaggg

SEQ ID NO: 384319 - DNA, 25 bp, Mus musculus
cccggaggctaacatatggcgtttg

SEQ ID NO: 384320 - DNA, 25 bp, Mus musculus
ttcctcggtcagacctcgttagctc

SEQ ID NO: 384321 - DNA, 25 bp, Mus musculus
gccgggattctgaccagagactatc

SEQ ID NO: 384322 - DNA, 25 bp, Mus musculus
cgcgacaggaaagctgcggattcca

SEQ ID NO: 384323 - DNA, 25 bp, Mus musculus
agagactatcctgcaccggggagtc

SEQ ID NO: 384324 - DNA, 25 bp, Mus musculus
tccgagctcgcaaaatggaggaggc

SEQ ID NO: 384325 - DNA, 25 bp, Mus musculus
ccgagttgcgcgaagtgtgtcactc

SEQ ID NO: 384326 - DNA, 25 bp, Mus musculus
gcgagtttctttagtttctcttctc

SEQ ID NO: 384327 - DNA, 25 bp, Mus musculus
gactgtcggcaactgcaagggcgcc

SEQ ID NO: 384328 - DNA, 25 bp, Mus musculus
acggtgcaacctgttggcgactgtc

SEQ ID NO: 384329 - DNA, 25 bp, Mus musculus
ggcgactcgggctccaggcactgac

SEQ ID NO: 384330 - DNA, 25 bp, Mus musculus
tcccaccgcagccagataaacaagt

SEQ ID NO: 384331 - DNA, 25 bp, Mus musculus
ccagataaacaagtcggcgtgcgga

SEQ ID NO: 384332 - DNA, 25 bp, Mus musculus
cgcgtgtcacggagaaggaagtcaa

SEQ ID NO: 384333 - DNA, 25 bp, Mus musculus
cggagaaggaagtcaacagtcgccc

SEQ ID NO: 384334 - DNA, 25 bp, Mus musculus
gaaagtcacccgttcccggctgaca

SEQ ID NO: 384335 - DNA, 25 bp, Mus musculus
cggcgtcttgttccacccacttaga

SEQ ID NO: 384336 - DNA, 25 bp, Mus musculus
ttgttccacccacttagaatccgtc

SEQ ID NO: 384337 - DNA, 25 bp, Mus musculus
caggcactgactccgagctcgcaaa

SEQ ID NO: 384338 - DNA, 25 bp, Mus musculus
tcttggtaaagagcagtgacgccac

SEQ ID NO: 384339 - DNA, 25 bp, Mus musculus
ggctgcccaatgtgtcttccgcttt

SEQ ID NO: 384340 - DNA, 25 bp, Mus musculus
tggatggaaaatgtaaaggctgccc

SEQ ID NO: 384341 - DNA, 25 bp, Mus musculus
cgaggcgccctttcttggatggaaa

SEQ ID NO: 384342 - DNA, 25 bp, Mus musculus
tctttagcttcaaaaccgaggcgcc

SEQ ID NO: 384343 - DNA, 25 bp, Mus musculus
tgacgccacacggtcaccattttgg

SEQ ID NO: 384344 - DNA, 25 bp, Mus musculus
cttggagatctctgattggggaagc

SEQ ID NO: 384345 - DNA, 25 bp, Mus musculus
tcctctgcctgacctcttggagatc

SEQ ID NO: 384346 - DNA, 25 bp, Mus musculus
cgatcgcgcagcacttggactccga

SEQ ID NO: 384347 - DNA, 25 bp, Mus musculus
acttctgatcggagctgaggctgcc

SEQ ID NO: 384348 - DNA, 25 bp, Mus musculus
ccagcgcttggcacttctgatcgga

SEQ ID NO: 384349 - DNA, 25 bp, Mus musculus
gtgcgaggaagtaacttttgctccc

SEQ ID NO: 384350 - DNA, 25 bp, Mus musculus
ccgcacgctacggtttaggggcctg

SEQ ID NO: 384351 - DNA, 25 bp, Mus musculus
tttggcagaggtgctctttagcttc

SEQ ID NO: 384352 - DNA, 25 bp, Mus musculus
gtcagcattgacagtggctgcggca

SEQ ID NO: 384353 - DNA, 25 bp, Mus musculus
atttctccgcgctttggaacgagca

SEQ ID NO: 384354 - DNA, 25 bp, Mus musculus
aagttgtgggtcgtcatttctccgc

SEQ ID NO: 384355 - DNA, 25 bp, Mus musculus
gcaccaagttgtgggtcgtcatttc

SEQ ID NO: 384356 - DNA, 25 bp, Mus musculus
tcagcccagcaccaagttgtgggtc

SEQ ID NO: 384357 - DNA, 25 bp, Mus musculus
tcgcgtcagcccagcaccaagttgt

SEQ ID NO: 384358 - DNA, 25 bp, Mus musculus
gcgcgaaccaggcaggtttgaatcc

SEQ ID NO: 384359 - DNA, 25 bp, Mus musculus
ccctggctgcggaggatatgagtca

SEQ ID NO: 384360 - DNA, 25 bp, Mus musculus
ctgtgacagacagccggccctggct

SEQ ID NO: 384361 - DNA, 25 bp, Mus musculus
tgaatcctctgtgacagacagccgg

SEQ ID NO: 384362 - DNA, 25 bp, Mus musculus
aggcaggtttgaatcctctgtgaca

SEQ ID NO: 384363 - DNA, 25 bp, Mus musculus
ctccgcgctttggaacgagcatgcg

SEQ ID NO: 384364 - DNA, 25 bp, Mus musculus
cggaggatatgagtcagcattgaca

SEQ ID NO: 384365 - DNA, 25 bp, Mus musculus
gctgcggcagatcccggtctcgcgt

SEQ ID NO: 384366 - DNA, 25 bp, Mus musculus
aagccgaaagcgcaacatggacccg

SEQ ID NO: 384367 - DNA, 25 bp, Mus musculus
tccgagaagacactcggcaactggg

SEQ ID NO: 384368 - DNA, 25 bp, Mus musculus
gtaggcgccgctccagctaaatata

SEQ ID NO: 384369 - DNA, 25 bp, Mus musculus
ctaaatataaacgaggggccgcgca

SEQ ID NO: 384370 - DNA, 25 bp, Mus musculus
gacaaccgctgccagaagccgaaag

SEQ ID NO: 384371 - DNA, 25 bp, Mus musculus
atggacccgggacactcaccaaacg

SEQ ID NO: 384372 - DNA, 25 bp, Mus musculus
cagtaacggctgtagctccagcggc

SEQ ID NO: 384373 - DNA, 25 bp, Mus musculus
ggtagccctgttgctacgtgtcaca

SEQ ID NO: 384374 - DNA, 25 bp, Mus musculus
tgtcacaggccgaggaactgcttcc

SEQ ID NO: 384375 - DNA, 25 bp, Mus musculus
gcccggttggattgatctccctcgg

SEQ ID NO: 384376 - DNA, 25 bp, Mus musculus
gcggtcttgactgagtcgtcctgta

SEQ ID NO: 384377 - DNA, 25 bp, Mus musculus
tcgtcctgtagcgagccaataggga

SEQ ID NO: 384378 - DNA, 25 bp, Mus musculus
cctgcttccggcagccgggttaaca

SEQ ID NO: 384379 - DNA, 25 bp, Mus musculus
acagcccgcgcagacagaccaggaa

SEQ ID NO: 384380 - DNA, 25 bp, Mus musculus
ctcggagggtgagtctagacccatg

SEQ ID NO: 384381 - DNA, 25 bp, Mus musculus
accacctgctcgaaggggtactgga

SEQ ID NO: 384382 - DNA, 25 bp, Mus musculus
aggaagcaagcgaccacctgctcga

SEQ ID NO: 384383 - DNA, 25 bp, Mus musculus
tgatacctttcggaggaagcaagcg

SEQ ID NO: 384384 - DNA, 25 bp, Mus musculus
caggtcagagggactgatacctttc

SEQ ID NO: 384385 - DNA, 25 bp, Mus musculus
tgcacttcccaggtcagagggactg

SEQ ID NO: 384386 - DNA, 25 bp, Mus musculus
ggcagttcagactgtccgcagcgga

SEQ ID NO: 384387 - DNA, 25 bp, Mus musculus
gttgggtacagacgacaagtgacgc

SEQ ID NO: 384388 - DNA, 25 bp, Mus musculus
agtctagacccatgagggttgggta

SEQ ID NO: 384389 - DNA, 25 bp, Mus musculus
tccgctcatccctgagagcagcttt

SEQ ID NO: 384390 - DNA, 25 bp, Mus musculus
agcagctttcgaggaaaaccgcctc

SEQ ID NO: 384391 - DNA, 25 bp, Mus musculus
aggggtactggaacacctggtgcac

SEQ ID NO: 384392 - DNA, 25 bp, Mus musculus
aacacctggtgcacgtccacggtga

SEQ ID NO: 384393 - DNA, 25 bp, Mus musculus
tgatgttctgcacggtaccctccgc

SEQ ID NO: 384394 - DNA, 25 bp, Mus musculus
agggccttctcagcacactggggca

SEQ ID NO: 384395 - DNA, 25 bp, Mus musculus
tcctggctggccaagttactggagc

SEQ ID NO: 384396 - DNA, 25 bp, Mus musculus
agtctataagatgcccggtgggtca

SEQ ID NO: 384397 - DNA, 25 bp, Mus musculus
gcgcgactgtcgagggatttttaaa

SEQ ID NO: 384398 - DNA, 25 bp, Mus musculus
ttccctgcaccatgctcatagaaga

SEQ ID NO: 384399 - DNA, 25 bp, Mus musculus
agataccatcttgcaccgggagttc

SEQ ID NO: 384400 - DNA, 25 bp, Mus musculus
tgtggatgccctcaagtcctggctg

SEQ ID NO: 384401 - DNA, 25 bp, Mus musculus
gctcttgggttagttcctgttaggc

SEQ ID NO: 384402 - DNA, 25 bp, Mus musculus
cgcctattggttagtcggcccgtca

SEQ ID NO: 384403 - DNA, 25 bp, Mus musculus
tgaactctccacctaccttgctagg

SEQ ID NO: 384404 - DNA, 25 bp, Mus musculus
ggaccctttaagagacacagcacct

SEQ ID NO: 384405 - DNA, 25 bp, Mus musculus
catcggagcgagtttccaggaaaaa

SEQ ID NO: 384406 - DNA, 25 bp, Mus musculus
acgagtcttacgattggccttctgc

SEQ ID NO: 384407 - DNA, 25 bp, Mus musculus
gcccagggagtaggtgaagtctata

SEQ ID NO: 384408 - DNA, 25 bp, Mus musculus
gtggatatcgtctcccacggcaaga

SEQ ID NO: 384409 - DNA, 25 bp, Mus musculus
ctcagcgatgtggagtcagaccctc

SEQ ID NO: 384410 - DNA, 25 bp, Mus musculus
ccacttgcatcaggccatgggcatg

SEQ ID NO: 384411 - DNA, 25 bp, Mus musculus
acccgcatcatctaggcgccatggg

SEQ ID NO: 384412 - DNA, 25 bp, Mus musculus
cgagggcgacttacttgagcacatc

SEQ ID NO: 384413 - DNA, 25 bp, Mus musculus
cgcatcacgcggtacatcagggcct

SEQ ID NO: 384414 - DNA, 25 bp, Mus musculus
gaggcatctcggttgcttgaaaatg

SEQ ID NO: 384415 - DNA, 25 bp, Mus musculus
atgtctctgatccacacgtctgttc

SEQ ID NO: 384416 - DNA, 25 bp, Mus musculus
tgtcgcccagaacaatcgccgctgt

SEQ ID NO: 384417 - DNA, 25 bp, Mus musculus
cgcttcaagcagaggcgcatcaagt

SEQ ID NO: 384418 - DNA, 25 bp, Mus musculus
ggccatgaacgccaagcagcctttc

SEQ ID NO: 384419 - DNA, 25 bp, Mus musculus
cttgcagctgcagggtaatatattt

SEQ ID NO: 384420 - DNA, 25 bp, Mus musculus
ggcacattttttgacaggcactagc

SEQ ID NO: 384421 - DNA, 25 bp, Mus musculus
gaggctgcctccgtattaattttta

SEQ ID NO: 384422 - DNA, 25 bp, Mus musculus
ctttccgatcaggtcaggtttccct

SEQ ID NO: 384423 - DNA, 25 bp, Mus musculus
agcctccggttcgatcgctactttc

SEQ ID NO: 384424 - DNA, 25 bp, Mus musculus
gggcgaattagcctccggttcgatc

SEQ ID NO: 384425 - DNA, 25 bp, Mus musculus
cctgggcggcagtcagagcccgcaa

SEQ ID NO: 384426 - DNA, 25 bp, Mus musculus
ctactttccgatcaggtcaggtttc

SEQ ID NO: 384427 - DNA, 25 bp, Mus musculus
ccctccgccctggacgctgcttccc

SEQ ID NO: 384428 - DNA, 25 bp, Mus musculus
tcatgggcacctccggaggggcttc

SEQ ID NO: 384429 - DNA, 25 bp, Mus musculus
ccctgggctgcagatctcctgtggt

SEQ ID NO: 384430 - DNA, 25 bp, Mus musculus
ggctgcagatctcctgtggtctttc

SEQ ID NO: 384431 - DNA, 25 bp, Mus musculus
agatctcctgtggtctttcttagcc

SEQ ID NO: 384432 - DNA, 25 bp, Mus musculus
cctgtggtctttcttagccctctca

SEQ ID NO: 384433 - DNA, 25 bp, Mus musculus
tggtctttcttagccctctcaccga

SEQ ID NO: 384434 - DNA, 25 bp, Mus musculus
ctccggttcgatcgctactttccga

SEQ ID NO: 384435 - DNA, 25 bp, Mus musculus
gttcgatcgctactttccgatcagg

SEQ ID NO: 384436 - DNA, 25 bp, Mus musculus
agctgaggtaaaaggcgccaccttc

SEQ ID NO: 384437 - DNA, 25 bp, Mus musculus
tcaagattcgcagccctgaccgttc

SEQ ID NO: 384438 - DNA, 25 bp, Mus musculus
taggcgctttttgcaggccagaggc

SEQ ID NO: 384439 - DNA, 25 bp, Mus musculus
ttccttcacatcgaagcgtgctggc

SEQ ID NO: 384440 - DNA, 25 bp, Mus musculus
ggtggatgaactcggctgtctgtaa

SEQ ID NO: 384441 - DNA, 25 bp, Mus musculus
caccttatgtgcgtgggattgacga

SEQ ID NO: 384442 - DNA, 25 bp, Mus musculus
ggcgagtttcaccagtcaatatata

SEQ ID NO: 384443 - DNA, 25 bp, Mus musculus
acgtcaagattgatggcgagtttca

SEQ ID NO: 384444 - DNA, 25 bp, Mus musculus
gacagtctcaataccgctttcaaag

SEQ ID NO: 384445 - DNA, 25 bp, Mus musculus
agcggccaatcaactgacagtctca

SEQ ID NO: 384446 - DNA, 25 bp, Mus musculus
tgccaaagtcccatttcccataaag

SEQ ID NO: 384447 - DNA, 25 bp, Mus musculus
ttctttccgcaagagggcgccactt

SEQ ID NO: 384448 - DNA, 25 bp, Mus musculus
ccggacacgtggctacgttaggctg

SEQ ID NO: 384449 - DNA, 25 bp, Mus musculus
tccgatccgttttcttttgtcaaga

SEQ ID NO: 384450 - DNA, 25 bp, Mus musculus
agcgcgcagtcctgccggggccatt

SEQ ID NO: 384451 - DNA, 25 bp, Mus musculus
ctgctttccagctcgccctcctggg

SEQ ID NO: 384452 - DNA, 25 bp, Mus musculus
cctggcgactggctctaatccaggc

SEQ ID NO: 384453 - DNA, 25 bp, Mus musculus
cgactggctctaatccaggcgactg

SEQ ID NO: 384454 - DNA, 25 bp, Mus musculus
tggctctaatccaggcgactggcaa

SEQ ID NO: 384455 - DNA, 25 bp, Mus musculus
aatccaggcgactggcaattcgctc

SEQ ID NO: 384456 - DNA, 25 bp, Mus musculus
caggcgactggcaattcgctccggg

SEQ ID NO: 384457 - DNA, 25 bp, Mus musculus
ggccattcgctcagccgcgtcctga

SEQ ID NO: 384458 - DNA, 25 bp, Mus musculus
caggtgcctgagcccagcgcgcagt

SEQ ID NO: 384459 - DNA, 25 bp, Mus musculus
ccctttgcagccgcaggtgcctgag

SEQ ID NO: 384460 - DNA, 25 bp, Mus musculus
cggttgtgctgggtcccctttgcag

SEQ ID NO: 384461 - DNA, 25 bp, Mus musculus
ggcgggctgcttggcgctctcttcc

SEQ ID NO: 384462 - DNA, 25 bp, Mus musculus
gctctcttcctcacccgggtcctgc

SEQ ID NO: 384463 - DNA, 25 bp, Mus musculus
ggttcccagccacgccctcctgctt

SEQ ID NO: 384464 - DNA, 25 bp, Mus musculus
ttcccggctctagcaaaactgcagc

SEQ ID NO: 384465 - DNA, 25 bp, Mus musculus
acccacttgttgatccggcgggctt

SEQ ID NO: 384466 - DNA, 25 bp, Mus musculus
ggcgctcagaattcgttccacagtg

SEQ ID NO: 384467 - DNA, 25 bp, Mus musculus
acggaaatggtcttcctacggagca

SEQ ID NO: 384468 - DNA, 25 bp, Mus musculus
ctacggagcaacgaaggcgaacttc

SEQ ID NO: 384469 - DNA, 25 bp, Mus musculus
tccctccacacaggcgtgcagagtg

SEQ ID NO: 384470 - DNA, 25 bp, Mus musculus
ggcgaaaatcacagccgcagtctca

SEQ ID NO: 384471 - DNA, 25 bp, Mus musculus
agcgctctcggagctgacgagttga

SEQ ID NO: 384472 - DNA, 25 bp, Mus musculus
cgccgagaggggaaactagattgct

SEQ ID NO: 384473 - DNA, 25 bp, Mus musculus
ccagatccgagtttccggggacagc

SEQ ID NO: 384474 - DNA, 25 bp, Mus musculus
cctgtgactttgtgcctgtcgctgc

SEQ ID NO: 384475 - DNA, 25 bp, Mus musculus
ggccgggtctctggtaatatctcca

SEQ ID NO: 384476 - DNA, 25 bp, Mus musculus
tccagtagcgctctgacaggcagcc

SEQ ID NO: 384477 - DNA, 25 bp, Mus musculus
gcagattaagctcctcgctgccgga

SEQ ID NO: 384478 - DNA, 25 bp, Mus musculus
tcggtctcgtactcatccgggccgt

SEQ ID NO: 384479 - DNA, 25 bp, Mus musculus
caagacggagatccagagccgcgca

SEQ ID NO: 384480 - DNA, 25 bp, Mus musculus
ccgcgcgcgacacaagacggagatc

SEQ ID NO: 384481 - DNA, 25 bp, Mus musculus
gaaagcgtttcagcctcgcggggct

SEQ ID NO: 384482 - DNA, 25 bp, Mus musculus
ggccgtccgccatcttggtgttaaa

SEQ ID NO: 384483 - DNA, 25 bp, Mus musculus
gctggagtgtgctctctgctgcact

SEQ ID NO: 384484 - DNA, 25 bp, Mus musculus
acgcagcccgtttcggtctcgtact

SEQ ID NO: 384485 - DNA, 25 bp, Mus musculus
cgggcctggactcgctttcttcagc

SEQ ID NO: 384486 - DNA, 25 bp, Mus musculus
aggcagcgcggcgacaccacaggac

SEQ ID NO: 384487 - DNA, 25 bp, Mus musculus
cggccgaggttccaaagtgtcagca

SEQ ID NO: 384488 - DNA, 25 bp, Mus musculus
aaccaaacagcagatcggctgcctc

SEQ ID NO: 384489 - DNA, 25 bp, Mus musculus
tccgccaccgagaaagaggggacga

SEQ ID NO: 384490 - DNA, 25 bp, Mus musculus
gaagggtcgtgtcatccgccaccga

SEQ ID NO: 384491 - DNA, 25 bp, Mus musculus
catcttggtgttaaatccctcctcc

SEQ ID NO: 384492 - DNA, 25 bp, Mus musculus
tgcgtcagtgtttaaggttttcctc

SEQ ID NO: 384493 - DNA, 25 bp, Mus musculus
agccatgcgctctcggcggtggaaa

SEQ ID NO: 384494 - DNA, 25 bp, Mus musculus
attctggctgcaggggatgtctgcc

SEQ ID NO: 384495 - DNA, 25 bp, Mus musculus
tctcggcggtggaaaaggacaaaca

SEQ ID NO: 384496 - DNA, 25 bp, Mus musculus
gacaaacaacccgaagttctctgcg

SEQ ID NO: 384497 - DNA, 25 bp, Mus musculus
gtgatccgcggaatgttcttcttgc

SEQ ID NO: 384498 - DNA, 25 bp, Mus musculus
gaatgttcttcttgccctggtagga

SEQ ID NO: 384499 - DNA, 25 bp, Mus musculus
cccaggatcgctgcatcagcgtggc

SEQ ID NO: 384500 - DNA, 25 bp, Mus musculus
gaccgggcacgccaatggcatccaa

SEQ ID NO: 384501 - DNA, 25 bp, Mus musculus
cggctgccagagacaatagtaaatc

SEQ ID NO: 384502 - DNA, 25 bp, Mus musculus
cggcaagaagccaccggcggactca

SEQ ID NO: 384503 - DNA, 25 bp, Mus musculus
cctggtaggacatggtggcgattct

SEQ ID NO: 384504 - DNA, 25 bp, Mus musculus
cggactcaccgtgatccgcggaatg

SEQ ID NO: 384505 - DNA, 25 bp, Mus musculus
ccgaagttctctgcgtcagtgttta

SEQ ID NO: 384506 - DNA, 25 bp, Mus musculus
cccggacgggccaagtacacaggca

SEQ ID NO: 384507 - DNA, 25 bp, Mus musculus
accagccaagctagtgagccgcagc

SEQ ID NO: 384508 - DNA, 25 bp, Mus musculus
ccttcgcgccagaggcggcagtgct

SEQ ID NO: 384509 - DNA, 25 bp, Mus musculus
cagcgcgcacagagccacagtgatg

SEQ ID NO: 384510 - DNA, 25 bp, Mus musculus
gcggctcaggggctttcttcttcag

SEQ ID NO: 384511 - DNA, 25 bp, Mus musculus
atggttcaagcgacagcggctcagg

SEQ ID NO: 384512 - DNA, 25 bp, Mus musculus
gcccgaagccatggttcaagcgaca

SEQ ID NO: 384513 - DNA, 25 bp, Mus musculus
agtacacaggcaggtcgtcctcgtg

SEQ ID NO: 384514 - DNA, 25 bp, Mus musculus
tcagggcatcaaaatccaacgtctt

SEQ ID NO: 384515 - DNA, 25 bp, Mus musculus
gtacttctgccgtgggacctgatct

SEQ ID NO: 384516 - DNA, 25 bp, Mus musculus
gttgcagaacatgccaccgtacttc

SEQ ID NO: 384517 - DNA, 25 bp, Mus musculus
tcgaaggcaccctccacgttgcaga

SEQ ID NO: 384518 - DNA, 25 bp, Mus musculus
tccaacgtcttgctctcgaaggcac

SEQ ID NO: 384519 - DNA, 25 bp, Mus musculus
tcgtcctcgtgggagctgtcccaac

SEQ ID NO: 384520 - DNA, 25 bp, Mus musculus
caccgggtcctccatagagaacgtg

SEQ ID NO: 384521 - DNA, 25 bp, Mus musculus
ccgccgcccgcgaccttccgcaccg

SEQ ID NO: 384522 - DNA, 25 bp, Mus musculus
ctcgtcctcgccttcccagcggtcc

SEQ ID NO: 384523 - DNA, 25 bp, Mus musculus
cgcaccgggtcctccatagagaacg

SEQ ID NO: 384524 - DNA, 25 bp, Mus musculus
ccgggtcctccatagagaacgtgtc

SEQ ID NO: 384525 - DNA, 25 bp, Mus musculus
ggtcctccatagagaacgtgtccgc

SEQ ID NO: 384526 - DNA, 25 bp, Mus musculus
cctccatagagaacgtgtccgcgtc

SEQ ID NO: 384527 - DNA, 25 bp, Mus musculus
cgccgccatctcgaaccgggggtga

SEQ ID NO: 384528 - DNA, 25 bp, Mus musculus
atgggaagagctgcgaagagttagc

SEQ ID NO: 384529 - DNA, 25 bp, Mus musculus
agctgcgaagagttagcgcggcaga

SEQ ID NO: 384530 - DNA, 25 bp, Mus musculus
tgagtcactgggctggctctcgttg

SEQ ID NO: 384531 - DNA, 25 bp, Mus musculus
actgggctggctctcgttggcccgc

SEQ ID NO: 384532 - DNA, 25 bp, Mus musculus
ttccgcaccgggtcctccatagaga

SEQ ID NO: 384533 - DNA, 25 bp, Mus musculus
agttagcgcggcagaggtgagtcac

SEQ ID NO: 384534 - DNA, 25 bp, Mus musculus
ccggacctcaagttctttctgtgta

SEQ ID NO: 384535 - DNA, 25 bp, Mus musculus
tccgcctgttacctcttcgtgtctg

SEQ ID NO: 384536 - DNA, 25 bp, Mus musculus
catcgatatggagcgctttaagtac

SEQ ID NO: 384537 - DNA, 25 bp, Mus musculus
tgtctctaccttcctcatcgatatg

SEQ ID NO: 384538 - DNA, 25 bp, Mus musculus
agcgcgccttcaccgtcttctggat

SEQ ID NO: 384539 - DNA, 25 bp, Mus musculus
cttctttagccaggatgagcgcgcc

SEQ ID NO: 384540 - DNA, 25 bp, Mus musculus
aagaccggccagatcgccaactgtg

SEQ ID NO: 384541 - DNA, 25 bp, Mus musculus
ccggacactctgtgcatggactaca

SEQ ID NO: 384542 - DNA, 25 bp, Mus musculus
acacgcccatctgcctggaggacta

SEQ ID NO: 384543 - DNA, 25 bp, Mus musculus
ccgctggtggagatacagtgctccc

SEQ ID NO: 384544 - DNA, 25 bp, Mus musculus
cgacacgcaagatgaggcgggccta

SEQ ID NO: 384545 - DNA, 25 bp, Mus musculus
ccgttgtgcaaaggcatcggttaca

SEQ ID NO: 384546 - DNA, 25 bp, Mus musculus
cctagaggtgcaccagttttggccg

SEQ ID NO: 384547 - DNA, 25 bp, Mus musculus
cagtacggctttgcttggcctgacc

SEQ ID NO: 384548 - DNA, 25 bp, Mus musculus
ggcagcgtcctggatgatctctgca

SEQ ID NO: 384549 - DNA, 25 bp, Mus musculus
acacccggcgtgcactcagtcaaag

SEQ ID NO: 384550 - DNA, 25 bp, Mus musculus
cagcatgaagcctgattggagccca

SEQ ID NO: 384551 - DNA, 25 bp, Mus musculus
ccagcttgacattgggcctttcacg

SEQ ID NO: 384552 - DNA, 25 bp, Mus musculus
ggccttgattctccattccggggta

SEQ ID NO: 384553 - DNA, 25 bp, Mus musculus
caccagtcctgggtctcagcactga

SEQ ID NO: 384554 - DNA, 25 bp, Mus musculus
gatctctgcaggtactagccgctca

SEQ ID NO: 384555 - DNA, 25 bp, Mus musculus
attatggagcccaaacgcctggaga

SEQ ID NO: 384556 - DNA, 25 bp, Mus musculus
cctgctgcgggtcctcattatggag

SEQ ID NO: 384557 - DNA, 25 bp, Mus musculus
gtaccgctttgagtcctcggcctca

SEQ ID NO: 384558 - DNA, 25 bp, Mus musculus
ttggtcttaagagcaggaactagca

SEQ ID NO: 384559 - DNA, 25 bp, Mus musculus
attcactcccgggttccactatgcg

SEQ ID NO: 384560 - DNA, 25 bp, Mus musculus
ctgcacatcttttagtcccgctttc

SEQ ID NO: 384561 - DNA, 25 bp, Mus musculus
aaacgtctcattggcgaagcgcgcg

SEQ ID NO: 384562 - DNA, 25 bp, Mus musculus
agctccggacctcagcagttcctta

SEQ ID NO: 384563 - DNA, 25 bp, Mus musculus
cctgggcaccagtgcgagaacgata

SEQ ID NO: 384564 - DNA, 25 bp, Mus musculus
gcgcccagcagagctcgggtatcct

SEQ ID NO: 384565 - DNA, 25 bp, Mus musculus
cccattacccggcaggcgggcagtt

SEQ ID NO: 384566 - DNA, 25 bp, Mus musculus
tggaatctcaccagcgagccatagc

SEQ ID NO: 384567 - DNA, 25 bp, Mus musculus
taccgtaagtcaggctggaatctca

SEQ ID NO: 384568 - DNA, 25 bp, Mus musculus
atggagaagctcgataccgtaagtc

SEQ ID NO: 384569 - DNA, 25 bp, Mus musculus
acccaggacagcagcgaggccagaa

SEQ ID NO: 384570 - DNA, 25 bp, Mus musculus
gtctagacagccattttcacccagg

SEQ ID NO: 384571 - DNA, 25 bp, Mus musculus
ccgccggcacatttcagtctagaca

SEQ ID NO: 384572 - DNA, 25 bp, Mus musculus
cctgcacttttcagagccgggctcg

SEQ ID NO: 384573 - DNA, 25 bp, Mus musculus
tttcaccgcaactccagaattcatg

SEQ ID NO: 384574 - DNA, 25 bp, Mus musculus
gctgaggagtcgttgccatatttca

SEQ ID NO: 384575 - DNA, 25 bp, Mus musculus
aacgatatgtgcctccggttcccgg

SEQ ID NO: 384576 - DNA, 25 bp, Mus musculus
ctcctcgccggtgctggacgtgtcg

SEQ ID NO: 384577 - DNA, 25 bp, Mus musculus
gcgtccaggaatcgcccaagtggca

SEQ ID NO: 384578 - DNA, 25 bp, Mus musculus
cgaacctgcccgatgacggagcatg

SEQ ID NO: 384579 - DNA, 25 bp, Mus musculus
gaagatgggcgtccaggaatcgccc

SEQ ID NO: 384580 - DNA, 25 bp, Mus musculus
cacctctccgggttttgctggggct

SEQ ID NO: 384581 - DNA, 25 bp, Mus musculus
gattccacctctccgggttttgctg

SEQ ID NO: 384582 - DNA, 25 bp, Mus musculus
tcgcctacctgctgatgtagccatc

SEQ ID NO: 384583 - DNA, 25 bp, Mus musculus
tgctggacgtgtcgctgctgccacc

SEQ ID NO: 384584 - DNA, 25 bp, Mus musculus
cgcccaagtggcacctgcggaacga

SEQ ID NO: 384585 - DNA, 25 bp, Mus musculus
gtcgcacgtctggaagagccgccgc

SEQ ID NO: 384586 - DNA, 25 bp, Mus musculus
ccgtcgccgtcgcacgtctggaaga

SEQ ID NO: 384587 - DNA, 25 bp, Mus musculus
tgctgatgtagccatcgccgtcgcc

SEQ ID NO: 384588 - DNA, 25 bp, Mus musculus
ggagctcccggctaccgattccacc

SEQ ID NO: 384589 - DNA, 25 bp, Mus musculus
ggacctgcaccgctcacaaacgctg

SEQ ID NO: 384590 - DNA, 25 bp, Mus musculus
gaagatcgccgtcaacatcgctctg

SEQ ID NO: 384591 - DNA, 25 bp, Mus musculus
tttgtgactctagcgctgggcagaa

SEQ ID NO: 384592 - DNA, 25 bp, Mus musculus
gcattagatgatcgagtgggtaacc

SEQ ID NO: 384593 - DNA, 25 bp, Mus musculus
tgggtaaccgaaataatatgtcctc

SEQ ID NO: 384594 - DNA, 25 bp, Mus musculus
gtcctccaattaaatgacacttttg

SEQ ID NO: 384595 - DNA, 25 bp, Mus musculus
agcttctctgggttagagtggtgcc

SEQ ID NO: 384596 - DNA, 25 bp, Mus musculus
tgtcttccgagcgttcagtccgccg

SEQ ID NO: 384597 - DNA, 25 bp, Mus musculus
accggctctcttgtctctgtcactg

SEQ ID NO: 384598 - DNA, 25 bp, Mus musculus
tctgtcactgctcgctggcagcagg

SEQ ID NO: 384599 - DNA, 25 bp, Mus musculus
ctcagggccatgtccaggccgagca

SEQ ID NO: 384600 - DNA, 25 bp, Mus musculus
tatcgacgaggaggtgaagatcgcc

SEQ ID NO: 384601 - DNA, 25 bp, Mus musculus
gcgcttccgctacggtgaccagaga

SEQ ID NO: 384602 - DNA, 25 bp, Mus musculus
ccggccgcagaggtgaaaccagcgc

SEQ ID NO: 384603 - DNA, 25 bp, Mus musculus
caagggcctcaaagacattcgtatc

SEQ ID NO: 384604 - DNA, 25 bp, Mus musculus
gtggtatctgaagaccatgagcttc

SEQ ID NO: 384605 - DNA, 25 bp, Mus musculus
cttagagggcttgatgccaggttca

SEQ ID NO: 384606 - DNA, 25 bp, Mus musculus
cttgatgccaggttcacgcaggtcc

SEQ ID NO: 384607 - DNA, 25 bp, Mus musculus
agcggtgacagggtcatgtattttc

SEQ ID NO: 384608 - DNA, 25 bp, Mus musculus
cagggtcatgtattttcaatagaaa

SEQ ID NO: 384609 - DNA, 25 bp, Mus musculus
ttcaatagaaaagaaagaattattc

SEQ ID NO: 384610 - DNA, 25 bp, Mus musculus
tcagtgtggtatctgaagaccatga

SEQ ID NO: 384611 - DNA, 25 bp, Mus musculus
gaccatgagcttcggtagcatactg

SEQ ID NO: 384612 - DNA, 25 bp, Mus musculus
gcatactgggcacacctaccttcta

SEQ ID NO: 384613 - DNA, 25 bp, Mus musculus
tgggcacacctaccttctatcttta

SEQ ID NO: 384614 - DNA, 25 bp, Mus musculus
accttctatctttaggcctcattga

SEQ ID NO: 384615 - DNA, 25 bp, Mus musculus
ctatctttaggcctcattgactata

SEQ ID NO: 384616 - DNA, 25 bp, Mus musculus
attggccatgggagtcttagagggc

SEQ ID NO: 384617 - DNA, 25 bp, Mus musculus
ttcggtagcatactgggcacaccta

SEQ ID NO: 384618 - DNA, 25 bp, Mus musculus
cccttcaccgaaatagccatgagca

SEQ ID NO: 384619 - DNA, 25 bp, Mus musculus
cagcagcggcaccaagtccagcaaa

SEQ ID NO: 384620 - DNA, 25 bp, Mus musculus
attctaacaacctggcgctctacgg

SEQ ID NO: 384621 - DNA, 25 bp, Mus musculus
agccggagcacaacaattctaacaa

SEQ ID NO: 384622 - DNA, 25 bp, Mus musculus
tggtctccctgcagctttaacagct

SEQ ID NO: 384623 - DNA, 25 bp, Mus musculus
attgcagttccagcgcggcttcttc

SEQ ID NO: 384624 - DNA, 25 bp, Mus musculus
acctgcattgccagcagcagcaaca

SEQ ID NO: 384625 - DNA, 25 bp, Mus musculus
ccactgtcgggctcttcgtgctgtt

SEQ ID NO: 384626 - DNA, 25 bp, Mus musculus
catgccagtgcgctccggcagcagt

SEQ ID NO: 384627 - DNA, 25 bp, Mus musculus
gtcatgcgtccgctcagcaacttga

SEQ ID NO: 384628 - DNA, 25 bp, Mus musculus
agcaacttgagctcgtcccgccgga

SEQ ID NO: 384629 - DNA, 25 bp, Mus musculus
atcgtggtgtctaagccggagcaca

SEQ ID NO: 384630 - DNA, 25 bp, Mus musculus
cccgccggaacctgcaggagatgga

SEQ ID NO: 384631 - DNA, 25 bp, Mus musculus
ctcaatgtgagcgagctgacgccgt

SEQ ID NO: 384632 - DNA, 25 bp, Mus musculus
accgaagccggcgagggcatcactt

SEQ ID NO: 384633 - DNA, 25 bp, Mus musculus
ctctctgtgctgcaacgagtgggcg

SEQ ID NO: 384634 - DNA, 25 bp, Mus musculus
ccaccgcgcgtaaggtgttctccag

SEQ ID NO: 384635 - DNA, 25 bp, Mus musculus
gtgttctccaggtagcgccggcacc

SEQ ID NO: 384636 - DNA, 25 bp, Mus musculus
tcgtccgcccgccaagaggaggaag

SEQ ID NO: 384637 - DNA, 25 bp, Mus musculus
agcagcccggagctgtggctagcca

SEQ ID NO: 384638 - DNA, 25 bp, Mus musculus
ctgtggctagccagacggtgcgtct

SEQ ID NO: 384639 - DNA, 25 bp, Mus musculus
gagggcatcactttctccgtgccgc

SEQ ID NO: 384640 - DNA, 25 bp, Mus musculus
ccctggctctctgtgctgcaacgag

SEQ ID NO: 384641 - DNA, 25 bp, Mus musculus
cgccctttgcgtccgtgggcttttg

SEQ ID NO: 384642 - DNA, 25 bp, Mus musculus
cgtgggcttttgcaccatcccggag

SEQ ID NO: 384643 - DNA, 25 bp, Mus musculus
agggagagccgagcctgcagccctt

SEQ ID NO: 384644 - DNA, 25 bp, Mus musculus
gagcctgcagcccttgcttgtgccg

SEQ ID NO: 384645 - DNA, 25 bp, Mus musculus
caccgccgggcagtttctggaacgt

SEQ ID NO: 384646 - DNA, 25 bp, Mus musculus
ctccgccgggtgacattaaccacgg

SEQ ID NO: 384647 - DNA, 25 bp, Mus musculus
acaaggctcccagccggtgtcagga

SEQ ID NO: 384648 - DNA, 25 bp, Mus musculus
gctccagacaaagggcggcacgctg

SEQ ID NO: 384649 - DNA, 25 bp, Mus musculus
caaagcgactacttctgcaggcaga

SEQ ID NO: 384650 - DNA, 25 bp, Mus musculus
tctcaagagcagaaaaaggcgccgc

SEQ ID NO: 384651 - DNA, 25 bp, Mus musculus
accagccgggagagaacaaccaaga

SEQ ID NO: 384652 - DNA, 25 bp, Mus musculus
tgcgtacctgagagtctgaggcatc

SEQ ID NO: 384653 - DNA, 25 bp, Mus musculus
accacggagtctttacaggcgcagc

SEQ ID NO: 384654 - DNA, 25 bp, Mus musculus
ctcgctagggcacccggagtctaaa

SEQ ID NO: 384655 - DNA, 25 bp, Mus musculus
cggcgccctggtccatttcactttt

SEQ ID NO: 384656 - DNA, 25 bp, Mus musculus
tttctgagggcgttcccaaagtgcg

SEQ ID NO: 384657 - DNA, 25 bp, Mus musculus
cgcgcgaaagcacggagaccagtga

SEQ ID NO: 384658 - DNA, 25 bp, Mus musculus
agaccagtgacgctcccagggaact

SEQ ID NO: 384659 - DNA, 25 bp, Mus musculus
caaccaagagttaagtgcgtacctg

SEQ ID NO: 384660 - DNA, 25 bp, Mus musculus
ctagtgcggagcacagacccgattc

SEQ ID NO: 384661 - DNA, 25 bp, Mus musculus
cattgtgtgcagctgggatgcgcta

SEQ ID NO: 384662 - DNA, 25 bp, Mus musculus
cccagcacgggaccgctccgatgcc

SEQ ID NO: 384663 - DNA, 25 bp, Mus musculus
aaggcagccacggtgcattgtgtgc

SEQ ID NO: 384664 - DNA, 25 bp, Mus musculus
cttcgacataaagaaaaggcagcca

SEQ ID NO: 384665 - DNA, 25 bp, Mus musculus
gctcctccaactagctctacgagtc

SEQ ID NO: 384666 - DNA, 25 bp, Mus musculus
ggcagccctttagtttccatcctct

SEQ ID NO: 384667 - DNA, 25 bp, Mus musculus
gtccggcagccctttagtttccatc

SEQ ID NO: 384668 - DNA, 25 bp, Mus musculus
ccaagtctctgtgctgtccggcagc

SEQ ID NO: 384669 - DNA, 25 bp, Mus musculus
acccattccaagtctctgtgctgtc

SEQ ID NO: 384670 - DNA, 25 bp, Mus musculus
tgagataacggatcggcggaccctc

SEQ ID NO: 384671 - DNA, 25 bp, Mus musculus
tgcctcccggcctctgagataacgg

SEQ ID NO: 384672 - DNA, 25 bp, Mus musculus
tcccggcctctgagataacggatcg

SEQ ID NO: 384673 - DNA, 25 bp, Mus musculus
agacccgattccagcttgtgtgccc

SEQ ID NO: 384674 - DNA, 25 bp, Mus musculus
acccaccgcgatccggaagcagttg

SEQ ID NO: 384675 - DNA, 25 bp, Mus musculus
catgctgctccggaagtgacaccca

SEQ ID NO: 384676 - DNA, 25 bp, Mus musculus
gcaggaaatccagccgttctccttc

SEQ ID NO: 384677 - DNA, 25 bp, Mus musculus
ggtcccgcaggaaatccagccgttc

SEQ ID NO: 384678 - DNA, 25 bp, Mus musculus
cgcacgtgccggtcccgcaggaaat

SEQ ID NO: 384679 - DNA, 25 bp, Mus musculus
agcgctgaaagaaccgcacgtgccg

SEQ ID NO: 384680 - DNA, 25 bp, Mus musculus
ctggaggcagcgctgaaagaaccgc

SEQ ID NO: 384681 - DNA, 25 bp, Mus musculus
ataccgctccggcaagacctggagg

SEQ ID NO: 384682 - DNA, 25 bp, Mus musculus
cgaggaataccgctccggcaagacc

SEQ ID NO: 384683 - DNA, 25 bp, Mus musculus
tggtctccagcgaggaataccgctc

SEQ ID NO: 384684 - DNA, 25 bp, Mus musculus
gttacctgctggtctccagcgagga

SEQ ID NO: 384685 - DNA, 25 bp, Mus musculus
cgcggcagcgtccagttacctgctg

SEQ ID NO: 384686 - DNA, 25 bp, Mus musculus
caacccggcaggtcccggcagtcca

SEQ ID NO: 384687 - DNA, 25 bp, Mus musculus
cctcggacaaggcagagatcgcggt

SEQ ID NO: 384688 - DNA, 25 bp, Mus musculus
ctgaaccttactgaggggcaaggtg

SEQ ID NO: 384689 - DNA, 25 bp, Mus musculus
ggctccgagcgccttcaaacgcagg

SEQ ID NO: 384690 - DNA, 25 bp, Mus musculus
agcaaggccggagcctccgcggtta

SEQ ID NO: 384691 - DNA, 25 bp, Mus musculus
ctccgcggttacctgttgcggcgtc

SEQ ID NO: 384692 - DNA, 25 bp, Mus musculus
ccaccgtagtcagagccgccatgtt

SEQ ID NO: 384693 - DNA, 25 bp, Mus musculus
gagccgccatgtttcctcgtcgaga

SEQ ID NO: 384694 - DNA, 25 bp, Mus musculus
atgtttcctcgtcgagactcccgcg

SEQ ID NO: 384695 - DNA, 25 bp, Mus musculus
ggatcggctcccgtgggcgttctcc

SEQ ID NO: 384696 - DNA, 25 bp, Mus musculus
gttctcccacgctccgcacactgtt

SEQ ID NO: 384697 - DNA, 25 bp, Mus musculus
tgttccgaaccgctggaccactggg

SEQ ID NO: 384698 - DNA, 25 bp, Mus musculus
tggctacatggggacaggcagcttg

SEQ ID NO: 384699 - DNA, 25 bp, Mus musculus
gggtactgaaccttactgaggggca

SEQ ID NO: 384700 - DNA, 25 bp, Mus musculus
tggacacggggtggtgtaacgcaac

SEQ ID NO: 384701 - DNA, 25 bp, Mus musculus
ccggtgagggtactgaaccttactg

SEQ ID NO: 384702 - DNA, 25 bp, Mus musculus
cggatacgcagaccggaccgcagtt

SEQ ID NO: 384703 - DNA, 25 bp, Mus musculus
gccgtctagacaccagtgcgcttct

SEQ ID NO: 384704 - DNA, 25 bp, Mus musculus
tgtctgatcgtctgcgccgtctaga

SEQ ID NO: 384705 - DNA, 25 bp, Mus musculus
aagcacgccggcacgctgtctgatc

SEQ ID NO: 384706 - DNA, 25 bp, Mus musculus
tccgcagcgttgcacgacaaccgtg

SEQ ID NO: 384707 - DNA, 25 bp, Mus musculus
ggtcgctgatgtgctgcagattgca

SEQ ID NO: 384708 - DNA, 25 bp, Mus musculus
cttccgcaagcggttccggttcacg

SEQ ID NO: 384709 - DNA, 25 bp, Mus musculus
accgtgttcttgttcagcgctccgc

SEQ ID NO: 384710 - DNA, 25 bp, Mus musculus
gcaggcggctacagctaccgacaga

SEQ ID NO: 384711 - DNA, 25 bp, Mus musculus
ctggacgacacgcagcacgaagttg

SEQ ID NO: 384712 - DNA, 25 bp, Mus musculus
agccagtgtcctcacggctgaggtc

SEQ ID NO: 384713 - DNA, 25 bp, Mus musculus
gagcagcaaggctccgagtcctgca

SEQ ID NO: 384714 - DNA, 25 bp, Mus musculus
accgtcgatgttttcccggtcgctg

SEQ ID NO: 384715 - DNA, 25 bp, Mus musculus
ggcttgcaacatttccgcctctctg

SEQ ID NO: 384716 - DNA, 25 bp, Mus musculus
atgcgccgtgagcaacccggtgaag

SEQ ID NO: 384717 - DNA, 25 bp, Mus musculus
gcagcgacggtcacggtgcaacccg

SEQ ID NO: 384718 - DNA, 25 bp, Mus musculus
cgatgactccgttgttgggccgcac

SEQ ID NO: 384719 - DNA, 25 bp, Mus musculus
ttgttgggccgcacgcagtagcgcc

SEQ ID NO: 384720 - DNA, 25 bp, Mus musculus
gagggctggtgctcttcaccttgaa

SEQ ID NO: 384721 - DNA, 25 bp, Mus musculus
tgctcttcaccttgaaacacacctt

SEQ ID NO: 384722 - DNA, 25 bp, Mus musculus
cttcctcgccgacgggttgcgcagt

SEQ ID NO: 384723 - DNA, 25 bp, Mus musculus
cgacgggttgcgcagtttaagatgc

SEQ ID NO: 384724 - DNA, 25 bp, Mus musculus
ttaagatgcgccgtgagcaacccgg

SEQ ID NO: 384725 - DNA, 25 bp, Mus musculus
tgcaacccgggtcgatgactccgtt

SEQ ID NO: 384726 - DNA, 25 bp, Mus musculus
ctccgcgtcacaaccgccgtggcca

SEQ ID NO: 384727 - DNA, 25 bp, Mus musculus
cctttgaacttgaggtccgtgggtg

SEQ ID NO: 384728 - DNA, 25 bp, Mus musculus
tgaaggggcctttgaacttgaggtc

SEQ ID NO: 384729 - DNA, 25 bp, Mus musculus
cgcagtttaagatgcgccgtgagca

SEQ ID NO: 384730 - DNA, 25 bp, Mus musculus
aaggtcagacgcaccaactctcggc

SEQ ID NO: 384731 - DNA, 25 bp, Mus musculus
acgcgaggcgctcaggaaatccgcc

SEQ ID NO: 384732 - DNA, 25 bp, Mus musculus
ttcaaactacgcgaggcgctcagga

SEQ ID NO: 384733 - DNA, 25 bp, Mus musculus
ttcttcccttcaaactacgcgaggc

SEQ ID NO: 384734 - DNA, 25 bp, Mus musculus
cacgctaagacctcgccggaaaagg

SEQ ID NO: 384735 - DNA, 25 bp, Mus musculus
cgcccagtagcgagtaaccgaaagg

SEQ ID NO: 384736 - DNA, 25 bp, Mus musculus
aactctcggcctgctcacgctaaga

SEQ ID NO: 384737 - DNA, 25 bp, Mus musculus
ttcgacaaggaacaaaaaggtcaga

SEQ ID NO: 384738 - DNA, 25 bp, Mus musculus
ccaggatgggtttcgacaaggaaca

SEQ ID NO: 384739 - DNA, 25 bp, Mus musculus
tctgcagcgaactcgccaagggcgc

SEQ ID NO: 384740 - DNA, 25 bp, Mus musculus
ttccttgcatctgcagcgaactcgc

SEQ ID NO: 384741 - DNA, 25 bp, Mus musculus
cagtagcgagtaaccgaaaggggca

SEQ ID NO: 384742 - DNA, 25 bp, Mus musculus
tgctcacgctaagacctcgccggaa

SEQ ID NO: 384743 - DNA, 25 bp, Mus musculus
aggtttcttccttgcatctgcagcg

SEQ ID NO: 384744 - DNA, 25 bp, Mus musculus
cctgcgtactaagggagaggcgtgg

SEQ ID NO: 384745 - DNA, 25 bp, Mus musculus
agttcgctccttcacattactgacg

SEQ ID NO: 384746 - DNA, 25 bp, Mus musculus
ccgcagccgcgccattgggtcgagg

SEQ ID NO: 384747 - DNA, 25 bp, Mus musculus
cggccgccgccagcaaccgcctagg

SEQ ID NO: 384748 - DNA, 25 bp, Mus musculus
ccagcaaccgcctaggggcggggca

SEQ ID NO: 384749 - DNA, 25 bp, Mus musculus
ccctggaaaatgcacctgcgtgcta

SEQ ID NO: 384750 - DNA, 25 bp, Mus musculus
gggcctgagagctccctggaaaatg

SEQ ID NO: 384751 - DNA, 25 bp, Mus musculus
cctgagagctccctggaaaatgcac

SEQ ID NO: 384752 - DNA, 25 bp, Mus musculus
gagctccctggaaaatgcacctgcg

SEQ ID NO: 384753 - DNA, 25 bp, Mus musculus
gctccctggaaaatgcacctgcgtg

SEQ ID NO: 384754 - DNA, 25 bp, Mus musculus
tgcacctgcgtgctacggaaagggc

SEQ ID NO: 384755 - DNA, 25 bp, Mus musculus
aatgcacctgcgtgctacggaaagg

SEQ ID NO: 384756 - DNA, 25 bp, Mus musculus
ggaaaatgcacctgcgtgctacgga

SEQ ID NO: 384757 - DNA, 25 bp, Mus musculus
ttcacattactgacgccgcagccgc

SEQ ID NO: 384758 - DNA, 25 bp, Mus musculus
tccgcggtgcgtgggcggcgctcct

SEQ ID NO: 384759 - DNA, 25 bp, Mus musculus
tccagtgacccggatgtggtatctg

SEQ ID NO: 384760 - DNA, 25 bp, Mus musculus
ccagtgacccggatgtggtatctgg

SEQ ID NO: 384761 - DNA, 25 bp, Mus musculus
gaaggcgaggcgatgcagtgaggac

SEQ ID NO: 384762 - DNA, 25 bp, Mus musculus
atgcagtgaggacgtggaagcgcgt

SEQ ID NO: 384763 - DNA, 25 bp, Mus musculus
ccagtgccgggaagtcgacggaaag

SEQ ID NO: 384764 - DNA, 25 bp, Mus musculus
taggaagggcgcgtcgtctctctgc

SEQ ID NO: 384765 - DNA, 25 bp, Mus musculus
aagggcgcgtcgtctctctgctcgt

SEQ ID NO: 384766 - DNA, 25 bp, Mus musculus
gtcgtctctctgctcgtccggctgt

SEQ ID NO: 384767 - DNA, 25 bp, Mus musculus
gtctctctgctcgtccggctgtgac

SEQ ID NO: 384768 - DNA, 25 bp, Mus musculus
ctctctgctcgtccggctgtgacgg

SEQ ID NO: 384769 - DNA, 25 bp, Mus musculus
ctgctcgtccggctgtgacggggaa

SEQ ID NO: 384770 - DNA, 25 bp, Mus musculus
gcgggaccgggacgggctccagtga

SEQ ID NO: 384771 - DNA, 25 bp, Mus musculus
tggccggccgttgcctaggaagggc

SEQ ID NO: 384772 - DNA, 25 bp, Mus musculus
gatcgaatttggcatacaaagccca

SEQ ID NO: 384773 - DNA, 25 bp, Mus musculus
cgctcacctgtattgatcgaatttg

SEQ ID NO: 384774 - DNA, 25 bp, Mus musculus
tacaaagcccactcggcgggattgc

SEQ ID NO: 384775 - DNA, 25 bp, Mus musculus
ggattgctctcgtaggcttccagta

SEQ ID NO: 384776 - DNA, 25 bp, Mus musculus
taggcttccagtacagcctgcacct

SEQ ID NO: 384777 - DNA, 25 bp, Mus musculus
ctcatgtaagatgcggatgaggtcc

SEQ ID NO: 384778 - DNA, 25 bp, Mus musculus
gggcttcagcagctcggtccgttcc

SEQ ID NO: 384779 - DNA, 25 bp, Mus musculus
cggctgcaggctagacaaccacaca

SEQ ID NO: 384780 - DNA, 25 bp, Mus musculus
gagctgaaaatctgagagccgtgca

SEQ ID NO: 384781 - DNA, 25 bp, Mus musculus
cccgccggagctctaacgtgctaga

SEQ ID NO: 384782 - DNA, 25 bp, Mus musculus
ctagctttgcagaagcccgagcgcg

SEQ ID NO: 384783 - DNA, 25 bp, Mus musculus
ttcaacggaggggacctagctttgc

SEQ ID NO: 384784 - DNA, 25 bp, Mus musculus
tctcttctggccagcggcggaggac

SEQ ID NO: 384785 - DNA, 25 bp, Mus musculus
cccgagcgcgctcacctgtattgat

SEQ ID NO: 384786 - DNA, 25 bp, Mus musculus
ttccgggtcccgagtgtgtctgccc

SEQ ID NO: 384787 - DNA, 25 bp, Mus musculus
ctccgcatcggtgagtggcgctcag

SEQ ID NO: 384788 - DNA, 25 bp, Mus musculus
gaggtgacatgacagctcgccatca

SEQ ID NO: 384789 - DNA, 25 bp, Mus musculus
tcagggcggatgacagcattctgct

SEQ ID NO: 384790 - DNA, 25 bp, Mus musculus
tagagaaggaagaggttccgccctg

SEQ ID NO: 384791 - DNA, 25 bp, Mus musculus
gaggagcccgagttcgctcgccgct

SEQ ID NO: 384792 - DNA, 25 bp, Mus musculus
ggcgtccctgtgatcccacggaagc

SEQ ID NO: 384793 - DNA, 25 bp, Mus musculus
tgccttttggggtgactgtagtccc

SEQ ID NO: 384794 - DNA, 25 bp, Mus musculus
tgtagtccctcagtcctacgttctg

SEQ ID NO: 384795 - DNA, 25 bp, Mus musculus
gtcctacgttctgagctcgggctgt

SEQ ID NO: 384796 - DNA, 25 bp, Mus musculus
gtctgcagcggtacaaagcccagtg

SEQ ID NO: 384797 - DNA, 25 bp, Mus musculus
tcccgaagtttgacagggcgacgcc

SEQ ID NO: 384798 - DNA, 25 bp, Mus musculus
gggtgaaaacctggcgctttgtcgc

SEQ ID NO: 384799 - DNA, 25 bp, Mus musculus
tctcctttgtcccttctgagaggga

SEQ ID NO: 384800 - DNA, 25 bp, Mus musculus
ttttgggatgtctagggagcagtcc

SEQ ID NO: 384801 - DNA, 25 bp, Mus musculus
agccgctgttttcctgtcgggcgat

SEQ ID NO: 384802 - DNA, 25 bp, Mus musculus
gtttctccgcctcaaggggcgctgc

SEQ ID NO: 384803 - DNA, 25 bp, Mus musculus
gttctaccagccctatgtgagtatg

SEQ ID NO: 384804 - DNA, 25 bp, Mus musculus
tcttcaacaaccacgggaagccgcg

SEQ ID NO: 384805 - DNA, 25 bp, Mus musculus
agccatgatcaaggccatcctcatc

SEQ ID NO: 384806 - DNA, 25 bp, Mus musculus
gtgagcagccatctgaccacgtacc

SEQ ID NO: 384807 - DNA, 25 bp, Mus musculus
tcgcagcgagttatgaagggcttcc

SEQ ID NO: 384808 - DNA, 25 bp, Mus musculus
agcagtccaggtagatagtatgttg

SEQ ID NO: 384809 - DNA, 25 bp, Mus musculus
ccgacatctttgcttgctgagaggc

SEQ ID NO: 384810 - DNA, 25 bp, Mus musculus
tggaccgctttctgttgtccgcgga

SEQ ID NO: 384811 - DNA, 25 bp, Mus musculus
ttgggccttgacacaggaagcgtca

SEQ ID NO: 384812 - DNA, 25 bp, Mus musculus
accgagtatggagcgctatctagtc

SEQ ID NO: 384813 - DNA, 25 bp, Mus musculus
ggagctgcagcacaacctctgaatc

SEQ ID NO: 384814 - DNA, 25 bp, Mus musculus
tggcttgtcccacttcactatgatc

SEQ ID NO: 384815 - DNA, 25 bp, Mus musculus
tgctcctgctggtgctagtggctct

SEQ ID NO: 384816 - DNA, 25 bp, Mus musculus
tgctggccgcgctgacagccgtgct

SEQ ID NO: 384817 - DNA, 25 bp, Mus musculus
ttcagctccggcgtctatgtgagcc

SEQ ID NO: 384818 - DNA, 25 bp, Mus musculus
cacgggtcgcgtgaacatcacggta

SEQ ID NO: 384819 - DNA, 25 bp, Mus musculus
ccgaatttgaccttcacgggtcgcg

SEQ ID NO: 384820 - DNA, 25 bp, Mus musculus
cacggtggggacctcccaagacttg

SEQ ID NO: 384821 - DNA, 25 bp, Mus musculus
tggctgcagccggataagctgtccc

SEQ ID NO: 384822 - DNA, 25 bp, Mus musculus
gcttccttgtatggcagctgcgctc

SEQ ID NO: 384823 - DNA, 25 bp, Mus musculus
gggtttaacccgctgtctgtcgcta

SEQ ID NO: 384824 - DNA, 25 bp, Mus musculus
tgtcgctagtctccgagttctccta

SEQ ID NO: 384825 - DNA, 25 bp, Mus musculus
gggccctgggatcatctgcgcctgc

SEQ ID NO: 384826 - DNA, 25 bp, Mus musculus
agaacacctcattgtggcctcccgg

SEQ ID NO: 384827 - DNA, 25 bp, Mus musculus
actatgatctggagctgtggccctg

SEQ ID NO: 384828 - DNA, 25 bp, Mus musculus
gccgtgattggctggactgtgcaca

SEQ ID NO: 384829 - DNA, 25 bp, Mus musculus
tggcggcgtccgcagcgctgatcct

SEQ ID NO: 384830 - DNA, 25 bp, Mus musculus
cttcggaaattaaacgcacagcatc

SEQ ID NO: 384831 - DNA, 25 bp, Mus musculus
cgcacaagccttcggaaattaaacg

SEQ ID NO: 384832 - DNA, 25 bp, Mus musculus
cggaccacgcacaagccttcggaaa

SEQ ID NO: 384833 - DNA, 25 bp, Mus musculus
cgcacagcatctcgaggtctcaaac

SEQ ID NO: 384834 - DNA, 25 bp, Mus musculus
gaggaacttcccagggcgcagagta

SEQ ID NO: 384835 - DNA, 25 bp, Mus musculus
ctgcggaggaacttcccagggcgca

SEQ ID NO: 384836 - DNA, 25 bp, Mus musculus
gcagcgctgatcctgcccgagagcc

SEQ ID NO: 384837 - DNA, 25 bp, Mus musculus
taaacgcacagcatctcgaggtctc

SEQ ID NO: 384838 - DNA, 25 bp, Mus musculus
tcaaacctgcccggcggcgagactt

SEQ ID NO: 384839 - DNA, 25 bp, Mus musculus
agcatctcgaggtctcaaacctgcc

SEQ ID NO: 384840 - DNA, 25 bp, Mus musculus
actgtgcacagctgacagtcgcgcg

SEQ ID NO: 384841 - DNA, 25 bp, Mus musculus
ggtttccgtcaggcgcgccgtgatt

SEQ ID NO: 384842 - DNA, 25 bp, Mus musculus
ccgctcaattcgttcggtctcagaa

SEQ ID NO: 384843 - DNA, 25 bp, Mus musculus
gggagacctcagatcctgcttcata

SEQ ID NO: 384844 - DNA, 25 bp, Mus musculus
ctggctctatacagcccgcgggaga

SEQ ID NO: 384845 - DNA, 25 bp, Mus musculus
gggtccggcttctctcactgacaca

SEQ ID NO: 384846 - DNA, 25 bp, Mus musculus
aagcgcctggtacagggaccctgca

SEQ ID NO: 384847 - DNA, 25 bp, Mus musculus
tttccgggagtcttaagctatcaca

SEQ ID NO: 384848 - DNA, 25 bp, Mus musculus
gagccctcagctggtgtttccggga

SEQ ID NO: 384849 - DNA, 25 bp, Mus musculus
actgcccacttctgcacaggctgga

SEQ ID NO: 384850 - DNA, 25 bp, Mus musculus
aacgcttgcccaggctaggaggaca

SEQ ID NO: 384851 - DNA, 25 bp, Mus musculus
cagcgagctagagccagtgtccaca

SEQ ID NO: 384852 - DNA, 25 bp, Mus musculus
acacgcgccctcacagtagcttatg

SEQ ID NO: 384853 - DNA, 25 bp, Mus musculus
agtagcttatgtccgccacttgtgg

SEQ ID NO: 384854 - DNA, 25 bp, Mus musculus
gcgggtcaggaggtaccattctcca

SEQ ID NO: 384855 - DNA, 25 bp, Mus musculus
ttcatacactgtctccctccgtgga

SEQ ID NO: 384856 - DNA, 25 bp, Mus musculus
attaactagtcatttcagggcgggg

SEQ ID NO: 384857 - DNA, 25 bp, Mus musculus
agcccggcttcctatcacttcaatt

SEQ ID NO: 384858 - DNA, 25 bp, Mus musculus
ggtgccagcgcccattaactagtca

SEQ ID NO: 384859 - DNA, 25 bp, Mus musculus
atctcgggcaatcggcaccgcggaa

SEQ ID NO: 384860 - DNA, 25 bp, Mus musculus
agcggagttggctgcagcctcaccc

SEQ ID NO: 384861 - DNA, 25 bp, Mus musculus
cgtgcggcacactactcctgtgtca

SEQ ID NO: 384862 - DNA, 25 bp, Mus musculus
tcctgtgtcactggagaggccgacg

SEQ ID NO: 384863 - DNA, 25 bp, Mus musculus
caagtcccggactggattgcgcaga

SEQ ID NO: 384864 - DNA, 25 bp, Mus musculus
ttgcgcagagcggactctcctccag

SEQ ID NO: 384865 - DNA, 25 bp, Mus musculus
tcctccgacccgaaggagagctgtg

SEQ ID NO: 384866 - DNA, 25 bp, Mus musculus
cgagccaaaggaaaaggagacctgc

SEQ ID NO: 384867 - DNA, 25 bp, Mus musculus
agacctgctgccgtgcgactgcagg

SEQ ID NO: 384868 - DNA, 25 bp, Mus musculus
caccgcggaaaagcgcctgtgctgc

SEQ ID NO: 384869 - DNA, 25 bp, Mus musculus
tggagctttggactgagtcgccagc

SEQ ID NO: 384870 - DNA, 25 bp, Mus musculus
ccgagtgagtttgtcgagcttgcca

SEQ ID NO: 384871 - DNA, 25 bp, Mus musculus
tttctctagaatgcaggtcgggctg

SEQ ID NO: 384872 - DNA, 25 bp, Mus musculus
cagcagagtgcagaacgggacgcta

SEQ ID NO: 384873 - DNA, 25 bp, Mus musculus
gactggaacgctgaaggctgccatg

SEQ ID NO: 384874 - DNA, 25 bp, Mus musculus
acactggtacgacttctccgggcgg

SEQ ID NO: 384875 - DNA, 25 bp, Mus musculus
gtcctcagtcaccatgaaaggtagg

SEQ ID NO: 384876 - DNA, 25 bp, Mus musculus
gcagccgtctttggggctcacggaa

SEQ ID NO: 384877 - DNA, 25 bp, Mus musculus
caggcgctctccttttcgtcggtct

SEQ ID NO: 384878 - DNA, 25 bp, Mus musculus
cgtcggtctcctcagtcctttagaa

SEQ ID NO: 384879 - DNA, 25 bp, Mus musculus
tgcggaggagatttaggcatcatca

SEQ ID NO: 384880 - DNA, 25 bp, Mus musculus
ggcatcatcattcttccgagtgagt

SEQ ID NO: 384881 - DNA, 25 bp, Mus musculus
tcacactgccacaggccggctgttt

SEQ ID NO: 384882 - DNA, 25 bp, Mus musculus
gcgagaggggttctacggatttctc

SEQ ID NO: 384883 - DNA, 25 bp, Mus musculus
gcgcggcacatctggcaacgattag

SEQ ID NO: 384884 - DNA, 25 bp, Mus musculus
ccagcggtgcgtccactggcatcta

SEQ ID NO: 384885 - DNA, 25 bp, Mus musculus
gtccactggcatctacgaggcccta

SEQ ID NO: 384886 - DNA, 25 bp, Mus musculus
aaggtctcttccgagctgcggtgcc

SEQ ID NO: 384887 - DNA, 25 bp, Mus musculus
ccgcaaaaggtctcttccgagctgc

SEQ ID NO: 384888 - DNA, 25 bp, Mus musculus
cgatcctactgccagaaattcgcca

SEQ ID NO: 384889 - DNA, 25 bp, Mus musculus
ctgccagaaattcgccatgtctatt

SEQ ID NO: 384890 - DNA, 25 bp, Mus musculus
ttcgccatgtctattctcaggatcc

SEQ ID NO: 384891 - DNA, 25 bp, Mus musculus
gtctattctcaggatccacgccaga

SEQ ID NO: 384892 - DNA, 25 bp, Mus musculus
ccgtgggaatcccactgttgaggtc

SEQ ID NO: 384893 - DNA, 25 bp, Mus musculus
gagatctttgactcccgtgggaatc

SEQ ID NO: 384894 - DNA, 25 bp, Mus musculus
tggcatctacgaggccctagaactc

SEQ ID NO: 384895 - DNA, 25 bp, Mus musculus
gtcgatctgtacaccgcaaaaggtc

SEQ ID NO: 384896 - DNA, 25 bp, Mus musculus
cccactgttgaggtcgatctgtaca

SEQ ID NO: 384897 - DNA, 25 bp, Mus musculus
tccacgccagagagatctttgactc

SEQ ID NO: 384898 - DNA, 25 bp, Mus musculus
gcgcaaagtgtaggagtcgcctgca

SEQ ID NO: 384899 - DNA, 25 bp, Mus musculus
tctaggcagcatcgccgggttctag

SEQ ID NO: 384900 - DNA, 25 bp, Mus musculus
acaacgtgaaattctaggcagcatc

SEQ ID NO: 384901 - DNA, 25 bp, Mus musculus
tgcgcagttctctgtatttaaaaga

SEQ ID NO: 384902 - DNA, 25 bp, Mus musculus
ctgcagaagccaccctgacgctttg

SEQ ID NO: 384903 - DNA, 25 bp, Mus musculus
ctgcctgggtaaggttaggcgcaaa

SEQ ID NO: 384904 - DNA, 25 bp, Mus musculus
gtgtgttgggttgcttctcctacgg

SEQ ID NO: 384905 - DNA, 25 bp, Mus musculus
ccattgcagaaagataagaagccta

SEQ ID NO: 384906 - DNA, 25 bp, Mus musculus
ctcagaggtgccgtgaggtccctcc

SEQ ID NO: 384907 - DNA, 25 bp, Mus musculus
agagtcaggccctcgcatggaagga

SEQ ID NO: 384908 - DNA, 25 bp, Mus musculus
agagttcgctcctcggcctgcggct

SEQ ID NO: 384909 - DNA, 25 bp, Mus musculus
cgtcggtgacgccaaggcgccagaa

SEQ ID NO: 384910 - DNA, 25 bp, Mus musculus
agagcccgtctgcactcgtgctgtc

SEQ ID NO: 384911 - DNA, 25 bp, Mus musculus
cctgacgctttgctctgcgcagttc

SEQ ID NO: 384912 - DNA, 25 bp, Mus musculus
ggagcagtaggtacgtttgcgcctc

SEQ ID NO: 384913 - DNA, 25 bp, Mus musculus
ggcgaccactgcttcgccgtgggca

SEQ ID NO: 384914 - DNA, 25 bp, Mus musculus
gtacgtttgcgcctcgggattggct

SEQ ID NO: 384915 - DNA, 25 bp, Mus musculus
ctcgggattggctcactcacgacta

SEQ ID NO: 384916 - DNA, 25 bp, Mus musculus
ctcacgactagaaaaggcgttgctg

SEQ ID NO: 384917 - DNA, 25 bp, Mus musculus
gaaaaggcgttgctgccgtgtgtcc

SEQ ID NO: 384918 - DNA, 25 bp, Mus musculus
cgtgtgtcccactggccattcggga

SEQ ID NO: 384919 - DNA, 25 bp, Mus musculus
cattcgggagccgtgaaggacttct

SEQ ID NO: 384920 - DNA, 25 bp, Mus musculus
ctcgcgatactttggcgcaagggcc

SEQ ID NO: 384921 - DNA, 25 bp, Mus musculus
aggatcgtgtggacagctcggtccc

SEQ ID NO: 384922 - DNA, 25 bp, Mus musculus
cgaccgaacgtctgcggcttcgggc

SEQ ID NO: 384923 - DNA, 25 bp, Mus musculus
atgaacctgcaccaggtgctgaccg

SEQ ID NO: 384924 - DNA, 25 bp, Mus musculus
ctgcgggactaggacgccgccatga

SEQ ID NO: 384925 - DNA, 25 bp, Mus musculus
cgtgaaggacttctcgcgatacttt

SEQ ID NO: 384926 - DNA, 25 bp, Mus musculus
cgcgcgattcgattcgtcactcctg

SEQ ID NO: 384927 - DNA, 25 bp, Mus musculus
attcgtcactcctgcggaactttcc

SEQ ID NO: 384928 - DNA, 25 bp, Mus musculus
cccgggaggttctgatctcagaggc

SEQ ID NO: 384929 - DNA, 25 bp, Mus musculus
ggttctgatctcagaggcttcctcc

SEQ ID NO: 384930 - DNA, 25 bp, Mus musculus
cggcgcacatctcactcgtctagga

SEQ ID NO: 384931 - DNA, 25 bp, Mus musculus
ccgccaagttcagcgcaggaatgtg

SEQ ID NO: 384932 - DNA, 25 bp, Mus musculus
atctcactcgtctaggagcctcgca

SEQ ID NO: 384933 - DNA, 25 bp, Mus musculus
agcctcacgtccatgtccgtggcgg

SEQ ID NO: 384934 - DNA, 25 bp, Mus musculus
tcacgtccatgtccgtggcggtggc

SEQ ID NO: 384935 - DNA, 25 bp, Mus musculus
ccgacagcatgctctccgaagcgga

SEQ ID NO: 384936 - DNA, 25 bp, Mus musculus
agcccagggaaggtacgccagccgc

SEQ ID NO: 384937 - DNA, 25 bp, Mus musculus
cgattcgattcgtcactcctgcgga

SEQ ID NO: 384938 - DNA, 25 bp, Mus musculus
gctggactccgccaagttcagcgca

SEQ ID NO: 384939 - DNA, 25 bp, Mus musculus
gaaggtacgccagccgctggactcc

SEQ ID NO: 384940 - DNA, 25 bp, Mus musculus
cccaccgaggggcatagagctcttc

SEQ ID NO: 384941 - DNA, 25 bp, Mus musculus
ccgccaatcgatgccaaagctactg

SEQ ID NO: 384942 - DNA, 25 bp, Mus musculus
gtgctggagagcatcgcgaaccgct

SEQ ID NO: 384943 - DNA, 25 bp, Mus musculus
ccttccctgcagagacctagcggtt

SEQ ID NO: 384944 - DNA, 25 bp, Mus musculus
agagacctagcggttgcagtggcca

SEQ ID NO: 384945 - DNA, 25 bp, Mus musculus
gtaaggacgtcccaggaccactcga

SEQ ID NO: 384946 - DNA, 25 bp, Mus musculus
ggacgtcccaggaccactcgagtct

SEQ ID NO: 384947 - DNA, 25 bp, Mus musculus
ggcatagagctcttccgccaatcga

SEQ ID NO: 384948 - DNA, 25 bp, Mus musculus
gcggccaagtgttgtgtacgaagcc

SEQ ID NO: 384949 - DNA, 25 bp, Mus musculus
aagctactgctcttccgccgttttc

SEQ ID NO: 384950 - DNA, 25 bp, Mus musculus
cttctgcgggcctgacctaacggaa

SEQ ID NO: 384951 - DNA, 25 bp, Mus musculus
tgcgggcctgacctaacggaagcgt

SEQ ID NO: 384952 - DNA, 25 bp, Mus musculus
cttacccatggcgtcccaggggtcg

SEQ ID NO: 384953 - DNA, 25 bp, Mus musculus
tggttccttacccatggcgtcccag

SEQ ID NO: 384954 - DNA, 25 bp, Mus musculus
gtgcaggctagactcatggcttcgc

SEQ ID NO: 384955 - DNA, 25 bp, Mus musculus
ccagtttcccgagaccggcaggtca

SEQ ID NO: 384956 - DNA, 25 bp, Mus musculus
cacttggaaccaccggcgccagttt

SEQ ID NO: 384957 - DNA, 25 bp, Mus musculus
gcaggcgcacttggaaccaccggcg

SEQ ID NO: 384958 - DNA, 25 bp, Mus musculus
agggagcttataaggcccacgtctt

SEQ ID NO: 384959 - DNA, 25 bp, Mus musculus
gtcccatgcccggagggagcttata

SEQ ID NO: 384960 - DNA, 25 bp, Mus musculus
aggctagactcatggcttcgccgct

SEQ ID NO: 384961 - DNA, 25 bp, Mus musculus
tgtgcgtggtgcaggctagactcat

SEQ ID NO: 384962 - DNA, 25 bp, Mus musculus
gcagtactcgggacgctgccagtgt

SEQ ID NO: 384963 - DNA, 25 bp, Mus musculus
ttgccgagcagtactcgggacgctg

SEQ ID NO: 384964 - DNA, 25 bp, Mus musculus
tgtcccggtcttgccgagcagtact

SEQ ID NO: 384965 - DNA, 25 bp, Mus musculus
ggcaggtcacttgtttgtgtgccgc

SEQ ID NO: 384966 - DNA, 25 bp, Mus musculus
cccgagaccggcaggtcacttgttt

SEQ ID NO: 384967 - DNA, 25 bp, Mus musculus
ccagcgatccggatagagggactgt

SEQ ID NO: 384968 - DNA, 25 bp, Mus musculus
gtggccaattccattcggagggtct

SEQ ID NO: 384969 - DNA, 25 bp, Mus musculus
cttcatcgcagaggtgcccataata

SEQ ID NO: 384970 - DNA, 25 bp, Mus musculus
ggtcttcatcgcagaggtgcccata

SEQ ID NO: 384971 - DNA, 25 bp, Mus musculus
ccattcggagggtcttcatcgcaga

SEQ ID NO: 384972 - DNA, 25 bp, Mus musculus
gccaattccattcggagggtcttca

SEQ ID NO: 384973 - DNA, 25 bp, Mus musculus
ttcatcgcagaggtgcccataatag

SEQ ID NO: 384974 - DNA, 25 bp, Mus musculus
cattatcgagaacacggacctggcg

SEQ ID NO: 384975 - DNA, 25 bp, Mus musculus
ttcattatcgagaacacggacctgg

SEQ ID NO: 384976 - DNA, 25 bp, Mus musculus
cgtcaagttcattatcgagaacacg

SEQ ID NO: 384977 - DNA, 25 bp, Mus musculus
accgaagagaacgtcaagttcatta

SEQ ID NO: 384978 - DNA, 25 bp, Mus musculus
actcaccgaagagaacgtcaagttc

SEQ ID NO: 384979 - DNA, 25 bp, Mus musculus
gaactcaccgaagagaacgtcaagt

SEQ ID NO: 384980 - DNA, 25 bp, Mus musculus
gagaacgtcaagttcattatcgaga

SEQ ID NO: 384981 - DNA, 25 bp, Mus musculus
attccattcggagggtcttcatcgc

SEQ ID NO: 384982 - DNA, 25 bp, Mus musculus
ctcgctcgcctgtcctgacctggct

SEQ ID NO: 384983 - DNA, 25 bp, Mus musculus
tcggggagttgatggcagcaccaca

SEQ ID NO: 384984 - DNA, 25 bp, Mus musculus
ctcgtcctccgcagccgagggaccg

SEQ ID NO: 384985 - DNA, 25 bp, Mus musculus
tgtcagccaagtccaaggggaaccc

SEQ ID NO: 384986 - DNA, 25 bp, Mus musculus
agaatgtcagccaagtccaagggga

SEQ ID NO: 384987 - DNA, 25 bp, Mus musculus
ccgaagaatgtcagccaagtccaag

SEQ ID NO: 384988 - DNA, 25 bp, Mus musculus
caccgaagaatgtcagccaagtcca

SEQ ID NO: 384989 - DNA, 25 bp, Mus musculus
tgcccgccgagcagtcgacatgtgg

SEQ ID NO: 384990 - DNA, 25 bp, Mus musculus
ctgtcctgacctggcttgctcgccc

SEQ ID NO: 384991 - DNA, 25 bp, Mus musculus
cggagcagcgccagggacccgggcg

SEQ ID NO: 384992 - DNA, 25 bp, Mus musculus
tctcggggagttgatggcagcacca

SEQ ID NO: 384993 - DNA, 25 bp, Mus musculus
cgccgagcgcctcgtctcggggagt

SEQ ID NO: 384994 - DNA, 25 bp, Mus musculus
ctgcccgccgagcagtcgacatgtg

SEQ ID NO: 384995 - DNA, 25 bp, Mus musculus
cccaccgaagaatgtcagccaagtc

SEQ ID NO: 384996 - DNA, 25 bp, Mus musculus
ggctagtcgtacacgcgccggaagt

SEQ ID NO: 384997 - DNA, 25 bp, Mus musculus
gctcaattccggctagtcgtacacg

SEQ ID NO: 384998 - DNA, 25 bp, Mus musculus
acgcagccgcggtgcaatcgccggt

SEQ ID NO: 384999 - DNA, 25 bp, Mus musculus
cgccggaagtcaccgttcccacttg

SEQ ID NO: 385000 - DNA, 25 bp, Mus musculus
tcccacttgcggcactgccggaaaa

SEQ ID NO: 385001 - DNA, 25 bp, Mus musculus
cactgccggaaaatcccaacgtttg

SEQ ID NO: 385002 - DNA, 25 bp, Mus musculus
cgtgcctacgcagccgcggtgcaat

SEQ ID NO: 385003 - DNA, 25 bp, Mus musculus
gagatggcggctgaccctcttcctc

SEQ ID NO: 385004 - DNA, 25 bp, Mus musculus
ctccgtccgcaatggttcagccggg

SEQ ID NO: 385005 - DNA, 25 bp, Mus musculus
ccgcaatggttcagccggggactct

SEQ ID NO: 385006 - DNA, 25 bp, Mus musculus
cagccggggactctgaacctcaata

SEQ ID NO: 385007 - DNA, 25 bp, Mus musculus
acctcaataacgaggtgagcgcgcg

SEQ ID NO: 385008 - DNA, 25 bp, Mus musculus
tgcaatcgccggtgctcacgtgctg

SEQ ID NO: 385009 - DNA, 25 bp, Mus musculus
cggggactctgaacctcaataacga

SEQ ID NO: 385010 - DNA, 25 bp, Mus musculus
gctgggtggcctcagattactgagc

SEQ ID NO: 385011 - DNA, 25 bp, Mus musculus
ggccgccacgtctagacagcactga

SEQ ID NO: 385012 - DNA, 25 bp, Mus musculus
tctaggggtgcttaccgtactggaa

SEQ ID NO: 385013 - DNA, 25 bp, Mus musculus
tactggaagtaaccggtgccgtatc

SEQ ID NO: 385014 - DNA, 25 bp, Mus musculus
cggggcctctcatacgtgtcatagt

SEQ ID NO: 385015 - DNA, 25 bp, Mus musculus
tcagcagactgaacacctgcccgtt

SEQ ID NO: 385016 - DNA, 25 bp, Mus musculus
gtcgtcgcccaccatgcgatctatg

SEQ ID NO: 385017 - DNA, 25 bp, Mus musculus
cgacggcgagaaaccagcttggaac

SEQ ID NO: 385018 - DNA, 25 bp, Mus musculus
cggttgtcacgcagcagaagaatgg

SEQ ID NO: 385019 - DNA, 25 bp, Mus musculus
cgtgccagggcgaacagcagaccct

SEQ ID NO: 385020 - DNA, 25 bp, Mus musculus
cgggactcagatcccacgaaggagg

SEQ ID NO: 385021 - DNA, 25 bp, Mus musculus
gcccaggcgaaacgcatggtgctcc

SEQ ID NO: 385022 - DNA, 25 bp, Mus musculus
tcccattggattgtctggcgccagg

SEQ ID NO: 385023 - DNA, 25 bp, Mus musculus
cgtcggagtacttgtagggattgta

SEQ ID NO: 385024 - DNA, 25 bp, Mus musculus
cgaaggcatggtgatagctacacta

SEQ ID NO: 385025 - DNA, 25 bp, Mus musculus
caataacaaacgtgaaggggatgcc

SEQ ID NO: 385026 - DNA, 25 bp, Mus musculus
gttgtgccaaggctcctaggagctg

SEQ ID NO: 385027 - DNA, 25 bp, Mus musculus
gttacgcttgctgctacctcggatg

SEQ ID NO: 385028 - DNA, 25 bp, Mus musculus
tttcattggcccttgcgctggcgtt

SEQ ID NO: 385029 - DNA, 25 bp, Mus musculus
ctggtgcaggggattgttcttttca

SEQ ID NO: 385030 - DNA, 25 bp, Mus musculus
ctcgcaatccctggctctggtgcag

SEQ ID NO: 385031 - DNA, 25 bp, Mus musculus
acgttgtggtaacccaggcagcttc

SEQ ID NO: 385032 - DNA, 25 bp, Mus musculus
ctgcagagagctacaagaggagaac

SEQ ID NO: 385033 - DNA, 25 bp, Mus musculus
gtgcaactttgcaccgggcgacacc

SEQ ID NO: 385034 - DNA, 25 bp, Mus musculus
gagggcagcccgtgcaactttgcac

SEQ ID NO: 385035 - DNA, 25 bp, Mus musculus
gcgctccggtgagtccaggtcccaa

SEQ ID NO: 385036 - DNA, 25 bp, Mus musculus
aacgcgcgaggtaagcagaagcagc

SEQ ID NO: 385037 - DNA, 25 bp, Mus musculus
tcactgtcggtcctgcctggtggtt

SEQ ID NO: 385038 - DNA, 25 bp, Mus musculus
acgccgcagtgtcgctactacttca

SEQ ID NO: 385039 - DNA, 25 bp, Mus musculus
ccctttctctcgctgaagggactga

SEQ ID NO: 385040 - DNA, 25 bp, Mus musculus
ctggcgctattctttccctttctct

SEQ ID NO: 385041 - DNA, 25 bp, Mus musculus
cgcttttcagtttgccggaggcgcg

SEQ ID NO: 385042 - DNA, 25 bp, Mus musculus
tgggcacgcgcaaccaagatgtctc

SEQ ID NO: 385043 - DNA, 25 bp, Mus musculus
aacctgacgtcatcactgggcgccg

SEQ ID NO: 385044 - DNA, 25 bp, Mus musculus
actctagccgttgccgtctctttgc

SEQ ID NO: 385045 - DNA, 25 bp, Mus musculus
cattaagggaaaggcgcactggcta

SEQ ID NO: 385046 - DNA, 25 bp, Mus musculus
tgagccacaccgcaccggagatctt

SEQ ID NO: 385047 - DNA, 25 bp, Mus musculus
ccactgctagtggagtcccagagcc

SEQ ID NO: 385048 - DNA, 25 bp, Mus musculus
agggcggagctgacaacacgaaaca

SEQ ID NO: 385049 - DNA, 25 bp, Mus musculus
gaaaaccagccttgccgtgcccagg

SEQ ID NO: 385050 - DNA, 25 bp, Mus musculus
agccgtcattcaccctctaggaaaa

SEQ ID NO: 385051 - DNA, 25 bp, Mus musculus
acttcaaagcaagccacttctgcgg

SEQ ID NO: 385052 - DNA, 25 bp, Mus musculus
cggctgcaccgcaggtgcctgtcaa

SEQ ID NO: 385053 - DNA, 25 bp, Mus musculus
cgtgccctgcgtggacagttagttc

SEQ ID NO: 385054 - DNA, 25 bp, Mus musculus
ccaggaagtcgggaagtgaactctt

SEQ ID NO: 385055 - DNA, 25 bp, Mus musculus
ccctgccacgggagagccaggaagt

SEQ ID NO: 385056 - DNA, 25 bp, Mus musculus
ggctgaggtgcttgtttctctgccc

SEQ ID NO: 385057 - DNA, 25 bp, Mus musculus
tccaggcaggagcaaggcttgtctc

SEQ ID NO: 385058 - DNA, 25 bp, Mus musculus
tgtcaaggggcctgatgtcggccta

SEQ ID NO: 385059 - DNA, 25 bp, Mus musculus
gtgacacctgtgacgccggctgcac

SEQ ID NO: 385060 - DNA, 25 bp, Mus musculus
agcaccgtctccacccttgaggtga

SEQ ID NO: 385061 - DNA, 25 bp, Mus musculus
gacggagaggacctgttcaccagca

SEQ ID NO: 385062 - DNA, 25 bp, Mus musculus
cttgcagacgtccaggccaagaggc

SEQ ID NO: 385063 - DNA, 25 bp, Mus musculus
ccagccttgcgtgctcacgtgacag

SEQ ID NO: 385064 - DNA, 25 bp, Mus musculus
tcggagctctagaaaaagcgcggcc

SEQ ID NO: 385065 - DNA, 25 bp, Mus musculus
acggaagccaacctacccgtgcttg

SEQ ID NO: 385066 - DNA, 25 bp, Mus musculus
ttgcccatcagaacgaaagccgaag

SEQ ID NO: 385067 - DNA, 25 bp, Mus musculus
acagcgatctggagcgcggctacac

SEQ ID NO: 385068 - DNA, 25 bp, Mus musculus
cagccacattgatgcggtgcgattc

SEQ ID NO: 385069 - DNA, 25 bp, Mus musculus
gcggtgcgattctattctcaggctg

SEQ ID NO: 385070 - DNA, 25 bp, Mus musculus
ttctcaggctgggaaggcttagcta

SEQ ID NO: 385071 - DNA, 25 bp, Mus musculus
cttagctagctgaacggggcgcagc

SEQ ID NO: 385072 - DNA, 25 bp, Mus musculus
tgaacggggcgcagcaccagaaccc

SEQ ID NO: 385073 - DNA, 25 bp, Mus musculus
tgaaagttggcagggcttgcccatc

SEQ ID NO: 385074 - DNA, 25 bp, Mus musculus
cgcccgcgaggtcgtcatggagact

SEQ ID NO: 385075 - DNA, 25 bp, Mus musculus
cgaaagccgaagcaagctgggcagc

SEQ ID NO: 385076 - DNA, 25 bp, Mus musculus
ccgccgcggccatggaggtctacat

SEQ ID NO: 385077 - DNA, 25 bp, Mus musculus
tggaggtctacatcccgtcctttcg

SEQ ID NO: 385078 - DNA, 25 bp, Mus musculus
ctttcgccacgaggacagcgatctg

SEQ ID NO: 385079 - DNA, 25 bp, Mus musculus
ggcagcatctcgaagcgccgtcttc

SEQ ID NO: 385080 - DNA, 25 bp, Mus musculus
ggacgcctgaggaccccgaagaaga

SEQ ID NO: 385081 - DNA, 25 bp, Mus musculus
gggcgcgctcctcccaagttcaaaa

SEQ ID NO: 385082 - DNA, 25 bp, Mus musculus
tgtggccggacgcttagccgcctgc

SEQ ID NO: 385083 - DNA, 25 bp, Mus musculus
cacgggcgcaaccttaggctccggg

SEQ ID NO: 385084 - DNA, 25 bp, Mus musculus
gagaagtttctgtagccgctggatc

SEQ ID NO: 385085 - DNA, 25 bp, Mus musculus
cccaggcagagcaccgcgggcagca

SEQ ID NO: 385086 - DNA, 25 bp, Mus musculus
ggcgcaaagcggagtaagcctaata

SEQ ID NO: 385087 - DNA, 25 bp, Mus musculus
agtaagcctaatagggcccgcagcg

SEQ ID NO: 385088 - DNA, 25 bp, Mus musculus
gacctcgttttcggacgcctgagga

SEQ ID NO: 385089 - DNA, 25 bp, Mus musculus
atcaccttgtccgtcaccgagggac

SEQ ID NO: 385090 - DNA, 25 bp, Mus musculus
cctggcccgccggagaagtttctgt

SEQ ID NO: 385091 - DNA, 25 bp, Mus musculus
tggatcaccttgtccgtcaccgagg

SEQ ID NO: 385092 - DNA, 25 bp, Mus musculus
tttctgtagccgctggatcaccttg

SEQ ID NO: 385093 - DNA, 25 bp, Mus musculus
atggcacgggcgcaaccttaggctc

SEQ ID NO: 385094 - DNA, 25 bp, Mus musculus
ctaattgtatatgagcgcgagcggc

SEQ ID NO: 385095 - DNA, 25 bp, Mus musculus
tcgctgtgggattgggatttccatc

SEQ ID NO: 385096 - DNA, 25 bp, Mus musculus
gcgagcacaagaccgccacaggcgg

SEQ ID NO: 385097 - DNA, 25 bp, Mus musculus
ccacaggcgggaagcctaaggtgcc

SEQ ID NO: 385098 - DNA, 25 bp, Mus musculus
gaggggtcgccacgagtaccagtcc

SEQ ID NO: 385099 - DNA, 25 bp, Mus musculus
aagaaggacggctctgtaaccaggc

SEQ ID NO: 385100 - DNA, 25 bp, Mus musculus
tgtaaccaggcaacaaggcccaggc

SEQ ID NO: 385101 - DNA, 25 bp, Mus musculus
ccatcgcagcgtagaagggagaaga

SEQ ID NO: 385102 - DNA, 25 bp, Mus musculus
gccctacgtgctgacgctaattgta

SEQ ID NO: 385103 - DNA, 25 bp, Mus musculus
ggctctcgggtcttttttagcgcca

SEQ ID NO: 385104 - DNA, 25 bp, Mus musculus
ttttttagcgccatctgctcgcggc

SEQ ID NO: 385105 - DNA, 25 bp, Mus musculus
cgagcctcctggaacggtaacggct

SEQ ID NO: 385106 - DNA, 25 bp, Mus musculus
cgacacctccgtcggagttggagga

SEQ ID NO: 385107 - DNA, 25 bp, Mus musculus
gttgctacgcaacgccgaggccagg

SEQ ID NO: 385108 - DNA, 25 bp, Mus musculus
aagcaaactccgctgtggggactgg

SEQ ID NO: 385109 - DNA, 25 bp, Mus musculus
tctggcacccaacagcattccggga

SEQ ID NO: 385110 - DNA, 25 bp, Mus musculus
ggatcgtctttagagaccctcgctc

SEQ ID NO: 385111 - DNA, 25 bp, Mus musculus
cggctgaaaagcaaactccgctgtg

SEQ ID NO: 385112 - DNA, 25 bp, Mus musculus
agcattccgggaaaatctgaacccg

SEQ ID NO: 385113 - DNA, 25 bp, Mus musculus
ggcgagtcaactctggcacccaaca

SEQ ID NO: 385114 - DNA, 25 bp, Mus musculus
cttggcgggcgagtcaactctggca

SEQ ID NO: 385115 - DNA, 25 bp, Mus musculus
attcacgctagagatggcttggcgg

SEQ ID NO: 385116 - DNA, 25 bp, Mus musculus
tcggaggattcacgctagagatggc

SEQ ID NO: 385117 - DNA, 25 bp, Mus musculus
ttttttcttcggaggattcacgcta

SEQ ID NO: 385118 - DNA, 25 bp, Mus musculus
ggtttcatgccagcgcacagcgtgc

SEQ ID NO: 385119 - DNA, 25 bp, Mus musculus
gctgagggtttcatgccagcgcaca

SEQ ID NO: 385120 - DNA, 25 bp, Mus musculus
cagcttcgctcaggctgcgggctga

SEQ ID NO: 385121 - DNA, 25 bp, Mus musculus
tctgaacccggctgaaaagcaaact

SEQ ID NO: 385122 - DNA, 25 bp, Mus musculus
gaaagcgccggctcttagggtccca

SEQ ID NO: 385123 - DNA, 25 bp, Mus musculus
gcacgcccaggcttccgagtaaact

SEQ ID NO: 385124 - DNA, 25 bp, Mus musculus
cgagtaaactttgcgcccaggagga

SEQ ID NO: 385125 - DNA, 25 bp, Mus musculus
ggggcttaggtgctccacccagctc

SEQ ID NO: 385126 - DNA, 25 bp, Mus musculus
ctcccagctcgaggcgtcggacatg

SEQ ID NO: 385127 - DNA, 25 bp, Mus musculus
tcgaggcgtcggacatgctgaagcc

SEQ ID NO: 385128 - DNA, 25 bp, Mus musculus
ggcagcaactcttcccgcacggagg

SEQ ID NO: 385129 - DNA, 25 bp, Mus musculus
cggctcggccttcctcaaagtggac

SEQ ID NO: 385130 - DNA, 25 bp, Mus musculus
tctcttatattgtgtcctgatcctg

SEQ ID NO: 385131 - DNA, 25 bp, Mus musculus
aagtggacccagcttacctgcagca

SEQ ID NO: 385132 - DNA, 25 bp, Mus musculus
acttcgcctcgggttggctccaggg

SEQ ID NO: 385133 - DNA, 25 bp, Mus musculus
ctttcctccacctatgcttcttttg

SEQ ID NO: 385134 - DNA, 25 bp, Mus musculus
cagcttacctgcagcactggcagca

SEQ ID NO: 385135 - DNA, 25 bp, Mus musculus
cgtcctgcccggagttgtgccggaa

SEQ ID NO: 385136 - DNA, 25 bp, Mus musculus
cgcctccattgtttgcgaaggctgc

SEQ ID NO: 385137 - DNA, 25 bp, Mus musculus
ggaaggtgccagagttcaattaggc

SEQ ID NO: 385138 - DNA, 25 bp, Mus musculus
cttgccttcccggagcaccttgggg

SEQ ID NO: 385139 - DNA, 25 bp, Mus musculus
cagagttcaattaggcggcagctgc

SEQ ID NO: 385140 - DNA, 25 bp, Mus musculus
tgtgcacgcagaaccccgacaggtg

SEQ ID NO: 385141 - DNA, 25 bp, Mus musculus
agatgcatgtgtgcacgcagaaccc

SEQ ID NO: 385142 - DNA, 25 bp, Mus musculus
tcctgcagatgcatgtgtgcacgca

SEQ ID NO: 385143 - DNA, 25 bp, Mus musculus
gcgcattctcctgcagatgcatgtg

SEQ ID NO: 385144 - DNA, 25 bp, Mus musculus
gctgcgcctccattgtttgcgaagg

SEQ ID NO: 385145 - DNA, 25 bp, Mus musculus
tttgcgaaggctgcacagacaggtt

SEQ ID NO: 385146 - DNA, 25 bp, Mus musculus
gttgccgagagaggcatctgcgcct

SEQ ID NO: 385147 - DNA, 25 bp, Mus musculus
gagagaggcatctgcgcctcgctcg

SEQ ID NO: 385148 - DNA, 25 bp, Mus musculus
cacagacaggttggtggttgccgag

SEQ ID NO: 385149 - DNA, 25 bp, Mus musculus
ggcagctgcgcctccattgtttgcg

SEQ ID NO: 385150 - DNA, 25 bp, Mus musculus
ctcaccttcgaggatggatacgacg

SEQ ID NO: 385151 - DNA, 25 bp, Mus musculus
tgctctaaacgcttcctggtcctgc

SEQ ID NO: 385152 - DNA, 25 bp, Mus musculus
agcgcaccagtgctctaaacgcttc

SEQ ID NO: 385153 - DNA, 25 bp, Mus musculus
aggcaggagacttgaaccaccaccc

SEQ ID NO: 385154 - DNA, 25 bp, Mus musculus
tcgcaagcggaaaggcaggagactt

SEQ ID NO: 385155 - DNA, 25 bp, Mus musculus
gccgcctgctggtcgcaagcggaaa

SEQ ID NO: 385156 - DNA, 25 bp, Mus musculus
ggagacgcggctgcattagcccgca

SEQ ID NO: 385157 - DNA, 25 bp, Mus musculus
cgccctttgacgctctttccaagag

SEQ ID NO: 385158 - DNA, 25 bp, Mus musculus
atagaacgtccatcagccgccttca

SEQ ID NO: 385159 - DNA, 25 bp, Mus musculus
gtcggggatagaacgtccatcagcc

SEQ ID NO: 385160 - DNA, 25 bp, Mus musculus
tgctaagccgctattcaaacgcccg

SEQ ID NO: 385161 - DNA, 25 bp, Mus musculus
tggatacgacgatgagcagttggtc

SEQ ID NO: 385162 - DNA, 25 bp, Mus musculus
ggccgctcaccttcgaggatggata

SEQ ID NO: 385163 - DNA, 25 bp, Mus musculus
gtctgcaggaaagaagccgagttga

SEQ ID NO: 385164 - DNA, 25 bp, Mus musculus
aatcggccggtgtcatcttcggctc

SEQ ID NO: 385165 - DNA, 25 bp, Mus musculus
gcggccgcgcctttgaggtaaattc

SEQ ID NO: 385166 - DNA, 25 bp, Mus musculus
gagccttccgccgactgcgaacttg

SEQ ID NO: 385167 - DNA, 25 bp, Mus musculus
attcattcccggttgcctcggtggc

SEQ ID NO: 385168 - DNA, 25 bp, Mus musculus
ccgaaggatgtttgacctccggata

SEQ ID NO: 385169 - DNA, 25 bp, Mus musculus
ctccggatgctcgaggccgaaggat

SEQ ID NO: 385170 - DNA, 25 bp, Mus musculus
cctctcatgtgttcacttccgggtc

SEQ ID NO: 385171 - DNA, 25 bp, Mus musculus
ctcggctcttttcgctgatgcgggc

SEQ ID NO: 385172 - DNA, 25 bp, Mus musculus
tctggctcctcgcagccaatgagcg

SEQ ID NO: 385173 - DNA, 25 bp, Mus musculus
gccggagagccgaccaatccgaatc

SEQ ID NO: 385174 - DNA, 25 bp, Mus musculus
gggcgagacttcgactttctggctc

SEQ ID NO: 385175 - DNA, 25 bp, Mus musculus
tatagctctctcagtcctctgcagg

SEQ ID NO: 385176 - DNA, 25 bp, Mus musculus
cggagagactagacgctttcctttc

SEQ ID NO: 385177 - DNA, 25 bp, Mus musculus
tctctctcgactctctgcagcgttt

SEQ ID NO: 385178 - DNA, 25 bp, Mus musculus
aactcgtgtttctctctccagctcg

SEQ ID NO: 385179 - DNA, 25 bp, Mus musculus
acggtggacaggaaatgcggagatg

SEQ ID NO: 385180 - DNA, 25 bp, Mus musculus
tgggaactacgcatgctccgatttg

SEQ ID NO: 385181 - DNA, 25 bp, Mus musculus
acgcatgctccgatttgcaaaaatc

SEQ ID NO: 385182 - DNA, 25 bp, Mus musculus
tgcaaaaatcaaacggatggcttac

SEQ ID NO: 385183 - DNA, 25 bp, Mus musculus
tcaaacggatggcttactgcctcgc

SEQ ID NO: 385184 - DNA, 25 bp, Mus musculus
aacggatggcttactgcctcgcgtg

SEQ ID NO: 385185 - DNA, 25 bp, Mus musculus
gcctcgcgtggcagtttaaacagtg

SEQ ID NO: 385186 - DNA, 25 bp, Mus musculus
cagtgttctcaaactcgtgtttctc

SEQ ID NO: 385187 - DNA, 25 bp, Mus musculus
tactcagttacaccaacgccggtgc

SEQ ID NO: 385188 - DNA, 25 bp, Mus musculus
gaggttagcgttactcagttacacc

SEQ ID NO: 385189 - DNA, 25 bp, Mus musculus
gcgtggcagtttaaacagtgttctc

SEQ ID NO: 385190 - DNA, 25 bp, Mus musculus
tgcggagatgaggttagcgttactc

SEQ ID NO: 385191 - DNA, 25 bp, Mus musculus
acacccaaatgggaactacgcatgc

SEQ ID NO: 385192 - DNA, 25 bp, Mus musculus
ttggcgcctcggctgctgtggcttt

SEQ ID NO: 385193 - DNA, 25 bp, Mus musculus
gccctgcagcaggtcgtgtttctct

SEQ ID NO: 385194 - DNA, 25 bp, Mus musculus
cgccattctggtggccctgcagcag

SEQ ID NO: 385195 - DNA, 25 bp, Mus musculus
ctgcagcaggtcgtgtttctctttc

SEQ ID NO: 385196 - DNA, 25 bp, Mus musculus
agcaggtcgtgtttctctttccggg

SEQ ID NO: 385197 - DNA, 25 bp, Mus musculus
tctctttccgggatctcgcagcatc

SEQ ID NO: 385198 - DNA, 25 bp, Mus musculus
tccgggatctcgcagcatccttatc

SEQ ID NO: 385199 - DNA, 25 bp, Mus musculus
atccttatcccgcttggcgcctcgg

SEQ ID NO: 385200 - DNA, 25 bp, Mus musculus
gtaccgttgctgtttgggttgctgc

SEQ ID NO: 385201 - DNA, 25 bp, Mus musculus
ctgctgtggcttttccctggcttct

SEQ ID NO: 385202 - DNA, 25 bp, Mus musculus
gtggcttttccctggcttctcttcc

SEQ ID NO: 385203 - DNA, 25 bp, Mus musculus
tcttccttgcttttcccacaggagc

SEQ ID NO: 385204 - DNA, 25 bp, Mus musculus
aggtcccggtgctggtaccgttgct

SEQ ID NO: 385205 - DNA, 25 bp, Mus musculus
gggatctcgcagcatccttatcccg

SEQ ID NO: 385206 - DNA, 25 bp, Mus musculus
gcgtagctgggctccaactcgcgcg

SEQ ID NO: 385207 - DNA, 25 bp, Mus musculus
gccactggcgatgacgcagccgcac

SEQ ID NO: 385208 - DNA, 25 bp, Mus musculus
aagcctcattcaaaccggccactgg

SEQ ID NO: 385209 - DNA, 25 bp, Mus musculus
gtgcgacaagcctcattcaaaccgg

SEQ ID NO: 385210 - DNA, 25 bp, Mus musculus
tccggtgcgacaagcctcattcaaa

SEQ ID NO: 385211 - DNA, 25 bp, Mus musculus
cagctccggtgcgacaagcctcatt

SEQ ID NO: 385212 - DNA, 25 bp, Mus musculus
tacgaagcaactcgtggaggcggcc

SEQ ID NO: 385213 - DNA, 25 bp, Mus musculus
ggcagccgaggaatacgaagcaact

SEQ ID NO: 385214 - DNA, 25 bp, Mus musculus
gtctgacaagggcagccgaggaata

SEQ ID NO: 385215 - DNA, 25 bp, Mus musculus
ctcaccagagtagagtggcatggcg

SEQ ID NO: 385216 - DNA, 25 bp, Mus musculus
aggacggagctcaccagagtagagt

SEQ ID NO: 385217 - DNA, 25 bp, Mus musculus
ctacgcggaggcctagcgtccgctg

SEQ ID NO: 385218 - DNA, 25 bp, Mus musculus
gccgccactccgcacttcccaccgt

SEQ ID NO: 385219 - DNA, 25 bp, Mus musculus
ttcccaccgtgtcccacggctgtgc

SEQ ID NO: 385220 - DNA, 25 bp, Mus musculus
gccagccaaagtgctcaccaagaga

SEQ ID NO: 385221 - DNA, 25 bp, Mus musculus
ccaacgtgtccatgttggcggcccg

SEQ ID NO: 385222 - DNA, 25 bp, Mus musculus
cgccggctccaacgtgtccatgttg

SEQ ID NO: 385223 - DNA, 25 bp, Mus musculus
gagcaccgccgcctggatgcgcagc

SEQ ID NO: 385224 - DNA, 25 bp, Mus musculus
cccgaatagggagccgagtgctggg

SEQ ID NO: 385225 - DNA, 25 bp, Mus musculus
cccgatgaccgagctccagcaagag

SEQ ID NO: 385226 - DNA, 25 bp, Mus musculus
tgaccgagctccagcaagaggtgga

SEQ ID NO: 385227 - DNA, 25 bp, Mus musculus
gacgccaagccagccaaagtgctca

SEQ ID NO: 385228 - DNA, 25 bp, Mus musculus
agtgacctctactggacgcgacgcg

SEQ ID NO: 385229 - DNA, 25 bp, Mus musculus
caaagtgctcaccaagagagaaggc

SEQ ID NO: 385230 - DNA, 25 bp, Mus musculus
gagaaggcaaagttggcccggccca

SEQ ID NO: 385231 - DNA, 25 bp, Mus musculus
ggcccggcccagtaagtgacctcta

SEQ ID NO: 385232 - DNA, 25 bp, Mus musculus
gtaagtgacctctactggacgcgac

SEQ ID NO: 385233 - DNA, 25 bp, Mus musculus
tggaggacgccaagccagccaaagt

SEQ ID NO: 385234 - DNA, 25 bp, Mus musculus
ctcccgggcaaaccttggctacaat

SEQ ID NO: 385235 - DNA, 25 bp, Mus musculus
tgggttggagccgagctttcaaacc

SEQ ID NO: 385236 - DNA, 25 bp, Mus musculus
tgcttctgaagtccgctgggttgga

SEQ ID NO: 385237 - DNA, 25 bp, Mus musculus
accctctgggtaaagttgctgcctc

SEQ ID NO: 385238 - DNA, 25 bp, Mus musculus
cggggatcccattgggtagcctcgc

SEQ ID NO: 385239 - DNA, 25 bp, Mus musculus
ctgcgagcgctcattgggcagaccc

SEQ ID NO: 385240 - DNA, 25 bp, Mus musculus
tactgagctcagcacgcaagaagcc

SEQ ID NO: 385241 - DNA, 25 bp, Mus musculus
ggggcacacgccacatactgagctc

SEQ ID NO: 385242 - DNA, 25 bp, Mus musculus
ggtcttcacagactgcacacagagc

SEQ ID NO: 385243 - DNA, 25 bp, Mus musculus
tccggaaagcttgctggtcttcaca

SEQ ID NO: 385244 - DNA, 25 bp, Mus musculus
ggcctgctccaaggtccggaaagct

SEQ ID NO: 385245 - DNA, 25 bp, Mus musculus
gcttccattatacacgccctcgtta

SEQ ID NO: 385246 - DNA, 25 bp, Mus musculus
tttccgggagtccagcatacctctc

SEQ ID NO: 385247 - DNA, 25 bp, Mus musculus
gctttcaaaccgacgcacgctgctg

SEQ ID NO: 385248 - DNA, 25 bp, Mus musculus
cccaagttaatgaggcgtacgccgg

SEQ ID NO: 385249 - DNA, 25 bp, Mus musculus
taatgaggcgtacgccggctgccga

SEQ ID NO: 385250 - DNA, 25 bp, Mus musculus
agcgcctctcggagctgggttttcc

SEQ ID NO: 385251 - DNA, 25 bp, Mus musculus
agcagcaccccttatgccggaagga

SEQ ID NO: 385252 - DNA, 25 bp, Mus musculus
tctggaagcctgaaggccgagcgga

SEQ ID NO: 385253 - DNA, 25 bp, Mus musculus
tgcgagtcagccttctctgcgcgct

SEQ ID NO: 385254 - DNA, 25 bp, Mus musculus
atcttgtggcgagtcaggacgcgcc

SEQ ID NO: 385255 - DNA, 25 bp, Mus musculus
gcccgctcacggctccgggatcttg

SEQ ID NO: 385256 - DNA, 25 bp, Mus musculus
cttcagtgagcgctcgccggaggac

SEQ ID NO: 385257 - DNA, 25 bp, Mus musculus
cggccagtgcccttcagtgagcgct

SEQ ID NO: 385258 - DNA, 25 bp, Mus musculus
tggcccattgaaaagcgccgcgagg

SEQ ID NO: 385259 - DNA, 25 bp, Mus musculus
agggtggcccattgaaaagcgccgc

SEQ ID NO: 385260 - DNA, 25 bp, Mus musculus
ccaggagccgccttttccgctgggt

SEQ ID NO: 385261 - DNA, 25 bp, Mus musculus
agaacagcggctgcaaggcgctgaa

SEQ ID NO: 385262 - DNA, 25 bp, Mus musculus
tttgtccagacatagaacgtgggga

SEQ ID NO: 385263 - DNA, 25 bp, Mus musculus
agttttgtgatggtgacgctcgccc

SEQ ID NO: 385264 - DNA, 25 bp, Mus musculus
aggggcagctttccgactcggattc

SEQ ID NO: 385265 - DNA, 25 bp, Mus musculus
ctcggattccgacatgacggtcgtc

SEQ ID NO: 385266 - DNA, 25 bp, Mus musculus
taggcctctgcaaatggcggtgagc

SEQ ID NO: 385267 - DNA, 25 bp, Mus musculus
tccggaatgcactgagtcggaggcc

SEQ ID NO: 385268 - DNA, 25 bp, Mus musculus
cgcctcccagcgctgagttttgtga

SEQ ID NO: 385269 - DNA, 25 bp, Mus musculus
cggagacatgcaactgctcgctttt

SEQ ID NO: 385270 - DNA, 25 bp, Mus musculus
ctgctcgcttttgccttagtggata

SEQ ID NO: 385271 - DNA, 25 bp, Mus musculus
cttagtggataaggagctcttggcg

SEQ ID NO: 385272 - DNA, 25 bp, Mus musculus
gccgggtctttgatgcctcctccat

SEQ ID NO: 385273 - DNA, 25 bp, Mus musculus
tccatccaccttcgagcttagtcgg

SEQ ID NO: 385274 - DNA, 25 bp, Mus musculus
ttagtcggctttcacgagcagcgtg

SEQ ID NO: 385275 - DNA, 25 bp, Mus musculus
ttgtttcaagccgtccagggttgta

SEQ ID NO: 385276 - DNA, 25 bp, Mus musculus
tcgccattggttcggcggcggtcac

SEQ ID NO: 385277 - DNA, 25 bp, Mus musculus
cagattttgaatttccaggccgggc

SEQ ID NO: 385278 - DNA, 25 bp, Mus musculus
gcccgagggtcagattttgaatttc

SEQ ID NO: 385279 - DNA, 25 bp, Mus musculus
cgacggttgcccgagggtcagattt

SEQ ID NO: 385280 - DNA, 25 bp, Mus musculus
ccgccacgcccagctcggggctcga

SEQ ID NO: 385281 - DNA, 25 bp, Mus musculus
tagagaaagacacgggcacgcactt

SEQ ID NO: 385282 - DNA, 25 bp, Mus musculus
ttccgggctaaggaccgagcagcgc

SEQ ID NO: 385283 - DNA, 25 bp, Mus musculus
tctttcccgccattcgcaggcccgg

SEQ ID NO: 385284 - DNA, 25 bp, Mus musculus
ggcacccatttaggccaggcttcgg

SEQ ID NO: 385285 - DNA, 25 bp, Mus musculus
tgggaccgcaggcacccatttaggc

SEQ ID NO: 385286 - DNA, 25 bp, Mus musculus
cagcaagctgcgagctgggaccgca

SEQ ID NO: 385287 - DNA, 25 bp, Mus musculus
acgggcacgcacttgggatcagcaa

SEQ ID NO: 385288 - DNA, 25 bp, Mus musculus
ctccgccatgttgcggagcgcggac

SEQ ID NO: 385289 - DNA, 25 bp, Mus musculus
cacttgggatcagcaagctgcgagc

SEQ ID NO: 385290 - DNA, 25 bp, Mus musculus
gcgctcagtcttggccctgtgacat

SEQ ID NO: 385291 - DNA, 25 bp, Mus musculus
ttgcctgcgatctgcgccggtcttc

SEQ ID NO: 385292 - DNA, 25 bp, Mus musculus
gacatttttgcctgcgatctgcgcc

SEQ ID NO: 385293 - DNA, 25 bp, Mus musculus
agtcttggccctgtgacatttttgc

SEQ ID NO: 385294 - DNA, 25 bp, Mus musculus
tgggtcttgctttggcgcgctcagt

SEQ ID NO: 385295 - DNA, 25 bp, Mus musculus
gaccggcccagagcgtccacggctc

SEQ ID NO: 385296 - DNA, 25 bp, Mus musculus
aagaatgaatgagttctaggcgggc

SEQ ID NO: 385297 - DNA, 25 bp, Mus musculus
cggcccgaagaatgaatgagttcta

SEQ ID NO: 385298 - DNA, 25 bp, Mus musculus
cgccaacggcccgaagaatgaatga

SEQ ID NO: 385299 - DNA, 25 bp, Mus musculus
gtggactcgccaacggcccgaagaa

SEQ ID NO: 385300 - DNA, 25 bp, Mus musculus
aaagcatctggtgggtttgctcggc

SEQ ID NO: 385301 - DNA, 25 bp, Mus musculus
ccggctggtgggagacaaagcatct

SEQ ID NO: 385302 - DNA, 25 bp, Mus musculus
agctgatgctcttgcgcgcgctcga

SEQ ID NO: 385303 - DNA, 25 bp, Mus musculus
ccctgtgacatttttgcctgcgatc

SEQ ID NO: 385304 - DNA, 25 bp, Mus musculus
tactagtgtttgactggcggaggcc

SEQ ID NO: 385305 - DNA, 25 bp, Mus musculus
ctggcccagtagagacgccaaatcc

SEQ ID NO: 385306 - DNA, 25 bp, Mus musculus
ctcaatgtccaatcgcttgcggctg

SEQ ID NO: 385307 - DNA, 25 bp, Mus musculus
agacgctctagctgcccgcaagttg

SEQ ID NO: 385308 - DNA, 25 bp, Mus musculus
cagggaaggctcttgctgacagacc

SEQ ID NO: 385309 - DNA, 25 bp, Mus musculus
tgctgacagaccgtaggagttccca

SEQ ID NO: 385310 - DNA, 25 bp, Mus musculus
atcctcagtcccaagttgcccggaa

SEQ ID NO: 385311 - DNA, 25 bp, Mus musculus
agccaatcgtcagggcaccaggatc

SEQ ID NO: 385312 - DNA, 25 bp, Mus musculus
cgctcagcgaatgaggcggaacaca

SEQ ID NO: 385313 - DNA, 25 bp, Mus musculus
agtaagtgtctcctgccttgccttg

SEQ ID NO: 385314 - DNA, 25 bp, Mus musculus
cggttccgacgcacaggcatgtcct

SEQ ID NO: 385315 - DNA, 25 bp, Mus musculus
gggtggcaaccaccaacgccaagtc

SEQ ID NO: 385316 - DNA, 25 bp, Mus musculus
atctaggaactgctgtgtgcgcacc

SEQ ID NO: 385317 - DNA, 25 bp, Mus musculus
ggaaccactctcaagccatctagga

SEQ ID NO: 385318 - DNA, 25 bp, Mus musculus
taactgccatggaagtctgcagcgc

SEQ ID NO: 385319 - DNA, 25 bp, Mus musculus
cgcacttccgccgtgcgccgcactt

SEQ ID NO: 385320 - DNA, 25 bp, Mus musculus
gaagccgaatttctcccttccgtca

SEQ ID NO: 385321 - DNA, 25 bp, Mus musculus
ttctcccttccgtcatttattcagc

SEQ ID NO: 385322 - DNA, 25 bp, Mus musculus
ttattcagctccctgagcgcgcgtt

SEQ ID NO: 385323 - DNA, 25 bp, Mus musculus
tcagctccctgagcgcgcgtttaca

SEQ ID NO: 385324 - DNA, 25 bp, Mus musculus
cagtggctcagggatttatagctcc

SEQ ID NO: 385325 - DNA, 25 bp, Mus musculus
cagggatttatagctcccggcttaa

SEQ ID NO: 385326 - DNA, 25 bp, Mus musculus
tatagctcccggcttaattaaatcc

SEQ ID NO: 385327 - DNA, 25 bp, Mus musculus
cccgctaactgccatggaagtctgc

SEQ ID NO: 385328 - DNA, 25 bp, Mus musculus
atggaagtctgcagcgcgccgcact

SEQ ID NO: 385329 - DNA, 25 bp, Mus musculus
cactgcggagggctcgcggcctttt

SEQ ID NO: 385330 - DNA, 25 bp, Mus musculus
gggcacctgcagtgctcaccgtagc

SEQ ID NO: 385331 - DNA, 25 bp, Mus musculus
cgcggccttttcctgcgggcgcgaa

SEQ ID NO: 385332 - DNA, 25 bp, Mus musculus
tctccgtcccgtcccacttttgcgc

SEQ ID NO: 385333 - DNA, 25 bp, Mus musculus
caaggctggcgggtcaccctccaat

SEQ ID NO: 385334 - DNA, 25 bp, Mus musculus
cggcagagggagctattccccaaga

SEQ ID NO: 385335 - DNA, 25 bp, Mus musculus
aggctggcgggtcaccctccaatcg

SEQ ID NO: 385336 - DNA, 25 bp, Mus musculus
ctccaatcgcctccctccatccttc

SEQ ID NO: 385337 - DNA, 25 bp, Mus musculus
tccttcccactttcccagtcactta

SEQ ID NO: 385338 - DNA, 25 bp, Mus musculus
acttagctgccgctcggttcgtgga

SEQ ID NO: 385339 - DNA, 25 bp, Mus musculus
agggacgcgctgtcctgtccgcctg

SEQ ID NO: 385340 - DNA, 25 bp, Mus musculus
aaatcacttcggacggcctggcagc

SEQ ID NO: 385341 - DNA, 25 bp, Mus musculus
ccaagaaatcacttcggacggcctg

SEQ ID NO: 385342 - DNA, 25 bp, Mus musculus
tcactccagggacgcgctgtcctgt

SEQ ID NO: 385343 - DNA, 25 bp, Mus musculus
cacttttgcgctccctcactccagg

SEQ ID NO: 385344 - DNA, 25 bp, Mus musculus
gcctggcagcgacccgcggggagtt

SEQ ID NO: 385345 - DNA, 25 bp, Mus musculus
cagtcacttagctgccgctcggttc

SEQ ID NO: 385346 - DNA, 25 bp, Mus musculus
ttggcgcggggcacacgctcctctg

SEQ ID NO: 385347 - DNA, 25 bp, Mus musculus
tctggtcttcctcgtccaccgtaag

SEQ ID NO: 385348 - DNA, 25 bp, Mus musculus
tcctcgtccaccgtaagccggatcc

SEQ ID NO: 385349 - DNA, 25 bp, Mus musculus
gatccgcgtgtgcagcttctgcgca

SEQ ID NO: 385350 - DNA, 25 bp, Mus musculus
tcgctccgacccaggtgagcgtgga

SEQ ID NO: 385351 - DNA, 25 bp, Mus musculus
tccgacccaggtgagcgtggacctg

SEQ ID NO: 385352 - DNA, 25 bp, Mus musculus
cggcggagacactcgtcgggacaac

SEQ ID NO: 385353 - DNA, 25 bp, Mus musculus
ggacaacggggtccctcccagcatc

SEQ ID NO: 385354 - DNA, 25 bp, Mus musculus
ctgcagacgtggcacagactgccca

SEQ ID NO: 385355 - DNA, 25 bp, Mus musculus
cggccgcaccctccggcgcgtgcac

SEQ ID NO: 385356 - DNA, 25 bp, Mus musculus
gcccggcctgcagacgtggcacaga

SEQ ID NO: 385357 - DNA, 25 bp, Mus musculus
gacgtggcacagactgcccaggccg

SEQ ID NO: 385358 - DNA, 25 bp, Mus musculus
gacgcagcggctcctcccgggatcc

SEQ ID NO: 385359 - DNA, 25 bp, Mus musculus
gtccctcccagcatcgctccggccc

SEQ ID NO: 385360 - DNA, 25 bp, Mus musculus
tatcagggttttctgtcggtacaac

SEQ ID NO: 385361 - DNA, 25 bp, Mus musculus
cagggcctccgatatcagggttttc

SEQ ID NO: 385362 - DNA, 25 bp, Mus musculus
cgtctcccaacgtgtcgggaatgga

SEQ ID NO: 385363 - DNA, 25 bp, Mus musculus
ccaacgtgtcgggaatggagtctct

SEQ ID NO: 385364 - DNA, 25 bp, Mus musculus
gtattccacgcctcagccctccctg

SEQ ID NO: 385365 - DNA, 25 bp, Mus musculus
gcgccacctccctttgtgtcgatgt

SEQ ID NO: 385366 - DNA, 25 bp, Mus musculus
gtgtcgatgtctccggctccttccg

SEQ ID NO: 385367 - DNA, 25 bp, Mus musculus
tgagtggcacttctgtgccgccctc

SEQ ID NO: 385368 - DNA, 25 bp, Mus musculus
tgtctccatcgcctgccactgcctt

SEQ ID NO: 385369 - DNA, 25 bp, Mus musculus
ccttcagcggccctccgatgtccca

SEQ ID NO: 385370 - DNA, 25 bp, Mus musculus
cgatgtcccacttcccgcctgcgac

SEQ ID NO: 385371 - DNA, 25 bp, Mus musculus
tgcctcgggtgctctcctgtctgca

SEQ ID NO: 385372 - DNA, 25 bp, Mus musculus
cgccttcagggcctccgatatcagg

SEQ ID NO: 385373 - DNA, 25 bp, Mus musculus
tgtcggtacaacctacgacatcacg

SEQ ID NO: 385374 - DNA, 25 bp, Mus musculus
ctagaggtggtctagccctgcatcc

SEQ ID NO: 385375 - DNA, 25 bp, Mus musculus
gcccgcagcggaaagcaagttcaac

SEQ ID NO: 385376 - DNA, 25 bp, Mus musculus
agttcaaccaacttcctccgcggtg

SEQ ID NO: 385377 - DNA, 25 bp, Mus musculus
actgaggggacctctgctctccaga

SEQ ID NO: 385378 - DNA, 25 bp, Mus musculus
tgacgataccttcttgcccgcagcg

SEQ ID NO: 385379 - DNA, 25 bp, Mus musculus
actctcccattttctgcggtcgctg

SEQ ID NO: 385380 - DNA, 25 bp, Mus musculus
cccgatgaagtctcaggggaagacc

SEQ ID NO: 385381 - DNA, 25 bp, Mus musculus
agggctcagagggactaatatgtcc

SEQ ID NO: 385382 - DNA, 25 bp, Mus musculus
ctgttcaaacaaacggagaccgccg

SEQ ID NO: 385383 - DNA, 25 bp, Mus musculus
aatatgtccgccttcctgttcaaac

SEQ ID NO: 385384 - DNA, 25 bp, Mus musculus
tgctgctacttgtgacgataccttc

SEQ ID NO: 385385 - DNA, 25 bp, Mus musculus
cccagtcgacatgatgctgctactt

SEQ ID NO: 385386 - DNA, 25 bp, Mus musculus
gtcgattttttcaaaccgagtctca

SEQ ID NO: 385387 - DNA, 25 bp, Mus musculus
cggcactgactagcctcggccaaga

SEQ ID NO: 385388 - DNA, 25 bp, Mus musculus
cagcgaggaagccaagggccgcttc

SEQ ID NO: 385389 - DNA, 25 bp, Mus musculus
gtgccctccggccaagaggatgcta

SEQ ID NO: 385390 - DNA, 25 bp, Mus musculus
cgggcccaacgtgagcttccagaac

SEQ ID NO: 385391 - DNA, 25 bp, Mus musculus
cgtcgtcggcggacgacagcctgtc

SEQ ID NO: 385392 - DNA, 25 bp, Mus musculus
gctgcctcgtcgtcggcggacgaca

SEQ ID NO: 385393 - DNA, 25 bp, Mus musculus
tgaacttcgtggacccggctgcctc

SEQ ID NO: 385394 - DNA, 25 bp, Mus musculus
gtggcgctgtgactctttctctctc

SEQ ID NO: 385395 - DNA, 25 bp, Mus musculus
ccaagggccgcttccgcgtgaactt

SEQ ID NO: 385396 - DNA, 25 bp, Mus musculus
gtgtagtggcgctgtgactctttct

SEQ ID NO: 385397 - DNA, 25 bp, Mus musculus
agccgcgccgtacgcagcgtccacc

SEQ ID NO: 385398 - DNA, 25 bp, Mus musculus
caagaggatgctactacggctggga

SEQ ID NO: 385399 - DNA, 25 bp, Mus musculus
ctccggccaagaggatgctactacg

SEQ ID NO: 385400 - DNA, 25 bp, Mus musculus
cgcttccgcgtgaacttcgtggacc

SEQ ID NO: 385401 - DNA, 25 bp, Mus musculus
catcagcggcggtccgtgccagagc

SEQ ID NO: 385402 - DNA, 25 bp, Mus musculus
gaggcgcctgccaaagaagctcaaa

SEQ ID NO: 385403 - DNA, 25 bp, Mus musculus
tttacacattgtagccggcgggatc

SEQ ID NO: 385404 - DNA, 25 bp, Mus musculus
ggcttcctgttcgtcagagcagaga

SEQ ID NO: 385405 - DNA, 25 bp, Mus musculus
agaatcttcgtgtcctgcgagcgcc

SEQ ID NO: 385406 - DNA, 25 bp, Mus musculus
ccggaagcagttttgcgatggcaac

SEQ ID NO: 385407 - DNA, 25 bp, Mus musculus
aacgtgactctcagccgcagaaaca

SEQ ID NO: 385408 - DNA, 25 bp, Mus musculus
gctggcggatctcgaagcatctttg

SEQ ID NO: 385409 - DNA, 25 bp, Mus musculus
gtctctttctttggccgcgcacttg

SEQ ID NO: 385410 - DNA, 25 bp, Mus musculus
cgcacttgggttgagcctcttttag

SEQ ID NO: 385411 - DNA, 25 bp, Mus musculus
gccacgtgcagctaacgcagtgttt

SEQ ID NO: 385412 - DNA, 25 bp, Mus musculus
cgcagtgtttttgccagcgaccgtc

SEQ ID NO: 385413 - DNA, 25 bp, Mus musculus
aagtgtacccgatgcgccttctgtc

SEQ ID NO: 385414 - DNA, 25 bp, Mus musculus
cccggtaaaagtgtgaggactcaga

SEQ ID NO: 385415 - DNA, 25 bp, Mus musculus
cacgcaggtctcatagggattatcc

SEQ ID NO: 385416 - DNA, 25 bp, Mus musculus
gattcccgtgcactccgggcacaga

SEQ ID NO: 385417 - DNA, 25 bp, Mus musculus
gtgtacagaggctgagcggattccc

SEQ ID NO: 385418 - DNA, 25 bp, Mus musculus
cagcagcggcataaagttacaaaga

SEQ ID NO: 385419 - DNA, 25 bp, Mus musculus
ttacaaaagtaacccgagcagcagc

SEQ ID NO: 385420 - DNA, 25 bp, Mus musculus
acgcagcgtcagctcctgataggca

SEQ ID NO: 385421 - DNA, 25 bp, Mus musculus
atgaagccaccttcggagcccgcta

SEQ ID NO: 385422 - DNA, 25 bp, Mus musculus
gtcagggtctgaccacccttcgtca

SEQ ID NO: 385423 - DNA, 25 bp, Mus musculus
gcacggcccactaaaaataaagtca

SEQ ID NO: 385424 - DNA, 25 bp, Mus musculus
agagagcactgtcggagaccaaatc

SEQ ID NO: 385425 - DNA, 25 bp, Mus musculus
atcgccggcgccaagagcgcacaga

SEQ ID NO: 385426 - DNA, 25 bp, Mus musculus
cacgaagtagggctggagacacaac

SEQ ID NO: 385427 - DNA, 25 bp, Mus musculus
cgggcacagatcctggaaagctgca

SEQ ID NO: 385428 - DNA, 25 bp, Mus musculus
tttaagcgttttcgtggagagggca

SEQ ID NO: 385429 - DNA, 25 bp, Mus musculus
agtatttcctgctgtcctcgcctgc

SEQ ID NO: 385430 - DNA, 25 bp, Mus musculus
aggtgatttgcagcttggtctggtc

SEQ ID NO: 385431 - DNA, 25 bp, Mus musculus
aggcctgcgactgctgtccggtctc

SEQ ID NO: 385432 - DNA, 25 bp, Mus musculus
ctacgcgccacaggtgactgtgtca

SEQ ID NO: 385433 - DNA, 25 bp, Mus musculus
cggtgctcttctgcttctcggtgtt

SEQ ID NO: 385434 - DNA, 25 bp, Mus musculus
ggctacgacgtgctcatccagaagt

SEQ ID NO: 385435 - DNA, 25 bp, Mus musculus
atccagaagttcctgagcctgtacg

SEQ ID NO: 385436 - DNA, 25 bp, Mus musculus
agcctgtacggcgatcagctcgaca

SEQ ID NO: 385437 - DNA, 25 bp, Mus musculus
tcagctcgacatgcaccgcaaattc

SEQ ID NO: 385438 - DNA, 25 bp, Mus musculus
ccgcaaattcgtggtgcagctcttc

SEQ ID NO: 385439 - DNA, 25 bp, Mus musculus
ggtcagtacgtggacctgcccaagg

SEQ ID NO: 385440 - DNA, 25 bp, Mus musculus
aagctgcgcctggtgccgctgcaga

SEQ ID NO: 385441 - DNA, 25 bp, Mus musculus
ctgcagatccaggtgggttccgccc

SEQ ID NO: 385442 - DNA, 25 bp, Mus musculus
accaggtctcgatctcgggtcggaa

SEQ ID NO: 385443 - DNA, 25 bp, Mus musculus
atctcgggtcggaagaaggtgattt

SEQ ID NO: 385444 - DNA, 25 bp, Mus musculus
ttcatctgtagggttgcagctcacc

SEQ ID NO: 385445 - DNA, 25 bp, Mus musculus
gcctgactcgcatctgctgctgctg

SEQ ID NO: 385446 - DNA, 25 bp, Mus musculus
taccagctaggcttcctgtcgcatg

SEQ ID NO: 385447 - DNA, 25 bp, Mus musculus
accacctcaggtacgttctagaatg

SEQ ID NO: 385448 - DNA, 25 bp, Mus musculus
ctccaacttggccagtgaggatcga

SEQ ID NO: 385449 - DNA, 25 bp, Mus musculus
gtgcacttctcttggccttatttta

SEQ ID NO: 385450 - DNA, 25 bp, Mus musculus
ctggagttctcaccggtttcagtta

SEQ ID NO: 385451 - DNA, 25 bp, Mus musculus
cgtggcttgcaggagtttcaggaac

SEQ ID NO: 385452 - DNA, 25 bp, Mus musculus
ttcgtgcaagcgtctggtatctgta

SEQ ID NO: 385453 - DNA, 25 bp, Mus musculus
cccggatctcgaggaatgggaagtc

SEQ ID NO: 385454 - DNA, 25 bp, Mus musculus
cacgagtggctctgcggaactttaa

SEQ ID NO: 385455 - DNA, 25 bp, Mus musculus
agtcgtgtttcctgcactctggcgc

SEQ ID NO: 385456 - DNA, 25 bp, Mus musculus
tcatcacctaattcgctggggagct

SEQ ID NO: 385457 - DNA, 25 bp, Mus musculus
tggaccttgtgcctgagtgcttgca

SEQ ID NO: 385458 - DNA, 25 bp, Mus musculus
tgtgatgaccgcacagaagtacctg

SEQ ID NO: 385459 - DNA, 25 bp, Mus musculus
cttcctgtacgtgggtgtgatgacc

SEQ ID NO: 385460 - DNA, 25 bp, Mus musculus
gccgctgccgaagtttcactcccga

SEQ ID NO: 385461 - DNA, 25 bp, Mus musculus
cagcgccgagcagagctgccacctc

SEQ ID NO: 385462 - DNA, 25 bp, Mus musculus
cctctgtgttccgagccgctacgat

SEQ ID NO: 385463 - DNA, 25 bp, Mus musculus
gagccgctacgatggccgtgcgctc

SEQ ID NO: 385464 - DNA, 25 bp, Mus musculus
cattggggttggtcctgggcttcac

SEQ ID NO: 385465 - DNA, 25 bp, Mus musculus
ttggtcctgggcttcaccgccgcgt

SEQ ID NO: 385466 - DNA, 25 bp, Mus musculus
gacgcggctccagtctttgctccta

SEQ ID NO: 385467 - DNA, 25 bp, Mus musculus
agtctttgctcctactacggccgct

SEQ ID NO: 385468 - DNA, 25 bp, Mus musculus
ggaggtcccagttttcggagcagcc

SEQ ID NO: 385469 - DNA, 25 bp, Mus musculus
agcagccggctctgttgccgcagag

SEQ ID NO: 385470 - DNA, 25 bp, Mus musculus
cacgcccgaaggtgcgacggcgctt

SEQ ID NO: 385471 - DNA, 25 bp, Mus musculus
cacagaagtacctgggcagtcgcgc

SEQ ID NO: 385472 - DNA, 25 bp, Mus musculus
gtcctgctgggtcggtttagcttac

SEQ ID NO: 385473 - DNA, 25 bp, Mus musculus
agctctacttctgccgctactgcag

SEQ ID NO: 385474 - DNA, 25 bp, Mus musculus
gtgctcatcccagtcactgcggctg

SEQ ID NO: 385475 - DNA, 25 bp, Mus musculus
tcgcacgaggtaactgggccgtccc

SEQ ID NO: 385476 - DNA, 25 bp, Mus musculus
ctggaatgtgtgtcgcacgaggtaa

SEQ ID NO: 385477 - DNA, 25 bp, Mus musculus
agcttcgatcgctggaatgtgtgtc

SEQ ID NO: 385478 - DNA, 25 bp, Mus musculus
gccgctactgcagtgagcttcgatc

SEQ ID NO: 385479 - DNA, 25 bp, Mus musculus
agaaggttcgggctccgctctcaca

SEQ ID NO: 385480 - DNA, 25 bp, Mus musculus
gcgggttctctatctcgtccaagga

SEQ ID NO: 385481 - DNA, 25 bp, Mus musculus
gctgcagtcggagcgggttctctat

SEQ ID NO: 385482 - DNA, 25 bp, Mus musculus
agatggcgtccctgctgcagtcgga

SEQ ID NO: 385483 - DNA, 25 bp, Mus musculus
tcggtttagcttacgtcaacgtcta

SEQ ID NO: 385484 - DNA, 25 bp, Mus musculus
acttagaccgcaacgtcctgctggg

SEQ ID NO: 385485 - DNA, 25 bp, Mus musculus
gttggctcctccctcaccaagatgg

SEQ ID NO: 385486 - DNA, 25 bp, Mus musculus
atgctttccttttacctcctgccgg

SEQ ID NO: 385487 - DNA, 25 bp, Mus musculus
cccgggactcccgatatggcgactt

SEQ ID NO: 385488 - DNA, 25 bp, Mus musculus
aacctccggctttgacgcgaggcca

SEQ ID NO: 385489 - DNA, 25 bp, Mus musculus
tcctgccggaagtgcagacagcgcc

SEQ ID NO: 385490 - DNA, 25 bp, Mus musculus
ggcgactccacacttccagatgctt

SEQ ID NO: 385491 - DNA, 25 bp, Mus musculus
aagagcgagccctcgtgcggcagat

SEQ ID NO: 385492 - DNA, 25 bp, Mus musculus
atggcgacttctctgggttccaaca

SEQ ID NO: 385493 - DNA, 25 bp, Mus musculus
gcagattatacgtagcccggcgcta

SEQ ID NO: 385494 - DNA, 25 bp, Mus musculus
tcccaccggttccttaagatgcaag

SEQ ID NO: 385495 - DNA, 25 bp, Mus musculus
atgcaaggacgtacacgggagctcc

SEQ ID NO: 385496 - DNA, 25 bp, Mus musculus
ccctgggcgcgcagattatacgtag

SEQ ID NO: 385497 - DNA, 25 bp, Mus musculus
cgggagctccgcaaaagcgccatga

SEQ ID NO: 385498 - DNA, 25 bp, Mus musculus
aagcgccatgaacctccggctttga

SEQ ID NO: 385499 - DNA, 25 bp, Mus musculus
ggttccaacacctacaacaggcaga

SEQ ID NO: 385500 - DNA, 25 bp, Mus musculus
gactccggggactagcacaggaaga

SEQ ID NO: 385501 - DNA, 25 bp, Mus musculus
cgttgatgatgttgcgcgccagaag

SEQ ID NO: 385502 - DNA, 25 bp, Mus musculus
aagcccagaatcctcggagtcgaga

SEQ ID NO: 385503 - DNA, 25 bp, Mus musculus
agtcgagagacacgtcggagtctgt

SEQ ID NO: 385504 - DNA, 25 bp, Mus musculus
cccagccgtccaggctgctaggagg

SEQ ID NO: 385505 - DNA, 25 bp, Mus musculus
acaggaagaaggtccgatgggcaac

SEQ ID NO: 385506 - DNA, 25 bp, Mus musculus
ggatgccaggcgacttaagcccaga

SEQ ID NO: 385507 - DNA, 25 bp, Mus musculus
agagaaagcagctccacggaagtta

SEQ ID NO: 385508 - DNA, 25 bp, Mus musculus
ctccacggaagttacgggcagggct

SEQ ID NO: 385509 - DNA, 25 bp, Mus musculus
gcgacttaagcccagaatcctcgga

SEQ ID NO: 385510 - DNA, 25 bp, Mus musculus
gccgcgttgatgatgttgcgcgcca

SEQ ID NO: 385511 - DNA, 25 bp, Mus musculus
cctcggtctccgatcgcagcgggga

SEQ ID NO: 385512 - DNA, 25 bp, Mus musculus
ccagaagcgcctgcagctggcggct

SEQ ID NO: 385513 - DNA, 25 bp, Mus musculus
tcctcggagtcgagagacacgtcgg

SEQ ID NO: 385514 - DNA, 25 bp, Mus musculus
agcgccctaagcaaggtcctagccg

SEQ ID NO: 385515 - DNA, 25 bp, Mus musculus
aggtcctagccgctagaggctgaag

SEQ ID NO: 385516 - DNA, 25 bp, Mus musculus
agcaaggtcctagccgctagaggct

SEQ ID NO: 385517 - DNA, 25 bp, Mus musculus
taagcaaggtcctagccgctagagg

SEQ ID NO: 385518 - DNA, 25 bp, Mus musculus
cctaagcaaggtcctagccgctaga

SEQ ID NO: 385519 - DNA, 25 bp, Mus musculus
gccctaagcaaggtcctagccgcta

SEQ ID NO: 385520 - DNA, 25 bp, Mus musculus
tcagcgccctaagcaaggtcctagc

SEQ ID NO: 385521 - DNA, 25 bp, Mus musculus
actcagcgccctaagcaaggtccta

SEQ ID NO: 385522 - DNA, 25 bp, Mus musculus
acctggctacgtccgtgcgtgagcc

SEQ ID NO: 385523 - DNA, 25 bp, Mus musculus
ctcacctggctacgtccgtgcgtga

SEQ ID NO: 385524 - DNA, 25 bp, Mus musculus
cttggctcacctggctacgtccgtg

SEQ ID NO: 385525 - DNA, 25 bp, Mus musculus
ggcaccgctctcctgccgagcgctc

SEQ ID NO: 385526 - DNA, 25 bp, Mus musculus
ccgctagaggctgaaggggacccaa

SEQ ID NO: 385527 - DNA, 25 bp, Mus musculus
cagctgcgcaggtggcaagggcgag

SEQ ID NO: 385528 - DNA, 25 bp, Mus musculus
acgtgacgcgggctgcctttgaccc

SEQ ID NO: 385529 - DNA, 25 bp, Mus musculus
ctctcccggccgattcggtgctgtt

SEQ ID NO: 385530 - DNA, 25 bp, Mus musculus
ccgattcggtgctgttcggcgacca

SEQ ID NO: 385531 - DNA, 25 bp, Mus musculus
tgctgttcggcgaccacgtgacgcg

SEQ ID NO: 385532 - DNA, 25 bp, Mus musculus
cggccaggaatctctggctgggccc

SEQ ID NO: 385533 - DNA, 25 bp, Mus musculus
gcgacttacggccaggaatctctgg

SEQ ID NO: 385534 - DNA, 25 bp, Mus musculus
tcgctgcgacttacggccaggaatc

SEQ ID NO: 385535 - DNA, 25 bp, Mus musculus
aagactcgctctcgctgcgacttac

SEQ ID NO: 385536 - DNA, 25 bp, Mus musculus
agccaacaagttatttggggtcagg

SEQ ID NO: 385537 - DNA, 25 bp, Mus musculus
cctggggaagccaacaagttatttg

SEQ ID NO: 385538 - DNA, 25 bp, Mus musculus
caaagccctggggaagccaacaagt

SEQ ID NO: 385539 - DNA, 25 bp, Mus musculus
ccacccggattctccctcggctctc

SEQ ID NO: 385540 - DNA, 25 bp, Mus musculus
tgaccccgagcaaacaaagccctgg

SEQ ID NO: 385541 - DNA, 25 bp, Mus musculus
ggctgcctttgaccccggtctcgga

SEQ ID NO: 385542 - DNA, 25 bp, Mus musculus
tcatatcttccgtgagtgtgactgg

SEQ ID NO: 385543 - DNA, 25 bp, Mus musculus
tcacaggcagcaggcttggcaggtc

SEQ ID NO: 385544 - DNA, 25 bp, Mus musculus
agcgccggctcacaggcagcaggct

SEQ ID NO: 385545 - DNA, 25 bp, Mus musculus
tcgtgggtctactctacgtctccta

SEQ ID NO: 385546 - DNA, 25 bp, Mus musculus
tgggtctactctacgtctcctacct

SEQ ID NO: 385547 - DNA, 25 bp, Mus musculus
tcctacctcggcgtgaatccctgcc

SEQ ID NO: 385548 - DNA, 25 bp, Mus musculus
gatagcctcggagcgcttccaagtc

SEQ ID NO: 385549 - DNA, 25 bp, Mus musculus
ttccgactcatatcttccgtgagtg

SEQ ID NO: 385550 - DNA, 25 bp, Mus musculus
ggtgtcgtgggtctactctacgtct

SEQ ID NO: 385551 - DNA, 25 bp, Mus musculus
tcttccgtgagtgtgactggtaacc

SEQ ID NO: 385552 - DNA, 25 bp, Mus musculus
ccgtgagtgtgactggtaaccgata

SEQ ID NO: 385553 - DNA, 25 bp, Mus musculus
tgtgactggtaaccgatagcctcgg

SEQ ID NO: 385554 - DNA, 25 bp, Mus musculus
gtaaccgatagcctcggagcgcttc

SEQ ID NO: 385555 - DNA, 25 bp, Mus musculus
gtttctttccgactcatatcttccg

SEQ ID NO: 385556 - DNA, 25 bp, Mus musculus
ccagagaagcggatcaaccacctga

SEQ ID NO: 385557 - DNA, 25 bp, Mus musculus
agcctccgctccagacacagccagc

SEQ ID NO: 385558 - DNA, 25 bp, Mus musculus
tcgggctgtgccagctggacccgcc

SEQ ID NO: 385559 - DNA, 25 bp, Mus musculus
cccgagctccatggttcgcccagcc

SEQ ID NO: 385560 - DNA, 25 bp, Mus musculus
cccgcgcgatggtgactctgggtgc

SEQ ID NO: 385561 - DNA, 25 bp, Mus musculus
gagggtggctatgggagagccagca

SEQ ID NO: 385562 - DNA, 25 bp, Mus musculus
gagagccagcagatcgcagcagcgt

SEQ ID NO: 385563 - DNA, 25 bp, Mus musculus
gagccagcagatcgcagcagcgtga

SEQ ID NO: 385564 - DNA, 25 bp, Mus musculus
ccagcagatcgcagcagcgtgaagg

SEQ ID NO: 385565 - DNA, 25 bp, Mus musculus
agcagatcgcagcagcgtgaaggca

SEQ ID NO: 385566 - DNA, 25 bp, Mus musculus
cagccgacccgaaggtctgcggcgg

SEQ ID NO: 385567 - DNA, 25 bp, Mus musculus
gcacccagagaagcggatcaaccac

SEQ ID NO: 385568 - DNA, 25 bp, Mus musculus
agaagcggatcaaccacctgaaccc

SEQ ID NO: 385569 - DNA, 25 bp, Mus musculus
cagcacccagagaagcggatcaacc

SEQ ID NO: 385570 - DNA, 25 bp, Mus musculus
ctagcctctcggagcagagcgcagc

SEQ ID NO: 385571 - DNA, 25 bp, Mus musculus
atcgagacccggaggggtccacgca

SEQ ID NO: 385572 - DNA, 25 bp, Mus musculus
tgtcacttcgtcactcgcgcgtctt

SEQ ID NO: 385573 - DNA, 25 bp, Mus musculus
ggggtccacgccaaatgtcacttcg

SEQ ID NO: 385574 - DNA, 25 bp, Mus musculus
tcaagcatttgctggggtccacgcc

SEQ ID NO: 385575 - DNA, 25 bp, Mus musculus
agtagccagatgtggtcaagcattt

SEQ ID NO: 385576 - DNA, 25 bp, Mus musculus
cttgggaaacttgagagtagccaga

SEQ ID NO: 385577 - DNA, 25 bp, Mus musculus
tggatggacggcaagaatcgagacc

SEQ ID NO: 385578 - DNA, 25 bp, Mus musculus
gtttgcggccacaggcctgtcactc

SEQ ID NO: 385579 - DNA, 25 bp, Mus musculus
tggctacctcatttcgccgtttgcg

SEQ ID NO: 385580 - DNA, 25 bp, Mus musculus
gcgcctgtgccagcgggaaacaaac

SEQ ID NO: 385581 - DNA, 25 bp, Mus musculus
ctttcttctggaggaactggaaggc

SEQ ID NO: 385582 - DNA, 25 bp, Mus musculus
cctgtcctttggtgggctggacacc

SEQ ID NO: 385583 - DNA, 25 bp, Mus musculus
ggccgcggactttcttctggaggaa

SEQ ID NO: 385584 - DNA, 25 bp, Mus musculus
gtgtccgctccgagagttctcatag

SEQ ID NO: 385585 - DNA, 25 bp, Mus musculus
ggaagtccgtcaagctgcagcagca

SEQ ID NO: 385586 - DNA, 25 bp, Mus musculus
cctctggcctgagatggaggaaatc

SEQ ID NO: 385587 - DNA, 25 bp, Mus musculus
gcatcctttggccagggccgtctgc

SEQ ID NO: 385588 - DNA, 25 bp, Mus musculus
ccttgagaatcgtgcggcatccttt

SEQ ID NO: 385589 - DNA, 25 bp, Mus musculus
tctctctttccggtggaggagtctg

SEQ ID NO: 385590 - DNA, 25 bp, Mus musculus
gtgacctcagagatacacttccgga

SEQ ID NO: 385591 - DNA, 25 bp, Mus musculus
ctagcctgaggttctgatggcggaa

SEQ ID NO: 385592 - DNA, 25 bp, Mus musculus
atggaggtttcttccggaagcctgc

SEQ ID NO: 385593 - DNA, 25 bp, Mus musculus
tagcttcgctggaaaccgtgatgga

SEQ ID NO: 385594 - DNA, 25 bp, Mus musculus
cgtaccggcggttttagcttcgctg

SEQ ID NO: 385595 - DNA, 25 bp, Mus musculus
cgtagcaccggcttcttttataggc

SEQ ID NO: 385596 - DNA, 25 bp, Mus musculus
ttcggtcacagcaacacgtagcacc

SEQ ID NO: 385597 - DNA, 25 bp, Mus musculus
gttctcataggcagattcggtcaca

SEQ ID NO: 385598 - DNA, 25 bp, Mus musculus
agaacctcatgttcctcacttccgg

SEQ ID NO: 385599 - DNA, 25 bp, Mus musculus
cgcggacgtagcctgcttgcaacag

SEQ ID NO: 385600 - DNA, 25 bp, Mus musculus
gctcctttacttcccgcgccgcgcg

SEQ ID NO: 385601 - DNA, 25 bp, Mus musculus
agcctgcttgcaacagatgatggta

SEQ ID NO: 385602 - DNA, 25 bp, Mus musculus
caacagatgatggtaaatgagggga

SEQ ID NO: 385603 - DNA, 25 bp, Mus musculus
tgcttgcaacagatgatggtaaatg

SEQ ID NO: 385604 - DNA, 25 bp, Mus musculus
gacgtagcctgcttgcaacagatga

SEQ ID NO: 385605 - DNA, 25 bp, Mus musculus
ctggccgctctgctcctttacttcc

SEQ ID NO: 385606 - DNA, 25 bp, Mus musculus
ttccctcgcgccctagaacctcatg

SEQ ID NO: 385607 - DNA, 25 bp, Mus musculus
taaatgaggggaagcagctcccgcc

SEQ ID NO: 385608 - DNA, 25 bp, Mus musculus
ggccaggggattcacgtgcacgccc

SEQ ID NO: 385609 - DNA, 25 bp, Mus musculus
atctggccaggggattcacgtgcac

SEQ ID NO: 385610 - DNA, 25 bp, Mus musculus
tcggccatgccagagatctggccag

SEQ ID NO: 385611 - DNA, 25 bp, Mus musculus
ctggcctcggccatgccagagatct

SEQ ID NO: 385612 - DNA, 25 bp, Mus musculus
tccctggtcagcctactcagcttgg

SEQ ID NO: 385613 - DNA, 25 bp, Mus musculus
tcatcctcaccgacgaccaagggta

SEQ ID NO: 385614 - DNA, 25 bp, Mus musculus
accacgacgtgggataccatggctc

SEQ ID NO: 385615 - DNA, 25 bp, Mus musculus
ccagaccggcgtcgcaatgcatgct

SEQ ID NO: 385616 - DNA, 25 bp, Mus musculus
cgcaatgcatgctctctcaggattc

SEQ ID NO: 385617 - DNA, 25 bp, Mus musculus
taccatggctcggatatcgagaccc

SEQ ID NO: 385618 - DNA, 25 bp, Mus musculus
acctgtcctgggattgggctaagcc

SEQ ID NO: 385619 - DNA, 25 bp, Mus musculus
ctaagcccggccttgtggctgatgg

SEQ ID NO: 385620 - DNA, 25 bp, Mus musculus
cctgccgaggctggcgatcagcctt

SEQ ID NO: 385621 - DNA, 25 bp, Mus musculus
tggcgatcagccttcggtggctcca

SEQ ID NO: 385622 - DNA, 25 bp, Mus musculus
gctctctcaggattctccctggtca

SEQ ID NO: 385623 - DNA, 25 bp, Mus musculus
ccgagggctctgactgcatccaggc

SEQ ID NO: 385624 - DNA, 25 bp, Mus musculus
cgacgaccaagggtaccacgacgtg

SEQ ID NO: 385625 - DNA, 25 bp, Mus musculus
ccctagcgcggcaggctctgaggtc

SEQ ID NO: 385626 - DNA, 25 bp, Mus musculus
cgcagcgccctaggctgaggagaca

SEQ ID NO: 385627 - DNA, 25 bp, Mus musculus
tgacagaaaccatcggtcgcagtta

SEQ ID NO: 385628 - DNA, 25 bp, Mus musculus
gggtgcgtgacagaaaccatcggtc

SEQ ID NO: 385629 - DNA, 25 bp, Mus musculus
ctgcggattggagcggcccaagccc

SEQ ID NO: 385630 - DNA, 25 bp, Mus musculus
tgaggagacacccagacagatccga

SEQ ID NO: 385631 - DNA, 25 bp, Mus musculus
gtcgatcctcccagccttgctcagg

SEQ ID NO: 385632 - DNA, 25 bp, Mus musculus
tcgtgccctaccttgcggaggtgag

SEQ ID NO: 385633 - DNA, 25 bp, Mus musculus
cttggagcttcttcatcttggagag

SEQ ID NO: 385634 - DNA, 25 bp, Mus musculus
cttcttcatcttggagagccggcgc

SEQ ID NO: 385635 - DNA, 25 bp, Mus musculus
gcagcttgcaagagcgcagagagcc

SEQ ID NO: 385636 - DNA, 25 bp, Mus musculus
caagcgggcgccgagcactggtcct

SEQ ID NO: 385637 - DNA, 25 bp, Mus musculus
cactggtcctacctctgcgcctttg

SEQ ID NO: 385638 - DNA, 25 bp, Mus musculus
gtggggtgctacgaacgccctgcct

SEQ ID NO: 385639 - DNA, 25 bp, Mus musculus
acagatccgatgacggacagacggc

SEQ ID NO: 385640 - DNA, 25 bp, Mus musculus
ctggatgacggtccggtcccagctt

SEQ ID NO: 385641 - DNA, 25 bp, Mus musculus
acgtgcgtgtaacccgcgaagtcgg

SEQ ID NO: 385642 - DNA, 25 bp, Mus musculus
ggggagtccttgtccagcacatagc

SEQ ID NO: 385643 - DNA, 25 bp, Mus musculus
cacgtacatggtgaccgcagggtcc

SEQ ID NO: 385644 - DNA, 25 bp, Mus musculus
agccgggcggctttgcatttcaaag

SEQ ID NO: 385645 - DNA, 25 bp, Mus musculus
aggagacaaattgccgccctaagcg

SEQ ID NO: 385646 - DNA, 25 bp, Mus musculus
aaattgccgccctaagcgggaggtg

SEQ ID NO: 385647 - DNA, 25 bp, Mus musculus
catccattcgtagggcgtccgcctt

SEQ ID NO: 385648 - DNA, 25 bp, Mus musculus
agcacatagcccacgtacatggtga

SEQ ID NO: 385649 - DNA, 25 bp, Mus musculus
acgctgcgccgcatccattcgtagg

SEQ ID NO: 385650 - DNA, 25 bp, Mus musculus
ggcgccggctccacgtgcgtgtaac

SEQ ID NO: 385651 - DNA, 25 bp, Mus musculus
cccagtcgtccttgggcgcagggaa

SEQ ID NO: 385652 - DNA, 25 bp, Mus musculus
ggccataggcagctgcccagtcgtc

SEQ ID NO: 385653 - DNA, 25 bp, Mus musculus
tccgccttggcgctcctggcgagga

SEQ ID NO: 385654 - DNA, 25 bp, Mus musculus
acttacccggaggagcttgcgagcc

SEQ ID NO: 385655 - DNA, 25 bp, Mus musculus
gcccgaagaaggtagcaaggacacg

SEQ ID NO: 385656 - DNA, 25 bp, Mus musculus
caaggacacgagtctccgtggcacc

SEQ ID NO: 385657 - DNA, 25 bp, Mus musculus
agcacaccactgatcgccagggaga

SEQ ID NO: 385658 - DNA, 25 bp, Mus musculus
tgattgcgtgcgaccctcgcgcaag

SEQ ID NO: 385659 - DNA, 25 bp, Mus musculus
aagcgcaaccgactgggcctctgtt

SEQ ID NO: 385660 - DNA, 25 bp, Mus musculus
tctgttggaaccgattggaggctta

SEQ ID NO: 385661 - DNA, 25 bp, Mus musculus
aaggcggtctgcttccggccaaact

SEQ ID NO: 385662 - DNA, 25 bp, Mus musculus
tttcgctccctgagtccgagtcgcg

SEQ ID NO: 385663 - DNA, 25 bp, Mus musculus
gcttgcgagcctcgcggctcacatt

SEQ ID NO: 385664 - DNA, 25 bp, Mus musculus
acacacggcgcggagtcgccacagt

SEQ ID NO: 385665 - DNA, 25 bp, Mus musculus
cggctccacgcgtgacagcggtaaa

SEQ ID NO: 385666 - DNA, 25 bp, Mus musculus
tgctgctgatctgtgcactcgcgct

SEQ ID NO: 385667 - DNA, 25 bp, Mus musculus
gaggcgagagctcgcgcacgcatcc

SEQ ID NO: 385668 - DNA, 25 bp, Mus musculus
taaccctgggccactgcaggtctgc

SEQ ID NO: 385669 - DNA, 25 bp, Mus musculus
caccagtccttgtctcggctgcaga

SEQ ID NO: 385670 - DNA, 25 bp, Mus musculus
tctcggctgcagacgccctgctgat

SEQ ID NO: 385671 - DNA, 25 bp, Mus musculus
gccgcacgggtacaggcagtccagc

SEQ ID NO: 385672 - DNA, 25 bp, Mus musculus
gcagcggaccacagtcaccggagta

SEQ ID NO: 385673 - DNA, 25 bp, Mus musculus
ctcttgggtcgctgaagatcctcgg

SEQ ID NO: 385674 - DNA, 25 bp, Mus musculus
gtctgccaggtcagcaccagtcctt

SEQ ID NO: 385675 - DNA, 25 bp, Mus musculus
cggccgcttgcttcttaccgattgg

SEQ ID NO: 385676 - DNA, 25 bp, Mus musculus
taccgattggctgttctggactaca

SEQ ID NO: 385677 - DNA, 25 bp, Mus musculus
gttctggactacaagccacacgtca

SEQ ID NO: 385678 - DNA, 25 bp, Mus musculus
cgtcaatgtctgtgagtcttccgtg

SEQ ID NO: 385679 - DNA, 25 bp, Mus musculus
agtcttccgtggatcccgcgatcta

SEQ ID NO: 385680 - DNA, 25 bp, Mus musculus
gcgatctactgcgtgggcttgcgct

SEQ ID NO: 385681 - DNA, 25 bp, Mus musculus
tcaccggagtaaaggtgcggaagta

SEQ ID NO: 385682 - DNA, 25 bp, Mus musculus
cacccagagccagcctttagggatc

SEQ ID NO: 385683 - DNA, 25 bp, Mus musculus
agcacacactcctgtcatgcgcttg

SEQ ID NO: 385684 - DNA, 25 bp, Mus musculus
gcgtgcacacatgttcccgcaactg

SEQ ID NO: 385685 - DNA, 25 bp, Mus musculus
ttaggcttgcaacaggcacgggcta

SEQ ID NO: 385686 - DNA, 25 bp, Mus musculus
agtcccacgggtttccgccttgcag

SEQ ID NO: 385687 - DNA, 25 bp, Mus musculus
acagtagactctaggtggccctggc

SEQ ID NO: 385688 - DNA, 25 bp, Mus musculus
ctcctccggttagtgagagctggaa

SEQ ID NO: 385689 - DNA, 25 bp, Mus musculus
ccctggctggattctacctgcggga

SEQ ID NO: 385690 - DNA, 25 bp, Mus musculus
cccgccacaagtgcacgtgaaagta

SEQ ID NO: 385691 - DNA, 25 bp, Mus musculus
tacctgcgggaggaattgtagtacc

SEQ ID NO: 385692 - DNA, 25 bp, Mus musculus
tgacaggaaactctgcgctgccgga

SEQ ID NO: 385693 - DNA, 25 bp, Mus musculus
ggaagacgcaatctccgcccgcatg

SEQ ID NO: 385694 - DNA, 25 bp, Mus musculus
tccctcccagtgttatgcaaaacgg

SEQ ID NO: 385695 - DNA, 25 bp, Mus musculus
ggcacaaacgcttccacaccaggta

SEQ ID NO: 385696 - DNA, 25 bp, Mus musculus
agagcgcgccctcgcctttgtcagt

SEQ ID NO: 385697 - DNA, 25 bp, Mus musculus
ggagtcacttgcacccgctgggctc

SEQ ID NO: 385698 - DNA, 25 bp, Mus musculus
cgccggatgccctccggagtcactt

SEQ ID NO: 385699 - DNA, 25 bp, Mus musculus
ctcctggcggcatcctgtcgccgtc

SEQ ID NO: 385700 - DNA, 25 bp, Mus musculus
gcacctcatctgtccagcagctgtt

SEQ ID NO: 385701 - DNA, 25 bp, Mus musculus
actgtctgctgtgcacgcgcagagc

SEQ ID NO: 385702 - DNA, 25 bp, Mus musculus
ctcgcctttgtcagttgccactcta

SEQ ID NO: 385703 - DNA, 25 bp, Mus musculus
tcagttgccactctaaggccaggtt

SEQ ID NO: 385704 - DNA, 25 bp, Mus musculus
tctaaggccaggttgttttccgcgc

SEQ ID NO: 385705 - DNA, 25 bp, Mus musculus
gccaggttgttttccgcgcgcgctc

SEQ ID NO: 385706 - DNA, 25 bp, Mus musculus
tccctgagtcatccagcagccgagg

SEQ ID NO: 385707 - DNA, 25 bp, Mus musculus
tccagcagccgagggcgttcccaga

SEQ ID NO: 385708 - DNA, 25 bp, Mus musculus
gctctgggaagctccactgtctgct

SEQ ID NO: 385709 - DNA, 25 bp, Mus musculus
gaagctccactgtctgctgtgcacg

SEQ ID NO: 385710 - DNA, 25 bp, Mus musculus
cttcgatcgccacccaggagtattc

SEQ ID NO: 385711 - DNA, 25 bp, Mus musculus
tttgagacacccgacctcatcgggg

SEQ ID NO: 385712 - DNA, 25 bp, Mus musculus
actgcggccggggacaagctgcaac

SEQ ID NO: 385713 - DNA, 25 bp, Mus musculus
gccggggacaagctgcaaccgctgc

SEQ ID NO: 385714 - DNA, 25 bp, Mus musculus
cggcgcaggcaactgcagttcgcac

SEQ ID NO: 385715 - DNA, 25 bp, Mus musculus
aactgcagttcgcacggtggcaacg

SEQ ID NO: 385716 - DNA, 25 bp, Mus musculus
gaattcttcttcgatcgccacccag

SEQ ID NO: 385717 - DNA, 25 bp, Mus musculus
cccaggagtattcgcctatgtgctc

SEQ ID NO: 385718 - DNA, 25 bp, Mus musculus
attcgcctatgtgctcaattactac

SEQ ID NO: 385719 - DNA, 25 bp, Mus musculus
ctcttcgaggaagagctggctttct

SEQ ID NO: 385720 - DNA, 25 bp, Mus musculus
atgacctacaggcagcaccgggacg

SEQ ID NO: 385721 - DNA, 25 bp, Mus musculus
ccctggacatctttgagacacccga

SEQ ID NO: 385722 - DNA, 25 bp, Mus musculus
cggaggaggccctggacatctttga

SEQ ID NO: 385723 - DNA, 25 bp, Mus musculus
ggaggccgcgaattcttcttcgatc

SEQ ID NO: 385724 - DNA, 25 bp, Mus musculus
cgcgttctcctgacgcacagcaaga

SEQ ID NO: 385725 - DNA, 25 bp, Mus musculus
gcgatcaacatcaccaatggcgagg

SEQ ID NO: 385726 - DNA, 25 bp, Mus musculus
ggggacatttatctagcgatcaaca

SEQ ID NO: 385727 - DNA, 25 bp, Mus musculus
gatctggctctttcggggacattta

SEQ ID NO: 385728 - DNA, 25 bp, Mus musculus
caaactggtgcggaagatcggatct

SEQ ID NO: 385729 - DNA, 25 bp, Mus musculus
cgtcggtggaaaatacaaactggtg

SEQ ID NO: 385730 - DNA, 25 bp, Mus musculus
cagcggctccaaggccgaatttatc

SEQ ID NO: 385731 - DNA, 25 bp, Mus musculus
ttcgcgtctcaggatggcgagcagc

SEQ ID NO: 385732 - DNA, 25 bp, Mus musculus
ggaggcttccatcctcttcctgagg

SEQ ID NO: 385733 - DNA, 25 bp, Mus musculus
cttctcacttctgccgcgggtggaa

SEQ ID NO: 385734 - DNA, 25 bp, Mus musculus
gacgccgacagagccttgggtttag

SEQ ID NO: 385735 - DNA, 25 bp, Mus musculus
gctagagtaacaagatggcggcctc

SEQ ID NO: 385736 - DNA, 25 bp, Mus musculus
caatggcgaggtaatcacccggttc

SEQ ID NO: 385737 - DNA, 25 bp, Mus musculus
actaacaggtagcacgaagagagcc

SEQ ID NO: 385738 - DNA, 25 bp, Mus musculus
tggcgacgcctctcccgtcagatgg

SEQ ID NO: 385739 - DNA, 25 bp, Mus musculus
tcaggccggctcagcaggagtctcc

SEQ ID NO: 385740 - DNA, 25 bp, Mus musculus
cgcagcccggctactgcaggaggca

SEQ ID NO: 385741 - DNA, 25 bp, Mus musculus
tcacgagccgtgacaggcggccagc

SEQ ID NO: 385742 - DNA, 25 bp, Mus musculus
aaggacagccgtccgttctccgcgg

SEQ ID NO: 385743 - DNA, 25 bp, Mus musculus
gggttctcctgcagcccgcaggtcg

SEQ ID NO: 385744 - DNA, 25 bp, Mus musculus
tacccggagacgctcagctgcttct

SEQ ID NO: 385745 - DNA, 25 bp, Mus musculus
tcagatgggagttacctgaggccgc

SEQ ID NO: 385746 - DNA, 25 bp, Mus musculus
caggagacgaaaatggccgccacgc

SEQ ID NO: 385747 - DNA, 25 bp, Mus musculus
tggaaggcaagctggcgtccacact

SEQ ID NO: 385748 - DNA, 25 bp, Mus musculus
cacactcagcgcaggcgcgttggga

SEQ ID NO: 385749 - DNA, 25 bp, Mus musculus
ggcggcttgtccacgcggtcatctc

SEQ ID NO: 385750 - DNA, 25 bp, Mus musculus
tcgcaagatgaagacccggagccgg

SEQ ID NO: 385751 - DNA, 25 bp, Mus musculus
ctgacgcgcccaggagacgaaaatg

SEQ ID NO: 385752 - DNA, 25 bp, Mus musculus
ccagtgttcagccaggtgccggtgc

SEQ ID NO: 385753 - DNA, 25 bp, Mus musculus
gggttgcgtgaatcccttcaccatg

SEQ ID NO: 385754 - DNA, 25 bp, Mus musculus
tgaatcccttcaccatgcaggagga

SEQ ID NO: 385755 - DNA, 25 bp, Mus musculus
cttcaccatgcaggaggaccgtagc

SEQ ID NO: 385756 - DNA, 25 bp, Mus musculus
caccatgcaggaggaccgtagcatg

SEQ ID NO: 385757 - DNA, 25 bp, Mus musculus
accgtagcatggtgagcgtgccagt

SEQ ID NO: 385758 - DNA, 25 bp, Mus musculus
ccgcttcccgcagcatcaaccacga

SEQ ID NO: 385759 - DNA, 25 bp, Mus musculus
tgagcgtgccagtgttcagccaggt

SEQ ID NO: 385760 - DNA, 25 bp, Mus musculus
tctgtcctcaacctcctcgccctgg

SEQ ID NO: 385761 - DNA, 25 bp, Mus musculus
gacttgcccgaggcgcggtgcctat

SEQ ID NO: 385762 - DNA, 25 bp, Mus musculus
aacctcctcgccctgggccctgccg

SEQ ID NO: 385763 - DNA, 25 bp, Mus musculus
gcctatgtttgggttgcgtgaatcc

SEQ ID NO: 385764 - DNA, 25 bp, Mus musculus
cctgccgccagcgtgtcgtcatgga

SEQ ID NO: 385765 - DNA, 25 bp, Mus musculus
agcatggtgagcgtgccagtgttca

SEQ ID NO: 385766 - DNA, 25 bp, Mus musculus
gatcggcctctagcggttggcgctc

SEQ ID NO: 385767 - DNA, 25 bp, Mus musculus
tccggatcggcctctagcggttggc

SEQ ID NO: 385768 - DNA, 25 bp, Mus musculus
ccggtcagctgcgaaccctcttccc

SEQ ID NO: 385769 - DNA, 25 bp, Mus musculus
gctgcgaaccctcttcccgcccgtc

SEQ ID NO: 385770 - DNA, 25 bp, Mus musculus
cgtcctcagtgagcaccccaccgca

SEQ ID NO: 385771 - DNA, 25 bp, Mus musculus
ctgcagcggcggtggtgaggactgt

SEQ ID NO: 385772 - DNA, 25 bp, Mus musculus
aggactgtggccagcacggcgagca

SEQ ID NO: 385773 - DNA, 25 bp, Mus musculus
actgtggccagcacggcgagcagcg

SEQ ID NO: 385774 - DNA, 25 bp, Mus musculus
gtgaccgggcagcacgctccggatc

SEQ ID NO: 385775 - DNA, 25 bp, Mus musculus
cggcctctagcggttggcgctcgac

SEQ ID NO: 385776 - DNA, 25 bp, Mus musculus
ctccggatcggcctctagcggttgg

SEQ ID NO: 385777 - DNA, 25 bp, Mus musculus
gcggttggcgctcgactgtgcgccc

SEQ ID NO: 385778 - DNA, 25 bp, Mus musculus
cctctagcggttggcgctcgactgt

SEQ ID NO: 385779 - DNA, 25 bp, Mus musculus
tgaccgggcagcacgctccggatcg

SEQ ID NO: 385780 - DNA, 25 bp, Mus musculus
tcgcgcggtagatgtaaaatgtgac

SEQ ID NO: 385781 - DNA, 25 bp, Mus musculus
tcatcctcgagaagcgatcgcgcgg

SEQ ID NO: 385782 - DNA, 25 bp, Mus musculus
agtaggtatggggtcctcgcctcat

SEQ ID NO: 385783 - DNA, 25 bp, Mus musculus
tgaggacgcttgtctcacgaagctc

SEQ ID NO: 385784 - DNA, 25 bp, Mus musculus
tctcacgaagctcgtagtaggtatg

SEQ ID NO: 385785 - DNA, 25 bp, Mus musculus
ccaatgcgtaaaggagaagggcacg

SEQ ID NO: 385786 - DNA, 25 bp, Mus musculus
gacttccggtttcctgtgcgctgct

SEQ ID NO: 385787 - DNA, 25 bp, Mus musculus
tcccttgcaagagccgcggcgtgga

SEQ ID NO: 385788 - DNA, 25 bp, Mus musculus
gaacgcgccgccatgttccagagta

SEQ ID NO: 385789 - DNA, 25 bp, Mus musculus
gttccagagtagagcgccaacacta

SEQ ID NO: 385790 - DNA, 25 bp, Mus musculus
gtagagcgccaacactacgcctgcg

SEQ ID NO: 385791 - DNA, 25 bp, Mus musculus
ccctagcaggcacgggacttccggt

SEQ ID NO: 385792 - DNA, 25 bp, Mus musculus
gctactctgctgtccggtggtggat

SEQ ID NO: 385793 - DNA, 25 bp, Mus musculus
gctcttccgggcatggcgctactct

SEQ ID NO: 385794 - DNA, 25 bp, Mus musculus
ctgcttcggtccatggctccggcgt

SEQ ID NO: 385795 - DNA, 25 bp, Mus musculus
cgccctcctgctgggctagcagtga

SEQ ID NO: 385796 - DNA, 25 bp, Mus musculus
ggaatagacccgagcacgcctcgcc

SEQ ID NO: 385797 - DNA, 25 bp, Mus musculus
tgcgcgctcccggaatagacccgag

SEQ ID NO: 385798 - DNA, 25 bp, Mus musculus
cccagacaggatgctcgcaggacgc

SEQ ID NO: 385799 - DNA, 25 bp, Mus musculus
ctggagcactcagcccagggcgcag

SEQ ID NO: 385800 - DNA, 25 bp, Mus musculus
cgtgaatcctggagcactcagccca

SEQ ID NO: 385801 - DNA, 25 bp, Mus musculus
gagtgtcccggtccgcactggccaa

SEQ ID NO: 385802 - DNA, 25 bp, Mus musculus
tgctgggctagcagtgacagcctca

SEQ ID NO: 385803 - DNA, 25 bp, Mus musculus
ggctagcagtgacagcctcacggcc

SEQ ID NO: 385804 - DNA, 25 bp, Mus musculus
cctcggatctccaaggcctcccttc

SEQ ID NO: 385805 - DNA, 25 bp, Mus musculus
ccttcccagtcctacccagcctcgg

SEQ ID NO: 385806 - DNA, 25 bp, Mus musculus
acggcccacacgcttcggttcagtg

SEQ ID NO: 385807 - DNA, 25 bp, Mus musculus
ctccggcgtgaatcctggagcactc

SEQ ID NO: 385808 - DNA, 25 bp, Mus musculus
ctcttggccagttttgggagccaga

SEQ ID NO: 385809 - DNA, 25 bp, Mus musculus
tatcccagccggcaggctgcggagc

SEQ ID NO: 385810 - DNA, 25 bp, Mus musculus
caaggcgagccaggcgaaacctgag

SEQ ID NO: 385811 - DNA, 25 bp, Mus musculus
ctgcaagcggctcatgaatcccgcg

SEQ ID NO: 385812 - DNA, 25 bp, Mus musculus
aagcggctcatgaatcccgcgggtc

SEQ ID NO: 385813 - DNA, 25 bp, Mus musculus
cggctcatgaatcccgcgggtcgtc

SEQ ID NO: 385814 - DNA, 25 bp, Mus musculus
tctggggtctgggatgccaaggcga

SEQ ID NO: 385815 - DNA, 25 bp, Mus musculus
cgagccaggcgaaacctgagagctc

SEQ ID NO: 385816 - DNA, 25 bp, Mus musculus
ctgagagctcgccatccatgatgtg

SEQ ID NO: 385817 - DNA, 25 bp, Mus musculus
gctcgccatccatgatgtgggctcg

SEQ ID NO: 385818 - DNA, 25 bp, Mus musculus
catccatgatgtgggctcgcagctt

SEQ ID NO: 385819 - DNA, 25 bp, Mus musculus
tgccacctgctggacgcgccggcgc

SEQ ID NO: 385820 - DNA, 25 bp, Mus musculus
gtggctcgtgcgcaccccgcgttat

SEQ ID NO: 385821 - DNA, 25 bp, Mus musculus
gaaacctgagagctcgccatccatg

SEQ ID NO: 385822 - DNA, 25 bp, Mus musculus
caccagactttaggggaattgccca

SEQ ID NO: 385823 - DNA, 25 bp, Mus musculus
tcgctcgaacttggcaatggctgtg

SEQ ID NO: 385824 - DNA, 25 bp, Mus musculus
atggccaggacgataaccgacatga

SEQ ID NO: 385825 - DNA, 25 bp, Mus musculus
accgacatgaggatggccatgccca

SEQ ID NO: 385826 - DNA, 25 bp, Mus musculus
ccgttcctgagtgacgtcgtggtct

SEQ ID NO: 385827 - DNA, 25 bp, Mus musculus
aagaagtcgctgtcgttcccgtgtg

SEQ ID NO: 385828 - DNA, 25 bp, Mus musculus
ggcggactcctggaagcttcattca

SEQ ID NO: 385829 - DNA, 25 bp, Mus musculus
tgcgtcctgcacactcagctcgtgg

SEQ ID NO: 385830 - DNA, 25 bp, Mus musculus
gacgaccaggacatgctcagactta

SEQ ID NO: 385831 - DNA, 25 bp, Mus musculus
tgcccgttatgtgcaccagacttta

SEQ ID NO: 385832 - DNA, 25 bp, Mus musculus
cgtgcaacaactttgggccaatggc

SEQ ID NO: 385833 - DNA, 25 bp, Mus musculus
aatctagggctgctgtgcaacccgc

SEQ ID NO: 385834 - DNA, 25 bp, Mus musculus
tctggaggtgctacctgtccgttca

SEQ ID NO: 385835 - DNA, 25 bp, Mus musculus
ccgcagcctgaatgcctgagaagca

SEQ ID NO: 385836 - DNA, 25 bp, Mus musculus
gcggccatgataagcgtggtatttc

SEQ ID NO: 385837 - DNA, 25 bp, Mus musculus
accgagaatcgcgacagactcttcc

SEQ ID NO: 385838 - DNA, 25 bp, Mus musculus
ccgtcctagcgaagcggccatgata

SEQ ID NO: 385839 - DNA, 25 bp, Mus musculus
gggcctcaccgcgtccatgttaggt

SEQ ID NO: 385840 - DNA, 25 bp, Mus musculus
tagcagccggcccttcttccggtga

SEQ ID NO: 385841 - DNA, 25 bp, Mus musculus
aaatcgttgcatctgcggacgcctg

SEQ ID NO: 385842 - DNA, 25 bp, Mus musculus
ggtctggcccaagtctcgcatttgg

SEQ ID NO: 385843 - DNA, 25 bp, Mus musculus
ctctgcgtggcggaattagaaaact

SEQ ID NO: 385844 - DNA, 25 bp, Mus musculus
gccgcctctagcgtcttccgaagaa

SEQ ID NO: 385845 - DNA, 25 bp, Mus musculus
aggcgttcctcgattgactgactca

SEQ ID NO: 385846 - DNA, 25 bp, Mus musculus
gcctgaaaggccagcgctacacttc

SEQ ID NO: 385847 - DNA, 25 bp, Mus musculus
actctcctttctcggtcgctctagg

SEQ ID NO: 385848 - DNA, 25 bp, Mus musculus
ccatgttaggtgtggctccgtccta

SEQ ID NO: 385849 - DNA, 25 bp, Mus musculus
gccctccgtctgtttttgtggtgga

SEQ ID NO: 385850 - DNA, 25 bp, Mus musculus
ccgcggcgctctgcaaatatgagga

SEQ ID NO: 385851 - DNA, 25 bp, Mus musculus
tgttcccagccctcctgttgcatgg

SEQ ID NO: 385852 - DNA, 25 bp, Mus musculus
cctcctgttgcatggtgagttcggg

SEQ ID NO: 385853 - DNA, 25 bp, Mus musculus
tcgctgggtgcacagtgtgcccatt

SEQ ID NO: 385854 - DNA, 25 bp, Mus musculus
gcacagtgtgcccatttgccctttc

SEQ ID NO: 385855 - DNA, 25 bp, Mus musculus
agtgtgcccatttgccctttccggc

SEQ ID NO: 385856 - DNA, 25 bp, Mus musculus
agccctcctgttgcatggtgagttc

SEQ ID NO: 385857 - DNA, 25 bp, Mus musculus
acagagacggactacagcgaggccc

SEQ ID NO: 385858 - DNA, 25 bp, Mus musculus
agatgtcccgtgtgcgccgccttct

SEQ ID NO: 385859 - DNA, 25 bp, Mus musculus
tgtacctctgagctgtgcacgccgc

SEQ ID NO: 385860 - DNA, 25 bp, Mus musculus
tctgcaaatatgaggagagtctgcc

SEQ ID NO: 385861 - DNA, 25 bp, Mus musculus
tctgcttggatacctgttcccagcc

SEQ ID NO: 385862 - DNA, 25 bp, Mus musculus
ccgccttctgcttggatacctgttc

SEQ ID NO: 385863 - DNA, 25 bp, Mus musculus
aaatatgaggagagtctgccgcggc

SEQ ID NO: 385864 - DNA, 25 bp, Mus musculus
cccaagttcgggattctgagctgca

SEQ ID NO: 385865 - DNA, 25 bp, Mus musculus
ccgcgaaaaccgtctcggcgcctca

SEQ ID NO: 385866 - DNA, 25 bp, Mus musculus
ctcggctgcgacgatcacccaagtt

SEQ ID NO: 385867 - DNA, 25 bp, Mus musculus
tgcggagggcgctggctttactcac

SEQ ID NO: 385868 - DNA, 25 bp, Mus musculus
cctcacccagccgttcgggcctctt

SEQ ID NO: 385869 - DNA, 25 bp, Mus musculus
gattctgagctgcacccgagcccgg

SEQ ID NO: 385870 - DNA, 25 bp, Mus musculus
aagttcgggattctgagctgcaccc

SEQ ID NO: 385871 - DNA, 25 bp, Mus musculus
ctgcgacgatcacccaagttcggga

SEQ ID NO: 385872 - DNA, 25 bp, Mus musculus
cggcgacagcaaccgccgctccgga

SEQ ID NO: 385873 - DNA, 25 bp, Mus musculus
tcgtcctccgggacggcaacggcga

SEQ ID NO: 385874 - DNA, 25 bp, Mus musculus
gctaggcctgcaaggcctctccggg

SEQ ID NO: 385875 - DNA, 25 bp, Mus musculus
actcgggctccgctaggcctgcaag

SEQ ID NO: 385876 - DNA, 25 bp, Mus musculus
agggcgctggctttactcacggcac

SEQ ID NO: 385877 - DNA, 25 bp, Mus musculus
tcttcctctcgctgacagtctgggc

SEQ ID NO: 385878 - DNA, 25 bp, Mus musculus
atgcaccgcggcgtttgcagcagac

SEQ ID NO: 385879 - DNA, 25 bp, Mus musculus
tgcagtcggccgtgacagcatgcac

SEQ ID NO: 385880 - DNA, 25 bp, Mus musculus
tggccaaggcagagaagtagtacgt

SEQ ID NO: 385881 - DNA, 25 bp, Mus musculus
atggcagcccagaagatcaacgagg

SEQ ID NO: 385882 - DNA, 25 bp, Mus musculus
ggtcctcagggtttgctgctgctct

SEQ ID NO: 385883 - DNA, 25 bp, Mus musculus
cgctccgggtgtttttgctgagatc

SEQ ID NO: 385884 - DNA, 25 bp, Mus musculus
cggcttcactcttcgcgtcagcaag

SEQ ID NO: 385885 - DNA, 25 bp, Mus musculus
ttgagtccttcgcttcccgtagtcc

SEQ ID NO: 385886 - DNA, 25 bp, Mus musculus
ttgccacaggaagtttgagtccttc

SEQ ID NO: 385887 - DNA, 25 bp, Mus musculus
atttccgggacagctttgccacagg

SEQ ID NO: 385888 - DNA, 25 bp, Mus musculus
gcattcattccacccatttccggga

SEQ ID NO: 385889 - DNA, 25 bp, Mus musculus
tatcaccgcgcttgcgcgaggccta

SEQ ID NO: 385890 - DNA, 25 bp, Mus musculus
cggtgccttcccttgtgggtcaatc

SEQ ID NO: 385891 - DNA, 25 bp, Mus musculus
tgctgagatctaggcggcttcactc

SEQ ID NO: 385892 - DNA, 25 bp, Mus musculus
acccttccgaagtaagtgagtctgg

SEQ ID NO: 385893 - DNA, 25 bp, Mus musculus
cgacgtgtcccagggccaataggaa

SEQ ID NO: 385894 - DNA, 25 bp, Mus musculus
tgggaccttgctagtccgagcagta

SEQ ID NO: 385895 - DNA, 25 bp, Mus musculus
tggcccgcccatgaagtgtggaatc

SEQ ID NO: 385896 - DNA, 25 bp, Mus musculus
gccggaaccaagacccagacgcgga

SEQ ID NO: 385897 - DNA, 25 bp, Mus musculus
gatcgctgaattgctgctccgctca

SEQ ID NO: 385898 - DNA, 25 bp, Mus musculus
tgtggaatcggaatccagcggcagc

SEQ ID NO: 385899 - DNA, 25 bp, Mus musculus
aactttgcaagctctcactcccgga

SEQ ID NO: 385900 - DNA, 25 bp, Mus musculus
aggatagctgtcctctgcctgctct

SEQ ID NO: 385901 - DNA, 25 bp, Mus musculus
tggccgagagtttctagctgaaccc

SEQ ID NO: 385902 - DNA, 25 bp, Mus musculus
cgacgctcaggggttcctagagctg

SEQ ID NO: 385903 - DNA, 25 bp, Mus musculus
atgtcaggcccatgtctacctaggg

SEQ ID NO: 385904 - DNA, 25 bp, Mus musculus
cagggcgcggagaaacattcccgac

SEQ ID NO: 385905 - DNA, 25 bp, Mus musculus
cgctaccaccgcgactttagtgaga

SEQ ID NO: 385906 - DNA, 25 bp, Mus musculus
gcgcgcttttccggccattcataac

SEQ ID NO: 385907 - DNA, 25 bp, Mus musculus
aaggtgcaaagcactcctcccgtcg

SEQ ID NO: 385908 - DNA, 25 bp, Mus musculus
tgcgtcgctaggatgaagctcgtga

SEQ ID NO: 385909 - DNA, 25 bp, Mus musculus
cccagtatccggcagcttaaacgga

SEQ ID NO: 385910 - DNA, 25 bp, Mus musculus
ctctggagcctgaattctgtgaaca

SEQ ID NO: 385911 - DNA, 25 bp, Mus musculus
ctgaattctgtgaacagtcgggcca

SEQ ID NO: 385912 - DNA, 25 bp, Mus musculus
agtggcccgttttcttggcgaatcg

SEQ ID NO: 385913 - DNA, 25 bp, Mus musculus
agcagtggcccgttttcttggcgaa

SEQ ID NO: 385914 - DNA, 25 bp, Mus musculus
gtatccggcagcttaaacggagcag

SEQ ID NO: 385915 - DNA, 25 bp, Mus musculus
gaactgcgtcgctaggatgaagctc

SEQ ID NO: 385916 - DNA, 25 bp, Mus musculus
aacagtcgggccagaagggagaact

SEQ ID NO: 385917 - DNA, 25 bp, Mus musculus
ctcccgccctccgaaggtgcaaagc

SEQ ID NO: 385918 - DNA, 25 bp, Mus musculus
cgagccgcctctgcccacccagtat

SEQ ID NO: 385919 - DNA, 25 bp, Mus musculus
cccgccggtcttccaggaatggagg

SEQ ID NO: 385920 - DNA, 25 bp, Mus musculus
gcagggacatccacgattttaaact

SEQ ID NO: 385921 - DNA, 25 bp, Mus musculus
cgcgtgacggcaccctttacaaaga

SEQ ID NO: 385922 - DNA, 25 bp, Mus musculus
gctgactttgaggagaccgggctaa

SEQ ID NO: 385923 - DNA, 25 bp, Mus musculus
ttgttttcaccaagcgctgactttg

SEQ ID NO: 385924 - DNA, 25 bp, Mus musculus
tactagcttcgctgacctaaagttc

SEQ ID NO: 385925 - DNA, 25 bp, Mus musculus
gcgccgctgtgcttctgaaattgct

SEQ ID NO: 385926 - DNA, 25 bp, Mus musculus
cttccttttgcgtgcccacctgagg

SEQ ID NO: 385927 - DNA, 25 bp, Mus musculus
cgttggacgtcatttccgccacttc

SEQ ID NO: 385928 - DNA, 25 bp, Mus musculus
gacgcttccggcctcaaaactgaag

SEQ ID NO: 385929 - DNA, 25 bp, Mus musculus
ctccggctggaaatctggatcgctc

SEQ ID NO: 385930 - DNA, 25 bp, Mus musculus
ttgaccacggcaagtctggagcccg

SEQ ID NO: 385931 - DNA, 25 bp, Mus musculus
ctcggccttaccctctcatggtgaa

SEQ ID NO: 385932 - DNA, 25 bp, Mus musculus
gacccgcactctgagctgaggccta

SEQ ID NO: 385933 - DNA, 25 bp, Mus musculus
gctgtggtcaccaccggacattcca

SEQ ID NO: 385934 - DNA, 25 bp, Mus musculus
ctggactgggcgagttgagaaaccc

SEQ ID NO: 385935 - DNA, 25 bp, Mus musculus
tgagcgttttccaccctggctctct

SEQ ID NO: 385936 - DNA, 25 bp, Mus musculus
gccggtgtcagctgatttactgcag

SEQ ID NO: 385937 - DNA, 25 bp, Mus musculus
tttacggcaattgaggccggtgtca

SEQ ID NO: 385938 - DNA, 25 bp, Mus musculus
cggtgtcagccgatttacggcaatt

SEQ ID NO: 385939 - DNA, 25 bp, Mus musculus
tttgcgacagttgcagcggcgtcac

SEQ ID NO: 385940 - DNA, 25 bp, Mus musculus
ctggctctcttttgcgacagttgca

SEQ ID NO: 385941 - DNA, 25 bp, Mus musculus
ggctccttgcaaccaggcagggtga

SEQ ID NO: 385942 - DNA, 25 bp, Mus musculus
ggcgagttgagaaaccctgagcgtt

SEQ ID NO: 385943 - DNA, 25 bp, Mus musculus
gaccacgcctgcctggactgggcga

SEQ ID NO: 385944 - DNA, 25 bp, Mus musculus
atagtaaccagaccacgcctgcctg

SEQ ID NO: 385945 - DNA, 25 bp, Mus musculus
gcgggctccagtcgccatagtaacc

SEQ ID NO: 385946 - DNA, 25 bp, Mus musculus
agctgatttactgcagcagcagcgg

SEQ ID NO: 385947 - DNA, 25 bp, Mus musculus
gactgcgtccttatagcgggctcca

SEQ ID NO: 385948 - DNA, 25 bp, Mus musculus
cgcgcagaccctccatcttccattt

SEQ ID NO: 385949 - DNA, 25 bp, Mus musculus
tcttccatttcagctccgggccagg

SEQ ID NO: 385950 - DNA, 25 bp, Mus musculus
tggagatggcaacctcgctgggaac

SEQ ID NO: 385951 - DNA, 25 bp, Mus musculus
gagacgcactgctccttgtgctcca

SEQ ID NO: 385952 - DNA, 25 bp, Mus musculus
gtagggagcgggctcccgcttctct

SEQ ID NO: 385953 - DNA, 25 bp, Mus musculus
ttccatttcagctccgggccaggct

SEQ ID NO: 385954 - DNA, 25 bp, Mus musculus
agggagcgggctcccgcttctctcg

SEQ ID NO: 385955 - DNA, 25 bp, Mus musculus
actgctccttgtgctccaccgcccg

SEQ ID NO: 385956 - DNA, 25 bp, Mus musculus
cggagacgcactgctccttgtgctc

SEQ ID NO: 385957 - DNA, 25 bp, Mus musculus
cagccggagacgcactgctccttgt

SEQ ID NO: 385958 - DNA, 25 bp, Mus musculus
ctgggaacgcgctggggagcctgag

SEQ ID NO: 385959 - DNA, 25 bp, Mus musculus
atggcaacctcgctgggaacgcgct

SEQ ID NO: 385960 - DNA, 25 bp, Mus musculus
agatggcaacctcgctgggaacgcg

SEQ ID NO: 385961 - DNA, 25 bp, Mus musculus
atttcagctccgggccaggctcgac

SEQ ID NO: 385962 - DNA, 25 bp, Mus musculus
cccagagatggacaaggcttgaggt

SEQ ID NO: 385963 - DNA, 25 bp, Mus musculus
cccttctcatctaatgatgcgcagg

SEQ ID NO: 385964 - DNA, 25 bp, Mus musculus
aggtgagcgacctggctgagcacta

SEQ ID NO: 385965 - DNA, 25 bp, Mus musculus
acctggctgagcactagcggcggac

SEQ ID NO: 385966 - DNA, 25 bp, Mus musculus
actagcggcggactccgcaggcctg

SEQ ID NO: 385967 - DNA, 25 bp, Mus musculus
atctaatggcgcaggcgccgactgc

SEQ ID NO: 385968 - DNA, 25 bp, Mus musculus
tctaatgatgcgcaggtttattctc

SEQ ID NO: 385969 - DNA, 25 bp, Mus musculus
gcgcaggtttattctcttgaagccc

SEQ ID NO: 385970 - DNA, 25 bp, Mus musculus
ctcccttcctggatttctgcaattc

SEQ ID NO: 385971 - DNA, 25 bp, Mus musculus
ctggatttctgcaattccttagccc

SEQ ID NO: 385972 - DNA, 25 bp, Mus musculus
aagctagccttctgctgagggccgc

SEQ ID NO: 385973 - DNA, 25 bp, Mus musculus
tgaacccagagatggacaaggcttg

SEQ ID NO: 385974 - DNA, 25 bp, Mus musculus
ccctcgcccggtcgaagtcaccgcg

SEQ ID NO: 385975 - DNA, 25 bp, Mus musculus
ctgcgggaagctagccttctgctga

SEQ ID NO: 385976 - DNA, 25 bp, Mus musculus
ccgtgcattagaacacattagcgcc

SEQ ID NO: 385977 - DNA, 25 bp, Mus musculus
cggaaaattaccgtgcattagaaca

SEQ ID NO: 385978 - DNA, 25 bp, Mus musculus
actctcgggaagtggctagctagga

SEQ ID NO: 385979 - DNA, 25 bp, Mus musculus
agcctgctagctcccggcgagggac

SEQ ID NO: 385980 - DNA, 25 bp, Mus musculus
gcattttaaaagctagcctgctagc

SEQ ID NO: 385981 - DNA, 25 bp, Mus musculus
cgcctgcattttaaaagctagcctg

SEQ ID NO: 385982 - DNA, 25 bp, Mus musculus
taccagtctcggaaaattaccgtgc

SEQ ID NO: 385983 - DNA, 25 bp, Mus musculus
ttagaacacattagcgcctgcattt

SEQ ID NO: 385984 - DNA, 25 bp, Mus musculus
gccgtccctgtgaaccttccgccgc

SEQ ID NO: 385985 - DNA, 25 bp, Mus musculus
gattatgcacataccagtctcggaa

SEQ ID NO: 385986 - DNA, 25 bp, Mus musculus
tgttctctcccatagattatgcaca

SEQ ID NO: 385987 - DNA, 25 bp, Mus musculus
ctgagttgttctctcccatagatta

SEQ ID NO: 385988 - DNA, 25 bp, Mus musculus
agctcaggcgttctgagttgttctc

SEQ ID NO: 385989 - DNA, 25 bp, Mus musculus
ccagctctcaaacagctcaggcgtt

SEQ ID NO: 385990 - DNA, 25 bp, Mus musculus
agatgcctagtatgagccagagcct

SEQ ID NO: 385991 - DNA, 25 bp, Mus musculus
ggcgatcttcgcacagagggttcta

SEQ ID NO: 385992 - DNA, 25 bp, Mus musculus
gcagcttcactctcatgcgggacga

SEQ ID NO: 385993 - DNA, 25 bp, Mus musculus
agcccttacaaggagatgcctagta

SEQ ID NO: 385994 - DNA, 25 bp, Mus musculus
ccggcaacgtcagtggcagcttcac

SEQ ID NO: 385995 - DNA, 25 bp, Mus musculus
ggtggccttcacaatgctcagcaga

SEQ ID NO: 385996 - DNA, 25 bp, Mus musculus
tccgccgggccatgacaaaatgctc

SEQ ID NO: 385997 - DNA, 25 bp, Mus musculus
acactgccatgctgacccgcggtga

SEQ ID NO: 385998 - DNA, 25 bp, Mus musculus
tgagcaacacctgtcccgaggcctg

SEQ ID NO: 385999 - DNA, 25 bp, Mus musculus
gcggccatgatgtctcacctcaatg

SEQ ID NO: 386000 - DNA, 25 bp, Mus musculus
cttcgtcctcctcgggttctcaggt

SEQ ID NO: 386001 - DNA, 25 bp, Mus musculus
gtccgggcagctggaagagatcaac

SEQ ID NO: 386002 - DNA, 25 bp, Mus musculus
ttctatgccggtctcaggggactct

SEQ ID NO: 386003 - DNA, 25 bp, Mus musculus
gcgcgggcttccgtccatgaacaac

SEQ ID NO: 386004 - DNA, 25 bp, Mus musculus
ttaaagcgggagctgattgtacgcg

SEQ ID NO: 386005 - DNA, 25 bp, Mus musculus
gccctctattgttctaggaacactg

SEQ ID NO: 386006 - DNA, 25 bp, Mus musculus
agcttttgtgctcgcagaccggcct

SEQ ID NO: 386007 - DNA, 25 bp, Mus musculus
cggcggacacagtttcgagcttttg

SEQ ID NO: 386008 - DNA, 25 bp, Mus musculus
cgcaaaagcgaaaggcgcagcctgg

SEQ ID NO: 386009 - DNA, 25 bp, Mus musculus
acactgtaacctcccgtgtgggcgg

SEQ ID NO: 386010 - DNA, 25 bp, Mus musculus
taggaacactgtaacctcccgtgtg

SEQ ID NO: 386011 - DNA, 25 bp, Mus musculus
aggcgaggtacagccctctattgtt

SEQ ID NO: 386012 - DNA, 25 bp, Mus musculus
ctctagtggccaagaggcgaggtac

SEQ ID NO: 386013 - DNA, 25 bp, Mus musculus
tctgtgcctcctctagtggccaaga

SEQ ID NO: 386014 - DNA, 25 bp, Mus musculus
gagcgggcacggctctctgtgcctc

SEQ ID NO: 386015 - DNA, 25 bp, Mus musculus
ccggtcaacgcgctggttacattgt

SEQ ID NO: 386016 - DNA, 25 bp, Mus musculus
cgcctttgcattaaagcgggagctg

SEQ ID NO: 386017 - DNA, 25 bp, Mus musculus
tggttacattgttccggagcgggca

SEQ ID NO: 386018 - DNA, 25 bp, Mus musculus
agcgccattgcagctactaccgtgc

SEQ ID NO: 386019 - DNA, 25 bp, Mus musculus
cggaagcacgacaaggaacactggc

SEQ ID NO: 386020 - DNA, 25 bp, Mus musculus
gcctcatcccggagccggaaacgga

SEQ ID NO: 386021 - DNA, 25 bp, Mus musculus
tagagccaagtttccgccgagcctc

SEQ ID NO: 386022 - DNA, 25 bp, Mus musculus
ttgcagctactaccgtgcgcctgcg

SEQ ID NO: 386023 - DNA, 25 bp, Mus musculus
gtaagcggaactccagatgctcctg

SEQ ID NO: 386024 - DNA, 25 bp, Mus musculus
cggctcaccggtaagcggaactcca

SEQ ID NO: 386025 - DNA, 25 bp, Mus musculus
acccaggacggctcaccggtaagcg

SEQ ID NO: 386026 - DNA, 25 bp, Mus musculus
cgtcgggtcaggttcacctgcttaa

SEQ ID NO: 386027 - DNA, 25 bp, Mus musculus
caaggagcccggcagcgccattgca

SEQ ID NO: 386028 - DNA, 25 bp, Mus musculus
cctgtgccatgagcaagagatagcg

SEQ ID NO: 386029 - DNA, 25 bp, Mus musculus
caagagatagcgattcaaggagccc

SEQ ID NO: 386030 - DNA, 25 bp, Mus musculus
gctccgtcctggagaaaggctgccg

SEQ ID NO: 386031 - DNA, 25 bp, Mus musculus
cacctgcttaactgcggcgccagga

SEQ ID NO: 386032 - DNA, 25 bp, Mus musculus
tgcgctggacaaaacccgctgtttg

SEQ ID NO: 386033 - DNA, 25 bp, Mus musculus
tccgctcgaactgcgctggacaaaa

SEQ ID NO: 386034 - DNA, 25 bp, Mus musculus
ggctcgccggcccatttaacagatg

SEQ ID NO: 386035 - DNA, 25 bp, Mus musculus
agtgagaaacttccgctcgaactgc

SEQ ID NO: 386036 - DNA, 25 bp, Mus musculus
ttggggcaaattgtcagtgagaaac

SEQ ID NO: 386037 - DNA, 25 bp, Mus musculus
atctatctatttggggcaaattgtc

SEQ ID NO: 386038 - DNA, 25 bp, Mus musculus
gtcgctgctgacaaatctatctatt

SEQ ID NO: 386039 - DNA, 25 bp, Mus musculus
tcccgaaggtcgctgctgacaaatc

SEQ ID NO: 386040 - DNA, 25 bp, Mus musculus
cttccttcccgaaggtcgctgctga

SEQ ID NO: 386041 - DNA, 25 bp, Mus musculus
cagaccggtggctttttgcttcctt

SEQ ID NO: 386042 - DNA, 25 bp, Mus musculus
ccttcagaccggtggctttttgctt

SEQ ID NO: 386043 - DNA, 25 bp, Mus musculus
cagatgcgtaaaagcgcagcgcgga

SEQ ID NO: 386044 - DNA, 25 bp, Mus musculus
gccggcccatttaacagatgcgtaa

SEQ ID NO: 386045 - DNA, 25 bp, Mus musculus
cgggccgcacaaagggcggattaat

SEQ ID NO: 386046 - DNA, 25 bp, Mus musculus
cgtcttctcccatggtggccgcaaa

SEQ ID NO: 386047 - DNA, 25 bp, Mus musculus
cccaacttgggaagcgtgtcgctcg

SEQ ID NO: 386048 - DNA, 25 bp, Mus musculus
caacagctgcggatagccgggcaac

SEQ ID NO: 386049 - DNA, 25 bp, Mus musculus
agactctggaggctagtgacgaccg

SEQ ID NO: 386050 - DNA, 25 bp, Mus musculus
ggccagctcagattctctcaagaca

SEQ ID NO: 386051 - DNA, 25 bp, Mus musculus
ggccgcaaagggtgaactgctcttc

SEQ ID NO: 386052 - DNA, 25 bp, Mus musculus
acaagcctcttgtgcactgcgatgt

SEQ ID NO: 386053 - DNA, 25 bp, Mus musculus
tgacagccagcagtgccacgatgga

SEQ ID NO: 386054 - DNA, 25 bp, Mus musculus
tcgtcgaatcgcaagctgagcagga

SEQ ID NO: 386055 - DNA, 25 bp, Mus musculus
aacctggaaagctgctgttgctgtc

SEQ ID NO: 386056 - DNA, 25 bp, Mus musculus
tcgccgctctcacgctgagaggatt

SEQ ID NO: 386057 - DNA, 25 bp, Mus musculus
catcaaattgtagtgcagcggcttg

SEQ ID NO: 386058 - DNA, 25 bp, Mus musculus
ccatgaaagcggtgagcatcaaatt

SEQ ID NO: 386059 - DNA, 25 bp, Mus musculus
tccagcgcagtcattggagaccgca

SEQ ID NO: 386060 - DNA, 25 bp, Mus musculus
tctctaggcgcggatgtgcacgccc

SEQ ID NO: 386061 - DNA, 25 bp, Mus musculus
ctggcaccttgtgacccttgttgag

SEQ ID NO: 386062 - DNA, 25 bp, Mus musculus
gttctctggcaccttgtgacccttg

SEQ ID NO: 386063 - DNA, 25 bp, Mus musculus
gacgttctctggcaccttgtgaccc

SEQ ID NO: 386064 - DNA, 25 bp, Mus musculus
gttgacgttctctggcaccttgtga

SEQ ID NO: 386065 - DNA, 25 bp, Mus musculus
cttgttgacgttctctggcaccttg

SEQ ID NO: 386066 - DNA, 25 bp, Mus musculus
ctatgcttgttgacgttctctggca

SEQ ID NO: 386067 - DNA, 25 bp, Mus musculus
tggctatgcttgttgacgttctctg

SEQ ID NO: 386068 - DNA, 25 bp, Mus musculus
ccgctggctatgcttgttgacgttc

SEQ ID NO: 386069 - DNA, 25 bp, Mus musculus
ccgcggtgccgctggctatgcttgt

SEQ ID NO: 386070 - DNA, 25 bp, Mus musculus
catgaatttggtgtgcttgtgaggc

SEQ ID NO: 386071 - DNA, 25 bp, Mus musculus
cccgcatgaatttggtgtgcttgtg

SEQ ID NO: 386072 - DNA, 25 bp, Mus musculus
tctaggcgcggatgtgcacgcccac

SEQ ID NO: 386073 - DNA, 25 bp, Mus musculus
tcccggatcctgtcccgcatgaatt

SEQ ID NO: 386074 - DNA, 25 bp, Mus musculus
aggtggaagctgcaactggccaaga

SEQ ID NO: 386075 - DNA, 25 bp, Mus musculus
aaactggaacgactgccacgactcg

SEQ ID NO: 386076 - DNA, 25 bp, Mus musculus
ctcacgttcgcgaacgcagacgcaa

SEQ ID NO: 386077 - DNA, 25 bp, Mus musculus
gaacgcagacgcaacccaacttacg

SEQ ID NO: 386078 - DNA, 25 bp, Mus musculus
caacttacgcggctcgcggagcaga

SEQ ID NO: 386079 - DNA, 25 bp, Mus musculus
gcgctggccgaaagcatttccggga

SEQ ID NO: 386080 - DNA, 25 bp, Mus musculus
ctggccaagataaggccgttggctt

SEQ ID NO: 386081 - DNA, 25 bp, Mus musculus
ttctgccaacctggtcgaaactgga

SEQ ID NO: 386082 - DNA, 25 bp, Mus musculus
gaggattttccggtcgcttctgcca

SEQ ID NO: 386083 - DNA, 25 bp, Mus musculus
gcagctggccctgggcgacttgaac

SEQ ID NO: 386084 - DNA, 25 bp, Mus musculus
attcccgctaggtctgcggcgccag

SEQ ID NO: 386085 - DNA, 25 bp, Mus musculus
gggtcagcgcacctgattcccgcta

SEQ ID NO: 386086 - DNA, 25 bp, Mus musculus
ccgttggcttggagaccagctcctg

SEQ ID NO: 386087 - DNA, 25 bp, Mus musculus
cgcagccatgttggcgctggccgaa

SEQ ID NO: 386088 - DNA, 25 bp, Mus musculus
aaggcttccttgactgaggcgttgc

SEQ ID NO: 386089 - DNA, 25 bp, Mus musculus
gaacgtcgggcatccattggctaga

SEQ ID NO: 386090 - DNA, 25 bp, Mus musculus
cacctccgaggacatagacactgca

SEQ ID NO: 386091 - DNA, 25 bp, Mus musculus
cgcggatatgagtcagcggaacgtc

SEQ ID NO: 386092 - DNA, 25 bp, Mus musculus
tcacctagagcagcggtcgcggata

SEQ ID NO: 386093 - DNA, 25 bp, Mus musculus
gaggcgttgcatcagatcacctaga

SEQ ID NO: 386094 - DNA, 25 bp, Mus musculus
tcagcggccgccatttttagtcagg

SEQ ID NO: 386095 - DNA, 25 bp, Mus musculus
gacgcacagggctggagcaaaacca

SEQ ID NO: 386096 - DNA, 25 bp, Mus musculus
gcctcggcggaatcacgagactttc

SEQ ID NO: 386097 - DNA, 25 bp, Mus musculus
cccaacgtgcactgaaggcttcctt

SEQ ID NO: 386098 - DNA, 25 bp, Mus musculus
gccgcgccaagcactaagagaagtt

SEQ ID NO: 386099 - DNA, 25 bp, Mus musculus
agagaagttctagaattcggccgga

SEQ ID NO: 386100 - DNA, 25 bp, Mus musculus
tcagggaagagaacacttccggttc

SEQ ID NO: 386101 - DNA, 25 bp, Mus musculus
ccacgaatatttgggagtgcgccta

SEQ ID NO: 386102 - DNA, 25 bp, Mus musculus
gacaaacagagtccgggtgcccttc

SEQ ID NO: 386103 - DNA, 25 bp, Mus musculus
agagggcccgcacttgctccagaat

SEQ ID NO: 386104 - DNA, 25 bp, Mus musculus
ctgcatagtgcgagcccggctcaac

SEQ ID NO: 386105 - DNA, 25 bp, Mus musculus
gcataggcaacgctgaatcccaaga

SEQ ID NO: 386106 - DNA, 25 bp, Mus musculus
ccttggcaatgctactcaggtagta

SEQ ID NO: 386107 - DNA, 25 bp, Mus musculus
tgagaaccttccagacgccagctgg

SEQ ID NO: 386108 - DNA, 25 bp, Mus musculus
gggccgccacttgaccttgaattag

SEQ ID NO: 386109 - DNA, 25 bp, Mus musculus
ggcaggaccttgaacctcagccgga

SEQ ID NO: 386110 - DNA, 25 bp, Mus musculus
ccttcccgaagtactgcagctgtgc

SEQ ID NO: 386111 - DNA, 25 bp, Mus musculus
ccagtgtcccttcagagccaggaga

SEQ ID NO: 386112 - DNA, 25 bp, Mus musculus
ggcggtcgtaaaccagcaactagtg

SEQ ID NO: 386113 - DNA, 25 bp, Mus musculus
agcacggcttttgcctcagccaacg

SEQ ID NO: 386114 - DNA, 25 bp, Mus musculus
cgctcagtcgcatcccaggagaaga

SEQ ID NO: 386115 - DNA, 25 bp, Mus musculus
tgaattagtagactcggcccagctc

SEQ ID NO: 386116 - DNA, 25 bp, Mus musculus
gttacggtaaatgttcaagagggca

SEQ ID NO: 386117 - DNA, 25 bp, Mus musculus
gtgcaaccgtctccatgacgacatg

SEQ ID NO: 386118 - DNA, 25 bp, Mus musculus
gttcaagagggcaatggtctggcta

SEQ ID NO: 386119 - DNA, 25 bp, Mus musculus
atgacgacatgctccgattttgaaa

SEQ ID NO: 386120 - DNA, 25 bp, Mus musculus
ccgtcagcggactgggaagagtttt

SEQ ID NO: 386121 - DNA, 25 bp, Mus musculus
gctgactacgcagaagtccctccgg

SEQ ID NO: 386122 - DNA, 25 bp, Mus musculus
atggcagccgacactgctgactacg

SEQ ID NO: 386123 - DNA, 25 bp, Mus musculus
gacgactctggcatggcagccgaca

SEQ ID NO: 386124 - DNA, 25 bp, Mus musculus
gccattttcgcgcagacgactctgg

SEQ ID NO: 386125 - DNA, 25 bp, Mus musculus
acagttgactttgtctttttcggtg

SEQ ID NO: 386126 - DNA, 25 bp, Mus musculus
tttgaaataaaatgaacagttgact

SEQ ID NO: 386127 - DNA, 25 bp, Mus musculus
caatggtctggctaaaggtcggttt

SEQ ID NO: 386128 - DNA, 25 bp, Mus musculus
cagcacagcgcaaaccgtcagcgga

SEQ ID NO: 386129 - DNA, 25 bp, Mus musculus
ggtcggtttattgtgcaaccgtctc

SEQ ID NO: 386130 - DNA, 25 bp, Mus musculus
aagtgacagccacaggtatcaaact

SEQ ID NO: 386131 - DNA, 25 bp, Mus musculus
ccgcgttttctttcaacaagtgaca

SEQ ID NO: 386132 - DNA, 25 bp, Mus musculus
caggtatcaaactggggattaagga

SEQ ID NO: 386133 - DNA, 25 bp, Mus musculus
acaggtatcaaactggggattaagg

SEQ ID NO: 386134 - DNA, 25 bp, Mus musculus
gcgttttctttcaacaagtgacagc

SEQ ID NO: 386135 - DNA, 25 bp, Mus musculus
cgcctgccgcgttttctttcaacaa

SEQ ID NO: 386136 - DNA, 25 bp, Mus musculus
gcctgccgcgttttctttcaacaag

SEQ ID NO: 386137 - DNA, 25 bp, Mus musculus
gttttctttcaacaagtgacagcca

SEQ ID NO: 386138 - DNA, 25 bp, Mus musculus
tgccgcgttttctttcaacaagtga

SEQ ID NO: 386139 - DNA, 25 bp, Mus musculus
acaagtgacagccacaggtatcaaa

SEQ ID NO: 386140 - DNA, 25 bp, Mus musculus
tctttcaacaagtgacagccacagg

SEQ ID NO: 386141 - DNA, 25 bp, Mus musculus
tttcaacaagtgacagccacaggta

SEQ ID NO: 386142 - DNA, 25 bp, Mus musculus
ctgccgcgttttctttcaacaagtg

SEQ ID NO: 386143 - DNA, 25 bp, Mus musculus
tcaacaagtgacagccacaggtatc

SEQ ID NO: 386144 - DNA, 25 bp, Mus musculus
gtgaccgatctttgtctactctgtg

SEQ ID NO: 386145 - DNA, 25 bp, Mus musculus
ccaagtcacgtttcgggatctgtca

SEQ ID NO: 386146 - DNA, 25 bp, Mus musculus
ctgcttcggtaagaggagccgcgct

SEQ ID NO: 386147 - DNA, 25 bp, Mus musculus
gaagcctgtccagttggccgcgact

SEQ ID NO: 386148 - DNA, 25 bp, Mus musculus
ccgaccggacaaactggtttctctg

SEQ ID NO: 386149 - DNA, 25 bp, Mus musculus
tcctgcttcagtgacacgatctagg

SEQ ID NO: 386150 - DNA, 25 bp, Mus musculus
agccgggacctgaactgcttcggta

SEQ ID NO: 386151 - DNA, 25 bp, Mus musculus
actctgtgaccctgctttttcggca

SEQ ID NO: 386152 - DNA, 25 bp, Mus musculus
tttttcggcagttctcggctcccag

SEQ ID NO: 386153 - DNA, 25 bp, Mus musculus
tttcccgcccactgttgtcggcttg

SEQ ID NO: 386154 - DNA, 25 bp, Mus musculus
tgaccgcgccagctcggaaaactgg

SEQ ID NO: 386155 - DNA, 25 bp, Mus musculus
ctgcgctagcgctgcatggcacaca

SEQ ID NO: 386156 - DNA, 25 bp, Mus musculus
aaactggctgggtttagtgagagcc

SEQ ID NO: 386157 - DNA, 25 bp, Mus musculus
ggttgttgtacggagtcctgcttca

SEQ ID NO: 386158 - DNA, 25 bp, Mus musculus
gtgtgtcacgtctaggtagccgcag

SEQ ID NO: 386159 - DNA, 25 bp, Mus musculus
cctgggacttttcttgctaatgggc

SEQ ID NO: 386160 - DNA, 25 bp, Mus musculus
ttttcttgctaatgggcgctcggta

SEQ ID NO: 386161 - DNA, 25 bp, Mus musculus
ctgccgaggaacctagtggtgtctc

SEQ ID NO: 386162 - DNA, 25 bp, Mus musculus
cggagtccgtgacgtgtgtcacgtc

SEQ ID NO: 386163 - DNA, 25 bp, Mus musculus
tgggcaacttttctggaccacgatc

SEQ ID NO: 386164 - DNA, 25 bp, Mus musculus
tctctcgaggctgttgggcaacttt

SEQ ID NO: 386165 - DNA, 25 bp, Mus musculus
cagccggggctccaagattccgggt

SEQ ID NO: 386166 - DNA, 25 bp, Mus musculus
acggggcccactccactgtgagcgt

SEQ ID NO: 386167 - DNA, 25 bp, Mus musculus
aggtgagttcctgcccagagcgctg

SEQ ID NO: 386168 - DNA, 25 bp, Mus musculus
ctttcggaagaggaggtgagttcct

SEQ ID NO: 386169 - DNA, 25 bp, Mus musculus
agcctgtctacggactttcggaaga

SEQ ID NO: 386170 - DNA, 25 bp, Mus musculus
ctcggtagcggatgtgtgcagatcc

SEQ ID NO: 386171 - DNA, 25 bp, Mus musculus
ttcagccagtcgcagcgtccaggac

SEQ ID NO: 386172 - DNA, 25 bp, Mus musculus
caccatggcccatcggcttcggttt

SEQ ID NO: 386173 - DNA, 25 bp, Mus musculus
ggcgtgttgttgtcgctcgccctct

SEQ ID NO: 386174 - DNA, 25 bp, Mus musculus
cggtttcattttggctctggtcgca

SEQ ID NO: 386175 - DNA, 25 bp, Mus musculus
tggctctggtcgcagcaatacggcc

SEQ ID NO: 386176 - DNA, 25 bp, Mus musculus
gcccatcggcttcggtttcattttg

SEQ ID NO: 386177 - DNA, 25 bp, Mus musculus
ccctgagtctgagattctagaccag

SEQ ID NO: 386178 - DNA, 25 bp, Mus musculus
ctgagattctagaccaggagagaga

SEQ ID NO: 386179 - DNA, 25 bp, Mus musculus
gaggactttttcatggcattccaga

SEQ ID NO: 386180 - DNA, 25 bp, Mus musculus
attccagacgctgccacggagaagc

SEQ ID NO: 386181 - DNA, 25 bp, Mus musculus
actccttcacccagagcacagggga

SEQ ID NO: 386182 - DNA, 25 bp, Mus musculus
cgtgggcgctctcaagcgcagctca

SEQ ID NO: 386183 - DNA, 25 bp, Mus musculus
caagcgcagctcatccatgttcatc

SEQ ID NO: 386184 - DNA, 25 bp, Mus musculus
gatctccctgcagcgaaaggccgca

SEQ ID NO: 386185 - DNA, 25 bp, Mus musculus
aaaggccgcagacggtgccacagac

SEQ ID NO: 386186 - DNA, 25 bp, Mus musculus
tacggagtcgcgtgagaccgacttg

SEQ ID NO: 386187 - DNA, 25 bp, Mus musculus
gctcagcgagagcttggaccgcgct

SEQ ID NO: 386188 - DNA, 25 bp, Mus musculus
gccaccggcgtagccatgtcgctgt

SEQ ID NO: 386189 - DNA, 25 bp, Mus musculus
cagcccgggagcagtgcttcttcct

SEQ ID NO: 386190 - DNA, 25 bp, Mus musculus
gaactcttcgctccttgccagtggg

SEQ ID NO: 386191 - DNA, 25 bp, Mus musculus
cccgggtcgctacaggtgaaactgt

SEQ ID NO: 386192 - DNA, 25 bp, Mus musculus
gcagcggtccacagcccgaagtcaa

SEQ ID NO: 386193 - DNA, 25 bp, Mus musculus
ctgctccactgactctgaagcggca

SEQ ID NO: 386194 - DNA, 25 bp, Mus musculus
gcaggcttcctaactgtgccagttc

SEQ ID NO: 386195 - DNA, 25 bp, Mus musculus
gggaagctcctacgccgcaggcttc

SEQ ID NO: 386196 - DNA, 25 bp, Mus musculus
tgaggtaagcatcctcccacggtcc

SEQ ID NO: 386197 - DNA, 25 bp, Mus musculus
ccctctccggtgtgaggtaagcatc

SEQ ID NO: 386198 - DNA, 25 bp, Mus musculus
ccaaaggtctgctgagagcggacgc

SEQ ID NO: 386199 - DNA, 25 bp, Mus musculus
gcacactcgcaagcccaaaggtctg

SEQ ID NO: 386200 - DNA, 25 bp, Mus musculus
gtctcctctgaacccgacctggctc

SEQ ID NO: 386201 - DNA, 25 bp, Mus musculus
gtgccgttactcaccttcccgctca

SEQ ID NO: 386202 - DNA, 25 bp, Mus musculus
agcacaacctcacgtggctctcgga

SEQ ID NO: 386203 - DNA, 25 bp, Mus musculus
agccgcaggccaccggtcaggagca

SEQ ID NO: 386204 - DNA, 25 bp, Mus musculus
tcacgtggctctcggactcacaaca

SEQ ID NO: 386205 - DNA, 25 bp, Mus musculus
ggactcacaacaacatccggtcggg

SEQ ID NO: 386206 - DNA, 25 bp, Mus musculus
catccggtcgggctaaaataacatc

SEQ ID NO: 386207 - DNA, 25 bp, Mus musculus
agccgtcgtgccgtactgcgcgtgc

SEQ ID NO: 386208 - DNA, 25 bp, Mus musculus
gtgcgcgtgcttcccccacatttta

SEQ ID NO: 386209 - DNA, 25 bp, Mus musculus
gaagtctacggcttttgaagtttgc

SEQ ID NO: 386210 - DNA, 25 bp, Mus musculus
ttttgaagtttgctcgggcgtggca

SEQ ID NO: 386211 - DNA, 25 bp, Mus musculus
ctcgggcgtggcacttttaacttgg

SEQ ID NO: 386212 - DNA, 25 bp, Mus musculus
cctggtgatgacgtagcacaacctc

SEQ ID NO: 386213 - DNA, 25 bp, Mus musculus
cgcgtgcctggtgatgacgtagcac

SEQ ID NO: 386214 - DNA, 25 bp, Mus musculus
cccgctcggctcttgcacacagacc

SEQ ID NO: 386215 - DNA, 25 bp, Mus musculus
accagctccagtgggggccacgtga

SEQ ID NO: 386216 - DNA, 25 bp, Mus musculus
gccgtgcgcccgcagcctttcaacc

SEQ ID NO: 386217 - DNA, 25 bp, Mus musculus
gcagcctttcaacccgggcaggcga

SEQ ID NO: 386218 - DNA, 25 bp, Mus musculus
tcgccgcgctcccttttgttcgctc

SEQ ID NO: 386219 - DNA, 25 bp, Mus musculus
ctcccttttgttcgctcgccgcccg

SEQ ID NO: 386220 - DNA, 25 bp, Mus musculus
gacacgcccgtagcatggaagcctc

SEQ ID NO: 386221 - DNA, 25 bp, Mus musculus
cgctcgcactgcagcgggcgcagca

SEQ ID NO: 386222 - DNA, 25 bp, Mus musculus
gcggagcagaggtcgcccgagccac

SEQ ID NO: 386223 - DNA, 25 bp, Mus musculus
ggacacccgggcttgagcgctgcgg

SEQ ID NO: 386224 - DNA, 25 bp, Mus musculus
gcggcggcctgtcccaccctggctt

SEQ ID NO: 386225 - DNA, 25 bp, Mus musculus
cgcgacacgcccgtagcatggaagc

SEQ ID NO: 386226 - DNA, 25 bp, Mus musculus
cccttgccttggcctgagtgcggcg

SEQ ID NO: 386227 - DNA, 25 bp, Mus musculus
ccaccagcacctccgggccgggtcg

SEQ ID NO: 386228 - DNA, 25 bp, Mus musculus
gaccatgcgcggctcggagctctcg

SEQ ID NO: 386229 - DNA, 25 bp, Mus musculus
cgcggctcgctatagagagacgtca

SEQ ID NO: 386230 - DNA, 25 bp, Mus musculus
gcgcaggcttcctttatataaagtc

SEQ ID NO: 386231 - DNA, 25 bp, Mus musculus
tttatataaagtccagggccgcgtg

SEQ ID NO: 386232 - DNA, 25 bp, Mus musculus
gtctgcagcagtggctctcgaagcg

SEQ ID NO: 386233 - DNA, 25 bp, Mus musculus
agtggcagagctcctgagaaccgtc

SEQ ID NO: 386234 - DNA, 25 bp, Mus musculus
tcctgtcgctgctccgtcgggacaa

SEQ ID NO: 386235 - DNA, 25 bp, Mus musculus
gtcgggacaacgcactctcagccta

SEQ ID NO: 386236 - DNA, 25 bp, Mus musculus
gagggtttccctccaggaccatgcg

SEQ ID NO: 386237 - DNA, 25 bp, Mus musculus
tctcgctcttgctgttggctctggt

SEQ ID NO: 386238 - DNA, 25 bp, Mus musculus
agagacgtcagtgcgctcaggtccc

SEQ ID NO: 386239 - DNA, 25 bp, Mus musculus
gcacggtcctggctaagatgtatcc

SEQ ID NO: 386240 - DNA, 25 bp, Mus musculus
tgttggctctggtcctctgccaggc

SEQ ID NO: 386241 - DNA, 25 bp, Mus musculus
cctagtcgagagctctgagggtttc

SEQ ID NO: 386242 - DNA, 25 bp, Mus musculus
cagcagggctagcaaagaaaagttc

SEQ ID NO: 386243 - DNA, 25 bp, Mus musculus
ccctctgacagcgaggctgaatttc

SEQ ID NO: 386244 - DNA, 25 bp, Mus musculus
gctgaatttccgtttggcctctttc

SEQ ID NO: 386245 - DNA, 25 bp, Mus musculus
tccgtttggcctctttcgaagagta

SEQ ID NO: 386246 - DNA, 25 bp, Mus musculus
agtgtcccgcccaaggctggctggc

SEQ ID NO: 386247 - DNA, 25 bp, Mus musculus
ggacccgcagtttgtccctctgaca

SEQ ID NO: 386248 - DNA, 25 bp, Mus musculus
gaaaagttcggccaccaggctgggc

SEQ ID NO: 386249 - DNA, 25 bp, Mus musculus
gtgcacacagggctcgcagcaactc

SEQ ID NO: 386250 - DNA, 25 bp, Mus musculus
cgcagcgcctctagagggcttgcca

SEQ ID NO: 386251 - DNA, 25 bp, Mus musculus
gcttgccagggctttccgatggcct

SEQ ID NO: 386252 - DNA, 25 bp, Mus musculus
ttccgatggcctggatgtgctcttt

SEQ ID NO: 386253 - DNA, 25 bp, Mus musculus
gtgctctttggccttcaggcgcaga

SEQ ID NO: 386254 - DNA, 25 bp, Mus musculus
gcgggtacgcctcttccagcgagaa

SEQ ID NO: 386255 - DNA, 25 bp, Mus musculus
tttcgaagagtaggcgcgagtgtcc

SEQ ID NO: 386256 - DNA, 25 bp, Mus musculus
gtgcactttgcaaactggagctcga

SEQ ID NO: 386257 - DNA, 25 bp, Mus musculus
cccagggactttgcagccttgctga

SEQ ID NO: 386258 - DNA, 25 bp, Mus musculus
gccttgctgagcactcaccttcgta

SEQ ID NO: 386259 - DNA, 25 bp, Mus musculus
cctctctgcaggaaaggtgtctagg

SEQ ID NO: 386260 - DNA, 25 bp, Mus musculus
atgccgtcttccttggtaaagccca

SEQ ID NO: 386261 - DNA, 25 bp, Mus musculus
aggatggcttcgatgctgtgcaaac

SEQ ID NO: 386262 - DNA, 25 bp, Mus musculus
gtaggttaaccttgccggccagctc

SEQ ID NO: 386263 - DNA, 25 bp, Mus musculus
gaggttcctcctccgacagcttcga

SEQ ID NO: 386264 - DNA, 25 bp, Mus musculus
tcgatgcttcttcttgggaggttcc

SEQ ID NO: 386265 - DNA, 25 bp, Mus musculus
gaagcgacctctctacggccctagg

SEQ ID NO: 386266 - DNA, 25 bp, Mus musculus
ctccagctcgtgcagttggtaagtg

SEQ ID NO: 386267 - DNA, 25 bp, Mus musculus
caaagctaaactcggtggatcggtc

SEQ ID NO: 386268 - DNA, 25 bp, Mus musculus
gcgaagctccaagccgtcagtgaca

SEQ ID NO: 386269 - DNA, 25 bp, Mus musculus
cggtctgtccaaagctaaactcggc

SEQ ID NO: 386270 - DNA, 25 bp, Mus musculus
cgaaaggctgctcgtggaccgcgcc

SEQ ID NO: 386271 - DNA, 25 bp, Mus musculus
ttgctggcggccgtcgctgtagccc

SEQ ID NO: 386272 - DNA, 25 bp, Mus musculus
cttcccatcccgttgtcgctgagga

SEQ ID NO: 386273 - DNA, 25 bp, Mus musculus
tcgctgaggagcacctcgcagttcc

SEQ ID NO: 386274 - DNA, 25 bp, Mus musculus
agttcctcacgaggcgccgctcggg

SEQ ID NO: 386275 - DNA, 25 bp, Mus musculus
ctcccgcaacaaccgagtgatggtg

SEQ ID NO: 386276 - DNA, 25 bp, Mus musculus
tacccggatgtggagccgctctcgc

SEQ ID NO: 386277 - DNA, 25 bp, Mus musculus
caatgagtaactcccgcaacaaccg

SEQ ID NO: 386278 - DNA, 25 bp, Mus musculus
ccatgtaggcactgtacggagcttc

SEQ ID NO: 386279 - DNA, 25 bp, Mus musculus
aggggcctacgacctgcgtatcctg

SEQ ID NO: 386280 - DNA, 25 bp, Mus musculus
ctgtacggagcttcgagagtccgga

SEQ ID NO: 386281 - DNA, 25 bp, Mus musculus
gggacaacggcacggccgccaacta

SEQ ID NO: 386282 - DNA, 25 bp, Mus musculus
actaccgctgctcaggggcctacga

SEQ ID NO: 386283 - DNA, 25 bp, Mus musculus
cctggacgcggctgtacccggatgt

SEQ ID NO: 386284 - DNA, 25 bp, Mus musculus
cgcctggacaccgccatcttggatt

SEQ ID NO: 386285 - DNA, 25 bp, Mus musculus
catcgctctgcaccagatgcggccc

SEQ ID NO: 386286 - DNA, 25 bp, Mus musculus
gctcactgattggtggagcccgaga

SEQ ID NO: 386287 - DNA, 25 bp, Mus musculus
gccatcttggattctgggacgcaga

SEQ ID NO: 386288 - DNA, 25 bp, Mus musculus
ctccagcctggggaaccctccgcct

SEQ ID NO: 386289 - DNA, 25 bp, Mus musculus
ctgattggtggagcccgagagaccc

SEQ ID NO: 386290 - DNA, 25 bp, Mus musculus
gtgaattggctgaaagacagcagca

SEQ ID NO: 386291 - DNA, 25 bp, Mus musculus
ctcccggtgaattggctgaaagaca

SEQ ID NO: 386292 - DNA, 25 bp, Mus musculus
ccgtgccgtcgctcccggtgaattg

SEQ ID NO: 386293 - DNA, 25 bp, Mus musculus
aaacggcggtgtggcaactcggcct

SEQ ID NO: 386294 - DNA, 25 bp, Mus musculus
tatttgtactcgaaacggcggtgtg

SEQ ID NO: 386295 - DNA, 25 bp, Mus musculus
taaagctgtatttgtactcgaaacg

SEQ ID NO: 386296 - DNA, 25 bp, Mus musculus
aaaagggcacggtcccatcgctctg

SEQ ID NO: 386297 - DNA, 25 bp, Mus musculus
ggatggccaacagggcgctcactga

SEQ ID NO: 386298 - DNA, 25 bp, Mus musculus
cggttcccgcatgagatgaaagtca

SEQ ID NO: 386299 - DNA, 25 bp, Mus musculus
cccgggaatctcttctggacgttca

SEQ ID NO: 386300 - DNA, 25 bp, Mus musculus
agtatgctggagtcccgggaatctc

SEQ ID NO: 386301 - DNA, 25 bp, Mus musculus
tgcggcgctcaaacttggggccaga

SEQ ID NO: 386302 - DNA, 25 bp, Mus musculus
accatcggggaagctcgcggcttct

SEQ ID NO: 386303 - DNA, 25 bp, Mus musculus
aggctcttgcccagctgcctcttgg

SEQ ID NO: 386304 - DNA, 25 bp, Mus musculus
ttcctctcggtaggtccacgtgtgt

SEQ ID NO: 386305 - DNA, 25 bp, Mus musculus
gatcagctaacctctccgccagtgg

SEQ ID NO: 386306 - DNA, 25 bp, Mus musculus
caactcacaactgggagcgccgagg

SEQ ID NO: 386307 - DNA, 25 bp, Mus musculus
agagggcatccagcgtcccaactca

SEQ ID NO: 386308 - DNA, 25 bp, Mus musculus
tcaaagaagtctgcacccgagcgcg

SEQ ID NO: 386309 - DNA, 25 bp, Mus musculus
gcgatcccactaccaagcgacaaga

SEQ ID NO: 386310 - DNA, 25 bp, Mus musculus
aggacagtgtccctgcacagagcga

SEQ ID NO: 386311 - DNA, 25 bp, Mus musculus
tggatccgccacatgtgatcgtctg

SEQ ID NO: 386312 - DNA, 25 bp, Mus musculus
gcgcctgaacagagaggattccagc

SEQ ID NO: 386313 - DNA, 25 bp, Mus musculus
tgacgtcaccggagaagtcccgata

SEQ ID NO: 386314 - DNA, 25 bp, Mus musculus
gcgcctgcatgttcgggccaaatcg

SEQ ID NO: 386315 - DNA, 25 bp, Mus musculus
gggctagaatgtacgcgcctgcatg

SEQ ID NO: 386316 - DNA, 25 bp, Mus musculus
ttgaggtcatactcgggacggttca

SEQ ID NO: 386317 - DNA, 25 bp, Mus musculus
tacctagcagttcggcccgcggaca

SEQ ID NO: 386318 - DNA, 25 bp, Mus musculus
acccaacgcgggcaggtacctagca

SEQ ID NO: 386319 - DNA, 25 bp, Mus musculus
gtcggaacgcgccagtgaacccaac

SEQ ID NO: 386320 - DNA, 25 bp, Mus musculus
gggaccttagtctcccgtgcgcagc

SEQ ID NO: 386321 - DNA, 25 bp, Mus musculus
cccagagcccagattggggacctta

SEQ ID NO: 386322 - DNA, 25 bp, Mus musculus
cggcactcgcgattcatcttgcgca

SEQ ID NO: 386323 - DNA, 25 bp, Mus musculus
tccagcgctggtgctgcctactgaa

SEQ ID NO: 386324 - DNA, 25 bp, Mus musculus
gagacctgctccacttcgctcggtt

SEQ ID NO: 386325 - DNA, 25 bp, Mus musculus
tcccgataaaatgcgagagccggtc

SEQ ID NO: 386326 - DNA, 25 bp, Mus musculus
ctcgcgcctgggacgttcgaaggat

SEQ ID NO: 386327 - DNA, 25 bp, Mus musculus
agcagaagcgggacctgcagcagac

SEQ ID NO: 386328 - DNA, 25 bp, Mus musculus
tcgaccgcatgctgcgcgagcagaa

SEQ ID NO: 386329 - DNA, 25 bp, Mus musculus
tcagccggggcatcgaccgcatgct

SEQ ID NO: 386330 - DNA, 25 bp, Mus musculus
gctaaagaggcgaggaaagtcagcc

SEQ ID NO: 386331 - DNA, 25 bp, Mus musculus
ccggcgacaggagcagctacgagcc

SEQ ID NO: 386332 - DNA, 25 bp, Mus musculus
gcagaggatgctcagcccagcgccg

SEQ ID NO: 386333 - DNA, 25 bp, Mus musculus
gcctcggaaccctgcgcagaggatg

SEQ ID NO: 386334 - DNA, 25 bp, Mus musculus
tatgctacagcctgcggccgctgct

SEQ ID NO: 386335 - DNA, 25 bp, Mus musculus
cccgatgggcctatgctacagcctg

SEQ ID NO: 386336 - DNA, 25 bp, Mus musculus
agggtccgagtgcagcgctgcctcc

SEQ ID NO: 386337 - DNA, 25 bp, Mus musculus
gcacaatggcccttcggggcagtga

SEQ ID NO: 386338 - DNA, 25 bp, Mus musculus
acgttcgaaggatgcacaatggccc

SEQ ID NO: 386339 - DNA, 25 bp, Mus musculus
gctctcaggtgcgagctcgcgcctg

SEQ ID NO: 386340 - DNA, 25 bp, Mus musculus
ccaggttagggaaacgctcctctga

SEQ ID NO: 386341 - DNA, 25 bp, Mus musculus
gtccctcttctgactcaccaggtta

SEQ ID NO: 386342 - DNA, 25 bp, Mus musculus
agcggtcgcgcacatcagacagtaa

SEQ ID NO: 386343 - DNA, 25 bp, Mus musculus
gctgatggccacaatcgccctgtga

SEQ ID NO: 386344 - DNA, 25 bp, Mus musculus
gccctgtgaggaccctttggtacga

SEQ ID NO: 386345 - DNA, 25 bp, Mus musculus
ctgtgcttagccactacgaggggca

SEQ ID NO: 386346 - DNA, 25 bp, Mus musculus
cctgcctttaaggagcgtttccctg

SEQ ID NO: 386347 - DNA, 25 bp, Mus musculus
cctggccgtctctttcagtatcaga

SEQ ID NO: 386348 - DNA, 25 bp, Mus musculus
ttcctacttgcctgaccgcagagcg

SEQ ID NO: 386349 - DNA, 25 bp, Mus musculus
acagcagcaagaccgcggaagatca

SEQ ID NO: 386350 - DNA, 25 bp, Mus musculus
tagatgaaaaagaacgccgcgaggc

SEQ ID NO: 386351 - DNA, 25 bp, Mus musculus
agttgcagaaagagcgcctggctta

SEQ ID NO: 386352 - DNA, 25 bp, Mus musculus
atcagactgagcatcgctgggcgcc

SEQ ID NO: 386353 - DNA, 25 bp, Mus musculus
gtacgagaaagccacgcggaccagc

SEQ ID NO: 386354 - DNA, 25 bp, Mus musculus
gcgctacgcacagcgacccaggtga

SEQ ID NO: 386355 - DNA, 25 bp, Mus musculus
cgccacgccagtcactagaggattc

SEQ ID NO: 386356 - DNA, 25 bp, Mus musculus
aactccagtccgcacggtgacctgg

SEQ ID NO: 386357 - DNA, 25 bp, Mus musculus
tcatcggagcaccatggcggagcag

SEQ ID NO: 386358 - DNA, 25 bp, Mus musculus
ccgcgggccacaacaggtggaagca

SEQ ID NO: 386359 - DNA, 25 bp, Mus musculus
gaaccgtgagaatctgagccgccga

SEQ ID NO: 386360 - DNA, 25 bp, Mus musculus
ggcgactgtcgccacgaactccagt

SEQ ID NO: 386361 - DNA, 25 bp, Mus musculus
ttcagctctccacgtggcatcggct

SEQ ID NO: 386362 - DNA, 25 bp, Mus musculus
gctcagccggtgtacttcagctctc

SEQ ID NO: 386363 - DNA, 25 bp, Mus musculus
aaaacacaggcggagttgggatcgc

SEQ ID NO: 386364 - DNA, 25 bp, Mus musculus
cggcttcagagttcaaaggggaaca

SEQ ID NO: 386365 - DNA, 25 bp, Mus musculus
tggaccatcagacacggaaaagcta

SEQ ID NO: 386366 - DNA, 25 bp, Mus musculus
tcactaacgtgcgtgctggaccatc

SEQ ID NO: 386367 - DNA, 25 bp, Mus musculus
tcaaaggggaacagagcgctcgaac

SEQ ID NO: 386368 - DNA, 25 bp, Mus musculus
tcgatggacgcgacgttgaaaagta

SEQ ID NO: 386369 - DNA, 25 bp, Mus musculus
tgacggccgaaccagtccgagattt

SEQ ID NO: 386370 - DNA, 25 bp, Mus musculus
gcccgccttcgggatcaagtctgac

SEQ ID NO: 386371 - DNA, 25 bp, Mus musculus
cgggcctcgatctcaacatggagct

SEQ ID NO: 386372 - DNA, 25 bp, Mus musculus
gaagatctccgctttgatggacaaa

SEQ ID NO: 386373 - DNA, 25 bp, Mus musculus
agaaccaggtggatatgctgctcca

SEQ ID NO: 386374 - DNA, 25 bp, Mus musculus
gcccgtgtccagactgcagtgacga

SEQ ID NO: 386375 - DNA, 25 bp, Mus musculus
tgccatccgccagaagaatcaaggg

SEQ ID NO: 386376 - DNA, 25 bp, Mus musculus
ttgcgaggattcacgccgaaaatgc

SEQ ID NO: 386377 - DNA, 25 bp, Mus musculus
gccgcacgacgatgtccaacatgga

SEQ ID NO: 386378 - DNA, 25 bp, Mus musculus
gtgcggaccttcttgcaccggtgtc

SEQ ID NO: 386379 - DNA, 25 bp, Mus musculus
cgccgcacgccgtaatacaggaagt

SEQ ID NO: 386380 - DNA, 25 bp, Mus musculus
cggcgcagagtttgacgtcaccgtc

SEQ ID NO: 386381 - DNA, 25 bp, Mus musculus
tctggacgtccagacgcagcaaatg

SEQ ID NO: 386382 - DNA, 25 bp, Mus musculus
tccaggaagtcgcagctacaccgag

SEQ ID NO: 386383 - DNA, 25 bp, Mus musculus
ccgtggcagcttctcgggaatcagc

SEQ ID NO: 386384 - DNA, 25 bp, Mus musculus
ggccaaagtctcagccgccgtggca

SEQ ID NO: 386385 - DNA, 25 bp, Mus musculus
ttctcgggaatcagctcaggaagcc

SEQ ID NO: 386386 - DNA, 25 bp, Mus musculus
tgctcgaatagaggaccggctcgtt

SEQ ID NO: 386387 - DNA, 25 bp, Mus musculus
cagctacaccgagcggtggcaggaa

SEQ ID NO: 386388 - DNA, 25 bp, Mus musculus
agatggaaacctacgcagggctgcg

SEQ ID NO: 386389 - DNA, 25 bp, Mus musculus
tgcctgggaagagcaaatgcaaata

SEQ ID NO: 386390 - DNA, 25 bp, Mus musculus
ccgcgtcctggaacgtcagctgcgg

SEQ ID NO: 386391 - DNA, 25 bp, Mus musculus
ctgggacctcgatcgcggccatgaa

SEQ ID NO: 386392 - DNA, 25 bp, Mus musculus
tcatacgggaaacctagagccctcc

SEQ ID NO: 386393 - DNA, 25 bp, Mus musculus
tcaggaagccgcgagagtccttccg

SEQ ID NO: 386394 - DNA, 25 bp, Mus musculus
cggtgtcgatcatacgggaaaccta

SEQ ID NO: 386395 - DNA, 25 bp, Mus musculus
tgcaaataaagatggaaacctacgc

SEQ ID NO: 386396 - DNA, 25 bp, Mus musculus
ctcgaggcgcgcctacttgggctgc

SEQ ID NO: 386397 - DNA, 25 bp, Mus musculus
gtggcagtacccagctcctcagagc

SEQ ID NO: 386398 - DNA, 25 bp, Mus musculus
caagtgagtgcggtggcagtaccca

SEQ ID NO: 386399 - DNA, 25 bp, Mus musculus
ctccacggaacaccggagatgggcg

SEQ ID NO: 386400 - DNA, 25 bp, Mus musculus
acgagtgcttcgaggtggccgtgca

SEQ ID NO: 386401 - DNA, 25 bp, Mus musculus
gcgaagccacgatgaagccgagcag

SEQ ID NO: 386402 - DNA, 25 bp, Mus musculus
tccggcgaagccacgatgaagccga

SEQ ID NO: 386403 - DNA, 25 bp, Mus musculus
cagcacgcggaacagagcagaaggt

SEQ ID NO: 386404 - DNA, 25 bp, Mus musculus
ccgcagcacgcggaacagagcagaa

SEQ ID NO: 386405 - DNA, 25 bp, Mus musculus
gtccggccgcagcacgcggaacaga

SEQ ID NO: 386406 - DNA, 25 bp, Mus musculus
aaggcgagggcactgtgcggagcct

SEQ ID NO: 386407 - DNA, 25 bp, Mus musculus
cttcctgctgcaacgcgcgctggag

SEQ ID NO: 386408 - DNA, 25 bp, Mus musculus
aggcgcgcctacttgggctgcagcc

SEQ ID NO: 386409 - DNA, 25 bp, Mus musculus
ctcagagctccacggaacaccggag

SEQ ID NO: 386410 - DNA, 25 bp, Mus musculus
ccagggagccagaactattcgctgc

SEQ ID NO: 386411 - DNA, 25 bp, Mus musculus
catcaggcgagtgccgaccacgtac

SEQ ID NO: 386412 - DNA, 25 bp, Mus musculus
cccaggccagggagccagaactatt

SEQ ID NO: 386413 - DNA, 25 bp, Mus musculus
gccagaactattcgctgctcgcagg

SEQ ID NO: 386414 - DNA, 25 bp, Mus musculus
ctgctcgcaggagcgcagcctgtcg

SEQ ID NO: 386415 - DNA, 25 bp, Mus musculus
cagcctgtcgccaaggtcgggtcaa

SEQ ID NO: 386416 - DNA, 25 bp, Mus musculus
cgccaaggtcgggtcaagtcgtcgc

SEQ ID NO: 386417 - DNA, 25 bp, Mus musculus
ctgatagggcagtgatttaagagac

SEQ ID NO: 386418 - DNA, 25 bp, Mus musculus
tgatttaagagacgcggctttggga

SEQ ID NO: 386419 - DNA, 25 bp, Mus musculus
caggaggacccgcaccaatggagac

SEQ ID NO: 386420 - DNA, 25 bp, Mus musculus
caccaatggagaccgccagggacta

SEQ ID NO: 386421 - DNA, 25 bp, Mus musculus
gggactacgcgggagccctcatcag

SEQ ID NO: 386422 - DNA, 25 bp, Mus musculus
actattcgctgctcgcaggagcgca

SEQ ID NO: 386423 - DNA, 25 bp, Mus musculus
gagccctcatcaggcgagtgccgac

SEQ ID NO: 386424 - DNA, 25 bp, Mus musculus
ctgccagccggggtcaccaagggct

SEQ ID NO: 386425 - DNA, 25 bp, Mus musculus
ccaagggctgcaaatgtgcgggacc

SEQ ID NO: 386426 - DNA, 25 bp, Mus musculus
tcgggtcccgcgtaccgcttgattc

SEQ ID NO: 386427 - DNA, 25 bp, Mus musculus
cacctctgcactgaactggcggctg

SEQ ID NO: 386428 - DNA, 25 bp, Mus musculus
gtcacgtaaacagcgcgcggacagg

SEQ ID NO: 386429 - DNA, 25 bp, Mus musculus
cggcaaccgcgagcccacctctgca

SEQ ID NO: 386430 - DNA, 25 bp, Mus musculus
tcaatgacctttccggcaaccgcga

SEQ ID NO: 386431 - DNA, 25 bp, Mus musculus
gcggacagggatgccacctcaatga

SEQ ID NO: 386432 - DNA, 25 bp, Mus musculus
cactgcttcttaccgccgcgtaaga

SEQ ID NO: 386433 - DNA, 25 bp, Mus musculus
ttaagtcacgtaaacagcgcgcgga

SEQ ID NO: 386434 - DNA, 25 bp, Mus musculus
agaagtacatacattaagtcacgta

SEQ ID NO: 386435 - DNA, 25 bp, Mus musculus
ccgccgcgtaagaagtacatacatt

SEQ ID NO: 386436 - DNA, 25 bp, Mus musculus
ctgcactgaactggcggctgccagc

SEQ ID NO: 386437 - DNA, 25 bp, Mus musculus
agggatgccacctcaatgacctttc

SEQ ID NO: 386438 - DNA, 25 bp, Mus musculus
ccagatcggtaccaaggtgggtccg

SEQ ID NO: 386439 - DNA, 25 bp, Mus musculus
aaccttgcttctccgagccaggctg

SEQ ID NO: 386440 - DNA, 25 bp, Mus musculus
aggctgaccctgctcactcctggga

SEQ ID NO: 386441 - DNA, 25 bp, Mus musculus
tcactcctgggagagcaagtcccgg

SEQ ID NO: 386442 - DNA, 25 bp, Mus musculus
cagactcagtgatccggtccagaga

SEQ ID NO: 386443 - DNA, 25 bp, Mus musculus
catgctctgacaggacccgaccgta

SEQ ID NO: 386444 - DNA, 25 bp, Mus musculus
ttcccggctgcctttcgggcatgct

SEQ ID NO: 386445 - DNA, 25 bp, Mus musculus
caatgagtcatcctgtgagtcgcgc

SEQ ID NO: 386446 - DNA, 25 bp, Mus musculus
ctggagaggatcagcgtgtactaca

SEQ ID NO: 386447 - DNA, 25 bp, Mus musculus
atcagtgatgagcacggcatcgacc

SEQ ID NO: 386448 - DNA, 25 bp, Mus musculus
tccggctcgaagtagaccaccggtc

SEQ ID NO: 386449 - DNA, 25 bp, Mus musculus
cctcgcaagttttgggaagtgatca

SEQ ID NO: 386450 - DNA, 25 bp, Mus musculus
tcaggctcccggtctgactctctgt

SEQ ID NO: 386451 - DNA, 25 bp, Mus musculus
cccgaagggcgcgtcctcgagaact

SEQ ID NO: 386452 - DNA, 25 bp, Mus musculus
cattgtcagtgcaccagctggtaga

SEQ ID NO: 386453 - DNA, 25 bp, Mus musculus
cacatcactgcgtttccctggccaa

SEQ ID NO: 386454 - DNA, 25 bp, Mus musculus
aaccacttggtatccgccaccatga

SEQ ID NO: 386455 - DNA, 25 bp, Mus musculus
cacttacggggacctcaaccacttg

SEQ ID NO: 386456 - DNA, 25 bp, Mus musculus
tggtagagaacaccgacgagaccta

SEQ ID NO: 386457 - DNA, 25 bp, Mus musculus
gccctacaacgccacattgtcagtg

SEQ ID NO: 386458 - DNA, 25 bp, Mus musculus
gtctcagacaccgtggtggagccct

SEQ ID NO: 386459 - DNA, 25 bp, Mus musculus
gtcacccaaggtctcagacaccgtg

SEQ ID NO: 386460 - DNA, 25 bp, Mus musculus
gaacaccttcagcgtcatgccgtca

SEQ ID NO: 386461 - DNA, 25 bp, Mus musculus
agatccgagaggagtacccggaccg

SEQ ID NO: 386462 - DNA, 25 bp, Mus musculus
tcagcaagatccgagaggagtaccc

SEQ ID NO: 386463 - DNA, 25 bp, Mus musculus
cgactgtcttcagggcttccagctc

SEQ ID NO: 386464 - DNA, 25 bp, Mus musculus
agtgtgagcattgcgactgtcttca

SEQ ID NO: 386465 - DNA, 25 bp, Mus musculus
aagctgaccacacccacttacgggg

SEQ ID NO: 386466 - DNA, 25 bp, Mus musculus
cgcagcttatcggttcttcggaaac

SEQ ID NO: 386467 - DNA, 25 bp, Mus musculus
ataagcagagccagattcgcgaccg

SEQ ID NO: 386468 - DNA, 25 bp, Mus musculus
taggaggggccaaataagcagagcc

SEQ ID NO: 386469 - DNA, 25 bp, Mus musculus
ctagagatggtagccaatgagaact

SEQ ID NO: 386470 - DNA, 25 bp, Mus musculus
ggcgtggccagcctattaaagagcc

SEQ ID NO: 386471 - DNA, 25 bp, Mus musculus
ttcttcggaaactgcgcgccaccgg

SEQ ID NO: 386472 - DNA, 25 bp, Mus musculus
tcaagagaaacaccgcccacgggga

SEQ ID NO: 386473 - DNA, 25 bp, Mus musculus
cagctttcgcggcttccgcagctta

SEQ ID NO: 386474 - DNA, 25 bp, Mus musculus
caggcaacctctgggcacgagcagg

SEQ ID NO: 386475 - DNA, 25 bp, Mus musculus
cggtgaccttgacacctgcgccgga

SEQ ID NO: 386476 - DNA, 25 bp, Mus musculus
ggaccaggagacacaggccgtcacg

SEQ ID NO: 386477 - DNA, 25 bp, Mus musculus
ggagaaaagccgaggcgtgaccttc

SEQ ID NO: 386478 - DNA, 25 bp, Mus musculus
caggagacccgcgacagaacgcgaa

SEQ ID NO: 386479 - DNA, 25 bp, Mus musculus
cgagaccacggcagcgaggagaaaa

SEQ ID NO: 386480 - DNA, 25 bp, Mus musculus
tcccgattggagaagcgtttcgttc

SEQ ID NO: 386481 - DNA, 25 bp, Mus musculus
atctggagctcggagcacgtgttcg

SEQ ID NO: 386482 - DNA, 25 bp, Mus musculus
accagcaagcgctccggagcctgga

SEQ ID NO: 386483 - DNA, 25 bp, Mus musculus
atcctcagccggtttgtgtcggcgg

SEQ ID NO: 386484 - DNA, 25 bp, Mus musculus
gcgtcgcgatcccatcggtaatagg

SEQ ID NO: 386485 - DNA, 25 bp, Mus musculus
cagcctcccttgtagcggttgtcac

SEQ ID NO: 386486 - DNA, 25 bp, Mus musculus
tagcggttgtcacccactgtaccca

SEQ ID NO: 386487 - DNA, 25 bp, Mus musculus
gcttgggctcgggaaaaatctagac

SEQ ID NO: 386488 - DNA, 25 bp, Mus musculus
gtgtttggtcctgaatccctgtgca

SEQ ID NO: 386489 - DNA, 25 bp, Mus musculus
tgaatccctgtgcacccggacactt

SEQ ID NO: 386490 - DNA, 25 bp, Mus musculus
ggacacttccaagccaccagggaca

SEQ ID NO: 386491 - DNA, 25 bp, Mus musculus
gggacaccgtgaactgccacgagtg

SEQ ID NO: 386492 - DNA, 25 bp, Mus musculus
cccatcgagtgttttgattagcttt

SEQ ID NO: 386493 - DNA, 25 bp, Mus musculus
ttgagactttctgatcccgattgga

SEQ ID NO: 386494 - DNA, 25 bp, Mus musculus
agcgaaccaaggctgggaacagcgc

SEQ ID NO: 386495 - DNA, 25 bp, Mus musculus
ttgcttagtgtctctttgcgggtcg

SEQ ID NO: 386496 - DNA, 25 bp, Mus musculus
cacaaacgaccggtggccaatgagc

SEQ ID NO: 386497 - DNA, 25 bp, Mus musculus
atgcacagaggacccgccaggccag

SEQ ID NO: 386498 - DNA, 25 bp, Mus musculus
ggaggccggcagctcccacctagag

SEQ ID NO: 386499 - DNA, 25 bp, Mus musculus
cacctagagggacccggaaggagca

SEQ ID NO: 386500 - DNA, 25 bp, Mus musculus
acccggcttgagtttgcttagtgtc

SEQ ID NO: 386501 - DNA, 25 bp, Mus musculus
acgctgcccgggcaagcgaaccaag

SEQ ID NO: 386502 - DNA, 25 bp, Mus musculus
aacagcgcgggcgagcgcctttacg

SEQ ID NO: 386503 - DNA, 25 bp, Mus musculus
ggagtcgctctggtctctccgcgac

SEQ ID NO: 386504 - DNA, 25 bp, Mus musculus
gccgcccttggaaaaagaaggtgca

SEQ ID NO: 386505 - DNA, 25 bp, Mus musculus
tgctccgctcacgtgactcgtcgag

SEQ ID NO: 386506 - DNA, 25 bp, Mus musculus
cacgtgactcgtcgaggcggaaacc

SEQ ID NO: 386507 - DNA, 25 bp, Mus musculus
atccaaaacgtctagtcactgctgc

SEQ ID NO: 386508 - DNA, 25 bp, Mus musculus
ggagccgcagcactggaagcacacg

SEQ ID NO: 386509 - DNA, 25 bp, Mus musculus
ttctgcagttatgcgcccggaccct

SEQ ID NO: 386510 - DNA, 25 bp, Mus musculus
gctcgcccacagtctatttaagaac

SEQ ID NO: 386511 - DNA, 25 bp, Mus musculus
cttgaattcaatctggggcgattta

SEQ ID NO: 386512 - DNA, 25 bp, Mus musculus
gaaacggtcatctgaatcgccctcg

SEQ ID NO: 386513 - DNA, 25 bp, Mus musculus
tctgaatcgccctcgtcactggctg

SEQ ID NO: 386514 - DNA, 25 bp, Mus musculus
gtcactggctgcctagcgcttccag

SEQ ID NO: 386515 - DNA, 25 bp, Mus musculus
tagcgcttccagctttggcctgcga

SEQ ID NO: 386516 - DNA, 25 bp, Mus musculus
ggcctgcgagcgcaggtccctctga

SEQ ID NO: 386517 - DNA, 25 bp, Mus musculus
tctgagcccttcgaggctcatctcg

SEQ ID NO: 386518 - DNA, 25 bp, Mus musculus
ttgtagagccgcaggatctcctcca

SEQ ID NO: 386519 - DNA, 25 bp, Mus musculus
agcgccggagcatcgtctccgcgag

SEQ ID NO: 386520 - DNA, 25 bp, Mus musculus
tggtcgcgaagtcgctgtcaccggt

SEQ ID NO: 386521 - DNA, 25 bp, Mus musculus
accgagctgtgggttctgcagttat

SEQ ID NO: 386522 - DNA, 25 bp, Mus musculus
cctcgggctaacttgtacgtggaca

SEQ ID NO: 386523 - DNA, 25 bp, Mus musculus
tgtacgtggacatctggaaagcgcc

SEQ ID NO: 386524 - DNA, 25 bp, Mus musculus
aggctttctccggaggcagcgacat

SEQ ID NO: 386525 - DNA, 25 bp, Mus musculus
aacgcgttccttgtcagtcatttga

SEQ ID NO: 386526 - DNA, 25 bp, Mus musculus
acgatcgcgagttgcgccttctgtc

SEQ ID NO: 386527 - DNA, 25 bp, Mus musculus
ccttctgtcccaaggaggtggcctc

SEQ ID NO: 386528 - DNA, 25 bp, Mus musculus
cagtcatgttcgttccctgcgggga

SEQ ID NO: 386529 - DNA, 25 bp, Mus musculus
ctaacgaactttacactcctgatgg

SEQ ID NO: 386530 - DNA, 25 bp, Mus musculus
agggaccctaaacatctggcctcgg

SEQ ID NO: 386531 - DNA, 25 bp, Mus musculus
ctctacttgagttgacgcgatcgcc

SEQ ID NO: 386532 - DNA, 25 bp, Mus musculus
aggtcctcaccttgctcagctgctg

SEQ ID NO: 386533 - DNA, 25 bp, Mus musculus
ctgccatcggccttcctggtgtaaa

SEQ ID NO: 386534 - DNA, 25 bp, Mus musculus
ctcctgatggtgagtctctacttga

SEQ ID NO: 386535 - DNA, 25 bp, Mus musculus
cttaactgtcttcaaacggtgcggg

SEQ ID NO: 386536 - DNA, 25 bp, Mus musculus
ttcggccgacaagaacacggtcagc

SEQ ID NO: 386537 - DNA, 25 bp, Mus musculus
aagtacctggaacgtcggacgtcag

SEQ ID NO: 386538 - DNA, 25 bp, Mus musculus
aactcccgctcgatggttgccgaca

SEQ ID NO: 386539 - DNA, 25 bp, Mus musculus
tgccagcgacactgagcatccagtt

SEQ ID NO: 386540 - DNA, 25 bp, Mus musculus
caccaagtataacggctgccagcga

SEQ ID NO: 386541 - DNA, 25 bp, Mus musculus
gcgcgggcctaagactcaccaagta

SEQ ID NO: 386542 - DNA, 25 bp, Mus musculus
tcaggtctaagcctcacagcggtga

SEQ ID NO: 386543 - DNA, 25 bp, Mus musculus
gcgagcggaactaccacagcggaca

SEQ ID NO: 386544 - DNA, 25 bp, Mus musculus
tggcgccgccttcagaaccaacagg

SEQ ID NO: 386545 - DNA, 25 bp, Mus musculus
acccgcaaatgaccgagactccgtg

SEQ ID NO: 386546 - DNA, 25 bp, Mus musculus
tctggtatagagctccggccacagg

SEQ ID NO: 386547 - DNA, 25 bp, Mus musculus
cttcagctccggctctggtatagag

SEQ ID NO: 386548 - DNA, 25 bp, Mus musculus
gatccctcaggagcttaggccgccg

SEQ ID NO: 386549 - DNA, 25 bp, Mus musculus
cggcacctcggtgcttcaggtctaa

SEQ ID NO: 386550 - DNA, 25 bp, Mus musculus
tttgcactcgctgagcgggactccc

SEQ ID NO: 386551 - DNA, 25 bp, Mus musculus
cgggactccctaagccacaactttg

SEQ ID NO: 386552 - DNA, 25 bp, Mus musculus
cctaagaagctctggttacgcggtt

SEQ ID NO: 386553 - DNA, 25 bp, Mus musculus
gcggttgaaccacccactcaaattg

SEQ ID NO: 386554 - DNA, 25 bp, Mus musculus
gggaagtgtctactagctctgtgca

SEQ ID NO: 386555 - DNA, 25 bp, Mus musculus
ggtgctttcacttttccatcctccg

SEQ ID NO: 386556 - DNA, 25 bp, Mus musculus
ccagcttcgtctgctgctgcagcga

SEQ ID NO: 386557 - DNA, 25 bp, Mus musculus
cggccatgtttgtggcgcgcagcat

SEQ ID NO: 386558 - DNA, 25 bp, Mus musculus
tcgcggcggaccacaaggacctcat

SEQ ID NO: 386559 - DNA, 25 bp, Mus musculus
tccacgatgtgtctttcgacttcca

SEQ ID NO: 386560 - DNA, 25 bp, Mus musculus
atggccacctgctccagcgatcaga

SEQ ID NO: 386561 - DNA, 25 bp, Mus musculus
tccagcgatcagagcgtcaaggtgc

SEQ ID NO: 386562 - DNA, 25 bp, Mus musculus
acggatcacgtgttttcggaggcgc

SEQ ID NO: 386563 - DNA, 25 bp, Mus musculus
actcaaattggctgcgggaagtgtc

SEQ ID NO: 386564 - DNA, 25 bp, Mus musculus
tcccatctaaactgcgcggcttcgg

SEQ ID NO: 386565 - DNA, 25 bp, Mus musculus
cggcttcgggccttcaaatccagga

SEQ ID NO: 386566 - DNA, 25 bp, Mus musculus
ccgggctttggagcggccgcatcct

SEQ ID NO: 386567 - DNA, 25 bp, Mus musculus
ctgctctgtgagatcaggcgccggc

SEQ ID NO: 386568 - DNA, 25 bp, Mus musculus
ggacgttttcctggcgctcgtggct

SEQ ID NO: 386569 - DNA, 25 bp, Mus musculus
tttagcggacgttttcctggcgctc

SEQ ID NO: 386570 - DNA, 25 bp, Mus musculus
gaaggtttctcccatctaaactgcg

SEQ ID NO: 386571 - DNA, 25 bp, Mus musculus
gcttcctactggagggagagctcgc

SEQ ID NO: 386572 - DNA, 25 bp, Mus musculus
cttcaaatccaggaacacgcggttc

SEQ ID NO: 386573 - DNA, 25 bp, Mus musculus
acgccctcgcttcctactggaggga

SEQ ID NO: 386574 - DNA, 25 bp, Mus musculus
ttcttaccaatcacaggcttctgcc

SEQ ID NO: 386575 - DNA, 25 bp, Mus musculus
gcggttcttaccaatcacaggcttc

SEQ ID NO: 386576 - DNA, 25 bp, Mus musculus
tggagcggccgcatccttgttccct

SEQ ID NO: 386577 - DNA, 25 bp, Mus musculus
gaacacgcggttcttaccaatcaca

SEQ ID NO: 386578 - DNA, 25 bp, Mus musculus
tctctttgaccctcacggtggaata

SEQ ID NO: 386579 - DNA, 25 bp, Mus musculus
gcaggcgtgtgttgaatttctcttt

SEQ ID NO: 386580 - DNA, 25 bp, Mus musculus
tgctgttacacttaggctgggtctc

SEQ ID NO: 386581 - DNA, 25 bp, Mus musculus
ctggcattggctggcaaagtcgatt

SEQ ID NO: 386582 - DNA, 25 bp, Mus musculus
ctgcatgcaagctacggcagtcttg

SEQ ID NO: 386583 - DNA, 25 bp, Mus musculus
gtggcacttctaggcctgcatgcaa

SEQ ID NO: 386584 - DNA, 25 bp, Mus musculus
tgcttgtcccaagcggtggcacttc

SEQ ID NO: 386585 - DNA, 25 bp, Mus musculus
ccgctgtatagtggcttcatcctgc

SEQ ID NO: 386586 - DNA, 25 bp, Mus musculus
gtgctctagagtgtcccgctgtata

SEQ ID NO: 386587 - DNA, 25 bp, Mus musculus
tgcccatcctccgagagagcgttgg

SEQ ID NO: 386588 - DNA, 25 bp, Mus musculus
ccggagttcacctctgagctggagc

SEQ ID NO: 386589 - DNA, 25 bp, Mus musculus
ccggtggcaggtccctcttaaagag

SEQ ID NO: 386590 - DNA, 25 bp, Mus musculus
ctcttaaagagctacgccgcgccgt

SEQ ID NO: 386591 - DNA, 25 bp, Mus musculus
ccgaagggccctgcacttgcatttg

SEQ ID NO: 386592 - DNA, 25 bp, Mus musculus
cgctttagaagattgtagggactcc

SEQ ID NO: 386593 - DNA, 25 bp, Mus musculus
tcgcacatcgctcgaggttcggttg

SEQ ID NO: 386594 - DNA, 25 bp, Mus musculus
cgttcttctcgcacatcgctcgagg

SEQ ID NO: 386595 - DNA, 25 bp, Mus musculus
cgagttatcacagcgccaaggggcg

SEQ ID NO: 386596 - DNA, 25 bp, Mus musculus
tctccgagttatcacagcgccaagg

SEQ ID NO: 386597 - DNA, 25 bp, Mus musculus
gcccacagcttatctccgagttatc

SEQ ID NO: 386598 - DNA, 25 bp, Mus musculus
ccagtgcttatctgcccacagctta

SEQ ID NO: 386599 - DNA, 25 bp, Mus musculus
gaagattgtagggactccgaggttc

SEQ ID NO: 386600 - DNA, 25 bp, Mus musculus
cggtccttcgctttagaagattgta

SEQ ID NO: 386601 - DNA, 25 bp, Mus musculus
gtgtccggtccttcgctttagaaga

SEQ ID NO: 386602 - DNA, 25 bp, Mus musculus
ttcgcgggcccttgggcctccagct

SEQ ID NO: 386603 - DNA, 25 bp, Mus musculus
tcgctcgaggttcggttgtttcctc

SEQ ID NO: 386604 - DNA, 25 bp, Mus musculus
acatcgctcgaggttcggttgtttc

SEQ ID NO: 386605 - DNA, 25 bp, Mus musculus
tcccgggatactccggaccagcctc

SEQ ID NO: 386606 - DNA, 25 bp, Mus musculus
gacgtaacaaggcacgcgtggctcc

SEQ ID NO: 386607 - DNA, 25 bp, Mus musculus
gtgctgacgactcccgccgtcaagg

SEQ ID NO: 386608 - DNA, 25 bp, Mus musculus
aattgactaagtcccgggcgcactc

SEQ ID NO: 386609 - DNA, 25 bp, Mus musculus
gtctggccttggaattgactaagtc

SEQ ID NO: 386610 - DNA, 25 bp, Mus musculus
ttccaacgcggaggaagccacgctc

SEQ ID NO: 386611 - DNA, 25 bp, Mus musculus
ggactcgtagttccaacgcggagga

SEQ ID NO: 386612 - DNA, 25 bp, Mus musculus
tgcccgctcgcagggctagaggcac

SEQ ID NO: 386613 - DNA, 25 bp, Mus musculus
gcggaggacgagcaaacactaggcc

SEQ ID NO: 386614 - DNA, 25 bp, Mus musculus
tgaggaactgcctcggcagggccac

SEQ ID NO: 386615 - DNA, 25 bp, Mus musculus
tggggacgtctccacggattcccgc

SEQ ID NO: 386616 - DNA, 25 bp, Mus musculus
tacctctcaggatgtggggacgtct

SEQ ID NO: 386617 - DNA, 25 bp, Mus musculus
aggacccaggctacctctcaggatg

SEQ ID NO: 386618 - DNA, 25 bp, Mus musculus
ccacagcaaacaaggacccaggcta

SEQ ID NO: 386619 - DNA, 25 bp, Mus musculus
gtttccgcaaacagaatcgtggatg

SEQ ID NO: 386620 - DNA, 25 bp, Mus musculus
cctacgggaaacgaaagctcagctt

SEQ ID NO: 386621 - DNA, 25 bp, Mus musculus
caccgcgtcttctgacctacgggaa

SEQ ID NO: 386622 - DNA, 25 bp, Mus musculus
ggacagctgtgcgatcacccttgcc

SEQ ID NO: 386623 - DNA, 25 bp, Mus musculus
tgtggcaaatttcgtggagactctg

SEQ ID NO: 386624 - DNA, 25 bp, Mus musculus
catgagacgcatacatcagtgtggc

SEQ ID NO: 386625 - DNA, 25 bp, Mus musculus
ccagggtttgaacatcggagactta

SEQ ID NO: 386626 - DNA, 25 bp, Mus musculus
ccctgtatgcggctcacactttttt

SEQ ID NO: 386627 - DNA, 25 bp, Mus musculus
tgggaatagggacaccagccctgta

SEQ ID NO: 386628 - DNA, 25 bp, Mus musculus
aaagtcacctccaagcgccgaatcg

SEQ ID NO: 386629 - DNA, 25 bp, Mus musculus
gggatgctcagaagcgcgcaaagtc

SEQ ID NO: 386630 - DNA, 25 bp, Mus musculus
cacaacagtggctcacggagggttc

SEQ ID NO: 386631 - DNA, 25 bp, Mus musculus
gcactgtggctcgatctgtgtggaa

SEQ ID NO: 386632 - DNA, 25 bp, Mus musculus
tcagcttggaatccaggcggccaac

SEQ ID NO: 386633 - DNA, 25 bp, Mus musculus
agggctaagccggtccacaacagtg

SEQ ID NO: 386634 - DNA, 25 bp, Mus musculus
cagcgccttctctttataagccgca

SEQ ID NO: 386635 - DNA, 25 bp, Mus musculus
ttgagtcagagatcaaggccggcca

SEQ ID NO: 386636 - DNA, 25 bp, Mus musculus
tcccggcgaggtctttcacgctgcg

SEQ ID NO: 386637 - DNA, 25 bp, Mus musculus
cgaggtctttcacgctgcgggaaca

SEQ ID NO: 386638 - DNA, 25 bp, Mus musculus
ttcacgctgcgggaacaacgctttt

SEQ ID NO: 386639 - DNA, 25 bp, Mus musculus
ctgcgggaacaacgcttttgagtca

SEQ ID NO: 386640 - DNA, 25 bp, Mus musculus
aacaacgcttttgagtcagagatca

SEQ ID NO: 386641 - DNA, 25 bp, Mus musculus
gagccacgacctgagtgagtcccac

SEQ ID NO: 386642 - DNA, 25 bp, Mus musculus
catcttggcggcctctctaggcgct

SEQ ID NO: 386643 - DNA, 25 bp, Mus musculus
gcggcctctctaggcgctctgttta

SEQ ID NO: 386644 - DNA, 25 bp, Mus musculus
aggcgctctgtttaccactctatgg

SEQ ID NO: 386645 - DNA, 25 bp, Mus musculus
ttctctttataagccgcagtgcccg

SEQ ID NO: 386646 - DNA, 25 bp, Mus musculus
ccagtcattgtctggtggagcagcc

SEQ ID NO: 386647 - DNA, 25 bp, Mus musculus
ttaccactctatggtcgcgtgctcc

SEQ ID NO: 386648 - DNA, 25 bp, Mus musculus
ctggagcaagaggagactacaaatc

SEQ ID NO: 386649 - DNA, 25 bp, Mus musculus
ccaccgactaatgactctgaaactc

SEQ ID NO: 386650 - DNA, 25 bp, Mus musculus
cctgccacctcggacgggatgctag

SEQ ID NO: 386651 - DNA, 25 bp, Mus musculus
ggggagatcagcgacgacgacaaca

SEQ ID NO: 386652 - DNA, 25 bp, Mus musculus
gaaactcaggtctgcggctgaaaga

SEQ ID NO: 386653 - DNA, 25 bp, Mus musculus
ttctacagaggctttctcgcgaggc

SEQ ID NO: 386654 - DNA, 25 bp, Mus musculus
aggaatttctcacgctcacggcacc

SEQ ID NO: 386655 - DNA, 25 bp, Mus musculus
ccgcaggaaatgacgctcgggaccc

SEQ ID NO: 386656 - DNA, 25 bp, Mus musculus
cgccttccggcgtgccgcaggaaat

SEQ ID NO: 386657 - DNA, 25 bp, Mus musculus
agcagctaccgacccaaagaaccgt

SEQ ID NO: 386658 - DNA, 25 bp, Mus musculus
gggcgcttcctgtctcgcaagactc

SEQ ID NO: 386659 - DNA, 25 bp, Mus musculus
cacaagggcgaagcctggagcaaga

SEQ ID NO: 386660 - DNA, 25 bp, Mus musculus
gctgaaagagcatgtccgcaaccca

SEQ ID NO: 386661 - DNA, 25 bp, Mus musculus
ctctagcggcctctcgccgaaggaa

SEQ ID NO: 386662 - DNA, 25 bp, Mus musculus
cccacccatttctttgctgaacttg

SEQ ID NO: 386663 - DNA, 25 bp, Mus musculus
cacccatttctttgctgaacttgca

SEQ ID NO: 386664 - DNA, 25 bp, Mus musculus
aagcagggggatagacatgaccgcc

SEQ ID NO: 386665 - DNA, 25 bp, Mus musculus
gatcttggctgtgtgtctgcggatc

SEQ ID NO: 386666 - DNA, 25 bp, Mus musculus
agtcagggatcttggctgtgtgtct

SEQ ID NO: 386667 - DNA, 25 bp, Mus musculus
ttaagagtcagggatcttggctgtg

SEQ ID NO: 386668 - DNA, 25 bp, Mus musculus
ttggtgttaagagtcagggatcttg

SEQ ID NO: 386669 - DNA, 25 bp, Mus musculus
tctttgctgaacttgcaattccgtg

SEQ ID NO: 386670 - DNA, 25 bp, Mus musculus
agaagagagttggtgttaagagtca

SEQ ID NO: 386671 - DNA, 25 bp, Mus musculus
attccgtgcgcctcgccgtgttccc

SEQ ID NO: 386672 - DNA, 25 bp, Mus musculus
ttgcaattccgtgcgcctcgccgtg

SEQ ID NO: 386673 - DNA, 25 bp, Mus musculus
gaacttgcaattccgtgcgcctcgc

SEQ ID NO: 386674 - DNA, 25 bp, Mus musculus
ctgaacttgcaattccgtgcgcctc

SEQ ID NO: 386675 - DNA, 25 bp, Mus musculus
tgctgaacttgcaattccgtgcgcc

SEQ ID NO: 386676 - DNA, 25 bp, Mus musculus
gctctggtgtcaggtttcggggccc

SEQ ID NO: 386677 - DNA, 25 bp, Mus musculus
gctccttgcgtctgcaacctgtggc

SEQ ID NO: 386678 - DNA, 25 bp, Mus musculus
ctgctccttgcgtctgcaacctgtg

SEQ ID NO: 386679 - DNA, 25 bp, Mus musculus
gggcactgctccttgcgtctgcaac

SEQ ID NO: 386680 - DNA, 25 bp, Mus musculus
cgccagcaaccaccgcgcgccggca

SEQ ID NO: 386681 - DNA, 25 bp, Mus musculus
gtcatgggcactgctccttgcgtct

SEQ ID NO: 386682 - DNA, 25 bp, Mus musculus
cacagagtcgcggtcatgggcactg

SEQ ID NO: 386683 - DNA, 25 bp, Mus musculus
gcagccagcctcacagagtcgcggt

SEQ ID NO: 386684 - DNA, 25 bp, Mus musculus
gcccgctccggtcttcccgagctcc

SEQ ID NO: 386685 - DNA, 25 bp, Mus musculus
gcattccagcccacagccagccttc

SEQ ID NO: 386686 - DNA, 25 bp, Mus musculus
ggtggaaccgcattccagcccacag

SEQ ID NO: 386687 - DNA, 25 bp, Mus musculus
gagtgggtggaaccgcattccagcc

SEQ ID NO: 386688 - DNA, 25 bp, Mus musculus
cacccggagtgggtggaaccgcatt

SEQ ID NO: 386689 - DNA, 25 bp, Mus musculus
ccgagctccgggtacccgccagcaa

SEQ ID NO: 386690 - DNA, 25 bp, Mus musculus
agaataaaagttagggcaagaaatg

SEQ ID NO: 386691 - DNA, 25 bp, Mus musculus
cgcggtgcagaataaaagttagggc

SEQ ID NO: 386692 - DNA, 25 bp, Mus musculus
ttcaatctcccgaattaaatccatc

SEQ ID NO: 386693 - DNA, 25 bp, Mus musculus
cggtgcagaataaaagttagggcaa

SEQ ID NO: 386694 - DNA, 25 bp, Mus musculus
gtgcagaataaaagttagggcaaga

SEQ ID NO: 386695 - DNA, 25 bp, Mus musculus
catcgcggtgcagaataaaagttag

SEQ ID NO: 386696 - DNA, 25 bp, Mus musculus
ccatcgcggtgcagaataaaagtta

SEQ ID NO: 386697 - DNA, 25 bp, Mus musculus
tccatcgcggtgcagaataaaagtt

SEQ ID NO: 386698 - DNA, 25 bp, Mus musculus
ctcccgaattaaatccatcgcggtg

SEQ ID NO: 386699 - DNA, 25 bp, Mus musculus
aattaaatccatcgcggtgcagaat

SEQ ID NO: 386700 - DNA, 25 bp, Mus musculus
cgaattaaatccatcgcggtgcaga

SEQ ID NO: 386701 - DNA, 25 bp, Mus musculus
cccgaattaaatccatcgcggtgca

SEQ ID NO: 386702 - DNA, 25 bp, Mus musculus
aatccatcgcggtgcagaataaaag

SEQ ID NO: 386703 - DNA, 25 bp, Mus musculus
atctcccgaattaaatccatcgcgg

SEQ ID NO: 386704 - DNA, 25 bp, Mus musculus
gctgctctctggttagcctgccaag

SEQ ID NO: 386705 - DNA, 25 bp, Mus musculus
ttgggtgaggaccttcatccctccg

SEQ ID NO: 386706 - DNA, 25 bp, Mus musculus
agacatggccttgggtgaggacctt

SEQ ID NO: 386707 - DNA, 25 bp, Mus musculus
gctgcagagactgggaccatccctg

SEQ ID NO: 386708 - DNA, 25 bp, Mus musculus
aacaccggttatggcaggccttggg

SEQ ID NO: 386709 - DNA, 25 bp, Mus musculus
cgggtctggaacaccggttatggca

SEQ ID NO: 386710 - DNA, 25 bp, Mus musculus
gggcaagaaatgtcaactacctcga

SEQ ID NO: 386711 - DNA, 25 bp, Mus musculus
gtcaactacctcgattcaaaacaca

SEQ ID NO: 386712 - DNA, 25 bp, Mus musculus
attcaaaacacagacgacccgaccg

SEQ ID NO: 386713 - DNA, 25 bp, Mus musculus
ccgcgtcaaaaaagtgccagggaga

SEQ ID NO: 386714 - DNA, 25 bp, Mus musculus
aaagtgccagggagatggacgctct

SEQ ID NO: 386715 - DNA, 25 bp, Mus musculus
gcctgccaaggcaacgggtctggaa

SEQ ID NO: 386716 - DNA, 25 bp, Mus musculus
aactcttggaaaccgctgctctctg

SEQ ID NO: 386717 - DNA, 25 bp, Mus musculus
ctctggaagcggagcacaactcttg

SEQ ID NO: 386718 - DNA, 25 bp, Mus musculus
gcgacaaagcatcccggagcgcgtc

SEQ ID NO: 386719 - DNA, 25 bp, Mus musculus
cccggcgaagagttcagaggtcaaa

SEQ ID NO: 386720 - DNA, 25 bp, Mus musculus
tctccctcctgctgcgggaaggatg

SEQ ID NO: 386721 - DNA, 25 bp, Mus musculus
gctttcaaaccgacccaacatggcg

SEQ ID NO: 386722 - DNA, 25 bp, Mus musculus
gacgcccgcgctcgctttcaaaccg

SEQ ID NO: 386723 - DNA, 25 bp, Mus musculus
caccgccttcctcgggaccgctatt

SEQ ID NO: 386724 - DNA, 25 bp, Mus musculus
ccgcagggcgcatgtgtagtaccag

SEQ ID NO: 386725 - DNA, 25 bp, Mus musculus
acgacgcgacaaagcatcccggagc

SEQ ID NO: 386726 - DNA, 25 bp, Mus musculus
tgcccaaaccggacgacgcgacaaa

SEQ ID NO: 386727 - DNA, 25 bp, Mus musculus
acagcccaagccctgcccaaaccgg

SEQ ID NO: 386728 - DNA, 25 bp, Mus musculus
taaagcgcgcacttccagactccgg

SEQ ID NO: 386729 - DNA, 25 bp, Mus musculus
ttttaaagcgcgcacttccagactc

SEQ ID NO: 386730 - DNA, 25 bp, Mus musculus
ccgcagaggactcaccgggacactt

SEQ ID NO: 386731 - DNA, 25 bp, Mus musculus
gaccgctatttcctccgccaccgca

SEQ ID NO: 386732 - DNA, 25 bp, Mus musculus
gcttcagcagccaacacggcactcc

SEQ ID NO: 386733 - DNA, 25 bp, Mus musculus
cgcctgcgcactgaagcgaaacagc

SEQ ID NO: 386734 - DNA, 25 bp, Mus musculus
gtgcgcaggaatgcagccgtcaccc

SEQ ID NO: 386735 - DNA, 25 bp, Mus musculus
ccaggcccgagcaggaccagaaggc

SEQ ID NO: 386736 - DNA, 25 bp, Mus musculus
gggctcccgcccttcacatctttcc

SEQ ID NO: 386737 - DNA, 25 bp, Mus musculus
tttcccgccatcacccggagggcgc

SEQ ID NO: 386738 - DNA, 25 bp, Mus musculus
cgcgtgcaagggctccatggcacga

SEQ ID NO: 386739 - DNA, 25 bp, Mus musculus
tccatggcacgaggagcgtcttctt

SEQ ID NO: 386740 - DNA, 25 bp, Mus musculus
gcacgaggagcgtcttcttcctccg

SEQ ID NO: 386741 - DNA, 25 bp, Mus musculus
ttcccttcgggccaaccgcaccgca

SEQ ID NO: 386742 - DNA, 25 bp, Mus musculus
agctgctgcacggtctcctaggaaa

SEQ ID NO: 386743 - DNA, 25 bp, Mus musculus
cccgagcaggaccagaaggccgcga

SEQ ID NO: 386744 - DNA, 25 bp, Mus musculus
gtctcctaggaaaccacggcctagc

SEQ ID NO: 386745 - DNA, 25 bp, Mus musculus
tgcacggtctcctaggaaaccacgg

SEQ ID NO: 386746 - DNA, 25 bp, Mus musculus
actccgccatagagcaggggggcca

SEQ ID NO: 386747 - DNA, 25 bp, Mus musculus
tgacacgggtcagtaggactccacc

SEQ ID NO: 386748 - DNA, 25 bp, Mus musculus
gtcagtaggactccaccggtctagc

SEQ ID NO: 386749 - DNA, 25 bp, Mus musculus
cggccacgcttgacacgggtcagta

SEQ ID NO: 386750 - DNA, 25 bp, Mus musculus
aggactccaccggtctagccttcag

SEQ ID NO: 386751 - DNA, 25 bp, Mus musculus
cgtagccggccacgcttgacacggg

SEQ ID NO: 386752 - DNA, 25 bp, Mus musculus
ggtctagccttcagcgctctgcctg

SEQ ID NO: 386753 - DNA, 25 bp, Mus musculus
tcggttacggaagaagcgcagagcc

SEQ ID NO: 386754 - DNA, 25 bp, Mus musculus
tcagcgctctgcctgcccagtgggg

SEQ ID NO: 386755 - DNA, 25 bp, Mus musculus
ccctagcttggaggacctaagaggc

SEQ ID NO: 386756 - DNA, 25 bp, Mus musculus
ctagcttggaggacctaagaggcgc

SEQ ID NO: 386757 - DNA, 25 bp, Mus musculus
tgtgcgcgcccgctctatgatgctt

SEQ ID NO: 386758 - DNA, 25 bp, Mus musculus
cgctctatgatgcttgcgcgcgtcc

SEQ ID NO: 386759 - DNA, 25 bp, Mus musculus
ctggcggcgactccgccatagagca

SEQ ID NO: 386760 - DNA, 25 bp, Mus musculus
aaggagccggcttcgaagactggct

SEQ ID NO: 386761 - DNA, 25 bp, Mus musculus
tcgcgacctccgagacggcggagct

SEQ ID NO: 386762 - DNA, 25 bp, Mus musculus
ccgcgatgccaagcggcagctccgc

SEQ ID NO: 386763 - DNA, 25 bp, Mus musculus
cacctagttccctacctcggctccg

SEQ ID NO: 386764 - DNA, 25 bp, Mus musculus
ggccatgaaacaaaagaaaccctga

SEQ ID NO: 386765 - DNA, 25 bp, Mus musculus
ggggctggttaaggccatgaaacaa

SEQ ID NO: 386766 - DNA, 25 bp, Mus musculus
agagcgcgccggcttcattcggaga

SEQ ID NO: 386767 - DNA, 25 bp, Mus musculus
cccggagattaaaagcagccaatca

SEQ ID NO: 386768 - DNA, 25 bp, Mus musculus
gggctcctcccggagattaaaagca

SEQ ID NO: 386769 - DNA, 25 bp, Mus musculus
atccaatccgaacggtctggggcga

SEQ ID NO: 386770 - DNA, 25 bp, Mus musculus
ctcgtcatccaatccgaacggtctg

SEQ ID NO: 386771 - DNA, 25 bp, Mus musculus
ggctcgttctcgtcatccaatccga

SEQ ID NO: 386772 - DNA, 25 bp, Mus musculus
cgaagactggctcgttctcgtcatc

SEQ ID NO: 386773 - DNA, 25 bp, Mus musculus
cggcttcgaagactggctcgttctc

SEQ ID NO: 386774 - DNA, 25 bp, Mus musculus
aggaaatgtaccagaccctcgccgc

SEQ ID NO: 386775 - DNA, 25 bp, Mus musculus
ctggccagcaggacccttcgaaacg

SEQ ID NO: 386776 - DNA, 25 bp, Mus musculus
ctcggccgctgaacggaacgtacca

SEQ ID NO: 386777 - DNA, 25 bp, Mus musculus
gggagcaccagtacagctcgctgtc

SEQ ID NO: 386778 - DNA, 25 bp, Mus musculus
ccctgtcgacttgggaggacctgtt

SEQ ID NO: 386779 - DNA, 25 bp, Mus musculus
gtgggctccatgctgtccggcctgc

SEQ ID NO: 386780 - DNA, 25 bp, Mus musculus
agcaggacccttcgaaacgccggtg

SEQ ID NO: 386781 - DNA, 25 bp, Mus musculus
aacgccggtgctccacagcttacag

SEQ ID NO: 386782 - DNA, 25 bp, Mus musculus
agcagccggaggaaatgtaccagac

SEQ ID NO: 386783 - DNA, 25 bp, Mus musculus
gccgcgaccgccagcaagctgttgt

SEQ ID NO: 386784 - DNA, 25 bp, Mus musculus
gcaactgcaggacgccgcagctcga

SEQ ID NO: 386785 - DNA, 25 bp, Mus musculus
ttcactgacctcgatcaggccgcga

SEQ ID NO: 386786 - DNA, 25 bp, Mus musculus
gaggacctgttgctcttcactgacc

SEQ ID NO: 386787 - DNA, 25 bp, Mus musculus
ccctaccttcaaggggcgggcagcg

SEQ ID NO: 386788 - DNA, 25 bp, Mus musculus
gtggctgcgggaatgctcggagctc

SEQ ID NO: 386789 - DNA, 25 bp, Mus musculus
gtcctgcgcctttcgcgggacaata

SEQ ID NO: 386790 - DNA, 25 bp, Mus musculus
gacatttccgagacctatctctctg

SEQ ID NO: 386791 - DNA, 25 bp, Mus musculus
acaatagcgacgctgagtggtggct

SEQ ID NO: 386792 - DNA, 25 bp, Mus musculus
ctttcgcgggacaatagcgacgctg

SEQ ID NO: 386793 - DNA, 25 bp, Mus musculus
taggcagacgtcctgcgcctttcgc

SEQ ID NO: 386794 - DNA, 25 bp, Mus musculus
gccataggcagacgtcctgcgcctt

SEQ ID NO: 386795 - DNA, 25 bp, Mus musculus
ggaaacgccataggcagacgtcctg

SEQ ID NO: 386796 - DNA, 25 bp, Mus musculus
gaaggaaacgccataggcagacgtc

SEQ ID NO: 386797 - DNA, 25 bp, Mus musculus
cctcggggaagtctgtaaagagcaa

SEQ ID NO: 386798 - DNA, 25 bp, Mus musculus
gcgccacgcgggtctcggcctccgc

SEQ ID NO: 386799 - DNA, 25 bp, Mus musculus
ttgttttctgcaccgcgccacgcgg

SEQ ID NO: 386800 - DNA, 25 bp, Mus musculus
tccgagacctatctctctggaagtc

SEQ ID NO: 386801 - DNA, 25 bp, Mus musculus
tcgcgggacaatagcgacgctgagt

SEQ ID NO: 386802 - DNA, 25 bp, Mus musculus
tacccaagcagcgtgggacagctcg

SEQ ID NO: 386803 - DNA, 25 bp, Mus musculus
gagcggatctctcactctgtccctt

SEQ ID NO: 386804 - DNA, 25 bp, Mus musculus
gctcgcctaactgcgagaggagttg

SEQ ID NO: 386805 - DNA, 25 bp, Mus musculus
gtagcagtttacttccgagcggatc

SEQ ID NO: 386806 - DNA, 25 bp, Mus musculus
ttggcttttgaagaccttggtggac

SEQ ID NO: 386807 - DNA, 25 bp, Mus musculus
gtgcggttcacagagtacccaagca

SEQ ID NO: 386808 - DNA, 25 bp, Mus musculus
cctcttcagacacggagtgcggttc

SEQ ID NO: 386809 - DNA, 25 bp, Mus musculus
gccttttcgcaggatgccctcttca

SEQ ID NO: 386810 - DNA, 25 bp, Mus musculus
ctctggctgagtttgagcagcgagc

SEQ ID NO: 386811 - DNA, 25 bp, Mus musculus
cgcggagaccacatccgggtaattt

SEQ ID NO: 386812 - DNA, 25 bp, Mus musculus
tgtcggaaggacactgagcatgcgc

SEQ ID NO: 386813 - DNA, 25 bp, Mus musculus
ttgctgccaacttgtcggaaggaca

SEQ ID NO: 386814 - DNA, 25 bp, Mus musculus
agggccgtgttgttgctgccaactt

SEQ ID NO: 386815 - DNA, 25 bp, Mus musculus
accttggtggacacagctggaccga

SEQ ID NO: 386816 - DNA, 25 bp, Mus musculus
accgcgcagagaatcgtggtcccac

SEQ ID NO: 386817 - DNA, 25 bp, Mus musculus
gtgacgtcagcgcagccctgctttc

SEQ ID NO: 386818 - DNA, 25 bp, Mus musculus
tccagccaaattgcgcgcccagtga

SEQ ID NO: 386819 - DNA, 25 bp, Mus musculus
ccgctcgcacgctccttttttaaag

SEQ ID NO: 386820 - DNA, 25 bp, Mus musculus
tctgagctgtgtgcagcagcatctc

SEQ ID NO: 386821 - DNA, 25 bp, Mus musculus
tctctctgaagtcgccgcagtggct

SEQ ID NO: 386822 - DNA, 25 bp, Mus musculus
tcgggagccctctctctgaagtcgc

SEQ ID NO: 386823 - DNA, 25 bp, Mus musculus
cccaatgggcgtctgccgggtcgta

SEQ ID NO: 386824 - DNA, 25 bp, Mus musculus
agagaatcgtggtcccaccggcctc

SEQ ID NO: 386825 - DNA, 25 bp, Mus musculus
tccatggtgcccgagactgggagca

SEQ ID NO: 386826 - DNA, 25 bp, Mus musculus
catctggtcccggtgagctgccggc

SEQ ID NO: 386827 - DNA, 25 bp, Mus musculus
agcgccagcaaggacaggagcatgt

SEQ ID NO: 386828 - DNA, 25 bp, Mus musculus
ggctgatgcagaaccgaggcgctcc

SEQ ID NO: 386829 - DNA, 25 bp, Mus musculus
gcttctgcagctcaccagacgtctg

SEQ ID NO: 386830 - DNA, 25 bp, Mus musculus
ggtcgcaggttcgtatccactcctc

SEQ ID NO: 386831 - DNA, 25 bp, Mus musculus
tcctgcccaactcaccctctctctc

SEQ ID NO: 386832 - DNA, 25 bp, Mus musculus
gggtgcaggcggctgacaccgccgc

SEQ ID NO: 386833 - DNA, 25 bp, Mus musculus
ccctcactcgggagctgcgtgggcc

SEQ ID NO: 386834 - DNA, 25 bp, Mus musculus
gcgtcctcgctgtcgggcgctcccg

SEQ ID NO: 386835 - DNA, 25 bp, Mus musculus
gggcgctcccgggacctctgcgccc

SEQ ID NO: 386836 - DNA, 25 bp, Mus musculus
cctgcgagctccgaggcagcgcgcc

SEQ ID NO: 386837 - DNA, 25 bp, Mus musculus
ccctcgggcgtcctgcccaactcac

SEQ ID NO: 386838 - DNA, 25 bp, Mus musculus
ctccgaggcccagcagtgtgcgagc

SEQ ID NO: 386839 - DNA, 25 bp, Mus musculus
agagggtcgcaggttcgtatccact

SEQ ID NO: 386840 - DNA, 25 bp, Mus musculus
tcgtatccactcctccggctcccta

SEQ ID NO: 386841 - DNA, 25 bp, Mus musculus
cggctccctaatgcgctggctgcga

SEQ ID NO: 386842 - DNA, 25 bp, Mus musculus
tccctaatgcgctggctgcgatgcg

SEQ ID NO: 386843 - DNA, 25 bp, Mus musculus
gcgctcctcagtttccaggctggca

SEQ ID NO: 386844 - DNA, 25 bp, Mus musculus
gaggccgcatgcatcagctcacgtg

SEQ ID NO: 386845 - DNA, 25 bp, Mus musculus
tgttaactgttctgaggccgcatgc

SEQ ID NO: 386846 - DNA, 25 bp, Mus musculus
cgagttcctgggtgttaactgttct

SEQ ID NO: 386847 - DNA, 25 bp, Mus musculus
agaaaccctagctccgtcgcttttg

SEQ ID NO: 386848 - DNA, 25 bp, Mus musculus
ctgaccgacaggcacgcgggccaat

SEQ ID NO: 386849 - DNA, 25 bp, Mus musculus
gtcctggcaccagcgagcccggaat

SEQ ID NO: 386850 - DNA, 25 bp, Mus musculus
gtaatcggctccatgggatagcgca

SEQ ID NO: 386851 - DNA, 25 bp, Mus musculus
gcgcagttcccggagcgaaaaggcc

SEQ ID NO: 386852 - DNA, 25 bp, Mus musculus
cgcagggtggcttatcccgatcacc

SEQ ID NO: 386853 - DNA, 25 bp, Mus musculus
gcgttcacgcgagaagacgttgtgc

SEQ ID NO: 386854 - DNA, 25 bp, Mus musculus
ggcgggtaccaatctcccagtccaa

SEQ ID NO: 386855 - DNA, 25 bp, Mus musculus
ataatggtgtgggttctcgtggacc

SEQ ID NO: 386856 - DNA, 25 bp, Mus musculus
acgacgcaggagagtagagaccaca

SEQ ID NO: 386857 - DNA, 25 bp, Mus musculus
ctacagccggagatgctcggccctg

SEQ ID NO: 386858 - DNA, 25 bp, Mus musculus
ccaaggggttggaagtcaatgaagc

SEQ ID NO: 386859 - DNA, 25 bp, Mus musculus
tgacaatgttgtcgtggtccaggcg

SEQ ID NO: 386860 - DNA, 25 bp, Mus musculus
ctaaacttgaagagctcgccctgca

SEQ ID NO: 386861 - DNA, 25 bp, Mus musculus
cagcacctcgtacaccttgacaatg

SEQ ID NO: 386862 - DNA, 25 bp, Mus musculus
ccaggcgccggatgattttgatctc

SEQ ID NO: 386863 - DNA, 25 bp, Mus musculus
tgatctctcggagcgcgtgcttcat

SEQ ID NO: 386864 - DNA, 25 bp, Mus musculus
tgcgggcgtcactcagaacgatctt

SEQ ID NO: 386865 - DNA, 25 bp, Mus musculus
aaggtcatacccgtagacgctggcg

SEQ ID NO: 386866 - DNA, 25 bp, Mus musculus
caagccctgctgtccgtagctgaca

SEQ ID NO: 386867 - DNA, 25 bp, Mus musculus
ggaagtcaatgaagcgcccaccaag

SEQ ID NO: 386868 - DNA, 25 bp, Mus musculus
atgaagcgcccaccaaggtcatacc

SEQ ID NO: 386869 - DNA, 25 bp, Mus musculus
cgatataggccacgctaaacttgaa

SEQ ID NO: 386870 - DNA, 25 bp, Mus musculus
gaacgatcttcttcacggccacctt

SEQ ID NO: 386871 - DNA, 25 bp, Mus musculus
gaagagctcgccctgcagatcgctc

SEQ ID NO: 386872 - DNA, 25 bp, Mus musculus
ggtccttttgcagttcccagctctc

SEQ ID NO: 386873 - DNA, 25 bp, Mus musculus
gtttctgcacctcctgcgtggacgt

SEQ ID NO: 386874 - DNA, 25 bp, Mus musculus
aaccgttgcgggctcagagctgtcc

SEQ ID NO: 386875 - DNA, 25 bp, Mus musculus
ccgacccacagaaggggtgcctctt

SEQ ID NO: 386876 - DNA, 25 bp, Mus musculus
aatgcgaggctaacccttgaacagg

SEQ ID NO: 386877 - DNA, 25 bp, Mus musculus
ctggaggagaggctaactaggaaca

SEQ ID NO: 386878 - DNA, 25 bp, Mus musculus
tccaaatcagaactcgcgaactgcc

SEQ ID NO: 386879 - DNA, 25 bp, Mus musculus
ccaaactggggagccagggacagca

SEQ ID NO: 386880 - DNA, 25 bp, Mus musculus
ccaccagagacagtggccggcgttc

SEQ ID NO: 386881 - DNA, 25 bp, Mus musculus
ccggcgttccgaaagtcgcgagttg

SEQ ID NO: 386882 - DNA, 25 bp, Mus musculus
agggagccactcaccgaggcagacg

SEQ ID NO: 386883 - DNA, 25 bp, Mus musculus
agacccggaggcgacctctcctgag

SEQ ID NO: 386884 - DNA, 25 bp, Mus musculus
ggggaccatccagctgggacccaga

SEQ ID NO: 386885 - DNA, 25 bp, Mus musculus
ctctcctgagcagccgggtttctgc

SEQ ID NO: 386886 - DNA, 25 bp, Mus musculus
cggcttcggagccagcgaccttgcg

SEQ ID NO: 386887 - DNA, 25 bp, Mus musculus
ccgaacctgctaagcgatgcctctt

SEQ ID NO: 386888 - DNA, 25 bp, Mus musculus
aggcgttcctccaacagcgcagact

SEQ ID NO: 386889 - DNA, 25 bp, Mus musculus
gcacaaaggcgttcctccaacagcg

SEQ ID NO: 386890 - DNA, 25 bp, Mus musculus
cgcgcaggcgcacaaaggcgttcct

SEQ ID NO: 386891 - DNA, 25 bp, Mus musculus
ttccagagcccaaattcaaacagcc

SEQ ID NO: 386892 - DNA, 25 bp, Mus musculus
gacgccagcttccagagcccaaatt

SEQ ID NO: 386893 - DNA, 25 bp, Mus musculus
gaaacgccaaatccagacgccagct

SEQ ID NO: 386894 - DNA, 25 bp, Mus musculus
agcgcgcaccggtccacgaccgaaa

SEQ ID NO: 386895 - DNA, 25 bp, Mus musculus
ctacggctggggaccaagcgcgcac

SEQ ID NO: 386896 - DNA, 25 bp, Mus musculus
cctgcgctacggctggggaccaagc

SEQ ID NO: 386897 - DNA, 25 bp, Mus musculus
agtctggagcgaagagcctgcgcta

SEQ ID NO: 386898 - DNA, 25 bp, Mus musculus
taagcgatgcctcttcgggcggctt

SEQ ID NO: 386899 - DNA, 25 bp, Mus musculus
ggccaaccctccgagtcgcccgctc

SEQ ID NO: 386900 - DNA, 25 bp, Mus musculus
cgctgtcttacggactcgatggtca

SEQ ID NO: 386901 - DNA, 25 bp, Mus musculus
ggggactgaaaaccgctgcctgttg

SEQ ID NO: 386902 - DNA, 25 bp, Mus musculus
ccgcgatccggaagctactatttgt

SEQ ID NO: 386903 - DNA, 25 bp, Mus musculus
gcggccatgcttcccggaacgtatg

SEQ ID NO: 386904 - DNA, 25 bp, Mus musculus
gagacctatttgtttgccgctaaag

SEQ ID NO: 386905 - DNA, 25 bp, Mus musculus
tcgcggctctaggtgggagacctat

SEQ ID NO: 386906 - DNA, 25 bp, Mus musculus
atggcggcgacagagagaccttcgc

SEQ ID NO: 386907 - DNA, 25 bp, Mus musculus
ggaacgtatggtctccgctgtctta

SEQ ID NO: 386908 - DNA, 25 bp, Mus musculus
ttgttgcctaggaacgcacggagtc

SEQ ID NO: 386909 - DNA, 25 bp, Mus musculus
caccgtacggacttggctgacaagg

SEQ ID NO: 386910 - DNA, 25 bp, Mus musculus
cgtcgaagcaaatgcggccatattg

SEQ ID NO: 386911 - DNA, 25 bp, Mus musculus
cgtctgcgtcgcaacgtcgaagcaa

SEQ ID NO: 386912 - DNA, 25 bp, Mus musculus
cctgatgacgctcagcggctgacga

SEQ ID NO: 386913 - DNA, 25 bp, Mus musculus
ctcggaggacctgaactgtaggcgc

SEQ ID NO: 386914 - DNA, 25 bp, Mus musculus
agacgcacaggcaaccgagacccgg

SEQ ID NO: 386915 - DNA, 25 bp, Mus musculus
cgccgctgtgaagccgcagtgcgca

SEQ ID NO: 386916 - DNA, 25 bp, Mus musculus
cacgcgtgaccaggctgtacacaca

SEQ ID NO: 386917 - DNA, 25 bp, Mus musculus
tacacacagcggctggtcctagtcg

SEQ ID NO: 386918 - DNA, 25 bp, Mus musculus
gttccgggagtaagcaaccgccgca

SEQ ID NO: 386919 - DNA, 25 bp, Mus musculus
caaccgccgcagaggcgactgtttt

SEQ ID NO: 386920 - DNA, 25 bp, Mus musculus
aggcgactgttttggaagaggcact

SEQ ID NO: 386921 - DNA, 25 bp, Mus musculus
tcgcgctagtgggatccttctcatg

SEQ ID NO: 386922 - DNA, 25 bp, Mus musculus
cgtcgttcagtgctcctgctatttg

SEQ ID NO: 386923 - DNA, 25 bp, Mus musculus
cctggtgtcaagctggtgagacagc

SEQ ID NO: 386924 - DNA, 25 bp, Mus musculus
tgcctgtgcaccgaggcgcgcagac

SEQ ID NO: 386925 - DNA, 25 bp, Mus musculus
ctgctatttgtggagaccgaaattc

SEQ ID NO: 386926 - DNA, 25 bp, Mus musculus
cccttgtgtccggagcgactttgga

SEQ ID NO: 386927 - DNA, 25 bp, Mus musculus
cttctcatgggtccacgggcctaga

SEQ ID NO: 386928 - DNA, 25 bp, Mus musculus
cagcgagctctacacccgggtgagt

SEQ ID NO: 386929 - DNA, 25 bp, Mus musculus
cgccaccttctctgccgctactgga

SEQ ID NO: 386930 - DNA, 25 bp, Mus musculus
ctgccagcgtctctgcggttccggt

SEQ ID NO: 386931 - DNA, 25 bp, Mus musculus
ctgacagcggcgcagcacggttcca

SEQ ID NO: 386932 - DNA, 25 bp, Mus musculus
tcggtccacccgagaaaggagcgcg

SEQ ID NO: 386933 - DNA, 25 bp, Mus musculus
tcagcctggacccagcgtcccgcga

SEQ ID NO: 386934 - DNA, 25 bp, Mus musculus
gggtcatgtcgtacagcgagctcta

SEQ ID NO: 386935 - DNA, 25 bp, Mus musculus
cgccactcctggtcgccgcaccagc

SEQ ID NO: 386936 - DNA, 25 bp, Mus musculus
gcactagcgccagcgggtcggtcca

SEQ ID NO: 386937 - DNA, 25 bp, Mus musculus
ccctaagttggatggtagagaaagt

SEQ ID NO: 386938 - DNA, 25 bp, Mus musculus
agccagccgtgcactgagatcgcgg

SEQ ID NO: 386939 - DNA, 25 bp, Mus musculus
gaagactgcgccagccagccgtgca

SEQ ID NO: 386940 - DNA, 25 bp, Mus musculus
accggtctgggaagactgcgccagc

SEQ ID NO: 386941 - DNA, 25 bp, Mus musculus
cccgcggggtcatgtcgtacagcga

SEQ ID NO: 386942 - DNA, 25 bp, Mus musculus
tcctttagcgcgtgtcagaatcccg

SEQ ID NO: 386943 - DNA, 25 bp, Mus musculus
cacagaagcgcgtggtaagtgtcgc

SEQ ID NO: 386944 - DNA, 25 bp, Mus musculus
ccacctcctttagcgcgtgtcagaa

SEQ ID NO: 386945 - DNA, 25 bp, Mus musculus
ggtgcggactcgcagcaacaccgtc

SEQ ID NO: 386946 - DNA, 25 bp, Mus musculus
tgcggtctctacagcaagatgaatg

SEQ ID NO: 386947 - DNA, 25 bp, Mus musculus
atcaagccacagaagcgcgtggtaa

SEQ ID NO: 386948 - DNA, 25 bp, Mus musculus
agcaagatgaatggcctcagcaggc

SEQ ID NO: 386949 - DNA, 25 bp, Mus musculus
gtgaactgcggctccatccagacgc

SEQ ID NO: 386950 - DNA, 25 bp, Mus musculus
catccagacgccactgtggagacga

SEQ ID NO: 386951 - DNA, 25 bp, Mus musculus
cgccactgtggagacgagacggcac

SEQ ID NO: 386952 - DNA, 25 bp, Mus musculus
gagacggcaccggtcattacctgtg

SEQ ID NO: 386953 - DNA, 25 bp, Mus musculus
ccggtcattacctgtgcaatgcatg

SEQ ID NO: 386954 - DNA, 25 bp, Mus musculus
cctgtgcaatgcatgcggtctctac

SEQ ID NO: 386955 - DNA, 25 bp, Mus musculus
ccgcgagtgcgtgaactgcggctcc

SEQ ID NO: 386956 - DNA, 25 bp, Mus musculus
ccacctccgctttttctgggatgtg

SEQ ID NO: 386957 - DNA, 25 bp, Mus musculus
ctgagttcttggctccagtcctgtc

SEQ ID NO: 386958 - DNA, 25 bp, Mus musculus
cggtgcctctagaagcctgggatag

SEQ ID NO: 386959 - DNA, 25 bp, Mus musculus
tgcggtcgaagtggttctcaaattc

SEQ ID NO: 386960 - DNA, 25 bp, Mus musculus
tggttctcaaattcccagaggaggg

SEQ ID NO: 386961 - DNA, 25 bp, Mus musculus
ccacactcttaaggctgggctaggg

SEQ ID NO: 386962 - DNA, 25 bp, Mus musculus
cccgcggaatagctgagcttcgcca

SEQ ID NO: 386963 - DNA, 25 bp, Mus musculus
gagcttcgccatggccctgctacga

SEQ ID NO: 386964 - DNA, 25 bp, Mus musculus
ggtatctgggctctgcgagcaagca

SEQ ID NO: 386965 - DNA, 25 bp, Mus musculus
tgcaggtcgttcctctcccagggct

SEQ ID NO: 386966 - DNA, 25 bp, Mus musculus
atcggggtggacactgtttgcatta

SEQ ID NO: 386967 - DNA, 25 bp, Mus musculus
gccggttacgagaggcctgatcata

SEQ ID NO: 386968 - DNA, 25 bp, Mus musculus
aaatacatcgggctcactcggggct

SEQ ID NO: 386969 - DNA, 25 bp, Mus musculus
tttgcattaaggaggaacaccgtgg

SEQ ID NO: 386970 - DNA, 25 bp, Mus musculus
acggatgatcttcctgaccgccgaa

SEQ ID NO: 386971 - DNA, 25 bp, Mus musculus
ccaccaggtaggcagctggcctcta

SEQ ID NO: 386972 - DNA, 25 bp, Mus musculus
agagttcaagtctgccctgcccagg

SEQ ID NO: 386973 - DNA, 25 bp, Mus musculus
ggcggcatttccagaacggatgatc

SEQ ID NO: 386974 - DNA, 25 bp, Mus musculus
aggcggttcatctcggcttttgctc

SEQ ID NO: 386975 - DNA, 25 bp, Mus musculus
ggcttttgctcatcttgtctcttgg

SEQ ID NO: 386976 - DNA, 25 bp, Mus musculus
agtttctctctcatggcggcatttc

SEQ ID NO: 386977 - DNA, 25 bp, Mus musculus
cgcggtctccacgtacctctatgta

SEQ ID NO: 386978 - DNA, 25 bp, Mus musculus
acgcacttccggtcataggcttccg

SEQ ID NO: 386979 - DNA, 25 bp, Mus musculus
ttgaaaaggacctcaggctccgagc

SEQ ID NO: 386980 - DNA, 25 bp, Mus musculus
tgcgtatggacagaaactcactttg

SEQ ID NO: 386981 - DNA, 25 bp, Mus musculus
gtcgttcctggtcctcctcagtcgt

SEQ ID NO: 386982 - DNA, 25 bp, Mus musculus
acagttctctatgcgcctccctggt

SEQ ID NO: 386983 - DNA, 25 bp, Mus musculus
agccgcagtatgaactggttctcga

SEQ ID NO: 386984 - DNA, 25 bp, Mus musculus
ccgcgaactccaggagaggtacttt

SEQ ID NO: 386985 - DNA, 25 bp, Mus musculus
tcccagagccgctgcgaagtcggga

SEQ ID NO: 386986 - DNA, 25 bp, Mus musculus
ttctagtcatctgacccatcgccag

SEQ ID NO: 386987 - DNA, 25 bp, Mus musculus
ccatcgccagatggatatttgcata

SEQ ID NO: 386988 - DNA, 25 bp, Mus musculus
ttgcataatttattcccgtctcggg

SEQ ID NO: 386989 - DNA, 25 bp, Mus musculus
cgggactctgattggtcacaccttc

SEQ ID NO: 386990 - DNA, 25 bp, Mus musculus
tcactgacgcccaaaccgagaactt

SEQ ID NO: 386991 - DNA, 25 bp, Mus musculus
ttcccaaagtttgaatgaaagtgcc

SEQ ID NO: 386992 - DNA, 25 bp, Mus musculus
gacgcctgcagggagaaactagcta

SEQ ID NO: 386993 - DNA, 25 bp, Mus musculus
ggagaaactagctacgcaccgcgga

SEQ ID NO: 386994 - DNA, 25 bp, Mus musculus
ccctggatatcgcaaagggatattt

SEQ ID NO: 386995 - DNA, 25 bp, Mus musculus
tccgaaacggtactcccactggaga

SEQ ID NO: 386996 - DNA, 25 bp, Mus musculus
ctcccactggagaagagatccggga

SEQ ID NO: 386997 - DNA, 25 bp, Mus musculus
gaagtcgggactcgccgctgtcaca

SEQ ID NO: 386998 - DNA, 25 bp, Mus musculus
ctaagcctgaaactggagaggcacg

SEQ ID NO: 386999 - DNA, 25 bp, Mus musculus
tccttgggctggaagtctcgcgaga

SEQ ID NO: 387000 - DNA, 25 bp, Mus musculus
gtctcgcgagaggtcgaggtctcat

SEQ ID NO: 387001 - DNA, 25 bp, Mus musculus
cgaggtctcatgaattctcccagta

SEQ ID NO: 387002 - DNA, 25 bp, Mus musculus
tgaattctcccagtagccttcgcgc

SEQ ID NO: 387003 - DNA, 25 bp, Mus musculus
cttcctcttcctgtaagcggccaga

SEQ ID NO: 387004 - DNA, 25 bp, Mus musculus
cagaggtgagtgctaactcggcgcc

SEQ ID NO: 387005 - DNA, 25 bp, Mus musculus
ggggcgaatcctccgccatcgttgt

SEQ ID NO: 387006 - DNA, 25 bp, Mus musculus
ccgccatcgttgttgtcgtggctcc

SEQ ID NO: 387007 - DNA, 25 bp, Mus musculus
catcccggcagctgagctccaaggg

SEQ ID NO: 387008 - DNA, 25 bp, Mus musculus
agctccaagggccatgggtcctcgc

SEQ ID NO: 387009 - DNA, 25 bp, Mus musculus
acgcccgaggctcggcttctacggt

SEQ ID NO: 387010 - DNA, 25 bp, Mus musculus
cgcactgctctgtgcctaagcctga

SEQ ID NO: 387011 - DNA, 25 bp, Mus musculus
cactcctcagatctcgttccttggg

SEQ ID NO: 387012 - DNA, 25 bp, Mus musculus
tggcctgctattggctgttggcagc

SEQ ID NO: 387013 - DNA, 25 bp, Mus musculus
cttggctgacgtatatggctttgtc

SEQ ID NO: 387014 - DNA, 25 bp, Mus musculus
gggcgctgactacagcgcagctccg

SEQ ID NO: 387015 - DNA, 25 bp, Mus musculus
cagctccggaagtgcggcgagccct

SEQ ID NO: 387016 - DNA, 25 bp, Mus musculus
gcgagccctgtgcacgtcatcgcta

SEQ ID NO: 387017 - DNA, 25 bp, Mus musculus
agtgcggacattgcccagggcgtct

SEQ ID NO: 387018 - DNA, 25 bp, Mus musculus
acgttctgcgcatcccttggctgac

SEQ ID NO: 387019 - DNA, 25 bp, Mus musculus
tccttgtttctctcgcggctttcct

SEQ ID NO: 387020 - DNA, 25 bp, Mus musculus
ctttgtcagtgtcttggcctgctat

SEQ ID NO: 387021 - DNA, 25 bp, Mus musculus
ccggcctcccggaagtgcggacatt

SEQ ID NO: 387022 - DNA, 25 bp, Mus musculus
cccaggaattaggtagcctgcttgc

SEQ ID NO: 387023 - DNA, 25 bp, Mus musculus
agcctgcttgccttgcatttctgca

SEQ ID NO: 387024 - DNA, 25 bp, Mus musculus
gctctccgtccgtggacctcggtgt

SEQ ID NO: 387025 - DNA, 25 bp, Mus musculus
gcacgtcatcgctacgttctgcgca

SEQ ID NO: 387026 - DNA, 25 bp, Mus musculus
cctcctgcgtctccgcacggacagc

SEQ ID NO: 387027 - DNA, 25 bp, Mus musculus
tggaacgccggaaggactacatttc

SEQ ID NO: 387028 - DNA, 25 bp, Mus musculus
cgagccttagtgtgttgcgtgtctg

SEQ ID NO: 387029 - DNA, 25 bp, Mus musculus
catttcccagaagctcgcgtgctcg

SEQ ID NO: 387030 - DNA, 25 bp, Mus musculus
acagccgaggttggctggacaaatg

SEQ ID NO: 387031 - DNA, 25 bp, Mus musculus
tggcgcgcgcttagccgttcggtcc

SEQ ID NO: 387032 - DNA, 25 bp, Mus musculus
ccctgacctacggaaccatggaggc

SEQ ID NO: 387033 - DNA, 25 bp, Mus musculus
atggaggcctaagccgccgtgcaca

SEQ ID NO: 387034 - DNA, 25 bp, Mus musculus
ctcccgttcccttgctgcctgccgg

SEQ ID NO: 387035 - DNA, 25 bp, Mus musculus
cgccgctgacccaggtgggcttccc

SEQ ID NO: 387036 - DNA, 25 bp, Mus musculus
tgtgcagaaccaagggaaccgaacc

SEQ ID NO: 387037 - DNA, 25 bp, Mus musculus
gaacggttggagcttccggacactc

SEQ ID NO: 387038 - DNA, 25 bp, Mus musculus
ccggacactccggacagccgaggtt

SEQ ID NO: 387039 - DNA, 25 bp, Mus musculus
aagctcgcgtgctcggcgtgccacg

SEQ ID NO: 387040 - DNA, 25 bp, Mus musculus
ccagcttgcaaagggacgcagccct

SEQ ID NO: 387041 - DNA, 25 bp, Mus musculus
ctcaggaatgaagaacgacacagtg

SEQ ID NO: 387042 - DNA, 25 bp, Mus musculus
tggggaactctcctggcacctgcct

SEQ ID NO: 387043 - DNA, 25 bp, Mus musculus
ctcccagtgtcccagcttgcaaagg

SEQ ID NO: 387044 - DNA, 25 bp, Mus musculus
ggtttcccgagaacatctcccagtg

SEQ ID NO: 387045 - DNA, 25 bp, Mus musculus
gcatcccgcactggggtttcccgag

SEQ ID NO: 387046 - DNA, 25 bp, Mus musculus
ttggtgcctggcaccgccatccaga

SEQ ID NO: 387047 - DNA, 25 bp, Mus musculus
tcccagccgggtcgctggaacttga

SEQ ID NO: 387048 - DNA, 25 bp, Mus musculus
gattgcagtcattaaggtttacagg

SEQ ID NO: 387049 - DNA, 25 bp, Mus musculus
agcggcgcagacaggcaagattgca

SEQ ID NO: 387050 - DNA, 25 bp, Mus musculus
cacagtggcctcattgttccgcagc

SEQ ID NO: 387051 - DNA, 25 bp, Mus musculus
ctcttgtgtgaatggactctcagga

SEQ ID NO: 387052 - DNA, 25 bp, Mus musculus
gcggtagtgctctcttgtgtgaatg

SEQ ID NO: 387053 - DNA, 25 bp, Mus musculus
cattgttccgcagccggggaaactg

SEQ ID NO: 387054 - DNA, 25 bp, Mus musculus
agccctgggcacattcgctcgctga

SEQ ID NO: 387055 - DNA, 25 bp, Mus musculus
gaccggctgggttcagcaaggaaaa

SEQ ID NO: 387056 - DNA, 25 bp, Mus musculus
ctgtggattaaaagaaatacgattt

SEQ ID NO: 387057 - DNA, 25 bp, Mus musculus
cctagccagacctttctgtggatta

SEQ ID NO: 387058 - DNA, 25 bp, Mus musculus
gcaagattgaagcagcctagccaga

SEQ ID NO: 387059 - DNA, 25 bp, Mus musculus
cacccagatacgcaagattgaagca

SEQ ID NO: 387060 - DNA, 25 bp, Mus musculus
ccagagactctaaaacacccagata

SEQ ID NO: 387061 - DNA, 25 bp, Mus musculus
acgcaggaggaaagaccagagactc

SEQ ID NO: 387062 - DNA, 25 bp, Mus musculus
ggccagcagctcatgagagcagccc

SEQ ID NO: 387063 - DNA, 25 bp, Mus musculus
attcgctcgctgatcggcgcacaga

SEQ ID NO: 387064 - DNA, 25 bp, Mus musculus
tgcgagaggacacccgggcctcctg

SEQ ID NO: 387065 - DNA, 25 bp, Mus musculus
cgacgaagagagtctccgaggaaga

SEQ ID NO: 387066 - DNA, 25 bp, Mus musculus
ccttccaacatcttgttttactttg

SEQ ID NO: 387067 - DNA, 25 bp, Mus musculus
agctgcctgagacgcagccagccag

SEQ ID NO: 387068 - DNA, 25 bp, Mus musculus
acaaaccctgggagagggcgagatc

SEQ ID NO: 387069 - DNA, 25 bp, Mus musculus
aagacatcggctacaccgcgcggct

SEQ ID NO: 387070 - DNA, 25 bp, Mus musculus
tcggaaccgggcacaagacatcggc

SEQ ID NO: 387071 - DNA, 25 bp, Mus musculus
gaaaggaatcttgctcacgagcttc

SEQ ID NO: 387072 - DNA, 25 bp, Mus musculus
cgttgcagcaaacgaggctccaaaa

SEQ ID NO: 387073 - DNA, 25 bp, Mus musculus
acggccaaagccgtcactgcaatgg

SEQ ID NO: 387074 - DNA, 25 bp, Mus musculus
caccacggtataggacggccaaagc

SEQ ID NO: 387075 - DNA, 25 bp, Mus musculus
tggcgctggagcaactgctcgttgc

SEQ ID NO: 387076 - DNA, 25 bp, Mus musculus
agctgcaagtttgcctggcgctgga

SEQ ID NO: 387077 - DNA, 25 bp, Mus musculus
acacacagagtcgtgggttccctcc

SEQ ID NO: 387078 - DNA, 25 bp, Mus musculus
aagctcgcagggacagccatccgca

SEQ ID NO: 387079 - DNA, 25 bp, Mus musculus
tgcctgtctagacgagagccatcca

SEQ ID NO: 387080 - DNA, 25 bp, Mus musculus
tcactgcaatggctccgccaaggcg

SEQ ID NO: 387081 - DNA, 25 bp, Mus musculus
agatcggagagtgcggtacccacta

SEQ ID NO: 387082 - DNA, 25 bp, Mus musculus
acgccgatgccagtgacctcttgca

SEQ ID NO: 387083 - DNA, 25 bp, Mus musculus
aatgtagttcgcctttctttcctag

SEQ ID NO: 387084 - DNA, 25 bp, Mus musculus
agttcgcctttctttcctaggatgg

SEQ ID NO: 387085 - DNA, 25 bp, Mus musculus
gcctttctttcctaggatggcgggc

SEQ ID NO: 387086 - DNA, 25 bp, Mus musculus
ctttcctaggatggcgggccctgga

SEQ ID NO: 387087 - DNA, 25 bp, Mus musculus
ggaactgcctggacagagtagtgtt

SEQ ID NO: 387088 - DNA, 25 bp, Mus musculus
ctgcctggacagagtagtgttgcta

SEQ ID NO: 387089 - DNA, 25 bp, Mus musculus
gttgctacgccgatgccagtgacct

SEQ ID NO: 387090 - DNA, 25 bp, Mus musculus
gccagtgacctcttgcattagcggg

SEQ ID NO: 387091 - DNA, 25 bp, Mus musculus
tgacctcttgcattagcggggccct

SEQ ID NO: 387092 - DNA, 25 bp, Mus musculus
tgcaaagacttgaaaggaaagaggg

SEQ ID NO: 387093 - DNA, 25 bp, Mus musculus
ggccacgtgcaaagacttgaaagga

SEQ ID NO: 387094 - DNA, 25 bp, Mus musculus
ctccggccacgtgcaaagacttgaa

SEQ ID NO: 387095 - DNA, 25 bp, Mus musculus
cagagtagtgttgctacgccgatgc

SEQ ID NO: 387096 - DNA, 25 bp, Mus musculus
ccagcgactgtcaaaatagaaatta

SEQ ID NO: 387097 - DNA, 25 bp, Mus musculus
tgtccctttaaatcctggaggaggc

SEQ ID NO: 387098 - DNA, 25 bp, Mus musculus
cgctccggtgtgagcaggtccagcc

SEQ ID NO: 387099 - DNA, 25 bp, Mus musculus
cctgcgaagggacctgactcctgct

SEQ ID NO: 387100 - DNA, 25 bp, Mus musculus
ccactcgccagcgactgtcaaaata

SEQ ID NO: 387101 - DNA, 25 bp, Mus musculus
caaaatagaaattagcggagccagg

SEQ ID NO: 387102 - DNA, 25 bp, Mus musculus
cgaccgcacacatccgggcccttta

SEQ ID NO: 387103 - DNA, 25 bp, Mus musculus
aggagctgcccgctcgactgatgct

SEQ ID NO: 387104 - DNA, 25 bp, Mus musculus
gctcgactgatgctcggctgcacag

SEQ ID NO: 387105 - DNA, 25 bp, Mus musculus
ctgatgctcggctgcacagccgctg

SEQ ID NO: 387106 - DNA, 25 bp, Mus musculus
aacccgggccacgagactcttgaca

SEQ ID NO: 387107 - DNA, 25 bp, Mus musculus
ccacgagactcttgacagcggcgcg

SEQ ID NO: 387108 - DNA, 25 bp, Mus musculus
cggagcgacctcagggccgttgcta

SEQ ID NO: 387109 - DNA, 25 bp, Mus musculus
aagggacctgactcctgcttgccgc

SEQ ID NO: 387110 - DNA, 25 bp, Mus musculus
gtctttacggagctcagccggggaa

SEQ ID NO: 387111 - DNA, 25 bp, Mus musculus
ctttacggagctcagccggggaatg

SEQ ID NO: 387112 - DNA, 25 bp, Mus musculus
tttacggagctcagccggggaatgt

SEQ ID NO: 387113 - DNA, 25 bp, Mus musculus
ttacggagctcagccggggaatgta

SEQ ID NO: 387114 - DNA, 25 bp, Mus musculus
tcaagtgcaggttgctgtgcaggaa

SEQ ID NO: 387115 - DNA, 25 bp, Mus musculus
caagtgcaggttgctgtgcaggaaa

SEQ ID NO: 387116 - DNA, 25 bp, Mus musculus
tctttacggagctcagccggggaat

SEQ ID NO: 387117 - DNA, 25 bp, Mus musculus
cgtctttacggagctcagccgggga

SEQ ID NO: 387118 - DNA, 25 bp, Mus musculus
ctgcgcagtcggctccagctgggcg

SEQ ID NO: 387119 - DNA, 25 bp, Mus musculus
cggtctgcgcagtcggctccagctg

SEQ ID NO: 387120 - DNA, 25 bp, Mus musculus
cggcgacgctgttgggcctccgccc

SEQ ID NO: 387121 - DNA, 25 bp, Mus musculus
actgtgactttcacacggcggcggc

SEQ ID NO: 387122 - DNA, 25 bp, Mus musculus
cgactgtgactttcacacggcggcg

SEQ ID NO: 387123 - DNA, 25 bp, Mus musculus
caggttgctgtgcaggaaagcggcg

SEQ ID NO: 387124 - DNA, 25 bp, Mus musculus
cttttgattgcggaagtcccggacg

SEQ ID NO: 387125 - DNA, 25 bp, Mus musculus
aggaaattgccttttgattgcggaa

SEQ ID NO: 387126 - DNA, 25 bp, Mus musculus
cgagcattgttcctttgccgggaga

SEQ ID NO: 387127 - DNA, 25 bp, Mus musculus
gcagcctcaggcgttggctcctcag

SEQ ID NO: 387128 - DNA, 25 bp, Mus musculus
tgccacggcccttgagcatcgccag

SEQ ID NO: 387129 - DNA, 25 bp, Mus musculus
cgcgctgagcgctcaacaagtggta

SEQ ID NO: 387130 - DNA, 25 bp, Mus musculus
gctcaacaagtggtacccagaagtg

SEQ ID NO: 387131 - DNA, 25 bp, Mus musculus
gtacccagaagtgccctggctggcc

SEQ ID NO: 387132 - DNA, 25 bp, Mus musculus
ggctggcctcccagcgagatgctga

SEQ ID NO: 387133 - DNA, 25 bp, Mus musculus
gatgctgaggcatggagccctaacg

SEQ ID NO: 387134 - DNA, 25 bp, Mus musculus
agccctaacggccttgtggataaca

SEQ ID NO: 387135 - DNA, 25 bp, Mus musculus
cttgtggataacactgagcgtcgtg

SEQ ID NO: 387136 - DNA, 25 bp, Mus musculus
acactgagcgtcgtgcaggtaagca

SEQ ID NO: 387137 - DNA, 25 bp, Mus musculus
tcgtgcaggtaagcaggcagagcaa

SEQ ID NO: 387138 - DNA, 25 bp, Mus musculus
cgaggctttgttattcgcgctgttg

SEQ ID NO: 387139 - DNA, 25 bp, Mus musculus
gacagcgaatcgtctctgatctcta

SEQ ID NO: 387140 - DNA, 25 bp, Mus musculus
caccaggaagaaggccggtagcagc

SEQ ID NO: 387141 - DNA, 25 bp, Mus musculus
ttattcgcgctgttggtttggtttc

SEQ ID NO: 387142 - DNA, 25 bp, Mus musculus
ctctacgaggctttgttattcgcgc

SEQ ID NO: 387143 - DNA, 25 bp, Mus musculus
ctctgatctctacgaggctttgtta

SEQ ID NO: 387144 - DNA, 25 bp, Mus musculus
cgaatcgtctctgatctctacgagg

SEQ ID NO: 387145 - DNA, 25 bp, Mus musculus
tgctgggttgacagcgaatcgtctc

SEQ ID NO: 387146 - DNA, 25 bp, Mus musculus
cacggaaaccctgtgcgcgtctttg

SEQ ID NO: 387147 - DNA, 25 bp, Mus musculus
tgcgcgtctttgctcgcctgagtgc

SEQ ID NO: 387148 - DNA, 25 bp, Mus musculus
tctcttgctgggttgacagcgaatc

SEQ ID NO: 387149 - DNA, 25 bp, Mus musculus
gcgcgtctcttgctgggttgacagc

SEQ ID NO: 387150 - DNA, 25 bp, Mus musculus
ttgctcgcctgagtgcgcgtctctt

SEQ ID NO: 387151 - DNA, 25 bp, Mus musculus
tttcaccaggaagaaggccggtagc

SEQ ID NO: 387152 - DNA, 25 bp, Mus musculus
caggttgagataaatgggcgcacga

SEQ ID NO: 387153 - DNA, 25 bp, Mus musculus
gcacctgggcaggttgagataaatg

SEQ ID NO: 387154 - DNA, 25 bp, Mus musculus
cgctcagaagagcatctcagctgcg

SEQ ID NO: 387155 - DNA, 25 bp, Mus musculus
tccaggggacgctcagaagagcatc

SEQ ID NO: 387156 - DNA, 25 bp, Mus musculus
ttacctccgggccttgataaagcta

SEQ ID NO: 387157 - DNA, 25 bp, Mus musculus
ccgggccttgataaagctaagcata

SEQ ID NO: 387158 - DNA, 25 bp, Mus musculus
aagctaagcatagccctcccgggaa

SEQ ID NO: 387159 - DNA, 25 bp, Mus musculus
cccgctgggcgacgggagatctctt

SEQ ID NO: 387160 - DNA, 25 bp, Mus musculus
gggagatctcttcctagtgacactc

SEQ ID NO: 387161 - DNA, 25 bp, Mus musculus
cctagtgacactcgcggtggagatc

SEQ ID NO: 387162 - DNA, 25 bp, Mus musculus
cactcgcggtggagatctctttcta

SEQ ID NO: 387163 - DNA, 25 bp, Mus musculus
ggagatctctttctagcgacagaca

SEQ ID NO: 387164 - DNA, 25 bp, Mus musculus
tctagcgacagacacggaaaccctg

SEQ ID NO: 387165 - DNA, 25 bp, Mus musculus
tgggcgcacgaaggaacgtattacc

SEQ ID NO: 387166 - DNA, 25 bp, Mus musculus
ctctgcctggcaccgcggatgaatc

SEQ ID NO: 387167 - DNA, 25 bp, Mus musculus
acacagcccgggcacgagcaagacg

SEQ ID NO: 387168 - DNA, 25 bp, Mus musculus
gcctctgcctggcaccgcggatgaa

SEQ ID NO: 387169 - DNA, 25 bp, Mus musculus
gcgcagagtggctctggccgcctct

SEQ ID NO: 387170 - DNA, 25 bp, Mus musculus
cctcggccagggtgggatgtgatcc

SEQ ID NO: 387171 - DNA, 25 bp, Mus musculus
acgagcaagacgtccgcggggtggc

SEQ ID NO: 387172 - DNA, 25 bp, Mus musculus
acagcccgggcacgagcaagacgtc

SEQ ID NO: 387173 - DNA, 25 bp, Mus musculus
gctcaggacacagcccgggcacgag

SEQ ID NO: 387174 - DNA, 25 bp, Mus musculus
tcggaccctggcggcgctcaggaca

SEQ ID NO: 387175 - DNA, 25 bp, Mus musculus
agcagcgctgccgcgtggacgctca

SEQ ID NO: 387176 - DNA, 25 bp, Mus musculus
ccagcgtgaatcaatgacaacctct

SEQ ID NO: 387177 - DNA, 25 bp, Mus musculus
cgcccagcgtgaatcaatgacaacc

SEQ ID NO: 387178 - DNA, 25 bp, Mus musculus
agcccgggcacgagcaagacgtccg

SEQ ID NO: 387179 - DNA, 25 bp, Mus musculus
tggacgctcaccctcggaccctggc

SEQ ID NO: 387180 - DNA, 25 bp, Mus musculus
ccgccgacaaggcagccttcgtgat

SEQ ID NO: 387181 - DNA, 25 bp, Mus musculus
agcggccctacttgtgcattcactg

SEQ ID NO: 387182 - DNA, 25 bp, Mus musculus
tggagggccgccagcctgctcttcg

SEQ ID NO: 387183 - DNA, 25 bp, Mus musculus
ttcgtgatgccacccgcgctgggcg

SEQ ID NO: 387184 - DNA, 25 bp, Mus musculus
acctgggcggcacagccgtgtgcct

SEQ ID NO: 387185 - DNA, 25 bp, Mus musculus
cgaggagacgcagatgaagctgttt

SEQ ID NO: 387186 - DNA, 25 bp, Mus musculus
tgcaccgccacatcaaacggcagag

SEQ ID NO: 387187 - DNA, 25 bp, Mus musculus
gcaacgccaagttcgtgcacaacta

SEQ ID NO: 387188 - DNA, 25 bp, Mus musculus
gttcgtgcacaactacgacctcaag

SEQ ID NO: 387189 - DNA, 25 bp, Mus musculus
gtgcggccctaccaatgcgagttct

SEQ ID NO: 387190 - DNA, 25 bp, Mus musculus
atgcgagttctgctacaagagcttc

SEQ ID NO: 387191 - DNA, 25 bp, Mus musculus
tgctacaagagcttcacgcgctccg

SEQ ID NO: 387192 - DNA, 25 bp, Mus musculus
aacggcagagctgccgcatggcacg

SEQ ID NO: 387193 - DNA, 25 bp, Mus musculus
tgcattcactgcaacgccaagttcg

SEQ ID NO: 387194 - DNA, 25 bp, Mus musculus
ccagcacgtccagctgagctgcaga

SEQ ID NO: 387195 - DNA, 25 bp, Mus musculus
gcgtggccgtcttgcgcactgcgac

SEQ ID NO: 387196 - DNA, 25 bp, Mus musculus
aacgagagcaaaggccactgccgtg

SEQ ID NO: 387197 - DNA, 25 bp, Mus musculus
gcagagacgcgactcacgcaaaata

SEQ ID NO: 387198 - DNA, 25 bp, Mus musculus
actgccgtgaggctggacctgcgac

SEQ ID NO: 387199 - DNA, 25 bp, Mus musculus
tcctttgggaaaggcgaccagccgc

SEQ ID NO: 387200 - DNA, 25 bp, Mus musculus
agagagaatacgacgaaacaccggg

SEQ ID NO: 387201 - DNA, 25 bp, Mus musculus
ctaatggggattattgcaagtggca

SEQ ID NO: 387202 - DNA, 25 bp, Mus musculus
agtcctcgaagaaagcaaaatgcta

SEQ ID NO: 387203 - DNA, 25 bp, Mus musculus
aggctacaagtcctcgaagaaagca

SEQ ID NO: 387204 - DNA, 25 bp, Mus musculus
ccgggactgccgaggctacaagtcc

SEQ ID NO: 387205 - DNA, 25 bp, Mus musculus
aacaaagcgaatccctggcggggcg

SEQ ID NO: 387206 - DNA, 25 bp, Mus musculus
ctgcgaccgcgggaaacaaagcgaa

SEQ ID NO: 387207 - DNA, 25 bp, Mus musculus
tcacgcaaaataggagaacgagagc

SEQ ID NO: 387208 - DNA, 25 bp, Mus musculus
gaactcaagcgcaaccgcgggcgta

SEQ ID NO: 387209 - DNA, 25 bp, Mus musculus
gcgatcctccacgagcccggtggga

SEQ ID NO: 387210 - DNA, 25 bp, Mus musculus
ccattccggcctcacgacggaggtg

SEQ ID NO: 387211 - DNA, 25 bp, Mus musculus
aagcctgcagctcgcgagcgccgag

SEQ ID NO: 387212 - DNA, 25 bp, Mus musculus
agcgacgtttcccttccgattccag

SEQ ID NO: 387213 - DNA, 25 bp, Mus musculus
caatcagcgagcgacgtttcccttc

SEQ ID NO: 387214 - DNA, 25 bp, Mus musculus
tcgcctcacgctcgacggggaaggc

SEQ ID NO: 387215 - DNA, 25 bp, Mus musculus
ggagcacgtgtccattccggcctca

SEQ ID NO: 387216 - DNA, 25 bp, Mus musculus
gacccaggctgcttcagagctctgc

SEQ ID NO: 387217 - DNA, 25 bp, Mus musculus
ccactcatttgcatagggcgcgccc

SEQ ID NO: 387218 - DNA, 25 bp, Mus musculus
acaagaacagctcggcggttttcgc

SEQ ID NO: 387219 - DNA, 25 bp, Mus musculus
cacggacaagaacagctcggcggtt

SEQ ID NO: 387220 - DNA, 25 bp, Mus musculus
gagcgcgccggacacgaactcaagc

SEQ ID NO: 387221 - DNA, 25 bp, Mus musculus
gaaggcggaaccaatcagcgagcga

SEQ ID NO: 387222 - DNA, 25 bp, Mus musculus
tgtagctccgaccagggaagggaac

SEQ ID NO: 387223 - DNA, 25 bp, Mus musculus
agccagggcgcccaggaattcttcg

SEQ ID NO: 387224 - DNA, 25 bp, Mus musculus
gaccctctccgactggacaagttct

SEQ ID NO: 387225 - DNA, 25 bp, Mus musculus
cgattggcgactgacaagagctcgg

SEQ ID NO: 387226 - DNA, 25 bp, Mus musculus
aacgtccgggcttgagctggcgatt

SEQ ID NO: 387227 - DNA, 25 bp, Mus musculus
actggacaagttctcgccgcaccta

SEQ ID NO: 387228 - DNA, 25 bp, Mus musculus
agcggctgtagctccgaccagggaa

SEQ ID NO: 387229 - DNA, 25 bp, Mus musculus
gcactttctttcagaagcggctgta

SEQ ID NO: 387230 - DNA, 25 bp, Mus musculus
tcccgtctctgcactttctttcaga

SEQ ID NO: 387231 - DNA, 25 bp, Mus musculus
cggagaggaaatcccgtctctgcac

SEQ ID NO: 387232 - DNA, 25 bp, Mus musculus
tgactgcgggacctttacccttggc

SEQ ID NO: 387233 - DNA, 25 bp, Mus musculus
ggccacctgactgcgggacctttac

SEQ ID NO: 387234 - DNA, 25 bp, Mus musculus
tgagctggcgattggcgactgacaa

SEQ ID NO: 387235 - DNA, 25 bp, Mus musculus
gactccgcactgaccgctgggagtc

SEQ ID NO: 387236 - DNA, 25 bp, Mus musculus
gctgtcagactacgctccacttggg

SEQ ID NO: 387237 - DNA, 25 bp, Mus musculus
ttcagagacagagaaaggcgctgtc

SEQ ID NO: 387238 - DNA, 25 bp, Mus musculus
tacgctccacttggggctcgcttgc

SEQ ID NO: 387239 - DNA, 25 bp, Mus musculus
cgcacccacactttctgtggtggtg

SEQ ID NO: 387240 - DNA, 25 bp, Mus musculus
cgccgggatttgagcgccattagct

SEQ ID NO: 387241 - DNA, 25 bp, Mus musculus
tgagcgccattagctcgcgccagta

SEQ ID NO: 387242 - DNA, 25 bp, Mus musculus
cgccagtaccgggatcttcgctcag

SEQ ID NO: 387243 - DNA, 25 bp, Mus musculus
gatcttcgctcagctcgcctgagtc

SEQ ID NO: 387244 - DNA, 25 bp, Mus musculus
gcccgctggattcgaggacccgctt

SEQ ID NO: 387245 - DNA, 25 bp, Mus musculus
gggccggcagctacaagcctaaaga

SEQ ID NO: 387246 - DNA, 25 bp, Mus musculus
gcctaaagacgtcaagggcttacca

SEQ ID NO: 387247 - DNA, 25 bp, Mus musculus
acgtcaagggcttaccaggtactgc

SEQ ID NO: 387248 - DNA, 25 bp, Mus musculus
cctccatcggacacgagttcagaga

SEQ ID NO: 387249 - DNA, 25 bp, Mus musculus
aggacccgcttggatgcttcgcctc

SEQ ID NO: 387250 - DNA, 25 bp, Mus musculus
ggaggacgtcaaggccatgttcaac

SEQ ID NO: 387251 - DNA, 25 bp, Mus musculus
gctacaacagctctcgcgccaagtg

SEQ ID NO: 387252 - DNA, 25 bp, Mus musculus
gcgccaagtgcatcaagtgtagcta

SEQ ID NO: 387253 - DNA, 25 bp, Mus musculus
gtgtagctactgcaacatgtacttc

SEQ ID NO: 387254 - DNA, 25 bp, Mus musculus
gccaagtacacacagccagacgcgg

SEQ ID NO: 387255 - DNA, 25 bp, Mus musculus
caagagccctcaggacgagctagtc

SEQ ID NO: 387256 - DNA, 25 bp, Mus musculus
ccatgttcaacggtggcagccgcaa

SEQ ID NO: 387257 - DNA, 25 bp, Mus musculus
ccgcgcttcgacgacgatgacgatt

SEQ ID NO: 387258 - DNA, 25 bp, Mus musculus
gcagccttcggcttgtgccacaaga

SEQ ID NO: 387259 - DNA, 25 bp, Mus musculus
cgtgctacagaagttcccgggctgc

SEQ ID NO: 387260 - DNA, 25 bp, Mus musculus
ctggcaccaaaggtccacgcagcta

SEQ ID NO: 387261 - DNA, 25 bp, Mus musculus
gattccctccaggaagctgccgtgg

SEQ ID NO: 387262 - DNA, 25 bp, Mus musculus
actcagttccgtcaaggctgctgcg

SEQ ID NO: 387263 - DNA, 25 bp, Mus musculus
gccagacgcggctaacttcaattcc

SEQ ID NO: 387264 - DNA, 25 bp, Mus musculus
aggagcgcttcctcaagaacagtga

SEQ ID NO: 387265 - DNA, 25 bp, Mus musculus
gcaggcgctgtgactccacaaacta

SEQ ID NO: 387266 - DNA, 25 bp, Mus musculus
cacaaactactaagcgcggggcgga

SEQ ID NO: 387267 - DNA, 25 bp, Mus musculus
ctgctccgtgatcgcgtttcgggcc

SEQ ID NO: 387268 - DNA, 25 bp, Mus musculus
gcctggggacagtttgaagtaacta

SEQ ID NO: 387269 - DNA, 25 bp, Mus musculus
tgaagtaactatggccttcacgctg

SEQ ID NO: 387270 - DNA, 25 bp, Mus musculus
atggccttcacgctgtactccctga

SEQ ID NO: 387271 - DNA, 25 bp, Mus musculus
ttcacgctgtactccctgatgcagg

SEQ ID NO: 387272 - DNA, 25 bp, Mus musculus
gtactccctgatgcaggcggccctg

SEQ ID NO: 387273 - DNA, 25 bp, Mus musculus
gccctgctgtgcgtgaacgccatcg

SEQ ID NO: 387274 - DNA, 25 bp, Mus musculus
gtgctgcacgaggagcgcttcctca

SEQ ID NO: 387275 - DNA, 25 bp, Mus musculus
ctcaagaacagtgagtgcccgggcg

SEQ ID NO: 387276 - DNA, 25 bp, Mus musculus
ctccctggtcgcaggcgctgtgact

SEQ ID NO: 387277 - DNA, 25 bp, Mus musculus
aacgccatcgccgtgctgcacgagg

SEQ ID NO: 387278 - DNA, 25 bp, Mus musculus
tcacgactgcatccgggttggaagg

SEQ ID NO: 387279 - DNA, 25 bp, Mus musculus
gacttccggcgcgtcacgactgcat

SEQ ID NO: 387280 - DNA, 25 bp, Mus musculus
tgctctgtggtcgtcgtatctaccg

SEQ ID NO: 387281 - DNA, 25 bp, Mus musculus
gtggtttgctctgtggtcgtcgtat

SEQ ID NO: 387282 - DNA, 25 bp, Mus musculus
acgcgcagaactgttctcccagggg

SEQ ID NO: 387283 - DNA, 25 bp, Mus musculus
gcacgcgcagaactgttctcccagg

SEQ ID NO: 387284 - DNA, 25 bp, Mus musculus
gaccggccctctgcggcgtgcgcac

SEQ ID NO: 387285 - DNA, 25 bp, Mus musculus
ctcctcgagaatggcgcttcacggc

SEQ ID NO: 387286 - DNA, 25 bp, Mus musculus
cgctctcctcgagaatggcgcttca

SEQ ID NO: 387287 - DNA, 25 bp, Mus musculus
gaacgcctgcgctctcctcgagaat

SEQ ID NO: 387288 - DNA, 25 bp, Mus musculus
ctgccggaggcggcatctcctgtga

SEQ ID NO: 387289 - DNA, 25 bp, Mus musculus
cgcgcaaccaagaggcagagggctt

SEQ ID NO: 387290 - DNA, 25 bp, Mus musculus
ctcgggcctttccagaggacagcgg

SEQ ID NO: 387291 - DNA, 25 bp, Mus musculus
gaatggcgcttcacggcccgggcct

SEQ ID NO: 387292 - DNA, 25 bp, Mus musculus
cgttaagagaacttgcgtttcttca

SEQ ID NO: 387293 - DNA, 25 bp, Mus musculus
tgcgtttcttcatggcttccgcctt

SEQ ID NO: 387294 - DNA, 25 bp, Mus musculus
atctcctgcgccaccaaatgtgggc

SEQ ID NO: 387295 - DNA, 25 bp, Mus musculus
accaaatgtgggctctgcagggcag

SEQ ID NO: 387296 - DNA, 25 bp, Mus musculus
caggcgagtgccgacgaggcaacct

SEQ ID NO: 387297 - DNA, 25 bp, Mus musculus
gaggcaacctctggtctcggcttcc

SEQ ID NO: 387298 - DNA, 25 bp, Mus musculus
ttgaccgccaggctcttggcacaga

SEQ ID NO: 387299 - DNA, 25 bp, Mus musculus
ctcttggcacagatggtcaggacca

SEQ ID NO: 387300 - DNA, 25 bp, Mus musculus
tggtcaggaccacgatgagaacacc

SEQ ID NO: 387301 - DNA, 25 bp, Mus musculus
aggaccacgatgagaacacccacca

SEQ ID NO: 387302 - DNA, 25 bp, Mus musculus
accaccggccagaggaagcagtgca

SEQ ID NO: 387303 - DNA, 25 bp, Mus musculus
agcagtgcaggagagcaatctcgtc

SEQ ID NO: 387304 - DNA, 25 bp, Mus musculus
caatctcgtcgtgtgtgcgctgtag

SEQ ID NO: 387305 - DNA, 25 bp, Mus musculus
tggtctcggcttcccacaatcctcc

SEQ ID NO: 387306 - DNA, 25 bp, Mus musculus
gccgccgtcaatgggcaccgagcat

SEQ ID NO: 387307 - DNA, 25 bp, Mus musculus
tggccgcgctcgctcatgctgctcc

SEQ ID NO: 387308 - DNA, 25 bp, Mus musculus
catggccgagagcagccatggccgc

SEQ ID NO: 387309 - DNA, 25 bp, Mus musculus
tcaatgggcaccgagcatggccgag

SEQ ID NO: 387310 - DNA, 25 bp, Mus musculus
cggccatcttggagcgagccgccac

SEQ ID NO: 387311 - DNA, 25 bp, Mus musculus
gaatgcgagccaagcggccatcttg

SEQ ID NO: 387312 - DNA, 25 bp, Mus musculus
gaaaatgaatgcgagccaagcggcc

SEQ ID NO: 387313 - DNA, 25 bp, Mus musculus
ctcagcagaaaatgaatgcgagcca

SEQ ID NO: 387314 - DNA, 25 bp, Mus musculus
aagtcgctcagcagaaaatgaatgc

SEQ ID NO: 387315 - DNA, 25 bp, Mus musculus
ccatcgcgaggcaatctgagcgggc

SEQ ID NO: 387316 - DNA, 25 bp, Mus musculus
tggccatcgcgaggcaatctgagcg

SEQ ID NO: 387317 - DNA, 25 bp, Mus musculus
aaagagtggccatcgcgaggcaatc

SEQ ID NO: 387318 - DNA, 25 bp, Mus musculus
gacaatgaaagttaaaagtcgctca

SEQ ID NO: 387319 - DNA, 25 bp, Mus musculus
ccgagcatggccgagagcagccatg

SEQ ID NO: 387320 - DNA, 25 bp, Mus musculus
gcgcgcgcttttcgcagtgttagaa

SEQ ID NO: 387321 - DNA, 25 bp, Mus musculus
gaggacgcgcccatcagcgctgagc

SEQ ID NO: 387322 - DNA, 25 bp, Mus musculus
gagacggattctccttcttcctacc

SEQ ID NO: 387323 - DNA, 25 bp, Mus musculus
cagtctagtcttaccgagcgtcttc

SEQ ID NO: 387324 - DNA, 25 bp, Mus musculus
tttcccttgtgtggggtgacagtct

SEQ ID NO: 387325 - DNA, 25 bp, Mus musculus
ctgaatgtcatgtgcgtttcccttg

SEQ ID NO: 387326 - DNA, 25 bp, Mus musculus
ttcctaccctgcgtgctgggtcgga

SEQ ID NO: 387327 - DNA, 25 bp, Mus musculus
tagaagcgtcttgcgtctgacaggg

SEQ ID NO: 387328 - DNA, 25 bp, Mus musculus
atagcgcggcagtcaaggacagtcc

SEQ ID NO: 387329 - DNA, 25 bp, Mus musculus
ctcgcggtcaagttcccaacaggtg

SEQ ID NO: 387330 - DNA, 25 bp, Mus musculus
gctgtgagtgaagagacggattctc

SEQ ID NO: 387331 - DNA, 25 bp, Mus musculus
ttcccgggaactccacgaaggctgc

SEQ ID NO: 387332 - DNA, 25 bp, Mus musculus
ggcccggaagacgtcgctctcttct

SEQ ID NO: 387333 - DNA, 25 bp, Mus musculus
cttgtgagagggacgctgaatgtca

SEQ ID NO: 387334 - DNA, 25 bp, Mus musculus
gcaaatcggacgcttaaccagcccg

SEQ ID NO: 387335 - DNA, 25 bp, Mus musculus
ctgcgagcgtatgattagtagagcc

SEQ ID NO: 387336 - DNA, 25 bp, Mus musculus
agtcaatcaagaggctgcgagcgta

SEQ ID NO: 387337 - DNA, 25 bp, Mus musculus
tgcgcaatcccagtcaatcaagagg

SEQ ID NO: 387338 - DNA, 25 bp, Mus musculus
tccagagagtctgcgcaatcccagt

SEQ ID NO: 387339 - DNA, 25 bp, Mus musculus
taagcgtttgatccagagagtctgc

SEQ ID NO: 387340 - DNA, 25 bp, Mus musculus
caaggtcacactaagcgtttgatcc

SEQ ID NO: 387341 - DNA, 25 bp, Mus musculus
acgcgtcaatcaaggtcacactaag

SEQ ID NO: 387342 - DNA, 25 bp, Mus musculus
gacggattctttaacgcgtcaatca

SEQ ID NO: 387343 - DNA, 25 bp, Mus musculus
tcatcggccacagacggattcttta

SEQ ID NO: 387344 - DNA, 25 bp, Mus musculus
cccttcgggattggccagagcccag

SEQ ID NO: 387345 - DNA, 25 bp, Mus musculus
gtgcctgctgcaaatcggacgctta

SEQ ID NO: 387346 - DNA, 25 bp, Mus musculus
accaacggacctgtgcctgctgcaa

SEQ ID NO: 387347 - DNA, 25 bp, Mus musculus
agagcccagacatgccaaccaatca

SEQ ID NO: 387348 - DNA, 25 bp, Mus musculus
ggtcacttcctcagccgaggcggtc

SEQ ID NO: 387349 - DNA, 25 bp, Mus musculus
ccaagtcccgggagaaggccacagt

SEQ ID NO: 387350 - DNA, 25 bp, Mus musculus
agaaggccacagttccggtacgagc

SEQ ID NO: 387351 - DNA, 25 bp, Mus musculus
cacagttccggtacgagcctcggga

SEQ ID NO: 387352 - DNA, 25 bp, Mus musculus
cgctcggtagggacaggccaccaac

SEQ ID NO: 387353 - DNA, 25 bp, Mus musculus
gccaccaaccggaagcgcgtgggtc

SEQ ID NO: 387354 - DNA, 25 bp, Mus musculus
gcaggtctgtcacgagatgaggccc

SEQ ID NO: 387355 - DNA, 25 bp, Mus musculus
aaaatggcggatttcgaggagttga

SEQ ID NO: 387356 - DNA, 25 bp, Mus musculus
acgggacagccaacggcggtcgcct

SEQ ID NO: 387357 - DNA, 25 bp, Mus musculus
agccaacggcggtcgcctttgcggt

SEQ ID NO: 387358 - DNA, 25 bp, Mus musculus
cccgccttcggagccgtgaaggagt

SEQ ID NO: 387359 - DNA, 25 bp, Mus musculus
ttgcgtttagggagctccctgtccc

SEQ ID NO: 387360 - DNA, 25 bp, Mus musculus
tctaggcaggtctgtcacgagatga

SEQ ID NO: 387361 - DNA, 25 bp, Mus musculus
cccagtgcaggatgttgcaggagac

SEQ ID NO: 387362 - DNA, 25 bp, Mus musculus
agcatcggaggccaaccttcgcact

SEQ ID NO: 387363 - DNA, 25 bp, Mus musculus
gctgaccttgctccgctttcacgga

SEQ ID NO: 387364 - DNA, 25 bp, Mus musculus
ggccgccaggatgcgctacgcagac

SEQ ID NO: 387365 - DNA, 25 bp, Mus musculus
cgcatagcgcgcgtgattgctgccc

SEQ ID NO: 387366 - DNA, 25 bp, Mus musculus
ttgaccacgcagttctcctaagggc

SEQ ID NO: 387367 - DNA, 25 bp, Mus musculus
tgtccttttgctgccgcctccggga

SEQ ID NO: 387368 - DNA, 25 bp, Mus musculus
cctggggctcagaggatctccacgc

SEQ ID NO: 387369 - DNA, 25 bp, Mus musculus
cccattggtcgtcacctcggcggga

SEQ ID NO: 387370 - DNA, 25 bp, Mus musculus
ttccaacctggctctttacgctacg

SEQ ID NO: 387371 - DNA, 25 bp, Mus musculus
gctcgtctcgatgaggttgcctctg

SEQ ID NO: 387372 - DNA, 25 bp, Mus musculus
tgcgtaccgcatgcaaatgctcgtc

SEQ ID NO: 387373 - DNA, 25 bp, Mus musculus
ccgcggtgactcaatgacctgcgta

SEQ ID NO: 387374 - DNA, 25 bp, Mus musculus
tcacggaggattctccagccgcgca

SEQ ID NO: 387375 - DNA, 25 bp, Mus musculus
tcccagaagccgcagcacgagaggg

SEQ ID NO: 387376 - DNA, 25 bp, Mus musculus
acctgagcagtgtgtcgcgctactg

SEQ ID NO: 387377 - DNA, 25 bp, Mus musculus
gctgctgccagcgttctacaacgtc

SEQ ID NO: 387378 - DNA, 25 bp, Mus musculus
cggcctttcttcagcgtgctgcaga

SEQ ID NO: 387379 - DNA, 25 bp, Mus musculus
tgctgcagaggtacgagaacgcctc

SEQ ID NO: 387380 - DNA, 25 bp, Mus musculus
gtacgagaacgcctcagtgctgctg

SEQ ID NO: 387381 - DNA, 25 bp, Mus musculus
tacaacgtccgcaacaccctggtat

SEQ ID NO: 387382 - DNA, 25 bp, Mus musculus
ccctggtatccttccgagtcaaata

SEQ ID NO: 387383 - DNA, 25 bp, Mus musculus
tccagtcgcggcagccggtctactt

SEQ ID NO: 387384 - DNA, 25 bp, Mus musculus
aggtgcacctgttcggtttctgggc

SEQ ID NO: 387385 - DNA, 25 bp, Mus musculus
atcacgcaccattactatgacaacg

SEQ ID NO: 387386 - DNA, 25 bp, Mus musculus
tatgacaacgtcaagcccaagccgg

SEQ ID NO: 387387 - DNA, 25 bp, Mus musculus
gcccaagccgggtttccatgctatg

SEQ ID NO: 387388 - DNA, 25 bp, Mus musculus
ccatgctatgccctcggagatcttc

SEQ ID NO: 387389 - DNA, 25 bp, Mus musculus
gtcaaatacatgctggacgacttcc

SEQ ID NO: 387390 - DNA, 25 bp, Mus musculus
cgaggtcatcgtgacgacaggctac

SEQ ID NO: 387391 - DNA, 25 bp, Mus musculus
agctgcgcaaggttcggctggaaca

SEQ ID NO: 387392 - DNA, 25 bp, Mus musculus
acagaccgcttctttctggagacgt

SEQ ID NO: 387393 - DNA, 25 bp, Mus musculus
aggggcagtacagaccgcttctttc

SEQ ID NO: 387394 - DNA, 25 bp, Mus musculus
cgcaacctcttcgagaggggcagta

SEQ ID NO: 387395 - DNA, 25 bp, Mus musculus
ctgaaacagaaaatgcgcaacctct

SEQ ID NO: 387396 - DNA, 25 bp, Mus musculus
cgggcaagcgcgaactgaaacagaa

SEQ ID NO: 387397 - DNA, 25 bp, Mus musculus
ggacacgggcaagcgcgaactgaaa

SEQ ID NO: 387398 - DNA, 25 bp, Mus musculus
catctttggcgcaaatggggacacg

SEQ ID NO: 387399 - DNA, 25 bp, Mus musculus
cgtctttgtgaccatctttggcgca

SEQ ID NO: 387400 - DNA, 25 bp, Mus musculus
gccaacgtctttgtgaccatctttg

SEQ ID NO: 387401 - DNA, 25 bp, Mus musculus
agcgggtactgatgccaacgtcttt

SEQ ID NO: 387402 - DNA, 25 bp, Mus musculus
tgacgacaggctacgaaccaggagc

SEQ ID NO: 387403 - DNA, 25 bp, Mus musculus
gctacgaaccaggagcgggtactga

SEQ ID NO: 387404 - DNA, 25 bp, Mus musculus
gcgcgcagcgccctgcacatacacg

SEQ ID NO: 387405 - DNA, 25 bp, Mus musculus
ccctctcgacattcaaaggcgctgg

SEQ ID NO: 387406 - DNA, 25 bp, Mus musculus
gcgagtgcacacgacccaaaggtcc

SEQ ID NO: 387407 - DNA, 25 bp, Mus musculus
cctgcacatacacgcgggcggcgtg

SEQ ID NO: 387408 - DNA, 25 bp, Mus musculus
ctcgacattcaaaggcgctggggcc

SEQ ID NO: 387409 - DNA, 25 bp, Mus musculus
tgcacacggagcgtgcacacgacgg

SEQ ID NO: 387410 - DNA, 25 bp, Mus musculus
tgcacacgacgggagacgtgctccc

SEQ ID NO: 387411 - DNA, 25 bp, Mus musculus
acgtgctcccggacatgtggagatg

SEQ ID NO: 387412 - DNA, 25 bp, Mus musculus
ctcccggacatgtggagatgcgctc

SEQ ID NO: 387413 - DNA, 25 bp, Mus musculus
cagacaggcagcgagtgcacacgac

SEQ ID NO: 387414 - DNA, 25 bp, Mus musculus
gggcaccgcacacaggtcactcggg

SEQ ID NO: 387415 - DNA, 25 bp, Mus musculus
acacaggtcactcggggacgtgcgc

SEQ ID NO: 387416 - DNA, 25 bp, Mus musculus
ggacgtgcgcacagaggctggcgca

SEQ ID NO: 387417 - DNA, 25 bp, Mus musculus
acatgtggagatgcgctcgccagcg

SEQ ID NO: 387418 - DNA, 25 bp, Mus musculus
cccagcaaggtgtccaatctctttc

SEQ ID NO: 387419 - DNA, 25 bp, Mus musculus
gtactcacccactcgagaagccttt

SEQ ID NO: 387420 - DNA, 25 bp, Mus musculus
aaaagcatggggctccgcttcccga

SEQ ID NO: 387421 - DNA, 25 bp, Mus musculus
gggcaaagcccgagccttaaaagca

SEQ ID NO: 387422 - DNA, 25 bp, Mus musculus
tcgatccggtaacgtcggtctcgga

SEQ ID NO: 387423 - DNA, 25 bp, Mus musculus
aatgtcaccagaggccgttccgctc

SEQ ID NO: 387424 - DNA, 25 bp, Mus musculus
cgatgtccgattcgtggagtcaccc

SEQ ID NO: 387425 - DNA, 25 bp, Mus musculus
aaggtgtccaatctctttcgctccc

SEQ ID NO: 387426 - DNA, 25 bp, Mus musculus
cgggaacctaagctagctggcggcc

SEQ ID NO: 387427 - DNA, 25 bp, Mus musculus
cccaagaaaatgtcaccagaggccg

SEQ ID NO: 387428 - DNA, 25 bp, Mus musculus
tcagacgactcccagcggcgagcag

SEQ ID NO: 387429 - DNA, 25 bp, Mus musculus
aagttgctccaacacaactccgcgg

SEQ ID NO: 387430 - DNA, 25 bp, Mus musculus
acagagcagcgcctgccggctagag

SEQ ID NO: 387431 - DNA, 25 bp, Mus musculus
cgagaagcctttccgaaggaagctc

SEQ ID NO: 387432 - DNA, 25 bp, Mus musculus
tctcggtcgcgaccgcaccgtggaa

SEQ ID NO: 387433 - DNA, 25 bp, Mus musculus
gcgaccgcaccgtggaacccggaca

SEQ ID NO: 387434 - DNA, 25 bp, Mus musculus
caaaaaaacagcagcggccggtggt

SEQ ID NO: 387435 - DNA, 25 bp, Mus musculus
cggtggttagccgatacgtggctcc

SEQ ID NO: 387436 - DNA, 25 bp, Mus musculus
cagctccggatgtcacctgcaatgc

SEQ ID NO: 387437 - DNA, 25 bp, Mus musculus
ctccggatgtcacctgcaatgcttt

SEQ ID NO: 387438 - DNA, 25 bp, Mus musculus
tgcaatgctttctcctccggcgcag

SEQ ID NO: 387439 - DNA, 25 bp, Mus musculus
tccggcgcagccatagccgccgctc

SEQ ID NO: 387440 - DNA, 25 bp, Mus musculus
gccgctcccgccacctcaatctcaa

SEQ ID NO: 387441 - DNA, 25 bp, Mus musculus
cctcaatctcaaagcctcgcgggga

SEQ ID NO: 387442 - DNA, 25 bp, Mus musculus
atctcaaagcctcgcggggaacgtc

SEQ ID NO: 387443 - DNA, 25 bp, Mus musculus
ctcgcggggaacgtccctggctcag

SEQ ID NO: 387444 - DNA, 25 bp, Mus musculus
gcccgcaaagggtctcggtcgcgac

SEQ ID NO: 387445 - DNA, 25 bp, Mus musculus
caaagggtctcggtcgcgaccgcac

SEQ ID NO: 387446 - DNA, 25 bp, Mus musculus
tgttcacgtacacctggacgcaggg

SEQ ID NO: 387447 - DNA, 25 bp, Mus musculus
ccctgcagtcggtgccacaggtgaa

SEQ ID NO: 387448 - DNA, 25 bp, Mus musculus
ccacaggtgaaggtgcactcgaaca

SEQ ID NO: 387449 - DNA, 25 bp, Mus musculus
ccgccgtggcttgcagatcctgcaa

SEQ ID NO: 387450 - DNA, 25 bp, Mus musculus
ctgagccagcagaagccgaagatga

SEQ ID NO: 387451 - DNA, 25 bp, Mus musculus
ccgaagatgaagagcgacaggatgc

SEQ ID NO: 387452 - DNA, 25 bp, Mus musculus
tgccggagacgatgaggaacaagcc

SEQ ID NO: 387453 - DNA, 25 bp, Mus musculus
tcggcttccgtgtactcgtaagaca

SEQ ID NO: 387454 - DNA, 25 bp, Mus musculus
taagacaccctgagcttcgccatcg

SEQ ID NO: 387455 - DNA, 25 bp, Mus musculus
cggaatcctcgccagatgcaacctg

SEQ ID NO: 387456 - DNA, 25 bp, Mus musculus
acggtcgaggcgaacgcttagcacc

SEQ ID NO: 387457 - DNA, 25 bp, Mus musculus
tgcgaagcgggaatcttcaaactcc

SEQ ID NO: 387458 - DNA, 25 bp, Mus musculus
cttaccttggggttggtcaggagct

SEQ ID NO: 387459 - DNA, 25 bp, Mus musculus
ttggactcggagttgttcacgtaca

SEQ ID NO: 387460 - DNA, 25 bp, Mus musculus
tctctccgagaagctgcaaggatgc

SEQ ID NO: 387461 - DNA, 25 bp, Mus musculus
atcttgcaccgtggctgcggagcag

SEQ ID NO: 387462 - DNA, 25 bp, Mus musculus
tggcccgtgccctccctcgacgggc

SEQ ID NO: 387463 - DNA, 25 bp, Mus musculus
tttgtgccagtcgtccggaggctgc

SEQ ID NO: 387464 - DNA, 25 bp, Mus musculus
tccgagaagctgcaaggatgctgtc

SEQ ID NO: 387465 - DNA, 25 bp, Mus musculus
gccattttgtgccagtcgtccggag

SEQ ID NO: 387466 - DNA, 25 bp, Mus musculus
tgcgctcggccattttgtgccagtc

SEQ ID NO: 387467 - DNA, 25 bp, Mus musculus
ttcctttgcgctcggccattttgtg

SEQ ID NO: 387468 - DNA, 25 bp, Mus musculus
tgaccttcctttgcgctcggccatt

SEQ ID NO: 387469 - DNA, 25 bp, Mus musculus
ggctgccttgaccttcctttgcgct

SEQ ID NO: 387470 - DNA, 25 bp, Mus musculus
cgggctggctgccttgaccttcctt

SEQ ID NO: 387471 - DNA, 25 bp, Mus musculus
aaggatgctgtctgtgcgcgtcgcc

SEQ ID NO: 387472 - DNA, 25 bp, Mus musculus
cgccatcttgcaccgtggctgcgga

SEQ ID NO: 387473 - DNA, 25 bp, Mus musculus
cagacggtctctccgagaagctgca

SEQ ID NO: 387474 - DNA, 25 bp, Mus musculus
gctcgctgttcaaggggaacttctg

SEQ ID NO: 387475 - DNA, 25 bp, Mus musculus
acccgagaactggtgctgtcatagc

SEQ ID NO: 387476 - DNA, 25 bp, Mus musculus
cgcgtgagacccgagaactggtgct

SEQ ID NO: 387477 - DNA, 25 bp, Mus musculus
tgatttccctcgcagcccacagaga

SEQ ID NO: 387478 - DNA, 25 bp, Mus musculus
ctctggggttctcggcccgagcttc

SEQ ID NO: 387479 - DNA, 25 bp, Mus musculus
tgtgagcagtcgctctggggttctc

SEQ ID NO: 387480 - DNA, 25 bp, Mus musculus
aaaaggaggcgcattccagcccgcg

SEQ ID NO: 387481 - DNA, 25 bp, Mus musculus
tcacgcttgaaaaccgaagcccaaa

SEQ ID NO: 387482 - DNA, 25 bp, Mus musculus
ggcgttctcacgcttgaaaaccgaa

SEQ ID NO: 387483 - DNA, 25 bp, Mus musculus
gtcacccggcgttctcacgcttgaa

SEQ ID NO: 387484 - DNA, 25 bp, Mus musculus
aacttctgggtaagtcagcgcggcg

SEQ ID NO: 387485 - DNA, 25 bp, Mus musculus
tcaaggggaacttctgggtaagtca

SEQ ID NO: 387486 - DNA, 25 bp, Mus musculus
agaactggtgctgtcatagcggtgc

SEQ ID NO: 387487 - DNA, 25 bp, Mus musculus
cggcatgacgggctcgctgttcaag

SEQ ID NO: 387488 - DNA, 25 bp, Mus musculus
ggaacctcttcgtaagccgcgcatg

SEQ ID NO: 387489 - DNA, 25 bp, Mus musculus
aacatttctctggacggacggcctc

SEQ ID NO: 387490 - DNA, 25 bp, Mus musculus
gcctccgctgcaggaccacgagtgg

SEQ ID NO: 387491 - DNA, 25 bp, Mus musculus
ccggagcaagggctcggctcagcct

SEQ ID NO: 387492 - DNA, 25 bp, Mus musculus
tggctgcaacgcgttctcggcaccg

SEQ ID NO: 387493 - DNA, 25 bp, Mus musculus
ggtgctcagctgcagttgcctgacg

SEQ ID NO: 387494 - DNA, 25 bp, Mus musculus
ggaggacgatgccttcaccaacgtg

SEQ ID NO: 387495 - DNA, 25 bp, Mus musculus
accaacgtgcaggtgccatcggcca

SEQ ID NO: 387496 - DNA, 25 bp, Mus musculus
ccatcggccagctttttgggctccg

SEQ ID NO: 387497 - DNA, 25 bp, Mus musculus
agtcggggccgcctcaactcgttca

SEQ ID NO: 387498 - DNA, 25 bp, Mus musculus
aactcgttcactcagggaatcctgc

SEQ ID NO: 387499 - DNA, 25 bp, Mus musculus
tccaggcagaactcgcagaactact

SEQ ID NO: 387500 - DNA, 25 bp, Mus musculus
gaactactgcgccttggagcagtca

SEQ ID NO: 387501 - DNA, 25 bp, Mus musculus
cccagacggacacaatggcggcggc

SEQ ID NO: 387502 - DNA, 25 bp, Mus musculus
tttgacagaaacagaccgcgacgtc

SEQ ID NO: 387503 - DNA, 25 bp, Mus musculus
tgaggatgctgtcactgccatgcga

SEQ ID NO: 387504 - DNA, 25 bp, Mus musculus
tcacgtgacacccaggaggccggaa

SEQ ID NO: 387505 - DNA, 25 bp, Mus musculus
ccaaaggcaaggtgaggatgctgtc

SEQ ID NO: 387506 - DNA, 25 bp, Mus musculus
gccagccgcaccaaaggcaaggtga

SEQ ID NO: 387507 - DNA, 25 bp, Mus musculus
aggccaaggccagccgcaccaaagg

SEQ ID NO: 387508 - DNA, 25 bp, Mus musculus
aacagaccgcgacgtcgcggaggta

SEQ ID NO: 387509 - DNA, 25 bp, Mus musculus
tgcaggagtttgacagaaacagacc

SEQ ID NO: 387510 - DNA, 25 bp, Mus musculus
cttgcgtgaattgcaggagtttgac

SEQ ID NO: 387511 - DNA, 25 bp, Mus musculus
aactgggcggcttgcgtgaattgca

SEQ ID NO: 387512 - DNA, 25 bp, Mus musculus
cgtgacacccaggaggccggaactg

SEQ ID NO: 387513 - DNA, 25 bp, Mus musculus
gatgctgtcactgccatgcgagccc

SEQ ID NO: 387514 - DNA, 25 bp, Mus musculus
cggcctccagttgccgcctcccatg

SEQ ID NO: 387515 - DNA, 25 bp, Mus musculus
cctcccatgcccaagtggtggaggg

SEQ ID NO: 387516 - DNA, 25 bp, Mus musculus
cccggcagcaccgagatgttgacga

SEQ ID NO: 387517 - DNA, 25 bp, Mus musculus
cgtgggtcactctgcagagcacaaa

SEQ ID NO: 387518 - DNA, 25 bp, Mus musculus
cgtcgggtggcacgcgctcccagaa

SEQ ID NO: 387519 - DNA, 25 bp, Mus musculus
agagcacaaagctcgcgggagcgtt

SEQ ID NO: 387520 - DNA, 25 bp, Mus musculus
gcaactcggcggtcacctggtagcc

SEQ ID NO: 387521 - DNA, 25 bp, Mus musculus
agatgttgacgatccgcggcgcagc

SEQ ID NO: 387522 - DNA, 25 bp, Mus musculus
cagcaccgagatgttgacgatccgc

SEQ ID NO: 387523 - DNA, 25 bp, Mus musculus
ggtcacctggtagccgtgaccctgg

SEQ ID NO: 387524 - DNA, 25 bp, Mus musculus
tcagcgcgggcaactcggcggtcac

SEQ ID NO: 387525 - DNA, 25 bp, Mus musculus
ctattggccgccgtgcacgtgtagc

SEQ ID NO: 387526 - DNA, 25 bp, Mus musculus
ggcccaggctattggccgccgtgca

SEQ ID NO: 387527 - DNA, 25 bp, Mus musculus
aacaggtagacgctggcctcggcgc

SEQ ID NO: 387528 - DNA, 25 bp, Mus musculus
agcggaacaggtagacgctggcctc

SEQ ID NO: 387529 - DNA, 25 bp, Mus musculus
ctcgcgggagcgttagagagcccac

SEQ ID NO: 387530 - DNA, 25 bp, Mus musculus
gtctcaccagtcacgcgcagacgga

SEQ ID NO: 387531 - DNA, 25 bp, Mus musculus
tggcgactctcatagcgatcgtggg

SEQ ID NO: 387532 - DNA, 25 bp, Mus musculus
cccatggcgactctcatagcgatcg

SEQ ID NO: 387533 - DNA, 25 bp, Mus musculus
tctcatagcgatcgtgggcgtcgcc

SEQ ID NO: 387534 - DNA, 25 bp, Mus musculus
tgggcgtcgccggtgaactccacgc

SEQ ID NO: 387535 - DNA, 25 bp, Mus musculus
ccggtgaactccacgcggcagaagt

SEQ ID NO: 387536 - DNA, 25 bp, Mus musculus
actccacgcggcagaagtagcggcc

SEQ ID NO: 387537 - DNA, 25 bp, Mus musculus
cagaagtagcggccgctgtccgcca

SEQ ID NO: 387538 - DNA, 25 bp, Mus musculus
gctcgacgcgcagggacaggtcgtt

SEQ ID NO: 387539 - DNA, 25 bp, Mus musculus
aggctcagcgccgtctggcacagct

SEQ ID NO: 387540 - DNA, 25 bp, Mus musculus
agcggaacacctgcgggcccgcgta

SEQ ID NO: 387541 - DNA, 25 bp, Mus musculus
tacggctcgcccgagcgccagatgg

SEQ ID NO: 387542 - DNA, 25 bp, Mus musculus
gggcacctgcatggaccagcgctgc

SEQ ID NO: 387543 - DNA, 25 bp, Mus musculus
cctcaggcgccagcccgtctcacca

SEQ ID NO: 387544 - DNA, 25 bp, Mus musculus
tcccgagtcccggagtcctactgaa

SEQ ID NO: 387545 - DNA, 25 bp, Mus musculus
gcgcttttgctgagctgtgcagttc

SEQ ID NO: 387546 - DNA, 25 bp, Mus musculus
gttacaaaatgttgcccggctgggc

SEQ ID NO: 387547 - DNA, 25 bp, Mus musculus
ttttctccaaaagatggattggagg

SEQ ID NO: 387548 - DNA, 25 bp, Mus musculus
ctctccgctcaatgctattttttcc

SEQ ID NO: 387549 - DNA, 25 bp, Mus musculus
ggctaattttagcaggaaccaaata

SEQ ID NO: 387550 - DNA, 25 bp, Mus musculus
cggcgagcccggctaattttagcag

SEQ ID NO: 387551 - DNA, 25 bp, Mus musculus
gtcctggagtaatcacattcacaca

SEQ ID NO: 387552 - DNA, 25 bp, Mus musculus
cccgaggagtcctggagtaatcaca

SEQ ID NO: 387553 - DNA, 25 bp, Mus musculus
gaaaatggcgtctccggagcccgag

SEQ ID NO: 387554 - DNA, 25 bp, Mus musculus
gccgcgccaccgatttacggagaga

SEQ ID NO: 387555 - DNA, 25 bp, Mus musculus
agcatctgtcaaacggcgacgcgcg

SEQ ID NO: 387556 - DNA, 25 bp, Mus musculus
actccatagcgacgagcatctgtca

SEQ ID NO: 387557 - DNA, 25 bp, Mus musculus
tgctgctgcggcaactccatagcga

SEQ ID NO: 387558 - DNA, 25 bp, Mus musculus
tccacgaactagagaagaccggggc

SEQ ID NO: 387559 - DNA, 25 bp, Mus musculus
ctgcagcgctgtggaagtcaagagc

SEQ ID NO: 387560 - DNA, 25 bp, Mus musculus
tctccgcggagactctctctgaggc

SEQ ID NO: 387561 - DNA, 25 bp, Mus musculus
ctgagtggggccgaaatcatgaacc

SEQ ID NO: 387562 - DNA, 25 bp, Mus musculus
cagcctcctgtttggcgctgggtac

SEQ ID NO: 387563 - DNA, 25 bp, Mus musculus
agaccctacgcttctacgactgcag

SEQ ID NO: 387564 - DNA, 25 bp, Mus musculus
taaactcccatttgggcgagccgcc

SEQ ID NO: 387565 - DNA, 25 bp, Mus musculus
tctgcactcggtcccttggcaaatg

SEQ ID NO: 387566 - DNA, 25 bp, Mus musculus
ccggcgtcgacaactttggagctta

SEQ ID NO: 387567 - DNA, 25 bp, Mus musculus
cagtgtaggctctgaaccagctcca

SEQ ID NO: 387568 - DNA, 25 bp, Mus musculus
gagagctgctcttttgttccacgaa

SEQ ID NO: 387569 - DNA, 25 bp, Mus musculus
tggctgcgccgcaatttggccttaa

SEQ ID NO: 387570 - DNA, 25 bp, Mus musculus
gctcttagggttcagggaccgataa

SEQ ID NO: 387571 - DNA, 25 bp, Mus musculus
ccggagttttcataagtctcagacc

SEQ ID NO: 387572 - DNA, 25 bp, Mus musculus
ggcgcttcagaagcggccacaagct

SEQ ID NO: 387573 - DNA, 25 bp, Mus musculus
gaagcggccacaagcttgccctgca

SEQ ID NO: 387574 - DNA, 25 bp, Mus musculus
gccatcctccacaacgggatgatct

SEQ ID NO: 387575 - DNA, 25 bp, Mus musculus
aacgggatgatcttcaggcttcagc

SEQ ID NO: 387576 - DNA, 25 bp, Mus musculus
cgttcagcatctgcgcatcggtcac

SEQ ID NO: 387577 - DNA, 25 bp, Mus musculus
tcggaagaaaactcggcgcttcaga

SEQ ID NO: 387578 - DNA, 25 bp, Mus musculus
tctccttcggaagaaaactcggcgc

SEQ ID NO: 387579 - DNA, 25 bp, Mus musculus
gaaaccaagcctctccttcggaaga

SEQ ID NO: 387580 - DNA, 25 bp, Mus musculus
tcggcagtgcttgaaaccaagcctc

SEQ ID NO: 387581 - DNA, 25 bp, Mus musculus
ttgccctcggcagtgcttgaaacca

SEQ ID NO: 387582 - DNA, 25 bp, Mus musculus
tcgccgcagtatcagggatgaagag

SEQ ID NO: 387583 - DNA, 25 bp, Mus musculus
catcggtcacgatcgccgcagtatc

SEQ ID NO: 387584 - DNA, 25 bp, Mus musculus
cagcatctgcgcatcggtcacgatc

SEQ ID NO: 387585 - DNA, 25 bp, Mus musculus
aggcttcagcttcattcccgggacg

SEQ ID NO: 387586 - DNA, 25 bp, Mus musculus
cctcccgcgcgccagaaagagaaga

SEQ ID NO: 387587 - DNA, 25 bp, Mus musculus
agatggcgctcagctgcctcaggaa

SEQ ID NO: 387588 - DNA, 25 bp, Mus musculus
aagatggcgctcagctgcctcagga

SEQ ID NO: 387589 - DNA, 25 bp, Mus musculus
gagaagatggcgctcagctgcctca

SEQ ID NO: 387590 - DNA, 25 bp, Mus musculus
gaaagagaagatggcgctcagctgc

SEQ ID NO: 387591 - DNA, 25 bp, Mus musculus
cccgcgcgccagaaagagaagatgg

SEQ ID NO: 387592 - DNA, 25 bp, Mus musculus
tcccgcgcgccagaaagagaagatg

SEQ ID NO: 387593 - DNA, 25 bp, Mus musculus
gcgctcagctgcctcaggaagtgac

SEQ ID NO: 387594 - DNA, 25 bp, Mus musculus
ctcagctgcctcaggaagtgacgtc

SEQ ID NO: 387595 - DNA, 25 bp, Mus musculus
tcagctgcctcaggaagtgacgtcg

SEQ ID NO: 387596 - DNA, 25 bp, Mus musculus
cagctgcctcaggaagtgacgtcgc

SEQ ID NO: 387597 - DNA, 25 bp, Mus musculus
atggcgctcagctgcctcaggaagt

SEQ ID NO: 387598 - DNA, 25 bp, Mus musculus
gaagtgacgtcgcctcatttgcatg

SEQ ID NO: 387599 - DNA, 25 bp, Mus musculus
gctgcctcaggaagtgacgtcgcct

SEQ ID NO: 387600 - DNA, 25 bp, Mus musculus
cccaggacttcgaagcagtcggtca

SEQ ID NO: 387601 - DNA, 25 bp, Mus musculus
tgggccactcctcccggactcctct

SEQ ID NO: 387602 - DNA, 25 bp, Mus musculus
cccagcgcccgctttgattctcagg

SEQ ID NO: 387603 - DNA, 25 bp, Mus musculus
cccgcatacttgcagcatgatgtaa

SEQ ID NO: 387604 - DNA, 25 bp, Mus musculus
cgcatacttgcagcatgatgtaata

SEQ ID NO: 387605 - DNA, 25 bp, Mus musculus
cttgcagcatgatgtaataatcctc

SEQ ID NO: 387606 - DNA, 25 bp, Mus musculus
tcaggcgcggggcagttaaccagcc

SEQ ID NO: 387607 - DNA, 25 bp, Mus musculus
cagcatgatgtaataatcctcattg

SEQ ID NO: 387608 - DNA, 25 bp, Mus musculus
ggggcagttaaccagccgcccagcg

SEQ ID NO: 387609 - DNA, 25 bp, Mus musculus
gccttcgcatcctcatgggccactc

SEQ ID NO: 387610 - DNA, 25 bp, Mus musculus
ccctaggacccaggacttcgaagca

SEQ ID NO: 387611 - DNA, 25 bp, Mus musculus
ctaggacccaggacttcgaagcagt

SEQ ID NO: 387612 - DNA, 25 bp, Mus musculus
ggacttcgaagcagtcggtcactcg

SEQ ID NO: 387613 - DNA, 25 bp, Mus musculus
atcctcattgaacccgggcgagcga

SEQ ID NO: 387614 - DNA, 25 bp, Mus musculus
tcttccctctctcgattggagccga

SEQ ID NO: 387615 - DNA, 25 bp, Mus musculus
agcacggcgacgctttacgtcccgt

SEQ ID NO: 387616 - DNA, 25 bp, Mus musculus
ttggagccgagacaaaagcaacggg

SEQ ID NO: 387617 - DNA, 25 bp, Mus musculus
cgccagacttccgaaaattggccaa

SEQ ID NO: 387618 - DNA, 25 bp, Mus musculus
aattggccaaaaactcaccgcatga

SEQ ID NO: 387619 - DNA, 25 bp, Mus musculus
catgaattttcttgtcccgcggatc

SEQ ID NO: 387620 - DNA, 25 bp, Mus musculus
cccgcggatccaagatggcgacgta

SEQ ID NO: 387621 - DNA, 25 bp, Mus musculus
ggctgctgggagcaagacctttacc

SEQ ID NO: 387622 - DNA, 25 bp, Mus musculus
ggagcaagacctttaccctctgacc

SEQ ID NO: 387623 - DNA, 25 bp, Mus musculus
aggctcgccgaatggacggaacgcc

SEQ ID NO: 387624 - DNA, 25 bp, Mus musculus
cgtacgccagtcgaccgtgagaagc

SEQ ID NO: 387625 - DNA, 25 bp, Mus musculus
gtgagaagcacaacgctcgcctgga

SEQ ID NO: 387626 - DNA, 25 bp, Mus musculus
tgtgtttgtgttttcctcggacacc

SEQ ID NO: 387627 - DNA, 25 bp, Mus musculus
aagatggcgacgtatccaccgcgga

SEQ ID NO: 387628 - DNA, 25 bp, Mus musculus
cattatttgcttattcagcgcctcg

SEQ ID NO: 387629 - DNA, 25 bp, Mus musculus
cgccctgatggtggcgccagactct

SEQ ID NO: 387630 - DNA, 25 bp, Mus musculus
gcgtttgtactccattatttgctta

SEQ ID NO: 387631 - DNA, 25 bp, Mus musculus
tccttcttgcgtttgtactccatta

SEQ ID NO: 387632 - DNA, 25 bp, Mus musculus
gccctcgctccttcttgcgtttgta

SEQ ID NO: 387633 - DNA, 25 bp, Mus musculus
tgaagccctcgctccttcttgcgtt

SEQ ID NO: 387634 - DNA, 25 bp, Mus musculus
tggcgccagactctgacactgaagc

SEQ ID NO: 387635 - DNA, 25 bp, Mus musculus
acgggtcggttcaggtgcctgctcc

SEQ ID NO: 387636 - DNA, 25 bp, Mus musculus
cttccggagcagacgggtcggttca

SEQ ID NO: 387637 - DNA, 25 bp, Mus musculus
ctctctcttccggagcagacgggtc

SEQ ID NO: 387638 - DNA, 25 bp, Mus musculus
cttctctctcttccggagcagacgg

SEQ ID NO: 387639 - DNA, 25 bp, Mus musculus
tgccaccgggatcgcaccttctctc

SEQ ID NO: 387640 - DNA, 25 bp, Mus musculus
ctcgcccaaaaggaagcttctgggg

SEQ ID NO: 387641 - DNA, 25 bp, Mus musculus
ctcctcgcccaaaaggaagcttctg

SEQ ID NO: 387642 - DNA, 25 bp, Mus musculus
agaagaagcgcagccctgtggccgc

SEQ ID NO: 387643 - DNA, 25 bp, Mus musculus
cgcaacagaccctgatccgtgcata

SEQ ID NO: 387644 - DNA, 25 bp, Mus musculus
cccgcaaacacgagtgggcgcagga

SEQ ID NO: 387645 - DNA, 25 bp, Mus musculus
agcaagttcttgctgccgcaggagg

SEQ ID NO: 387646 - DNA, 25 bp, Mus musculus
cctggttttcgaagcaaatttcttg

SEQ ID NO: 387647 - DNA, 25 bp, Mus musculus
cctgatccgtgcatacctggttttc

SEQ ID NO: 387648 - DNA, 25 bp, Mus musculus
cgcgtgtaagccctagactaccaaa

SEQ ID NO: 387649 - DNA, 25 bp, Mus musculus
accaggcgaccaggcccgcaacaga

SEQ ID NO: 387650 - DNA, 25 bp, Mus musculus
ctagactaccaaagacctgacctga

SEQ ID NO: 387651 - DNA, 25 bp, Mus musculus
agacctgacctgacaacaggaagcc

SEQ ID NO: 387652 - DNA, 25 bp, Mus musculus
gacggacccgcgtgtaagccctaga

SEQ ID NO: 387653 - DNA, 25 bp, Mus musculus
ctaacccggcatgggcgtggctaac

SEQ ID NO: 387654 - DNA, 25 bp, Mus musculus
ctccatccaaccgtgcaccaggcga

SEQ ID NO: 387655 - DNA, 25 bp, Mus musculus
ccgtgcatacctggttttcgaagca

SEQ ID NO: 387656 - DNA, 25 bp, Mus musculus
gcatcgccgaaaaggtaactcatgt

SEQ ID NO: 387657 - DNA, 25 bp, Mus musculus
acgaggttctgtacagcatcgccga

SEQ ID NO: 387658 - DNA, 25 bp, Mus musculus
taactcatgtgcagtgttcgccgtg

SEQ ID NO: 387659 - DNA, 25 bp, Mus musculus
cttgcatgaagatggacgaggttct

SEQ ID NO: 387660 - DNA, 25 bp, Mus musculus
cgcgtggtcgtcattcgtttcggac

SEQ ID NO: 387661 - DNA, 25 bp, Mus musculus
ggcaggtagaccaggccatcctttc

SEQ ID NO: 387662 - DNA, 25 bp, Mus musculus
agcgcgagattagactcgggtatcc

SEQ ID NO: 387663 - DNA, 25 bp, Mus musculus
caagaaggcgagctcgacgcgctca

SEQ ID NO: 387664 - DNA, 25 bp, Mus musculus
ggtcgcgatcctctgctctttctac

SEQ ID NO: 387665 - DNA, 25 bp, Mus musculus
tttctacccacaggtagctcgcggc

SEQ ID NO: 387666 - DNA, 25 bp, Mus musculus
ttccgcatctgcacaatggctggca

SEQ ID NO: 387667 - DNA, 25 bp, Mus musculus
gtttggacgccagatttcaagcccg

SEQ ID NO: 387668 - DNA, 25 bp, Mus musculus
cgtgctctggagcacttgctaaaga

SEQ ID NO: 387669 - DNA, 25 bp, Mus musculus
aggcgcgctcaagatgtcgtacatg

SEQ ID NO: 387670 - DNA, 25 bp, Mus musculus
ttctggaacgcagaccgcacggctc

SEQ ID NO: 387671 - DNA, 25 bp, Mus musculus
ggaccgcctcacgttcatctgtcag

SEQ ID NO: 387672 - DNA, 25 bp, Mus musculus
gttcatctgtcagctctcccggctt

SEQ ID NO: 387673 - DNA, 25 bp, Mus musculus
agagcccagccagccacctcggtct

SEQ ID NO: 387674 - DNA, 25 bp, Mus musculus
tgacacgacgctctgctcagccaat

SEQ ID NO: 387675 - DNA, 25 bp, Mus musculus
agcagggaccgcctcacgttcatct

SEQ ID NO: 387676 - DNA, 25 bp, Mus musculus
cttgagggctccaagcgtttctgct

SEQ ID NO: 387677 - DNA, 25 bp, Mus musculus
cgacgctctgctcagccaatcaggg

SEQ ID NO: 387678 - DNA, 25 bp, Mus musculus
cgtttcctcgacatccgcatcgaga

SEQ ID NO: 387679 - DNA, 25 bp, Mus musculus
aagccaggtaacaggtgcagaaggt

SEQ ID NO: 387680 - DNA, 25 bp, Mus musculus
tgagaagccaggtaacaggtgcaga

SEQ ID NO: 387681 - DNA, 25 bp, Mus musculus
gctcaccttgttggtgaggtgagaa

SEQ ID NO: 387682 - DNA, 25 bp, Mus musculus
cccgggcagcttctggaacgcagac

SEQ ID NO: 387683 - DNA, 25 bp, Mus musculus
gcacgcctgctcaccttgttggtga

SEQ ID NO: 387684 - DNA, 25 bp, Mus musculus
tcacgactttggctcaggactttag

SEQ ID NO: 387685 - DNA, 25 bp, Mus musculus
caggactttagtttcctagcatccc

SEQ ID NO: 387686 - DNA, 25 bp, Mus musculus
ggccacgatcccttccagtacccta

SEQ ID NO: 387687 - DNA, 25 bp, Mus musculus
aaccggcgaccttggtcctcagagc

SEQ ID NO: 387688 - DNA, 25 bp, Mus musculus
tagggcacgcgtcactcaccgcgtt

SEQ ID NO: 387689 - DNA, 25 bp, Mus musculus
gtccgccatcacgactttggctcag

SEQ ID NO: 387690 - DNA, 25 bp, Mus musculus
tcactcaccgcgttctgcagcaagt

SEQ ID NO: 387691 - DNA, 25 bp, Mus musculus
cgggtgtccatccacaccagcttaa

SEQ ID NO: 387692 - DNA, 25 bp, Mus musculus
accagcttaacagtccggggtcctg

SEQ ID NO: 387693 - DNA, 25 bp, Mus musculus
gtcttaggtggacccagcaagtgtc

SEQ ID NO: 387694 - DNA, 25 bp, Mus musculus
ggacccagcaagtgtcgcgcttaga

SEQ ID NO: 387695 - DNA, 25 bp, Mus musculus
aagtgtcgcgcttagagctggccac

SEQ ID NO: 387696 - DNA, 25 bp, Mus musculus
ttagagctggccacgggtaaaccca

SEQ ID NO: 387697 - DNA, 25 bp, Mus musculus
cacgggtaaacccagagagcgagcg

SEQ ID NO: 387698 - DNA, 25 bp, Mus musculus
gccatgtggaggtgacagtcagctt

SEQ ID NO: 387699 - DNA, 25 bp, Mus musculus
tttttcctaatctgggacacgcagc

SEQ ID NO: 387700 - DNA, 25 bp, Mus musculus
cccaggtggatatcgctggttggca

SEQ ID NO: 387701 - DNA, 25 bp, Mus musculus
tcagcttgcggactcagagagccca

SEQ ID NO: 387702 - DNA, 25 bp, Mus musculus
tcacgtggtcacttggcctgaaagc

SEQ ID NO: 387703 - DNA, 25 bp, Mus musculus
acgcagcagagcagagtgcccgcca

SEQ ID NO: 387704 - DNA, 25 bp, Mus musculus
tgacctccattgtgacgccacgggg

SEQ ID NO: 387705 - DNA, 25 bp, Mus musculus
acgcggattcagctcactttggttg

SEQ ID NO: 387706 - DNA, 25 bp, Mus musculus
cctccctgaggaacgtgaagacttg

SEQ ID NO: 387707 - DNA, 25 bp, Mus musculus
ggggtgcactcctacctgcacctgg

SEQ ID NO: 387708 - DNA, 25 bp, Mus musculus
cagctccttagccttcctggaagca

SEQ ID NO: 387709 - DNA, 25 bp, Mus musculus
cctgctagactccaggtcgggcaca

SEQ ID NO: 387710 - DNA, 25 bp, Mus musculus
tggtccagctcctgtcagtgcttta

SEQ ID NO: 387711 - DNA, 25 bp, Mus musculus
ggcgctagctagagaccgttcacgt

SEQ ID NO: 387712 - DNA, 25 bp, Mus musculus
ccacggtggtcatggagatgactgc

SEQ ID NO: 387713 - DNA, 25 bp, Mus musculus
ctcagggtcctgagagctgtcctca

SEQ ID NO: 387714 - DNA, 25 bp, Mus musculus
tcgccctatggaggagaggaacatc

SEQ ID NO: 387715 - DNA, 25 bp, Mus musculus
ggcactttgtggagcactcgcccta

SEQ ID NO: 387716 - DNA, 25 bp, Mus musculus
ccgtctccagcacgaacaggttgcg

SEQ ID NO: 387717 - DNA, 25 bp, Mus musculus
tcgaaggagaaccaggccacgcaca

SEQ ID NO: 387718 - DNA, 25 bp, Mus musculus
cgcacttgctctcagcctgcaggga

SEQ ID NO: 387719 - DNA, 25 bp, Mus musculus
cgccaggcgcatcacgtagagcacg

SEQ ID NO: 387720 - DNA, 25 bp, Mus musculus
cagcagtccgaactcgcgtgcgcag

SEQ ID NO: 387721 - DNA, 25 bp, Mus musculus
gcgctggccgaacgtgtactgtcat

SEQ ID NO: 387722 - DNA, 25 bp, Mus musculus
agatgactgcccaccagtagctggc

SEQ ID NO: 387723 - DNA, 25 bp, Mus musculus
gctgcgcggcaccatgtctccatag

SEQ ID NO: 387724 - DNA, 25 bp, Mus musculus
tgtactgtcatcacgcgtgctgtcc

SEQ ID NO: 387725 - DNA, 25 bp, Mus musculus
agcgccatggccacgcagaggaaga

SEQ ID NO: 387726 - DNA, 25 bp, Mus musculus
gcgcagcagccttagcttgccggcg

SEQ ID NO: 387727 - DNA, 25 bp, Mus musculus
ctgcggcctgccgtcggataaggcc

SEQ ID NO: 387728 - DNA, 25 bp, Mus musculus
gactgggcctgcaaaaggaatcgca

SEQ ID NO: 387729 - DNA, 25 bp, Mus musculus
cagcagcgccacgatggcgcggaaa

SEQ ID NO: 387730 - DNA, 25 bp, Mus musculus
tagtcgtcacacacgcgcagcagct

SEQ ID NO: 387731 - DNA, 25 bp, Mus musculus
cccagtaggccagctcgtcgcggaa

SEQ ID NO: 387732 - DNA, 25 bp, Mus musculus
agtgcgggttctccaccacgtcgcg

SEQ ID NO: 387733 - DNA, 25 bp, Mus musculus
ccacggagacgtaggcgaagagcct

SEQ ID NO: 387734 - DNA, 25 bp, Mus musculus
tgacggccacgaaggccacggagac

SEQ ID NO: 387735 - DNA, 25 bp, Mus musculus
tgctcaggcacaggccgacggctgt

SEQ ID NO: 387736 - DNA, 25 bp, Mus musculus
acgtccggcatggtgctcaggcaca

SEQ ID NO: 387737 - DNA, 25 bp, Mus musculus
ctcttctgcgcggacgtccggcatg

SEQ ID NO: 387738 - DNA, 25 bp, Mus musculus
cggctcacgtcgtagtcgtcacaca

SEQ ID NO: 387739 - DNA, 25 bp, Mus musculus
tcgcagtgttaggactgcggcctgc

SEQ ID NO: 387740 - DNA, 25 bp, Mus musculus
gccgccggatgagaacctctttcac

SEQ ID NO: 387741 - DNA, 25 bp, Mus musculus
tctcggtgcagactccggttacaca

SEQ ID NO: 387742 - DNA, 25 bp, Mus musculus
agagcccacagctcagagtccggca

SEQ ID NO: 387743 - DNA, 25 bp, Mus musculus
tctcggacgtataagaggcagctca

SEQ ID NO: 387744 - DNA, 25 bp, Mus musculus
tgcacagacctctttcacagctacg

SEQ ID NO: 387745 - DNA, 25 bp, Mus musculus
gcggtgccactgtactgaccagatg

SEQ ID NO: 387746 - DNA, 25 bp, Mus musculus
tgaccagatgttgctgtccgagccg

SEQ ID NO: 387747 - DNA, 25 bp, Mus musculus
ttgcagaatttggaacgcgggagcc

SEQ ID NO: 387748 - DNA, 25 bp, Mus musculus
ggggcattcaccatctcggaccaga

SEQ ID NO: 387749 - DNA, 25 bp, Mus musculus
agtcacctgtccaccaaagctggtg

SEQ ID NO: 387750 - DNA, 25 bp, Mus musculus
gacaggtgtccagctccgctcggac

SEQ ID NO: 387751 - DNA, 25 bp, Mus musculus
atccgggagagccatgatcgcttcc

SEQ ID NO: 387752 - DNA, 25 bp, Mus musculus
cggccgccagaagcgccatgaaagc

SEQ ID NO: 387753 - DNA, 25 bp, Mus musculus
ggtgcgcacagccttcaagcctggt

SEQ ID NO: 387754 - DNA, 25 bp, Mus musculus
gcggatcgctgccacaagttttctg

SEQ ID NO: 387755 - DNA, 25 bp, Mus musculus
cgggcctagactcggttcttctcta

SEQ ID NO: 387756 - DNA, 25 bp, Mus musculus
cggagtttatagcatcgacggcgga

SEQ ID NO: 387757 - DNA, 25 bp, Mus musculus
tgagaccacagccatgtcacgcgga

SEQ ID NO: 387758 - DNA, 25 bp, Mus musculus
agttttctgtcacccgctgctagtc

SEQ ID NO: 387759 - DNA, 25 bp, Mus musculus
cgctgctagtcctgacgcatcgaga

SEQ ID NO: 387760 - DNA, 25 bp, Mus musculus
tcgagactacaggttccggcatgca

SEQ ID NO: 387761 - DNA, 25 bp, Mus musculus
ccggcatgcagtgcgaatcgatgtc

SEQ ID NO: 387762 - DNA, 25 bp, Mus musculus
tcccgtcgtacactgcgaattccga

SEQ ID NO: 387763 - DNA, 25 bp, Mus musculus
tccgactacgggagacttcagactc

SEQ ID NO: 387764 - DNA, 25 bp, Mus musculus
cgcggaccgctgtattggattgtac

SEQ ID NO: 387765 - DNA, 25 bp, Mus musculus
gaagctataggtcccgctccgcagt

SEQ ID NO: 387766 - DNA, 25 bp, Mus musculus
gattaagaatgtccgcctcgcctgc

SEQ ID NO: 387767 - DNA, 25 bp, Mus musculus
tcgtgcactgcgaggtttacaagta

SEQ ID NO: 387768 - DNA, 25 bp, Mus musculus
gctcggtgcaggctaatccacgcgc

SEQ ID NO: 387769 - DNA, 25 bp, Mus musculus
ggacagacgccgctccactccgccg

SEQ ID NO: 387770 - DNA, 25 bp, Mus musculus
acttaagcaactccgcgaccgaggc

SEQ ID NO: 387771 - DNA, 25 bp, Mus musculus
gcgacttaagcaactccgcgaccga

SEQ ID NO: 387772 - DNA, 25 bp, Mus musculus
attcccgaagtcaggctgggccgag

SEQ ID NO: 387773 - DNA, 25 bp, Mus musculus
gtcccgattcccgaagtcaggctgg

SEQ ID NO: 387774 - DNA, 25 bp, Mus musculus
cagggggaaccgctgttctcccact

SEQ ID NO: 387775 - DNA, 25 bp, Mus musculus
cccagcctcgctattccgcgggcgg

SEQ ID NO: 387776 - DNA, 25 bp, Mus musculus
gcgtccacccggcaccatcctctcc

SEQ ID NO: 387777 - DNA, 25 bp, Mus musculus
aactggcaactcttcgcgtgctgca

SEQ ID NO: 387778 - DNA, 25 bp, Mus musculus
ccaacaactggcaactcttcgcgtg

SEQ ID NO: 387779 - DNA, 25 bp, Mus musculus
cattacggatcgatgttttaatccc

SEQ ID NO: 387780 - DNA, 25 bp, Mus musculus
agtgcgccagccagccattacggat

SEQ ID NO: 387781 - DNA, 25 bp, Mus musculus
ccagccattacggatcgatgtttta

SEQ ID NO: 387782 - DNA, 25 bp, Mus musculus
agccagctctcctccgtgatgcttg

SEQ ID NO: 387783 - DNA, 25 bp, Mus musculus
gagccagctctcctccgtgatgctt

SEQ ID NO: 387784 - DNA, 25 bp, Mus musculus
cctccgtgatgcttgcccgaggaga

SEQ ID NO: 387785 - DNA, 25 bp, Mus musculus
ctccgtgatgcttgcccgaggagag

SEQ ID NO: 387786 - DNA, 25 bp, Mus musculus
tctcctccgtgatgcttgcccgagg

SEQ ID NO: 387787 - DNA, 25 bp, Mus musculus
atgcttgcccgaggagaggtggatg

SEQ ID NO: 387788 - DNA, 25 bp, Mus musculus
gagtgcctgggcgatcctagcaggt

SEQ ID NO: 387789 - DNA, 25 bp, Mus musculus
gcctgggcgatcctagcaggtggca

SEQ ID NO: 387790 - DNA, 25 bp, Mus musculus
gcaggcacccaggcttcggggaaaa

SEQ ID NO: 387791 - DNA, 25 bp, Mus musculus
tccgggtccgtggtcttgggagaca

SEQ ID NO: 387792 - DNA, 25 bp, Mus musculus
gtccgtggtcttgggagacacgcag

SEQ ID NO: 387793 - DNA, 25 bp, Mus musculus
agacacgcagggtgactgccacgga

SEQ ID NO: 387794 - DNA, 25 bp, Mus musculus
acacgcagggtgactgccacggaga

SEQ ID NO: 387795 - DNA, 25 bp, Mus musculus
cagggtgactgccacggagaggtct

SEQ ID NO: 387796 - DNA, 25 bp, Mus musculus
ccaggcggtagcagccgggctctca

SEQ ID NO: 387797 - DNA, 25 bp, Mus musculus
ggctctcagaaagggcggcttccga

SEQ ID NO: 387798 - DNA, 25 bp, Mus musculus
gactacgaggtccaagtcctgcgcc

SEQ ID NO: 387799 - DNA, 25 bp, Mus musculus
cggcccggtgctccgatgccaggaa

SEQ ID NO: 387800 - DNA, 25 bp, Mus musculus
ctccgatgccaggaagtgccgggcc

SEQ ID NO: 387801 - DNA, 25 bp, Mus musculus
ccgccgctctgatcgaactcgaaga

SEQ ID NO: 387802 - DNA, 25 bp, Mus musculus
cgaactcgaagaggaaatcgaagtc

SEQ ID NO: 387803 - DNA, 25 bp, Mus musculus
atcgaagtcgaactccgggtcctgc

SEQ ID NO: 387804 - DNA, 25 bp, Mus musculus
gggtttacataaacaagcggctcgc

SEQ ID NO: 387805 - DNA, 25 bp, Mus musculus
ttttaaataaactccgcgcgcgcga

SEQ ID NO: 387806 - DNA, 25 bp, Mus musculus
aagcgtagcccaggctccactcgtg

SEQ ID NO: 387807 - DNA, 25 bp, Mus musculus
gggcttcgctctcccttaggatacc

SEQ ID NO: 387808 - DNA, 25 bp, Mus musculus
agctgaccgcctccaggggagcgca

SEQ ID NO: 387809 - DNA, 25 bp, Mus musculus
gctcccggacccagtacagggctga

SEQ ID NO: 387810 - DNA, 25 bp, Mus musculus
cgccttgcatgctgaagtcattatg

SEQ ID NO: 387811 - DNA, 25 bp, Mus musculus
cagttcggagcctctcggtctcact

SEQ ID NO: 387812 - DNA, 25 bp, Mus musculus
tctcggtctcactctgacgcagggc

SEQ ID NO: 387813 - DNA, 25 bp, Mus musculus
accagccggacgcattgagagggaa

SEQ ID NO: 387814 - DNA, 25 bp, Mus musculus
cacaagggactggagggagctccca

SEQ ID NO: 387815 - DNA, 25 bp, Mus musculus
agctcccagaggtgtgcagaggcac

SEQ ID NO: 387816 - DNA, 25 bp, Mus musculus
gagactaggaggaaaaggactcctg

SEQ ID NO: 387817 - DNA, 25 bp, Mus musculus
cttagaaacagtcagggacgaaacg

SEQ ID NO: 387818 - DNA, 25 bp, Mus musculus
ccaaaccgggatggcggcggcttca

SEQ ID NO: 387819 - DNA, 25 bp, Mus musculus
gcgggtgccctgagaaagctactct

SEQ ID NO: 387820 - DNA, 25 bp, Mus musculus
ctctcccttttaatgaggggctcgg

SEQ ID NO: 387821 - DNA, 25 bp, Mus musculus
ggaaagctggtacttggcatccacg

SEQ ID NO: 387822 - DNA, 25 bp, Mus musculus
gtgccgagacgccttgcatgctgaa

SEQ ID NO: 387823 - DNA, 25 bp, Mus musculus
tgaagtcattatgtaaaatcgcagg

SEQ ID NO: 387824 - DNA, 25 bp, Mus musculus
cggagctgtagtaggccgcacgtct

SEQ ID NO: 387825 - DNA, 25 bp, Mus musculus
cctccattggcgttgcctgatgacg

SEQ ID NO: 387826 - DNA, 25 bp, Mus musculus
tggcgtcacagaacagcgaaggatc

SEQ ID NO: 387827 - DNA, 25 bp, Mus musculus
ctcagtttccagtcagggccgaagc

SEQ ID NO: 387828 - DNA, 25 bp, Mus musculus
gccgagtctactcagtttccagtca

SEQ ID NO: 387829 - DNA, 25 bp, Mus musculus
acaggggaatctggtccgccatgct

SEQ ID NO: 387830 - DNA, 25 bp, Mus musculus
gtgtttgtcaccctcgctatggcga

SEQ ID NO: 387831 - DNA, 25 bp, Mus musculus
cggctcaagggctccgtgcagaccg

SEQ ID NO: 387832 - DNA, 25 bp, Mus musculus
cacacactaagttttggggctcccg

SEQ ID NO: 387833 - DNA, 25 bp, Mus musculus
ctgctcgcccacacactaagttttg

SEQ ID NO: 387834 - DNA, 25 bp, Mus musculus
gagtggcacctgtcaccggcctgct

SEQ ID NO: 387835 - DNA, 25 bp, Mus musculus
cctcgctatggcgagtggcacctgt

SEQ ID NO: 387836 - DNA, 25 bp, Mus musculus
tcgttccggaggtgtggctacgata

SEQ ID NO: 387837 - DNA, 25 bp, Mus musculus
ggcggaatctcccagccgagtctac

SEQ ID NO: 387838 - DNA, 25 bp, Mus musculus
ttgtcacctctcgactctgttctcg

SEQ ID NO: 387839 - DNA, 25 bp, Mus musculus
tctccatttgtttctggacgagagc

SEQ ID NO: 387840 - DNA, 25 bp, Mus musculus
atctgcgctttgtcttctccatttg

SEQ ID NO: 387841 - DNA, 25 bp, Mus musculus
gtccgactggatctgcgctttgtct

SEQ ID NO: 387842 - DNA, 25 bp, Mus musculus
cgacggcttcgctcagggtgctccg

SEQ ID NO: 387843 - DNA, 25 bp, Mus musculus
ctccgaagctaggagacgtgagtca

SEQ ID NO: 387844 - DNA, 25 bp, Mus musculus
cgccaaatgctggtctccgaagcta

SEQ ID NO: 387845 - DNA, 25 bp, Mus musculus
gtgagccagttcacgccaaatgctg

SEQ ID NO: 387846 - DNA, 25 bp, Mus musculus
tggtcacggcaagtgagccagttca

SEQ ID NO: 387847 - DNA, 25 bp, Mus musculus
atctggtcggagtgtcttcgcctga

SEQ ID NO: 387848 - DNA, 25 bp, Mus musculus
cttcttcccggaatggatctggtcg

SEQ ID NO: 387849 - DNA, 25 bp, Mus musculus
tcgtctctgccttcttcccggaatg

SEQ ID NO: 387850 - DNA, 25 bp, Mus musculus
cggcggagccctttcttcctcttgt

SEQ ID NO: 387851 - DNA, 25 bp, Mus musculus
tttctggacgagagcggagcgtccc

SEQ ID NO: 387852 - DNA, 25 bp, Mus musculus
gaccgagtcaatcattttcatctgg

SEQ ID NO: 387853 - DNA, 25 bp, Mus musculus
tcttttcatcaaagggcaggtcggc

SEQ ID NO: 387854 - DNA, 25 bp, Mus musculus
agtcgttgctcaagcgatcgctttc

SEQ ID NO: 387855 - DNA, 25 bp, Mus musculus
ccgacttcaagttggccagttgctg

SEQ ID NO: 387856 - DNA, 25 bp, Mus musculus
ttgctggcagttcatgaccgagtca

SEQ ID NO: 387857 - DNA, 25 bp, Mus musculus
gcgttcgtgaacttcttctggcaga

SEQ ID NO: 387858 - DNA, 25 bp, Mus musculus
gtcctcccatgtgcatacggatatg

SEQ ID NO: 387859 - DNA, 25 bp, Mus musculus
tggcgtgtttgggatctgtcctccc

SEQ ID NO: 387860 - DNA, 25 bp, Mus musculus
ctgctgagggtctctgcgttctttt

SEQ ID NO: 387861 - DNA, 25 bp, Mus musculus
tcgatgtcatcgtcaaagctgctga

SEQ ID NO: 387862 - DNA, 25 bp, Mus musculus
ctccatggagttctcgtcgatgtca

SEQ ID NO: 387863 - DNA, 25 bp, Mus musculus
gcccgagtaagacagaagtggttta

SEQ ID NO: 387864 - DNA, 25 bp, Mus musculus
tcatctggttctcgagggcagcgat

SEQ ID NO: 387865 - DNA, 25 bp, Mus musculus
gaagtgcgtcttcaggttgcctttg

SEQ ID NO: 387866 - DNA, 25 bp, Mus musculus
agcacttctcacacacgctggtttc

SEQ ID NO: 387867 - DNA, 25 bp, Mus musculus
gggcccttgtccgtagatacctcca

SEQ ID NO: 387868 - DNA, 25 bp, Mus musculus
cgcacgtgcaccctgtgagaactgt

SEQ ID NO: 387869 - DNA, 25 bp, Mus musculus
tgagaactgtgccacggccaccttg

SEQ ID NO: 387870 - DNA, 25 bp, Mus musculus
accttggtgctgagcagcgtctcca

SEQ ID NO: 387871 - DNA, 25 bp, Mus musculus
cgtctccagggtcacattggtacta

SEQ ID NO: 387872 - DNA, 25 bp, Mus musculus
tactaggcatgctgaaggccgcagg

SEQ ID NO: 387873 - DNA, 25 bp, Mus musculus
ctttgtagcagccttcacctcgctg

SEQ ID NO: 387874 - DNA, 25 bp, Mus musculus
acctcactctcagtgcggtcactgg

SEQ ID NO: 387875 - DNA, 25 bp, Mus musculus
ttctggaaagtcctcagagggcggc

SEQ ID NO: 387876 - DNA, 25 bp, Mus musculus
gccggctcatcgtcgtgcacgatca

SEQ ID NO: 387877 - DNA, 25 bp, Mus musculus
tgcacgatcagcaccagtgggttct

SEQ ID NO: 387878 - DNA, 25 bp, Mus musculus
agtccgcccacttgaagaactctgc

SEQ ID NO: 387879 - DNA, 25 bp, Mus musculus
aggtcttcttgtgctgcaggaagtc

SEQ ID NO: 387880 - DNA, 25 bp, Mus musculus
ggctgagcaattaggctggtgaata

SEQ ID NO: 387881 - DNA, 25 bp, Mus musculus
gctggtgaataatgcatggccatta

SEQ ID NO: 387882 - DNA, 25 bp, Mus musculus
gactccggcggcctatgcaaatgag

SEQ ID NO: 387883 - DNA, 25 bp, Mus musculus
ccctttatagagtgtctgcgccgcc

SEQ ID NO: 387884 - DNA, 25 bp, Mus musculus
gctctcgcaattagcggccgcgcta

SEQ ID NO: 387885 - DNA, 25 bp, Mus musculus
cttgcgccgagacatgctgctagcg

SEQ ID NO: 387886 - DNA, 25 bp, Mus musculus
tcgtccgacttgagatgctggggct

SEQ ID NO: 387887 - DNA, 25 bp, Mus musculus
cggtagctcctcgtccgacttgaga

SEQ ID NO: 387888 - DNA, 25 bp, Mus musculus
agaactctgggccaccctgaggtcc

SEQ ID NO: 387889 - DNA, 25 bp, Mus musculus
ggaactttctcccactcggagacgc

SEQ ID NO: 387890 - DNA, 25 bp, Mus musculus
cgctcacgcgaacaggggaactttc

SEQ ID NO: 387891 - DNA, 25 bp, Mus musculus
gggccggactcagctagcactcgct

SEQ ID NO: 387892 - DNA, 25 bp, Mus musculus
tcccgcgcgcttcgagggagtacca

SEQ ID NO: 387893 - DNA, 25 bp, Mus musculus
caggctgcaaactttggtggcgtcc

SEQ ID NO: 387894 - DNA, 25 bp, Mus musculus
catgtacgcgcgtgggagcaggagc

SEQ ID NO: 387895 - DNA, 25 bp, Mus musculus
agcaggcccatcgaaggtctatgga

SEQ ID NO: 387896 - DNA, 25 bp, Mus musculus
accgcaccagcctgttctaccagcg

SEQ ID NO: 387897 - DNA, 25 bp, Mus musculus
aggcccatcgaaggtctatggaggc

SEQ ID NO: 387898 - DNA, 25 bp, Mus musculus
ccatcgaaggtctatggaggccggc

SEQ ID NO: 387899 - DNA, 25 bp, Mus musculus
aggagcaggcccatcgaaggtctat

SEQ ID NO: 387900 - DNA, 25 bp, Mus musculus
cgtgcatgaggacgcatgtacgcgc

SEQ ID NO: 387901 - DNA, 25 bp, Mus musculus
cccaggagcgtgcatgaggacgcat

SEQ ID NO: 387902 - DNA, 25 bp, Mus musculus
ttgtagtcgatttcccccaggagcg

SEQ ID NO: 387903 - DNA, 25 bp, Mus musculus
accagagatttgtagtcgatttccc

SEQ ID NO: 387904 - DNA, 25 bp, Mus musculus
ggggaccagagatttgtagtcgatt

SEQ ID NO: 387905 - DNA, 25 bp, Mus musculus
cagcctgttctaccagcgctccggg

SEQ ID NO: 387906 - DNA, 25 bp, Mus musculus
agcgtgcatgaggacgcatgtacgc

SEQ ID NO: 387907 - DNA, 25 bp, Mus musculus
aaggtctatggaggccggccgattt

SEQ ID NO: 387908 - DNA, 25 bp, Mus musculus
gggactactgctggcttcccgggac

SEQ ID NO: 387909 - DNA, 25 bp, Mus musculus
tggatttctgtgtcgccaacctcga

SEQ ID NO: 387910 - DNA, 25 bp, Mus musculus
tcccgggactgttttcacggagaga

SEQ ID NO: 387911 - DNA, 25 bp, Mus musculus
tctgtgtcgccaacctcgaagaatg

SEQ ID NO: 387912 - DNA, 25 bp, Mus musculus
tgtcgccaacctcgaagaatgctcg

SEQ ID NO: 387913 - DNA, 25 bp, Mus musculus
ccatgtgacgggctcccactgtgcg

SEQ ID NO: 387914 - DNA, 25 bp, Mus musculus
ttcttggagagagccgcctgcgcag

SEQ ID NO: 387915 - DNA, 25 bp, Mus musculus
gcttctttctcgtctttacattaca

SEQ ID NO: 387916 - DNA, 25 bp, Mus musculus
ctgtgcgggccctggcgcttgaacc

SEQ ID NO: 387917 - DNA, 25 bp, Mus musculus
tgcgcctgcttctttctcgtcttta

SEQ ID NO: 387918 - DNA, 25 bp, Mus musculus
ggagagaattgctgcacccttcggc

SEQ ID NO: 387919 - DNA, 25 bp, Mus musculus
ggcgcttgaacctgccgttctcttt

SEQ ID NO: 387920 - DNA, 25 bp, Mus musculus
tttcacggagagaattgctgcaccc

SEQ ID NO: 387921 - DNA, 25 bp, Mus musculus
aggtggctggatttctgtgtcgcca

SEQ ID NO: 387922 - DNA, 25 bp, Mus musculus
acttcttcacttggggtgaggaccg

SEQ ID NO: 387923 - DNA, 25 bp, Mus musculus
gcaggtcctgctagaaacttcttca

SEQ ID NO: 387924 - DNA, 25 bp, Mus musculus
gtttccgcctcctgcgtggcgggct

SEQ ID NO: 387925 - DNA, 25 bp, Mus musculus
cggattccgcgtagaggagagaacc

SEQ ID NO: 387926 - DNA, 25 bp, Mus musculus
ggctcaccatggttccgacggattc

SEQ ID NO: 387927 - DNA, 25 bp, Mus musculus
ttggccgaaagctaggctcaccatg

SEQ ID NO: 387928 - DNA, 25 bp, Mus musculus
cagggagcctaagtccttggccgaa

SEQ ID NO: 387929 - DNA, 25 bp, Mus musculus
tccggttagacaagaggaccagcgg

SEQ ID NO: 387930 - DNA, 25 bp, Mus musculus
cggagcctgcgactccggttagaca

SEQ ID NO: 387931 - DNA, 25 bp, Mus musculus
atgcccggcccgagccatgtgcgga

SEQ ID NO: 387932 - DNA, 25 bp, Mus musculus
agatgctgacttagtgtgcgttccc

SEQ ID NO: 387933 - DNA, 25 bp, Mus musculus
cctagccgagaaacagccctgatct

SEQ ID NO: 387934 - DNA, 25 bp, Mus musculus
ggtcgagcacggaccaacatagcta

SEQ ID NO: 387935 - DNA, 25 bp, Mus musculus
gccctgatcttacaaagagatgctg

SEQ ID NO: 387936 - DNA, 25 bp, Mus musculus
ctgccacctagtggccgaaatccta

SEQ ID NO: 387937 - DNA, 25 bp, Mus musculus
tttcggagcaatgctgccacctagt

SEQ ID NO: 387938 - DNA, 25 bp, Mus musculus
cgaaatcctaacagaaggctcagtc

SEQ ID NO: 387939 - DNA, 25 bp, Mus musculus
aaggctcagtctgccctccactgga

SEQ ID NO: 387940 - DNA, 25 bp, Mus musculus
ccactggatttctcggaggttgaaa

SEQ ID NO: 387941 - DNA, 25 bp, Mus musculus
gggtgctcgcccgagcttacatgca

SEQ ID NO: 387942 - DNA, 25 bp, Mus musculus
gagcttacatgcaccgccgggtcct

SEQ ID NO: 387943 - DNA, 25 bp, Mus musculus
ctgttacatactgagggttgagctg

SEQ ID NO: 387944 - DNA, 25 bp, Mus musculus
ccgcagacctggctgtgagagcccg

SEQ ID NO: 387945 - DNA, 25 bp, Mus musculus
tgagagcccggaatatgcccgcgtt

SEQ ID NO: 387946 - DNA, 25 bp, Mus musculus
aatatgcccgcgttgtcctgaccga

SEQ ID NO: 387947 - DNA, 25 bp, Mus musculus
cctgaccgagcacagtgggccgaaa

SEQ ID NO: 387948 - DNA, 25 bp, Mus musculus
atccgccagcgcacaggctgttaca

SEQ ID NO: 387949 - DNA, 25 bp, Mus musculus
ccgccgcgcatttcggagcaatgct

SEQ ID NO: 387950 - DNA, 25 bp, Mus musculus
cggcaggctccagaacacagaggta

SEQ ID NO: 387951 - DNA, 25 bp, Mus musculus
tacacggtggcctgaaaagggatgc

SEQ ID NO: 387952 - DNA, 25 bp, Mus musculus
caggccaaacactaccagcgtaatg

SEQ ID NO: 387953 - DNA, 25 bp, Mus musculus
aatgaagttctccacgccaatgccg

SEQ ID NO: 387954 - DNA, 25 bp, Mus musculus
gaggttcaccatagccagttccatc

SEQ ID NO: 387955 - DNA, 25 bp, Mus musculus
tagcctaggatcacggagtggccca

SEQ ID NO: 387956 - DNA, 25 bp, Mus musculus
tccgcaggcggagaatcttctgagc

SEQ ID NO: 387957 - DNA, 25 bp, Mus musculus
gcaacccgcaagaaagcctggaaga

SEQ ID NO: 387958 - DNA, 25 bp, Mus musculus
gctgcaagtcccgagctaagccttt

SEQ ID NO: 387959 - DNA, 25 bp, Mus musculus
aggcgactctcactgctcgcagtca

SEQ ID NO: 387960 - DNA, 25 bp, Mus musculus
aacttgcagatgaaggcgcccagca

SEQ ID NO: 387961 - DNA, 25 bp, Mus musculus
ggccacgtagcgatccacagacatc

SEQ ID NO: 387962 - DNA, 25 bp, Mus musculus
tgtgcccgatcacactatcctcgtg

SEQ ID NO: 387963 - DNA, 25 bp, Mus musculus
ccagcatggacacggtgaagaagta

SEQ ID NO: 387964 - DNA, 25 bp, Mus musculus
cgtagggcggtgacgagcaaagccc

SEQ ID NO: 387965 - DNA, 25 bp, Mus musculus
cgtttacctgctttcaagcactggg

SEQ ID NO: 387966 - DNA, 25 bp, Mus musculus
agcagccgctgtcagtcaccgccgc

SEQ ID NO: 387967 - DNA, 25 bp, Mus musculus
ccagggaggaccagcctctggctca

SEQ ID NO: 387968 - DNA, 25 bp, Mus musculus
gctcaggcggcctgagcttcacgac

SEQ ID NO: 387969 - DNA, 25 bp, Mus musculus
ggaacatagtatccgcgccccagcg

SEQ ID NO: 387970 - DNA, 25 bp, Mus musculus
agcgttgggtcccatccgccgggat

SEQ ID NO: 387971 - DNA, 25 bp, Mus musculus
ccctcttggcctccgagcagcagcc

SEQ ID NO: 387972 - DNA, 25 bp, Mus musculus
gagcagcagccagcaccagtaagtg

SEQ ID NO: 387973 - DNA, 25 bp, Mus musculus
agccagcaccagtaagtgatcatta

SEQ ID NO: 387974 - DNA, 25 bp, Mus musculus
taagtgatcattagcagggacgcga

SEQ ID NO: 387975 - DNA, 25 bp, Mus musculus
aggggcagccctggtgcctttgtct

SEQ ID NO: 387976 - DNA, 25 bp, Mus musculus
ccagtggcgcgcgtttacctgcttt

SEQ ID NO: 387977 - DNA, 25 bp, Mus musculus
gcgcgcgtttacctgctttcaagca

SEQ ID NO: 387978 - DNA, 25 bp, Mus musculus
ggcactggcactgagtccgatcttc

SEQ ID NO: 387979 - DNA, 25 bp, Mus musculus
actgagtccgatcttcccgcggtaa

SEQ ID NO: 387980 - DNA, 25 bp, Mus musculus
cttcccgcggtaacttgatctcctg

SEQ ID NO: 387981 - DNA, 25 bp, Mus musculus
cgcggtaacttgatctcctggtcct

SEQ ID NO: 387982 - DNA, 25 bp, Mus musculus
gatctcctggtcctgcctaagcgca

SEQ ID NO: 387983 - DNA, 25 bp, Mus musculus
cctggtcctgcctaagcgcagggtc

SEQ ID NO: 387984 - DNA, 25 bp, Mus musculus
taagcgcagggtcccagtggttccc

SEQ ID NO: 387985 - DNA, 25 bp, Mus musculus
ggggcagtcctcgtgttctgctatg

SEQ ID NO: 387986 - DNA, 25 bp, Mus musculus
tcgtgttctgctatggtttgttgta

SEQ ID NO: 387987 - DNA, 25 bp, Mus musculus
ctgctatggtttgttgtaaactctg

SEQ ID NO: 387988 - DNA, 25 bp, Mus musculus
aactctggtttttagggcttgtatg

SEQ ID NO: 387989 - DNA, 25 bp, Mus musculus
tttttagggcttgtatgaaccgcgc

SEQ ID NO: 387990 - DNA, 25 bp, Mus musculus
ggcttgtatgaaccgcgcgtacccg

SEQ ID NO: 387991 - DNA, 25 bp, Mus musculus
cacctgctggcactggcactgagtc

SEQ ID NO: 387992 - DNA, 25 bp, Mus musculus
aggcctcggtccctgccaggacggg

SEQ ID NO: 387993 - DNA, 25 bp, Mus musculus
gcacgagagcctactgtgcgcactc

SEQ ID NO: 387994 - DNA, 25 bp, Mus musculus
ctgtgcgcacgagagcctactgtgc

SEQ ID NO: 387995 - DNA, 25 bp, Mus musculus
tactgtgcgcacgagagcctactgt

SEQ ID NO: 387996 - DNA, 25 bp, Mus musculus
ctactgtgcgcacgagagcctactg

SEQ ID NO: 387997 - DNA, 25 bp, Mus musculus
gcctactgtgcgcacgagagcctac

SEQ ID NO: 387998 - DNA, 25 bp, Mus musculus
gaggcctactgtgcgcacgagagcc

SEQ ID NO: 387999 - DNA, 25 bp, Mus musculus
cgggatacaccggaagagcggacac

SEQ ID NO: 388000 - DNA, 25 bp, Mus musculus
ggatacaccggaagagcggacactc

SEQ ID NO: 388001 - DNA, 25 bp, Mus musculus
gatacaccggaagagcggacactcc

SEQ ID NO: 388002 - DNA, 25 bp, Mus musculus
agagcggacactccctagggcctgc

SEQ ID NO: 388003 - DNA, 25 bp, Mus musculus
ggacactccctagggcctgcgccga

SEQ ID NO: 388004 - DNA, 25 bp, Mus musculus
actccctagggcctgcgccgagggc

SEQ ID NO: 388005 - DNA, 25 bp, Mus musculus
acgagagcctactgtgcgcactccc

SEQ ID NO: 388006 - DNA, 25 bp, Mus musculus
gactgcaacctctgcggaagagctg

SEQ ID NO: 388007 - DNA, 25 bp, Mus musculus
tcgccgcaccctcgccgaagagtgc

SEQ ID NO: 388008 - DNA, 25 bp, Mus musculus
gatcgcggactgcaacctctgcgga

SEQ ID NO: 388009 - DNA, 25 bp, Mus musculus
aacctctgcggaagagctgtgcgcg

SEQ ID NO: 388010 - DNA, 25 bp, Mus musculus
ccatgggcggcgaggactactacct

SEQ ID NO: 388011 - DNA, 25 bp, Mus musculus
cggcgaggactactacctggagctg

SEQ ID NO: 388012 - DNA, 25 bp, Mus musculus
ggactactacctggagctgtgcgag

SEQ ID NO: 388013 - DNA, 25 bp, Mus musculus
ccggtgcagttcgagaaggcgaacc

SEQ ID NO: 388014 - DNA, 25 bp, Mus musculus
tgcagttcgagaaggcgaacccggt

SEQ ID NO: 388015 - DNA, 25 bp, Mus musculus
ccggttaactgcgtgttcttcgatg

SEQ ID NO: 388016 - DNA, 25 bp, Mus musculus
aactgcgtgttcttcgatgaggcca

SEQ ID NO: 388017 - DNA, 25 bp, Mus musculus
tgcgtgttcttcgatgaggccaaca

SEQ ID NO: 388018 - DNA, 25 bp, Mus musculus
agctgtgcgcgtcccagccatgggc

SEQ ID NO: 388019 - DNA, 25 bp, Mus musculus
gttcttcgatgaggccaacaagcag

SEQ ID NO: 388020 - DNA, 25 bp, Mus musculus
agggtggcgtgcttgccctgctctc

SEQ ID NO: 388021 - DNA, 25 bp, Mus musculus
agccgccggcatagccggcctgcag

SEQ ID NO: 388022 - DNA, 25 bp, Mus musculus
acaggcggcggcgtcacctagctcg

SEQ ID NO: 388023 - DNA, 25 bp, Mus musculus
ctagctcggcgagccgccggcatag

SEQ ID NO: 388024 - DNA, 25 bp, Mus musculus
ccctggcctggtttgcactgtgctt

SEQ ID NO: 388025 - DNA, 25 bp, Mus musculus
ggcctggtttgcactgtgcttcgga

SEQ ID NO: 388026 - DNA, 25 bp, Mus musculus
gtttgcactgtgcttcggaggcttc

SEQ ID NO: 388027 - DNA, 25 bp, Mus musculus
cactgtgcttcggaggcttctcggt

SEQ ID NO: 388028 - DNA, 25 bp, Mus musculus
tcggaggcttctcggtgctccatcc

SEQ ID NO: 388029 - DNA, 25 bp, Mus musculus
ctccatcccggaccttgaacgccgg

SEQ ID NO: 388030 - DNA, 25 bp, Mus musculus
cttgaacgccggtcgggactgccaa

SEQ ID NO: 388031 - DNA, 25 bp, Mus musculus
gtcgggactgccaaccctcttagtc

SEQ ID NO: 388032 - DNA, 25 bp, Mus musculus
cccaactactcaggagacggaaggg

SEQ ID NO: 388033 - DNA, 25 bp, Mus musculus
caactactcaggagacggaaggggt

SEQ ID NO: 388034 - DNA, 25 bp, Mus musculus
ttgccaaatagatgcgtggagatga

SEQ ID NO: 388035 - DNA, 25 bp, Mus musculus
gcagcggctttccacgagaacagca

SEQ ID NO: 388036 - DNA, 25 bp, Mus musculus
atgaaagggatctcttccgctaacg

SEQ ID NO: 388037 - DNA, 25 bp, Mus musculus
tcatttctgtgacgcgagggcagcg

SEQ ID NO: 388038 - DNA, 25 bp, Mus musculus
gcgtggagatgaaagggatctcttc

SEQ ID NO: 388039 - DNA, 25 bp, Mus musculus
ctctcatttctgtgacgcgagggca

SEQ ID NO: 388040 - DNA, 25 bp, Mus musculus
ggaagcctgtctctcatttctgtga

SEQ ID NO: 388041 - DNA, 25 bp, Mus musculus
agccgggacaggaagcctgtctctc

SEQ ID NO: 388042 - DNA, 25 bp, Mus musculus
acttggtgtgcttggagagacgctg

SEQ ID NO: 388043 - DNA, 25 bp, Mus musculus
tccacgagaacagcaattttgtgtc

SEQ ID NO: 388044 - DNA, 25 bp, Mus musculus
cgagaacagcaattttgtgtcgacg

SEQ ID NO: 388045 - DNA, 25 bp, Mus musculus
ttgtgtcgacgttgccaaatagatg

SEQ ID NO: 388046 - DNA, 25 bp, Mus musculus
cgacgttgccaaatagatgcgtgga

SEQ ID NO: 388047 - DNA, 25 bp, Mus musculus
gctttccacgagaacagcaattttg

SEQ ID NO: 388048 - DNA, 25 bp, Mus musculus
gcttaagttggcaggtcacgcatcc

SEQ ID NO: 388049 - DNA, 25 bp, Mus musculus
tcccaagcacctctgcacgtatgtg

SEQ ID NO: 388050 - DNA, 25 bp, Mus musculus
tgcgcgcgtaaacagccttcaggaa

SEQ ID NO: 388051 - DNA, 25 bp, Mus musculus
ggagcttcggcaacctgagacctta

SEQ ID NO: 388052 - DNA, 25 bp, Mus musculus
ccgacgtcgtgattcagggctatta

SEQ ID NO: 388053 - DNA, 25 bp, Mus musculus
atctaggtctgagtcatcgtgagcc

SEQ ID NO: 388054 - DNA, 25 bp, Mus musculus
tctccgcagtgtggcagaactttgt

SEQ ID NO: 388055 - DNA, 25 bp, Mus musculus
gcgtttcctacagggcagaccattc

SEQ ID NO: 388056 - DNA, 25 bp, Mus musculus
gggcgctctgcttcaccttcagatg

SEQ ID NO: 388057 - DNA, 25 bp, Mus musculus
ccagagctgtcctgttcttcccaaa

SEQ ID NO: 388058 - DNA, 25 bp, Mus musculus
ttcccaaagcatgcggactcccaga

SEQ ID NO: 388059 - DNA, 25 bp, Mus musculus
cgaggctcagcgtccagttgcttaa

SEQ ID NO: 388060 - DNA, 25 bp, Mus musculus
tgtcactaactacgacccacggagg

SEQ ID NO: 388061 - DNA, 25 bp, Mus musculus
gccacgatgataaccgagtccaagc

SEQ ID NO: 388062 - DNA, 25 bp, Mus musculus
ccgagagttcccacttagttactag

SEQ ID NO: 388063 - DNA, 25 bp, Mus musculus
cttcgcaccgtaacaaaggcttggg

SEQ ID NO: 388064 - DNA, 25 bp, Mus musculus
agcccaacttcgcaccgtaacaaag

SEQ ID NO: 388065 - DNA, 25 bp, Mus musculus
ctgtaacccaagaagtgaaagagac

SEQ ID NO: 388066 - DNA, 25 bp, Mus musculus
acggacgtcacacgccttcactgta

SEQ ID NO: 388067 - DNA, 25 bp, Mus musculus
cccgtcatgtggaacggacgtcaca

SEQ ID NO: 388068 - DNA, 25 bp, Mus musculus
ttcctatttctgtgtgtcccggccg

SEQ ID NO: 388069 - DNA, 25 bp, Mus musculus
gtcgttgcattaaatcattcctatt

SEQ ID NO: 388070 - DNA, 25 bp, Mus musculus
cttgaggaatgggtatgtcgttgca

SEQ ID NO: 388071 - DNA, 25 bp, Mus musculus
cggccctctctccaatctctgcaag

SEQ ID NO: 388072 - DNA, 25 bp, Mus musculus
gttcgcgtatctcctcctacgcggg

SEQ ID NO: 388073 - DNA, 25 bp, Mus musculus
cccacttagttactaggtgttgtca

SEQ ID NO: 388074 - DNA, 25 bp, Mus musculus
cgtgcaccgaggtcacctcgagggt

SEQ ID NO: 388075 - DNA, 25 bp, Mus musculus
taggtgttgtcagttcgcgtatctc

SEQ ID NO: 388076 - DNA, 25 bp, Mus musculus
ggcagagactgccttgtaactgtca

SEQ ID NO: 388077 - DNA, 25 bp, Mus musculus
gagccgttactcgtgcgttttcctc

SEQ ID NO: 388078 - DNA, 25 bp, Mus musculus
tgggtatcgacaactctgacgcgtg

SEQ ID NO: 388079 - DNA, 25 bp, Mus musculus
tcgcgccgcattcgagtcactcaaa

SEQ ID NO: 388080 - DNA, 25 bp, Mus musculus
acgcacatcgtgcttcggcgtgtca

SEQ ID NO: 388081 - DNA, 25 bp, Mus musculus
cggaggtaaaccctgcacgcacatc

SEQ ID NO: 388082 - DNA, 25 bp, Mus musculus
aaatggccgctgtgtagttagcacg

SEQ ID NO: 388083 - DNA, 25 bp, Mus musculus
ctccttctggagtcgggaaatggcc

SEQ ID NO: 388084 - DNA, 25 bp, Mus musculus
ctgcctagcgatttagcggcctgga

SEQ ID NO: 388085 - DNA, 25 bp, Mus musculus
tgggctacactcaaccgcggttcgc

SEQ ID NO: 388086 - DNA, 25 bp, Mus musculus
tcttcgaacaaagccgagccgcctg

SEQ ID NO: 388087 - DNA, 25 bp, Mus musculus
ttccggccttttcctcagtgagaga

SEQ ID NO: 388088 - DNA, 25 bp, Mus musculus
ccgcgtgtgttagtttccgagcctt

SEQ ID NO: 388089 - DNA, 25 bp, Mus musculus
actgtcatgttaggcgtccgaggga

SEQ ID NO: 388090 - DNA, 25 bp, Mus musculus
ccgtgcacgccgtgacagggatcct

SEQ ID NO: 388091 - DNA, 25 bp, Mus musculus
cactggccagggcaagtcctctgag

SEQ ID NO: 388092 - DNA, 25 bp, Mus musculus
gcggttcactcagcgagggtgactc

SEQ ID NO: 388093 - DNA, 25 bp, Mus musculus
ccagggcaagtcctctgagtgcttc

SEQ ID NO: 388094 - DNA, 25 bp, Mus musculus
gcaagtcctctgagtgcttcgagtg

SEQ ID NO: 388095 - DNA, 25 bp, Mus musculus
cctctgagtgcttcgagtgcggcaa

SEQ ID NO: 388096 - DNA, 25 bp, Mus musculus
cttcgagtgcggcaagatcttccgc

SEQ ID NO: 388097 - DNA, 25 bp, Mus musculus
gtgcggcaagatcttccgcacctac

SEQ ID NO: 388098 - DNA, 25 bp, Mus musculus
agatggtgctccactcccgcgtgca

SEQ ID NO: 388099 - DNA, 25 bp, Mus musculus
gcacgccgtgacagggatcctgaag

SEQ ID NO: 388100 - DNA, 25 bp, Mus musculus
cagggatcctgaaggggacagagca

SEQ ID NO: 388101 - DNA, 25 bp, Mus musculus
cagcgcgtgcccgttgcggttcact

SEQ ID NO: 388102 - DNA, 25 bp, Mus musculus
gtgcccgttgcggttcactcagcga

SEQ ID NO: 388103 - DNA, 25 bp, Mus musculus
cttccgcacctaccaccagatggtg

SEQ ID NO: 388104 - DNA, 25 bp, Mus musculus
accagcgtgtcgtaggccgcgctgc

SEQ ID NO: 388105 - DNA, 25 bp, Mus musculus
acgacgtctgctgcagcgtcttggc

SEQ ID NO: 388106 - DNA, 25 bp, Mus musculus
tctcgttcatgtgcaccgtcagttc

SEQ ID NO: 388107 - DNA, 25 bp, Mus musculus
tggcctgtctcgttcatgtgcaccg

SEQ ID NO: 388108 - DNA, 25 bp, Mus musculus
agttccaccagcgtgtcgtaggccg

SEQ ID NO: 388109 - DNA, 25 bp, Mus musculus
gccgcgctgcagtctttgcacctga

SEQ ID NO: 388110 - DNA, 25 bp, Mus musculus
gcagtctttgcacctgaacttgctg

SEQ ID NO: 388111 - DNA, 25 bp, Mus musculus
ccgtgaacacggagccatacagctt

SEQ ID NO: 388112 - DNA, 25 bp, Mus musculus
cacggagccatacagcttgttattc

SEQ ID NO: 388113 - DNA, 25 bp, Mus musculus
cagcttgttattctgtcggtagagc

SEQ ID NO: 388114 - DNA, 25 bp, Mus musculus
tattctgtcggtagagctgcacggt

SEQ ID NO: 388115 - DNA, 25 bp, Mus musculus
gctcaggcagcagtccgtaggacga

SEQ ID NO: 388116 - DNA, 25 bp, Mus musculus
agtccgtaggacgacgtctgctgca

SEQ ID NO: 388117 - DNA, 25 bp, Mus musculus
atgtgcaccgtcagttccaccagcg

SEQ ID NO: 388118 - DNA, 25 bp, Mus musculus
gagtctccgcgcgcaactttctcgg

SEQ ID NO: 388119 - DNA, 25 bp, Mus musculus
cgggtcgcagctctctcattgtgcg

SEQ ID NO: 388120 - DNA, 25 bp, Mus musculus
ggcgcgcccaactttggcctcgtcc

SEQ ID NO: 388121 - DNA, 25 bp, Mus musculus
cgctccatgccgctggcgctgtgat

SEQ ID NO: 388122 - DNA, 25 bp, Mus musculus
ttggccgccaggatcgccgcttctt

SEQ ID NO: 388123 - DNA, 25 bp, Mus musculus
tcaaacagtgtcacccgccggagcg

SEQ ID NO: 388124 - DNA, 25 bp, Mus musculus
gtcacagatcaaacagtgtcacccg

SEQ ID NO: 388125 - DNA, 25 bp, Mus musculus
ggggagatgtcagcgccgctccacc

SEQ ID NO: 388126 - DNA, 25 bp, Mus musculus
ctgtacatacatgcgccgggggaga

SEQ ID NO: 388127 - DNA, 25 bp, Mus musculus
aaagcaaacaagacaggagtgaagc

SEQ ID NO: 388128 - DNA, 25 bp, Mus musculus
ctctctcattgtgcgccagcgaggc

SEQ ID NO: 388129 - DNA, 25 bp, Mus musculus
cccgcacttagtctaggaggaagaa

SEQ ID NO: 388130 - DNA, 25 bp, Mus musculus
caccttccaaacagtcacagatcaa

SEQ ID NO: 388131 - DNA, 25 bp, Mus musculus
cagcgaggccgaccggctgtccttt

SEQ ID NO: 388132 - DNA, 25 bp, Mus musculus
tggtgacccggctgagccctaactt

SEQ ID NO: 388133 - DNA, 25 bp, Mus musculus
cggaggaaatcctaggccagtgtga

SEQ ID NO: 388134 - DNA, 25 bp, Mus musculus
ccagtgtgagccgagaggattcaaa

SEQ ID NO: 388135 - DNA, 25 bp, Mus musculus
aaaagattaaaggagcagcggctgc

SEQ ID NO: 388136 - DNA, 25 bp, Mus musculus
ctggcgaaggcgaatgtaatgtgac

SEQ ID NO: 388137 - DNA, 25 bp, Mus musculus
tgtcgtacgcccgtcacttcctgga

SEQ ID NO: 388138 - DNA, 25 bp, Mus musculus
gaatcgaatcccttcgcagagcgtg

SEQ ID NO: 388139 - DNA, 25 bp, Mus musculus
cacagcctgactttgcgagatccca

SEQ ID NO: 388140 - DNA, 25 bp, Mus musculus
cccgagccatcgtggacatgtcgta

SEQ ID NO: 388141 - DNA, 25 bp, Mus musculus
ggctgagccctaacttccacgaggc

SEQ ID NO: 388142 - DNA, 25 bp, Mus musculus
tgaacccgccgccatctggcgaagg

SEQ ID NO: 388143 - DNA, 25 bp, Mus musculus
cgagatcccaggaagttgaacccgc

SEQ ID NO: 388144 - DNA, 25 bp, Mus musculus
ggggttgattcgtaccaccttgcaa

SEQ ID NO: 388145 - DNA, 25 bp, Mus musculus
caccttgcaaggaagtgaacgcttc

SEQ ID NO: 388146 - DNA, 25 bp, Mus musculus
agggcgctaccggtctgatgcctgc

SEQ ID NO: 388147 - DNA, 25 bp, Mus musculus
tgatgcctgcgggaagaggttcgca

SEQ ID NO: 388148 - DNA, 25 bp, Mus musculus
cggctttctggccagggcgctaccg

SEQ ID NO: 388149 - DNA, 25 bp, Mus musculus
ggttccctgcacagacccgacccga

SEQ ID NO: 388150 - DNA, 25 bp, Mus musculus
tctctcccgagggtggaaatggaaa

SEQ ID NO: 388151 - DNA, 25 bp, Mus musculus
cattgatgtctctcccgagggtgga

SEQ ID NO: 388152 - DNA, 25 bp, Mus musculus
ccggacgtgatcattgatgtctctc

SEQ ID NO: 388153 - DNA, 25 bp, Mus musculus
agcaatttcgtcttactcccggacg

SEQ ID NO: 388154 - DNA, 25 bp, Mus musculus
ccggaagcccagcaatttcgtctta

SEQ ID NO: 388155 - DNA, 25 bp, Mus musculus
tggggcccggaagcccagcaatttc

SEQ ID NO: 388156 - DNA, 25 bp, Mus musculus
ctgggactcggaagagcttgttcgt

SEQ ID NO: 388157 - DNA, 25 bp, Mus musculus
ctttcctgggactcggaagagcttg

SEQ ID NO: 388158 - DNA, 25 bp, Mus musculus
cgctctgcgtggctttcctgggact

SEQ ID NO: 388159 - DNA, 25 bp, Mus musculus
ttactcccggacgtgatcattgatg

SEQ ID NO: 388160 - DNA, 25 bp, Mus musculus
gtcaccagcatagcttaacggaaga

SEQ ID NO: 388161 - DNA, 25 bp, Mus musculus
cgcagcggccagagtctctcgacag

SEQ ID NO: 388162 - DNA, 25 bp, Mus musculus
cagcggccagagtctctcgacagtc

SEQ ID NO: 388163 - DNA, 25 bp, Mus musculus
gcggccagagtctctcgacagtcga

SEQ ID NO: 388164 - DNA, 25 bp, Mus musculus
gccagagtctctcgacagtcgagta

SEQ ID NO: 388165 - DNA, 25 bp, Mus musculus
cagagtctctcgacagtcgagtaga

SEQ ID NO: 388166 - DNA, 25 bp, Mus musculus
tcgacagtcgagtagagcaggaacc

SEQ ID NO: 388167 - DNA, 25 bp, Mus musculus
acagtcgagtagagcaggaacctcc

SEQ ID NO: 388168 - DNA, 25 bp, Mus musculus
tcgagtagagcaggaacctcccttt

SEQ ID NO: 388169 - DNA, 25 bp, Mus musculus
catagcttaacggaagacgcgcgag

SEQ ID NO: 388170 - DNA, 25 bp, Mus musculus
ctgtcaccagcatagcttaacggaa

SEQ ID NO: 388171 - DNA, 25 bp, Mus musculus
accagcatagcttaacggaagacgc

SEQ ID NO: 388172 - DNA, 25 bp, Mus musculus
agcatagcttaacggaagacgcgcg

SEQ ID NO: 388173 - DNA, 25 bp, Mus musculus
tcctgtcaccagcatagcttaacgg

SEQ ID NO: 388174 - DNA, 25 bp, Mus musculus
ccagctcttttgtgattcgtcgttc

SEQ ID NO: 388175 - DNA, 25 bp, Mus musculus
cttcccgggaagtagtccagctctt

SEQ ID NO: 388176 - DNA, 25 bp, Mus musculus
gggtcacgcaggcaggcgaccttcc

SEQ ID NO: 388177 - DNA, 25 bp, Mus musculus
ccttagatgcaggttttggaacacc

SEQ ID NO: 388178 - DNA, 25 bp, Mus musculus
cccttgtgggcgtgccttagatgca

SEQ ID NO: 388179 - DNA, 25 bp, Mus musculus
tttgccgagccacgtctgcaagcgc

SEQ ID NO: 388180 - DNA, 25 bp, Mus musculus
attgctgggccaagccctttgccga

SEQ ID NO: 388181 - DNA, 25 bp, Mus musculus
acccggcttagagcgcattgctggg

SEQ ID NO: 388182 - DNA, 25 bp, Mus musculus
gctaaactctcagggacccggctta

SEQ ID NO: 388183 - DNA, 25 bp, Mus musculus
cggtgtcagcgctgctgcctctcgg

SEQ ID NO: 388184 - DNA, 25 bp, Mus musculus
tctcagttcggctcgcggagcaccg

SEQ ID NO: 388185 - DNA, 25 bp, Mus musculus
cggggctacagctctcagttcggct

SEQ ID NO: 388186 - DNA, 25 bp, Mus musculus
gtggtgcgcacccatgctgtcgccg

SEQ ID NO: 388187 - DNA, 25 bp, Mus musculus
attcgtcgttcctgcgcgtcccttg

SEQ ID NO: 388188 - DNA, 25 bp, Mus musculus
tgtccaggcgctaccctagttcatg

SEQ ID NO: 388189 - DNA, 25 bp, Mus musculus
cgccttggctaatgacctaacattc

SEQ ID NO: 388190 - DNA, 25 bp, Mus musculus
ttttcgtggcgattcacgtatccgc

SEQ ID NO: 388191 - DNA, 25 bp, Mus musculus
ggctctgcgtgtcgacttgttttca

SEQ ID NO: 388192 - DNA, 25 bp, Mus musculus
gagccgcgaatctcgtggttcctga

SEQ ID NO: 388193 - DNA, 25 bp, Mus musculus
cagggaatccaacgacaccagaatg

SEQ ID NO: 388194 - DNA, 25 bp, Mus musculus
atgcgaagatcgtgagtgtccaggc

SEQ ID NO: 388195 - DNA, 25 bp, Mus musculus
gcctctggggttctcatgcgaagat

SEQ ID NO: 388196 - DNA, 25 bp, Mus musculus
tcccgaggatgctcaccggaaccgt

SEQ ID NO: 388197 - DNA, 25 bp, Mus musculus
aggacttgtcgtcttcccgaggatg

SEQ ID NO: 388198 - DNA, 25 bp, Mus musculus
gttcttcgtcggaggacttgtcgtc

SEQ ID NO: 388199 - DNA, 25 bp, Mus musculus
cggaaagcctagagagtcaatctgt

SEQ ID NO: 388200 - DNA, 25 bp, Mus musculus
ttgttttcagcccagcggtactttc

SEQ ID NO: 388201 - DNA, 25 bp, Mus musculus
ccagaatggggtctcccaggtgttc

SEQ ID NO: 388202 - DNA, 25 bp, Mus musculus
ccgacggtctaatgtggagctctga

SEQ ID NO: 388203 - DNA, 25 bp, Mus musculus
tcatgtccctcgctatacaaagcgc

SEQ ID NO: 388204 - DNA, 25 bp, Mus musculus
ggccaggtgacctcgcacttctgga

SEQ ID NO: 388205 - DNA, 25 bp, Mus musculus
tggaggtctgcggatcctatcccgc

SEQ ID NO: 388206 - DNA, 25 bp, Mus musculus
cggggtcccaggctaagatcgccaa

SEQ ID NO: 388207 - DNA, 25 bp, Mus musculus
gctaagatcgccaaaaccgcgggcc

SEQ ID NO: 388208 - DNA, 25 bp, Mus musculus
ctcaggcctgggctgactgcattaa

SEQ ID NO: 388209 - DNA, 25 bp, Mus musculus
ctgcattaaggatcggggacctgcc

SEQ ID NO: 388210 - DNA, 25 bp, Mus musculus
tccacccagaccaaggcaactcagg

SEQ ID NO: 388211 - DNA, 25 bp, Mus musculus
caccagccaatgtccggaggcctgg

SEQ ID NO: 388212 - DNA, 25 bp, Mus musculus
gccaatgccaggtctcctcgggata

SEQ ID NO: 388213 - DNA, 25 bp, Mus musculus
atgccaggtctcctcgggatagccc

SEQ ID NO: 388214 - DNA, 25 bp, Mus musculus
acttctggaggtctgcggatcctat

SEQ ID NO: 388215 - DNA, 25 bp, Mus musculus
cgccctcttaccgacggtctaatgt

SEQ ID NO: 388216 - DNA, 25 bp, Mus musculus
gcattgcccagtgtcgcgcgtccag

SEQ ID NO: 388217 - DNA, 25 bp, Mus musculus
gcgctgcgactcctacgcggtgccc

SEQ ID NO: 388218 - DNA, 25 bp, Mus musculus
cgctcctcgccttcgccgcgtggac

SEQ ID NO: 388219 - DNA, 25 bp, Mus musculus
cagctgcgctgctgctccgcgcaca

SEQ ID NO: 388220 - DNA, 25 bp, Mus musculus
tgctccgcgcacacccgagcgtcct

SEQ ID NO: 388221 - DNA, 25 bp, Mus musculus
ctctccgagcgctgcacggatgaga

SEQ ID NO: 388222 - DNA, 25 bp, Mus musculus
cacggatgagaagagccggcgcatc

SEQ ID NO: 388223 - DNA, 25 bp, Mus musculus
gggagcagatctccgcgctgcgact

SEQ ID NO: 388224 - DNA, 25 bp, Mus musculus
acctgcgatgctgcaacatcgtagc

SEQ ID NO: 388225 - DNA, 25 bp, Mus musculus
cgtccaggtcgggttccagacacct

SEQ ID NO: 388226 - DNA, 25 bp, Mus musculus
caggtcgggttccagacaccttctc

SEQ ID NO: 388227 - DNA, 25 bp, Mus musculus
gggtcctcggagtccacgtcacctg

SEQ ID NO: 388228 - DNA, 25 bp, Mus musculus
gtccacgtcacctgcgatgctgcaa

SEQ ID NO: 388229 - DNA, 25 bp, Mus musculus
tcctggctgcgctggtaggtcccgc

SEQ ID NO: 388230 - DNA, 25 bp, Mus musculus
attgtgcctcgtcttccgagatgta

SEQ ID NO: 388231 - DNA, 25 bp, Mus musculus
agtgcttcccggctcacatgggcag

SEQ ID NO: 388232 - DNA, 25 bp, Mus musculus
ctcacatgggcaggtcagtactatt

SEQ ID NO: 388233 - DNA, 25 bp, Mus musculus
gtcagtactattgtgcctcgtcttc

SEQ ID NO: 388234 - DNA, 25 bp, Mus musculus
tcgtcttccgagatgtaccgtcgtc

SEQ ID NO: 388235 - DNA, 25 bp, Mus musculus
tcgtctcgaggcagcgctttctgca

SEQ ID NO: 388236 - DNA, 25 bp, Mus musculus
cagcgctttctgcaagttggacata

SEQ ID NO: 388237 - DNA, 25 bp, Mus musculus
caagttggacatagcagcagttctc

SEQ ID NO: 388238 - DNA, 25 bp, Mus musculus
gcagcagttctctcaatgtctatca

SEQ ID NO: 388239 - DNA, 25 bp, Mus musculus
atgtctatcacagcgtacagctctg

SEQ ID NO: 388240 - DNA, 25 bp, Mus musculus
cagcgtacagctctgtgcgccgcgt

SEQ ID NO: 388241 - DNA, 25 bp, Mus musculus
cgctctgaacgccttgcggagaagg

SEQ ID NO: 388242 - DNA, 25 bp, Mus musculus
ttgcggagaaggacgcagtgcttcc

SEQ ID NO: 388243 - DNA, 25 bp, Mus musculus
agatgtaccgtcgtctcgaggcagc

SEQ ID NO: 388244 - DNA, 25 bp, Mus musculus
gcgctccgggttcaggtgacgctcc

SEQ ID NO: 388245 - DNA, 25 bp, Mus musculus
ccggcgtcagaatgaccgaggcttg

SEQ ID NO: 388246 - DNA, 25 bp, Mus musculus
agccgggctgagatagtcccgaatg

SEQ ID NO: 388247 - DNA, 25 bp, Mus musculus
ccaagaaccggcgtcagaatgaccg

SEQ ID NO: 388248 - DNA, 25 bp, Mus musculus
gatagtcccgaatgtccttccagca

SEQ ID NO: 388249 - DNA, 25 bp, Mus musculus
ccgaggtgttcgcagagcaactcag

SEQ ID NO: 388250 - DNA, 25 bp, Mus musculus
cgcagagcaactcagtcaacgcatg

SEQ ID NO: 388251 - DNA, 25 bp, Mus musculus
tcagtcaacgcatgcgcgatcccgg

SEQ ID NO: 388252 - DNA, 25 bp, Mus musculus
cgatcccggtcgtggttctgcgcat

SEQ ID NO: 388253 - DNA, 25 bp, Mus musculus
ggcagtggcgctgcgcttttctgtc

SEQ ID NO: 388254 - DNA, 25 bp, Mus musculus
ctgcgcttttctgtccggccgctag

SEQ ID NO: 388255 - DNA, 25 bp, Mus musculus
ccgctaggtgtctttgggtctccat

SEQ ID NO: 388256 - DNA, 25 bp, Mus musculus
tgctgaggggatgttttggcctcca

SEQ ID NO: 388257 - DNA, 25 bp, Mus musculus
ccaggcgcagcgagggtcacttcat

SEQ ID NO: 388258 - DNA, 25 bp, Mus musculus
gtggatgagactggcgactgaacaa

SEQ ID NO: 388259 - DNA, 25 bp, Mus musculus
cgactgaacaagtccctgcctctga

SEQ ID NO: 388260 - DNA, 25 bp, Mus musculus
ctgcctctgacttcgctgtcgtctg

SEQ ID NO: 388261 - DNA, 25 bp, Mus musculus
cgtctgcccagtcgttgccgtcgat

SEQ ID NO: 388262 - DNA, 25 bp, Mus musculus
cgcccgggtgtaatgcgagcgtcat

SEQ ID NO: 388263 - DNA, 25 bp, Mus musculus
acaccagatcgggtcccggcttcgg

SEQ ID NO: 388264 - DNA, 25 bp, Mus musculus
cgccgcgtcctcctgacagctgcgg

SEQ ID NO: 388265 - DNA, 25 bp, Mus musculus
gctggacatcctccgggcgacgctg

SEQ ID NO: 388266 - DNA, 25 bp, Mus musculus
tgacttcgctgtcgtctgcccagtc

SEQ ID NO: 388267 - DNA, 25 bp, Mus musculus
ttctgcctctcacaccagatcgggt

SEQ ID NO: 388268 - DNA, 25 bp, Mus musculus
gccttcaatgcctcagcagaagacc

SEQ ID NO: 388269 - DNA, 25 bp, Mus musculus
gcagcccgacgagccgatgacggac

SEQ ID NO: 388270 - DNA, 25 bp, Mus musculus
tcgttgccgtcgatccggaccggtc

SEQ ID NO: 388271 - DNA, 25 bp, Mus musculus
ctgcggctggacatcctccgggcga

SEQ ID NO: 388272 - DNA, 25 bp, Mus musculus
acaacttctccgacatcggtactcg

SEQ ID NO: 388273 - DNA, 25 bp, Mus musculus
cggagcagttattggccaggcgctg

SEQ ID NO: 388274 - DNA, 25 bp, Mus musculus
ggtcgtgctccgaggtgtcctcctc

SEQ ID NO: 388275 - DNA, 25 bp, Mus musculus
gaggtgtcctcctcccgctagctcc

SEQ ID NO: 388276 - DNA, 25 bp, Mus musculus
gcctgcctcattttctctaagcaga

SEQ ID NO: 388277 - DNA, 25 bp, Mus musculus
cagaacaacttctccgacatcggta

SEQ ID NO: 388278 - DNA, 25 bp, Mus musculus
cccgaaggaggcaaactgcgcgcct

SEQ ID NO: 388279 - DNA, 25 bp, Mus musculus
aaggaggcaaactgcgcgccttggt

SEQ ID NO: 388280 - DNA, 25 bp, Mus musculus
ggctcctggcttcggcgcggctcaa

SEQ ID NO: 388281 - DNA, 25 bp, Mus musculus
gcggctcaacccgagcgggtagcaa

SEQ ID NO: 388282 - DNA, 25 bp, Mus musculus
ccgagcgggtagcaagtaggttcca

SEQ ID NO: 388283 - DNA, 25 bp, Mus musculus
tagcaagtaggttccaggcacggtc

SEQ ID NO: 388284 - DNA, 25 bp, Mus musculus
ttccaggcacggtcgtgcgtgcgct

SEQ ID NO: 388285 - DNA, 25 bp, Mus musculus
ttctctaagcagaacaacttctccg

SEQ ID NO: 388286 - DNA, 25 bp, Mus musculus
tgagcaaccgtaccatgaccatcta

SEQ ID NO: 388287 - DNA, 25 bp, Mus musculus
cttctgccggccttgacgttcacag

SEQ ID NO: 388288 - DNA, 25 bp, Mus musculus
ctgcgtgagccagccgactttggct

SEQ ID NO: 388289 - DNA, 25 bp, Mus musculus
ccgtaagggctcagaacgacacgga

SEQ ID NO: 388290 - DNA, 25 bp, Mus musculus
acggagcccatcgtgctagagggca

SEQ ID NO: 388291 - DNA, 25 bp, Mus musculus
caagtgcctggtagtgtgcgattcc

SEQ ID NO: 388292 - DNA, 25 bp, Mus musculus
tagtgtgcgattccagcccatcggg

SEQ ID NO: 388293 - DNA, 25 bp, Mus musculus
ggatggcgccgtcacttcttccctg

SEQ ID NO: 388294 - DNA, 25 bp, Mus musculus
ttcttccctgggcatttctgtgcgc

SEQ ID NO: 388295 - DNA, 25 bp, Mus musculus
atttctgtgcgctcaggcagtgcca

SEQ ID NO: 388296 - DNA, 25 bp, Mus musculus
aggtggccttctccgctactcggag

SEQ ID NO: 388297 - DNA, 25 bp, Mus musculus
caggcagtgccaaggtggccttctc

SEQ ID NO: 388298 - DNA, 25 bp, Mus musculus
ttcgaccaggtcagcggctaaactg

SEQ ID NO: 388299 - DNA, 25 bp, Mus musculus
gagccgtcagagatgagcaaccgta

SEQ ID NO: 388300 - DNA, 25 bp, Mus musculus
ggctataatggtggcttctcagtga

SEQ ID NO: 388301 - DNA, 25 bp, Mus musculus
gctttcactcgcatctccatcttga

SEQ ID NO: 388302 - DNA, 25 bp, Mus musculus
gctggcagcatgcaccagtgctttc

SEQ ID NO: 388303 - DNA, 25 bp, Mus musculus
gatccttgcgcacaccgttgactgg

SEQ ID NO: 388304 - DNA, 25 bp, Mus musculus
tctcgcagctccctgggctgtagct

SEQ ID NO: 388305 - DNA, 25 bp, Mus musculus
tacaggcacgtgttcctccaggtgg

SEQ ID NO: 388306 - DNA, 25 bp, Mus musculus
tgagtccgattactacaggcacgtg

SEQ ID NO: 388307 - DNA, 25 bp, Mus musculus
cacggtgtactgaaggtagtcctga

SEQ ID NO: 388308 - DNA, 25 bp, Mus musculus
gggcacatcccgtcatctaaaggca

SEQ ID NO: 388309 - DNA, 25 bp, Mus musculus
gcgcggcccttcaagagggcacatc

SEQ ID NO: 388310 - DNA, 25 bp, Mus musculus
agaagacgtatccaggcagcagctg

SEQ ID NO: 388311 - DNA, 25 bp, Mus musculus
tacggctgacacctccatgggagaa

SEQ ID NO: 388312 - DNA, 25 bp, Mus musculus
gtcttcggagaaggcaccactcgcc

SEQ ID NO: 388313 - DNA, 25 bp, Mus musculus
gtagtcctgagacatgagtccgatt

SEQ ID NO: 388314 - DNA, 25 bp, Mus musculus
gccggcctgggcctcaccctcacct

SEQ ID NO: 388315 - DNA, 25 bp, Mus musculus
tcccgcgacccttccagggcacctc

SEQ ID NO: 388316 - DNA, 25 bp, Mus musculus
gcgacccttccagggcacctcgcgc

SEQ ID NO: 388317 - DNA, 25 bp, Mus musculus
gcgctcggccatctggtcccggccc

SEQ ID NO: 388318 - DNA, 25 bp, Mus musculus
cactcggcatctcatcccctggacg

SEQ ID NO: 388319 - DNA, 25 bp, Mus musculus
caggcgaccgcgcagattctatggt

SEQ ID NO: 388320 - DNA, 25 bp, Mus musculus
ggcgaccgcgcagattctatggtcc

SEQ ID NO: 388321 - DNA, 25 bp, Mus musculus
cgaccgcgcagattctatggtcccg

SEQ ID NO: 388322 - DNA, 25 bp, Mus musculus
accgcgcagattctatggtcccgct

SEQ ID NO: 388323 - DNA, 25 bp, Mus musculus
cgcagattctatggtcccgctccga

SEQ ID NO: 388324 - DNA, 25 bp, Mus musculus
gccctcagcacagcccggtaggcgg

SEQ ID NO: 388325 - DNA, 25 bp, Mus musculus
agattctatggtcccgctccgagag

SEQ ID NO: 388326 - DNA, 25 bp, Mus musculus
cctccctaccctgggccacacgcga

SEQ ID NO: 388327 - DNA, 25 bp, Mus musculus
cagattctatggtcccgctccgaga

SEQ ID NO: 388328 - DNA, 25 bp, Mus musculus
gctcggtaactgtcgatgttgccca

SEQ ID NO: 388329 - DNA, 25 bp, Mus musculus
tcaggaagctcggtaactgtcgatg

SEQ ID NO: 388330 - DNA, 25 bp, Mus musculus
ctcatcaggaagctcggtaactgtc

SEQ ID NO: 388331 - DNA, 25 bp, Mus musculus
cggggctcatcaggaagctcggtaa

SEQ ID NO: 388332 - DNA, 25 bp, Mus musculus
actgtcgatgttgcccagggtcaga

SEQ ID NO: 388333 - DNA, 25 bp, Mus musculus
tggcgcgacagtttaattctccggc

SEQ ID NO: 388334 - DNA, 25 bp, Mus musculus
ttctggcggggctcatcaggaagct

SEQ ID NO: 388335 - DNA, 25 bp, Mus musculus
tctgtggcgcgacagtttaattctc

SEQ ID NO: 388336 - DNA, 25 bp, Mus musculus
tatgaacggattctgtggcgcgaca

SEQ ID NO: 388337 - DNA, 25 bp, Mus musculus
ccggaggatattaattatgaacgga

SEQ ID NO: 388338 - DNA, 25 bp, Mus musculus
cgagtttccggaggatattaattat

SEQ ID NO: 388339 - DNA, 25 bp, Mus musculus
ttctccggcggcgactgattgtggc

SEQ ID NO: 388340 - DNA, 25 bp, Mus musculus
gacagtttaattctccggcggcgac

SEQ ID NO: 388341 - DNA, 25 bp, Mus musculus
aagagccctcgggtcttggcttggt

SEQ ID NO: 388342 - DNA, 25 bp, Mus musculus
cggaaagtgaggaaagcctcagtga

SEQ ID NO: 388343 - DNA, 25 bp, Mus musculus
gggcacatagcacagcccagagctc

SEQ ID NO: 388344 - DNA, 25 bp, Mus musculus
cgcgggcacatagcacagcccagag

SEQ ID NO: 388345 - DNA, 25 bp, Mus musculus
gcctgcccgcgctgacacgcctcac

SEQ ID NO: 388346 - DNA, 25 bp, Mus musculus
cgcgcgttccctcggccgctgacag

SEQ ID NO: 388347 - DNA, 25 bp, Mus musculus
ggacatcctgcacatgtccgccgtg

SEQ ID NO: 388348 - DNA, 25 bp, Mus musculus
ctcaccttgaaggacatcctgcaca

SEQ ID NO: 388349 - DNA, 25 bp, Mus musculus
gctgctcaccttgaaggacatcctg

SEQ ID NO: 388350 - DNA, 25 bp, Mus musculus
gctgcgctgctcaccttgaaggaca

SEQ ID NO: 388351 - DNA, 25 bp, Mus musculus
ctcagtgaagcgtgtggagctgcct

SEQ ID NO: 388352 - DNA, 25 bp, Mus musculus
aaagcctcagtgaagcgtgtggagc

SEQ ID NO: 388353 - DNA, 25 bp, Mus musculus
ccttgaaggacatcctgcacatgtc

SEQ ID NO: 388354 - DNA, 25 bp, Mus musculus
cacgcggggctcaccaacccgggcg

SEQ ID NO: 388355 - DNA, 25 bp, Mus musculus
tgaggaaagcctcagtgaagcgtgt

SEQ ID NO: 388356 - DNA, 25 bp, Mus musculus
cacagctggccggagcgcaccatcg

SEQ ID NO: 388357 - DNA, 25 bp, Mus musculus
gggtcgatagctgggccgccacaca

SEQ ID NO: 388358 - DNA, 25 bp, Mus musculus
tcgggttcctctgctgggcgatccg

SEQ ID NO: 388359 - DNA, 25 bp, Mus musculus
ggcgatccgcttctcggagtcgaca

SEQ ID NO: 388360 - DNA, 25 bp, Mus musculus
ttctcggagtcgacaaccgctgtcc

SEQ ID NO: 388361 - DNA, 25 bp, Mus musculus
gtccacgcaggtctcgcatccagcc

SEQ ID NO: 388362 - DNA, 25 bp, Mus musculus
cccaggctcctgctggcgcggaccc

SEQ ID NO: 388363 - DNA, 25 bp, Mus musculus
tagctgggccgccacacacggagac

SEQ ID NO: 388364 - DNA, 25 bp, Mus musculus
cacacggagacaagggatccgggcc

SEQ ID NO: 388365 - DNA, 25 bp, Mus musculus
ccggaactgctcagcagcaccagca

SEQ ID NO: 388366 - DNA, 25 bp, Mus musculus
ctcgcgacccgtcgtcaccttcgcc

SEQ ID NO: 388367 - DNA, 25 bp, Mus musculus
gccgttgcgcccgatcggctccctc

SEQ ID NO: 388368 - DNA, 25 bp, Mus musculus
cccggcagcacccacaggctggcgc

SEQ ID NO: 388369 - DNA, 25 bp, Mus musculus
cgacccgcgccaccgccagttgtac

SEQ ID NO: 388370 - DNA, 25 bp, Mus musculus
gcaggttctcaacccggggccacgc

SEQ ID NO: 388371 - DNA, 25 bp, Mus musculus
tccaggcgtgctgagagtagcagcc

SEQ ID NO: 388372 - DNA, 25 bp, Mus musculus
gggcagcggccacaccatccaggta

SEQ ID NO: 388373 - DNA, 25 bp, Mus musculus
cttttctgcaaattggtgggcggcc

SEQ ID NO: 388374 - DNA, 25 bp, Mus musculus
cccggcctgagcttttctgcaaatt

SEQ ID NO: 388375 - DNA, 25 bp, Mus musculus
atgtcctcgcgcagcctgcacccgc

SEQ ID NO: 388376 - DNA, 25 bp, Mus musculus
gggtcaggaccatcccatgtcctcg

SEQ ID NO: 388377 - DNA, 25 bp, Mus musculus
tgctgagagtagcagcctcctgctc

SEQ ID NO: 388378 - DNA, 25 bp, Mus musculus
tggtgggtcaggaccatcccatgtc

SEQ ID NO: 388379 - DNA, 25 bp, Mus musculus
ctgttgctgaggatgtcgcccagct

SEQ ID NO: 388380 - DNA, 25 bp, Mus musculus
tgctcactctattgctgctgctgtt

SEQ ID NO: 388381 - DNA, 25 bp, Mus musculus
ttaccgctgctgctcactctattgc

SEQ ID NO: 388382 - DNA, 25 bp, Mus musculus
ctgggcagggcaccgcgatccttac

SEQ ID NO: 388383 - DNA, 25 bp, Mus musculus
cgcggtgctaccctgggcacaggca

SEQ ID NO: 388384 - DNA, 25 bp, Mus musculus
ggcatccagacccagttaagtttcg

SEQ ID NO: 388385 - DNA, 25 bp, Mus musculus
gccggcggtgttatcctttctcgct

SEQ ID NO: 388386 - DNA, 25 bp, Mus musculus
taatttcgccgagcccggagcattc

SEQ ID NO: 388387 - DNA, 25 bp, Mus musculus
caggggcccggagaatctaatttcg

SEQ ID NO: 388388 - DNA, 25 bp, Mus musculus
cgcctgttaggatcgctcccttcta

SEQ ID NO: 388389 - DNA, 25 bp, Mus musculus
cgaaccctagacaagcacttccggg

SEQ ID NO: 388390 - DNA, 25 bp, Mus musculus
ggcgcctgtgtctacaaggcctctc

SEQ ID NO: 388391 - DNA, 25 bp, Mus musculus
ccgacggctgaacctgcagcggaca

SEQ ID NO: 388392 - DNA, 25 bp, Mus musculus
atgtccagtgcagtctggctgtccc

SEQ ID NO: 388393 - DNA, 25 bp, Mus musculus
gcgacgaaagttggacactgatgtc

SEQ ID NO: 388394 - DNA, 25 bp, Mus musculus
ccctgggacacaggataattactga

SEQ ID NO: 388395 - DNA, 25 bp, Mus musculus
gagatcgccagcatccacacaggga

SEQ ID NO: 388396 - DNA, 25 bp, Mus musculus
cgagtccaaatcgaacctccggcga

SEQ ID NO: 388397 - DNA, 25 bp, Mus musculus
ccagttaagtttcgagccgagtcca

SEQ ID NO: 388398 - DNA, 25 bp, Mus musculus
tgctttcaagctgtcgcctggtctc

SEQ ID NO: 388399 - DNA, 25 bp, Mus musculus
ctggccttggctggcatcaatatgc

SEQ ID NO: 388400 - DNA, 25 bp, Mus musculus
atgcttctcaacaacggcttcaggg

SEQ ID NO: 388401 - DNA, 25 bp, Mus musculus
gagtcggatcagcttttcaaacaat

SEQ ID NO: 388402 - DNA, 25 bp, Mus musculus
caaacaatacaggtgactccggctc

SEQ ID NO: 388403 - DNA, 25 bp, Mus musculus
tggtcacttcgcgacctgtggctgc

SEQ ID NO: 388404 - DNA, 25 bp, Mus musculus
cccagggctttatctgcagcctttg

SEQ ID NO: 388405 - DNA, 25 bp, Mus musculus
atgaccgcagtacggcctcactttc

SEQ ID NO: 388406 - DNA, 25 bp, Mus musculus
cagcgagcctggcacttgcagggtt

SEQ ID NO: 388407 - DNA, 25 bp, Mus musculus
gtatttctccactgctttcaagctg

SEQ ID NO: 388408 - DNA, 25 bp, Mus musculus
cgagccggctgctgagtaatcccgg

SEQ ID NO: 388409 - DNA, 25 bp, Mus musculus
tgatgcattagaggcagcagcgagc

SEQ ID NO: 388410 - DNA, 25 bp, Mus musculus
ccgaggggtgtccagtatttctcca

SEQ ID NO: 388411 - DNA, 25 bp, Mus musculus
cgggcgcagacacccgaaacggctg

SEQ ID NO: 388412 - DNA, 25 bp, Mus musculus
ggtctgcgctctctcgcacaggagc

SEQ ID NO: 388413 - DNA, 25 bp, Mus musculus
ccgtggcccggaaggtgccttcgat

SEQ ID NO: 388414 - DNA, 25 bp, Mus musculus
atctggcatcctctacctaccgtgg

SEQ ID NO: 388415 - DNA, 25 bp, Mus musculus
gcggggatctggcatcctctaccta

SEQ ID NO: 388416 - DNA, 25 bp, Mus musculus
ggaagctctattgaagccggagaga

SEQ ID NO: 388417 - DNA, 25 bp, Mus musculus
ggggcaaagaggaagctctattgaa

SEQ ID NO: 388418 - DNA, 25 bp, Mus musculus
ccgtagttcccactggcatcggcgg

SEQ ID NO: 388419 - DNA, 25 bp, Mus musculus
aaatagtcggcggtctgcgctctct

SEQ ID NO: 388420 - DNA, 25 bp, Mus musculus
ggtataaatagtcggcggtctgcgc

SEQ ID NO: 388421 - DNA, 25 bp, Mus musculus
tcaggggtataaatagtcggcggtc

SEQ ID NO: 388422 - DNA, 25 bp, Mus musculus
acgtgttcaggggtataaatagtcg

SEQ ID NO: 388423 - DNA, 25 bp, Mus musculus
cgcgtgacgtgttcaggggtataaa

SEQ ID NO: 388424 - DNA, 25 bp, Mus musculus
ctctgtgacgcacgcgtgacgtgtt

SEQ ID NO: 388425 - DNA, 25 bp, Mus musculus
tcccactggcatcggcgggcagaaa

SEQ ID NO: 388426 - DNA, 25 bp, Mus musculus
gcggtcttgcgcaaggtgttttcca

SEQ ID NO: 388427 - DNA, 25 bp, Mus musculus
gcctgcactgactggtcacccgaga

SEQ ID NO: 388428 - DNA, 25 bp, Mus musculus
gtgggaggagcctcgagtccacacc

SEQ ID NO: 388429 - DNA, 25 bp, Mus musculus
tgttttccagctgtacctgcgtgca

SEQ ID NO: 388430 - DNA, 25 bp, Mus musculus
gtgcagcaggccactcgagtgttca

SEQ ID NO: 388431 - DNA, 25 bp, Mus musculus
tgggaggcacgctccgtttcagagt

SEQ ID NO: 388432 - DNA, 25 bp, Mus musculus
tgaaacacactcagggcaccctaaa

SEQ ID NO: 388433 - DNA, 25 bp, Mus musculus
accctgttaacctgagtgttctgtg

SEQ ID NO: 388434 - DNA, 25 bp, Mus musculus
ggaccagggctctgcggaaccctga

SEQ ID NO: 388435 - DNA, 25 bp, Mus musculus
ggaaccctgactctaggcgcctgaa

SEQ ID NO: 388436 - DNA, 25 bp, Mus musculus
tctaggcgcctgaaccagcattggg

SEQ ID NO: 388437 - DNA, 25 bp, Mus musculus
tctccgtaaacagaaagagcctgtc

SEQ ID NO: 388438 - DNA, 25 bp, Mus musculus
tcggctggcccggaacacaagaacc

SEQ ID NO: 388439 - DNA, 25 bp, Mus musculus
gtcacccgagatccgggaagaagga

SEQ ID NO: 388440 - DNA, 25 bp, Mus musculus
ccctccagacgatctgatccgtgag

SEQ ID NO: 388441 - DNA, 25 bp, Mus musculus
gcagtgtggcctgcagccgaaagca

SEQ ID NO: 388442 - DNA, 25 bp, Mus musculus
gcagccgaaagcaggcggttccctt

SEQ ID NO: 388443 - DNA, 25 bp, Mus musculus
cggttcccttccttgtggtcgcagt

SEQ ID NO: 388444 - DNA, 25 bp, Mus musculus
ttccctggtgtgtcggctccgggaa

SEQ ID NO: 388445 - DNA, 25 bp, Mus musculus
ggtggcccagtactctgctgtttga

SEQ ID NO: 388446 - DNA, 25 bp, Mus musculus
aggtctccctaagtcacctctgcgg

SEQ ID NO: 388447 - DNA, 25 bp, Mus musculus
agtaccgcaaggtctccctaagtca

SEQ ID NO: 388448 - DNA, 25 bp, Mus musculus
gatctgatccgtgaggcgcgatcca

SEQ ID NO: 388449 - DNA, 25 bp, Mus musculus
cacagatgttttcggcctgctctcc

SEQ ID NO: 388450 - DNA, 25 bp, Mus musculus
ggcacgcttcagcacagatgttttc

SEQ ID NO: 388451 - DNA, 25 bp, Mus musculus
tcctcggcacgcttcagcacagatg

SEQ ID NO: 388452 - DNA, 25 bp, Mus musculus
ctgctgtttgagcacagaggtcggc

SEQ ID NO: 388453 - DNA, 25 bp, Mus musculus
atccagggcagtaccgcaaggtctc

SEQ ID NO: 388454 - DNA, 25 bp, Mus musculus
gcagagcgtagtgcccgctacccag

SEQ ID NO: 388455 - DNA, 25 bp, Mus musculus
gccagaaatgttggcgccgagctca

SEQ ID NO: 388456 - DNA, 25 bp, Mus musculus
tcagatggaacgtgggacaatggtc

SEQ ID NO: 388457 - DNA, 25 bp, Mus musculus
gggacaatggtctcacgcacgacgc

SEQ ID NO: 388458 - DNA, 25 bp, Mus musculus
cgcacgacgcgtgacttccattgtc

SEQ ID NO: 388459 - DNA, 25 bp, Mus musculus
attgtcaatcaatcctcggggctga

SEQ ID NO: 388460 - DNA, 25 bp, Mus musculus
tcctcggggctgaaaggatactaca

SEQ ID NO: 388461 - DNA, 25 bp, Mus musculus
gatactacaagttaggacgtgcgct

SEQ ID NO: 388462 - DNA, 25 bp, Mus musculus
gacgtgcgctcctaagtcactcgca

SEQ ID NO: 388463 - DNA, 25 bp, Mus musculus
gtcactcgcatttgcgcagagcgta

SEQ ID NO: 388464 - DNA, 25 bp, Mus musculus
gaacccaaggatccgcgggtcagga

SEQ ID NO: 388465 - DNA, 25 bp, Mus musculus
tcctgccggactaggactaactgtc

SEQ ID NO: 388466 - DNA, 25 bp, Mus musculus
agctcagcacgtgactcgctcgcgg

SEQ ID NO: 388467 - DNA, 25 bp, Mus musculus
gaacgcgcgcgccagaaatgttggc

SEQ ID NO: 388468 - DNA, 25 bp, Mus musculus
gcaggctcgcactagctttgccgca

SEQ ID NO: 388469 - DNA, 25 bp, Mus musculus
gactaggctgctgcgtcacacgagc

SEQ ID NO: 388470 - DNA, 25 bp, Mus musculus
ggctgctgcgtcacacgagcaggct

SEQ ID NO: 388471 - DNA, 25 bp, Mus musculus
ttgtcacatgagcaggcccggccca

SEQ ID NO: 388472 - DNA, 25 bp, Mus musculus
gcattgtcacatgagcaggcccggc

SEQ ID NO: 388473 - DNA, 25 bp, Mus musculus
ctaggctgctgcgtcacacgagcag

SEQ ID NO: 388474 - DNA, 25 bp, Mus musculus
ctgcgttgtcacatgttagcaaggc

SEQ ID NO: 388475 - DNA, 25 bp, Mus musculus
gctcggctgcgttgtcacatgttag

SEQ ID NO: 388476 - DNA, 25 bp, Mus musculus
cgtcactggactcggctgctcggct

SEQ ID NO: 388477 - DNA, 25 bp, Mus musculus
ctgctgcgtcactggactcggctgc

SEQ ID NO: 388478 - DNA, 25 bp, Mus musculus
cattgtcacatgagcaggcccggcc

SEQ ID NO: 388479 - DNA, 25 bp, Mus musculus
ctagctttgccgcattgtcacatga

SEQ ID NO: 388480 - DNA, 25 bp, Mus musculus
ggctcgcactagctttgccgcattg

SEQ ID NO: 388481 - DNA, 25 bp, Mus musculus
cgcactagctttgccgcattgtcac

SEQ ID NO: 388482 - DNA, 25 bp, Mus musculus
tacaggcgcaggctcgcactagctt

SEQ ID NO: 388483 - DNA, 25 bp, Mus musculus
tggctcagctgctgcgtcactggac

SEQ ID NO: 388484 - DNA, 25 bp, Mus musculus
attgtcacataaacaggcgcggcca

SEQ ID NO: 388485 - DNA, 25 bp, Mus musculus
agcaggctcgcactagctttgccgc

SEQ ID NO: 388486 - DNA, 25 bp, Mus musculus
cgactaggctgctgcgtcacacgag

SEQ ID NO: 388487 - DNA, 25 bp, Mus musculus
cacgagcaggctttgctgcattgtc

SEQ ID NO: 388488 - DNA, 25 bp, Mus musculus
tgcattgtcacatgagcaggcccgg

SEQ ID NO: 388489 - DNA, 25 bp, Mus musculus
gcacagctcggctgttgcgtcactg

SEQ ID NO: 388490 - DNA, 25 bp, Mus musculus
tcttaacatgagcaggcccgcacta

SEQ ID NO: 388491 - DNA, 25 bp, Mus musculus
ggcccgcactagctttgccgcattg

SEQ ID NO: 388492 - DNA, 25 bp, Mus musculus
cgcattgttacacgagcaggcctgg

SEQ ID NO: 388493 - DNA, 25 bp, Mus musculus
tcggccgcgttattactgagcaagc

SEQ ID NO: 388494 - DNA, 25 bp, Mus musculus
cgctcggctgctctttacaggcgca

SEQ ID NO: 388495 - DNA, 25 bp, Mus musculus
cgtcactgggttcgatctccttgtc

SEQ ID NO: 388496 - DNA, 25 bp, Mus musculus
tacggggactacacagagaggcacc

SEQ ID NO: 388497 - DNA, 25 bp, Mus musculus
gctgtcttttctcacccactttcta

SEQ ID NO: 388498 - DNA, 25 bp, Mus musculus
ttctttcagcccagacggagatctc

SEQ ID NO: 388499 - DNA, 25 bp, Mus musculus
tgccgcatgagtttctgcatattta

SEQ ID NO: 388500 - DNA, 25 bp, Mus musculus
cctcgctcctgtccataggttttta

SEQ ID NO: 388501 - DNA, 25 bp, Mus musculus
tttttaatacgcaaggactcctcgc

SEQ ID NO: 388502 - DNA, 25 bp, Mus musculus
gactttggtggctgttgtgtacgca

SEQ ID NO: 388503 - DNA, 25 bp, Mus musculus
ggcaagacctgcagaacccgaacga

SEQ ID NO: 388504 - DNA, 25 bp, Mus musculus
ccagaccggcagaagctaggcaaga

SEQ ID NO: 388505 - DNA, 25 bp, Mus musculus
caaacttcctctgctacggggacta

SEQ ID NO: 388506 - DNA, 25 bp, Mus musculus
gcggtcaactttccgggcaaatcta

SEQ ID NO: 388507 - DNA, 25 bp, Mus musculus
tacccacagtgacactcacggatgg

SEQ ID NO: 388508 - DNA, 25 bp, Mus musculus
agccaccagatcgataacttcagtg

SEQ ID NO: 388509 - DNA, 25 bp, Mus musculus
agcccaagtgcaccgggcccagttg

SEQ ID NO: 388510 - DNA, 25 bp, Mus musculus
gcctctgcccggacgctcaggaaat

SEQ ID NO: 388511 - DNA, 25 bp, Mus musculus
gagggcctcaactccgaggagtttg

SEQ ID NO: 388512 - DNA, 25 bp, Mus musculus
aactgtgccctcgaccctctgggga

SEQ ID NO: 388513 - DNA, 25 bp, Mus musculus
gctcaggaaatggtcccgccacggc

SEQ ID NO: 388514 - DNA, 25 bp, Mus musculus
tccgggcagttccaccttagggcgc

SEQ ID NO: 388515 - DNA, 25 bp, Mus musculus
ggctgcgaacgccacagacatgttg

SEQ ID NO: 388516 - DNA, 25 bp, Mus musculus
gcgccaaagggctccgtcggaaagc

SEQ ID NO: 388517 - DNA, 25 bp, Mus musculus
gcgctcaggcgcatctatctgctgc

SEQ ID NO: 388518 - DNA, 25 bp, Mus musculus
ctcaagttctccgaagagggcctca

SEQ ID NO: 388519 - DNA, 25 bp, Mus musculus
tcccagcaaggagtgtaagacgctc

SEQ ID NO: 388520 - DNA, 25 bp, Mus musculus
tgtaagacgctcactgctgccggtg

SEQ ID NO: 388521 - DNA, 25 bp, Mus musculus
ttgccagcgcttttgtgcgggcaga

SEQ ID NO: 388522 - DNA, 25 bp, Mus musculus
ggcttggccttaacgctgagccgca

SEQ ID NO: 388523 - DNA, 25 bp, Mus musculus
tatctgctgcagaccggaacagatc

SEQ ID NO: 388524 - DNA, 25 bp, Mus musculus
gctagccgctcgcacgtgataactt

SEQ ID NO: 388525 - DNA, 25 bp, Mus musculus
tagcgcgattcctctcgctggccaa

SEQ ID NO: 388526 - DNA, 25 bp, Mus musculus
cgtgataactttccgggaacctgcg

SEQ ID NO: 388527 - DNA, 25 bp, Mus musculus
ggaacctgcgcctctgagcttcaga

SEQ ID NO: 388528 - DNA, 25 bp, Mus musculus
cagcgtgacgtcactagcgcgattc

SEQ ID NO: 388529 - DNA, 25 bp, Mus musculus
tggccaatcagaaggtcgaacttca

SEQ ID NO: 388530 - DNA, 25 bp, Mus musculus
agggctccgcgtggctatataaaca

SEQ ID NO: 388531 - DNA, 25 bp, Mus musculus
ctgctcctgtagtctcgagcgcgtc

SEQ ID NO: 388532 - DNA, 25 bp, Mus musculus
tcgcctcgcttcagttccgggaagg

SEQ ID NO: 388533 - DNA, 25 bp, Mus musculus
cgcggaagctccgagttaaagctcc

SEQ ID NO: 388534 - DNA, 25 bp, Mus musculus
ttttgaatttctggcgcggaagctc

SEQ ID NO: 388535 - DNA, 25 bp, Mus musculus
actctgcgggtctgtaggattttga

SEQ ID NO: 388536 - DNA, 25 bp, Mus musculus
ataaacatggctggctgagccgcgc

SEQ ID NO: 388537 - DNA, 25 bp, Mus musculus
ttctgctgaagactcggagctactc

SEQ ID NO: 388538 - DNA, 25 bp, Mus musculus
ccgctcttagaacgggcctcggcat

SEQ ID NO: 388539 - DNA, 25 bp, Mus musculus
atggatcatatggaccggctccggc

SEQ ID NO: 388540 - DNA, 25 bp, Mus musculus
ggcgctctggtccatatggatcata

SEQ ID NO: 388541 - DNA, 25 bp, Mus musculus
tactcccggaagatgcgcacggcgt

SEQ ID NO: 388542 - DNA, 25 bp, Mus musculus
gccttttcgctcaggtactcccgga

SEQ ID NO: 388543 - DNA, 25 bp, Mus musculus
cctcggcatagaaggagcgcagcac

SEQ ID NO: 388544 - DNA, 25 bp, Mus musculus
ggcattctcgccatattgccgtctc

SEQ ID NO: 388545 - DNA, 25 bp, Mus musculus
cttgctgtagagctggccgctctta

SEQ ID NO: 388546 - DNA, 25 bp, Mus musculus
tgcggatactgatgagcgaggactt

SEQ ID NO: 388547 - DNA, 25 bp, Mus musculus
tgcacgtctcgaaccagaccttgtt

SEQ ID NO: 388548 - DNA, 25 bp, Mus musculus
cttgtccatggtctcgaagtccggg

SEQ ID NO: 388549 - DNA, 25 bp, Mus musculus
tcacggcctcgcgtgcagaagtaca

SEQ ID NO: 388550 - DNA, 25 bp, Mus musculus
gcgtgatggcttgcttctgcaccac

SEQ ID NO: 388551 - DNA, 25 bp, Mus musculus
accttgttgagcagcccaaagggcg

SEQ ID NO: 388552 - DNA, 25 bp, Mus musculus
acgacaagacggacgagcctatcca

SEQ ID NO: 388553 - DNA, 25 bp, Mus musculus
cgaacgaagctaagcgctctttgct

SEQ ID NO: 388554 - DNA, 25 bp, Mus musculus
aagcgctctttgctgactttatcag

SEQ ID NO: 388555 - DNA, 25 bp, Mus musculus
gcttcgggaacgacaagacggacga

SEQ ID NO: 388556 - DNA, 25 bp, Mus musculus
cgagcctatccagggtctgcgactg

SEQ ID NO: 388557 - DNA, 25 bp, Mus musculus
gggtctgcgactgatgccctagcca

SEQ ID NO: 388558 - DNA, 25 bp, Mus musculus
cccggcacctttgtgtttggcggtg

SEQ ID NO: 388559 - DNA, 25 bp, Mus musculus
ggggcccaatgagcgccgagcttcc

SEQ ID NO: 388560 - DNA, 25 bp, Mus musculus
tctcccgccggagtcaggtccaaat

SEQ ID NO: 388561 - DNA, 25 bp, Mus musculus
gtcaggtccaaattccgccattctc

SEQ ID NO: 388562 - DNA, 25 bp, Mus musculus
ccgccattctcttgaacatattgtc

SEQ ID NO: 388563 - DNA, 25 bp, Mus musculus
atgcgcaacgggctcaggcagacag

SEQ ID NO: 388564 - DNA, 25 bp, Mus musculus
ctcaggcagacagtgcgcacgcgcg

SEQ ID NO: 388565 - DNA, 25 bp, Mus musculus
actttatcagcacggggcttcggga

SEQ ID NO: 388566 - DNA, 25 bp, Mus musculus
gaggtactgtcccacttccagccag

SEQ ID NO: 388567 - DNA, 25 bp, Mus musculus
tactgtcccacttccagccagcttc

SEQ ID NO: 388568 - DNA, 25 bp, Mus musculus
gacgcgcccaggctctgggtgcttc

SEQ ID NO: 388569 - DNA, 25 bp, Mus musculus
cccaggctctgggtgcttcctcgcg

SEQ ID NO: 388570 - DNA, 25 bp, Mus musculus
aggaggtactgtcccacttccagcc

SEQ ID NO: 388571 - DNA, 25 bp, Mus musculus
cataggaggtactgtcccacttcca

SEQ ID NO: 388572 - DNA, 25 bp, Mus musculus
ctgggtcccgctttcccataggagg

SEQ ID NO: 388573 - DNA, 25 bp, Mus musculus
tcccgctttcccataggaggtactg

SEQ ID NO: 388574 - DNA, 25 bp, Mus musculus
ccgctttcccataggaggtactgtc

SEQ ID NO: 388575 - DNA, 25 bp, Mus musculus
cgctttcccataggaggtactgtcc

SEQ ID NO: 388576 - DNA, 25 bp, Mus musculus
ctttcccataggaggtactgtccca

SEQ ID NO: 388577 - DNA, 25 bp, Mus musculus
ttcccataggaggtactgtcccact

SEQ ID NO: 388578 - DNA, 25 bp, Mus musculus
cgctgggtcccgctttcccatagga

SEQ ID NO: 388579 - DNA, 25 bp, Mus musculus
cccataggaggtactgtcccacttc

SEQ ID NO: 388580 - DNA, 25 bp, Mus musculus
aactggaaagacagccagagagctc

SEQ ID NO: 388581 - DNA, 25 bp, Mus musculus
caattaggatctctagcgcgctctc

SEQ ID NO: 388582 - DNA, 25 bp, Mus musculus
gctctcgccacaattctagcaatta

SEQ ID NO: 388583 - DNA, 25 bp, Mus musculus
cgccacaattctagcaattaggatc

SEQ ID NO: 388584 - DNA, 25 bp, Mus musculus
tctagcaattaggatctctagcgcg

SEQ ID NO: 388585 - DNA, 25 bp, Mus musculus
tctagcgcgctctcacttaagtttg

SEQ ID NO: 388586 - DNA, 25 bp, Mus musculus
gcgcgctctcacttaagtttgccaa

SEQ ID NO: 388587 - DNA, 25 bp, Mus musculus
cgctctcacttaagtttgccaactg

SEQ ID NO: 388588 - DNA, 25 bp, Mus musculus
acttaagtttgccaactgccttgca

SEQ ID NO: 388589 - DNA, 25 bp, Mus musculus
agtttgccaactgccttgcattcgc

SEQ ID NO: 388590 - DNA, 25 bp, Mus musculus
aactgccttgcattcgccctcgggg

SEQ ID NO: 388591 - DNA, 25 bp, Mus musculus
cacctcggaaactggaaagacagcc

SEQ ID NO: 388592 - DNA, 25 bp, Mus musculus
ttaggatctctagcgcgctctcact

SEQ ID NO: 388593 - DNA, 25 bp, Mus musculus
gcgggcacctcggaaactggaaaga

SEQ ID NO: 388594 - DNA, 25 bp, Mus musculus
cgacgaatctggatcagcccgggtg

SEQ ID NO: 388595 - DNA, 25 bp, Mus musculus
tggcggccacgaaactctgtccctt

SEQ ID NO: 388596 - DNA, 25 bp, Mus musculus
catatttccatcaggaggggaggca

SEQ ID NO: 388597 - DNA, 25 bp, Mus musculus
ggagaggaagcgcacaccatatttc

SEQ ID NO: 388598 - DNA, 25 bp, Mus musculus
tgcaagcagttcaccacaacgcgtc

SEQ ID NO: 388599 - DNA, 25 bp, Mus musculus
ctacttcggcgttcagggactcaac

SEQ ID NO: 388600 - DNA, 25 bp, Mus musculus
ggcaatcgctgaaaagccgccgtta

SEQ ID NO: 388601 - DNA, 25 bp, Mus musculus
tctgtccctttaagagaaccgtgga

SEQ ID NO: 388602 - DNA, 25 bp, Mus musculus
tgcctaggtctctatcaggggagaa

SEQ ID NO: 388603 - DNA, 25 bp, Mus musculus
tttccaggaggtgaggattctttta

SEQ ID NO: 388604 - DNA, 25 bp, Mus musculus
gccgcggctcacaaaagggctcagc

SEQ ID NO: 388605 - DNA, 25 bp, Mus musculus
gctcagcagccacaatggcgtcttt

SEQ ID NO: 388606 - DNA, 25 bp, Mus musculus
gcctcccaaggagacgtcgattccg

SEQ ID NO: 388607 - DNA, 25 bp, Mus musculus
gggactcaacctcactttgcaagca

SEQ ID NO: 388608 - DNA, 25 bp, Mus musculus
tggagctgttgcaggtaccactcta

SEQ ID NO: 388609 - DNA, 25 bp, Mus musculus
cccaccgcggtgatcagaggcgccc

SEQ ID NO: 388610 - DNA, 25 bp, Mus musculus
cgcccggactgggagtaccgcgcat

SEQ ID NO: 388611 - DNA, 25 bp, Mus musculus
cccagtgcagttaccttggcatccg

SEQ ID NO: 388612 - DNA, 25 bp, Mus musculus
tccgtccctggagctgttgcaggta

SEQ ID NO: 388613 - DNA, 25 bp, Mus musculus
tctccggaacgagtccgcgcgactg

SEQ ID NO: 388614 - DNA, 25 bp, Mus musculus
ctgttgcaggtaccactctagcaga

SEQ ID NO: 388615 - DNA, 25 bp, Mus musculus
taccactctagcagagcgggttggg

SEQ ID NO: 388616 - DNA, 25 bp, Mus musculus
ttggggaagaaacttgcccgcgctc

SEQ ID NO: 388617 - DNA, 25 bp, Mus musculus
gggaagaaacttgcccgcgctctag

SEQ ID NO: 388618 - DNA, 25 bp, Mus musculus
gcgctctagggcaaactctccggaa

SEQ ID NO: 388619 - DNA, 25 bp, Mus musculus
tagggcaaactctccggaacgagtc

SEQ ID NO: 388620 - DNA, 25 bp, Mus musculus
gcagaccgctgagccggaccggcta

SEQ ID NO: 388621 - DNA, 25 bp, Mus musculus
agttaccttggcatccgtccctgga

SEQ ID NO: 388622 - DNA, 25 bp, Mus musculus
acggaaccgaatcccgcgctctatt

SEQ ID NO: 388623 - DNA, 25 bp, Mus musculus
cagttggcgagtgctttatagttca

SEQ ID NO: 388624 - DNA, 25 bp, Mus musculus
agcccgctgacctttggcgtttact

SEQ ID NO: 388625 - DNA, 25 bp, Mus musculus
gcgtttacttcctgctgccctgata

SEQ ID NO: 388626 - DNA, 25 bp, Mus musculus
tgccctgataatggctgctcgcggc

SEQ ID NO: 388627 - DNA, 25 bp, Mus musculus
tattgacccgtttgcccgtgtgttc

SEQ ID NO: 388628 - DNA, 25 bp, Mus musculus
tgcccgtgtgttcccagagacggaa

SEQ ID NO: 388629 - DNA, 25 bp, Mus musculus
ctcctcagttgtccagggactattg

SEQ ID NO: 388630 - DNA, 25 bp, Mus musculus
gcatcgggagcgaagaacagtcttc

SEQ ID NO: 388631 - DNA, 25 bp, Mus musculus
acagtcttcggtggttgcggaaaca

SEQ ID NO: 388632 - DNA, 25 bp, Mus musculus
tggagcacgactgcccagtacagca

SEQ ID NO: 388633 - DNA, 25 bp, Mus musculus
gcgcgcatgctcataagcccgctga

SEQ ID NO: 388634 - DNA, 25 bp, Mus musculus
cccagtacagcagtgaaatcgttta

SEQ ID NO: 388635 - DNA, 25 bp, Mus musculus
gcgctctatttccaggctcctcagt

SEQ ID NO: 388636 - DNA, 25 bp, Mus musculus
cccagacttgagaggggagtgaaca

SEQ ID NO: 388637 - DNA, 25 bp, Mus musculus
gcgcaccatggacagggctcgacgc

SEQ ID NO: 388638 - DNA, 25 bp, Mus musculus
cccctctagagagcgacgggagaag

SEQ ID NO: 388639 - DNA, 25 bp, Mus musculus
gggagaaggagacccatgcccgccc

SEQ ID NO: 388640 - DNA, 25 bp, Mus musculus
agaaggagacccatgcccgccctgt

SEQ ID NO: 388641 - DNA, 25 bp, Mus musculus
tgtcccgcctcggtgactgcagcac

SEQ ID NO: 388642 - DNA, 25 bp, Mus musculus
cggggtggcacttccgagcctcgcc

SEQ ID NO: 388643 - DNA, 25 bp, Mus musculus
cccgggtgcccaggcccagacttga

SEQ ID NO: 388644 - DNA, 25 bp, Mus musculus
acttgagaggggagtgaacagcacc

SEQ ID NO: 388645 - DNA, 25 bp, Mus musculus
aggggagtgaacagcaccatctgtg

SEQ ID NO: 388646 - DNA, 25 bp, Mus musculus
ggagtgaacagcaccatctgtgccc

SEQ ID NO: 388647 - DNA, 25 bp, Mus musculus
tgtgcccatttctcgctcccactgc

SEQ ID NO: 388648 - DNA, 25 bp, Mus musculus
atttctcgctcccactgcccgcggg

SEQ ID NO: 388649 - DNA, 25 bp, Mus musculus
ctgcagcactctccagtcccgcggc

SEQ ID NO: 388650 - DNA, 25 bp, Mus musculus
taaaacagacgggagatcaaggagc

SEQ ID NO: 388651 - DNA, 25 bp, Mus musculus
ttggagactgttctccggctgcggc

SEQ ID NO: 388652 - DNA, 25 bp, Mus musculus
ccgctatccggcacatggaggcgga

SEQ ID NO: 388653 - DNA, 25 bp, Mus musculus
gcggcaccaacagcagcgcggagtc

SEQ ID NO: 388654 - DNA, 25 bp, Mus musculus
ccgccaatgagagcgagctggtaac

SEQ ID NO: 388655 - DNA, 25 bp, Mus musculus
caaatagcgggcctcggagtccgcc

SEQ ID NO: 388656 - DNA, 25 bp, Mus musculus
gcgcaccgcgaaggttctccactgg

SEQ ID NO: 388657 - DNA, 25 bp, Mus musculus
tcgcaccaggagtaataaaacagac

SEQ ID NO: 388658 - DNA, 25 bp, Mus musculus
gccgcagcacaggaggctgagctcc

SEQ ID NO: 388659 - DNA, 25 bp, Mus musculus
gtgcgacaaagcttccgggcgtaga

SEQ ID NO: 388660 - DNA, 25 bp, Mus musculus
aaggttctccactggcgcgacccgg

SEQ ID NO: 388661 - DNA, 25 bp, Mus musculus
cccacaaagggcgacggtcctgctg

SEQ ID NO: 388662 - DNA, 25 bp, Mus musculus
gccgtgcgcgttgcgcccacaaagg

SEQ ID NO: 388663 - DNA, 25 bp, Mus musculus
cgccggactcgcaccaggagtaata

SEQ ID NO: 388664 - DNA, 25 bp, Mus musculus
atggccagctcaagggacaggtcac

SEQ ID NO: 388665 - DNA, 25 bp, Mus musculus
ttaaggtgtcctgaggcccgttgac

SEQ ID NO: 388666 - DNA, 25 bp, Mus musculus
gcacacaggcgcttttctcgcgctt

SEQ ID NO: 388667 - DNA, 25 bp, Mus musculus
gatcgcgcgcctattacagctctca

SEQ ID NO: 388668 - DNA, 25 bp, Mus musculus
gcgcatagatcccacagccgccatg

SEQ ID NO: 388669 - DNA, 25 bp, Mus musculus
cagggctcccggagcgcatagatcc

SEQ ID NO: 388670 - DNA, 25 bp, Mus musculus
tgtcccaggccgaaggcagggctcc

SEQ ID NO: 388671 - DNA, 25 bp, Mus musculus
accgcaagggtcaacaggtgtccca

SEQ ID NO: 388672 - DNA, 25 bp, Mus musculus
tctcttcccgtccttgagatggtcc

SEQ ID NO: 388673 - DNA, 25 bp, Mus musculus
cacatgtttctcttcccgtccttga

SEQ ID NO: 388674 - DNA, 25 bp, Mus musculus
caactgctcagtttaaggtgtcctg

SEQ ID NO: 388675 - DNA, 25 bp, Mus musculus
tcaccgccaacaactgctcagttta

SEQ ID NO: 388676 - DNA, 25 bp, Mus musculus
cggagctcaccgcaagggtcaacag

SEQ ID NO: 388677 - DNA, 25 bp, Mus musculus
ttctcgcgcttgtctgatgctcccg

SEQ ID NO: 388678 - DNA, 25 bp, Mus musculus
cctcctccatctaggctgtggcccg

SEQ ID NO: 388679 - DNA, 25 bp, Mus musculus
aggcagaatcggcgcgcgctatcac

SEQ ID NO: 388680 - DNA, 25 bp, Mus musculus
cgggagagcagggtaggcagaatcg

SEQ ID NO: 388681 - DNA, 25 bp, Mus musculus
tggtgcgacagcgaagggcccaacc

SEQ ID NO: 388682 - DNA, 25 bp, Mus musculus
acctgcccaggaggatccgcagggc

SEQ ID NO: 388683 - DNA, 25 bp, Mus musculus
agggacctgcccaggaggatccgca

SEQ ID NO: 388684 - DNA, 25 bp, Mus musculus
ccgcagagtcagagaagggcggccc

SEQ ID NO: 388685 - DNA, 25 bp, Mus musculus
ccgggtcccgcagagtcagagaagg

SEQ ID NO: 388686 - DNA, 25 bp, Mus musculus
ggctaccctttctgacccgggcaca

SEQ ID NO: 388687 - DNA, 25 bp, Mus musculus
gagggcgggaactgcctcgtacctc

SEQ ID NO: 388688 - DNA, 25 bp, Mus musculus
atcggcgcgcgctatcactctctcc

SEQ ID NO: 388689 - DNA, 25 bp, Mus musculus
tgcgacagcgaagggcccaacctgc

SEQ ID NO: 388690 - DNA, 25 bp, Mus musculus
tgacccgggcacacctggaaccgca

SEQ ID NO: 388691 - DNA, 25 bp, Mus musculus
tggtaagtgcagtgacccccgcgcc

SEQ ID NO: 388692 - DNA, 25 bp, Mus musculus
gaaggagaaacggatgcaatgaatg

SEQ ID NO: 388693 - DNA, 25 bp, Mus musculus
tggtcctggtactccgcgccagcat

SEQ ID NO: 388694 - DNA, 25 bp, Mus musculus
gggtcctgattggtcctggtactcc

SEQ ID NO: 388695 - DNA, 25 bp, Mus musculus
cgcccggagaagaggaaccaagagc

SEQ ID NO: 388696 - DNA, 25 bp, Mus musculus
aggacaatcccgacagccctgtgcg

SEQ ID NO: 388697 - DNA, 25 bp, Mus musculus
ggaccgcggacacccacgaggacaa

SEQ ID NO: 388698 - DNA, 25 bp, Mus musculus
aaaagatgacagacgcgaggcgatc

SEQ ID NO: 388699 - DNA, 25 bp, Mus musculus
tccgcttgagcgcagacatcttcct

SEQ ID NO: 388700 - DNA, 25 bp, Mus musculus
acttccatgaatgtacggagaaccc

SEQ ID NO: 388701 - DNA, 25 bp, Mus musculus
cggtccaggccctaaacttccatga

SEQ ID NO: 388702 - DNA, 25 bp, Mus musculus
gcgggctgcgctctcaggccagact

SEQ ID NO: 388703 - DNA, 25 bp, Mus musculus
tctgccctgccagtagcgcgggctg

SEQ ID NO: 388704 - DNA, 25 bp, Mus musculus
ctgtgccttggcgaacgctgctagt

SEQ ID NO: 388705 - DNA, 25 bp, Mus musculus
ctctaaagtgggcaccggggcacgc

SEQ ID NO: 388706 - DNA, 25 bp, Mus musculus
gattggaaccggaaatactgtgacc

SEQ ID NO: 388707 - DNA, 25 bp, Mus musculus
caagagcgcgctgtcttgacagacg

SEQ ID NO: 388708 - DNA, 25 bp, Mus musculus
tcgaccacagctcggtttcagcctg

SEQ ID NO: 388709 - DNA, 25 bp, Mus musculus
ggccaccacgtaccttcggaagtga

SEQ ID NO: 388710 - DNA, 25 bp, Mus musculus
gatgagctcctgcaccgactgcacg

SEQ ID NO: 388711 - DNA, 25 bp, Mus musculus
agcctgcagccgactgtgcgtagct

SEQ ID NO: 388712 - DNA, 25 bp, Mus musculus
gctttgcatcccactctggcaggtg

SEQ ID NO: 388713 - DNA, 25 bp, Mus musculus
gcaaagccttggtcactgtccgaca

SEQ ID NO: 388714 - DNA, 25 bp, Mus musculus
acgcctcacgtgactgtgtcaaaga

SEQ ID NO: 388715 - DNA, 25 bp, Mus musculus
actgtgaccagtgggttccctgagc

SEQ ID NO: 388716 - DNA, 25 bp, Mus musculus
tgtgtcggggcttaagtttatcttc

SEQ ID NO: 388717 - DNA, 25 bp, Mus musculus
tcttcgcgacttaatgaccagggtc

SEQ ID NO: 388718 - DNA, 25 bp, Mus musculus
ctgtccgacaggaaccgccatgttg

SEQ ID NO: 388719 - DNA, 25 bp, Mus musculus
gtctgtccaaggaagcaagcgccta

SEQ ID NO: 388720 - DNA, 25 bp, Mus musculus
ttcgcttcacaaaggccaaggactg

SEQ ID NO: 388721 - DNA, 25 bp, Mus musculus
gaccgtgcgcggacagagacacaaa

SEQ ID NO: 388722 - DNA, 25 bp, Mus musculus
tttttgttctgtccagccaccgcgc

SEQ ID NO: 388723 - DNA, 25 bp, Mus musculus
cctcacgtacctggttgaactcttc

SEQ ID NO: 388724 - DNA, 25 bp, Mus musculus
cggcccgcaaaacgacgcgcgagaa

SEQ ID NO: 388725 - DNA, 25 bp, Mus musculus
cgagccaacaatggagcgggagacc

SEQ ID NO: 388726 - DNA, 25 bp, Mus musculus
agctaggataccaccatcttttttg

SEQ ID NO: 388727 - DNA, 25 bp, Mus musculus
atccgcgtaaatgtctatgtggtcc

SEQ ID NO: 388728 - DNA, 25 bp, Mus musculus
acaaagggctgtgaacgcggccttc

SEQ ID NO: 388729 - DNA, 25 bp, Mus musculus
cttgttgcggatggaaccaaaccta

SEQ ID NO: 388730 - DNA, 25 bp, Mus musculus
cggtggctccaaaagtcagatgact

SEQ ID NO: 388731 - DNA, 25 bp, Mus musculus
tcccaagtctttggcgcaagccatt

SEQ ID NO: 388732 - DNA, 25 bp, Mus musculus
cggaggcactgcaaaccctcgatga

SEQ ID NO: 388733 - DNA, 25 bp, Mus musculus
acttttaaatgcgatcggtggctcc

SEQ ID NO: 388734 - DNA, 25 bp, Mus musculus
tcacctccttcgactgctcagtgtg

SEQ ID NO: 388735 - DNA, 25 bp, Mus musculus
gctcctggcagctcgctgagctaga

SEQ ID NO: 388736 - DNA, 25 bp, Mus musculus
acccgctgtggccacgtgtgagtgt

SEQ ID NO: 388737 - DNA, 25 bp, Mus musculus
ggggactcggagctgcccatcacct

SEQ ID NO: 388738 - DNA, 25 bp, Mus musculus
agctagagcgcagcgatgggctccc

SEQ ID NO: 388739 - DNA, 25 bp, Mus musculus
gggcgggacaacagaaccacccgca

SEQ ID NO: 388740 - DNA, 25 bp, Mus musculus
tctcgcggaagagcgtttgtaagcg

SEQ ID NO: 388741 - DNA, 25 bp, Mus musculus
agtgccttgtctctcgcggaagagc

SEQ ID NO: 388742 - DNA, 25 bp, Mus musculus
agcctctgcagtgccttgtctctcg

SEQ ID NO: 388743 - DNA, 25 bp, Mus musculus
tccggggacctcgagcctctgcagt

SEQ ID NO: 388744 - DNA, 25 bp, Mus musculus
tccgagtggagggttcaggtttcac

SEQ ID NO: 388745 - DNA, 25 bp, Mus musculus
actctgagtgcggactccgagtgga

SEQ ID NO: 388746 - DNA, 25 bp, Mus musculus
ggaactcttgcggaactctgagtgc

SEQ ID NO: 388747 - DNA, 25 bp, Mus musculus
tgggctccctgctgagcagcgacag

SEQ ID NO: 388748 - DNA, 25 bp, Mus musculus
ttcacggtgctgcacgagcctcact

SEQ ID NO: 388749 - DNA, 25 bp, Mus musculus
cggccacgtcctacacggaagatga

SEQ ID NO: 388750 - DNA, 25 bp, Mus musculus
tgaaaccacgagacggcgcaggacc

SEQ ID NO: 388751 - DNA, 25 bp, Mus musculus
cgttgatagaagctgcggcgtaacc

SEQ ID NO: 388752 - DNA, 25 bp, Mus musculus
cggcgtaaccaatgactgcgtcttc

SEQ ID NO: 388753 - DNA, 25 bp, Mus musculus
ctaagctccgccttcacgctggtgt

SEQ ID NO: 388754 - DNA, 25 bp, Mus musculus
tcgccatgtccgaggaactttcggc

SEQ ID NO: 388755 - DNA, 25 bp, Mus musculus
agatgatttctactgccctgtctgt

SEQ ID NO: 388756 - DNA, 25 bp, Mus musculus
cctgtctgtcaggaggtgctcaaga

SEQ ID NO: 388757 - DNA, 25 bp, Mus musculus
cctgtcagcacgtgtgagtggacgc

SEQ ID NO: 388758 - DNA, 25 bp, Mus musculus
ctcgccaggcccgagaggaatcaca

SEQ ID NO: 388759 - DNA, 25 bp, Mus musculus
ggcttagtcccatgaggcctgcgca

SEQ ID NO: 388760 - DNA, 25 bp, Mus musculus
gaatcacagagaacgtggagccttt

SEQ ID NO: 388761 - DNA, 25 bp, Mus musculus
tggagccttttttgtttcctagcaa

SEQ ID NO: 388762 - DNA, 25 bp, Mus musculus
tcccggcactgactaatcaacaagg

SEQ ID NO: 388763 - DNA, 25 bp, Mus musculus
gctccgcctccctttcagtaggatg

SEQ ID NO: 388764 - DNA, 25 bp, Mus musculus
cagtaggatgggatttccacatgtc

SEQ ID NO: 388765 - DNA, 25 bp, Mus musculus
cgcaattcactagctaggcgctctg

SEQ ID NO: 388766 - DNA, 25 bp, Mus musculus
actccgctggtacgcaggcttcgct

SEQ ID NO: 388767 - DNA, 25 bp, Mus musculus
tcaacaaggtgcaagcgacgcctgc

SEQ ID NO: 388768 - DNA, 25 bp, Mus musculus
tccgaggaacgccatagcagcgctc

SEQ ID NO: 388769 - DNA, 25 bp, Mus musculus
gccctcaagccaggggagcactgca

SEQ ID NO: 388770 - DNA, 25 bp, Mus musculus
ttcagtggccacaccgaggcatggc

SEQ ID NO: 388771 - DNA, 25 bp, Mus musculus
cccaacgagggagccgggtccatct

SEQ ID NO: 388772 - DNA, 25 bp, Mus musculus
tccttgaggctgcaacccaacgagg

SEQ ID NO: 388773 - DNA, 25 bp, Mus musculus
actgggctccacttcacatccttga

SEQ ID NO: 388774 - DNA, 25 bp, Mus musculus
tgctgaccagcaggtcgagcggcat

SEQ ID NO: 388775 - DNA, 25 bp, Mus musculus
gaggccttgcctctttgactctgtc

SEQ ID NO: 388776 - DNA, 25 bp, Mus musculus
agcgcaaagcggaggcgcttcatga

SEQ ID NO: 388777 - DNA, 25 bp, Mus musculus
tccagccacagcacggacatctgga

SEQ ID NO: 388778 - DNA, 25 bp, Mus musculus
gcgagtccagcagggcacgcatctc

SEQ ID NO: 388779 - DNA, 25 bp, Mus musculus
aaagtgccagctccgactccacggg

SEQ ID NO: 388780 - DNA, 25 bp, Mus musculus
cggacatctggaaaagtgccagctc

SEQ ID NO: 388781 - DNA, 25 bp, Mus musculus
cacagcacggacatctggaaaagtg

SEQ ID NO: 388782 - DNA, 25 bp, Mus musculus
gggtctcacggtcgtgctccagcca

SEQ ID NO: 388783 - DNA, 25 bp, Mus musculus
tactgcatgcgggtctcacggtcgt

SEQ ID NO: 388784 - DNA, 25 bp, Mus musculus
cgcttcatgaggtcgggcgcgtact

SEQ ID NO: 388785 - DNA, 25 bp, Mus musculus
tggacccgctctaccagctccgggg

SEQ ID NO: 388786 - DNA, 25 bp, Mus musculus
atgaaatccaccgactggacccgct

SEQ ID NO: 388787 - DNA, 25 bp, Mus musculus
gtgcgcatgaaatccaccgactgga

SEQ ID NO: 388788 - DNA, 25 bp, Mus musculus
cgggtcggtgcgcatgaaatccacc

SEQ ID NO: 388789 - DNA, 25 bp, Mus musculus
ggcgcgtactgcatgcgggtctcac

SEQ ID NO: 388790 - DNA, 25 bp, Mus musculus
aggactgacagtccgggttcccacg

SEQ ID NO: 388791 - DNA, 25 bp, Mus musculus
gctggcagtccgctaagcggctcaa

SEQ ID NO: 388792 - DNA, 25 bp, Mus musculus
ccgctaagcggctcaacgggatgga

SEQ ID NO: 388793 - DNA, 25 bp, Mus musculus
ccagcagagcctcctcgcaccatcc

SEQ ID NO: 388794 - DNA, 25 bp, Mus musculus
cccaacttctctagcccggatattg

SEQ ID NO: 388795 - DNA, 25 bp, Mus musculus
gagtgtgctccgagcatgctccacc

SEQ ID NO: 388796 - DNA, 25 bp, Mus musculus
tccgagcatgctccacccggtagta

SEQ ID NO: 388797 - DNA, 25 bp, Mus musculus
tccacccggtagtagcaggctgggt

SEQ ID NO: 388798 - DNA, 25 bp, Mus musculus
gaaccggtcggtaagtcctggcagc

SEQ ID NO: 388799 - DNA, 25 bp, Mus musculus
cccggctgatgttggctccagagag

SEQ ID NO: 388800 - DNA, 25 bp, Mus musculus
ggcagccgtccgtttgggtcgctcc

SEQ ID NO: 388801 - DNA, 25 bp, Mus musculus
gcccggatattgttgggtccctgtc

SEQ ID NO: 388802 - DNA, 25 bp, Mus musculus
gtaagtcctggcagccgtccgtttg

SEQ ID NO: 388803 - DNA, 25 bp, Mus musculus
ggcggaccctccattccaggactga

SEQ ID NO: 388804 - DNA, 25 bp, Mus musculus
gggacaccttcgattatccgcgctg

SEQ ID NO: 388805 - DNA, 25 bp, Mus musculus
acacctcgtgggctcgagtccatgc

SEQ ID NO: 388806 - DNA, 25 bp, Mus musculus
ccatgcccggctggatgaacggaaa

SEQ ID NO: 388807 - DNA, 25 bp, Mus musculus
ctcaagagctcagaggcgaccgacg

SEQ ID NO: 388808 - DNA, 25 bp, Mus musculus
caggtcaactggtgctggaagcttt

SEQ ID NO: 388809 - DNA, 25 bp, Mus musculus
gctttgctttttcttagttggccca

SEQ ID NO: 388810 - DNA, 25 bp, Mus musculus
ggtgggcgattcttagctttctaaa

SEQ ID NO: 388811 - DNA, 25 bp, Mus musculus
ccgaaaaagtcctaggctcacagtc

SEQ ID NO: 388812 - DNA, 25 bp, Mus musculus
gcgggagctgtccttatcaattcta

SEQ ID NO: 388813 - DNA, 25 bp, Mus musculus
aaactgttggctttcctcgctgcca

SEQ ID NO: 388814 - DNA, 25 bp, Mus musculus
cccgcttcgcaaactgttggctttc

SEQ ID NO: 388815 - DNA, 25 bp, Mus musculus
ctgagagaagagataaagccctttc

SEQ ID NO: 388816 - DNA, 25 bp, Mus musculus
ggacccgctcagtggactcggcaga

SEQ ID NO: 388817 - DNA, 25 bp, Mus musculus
tcttctcccggggaagtgcagcgga

SEQ ID NO: 388818 - DNA, 25 bp, Mus musculus
tcccgagacctttgtgtggcaatta

SEQ ID NO: 388819 - DNA, 25 bp, Mus musculus
cccgtgacgtcagagtgtattgttg

SEQ ID NO: 388820 - DNA, 25 bp, Mus musculus
tcccgcgaaccggtgaatctctcaa

SEQ ID NO: 388821 - DNA, 25 bp, Mus musculus
aatctctcaacgtttggcgcggggc

SEQ ID NO: 388822 - DNA, 25 bp, Mus musculus
cgggacacttcttcacgggacttgg

SEQ ID NO: 388823 - DNA, 25 bp, Mus musculus
cggctctttgttattccgcgggagt

SEQ ID NO: 388824 - DNA, 25 bp, Mus musculus
gtcatcctcagcaccatcaatgaga

SEQ ID NO: 388825 - DNA, 25 bp, Mus musculus
tcactgggtcattgtctcggcgccc

SEQ ID NO: 388826 - DNA, 25 bp, Mus musculus
ttgtgtggcaattaccactccctcc

SEQ ID NO: 388827 - DNA, 25 bp, Mus musculus
tcaccgggtcactgggtcattgtct

SEQ ID NO: 388828 - DNA, 25 bp, Mus musculus
ttcatcaataactccgggaacagtc

SEQ ID NO: 388829 - DNA, 25 bp, Mus musculus
tgtgtgtcccgcgtttgtgagttca

SEQ ID NO: 388830 - DNA, 25 bp, Mus musculus
tgagttcagctcttccacacgtgca

SEQ ID NO: 388831 - DNA, 25 bp, Mus musculus
gaagaagaaggaccgcacctgggcc

SEQ ID NO: 388832 - DNA, 25 bp, Mus musculus
tggcccagctggaaacccttcgatt

SEQ ID NO: 388833 - DNA, 25 bp, Mus musculus
ggagcttgactctgagccgttgaga

SEQ ID NO: 388834 - DNA, 25 bp, Mus musculus
gacccgcacgaagagcacttgcttg

SEQ ID NO: 388835 - DNA, 25 bp, Mus musculus
tccgggctgctccaacagacaaata

SEQ ID NO: 388836 - DNA, 25 bp, Mus musculus
ccagcgttctcgcagcaaaacttga

SEQ ID NO: 388837 - DNA, 25 bp, Mus musculus
cgcccgacgcagtgaagacaagctc

SEQ ID NO: 388838 - DNA, 25 bp, Mus musculus
agaaaccggctcaccgtggtcttga

SEQ ID NO: 388839 - DNA, 25 bp, Mus musculus
gctctgcaggttcgctatcgcttta

SEQ ID NO: 388840 - DNA, 25 bp, Mus musculus
tcaaccgccacattcaggctttgtg

SEQ ID NO: 388841 - DNA, 25 bp, Mus musculus
cccagaccacgatgcaaggacgcga

SEQ ID NO: 388842 - DNA, 25 bp, Mus musculus
ggtctcatgaaatatgccgcccaga

SEQ ID NO: 388843 - DNA, 25 bp, Mus musculus
tcaccgtcttggtcttgcctgagtc

SEQ ID NO: 388844 - DNA, 25 bp, Mus musculus
cgctcatatttcttacgggtcaccg

SEQ ID NO: 388845 - DNA, 25 bp, Mus musculus
cgtcagcctcgcctgttatcagagc

SEQ ID NO: 388846 - DNA, 25 bp, Mus musculus
gcgcttctcctggaagattctcggg

SEQ ID NO: 388847 - DNA, 25 bp, Mus musculus
gggtgcgcttctcctggaagattct

SEQ ID NO: 388848 - DNA, 25 bp, Mus musculus
cccggagctctctggctgctcagtg

SEQ ID NO: 388849 - DNA, 25 bp, Mus musculus
gcatggatcggctcagccagccgga

SEQ ID NO: 388850 - DNA, 25 bp, Mus musculus
gttcctgagtggtccgagcccacca

SEQ ID NO: 388851 - DNA, 25 bp, Mus musculus
atcggctcagccagccggatggccg

SEQ ID NO: 388852 - DNA, 25 bp, Mus musculus
agctctctggctgctcagtggctcc

SEQ ID NO: 388853 - DNA, 25 bp, Mus musculus
cgggtcgcatggatcggctcagcca

SEQ ID NO: 388854 - DNA, 25 bp, Mus musculus
gaccctcgccgcgttcctgagtggt

SEQ ID NO: 388855 - DNA, 25 bp, Mus musculus
gcagccgctcctctttactgcactc

SEQ ID NO: 388856 - DNA, 25 bp, Mus musculus
gaacgcggctcggtcccggagctct

SEQ ID NO: 388857 - DNA, 25 bp, Mus musculus
tactgcactccctgccgaggccagc

SEQ ID NO: 388858 - DNA, 25 bp, Mus musculus
ggagttccagtcctgctccctgcag

SEQ ID NO: 388859 - DNA, 25 bp, Mus musculus
tggaaccaggggagttccagtcctg

SEQ ID NO: 388860 - DNA, 25 bp, Mus musculus
gccggtcccattgcaaggtgtgtgt

SEQ ID NO: 388861 - DNA, 25 bp, Mus musculus
gagctggtctctcccacggcggcgt

SEQ ID NO: 388862 - DNA, 25 bp, Mus musculus
cgggaaacccgcgagctggtctctc

SEQ ID NO: 388863 - DNA, 25 bp, Mus musculus
ttctgtcgggatctgctctcggggt

SEQ ID NO: 388864 - DNA, 25 bp, Mus musculus
atgagctgttctgtcgggatctgct

SEQ ID NO: 388865 - DNA, 25 bp, Mus musculus
ccggctcctcgggatgagctgttct

SEQ ID NO: 388866 - DNA, 25 bp, Mus musculus
gatcggggcgccctatcaagggcag

SEQ ID NO: 388867 - DNA, 25 bp, Mus musculus
tgtcccttctcacccggagcctcgg

SEQ ID NO: 388868 - DNA, 25 bp, Mus musculus
tgggctgcggcgctgtcccttctca

SEQ ID NO: 388869 - DNA, 25 bp, Mus musculus
actgctcccttgacggctcggggtg

SEQ ID NO: 388870 - DNA, 25 bp, Mus musculus
acgttgactgctcccttgacggctc

SEQ ID NO: 388871 - DNA, 25 bp, Mus musculus
gtgtgcacgttgactgctcccttga

SEQ ID NO: 388872 - DNA, 25 bp, Mus musculus
acacaggcgccggtcccattgcaag

SEQ ID NO: 388873 - DNA, 25 bp, Mus musculus
ccattgcaaggtgtgtgtgcacgtt

SEQ ID NO: 388874 - DNA, 25 bp, Mus musculus
tcgctgtcctcaataccctgcaggg

SEQ ID NO: 388875 - DNA, 25 bp, Mus musculus
tcttgggagctagggcggagatccc

SEQ ID NO: 388876 - DNA, 25 bp, Mus musculus
gtgggcaccatctgcgcagcgttcc

SEQ ID NO: 388877 - DNA, 25 bp, Mus musculus
atctgcgcagcgttcccgggaccgc

SEQ ID NO: 388878 - DNA, 25 bp, Mus musculus
gtccaacacgggctccgacaggtca

SEQ ID NO: 388879 - DNA, 25 bp, Mus musculus
ccaacacgggctccgacaggtcatg

SEQ ID NO: 388880 - DNA, 25 bp, Mus musculus
caccaggctcgctcgctgtcctcaa

SEQ ID NO: 388881 - DNA, 25 bp, Mus musculus
gctgtcctcaataccctgcagggca

SEQ ID NO: 388882 - DNA, 25 bp, Mus musculus
tcctcaataccctgcagggcacgtt

SEQ ID NO: 388883 - DNA, 25 bp, Mus musculus
tcaataccctgcagggcacgttgtc

SEQ ID NO: 388884 - DNA, 25 bp, Mus musculus
taccctgcagggcacgttgtcttgg

SEQ ID NO: 388885 - DNA, 25 bp, Mus musculus
ccctgcagggcacgttgtcttggga

SEQ ID NO: 388886 - DNA, 25 bp, Mus musculus
accgtgggcaccatctgcgcagcgt

SEQ ID NO: 388887 - DNA, 25 bp, Mus musculus
aacacgggctccgacaggtcatgcc

SEQ ID NO: 388888 - DNA, 25 bp, Mus musculus
ctcccgagtggactctgacggtggc

SEQ ID NO: 388889 - DNA, 25 bp, Mus musculus
tgaagaagttatccagcccagggtg

SEQ ID NO: 388890 - DNA, 25 bp, Mus musculus
ctgcagatctcggagcaagcggatc

SEQ ID NO: 388891 - DNA, 25 bp, Mus musculus
ccgcctgggtctgctgtctgcagat

SEQ ID NO: 388892 - DNA, 25 bp, Mus musculus
tttgcactgggtcggtccctcccag

SEQ ID NO: 388893 - DNA, 25 bp, Mus musculus
cgacaccctttgcactgggtcggtc

SEQ ID NO: 388894 - DNA, 25 bp, Mus musculus
ggtgtgagcgcagccgcgctcctac

SEQ ID NO: 388895 - DNA, 25 bp, Mus musculus
tcaaagctgtacagccctggcgcgc

SEQ ID NO: 388896 - DNA, 25 bp, Mus musculus
gtacgttcaaagctgtacagccctg

SEQ ID NO: 388897 - DNA, 25 bp, Mus musculus
ctgacggtggcagacagcgagtcac

SEQ ID NO: 388898 - DNA, 25 bp, Mus musculus
cggggtcttcaaacccatgaagaag

SEQ ID NO: 388899 - DNA, 25 bp, Mus musculus
cgacaacgccggagcaggtgagtca

SEQ ID NO: 388900 - DNA, 25 bp, Mus musculus
gagcaagcggatcccggggtcttca

SEQ ID NO: 388901 - DNA, 25 bp, Mus musculus
caggtgagtcaagtacgttcaaagc

SEQ ID NO: 388902 - DNA, 25 bp, Mus musculus
cccaaatggcgagaacaacaacgac

SEQ ID NO: 388903 - DNA, 25 bp, Mus musculus
attgcttggttgcagggtctcgtgt

SEQ ID NO: 388904 - DNA, 25 bp, Mus musculus
tgcggacggtctgtcccgttacgta

SEQ ID NO: 388905 - DNA, 25 bp, Mus musculus
cggtcctacaggtactggcacggga

SEQ ID NO: 388906 - DNA, 25 bp, Mus musculus
tcctttccggaagcacacagtgcgc

SEQ ID NO: 388907 - DNA, 25 bp, Mus musculus
catcatccaggataacgggactatc

SEQ ID NO: 388908 - DNA, 25 bp, Mus musculus
cgtgtgttccctctgtcgggagagc

SEQ ID NO: 388909 - DNA, 25 bp, Mus musculus
caagcagcggggagacacaaccctc

SEQ ID NO: 388910 - DNA, 25 bp, Mus musculus
tatggtgacagatagccacgtgacc

SEQ ID NO: 388911 - DNA, 25 bp, Mus musculus
tagcgggttgctatggtgacagata

SEQ ID NO: 388912 - DNA, 25 bp, Mus musculus
acctaggcaagctgacgagttagcg

SEQ ID NO: 388913 - DNA, 25 bp, Mus musculus
cgctgctctgcgtgaacctaggcaa

SEQ ID NO: 388914 - DNA, 25 bp, Mus musculus
gggtccatgccagatgccggccagc

SEQ ID NO: 388915 - DNA, 25 bp, Mus musculus
gggactatcattcctttccggaagc

SEQ ID NO: 388916 - DNA, 25 bp, Mus musculus
ctgctcctccgctgtagctggggct

SEQ ID NO: 388917 - DNA, 25 bp, Mus musculus
gacaatgggacacagcgggctgcaa

SEQ ID NO: 388918 - DNA, 25 bp, Mus musculus
ctgccgcccagagcgtgaagagcgc

SEQ ID NO: 388919 - DNA, 25 bp, Mus musculus
gaagagcgcggttggaccgttactc

SEQ ID NO: 388920 - DNA, 25 bp, Mus musculus
cacccacaggtttactctcatcaga

SEQ ID NO: 388921 - DNA, 25 bp, Mus musculus
tcagagctcacgaaaaacagccgta

SEQ ID NO: 388922 - DNA, 25 bp, Mus musculus
ggcacgcgcctacgctgtgctttaa

SEQ ID NO: 388923 - DNA, 25 bp, Mus musculus
atccgattatgggactgggaaactg

SEQ ID NO: 388924 - DNA, 25 bp, Mus musculus
cgcgcctcaggcctttgtggctaat

SEQ ID NO: 388925 - DNA, 25 bp, Mus musculus
ttgtggctaatgtccgctactcggg

SEQ ID NO: 388926 - DNA, 25 bp, Mus musculus
agccctgcggcagatcccgaagtcg

SEQ ID NO: 388927 - DNA, 25 bp, Mus musculus
cgctgtgctttaacccggaagctaa

SEQ ID NO: 388928 - DNA, 25 bp, Mus musculus
cggaagctaaaaatagggtgcgtgc

SEQ ID NO: 388929 - DNA, 25 bp, Mus musculus
cagccgtaaaagaggaaaatccgat

SEQ ID NO: 388930 - DNA, 25 bp, Mus musculus
gtgcaatccggcactcggcaggatc

SEQ ID NO: 388931 - DNA, 25 bp, Mus musculus
ggagccctctggttaactgacgaaa

SEQ ID NO: 388932 - DNA, 25 bp, Mus musculus
cggcaggatccaggtcttcagcgac

SEQ ID NO: 388933 - DNA, 25 bp, Mus musculus
tacaaatcccagtaggtggtgcgcg

SEQ ID NO: 388934 - DNA, 25 bp, Mus musculus
gccggatcccacttcagcttgagcg

SEQ ID NO: 388935 - DNA, 25 bp, Mus musculus
gcagtcgctacgtgtaaatcggtta

SEQ ID NO: 388936 - DNA, 25 bp, Mus musculus
agcttgagcgtctcccagaatccta

SEQ ID NO: 388937 - DNA, 25 bp, Mus musculus
cgcgagccgccagagcctcgaaata

SEQ ID NO: 388938 - DNA, 25 bp, Mus musculus
ggcttgatgacaatggccgcattga

SEQ ID NO: 388939 - DNA, 25 bp, Mus musculus
tggcgcctttcgcagagtgactgtt

SEQ ID NO: 388940 - DNA, 25 bp, Mus musculus
cccgggaccagcaggactacaaatc

SEQ ID NO: 388941 - DNA, 25 bp, Mus musculus
gcagttccacgagtgcccggtactc

SEQ ID NO: 388942 - DNA, 25 bp, Mus musculus
agtgtgctgtaatcgggtcaaccgc

SEQ ID NO: 388943 - DNA, 25 bp, Mus musculus
gactgttgctctctgttccactcca

SEQ ID NO: 388944 - DNA, 25 bp, Mus musculus
ggctagctggcctcttcttgctgtt

SEQ ID NO: 388945 - DNA, 25 bp, Mus musculus
tgcgcatgcgctcttgttcccggac

SEQ ID NO: 388946 - DNA, 25 bp, Mus musculus
acggtgcggacagtacctgagcaaa

SEQ ID NO: 388947 - DNA, 25 bp, Mus musculus
ctccgctgctgttgtgagaagggct

SEQ ID NO: 388948 - DNA, 25 bp, Mus musculus
cggctcgatgttacttccgtgttga

SEQ ID NO: 388949 - DNA, 25 bp, Mus musculus
tcttgctgttcctagctacggcggg

SEQ ID NO: 388950 - DNA, 25 bp, Mus musculus
agtggcagccacgatgggaatttga

SEQ ID NO: 388951 - DNA, 25 bp, Mus musculus
attctgcccgcagtcagcctgcaga

SEQ ID NO: 388952 - DNA, 25 bp, Mus musculus
cttccaaggcgagcccgagaacttc

SEQ ID NO: 388953 - DNA, 25 bp, Mus musculus
ccgtgttgatgctcggaaactccgc

SEQ ID NO: 388954 - DNA, 25 bp, Mus musculus
tcggaaactccgcaagcctcttgga

SEQ ID NO: 388955 - DNA, 25 bp, Mus musculus
ggaggcggatagctttttcttctta

SEQ ID NO: 388956 - DNA, 25 bp, Mus musculus
cctcttggagcttaaccgagtcctc

SEQ ID NO: 388957 - DNA, 25 bp, Mus musculus
ctgctggcgttgtgaaccttgacct

SEQ ID NO: 388958 - DNA, 25 bp, Mus musculus
tgcggaccctgagatctagcgtgat

SEQ ID NO: 388959 - DNA, 25 bp, Mus musculus
tgagtatcgtctctggctcccggaa

SEQ ID NO: 388960 - DNA, 25 bp, Mus musculus
tcgggtaaatagagcccagggctga

SEQ ID NO: 388961 - DNA, 25 bp, Mus musculus
tggcgcgccatcagagccactcaga

SEQ ID NO: 388962 - DNA, 25 bp, Mus musculus
ggattcgcccgactgttgtcttgga

SEQ ID NO: 388963 - DNA, 25 bp, Mus musculus
gaaggaggctctaggtcagctctga

SEQ ID NO: 388964 - DNA, 25 bp, Mus musculus
ggccgcagatcgctttactccaaac

SEQ ID NO: 388965 - DNA, 25 bp, Mus musculus
cgcgcactcctgaagagcgagctgg

SEQ ID NO: 388966 - DNA, 25 bp, Mus musculus
ctagcgtgatcttgcgttctccagg

SEQ ID NO: 388967 - DNA, 25 bp, Mus musculus
ctgagttgttctctcgactggaccc

SEQ ID NO: 388968 - DNA, 25 bp, Mus musculus
tttctctgtagacccgcgggaggct

SEQ ID NO: 388969 - DNA, 25 bp, Mus musculus
cgggaggctgaaagttaagttgcta

SEQ ID NO: 388970 - DNA, 25 bp, Mus musculus
atcctaggcttaggtcgcgaccgaa

SEQ ID NO: 388971 - DNA, 25 bp, Mus musculus
cgctacgtccatccggagcggatca

SEQ ID NO: 388972 - DNA, 25 bp, Mus musculus
ctgcgagttggcgtcctagtttgac

SEQ ID NO: 388973 - DNA, 25 bp, Mus musculus
ggctccgcatcaggcgtggccttgt

SEQ ID NO: 388974 - DNA, 25 bp, Mus musculus
tgcgacggcgccttcgttttcagcc

SEQ ID NO: 388975 - DNA, 25 bp, Mus musculus
gaccgactcgccgaggctttactcg

SEQ ID NO: 388976 - DNA, 25 bp, Mus musculus
ggctttactcgcttgccgccgtctt

SEQ ID NO: 388977 - DNA, 25 bp, Mus musculus
cgccgtctttgtccgcacacaggtg

SEQ ID NO: 388978 - DNA, 25 bp, Mus musculus
ctttgtccgcacacaggtgggcacc

SEQ ID NO: 388979 - DNA, 25 bp, Mus musculus
aggtgggcaccgtctcctgcccgag

SEQ ID NO: 388980 - DNA, 25 bp, Mus musculus
gactgcaccgcggaaccaagcgcgg

SEQ ID NO: 388981 - DNA, 25 bp, Mus musculus
cgtcctagtttgacattgagttaga

SEQ ID NO: 388982 - DNA, 25 bp, Mus musculus
gacggaagtttgttttattgacaga

SEQ ID NO: 388983 - DNA, 25 bp, Mus musculus
ttgacagaggtacatgcagctaaac

SEQ ID NO: 388984 - DNA, 25 bp, Mus musculus
gcagctaaacatggctcctggtttc

SEQ ID NO: 388985 - DNA, 25 bp, Mus musculus
acaggaagcgactgcaccgcggaac

SEQ ID NO: 388986 - DNA, 25 bp, Mus musculus
cctcccgaatgagagaaggctttgc

SEQ ID NO: 388987 - DNA, 25 bp, Mus musculus
gcagggcggacccaaccaagttatc

SEQ ID NO: 388988 - DNA, 25 bp, Mus musculus
caccgggtcggatgcttcaaacatc

SEQ ID NO: 388989 - DNA, 25 bp, Mus musculus
ttcgggccctcagaattacactagg

SEQ ID NO: 388990 - DNA, 25 bp, Mus musculus
tgccgagagtctacgcactgatctg

SEQ ID NO: 388991 - DNA, 25 bp, Mus musculus
gctccctggattgcacctagactcg

SEQ ID NO: 388992 - DNA, 25 bp, Mus musculus
cctcagcaggtagaaggacctttcc

SEQ ID NO: 388993 - DNA, 25 bp, Mus musculus
gtccctggagcaggtccgtttctta

SEQ ID NO: 388994 - DNA, 25 bp, Mus musculus
cactgtacctggaacggtccctgga

SEQ ID NO: 388995 - DNA, 25 bp, Mus musculus
ccggttgcttccaggctgttcccaa

SEQ ID NO: 388996 - DNA, 25 bp, Mus musculus
tgagcttctgctcccatccactgta

SEQ ID NO: 388997 - DNA, 25 bp, Mus musculus
cctgtgtgcaatctaagtgagcttc

SEQ ID NO: 388998 - DNA, 25 bp, Mus musculus
tgctcgccatagtccagccgacgta

SEQ ID NO: 388999 - DNA, 25 bp, Mus musculus
ggttgctctcggttgcttctcttta

SEQ ID NO: 389000 - DNA, 25 bp, Mus musculus
gccaggctcggtacctcctgtaaga

SEQ ID NO: 389001 - DNA, 25 bp, Mus musculus
tgtgtcgcgaatgcgtgtttccgga

SEQ ID NO: 389002 - DNA, 25 bp, Mus musculus
tggttacactgagaaagccgacttc

SEQ ID NO: 389003 - DNA, 25 bp, Mus musculus
cgtggagttctttcgcagcgtttga

SEQ ID NO: 389004 - DNA, 25 bp, Mus musculus
cgcagcgtttgagcgactgagttct

SEQ ID NO: 389005 - DNA, 25 bp, Mus musculus
gactgagttctcgagcgatgcggca

SEQ ID NO: 389006 - DNA, 25 bp, Mus musculus
agtattacattgaagcggctgctcg

SEQ ID NO: 389007 - DNA, 25 bp, Mus musculus
gaccggaactcctgtgtcgcgaatg

SEQ ID NO: 389008 - DNA, 25 bp, Mus musculus
cgcagaggcctaggatggttacact

SEQ ID NO: 389009 - DNA, 25 bp, Mus musculus
tgggcctacagttcgacacacggta

SEQ ID NO: 389010 - DNA, 25 bp, Mus musculus
acacacggtaggagaacgccggctg

SEQ ID NO: 389011 - DNA, 25 bp, Mus musculus
cgagcgatgcggcagaagtattaca

SEQ ID NO: 389012 - DNA, 25 bp, Mus musculus
acttccggcgtggagttctttcgca

SEQ ID NO: 389013 - DNA, 25 bp, Mus musculus
tccatacacgacacggaggagaccg

SEQ ID NO: 389014 - DNA, 25 bp, Mus musculus
ctcaggaagcctgctcaagaggagc

SEQ ID NO: 389015 - DNA, 25 bp, Mus musculus
cctgacagtcggacggttcgttaag

SEQ ID NO: 389016 - DNA, 25 bp, Mus musculus
gttcccacaccgtgacgatgggccg

SEQ ID NO: 389017 - DNA, 25 bp, Mus musculus
gcgctgctctccctgggaaaggagc

SEQ ID NO: 389018 - DNA, 25 bp, Mus musculus
gaggccggtcgcaatccagcaagat

SEQ ID NO: 389019 - DNA, 25 bp, Mus musculus
gaaggcggacatccctccggaacca

SEQ ID NO: 389020 - DNA, 25 bp, Mus musculus
gagttgctcaactcggacagcttct

SEQ ID NO: 389021 - DNA, 25 bp, Mus musculus
tgggagcctggatccaagaacccag

SEQ ID NO: 389022 - DNA, 25 bp, Mus musculus
acctgggaaagcctgaggagtccga

SEQ ID NO: 389023 - DNA, 25 bp, Mus musculus
ccaggggatccggacagaatcacca

SEQ ID NO: 389024 - DNA, 25 bp, Mus musculus
cgttaagggccaagggcaagatgcc

SEQ ID NO: 389025 - DNA, 25 bp, Mus musculus
ggctaaaagtcgagcacccggagca

SEQ ID NO: 389026 - DNA, 25 bp, Mus musculus
cgcgcagagagccagggctaaaagt

SEQ ID NO: 389027 - DNA, 25 bp, Mus musculus
gaaaggacgcgggatccagaaagcc

SEQ ID NO: 389028 - DNA, 25 bp, Mus musculus
gcacgcagactgtagggcgagaact

SEQ ID NO: 389029 - DNA, 25 bp, Mus musculus
acgcatctgattgacagcacccgga

SEQ ID NO: 389030 - DNA, 25 bp, Mus musculus
gacccggaaatcacgcatctgattg

SEQ ID NO: 389031 - DNA, 25 bp, Mus musculus
cccgatggattcgaagccgtccaga

SEQ ID NO: 389032 - DNA, 25 bp, Mus musculus
aggaaagacccggaaatcacgcatc

SEQ ID NO: 389033 - DNA, 25 bp, Mus musculus
ctatctggtgagcagttacaggaaa

SEQ ID NO: 389034 - DNA, 25 bp, Mus musculus
ggatccacatcatgccttccatgaa

SEQ ID NO: 389035 - DNA, 25 bp, Mus musculus
aactgctgctccacctgatcgacta

SEQ ID NO: 389036 - DNA, 25 bp, Mus musculus
ctcttttgcacgcagactgtagggc

SEQ ID NO: 389037 - DNA, 25 bp, Mus musculus
gccgcattcctcttttgcacgcaga

SEQ ID NO: 389038 - DNA, 25 bp, Mus musculus
ttaataataataaccgccgcattcc

SEQ ID NO: 389039 - DNA, 25 bp, Mus musculus
cggagtcgttttcttattcctgacg

SEQ ID NO: 389040 - DNA, 25 bp, Mus musculus
tgacagcacccggatccacatcatg

SEQ ID NO: 389041 - DNA, 25 bp, Mus musculus
tgatcgactatctggtgagcagtta

SEQ ID NO: 389042 - DNA, 25 bp, Mus musculus
aaccgtctgggaccacgagctcctt

SEQ ID NO: 389043 - DNA, 25 bp, Mus musculus
tccggtctccgagaagcctttacga

SEQ ID NO: 389044 - DNA, 25 bp, Mus musculus
ggtcttgcggaactcacctctcctg

SEQ ID NO: 389045 - DNA, 25 bp, Mus musculus
ctccaagcaggacaatcggtaatta

SEQ ID NO: 389046 - DNA, 25 bp, Mus musculus
ccgcttttccgcgtgttctcagacg

SEQ ID NO: 389047 - DNA, 25 bp, Mus musculus
tcagagcctctagtgtgcgtgcgct

SEQ ID NO: 389048 - DNA, 25 bp, Mus musculus
agctccttcgagagtgccctgccta

SEQ ID NO: 389049 - DNA, 25 bp, Mus musculus
cggccattgaccacctagcatcatg

SEQ ID NO: 389050 - DNA, 25 bp, Mus musculus
ttcttctgtgctggaggtgtctcat

SEQ ID NO: 389051 - DNA, 25 bp, Mus musculus
gtgtctcatgtgttttgctgcccga

SEQ ID NO: 389052 - DNA, 25 bp, Mus musculus
aggactcctggctttcggcacatcc

SEQ ID NO: 389053 - DNA, 25 bp, Mus musculus
cgttgtgctctatgaccctcaggta

SEQ ID NO: 389054 - DNA, 25 bp, Mus musculus
cggtccagcacactccaggggtgta

SEQ ID NO: 389055 - DNA, 25 bp, Mus musculus
ggtctgccaagaccgatccgctttt

SEQ ID NO: 389056 - DNA, 25 bp, Mus musculus
agcgcttggcccacggctacggctt

SEQ ID NO: 389057 - DNA, 25 bp, Mus musculus
aggccgcacggaactgaaagctctc

SEQ ID NO: 389058 - DNA, 25 bp, Mus musculus
gtccaggtgtcccttgatcagcgct

SEQ ID NO: 389059 - DNA, 25 bp, Mus musculus
gtcccttgatcagcgctgggctgtg

SEQ ID NO: 389060 - DNA, 25 bp, Mus musculus
gatgaccgatgaccgcagagtgcgc

SEQ ID NO: 389061 - DNA, 25 bp, Mus musculus
cagagtgcgcgaccgggtcctgtcc

SEQ ID NO: 389062 - DNA, 25 bp, Mus musculus
gtcctgtcccaggtgggcaaaggcc

SEQ ID NO: 389063 - DNA, 25 bp, Mus musculus
ggaactgaaagctctccgtgagtca

SEQ ID NO: 389064 - DNA, 25 bp, Mus musculus
ctctccgtgagtcagcgagcttcga

SEQ ID NO: 389065 - DNA, 25 bp, Mus musculus
cggggttcagccctggcgaaatcgc

SEQ ID NO: 389066 - DNA, 25 bp, Mus musculus
gcgaaatcgcctgccttgctcactt

SEQ ID NO: 389067 - DNA, 25 bp, Mus musculus
ccgcagacttcaggcgcgatccatg

SEQ ID NO: 389068 - DNA, 25 bp, Mus musculus
acggcttgcgcagcatgagcgagct

SEQ ID NO: 389069 - DNA, 25 bp, Mus musculus
tggacggtctggatcccgcagactt

SEQ ID NO: 389070 - DNA, 25 bp, Mus musculus
gccctgaaagatgccggggtcagaa

SEQ ID NO: 389071 - DNA, 25 bp, Mus musculus
acgctgcgcaaacgactctcgcatt

SEQ ID NO: 389072 - DNA, 25 bp, Mus musculus
gctgttcacattccgcgaggacctg

SEQ ID NO: 389073 - DNA, 25 bp, Mus musculus
gacgacaccgatcctttcaacagca

SEQ ID NO: 389074 - DNA, 25 bp, Mus musculus
tcgcgtgcagttcttggacgacacc

SEQ ID NO: 389075 - DNA, 25 bp, Mus musculus
atcatggccacgctggcttgtcgcg

SEQ ID NO: 389076 - DNA, 25 bp, Mus musculus
ggtccggtgcccagtaaaccgagca

SEQ ID NO: 389077 - DNA, 25 bp, Mus musculus
cgggcgccgcacaaggtaagaaccg

SEQ ID NO: 389078 - DNA, 25 bp, Mus musculus
agcacccagaagcaggcgcacgact

SEQ ID NO: 389079 - DNA, 25 bp, Mus musculus
acgactctctttggctggcgggaag

SEQ ID NO: 389080 - DNA, 25 bp, Mus musculus
ttgcgttaggatctccgtggcctct

SEQ ID NO: 389081 - DNA, 25 bp, Mus musculus
ggcctctccgttagctcggcctggt

SEQ ID NO: 389082 - DNA, 25 bp, Mus musculus
gtcagaagctctgttgggcctccct

SEQ ID NO: 389083 - DNA, 25 bp, Mus musculus
tctacgccctagtgcagatctttgg

SEQ ID NO: 389084 - DNA, 25 bp, Mus musculus
tcaaggtgcggcttgctgccggctt

SEQ ID NO: 389085 - DNA, 25 bp, Mus musculus
tagggtcaacttctcaaggtgcggc

SEQ ID NO: 389086 - DNA, 25 bp, Mus musculus
ggggcgttgtctcctccatggcacg

SEQ ID NO: 389087 - DNA, 25 bp, Mus musculus
gttgtagttttcagcgcctgagggc

SEQ ID NO: 389088 - DNA, 25 bp, Mus musculus
cctccagtggcggttgtttcaagat

SEQ ID NO: 389089 - DNA, 25 bp, Mus musculus
ttctggagccgcgactgtatccttt

SEQ ID NO: 389090 - DNA, 25 bp, Mus musculus
gcgaggctttatgtggtccagagaa

SEQ ID NO: 389091 - DNA, 25 bp, Mus musculus
tttatgtggtccagagaagcgtggc

SEQ ID NO: 389092 - DNA, 25 bp, Mus musculus
ctaggggcgggcctttccacttcag

SEQ ID NO: 389093 - DNA, 25 bp, Mus musculus
ctttccacttcaggctgggtgcccg

SEQ ID NO: 389094 - DNA, 25 bp, Mus musculus
atcacctggcgacgacgtgtctcta

SEQ ID NO: 389095 - DNA, 25 bp, Mus musculus
acgacgtgtctctaggtgggaattc

SEQ ID NO: 389096 - DNA, 25 bp, Mus musculus
tgggaattctggctcaacgggtaac

SEQ ID NO: 389097 - DNA, 25 bp, Mus musculus
cgagtgacgcctagggtcaacttct

SEQ ID NO: 389098 - DNA, 25 bp, Mus musculus
tgctaaccaacaccggcagatagac

SEQ ID NO: 389099 - DNA, 25 bp, Mus musculus
ctaagcacacacctcgcgatgagtg

SEQ ID NO: 389100 - DNA, 25 bp, Mus musculus
ctcagaaggcgacgggtccatccaa

SEQ ID NO: 389101 - DNA, 25 bp, Mus musculus
gcgatgagtgctgtacgacttccta

SEQ ID NO: 389102 - DNA, 25 bp, Mus musculus
atgtcgagcaccttccactaccgtt

SEQ ID NO: 389103 - DNA, 25 bp, Mus musculus
cctcgccactgtgggaaacttccta

SEQ ID NO: 389104 - DNA, 25 bp, Mus musculus
gccatggttacctgtgcgagtcctg

SEQ ID NO: 389105 - DNA, 25 bp, Mus musculus
cgggcggaggagcttattgcacact

SEQ ID NO: 389106 - DNA, 25 bp, Mus musculus
tcgaagctcacgaagcctggcgaga

SEQ ID NO: 389107 - DNA, 25 bp, Mus musculus
ctggaagccgttcatggcctggatg

SEQ ID NO: 389108 - DNA, 25 bp, Mus musculus
ttgagcctcttcatgcctatctgga

SEQ ID NO: 389109 - DNA, 25 bp, Mus musculus
tctttgggccgcttcagctgcacct

SEQ ID NO: 389110 - DNA, 25 bp, Mus musculus
ctcagtacgggcgattggcgtcttt

SEQ ID NO: 389111 - DNA, 25 bp, Mus musculus
cttcctagggatgtcgagcaccttc

SEQ ID NO: 389112 - DNA, 25 bp, Mus musculus
ccctgctggatgctcttgggaacaa

SEQ ID NO: 389113 - DNA, 25 bp, Mus musculus
cacgctcgcagtaggtgaggaaagc

SEQ ID NO: 389114 - DNA, 25 bp, Mus musculus
gtcttctgctcgtgcagcgcgctct

SEQ ID NO: 389115 - DNA, 25 bp, Mus musculus
gtgcgctttagctgcacctgggctc

SEQ ID NO: 389116 - DNA, 25 bp, Mus musculus
aggcatcgcccgacagtgctcagct

SEQ ID NO: 389117 - DNA, 25 bp, Mus musculus
gggccaaggcgcgatagtttatcaa

SEQ ID NO: 389118 - DNA, 25 bp, Mus musculus
gaacaaggcgagcatcggaggcatc

SEQ ID NO: 389119 - DNA, 25 bp, Mus musculus
ctatcgcggccggaggctaggcaac

SEQ ID NO: 389120 - DNA, 25 bp, Mus musculus
ataaaccgcggtgatctcactggcg

SEQ ID NO: 389121 - DNA, 25 bp, Mus musculus
cgctgactcacgctcgcagtaggtg

SEQ ID NO: 389122 - DNA, 25 bp, Mus musculus
tggctccttaaataaaccgcggtga

SEQ ID NO: 389123 - DNA, 25 bp, Mus musculus
gctctgggccttcagcgctgactca

SEQ ID NO: 389124 - DNA, 25 bp, Mus musculus
cgcgcagaagctataaaccagggcc

SEQ ID NO: 389125 - DNA, 25 bp, Mus musculus
caaagacgagggctggctccttaaa

SEQ ID NO: 389126 - DNA, 25 bp, Mus musculus
aggcaccgtgcagctgcagattcta

SEQ ID NO: 389127 - DNA, 25 bp, Mus musculus
ttgaaccaggcggtaggcaagctct

SEQ ID NO: 389128 - DNA, 25 bp, Mus musculus
aactgcctgggcttcttcgccctgg

SEQ ID NO: 389129 - DNA, 25 bp, Mus musculus
tacaccgctgccaagaactgcctgg

SEQ ID NO: 389130 - DNA, 25 bp, Mus musculus
cctgcggcgaagtccggccaagttt

SEQ ID NO: 389131 - DNA, 25 bp, Mus musculus
cccggcttgtaacaaaggcaccgtg

SEQ ID NO: 389132 - DNA, 25 bp, Mus musculus
tgtttcagcacatggagtacccggc

SEQ ID NO: 389133 - DNA, 25 bp, Mus musculus
gctactgcccggtgctgtttcagca

SEQ ID NO: 389134 - DNA, 25 bp, Mus musculus
ctttgcgtgcctaccaaggcgggaa

SEQ ID NO: 389135 - DNA, 25 bp, Mus musculus
ctcagtcctcgggatggctttgcgt

SEQ ID NO: 389136 - DNA, 25 bp, Mus musculus
aattcggaggcagcaccgggccaca

SEQ ID NO: 389137 - DNA, 25 bp, Mus musculus
gaagtcgcgatcctgcctaggaggc

SEQ ID NO: 389138 - DNA, 25 bp, Mus musculus
cggaactgtgatgctgctgaccggc

SEQ ID NO: 389139 - DNA, 25 bp, Mus musculus
ggcgcaggagggaacacaatttcaa

SEQ ID NO: 389140 - DNA, 25 bp, Mus musculus
gcgttgtcagcctgtccgtttgcta

SEQ ID NO: 389141 - DNA, 25 bp, Mus musculus
gcttccatcggctgttcgcctcaaa

SEQ ID NO: 389142 - DNA, 25 bp, Mus musculus
aggtccttctcatccaggtttcggg

SEQ ID NO: 389143 - DNA, 25 bp, Mus musculus
ccgtctctctcttgtcagtcgctgg

SEQ ID NO: 389144 - DNA, 25 bp, Mus musculus
ctttgtgcatgcctgtgaacctgtc

SEQ ID NO: 389145 - DNA, 25 bp, Mus musculus
tgtccttcagaaccgtaagctcgta

SEQ ID NO: 389146 - DNA, 25 bp, Mus musculus
taagctcgtagatcttgccgaactc

SEQ ID NO: 389147 - DNA, 25 bp, Mus musculus
tcgaagaggggcttgaggtccttct

SEQ ID NO: 389148 - DNA, 25 bp, Mus musculus
ccttcatgggaatggtcgacgggtt

SEQ ID NO: 389149 - DNA, 25 bp, Mus musculus
cgggctgtggcttaatccgttcata

SEQ ID NO: 389150 - DNA, 25 bp, Mus musculus
aatccgttcatatgcccggcgctgc

SEQ ID NO: 389151 - DNA, 25 bp, Mus musculus
ggctgctgcctagcccgttggtact

SEQ ID NO: 389152 - DNA, 25 bp, Mus musculus
ttggtactgaggctcgcgttgtcag

SEQ ID NO: 389153 - DNA, 25 bp, Mus musculus
tctgcccaatgaacagcttgatggc

SEQ ID NO: 389154 - DNA, 25 bp, Mus musculus
gggcgcttttctctcccatctggct

SEQ ID NO: 389155 - DNA, 25 bp, Mus musculus
gccctcgttttgtttaactgtagca

SEQ ID NO: 389156 - DNA, 25 bp, Mus musculus
gacttttcccgtccggagagcggca

SEQ ID NO: 389157 - DNA, 25 bp, Mus musculus
aattcagctcggttctccgtcccag

SEQ ID NO: 389158 - DNA, 25 bp, Mus musculus
ggctgcgtcagagtctcagggaata

SEQ ID NO: 389159 - DNA, 25 bp, Mus musculus
gacaccggatccacctgagagcacg

SEQ ID NO: 389160 - DNA, 25 bp, Mus musculus
ctgccagagcagaacccaaattttt

SEQ ID NO: 389161 - DNA, 25 bp, Mus musculus
tagcgcgcgctctttctgtatctcg

SEQ ID NO: 389162 - DNA, 25 bp, Mus musculus
actaccggatccagaggtgcgaagc

SEQ ID NO: 389163 - DNA, 25 bp, Mus musculus
gtccgcccagttagctgagtatcca

SEQ ID NO: 389164 - DNA, 25 bp, Mus musculus
atccacttagctgcgctctgttagg

SEQ ID NO: 389165 - DNA, 25 bp, Mus musculus
gtggctctcggtctcttcttttcgc

SEQ ID NO: 389166 - DNA, 25 bp, Mus musculus
gtgcctgttagctaccgtggctctc

SEQ ID NO: 389167 - DNA, 25 bp, Mus musculus
tctatagtcaggagctctagcgcgc

SEQ ID NO: 389168 - DNA, 25 bp, Mus musculus
ttcctggagtcttcctcctcgcggg

SEQ ID NO: 389169 - DNA, 25 bp, Mus musculus
cggaacaggaagttttcatgttttg

SEQ ID NO: 389170 - DNA, 25 bp, Mus musculus
ctttcgttaggtgcggggattgctc

SEQ ID NO: 389171 - DNA, 25 bp, Mus musculus
tgcagcggcggtttcttcctggagt

SEQ ID NO: 389172 - DNA, 25 bp, Mus musculus
tacatctacagctgtgacctggaca

SEQ ID NO: 389173 - DNA, 25 bp, Mus musculus
ggcggagaagttccactacatctac

SEQ ID NO: 389174 - DNA, 25 bp, Mus musculus
tgacctggacatcaacgtgcagctg

SEQ ID NO: 389175 - DNA, 25 bp, Mus musculus
tcatgttttgatgcagcggcggttt

SEQ ID NO: 389176 - DNA, 25 bp, Mus musculus
ctccttgaagggaatcggcagaaca

SEQ ID NO: 389177 - DNA, 25 bp, Mus musculus
tcggcagaacaacccacggcgaagc

SEQ ID NO: 389178 - DNA, 25 bp, Mus musculus
gagccctttgcgtgttccgcttttg

SEQ ID NO: 389179 - DNA, 25 bp, Mus musculus
aacgtgcagctgaagatgtgagagc

SEQ ID NO: 389180 - DNA, 25 bp, Mus musculus
tgttccgcttttgtgggaataccgc

SEQ ID NO: 389181 - DNA, 25 bp, Mus musculus
tgttccgtcgcgtttgctttcgtta

SEQ ID NO: 389182 - DNA, 25 bp, Mus musculus
cgctcctctggggagctccctagcg

SEQ ID NO: 389183 - DNA, 25 bp, Mus musculus
aaaaagccgctgattgctgcaatcg

SEQ ID NO: 389184 - DNA, 25 bp, Mus musculus
tgctctggcgggacacctcggcgcc

SEQ ID NO: 389185 - DNA, 25 bp, Mus musculus
cacactcttcgcctttgtcttgcaa

SEQ ID NO: 389186 - DNA, 25 bp, Mus musculus
ggccgctcctgtgaactgcctgccc

SEQ ID NO: 389187 - DNA, 25 bp, Mus musculus
gggtacttttcaatgcagcgccgca

SEQ ID NO: 389188 - DNA, 25 bp, Mus musculus
acttttcaatgcagcgccgcagctc

SEQ ID NO: 389189 - DNA, 25 bp, Mus musculus
gccgcagctccctccagatttgtaa

SEQ ID NO: 389190 - DNA, 25 bp, Mus musculus
cgcagctccctccagatttgtaatc

SEQ ID NO: 389191 - DNA, 25 bp, Mus musculus
agctccctccagatttgtaatccgc

SEQ ID NO: 389192 - DNA, 25 bp, Mus musculus
cctccagatttgtaatccgccaaaa

SEQ ID NO: 389193 - DNA, 25 bp, Mus musculus
ttgtaatccgccaaaaagccgctga

SEQ ID NO: 389194 - DNA, 25 bp, Mus musculus
ttcgcctttgtcttgcaaccggacc

SEQ ID NO: 389195 - DNA, 25 bp, Mus musculus
taatccgccaaaaagccgctgattg

SEQ ID NO: 389196 - DNA, 25 bp, Mus musculus
ccagctggagacatgtcaggactta

SEQ ID NO: 389197 - DNA, 25 bp, Mus musculus
cccacggagcgggtacctgctactt

SEQ ID NO: 389198 - DNA, 25 bp, Mus musculus
gagtccgggaccaggcacctgtcac

SEQ ID NO: 389199 - DNA, 25 bp, Mus musculus
gcgagctgtcccttacctggaggcc

SEQ ID NO: 389200 - DNA, 25 bp, Mus musculus
cccgttaacaaagcagagttctgtg

SEQ ID NO: 389201 - DNA, 25 bp, Mus musculus
ctcgcccagcagacggctgcggaaa

SEQ ID NO: 389202 - DNA, 25 bp, Mus musculus
agaacgccggaagccacgggccatc

SEQ ID NO: 389203 - DNA, 25 bp, Mus musculus
cccacaggaagagctgagtcaactc

SEQ ID NO: 389204 - DNA, 25 bp, Mus musculus
tgcaaaacgacgtcggcgagctgtc

SEQ ID NO: 389205 - DNA, 25 bp, Mus musculus
accatggtcgctccagagctcgagc

SEQ ID NO: 389206 - DNA, 25 bp, Mus musculus
gtcaggacttagctcctccgacagc

SEQ ID NO: 389207 - DNA, 25 bp, Mus musculus
ccgcagaatgacatcagggcccagc

SEQ ID NO: 389208 - DNA, 25 bp, Mus musculus
gacgccggacgtgtcccaacttgac

SEQ ID NO: 389209 - DNA, 25 bp, Mus musculus
gacgccgcctcctggaccaatagga

SEQ ID NO: 389210 - DNA, 25 bp, Mus musculus
cacaaatcgcgtgccgaggaggctc

SEQ ID NO: 389211 - DNA, 25 bp, Mus musculus
ctgacaaccggaagtcacggctaga

SEQ ID NO: 389212 - DNA, 25 bp, Mus musculus
atcgaagccctcagggcgccgcgga

SEQ ID NO: 389213 - DNA, 25 bp, Mus musculus
aagggccgccgaaagccggatcatc

SEQ ID NO: 389214 - DNA, 25 bp, Mus musculus
tgaaccgaaggagcgcgcatggaaa

SEQ ID NO: 389215 - DNA, 25 bp, Mus musculus
cagttccgtccctgaaccgaaggag

SEQ ID NO: 389216 - DNA, 25 bp, Mus musculus
ggcgtcgtcacccagtggcccagtt

SEQ ID NO: 389217 - DNA, 25 bp, Mus musculus
taggagcacgtgactccgccctggc

SEQ ID NO: 389218 - DNA, 25 bp, Mus musculus
ctcctttcagggcagaggacgaaag

SEQ ID NO: 389219 - DNA, 25 bp, Mus musculus
aacccggaagtcctaggagcacgtg

SEQ ID NO: 389220 - DNA, 25 bp, Mus musculus
cccggagagagcacaaatcgcgtgc

SEQ ID NO: 389221 - DNA, 25 bp, Mus musculus
cgcggatgtcacctagtgcggtgac

SEQ ID NO: 389222 - DNA, 25 bp, Mus musculus
gcacgccgtaggaagggctcttttc

SEQ ID NO: 389223 - DNA, 25 bp, Mus musculus
tgcgcgtccggagactgacaaccgg

SEQ ID NO: 389224 - DNA, 25 bp, Mus musculus
ggagcccgaggacattagccctaaa

SEQ ID NO: 389225 - DNA, 25 bp, Mus musculus
accgactgttgtcctgttccctgca

SEQ ID NO: 389226 - DNA, 25 bp, Mus musculus
gtcgtagccagtaagcgaaagtctc

SEQ ID NO: 389227 - DNA, 25 bp, Mus musculus
ttaaagtgactctccacatccgggc

SEQ ID NO: 389228 - DNA, 25 bp, Mus musculus
gttccgaattgcgttccctccgtgc

SEQ ID NO: 389229 - DNA, 25 bp, Mus musculus
caactgcggattggtgctggataca

SEQ ID NO: 389230 - DNA, 25 bp, Mus musculus
cctagaggcctcttcggctccaaga

SEQ ID NO: 389231 - DNA, 25 bp, Mus musculus
cttcttgccagggatcgcctatctc

SEQ ID NO: 389232 - DNA, 25 bp, Mus musculus
tagccctaaagacggagagcacaca

SEQ ID NO: 389233 - DNA, 25 bp, Mus musculus
agagcaagctctagacggcgtggcc

SEQ ID NO: 389234 - DNA, 25 bp, Mus musculus
tttagcaagctaggcagagcagtta

SEQ ID NO: 389235 - DNA, 25 bp, Mus musculus
tgcggtcctcattccagctctttag

SEQ ID NO: 389236 - DNA, 25 bp, Mus musculus
ggagtttggcttctggagcagttta

SEQ ID NO: 389237 - DNA, 25 bp, Mus musculus
gatcgcctatctctcccttctattg

SEQ ID NO: 389238 - DNA, 25 bp, Mus musculus
agcccagtagatgtcaggttttccc

SEQ ID NO: 389239 - DNA, 25 bp, Mus musculus
agctgaactggttgggctcctcacc

SEQ ID NO: 389240 - DNA, 25 bp, Mus musculus
ccacctaggcgcatggctccatgaa

SEQ ID NO: 389241 - DNA, 25 bp, Mus musculus
tcaccgactcgctagaggacgtttg

SEQ ID NO: 389242 - DNA, 25 bp, Mus musculus
cacccgtcttgggactctgcttttt

SEQ ID NO: 389243 - DNA, 25 bp, Mus musculus
ggatctctatggttctcaccgactc

SEQ ID NO: 389244 - DNA, 25 bp, Mus musculus
ttttcccggagagactcgctcactg

SEQ ID NO: 389245 - DNA, 25 bp, Mus musculus
agcagttgtagcctcagtgcctgaa

SEQ ID NO: 389246 - DNA, 25 bp, Mus musculus
gctttctcttgccaggccttctcga

SEQ ID NO: 389247 - DNA, 25 bp, Mus musculus
ctgctcagttccgaggcggacagta

SEQ ID NO: 389248 - DNA, 25 bp, Mus musculus
gtttggtccactggaggactcccta

SEQ ID NO: 389249 - DNA, 25 bp, Mus musculus
tcacgtgaccaatgggcggtcctcc

SEQ ID NO: 389250 - DNA, 25 bp, Mus musculus
tcctcccagagcttcgggatctcta

SEQ ID NO: 389251 - DNA, 25 bp, Mus musculus
gcctatacactaagcagcgccaatc

SEQ ID NO: 389252 - DNA, 25 bp, Mus musculus
ttgtaggagcccaccctcgcggctt

SEQ ID NO: 389253 - DNA, 25 bp, Mus musculus
gaccggaagccgctaggacagcacc

SEQ ID NO: 389254 - DNA, 25 bp, Mus musculus
gcagtgtagaccctgtccgacctgc

SEQ ID NO: 389255 - DNA, 25 bp, Mus musculus
gtccgacctgcccttctccgccctc

SEQ ID NO: 389256 - DNA, 25 bp, Mus musculus
cgcctccgagctggattggttcctt

SEQ ID NO: 389257 - DNA, 25 bp, Mus musculus
ctccgagctggattggttcctttcc

SEQ ID NO: 389258 - DNA, 25 bp, Mus musculus
tggttcctttccttgtaggagccca

SEQ ID NO: 389259 - DNA, 25 bp, Mus musculus
accctcgcggcttccgtctccggcg

SEQ ID NO: 389260 - DNA, 25 bp, Mus musculus
ctgtggcggcacgtcctaaagtaat

SEQ ID NO: 389261 - DNA, 25 bp, Mus musculus
tggcggcacgtcctaaagtaatggc

SEQ ID NO: 389262 - DNA, 25 bp, Mus musculus
cggcacgtcctaaagtaatggcggc

SEQ ID NO: 389263 - DNA, 25 bp, Mus musculus
cacgtcctaaagtaatggcggcggg

SEQ ID NO: 389264 - DNA, 25 bp, Mus musculus
cgatcctcgggctggcgacgtagaa

SEQ ID NO: 389265 - DNA, 25 bp, Mus musculus
agctggattggttcctttccttgta

SEQ ID NO: 389266 - DNA, 25 bp, Mus musculus
atggcggctgcatctttgaaggaga

SEQ ID NO: 389267 - DNA, 25 bp, Mus musculus
gtaagtccgccgtggcacccgtgag

SEQ ID NO: 389268 - DNA, 25 bp, Mus musculus
ggcgggtcgcgctccgccattttcg

SEQ ID NO: 389269 - DNA, 25 bp, Mus musculus
aggccgtgaggcaacctaacctagg

SEQ ID NO: 389270 - DNA, 25 bp, Mus musculus
ctgcatctttgaaggagaggaattg

SEQ ID NO: 389271 - DNA, 25 bp, Mus musculus
gaggcaacctaacctaggcccagct

SEQ ID NO: 389272 - DNA, 25 bp, Mus musculus
cacctgcgcgcatgctctattcgag

SEQ ID NO: 389273 - DNA, 25 bp, Mus musculus
tgctctattcgagccctacggtaga

SEQ ID NO: 389274 - DNA, 25 bp, Mus musculus
ctacggtagacctgcggcacaggcg

SEQ ID NO: 389275 - DNA, 25 bp, Mus musculus
agagacgttccctgcggcgccaaag

SEQ ID NO: 389276 - DNA, 25 bp, Mus musculus
cgctcggtggctcctcgggtaagat

SEQ ID NO: 389277 - DNA, 25 bp, Mus musculus
cgccgtgaggccgtgatgacgcaca

SEQ ID NO: 389278 - DNA, 25 bp, Mus musculus
cgtgatgacgcacaggcgtacgctc

SEQ ID NO: 389279 - DNA, 25 bp, Mus musculus
ccgcaaagacgcgaagttcggagga

SEQ ID NO: 389280 - DNA, 25 bp, Mus musculus
gggctgacacttccggggtttgtca

SEQ ID NO: 389281 - DNA, 25 bp, Mus musculus
cctcgagactgggactgtcacaccg

SEQ ID NO: 389282 - DNA, 25 bp, Mus musculus
cgccggtgcatcagttcttgacatc

SEQ ID NO: 389283 - DNA, 25 bp, Mus musculus
ttgacatccgcttcaagcgcacgga

SEQ ID NO: 389284 - DNA, 25 bp, Mus musculus
agtccagttggtgccttgtccttgt

SEQ ID NO: 389285 - DNA, 25 bp, Mus musculus
ggagtgtccctagcctggctggttt

SEQ ID NO: 389286 - DNA, 25 bp, Mus musculus
ctggtttcctcttcctcgagactgg

SEQ ID NO: 389287 - DNA, 25 bp, Mus musculus
ccagtcccgcgatttaggcgaccga

SEQ ID NO: 389288 - DNA, 25 bp, Mus musculus
aggagcccgatcaacgcgtagagca

SEQ ID NO: 389289 - DNA, 25 bp, Mus musculus
gcggctacctgtgcgcaagcgccga

SEQ ID NO: 389290 - DNA, 25 bp, Mus musculus
gccgtcagcaccgtactgcgcagga

SEQ ID NO: 389291 - DNA, 25 bp, Mus musculus
agcaccgagcccagcgaccagagga

SEQ ID NO: 389292 - DNA, 25 bp, Mus musculus
agatccgccatctcggacccgagtg

SEQ ID NO: 389293 - DNA, 25 bp, Mus musculus
ccctgcttcaggtagtcttgcagct

SEQ ID NO: 389294 - DNA, 25 bp, Mus musculus
ctgtagaacggaactgcccagcacc

SEQ ID NO: 389295 - DNA, 25 bp, Mus musculus
cgcgactatggccacgcgcaagacg

SEQ ID NO: 389296 - DNA, 25 bp, Mus musculus
cgactatggccacgcgcaagacgaa

SEQ ID NO: 389297 - DNA, 25 bp, Mus musculus
taggtccaccgccatctttcggcgg

SEQ ID NO: 389298 - DNA, 25 bp, Mus musculus
tatggccacgcgcaagacgaatgcc

SEQ ID NO: 389299 - DNA, 25 bp, Mus musculus
tggccacgcgcaagacgaatgccct

SEQ ID NO: 389300 - DNA, 25 bp, Mus musculus
ggccacgcgcaagacgaatgccctt

SEQ ID NO: 389301 - DNA, 25 bp, Mus musculus
ttcccggggctactgcgagcgagat

SEQ ID NO: 389302 - DNA, 25 bp, Mus musculus
ctactgcgagcgagatggccacggc

SEQ ID NO: 389303 - DNA, 25 bp, Mus musculus
tgcgagcgagatggccacggcggcc

SEQ ID NO: 389304 - DNA, 25 bp, Mus musculus
gcgccggccctgctctaggtccacc

SEQ ID NO: 389305 - DNA, 25 bp, Mus musculus
cagcaccgcgcgattcctacagccg

SEQ ID NO: 389306 - DNA, 25 bp, Mus musculus
tctgtagaacggaactgcccagcac

SEQ ID NO: 389307 - DNA, 25 bp, Mus musculus
aactgcccagcaccgcgcgattcct

SEQ ID NO: 389308 - DNA, 25 bp, Mus musculus
gacgagtaccgaggctgctcgcccg

SEQ ID NO: 389309 - DNA, 25 bp, Mus musculus
gcgactacacctaccgcgactatgg

SEQ ID NO: 389310 - DNA, 25 bp, Mus musculus
tatggcggccgcgacagctaccgca

SEQ ID NO: 389311 - DNA, 25 bp, Mus musculus
agtaccgaggctgctcgcccgacgg

SEQ ID NO: 389312 - DNA, 25 bp, Mus musculus
gacagctaccgcagcgagcgctact

SEQ ID NO: 389313 - DNA, 25 bp, Mus musculus
atgacgagtaccgaggctgctcgcc

SEQ ID NO: 389314 - DNA, 25 bp, Mus musculus
gctatgacgagtaccgaggctgctc

SEQ ID NO: 389315 - DNA, 25 bp, Mus musculus
ccgctatgacgagtaccgaggctgc

SEQ ID NO: 389316 - DNA, 25 bp, Mus musculus
ggccgctatgacgagtaccgaggct

SEQ ID NO: 389317 - DNA, 25 bp, Mus musculus
cttcgacagctacggggacccgcgt

SEQ ID NO: 389318 - DNA, 25 bp, Mus musculus
ctagcggaggctcctaccgcgaccc

SEQ ID NO: 389319 - DNA, 25 bp, Mus musculus
agcatcctagcggaggctcctaccg

SEQ ID NO: 389320 - DNA, 25 bp, Mus musculus
acgaatgcccttcccggggctactg

SEQ ID NO: 389321 - DNA, 25 bp, Mus musculus
ctgctcgcccgacggctatggcggc

SEQ ID NO: 389322 - DNA, 25 bp, Mus musculus
ctgtacttccggtcagcgaggcctc

SEQ ID NO: 389323 - DNA, 25 bp, Mus musculus
ctccgccgctttgccgggtctccct

SEQ ID NO: 389324 - DNA, 25 bp, Mus musculus
cttcctccgccgctttgccgggtct

SEQ ID NO: 389325 - DNA, 25 bp, Mus musculus
tccggtcagcgaggcctcttcctcc

SEQ ID NO: 389326 - DNA, 25 bp, Mus musculus
tacttccggtcagcgaggcctcttc

SEQ ID NO: 389327 - DNA, 25 bp, Mus musculus
tgctcgctgtacttccggtcagcga

SEQ ID NO: 389328 - DNA, 25 bp, Mus musculus
aggtgctcgctgtacttccggtcag

SEQ ID NO: 389329 - DNA, 25 bp, Mus musculus
cgtaggtgctcgctgtacttccggt

SEQ ID NO: 389330 - DNA, 25 bp, Mus musculus
ccgcgtaggtgctcgctgtacttcc

SEQ ID NO: 389331 - DNA, 25 bp, Mus musculus
cgccgcaccgcttcgccgaggctcg

SEQ ID NO: 389332 - DNA, 25 bp, Mus musculus
cccttccgcgtaggtgctcgctgta

SEQ ID NO: 389333 - DNA, 25 bp, Mus musculus
cagctccgttgaggccaccgcgctg

SEQ ID NO: 389334 - DNA, 25 bp, Mus musculus
cttccgcgtaggtgctcgctgtact

SEQ ID NO: 389335 - DNA, 25 bp, Mus musculus
cttcgccgaggctcgcgagccggga

SEQ ID NO: 389336 - DNA, 25 bp, Mus musculus
attgggcggtagatcacgcagagtc

SEQ ID NO: 389337 - DNA, 25 bp, Mus musculus
cttcccggaatgcacgtatggcttg

SEQ ID NO: 389338 - DNA, 25 bp, Mus musculus
agtcccgcggaggaagcctgaccca

SEQ ID NO: 389339 - DNA, 25 bp, Mus musculus
cgcaagtgtgctgcaggactcttcc

SEQ ID NO: 389340 - DNA, 25 bp, Mus musculus
cctgacccaccaaggaggcagagta

SEQ ID NO: 389341 - DNA, 25 bp, Mus musculus
ggcagagtagaaatcctaagtaccc

SEQ ID NO: 389342 - DNA, 25 bp, Mus musculus
cgatgagcgcgagcagagacaaata

SEQ ID NO: 389343 - DNA, 25 bp, Mus musculus
gacaaataatgcaggctcccgcctc

SEQ ID NO: 389344 - DNA, 25 bp, Mus musculus
gttcttcctgtgacggcgcaagtgt

SEQ ID NO: 389345 - DNA, 25 bp, Mus musculus
ttcaggatcccggtagcccagcgaa

SEQ ID NO: 389346 - DNA, 25 bp, Mus musculus
gcacgcgcatttgagttctcgaaga

SEQ ID NO: 389347 - DNA, 25 bp, Mus musculus
gcccagcgaaggtagcctgtgagca

SEQ ID NO: 389348 - DNA, 25 bp, Mus musculus
tgtgagcatgcgcaagaagtgacgc

SEQ ID NO: 389349 - DNA, 25 bp, Mus musculus
aagaagtgacgcatgcgcccaagca

SEQ ID NO: 389350 - DNA, 25 bp, Mus musculus
gatcgcgggatccacggaagactca

SEQ ID NO: 389351 - DNA, 25 bp, Mus musculus
tgacctggcagacctgcagtggccc

SEQ ID NO: 389352 - DNA, 25 bp, Mus musculus
gacaaggactggtgctgacctggca

SEQ ID NO: 389353 - DNA, 25 bp, Mus musculus
ggcccgaggatcttcagcgacccaa

SEQ ID NO: 389354 - DNA, 25 bp, Mus musculus
cagcgcaagcccacgcagtagatcg

SEQ ID NO: 389355 - DNA, 25 bp, Mus musculus
cggaagactcacagacattgacgtg

SEQ ID NO: 389356 - DNA, 25 bp, Mus musculus
gacgtgtggcttgtagtccagaaca

SEQ ID NO: 389357 - DNA, 25 bp, Mus musculus
tgtagtccagaacagccaatcggta

SEQ ID NO: 389358 - DNA, 25 bp, Mus musculus
ccaatcggtaagaagcaagcggccg

SEQ ID NO: 389359 - DNA, 25 bp, Mus musculus
tacttccgcacctttactccggtga

SEQ ID NO: 389360 - DNA, 25 bp, Mus musculus
tttactccggtgactgtggtccgct

SEQ ID NO: 389361 - DNA, 25 bp, Mus musculus
cgccgcgatcagcagggcgtctgca

SEQ ID NO: 389362 - DNA, 25 bp, Mus musculus
gcgtctgcagccgagacaaggactg

SEQ ID NO: 389363 - DNA, 25 bp, Mus musculus
ggccgcctcggacctgatgtgtccg

SEQ ID NO: 389364 - DNA, 25 bp, Mus musculus
cgacttactgggaggcgcagattcc

SEQ ID NO: 389365 - DNA, 25 bp, Mus musculus
ccaggtgaccacgaagtgcaccagg

SEQ ID NO: 389366 - DNA, 25 bp, Mus musculus
ccacgaagtgcaccagggtcaggct

SEQ ID NO: 389367 - DNA, 25 bp, Mus musculus
cgcagccacgtgattccgccgcgca

SEQ ID NO: 389368 - DNA, 25 bp, Mus musculus
ctccgctgggttgcttaactcggct

SEQ ID NO: 389369 - DNA, 25 bp, Mus musculus
cttaactcggctggagggaagccct

SEQ ID NO: 389370 - DNA, 25 bp, Mus musculus
gcccttggctcccagggaagattag

SEQ ID NO: 389371 - DNA, 25 bp, Mus musculus
agattagtttctgtggccgattccc

SEQ ID NO: 389372 - DNA, 25 bp, Mus musculus
gccagttttactctccacgttgctg

SEQ ID NO: 389373 - DNA, 25 bp, Mus musculus
ctctccacgttgctgagctgtttta

SEQ ID NO: 389374 - DNA, 25 bp, Mus musculus
acgttgctgagctgttttaatcctc

SEQ ID NO: 389375 - DNA, 25 bp, Mus musculus
ttttaatcctctgaaggggggcaga

SEQ ID NO: 389376 - DNA, 25 bp, Mus musculus
aggggggcagagcattacttactga

SEQ ID NO: 389377 - DNA, 25 bp, Mus musculus
ggctcccagggaagattagtttctg

SEQ ID NO: 389378 - DNA, 25 bp, Mus musculus
tcccagtagtgagaaaccctgctgc

SEQ ID NO: 389379 - DNA, 25 bp, Mus musculus
ggccagagcctagactcccagtagt

SEQ ID NO: 389380 - DNA, 25 bp, Mus musculus
ctctcgccgatgatgagtatcttca

SEQ ID NO: 389381 - DNA, 25 bp, Mus musculus
gtatcttcagagtggtcagcacgtc

SEQ ID NO: 389382 - DNA, 25 bp, Mus musculus
agtggtcagcacgtcctcgtccatc

SEQ ID NO: 389383 - DNA, 25 bp, Mus musculus
tcagcgctgccctgtgtcggcaaag

SEQ ID NO: 389384 - DNA, 25 bp, Mus musculus
cagctgaggctacagagcgtctggt

SEQ ID NO: 389385 - DNA, 25 bp, Mus musculus
acagagcgtctggttccgcccagaa

SEQ ID NO: 389386 - DNA, 25 bp, Mus musculus
ttccgcccagaagtggctctgcgtc

SEQ ID NO: 389387 - DNA, 25 bp, Mus musculus
ctctgcgtctgcgtactccctggag

SEQ ID NO: 389388 - DNA, 25 bp, Mus musculus
gtactccctggagcgcaggcgtttt

SEQ ID NO: 389389 - DNA, 25 bp, Mus musculus
tgtaaatcctcctacggccttccag

SEQ ID NO: 389390 - DNA, 25 bp, Mus musculus
gcaggcgtttttccgcgtggctcct

SEQ ID NO: 389391 - DNA, 25 bp, Mus musculus
ggcagagctgctgtaaatcctccta

SEQ ID NO: 389392 - DNA, 25 bp, Mus musculus
gttagcggaagagatccctttcatc

SEQ ID NO: 389393 - DNA, 25 bp, Mus musculus
cagcgtctctccaagcacaccaagt

SEQ ID NO: 389394 - DNA, 25 bp, Mus musculus
aagcagcagcgtctctccaagcaca

SEQ ID NO: 389395 - DNA, 25 bp, Mus musculus
tgagagacaggcttcctgtcccggc

SEQ ID NO: 389396 - DNA, 25 bp, Mus musculus
tcacagaaatgagagacaggcttcc

SEQ ID NO: 389397 - DNA, 25 bp, Mus musculus
gccctcgcgtcacagaaatgagaga

SEQ ID NO: 389398 - DNA, 25 bp, Mus musculus
cgctgccctcgcgtcacagaaatga

SEQ ID NO: 389399 - DNA, 25 bp, Mus musculus
tgctgttctcgtggaaagccgctgc

SEQ ID NO: 389400 - DNA, 25 bp, Mus musculus
caaaattgctgttctcgtggaaagc

SEQ ID NO: 389401 - DNA, 25 bp, Mus musculus
cgtcgacacaaaattgctgttctcg

SEQ ID NO: 389402 - DNA, 25 bp, Mus musculus
gcatctatttggcaacgtcgacaca

SEQ ID NO: 389403 - DNA, 25 bp, Mus musculus
ccacgcatctatttggcaacgtcga

SEQ ID NO: 389404 - DNA, 25 bp, Mus musculus
ggaagagatccctttcatctccacg

SEQ ID NO: 389405 - DNA, 25 bp, Mus musculus
ttcatctccacgcatctatttggca

SEQ ID NO: 389406 - DNA, 25 bp, Mus musculus
gaggccatctgctccgcgatgcagc

SEQ ID NO: 389407 - DNA, 25 bp, Mus musculus
ctctccacggtggacgaggccatct

SEQ ID NO: 389408 - DNA, 25 bp, Mus musculus
tgatgcttcctgctcggccagttta

SEQ ID NO: 389409 - DNA, 25 bp, Mus musculus
ttagtcctgtgggacccgagttcca

SEQ ID NO: 389410 - DNA, 25 bp, Mus musculus
gaccagaatccgcaaaaggccctgc

SEQ ID NO: 389411 - DNA, 25 bp, Mus musculus
ccaagccagtgattgcagtaggatc

SEQ ID NO: 389412 - DNA, 25 bp, Mus musculus
agtaggatccctgtttccctgctcc

SEQ ID NO: 389413 - DNA, 25 bp, Mus musculus
cctactgagtttgtgtgttgacgca

SEQ ID NO: 389414 - DNA, 25 bp, Mus musculus
tgacgcacaaggttcgcgctgcttc

SEQ ID NO: 389415 - DNA, 25 bp, Mus musculus
gactgtggaaacatggctgctgcca

SEQ ID NO: 389416 - DNA, 25 bp, Mus musculus
gctgctgccatagcggcctcggcat

SEQ ID NO: 389417 - DNA, 25 bp, Mus musculus
tgtgtagccgtagcatcttggcatc

SEQ ID NO: 389418 - DNA, 25 bp, Mus musculus
catcccagggatccggatcaggtga

SEQ ID NO: 389419 - DNA, 25 bp, Mus musculus
agctgctgggccacgaaactctcca

SEQ ID NO: 389420 - DNA, 25 bp, Mus musculus
gccgccgtctgcagactcggtaaga

SEQ ID NO: 389421 - DNA, 25 bp, Mus musculus
ggtgtcagagactgcccaaggtcgc

SEQ ID NO: 389422 - DNA, 25 bp, Mus musculus
agacccagactgtgcccgtagggta

SEQ ID NO: 389423 - DNA, 25 bp, Mus musculus
gggcaaaatgcctccactcgggacg

SEQ ID NO: 389424 - DNA, 25 bp, Mus musculus
tggattcactcaccgcgtgggtttg

SEQ ID NO: 389425 - DNA, 25 bp, Mus musculus
ctgtgcggtaacagcgggtaccctt

SEQ ID NO: 389426 - DNA, 25 bp, Mus musculus
cgcgggtgtcattcttaagagtgtg

SEQ ID NO: 389427 - DNA, 25 bp, Mus musculus
tgattaggcgtgactccttggtccc

SEQ ID NO: 389428 - DNA, 25 bp, Mus musculus
ccctgaccagtaggagtgtcaactc

SEQ ID NO: 389429 - DNA, 25 bp, Mus musculus
acgccgagcgttctccaggctcttt

SEQ ID NO: 389430 - DNA, 25 bp, Mus musculus
tgcagtatagccttcgggacacacc

SEQ ID NO: 389431 - DNA, 25 bp, Mus musculus
ggacacacccttggcgcagagactt

SEQ ID NO: 389432 - DNA, 25 bp, Mus musculus
cgcagagacttaagtgttttgcacc

SEQ ID NO: 389433 - DNA, 25 bp, Mus musculus
ctcggcagtaggaaggatgctcgca

SEQ ID NO: 389434 - DNA, 25 bp, Mus musculus
ctgtgacggcctgcccactgcccgc

SEQ ID NO: 389435 - DNA, 25 bp, Mus musculus
caacttcggcttaggatctgagccc

SEQ ID NO: 389436 - DNA, 25 bp, Mus musculus
cttcggcttaggatctgagcccgcc

SEQ ID NO: 389437 - DNA, 25 bp, Mus musculus
tcggcttaggatctgagcccgccct

SEQ ID NO: 389438 - DNA, 25 bp, Mus musculus
ccgccctccggccagtgcagctcac

SEQ ID NO: 389439 - DNA, 25 bp, Mus musculus
agtgcagctcactccagcttcgaaa

SEQ ID NO: 389440 - DNA, 25 bp, Mus musculus
tgcagctcactccagcttcgaaata

SEQ ID NO: 389441 - DNA, 25 bp, Mus musculus
gctcactccagcttcgaaataccgg

SEQ ID NO: 389442 - DNA, 25 bp, Mus musculus
tcactccagcttcgaaataccggag

SEQ ID NO: 389443 - DNA, 25 bp, Mus musculus
tccagcttcgaaataccggagtggg

SEQ ID NO: 389444 - DNA, 25 bp, Mus musculus
agcttcgaaataccggagtgggtgt

SEQ ID NO: 389445 - DNA, 25 bp, Mus musculus
cgaaataccggagtgggtgtggcct

SEQ ID NO: 389446 - DNA, 25 bp, Mus musculus
gctcaacttcggcttaggatctgag

SEQ ID NO: 389447 - DNA, 25 bp, Mus musculus
tgtggcctgtgacggcctgcccact

SEQ ID NO: 389448 - DNA, 25 bp, Mus musculus
gcggcctttagaaacgcctcccata

SEQ ID NO: 389449 - DNA, 25 bp, Mus musculus
gatgcatcggtttgtagtcccgcga

SEQ ID NO: 389450 - DNA, 25 bp, Mus musculus
cccttaaatcgtcccatgatgcatc

SEQ ID NO: 389451 - DNA, 25 bp, Mus musculus
atccatcgcgcctggcttcggtttt

SEQ ID NO: 389452 - DNA, 25 bp, Mus musculus
ccggccagataacgcacggtggcta

SEQ ID NO: 389453 - DNA, 25 bp, Mus musculus
gcactgcatcctgccgtgggctcga

SEQ ID NO: 389454 - DNA, 25 bp, Mus musculus
gggtagaggacgcacactcagcatc

SEQ ID NO: 389455 - DNA, 25 bp, Mus musculus
acaggcccatgggtagtttgcagcc

SEQ ID NO: 389456 - DNA, 25 bp, Mus musculus
gggcacatgtctgggcacaggccca

SEQ ID NO: 389457 - DNA, 25 bp, Mus musculus
tggctccacctccagtcggtgcagg

SEQ ID NO: 389458 - DNA, 25 bp, Mus musculus
cggctgtactccttcactgtgcgct

SEQ ID NO: 389459 - DNA, 25 bp, Mus musculus
aaccgaagccttcctgcacctgagt

SEQ ID NO: 389460 - DNA, 25 bp, Mus musculus
aggcggtcggccacaaagctcgcca

SEQ ID NO: 389461 - DNA, 25 bp, Mus musculus
tgcagcgacagatctagccgcactg

SEQ ID NO: 389462 - DNA, 25 bp, Mus musculus
tcgagaccctgggattccgacccta

SEQ ID NO: 389463 - DNA, 25 bp, Mus musculus
gcgccaaggcctacacccgtagatg

SEQ ID NO: 389464 - DNA, 25 bp, Mus musculus
aggcagcgtgacgtccgagtcacca

SEQ ID NO: 389465 - DNA, 25 bp, Mus musculus
cgcagtgatactggagtcccaagtc

SEQ ID NO: 389466 - DNA, 25 bp, Mus musculus
gtcccaagtctaggccgggccttga

SEQ ID NO: 389467 - DNA, 25 bp, Mus musculus
cgtgacgcaccaccggcaataggta

SEQ ID NO: 389468 - DNA, 25 bp, Mus musculus
accgctctagcgctcggaggataca

SEQ ID NO: 389469 - DNA, 25 bp, Mus musculus
ctcggaggatacagcatgagcagcc

SEQ ID NO: 389470 - DNA, 25 bp, Mus musculus
ggcgactttgaagcctgctgcgtta

SEQ ID NO: 389471 - DNA, 25 bp, Mus musculus
cctgctgcgttaacccttgtcggga

SEQ ID NO: 389472 - DNA, 25 bp, Mus musculus
cggatgccagacagaggctgacttt

SEQ ID NO: 389473 - DNA, 25 bp, Mus musculus
ggctgactttctcgagcagtatctc

SEQ ID NO: 389474 - DNA, 25 bp, Mus musculus
tatctcgtctgggtagggagtagcc

SEQ ID NO: 389475 - DNA, 25 bp, Mus musculus
ggacctgtggccaaccgagtccacg

SEQ ID NO: 389476 - DNA, 25 bp, Mus musculus
gcagaaagtcaagcgtggccacctt

SEQ ID NO: 389477 - DNA, 25 bp, Mus musculus
agcgacaagtgtggctgtcagcgcc

SEQ ID NO: 389478 - DNA, 25 bp, Mus musculus
cgtgacgctcagaagttaggtgttc

SEQ ID NO: 389479 - DNA, 25 bp, Mus musculus
agcgcttcgaggctgaggtaaccgc

SEQ ID NO: 389480 - DNA, 25 bp, Mus musculus
cctttctgaggtgctggaggaaccc

SEQ ID NO: 389481 - DNA, 25 bp, Mus musculus
cagtcttttgacttcgacgtcctct

SEQ ID NO: 389482 - DNA, 25 bp, Mus musculus
gaccgacgagaacctgagtccctgg

SEQ ID NO: 389483 - DNA, 25 bp, Mus musculus
ccgagttcagaggagaccgacgaga

SEQ ID NO: 389484 - DNA, 25 bp, Mus musculus
tgcacatcaagctaaaggccgagtt

SEQ ID NO: 389485 - DNA, 25 bp, Mus musculus
ccaaggcttcgcttgtgcacatcaa

SEQ ID NO: 389486 - DNA, 25 bp, Mus musculus
ttggcgggaagttccaaggcttcgc

SEQ ID NO: 389487 - DNA, 25 bp, Mus musculus
gcgcaggcttcagttttgtgaaacc

SEQ ID NO: 389488 - DNA, 25 bp, Mus musculus
ttaggtgttcttgcgcaggcttcag

SEQ ID NO: 389489 - DNA, 25 bp, Mus musculus
aaccctagtcagtgtgcgagcgaca

SEQ ID NO: 389490 - DNA, 25 bp, Mus musculus
ctcggcagatatcccgggactcaga

SEQ ID NO: 389491 - DNA, 25 bp, Mus musculus
gaccctagaggttgcctcggtggaa

SEQ ID NO: 389492 - DNA, 25 bp, Mus musculus
tcaagggtccttagcggtggttctg

SEQ ID NO: 389493 - DNA, 25 bp, Mus musculus
tccttagcggtggttctgccgctcg

SEQ ID NO: 389494 - DNA, 25 bp, Mus musculus
gcgaccctcggcagatatcccggga

SEQ ID NO: 389495 - DNA, 25 bp, Mus musculus
cgccgaccctagaggttgcctcggt

SEQ ID NO: 389496 - DNA, 25 bp, Mus musculus
atatcccgggactcagatcagcgcg

SEQ ID NO: 389497 - DNA, 25 bp, Mus musculus
ccgggactcagatcagcgcggtgca

SEQ ID NO: 389498 - DNA, 25 bp, Mus musculus
gctcgctgcgcaccggcacccgccg

SEQ ID NO: 389499 - DNA, 25 bp, Mus musculus
gccgcccagctgctcaggatgacat

SEQ ID NO: 389500 - DNA, 25 bp, Mus musculus
ccagctgctcaggatgacatcaagt

SEQ ID NO: 389501 - DNA, 25 bp, Mus musculus
tcaggatgacatcaagtcacctccc

SEQ ID NO: 389502 - DNA, 25 bp, Mus musculus
gggtgctggagcatgcccccagctc

SEQ ID NO: 389503 - DNA, 25 bp, Mus musculus
ctcggtggaagagacgacggttcaa

SEQ ID NO: 389504 - DNA, 25 bp, Mus musculus
gtggccatggtcgaactgtgtgaaa

SEQ ID NO: 389505 - DNA, 25 bp, Mus musculus
aactgtgtgaaagagcgtgtctgcc

SEQ ID NO: 389506 - DNA, 25 bp, Mus musculus
cgagatgtcacgatggctgtggcca

SEQ ID NO: 389507 - DNA, 25 bp, Mus musculus
agcacagccggaccgagatcgccgg

SEQ ID NO: 389508 - DNA, 25 bp, Mus musculus
tcgcccttcgcaatgaccaatggca

SEQ ID NO: 389509 - DNA, 25 bp, Mus musculus
tcccactcagaatttacgcgcaagc

SEQ ID NO: 389510 - DNA, 25 bp, Mus musculus
actgtcgccctacggttgcagcctt

SEQ ID NO: 389511 - DNA, 25 bp, Mus musculus
agcctttccgcagcttgaagcaagg

SEQ ID NO: 389512 - DNA, 25 bp, Mus musculus
catttcatctcgcaaagagcccagt

SEQ ID NO: 389513 - DNA, 25 bp, Mus musculus
ccagtccctttttcgctcttcaagg

SEQ ID NO: 389514 - DNA, 25 bp, Mus musculus
gaggttaaaggtcctcccactcaga

SEQ ID NO: 389515 - DNA, 25 bp, Mus musculus
tacgcgcaagcgtaaactacgattg

SEQ ID NO: 389516 - DNA, 25 bp, Mus musculus
cgcagcttgaagcaaggaggttaaa

SEQ ID NO: 389517 - DNA, 25 bp, Mus musculus
actacgattgggagcatttcatctc

SEQ ID NO: 389518 - DNA, 25 bp, Mus musculus
gacgtctgggctgaactgtcagtgc

SEQ ID NO: 389519 - DNA, 25 bp, Mus musculus
tcagcgttcttgtttgcggttcagc

SEQ ID NO: 389520 - DNA, 25 bp, Mus musculus
acctggactttaggaatctgttgaa

SEQ ID NO: 389521 - DNA, 25 bp, Mus musculus
tctgggaagccggaagtctataacc

SEQ ID NO: 389522 - DNA, 25 bp, Mus musculus
gcgcatgcgcgactttcgtctccag

SEQ ID NO: 389523 - DNA, 25 bp, Mus musculus
agaaacaatgttcccgctcggcgca

SEQ ID NO: 389524 - DNA, 25 bp, Mus musculus
ggctaagccagtcccagagaaacaa

SEQ ID NO: 389525 - DNA, 25 bp, Mus musculus
aactctttgactgcagcctggccgc

SEQ ID NO: 389526 - DNA, 25 bp, Mus musculus
cgcctagaaccttgcaactctttga

SEQ ID NO: 389527 - DNA, 25 bp, Mus musculus
atggcttcagcggtctccgcctaga

SEQ ID NO: 389528 - DNA, 25 bp, Mus musculus
caggactgacctgtccatggcttca

SEQ ID NO: 389529 - DNA, 25 bp, Mus musculus
ttacgtcgctaacaggcgagagccc

SEQ ID NO: 389530 - DNA, 25 bp, Mus musculus
ggccctgagctcgaactgcttcatt

SEQ ID NO: 389531 - DNA, 25 bp, Mus musculus
cggttcagcgccactttacgggatc

SEQ ID NO: 389532 - DNA, 25 bp, Mus musculus
cggagcaaaacaggtgcggttgcca

SEQ ID NO: 389533 - DNA, 25 bp, Mus musculus
cgcagccacgagctcgcgatatttg

SEQ ID NO: 389534 - DNA, 25 bp, Mus musculus
taccaaaggcctccggagccattgc

SEQ ID NO: 389535 - DNA, 25 bp, Mus musculus
cccagcgcgaggataccaaaggcct

SEQ ID NO: 389536 - DNA, 25 bp, Mus musculus
tcggcaacgccttcctcaacaggta

SEQ ID NO: 389537 - DNA, 25 bp, Mus musculus
ttcatccgccacctgatcgagcagg

SEQ ID NO: 389538 - DNA, 25 bp, Mus musculus
ggacgctgacttcgacaacaagccg

SEQ ID NO: 389539 - DNA, 25 bp, Mus musculus
agctgtacgcgcagaagctgctgcc

SEQ ID NO: 389540 - DNA, 25 bp, Mus musculus
gccgcaagaaggagccggagctctt

SEQ ID NO: 389541 - DNA, 25 bp, Mus musculus
tccggcatcatgttcagctgggtga

SEQ ID NO: 389542 - DNA, 25 bp, Mus musculus
gcttattataaaggggcggctcgac

SEQ ID NO: 389543 - DNA, 25 bp, Mus musculus
ggagcactatcgcttccacgagttc

SEQ ID NO: 389544 - DNA, 25 bp, Mus musculus
gccatccctcgaggggcggagcaaa

SEQ ID NO: 389545 - DNA, 25 bp, Mus musculus
caacaagccgatggtgctcctggtc

SEQ ID NO: 389546 - DNA, 25 bp, Mus musculus
taggctctgtctaggttagtgtctc

SEQ ID NO: 389547 - DNA, 25 bp, Mus musculus
cgccgctttcaaaccgaggccagag

SEQ ID NO: 389548 - DNA, 25 bp, Mus musculus
aaccgaggccagagcggactacaac

SEQ ID NO: 389549 - DNA, 25 bp, Mus musculus
tacaactcccatccggcttcagggc

SEQ ID NO: 389550 - DNA, 25 bp, Mus musculus
ggtgcaccaagagctcagcagcgcc

SEQ ID NO: 389551 - DNA, 25 bp, Mus musculus
gaagttgcgctaggctctgtctagg

SEQ ID NO: 389552 - DNA, 25 bp, Mus musculus
ttagtgtctcatgagggtctaggtg

SEQ ID NO: 389553 - DNA, 25 bp, Mus musculus
caccgtgatcagaggggccttttgc

SEQ ID NO: 389554 - DNA, 25 bp, Mus musculus
ctcccacttcctggacgagggtcgg

SEQ ID NO: 389555 - DNA, 25 bp, Mus musculus
aagccgcgcagaacgagccacggga

SEQ ID NO: 389556 - DNA, 25 bp, Mus musculus
acgagccacgggaccacagacggac

SEQ ID NO: 389557 - DNA, 25 bp, Mus musculus
gctccagcggcagccatggagcagc

SEQ ID NO: 389558 - DNA, 25 bp, Mus musculus
tcgacggcctcctggatctgctgct

SEQ ID NO: 389559 - DNA, 25 bp, Mus musculus
tcccgcgggaagttgcgctaggctc

SEQ ID NO: 389560 - DNA, 25 bp, Mus musculus
gggtgccaagatcccggaatcccga

SEQ ID NO: 389561 - DNA, 25 bp, Mus musculus
ccgcagacatcttccaggtgggaga

SEQ ID NO: 389562 - DNA, 25 bp, Mus musculus
agtgctggccgcaagtcacgaagcc

SEQ ID NO: 389563 - DNA, 25 bp, Mus musculus
ccactgccggcgtctacgtggatag

SEQ ID NO: 389564 - DNA, 25 bp, Mus musculus
ccgtggagctcagcctcagcgagct

SEQ ID NO: 389565 - DNA, 25 bp, Mus musculus
acccttagcgctgggaactggtctg

SEQ ID NO: 389566 - DNA, 25 bp, Mus musculus
gctgctcaatgaggctgcaccctta

SEQ ID NO: 389567 - DNA, 25 bp, Mus musculus
caccagctccggtgcagagcctggg

SEQ ID NO: 389568 - DNA, 25 bp, Mus musculus
cgcatccgagagctgcaagcaccag

SEQ ID NO: 389569 - DNA, 25 bp, Mus musculus
agttctctgttaccagctgggccca

SEQ ID NO: 389570 - DNA, 25 bp, Mus musculus
tgtggcagtcaaacgccaagttctc

SEQ ID NO: 389571 - DNA, 25 bp, Mus musculus
tccagtgctctgtgtggcagtcaaa

SEQ ID NO: 389572 - DNA, 25 bp, Mus musculus
ttgcaggcccggactccagtgctct

SEQ ID NO: 389573 - DNA, 25 bp, Mus musculus
ttcgccctggacgaactggagagtg

SEQ ID NO: 389574 - DNA, 25 bp, Mus musculus
ttcctggctgtcaaccgtgtcatcc

SEQ ID NO: 389575 - DNA, 25 bp, Mus musculus
ttgtaaggaactagaaggccctata

SEQ ID NO: 389576 - DNA, 25 bp, Mus musculus
tctatcctcgagagggaggtgtttc

SEQ ID NO: 389577 - DNA, 25 bp, Mus musculus
attgctgccctctatgcccgattca

SEQ ID NO: 389578 - DNA, 25 bp, Mus musculus
aggccctatatagccttggttgaag

SEQ ID NO: 389579 - DNA, 25 bp, Mus musculus
tggtggcctcacctacttcccggtg

SEQ ID NO: 389580 - DNA, 25 bp, Mus musculus
agccgggactctccttgggacttgt

SEQ ID NO: 389581 - DNA, 25 bp, Mus musculus
cttcgtggagcatttcctggctgtc

SEQ ID NO: 389582 - DNA, 25 bp, Mus musculus
tgacctggtgctcctgtccttggtc

SEQ ID NO: 389583 - DNA, 25 bp, Mus musculus
tctgcgctctatcgacgacgtggtg

SEQ ID NO: 389584 - DNA, 25 bp, Mus musculus
aaggccgcccagaagacgctgttcc

SEQ ID NO: 389585 - DNA, 25 bp, Mus musculus
ttgggtttgccttctggacaggctc

SEQ ID NO: 389586 - DNA, 25 bp, Mus musculus
tgaagggtctcagaaaccgagccgc

SEQ ID NO: 389587 - DNA, 25 bp, Mus musculus
cggtggccgacctatccatcattgc

SEQ ID NO: 389588 - DNA, 25 bp, Mus musculus
tcaagctagacccaggtgtgggccc

SEQ ID NO: 389589 - DNA, 25 bp, Mus musculus
caggatccgcgggaccgcttcgagc

SEQ ID NO: 389590 - DNA, 25 bp, Mus musculus
gggaccgcttcgagctgctacagcg

SEQ ID NO: 389591 - DNA, 25 bp, Mus musculus
cgcttcgagctgctacagcgtgtgg

SEQ ID NO: 389592 - DNA, 25 bp, Mus musculus
gccgggacctatggcgacgtttaca

SEQ ID NO: 389593 - DNA, 25 bp, Mus musculus
cctatggcgacgtttacaaggtgcg

SEQ ID NO: 389594 - DNA, 25 bp, Mus musculus
cgacgtttacaaggtgcgctgagcg

SEQ ID NO: 389595 - DNA, 25 bp, Mus musculus
caggaggagggtgcatcttcacgtc

SEQ ID NO: 389596 - DNA, 25 bp, Mus musculus
gagggtgcatcttcacgtcccgccg

SEQ ID NO: 389597 - DNA, 25 bp, Mus musculus
gtgacaccgtcacgtccgaactggc

SEQ ID NO: 389598 - DNA, 25 bp, Mus musculus
tcacgtccgaactggccgcggtgaa

SEQ ID NO: 389599 - DNA, 25 bp, Mus musculus
aactggccgcggtgaagatcgtcaa

SEQ ID NO: 389600 - DNA, 25 bp, Mus musculus
ccgcggtgaagatcgtcaagctaga

SEQ ID NO: 389601 - DNA, 25 bp, Mus musculus
cgggacgtgtcgctgcaggatccgc

SEQ ID NO: 389602 - DNA, 25 bp, Mus musculus
tctgcatcagcaggcctcgtctgga

SEQ ID NO: 389603 - DNA, 25 bp, Mus musculus
cacaaaggggaagtcaggtacgccg

SEQ ID NO: 389604 - DNA, 25 bp, Mus musculus
gaggtctccgaggatctgcatcagc

SEQ ID NO: 389605 - DNA, 25 bp, Mus musculus
cgtctggaacgcctccgaggtttca

SEQ ID NO: 389606 - DNA, 25 bp, Mus musculus
agccactgccttgtccatctcggag

SEQ ID NO: 389607 - DNA, 25 bp, Mus musculus
tgtccatctcggaggctctacctgg

SEQ ID NO: 389608 - DNA, 25 bp, Mus musculus
gctttgcaagggcagtcccaggcct

SEQ ID NO: 389609 - DNA, 25 bp, Mus musculus
gtcccggacgtctgggacatgctgc

SEQ ID NO: 389610 - DNA, 25 bp, Mus musculus
agcgctgccggcagctgctagcacg

SEQ ID NO: 389611 - DNA, 25 bp, Mus musculus
tagcacggaccactgcccggttacg

SEQ ID NO: 389612 - DNA, 25 bp, Mus musculus
gcgttgctctacacgctgcgttcta

SEQ ID NO: 389613 - DNA, 25 bp, Mus musculus
acgctgcgttctagtcgcctggttg

SEQ ID NO: 389614 - DNA, 25 bp, Mus musculus
tccgaggtttcagcagccactgcct

SEQ ID NO: 389615 - DNA, 25 bp, Mus musculus
agtcgcctggttgggagacacaaag

SEQ ID NO: 389616 - DNA, 25 bp, Mus musculus
actctggcctcagtccgcgcagtaa

SEQ ID NO: 389617 - DNA, 25 bp, Mus musculus
tcggccaatcccgacccatattgaa

SEQ ID NO: 389618 - DNA, 25 bp, Mus musculus
gctagccgttctctcacgtcacaga

SEQ ID NO: 389619 - DNA, 25 bp, Mus musculus
gtttcagccaatgagctagccgttc

SEQ ID NO: 389620 - DNA, 25 bp, Mus musculus
gaggcgcttacctccatcggtttca

SEQ ID NO: 389621 - DNA, 25 bp, Mus musculus
gtgctccaccaatcggaggccgctg

SEQ ID NO: 389622 - DNA, 25 bp, Mus musculus
ttcctgggcccagaggcagcttcaa

SEQ ID NO: 389623 - DNA, 25 bp, Mus musculus
aagcccagcctattggcgctcggga

SEQ ID NO: 389624 - DNA, 25 bp, Mus musculus
taaccacggccttgtccttagcggc

SEQ ID NO: 389625 - DNA, 25 bp, Mus musculus
gctcttttcagcgagggtcgcctcc

SEQ ID NO: 389626 - DNA, 25 bp, Mus musculus
caatcgtgtggcactacgacgccga

SEQ ID NO: 389627 - DNA, 25 bp, Mus musculus
gggaatcgtttcagccaatcgtgtg

SEQ ID NO: 389628 - DNA, 25 bp, Mus musculus
ttctccattctcgagcggctggctc

SEQ ID NO: 389629 - DNA, 25 bp, Mus musculus
cccatattgaaaagagccagtgctc

SEQ ID NO: 389630 - DNA, 25 bp, Mus musculus
gccctccacgcctctcttcccagcg

SEQ ID NO: 389631 - DNA, 25 bp, Mus musculus
ctgggactcagtcccttttccggtg

SEQ ID NO: 389632 - DNA, 25 bp, Mus musculus
ccagcgctgtgtccatactaggtca

SEQ ID NO: 389633 - DNA, 25 bp, Mus musculus
aggcttggcgccttcttggctccgc

SEQ ID NO: 389634 - DNA, 25 bp, Mus musculus
ggcggtgtctgggactcagtccctt

SEQ ID NO: 389635 - DNA, 25 bp, Mus musculus
gactcagtcccttttccggtgtcgc

SEQ ID NO: 389636 - DNA, 25 bp, Mus musculus
ttcccagcgctgtgtccatactagg

SEQ ID NO: 389637 - DNA, 25 bp, Mus musculus
tgtgtccatactaggtcagcggcca

SEQ ID NO: 389638 - DNA, 25 bp, Mus musculus
ccatactaggtcagcggccagctta

SEQ ID NO: 389639 - DNA, 25 bp, Mus musculus
aggtcagcggccagcttagttggtc

SEQ ID NO: 389640 - DNA, 25 bp, Mus musculus
gagtcggtactcgggccgaatcctc

SEQ ID NO: 389641 - DNA, 25 bp, Mus musculus
cgaatcctcccggactacggagctt

SEQ ID NO: 389642 - DNA, 25 bp, Mus musculus
ctacggagctttccccgctgtctgg

SEQ ID NO: 389643 - DNA, 25 bp, Mus musculus
caggtgcatcctctgtggggagaga

SEQ ID NO: 389644 - DNA, 25 bp, Mus musculus
tggaccaaaaccagctcgcattctg

SEQ ID NO: 389645 - DNA, 25 bp, Mus musculus
cactggaccaaaaccagctcgcatt

SEQ ID NO: 389646 - DNA, 25 bp, Mus musculus
aggccatcgcaaggatccgcagccc

SEQ ID NO: 389647 - DNA, 25 bp, Mus musculus
tttttgaggctccactggaccaaaa

SEQ ID NO: 389648 - DNA, 25 bp, Mus musculus
ttgaggctccactggaccaaaacca

SEQ ID NO: 389649 - DNA, 25 bp, Mus musculus
gaggctccactggaccaaaaccagc

SEQ ID NO: 389650 - DNA, 25 bp, Mus musculus
aggctccactggaccaaaaccagct

SEQ ID NO: 389651 - DNA, 25 bp, Mus musculus
gctttttgaggctccactggaccaa

SEQ ID NO: 389652 - DNA, 25 bp, Mus musculus
cccaggccatcgcaaggatccgcag

SEQ ID NO: 389653 - DNA, 25 bp, Mus musculus
tccgccgcccgcaggaagacgcccg

SEQ ID NO: 389654 - DNA, 25 bp, Mus musculus
caccgcagtccgcttcctgcccctc

SEQ ID NO: 389655 - DNA, 25 bp, Mus musculus
ccctcccggcttcctccgtgcgaca

SEQ ID NO: 389656 - DNA, 25 bp, Mus musculus
ggctttttgaggctccactggacca

SEQ ID NO: 389657 - DNA, 25 bp, Mus musculus
cttcctccgtgcgacacccaggcgg

SEQ ID NO: 389658 - DNA, 25 bp, Mus musculus
gcgggtcccaagagtgagtgagcga

SEQ ID NO: 389659 - DNA, 25 bp, Mus musculus
ggcattccggtgctcgcctgaaacg

SEQ ID NO: 389660 - DNA, 25 bp, Mus musculus
tccgcgctgcgggtcccaagagtga

SEQ ID NO: 389661 - DNA, 25 bp, Mus musculus
gcgtgggacacagagggtgcggccc

SEQ ID NO: 389662 - DNA, 25 bp, Mus musculus
ctagggatctcctaggggcaggctg

SEQ ID NO: 389663 - DNA, 25 bp, Mus musculus
ggaatctgcggtcctgggtgggaca

SEQ ID NO: 389664 - DNA, 25 bp, Mus musculus
tcctgggtgggacagagcttgcgga

SEQ ID NO: 389665 - DNA, 25 bp, Mus musculus
aggggatgaggcacttagagccacc

SEQ ID NO: 389666 - DNA, 25 bp, Mus musculus
gatgaggcacttagagccacccgca

SEQ ID NO: 389667 - DNA, 25 bp, Mus musculus
gaggcacttagagccacccgcagga

SEQ ID NO: 389668 - DNA, 25 bp, Mus musculus
cacttagagccacccgcaggagggg

SEQ ID NO: 389669 - DNA, 25 bp, Mus musculus
gcgttcgaggcattccggtgctcgc

SEQ ID NO: 389670 - DNA, 25 bp, Mus musculus
gggtgcggcccctagggatctccta

SEQ ID NO: 389671 - DNA, 25 bp, Mus musculus
gaggcattccggtgctcgcctgaaa

SEQ ID NO: 389672 - DNA, 25 bp, Mus musculus
gccttgacgtcaggcgttcagcctc

SEQ ID NO: 389673 - DNA, 25 bp, Mus musculus
gtccgacataatcggtgtcagcctc

SEQ ID NO: 389674 - DNA, 25 bp, Mus musculus
gacgtcaggcgttcagcctcgctct

SEQ ID NO: 389675 - DNA, 25 bp, Mus musculus
gtttggcggtgtcgccttgacgtca

SEQ ID NO: 389676 - DNA, 25 bp, Mus musculus
gggcctccgagtgcacagtcgccaa

SEQ ID NO: 389677 - DNA, 25 bp, Mus musculus
gtcgtgctcgcctcgcagtgggcct

SEQ ID NO: 389678 - DNA, 25 bp, Mus musculus
gctggctgggctgtccgacataatc

SEQ ID NO: 389679 - DNA, 25 bp, Mus musculus
ggtctcgtcgtgctcgcctcgcagt

SEQ ID NO: 389680 - DNA, 25 bp, Mus musculus
tcagcctcagcggagcgcatccgtt

SEQ ID NO: 389681 - DNA, 25 bp, Mus musculus
tcagcggagcgcatccgtttcgacc

SEQ ID NO: 389682 - DNA, 25 bp, Mus musculus
agctcaggggcttggaaacctctga

SEQ ID NO: 389683 - DNA, 25 bp, Mus musculus
aggggcttggaaacctctgacgcct

SEQ ID NO: 389684 - DNA, 25 bp, Mus musculus
ggctgctttccacgcctgactctgg

SEQ ID NO: 389685 - DNA, 25 bp, Mus musculus
ctgccctgcgtctcgttgctgcggt

SEQ ID NO: 389686 - DNA, 25 bp, Mus musculus
aggggcaacggcaggcaactccgcc

SEQ ID NO: 389687 - DNA, 25 bp, Mus musculus
ggccggaagcctctcagctagtcca

SEQ ID NO: 389688 - DNA, 25 bp, Mus musculus
cggaagcctctcagctagtccattt

SEQ ID NO: 389689 - DNA, 25 bp, Mus musculus
gaagcctctcagctagtccatttcc

SEQ ID NO: 389690 - DNA, 25 bp, Mus musculus
tctcagctagtccatttcccaacta

SEQ ID NO: 389691 - DNA, 25 bp, Mus musculus
catttcccaactagcgagttgcacc

SEQ ID NO: 389692 - DNA, 25 bp, Mus musculus
ttcccaactagcgagttgcaccatc

SEQ ID NO: 389693 - DNA, 25 bp, Mus musculus
aactagcgagttgcaccatcccggg

SEQ ID NO: 389694 - DNA, 25 bp, Mus musculus
tagcgagttgcaccatcccggggca

SEQ ID NO: 389695 - DNA, 25 bp, Mus musculus
gagttgcaccatcccggggcaggac

SEQ ID NO: 389696 - DNA, 25 bp, Mus musculus
accctagaggggcaacggcaggcaa

SEQ ID NO: 389697 - DNA, 25 bp, Mus musculus
ctagaggggcaacggcaggcaactc

SEQ ID NO: 389698 - DNA, 25 bp, Mus musculus
tgggccggaagcctctcagctagtc

SEQ ID NO: 389699 - DNA, 25 bp, Mus musculus
ggcaactccgcccatgcccagcagg

SEQ ID NO: 389700 - DNA, 25 bp, Mus musculus
ccagacctggcctgcggacccacgc

SEQ ID NO: 389701 - DNA, 25 bp, Mus musculus
tccaggagagtaactcgctacgccc

SEQ ID NO: 389702 - DNA, 25 bp, Mus musculus
gcttccatctgacccgccagacctg

SEQ ID NO: 389703 - DNA, 25 bp, Mus musculus
agaatcgcagcgcttccatctgacc

SEQ ID NO: 389704 - DNA, 25 bp, Mus musculus
ggaggccgcatgggcttcgtacaca

SEQ ID NO: 389705 - DNA, 25 bp, Mus musculus
cacccggtccacacgggaacactag

SEQ ID NO: 389706 - DNA, 25 bp, Mus musculus
agagtaactcgctacgcccggttgc

SEQ ID NO: 389707 - DNA, 25 bp, Mus musculus
cttctgctggcccacccggtccaca

SEQ ID NO: 389708 - DNA, 25 bp, Mus musculus
ccggttgcctgtcgccactgcaaag

SEQ ID NO: 389709 - DNA, 25 bp, Mus musculus
tgcctgtcgccactgcaaagctctg

SEQ ID NO: 389710 - DNA, 25 bp, Mus musculus
tgtcgccactgcaaagctctggtga

SEQ ID NO: 389711 - DNA, 25 bp, Mus musculus
cactgcaaagctctggtgagcgccc

SEQ ID NO: 389712 - DNA, 25 bp, Mus musculus
tggtgagcgccccactgcccagaat

SEQ ID NO: 389713 - DNA, 25 bp, Mus musculus
ccagctccgtgctgggaggccgcat

SEQ ID NO: 389714 - DNA, 25 bp, Mus musculus
ccgaggtccgctcaaagcggcgcga

SEQ ID NO: 389715 - DNA, 25 bp, Mus musculus
gcacatggtgttgctgacccgcgac

SEQ ID NO: 389716 - DNA, 25 bp, Mus musculus
gatgcaggtggccagcgacctgttc

SEQ ID NO: 389717 - DNA, 25 bp, Mus musculus
ccacactggatttggcggcaagttc

SEQ ID NO: 389718 - DNA, 25 bp, Mus musculus
cgacctgttcgtgggcggcatccct

SEQ ID NO: 389719 - DNA, 25 bp, Mus musculus
gcaccgtcaagtacgagccgccttt

SEQ ID NO: 389720 - DNA, 25 bp, Mus musculus
tgcgactgcagccacactggatttg

SEQ ID NO: 389721 - DNA, 25 bp, Mus musculus
acccgccacggttgcatggagatgc

SEQ ID NO: 389722 - DNA, 25 bp, Mus musculus
catggagatgcccagattaggtttt

SEQ ID NO: 389723 - DNA, 25 bp, Mus musculus
gcgagcaccggcgagctcagcttca

SEQ ID NO: 389724 - DNA, 25 bp, Mus musculus
ccgacgaccgctggcacatggtgtt

SEQ ID NO: 389725 - DNA, 25 bp, Mus musculus
tgcgcttcacgctgtcttgcgcgga

SEQ ID NO: 389726 - DNA, 25 bp, Mus musculus
cgctgctgctctacctggacgacgg

SEQ ID NO: 389727 - DNA, 25 bp, Mus musculus
aacggcggtctctgcaccgtgctag

SEQ ID NO: 389728 - DNA, 25 bp, Mus musculus
tgctcccgggagaccctgaagcagt

SEQ ID NO: 389729 - DNA, 25 bp, Mus musculus
acggagtcgagatctccggggcctg

SEQ ID NO: 389730 - DNA, 25 bp, Mus musculus
gggcgttgctcctttctgctcccgg

SEQ ID NO: 389731 - DNA, 25 bp, Mus musculus
cccgggagaccctgaagcagtgtgc

SEQ ID NO: 389732 - DNA, 25 bp, Mus musculus
accctgaagcagtgtgcgtcggccc

SEQ ID NO: 389733 - DNA, 25 bp, Mus musculus
cccttgtcgaaacgggggcatctgt

SEQ ID NO: 389734 - DNA, 25 bp, Mus musculus
ggcatctgtcgagagggctggaacc

SEQ ID NO: 389735 - DNA, 25 bp, Mus musculus
ggctggaaccggttcgtctgtgact

SEQ ID NO: 389736 - DNA, 25 bp, Mus musculus
tggaaccggttcgtctgtgactgca

SEQ ID NO: 389737 - DNA, 25 bp, Mus musculus
aaccggttcgtctgtgactgcatcg

SEQ ID NO: 389738 - DNA, 25 bp, Mus musculus
ttcgtctgtgactgcatcgggaccg

SEQ ID NO: 389739 - DNA, 25 bp, Mus musculus
ctgtgactgcatcgggaccggcttt

SEQ ID NO: 389740 - DNA, 25 bp, Mus musculus
tttctgggtcgggtctgcgagagag

SEQ ID NO: 389741 - DNA, 25 bp, Mus musculus
gctgtgggcgttgctcctttctgct

SEQ ID NO: 389742 - DNA, 25 bp, Mus musculus
gaggctcgggctctggttttccttc

SEQ ID NO: 389743 - DNA, 25 bp, Mus musculus
gagccgggcctctgtcgcttctgcg

SEQ ID NO: 389744 - DNA, 25 bp, Mus musculus
tagccgcccgcgatggatccaggct

SEQ ID NO: 389745 - DNA, 25 bp, Mus musculus
tggatccaggcttcacggaccttgg

SEQ ID NO: 389746 - DNA, 25 bp, Mus musculus
ccggcgggatccagttgatttgctt

SEQ ID NO: 389747 - DNA, 25 bp, Mus musculus
cgtgcccatcgccatcaaccgcatg

SEQ ID NO: 389748 - DNA, 25 bp, Mus musculus
atttgcttggctccggactgaggct

SEQ ID NO: 389749 - DNA, 25 bp, Mus musculus
ggctctggttttccttcgcttcacc

SEQ ID NO: 389750 - DNA, 25 bp, Mus musculus
cctctcggagctcgcaaccggaggg

SEQ ID NO: 389751 - DNA, 25 bp, Mus musculus
cgggtctcgtccagcctcagcacca

SEQ ID NO: 389752 - DNA, 25 bp, Mus musculus
ttctctggcctctgtcgggcagcag

SEQ ID NO: 389753 - DNA, 25 bp, Mus musculus
cggaatctcgcaggctcgcgccttt

SEQ ID NO: 389754 - DNA, 25 bp, Mus musculus
ttctagccctctcagcctctgcagc

SEQ ID NO: 389755 - DNA, 25 bp, Mus musculus
gttgatttgcttggctccggactga

SEQ ID NO: 389756 - DNA, 25 bp, Mus musculus
ttcctaggaggagagttaatattgc

SEQ ID NO: 389757 - DNA, 25 bp, Mus musculus
cgtagtctccgccaaagccaattga

SEQ ID NO: 389758 - DNA, 25 bp, Mus musculus
ggtgtgaggctgttgtttctctctc

SEQ ID NO: 389759 - DNA, 25 bp, Mus musculus
gaggtgatccgcgaatccagcagca

SEQ ID NO: 389760 - DNA, 25 bp, Mus musculus
tgcccattatcacggaggactcctt

SEQ ID NO: 389761 - DNA, 25 bp, Mus musculus
cgacgacagcgactgcgaggagccc

SEQ ID NO: 389762 - DNA, 25 bp, Mus musculus
cggggaggtctttgactccagcctc

SEQ ID NO: 389763 - DNA, 25 bp, Mus musculus
cacggacgacgaggacttttacact

SEQ ID NO: 389764 - DNA, 25 bp, Mus musculus
caacctcaggacagatggggccacg

SEQ ID NO: 389765 - DNA, 25 bp, Mus musculus
tgcccgcgggcaaaatgaaccaccg

SEQ ID NO: 389766 - DNA, 25 bp, Mus musculus
aatgaaccaccgagacccactgcag

SEQ ID NO: 389767 - DNA, 25 bp, Mus musculus
tcctctacgccatgtacaagtaccg

SEQ ID NO: 389768 - DNA, 25 bp, Mus musculus
agccgcagcccgcttaaagcgcagg

SEQ ID NO: 389769 - DNA, 25 bp, Mus musculus
gccaattgaaccgatttgggtgtga

SEQ ID NO: 389770 - DNA, 25 bp, Mus musculus
ccgccataggcgtgggcctgaatca

SEQ ID NO: 389771 - DNA, 25 bp, Mus musculus
aggaagtgcgtcacacatccgcagc

SEQ ID NO: 389772 - DNA, 25 bp, Mus musculus
cgcccactaaaggtgcgcgggcaca

SEQ ID NO: 389773 - DNA, 25 bp, Mus musculus
tccgttcctttgagctctgtcctcg

SEQ ID NO: 389774 - DNA, 25 bp, Mus musculus
agtggcgtgtccagggacctccgtt

SEQ ID NO: 389775 - DNA, 25 bp, Mus musculus
acatccgcagccagtggcgtgtcca

SEQ ID NO: 389776 - DNA, 25 bp, Mus musculus
cgggaccggcgcgacagaaacacac

SEQ ID NO: 389777 - DNA, 25 bp, Mus musculus
agccagacgggtcacctccggctgt

SEQ ID NO: 389778 - DNA, 25 bp, Mus musculus
tgccgctagcatcgcgggagccaga

SEQ ID NO: 389779 - DNA, 25 bp, Mus musculus
ccgccgagaaaatgccgtgccgcta

SEQ ID NO: 389780 - DNA, 25 bp, Mus musculus
tgaaacgcacagatacccgcacggg

SEQ ID NO: 389781 - DNA, 25 bp, Mus musculus
aatcagggcgggctcaccgtgccgc

SEQ ID NO: 389782 - DNA, 25 bp, Mus musculus
cgcgggcacagagaccggaaattta

SEQ ID NO: 389783 - DNA, 25 bp, Mus musculus
gtgccgctgctgaaacgcacagata

SEQ ID NO: 389784 - DNA, 25 bp, Mus musculus
gctgccgtcctgaagccacgagctg

SEQ ID NO: 389785 - DNA, 25 bp, Mus musculus
tccggagcttctgcttgcgcctctt

SEQ ID NO: 389786 - DNA, 25 bp, Mus musculus
ctcttggccagaggcgcattctcta

SEQ ID NO: 389787 - DNA, 25 bp, Mus musculus
aggcgcattctctacactcttgaga

SEQ ID NO: 389788 - DNA, 25 bp, Mus musculus
cttgagaaagaagccctcgcgcttg

SEQ ID NO: 389789 - DNA, 25 bp, Mus musculus
ttgcctcggttgaacgcctgggaaa

SEQ ID NO: 389790 - DNA, 25 bp, Mus musculus
cccgcctgattttggtttgctagtc

SEQ ID NO: 389791 - DNA, 25 bp, Mus musculus
tttgctagtcctcgccttggcgcgc

SEQ ID NO: 389792 - DNA, 25 bp, Mus musculus
tcctgcagtgcccagatcgacaagc

SEQ ID NO: 389793 - DNA, 25 bp, Mus musculus
tcaaaggcgggttccgcctaccagc

SEQ ID NO: 389794 - DNA, 25 bp, Mus musculus
agcggcccgcctcttaccatgaaag

SEQ ID NO: 389795 - DNA, 25 bp, Mus musculus
ttaccatgaaagtggcattgagccc

SEQ ID NO: 389796 - DNA, 25 bp, Mus musculus
cggaacgcacagctggcccagagga

SEQ ID NO: 389797 - DNA, 25 bp, Mus musculus
agaggactccagcacatccggcgtg

SEQ ID NO: 389798 - DNA, 25 bp, Mus musculus
agtgtcgtccgcgtacaagatgttc

SEQ ID NO: 389799 - DNA, 25 bp, Mus musculus
aagtcgatgatcttcaccggggccc

SEQ ID NO: 389800 - DNA, 25 bp, Mus musculus
acaagatgttctaccggaggggagc

SEQ ID NO: 389801 - DNA, 25 bp, Mus musculus
gcccagcataggtgccaggcagtcc

SEQ ID NO: 389802 - DNA, 25 bp, Mus musculus
acctcgggtttcaggtcgcggtgca

SEQ ID NO: 389803 - DNA, 25 bp, Mus musculus
tgcctcctcgtgcatgaagctcacg

SEQ ID NO: 389804 - DNA, 25 bp, Mus musculus
tgcatgaagctcacggccgaaacca

SEQ ID NO: 389805 - DNA, 25 bp, Mus musculus
gctccgaaggatctggctggcctcc

SEQ ID NO: 389806 - DNA, 25 bp, Mus musculus
cgcttcttgcggatgtgttccaata

SEQ ID NO: 389807 - DNA, 25 bp, Mus musculus
tgtgttccaatagctctccgcctcg

SEQ ID NO: 389808 - DNA, 25 bp, Mus musculus
ctccaggaccaggtaagtgtgtagc

SEQ ID NO: 389809 - DNA, 25 bp, Mus musculus
cgggatgcaaggcacgtcactacca

SEQ ID NO: 389810 - DNA, 25 bp, Mus musculus
ccgaaaccaggctccgaaggatctg

SEQ ID NO: 389811 - DNA, 25 bp, Mus musculus
tcgcgcgaacccgaagtcgatgatc

SEQ ID NO: 389812 - DNA, 25 bp, Mus musculus
gggcacgcacgcataggactttgca

SEQ ID NO: 389813 - DNA, 25 bp, Mus musculus
tgactcttgccacccgtccgggaga

SEQ ID NO: 389814 - DNA, 25 bp, Mus musculus
tgagcccagagggtcgctgactctt

SEQ ID NO: 389815 - DNA, 25 bp, Mus musculus
tcctcatgcccggtgaggttggctg

SEQ ID NO: 389816 - DNA, 25 bp, Mus musculus
agcagcgcgaagttctccacgctca

SEQ ID NO: 389817 - DNA, 25 bp, Mus musculus
tgcccagcaccttgagcagcgcgaa

SEQ ID NO: 389818 - DNA, 25 bp, Mus musculus
tgaaagcggtttctcacctcccgtg

SEQ ID NO: 389819 - DNA, 25 bp, Mus musculus
gcaccatgccagtgaaagcggtttc

SEQ ID NO: 389820 - DNA, 25 bp, Mus musculus
gggcagaaggcccaaagcaccatgc

SEQ ID NO: 389821 - DNA, 25 bp, Mus musculus
caagtaggctcggaaccctggtacg

SEQ ID NO: 389822 - DNA, 25 bp, Mus musculus
gacgcccggcaagtaggctcggaac

SEQ ID NO: 389823 - DNA, 25 bp, Mus musculus
gtcctgtcaacgtggacgcccggca

SEQ ID NO: 389824 - DNA, 25 bp, Mus musculus
gactttgcagagaagagtcctgtca

SEQ ID NO: 389825 - DNA, 25 bp, Mus musculus
atcctcgtctcccatggcgggcggg

SEQ ID NO: 389826 - DNA, 25 bp, Mus musculus
ccggcccgcgaagcttgatattcca

SEQ ID NO: 389827 - DNA, 25 bp, Mus musculus
gctactctgcggctgtaggtcgcgt

SEQ ID NO: 389828 - DNA, 25 bp, Mus musculus
gcgattccgggaagaagctactctg

SEQ ID NO: 389829 - DNA, 25 bp, Mus musculus
tgtaggtcgcgtccggagagtttcc

SEQ ID NO: 389830 - DNA, 25 bp, Mus musculus
tgatattccaggctggggtcgagtc

SEQ ID NO: 389831 - DNA, 25 bp, Mus musculus
ccgcgaagcttgatattccaggctg

SEQ ID NO: 389832 - DNA, 25 bp, Mus musculus
tagggatagactccgaactccggcc

SEQ ID NO: 389833 - DNA, 25 bp, Mus musculus
gcgtccaatagggatagactccgaa

SEQ ID NO: 389834 - DNA, 25 bp, Mus musculus
gcctattggctcttacccttccaat

SEQ ID NO: 389835 - DNA, 25 bp, Mus musculus
gcacggtgcgcatgcgcctttcgaa

SEQ ID NO: 389836 - DNA, 25 bp, Mus musculus
tcctccggcggcgtccaatagggat

SEQ ID NO: 389837 - DNA, 25 bp, Mus musculus
cacgggctccgttaggcctcggctt

SEQ ID NO: 389838 - DNA, 25 bp, Mus musculus
cgcatgcgcctttcgaatgcgccta

SEQ ID NO: 389839 - DNA, 25 bp, Mus musculus
tcgaatgcgcctattggctcttacc

SEQ ID NO: 389840 - DNA, 25 bp, Mus musculus
ggaagacgttggaccgcacctcctg

SEQ ID NO: 389841 - DNA, 25 bp, Mus musculus
gttggaccgcacctcctggcggagc

SEQ ID NO: 389842 - DNA, 25 bp, Mus musculus
acagcgccgcagttcttcctgcagg

SEQ ID NO: 389843 - DNA, 25 bp, Mus musculus
cgctcccgcagtgcctctgcctcct

SEQ ID NO: 389844 - DNA, 25 bp, Mus musculus
tgcctcctcgcggtagagctctgcg

SEQ ID NO: 389845 - DNA, 25 bp, Mus musculus
cctcgcggtagagctctgcgcgctt

SEQ ID NO: 389846 - DNA, 25 bp, Mus musculus
cgcttggcttgtgcggacagcgcct

SEQ ID NO: 389847 - DNA, 25 bp, Mus musculus
acagcgcctgagtctgggccatatg

SEQ ID NO: 389848 - DNA, 25 bp, Mus musculus
gtctgggccatatggtgtggaacta

SEQ ID NO: 389849 - DNA, 25 bp, Mus musculus
catatggtgtggaactaggattagc

SEQ ID NO: 389850 - DNA, 25 bp, Mus musculus
actaggattagcgagccacgggaca

SEQ ID NO: 389851 - DNA, 25 bp, Mus musculus
cgcaagaagcaataggaccacgatg

SEQ ID NO: 389852 - DNA, 25 bp, Mus musculus
cgcagttcttcctgcaggcgtggca

SEQ ID NO: 389853 - DNA, 25 bp, Mus musculus
accacgatgaagaggggacaatggc

SEQ ID NO: 389854 - DNA, 25 bp, Mus musculus
tgcacggagcacagaactggctttg

SEQ ID NO: 389855 - DNA, 25 bp, Mus musculus
gtccggcgaagagttcaacggcttc

SEQ ID NO: 389856 - DNA, 25 bp, Mus musculus
agggctcgcacaccttcttcaatcg

SEQ ID NO: 389857 - DNA, 25 bp, Mus musculus
cttcaatcgcagaaagaggtgcctg

SEQ ID NO: 389858 - DNA, 25 bp, Mus musculus
aggtgcctggtttaccgacgtgaca

SEQ ID NO: 389859 - DNA, 25 bp, Mus musculus
ccgacgtgacagttcgtgacccata

SEQ ID NO: 389860 - DNA, 25 bp, Mus musculus
tgcacaagggttcatcgcccatata

SEQ ID NO: 389861 - DNA, 25 bp, Mus musculus
tggctgagcctcaaatgtgttcgtt

SEQ ID NO: 389862 - DNA, 25 bp, Mus musculus
atgtgttcgttttacctgcgccgta

SEQ ID NO: 389863 - DNA, 25 bp, Mus musculus
agccggtttacacgtgacttgcata

SEQ ID NO: 389864 - DNA, 25 bp, Mus musculus
gtactctcttcagcgagcgggattc

SEQ ID NO: 389865 - DNA, 25 bp, Mus musculus
tcggcgtaagcctttgcagtctccc

SEQ ID NO: 389866 - DNA, 25 bp, Mus musculus
tccggtaccaggacgtgacccaaca

SEQ ID NO: 389867 - DNA, 25 bp, Mus musculus
tgcctgccaagcacgtcgatgcacg

SEQ ID NO: 389868 - DNA, 25 bp, Mus musculus
acaaaaggacatcgcggctgcttcc

SEQ ID NO: 389869 - DNA, 25 bp, Mus musculus
cggctgcttcctactccgcttcctc

SEQ ID NO: 389870 - DNA, 25 bp, Mus musculus
ctgcttcctactccgcttcctccag

SEQ ID NO: 389871 - DNA, 25 bp, Mus musculus
gctgcttcctactccgcttcctcca

SEQ ID NO: 389872 - DNA, 25 bp, Mus musculus
cgcggctgcttcctactccgcttcc

SEQ ID NO: 389873 - DNA, 25 bp, Mus musculus
tcgcggctgcttcctactccgcttc

SEQ ID NO: 389874 - DNA, 25 bp, Mus musculus
acatcgcggctgcttcctactccgc

SEQ ID NO: 389875 - DNA, 25 bp, Mus musculus
gacatcgcggctgcttcctactccg

SEQ ID NO: 389876 - DNA, 25 bp, Mus musculus
aggacatcgcggctgcttcctactc

SEQ ID NO: 389877 - DNA, 25 bp, Mus musculus
gctggctgcttgtaggacacaaaag

SEQ ID NO: 389878 - DNA, 25 bp, Mus musculus
cgctggctgcttgtaggacacaaaa

SEQ ID NO: 389879 - DNA, 25 bp, Mus musculus
ccgctggctgcttgtaggacacaaa

SEQ ID NO: 389880 - DNA, 25 bp, Mus musculus
gccgctggctgcttgtaggacacaa

SEQ ID NO: 389881 - DNA, 25 bp, Mus musculus
ggacatcgcggctgcttcctactcc

SEQ ID NO: 389882 - DNA, 25 bp, Mus musculus
agccggagcacccttgcatcacgaa

SEQ ID NO: 389883 - DNA, 25 bp, Mus musculus
agagaagccggagcacccttgcatc

SEQ ID NO: 389884 - DNA, 25 bp, Mus musculus
cacccttgcatcacgaaggagggcg

SEQ ID NO: 389885 - DNA, 25 bp, Mus musculus
agcgaagactaggaactggtgcggg

SEQ ID NO: 389886 - DNA, 25 bp, Mus musculus
tgaacctaggggaggagcgaagact

SEQ ID NO: 389887 - DNA, 25 bp, Mus musculus
tgtcgatacacacgcgtgcgcggcc

SEQ ID NO: 389888 - DNA, 25 bp, Mus musculus
aggccttgtcgatacacacgcgtgc

SEQ ID NO: 389889 - DNA, 25 bp, Mus musculus
cagcgggcaggccttgtcgatacac

SEQ ID NO: 389890 - DNA, 25 bp, Mus musculus
ctgcgtacccggaggacagcgggca

SEQ ID NO: 389891 - DNA, 25 bp, Mus musculus
cctatgctaatatccgagggaggcg

SEQ ID NO: 389892 - DNA, 25 bp, Mus musculus
caggtgccctatgctaatatccgag

SEQ ID NO: 389893 - DNA, 25 bp, Mus musculus
ccggcctgcgcatgcaaaacagggg

SEQ ID NO: 389894 - DNA, 25 bp, Mus musculus
ggccggcctgcgcatgcaaaacagg

SEQ ID NO: 389895 - DNA, 25 bp, Mus musculus
gggccaggtgccctatgctaatatc

SEQ ID NO: 389896 - DNA, 25 bp, Mus musculus
aaaggacacggagcggacgtctcgt

SEQ ID NO: 389897 - DNA, 25 bp, Mus musculus
ttccatgcagatgaggttgagcttg

SEQ ID NO: 389898 - DNA, 25 bp, Mus musculus
aagcagccacgcactgactctggga

SEQ ID NO: 389899 - DNA, 25 bp, Mus musculus
cgagcggacaaaactcaaggtcact

SEQ ID NO: 389900 - DNA, 25 bp, Mus musculus
acaaaactcaaggtcactgcggtga

SEQ ID NO: 389901 - DNA, 25 bp, Mus musculus
tcactgcggtgaccgaatgaaggtc

SEQ ID NO: 389902 - DNA, 25 bp, Mus musculus
ggccacgtgcgtccgcctcacgcaa

SEQ ID NO: 389903 - DNA, 25 bp, Mus musculus
gccacgcactgactctgggaccatg

SEQ ID NO: 389904 - DNA, 25 bp, Mus musculus
cgcactgactctgggaccatgcata

SEQ ID NO: 389905 - DNA, 25 bp, Mus musculus
tctgggaccatgcatagactcttta

SEQ ID NO: 389906 - DNA, 25 bp, Mus musculus
gcatagactctttaatttctctagg

SEQ ID NO: 389907 - DNA, 25 bp, Mus musculus
tttctctaggattcaaattccatgc

SEQ ID NO: 389908 - DNA, 25 bp, Mus musculus
ggattcaaattccatgcagatgagg

SEQ ID NO: 389909 - DNA, 25 bp, Mus musculus
tgaccgaatgaaggtcacggggaaa

SEQ ID NO: 389910 - DNA, 25 bp, Mus musculus
tgggatccgggtccagagatcctgc

SEQ ID NO: 389911 - DNA, 25 bp, Mus musculus
acggccttgtctcggagtcgcccag

SEQ ID NO: 389912 - DNA, 25 bp, Mus musculus
gaggcagggcacagccacgctcact

SEQ ID NO: 389913 - DNA, 25 bp, Mus musculus
cacgctcactctgcgtgtctgagga

SEQ ID NO: 389914 - DNA, 25 bp, Mus musculus
ctgggcccagttcgctgggtcactc

SEQ ID NO: 389915 - DNA, 25 bp, Mus musculus
agggcaggagtggttgctccttctc

SEQ ID NO: 389916 - DNA, 25 bp, Mus musculus
ggtcactcgcgctgtcactgtgccg

SEQ ID NO: 389917 - DNA, 25 bp, Mus musculus
ggccagattctcactggggtaatcc

SEQ ID NO: 389918 - DNA, 25 bp, Mus musculus
ggactcgtcgatgaaggccagattc

SEQ ID NO: 389919 - DNA, 25 bp, Mus musculus
actggggtaatccagagctgaggcc

SEQ ID NO: 389920 - DNA, 25 bp, Mus musculus
ggggacggagtctcaaccttctctg

SEQ ID NO: 389921 - DNA, 25 bp, Mus musculus
tctcaaccttctctgcgggtgcagg

SEQ ID NO: 389922 - DNA, 25 bp, Mus musculus
tgccggctggctcaacaacagcagg

SEQ ID NO: 389923 - DNA, 25 bp, Mus musculus
caacagcaggcggtgccggcaaaga

SEQ ID NO: 389924 - DNA, 25 bp, Mus musculus
taccagagctgcgtctccctacgtg

SEQ ID NO: 389925 - DNA, 25 bp, Mus musculus
gcccaggctgcaggcatagcactgc

SEQ ID NO: 389926 - DNA, 25 bp, Mus musculus
tgcaggcatagcactgcaccacgct

SEQ ID NO: 389927 - DNA, 25 bp, Mus musculus
tggcacaactaaccaccatgggcgt

SEQ ID NO: 389928 - DNA, 25 bp, Mus musculus
cagggccgagctaccctagaggtcc

SEQ ID NO: 389929 - DNA, 25 bp, Mus musculus
taccctagaggtccacgcgcacgaa

SEQ ID NO: 389930 - DNA, 25 bp, Mus musculus
cacagatacacacacggaacccgtg

SEQ ID NO: 389931 - DNA, 25 bp, Mus musculus
accactcgaggaaggcatccacgcg

SEQ ID NO: 389932 - DNA, 25 bp, Mus musculus
agggcctgagatccagcccacattc

SEQ ID NO: 389933 - DNA, 25 bp, Mus musculus
gcacttactgtctgcccactctgtg

SEQ ID NO: 389934 - DNA, 25 bp, Mus musculus
ctgcccactctgtggctgcggcttt

SEQ ID NO: 389935 - DNA, 25 bp, Mus musculus
tttggctgcggccaggtctcccgcg

SEQ ID NO: 389936 - DNA, 25 bp, Mus musculus
tccttgggagcttaaccctaccaga

SEQ ID NO: 389937 - DNA, 25 bp, Mus musculus
gacgcacggtcacaccactcgagga

SEQ ID NO: 389938 - DNA, 25 bp, Mus musculus
cagctcttaatgtttggggactacc

SEQ ID NO: 389939 - DNA, 25 bp, Mus musculus
cccgcacagggtcactgaaggaaac

SEQ ID NO: 389940 - DNA, 25 bp, Mus musculus
ccaaatccacatcgcgttcggcgtg

SEQ ID NO: 389941 - DNA, 25 bp, Mus musculus
cggccgatgcccgtcagcttaggac

SEQ ID NO: 389942 - DNA, 25 bp, Mus musculus
ataatccggattgggaggcttcttc

SEQ ID NO: 389943 - DNA, 25 bp, Mus musculus
gaggcttcttcctctgtcctcaaga

SEQ ID NO: 389944 - DNA, 25 bp, Mus musculus
aagtcgatgtcaggtctcaggccgc

SEQ ID NO: 389945 - DNA, 25 bp, Mus musculus
cccggcgtgcatctcttcgagaatc

SEQ ID NO: 389946 - DNA, 25 bp, Mus musculus
cagtgccatggaccgccagctctta

SEQ ID NO: 389947 - DNA, 25 bp, Mus musculus
gggactaccatttcccacgcttaga

SEQ ID NO: 389948 - DNA, 25 bp, Mus musculus
gaaacttccgcccacaaccaagatg

SEQ ID NO: 389949 - DNA, 25 bp, Mus musculus
tcctcaagattccagacgtgttccc

SEQ ID NO: 389950 - DNA, 25 bp, Mus musculus
aagcacctgggctaccagtgccatg

SEQ ID NO: 389951 - DNA, 25 bp, Mus musculus
gtccgttcgctacgtaaactgcgta

SEQ ID NO: 389952 - DNA, 25 bp, Mus musculus
agtgaggacgcacgcgtaggccacc

SEQ ID NO: 389953 - DNA, 25 bp, Mus musculus
cccgacagctgcaagctggttgtcc

SEQ ID NO: 389954 - DNA, 25 bp, Mus musculus
tgcaagctggttgtcctgggaagct

SEQ ID NO: 389955 - DNA, 25 bp, Mus musculus
ctgtgcggagcggactcactgcctg

SEQ ID NO: 389956 - DNA, 25 bp, Mus musculus
actcactgcctgctgggtgcggatt

SEQ ID NO: 389957 - DNA, 25 bp, Mus musculus
gtgcggattcagtgctgcgtagaca

SEQ ID NO: 389958 - DNA, 25 bp, Mus musculus
ctgcgtagacagaggggtactcaga

SEQ ID NO: 389959 - DNA, 25 bp, Mus musculus
caaagagcgccagtcgtgagcgagc

SEQ ID NO: 389960 - DNA, 25 bp, Mus musculus
ggacactcgcttgtgggacccgagt

SEQ ID NO: 389961 - DNA, 25 bp, Mus musculus
caccgggccgccagccttataaggg

SEQ ID NO: 389962 - DNA, 25 bp, Mus musculus
ccagccttataaggggcatcgcgct

SEQ ID NO: 389963 - DNA, 25 bp, Mus musculus
ccggatgctgactcaacacgttgga

SEQ ID NO: 389964 - DNA, 25 bp, Mus musculus
tcaacacgttggagagagaagccgg

SEQ ID NO: 389965 - DNA, 25 bp, Mus musculus
tactcagagtgaggacgcacgcgta

SEQ ID NO: 389966 - DNA, 25 bp, Mus musculus
atcgggcttggggtgagacctattc

SEQ ID NO: 389967 - DNA, 25 bp, Mus musculus
cgggatttacttcgaaaactgattg

SEQ ID NO: 389968 - DNA, 25 bp, Mus musculus
tttacttcgaaaactgattgggtca

SEQ ID NO: 389969 - DNA, 25 bp, Mus musculus
cgatcccggaatccggagcctgggg

SEQ ID NO: 389970 - DNA, 25 bp, Mus musculus
cttcgaaaactgattgggtcagatc

SEQ ID NO: 389971 - DNA, 25 bp, Mus musculus
aactgattgggtcagatctgtgaca

SEQ ID NO: 389972 - DNA, 25 bp, Mus musculus
ttgggtcagatctgtgacagttctc

SEQ ID NO: 389973 - DNA, 25 bp, Mus musculus
gatctgtgacagttctcgtcgccca

SEQ ID NO: 389974 - DNA, 25 bp, Mus musculus
ctgtgacagttctcgtcgcccagga

SEQ ID NO: 389975 - DNA, 25 bp, Mus musculus
tgacagttctcgtcgcccaggaaac

SEQ ID NO: 389976 - DNA, 25 bp, Mus musculus
ttctcgtcgcccaggaaactagggc

SEQ ID NO: 389977 - DNA, 25 bp, Mus musculus
ctcgtcgcccaggaaactagggccg

SEQ ID NO: 389978 - DNA, 25 bp, Mus musculus
cgggcgcccttagaactggagggag

SEQ ID NO: 389979 - DNA, 25 bp, Mus musculus
ggtcaggggcctcgagatcgggctt

SEQ ID NO: 389980 - DNA, 25 bp, Mus musculus
cgcgagaaacgtgctttataataaa

SEQ ID NO: 389981 - DNA, 25 bp, Mus musculus
cgaggtcgcgagaaacgtgctttat

SEQ ID NO: 389982 - DNA, 25 bp, Mus musculus
tataataaagcctgcgcatgtgccg

SEQ ID NO: 389983 - DNA, 25 bp, Mus musculus
tctatccttcgtttggggttccgca

SEQ ID NO: 389984 - DNA, 25 bp, Mus musculus
tggggttccgcaatccggatctcta

SEQ ID NO: 389985 - DNA, 25 bp, Mus musculus
ggatctctatccctgatagttttaa

SEQ ID NO: 389986 - DNA, 25 bp, Mus musculus
ctgatagttttaagagagactcgtt

SEQ ID NO: 389987 - DNA, 25 bp, Mus musculus
ttaccggaggaagaaacaagctcta

SEQ ID NO: 389988 - DNA, 25 bp, Mus musculus
caagctctaaggactgagaggaaga

SEQ ID NO: 389989 - DNA, 25 bp, Mus musculus
cgtggctagacccttgggactgcca

SEQ ID NO: 389990 - DNA, 25 bp, Mus musculus
cccttatctctaatatggtaattgg

SEQ ID NO: 389991 - DNA, 25 bp, Mus musculus
aatatggtaattgggagccgcagtc

SEQ ID NO: 389992 - DNA, 25 bp, Mus musculus
ccgccggaatttagcgttctgcaaa

SEQ ID NO: 389993 - DNA, 25 bp, Mus musculus
gttctgcaaaccatgtcgcggctcc

SEQ ID NO: 389994 - DNA, 25 bp, Mus musculus
ggaaccagtgttgtcgcgtcgtccc

SEQ ID NO: 389995 - DNA, 25 bp, Mus musculus
tgcaaaactttaaagcgcgcgggtc

SEQ ID NO: 389996 - DNA, 25 bp, Mus musculus
gatagcattcagctcctttcctgca

SEQ ID NO: 389997 - DNA, 25 bp, Mus musculus
gtggttcctcttgccgatagcattc

SEQ ID NO: 389998 - DNA, 25 bp, Mus musculus
cggtgtaggacacctgtggttcctc

SEQ ID NO: 389999 - DNA, 25 bp, Mus musculus
ccttgacagtgggacgaaaggctgc

SEQ ID NO: 390000 - DNA, 25 bp, Mus musculus
gcttttgctcccgttaactgtcggc

SEQ ID NO: 390001 - DNA, 25 bp, Mus musculus
gcagctccggtatcctcattggcca

SEQ ID NO: 390002 - DNA, 25 bp, Mus musculus
cccttacgagtgctggttggtctaa

SEQ ID NO: 390003 - DNA, 25 bp, Mus musculus
tcgtaatgacggtgagggctgccat

SEQ ID NO: 390004 - DNA, 25 bp, Mus musculus
ggctgccattggtctttaggcctca

SEQ ID NO: 390005 - DNA, 25 bp, Mus musculus
tttaggcctcaaaatgggcggagca

SEQ ID NO: 390006 - DNA, 25 bp, Mus musculus
ccaggatcttgctagggaaccagtg

SEQ ID NO: 390007 - DNA, 25 bp, Mus musculus
agcgcgcgggtcttttaaacgcttg

SEQ ID NO: 390008 - DNA, 25 bp, Mus musculus
ggaaccgacggtgccactgctctct

SEQ ID NO: 390009 - DNA, 25 bp, Mus musculus
atggtgccgcccgacccacggcggc

SEQ ID NO: 390010 - DNA, 25 bp, Mus musculus
ctcccaccgctatggtgccgcccga

SEQ ID NO: 390011 - DNA, 25 bp, Mus musculus
ctgtcccggacggaccggagactcg

SEQ ID NO: 390012 - DNA, 25 bp, Mus musculus
cagtctgtcccggacggaccggaga

SEQ ID NO: 390013 - DNA, 25 bp, Mus musculus
gcccgccagccagtctgtcccggac

SEQ ID NO: 390014 - DNA, 25 bp, Mus musculus
tctctccacacgctcccgcgcggcc

SEQ ID NO: 390015 - DNA, 25 bp, Mus musculus
tggacgccgggcctcgcgcccgcca

SEQ ID NO: 390016 - DNA, 25 bp, Mus musculus
ggtgccactgctctctccacacgct

SEQ ID NO: 390017 - DNA, 25 bp, Mus musculus
cgggaaccgacggtgccactgctct

SEQ ID NO: 390018 - DNA, 25 bp, Mus musculus
gacgggaaccgacggtgccactgct

SEQ ID NO: 390019 - DNA, 25 bp, Mus musculus
ccgacgggaaccgacggtgccactg

SEQ ID NO: 390020 - DNA, 25 bp, Mus musculus
gtctccaccacggtgggcggctcca

SEQ ID NO: 390021 - DNA, 25 bp, Mus musculus
actgctctctccacacgctcccgcg

SEQ ID NO: 390022 - DNA, 25 bp, Mus musculus
cccaaacaagtttgcgcttcaatgc

SEQ ID NO: 390023 - DNA, 25 bp, Mus musculus
tccacgtgtcgacccatgcgcggaa

SEQ ID NO: 390024 - DNA, 25 bp, Mus musculus
accaagtagggcatcccggccggca

SEQ ID NO: 390025 - DNA, 25 bp, Mus musculus
gcgtgagaccagaccaagtagggca

SEQ ID NO: 390026 - DNA, 25 bp, Mus musculus
agctcttccttgaggggcgtgagac

SEQ ID NO: 390027 - DNA, 25 bp, Mus musculus
aagccaaacggccaaatctacacgc

SEQ ID NO: 390028 - DNA, 25 bp, Mus musculus
tcctggctattgtaagccaaacggc

SEQ ID NO: 390029 - DNA, 25 bp, Mus musculus
gtggtcgtcccagtcctggctattg

SEQ ID NO: 390030 - DNA, 25 bp, Mus musculus
gccgctgactacattgcccacaata

SEQ ID NO: 390031 - DNA, 25 bp, Mus musculus
tttgcgcttcaatgcgggctctgca

SEQ ID NO: 390032 - DNA, 25 bp, Mus musculus
tgatgaccaagggtcccgcacgttc

SEQ ID NO: 390033 - DNA, 25 bp, Mus musculus
gcacaatcctgccagctcagagggg

SEQ ID NO: 390034 - DNA, 25 bp, Mus musculus
gacccatgcgcggaagttctctcgc

SEQ ID NO: 390035 - DNA, 25 bp, Mus musculus
ggcagcatcgacgagccgctgacta

SEQ ID NO: 390036 - DNA, 25 bp, Mus musculus
tgagtgtgcgctctttcttgcctga

SEQ ID NO: 390037 - DNA, 25 bp, Mus musculus
ggcaagggaaggtcaccgtcaagta

SEQ ID NO: 390038 - DNA, 25 bp, Mus musculus
acgcgactctacgactgccaggtgt

SEQ ID NO: 390039 - DNA, 25 bp, Mus musculus
gactctacgactgccaggtgtgctc

SEQ ID NO: 390040 - DNA, 25 bp, Mus musculus
ctaaaatcggccctaagtcggtctg

SEQ ID NO: 390041 - DNA, 25 bp, Mus musculus
ggccctaagtcggtctgtctccaga

SEQ ID NO: 390042 - DNA, 25 bp, Mus musculus
cggtctgtctccagagtcaatggga

SEQ ID NO: 390043 - DNA, 25 bp, Mus musculus
tcaatgggagctctgctgccaagcc

SEQ ID NO: 390044 - DNA, 25 bp, Mus musculus
gggagctctgctgccaagccaccgg

SEQ ID NO: 390045 - DNA, 25 bp, Mus musculus
ttgcactcgccgctcccagtgagtg

SEQ ID NO: 390046 - DNA, 25 bp, Mus musculus
actcgccgctcccagtgagtgtgcg

SEQ ID NO: 390047 - DNA, 25 bp, Mus musculus
aagacactctagctttctccgctgc

SEQ ID NO: 390048 - DNA, 25 bp, Mus musculus
cttgcctgacctaagacactctagc

SEQ ID NO: 390049 - DNA, 25 bp, Mus musculus
gtgcgctctttcttgcctgacctaa

SEQ ID NO: 390050 - DNA, 25 bp, Mus musculus
tcctactccagctatgggccactgg

SEQ ID NO: 390051 - DNA, 25 bp, Mus musculus
tcctgagtgactgcgtgacaacgtc

SEQ ID NO: 390052 - DNA, 25 bp, Mus musculus
cggccatagctcaagcttagctctg

SEQ ID NO: 390053 - DNA, 25 bp, Mus musculus
ttagctctgcgcaaggctccttggc

SEQ ID NO: 390054 - DNA, 25 bp, Mus musculus
cctccgcaatgttagacctagtctc

SEQ ID NO: 390055 - DNA, 25 bp, Mus musculus
acctagtctccagcagaggggccac

SEQ ID NO: 390056 - DNA, 25 bp, Mus musculus
ggccacgccactcactgactgaagt

SEQ ID NO: 390057 - DNA, 25 bp, Mus musculus
tgaagtcccacctccaacgactggg

SEQ ID NO: 390058 - DNA, 25 bp, Mus musculus
aacgactgggatctcacgccctctg

SEQ ID NO: 390059 - DNA, 25 bp, Mus musculus
tgtctccgagccaaaggctccactt

SEQ ID NO: 390060 - DNA, 25 bp, Mus musculus
aatcccgctcgtgctgtcacttctg

SEQ ID NO: 390061 - DNA, 25 bp, Mus musculus
aaacccgctgctgcatctatgggcg

SEQ ID NO: 390062 - DNA, 25 bp, Mus musculus
ttggaccgtccaaaacccgctgctg

SEQ ID NO: 390063 - DNA, 25 bp, Mus musculus
tcatttggccctgcctcctgagtga

SEQ ID NO: 390064 - DNA, 25 bp, Mus musculus
gtgacctgaaggaccgaatcggaca

SEQ ID NO: 390065 - DNA, 25 bp, Mus musculus
cacttccgccaaccttgagagggca

SEQ ID NO: 390066 - DNA, 25 bp, Mus musculus
ccaaccttgagagggcaccgcgggc

SEQ ID NO: 390067 - DNA, 25 bp, Mus musculus
cgggatgtcgcggacgcacgtacct

SEQ ID NO: 390068 - DNA, 25 bp, Mus musculus
gacgcacgtacctgggtgcgagcca

SEQ ID NO: 390069 - DNA, 25 bp, Mus musculus
gtgcgagccagctgcagcagtgcaa

SEQ ID NO: 390070 - DNA, 25 bp, Mus musculus
tgcagcagtgcaacaagcagcaggc

SEQ ID NO: 390071 - DNA, 25 bp, Mus musculus
cagcgacggcctgaggaacaagaca

SEQ ID NO: 390072 - DNA, 25 bp, Mus musculus
gacggcctgaggaacaagacaggca

SEQ ID NO: 390073 - DNA, 25 bp, Mus musculus
cgggcaagaggctcatgtgacctaa

SEQ ID NO: 390074 - DNA, 25 bp, Mus musculus
gaggctcatgtgacctaaacacgcg

SEQ ID NO: 390075 - DNA, 25 bp, Mus musculus
gagatgcgtgacctgaaggaccgaa

SEQ ID NO: 390076 - DNA, 25 bp, Mus musculus
cctgaaggaccgaatcggacaggcg

SEQ ID NO: 390077 - DNA, 25 bp, Mus musculus
gacagaggtagcaggcgcctcccca

SEQ ID NO: 390078 - DNA, 25 bp, Mus musculus
cacctgctccatagcctggcccgga

SEQ ID NO: 390079 - DNA, 25 bp, Mus musculus
cccgttgaatcgaattcgtccgctc

SEQ ID NO: 390080 - DNA, 25 bp, Mus musculus
gaatcgaattcgtccgctccgcgtt

SEQ ID NO: 390081 - DNA, 25 bp, Mus musculus
cttctctgcagtcgcgcgggtcctt

SEQ ID NO: 390082 - DNA, 25 bp, Mus musculus
cacagatgccgtgtaccccgaaggc

SEQ ID NO: 390083 - DNA, 25 bp, Mus musculus
ctggggtgatcggtcaccggatccc

SEQ ID NO: 390084 - DNA, 25 bp, Mus musculus
atcggtcaccggatccctccaagtt

SEQ ID NO: 390085 - DNA, 25 bp, Mus musculus
tccaagttcgcagcggccgacaggg

SEQ ID NO: 390086 - DNA, 25 bp, Mus musculus
ttcgcagcggccgacaggggcctct

SEQ ID NO: 390087 - DNA, 25 bp, Mus musculus
ggccaggcctgttcccgctccactc

SEQ ID NO: 390088 - DNA, 25 bp, Mus musculus
ttcccgctccactcggcgggtcgcg

SEQ ID NO: 390089 - DNA, 25 bp, Mus musculus
ggcgacgggcgctcgccattctccc

SEQ ID NO: 390090 - DNA, 25 bp, Mus musculus
accgcggctctcacgcccgcgcctc

SEQ ID NO: 390091 - DNA, 25 bp, Mus musculus
ctcacacgcccgaccgcggctctca

SEQ ID NO: 390092 - DNA, 25 bp, Mus musculus
tcctgactattaggcccggaatgta

SEQ ID NO: 390093 - DNA, 25 bp, Mus musculus
cggtgtcgcctaggctttaactaca

SEQ ID NO: 390094 - DNA, 25 bp, Mus musculus
cctaggctttaactacagcgttaca

SEQ ID NO: 390095 - DNA, 25 bp, Mus musculus
cgttacaagctgttttccctgagtc

SEQ ID NO: 390096 - DNA, 25 bp, Mus musculus
gctgttttccctgagtctgagactg

SEQ ID NO: 390097 - DNA, 25 bp, Mus musculus
gcgcttcctcgcatcctgactatta

SEQ ID NO: 390098 - DNA, 25 bp, Mus musculus
aggcctccgcttttccggcagtgtc

SEQ ID NO: 390099 - DNA, 25 bp, Mus musculus
gcccggaatgtacccaaaatattgc

SEQ ID NO: 390100 - DNA, 25 bp, Mus musculus
aatattgcgggctatgacgggcctg

SEQ ID NO: 390101 - DNA, 25 bp, Mus musculus
cgggcctgcgttgaatgttcccaaa

SEQ ID NO: 390102 - DNA, 25 bp, Mus musculus
ttttccggcagtgtcctggcggacc

SEQ ID NO: 390103 - DNA, 25 bp, Mus musculus
tcccaaaatgctgcgggccacgaca

SEQ ID NO: 390104 - DNA, 25 bp, Mus musculus
agtcgagcatctggcccggtgtcgc

SEQ ID NO: 390105 - DNA, 25 bp, Mus musculus
tctgagactgttggcccgcgcttcc

SEQ ID NO: 390106 - DNA, 25 bp, Mus musculus
ctgagcacctccaccgactggaagg

SEQ ID NO: 390107 - DNA, 25 bp, Mus musculus
cgagtttacttatgagccacggcaa

SEQ ID NO: 390108 - DNA, 25 bp, Mus musculus
ccacggcaactaggcggaaagaact

SEQ ID NO: 390109 - DNA, 25 bp, Mus musculus
acccacgcacggagtgccttgtcga

SEQ ID NO: 390110 - DNA, 25 bp, Mus musculus
ccttgtcgaatcaccgagcttcgga

SEQ ID NO: 390111 - DNA, 25 bp, Mus musculus
cttcggaaggttggctgcagccaca

SEQ ID NO: 390112 - DNA, 25 bp, Mus musculus
ctgcagccacactcgggaggacaca

SEQ ID NO: 390113 - DNA, 25 bp, Mus musculus
cgcggtctctaagcaggtcgccacg

SEQ ID NO: 390114 - DNA, 25 bp, Mus musculus
aggcactccacgagcaactgagaca

SEQ ID NO: 390115 - DNA, 25 bp, Mus musculus
cgccactctcgtcccagagtaaata

SEQ ID NO: 390116 - DNA, 25 bp, Mus musculus
aaataagggaccgagcgcgactctc

SEQ ID NO: 390117 - DNA, 25 bp, Mus musculus
gcgactctccggagcaccgtaaata

SEQ ID NO: 390118 - DNA, 25 bp, Mus musculus
accgtaaatagagtccgagtgggcg

SEQ ID NO: 390119 - DNA, 25 bp, Mus musculus
cgcgataggaccgagtttacttatg

SEQ ID NO: 390120 - DNA, 25 bp, Mus musculus
gcctcttggacctcgggactaatcg

SEQ ID NO: 390121 - DNA, 25 bp, Mus musculus
tcgagttttgcaatccggggcctgc

SEQ ID NO: 390122 - DNA, 25 bp, Mus musculus
cagtgaaaggtgacgtaaaacgctc

SEQ ID NO: 390123 - DNA, 25 bp, Mus musculus
taatcggattgaaagcgcgccggcc

SEQ ID NO: 390124 - DNA, 25 bp, Mus musculus
tcgagtgacagctgagcgcgccaat

SEQ ID NO: 390125 - DNA, 25 bp, Mus musculus
cgccaatcgagagtgaggaccgatc

SEQ ID NO: 390126 - DNA, 25 bp, Mus musculus
ttccggccggagctctatttaccag

SEQ ID NO: 390127 - DNA, 25 bp, Mus musculus
ctctatttaccaggggcgtgcagct

SEQ ID NO: 390128 - DNA, 25 bp, Mus musculus
gcgtgcagctcgcttgccaatcaga

SEQ ID NO: 390129 - DNA, 25 bp, Mus musculus
tgggatgtcctacaaacctatcgcg

SEQ ID NO: 390130 - DNA, 25 bp, Mus musculus
ccggtccctacaggtgaggctccaa

SEQ ID NO: 390131 - DNA, 25 bp, Mus musculus
cgccaattgaggaggacgactgtca

SEQ ID NO: 390132 - DNA, 25 bp, Mus musculus
tcgaggtcttggagagaaaccgctc

SEQ ID NO: 390133 - DNA, 25 bp, Mus musculus
gaggctccaactccatccttgttcg

SEQ ID NO: 390134 - DNA, 25 bp, Mus musculus
cgactctgagcgtctgagcggccac

SEQ ID NO: 390135 - DNA, 25 bp, Mus musculus
tgtttgctgaggcttgccggccgcc

SEQ ID NO: 390136 - DNA, 25 bp, Mus musculus
ttaaatgtgtttgctgaggcttgcc

SEQ ID NO: 390137 - DNA, 25 bp, Mus musculus
ctgtcacttcagatttaaatgtgtt

SEQ ID NO: 390138 - DNA, 25 bp, Mus musculus
gtaaatcgctttatctgtcacttca

SEQ ID NO: 390139 - DNA, 25 bp, Mus musculus
ctgtcgccgtaaatcgctttatctg

SEQ ID NO: 390140 - DNA, 25 bp, Mus musculus
tgacgctaaactgtcgccgtaaatc

SEQ ID NO: 390141 - DNA, 25 bp, Mus musculus
gatctgacgctaaactgtcgccgta

SEQ ID NO: 390142 - DNA, 25 bp, Mus musculus
tgggaagtgatctgacgctaaactg

SEQ ID NO: 390143 - DNA, 25 bp, Mus musculus
actgcctggtgggaagtgatctgac

SEQ ID NO: 390144 - DNA, 25 bp, Mus musculus
cgccttgatggactagcaagcaggg

SEQ ID NO: 390145 - DNA, 25 bp, Mus musculus
ttagagaccgccttgatggactagc

SEQ ID NO: 390146 - DNA, 25 bp, Mus musculus
gcgggtgatttagagaccgccttga

SEQ ID NO: 390147 - DNA, 25 bp, Mus musculus
ctgagcgtctgagcggccacagagt

SEQ ID NO: 390148 - DNA, 25 bp, Mus musculus
aatctcctttgtggcagcagctcgg

SEQ ID NO: 390149 - DNA, 25 bp, Mus musculus
tgcaaagttaagttcgcgacccggc

SEQ ID NO: 390150 - DNA, 25 bp, Mus musculus
cacgaatctcctttgtggcagcagc

SEQ ID NO: 390151 - DNA, 25 bp, Mus musculus
cctttgtggcagcagctcggggctc

SEQ ID NO: 390152 - DNA, 25 bp, Mus musculus
ggcgtggagattcggccctctcttc

SEQ ID NO: 390153 - DNA, 25 bp, Mus musculus
acagtcggaacccaacaagccaggg

SEQ ID NO: 390154 - DNA, 25 bp, Mus musculus
acccgaagccaggtctcaccgtgtg

SEQ ID NO: 390155 - DNA, 25 bp, Mus musculus
caggtctcaccgtgtgggctgtagt

SEQ ID NO: 390156 - DNA, 25 bp, Mus musculus
ggtgggcagcgaaccccctcttcta

SEQ ID NO: 390157 - DNA, 25 bp, Mus musculus
ccctcttctagggagaagatggaag

SEQ ID NO: 390158 - DNA, 25 bp, Mus musculus
gaagatggaaggagacacccggccc

SEQ ID NO: 390159 - DNA, 25 bp, Mus musculus
gcgcacccgccagctgcaaagttaa

SEQ ID NO: 390160 - DNA, 25 bp, Mus musculus
ctcggggctcgcccaagttgcagag

SEQ ID NO: 390161 - DNA, 25 bp, Mus musculus
cccgccagctgcaaagttaagttcg

SEQ ID NO: 390162 - DNA, 25 bp, Mus musculus
ggcgtgctcgcggtctattgcctcc

SEQ ID NO: 390163 - DNA, 25 bp, Mus musculus
cggtctattgcctccttgtctaggg

SEQ ID NO: 390164 - DNA, 25 bp, Mus musculus
ggtctattgcctccttgtctaggga

SEQ ID NO: 390165 - DNA, 25 bp, Mus musculus
tctattgcctccttgtctagggagc

SEQ ID NO: 390166 - DNA, 25 bp, Mus musculus
tattgcctccttgtctagggagctg

SEQ ID NO: 390167 - DNA, 25 bp, Mus musculus
ttgcctccttgtctagggagctggg

SEQ ID NO: 390168 - DNA, 25 bp, Mus musculus
gggattctgtgctgtgcccccagct

SEQ ID NO: 390169 - DNA, 25 bp, Mus musculus
ctgggcctcggatccccacgaggag

SEQ ID NO: 390170 - DNA, 25 bp, Mus musculus
cgtgctcgcggtctattgcctcctt

SEQ ID NO: 390171 - DNA, 25 bp, Mus musculus
tgctcgcggtctattgcctccttgt

SEQ ID NO: 390172 - DNA, 25 bp, Mus musculus
tcgcggtctattgcctccttgtcta

SEQ ID NO: 390173 - DNA, 25 bp, Mus musculus
gcggtctattgcctccttgtctagg

SEQ ID NO: 390174 - DNA, 25 bp, Mus musculus
ctcgcggtctattgcctccttgtct

SEQ ID NO: 390175 - DNA, 25 bp, Mus musculus
gctttccgcccctgggcctcggatc

SEQ ID NO: 390176 - DNA, 25 bp, Mus musculus
cgcgacggagctctgtggcgggccc

SEQ ID NO: 390177 - DNA, 25 bp, Mus musculus
cagcccgggagaaacggcgtccgtg

SEQ ID NO: 390178 - DNA, 25 bp, Mus musculus
ccgcgcggggactctggcccagccc

SEQ ID NO: 390179 - DNA, 25 bp, Mus musculus
gcgctgcgcactggccggcgggacc

SEQ ID NO: 390180 - DNA, 25 bp, Mus musculus
cgccgcgctgcgcactggccggcgg

SEQ ID NO: 390181 - DNA, 25 bp, Mus musculus
cggggctgtgcgtgcagcgcggagc

SEQ ID NO: 390182 - DNA, 25 bp, Mus musculus
tgcccgggctggtgcgctcagcggg

SEQ ID NO: 390183 - DNA, 25 bp, Mus musculus
tgtgcccgggctggtgcgctcagcg

SEQ ID NO: 390184 - DNA, 25 bp, Mus musculus
cgtgtgcccgggctggtgcgctcag

SEQ ID NO: 390185 - DNA, 25 bp, Mus musculus
cgcatctgcccagcggagcggcggg

SEQ ID NO: 390186 - DNA, 25 bp, Mus musculus
ggcgcatctgcccagcggagcggcg

SEQ ID NO: 390187 - DNA, 25 bp, Mus musculus
ggcggcgcatctgcccagcggagcg

SEQ ID NO: 390188 - DNA, 25 bp, Mus musculus
cgacggagctctgtggcgggcccgg

SEQ ID NO: 390189 - DNA, 25 bp, Mus musculus
gcggcggcgcatctgcccagcggag

SEQ ID NO: 390190 - DNA, 25 bp, Mus musculus
gctggagcctcaggggttattccaa

SEQ ID NO: 390191 - DNA, 25 bp, Mus musculus
accggaccgactccggcggcgcgat

SEQ ID NO: 390192 - DNA, 25 bp, Mus musculus
gcgatccggcccgatgcgtgcagca

SEQ ID NO: 390193 - DNA, 25 bp, Mus musculus
atccggcccgatgcgtgcagcacgg

SEQ ID NO: 390194 - DNA, 25 bp, Mus musculus
cggcccgatgcgtgcagcacggccc

SEQ ID NO: 390195 - DNA, 25 bp, Mus musculus
cgcgcagcttgccttacctgcgtag

SEQ ID NO: 390196 - DNA, 25 bp, Mus musculus
gcagcttgccttacctgcgtagcgg

SEQ ID NO: 390197 - DNA, 25 bp, Mus musculus
agcttgccttacctgcgtagcggcc

SEQ ID NO: 390198 - DNA, 25 bp, Mus musculus
cttgccttacctgcgtagcggccgg

SEQ ID NO: 390199 - DNA, 25 bp, Mus musculus
cctcaggggttattccaaggagcgg

SEQ ID NO: 390200 - DNA, 25 bp, Mus musculus
tctcctcgggaaactttgcggcggc

SEQ ID NO: 390201 - DNA, 25 bp, Mus musculus
ggagcctcaggggttattccaagga

SEQ ID NO: 390202 - DNA, 25 bp, Mus musculus
agcctcaggggttattccaaggagc

SEQ ID NO: 390203 - DNA, 25 bp, Mus musculus
ccttacctgcgtagcggccggggag

SEQ ID NO: 390204 - DNA, 25 bp, Mus musculus
taccttcggagtcgctacccagtgg

SEQ ID NO: 390205 - DNA, 25 bp, Mus musculus
aacagcgccgcactggcgatcgctt

SEQ ID NO: 390206 - DNA, 25 bp, Mus musculus
ttcgtaccttcggagtcgctaccca

SEQ ID NO: 390207 - DNA, 25 bp, Mus musculus
cgtaccttcggagtcgctacccagt

SEQ ID NO: 390208 - DNA, 25 bp, Mus musculus
tcggagtcgctacccagtggctcct

SEQ ID NO: 390209 - DNA, 25 bp, Mus musculus
gtggattgcccccgctagcccggga

SEQ ID NO: 390210 - DNA, 25 bp, Mus musculus
tcggtcgcacgctgcgcctactccc

SEQ ID NO: 390211 - DNA, 25 bp, Mus musculus
tgcttctgctgctgaggttcctccg

SEQ ID NO: 390212 - DNA, 25 bp, Mus musculus
gcttctgctgctgaggttcctccgc

SEQ ID NO: 390213 - DNA, 25 bp, Mus musculus
gccatctttaaacagcgccgcactg

SEQ ID NO: 390214 - DNA, 25 bp, Mus musculus
catctttaaacagcgccgcactggc

SEQ ID NO: 390215 - DNA, 25 bp, Mus musculus
taaacagcgccgcactggcgatcgc

SEQ ID NO: 390216 - DNA, 25 bp, Mus musculus
tccgttcgtaccttcggagtcgcta

SEQ ID NO: 390217 - DNA, 25 bp, Mus musculus
cttcggagtcgctacccagtggctc

SEQ ID NO: 390218 - DNA, 25 bp, Mus musculus
tcagggagtcaagatggccgaacca

SEQ ID NO: 390219 - DNA, 25 bp, Mus musculus
gagccggtcaggctcctcagcagca

SEQ ID NO: 390220 - DNA, 25 bp, Mus musculus
cctcagcagcagtggcgtcaggaca

SEQ ID NO: 390221 - DNA, 25 bp, Mus musculus
tcaggacagacatgacggcgcggaa

SEQ ID NO: 390222 - DNA, 25 bp, Mus musculus
gaacgaccacggacgaggaccagtc

SEQ ID NO: 390223 - DNA, 25 bp, Mus musculus
aggaccagtccaaggtcagggagtc

SEQ ID NO: 390224 - DNA, 25 bp, Mus musculus
cgccggcttcgagtggacctgagcc

SEQ ID NO: 390225 - DNA, 25 bp, Mus musculus
aaccagccggaagttccggcgctga

SEQ ID NO: 390226 - DNA, 25 bp, Mus musculus
ttccggcgctgaagttgccggacgc

SEQ ID NO: 390227 - DNA, 25 bp, Mus musculus
tgccggacgcccgagccggaagtat

SEQ ID NO: 390228 - DNA, 25 bp, Mus musculus
cgagccggaagtatttcggaaatga

SEQ ID NO: 390229 - DNA, 25 bp, Mus musculus
ttcggaaatgacgtcgggacaagcc

SEQ ID NO: 390230 - DNA, 25 bp, Mus musculus
cctcgcccgcctgggctgtttttgg

SEQ ID NO: 390231 - DNA, 25 bp, Mus musculus
tttggcgcgctcctcgaaacaacca

SEQ ID NO: 390232 - DNA, 25 bp, Mus musculus
cggcctggagcaagctagcctcgga

SEQ ID NO: 390233 - DNA, 25 bp, Mus musculus
acggcggaacccgagcgacagcgaa

SEQ ID NO: 390234 - DNA, 25 bp, Mus musculus
aagctagcctcggagccacttggtg

SEQ ID NO: 390235 - DNA, 25 bp, Mus musculus
gtaactatggcaacgaccacgcgga

SEQ ID NO: 390236 - DNA, 25 bp, Mus musculus
cctctcgcacttgcccgtagggagg

SEQ ID NO: 390237 - DNA, 25 bp, Mus musculus
cacttgcccgtagggaggtggcaac

SEQ ID NO: 390238 - DNA, 25 bp, Mus musculus
tccgcgtctgtaactatggcaacga

SEQ ID NO: 390239 - DNA, 25 bp, Mus musculus
tcgacggtccgcgtctgtaactatg

SEQ ID NO: 390240 - DNA, 25 bp, Mus musculus
cgctaggaatgacgcgcacgcgccg

SEQ ID NO: 390241 - DNA, 25 bp, Mus musculus
cagagcgtcgcgctaggaatgacgc

SEQ ID NO: 390242 - DNA, 25 bp, Mus musculus
cgcgcggaaggcctgagaacagaaa

SEQ ID NO: 390243 - DNA, 25 bp, Mus musculus
cgccggcgcagaaccggaccagagt

SEQ ID NO: 390244 - DNA, 25 bp, Mus musculus
gcgcactacgcatgcgtctcacaaa

SEQ ID NO: 390245 - DNA, 25 bp, Mus musculus
atggcaacgaccacgcggagcggaa

SEQ ID NO: 390246 - DNA, 25 bp, Mus musculus
tgccgggtagggtaatgccctcagt

SEQ ID NO: 390247 - DNA, 25 bp, Mus musculus
ctgcctctcgtagcctcagtggcga

SEQ ID NO: 390248 - DNA, 25 bp, Mus musculus
gccaggcgcagcactcgaggcaagc

SEQ ID NO: 390249 - DNA, 25 bp, Mus musculus
cactcgaggcaagcgcggcaagctc

SEQ ID NO: 390250 - DNA, 25 bp, Mus musculus
aagctcctgcgctctccaaaggatc

SEQ ID NO: 390251 - DNA, 25 bp, Mus musculus
ggccactgcgcggtagcccttgctg

SEQ ID NO: 390252 - DNA, 25 bp, Mus musculus
ccttgctggccaaacagcgtgggca

SEQ ID NO: 390253 - DNA, 25 bp, Mus musculus
tcgcagtgagcgttagggctgccct

SEQ ID NO: 390254 - DNA, 25 bp, Mus musculus
atcggggcatcctcagcgcagccga

SEQ ID NO: 390255 - DNA, 25 bp, Mus musculus
ctccgggatcttgtcccgaagtcgg

SEQ ID NO: 390256 - DNA, 25 bp, Mus musculus
cgaagtcgggccaagacggcaccca

SEQ ID NO: 390257 - DNA, 25 bp, Mus musculus
caagacggcacccaacggcggacag

SEQ ID NO: 390258 - DNA, 25 bp, Mus musculus
caacggcggacagccacactcggag

SEQ ID NO: 390259 - DNA, 25 bp, Mus musculus
ccacactcggaggatgacagcagcg

SEQ ID NO: 390260 - DNA, 25 bp, Mus musculus
tccgccggcaagagccggaaacatc

SEQ ID NO: 390261 - DNA, 25 bp, Mus musculus
caacacccgagagctgccgaggcta

SEQ ID NO: 390262 - DNA, 25 bp, Mus musculus
cggtagtcagccatttccggcaaca

SEQ ID NO: 390263 - DNA, 25 bp, Mus musculus
aagaggctccgcgtgtgctaaaccg

SEQ ID NO: 390264 - DNA, 25 bp, Mus musculus
gcaagctttcggcagtttccggaaa

SEQ ID NO: 390265 - DNA, 25 bp, Mus musculus
tccgcccacttggagcaagctttcg

SEQ ID NO: 390266 - DNA, 25 bp, Mus musculus
cggctctgtttacggaaatccacga

SEQ ID NO: 390267 - DNA, 25 bp, Mus musculus
ttccgaagaccgaggttcggctctg

SEQ ID NO: 390268 - DNA, 25 bp, Mus musculus
gcgcgcacctcctagattccgaaga

SEQ ID NO: 390269 - DNA, 25 bp, Mus musculus
gacgatgggtgaattccggaaacta

SEQ ID NO: 390270 - DNA, 25 bp, Mus musculus
ttcctctcggcccagacgatgggtg

SEQ ID NO: 390271 - DNA, 25 bp, Mus musculus
gtgtccctttcgttcagcgtgggta

SEQ ID NO: 390272 - DNA, 25 bp, Mus musculus
gggcttctcacagcaggagcacccg

SEQ ID NO: 390273 - DNA, 25 bp, Mus musculus
gctgccgaggctaagaatctatctc

SEQ ID NO: 390274 - DNA, 25 bp, Mus musculus
cccttggctttcagggccatggcga

SEQ ID NO: 390275 - DNA, 25 bp, Mus musculus
gaaccctgtgcagcgcgtttgtctc

SEQ ID NO: 390276 - DNA, 25 bp, Mus musculus
agccgggcacaaaccactgtactgg

SEQ ID NO: 390277 - DNA, 25 bp, Mus musculus
tgtactgggaatccggcctctactc

SEQ ID NO: 390278 - DNA, 25 bp, Mus musculus
ctccttcggtgtggatggaagtctc

SEQ ID NO: 390279 - DNA, 25 bp, Mus musculus
gacctggagatctagtcccggacca

SEQ ID NO: 390280 - DNA, 25 bp, Mus musculus
gcgtcacctcgaagcaatccagagc

SEQ ID NO: 390281 - DNA, 25 bp, Mus musculus
atagccgaggacgttcgcacagacc

SEQ ID NO: 390282 - DNA, 25 bp, Mus musculus
agccacgggcttcaacgcgtcacga

SEQ ID NO: 390283 - DNA, 25 bp, Mus musculus
cgccgctcccttttatggaggctca

SEQ ID NO: 390284 - DNA, 25 bp, Mus musculus
aggctcattgtcagcgtccgtccgg

SEQ ID NO: 390285 - DNA, 25 bp, Mus musculus
caggctggccaatcacgtgaggaca

SEQ ID NO: 390286 - DNA, 25 bp, Mus musculus
cgaagcctggagttttcctgggagc

SEQ ID NO: 390287 - DNA, 25 bp, Mus musculus
ccaccaagcggaagtgaggtgtccc

SEQ ID NO: 390288 - DNA, 25 bp, Mus musculus
ggcggatccctgctccttaaagggc

SEQ ID NO: 390289 - DNA, 25 bp, Mus musculus
ggcgactctttaccagccggagctg

SEQ ID NO: 390290 - DNA, 25 bp, Mus musculus
gactctttaccagccggagctgcag

SEQ ID NO: 390291 - DNA, 25 bp, Mus musculus
gcgtccgtaacaagcgcccgttgcg

SEQ ID NO: 390292 - DNA, 25 bp, Mus musculus
acaagcgcccgttgcggacttgcca

SEQ ID NO: 390293 - DNA, 25 bp, Mus musculus
tgcggacttgccacctcccgctttc

SEQ ID NO: 390294 - DNA, 25 bp, Mus musculus
cgctgccgagcgagcagtcagccgt

SEQ ID NO: 390295 - DNA, 25 bp, Mus musculus
cccgcgcccagctcctgcgggagga

SEQ ID NO: 390296 - DNA, 25 bp, Mus musculus
cgagcgagcagtcagccgtccgtgc

SEQ ID NO: 390297 - DNA, 25 bp, Mus musculus
gcggtaagatctggggccgacgacc

SEQ ID NO: 390298 - DNA, 25 bp, Mus musculus
gcgcagagagcagctacaaggcccg

SEQ ID NO: 390299 - DNA, 25 bp, Mus musculus
cagagagcagctacaaggcccgcgg

SEQ ID NO: 390300 - DNA, 25 bp, Mus musculus
aagcgcgtcgcagcggactggacac

SEQ ID NO: 390301 - DNA, 25 bp, Mus musculus
ggtcacctcggcgactctttaccag

SEQ ID NO: 390302 - DNA, 25 bp, Mus musculus
tggctgtaaggacgaatggaaactc

SEQ ID NO: 390303 - DNA, 25 bp, Mus musculus
gggtcgcttcctgaaagatatcttg

SEQ ID NO: 390304 - DNA, 25 bp, Mus musculus
aggcaacactgggttcgcctctgcc

SEQ ID NO: 390305 - DNA, 25 bp, Mus musculus
tctgagcctttctactgctctgggc

SEQ ID NO: 390306 - DNA, 25 bp, Mus musculus
ctgcgtggaaaagaggtcagctctg

SEQ ID NO: 390307 - DNA, 25 bp, Mus musculus
tccctaaggttctggtcttggaagc

SEQ ID NO: 390308 - DNA, 25 bp, Mus musculus
ccagagggataccagtggaccgctc

SEQ ID NO: 390309 - DNA, 25 bp, Mus musculus
tgaacgtctaggagtggagtacaca

SEQ ID NO: 390310 - DNA, 25 bp, Mus musculus
ttagcagagttgcagaggcccattg

SEQ ID NO: 390311 - DNA, 25 bp, Mus musculus
tcttctggcaccgtaaggtaagtta

SEQ ID NO: 390312 - DNA, 25 bp, Mus musculus
ccagcctggaatgggcaacctcgtg

SEQ ID NO: 390313 - DNA, 25 bp, Mus musculus
tcgggctccatctggaaaccgaggc

SEQ ID NO: 390314 - DNA, 25 bp, Mus musculus
ggcgcccaccagaagctagaggtga

SEQ ID NO: 390315 - DNA, 25 bp, Mus musculus
cccaccgacttcaggggatgaaatg

SEQ ID NO: 390316 - DNA, 25 bp, Mus musculus
tcgatcccgcctgctggctcagtgg

SEQ ID NO: 390317 - DNA, 25 bp, Mus musculus
cctttcgggcggaatggcaacgcct

SEQ ID NO: 390318 - DNA, 25 bp, Mus musculus
aaggaaggtctatgcgtttgaaagc

SEQ ID NO: 390319 - DNA, 25 bp, Mus musculus
gctcctccctgcgacattaagaagg

SEQ ID NO: 390320 - DNA, 25 bp, Mus musculus
tccaaggccggagttctgcaaacgc

SEQ ID NO: 390321 - DNA, 25 bp, Mus musculus
tcgcgagaccttaaagcgacggtta

SEQ ID NO: 390322 - DNA, 25 bp, Mus musculus
gcaacgcctcgaggggctcttctcg

SEQ ID NO: 390323 - DNA, 25 bp, Mus musculus
cgaccggctgtctgtcttcgcacgg

SEQ ID NO: 390324 - DNA, 25 bp, Mus musculus
gcacttctggcagtcgcggtttaca

SEQ ID NO: 390325 - DNA, 25 bp, Mus musculus
actcgctccctagggcaagaggcca

SEQ ID NO: 390326 - DNA, 25 bp, Mus musculus
cgccgggaagccagacacttgcgtt

SEQ ID NO: 390327 - DNA, 25 bp, Mus musculus
aaggcgctccgacgcgacgtccagt

SEQ ID NO: 390328 - DNA, 25 bp, Mus musculus
gaagcgctcgccatgttgccggcct

SEQ ID NO: 390329 - DNA, 25 bp, Mus musculus
gacggcctaacgacggcgctgctcg

SEQ ID NO: 390330 - DNA, 25 bp, Mus musculus
tgtgcatggcctgcggccgggcact

SEQ ID NO: 390331 - DNA, 25 bp, Mus musculus
gaatcggctggtgtgcatggcctgc

SEQ ID NO: 390332 - DNA, 25 bp, Mus musculus
cacttggacgacatccgtgctcacg

SEQ ID NO: 390333 - DNA, 25 bp, Mus musculus
agcctgcacttggacgacatccgtg

SEQ ID NO: 390334 - DNA, 25 bp, Mus musculus
agtgtctcatggactacgacccacg

SEQ ID NO: 390335 - DNA, 25 bp, Mus musculus
tccgggctgagtgtctcatggacta

SEQ ID NO: 390336 - DNA, 25 bp, Mus musculus
actggttccgggctgagtgtctcat

SEQ ID NO: 390337 - DNA, 25 bp, Mus musculus
ctgcagaactggttccgggctgagt

SEQ ID NO: 390338 - DNA, 25 bp, Mus musculus
gaggctgaaggagtcactgcagaac

SEQ ID NO: 390339 - DNA, 25 bp, Mus musculus
cactgcagaactggttccgggctga

SEQ ID NO: 390340 - DNA, 25 bp, Mus musculus
aggagtcactgcagaactggttccg

SEQ ID NO: 390341 - DNA, 25 bp, Mus musculus
gtctcatggactacgacccacgggg

SEQ ID NO: 390342 - DNA, 25 bp, Mus musculus
tgaaggagtcactgcagaactggtt

SEQ ID NO: 390343 - DNA, 25 bp, Mus musculus
gctgagtgtctcatggactacgacc

SEQ ID NO: 390344 - DNA, 25 bp, Mus musculus
cgccagaccattttagaggcctatg

SEQ ID NO: 390345 - DNA, 25 bp, Mus musculus
tccaggcactctttgtgcggtgctc

SEQ ID NO: 390346 - DNA, 25 bp, Mus musculus
agtgagcactcttggctgtccctga

SEQ ID NO: 390347 - DNA, 25 bp, Mus musculus
tgctgtgccagctagtacttgcgcc

SEQ ID NO: 390348 - DNA, 25 bp, Mus musculus
agtcgtcccgtgacactttgctgtg

SEQ ID NO: 390349 - DNA, 25 bp, Mus musculus
cttgggctgagagaccttgatgtca

SEQ ID NO: 390350 - DNA, 25 bp, Mus musculus
tagcagtcaccctgcgctgtcctgg

SEQ ID NO: 390351 - DNA, 25 bp, Mus musculus
agcgacacattctgcaggtgcatcc

SEQ ID NO: 390352 - DNA, 25 bp, Mus musculus
aaggtgagcaccatcaagcgacaca

SEQ ID NO: 390353 - DNA, 25 bp, Mus musculus
tacttgatggactacgacggcagcc

SEQ ID NO: 390354 - DNA, 25 bp, Mus musculus
cgacgaagatgacagccaggagccc

SEQ ID NO: 390355 - DNA, 25 bp, Mus musculus
ggtgcatcccttctccatggacttc

SEQ ID NO: 390356 - DNA, 25 bp, Mus musculus
aggcagccctttgttcttctccagg

SEQ ID NO: 390357 - DNA, 25 bp, Mus musculus
tgggcctgattgatggcactcgctc

SEQ ID NO: 390358 - DNA, 25 bp, Mus musculus
atgcgcaggcgcaagaactgtccct

SEQ ID NO: 390359 - DNA, 25 bp, Mus musculus
gagtggccgctgacgactccgccat

SEQ ID NO: 390360 - DNA, 25 bp, Mus musculus
tcccggcgacgcctgttcggaagac

SEQ ID NO: 390361 - DNA, 25 bp, Mus musculus
gacgcctgttcggaagactgactcc

SEQ ID NO: 390362 - DNA, 25 bp, Mus musculus
ggaagactgactccgacagactgac

SEQ ID NO: 390363 - DNA, 25 bp, Mus musculus
agactgactgactcagccgagctcc

SEQ ID NO: 390364 - DNA, 25 bp, Mus musculus
gccaagagactaaagccgcccacgg

SEQ ID NO: 390365 - DNA, 25 bp, Mus musculus
tgcgcacaaagagcctggacgcgcg

SEQ ID NO: 390366 - DNA, 25 bp, Mus musculus
ccgcacacgaggagccgcagctctt

SEQ ID NO: 390367 - DNA, 25 bp, Mus musculus
caggcgcaagaactgtccctctgcg

SEQ ID NO: 390368 - DNA, 25 bp, Mus musculus
tctgcgctcccgcaggaaaggacgc

SEQ ID NO: 390369 - DNA, 25 bp, Mus musculus
cccgcaggaaaggacgcagtgactg

SEQ ID NO: 390370 - DNA, 25 bp, Mus musculus
agcgcgcatgcgcacaaagagcctg

SEQ ID NO: 390371 - DNA, 25 bp, Mus musculus
gggacacagaataatccagcagctg

SEQ ID NO: 390372 - DNA, 25 bp, Mus musculus
cgaagcgttcgcgtcatcatgttaa

SEQ ID NO: 390373 - DNA, 25 bp, Mus musculus
cacctgtagtcctggccagcgagga

SEQ ID NO: 390374 - DNA, 25 bp, Mus musculus
ttcagcggtaggaagacccactcgg

SEQ ID NO: 390375 - DNA, 25 bp, Mus musculus
cctttgcaaggcctaatgggagttg

SEQ ID NO: 390376 - DNA, 25 bp, Mus musculus
ggacccgacattccagtacgcagtc

SEQ ID NO: 390377 - DNA, 25 bp, Mus musculus
gggtcttccgagagccctcctcatt

SEQ ID NO: 390378 - DNA, 25 bp, Mus musculus
gccgccgccttttttggtgtggcga

SEQ ID NO: 390379 - DNA, 25 bp, Mus musculus
cagtgcttcggctccgaggtgacaa

SEQ ID NO: 390380 - DNA, 25 bp, Mus musculus
agcaggtgaggcgtccaattttccc

SEQ ID NO: 390381 - DNA, 25 bp, Mus musculus
cctcagcgaactgcagcggtggcat

SEQ ID NO: 390382 - DNA, 25 bp, Mus musculus
acttctgctgaaggaggaggctcca

SEQ ID NO: 390383 - DNA, 25 bp, Mus musculus
gtcttctctgcctctgctacttctg

SEQ ID NO: 390384 - DNA, 25 bp, Mus musculus
tgtctcctgagctgtaggctttctc

SEQ ID NO: 390385 - DNA, 25 bp, Mus musculus
cagtcacaggtacccgcggcacgat

SEQ ID NO: 390386 - DNA, 25 bp, Mus musculus
gcgccagtgtctacgcatacgctta

SEQ ID NO: 390387 - DNA, 25 bp, Mus musculus
tacgcatacgcttactgcacagttg

SEQ ID NO: 390388 - DNA, 25 bp, Mus musculus
tactgcacagttgcagcggcccaca

SEQ ID NO: 390389 - DNA, 25 bp, Mus musculus
tttgacacgcgctccctggaggcga

SEQ ID NO: 390390 - DNA, 25 bp, Mus musculus
ccagtgcccatgatcccggggctag

SEQ ID NO: 390391 - DNA, 25 bp, Mus musculus
ctgcaggcgcgttgtccctgctggc

SEQ ID NO: 390392 - DNA, 25 bp, Mus musculus
ttccgttgagttgctggggcgcctt

SEQ ID NO: 390393 - DNA, 25 bp, Mus musculus
gcgcctgcctttccgttgagttgct

SEQ ID NO: 390394 - DNA, 25 bp, Mus musculus
actcctgcgtggagcgcctgccttt

SEQ ID NO: 390395 - DNA, 25 bp, Mus musculus
atgaatgacctaactcctgcgtgga

SEQ ID NO: 390396 - DNA, 25 bp, Mus musculus
ctttgcgtgactcatgaatgaccta

SEQ ID NO: 390397 - DNA, 25 bp, Mus musculus
cgcgtctttgcgtgactcatgaatg

SEQ ID NO: 390398 - DNA, 25 bp, Mus musculus
gcctttccagggtcccatggccacg

SEQ ID NO: 390399 - DNA, 25 bp, Mus musculus
atgatcccggggctaggcggaccct

SEQ ID NO: 390400 - DNA, 25 bp, Mus musculus
agagaagtcttttcgcacctccagc

SEQ ID NO: 390401 - DNA, 25 bp, Mus musculus
cccggtccgcctcttaaagagatgc

SEQ ID NO: 390402 - DNA, 25 bp, Mus musculus
gcggcgcccgaacgatgataaccac

SEQ ID NO: 390403 - DNA, 25 bp, Mus musculus
ctcatggtgcctgcagaaacggtga

SEQ ID NO: 390404 - DNA, 25 bp, Mus musculus
gcttcctaactgcttctgccgctgg

SEQ ID NO: 390405 - DNA, 25 bp, Mus musculus
gcctgtagtcagtgaggcagctcta

SEQ ID NO: 390406 - DNA, 25 bp, Mus musculus
ttcatgtccacttcggtgtcctggc

SEQ ID NO: 390407 - DNA, 25 bp, Mus musculus
cttctccggttctagctcgttcagc

SEQ ID NO: 390408 - DNA, 25 bp, Mus musculus
ccgctgcattcatgggctgcttctc

SEQ ID NO: 390409 - DNA, 25 bp, Mus musculus
atgcccagccaaccgagccagaaga

SEQ ID NO: 390410 - DNA, 25 bp, Mus musculus
ccgtgaggctagcagagcttcctaa

SEQ ID NO: 390411 - DNA, 25 bp, Mus musculus
agcctcgctgaatactcccgtctat

SEQ ID NO: 390412 - DNA, 25 bp, Mus musculus
cctccttggataagccggtgaactt

SEQ ID NO: 390413 - DNA, 25 bp, Mus musculus
aaacggtgacacgacacggcctgta

SEQ ID NO: 390414 - DNA, 25 bp, Mus musculus
gagatggatcaacacgcggcttagc

SEQ ID NO: 390415 - DNA, 25 bp, Mus musculus
cgctgcgctgacaacctggacatca

SEQ ID NO: 390416 - DNA, 25 bp, Mus musculus
gtgttcagtaggttcaggatccata

SEQ ID NO: 390417 - DNA, 25 bp, Mus musculus
gagaaatcgcctcaacgtatggata

SEQ ID NO: 390418 - DNA, 25 bp, Mus musculus
tggatattggtagttgtgacccaga

SEQ ID NO: 390419 - DNA, 25 bp, Mus musculus
gtgacccagacagtcgagctgtatg

SEQ ID NO: 390420 - DNA, 25 bp, Mus musculus
tgtatgggtcgcgaaccaaaatctc

SEQ ID NO: 390421 - DNA, 25 bp, Mus musculus
atctccagcgatgacgttttacccg

SEQ ID NO: 390422 - DNA, 25 bp, Mus musculus
acccgcagtgagtaagaaccgccta

SEQ ID NO: 390423 - DNA, 25 bp, Mus musculus
agcgccaaaggcgtagcgtcgcact

SEQ ID NO: 390424 - DNA, 25 bp, Mus musculus
tgcgcctctttttcgcgctgcaaaa

SEQ ID NO: 390425 - DNA, 25 bp, Mus musculus
cgcgctgcaaaatcagaggcggagc

SEQ ID NO: 390426 - DNA, 25 bp, Mus musculus
gggcggattcctctacccacaattc

SEQ ID NO: 390427 - DNA, 25 bp, Mus musculus
gacaccgtcggtggagtgttcagta

SEQ ID NO: 390428 - DNA, 25 bp, Mus musculus
ctgagaccggcatcctgaaaggtga

SEQ ID NO: 390429 - DNA, 25 bp, Mus musculus
ttcagcggaaacatgcggcaaattt

SEQ ID NO: 390430 - DNA, 25 bp, Mus musculus
taggggtgaaccttcagcggaaaca

SEQ ID NO: 390431 - DNA, 25 bp, Mus musculus
gcgtgactgacgtcctcgtccctta

SEQ ID NO: 390432 - DNA, 25 bp, Mus musculus
tgcaggggtcgcttgtttgtcaccc

SEQ ID NO: 390433 - DNA, 25 bp, Mus musculus
tcctgaaaggtgagtattagagttg

SEQ ID NO: 390434 - DNA, 25 bp, Mus musculus
cggcaaatttcacaccgtccggaca

SEQ ID NO: 390435 - DNA, 25 bp, Mus musculus
cggcgctcgctgatgatgcagtagt

SEQ ID NO: 390436 - DNA, 25 bp, Mus musculus
aagtgcaagccacgggctggtctgc

SEQ ID NO: 390437 - DNA, 25 bp, Mus musculus
tctgcgatggcgactgcctcggctc

SEQ ID NO: 390438 - DNA, 25 bp, Mus musculus
gcctcggctcgctggaaccatgtgt

SEQ ID NO: 390439 - DNA, 25 bp, Mus musculus
ctggaaccatgtgtgggtcggcact

SEQ ID NO: 390440 - DNA, 25 bp, Mus musculus
tcggcactgagaccggcatcctgaa

SEQ ID NO: 390441 - DNA, 25 bp, Mus musculus
ttagagttgtttgtgggacagtgca

SEQ ID NO: 390442 - DNA, 25 bp, Mus musculus
gccgcggtggcagtctaaccaatag

SEQ ID NO: 390443 - DNA, 25 bp, Mus musculus
ggcggctccgcgtaagcgaatacct

SEQ ID NO: 390444 - DNA, 25 bp, Mus musculus
caggagtaagtcctgctggcggctc

SEQ ID NO: 390445 - DNA, 25 bp, Mus musculus
agtccagcctctgtcgttcggctca

SEQ ID NO: 390446 - DNA, 25 bp, Mus musculus
ttcgcttcagtaggagtccagcctc

SEQ ID NO: 390447 - DNA, 25 bp, Mus musculus
acagaagaggtagggtttcgcttca

SEQ ID NO: 390448 - DNA, 25 bp, Mus musculus
acaagtccttcgaggaggcggcaac

SEQ ID NO: 390449 - DNA, 25 bp, Mus musculus
ggtccggcttccactgcttacaagt

SEQ ID NO: 390450 - DNA, 25 bp, Mus musculus
cggctcctgttctttggtccggctt

SEQ ID NO: 390451 - DNA, 25 bp, Mus musculus
tacgtctaggtgacgtggcggctcc

SEQ ID NO: 390452 - DNA, 25 bp, Mus musculus
cgtcaccgagttaggagtacgtcta

SEQ ID NO: 390453 - DNA, 25 bp, Mus musculus
cgcagcagccacgtcaccgagttag

SEQ ID NO: 390454 - DNA, 25 bp, Mus musculus
ctaaccaataggagagcggagtcga

SEQ ID NO: 390455 - DNA, 25 bp, Mus musculus
gtgtgttctttctgtctctgggcta

SEQ ID NO: 390456 - DNA, 25 bp, Mus musculus
tgggccgttactcccgttcagaggc

SEQ ID NO: 390457 - DNA, 25 bp, Mus musculus
caggctcagagagcgcgttcacgtc

SEQ ID NO: 390458 - DNA, 25 bp, Mus musculus
catggcggacgaagggaagtcatac

SEQ ID NO: 390459 - DNA, 25 bp, Mus musculus
gagagattctgtcctgagcgctaag

SEQ ID NO: 390460 - DNA, 25 bp, Mus musculus
cgcgacgtgcttcgccggataaatg

SEQ ID NO: 390461 - DNA, 25 bp, Mus musculus
ctgcgacttactcgctgccgggatc

SEQ ID NO: 390462 - DNA, 25 bp, Mus musculus
gaccgggccagcgaagaaataggaa

SEQ ID NO: 390463 - DNA, 25 bp, Mus musculus
gttcagtgctaacgcagagggttta

SEQ ID NO: 390464 - DNA, 25 bp, Mus musculus
gaccctgctcctcttgagttcagtg

SEQ ID NO: 390465 - DNA, 25 bp, Mus musculus
ttcagaggccaggtctccattcttg

SEQ ID NO: 390466 - DNA, 25 bp, Mus musculus
agtcatacaacggtcagtgcggggc

SEQ ID NO: 390467 - DNA, 25 bp, Mus musculus
ctggcaaggaactgagctgcgactt

SEQ ID NO: 390468 - DNA, 25 bp, Mus musculus
ttcgtcgtggagatgagaaaagcta

SEQ ID NO: 390469 - DNA, 25 bp, Mus musculus
ccattcttgtgtgtagccctcgacc

SEQ ID NO: 390470 - DNA, 25 bp, Mus musculus
cgaggtcatcgccaaagccgcctaa

SEQ ID NO: 390471 - DNA, 25 bp, Mus musculus
caggagagaggtgagcctggcggtc

SEQ ID NO: 390472 - DNA, 25 bp, Mus musculus
cggggtgccaggctccgtacctggc

SEQ ID NO: 390473 - DNA, 25 bp, Mus musculus
gcttcatcgaggtcatcgccaaagc

SEQ ID NO: 390474 - DNA, 25 bp, Mus musculus
tcatcgaggtcatcgccaaagccgc

SEQ ID NO: 390475 - DNA, 25 bp, Mus musculus
aggtcatcgccaaagccgcctaagc

SEQ ID NO: 390476 - DNA, 25 bp, Mus musculus
aggagaaggcgaggacgacgaagag

SEQ ID NO: 390477 - DNA, 25 bp, Mus musculus
gcgctccaggccaggtggcaccttg

SEQ ID NO: 390478 - DNA, 25 bp, Mus musculus
tccaggccaggtggcaccttgcgaa

SEQ ID NO: 390479 - DNA, 25 bp, Mus musculus
aggccaggtggcaccttgcgaaatc

SEQ ID NO: 390480 - DNA, 25 bp, Mus musculus
ccaggtggcaccttgcgaaatccga

SEQ ID NO: 390481 - DNA, 25 bp, Mus musculus
aggtggcaccttgcgaaatccgaga

SEQ ID NO: 390482 - DNA, 25 bp, Mus musculus
tggcaccttgcgaaatccgagaggg

SEQ ID NO: 390483 - DNA, 25 bp, Mus musculus
gggagaggctctggcgacaggcgcc

SEQ ID NO: 390484 - DNA, 25 bp, Mus musculus
tggatcccgtcctctcgaagtcttg

SEQ ID NO: 390485 - DNA, 25 bp, Mus musculus
tcgaagtcttgcgatgagatccgcc

SEQ ID NO: 390486 - DNA, 25 bp, Mus musculus
gaggatggacacaaaccttagtgcc

SEQ ID NO: 390487 - DNA, 25 bp, Mus musculus
ttgcgatgagatccgccatcctcct

SEQ ID NO: 390488 - DNA, 25 bp, Mus musculus
tgaaagtccggcaactctcctcggc

SEQ ID NO: 390489 - DNA, 25 bp, Mus musculus
ccctcctgtatcacacgcttttgga

SEQ ID NO: 390490 - DNA, 25 bp, Mus musculus
gtatcacacgcttttggatcccgtc

SEQ ID NO: 390491 - DNA, 25 bp, Mus musculus
ccttagtgccatcctgaaagtccgg

SEQ ID NO: 390492 - DNA, 25 bp, Mus musculus
cttcagaagagacgctgggaaagtg

SEQ ID NO: 390493 - DNA, 25 bp, Mus musculus
tttcggcaacttccggactcgctcg

SEQ ID NO: 390494 - DNA, 25 bp, Mus musculus
gactcgctcggtagcttccggacct

SEQ ID NO: 390495 - DNA, 25 bp, Mus musculus
tccggacctgtttcggcaactccta

SEQ ID NO: 390496 - DNA, 25 bp, Mus musculus
tgtttcggcaactcctagcgcctcg

SEQ ID NO: 390497 - DNA, 25 bp, Mus musculus
atgcgcaccgcgcttcagaagagac

SEQ ID NO: 390498 - DNA, 25 bp, Mus musculus
ttttgtgcgggtcagggcatcttct

SEQ ID NO: 390499 - DNA, 25 bp, Mus musculus
cccggagacggaagtgcgccgccat

SEQ ID NO: 390500 - DNA, 25 bp, Mus musculus
cgctgcggaatgtcagccacctttt

SEQ ID NO: 390501 - DNA, 25 bp, Mus musculus
gccaccttttgtctgtgctgcggtc

SEQ ID NO: 390502 - DNA, 25 bp, Mus musculus
ctgtgctgcggtcccaaaatgtgcc

SEQ ID NO: 390503 - DNA, 25 bp, Mus musculus
ccggtatttgcaaaatggcgtccca

SEQ ID NO: 390504 - DNA, 25 bp, Mus musculus
gtcccacgggatgtgctgctcttcc

SEQ ID NO: 390505 - DNA, 25 bp, Mus musculus
gggccgcttctttgccatccttgga

SEQ ID NO: 390506 - DNA, 25 bp, Mus musculus
ccatccttggactgttttgtgcggg

SEQ ID NO: 390507 - DNA, 25 bp, Mus musculus
gggcatcttctggacctccctggct

SEQ ID NO: 390508 - DNA, 25 bp, Mus musculus
gacctccctggctgttgcagccttg

SEQ ID NO: 390509 - DNA, 25 bp, Mus musculus
gttgcagccttgtccagacctctga

SEQ ID NO: 390510 - DNA, 25 bp, Mus musculus
gacctctgagccgagtacctgcgga

SEQ ID NO: 390511 - DNA, 25 bp, Mus musculus
tgcggaggctccgaaccggagctac

SEQ ID NO: 390512 - DNA, 25 bp, Mus musculus
acgggctttcgtcaccctgagggct

SEQ ID NO: 390513 - DNA, 25 bp, Mus musculus
gtgtggctttattctccgaggcgcc

SEQ ID NO: 390514 - DNA, 25 bp, Mus musculus
tacagcgagtagtcggagagcgccc

SEQ ID NO: 390515 - DNA, 25 bp, Mus musculus
cctcacagcggcaggtacagcgagt

SEQ ID NO: 390516 - DNA, 25 bp, Mus musculus
gcccacgagcatagacacgtcactt

SEQ ID NO: 390517 - DNA, 25 bp, Mus musculus
gccatggcgcccaggctaccaggaa

SEQ ID NO: 390518 - DNA, 25 bp, Mus musculus
aagagctcaactcgctgcaaccagg

SEQ ID NO: 390519 - DNA, 25 bp, Mus musculus
ttttccgcaccgaatccggggcagc

SEQ ID NO: 390520 - DNA, 25 bp, Mus musculus
ctcttctggaagacgtctcgcgttc

SEQ ID NO: 390521 - DNA, 25 bp, Mus musculus
tataaaccggaagtgtggggcgcca

SEQ ID NO: 390522 - DNA, 25 bp, Mus musculus
cggcctgacgccctgcgattataaa

SEQ ID NO: 390523 - DNA, 25 bp, Mus musculus
cccatatggggcaggaaaggcagtt

SEQ ID NO: 390524 - DNA, 25 bp, Mus musculus
tacggccgatcatgggcagcttctg

SEQ ID NO: 390525 - DNA, 25 bp, Mus musculus
ggcagccgcaggctccttcttgtct

SEQ ID NO: 390526 - DNA, 25 bp, Mus musculus
ggcaggacctgctcacctgcagact

SEQ ID NO: 390527 - DNA, 25 bp, Mus musculus
tatgtgcgggtaaagccactagggc

SEQ ID NO: 390528 - DNA, 25 bp, Mus musculus
cactagggcgacgttggtcacgtga

SEQ ID NO: 390529 - DNA, 25 bp, Mus musculus
ccacctcaagattggccagtgtgta

SEQ ID NO: 390530 - DNA, 25 bp, Mus musculus
gttttccgcccaccaaagaggcata

SEQ ID NO: 390531 - DNA, 25 bp, Mus musculus
ggccgtctactgagttttccgccca

SEQ ID NO: 390532 - DNA, 25 bp, Mus musculus
gagccaatcggtggccgtctactga

SEQ ID NO: 390533 - DNA, 25 bp, Mus musculus
cctccatatgcggagccaatcggtg

SEQ ID NO: 390534 - DNA, 25 bp, Mus musculus
ccagtgtgtatgtgcgggtaaagcc

SEQ ID NO: 390535 - DNA, 25 bp, Mus musculus
tcacctgcagactccggggttggga

SEQ ID NO: 390536 - DNA, 25 bp, Mus musculus
cgatccctggatcggggcaggacct

SEQ ID NO: 390537 - DNA, 25 bp, Mus musculus
agagcaccgcgggaagcgatccctg

SEQ ID NO: 390538 - DNA, 25 bp, Mus musculus
ctccgtggctggtgagcagagcacc

SEQ ID NO: 390539 - DNA, 25 bp, Mus musculus
agggacggctgcttccactcaccgg

SEQ ID NO: 390540 - DNA, 25 bp, Mus musculus
cgcttccgtgctacgaggcacttga

SEQ ID NO: 390541 - DNA, 25 bp, Mus musculus
aagtgagggaactccgtcgtcctcg

SEQ ID NO: 390542 - DNA, 25 bp, Mus musculus
cgccgtcttgttttgcgctcagtga

SEQ ID NO: 390543 - DNA, 25 bp, Mus musculus
gaactggcagccaagccgggcttca

SEQ ID NO: 390544 - DNA, 25 bp, Mus musculus
aggcgacataaacacgccgcgaaga

SEQ ID NO: 390545 - DNA, 25 bp, Mus musculus
aagcggctgaaagtgaccgagctgc

SEQ ID NO: 390546 - DNA, 25 bp, Mus musculus
ttcgcgcggcctcaaaatggatctg

SEQ ID NO: 390547 - DNA, 25 bp, Mus musculus
cagcgtcttcaggaggcactggatg

SEQ ID NO: 390548 - DNA, 25 bp, Mus musculus
gacgaggaaccaccacctgctcagg

SEQ ID NO: 390549 - DNA, 25 bp, Mus musculus
agacgtcagccatggaggccgagtc

SEQ ID NO: 390550 - DNA, 25 bp, Mus musculus
ggccgagtccgaagcttccgacaca

SEQ ID NO: 390551 - DNA, 25 bp, Mus musculus
gtggcgaagagcatgacaacggcaa

SEQ ID NO: 390552 - DNA, 25 bp, Mus musculus
ccgtagaggaacaaggtgaggaact

SEQ ID NO: 390553 - DNA, 25 bp, Mus musculus
tacagagtgtgtcggaagctgctcc

SEQ ID NO: 390554 - DNA, 25 bp, Mus musculus
gcgtgcctccatgcgggtacgaaca

SEQ ID NO: 390555 - DNA, 25 bp, Mus musculus
cgggtacgaacaggcagccgccatc

SEQ ID NO: 390556 - DNA, 25 bp, Mus musculus
cgccatcttgggcattggctgccgc

SEQ ID NO: 390557 - DNA, 25 bp, Mus musculus
accctgctcgcccttgtgtggttct

SEQ ID NO: 390558 - DNA, 25 bp, Mus musculus
ttgtgtggttctcgccgcttacgtt

SEQ ID NO: 390559 - DNA, 25 bp, Mus musculus
atccttacaatgtctaacgggctcg

SEQ ID NO: 390560 - DNA, 25 bp, Mus musculus
ctcgtgtgaatgctccgcggcttct

SEQ ID NO: 390561 - DNA, 25 bp, Mus musculus
cgcggcttctgagcgctcgttttaa

SEQ ID NO: 390562 - DNA, 25 bp, Mus musculus
attttaagagcaccctcggcgcgtg

SEQ ID NO: 390563 - DNA, 25 bp, Mus musculus
gctggggaccgccattttaagagca

SEQ ID NO: 390564 - DNA, 25 bp, Mus musculus
cgcataagggatcgttccctattgg

SEQ ID NO: 390565 - DNA, 25 bp, Mus musculus
ggcgctcgggcaccttatactttgc

SEQ ID NO: 390566 - DNA, 25 bp, Mus musculus
tttgcgatctccaatccttacaatg

SEQ ID NO: 390567 - DNA, 25 bp, Mus musculus
ttacgttgcgcgctcgtgtgaatgc

SEQ ID NO: 390568 - DNA, 25 bp, Mus musculus
tccacgtgacacaaacagaccgggc

SEQ ID NO: 390569 - DNA, 25 bp, Mus musculus
tgggcgctattcacggtgtttctgc

SEQ ID NO: 390570 - DNA, 25 bp, Mus musculus
aaggctctggccctcacagggaacc

SEQ ID NO: 390571 - DNA, 25 bp, Mus musculus
acccgtccaccctgcctccacgtga

SEQ ID NO: 390572 - DNA, 25 bp, Mus musculus
gacacaaacagaccgggcacttccg

SEQ ID NO: 390573 - DNA, 25 bp, Mus musculus
gtctcccgccccgtgagttagcgag

SEQ ID NO: 390574 - DNA, 25 bp, Mus musculus
gggctgacccttgcggtcttccttc

SEQ ID NO: 390575 - DNA, 25 bp, Mus musculus
ccctcacagggaaccagggcatcga

SEQ ID NO: 390576 - DNA, 25 bp, Mus musculus
gacccttgcggtcttccttctggtc

SEQ ID NO: 390577 - DNA, 25 bp, Mus musculus
agagcctcatcgagatgggctttcc

SEQ ID NO: 390578 - DNA, 25 bp, Mus musculus
atcgagatgggctttcccaggggac

SEQ ID NO: 390579 - DNA, 25 bp, Mus musculus
ggccggcctgactgtcaccatggct

SEQ ID NO: 390580 - DNA, 25 bp, Mus musculus
tcaccatggctggtgggcgctattc

SEQ ID NO: 390581 - DNA, 25 bp, Mus musculus
cacagggaaccagggcatcgaggct

SEQ ID NO: 390582 - DNA, 25 bp, Mus musculus
actgcgggacctagctacatttctg

SEQ ID NO: 390583 - DNA, 25 bp, Mus musculus
tgcagaaccttacatgcgcatcttt

SEQ ID NO: 390584 - DNA, 25 bp, Mus musculus
ccacctcaagaagcgggcgtacgta

SEQ ID NO: 390585 - DNA, 25 bp, Mus musculus
gggctgactacgaagcaccacctca

SEQ ID NO: 390586 - DNA, 25 bp, Mus musculus
ttcaagcgccgcagggtattaagca

SEQ ID NO: 390587 - DNA, 25 bp, Mus musculus
gcgcatctttttcttccgcaggagc

SEQ ID NO: 390588 - DNA, 25 bp, Mus musculus
tgcttcccggcattttcctctttgg

SEQ ID NO: 390589 - DNA, 25 bp, Mus musculus
cctccgggaggaaagatcaatcgtc

SEQ ID NO: 390590 - DNA, 25 bp, Mus musculus
gcaacgcgcggaacaaccttatata

SEQ ID NO: 390591 - DNA, 25 bp, Mus musculus
ccagtagttccctcgcatataaaga

SEQ ID NO: 390592 - DNA, 25 bp, Mus musculus
agtcaggcccagttcccagtagttc

SEQ ID NO: 390593 - DNA, 25 bp, Mus musculus
cacggttaagtgttccggcgtctga

SEQ ID NO: 390594 - DNA, 25 bp, Mus musculus
cgggagcgtcaatgtcgacctaaaa

SEQ ID NO: 390595 - DNA, 25 bp, Mus musculus
tctgaggatagaacccgcgaacggg

SEQ ID NO: 390596 - DNA, 25 bp, Mus musculus
gtcgcgtttccagtcagcacgcatg

SEQ ID NO: 390597 - DNA, 25 bp, Mus musculus
tggtcgcgtcttcccggaactcagg

SEQ ID NO: 390598 - DNA, 25 bp, Mus musculus
gatgcgacgcggaaccaaagtacta

SEQ ID NO: 390599 - DNA, 25 bp, Mus musculus
agtactagggctccagacttagccg

SEQ ID NO: 390600 - DNA, 25 bp, Mus musculus
gacttagccggacggattttcctga

SEQ ID NO: 390601 - DNA, 25 bp, Mus musculus
attttcctgagaggcggggtcgata

SEQ ID NO: 390602 - DNA, 25 bp, Mus musculus
gggtcgatagtttctgtcgcgtttc

SEQ ID NO: 390603 - DNA, 25 bp, Mus musculus
ggatgtccgcgttgtgcgaccctcc

SEQ ID NO: 390604 - DNA, 25 bp, Mus musculus
tcccgcgcctctcaggtagtcagag

SEQ ID NO: 390605 - DNA, 25 bp, Mus musculus
cttctcctcagaaagctggatctta

SEQ ID NO: 390606 - DNA, 25 bp, Mus musculus
ggatcttacctagagaacccgcgtc

SEQ ID NO: 390607 - DNA, 25 bp, Mus musculus
ctcagagattctggtcgcgtcttcc

SEQ ID NO: 390608 - DNA, 25 bp, Mus musculus
agtcagcacgcatgcgtcgcctgtg

SEQ ID NO: 390609 - DNA, 25 bp, Mus musculus
cccgcgtcaggattctcagagattc

SEQ ID NO: 390610 - DNA, 25 bp, Mus musculus
agattcacgagtcgctgcggccctt

SEQ ID NO: 390611 - DNA, 25 bp, Mus musculus
ggtggtcaatgctttcgtctccttc

SEQ ID NO: 390612 - DNA, 25 bp, Mus musculus
taaagaacgcgctcgaccaatggga

SEQ ID NO: 390613 - DNA, 25 bp, Mus musculus
accaatgggatagacgtccggccgc

SEQ ID NO: 390614 - DNA, 25 bp, Mus musculus
ctctggacgagccaatcggaaggcc

SEQ ID NO: 390615 - DNA, 25 bp, Mus musculus
tacgtggctcaacgtgcacaggggc

SEQ ID NO: 390616 - DNA, 25 bp, Mus musculus
gtcaaggagcaaacccggtacaaga

SEQ ID NO: 390617 - DNA, 25 bp, Mus musculus
ttttgtatgccttcccatcaccctg

SEQ ID NO: 390618 - DNA, 25 bp, Mus musculus
tacttctggcctcgcaacgggctct

SEQ ID NO: 390619 - DNA, 25 bp, Mus musculus
caacgggctctttgtcctcgtggtg

SEQ ID NO: 390620 - DNA, 25 bp, Mus musculus
ggttcctgaatctcgccgggcttag

SEQ ID NO: 390621 - DNA, 25 bp, Mus musculus
tcgccgggcttagaaaggctgaagc

SEQ ID NO: 390622 - DNA, 25 bp, Mus musculus
aaggctgaagctgggtgctgtcttc

SEQ ID NO: 390623 - DNA, 25 bp, Mus musculus
tgtcttcggtcttgtccgctcccag

SEQ ID NO: 390624 - DNA, 25 bp, Mus musculus
ccacgacgtagacgactgtgttctc

SEQ ID NO: 390625 - DNA, 25 bp, Mus musculus
tgccagagagcttcttctgcaagaa

SEQ ID NO: 390626 - DNA, 25 bp, Mus musculus
gtgcgcagctgccagagagcttctt

SEQ ID NO: 390627 - DNA, 25 bp, Mus musculus
cgaaacctgttgagggtgcgcagct

SEQ ID NO: 390628 - DNA, 25 bp, Mus musculus
tcgaaggctgggatgcgaaacctgt

SEQ ID NO: 390629 - DNA, 25 bp, Mus musculus
cgtctgcctggggaaaccgcgcttc

SEQ ID NO: 390630 - DNA, 25 bp, Mus musculus
ccgggtggcactcctgagttcagac

SEQ ID NO: 390631 - DNA, 25 bp, Mus musculus
ctgagttcagactcctgcgcgatga

SEQ ID NO: 390632 - DNA, 25 bp, Mus musculus
tgtttcaaacgcgtctgcctgggga

SEQ ID NO: 390633 - DNA, 25 bp, Mus musculus
ctcctgcgcgatgatgtacactctg

SEQ ID NO: 390634 - DNA, 25 bp, Mus musculus
cgatgatgtacactctggagcggcc

SEQ ID NO: 390635 - DNA, 25 bp, Mus musculus
cgggtcactgccgtgtaaacatgtt

SEQ ID NO: 390636 - DNA, 25 bp, Mus musculus
gtgtaaacatgttgccagtgctggc

SEQ ID NO: 390637 - DNA, 25 bp, Mus musculus
ctgcaagaagtgtttcaaacgcgtc

SEQ ID NO: 390638 - DNA, 25 bp, Mus musculus
aacgtgtttcttgcctacttcctgg

SEQ ID NO: 390639 - DNA, 25 bp, Mus musculus
ggtcccaggtgtcgctcagagtccc

SEQ ID NO: 390640 - DNA, 25 bp, Mus musculus
ccactagccggaagtggtcccaggt

SEQ ID NO: 390641 - DNA, 25 bp, Mus musculus
ccctgaatggcctaccaggaggcgg

SEQ ID NO: 390642 - DNA, 25 bp, Mus musculus
tcaacgccctgaatggcctaccagg

SEQ ID NO: 390643 - DNA, 25 bp, Mus musculus
agcggatatagcgtcaacgccctga

SEQ ID NO: 390644 - DNA, 25 bp, Mus musculus
gaccgcttgacccagcggatatagc

SEQ ID NO: 390645 - DNA, 25 bp, Mus musculus
tcggcagtctgcaactccgcggata

SEQ ID NO: 390646 - DNA, 25 bp, Mus musculus
gcctacttcctggtgtcgatcgccg

SEQ ID NO: 390647 - DNA, 25 bp, Mus musculus
gtggcaccggccatgaagctgaagc

SEQ ID NO: 390648 - DNA, 25 bp, Mus musculus
gcaactccgcggataccggtcaagc

SEQ ID NO: 390649 - DNA, 25 bp, Mus musculus
cccttgtgtagaactctcggcagtc

SEQ ID NO: 390650 - DNA, 25 bp, Mus musculus
agctgaagctgaagaacgtgtttct

SEQ ID NO: 390651 - DNA, 25 bp, Mus musculus
atgagacccgcagacagcggcttcc

SEQ ID NO: 390652 - DNA, 25 bp, Mus musculus
gttgtagagggcagatcttcgctcc

SEQ ID NO: 390653 - DNA, 25 bp, Mus musculus
gcaactctgcattctgctgctcagg

SEQ ID NO: 390654 - DNA, 25 bp, Mus musculus
tgacgcgatcccgaagcaactctgc

SEQ ID NO: 390655 - DNA, 25 bp, Mus musculus
gctacccgcgagactctgacgcgat

SEQ ID NO: 390656 - DNA, 25 bp, Mus musculus
tgtcgctcaccaagggaacctctgg

SEQ ID NO: 390657 - DNA, 25 bp, Mus musculus
ccagtttagcatcgatgatgccttc

SEQ ID NO: 390658 - DNA, 25 bp, Mus musculus
aggtgaacggccctgctcgtctcac

SEQ ID NO: 390659 - DNA, 25 bp, Mus musculus
ccggctacgctaccaggtgaacggc

SEQ ID NO: 390660 - DNA, 25 bp, Mus musculus
tgaagacaagcagtcccggctacgc

SEQ ID NO: 390661 - DNA, 25 bp, Mus musculus
ttcgaggtggctgatgaagacaagc

SEQ ID NO: 390662 - DNA, 25 bp, Mus musculus
ctgcacttcgaacgccgggctcggt

SEQ ID NO: 390663 - DNA, 25 bp, Mus musculus
atgccttcgagctgaccctggagga

SEQ ID NO: 390664 - DNA, 25 bp, Mus musculus
gagaattctaactccggagcctctg

SEQ ID NO: 390665 - DNA, 25 bp, Mus musculus
ggcagatcttcgctcccagggagac

SEQ ID NO: 390666 - DNA, 25 bp, Mus musculus
cttaagagacccagatctcaagctc

SEQ ID NO: 390667 - DNA, 25 bp, Mus musculus
tggattccctgagcgccagccggac

SEQ ID NO: 390668 - DNA, 25 bp, Mus musculus
cgccctgccctttcgcggaagtgag

SEQ ID NO: 390669 - DNA, 25 bp, Mus musculus
tctagtggcgtgctcgcgtgctcct

SEQ ID NO: 390670 - DNA, 25 bp, Mus musculus
ctggaccgctgtctagtggcgtgct

SEQ ID NO: 390671 - DNA, 25 bp, Mus musculus
tgctagtgctggaccgctgtctagt

SEQ ID NO: 390672 - DNA, 25 bp, Mus musculus
cagccggacgggcactgctagtgct

SEQ ID NO: 390673 - DNA, 25 bp, Mus musculus
aagtgagtttggtacgctgggcttc

SEQ ID NO: 390674 - DNA, 25 bp, Mus musculus
ccgcgcctgtttgtgctgcagcgca

SEQ ID NO: 390675 - DNA, 25 bp, Mus musculus
gcttcaggcttaagagacccagatc

SEQ ID NO: 390676 - DNA, 25 bp, Mus musculus
tacgctgggcttcaggcttaagaga

SEQ ID NO: 390677 - DNA, 25 bp, Mus musculus
cgtggcctggattccctgagcgcca

SEQ ID NO: 390678 - DNA, 25 bp, Mus musculus
tgccctttcgcggaagtgagtttgg

SEQ ID NO: 390679 - DNA, 25 bp, Mus musculus
tccgacgacgctgctcggagcaacg

SEQ ID NO: 390680 - DNA, 25 bp, Mus musculus
gacgctaggagctggaacctcactc

SEQ ID NO: 390681 - DNA, 25 bp, Mus musculus
ctcactccggtcaggcaggaatcga

SEQ ID NO: 390682 - DNA, 25 bp, Mus musculus
ctcgttccggaagaagccgagtaga

SEQ ID NO: 390683 - DNA, 25 bp, Mus musculus
tcttgagacctgtgactggatcgcc

SEQ ID NO: 390684 - DNA, 25 bp, Mus musculus
gcagaggcttacctgcagccgtaac

SEQ ID NO: 390685 - DNA, 25 bp, Mus musculus
accggaaccggaatcaagagccatg

SEQ ID NO: 390686 - DNA, 25 bp, Mus musculus
tgaggctatagcagtgtcgtcgtcg

SEQ ID NO: 390687 - DNA, 25 bp, Mus musculus
cttgttctccggatcggccgaaggt

SEQ ID NO: 390688 - DNA, 25 bp, Mus musculus
cagccgtaacggtgctcttgagacc

SEQ ID NO: 390689 - DNA, 25 bp, Mus musculus
ggggtcgagctgcaacggaaataac

SEQ ID NO: 390690 - DNA, 25 bp, Mus musculus
tgcaaagagttaattccggctcctc

SEQ ID NO: 390691 - DNA, 25 bp, Mus musculus
gggagctgctaggacccatagtgca

SEQ ID NO: 390692 - DNA, 25 bp, Mus musculus
ggcgcagagtctaccgcagaggctt

SEQ ID NO: 390693 - DNA, 25 bp, Mus musculus
aggagccgagttccttccggaagtg

SEQ ID NO: 390694 - DNA, 25 bp, Mus musculus
tgcgatgttactacagccaaccgta

SEQ ID NO: 390695 - DNA, 25 bp, Mus musculus
ctttcccgaaagtgttttagagctg

SEQ ID NO: 390696 - DNA, 25 bp, Mus musculus
tggattcggacgttgtatcgctgcc

SEQ ID NO: 390697 - DNA, 25 bp, Mus musculus
cgaaataggctgtaggcgttccgta

SEQ ID NO: 390698 - DNA, 25 bp, Mus musculus
tgtgtttccggcgaaataggctgta

SEQ ID NO: 390699 - DNA, 25 bp, Mus musculus
ttagttgtgtgttccggtgtgtttc

SEQ ID NO: 390700 - DNA, 25 bp, Mus musculus
ccgcacgcacgttacaatttttagt

SEQ ID NO: 390701 - DNA, 25 bp, Mus musculus
ctactacattgacggaagtggcttc

SEQ ID NO: 390702 - DNA, 25 bp, Mus musculus
cacgacgtcacttcctactacattg

SEQ ID NO: 390703 - DNA, 25 bp, Mus musculus
atatggcagcaaaggacacgacgtc

SEQ ID NO: 390704 - DNA, 25 bp, Mus musculus
acgaggtttctggaggaatatggca

SEQ ID NO: 390705 - DNA, 25 bp, Mus musculus
gctgctgcctctgcgatgttactac

SEQ ID NO: 390706 - DNA, 25 bp, Mus musculus
gttttagagctggaactctcaatcc

SEQ ID NO: 390707 - DNA, 25 bp, Mus musculus
ctctcaatcctacgaacgaggtttc

SEQ ID NO: 390708 - DNA, 25 bp, Mus musculus
tctcctttgcggcttactttgcggc

SEQ ID NO: 390709 - DNA, 25 bp, Mus musculus
ccgatctggggttcacaagccgtac

SEQ ID NO: 390710 - DNA, 25 bp, Mus musculus
gagtttcagacccaagccgcgagcc

SEQ ID NO: 390711 - DNA, 25 bp, Mus musculus
caccgccatcctttgcctgagtggg

SEQ ID NO: 390712 - DNA, 25 bp, Mus musculus
ttctctgcggaatcaccatggcggc

SEQ ID NO: 390713 - DNA, 25 bp, Mus musculus
cttttatgccgtcctcgctttccgg

SEQ ID NO: 390714 - DNA, 25 bp, Mus musculus
actgtcgtgcgtatgccttttatgc

SEQ ID NO: 390715 - DNA, 25 bp, Mus musculus
gctgtagacggaactgtcgtgcgta

SEQ ID NO: 390716 - DNA, 25 bp, Mus musculus
ctttttccaactcagcggggctgta

SEQ ID NO: 390717 - DNA, 25 bp, Mus musculus
agttatactacgcaggcgcccgctc

SEQ ID NO: 390718 - DNA, 25 bp, Mus musculus
ggcaggatcgtccagagttatacta

SEQ ID NO: 390719 - DNA, 25 bp, Mus musculus
tatcaggcttccgattggtcggcga

SEQ ID NO: 390720 - DNA, 25 bp, Mus musculus
gtgagctccgtctcctatcaggctt

SEQ ID NO: 390721 - DNA, 25 bp, Mus musculus
ctccggtgattagggtcaccctatc

SEQ ID NO: 390722 - DNA, 25 bp, Mus musculus
ctcagagcgctacttggttcctata

SEQ ID NO: 390723 - DNA, 25 bp, Mus musculus
catctcgaacttcgcgtccggattc

SEQ ID NO: 390724 - DNA, 25 bp, Mus musculus
agacccgcccgagttacaagagccg

SEQ ID NO: 390725 - DNA, 25 bp, Mus musculus
taccatgtttactggagaagtttcc

SEQ ID NO: 390726 - DNA, 25 bp, Mus musculus
ctgaccgattccatctctttggggc

SEQ ID NO: 390727 - DNA, 25 bp, Mus musculus
gttcctgatctggtggtccctgacc

SEQ ID NO: 390728 - DNA, 25 bp, Mus musculus
caactgcagtgcagggcgttcctga

SEQ ID NO: 390729 - DNA, 25 bp, Mus musculus
tcccgcggatgtattgtcgttccaa

SEQ ID NO: 390730 - DNA, 25 bp, Mus musculus
cgaagtgtgctttgctgcgctttta

SEQ ID NO: 390731 - DNA, 25 bp, Mus musculus
agtaaagctctttctccggagttgg

SEQ ID NO: 390732 - DNA, 25 bp, Mus musculus
cgacgcgtcacgcttcgggagtaaa

SEQ ID NO: 390733 - DNA, 25 bp, Mus musculus
gttccgactgttgggagcaaacctg

SEQ ID NO: 390734 - DNA, 25 bp, Mus musculus
agtgtcactacgagggttccgactg

SEQ ID NO: 390735 - DNA, 25 bp, Mus musculus
agggactcggacaaggtgcatttgc

SEQ ID NO: 390736 - DNA, 25 bp, Mus musculus
aatcacgtaacaggacgcacgagtc

SEQ ID NO: 390737 - DNA, 25 bp, Mus musculus
tcaagtccggaatgcttctgcgttc

SEQ ID NO: 390738 - DNA, 25 bp, Mus musculus
agcgcgggcgaatctacgattttca

SEQ ID NO: 390739 - DNA, 25 bp, Mus musculus
ccgcggcttccgcagattaagcttc

SEQ ID NO: 390740 - DNA, 25 bp, Mus musculus
ggctggactcccagtaccgcgagct

SEQ ID NO: 390741 - DNA, 25 bp, Mus musculus
ttgtctgggcggttacaaaactcca

SEQ ID NO: 390742 - DNA, 25 bp, Mus musculus
cgcacgagtccgcttatctgctggc

SEQ ID NO: 390743 - DNA, 25 bp, Mus musculus
atctgctggctgttagtgctgtcaa

SEQ ID NO: 390744 - DNA, 25 bp, Mus musculus
gtgctgtcaatctgtgggactagga

SEQ ID NO: 390745 - DNA, 25 bp, Mus musculus
gaagctgcggcaatctacccggcga

SEQ ID NO: 390746 - DNA, 25 bp, Mus musculus
cgaggaagtggttgcgacgaattac

SEQ ID NO: 390747 - DNA, 25 bp, Mus musculus
acaagtccctgcgtgcactgcgaag

SEQ ID NO: 390748 - DNA, 25 bp, Mus musculus
tgcctatttatcttcgagccagccg

SEQ ID NO: 390749 - DNA, 25 bp, Mus musculus
agccagccgcttggttcgtttcaag

SEQ ID NO: 390750 - DNA, 25 bp, Mus musculus
cgcttcgagcctgagccctttgcaa

SEQ ID NO: 390751 - DNA, 25 bp, Mus musculus
cgggccacagaaacagcgcgcttgt

SEQ ID NO: 390752 - DNA, 25 bp, Mus musculus
tctatctgtctatggtgagtgcggc

SEQ ID NO: 390753 - DNA, 25 bp, Mus musculus
cttgttgccaggcaccgctcttgca

SEQ ID NO: 390754 - DNA, 25 bp, Mus musculus
tgcgggtttgggcaacacgcccaca

SEQ ID NO: 390755 - DNA, 25 bp, Mus musculus
cgctgattggccagcgctcgcctga

SEQ ID NO: 390756 - DNA, 25 bp, Mus musculus
ctgacgcaggatcccgctataagtg

SEQ ID NO: 390757 - DNA, 25 bp, Mus musculus
caacagtgcttgaacggaacccggt

SEQ ID NO: 390758 - DNA, 25 bp, Mus musculus
gagttgtatgcctcctacgtctatc

SEQ ID NO: 390759 - DNA, 25 bp, Mus musculus
tttgcaacttcgtcgttccgccgct

SEQ ID NO: 390760 - DNA, 25 bp, Mus musculus
gtgcgccagaactaccaccaggacg

SEQ ID NO: 390761 - DNA, 25 bp, Mus musculus
ggaggctgccatcaaccgccagatc

SEQ ID NO: 390762 - DNA, 25 bp, Mus musculus
cgccagatcaacctggagttgtatg

SEQ ID NO: 390763 - DNA, 25 bp, Mus musculus
gccgcggtttcctgcttcaacagtg

SEQ ID NO: 390764 - DNA, 25 bp, Mus musculus
ggggctcactgctgttgtttgcacc

SEQ ID NO: 390765 - DNA, 25 bp, Mus musculus
caagggtggaccaaaagtgcaaggc

SEQ ID NO: 390766 - DNA, 25 bp, Mus musculus
cagcagcgaggtgcattgtagcatg

SEQ ID NO: 390767 - DNA, 25 bp, Mus musculus
gataatctgtactctcagccctgcc

SEQ ID NO: 390768 - DNA, 25 bp, Mus musculus
agcccgagagctgaaaggaccttgg

SEQ ID NO: 390769 - DNA, 25 bp, Mus musculus
cccacttgggagataatctgtactc

SEQ ID NO: 390770 - DNA, 25 bp, Mus musculus
cactgcagcccgagagctgaaagga

SEQ ID NO: 390771 - DNA, 25 bp, Mus musculus
tctgcgctccgtctgggccgtgctg

SEQ ID NO: 390772 - DNA, 25 bp, Mus musculus
cccgttcactctggcgggtcattgt

SEQ ID NO: 390773 - DNA, 25 bp, Mus musculus
gatggaaccagtcccgttcactctg

SEQ ID NO: 390774 - DNA, 25 bp, Mus musculus
tgcaagatgatggaaccagtcccgt

SEQ ID NO: 390775 - DNA, 25 bp, Mus musculus
gccagctctggatgcaagatgatgg

SEQ ID NO: 390776 - DNA, 25 bp, Mus musculus
tggaccaaaagtgcaaggcagaaag

SEQ ID NO: 390777 - DNA, 25 bp, Mus musculus
ctcaaacaagggtggaccaaaagtg

SEQ ID NO: 390778 - DNA, 25 bp, Mus musculus
tgccctcagcttaccacctactccg

SEQ ID NO: 390779 - DNA, 25 bp, Mus musculus
ggccagcaacctgccgacgcgtggt

SEQ ID NO: 390780 - DNA, 25 bp, Mus musculus
gaagttgcgcgggaacccacggcca

SEQ ID NO: 390781 - DNA, 25 bp, Mus musculus
acatctcctggagcacgctggcgct

SEQ ID NO: 390782 - DNA, 25 bp, Mus musculus
tttgcagattcctcgctgggcgtcc

SEQ ID NO: 390783 - DNA, 25 bp, Mus musculus
tctggacttccgatggcgtctcgag

SEQ ID NO: 390784 - DNA, 25 bp, Mus musculus
tggcgtctcgagatccctagcactc

SEQ ID NO: 390785 - DNA, 25 bp, Mus musculus
ctcagaacccaaaaggtctagcggg

SEQ ID NO: 390786 - DNA, 25 bp, Mus musculus
acctactccgcctcgggtttgcaga

SEQ ID NO: 390787 - DNA, 25 bp, Mus musculus
cctcgggtttgcagattcctcgctg

SEQ ID NO: 390788 - DNA, 25 bp, Mus musculus
tcggagaggacagccacgcaaactc

SEQ ID NO: 390789 - DNA, 25 bp, Mus musculus
caatcctcgccaaggccgtggtcga

SEQ ID NO: 390790 - DNA, 25 bp, Mus musculus
tccctagcactcagaacccaaaagg

SEQ ID NO: 390791 - DNA, 25 bp, Mus musculus
acctgccgacgcgtggtgaagactg

SEQ ID NO: 390792 - DNA, 25 bp, Mus musculus
tgcctcagcacttcctggatcgttg

SEQ ID NO: 390793 - DNA, 25 bp, Mus musculus
acttcctggatcgttgggctttgcg

SEQ ID NO: 390794 - DNA, 25 bp, Mus musculus
tgggctttgcgcctctaattgacgc

SEQ ID NO: 390795 - DNA, 25 bp, Mus musculus
acggaggtctgctcatcagctcgca

SEQ ID NO: 390796 - DNA, 25 bp, Mus musculus
ttgacgccaggacgttcttcacgtc

SEQ ID NO: 390797 - DNA, 25 bp, Mus musculus
ctaaaacactgtcaccctgctctga

SEQ ID NO: 390798 - DNA, 25 bp, Mus musculus
gccatcttgggcgtctaaaacactg

SEQ ID NO: 390799 - DNA, 25 bp, Mus musculus
tgcttctaacatggtcatcgccatc

SEQ ID NO: 390800 - DNA, 25 bp, Mus musculus
cgacgtgttcgccattgcttctaac

SEQ ID NO: 390801 - DNA, 25 bp, Mus musculus
atttctgcatttgcgacgtgttcgc

SEQ ID NO: 390802 - DNA, 25 bp, Mus musculus
gtgggacgtcgtttatttctgcatt

SEQ ID NO: 390803 - DNA, 25 bp, Mus musculus
cctgatcttgatccagtgggacgtc

SEQ ID NO: 390804 - DNA, 25 bp, Mus musculus
tctccagggcgaccacctgatcttg

SEQ ID NO: 390805 - DNA, 25 bp, Mus musculus
tccacttttaagtgccacggaggtc

SEQ ID NO: 390806 - DNA, 25 bp, Mus musculus
catcgagcgccgtgtctacgacatc

SEQ ID NO: 390807 - DNA, 25 bp, Mus musculus
ggaaaagttccctgcgcggagagcc

SEQ ID NO: 390808 - DNA, 25 bp, Mus musculus
ggacgccacggtaagctaacccaca

SEQ ID NO: 390809 - DNA, 25 bp, Mus musculus
tgtctacgacatcagccgctgggca

SEQ ID NO: 390810 - DNA, 25 bp, Mus musculus
cgacaagtggctggtcatcgagcgc

SEQ ID NO: 390811 - DNA, 25 bp, Mus musculus
catgacctaccaggcgacaagtggc

SEQ ID NO: 390812 - DNA, 25 bp, Mus musculus
agatccgccagcatgacctaccagg

SEQ ID NO: 390813 - DNA, 25 bp, Mus musculus
tgttcataggcttggcgtctcattc

SEQ ID NO: 390814 - DNA, 25 bp, Mus musculus
acccatcttccgctgggagcagatc

SEQ ID NO: 390815 - DNA, 25 bp, Mus musculus
ccggaggacttgtgtacagcggcaa

SEQ ID NO: 390816 - DNA, 25 bp, Mus musculus
cagtgtctctcttagaccttggtca

SEQ ID NO: 390817 - DNA, 25 bp, Mus musculus
cgccttctcagttgagccgagagtc

SEQ ID NO: 390818 - DNA, 25 bp, Mus musculus
cagccaatagatgtggaggcgccgc

SEQ ID NO: 390819 - DNA, 25 bp, Mus musculus
catcggccaccacggtgcggaggac

SEQ ID NO: 390820 - DNA, 25 bp, Mus musculus
ccaggaggatctttcgaaggccagc

SEQ ID NO: 390821 - DNA, 25 bp, Mus musculus
tgaatctcctcccaacggaaggtgg

SEQ ID NO: 390822 - DNA, 25 bp, Mus musculus
tgcgcaggttgtgcttctgaatctc

SEQ ID NO: 390823 - DNA, 25 bp, Mus musculus
acgttgtagaccttgcggtcgatga

SEQ ID NO: 390824 - DNA, 25 bp, Mus musculus
gctgggaccatttggtaacgttgta

SEQ ID NO: 390825 - DNA, 25 bp, Mus musculus
tcttctcccgaatagtgtccgatga

SEQ ID NO: 390826 - DNA, 25 bp, Mus musculus
ctgtggacttttgcctccggtgaaa

SEQ ID NO: 390827 - DNA, 25 bp, Mus musculus
actccaggatagctcagggcctcgc

SEQ ID NO: 390828 - DNA, 25 bp, Mus musculus
acccgggtttccacagtgatcagca

SEQ ID NO: 390829 - DNA, 25 bp, Mus musculus
cgcccgcatggagttaagccctgct

SEQ ID NO: 390830 - DNA, 25 bp, Mus musculus
cctcgctttcggcttttgtcttcta

SEQ ID NO: 390831 - DNA, 25 bp, Mus musculus
cggggatttgcacctgatgctcgca

SEQ ID NO: 390832 - DNA, 25 bp, Mus musculus
tcgcacaaaggaggcgcagcggtta

SEQ ID NO: 390833 - DNA, 25 bp, Mus musculus
tgggcttttctttgcgcgcttcaga

SEQ ID NO: 390834 - DNA, 25 bp, Mus musculus
ctccctcggctatcacttcctgatt

SEQ ID NO: 390835 - DNA, 25 bp, Mus musculus
tgggcgggacatcctaaagccccgc

SEQ ID NO: 390836 - DNA, 25 bp, Mus musculus
acccgcggctccaagcaggcccgcc

SEQ ID NO: 390837 - DNA, 25 bp, Mus musculus
aggcccgcccctttcaacaagcagc

SEQ ID NO: 390838 - DNA, 25 bp, Mus musculus
agcccagggcctggcgactaggcct

SEQ ID NO: 390839 - DNA, 25 bp, Mus musculus
ccagggcctggcgactaggccttgc

SEQ ID NO: 390840 - DNA, 25 bp, Mus musculus
agtctgtacccgcggctccaagcag

SEQ ID NO: 390841 - DNA, 25 bp, Mus musculus
cgcacagtctgtacccgcggctcca

SEQ ID NO: 390842 - DNA, 25 bp, Mus musculus
cggtgagagcggcagggacggacta

SEQ ID NO: 390843 - DNA, 25 bp, Mus musculus
gcctccctcggctatcacttcctga

SEQ ID NO: 390844 - DNA, 25 bp, Mus musculus
cccgccttctgcgcgtgaccttgcc

SEQ ID NO: 390845 - DNA, 25 bp, Mus musculus
agggcctggcgactaggccttgccc

SEQ ID NO: 390846 - DNA, 25 bp, Mus musculus
cgcgagccggaagagcgcctcgccc

SEQ ID NO: 390847 - DNA, 25 bp, Mus musculus
agggacggactaggggcgcagacgt

SEQ ID NO: 390848 - DNA, 25 bp, Mus musculus
gatcgaccggaaggtgtacaacatc

SEQ ID NO: 390849 - DNA, 25 bp, Mus musculus
acgcgctactttacttgggaggagg

SEQ ID NO: 390850 - DNA, 25 bp, Mus musculus
agcttgctatggctcccgacccggt

SEQ ID NO: 390851 - DNA, 25 bp, Mus musculus
tgctgaaaaccctgcgcgcgaacgg

SEQ ID NO: 390852 - DNA, 25 bp, Mus musculus
tccgcgccaagggtgctgaaaaccc

SEQ ID NO: 390853 - DNA, 25 bp, Mus musculus
gagtctgtctttgctacccgagaga

SEQ ID NO: 390854 - DNA, 25 bp, Mus musculus
gaagtagcctgagtctctccgggga

SEQ ID NO: 390855 - DNA, 25 bp, Mus musculus
gcgtctctgccgctggaagtagcct

SEQ ID NO: 390856 - DNA, 25 bp, Mus musculus
tgtacaacatcagcgacttcagccg

SEQ ID NO: 390857 - DNA, 25 bp, Mus musculus
aaggagcgatggctcgtgatcgacc

SEQ ID NO: 390858 - DNA, 25 bp, Mus musculus
tcatcagccactacgcgggtcagga

SEQ ID NO: 390859 - DNA, 25 bp, Mus musculus
atgccacggtgagagcggacaatag

SEQ ID NO: 390860 - DNA, 25 bp, Mus musculus
aataggcgcatctgcacctcgggga

SEQ ID NO: 390861 - DNA, 25 bp, Mus musculus
atgcaagcgcctgagagaccggagc

SEQ ID NO: 390862 - DNA, 25 bp, Mus musculus
cccgtctcgagtgcacgagccttaa

SEQ ID NO: 390863 - DNA, 25 bp, Mus musculus
agcagctagcagtggtttggagtcc

SEQ ID NO: 390864 - DNA, 25 bp, Mus musculus
cacagcgttctctggacagtcccga

SEQ ID NO: 390865 - DNA, 25 bp, Mus musculus
ttctctggacagtcccgagcccgtt

SEQ ID NO: 390866 - DNA, 25 bp, Mus musculus
gtgcacgagccttaagcagctagca

SEQ ID NO: 390867 - DNA, 25 bp, Mus musculus
gtttggagtccacagcgttctctgg

SEQ ID NO: 390868 - DNA, 25 bp, Mus musculus
tcagagacgcttccgcgagacctca

SEQ ID NO: 390869 - DNA, 25 bp, Mus musculus
ttcagtatcgttcccagcttcgccg

SEQ ID NO: 390870 - DNA, 25 bp, Mus musculus
aaagcccgcgctctcgtcacgtgat

SEQ ID NO: 390871 - DNA, 25 bp, Mus musculus
ctctcgtcacgtgatctgccaggcg

SEQ ID NO: 390872 - DNA, 25 bp, Mus musculus
agcgaatggcccaagcccgggctgc

SEQ ID NO: 390873 - DNA, 25 bp, Mus musculus
atgttcggagcagagcgaatggccc

SEQ ID NO: 390874 - DNA, 25 bp, Mus musculus
cgagcccgttctttcagtatcgttc

SEQ ID NO: 390875 - DNA, 25 bp, Mus musculus
gctctgccgctttcagagacgcttc

SEQ ID NO: 390876 - DNA, 25 bp, Mus musculus
tgggctcccggtacagtccggccag

SEQ ID NO: 390877 - DNA, 25 bp, Mus musculus
ccagagccgcaacctcgggtagcag

SEQ ID NO: 390878 - DNA, 25 bp, Mus musculus
ccgcaacctcgggtagcagggtgcc

SEQ ID NO: 390879 - DNA, 25 bp, Mus musculus
gcagggtgccgcgtcgtctgcaggg

SEQ ID NO: 390880 - DNA, 25 bp, Mus musculus
ccgcggtctctcaccttcgaagaag

SEQ ID NO: 390881 - DNA, 25 bp, Mus musculus
cctctggcggtacgcccagagccgc

SEQ ID NO: 390882 - DNA, 25 bp, Mus musculus
agtccggccaggctctcctcacgct

SEQ ID NO: 390883 - DNA, 25 bp, Mus musculus
gacagtcccggctgggctcccggta

SEQ ID NO: 390884 - DNA, 25 bp, Mus musculus
agcgcttcggtctcgtccaccacct

SEQ ID NO: 390885 - DNA, 25 bp, Mus musculus
cgctgcagcgcttcggtctcgtcca

SEQ ID NO: 390886 - DNA, 25 bp, Mus musculus
caccttcgaagaagcgctgcagcgc

SEQ ID NO: 390887 - DNA, 25 bp, Mus musculus
ctctcaccttcgaagaagcgctgca

SEQ ID NO: 390888 - DNA, 25 bp, Mus musculus
gtctctcaccttcgaagaagcgctg

SEQ ID NO: 390889 - DNA, 25 bp, Mus musculus
gcggtctctcaccttcgaagaagcg

SEQ ID NO: 390890 - DNA, 25 bp, Mus musculus
actgaacaggggcacggtagctgct

SEQ ID NO: 390891 - DNA, 25 bp, Mus musculus
accgcgcgcagtggacattgcccag

SEQ ID NO: 390892 - DNA, 25 bp, Mus musculus
cgcggacctcacacctgccacgagc

SEQ ID NO: 390893 - DNA, 25 bp, Mus musculus
cgcccgtgccatgcgtgtcaccatc

SEQ ID NO: 390894 - DNA, 25 bp, Mus musculus
actgcgaccgccacctccatcctgg

SEQ ID NO: 390895 - DNA, 25 bp, Mus musculus
tgtatccacgttgcccacgcccgtg

SEQ ID NO: 390896 - DNA, 25 bp, Mus musculus
actaacgttgcttccgcagggcgcc

SEQ ID NO: 390897 - DNA, 25 bp, Mus musculus
ttcaggtcccgcgtgacagggttta

SEQ ID NO: 390898 - DNA, 25 bp, Mus musculus
tattcactaacgttgcttccgcagg

SEQ ID NO: 390899 - DNA, 25 bp, Mus musculus
accctcgccaggaaaaatcacgctg

SEQ ID NO: 390900 - DNA, 25 bp, Mus musculus
tgagtcttctgacaccctcgccagg

SEQ ID NO: 390901 - DNA, 25 bp, Mus musculus
caccgctacaccaaggcgggggtga

SEQ ID NO: 390902 - DNA, 25 bp, Mus musculus
cgctgcccgtgctgtatccacgttg

SEQ ID NO: 390903 - DNA, 25 bp, Mus musculus
gccaggaaaaatcacgctgcccgtg

SEQ ID NO: 390904 - DNA, 25 bp, Mus musculus
tggatcgcgtcttccgtaaactaga

SEQ ID NO: 390905 - DNA, 25 bp, Mus musculus
tgtcccgagctaacgccctcgagta

SEQ ID NO: 390906 - DNA, 25 bp, Mus musculus
cgctgttccttgtcccgagctaacg

SEQ ID NO: 390907 - DNA, 25 bp, Mus musculus
atagcggtggagctctgccgtcctt

SEQ ID NO: 390908 - DNA, 25 bp, Mus musculus
gtcttccgtaaactagacgagcata

SEQ ID NO: 390909 - DNA, 25 bp, Mus musculus
gagctctgccgtccttccaggcggg

SEQ ID NO: 390910 - DNA, 25 bp, Mus musculus
acgggccgaatggatcgcgtcttcc

SEQ ID NO: 390911 - DNA, 25 bp, Mus musculus
ccacccgtggtgcacgggccgaatg

SEQ ID NO: 390912 - DNA, 25 bp, Mus musculus
gaccctgtggcgtgagacaccaccg

SEQ ID NO: 390913 - DNA, 25 bp, Mus musculus
cacgcctttcggagcggagtcagag

SEQ ID NO: 390914 - DNA, 25 bp, Mus musculus
gggtggatctccacgcctttcggag

SEQ ID NO: 390915 - DNA, 25 bp, Mus musculus
agcggaaaatctggggtggatctcc

SEQ ID NO: 390916 - DNA, 25 bp, Mus musculus
cgagtagccaccgagcggaaaatct

SEQ ID NO: 390917 - DNA, 25 bp, Mus musculus
aactagacgagcatagcggtggagc

SEQ ID NO: 390918 - DNA, 25 bp, Mus musculus
ggttctagtggcagagactcttatt

SEQ ID NO: 390919 - DNA, 25 bp, Mus musculus
cccgcagtcgggacattgataggct

SEQ ID NO: 390920 - DNA, 25 bp, Mus musculus
tcgggacattgataggctggatgcc

SEQ ID NO: 390921 - DNA, 25 bp, Mus musculus
gtggcagagactcttattcaaaccc

SEQ ID NO: 390922 - DNA, 25 bp, Mus musculus
ttctagtggcagagactcttattca

SEQ ID NO: 390923 - DNA, 25 bp, Mus musculus
gtgggttctagtggcagagactctt

SEQ ID NO: 390924 - DNA, 25 bp, Mus musculus
ctttctaccagggtcatccgtgccc

SEQ ID NO: 390925 - DNA, 25 bp, Mus musculus
cgaattgcacccctttctaccaggg

SEQ ID NO: 390926 - DNA, 25 bp, Mus musculus
ggctggagccgcacgaattgcaccc

SEQ ID NO: 390927 - DNA, 25 bp, Mus musculus
ctgctgtcggctggagccgcacgaa

SEQ ID NO: 390928 - DNA, 25 bp, Mus musculus
gccggcgacgaaggggaccatgtac

SEQ ID NO: 390929 - DNA, 25 bp, Mus musculus
aggcggccagcccaggtaagcgcgg

SEQ ID NO: 390930 - DNA, 25 bp, Mus musculus
cgggacattgataggctggatgccc

SEQ ID NO: 390931 - DNA, 25 bp, Mus musculus
gagactcttattcaaaccccgcagt

SEQ ID NO: 390932 - DNA, 25 bp, Mus musculus
ggccgcagccgctccaacccaggca

SEQ ID NO: 390933 - DNA, 25 bp, Mus musculus
gaaccagcagggccggcagcccagt

SEQ ID NO: 390934 - DNA, 25 bp, Mus musculus
gggagagccgaaatgccagcgaccc

SEQ ID NO: 390935 - DNA, 25 bp, Mus musculus
tgcagcagccgctgagccagaacca

SEQ ID NO: 390936 - DNA, 25 bp, Mus musculus
agcagccgctgagccagaaccagca

SEQ ID NO: 390937 - DNA, 25 bp, Mus musculus
agccgctgagccagaaccagcaggg

SEQ ID NO: 390938 - DNA, 25 bp, Mus musculus
agcccaccaccagccagagcctggg

SEQ ID NO: 390939 - DNA, 25 bp, Mus musculus
acgcggcctcggcaccgggctccaa

SEQ ID NO: 390940 - DNA, 25 bp, Mus musculus
ccgggcctatggtcggggtcaggct

SEQ ID NO: 390941 - DNA, 25 bp, Mus musculus
tcaggctcggcagggcacctcggcc

SEQ ID NO: 390942 - DNA, 25 bp, Mus musculus
ccggctccaagtaccgggcagctgg

SEQ ID NO: 390943 - DNA, 25 bp, Mus musculus
gcagccgctccaacccaggcagctg

SEQ ID NO: 390944 - DNA, 25 bp, Mus musculus
cacgtggtggggcagattcgaaacc

SEQ ID NO: 390945 - DNA, 25 bp, Mus musculus
tcggccggctccaagtaccgggcag

SEQ ID NO: 390946 - DNA, 25 bp, Mus musculus
gcaaccaatcaactcgacccgggta

SEQ ID NO: 390947 - DNA, 25 bp, Mus musculus
tcctctgcccgctctcttaaaaaga

SEQ ID NO: 390948 - DNA, 25 bp, Mus musculus
aaaggtcacgactcttgggcgcaga

SEQ ID NO: 390949 - DNA, 25 bp, Mus musculus
tctttttagaggtgctgggcgtttc

SEQ ID NO: 390950 - DNA, 25 bp, Mus musculus
ctggctgctgacagtttcagaactg

SEQ ID NO: 390951 - DNA, 25 bp, Mus musculus
aagccggtcagcttccgggaacatc

SEQ ID NO: 390952 - DNA, 25 bp, Mus musculus
cgcgcggtgtccaaaactgcaacca

SEQ ID NO: 390953 - DNA, 25 bp, Mus musculus
acaactctacaaaacctggcgcgcg

SEQ ID NO: 390954 - DNA, 25 bp, Mus musculus
cggcgaacttggctcaaaacaactc

SEQ ID NO: 390955 - DNA, 25 bp, Mus musculus
agccattatctcttcggcgaacttg

SEQ ID NO: 390956 - DNA, 25 bp, Mus musculus
gctgcagagttcctcggcatccaca

SEQ ID NO: 390957 - DNA, 25 bp, Mus musculus
gctaggtgcctccttacacgtaaaa

SEQ ID NO: 390958 - DNA, 25 bp, Mus musculus
cgcagacgatcctgcctagccatta

SEQ ID NO: 390959 - DNA, 25 bp, Mus musculus
tgccgggcagtgagaatcgaaaata

SEQ ID NO: 390960 - DNA, 25 bp, Mus musculus
cggtgccgctcacatacagcttctg

SEQ ID NO: 390961 - DNA, 25 bp, Mus musculus
gcgggaactcttcgaagcgattgcc

SEQ ID NO: 390962 - DNA, 25 bp, Mus musculus
tggactctgcgatgcccatggtcac

SEQ ID NO: 390963 - DNA, 25 bp, Mus musculus
gcgcgtgcggctgccaataggcaaa

SEQ ID NO: 390964 - DNA, 25 bp, Mus musculus
ctgacttgcagcttagcgacccgtc

SEQ ID NO: 390965 - DNA, 25 bp, Mus musculus
tgcaagcggctcaatgcgcacacgg

SEQ ID NO: 390966 - DNA, 25 bp, Mus musculus
gcagctcctcgatctcctcgggaag

SEQ ID NO: 390967 - DNA, 25 bp, Mus musculus
aggcgctccagcttgttgaagtcga

SEQ ID NO: 390968 - DNA, 25 bp, Mus musculus
caggaagttgccttcgatccagagg

SEQ ID NO: 390969 - DNA, 25 bp, Mus musculus
ccaggcgcaacaacggccgcggaaa

SEQ ID NO: 390970 - DNA, 25 bp, Mus musculus
tgcagcgattgcagcgccaccaggc

SEQ ID NO: 390971 - DNA, 25 bp, Mus musculus
cggttgtcgcccatctgcagcgatt

SEQ ID NO: 390972 - DNA, 25 bp, Mus musculus
cagaggccacgcaagccggtcatgc

SEQ ID NO: 390973 - DNA, 25 bp, Mus musculus
gcgattgccgtagagccagaggcca

SEQ ID NO: 390974 - DNA, 25 bp, Mus musculus
acccgcgccagcgtcgggatcaagg

SEQ ID NO: 390975 - DNA, 25 bp, Mus musculus
cgggatcaaggtgaccaccgccatc

SEQ ID NO: 390976 - DNA, 25 bp, Mus musculus
cataggcaactacgggcgccgactc

SEQ ID NO: 390977 - DNA, 25 bp, Mus musculus
tggcggtggcgccataggcaactac

SEQ ID NO: 390978 - DNA, 25 bp, Mus musculus
ctctcaggagtcgaggcccggactt

SEQ ID NO: 390979 - DNA, 25 bp, Mus musculus
cctgagggccctctcaggagtcgag

SEQ ID NO: 390980 - DNA, 25 bp, Mus musculus
gcggccgccgccatattcccggtaa

SEQ ID NO: 390981 - DNA, 25 bp, Mus musculus
gcttcgggcctagtcgggactctcc

SEQ ID NO: 390982 - DNA, 25 bp, Mus musculus
caaccgagcgtatggcggaagtagc

SEQ ID NO: 390983 - DNA, 25 bp, Mus musculus
agccggaaggcgcaaccgagcgtat

SEQ ID NO: 390984 - DNA, 25 bp, Mus musculus
aattccgggcggtcgatctgaggac

SEQ ID NO: 390985 - DNA, 25 bp, Mus musculus
gccatctctctcttatagcacagta

SEQ ID NO: 390986 - DNA, 25 bp, Mus musculus
gtaagctggcaaccgggccacttcc

SEQ ID NO: 390987 - DNA, 25 bp, Mus musculus
tagcacagtaagctggcaaccgggc

SEQ ID NO: 390988 - DNA, 25 bp, Mus musculus
ggcgccatgttcagtccccatggaa

SEQ ID NO: 390989 - DNA, 25 bp, Mus musculus
tcatggcgtaggtcgttagtggccc

SEQ ID NO: 390990 - DNA, 25 bp, Mus musculus
gaacacttctccagctgaactctct

SEQ ID NO: 390991 - DNA, 25 bp, Mus musculus
gagaccagaacacttctccagctga

SEQ ID NO: 390992 - DNA, 25 bp, Mus musculus
gacggcagagagaccagaacacttc

SEQ ID NO: 390993 - DNA, 25 bp, Mus musculus
tttaaacgacggcagagagaccaga

SEQ ID NO: 390994 - DNA, 25 bp, Mus musculus
tcaaccacctacagtggtctagggg

SEQ ID NO: 390995 - DNA, 25 bp, Mus musculus
gccgtcaaccacctacagtggtcta

SEQ ID NO: 390996 - DNA, 25 bp, Mus musculus
atgcacagaacagcgccagccgtca

SEQ ID NO: 390997 - DNA, 25 bp, Mus musculus
accggccgcgcccatgcacagaaca

SEQ ID NO: 390998 - DNA, 25 bp, Mus musculus
tgctactctatggttaccccaccgg

SEQ ID NO: 390999 - DNA, 25 bp, Mus musculus
ctctgcctgccggtgctactctatg

SEQ ID NO: 391000 - DNA, 25 bp, Mus musculus
cccatggaaactgcgtacactgcag

SEQ ID NO: 391001 - DNA, 25 bp, Mus musculus
aactgcgtacactgcagcgcccgga

SEQ ID NO: 391002 - DNA, 25 bp, Mus musculus
gttgacgcaatagcttcacccactc

SEQ ID NO: 391003 - DNA, 25 bp, Mus musculus
ctgtcggaaagcctctcgggagtcg

SEQ ID NO: 391004 - DNA, 25 bp, Mus musculus
gcttcacccactctcaagtcgagtg

SEQ ID NO: 391005 - DNA, 25 bp, Mus musculus
gtctaaatcaaatacggccgccatg

SEQ ID NO: 391006 - DNA, 25 bp, Mus musculus
ctcgctctgttgacgcaatagcttc

SEQ ID NO: 391007 - DNA, 25 bp, Mus musculus
agccgctcgctctgttgacgcaata

SEQ ID NO: 391008 - DNA, 25 bp, Mus musculus
ttcctcggtctccaagtctaaatca

SEQ ID NO: 391009 - DNA, 25 bp, Mus musculus
ggctgtgcctacgtcatttctccgc

SEQ ID NO: 391010 - DNA, 25 bp, Mus musculus
gcaccgggctgtgcctacgtcattt

SEQ ID NO: 391011 - DNA, 25 bp, Mus musculus
aactctgactgacagcaccgggctg

SEQ ID NO: 391012 - DNA, 25 bp, Mus musculus
gcccggaccaggcagaactctgact

SEQ ID NO: 391013 - DNA, 25 bp, Mus musculus
ctcaccgcagggctgaactccggtt

SEQ ID NO: 391014 - DNA, 25 bp, Mus musculus
cgacagcagccgctcgctctgttga

SEQ ID NO: 391015 - DNA, 25 bp, Mus musculus
aaaagatggcgcctgtcggaaagcc

SEQ ID NO: 391016 - DNA, 25 bp, Mus musculus
agggtctttgctttctcaggctctc

SEQ ID NO: 391017 - DNA, 25 bp, Mus musculus
ttgcccgccatgttagggtctttgc

SEQ ID NO: 391018 - DNA, 25 bp, Mus musculus
agtagattgctaattgcccgccatg

SEQ ID NO: 391019 - DNA, 25 bp, Mus musculus
cggcttccggaagctggctttaaat

SEQ ID NO: 391020 - DNA, 25 bp, Mus musculus
tgtcatgggaacactcgctcggctt

SEQ ID NO: 391021 - DNA, 25 bp, Mus musculus
aagtggccgagcctataaaaatctc

SEQ ID NO: 391022 - DNA, 25 bp, Mus musculus
aggctgataggacgcagcgctccta

SEQ ID NO: 391023 - DNA, 25 bp, Mus musculus
accgacgtcggttgtcatgggaaca

SEQ ID NO: 391024 - DNA, 25 bp, Mus musculus
ccctgtgaccggttcttctatcttg

SEQ ID NO: 391025 - DNA, 25 bp, Mus musculus
tctatcttgcctcgctgagggccga

SEQ ID NO: 391026 - DNA, 25 bp, Mus musculus
gccgaccctagcgtgaggttgttaa

SEQ ID NO: 391027 - DNA, 25 bp, Mus musculus
agcatttcacctgtctctggacggg

SEQ ID NO: 391028 - DNA, 25 bp, Mus musculus
acttagcgccctctgtagcggatgc

SEQ ID NO: 391029 - DNA, 25 bp, Mus musculus
gcgctcctaggaatcggaccgctca

SEQ ID NO: 391030 - DNA, 25 bp, Mus musculus
ccttagctcgcgatctcaaaggagc

SEQ ID NO: 391031 - DNA, 25 bp, Mus musculus
tactgcagtgaacggctgtgtgacc

SEQ ID NO: 391032 - DNA, 25 bp, Mus musculus
tcgtaacggcgcagaagcctactgc

SEQ ID NO: 391033 - DNA, 25 bp, Mus musculus
cggtactctcgctctcatccgggta

SEQ ID NO: 391034 - DNA, 25 bp, Mus musculus
cgcgatctcaaaggagctgttccca

SEQ ID NO: 391035 - DNA, 25 bp, Mus musculus
cccaaggcctcaatatgtcgtacaa

SEQ ID NO: 391036 - DNA, 25 bp, Mus musculus
cgtctctctatcgtcgctctaggcg

SEQ ID NO: 391037 - DNA, 25 bp, Mus musculus
gggttctcagtctcttcgctcgcgc

SEQ ID NO: 391038 - DNA, 25 bp, Mus musculus
ctctctggcctgcaacgtgtctcag

SEQ ID NO: 391039 - DNA, 25 bp, Mus musculus
tgaggccgtcccgtgatcctctgcg

SEQ ID NO: 391040 - DNA, 25 bp, Mus musculus
tcgggctccgtaagtcctccaagag

SEQ ID NO: 391041 - DNA, 25 bp, Mus musculus
tactgcgacctctggcggttaggag

SEQ ID NO: 391042 - DNA, 25 bp, Mus musculus
tctcatccgggtactgcgacctctg

SEQ ID NO: 391043 - DNA, 25 bp, Mus musculus
tgtcgtacaactacgtcgtaacggc

SEQ ID NO: 391044 - DNA, 25 bp, Mus musculus
caagtctgcgcaggcgtactcgcaa

SEQ ID NO: 391045 - DNA, 25 bp, Mus musculus
ccaccagcgtctgagtgcaggtatc

SEQ ID NO: 391046 - DNA, 25 bp, Mus musculus
cgtactcgcaatgggcggagtccta

SEQ ID NO: 391047 - DNA, 25 bp, Mus musculus
ctcagagatgggtttcctggccgaa

SEQ ID NO: 391048 - DNA, 25 bp, Mus musculus
gaagggacgcctgcaagtctgcgca

SEQ ID NO: 391049 - DNA, 25 bp, Mus musculus
ctgagtgcaggtatcgtggccaccc

SEQ ID NO: 391050 - DNA, 25 bp, Mus musculus
cctaggcctacaaggcaggacactc

SEQ ID NO: 391051 - DNA, 25 bp, Mus musculus
ctacaaggcaggacactcggggcgc

SEQ ID NO: 391052 - DNA, 25 bp, Mus musculus
cagtgcggctcgttctcagctggac

SEQ ID NO: 391053 - DNA, 25 bp, Mus musculus
ctggacgcgggagtaagtcacatcc

SEQ ID NO: 391054 - DNA, 25 bp, Mus musculus
gagtaagtcacatccggtagaggcg

SEQ ID NO: 391055 - DNA, 25 bp, Mus musculus
ttgccggcgaactcagagatgggtt

SEQ ID NO: 391056 - DNA, 25 bp, Mus musculus
tttcctggccgaagccggcgattgg

SEQ ID NO: 391057 - DNA, 25 bp, Mus musculus
cctgaagccaccagcgtctgagtgc

SEQ ID NO: 391058 - DNA, 25 bp, Mus musculus
tgcggatcccaaaacccagagcgtg

SEQ ID NO: 391059 - DNA, 25 bp, Mus musculus
ggctcaggtggctgcaatctgtccc

SEQ ID NO: 391060 - DNA, 25 bp, Mus musculus
gtcctagtgccctgcggatcccaaa

SEQ ID NO: 391061 - DNA, 25 bp, Mus musculus
cccagacaatggagcaggagcagtg

SEQ ID NO: 391062 - DNA, 25 bp, Mus musculus
ggctgcagttcccagacaatggagc

SEQ ID NO: 391063 - DNA, 25 bp, Mus musculus
tgtggccagctagttccctgcgccg

SEQ ID NO: 391064 - DNA, 25 bp, Mus musculus
cgccagccgctgtggccagctagtt

SEQ ID NO: 391065 - DNA, 25 bp, Mus musculus
gttcagtcatcgaggcgcactcctt

SEQ ID NO: 391066 - DNA, 25 bp, Mus musculus
gcagccttgcgttcagtcatcgagg

SEQ ID NO: 391067 - DNA, 25 bp, Mus musculus
ggccgcagccttgcgttcagtcatc

SEQ ID NO: 391068 - DNA, 25 bp, Mus musculus
ggcagaaccaggcaccgtagggccc

SEQ ID NO: 391069 - DNA, 25 bp, Mus musculus
gccaccaggaggcagaaccaggcac

SEQ ID NO: 391070 - DNA, 25 bp, Mus musculus
tgacctctcacgacttccagggcga

SEQ ID NO: 391071 - DNA, 25 bp, Mus musculus
tcacgacttccagggcgagagccac

SEQ ID NO: 391072 - DNA, 25 bp, Mus musculus
cgtgggacttcgctagaaaacgcgc

SEQ ID NO: 391073 - DNA, 25 bp, Mus musculus
tggaacggaagcgaagcctttggca

SEQ ID NO: 391074 - DNA, 25 bp, Mus musculus
acggaggagactggcaggtctttct

SEQ ID NO: 391075 - DNA, 25 bp, Mus musculus
ttcctcccgggaagtgcagttccta

SEQ ID NO: 391076 - DNA, 25 bp, Mus musculus
catttagggcggcagtttcctcccg

SEQ ID NO: 391077 - DNA, 25 bp, Mus musculus
tccgagtctacaacgcatttagggc

SEQ ID NO: 391078 - DNA, 25 bp, Mus musculus
aagaaagaactgtcgaggctgtggc

SEQ ID NO: 391079 - DNA, 25 bp, Mus musculus
tatttccaagagaagaatggcgccg

SEQ ID NO: 391080 - DNA, 25 bp, Mus musculus
gctctgctcgctccattatggtttg

SEQ ID NO: 391081 - DNA, 25 bp, Mus musculus
catcgtggacgcatgcgctctgctc

SEQ ID NO: 391082 - DNA, 25 bp, Mus musculus
aggtctttctggcaggcatcgtgga

SEQ ID NO: 391083 - DNA, 25 bp, Mus musculus
ttggtttatagtctgcgcatgcgcg

SEQ ID NO: 391084 - DNA, 25 bp, Mus musculus
ggtcaccgctatccttcacgtggga

SEQ ID NO: 391085 - DNA, 25 bp, Mus musculus
gggattcggtgcagatccgagtcta

SEQ ID NO: 391086 - DNA, 25 bp, Mus musculus
aaccctctgtgaggcgactggcagc

SEQ ID NO: 391087 - DNA, 25 bp, Mus musculus
cgggccttttcctgctcggttgcat

SEQ ID NO: 391088 - DNA, 25 bp, Mus musculus
gtttccgttagctgcagaaggctga

SEQ ID NO: 391089 - DNA, 25 bp, Mus musculus
tcgccggaagaagccgagccaatgc

SEQ ID NO: 391090 - DNA, 25 bp, Mus musculus
ggctgcagagaaccgggaaccctct

SEQ ID NO: 391091 - DNA, 25 bp, Mus musculus
tcctgctcggttgcatgctgggaaa

SEQ ID NO: 391092 - DNA, 25 bp, Mus musculus
tacgacggcgccatgtccctgatct

SEQ ID NO: 391093 - DNA, 25 bp, Mus musculus
tccctgatctgctcgagtgagtgct

SEQ ID NO: 391094 - DNA, 25 bp, Mus musculus
cctgcgtgcagggtgcatttgcgca

SEQ ID NO: 391095 - DNA, 25 bp, Mus musculus
gcagggctgcgcaattcacgtagct

SEQ ID NO: 391096 - DNA, 25 bp, Mus musculus
cacgtagctgggaagaatgactgtc

SEQ ID NO: 391097 - DNA, 25 bp, Mus musculus
ctgtctcaggggtcttttgaaaccg

SEQ ID NO: 391098 - DNA, 25 bp, Mus musculus
catcgccacgctgggcagctgtcta

SEQ ID NO: 391099 - DNA, 25 bp, Mus musculus
cacgtgaagcagttgtgcgagcatc

SEQ ID NO: 391100 - DNA, 25 bp, Mus musculus
catctttgttatgaaccgttctgtc

SEQ ID NO: 391101 - DNA, 25 bp, Mus musculus
ggatctaagaggtttgtgttacatc

SEQ ID NO: 391102 - DNA, 25 bp, Mus musculus
ggcctcctggccacgatggatctaa

SEQ ID NO: 391103 - DNA, 25 bp, Mus musculus
aacagcggctggaatccgggaaagc

SEQ ID NO: 391104 - DNA, 25 bp, Mus musculus
ccgtcttgggacatgacccaggaga

SEQ ID NO: 391105 - DNA, 25 bp, Mus musculus
tcccgtcaggaaagaaatgcgtgct

SEQ ID NO: 391106 - DNA, 25 bp, Mus musculus
cggagcttgcaacacgccgtcgcag

SEQ ID NO: 391107 - DNA, 25 bp, Mus musculus
cggaaattcagctccacgacggctg

SEQ ID NO: 391108 - DNA, 25 bp, Mus musculus
cgcctttcacaaccgcggaaattca

SEQ ID NO: 391109 - DNA, 25 bp, Mus musculus
gcaaagctctcccagcagtgcgggc

SEQ ID NO: 391110 - DNA, 25 bp, Mus musculus
tcgcagctgtccaggatcccgcaaa

SEQ ID NO: 391111 - DNA, 25 bp, Mus musculus
accggcaggtctgagtcgcactcac

SEQ ID NO: 391112 - DNA, 25 bp, Mus musculus
gtgctcaccgagaaacacgtttttg

SEQ ID NO: 391113 - DNA, 25 bp, Mus musculus
gaagagcagcaactgtggcgacagc

SEQ ID NO: 391114 - DNA, 25 bp, Mus musculus
ccaacccgcttgatcggctggatga

SEQ ID NO: 391115 - DNA, 25 bp, Mus musculus
agtctgcctgatgctctgggctctg

SEQ ID NO: 391116 - DNA, 25 bp, Mus musculus
ggccgcatcatgtgctactacaact

SEQ ID NO: 391117 - DNA, 25 bp, Mus musculus
ctctggcggtgctcaacacaatacc

SEQ ID NO: 391118 - DNA, 25 bp, Mus musculus
ttcagagacaccatcccgcggcttg

SEQ ID NO: 391119 - DNA, 25 bp, Mus musculus
tgcgactaccgccagaaggccctgg

SEQ ID NO: 391120 - DNA, 25 bp, Mus musculus
aggccctggcggtcagcaaattcct

SEQ ID NO: 391121 - DNA, 25 bp, Mus musculus
caaattcctgctggccttcatggta

SEQ ID NO: 391122 - DNA, 25 bp, Mus musculus
ggggccctaccacatcttcagtctg

SEQ ID NO: 391123 - DNA, 25 bp, Mus musculus
tggccttcttcaacagcgtggtcaa

SEQ ID NO: 391124 - DNA, 25 bp, Mus musculus
acatgttgtacaaactgcggcgctc

SEQ ID NO: 391125 - DNA, 25 bp, Mus musculus
taccctcctgctggctgaccgaatt

SEQ ID NO: 391126 - DNA, 25 bp, Mus musculus
ggccataattgcctcgagccacgta

SEQ ID NO: 391127 - DNA, 25 bp, Mus musculus
acaacttgctgctctggaatccagg

SEQ ID NO: 391128 - DNA, 25 bp, Mus musculus
tcagcggcgtatccatggctcacgt

SEQ ID NO: 391129 - DNA, 25 bp, Mus musculus
ctcagtggtggaactctcgtagact

SEQ ID NO: 391130 - DNA, 25 bp, Mus musculus
ctcgtagacttgagctctcctgttt

SEQ ID NO: 391131 - DNA, 25 bp, Mus musculus
tcttctgagttcgacttgaaatcta

SEQ ID NO: 391132 - DNA, 25 bp, Mus musculus
cttgaaatctacaagagcccgtttc

SEQ ID NO: 391133 - DNA, 25 bp, Mus musculus
aagagcccgtttcgcccgagagact

SEQ ID NO: 391134 - DNA, 25 bp, Mus musculus
ccatggctcacgtgtagcctctgta

SEQ ID NO: 391135 - DNA, 25 bp, Mus musculus
agcctctgtagccttcggaactgtc

SEQ ID NO: 391136 - DNA, 25 bp, Mus musculus
ctgtcggcgccttcatatgacgtca

SEQ ID NO: 391137 - DNA, 25 bp, Mus musculus
gacgtcagactcgtccatttccgta

SEQ ID NO: 391138 - DNA, 25 bp, Mus musculus
tccatttccgtaccgggcaggaagc

SEQ ID NO: 391139 - DNA, 25 bp, Mus musculus
cgcacttgcggtagagagacccgtg

SEQ ID NO: 391140 - DNA, 25 bp, Mus musculus
gacagaggttttaggccttccagcc

SEQ ID NO: 391141 - DNA, 25 bp, Mus musculus
acaggaaggttttctggagacagag

SEQ ID NO: 391142 - DNA, 25 bp, Mus musculus
tggttagaatttcctcaagatattt

SEQ ID NO: 391143 - DNA, 25 bp, Mus musculus
caagtctttcacttgtttggttaga

SEQ ID NO: 391144 - DNA, 25 bp, Mus musculus
agtttttaatcatacaagtctttca

SEQ ID NO: 391145 - DNA, 25 bp, Mus musculus
gcgccagatcttttcatcttctgag

SEQ ID NO: 391146 - DNA, 25 bp, Mus musculus
gcgggcgagcgccagatcttttcat

SEQ ID NO: 391147 - DNA, 25 bp, Mus musculus
tcacttgtttggttagaatttcctc

SEQ ID NO: 391148 - DNA, 25 bp, Mus musculus
tgttcatgtgctcaaaccgcctttg

SEQ ID NO: 391149 - DNA, 25 bp, Mus musculus
agaatgttattttctgttcatgtgc

SEQ ID NO: 391150 - DNA, 25 bp, Mus musculus
cctatcacttctgacaaagtcttta

SEQ ID NO: 391151 - DNA, 25 bp, Mus musculus
ttcctccctatcacttctgacaaag

SEQ ID NO: 391152 - DNA, 25 bp, Mus musculus
cacaaggaagtacttcttatgggtt

SEQ ID NO: 391153 - DNA, 25 bp, Mus musculus
tcattactatgtgagtgttaaaagc

SEQ ID NO: 391154 - DNA, 25 bp, Mus musculus
ggctattgtgaaggttgttatttcc

SEQ ID NO: 391155 - DNA, 25 bp, Mus musculus
gagtgttaaaagctgcaccatgaga

SEQ ID NO: 391156 - DNA, 25 bp, Mus musculus
tccagcgccggaagcattccgggca

SEQ ID NO: 391157 - DNA, 25 bp, Mus musculus
acgccacttatcctgatgaccgatc

SEQ ID NO: 391158 - DNA, 25 bp, Mus musculus
cgccgcggactcacggccttcagct

SEQ ID NO: 391159 - DNA, 25 bp, Mus musculus
ttcagctgctccagccggtccttca

SEQ ID NO: 391160 - DNA, 25 bp, Mus musculus
tcaggtgagcgcgtcccaagtgagc

SEQ ID NO: 391161 - DNA, 25 bp, Mus musculus
tgagcgcgtcccaagtgagcggcct

SEQ ID NO: 391162 - DNA, 25 bp, Mus musculus
cggcgccgcgctccaaatccggcta

SEQ ID NO: 391163 - DNA, 25 bp, Mus musculus
ccgagctcctgcttaaagggccagc

SEQ ID NO: 391164 - DNA, 25 bp, Mus musculus
gccggaagcattccgggcacacctt

SEQ ID NO: 391165 - DNA, 25 bp, Mus musculus
ggtctgtctggcttcgattccgtat

SEQ ID NO: 391166 - DNA, 25 bp, Mus musculus
cgattccgtattttccgcactgttc

SEQ ID NO: 391167 - DNA, 25 bp, Mus musculus
cgtattttccgcactgttcttattg

SEQ ID NO: 391168 - DNA, 25 bp, Mus musculus
ctgttcttattgttcggccctctgc

SEQ ID NO: 391169 - DNA, 25 bp, Mus musculus
aaatccggctacgagaccgcgccgg

SEQ ID NO: 391170 - DNA, 25 bp, Mus musculus
cccagtggtcacgaaaccggcaggc

SEQ ID NO: 391171 - DNA, 25 bp, Mus musculus
tcggacaaagcggatcggtgactcc

SEQ ID NO: 391172 - DNA, 25 bp, Mus musculus
tgcgacagctgtcctcggacaaagc

SEQ ID NO: 391173 - DNA, 25 bp, Mus musculus
cctacttttctcagccgtcacgtga

SEQ ID NO: 391174 - DNA, 25 bp, Mus musculus
gctggctgttttgttgtatgcgaca

SEQ ID NO: 391175 - DNA, 25 bp, Mus musculus
cgaaacccttcgaggcacggtgccg

SEQ ID NO: 391176 - DNA, 25 bp, Mus musculus
tttcgcagcgaaacccttcgaggca

SEQ ID NO: 391177 - DNA, 25 bp, Mus musculus
agcgctgcaatttttactttatttt

SEQ ID NO: 391178 - DNA, 25 bp, Mus musculus
gcccattcataaaagcgctgcaatt

SEQ ID NO: 391179 - DNA, 25 bp, Mus musculus
ctcttgcccattttgcccattcata

SEQ ID NO: 391180 - DNA, 25 bp, Mus musculus
accctgattcctcttgcccattttg

SEQ ID NO: 391181 - DNA, 25 bp, Mus musculus
gtttagccaaccctgattcctcttg

SEQ ID NO: 391182 - DNA, 25 bp, Mus musculus
gcaggcctgattctctcgggagttt

SEQ ID NO: 391183 - DNA, 25 bp, Mus musculus
ccggtggaacaggatccgagcgccc

SEQ ID NO: 391184 - DNA, 25 bp, Mus musculus
tctggtctgaagaactggtcccgcc

SEQ ID NO: 391185 - DNA, 25 bp, Mus musculus
ccctcagtgtccttggcagggtata

SEQ ID NO: 391186 - DNA, 25 bp, Mus musculus
ggcacggccactctggtctgaagaa

SEQ ID NO: 391187 - DNA, 25 bp, Mus musculus
tcagaacacgatctgggtcgcgccc

SEQ ID NO: 391188 - DNA, 25 bp, Mus musculus
accagcagctgcttgccgtccatga

SEQ ID NO: 391189 - DNA, 25 bp, Mus musculus
gcctctaggcacaggccactgttca

SEQ ID NO: 391190 - DNA, 25 bp, Mus musculus
ttcagcttaaggaccacgggcgtca

SEQ ID NO: 391191 - DNA, 25 bp, Mus musculus
gtgcgtccgatcaccgtgagaacta

SEQ ID NO: 391192 - DNA, 25 bp, Mus musculus
tgagaactaagtccacgcctgggcc

SEQ ID NO: 391193 - DNA, 25 bp, Mus musculus
tgcgcggaatgagcttcccacaacc

SEQ ID NO: 391194 - DNA, 25 bp, Mus musculus
cgtccgtcctcaccgaggaagtcgg

SEQ ID NO: 391195 - DNA, 25 bp, Mus musculus
acgcgccttcggctgcttctttgat

SEQ ID NO: 391196 - DNA, 25 bp, Mus musculus
acgaacttcttgctgacgccgccgg

SEQ ID NO: 391197 - DNA, 25 bp, Mus musculus
tttgatgccctgctccagaagcgcc

SEQ ID NO: 391198 - DNA, 25 bp, Mus musculus
cggggacagcggttccatctcctcg

SEQ ID NO: 391199 - DNA, 25 bp, Mus musculus
gaccctggaagtgggctgcgggcca

SEQ ID NO: 391200 - DNA, 25 bp, Mus musculus
acgggcgcacatggcgggcctcacg

SEQ ID NO: 391201 - DNA, 25 bp, Mus musculus
tagggaatcccggacgggcgcacat

SEQ ID NO: 391202 - DNA, 25 bp, Mus musculus
gacagtcacagttctgcatgcgggg

SEQ ID NO: 391203 - DNA, 25 bp, Mus musculus
agtgactggtggacagtcacagttc

SEQ ID NO: 391204 - DNA, 25 bp, Mus musculus
acatctgcgtgtgtgctttcgtcgg

SEQ ID NO: 391205 - DNA, 25 bp, Mus musculus
gcgtccacatctgcgtgtgtgcttt

SEQ ID NO: 391206 - DNA, 25 bp, Mus musculus
cacggcgtccacatctgcgtgtgtg

SEQ ID NO: 391207 - DNA, 25 bp, Mus musculus
ttgaccacggcgtccacatctgcgt

SEQ ID NO: 391208 - DNA, 25 bp, Mus musculus
gacttggggtgtccgtcagtccgtc

SEQ ID NO: 391209 - DNA, 25 bp, Mus musculus
tgtcctccgcgcgacttggggtgtc

SEQ ID NO: 391210 - DNA, 25 bp, Mus musculus
agcggttccatctcctcggtgatgc

SEQ ID NO: 391211 - DNA, 25 bp, Mus musculus
tcggtgatgcgcgaccctcctctgt

SEQ ID NO: 391212 - DNA, 25 bp, Mus musculus
cgctgactgttcagccatcttcaaa

SEQ ID NO: 391213 - DNA, 25 bp, Mus musculus
cggcgctgactgttcagccatcttc

SEQ ID NO: 391214 - DNA, 25 bp, Mus musculus
ctgttcagccatcttcaaatcccga

SEQ ID NO: 391215 - DNA, 25 bp, Mus musculus
gccatcttcaaatcccgagaatcga

SEQ ID NO: 391216 - DNA, 25 bp, Mus musculus
ttcaaatcccgagaatcgaaggaga

SEQ ID NO: 391217 - DNA, 25 bp, Mus musculus
tcccgagaatcgaaggagatggacg

SEQ ID NO: 391218 - DNA, 25 bp, Mus musculus
gccgggaacctgaggtgatgaacct

SEQ ID NO: 391219 - DNA, 25 bp, Mus musculus
aacctgaggtgatgaacctgcctga

SEQ ID NO: 391220 - DNA, 25 bp, Mus musculus
aggtgatgaacctgcctgacgaacc

SEQ ID NO: 391221 - DNA, 25 bp, Mus musculus
tgatgaacctgcctgacgaaccacg

SEQ ID NO: 391222 - DNA, 25 bp, Mus musculus
gaacctgcctgacgaaccacggctg

SEQ ID NO: 391223 - DNA, 25 bp, Mus musculus
tgcctgacgaaccacggctgcagcg

SEQ ID NO: 391224 - DNA, 25 bp, Mus musculus
cctgacgaaccacggctgcagcggg

SEQ ID NO: 391225 - DNA, 25 bp, Mus musculus
tgcagcgggccgctcaggttaacta

SEQ ID NO: 391226 - DNA, 25 bp, Mus musculus
taggaagccaaacgccaaatctgtc

SEQ ID NO: 391227 - DNA, 25 bp, Mus musculus
agtgtctcgcctagggatctctttc

SEQ ID NO: 391228 - DNA, 25 bp, Mus musculus
ggggtcgcatcctgtgacattcaca

SEQ ID NO: 391229 - DNA, 25 bp, Mus musculus
tgacattcacaaggcttttctccgc

SEQ ID NO: 391230 - DNA, 25 bp, Mus musculus
tttctccgcccaatcagtgacggga

SEQ ID NO: 391231 - DNA, 25 bp, Mus musculus
tgacgggaacctcgtgactcaaaag

SEQ ID NO: 391232 - DNA, 25 bp, Mus musculus
gactcaaaagcactgcgcaactgtg

SEQ ID NO: 391233 - DNA, 25 bp, Mus musculus
cccaagaatgttccgctacgaggtg

SEQ ID NO: 391234 - DNA, 25 bp, Mus musculus
tgcggtaacctgacccttggcttgc

SEQ ID NO: 391235 - DNA, 25 bp, Mus musculus
gagctgccttggagacctgcatggc

SEQ ID NO: 391236 - DNA, 25 bp, Mus musculus
tgcatggctcctacccggtggtttt

SEQ ID NO: 391237 - DNA, 25 bp, Mus musculus
cggtggtttttcctgaggcagaatc

SEQ ID NO: 391238 - DNA, 25 bp, Mus musculus
ttacacacagccctgtgcacgcggg

SEQ ID NO: 391239 - DNA, 25 bp, Mus musculus
gcaactgtgcagttaggaaaacgga

SEQ ID NO: 391240 - DNA, 25 bp, Mus musculus
aaaccggccgtgagctctgcattct

SEQ ID NO: 391241 - DNA, 25 bp, Mus musculus
tggctttcctgttagccaatcgaaa

SEQ ID NO: 391242 - DNA, 25 bp, Mus musculus
ccaatgattttgtagccctgcctga

SEQ ID NO: 391243 - DNA, 25 bp, Mus musculus
gtgacgtggcaatgacagaagcata

SEQ ID NO: 391244 - DNA, 25 bp, Mus musculus
gtggcaatgacagaagcataaactg

SEQ ID NO: 391245 - DNA, 25 bp, Mus musculus
gcataaactgtaatgactgacggaa

SEQ ID NO: 391246 - DNA, 25 bp, Mus musculus
tgactgacggaagtactagccattc

SEQ ID NO: 391247 - DNA, 25 bp, Mus musculus
gtcctcggacttcggaaagccacca

SEQ ID NO: 391248 - DNA, 25 bp, Mus musculus
cattcggaggccaaaccggccgtga

SEQ ID NO: 391249 - DNA, 25 bp, Mus musculus
ggccgtgagctctgcattctcccgt

SEQ ID NO: 391250 - DNA, 25 bp, Mus musculus
agctctgcattctcccgtcctcgga

SEQ ID NO: 391251 - DNA, 25 bp, Mus musculus
tagccctgcctgattggctttcctg

SEQ ID NO: 391252 - DNA, 25 bp, Mus musculus
cttcggaaagccaccaatgattttg

SEQ ID NO: 391253 - DNA, 25 bp, Mus musculus
ctagccattcggaggccaaaccggc

SEQ ID NO: 391254 - DNA, 25 bp, Mus musculus
cgatcgactggttcggcgctcgctg

SEQ ID NO: 391255 - DNA, 25 bp, Mus musculus
ttcaactacggcagctgcgtggcgt

SEQ ID NO: 391256 - DNA, 25 bp, Mus musculus
atggccgacacggacccgggctatc

SEQ ID NO: 391257 - DNA, 25 bp, Mus musculus
cagcgtgcacatccgcatgggtatg

SEQ ID NO: 391258 - DNA, 25 bp, Mus musculus
cgtggcgtcggccagcgtgcacatc

SEQ ID NO: 391259 - DNA, 25 bp, Mus musculus
ccgctcgtccatcgaggatgacttc

SEQ ID NO: 391260 - DNA, 25 bp, Mus musculus
ggatgacttcaactacggcagctgc

SEQ ID NO: 391261 - DNA, 25 bp, Mus musculus
gaggcagttcggctagttctgtctg

SEQ ID NO: 391262 - DNA, 25 bp, Mus musculus
gcactgctggcgacatggccgacac

SEQ ID NO: 391263 - DNA, 25 bp, Mus musculus
ctgtctggcggccatcccggaagtg

SEQ ID NO: 391264 - DNA, 25 bp, Mus musculus
ctagttctgtctggcggccatcccg

SEQ ID NO: 391265 - DNA, 25 bp, Mus musculus
ttcggctagttctgtctggcggcca

SEQ ID NO: 391266 - DNA, 25 bp, Mus musculus
tcgctgcagagaggcagttcggcta

SEQ ID NO: 391267 - DNA, 25 bp, Mus musculus
actggttcggcgctcgctgcagaga

SEQ ID NO: 391268 - DNA, 25 bp, Mus musculus
agagggctggctcttcaaatggacc

SEQ ID NO: 391269 - DNA, 25 bp, Mus musculus
ggcttcactgccaaggtcgccctgg

SEQ ID NO: 391270 - DNA, 25 bp, Mus musculus
gctggctcttcaaatggaccaatta

SEQ ID NO: 391271 - DNA, 25 bp, Mus musculus
tggaccaattacatcaaaggctacc

SEQ ID NO: 391272 - DNA, 25 bp, Mus musculus
agctactacaggtaactgcttccgg

SEQ ID NO: 391273 - DNA, 25 bp, Mus musculus
ccggctggcttcactgccaaggtcg

SEQ ID NO: 391274 - DNA, 25 bp, Mus musculus
tgtgcagcccacagacccgcgctgt

SEQ ID NO: 391275 - DNA, 25 bp, Mus musculus
caggtaactgcttccggggcgccac

SEQ ID NO: 391276 - DNA, 25 bp, Mus musculus
agcaacgggctcctaagctactaca

SEQ ID NO: 391277 - DNA, 25 bp, Mus musculus
gttcgtgctgagcaacgggctccta

SEQ ID NO: 391278 - DNA, 25 bp, Mus musculus
taccagcggcgatggttcgtgctga

SEQ ID NO: 391279 - DNA, 25 bp, Mus musculus
caaaggctaccagcggcgatggttc

SEQ ID NO: 391280 - DNA, 25 bp, Mus musculus
ttacatcaaaggctaccagcggcga

SEQ ID NO: 391281 - DNA, 25 bp, Mus musculus
cgctgtcactctccgccggctggct

SEQ ID NO: 391282 - DNA, 25 bp, Mus musculus
cgcctcgatgtggtgactcacggct

SEQ ID NO: 391283 - DNA, 25 bp, Mus musculus
ccagtctcgagagcacgcgcgccat

SEQ ID NO: 391284 - DNA, 25 bp, Mus musculus
tcagtggcctccaggaggagtcgcc

SEQ ID NO: 391285 - DNA, 25 bp, Mus musculus
cgagtaagccgaccgcggtggcaca

SEQ ID NO: 391286 - DNA, 25 bp, Mus musculus
tccgcttcgagtaagccgaccgcgg

SEQ ID NO: 391287 - DNA, 25 bp, Mus musculus
ggcttcatgcaaaggcccggccctg

SEQ ID NO: 391288 - DNA, 25 bp, Mus musculus
agctgcccgtctccgactgcgctcc

SEQ ID NO: 391289 - DNA, 25 bp, Mus musculus
cgcgtaggcactgggacacggaccc

SEQ ID NO: 391290 - DNA, 25 bp, Mus musculus
gcccggccttctgcgcttcctccgg

SEQ ID NO: 391291 - DNA, 25 bp, Mus musculus
caccactgccgaggccaggagcatg

SEQ ID NO: 391292 - DNA, 25 bp, Mus musculus
ggccgtgttcgttcagccattccca

SEQ ID NO: 391293 - DNA, 25 bp, Mus musculus
cagcggccgtgttcgttcagccatt

SEQ ID NO: 391294 - DNA, 25 bp, Mus musculus
agccggctgtccacctggcccaaca

SEQ ID NO: 391295 - DNA, 25 bp, Mus musculus
gcgcaccaccgcctcgatgtggtga

SEQ ID NO: 391296 - DNA, 25 bp, Mus musculus
tcccggtgcctaagcgactgcagac

SEQ ID NO: 391297 - DNA, 25 bp, Mus musculus
tggcaagcgagcttttggacacccg

SEQ ID NO: 391298 - DNA, 25 bp, Mus musculus
ggtgcctaagcgactgcagactccc

SEQ ID NO: 391299 - DNA, 25 bp, Mus musculus
ggtcaggttttttgcatgaagccgc

SEQ ID NO: 391300 - DNA, 25 bp, Mus musculus
cgaatgtgcagggtcaggttttttg

SEQ ID NO: 391301 - DNA, 25 bp, Mus musculus
ctccagcgaggctcaactggtgcga

SEQ ID NO: 391302 - DNA, 25 bp, Mus musculus
cgtgaccatgcaactccagcgaggc

SEQ ID NO: 391303 - DNA, 25 bp, Mus musculus
acggagggcgtgaccatgcaactcc

SEQ ID NO: 391304 - DNA, 25 bp, Mus musculus
cgttgcctggctcccagcggagaga

SEQ ID NO: 391305 - DNA, 25 bp, Mus musculus
acctggaagcctctgagcggagccc

SEQ ID NO: 391306 - DNA, 25 bp, Mus musculus
ggagacacctggaagcctctgagcg

SEQ ID NO: 391307 - DNA, 25 bp, Mus musculus
ctcaccttggcgttcttccggggag

SEQ ID NO: 391308 - DNA, 25 bp, Mus musculus
tgagctcaccttggcgttcttccgg

SEQ ID NO: 391309 - DNA, 25 bp, Mus musculus
gtatccgcgggcgtgagctcacctt

SEQ ID NO: 391310 - DNA, 25 bp, Mus musculus
agagcgcgaggtttccttgcccgcg

SEQ ID NO: 391311 - DNA, 25 bp, Mus musculus
gatactcggcctttctccggcggga

SEQ ID NO: 391312 - DNA, 25 bp, Mus musculus
ctctcgaggggagaagtggtaaatt

SEQ ID NO: 391313 - DNA, 25 bp, Mus musculus
agtagcctggacgttatcccgcctc

SEQ ID NO: 391314 - DNA, 25 bp, Mus musculus
ctagcctaagaagtagcctggacgt

SEQ ID NO: 391315 - DNA, 25 bp, Mus musculus
cctcaagggttcttactagcctaag

SEQ ID NO: 391316 - DNA, 25 bp, Mus musculus
ccactttggagttcggctcaagcta

SEQ ID NO: 391317 - DNA, 25 bp, Mus musculus
gcgtctcgcgacaatcccaaagtga

SEQ ID NO: 391318 - DNA, 25 bp, Mus musculus
ccgttctcaccgttaaacggctgcg

SEQ ID NO: 391319 - DNA, 25 bp, Mus musculus
cttcctccaaccaatcaggaaacgg

SEQ ID NO: 391320 - DNA, 25 bp, Mus musculus
cggacggacacgcagcgggccaatc

SEQ ID NO: 391321 - DNA, 25 bp, Mus musculus
ggcgaggacaaaacgcaccgttctc

SEQ ID NO: 391322 - DNA, 25 bp, Mus musculus
accgttaaacggctgcgtctcgcga

SEQ ID NO: 391323 - DNA, 25 bp, Mus musculus
cgcgacaatcccaaagtgacctttc

SEQ ID NO: 391324 - DNA, 25 bp, Mus musculus
tttcaccgctgacaaatggcaagcc

SEQ ID NO: 391325 - DNA, 25 bp, Mus musculus
gaatggtcgcttcttccctgagagc

SEQ ID NO: 391326 - DNA, 25 bp, Mus musculus
tggcgtggagctccgaccaataact

SEQ ID NO: 391327 - DNA, 25 bp, Mus musculus
cggttctgtgttactgcccatcatt

SEQ ID NO: 391328 - DNA, 25 bp, Mus musculus
accaatcggagatggctgaacatta

SEQ ID NO: 391329 - DNA, 25 bp, Mus musculus
gagggcgccgcatcaaccaatcgga

SEQ ID NO: 391330 - DNA, 25 bp, Mus musculus
ggatgcctccagattgactacagtc

SEQ ID NO: 391331 - DNA, 25 bp, Mus musculus
taattggctgctattcctcggaatg

SEQ ID NO: 391332 - DNA, 25 bp, Mus musculus
cccaaggagcatcccgggagatgta

SEQ ID NO: 391333 - DNA, 25 bp, Mus musculus
catattcacgaccatccgcggaggg

SEQ ID NO: 391334 - DNA, 25 bp, Mus musculus
acgcgctctgtgtaggtgacttctt

SEQ ID NO: 391335 - DNA, 25 bp, Mus musculus
ggaacagctctaacaacgcgctctg

SEQ ID NO: 391336 - DNA, 25 bp, Mus musculus
gctactgtggccaaggatgcctcca

SEQ ID NO: 391337 - DNA, 25 bp, Mus musculus
gcgcaaactcctttggttcggaaga

SEQ ID NO: 391338 - DNA, 25 bp, Mus musculus
tctcaggccgctcactgattggctc

SEQ ID NO: 391339 - DNA, 25 bp, Mus musculus
ttccgagttctgaggactatgctcc

SEQ ID NO: 391340 - DNA, 25 bp, Mus musculus
cgtctgtgcacaggagcgcatttcg

SEQ ID NO: 391341 - DNA, 25 bp, Mus musculus
gcgcatttcggcctcagcaactatc

SEQ ID NO: 391342 - DNA, 25 bp, Mus musculus
gctcaccgctgtctgtatctcaaca

SEQ ID NO: 391343 - DNA, 25 bp, Mus musculus
accttaccgagtgtggcagcttggc

SEQ ID NO: 391344 - DNA, 25 bp, Mus musculus
tgccctggcctctgaacaacttcga

SEQ ID NO: 391345 - DNA, 25 bp, Mus musculus
tggcttccatggtgctaaggcgaca

SEQ ID NO: 391346 - DNA, 25 bp, Mus musculus
gccacgctcactatcggagtctacg

SEQ ID NO: 391347 - DNA, 25 bp, Mus musculus
gctccattggttcgctgtctcaggc

SEQ ID NO: 391348 - DNA, 25 bp, Mus musculus
gattggctctcgctcagaagctccc

SEQ ID NO: 391349 - DNA, 25 bp, Mus musculus
gaagccggcagctttcaatttccga

SEQ ID NO: 391350 - DNA, 25 bp, Mus musculus
tcaatcggctttagcggtcaacgca

SEQ ID NO: 391351 - DNA, 25 bp, Mus musculus
cgcgtctccggatgcaaaggcagag

SEQ ID NO: 391352 - DNA, 25 bp, Mus musculus
ttcctccagggtggagccgacctaa

SEQ ID NO: 391353 - DNA, 25 bp, Mus musculus
gcctgggaagaacgtgcagctgaca

SEQ ID NO: 391354 - DNA, 25 bp, Mus musculus
gtactcagtgcagggctcacggcct

SEQ ID NO: 391355 - DNA, 25 bp, Mus musculus
ccaagaccctattccgtactcagtg

SEQ ID NO: 391356 - DNA, 25 bp, Mus musculus
tttgaaggcctgacgcaaaggtttc

SEQ ID NO: 391357 - DNA, 25 bp, Mus musculus
ctaaggggtcggatcttgcctttga

SEQ ID NO: 391358 - DNA, 25 bp, Mus musculus
acaggcgtttctctggaggccctcc

SEQ ID NO: 391359 - DNA, 25 bp, Mus musculus
acaggctgctgagcacaggcgtttc

SEQ ID NO: 391360 - DNA, 25 bp, Mus musculus
agggatcccgaagcgaggaagcttc

SEQ ID NO: 391361 - DNA, 25 bp, Mus musculus
aggctcctgcgaagctagctgggaa

SEQ ID NO: 391362 - DNA, 25 bp, Mus musculus
acaggccgtgaggatccatggccac

SEQ ID NO: 391363 - DNA, 25 bp, Mus musculus
tcaacctggactccatcatcgggcg

SEQ ID NO: 391364 - DNA, 25 bp, Mus musculus
gtccgacagcgagaagctcaacctg

SEQ ID NO: 391365 - DNA, 25 bp, Mus musculus
tgcagctgacagagaacgagatccg

SEQ ID NO: 391366 - DNA, 25 bp, Mus musculus
ccatcagctggaggcgagtagatgc

SEQ ID NO: 391367 - DNA, 25 bp, Mus musculus
cgagtagatgctctgcagtgagcgc

SEQ ID NO: 391368 - DNA, 25 bp, Mus musculus
ggcggcaaaaactcctttgtggcta

SEQ ID NO: 391369 - DNA, 25 bp, Mus musculus
gccacggctggaaggagctcttgat

SEQ ID NO: 391370 - DNA, 25 bp, Mus musculus
aaggagctcttgatggccaccagcg

SEQ ID NO: 391371 - DNA, 25 bp, Mus musculus
cggttcaccctgagcgtgctgagca

SEQ ID NO: 391372 - DNA, 25 bp, Mus musculus
gcagccggtcggcattgaagtccag

SEQ ID NO: 391373 - DNA, 25 bp, Mus musculus
ggcattgaagtccagcacgccgtcc

SEQ ID NO: 391374 - DNA, 25 bp, Mus musculus
cagcgcgcacaggtactcgtagtgc

SEQ ID NO: 391375 - DNA, 25 bp, Mus musculus
ctcgtagtgcgagaagaagtcggcc

SEQ ID NO: 391376 - DNA, 25 bp, Mus musculus
cgccggagcttcaccgagtcgatca

SEQ ID NO: 391377 - DNA, 25 bp, Mus musculus
accgagtcgatcatgaccggcaacc

SEQ ID NO: 391378 - DNA, 25 bp, Mus musculus
ggccgcttcgcaggctgatcctgca

SEQ ID NO: 391379 - DNA, 25 bp, Mus musculus
cgtccaacgcgccatcagctggagg

SEQ ID NO: 391380 - DNA, 25 bp, Mus musculus
ttcctcgcgcgtcccaggctcccgg

SEQ ID NO: 391381 - DNA, 25 bp, Mus musculus
ggatcaacgacgagatcgagcggca

SEQ ID NO: 391382 - DNA, 25 bp, Mus musculus
cccggaggatcaacgacgagatcga

SEQ ID NO: 391383 - DNA, 25 bp, Mus musculus
caaggaagcccggaggatcaacgac

SEQ ID NO: 391384 - DNA, 25 bp, Mus musculus
ctgcctgagcgaggaggccaaggaa

SEQ ID NO: 391385 - DNA, 25 bp, Mus musculus
cttcggaagaatgactctggagtcc

SEQ ID NO: 391386 - DNA, 25 bp, Mus musculus
ctgagctcgtccctgacgcgcgccc

SEQ ID NO: 391387 - DNA, 25 bp, Mus musculus
gcgcacagccttgggcagcgtcggc

SEQ ID NO: 391388 - DNA, 25 bp, Mus musculus
cctcggtggatgagctcgggccgct

SEQ ID NO: 391389 - DNA, 25 bp, Mus musculus
tgcccggtttgcgagcgagccgagt

SEQ ID NO: 391390 - DNA, 25 bp, Mus musculus
ggatctgtgctccagttcagagaaa

SEQ ID NO: 391391 - DNA, 25 bp, Mus musculus
tcccggatctgtgctccagttcaga

SEQ ID NO: 391392 - DNA, 25 bp, Mus musculus
cgaggagagcgcgagctgtccagga

SEQ ID NO: 391393 - DNA, 25 bp, Mus musculus
cgaggcacttcggaagaatgactct

SEQ ID NO: 391394 - DNA, 25 bp, Mus musculus
cccaacttttgattcgcggtgtgcg

SEQ ID NO: 391395 - DNA, 25 bp, Mus musculus
gcctgacctcggaactgccttcgag

SEQ ID NO: 391396 - DNA, 25 bp, Mus musculus
cggggacgcacatcttctggagaca

SEQ ID NO: 391397 - DNA, 25 bp, Mus musculus
agtggccgcctttatccagcgcgca

SEQ ID NO: 391398 - DNA, 25 bp, Mus musculus
agcttcgccgcgacaagaaggacgc

SEQ ID NO: 391399 - DNA, 25 bp, Mus musculus
agaaagagtctcagcgcatcagcgc

SEQ ID NO: 391400 - DNA, 25 bp, Mus musculus
ctgctgtttgtctgcggaggagaaa

SEQ ID NO: 391401 - DNA, 25 bp, Mus musculus
tcaaaccttgcgtctggcgcggata

SEQ ID NO: 391402 - DNA, 25 bp, Mus musculus
catagttggttcaggtggtttcctc

SEQ ID NO: 391403 - DNA, 25 bp, Mus musculus
agcctctttctccataccatagttg

SEQ ID NO: 391404 - DNA, 25 bp, Mus musculus
ctgccttcgagaaagcgttagccta

SEQ ID NO: 391405 - DNA, 25 bp, Mus musculus
tcttctggagacagcgccaatcaca

SEQ ID NO: 391406 - DNA, 25 bp, Mus musculus
cccagctacagtgtccggggacgca

SEQ ID NO: 391407 - DNA, 25 bp, Mus musculus
agcctaggagatccgagcctctttc

SEQ ID NO: 391408 - DNA, 25 bp, Mus musculus
cctagatcggagatgtgacggtcct

SEQ ID NO: 391409 - DNA, 25 bp, Mus musculus
aactccgcggcgtgaaggactggct

SEQ ID NO: 391410 - DNA, 25 bp, Mus musculus
cggtgttgtctctcaggtgagttgc

SEQ ID NO: 391411 - DNA, 25 bp, Mus musculus
tcccgcacacggaccactggtgatt

SEQ ID NO: 391412 - DNA, 25 bp, Mus musculus
gagagccatttccagacctagatcg

SEQ ID NO: 391413 - DNA, 25 bp, Mus musculus
cgagccttagggagagccatttcca

SEQ ID NO: 391414 - DNA, 25 bp, Mus musculus
ccgaacttggtagaaaggagctgac

SEQ ID NO: 391415 - DNA, 25 bp, Mus musculus
tagctccgggttgaagccgaacttg

SEQ ID NO: 391416 - DNA, 25 bp, Mus musculus
tgacctgtacggtgtgcagcagagc

SEQ ID NO: 391417 - DNA, 25 bp, Mus musculus
gaccactggtgattgctgacgctca

SEQ ID NO: 391418 - DNA, 25 bp, Mus musculus
ctttggactcaactccgcggcgtga

SEQ ID NO: 391419 - DNA, 25 bp, Mus musculus
cctctcaaggatcccggcatgctgt

SEQ ID NO: 391420 - DNA, 25 bp, Mus musculus
cacggttctcgtgacctgtacggtg

SEQ ID NO: 391421 - DNA, 25 bp, Mus musculus
agcgcctgtacttccggttggcgtc

SEQ ID NO: 391422 - DNA, 25 bp, Mus musculus
ttacctttccaaatgcccagggaga

SEQ ID NO: 391423 - DNA, 25 bp, Mus musculus
tgattctcctttttacccgcagcga

SEQ ID NO: 391424 - DNA, 25 bp, Mus musculus
ttagcaacagaacaccagtcgagcg

SEQ ID NO: 391425 - DNA, 25 bp, Mus musculus
cacagaaggaaggtagccgctcgca

SEQ ID NO: 391426 - DNA, 25 bp, Mus musculus
cgaccaccgactcgaataccatttt

SEQ ID NO: 391427 - DNA, 25 bp, Mus musculus
cacatagtctcccaggaaccggttc

SEQ ID NO: 391428 - DNA, 25 bp, Mus musculus
cagcgaactttctctaggaggcggg

SEQ ID NO: 391429 - DNA, 25 bp, Mus musculus
tgataaccgacaggaacgccgcttc

SEQ ID NO: 391430 - DNA, 25 bp, Mus musculus
aggaccgaagccacgagaaaccgcg

SEQ ID NO: 391431 - DNA, 25 bp, Mus musculus
ccgctttacataacttgaagggcga

SEQ ID NO: 391432 - DNA, 25 bp, Mus musculus
cttcacgtgcaagtcggcgtgcgac

SEQ ID NO: 391433 - DNA, 25 bp, Mus musculus
ctcgcctagaaagcacggtgaagtg

SEQ ID NO: 391434 - DNA, 25 bp, Mus musculus
cggaccggaactcgcctagaaagca

SEQ ID NO: 391435 - DNA, 25 bp, Mus musculus
gggactcgtccaggttcaccacata

SEQ ID NO: 391436 - DNA, 25 bp, Mus musculus
ttttggtcgctgtaggaactcttcc

SEQ ID NO: 391437 - DNA, 25 bp, Mus musculus
cctcctgcatcttgccgggatggga

SEQ ID NO: 391438 - DNA, 25 bp, Mus musculus
aacttgtagatgtcgctcagaggca

SEQ ID NO: 391439 - DNA, 25 bp, Mus musculus
cagaagctgcccttaccgggttggt

SEQ ID NO: 391440 - DNA, 25 bp, Mus musculus
gttctcgaacatgtcaccgcagtca

SEQ ID NO: 391441 - DNA, 25 bp, Mus musculus
gaggcagcatcttctcagccgaatg

SEQ ID NO: 391442 - DNA, 25 bp, Mus musculus
acagtgggccttaacgcctctcgga

SEQ ID NO: 391443 - DNA, 25 bp, Mus musculus
gaactcttccctggccgtggcatct

SEQ ID NO: 391444 - DNA, 25 bp, Mus musculus
gcctctcggaaagccggataccagg

SEQ ID NO: 391445 - DNA, 25 bp, Mus musculus
tttatggcgctcacaacttctggtc

SEQ ID NO: 391446 - DNA, 25 bp, Mus musculus
cttctggtcttgactgtcgtgggca

SEQ ID NO: 391447 - DNA, 25 bp, Mus musculus
ctcacagtagccagagagactcgcc

SEQ ID NO: 391448 - DNA, 25 bp, Mus musculus
gagactcgccagctttaccttgctt

SEQ ID NO: 391449 - DNA, 25 bp, Mus musculus
cctcctcttggatgactagacttga

SEQ ID NO: 391450 - DNA, 25 bp, Mus musculus
cgcaccgcgtcaggaggccaccgcg

SEQ ID NO: 391451 - DNA, 25 bp, Mus musculus
ctgcgcaaagcgaccactttctgga

SEQ ID NO: 391452 - DNA, 25 bp, Mus musculus
ggtccctgcgcaaagcgaccacttt

SEQ ID NO: 391453 - DNA, 25 bp, Mus musculus
agcggctggtccctgcgcaaagcga

SEQ ID NO: 391454 - DNA, 25 bp, Mus musculus
aagcaaggagggctcagtcccggcc

SEQ ID NO: 391455 - DNA, 25 bp, Mus musculus
gcaagccgcccagaggaagcaagga

SEQ ID NO: 391456 - DNA, 25 bp, Mus musculus
aagcgaccactttctggagatcccg

SEQ ID NO: 391457 - DNA, 25 bp, Mus musculus
gctcccgggcggcacacccactttc

SEQ ID NO: 391458 - DNA, 25 bp, Mus musculus
ttattaggacagagtcggagctgga

SEQ ID NO: 391459 - DNA, 25 bp, Mus musculus
ttccttattaggacagagtcggagc

SEQ ID NO: 391460 - DNA, 25 bp, Mus musculus
ctttctggagatcccgctcaagtcc

SEQ ID NO: 391461 - DNA, 25 bp, Mus musculus
agtccaccgcagctctcctctctcg

SEQ ID NO: 391462 - DNA, 25 bp, Mus musculus
acccactttccttattaggacagag

SEQ ID NO: 391463 - DNA, 25 bp, Mus musculus
gaccactttctggagatcccgctca

SEQ ID NO: 391464 - DNA, 25 bp, Mus musculus
cactgcctccttggtgcagcccgtc

SEQ ID NO: 391465 - DNA, 25 bp, Mus musculus
cacgccctaggacccaccctcgaga

SEQ ID NO: 391466 - DNA, 25 bp, Mus musculus
agccttctgcgctccagacctccga

SEQ ID NO: 391467 - DNA, 25 bp, Mus musculus
atcggctcgccaagcggatactggc

SEQ ID NO: 391468 - DNA, 25 bp, Mus musculus
aacagtgctggatcggctcgccaag

SEQ ID NO: 391469 - DNA, 25 bp, Mus musculus
cctgcagggcgcacgaaacagtgct

SEQ ID NO: 391470 - DNA, 25 bp, Mus musculus
aggttacctggagcctgtgcctgca

SEQ ID NO: 391471 - DNA, 25 bp, Mus musculus
cagcctaggttacctggagcctgtg

SEQ ID NO: 391472 - DNA, 25 bp, Mus musculus
gtgctgtccaactctgccgggcaac

SEQ ID NO: 391473 - DNA, 25 bp, Mus musculus
agatccggttcggtgctgtccaact

SEQ ID NO: 391474 - DNA, 25 bp, Mus musculus
cgcccgttagatccggttcggtgct

SEQ ID NO: 391475 - DNA, 25 bp, Mus musculus
aggagagtgctaagaggactcctgc

SEQ ID NO: 391476 - DNA, 25 bp, Mus musculus
tgtgtatccgcgtcccaccgaagga

SEQ ID NO: 391477 - DNA, 25 bp, Mus musculus
ggactcctgctccatcctagccggg

SEQ ID NO: 391478 - DNA, 25 bp, Mus musculus
ctatcctgcgggcaggcactggtcg

SEQ ID NO: 391479 - DNA, 25 bp, Mus musculus
gaaggcaccgcaggttggattggcc

SEQ ID NO: 391480 - DNA, 25 bp, Mus musculus
tgccgttcttctgccgcggccaggt

SEQ ID NO: 391481 - DNA, 25 bp, Mus musculus
gccgcggctccaagcaactgggcat

SEQ ID NO: 391482 - DNA, 25 bp, Mus musculus
ctgccgctagcgacgagctgcgcag

SEQ ID NO: 391483 - DNA, 25 bp, Mus musculus
aggtcagcgtcatgaggagcctgcc

SEQ ID NO: 391484 - DNA, 25 bp, Mus musculus
attcgccgcggttgtcgtagttccg

SEQ ID NO: 391485 - DNA, 25 bp, Mus musculus
ctccgtcgcaggcacggagcgagga

SEQ ID NO: 391486 - DNA, 25 bp, Mus musculus
agacctgtgcattcgccgcggttgt

SEQ ID NO: 391487 - DNA, 25 bp, Mus musculus
gtccgcactacgatgtcggcgagcg

SEQ ID NO: 391488 - DNA, 25 bp, Mus musculus
ctgggccgcagacctgtgcattcgc

SEQ ID NO: 391489 - DNA, 25 bp, Mus musculus
gaggagcctgccgttcttctgccgc

SEQ ID NO: 391490 - DNA, 25 bp, Mus musculus
cgtcctccgaggtcagcgtcatgag

SEQ ID NO: 391491 - DNA, 25 bp, Mus musculus
cactggtcgcggcaggtgtctcgct

SEQ ID NO: 391492 - DNA, 25 bp, Mus musculus
gcacaactaacttctccggcctggg

SEQ ID NO: 391493 - DNA, 25 bp, Mus musculus
gcgttggagagagcatcgccctaga

SEQ ID NO: 391494 - DNA, 25 bp, Mus musculus
tggactcttcgtttgcctcttgctc

SEQ ID NO: 391495 - DNA, 25 bp, Mus musculus
ggctttgctcttggactcttcgttt

SEQ ID NO: 391496 - DNA, 25 bp, Mus musculus
cgggagcagagcagaacagctagcc

SEQ ID NO: 391497 - DNA, 25 bp, Mus musculus
gcagtgccagcacgcacagcaggtc

SEQ ID NO: 391498 - DNA, 25 bp, Mus musculus
gcgtccggcataccgggagcagaca

SEQ ID NO: 391499 - DNA, 25 bp, Mus musculus
tggctatgcgatctgcctccgcgaa

SEQ ID NO: 391500 - DNA, 25 bp, Mus musculus
tgaatccgtacttgctggctatgcg

SEQ ID NO: 391501 - DNA, 25 bp, Mus musculus
ttggttacctgtcctacgttgatga

SEQ ID NO: 391502 - DNA, 25 bp, Mus musculus
caaacgactagcttctgggtgcaga

SEQ ID NO: 391503 - DNA, 25 bp, Mus musculus
cgggccacagctgcagaagcacatc

SEQ ID NO: 391504 - DNA, 25 bp, Mus musculus
atcgccctagagttcgggccacagc

SEQ ID NO: 391505 - DNA, 25 bp, Mus musculus
aggctcttagaccatgcctggggca

SEQ ID NO: 391506 - DNA, 25 bp, Mus musculus
ttcgcctgccggtcaagaactccaa

SEQ ID NO: 391507 - DNA, 25 bp, Mus musculus
actgcctgctgcgtacacacggcga

SEQ ID NO: 391508 - DNA, 25 bp, Mus musculus
cttgacagcgacagggcgaaatatg

SEQ ID NO: 391509 - DNA, 25 bp, Mus musculus
acaccgctagaacgtcctggcgagc

SEQ ID NO: 391510 - DNA, 25 bp, Mus musculus
gcgctacacggagcgaccaggctca

SEQ ID NO: 391511 - DNA, 25 bp, Mus musculus
ggacttcgctgcctaggtgagcacc

SEQ ID NO: 391512 - DNA, 25 bp, Mus musculus
agtggtaggcatgaaacgctcttga

SEQ ID NO: 391513 - DNA, 25 bp, Mus musculus
tcttgaagcttgctctgcgaccctg

SEQ ID NO: 391514 - DNA, 25 bp, Mus musculus
cgaggcctgggaatcttcaagagtc

SEQ ID NO: 391515 - DNA, 25 bp, Mus musculus
tcaagagtctccttcgctgtatgta

SEQ ID NO: 391516 - DNA, 25 bp, Mus musculus
cgctgtatgtaccaggaacctgatc

SEQ ID NO: 391517 - DNA, 25 bp, Mus musculus
acctgatcgtgtctagggaaaccgc

SEQ ID NO: 391518 - DNA, 25 bp, Mus musculus
aacccgcttcggtgagtacccactg

SEQ ID NO: 391519 - DNA, 25 bp, Mus musculus
gaccctgctgggaaggattcgaacc

SEQ ID NO: 391520 - DNA, 25 bp, Mus musculus
tttgcacacgaaccgggacgggata

SEQ ID NO: 391521 - DNA, 25 bp, Mus musculus
gtcacgtgatctagtcggttcattg

SEQ ID NO: 391522 - DNA, 25 bp, Mus musculus
ccgggacgggataggacatataatg

SEQ ID NO: 391523 - DNA, 25 bp, Mus musculus
gacatataatgagtcccagcagcta

SEQ ID NO: 391524 - DNA, 25 bp, Mus musculus
taatgagtcccagcagctactacga

SEQ ID NO: 391525 - DNA, 25 bp, Mus musculus
agctactacgactgcctaaagttcc

SEQ ID NO: 391526 - DNA, 25 bp, Mus musculus
atctagtcggttcattgggtgtggc

SEQ ID NO: 391527 - DNA, 25 bp, Mus musculus
tggcctccgcttccttattggttca

SEQ ID NO: 391528 - DNA, 25 bp, Mus musculus
tctccgtcacgtgagaaaaacgttc

SEQ ID NO: 391529 - DNA, 25 bp, Mus musculus
cgtgagaaaaacgttcctaagctcg

SEQ ID NO: 391530 - DNA, 25 bp, Mus musculus
aaacgttcctaagctcggtgtcacg

SEQ ID NO: 391531 - DNA, 25 bp, Mus musculus
cctaagctcggtgtcacgtgatcta

SEQ ID NO: 391532 - DNA, 25 bp, Mus musculus
cggtgtcacgtgatctagtcggttc

SEQ ID NO: 391533 - DNA, 25 bp, Mus musculus
cgagcttgttttgcacacgaaccgg

SEQ ID NO: 391534 - DNA, 25 bp, Mus musculus
tttgtagagaactgaacggtgctgc

SEQ ID NO: 391535 - DNA, 25 bp, Mus musculus
gccctctaagcgtattcggacgtca

SEQ ID NO: 391536 - DNA, 25 bp, Mus musculus
tattcggacgtcagcgcgtcgtagc

SEQ ID NO: 391537 - DNA, 25 bp, Mus musculus
cggaagcccggcagcgaatgaacgc

SEQ ID NO: 391538 - DNA, 25 bp, Mus musculus
ccttagcctggtcgtcggcgcgtgc

SEQ ID NO: 391539 - DNA, 25 bp, Mus musculus
gtcccgaaaccctggcggagcgcag

SEQ ID NO: 391540 - DNA, 25 bp, Mus musculus
ccgccggagcgagtgtgcacttttt

SEQ ID NO: 391541 - DNA, 25 bp, Mus musculus
aacggtgctgccgagtggctctgac

SEQ ID NO: 391542 - DNA, 25 bp, Mus musculus
agagatcccggagttgcaaaatgtg

SEQ ID NO: 391543 - DNA, 25 bp, Mus musculus
tgcaaaatgtgcatcttggtaagga

SEQ ID NO: 391544 - DNA, 25 bp, Mus musculus
caccggagccggctttatgttcttg

SEQ ID NO: 391545 - DNA, 25 bp, Mus musculus
tttatgttcttgtggtctgcgagta

SEQ ID NO: 391546 - DNA, 25 bp, Mus musculus
tctgcgagtaagtacggaattcctc

SEQ ID NO: 391547 - DNA, 25 bp, Mus musculus
cgctactacgggtaaggcgcgcccg

SEQ ID NO: 391548 - DNA, 25 bp, Mus musculus
caggtaggtccgctactcactagcc

SEQ ID NO: 391549 - DNA, 25 bp, Mus musculus
ctcgggacagccgagctctgcgctg

SEQ ID NO: 391550 - DNA, 25 bp, Mus musculus
caggttcgaaactccggcgctgcgc

SEQ ID NO: 391551 - DNA, 25 bp, Mus musculus
cgcatcacggcgcaggttcgaaact

SEQ ID NO: 391552 - DNA, 25 bp, Mus musculus
accaaccagcggctgtgctggatgg

SEQ ID NO: 391553 - DNA, 25 bp, Mus musculus
tcagagggcgcacttccggccgcaa

SEQ ID NO: 391554 - DNA, 25 bp, Mus musculus
tcactagcccggagctcggtgccag

SEQ ID NO: 391555 - DNA, 25 bp, Mus musculus
ccgtgcaagtcaaaagaaggccgcc

SEQ ID NO: 391556 - DNA, 25 bp, Mus musculus
acaggggaatgcgaacaaccgtgca

SEQ ID NO: 391557 - DNA, 25 bp, Mus musculus
ccgagaggcgcacacacaggggaat

SEQ ID NO: 391558 - DNA, 25 bp, Mus musculus
ccgagtcctcgcttggggaccgaga

SEQ ID NO: 391559 - DNA, 25 bp, Mus musculus
acttgccgctgggacctctgaggcc

SEQ ID NO: 391560 - DNA, 25 bp, Mus musculus
cccaggatcgcagcacagaggaaag

SEQ ID NO: 391561 - DNA, 25 bp, Mus musculus
cgctgcgggctaagcagacacttcc

SEQ ID NO: 391562 - DNA, 25 bp, Mus musculus
gctctgaaagatggacgcagccttc

SEQ ID NO: 391563 - DNA, 25 bp, Mus musculus
cgggatctcccgtccctagtctgag

SEQ ID NO: 391564 - DNA, 25 bp, Mus musculus
tcccgtccctagtctgagttaccta

SEQ ID NO: 391565 - DNA, 25 bp, Mus musculus
tctgagttacctaggcaacagcggc

SEQ ID NO: 391566 - DNA, 25 bp, Mus musculus
ttacctaggcaacagcggcagaggc

SEQ ID NO: 391567 - DNA, 25 bp, Mus musculus
tccgcactgcggcactgagctggct

SEQ ID NO: 391568 - DNA, 25 bp, Mus musculus
ctcgtcctcgcctaggcgcagggaa

SEQ ID NO: 391569 - DNA, 25 bp, Mus musculus
ctaggcgcagggaaccgcttcgcgc

SEQ ID NO: 391570 - DNA, 25 bp, Mus musculus
gctgtccctcctctctgtgagtatc

SEQ ID NO: 391571 - DNA, 25 bp, Mus musculus
cacccggagactgtgggatgctcgc

SEQ ID NO: 391572 - DNA, 25 bp, Mus musculus
atgctcgcgagcaggctaccggaga

SEQ ID NO: 391573 - DNA, 25 bp, Mus musculus
ccagatcccggaagcgcgccgggta

SEQ ID NO: 391574 - DNA, 25 bp, Mus musculus
cccagtccggtgctctgaaagatgg

SEQ ID NO: 391575 - DNA, 25 bp, Mus musculus
gaaagatggacgcagccttcgcctt

SEQ ID NO: 391576 - DNA, 25 bp, Mus musculus
acccgaacatgattatcgtagctga

SEQ ID NO: 391577 - DNA, 25 bp, Mus musculus
actgcgatctcgaataggtaggatt

SEQ ID NO: 391578 - DNA, 25 bp, Mus musculus
cgaataggtaggatttgcgaaatgc

SEQ ID NO: 391579 - DNA, 25 bp, Mus musculus
acgaggaggaattcgctgtcgcttc

SEQ ID NO: 391580 - DNA, 25 bp, Mus musculus
gcgaaatgctagctttcaagtcctc

SEQ ID NO: 391581 - DNA, 25 bp, Mus musculus
agctttcaagtcctctagtctccac

SEQ ID NO: 391582 - DNA, 25 bp, Mus musculus
tagtctccacccgaacatgattatc

SEQ ID NO: 391583 - DNA, 25 bp, Mus musculus
tccgagtccaggaggaatcgagtcc

SEQ ID NO: 391584 - DNA, 25 bp, Mus musculus
gcagtctttcttccgggagttggga

SEQ ID NO: 391585 - DNA, 25 bp, Mus musculus
ggcaggacccgcagtctttcttccg

SEQ ID NO: 391586 - DNA, 25 bp, Mus musculus
tggcaaccgcgtggacccttccgaa

SEQ ID NO: 391587 - DNA, 25 bp, Mus musculus
tcgtagctgaggttttggcaaccgc

SEQ ID NO: 391588 - DNA, 25 bp, Mus musculus
tgtcccggacgaggaggaattcgct

SEQ ID NO: 391589 - DNA, 25 bp, Mus musculus
gcacgcgtatctaactgcgatctcg

SEQ ID NO: 391590 - DNA, 25 bp, Mus musculus
agagcgacgcgcagaaaagattcaa

SEQ ID NO: 391591 - DNA, 25 bp, Mus musculus
aggcgcgattagcactgtcctggtc

SEQ ID NO: 391592 - DNA, 25 bp, Mus musculus
ctgtcctggtctccaaaaaatgcgc

SEQ ID NO: 391593 - DNA, 25 bp, Mus musculus
aaaaatgcgcccttcagcgtcctgc

SEQ ID NO: 391594 - DNA, 25 bp, Mus musculus
aggccatttgcagtcccacctgcga

SEQ ID NO: 391595 - DNA, 25 bp, Mus musculus
ctgcgaaccgaactcggggagcctc

SEQ ID NO: 391596 - DNA, 25 bp, Mus musculus
gggagcctcgagtagccaatctctc

SEQ ID NO: 391597 - DNA, 25 bp, Mus musculus
tccgctcagcacgagggaagaaggc

SEQ ID NO: 391598 - DNA, 25 bp, Mus musculus
gagctgctccgctgagagaagcatc

SEQ ID NO: 391599 - DNA, 25 bp, Mus musculus
tccctttaggcagatgtcgtggcca

SEQ ID NO: 391600 - DNA, 25 bp, Mus musculus
tccgcgtagtcatgaagctcccagc

SEQ ID NO: 391601 - DNA, 25 bp, Mus musculus
gctctctatcccgtgtcctgtggcg

SEQ ID NO: 391602 - DNA, 25 bp, Mus musculus
ggctcgcttacctcgcatgatgtgg

SEQ ID NO: 391603 - DNA, 25 bp, Mus musculus
tcccggtctagctagagttgtcctg

SEQ ID NO: 391604 - DNA, 25 bp, Mus musculus
gcctcggcgcttctgcacgaacaaa

SEQ ID NO: 391605 - DNA, 25 bp, Mus musculus
tagacaatggcagaggcggctactg

SEQ ID NO: 391606 - DNA, 25 bp, Mus musculus
gggttaaaaatagaagcgctgcctc

SEQ ID NO: 391607 - DNA, 25 bp, Mus musculus
ccgaccgggttttcgctgacgcaca

SEQ ID NO: 391608 - DNA, 25 bp, Mus musculus
ctcagatcccgagcgccggtcagag

SEQ ID NO: 391609 - DNA, 25 bp, Mus musculus
cggtcagagccagagcgtcagtcgt

SEQ ID NO: 391610 - DNA, 25 bp, Mus musculus
cagagcgtcagtcgtcgggatcgct

SEQ ID NO: 391611 - DNA, 25 bp, Mus musculus
tgtgcatctggtcaggcgtccgctc

SEQ ID NO: 391612 - DNA, 25 bp, Mus musculus
cgcagagtctctggcgaacgcggaa

SEQ ID NO: 391613 - DNA, 25 bp, Mus musculus
acgcggaagcccgaagagcgcagtc

SEQ ID NO: 391614 - DNA, 25 bp, Mus musculus
tctgcacgaacaaaggaggcctccg

SEQ ID NO: 391615 - DNA, 25 bp, Mus musculus
gcgccagctcgctagtgcatccggg

SEQ ID NO: 391616 - DNA, 25 bp, Mus musculus
ggccgaccgaccgacaggatagaca

SEQ ID NO: 391617 - DNA, 25 bp, Mus musculus
cgcccgatcggcgagcacaaagacg

SEQ ID NO: 391618 - DNA, 25 bp, Mus musculus
ggtgcccactcactttgccgctgtc

SEQ ID NO: 391619 - DNA, 25 bp, Mus musculus
gtccgagccgcacacatggctgcag

SEQ ID NO: 391620 - DNA, 25 bp, Mus musculus
aaagtccctcggaagacgagcgcca

SEQ ID NO: 391621 - DNA, 25 bp, Mus musculus
tccaggtggagtggacgaaagtccc

SEQ ID NO: 391622 - DNA, 25 bp, Mus musculus
aagcacctccatggggcaggtccag

SEQ ID NO: 391623 - DNA, 25 bp, Mus musculus
gtgatcgcgaagcacctccatgggg

SEQ ID NO: 391624 - DNA, 25 bp, Mus musculus
ttgccgctgtcgctcacgccgagga

SEQ ID NO: 391625 - DNA, 25 bp, Mus musculus
agctgctggctcttggggctcgttc

SEQ ID NO: 391626 - DNA, 25 bp, Mus musculus
tgaacgcgcagtgcctcgccagggt

SEQ ID NO: 391627 - DNA, 25 bp, Mus musculus
ttcactggccaaggagggcgcaccg

SEQ ID NO: 391628 - DNA, 25 bp, Mus musculus
aggagcgaaccctgaacgcgcagtg

SEQ ID NO: 391629 - DNA, 25 bp, Mus musculus
cgtgctcgctctacaggagcgaacc

SEQ ID NO: 391630 - DNA, 25 bp, Mus musculus
cagcgcgagttcactggccaaggag

SEQ ID NO: 391631 - DNA, 25 bp, Mus musculus
ccgaggaggtgatcgcgaagcacct

SEQ ID NO: 391632 - DNA, 25 bp, Mus musculus
tcactgagcagctcgaaccgggccg

SEQ ID NO: 391633 - DNA, 25 bp, Mus musculus
ttagtcagcagaacgcgaacgcgcg

SEQ ID NO: 391634 - DNA, 25 bp, Mus musculus
tgactcattagggaggtcacgctcg

SEQ ID NO: 391635 - DNA, 25 bp, Mus musculus
attttagatggagtccgcccggagc

SEQ ID NO: 391636 - DNA, 25 bp, Mus musculus
tggatctgggccacttcgggccctc

SEQ ID NO: 391637 - DNA, 25 bp, Mus musculus
ggctccgtagcgtagcgactccgct

SEQ ID NO: 391638 - DNA, 25 bp, Mus musculus
gactccgctgcgcagtttgtgattg

SEQ ID NO: 391639 - DNA, 25 bp, Mus musculus
ctattggctcttcttttccgcaatc

SEQ ID NO: 391640 - DNA, 25 bp, Mus musculus
cattggctcgaacgcggctgtccat

SEQ ID NO: 391641 - DNA, 25 bp, Mus musculus
cggctttcttcgaatctagaactcc

SEQ ID NO: 391642 - DNA, 25 bp, Mus musculus
ccaaggtgcaagtccggctttcttc

SEQ ID NO: 391643 - DNA, 25 bp, Mus musculus
cttcctcggacccaaggtgcaagtc

SEQ ID NO: 391644 - DNA, 25 bp, Mus musculus
ctcgactaccggcttcacggaaagc

SEQ ID NO: 391645 - DNA, 25 bp, Mus musculus
gtcccgccagcctcgattttagatg

SEQ ID NO: 391646 - DNA, 25 bp, Mus musculus
gactgcttctcctccggcgtaggtt

SEQ ID NO: 391647 - DNA, 25 bp, Mus musculus
ttgccgagaagcacaacatcctgtg

SEQ ID NO: 391648 - DNA, 25 bp, Mus musculus
taaggctcctctagtcccgggtgcc

SEQ ID NO: 391649 - DNA, 25 bp, Mus musculus
tagacacctgagtagaccgacgcca

SEQ ID NO: 391650 - DNA, 25 bp, Mus musculus
tctggccatcgcgtagacacctgag

SEQ ID NO: 391651 - DNA, 25 bp, Mus musculus
cgtaggttgccgctgaattcagagc

SEQ ID NO: 391652 - DNA, 25 bp, Mus musculus
gaaggatccaagagcgccaagccgg

SEQ ID NO: 391653 - DNA, 25 bp, Mus musculus
tgccgctattgtctcggagccgcac

SEQ ID NO: 391654 - DNA, 25 bp, Mus musculus
attagagggaccctagcgagccgcg

SEQ ID NO: 391655 - DNA, 25 bp, Mus musculus
cgccggagttctcccatacatagcg

SEQ ID NO: 391656 - DNA, 25 bp, Mus musculus
acttgcgcaccttggcgtcctggag

SEQ ID NO: 391657 - DNA, 25 bp, Mus musculus
ctgagccttcgtctgcagcttgtgg

SEQ ID NO: 391658 - DNA, 25 bp, Mus musculus
gcgtccttcctgctgaaggcagctg

SEQ ID NO: 391659 - DNA, 25 bp, Mus musculus
caggtctcgtccctctgacaacagg

SEQ ID NO: 391660 - DNA, 25 bp, Mus musculus
aactgacctccaggagccaagacgc

SEQ ID NO: 391661 - DNA, 25 bp, Mus musculus
cttctcgttctttgtggcgcttgcg

SEQ ID NO: 391662 - DNA, 25 bp, Mus musculus
gaacaccttcatctgcttcgccata

SEQ ID NO: 391663 - DNA, 25 bp, Mus musculus
gcttcgccataaccagcttctcgtt

SEQ ID NO: 391664 - DNA, 25 bp, Mus musculus
ccgaaagcggaagaggcacaagaac

SEQ ID NO: 391665 - DNA, 25 bp, Mus musculus
cagcggactccgagcgagagccgaa

SEQ ID NO: 391666 - DNA, 25 bp, Mus musculus
taaccagcttctcgttctttgtggc

SEQ ID NO: 391667 - DNA, 25 bp, Mus musculus
gccaaactgacctccaggagccaag

SEQ ID NO: 391668 - DNA, 25 bp, Mus musculus
aagaaccacgcctccgccaaactga

SEQ ID NO: 391669 - DNA, 25 bp, Mus musculus
cccgcgcctcctccaaagaaccacg

SEQ ID NO: 391670 - DNA, 25 bp, Mus musculus
ctcacctggttatgttcccgggaag

SEQ ID NO: 391671 - DNA, 25 bp, Mus musculus
cgctcacctggttatgttcccggga

SEQ ID NO: 391672 - DNA, 25 bp, Mus musculus
agaggcacaagaacaccttcatctg

SEQ ID NO: 391673 - DNA, 25 bp, Mus musculus
actccgagcgagagccgaaagcgga

SEQ ID NO: 391674 - DNA, 25 bp, Mus musculus
agcgcagcctgctggcagctttacg

SEQ ID NO: 391675 - DNA, 25 bp, Mus musculus
tctgaccgcgaggacagcgcagaga

SEQ ID NO: 391676 - DNA, 25 bp, Mus musculus
gggactgccggcacagcagacaccg

SEQ ID NO: 391677 - DNA, 25 bp, Mus musculus
aggggtccaccaagcgctcgggact

SEQ ID NO: 391678 - DNA, 25 bp, Mus musculus
aggctgctctgagcactgccaaggg

SEQ ID NO: 391679 - DNA, 25 bp, Mus musculus
aggctgctaagaatgggcaagaagt

SEQ ID NO: 391680 - DNA, 25 bp, Mus musculus
agaggttgctctgaccgcgaggaca

SEQ ID NO: 391681 - DNA, 25 bp, Mus musculus
ctcccgcgccttgaaggcggtggct

SEQ ID NO: 391682 - DNA, 25 bp, Mus musculus
cctgttgagccaatcgcgagcgcaa

SEQ ID NO: 391683 - DNA, 25 bp, Mus musculus
ttaagttccaagcaggggtccacca

SEQ ID NO: 391684 - DNA, 25 bp, Mus musculus
aatcgcgagcgcaagcgcagcctgc

SEQ ID NO: 391685 - DNA, 25 bp, Mus musculus
agctttacggagctcccgactcagg

SEQ ID NO: 391686 - DNA, 25 bp, Mus musculus
tctgagcactgccaagggccaggct

SEQ ID NO: 391687 - DNA, 25 bp, Mus musculus
agcaatttggggtgcataaggaagc

SEQ ID NO: 391688 - DNA, 25 bp, Mus musculus
agagcaaacctagctgggccgggcc

SEQ ID NO: 391689 - DNA, 25 bp, Mus musculus
tggccggacccagcaggaaaaagtc

SEQ ID NO: 391690 - DNA, 25 bp, Mus musculus
actccggttactacgctgcgcgcgg

SEQ ID NO: 391691 - DNA, 25 bp, Mus musculus
tcccagggaacccgcggacacagag

SEQ ID NO: 391692 - DNA, 25 bp, Mus musculus
cacgggactccggttactacgctgc

SEQ ID NO: 391693 - DNA, 25 bp, Mus musculus
cagcaggaaaaagtccgtcagcggc

SEQ ID NO: 391694 - DNA, 25 bp, Mus musculus
agggcagagcaaacctagctgggcc

SEQ ID NO: 391695 - DNA, 25 bp, Mus musculus
catggacctccgagcaggtaggagc

SEQ ID NO: 391696 - DNA, 25 bp, Mus musculus
cgcccagcaccagtgagatccggtt

SEQ ID NO: 391697 - DNA, 25 bp, Mus musculus
agtgagatccggttcccgtcctcct

SEQ ID NO: 391698 - DNA, 25 bp, Mus musculus
acgcggcattcctggagtccgcttg

SEQ ID NO: 391699 - DNA, 25 bp, Mus musculus
cattcctggagtccgcttggcggag

SEQ ID NO: 391700 - DNA, 25 bp, Mus musculus
ggagcctggacaaccctcagacctg

SEQ ID NO: 391701 - DNA, 25 bp, Mus musculus
gacaaccctcagacctggacgggcg

SEQ ID NO: 391702 - DNA, 25 bp, Mus musculus
aaacactccctttcctctatcgtgg

SEQ ID NO: 391703 - DNA, 25 bp, Mus musculus
accaggccgttctctaatcggcatc

SEQ ID NO: 391704 - DNA, 25 bp, Mus musculus
gacgccttacacctgaactctgctg

SEQ ID NO: 391705 - DNA, 25 bp, Mus musculus
ctgaactctgctggtcccgggataa

SEQ ID NO: 391706 - DNA, 25 bp, Mus musculus
ggtcccgggataagcgcaaacactc

SEQ ID NO: 391707 - DNA, 25 bp, Mus musculus
ctatcgtggcttccagaaactcaga

SEQ ID NO: 391708 - DNA, 25 bp, Mus musculus
cggtgtgtagtgaaccaggccgttc

SEQ ID NO: 391709 - DNA, 25 bp, Mus musculus
tgcgagaatcgtatcgggcagtaga

SEQ ID NO: 391710 - DNA, 25 bp, Mus musculus
cgggcagtagatattccaaggtgta

SEQ ID NO: 391711 - DNA, 25 bp, Mus musculus
tattccaaggtgtacgcgtctcgtg

SEQ ID NO: 391712 - DNA, 25 bp, Mus musculus
tgtacgcgtctcgtgaaagaaaaga

SEQ ID NO: 391713 - DNA, 25 bp, Mus musculus
gtctcgtgaaagaaaagagcgcaca

SEQ ID NO: 391714 - DNA, 25 bp, Mus musculus
actcagaaaataccctgcgagaatc

SEQ ID NO: 391715 - DNA, 25 bp, Mus musculus
agagcgcacacgtgcggagcagacc

SEQ ID NO: 391716 - DNA, 25 bp, Mus musculus
aagctgatgtcatcgcgacacccta

SEQ ID NO: 391717 - DNA, 25 bp, Mus musculus
ctgcagcaaagagagcttgatgttc

SEQ ID NO: 391718 - DNA, 25 bp, Mus musculus
tccttgcacgagtttggggcggatt

SEQ ID NO: 391719 - DNA, 25 bp, Mus musculus
aatgtcaaggttagctcacgtgggc

SEQ ID NO: 391720 - DNA, 25 bp, Mus musculus
cacacccatggtacctcagggatta

SEQ ID NO: 391721 - DNA, 25 bp, Mus musculus
cgcagggcaggttttcctgatcttc

SEQ ID NO: 391722 - DNA, 25 bp, Mus musculus
gccttagcctcgaggcagaaccata

SEQ ID NO: 391723 - DNA, 25 bp, Mus musculus
gcacgattcctgcaaagtcatctcc

SEQ ID NO: 391724 - DNA, 25 bp, Mus musculus
gctgcagtcgtggaaagcacgattc

SEQ ID NO: 391725 - DNA, 25 bp, Mus musculus
tcgtaggaaagatgtggctgcagtc

SEQ ID NO: 391726 - DNA, 25 bp, Mus musculus
ggacaccgggtcgaaatactgcttg

SEQ ID NO: 391727 - DNA, 25 bp, Mus musculus
ggctggggatgcataggcttataaa

SEQ ID NO: 391728 - DNA, 25 bp, Mus musculus
cccaatctagggcagtttgttcaac

SEQ ID NO: 391729 - DNA, 25 bp, Mus musculus
tggaaagtggcctgccttctcagca

SEQ ID NO: 391730 - DNA, 25 bp, Mus musculus
cccattacagagtgcatacaggtta

SEQ ID NO: 391731 - DNA, 25 bp, Mus musculus
cctacatggacttcgtggctgccca

SEQ ID NO: 391732 - DNA, 25 bp, Mus musculus
gcccagtgtctggtttccatctcca

SEQ ID NO: 391733 - DNA, 25 bp, Mus musculus
ctcgcagttggctttctctgggact

SEQ ID NO: 391734 - DNA, 25 bp, Mus musculus
tctgggactccgacacgtttgcagt

SEQ ID NO: 391735 - DNA, 25 bp, Mus musculus
gaggcgctgccggttacgtaaagat

SEQ ID NO: 391736 - DNA, 25 bp, Mus musculus
cctacagtggctgtgggaaagtcta

SEQ ID NO: 391737 - DNA, 25 bp, Mus musculus
cacctggaaggattattgcacgctg

SEQ ID NO: 391738 - DNA, 25 bp, Mus musculus
tgcacgctggtcactatcgccaaga

SEQ ID NO: 391739 - DNA, 25 bp, Mus musculus
cgccaagagcttgttggacctcaac

SEQ ID NO: 391740 - DNA, 25 bp, Mus musculus
tataggatccgacagcgacgtgacc

SEQ ID NO: 391741 - DNA, 25 bp, Mus musculus
caccgaatctgggtcgagtccttcc

SEQ ID NO: 391742 - DNA, 25 bp, Mus musculus
agacaggattctggcagcgcgccca

SEQ ID NO: 391743 - DNA, 25 bp, Mus musculus
agctccgcagccaccttcaagtttg

SEQ ID NO: 391744 - DNA, 25 bp, Mus musculus
cacaagaagttctccatggcgatgc

SEQ ID NO: 391745 - DNA, 25 bp, Mus musculus
tctccatggcgatgcggacgattga

SEQ ID NO: 391746 - DNA, 25 bp, Mus musculus
atggcgatgcggacgattgagccct

SEQ ID NO: 391747 - DNA, 25 bp, Mus musculus
acgattgagccctcgacgaaggtcc

SEQ ID NO: 391748 - DNA, 25 bp, Mus musculus
tgagccctcgacgaaggtcccggac

SEQ ID NO: 391749 - DNA, 25 bp, Mus musculus
cagcgtcggcaacgggttcgagttc

SEQ ID NO: 391750 - DNA, 25 bp, Mus musculus
cgggttcgagttctttctcttgctc

SEQ ID NO: 391751 - DNA, 25 bp, Mus musculus
ctttctcttgctcgggacctcggag

SEQ ID NO: 391752 - DNA, 25 bp, Mus musculus
ggacctcggaggaagcatctctcgg

SEQ ID NO: 391753 - DNA, 25 bp, Mus musculus
ctcggaggaagcatctctcgggaga

SEQ ID NO: 391754 - DNA, 25 bp, Mus musculus
tctcgggagagaccgcttggaaacc

SEQ ID NO: 391755 - DNA, 25 bp, Mus musculus
tcggagtcgccatcctggcttcctc

SEQ ID NO: 391756 - DNA, 25 bp, Mus musculus
cgccactcacaagaagttctccatg

SEQ ID NO: 391757 - DNA, 25 bp, Mus musculus
gggagcagccttcccgctcggagtc

SEQ ID NO: 391758 - DNA, 25 bp, Mus musculus
tgctcgagctggagatgaactccga

SEQ ID NO: 391759 - DNA, 25 bp, Mus musculus
gaactccgatctcaaggcgcagctg

SEQ ID NO: 391760 - DNA, 25 bp, Mus musculus
atgaactccgatctcaaggcgcagc

SEQ ID NO: 391761 - DNA, 25 bp, Mus musculus
agatgaactccgatctcaaggcgca

SEQ ID NO: 391762 - DNA, 25 bp, Mus musculus
tggagatgaactccgatctcaaggc

SEQ ID NO: 391763 - DNA, 25 bp, Mus musculus
agctggagatgaactccgatctcaa

SEQ ID NO: 391764 - DNA, 25 bp, Mus musculus
ctcgagctggagatgaactccgatc

SEQ ID NO: 391765 - DNA, 25 bp, Mus musculus
gctgctcgagctggagatgaactcc

SEQ ID NO: 391766 - DNA, 25 bp, Mus musculus
gcgctgctcgagctggagatgaact

SEQ ID NO: 391767 - DNA, 25 bp, Mus musculus
gagttcgagtctggcatctctcagg

SEQ ID NO: 391768 - DNA, 25 bp, Mus musculus
acgagttcgagtctggcatctctca

SEQ ID NO: 391769 - DNA, 25 bp, Mus musculus
gacgagttcgagtctggcatctctc

SEQ ID NO: 391770 - DNA, 25 bp, Mus musculus
actccgatctcaaggcgcagctgcg

SEQ ID NO: 391771 - DNA, 25 bp, Mus musculus
cgagctggagatgaactccgatctc

SEQ ID NO: 391772 - DNA, 25 bp, Mus musculus
agttttctgccctgcgcgacgcgtc

SEQ ID NO: 391773 - DNA, 25 bp, Mus musculus
aggtccctgggtaaaggccactctg

SEQ ID NO: 391774 - DNA, 25 bp, Mus musculus
aggcgactctcggttgcatccagtg

SEQ ID NO: 391775 - DNA, 25 bp, Mus musculus
aaaggccactctgggacacggctgc

SEQ ID NO: 391776 - DNA, 25 bp, Mus musculus
gtcccgggagttgtggcaactcttc

SEQ ID NO: 391777 - DNA, 25 bp, Mus musculus
cacgtcggagcgtggagttttctgc

SEQ ID NO: 391778 - DNA, 25 bp, Mus musculus
agcgacctccgagagccacgtcgga

SEQ ID NO: 391779 - DNA, 25 bp, Mus musculus
agccggctggccgttaccaagacgc

SEQ ID NO: 391780 - DNA, 25 bp, Mus musculus
cttccgaaggaacccgcacatgtga

SEQ ID NO: 391781 - DNA, 25 bp, Mus musculus
ggacatcaccaacgccttccgaagg

SEQ ID NO: 391782 - DNA, 25 bp, Mus musculus
ccaacatggccgagtcgaacgagga

SEQ ID NO: 391783 - DNA, 25 bp, Mus musculus
ccaaaagccaccgagctcgaagagc

SEQ ID NO: 391784 - DNA, 25 bp, Mus musculus
ttcctccacgcctagtgaaccaaaa

SEQ ID NO: 391785 - DNA, 25 bp, Mus musculus
gtctctgtgtcttggaggcgactct

SEQ ID NO: 391786 - DNA, 25 bp, Mus musculus
cgggcatcgagaaaccaagtggacc

SEQ ID NO: 391787 - DNA, 25 bp, Mus musculus
ccacgcggcagtgtgtcctaagcgt

SEQ ID NO: 391788 - DNA, 25 bp, Mus musculus
agaggacacgggcagccgtccacgc

SEQ ID NO: 391789 - DNA, 25 bp, Mus musculus
actaagcaagaggacacgggcagcc

SEQ ID NO: 391790 - DNA, 25 bp, Mus musculus
ctgcgtgtcactaagcaagaggaca

SEQ ID NO: 391791 - DNA, 25 bp, Mus musculus
gaagcgggaaaactgcgtgtcacta

SEQ ID NO: 391792 - DNA, 25 bp, Mus musculus
caagctttttcttggctttcaggcc

SEQ ID NO: 391793 - DNA, 25 bp, Mus musculus
actcgaggagcgcagcgccgcattg

SEQ ID NO: 391794 - DNA, 25 bp, Mus musculus
agacgcccagcttgttcctctcaag

SEQ ID NO: 391795 - DNA, 25 bp, Mus musculus
cggccagacagacgcccagcttgtt

SEQ ID NO: 391796 - DNA, 25 bp, Mus musculus
ccgccttccagacgctttctgggtg

SEQ ID NO: 391797 - DNA, 25 bp, Mus musculus
tcctaagcgtgaccagagcccattc

SEQ ID NO: 391798 - DNA, 25 bp, Mus musculus
tcgagaaaccaagtggaccatttcc

SEQ ID NO: 391799 - DNA, 25 bp, Mus musculus
aagcgtgaccagagcccattcgcag

SEQ ID NO: 391800 - DNA, 25 bp, Mus musculus
ggtgcgcgctgagatacccggcttt

SEQ ID NO: 391801 - DNA, 25 bp, Mus musculus
tccggtgcgcgctgagatacccggc

SEQ ID NO: 391802 - DNA, 25 bp, Mus musculus
gagctaggggtgaagcgtggaacaa

SEQ ID NO: 391803 - DNA, 25 bp, Mus musculus
tgaagcgtggaacaatagtgcggat

SEQ ID NO: 391804 - DNA, 25 bp, Mus musculus
aatagtgcggatgaacagggacggc

SEQ ID NO: 391805 - DNA, 25 bp, Mus musculus
gaacagggacggcaggcgacatcca

SEQ ID NO: 391806 - DNA, 25 bp, Mus musculus
aacagggacggcaggcgacatccag

SEQ ID NO: 391807 - DNA, 25 bp, Mus musculus
acggcaggcgacatccagggaggca

SEQ ID NO: 391808 - DNA, 25 bp, Mus musculus
gacatccagggaggcagtgcttgga

SEQ ID NO: 391809 - DNA, 25 bp, Mus musculus
aggcagtgcttggagctagcgaggc

SEQ ID NO: 391810 - DNA, 25 bp, Mus musculus
aagggtgtgtactagagagatgcca

SEQ ID NO: 391811 - DNA, 25 bp, Mus musculus
agatgccaggcgtccggtgcgcgct

SEQ ID NO: 391812 - DNA, 25 bp, Mus musculus
cgcgctgagatacccggctttggga

SEQ ID NO: 391813 - DNA, 25 bp, Mus musculus
gtgtgtactagagagatgccaggcg

SEQ ID NO: 391814 - DNA, 25 bp, Mus musculus
accacacggacacggccgagggcga

SEQ ID NO: 391815 - DNA, 25 bp, Mus musculus
gcatgagttcgcagagcctcgacaa

SEQ ID NO: 391816 - DNA, 25 bp, Mus musculus
ccaccatgaaccacttggagggctc

SEQ ID NO: 391817 - DNA, 25 bp, Mus musculus
ccgaggtcaagcagagcatgagttc

SEQ ID NO: 391818 - DNA, 25 bp, Mus musculus
catcgaccagatcgtggccgaggtc

SEQ ID NO: 391819 - DNA, 25 bp, Mus musculus
tatgagcaggaagaggacatcgacc

SEQ ID NO: 391820 - DNA, 25 bp, Mus musculus
cctacccgcgcatggacagttatga

SEQ ID NO: 391821 - DNA, 25 bp, Mus musculus
gagagcggcttccacaaccacacgg

SEQ ID NO: 391822 - DNA, 25 bp, Mus musculus
aggacgagccgtacgccgagcccta

SEQ ID NO: 391823 - DNA, 25 bp, Mus musculus
tgaacgccgcctactcgggctacgt

SEQ ID NO: 391824 - DNA, 25 bp, Mus musculus
tggagcacgaggaagccatgaacgc

SEQ ID NO: 391825 - DNA, 25 bp, Mus musculus
tgcacttccactcgctggagcacga

SEQ ID NO: 391826 - DNA, 25 bp, Mus musculus
acgccgacgatgagagcgcctacgc

SEQ ID NO: 391827 - DNA, 25 bp, Mus musculus
acaaggcggccgaagacatgcccga

SEQ ID NO: 391828 - DNA, 25 bp, Mus musculus
ccgtggtggacccaggtcccttgag

SEQ ID NO: 391829 - DNA, 25 bp, Mus musculus
tcacccacggtgacaagtgcgccgt

SEQ ID NO: 391830 - DNA, 25 bp, Mus musculus
aggacactcactggacgttaccgcc

SEQ ID NO: 391831 - DNA, 25 bp, Mus musculus
gcccggaaagaggacactcactgga

SEQ ID NO: 391832 - DNA, 25 bp, Mus musculus
tcctagcccggaaagaggacactca

SEQ ID NO: 391833 - DNA, 25 bp, Mus musculus
gagctggcaacctttaaataggaaa

SEQ ID NO: 391834 - DNA, 25 bp, Mus musculus
gtcccttgagctggcaacctttaaa

SEQ ID NO: 391835 - DNA, 25 bp, Mus musculus
gtctgtctgcaaccgcggcgccaag

SEQ ID NO: 391836 - DNA, 25 bp, Mus musculus
tcagagtctgtctgcaaccgcggcg

SEQ ID NO: 391837 - DNA, 25 bp, Mus musculus
ggctcaaccgttgtcagagtctgtc

SEQ ID NO: 391838 - DNA, 25 bp, Mus musculus
tgcagctagcggctcaaccgttgtc

SEQ ID NO: 391839 - DNA, 25 bp, Mus musculus
cgggaaccatgcagctagcggctca

SEQ ID NO: 391840 - DNA, 25 bp, Mus musculus
aagtgcgccgttgccttggggtcac

SEQ ID NO: 391841 - DNA, 25 bp, Mus musculus
acggtgacaagtgcgccgttgcctt

SEQ ID NO: 391842 - DNA, 25 bp, Mus musculus
ccaggaagaagagattggagccacc

SEQ ID NO: 391843 - DNA, 25 bp, Mus musculus
tcactgtgaccagcgccataaggta

SEQ ID NO: 391844 - DNA, 25 bp, Mus musculus
cggcgagcgactcactgtgaccagc

SEQ ID NO: 391845 - DNA, 25 bp, Mus musculus
tcccacaggcgtggagtggccactt

SEQ ID NO: 391846 - DNA, 25 bp, Mus musculus
ccataaggtaggcaggcccggaaca

SEQ ID NO: 391847 - DNA, 25 bp, Mus musculus
cctgccttcgcacaaccaggaagaa

SEQ ID NO: 391848 - DNA, 25 bp, Mus musculus
gattggagccaccagggcctggcac

SEQ ID NO: 391849 - DNA, 25 bp, Mus musculus
ttaaagggcccgactcatgaccagt

SEQ ID NO: 391850 - DNA, 25 bp, Mus musculus
ggcccgactcatgaccagtctggtc

SEQ ID NO: 391851 - DNA, 25 bp, Mus musculus
tgaccagtctggtcgcgtagagctg

SEQ ID NO: 391852 - DNA, 25 bp, Mus musculus
tcgcgtagagctggtaccgagcgac

SEQ ID NO: 391853 - DNA, 25 bp, Mus musculus
agctggtaccgagcgacagcggccc

SEQ ID NO: 391854 - DNA, 25 bp, Mus musculus
ccgaccgcgctagaggcgtggtcaa

SEQ ID NO: 391855 - DNA, 25 bp, Mus musculus
caggcccggaacacctgggcgaaca

SEQ ID NO: 391856 - DNA, 25 bp, Mus musculus
acttggagtgaattgtgtcccttga

SEQ ID NO: 391857 - DNA, 25 bp, Mus musculus
ggcgtactgacttgctgctgcttcc

SEQ ID NO: 391858 - DNA, 25 bp, Mus musculus
gcgtcctcgcttctgtggcaccggg

SEQ ID NO: 391859 - DNA, 25 bp, Mus musculus
tgcgccggggactactgctgctgct

SEQ ID NO: 391860 - DNA, 25 bp, Mus musculus
atcaacaccggacgtccagcggctg

SEQ ID NO: 391861 - DNA, 25 bp, Mus musculus
ccagcggctgccaaaaagagagagg

SEQ ID NO: 391862 - DNA, 25 bp, Mus musculus
tctctccgcaaaggctcgggagttg

SEQ ID NO: 391863 - DNA, 25 bp, Mus musculus
tgtgtcccttgaaatgttaggcggg

SEQ ID NO: 391864 - DNA, 25 bp, Mus musculus
acagaacgggacagagatagagact

SEQ ID NO: 391865 - DNA, 25 bp, Mus musculus
agactgactagtgcggtcagaaacc

SEQ ID NO: 391866 - DNA, 25 bp, Mus musculus
aaccgaggagagagtggaagtttct

SEQ ID NO: 391867 - DNA, 25 bp, Mus musculus
gctagcttgcgctgccgtagccgct

SEQ ID NO: 391868 - DNA, 25 bp, Mus musculus
cgcgcactctccaggggaactcggt

SEQ ID NO: 391869 - DNA, 25 bp, Mus musculus
agggttgctctctccgcaaaggctc

SEQ ID NO: 391870 - DNA, 25 bp, Mus musculus
gccgcctccgtagtcgggttcataa

SEQ ID NO: 391871 - DNA, 25 bp, Mus musculus
tggacacaaagtcgcggtccagccc

SEQ ID NO: 391872 - DNA, 25 bp, Mus musculus
ctctggatgggctctacggtcatat

SEQ ID NO: 391873 - DNA, 25 bp, Mus musculus
atatgatgggctgtagccgcctccg

SEQ ID NO: 391874 - DNA, 25 bp, Mus musculus
gctccgttcatagcgggtctctgga

SEQ ID NO: 391875 - DNA, 25 bp, Mus musculus
agtcgggttcataagcttcgtgata

SEQ ID NO: 391876 - DNA, 25 bp, Mus musculus
cttcgtgataggagcgctcatagtc

SEQ ID NO: 391877 - DNA, 25 bp, Mus musculus
agcgctcatagtctcggtcgtagtc

SEQ ID NO: 391878 - DNA, 25 bp, Mus musculus
aacgtaggtgttctcggctgcggct

SEQ ID NO: 391879 - DNA, 25 bp, Mus musculus
tagtctcggtcgtagtccctgtcga

SEQ ID NO: 391880 - DNA, 25 bp, Mus musculus
tagtccctgtcgatgctacggccac

SEQ ID NO: 391881 - DNA, 25 bp, Mus musculus
cacggctgtggtccctggacacaaa

SEQ ID NO: 391882 - DNA, 25 bp, Mus musculus
ggctgcgcccatagtcttcctggtc

SEQ ID NO: 391883 - DNA, 25 bp, Mus musculus
ctctacggtcatatgatgggctgta

SEQ ID NO: 391884 - DNA, 25 bp, Mus musculus
aggctcccgagctctcgcgtcccgc

SEQ ID NO: 391885 - DNA, 25 bp, Mus musculus
ggggaacactctttaaagagcatcg

SEQ ID NO: 391886 - DNA, 25 bp, Mus musculus
aagccagcaggtccagccgagcgcg

SEQ ID NO: 391887 - DNA, 25 bp, Mus musculus
cttagaagccagcaggtccagccga

SEQ ID NO: 391888 - DNA, 25 bp, Mus musculus
ccgcgcgcttagaagccagcaggtc

SEQ ID NO: 391889 - DNA, 25 bp, Mus musculus
ctcgctggccggatggttcgctccg

SEQ ID NO: 391890 - DNA, 25 bp, Mus musculus
cagtggaggacccggttcgccacca

SEQ ID NO: 391891 - DNA, 25 bp, Mus musculus
ggaggaaacttacgcgctgccagcc

SEQ ID NO: 391892 - DNA, 25 bp, Mus musculus
cgcaccagctcccacgcaaccgctc

SEQ ID NO: 391893 - DNA, 25 bp, Mus musculus
gggagcctcacggaacgcaccagct

SEQ ID NO: 391894 - DNA, 25 bp, Mus musculus
atagtggggagcctcacggaacgca

SEQ ID NO: 391895 - DNA, 25 bp, Mus musculus
actctttaaagagcatcgcggggct

SEQ ID NO: 391896 - DNA, 25 bp, Mus musculus
cgggcagcgtcatgcactctgactc

SEQ ID NO: 391897 - DNA, 25 bp, Mus musculus
tcgccgcggctcagaactacaagct

SEQ ID NO: 391898 - DNA, 25 bp, Mus musculus
tggaagtacgcacgcaaaaagcagt

SEQ ID NO: 391899 - DNA, 25 bp, Mus musculus
cgacgggactgttttcctgtcggcg

SEQ ID NO: 391900 - DNA, 25 bp, Mus musculus
tcgctgccaacagaaacccaaaggc

SEQ ID NO: 391901 - DNA, 25 bp, Mus musculus
acccaaaggccctctgaatctagca

SEQ ID NO: 391902 - DNA, 25 bp, Mus musculus
tgaatctagcagaagagacgctctg

SEQ ID NO: 391903 - DNA, 25 bp, Mus musculus
cgctctgcgggagcgaaacaatgtc

SEQ ID NO: 391904 - DNA, 25 bp, Mus musculus
caggcacctgtagcagcggcgtaaa

SEQ ID NO: 391905 - DNA, 25 bp, Mus musculus
tcagatcccgggtgaccctaagtca

SEQ ID NO: 391906 - DNA, 25 bp, Mus musculus
gcagtgctcaagaaatcacatccca

SEQ ID NO: 391907 - DNA, 25 bp, Mus musculus
ggacaaccggcgttcacgcacgctg

SEQ ID NO: 391908 - DNA, 25 bp, Mus musculus
gccaaggctccagagcaatcttgta

SEQ ID NO: 391909 - DNA, 25 bp, Mus musculus
agccagcagagtcagcgcgcagaaa

SEQ ID NO: 391910 - DNA, 25 bp, Mus musculus
cgcgcagaaagcgacggtcccaggc

SEQ ID NO: 391911 - DNA, 25 bp, Mus musculus
tagcagcggcgtaaactcagatccc

SEQ ID NO: 391912 - DNA, 25 bp, Mus musculus
gcaagcccacggctgcgcgacctcc

SEQ ID NO: 391913 - DNA, 25 bp, Mus musculus
gcccacatgctactccagctccgcg

SEQ ID NO: 391914 - DNA, 25 bp, Mus musculus
gatcggttccctccagcgcgggttc

SEQ ID NO: 391915 - DNA, 25 bp, Mus musculus
aggttacgatcggttccctccagcg

SEQ ID NO: 391916 - DNA, 25 bp, Mus musculus
cgcaggttacgatcggttccctcca

SEQ ID NO: 391917 - DNA, 25 bp, Mus musculus
cctcggcggccgcaggttacgatcg

SEQ ID NO: 391918 - DNA, 25 bp, Mus musculus
ctgtgacatgtaggcctcggcggcc

SEQ ID NO: 391919 - DNA, 25 bp, Mus musculus
ttgactgtgacatgtaggcctcggc

SEQ ID NO: 391920 - DNA, 25 bp, Mus musculus
ccggcgttgactgtgacatgtaggc

SEQ ID NO: 391921 - DNA, 25 bp, Mus musculus
ccggcgaagcgcgtactcacggcgt

SEQ ID NO: 391922 - DNA, 25 bp, Mus musculus
tgcggcccggcgaagcgcgtactca

SEQ ID NO: 391923 - DNA, 25 bp, Mus musculus
aaacgcgcgcgcaaccagagcgact

SEQ ID NO: 391924 - DNA, 25 bp, Mus musculus
gaagcccgcgcaaacaccgcgcgcg

SEQ ID NO: 391925 - DNA, 25 bp, Mus musculus
gcgacctccgaacgcccacatgcta

SEQ ID NO: 391926 - DNA, 25 bp, Mus musculus
tctctcggttgatcaggtccatgcc

SEQ ID NO: 391927 - DNA, 25 bp, Mus musculus
ctcgggaacgtcgtgctgttccgtc

SEQ ID NO: 391928 - DNA, 25 bp, Mus musculus
atcttctcctgagccatggcgcggc

SEQ ID NO: 391929 - DNA, 25 bp, Mus musculus
ccttcgagaatctgtcagcgggttc

SEQ ID NO: 391930 - DNA, 25 bp, Mus musculus
ggcggatttctccacgtcgttgtca

SEQ ID NO: 391931 - DNA, 25 bp, Mus musculus
cgccagcttagtgcgtcatggctgc

SEQ ID NO: 391932 - DNA, 25 bp, Mus musculus
gactccagtgttcgtttcttccgca

SEQ ID NO: 391933 - DNA, 25 bp, Mus musculus
ggctgaaactttcctcccaggagtg

SEQ ID NO: 391934 - DNA, 25 bp, Mus musculus
atctgcattgcggtctgcacctcgc

SEQ ID NO: 391935 - DNA, 25 bp, Mus musculus
caccggaatgaaatcgatgcgcttc

SEQ ID NO: 391936 - DNA, 25 bp, Mus musculus
ctcgtgaacggtctctcggttgatc

SEQ ID NO: 391937 - DNA, 25 bp, Mus musculus
ccctcctcctgtttgatctggtgca

SEQ ID NO: 391938 - DNA, 25 bp, Mus musculus
cccaggagtggcttatctgcattgc

SEQ ID NO: 391939 - DNA, 25 bp, Mus musculus
tttcttccgcaaatagtcactgggc

SEQ ID NO: 391940 - DNA, 25 bp, Mus musculus
ccctgcaaggaagccagaccggttt

SEQ ID NO: 391941 - DNA, 25 bp, Mus musculus
gaccactaggaccagacagcgccgg

SEQ ID NO: 391942 - DNA, 25 bp, Mus musculus
gcagaacggcaagcggaccactagg

SEQ ID NO: 391943 - DNA, 25 bp, Mus musculus
ccagttgcgccaccgcgggcaagtt

SEQ ID NO: 391944 - DNA, 25 bp, Mus musculus
cagagcagcccgcagtcggacctaa

SEQ ID NO: 391945 - DNA, 25 bp, Mus musculus
ttggcggccgagaccagttgcgcca

SEQ ID NO: 391946 - DNA, 25 bp, Mus musculus
acgcgcaggaaacttacctccttcg

SEQ ID NO: 391947 - DNA, 25 bp, Mus musculus
cgctcctctggtcggcagaacggca

SEQ ID NO: 391948 - DNA, 25 bp, Mus musculus
tcggacctaacgctctagtcggtgc

SEQ ID NO: 391949 - DNA, 25 bp, Mus musculus
cagagacacacagagcctcaggcgc

SEQ ID NO: 391950 - DNA, 25 bp, Mus musculus
aggtcaggtcccagcagagacacac

SEQ ID NO: 391951 - DNA, 25 bp, Mus musculus
cagcacaacttggacaggcaaagtg

SEQ ID NO: 391952 - DNA, 25 bp, Mus musculus
agcgaaggtcctggtttgacgacca

SEQ ID NO: 391953 - DNA, 25 bp, Mus musculus
accggtttgcagcagcagagcagcc

SEQ ID NO: 391954 - DNA, 25 bp, Mus musculus
aggtagttgcgctggccctcgaaga

SEQ ID NO: 391955 - DNA, 25 bp, Mus musculus
tcccgtcgctactctcggattgtcc

SEQ ID NO: 391956 - DNA, 25 bp, Mus musculus
caccgtcagcactgggatggggctc

SEQ ID NO: 391957 - DNA, 25 bp, Mus musculus
tcatagggcgccgtgggcaccgtca

SEQ ID NO: 391958 - DNA, 25 bp, Mus musculus
tcggccgctggtcctcatagggcgc

SEQ ID NO: 391959 - DNA, 25 bp, Mus musculus
tcgcgcaggtcgatggacgacagca

SEQ ID NO: 391960 - DNA, 25 bp, Mus musculus
accatggtgcaaccctgacggtcgc

SEQ ID NO: 391961 - DNA, 25 bp, Mus musculus
cctcgaagagccctgtgggccgtcg

SEQ ID NO: 391962 - DNA, 25 bp, Mus musculus
gtcgatggacgacagcacactctgg

SEQ ID NO: 391963 - DNA, 25 bp, Mus musculus
agccgtcctgctgaagtacctgccg

SEQ ID NO: 391964 - DNA, 25 bp, Mus musculus
acgatctcagtagccgtcctgctga

SEQ ID NO: 391965 - DNA, 25 bp, Mus musculus
aaccggggcgtgagagtcactcacc

SEQ ID NO: 391966 - DNA, 25 bp, Mus musculus
cactctggatgaagttgggcaggta

SEQ ID NO: 391967 - DNA, 25 bp, Mus musculus
tgctgaagtacctgccgtcgctgcc

SEQ ID NO: 391968 - DNA, 25 bp, Mus musculus
gatctcagaggccacactttaaaaa

SEQ ID NO: 391969 - DNA, 25 bp, Mus musculus
ccgcgcgacgtggaatccagaaccg

SEQ ID NO: 391970 - DNA, 25 bp, Mus musculus
accgtccagctttcgggatctcaga

SEQ ID NO: 391971 - DNA, 25 bp, Mus musculus
tgtcgccacgagaccgtccagcttt

SEQ ID NO: 391972 - DNA, 25 bp, Mus musculus
tggaatccagaaccgccggctgtgg

SEQ ID NO: 391973 - DNA, 25 bp, Mus musculus
aggagccgcgaccacagcacggttc

SEQ ID NO: 391974 - DNA, 25 bp, Mus musculus
gcgatgaggatagccagactgtgca

SEQ ID NO: 391975 - DNA, 25 bp, Mus musculus
gttcaggatccgtccagtcagtctg

SEQ ID NO: 391976 - DNA, 25 bp, Mus musculus
tggcccgcacaatccgttcaggatc

SEQ ID NO: 391977 - DNA, 25 bp, Mus musculus
tctgaccgtggggatggcccgcaca

SEQ ID NO: 391978 - DNA, 25 bp, Mus musculus
gtccagtcagtctgtcgccacgaga

SEQ ID NO: 391979 - DNA, 25 bp, Mus musculus
ctcgagtgctcctgggatgtggcac

SEQ ID NO: 391980 - DNA, 25 bp, Mus musculus
atagccagactgtgcacgcggcgcg

SEQ ID NO: 391981 - DNA, 25 bp, Mus musculus
agttcctgcgggttctcaggagccg

SEQ ID NO: 391982 - DNA, 25 bp, Mus musculus
ccggaccgagttccagagctctggt

SEQ ID NO: 391983 - DNA, 25 bp, Mus musculus
agctctggtctctctcccaaggctg

SEQ ID NO: 391984 - DNA, 25 bp, Mus musculus
gcacagtgatgctgttcttgctgca

SEQ ID NO: 391985 - DNA, 25 bp, Mus musculus
cggggtccaggctccaatagttgcc

SEQ ID NO: 391986 - DNA, 25 bp, Mus musculus
ttccgcttttctagggttgtcgcca

SEQ ID NO: 391987 - DNA, 25 bp, Mus musculus
atggtgaacgaagcgcacccgcgtc

SEQ ID NO: 391988 - DNA, 25 bp, Mus musculus
ccctgcatgatgctctcgatggtga

SEQ ID NO: 391989 - DNA, 25 bp, Mus musculus
caaaggacggactctgcgcagaccc

SEQ ID NO: 391990 - DNA, 25 bp, Mus musculus
cgggaacctgcggacatgtgaaaca

SEQ ID NO: 391991 - DNA, 25 bp, Mus musculus
tgcggctgctgaggcaatattgtcc

SEQ ID NO: 391992 - DNA, 25 bp, Mus musculus
ctgatgaaggcgcagataccgctga

SEQ ID NO: 391993 - DNA, 25 bp, Mus musculus
cctttaccgggagcgcagctaatgg

SEQ ID NO: 391994 - DNA, 25 bp, Mus musculus
gtgctggcctaaccgcacgccttta

SEQ ID NO: 391995 - DNA, 25 bp, Mus musculus
atgttgcagcaggtggcagtagctc

SEQ ID NO: 391996 - DNA, 25 bp, Mus musculus
tccagctacgccactattcaaacta

SEQ ID NO: 391997 - DNA, 25 bp, Mus musculus
cacgccccttatagagagggacaca

SEQ ID NO: 391998 - DNA, 25 bp, Mus musculus
ccagtcgcgtttccgcgacaggatt

SEQ ID NO: 391999 - DNA, 25 bp, Mus musculus
cgacaggattcagtcggcgcggggc

SEQ ID NO: 392000 - DNA, 25 bp, Mus musculus
gggctgatgatgtcaccacaacgcg

SEQ ID NO: 392001 - DNA, 25 bp, Mus musculus
tgatgtcaccacaacgcgtcgcgga

SEQ ID NO: 392002 - DNA, 25 bp, Mus musculus
tcaccacaacgcgtcgcggagcagg

SEQ ID NO: 392003 - DNA, 25 bp, Mus musculus
cgcggagcaggcctctgaggaacca

SEQ ID NO: 392004 - DNA, 25 bp, Mus musculus
agcaggcctctgaggaaccagcccg

SEQ ID NO: 392005 - DNA, 25 bp, Mus musculus
attcaaactagacacgccttcccgg

SEQ ID NO: 392006 - DNA, 25 bp, Mus musculus
aggcacgcccctacgcagagataga

SEQ ID NO: 392007 - DNA, 25 bp, Mus musculus
gcagagatagatacacccccacgca

SEQ ID NO: 392008 - DNA, 25 bp, Mus musculus
cccccgggtgtgaagcacgctctag

SEQ ID NO: 392009 - DNA, 25 bp, Mus musculus
aagcacgctctaggggcgtgccctc

SEQ ID NO: 392010 - DNA, 25 bp, Mus musculus
ggtacccacgcagccacttgcagga

SEQ ID NO: 392011 - DNA, 25 bp, Mus musculus
tgacgaaccctagggaacgcacaga

SEQ ID NO: 392012 - DNA, 25 bp, Mus musculus
tcagaggctattgtacggctagacc

SEQ ID NO: 392013 - DNA, 25 bp, Mus musculus
cgtggtacggccttgtcagaggcta

SEQ ID NO: 392014 - DNA, 25 bp, Mus musculus
ctgcggagcatctgagctcagcctc

SEQ ID NO: 392015 - DNA, 25 bp, Mus musculus
ctgctgtgcagatcggtgtagccgt

SEQ ID NO: 392016 - DNA, 25 bp, Mus musculus
tctaggtagcctcggtgagagtgaa

SEQ ID NO: 392017 - DNA, 25 bp, Mus musculus
ccaggagatttagcgcatgacgaac

SEQ ID NO: 392018 - DNA, 25 bp, Mus musculus
tccctaaatgtgagccaggagattt

SEQ ID NO: 392019 - DNA, 25 bp, Mus musculus
cgcgcgcggggatatgatccctaaa

SEQ ID NO: 392020 - DNA, 25 bp, Mus musculus
aggggcccagcctggttcccacgat

SEQ ID NO: 392021 - DNA, 25 bp, Mus musculus
gcgcctttgaagtctcggcagcaga

SEQ ID NO: 392022 - DNA, 25 bp, Mus musculus
accgagcgtgtctggatgagccaac

SEQ ID NO: 392023 - DNA, 25 bp, Mus musculus
aggatggagagtgtcctactggtta

SEQ ID NO: 392024 - DNA, 25 bp, Mus musculus
ggaacagccggaacttcattttgaa

SEQ ID NO: 392025 - DNA, 25 bp, Mus musculus
gtgctgtccagtctccagggcaacc

SEQ ID NO: 392026 - DNA, 25 bp, Mus musculus
agtagattccgtactttggcaccgg

SEQ ID NO: 392027 - DNA, 25 bp, Mus musculus
cttcagggcctcaccttgcggctgt

SEQ ID NO: 392028 - DNA, 25 bp, Mus musculus
tcaccttgcggctgtgcagtgcggc

SEQ ID NO: 392029 - DNA, 25 bp, Mus musculus
cagtgcggcctccagttcgcggtgc

SEQ ID NO: 392030 - DNA, 25 bp, Mus musculus
ttcgcggtgccggttcgcccagact

SEQ ID NO: 392031 - DNA, 25 bp, Mus musculus
ttcgcccagactagccggtgcagcg

SEQ ID NO: 392032 - DNA, 25 bp, Mus musculus
gccatgctgggcttcagcaccgcat

SEQ ID NO: 392033 - DNA, 25 bp, Mus musculus
ggggcatagctgcagctccacccgt

SEQ ID NO: 392034 - DNA, 25 bp, Mus musculus
cgtagctacggcaaccactgcaggc

SEQ ID NO: 392035 - DNA, 25 bp, Mus musculus
tgagctgcggagtagattccgtact

SEQ ID NO: 392036 - DNA, 25 bp, Mus musculus
cttcattttgaagcgccatggtcgg

SEQ ID NO: 392037 - DNA, 25 bp, Mus musculus
gagcgaaaggcccagcccttcttgg

SEQ ID NO: 392038 - DNA, 25 bp, Mus musculus
cggccggcgactctgagtatccgga

SEQ ID NO: 392039 - DNA, 25 bp, Mus musculus
ctgttctgagacaggtggcccgacc

SEQ ID NO: 392040 - DNA, 25 bp, Mus musculus
cgctgctgtccggaccagcgtcttg

SEQ ID NO: 392041 - DNA, 25 bp, Mus musculus
ggcgactcattctcgtcctcttgtc

SEQ ID NO: 392042 - DNA, 25 bp, Mus musculus
tcaacaggtaagacggcgcggttcc

SEQ ID NO: 392043 - DNA, 25 bp, Mus musculus
ccttccttccagtcgggagacagcg

SEQ ID NO: 392044 - DNA, 25 bp, Mus musculus
aaattgcgccttccttccagtcggg

SEQ ID NO: 392045 - DNA, 25 bp, Mus musculus
acttggcttaacaaattgcgccttc

SEQ ID NO: 392046 - DNA, 25 bp, Mus musculus
ttcgcgctcaagatcaacaggtaag

SEQ ID NO: 392047 - DNA, 25 bp, Mus musculus
gccaaggtggaaatgcggaagtttc

SEQ ID NO: 392048 - DNA, 25 bp, Mus musculus
gactctgagtatccggagcgcggct

SEQ ID NO: 392049 - DNA, 25 bp, Mus musculus
tgcttctggatccagcgctcactgc

SEQ ID NO: 392050 - DNA, 25 bp, Mus musculus
ggcgtttccggccagctctcgcggt

SEQ ID NO: 392051 - DNA, 25 bp, Mus musculus
tcgcgcgcccgaacttggcttaaca

SEQ ID NO: 392052 - DNA, 25 bp, Mus musculus
aacgcctcccagctggaactgcttg

SEQ ID NO: 392053 - DNA, 25 bp, Mus musculus
ttaaggccctgcaaggatacggctg

SEQ ID NO: 392054 - DNA, 25 bp, Mus musculus
aacgctcctacagtgcgggcaacgc

SEQ ID NO: 392055 - DNA, 25 bp, Mus musculus
cggcggggaattgtacatcgactac

SEQ ID NO: 392056 - DNA, 25 bp, Mus musculus
tagagcagagcacgcagcggatcca

SEQ ID NO: 392057 - DNA, 25 bp, Mus musculus
cggatccaggagttccgacagctca

SEQ ID NO: 392058 - DNA, 25 bp, Mus musculus
gttccgacagctcacggccgacatg

SEQ ID NO: 392059 - DNA, 25 bp, Mus musculus
gcggaagattcaggatagcagctgc

SEQ ID NO: 392060 - DNA, 25 bp, Mus musculus
catcagagctcagggagaatgggca

SEQ ID NO: 392061 - DNA, 25 bp, Mus musculus
cgtcccagaacgaagcgtgcggtgt

SEQ ID NO: 392062 - DNA, 25 bp, Mus musculus
cagtgcccgtctcgggagtgcaagt

SEQ ID NO: 392063 - DNA, 25 bp, Mus musculus
ccgtgggtagtgatgagaacatgaa

SEQ ID NO: 392064 - DNA, 25 bp, Mus musculus
acgatgtcgttgtataccacagaga

SEQ ID NO: 392065 - DNA, 25 bp, Mus musculus
tgcggtgtgaggaaacgctcctaca

SEQ ID NO: 392066 - DNA, 25 bp, Mus musculus
ccatagtctccaagggcgctctgcg

SEQ ID NO: 392067 - DNA, 25 bp, Mus musculus
gctccatgccgaacgacgacacatt

SEQ ID NO: 392068 - DNA, 25 bp, Mus musculus
agccggaggttacagcaaagctgcc

SEQ ID NO: 392069 - DNA, 25 bp, Mus musculus
aggctgcccaaatgcgctcgctgca

SEQ ID NO: 392070 - DNA, 25 bp, Mus musculus
ttgccagtgcaagaagtgcagcctg

SEQ ID NO: 392071 - DNA, 25 bp, Mus musculus
ccgtctgcttgaatcccgcggattt

SEQ ID NO: 392072 - DNA, 25 bp, Mus musculus
gtgcaccctcgccatcggtagacga

SEQ ID NO: 392073 - DNA, 25 bp, Mus musculus
cggtagacgagtggctcagtattta

SEQ ID NO: 392074 - DNA, 25 bp, Mus musculus
tgacctcgtcttccagctgaatttc

SEQ ID NO: 392075 - DNA, 25 bp, Mus musculus
acggagtcgcgagattccctgaatc

SEQ ID NO: 392076 - DNA, 25 bp, Mus musculus
gggtgtcccgagattcaaactttgc

SEQ ID NO: 392077 - DNA, 25 bp, Mus musculus
cactgggagagctgccatgatttta

SEQ ID NO: 392078 - DNA, 25 bp, Mus musculus
tcctccgggaagaatctccatagcc

SEQ ID NO: 392079 - DNA, 25 bp, Mus musculus
tttaactctgcacggggttctcttc

SEQ ID NO: 392080 - DNA, 25 bp, Mus musculus
ctgcgcagagacctcggtgttcctt

SEQ ID NO: 392081 - DNA, 25 bp, Mus musculus
atgttccagacacgggcgaagccta

SEQ ID NO: 392082 - DNA, 25 bp, Mus musculus
cgcaccaacttttgctccctgatga

SEQ ID NO: 392083 - DNA, 25 bp, Mus musculus
cctctgcttcgctgactcgtcagta

SEQ ID NO: 392084 - DNA, 25 bp, Mus musculus
tcgtcagtagttggtagtcatattc

SEQ ID NO: 392085 - DNA, 25 bp, Mus musculus
tgttccttcgccactagtctggaga

SEQ ID NO: 392086 - DNA, 25 bp, Mus musculus
gcctagtcgcctctagtcttccttg

SEQ ID NO: 392087 - DNA, 25 bp, Mus musculus
cctgatgaaactccgcagaccctgg

SEQ ID NO: 392088 - DNA, 25 bp, Mus musculus
cgggagtgctcaccggaagtcctat

SEQ ID NO: 392089 - DNA, 25 bp, Mus musculus
gtcctattccaagatgtgcagcagc

SEQ ID NO: 392090 - DNA, 25 bp, Mus musculus
cccgatttcgagatccgggagtcga

SEQ ID NO: 392091 - DNA, 25 bp, Mus musculus
gagtcgagttcgcacccactctttc

SEQ ID NO: 392092 - DNA, 25 bp, Mus musculus
cagcggtttcccaggtcggctagat

SEQ ID NO: 392093 - DNA, 25 bp, Mus musculus
tttagaacgcagactgggcccaatg

SEQ ID NO: 392094 - DNA, 25 bp, Mus musculus
ggagtaccctcaattccctcgcaag

SEQ ID NO: 392095 - DNA, 25 bp, Mus musculus
acctgcgagaagtgcatcctgatca

SEQ ID NO: 392096 - DNA, 25 bp, Mus musculus
cgcttcaaggactgcacctgcgaga

SEQ ID NO: 392097 - DNA, 25 bp, Mus musculus
acaagcgctactgtcgcttcaagga

SEQ ID NO: 392098 - DNA, 25 bp, Mus musculus
accacggggtgctgtcctggctcaa

SEQ ID NO: 392099 - DNA, 25 bp, Mus musculus
atcctgatcatcgagcggcagcggg

SEQ ID NO: 392100 - DNA, 25 bp, Mus musculus
cctacctgtacatgggcggcccggt

SEQ ID NO: 392101 - DNA, 25 bp, Mus musculus
ccggggagactgctgccgtagctcc

SEQ ID NO: 392102 - DNA, 25 bp, Mus musculus
tcccggctcaggaaggggtaacaga

SEQ ID NO: 392103 - DNA, 25 bp, Mus musculus
cgcaagctccgaatggctgaggcca

SEQ ID NO: 392104 - DNA, 25 bp, Mus musculus
agccctgggcatgaacggctacggc

SEQ ID NO: 392105 - DNA, 25 bp, Mus musculus
gccgacctgcggagtaccctcaatt

SEQ ID NO: 392106 - DNA, 25 bp, Mus musculus
ggctcagtgcttcgaggccagtgct

SEQ ID NO: 392107 - DNA, 25 bp, Mus musculus
ggaagtggctcagaccgtaatcaga

SEQ ID NO: 392108 - DNA, 25 bp, Mus musculus
cccgagatcgtgtccgtggatgaag

SEQ ID NO: 392109 - DNA, 25 bp, Mus musculus
gggcccatcggggaccgtctctctg

SEQ ID NO: 392110 - DNA, 25 bp, Mus musculus
ccaagtaccacgctgagcagagcca

SEQ ID NO: 392111 - DNA, 25 bp, Mus musculus
tcagtgccgtggaggtcctgctgtc

SEQ ID NO: 392112 - DNA, 25 bp, Mus musculus
gagctcatcttgaaaggttgcgggg

SEQ ID NO: 392113 - DNA, 25 bp, Mus musculus
aaccagaagcccactgtcctggagc

SEQ ID NO: 392114 - DNA, 25 bp, Mus musculus
gaagtgttgaagaaaatctttccca

SEQ ID NO: 392115 - DNA, 25 bp, Mus musculus
ccctggaagtgttgaagaaaatctt

SEQ ID NO: 392116 - DNA, 25 bp, Mus musculus
ttcagcttgaaagccaaccggccac

SEQ ID NO: 392117 - DNA, 25 bp, Mus musculus
tctctgcccttcagcttgaaagcca

SEQ ID NO: 392118 - DNA, 25 bp, Mus musculus
gaggtcctgctgtccagtcgctcct

SEQ ID NO: 392119 - DNA, 25 bp, Mus musculus
acctcctgatcgagggcccatcggg

SEQ ID NO: 392120 - DNA, 25 bp, Mus musculus
tacgccgtgcagaaaaacgggggca

SEQ ID NO: 392121 - DNA, 25 bp, Mus musculus
tgcccttcagcttgaaagccaaccg

SEQ ID NO: 392122 - DNA, 25 bp, Mus musculus
tctgcgccgaaagcaagcagggtgc

SEQ ID NO: 392123 - DNA, 25 bp, Mus musculus
aatcagcttgttctctagtcggcga

SEQ ID NO: 392124 - DNA, 25 bp, Mus musculus
tggataatactaggaaggggagctc

SEQ ID NO: 392125 - DNA, 25 bp, Mus musculus
gcccaactgccggtcgatggttaaa

SEQ ID NO: 392126 - DNA, 25 bp, Mus musculus
cgatggttaaacaccggagattatg

SEQ ID NO: 392127 - DNA, 25 bp, Mus musculus
accttctcgagaacaacgcgatgta

SEQ ID NO: 392128 - DNA, 25 bp, Mus musculus
cgcgatgtataagagtacgagaatc

SEQ ID NO: 392129 - DNA, 25 bp, Mus musculus
gtgctccggccaatcggcgtgcaca

SEQ ID NO: 392130 - DNA, 25 bp, Mus musculus
tgcccacatttttaggtttagcttc

SEQ ID NO: 392131 - DNA, 25 bp, Mus musculus
taaaaggcgactgctccgccgcaac

SEQ ID NO: 392132 - DNA, 25 bp, Mus musculus
ctctagtcggcgagataaaaggcga

SEQ ID NO: 392133 - DNA, 25 bp, Mus musculus
cgcagtagcgctaaagggaagcttc

SEQ ID NO: 392134 - DNA, 25 bp, Mus musculus
actgcagtgagtgtctctgcgccga

SEQ ID NO: 392135 - DNA, 25 bp, Mus musculus
ttagcttctggatcagggacccggc

SEQ ID NO: 392136 - DNA, 25 bp, Mus musculus
gcagagccgcgcaaactgagccgca

SEQ ID NO: 392137 - DNA, 25 bp, Mus musculus
ctagcgcgcgggcaaccgagccgaa

SEQ ID NO: 392138 - DNA, 25 bp, Mus musculus
gccgaacgacagtctagtgtcatga

SEQ ID NO: 392139 - DNA, 25 bp, Mus musculus
agtctagtgtcatgacggaagggca

SEQ ID NO: 392140 - DNA, 25 bp, Mus musculus
actgggagatcgacgtggaaagcct

SEQ ID NO: 392141 - DNA, 25 bp, Mus musculus
tcgacgtggaaagcctagacctgga

SEQ ID NO: 392142 - DNA, 25 bp, Mus musculus
tgtgggactccactgcgggccacgc

SEQ ID NO: 392143 - DNA, 25 bp, Mus musculus
ggcaaccgagccgaacgacagtcta

SEQ ID NO: 392144 - DNA, 25 bp, Mus musculus
aaactgagccgcacacccaagtgcg

SEQ ID NO: 392145 - DNA, 25 bp, Mus musculus
aaccacggcgtggtatcctgtctca

SEQ ID NO: 392146 - DNA, 25 bp, Mus musculus
ggtatcctgtctcaagggccacaag

SEQ ID NO: 392147 - DNA, 25 bp, Mus musculus
gattctgtcgctggcgggactgcca

SEQ ID NO: 392148 - DNA, 25 bp, Mus musculus
gggactgccagtgcgccaactgcct

SEQ ID NO: 392149 - DNA, 25 bp, Mus musculus
aggaagatagctgtgggactccact

SEQ ID NO: 392150 - DNA, 25 bp, Mus musculus
cgccgcgcactcttggggaagacga

SEQ ID NO: 392151 - DNA, 25 bp, Mus musculus
cagagacccaggcagagcgcgattg

SEQ ID NO: 392152 - DNA, 25 bp, Mus musculus
gcctgacctcgttctgcgctgtccc

SEQ ID NO: 392153 - DNA, 25 bp, Mus musculus
ggcgacgccttcctggttcccacgc

SEQ ID NO: 392154 - DNA, 25 bp, Mus musculus
ccctcgttggcgaggagcgtctccg

SEQ ID NO: 392155 - DNA, 25 bp, Mus musculus
gggtccacgccgagactctacggca

SEQ ID NO: 392156 - DNA, 25 bp, Mus musculus
cactcttggggaagacgagcctccg

SEQ ID NO: 392157 - DNA, 25 bp, Mus musculus
gaagacgagcctccgctgtccgatc

SEQ ID NO: 392158 - DNA, 25 bp, Mus musculus
gcatgacgggaaattcctgggcacg

SEQ ID NO: 392159 - DNA, 25 bp, Mus musculus
cacgggcggccgagtccaaatatga

SEQ ID NO: 392160 - DNA, 25 bp, Mus musculus
gcggccgagtccaaatatgagcata

SEQ ID NO: 392161 - DNA, 25 bp, Mus musculus
tatgagcatagcagacaagcgaggg

SEQ ID NO: 392162 - DNA, 25 bp, Mus musculus
agccctgcgggaacagggcttccgc

SEQ ID NO: 392163 - DNA, 25 bp, Mus musculus
cagggggatgactctcaagactgag

SEQ ID NO: 392164 - DNA, 25 bp, Mus musculus
gctccctgctttcgagtttgcttta

SEQ ID NO: 392165 - DNA, 25 bp, Mus musculus
tgtccagcccgggtctcattacaga

SEQ ID NO: 392166 - DNA, 25 bp, Mus musculus
tgactgtcacaacaggacccgcacg

SEQ ID NO: 392167 - DNA, 25 bp, Mus musculus
ggataatcctctctgcctgactgtc

SEQ ID NO: 392168 - DNA, 25 bp, Mus musculus
ggggaggccatgatccggataatcc

SEQ ID NO: 392169 - DNA, 25 bp, Mus musculus
ggagcctcctcctagcgatgacact

SEQ ID NO: 392170 - DNA, 25 bp, Mus musculus
ccgaggtgtccactaggctctgtta

SEQ ID NO: 392171 - DNA, 25 bp, Mus musculus
cgcggaccctcttgtctggtaccta

SEQ ID NO: 392172 - DNA, 25 bp, Mus musculus
aatgttgattggtgacaggccttta

SEQ ID NO: 392173 - DNA, 25 bp, Mus musculus
gccactaccacagggttggtgcctt

SEQ ID NO: 392174 - DNA, 25 bp, Mus musculus
gacttgtttaaagggctccggctgc

SEQ ID NO: 392175 - DNA, 25 bp, Mus musculus
tgctattcgcctcccggggacttgt

SEQ ID NO: 392176 - DNA, 25 bp, Mus musculus
agggcgccaaccaacacggctgcta

SEQ ID NO: 392177 - DNA, 25 bp, Mus musculus
ttggtgtctttccttggcaagcgcc

SEQ ID NO: 392178 - DNA, 25 bp, Mus musculus
ggcgcccagggcttgcggacaccaa

SEQ ID NO: 392179 - DNA, 25 bp, Mus musculus
ccggcgtggccttgctcttctccat

SEQ ID NO: 392180 - DNA, 25 bp, Mus musculus
gcagcaggatcttcttgctggcgcg

SEQ ID NO: 392181 - DNA, 25 bp, Mus musculus
gctctggcagcaggatcttcttgct

SEQ ID NO: 392182 - DNA, 25 bp, Mus musculus
gcacaggcgggctcacctgggctct

SEQ ID NO: 392183 - DNA, 25 bp, Mus musculus
ccagaataatggggtctccggggca

SEQ ID NO: 392184 - DNA, 25 bp, Mus musculus
gcttgcggacaccaagccttgcggc

SEQ ID NO: 392185 - DNA, 25 bp, Mus musculus
aggtagctcacatcggccagcaccg

SEQ ID NO: 392186 - DNA, 25 bp, Mus musculus
taggagcttggacttggggcgccca

SEQ ID NO: 392187 - DNA, 25 bp, Mus musculus
ggcccagggctaggagcttggactt

SEQ ID NO: 392188 - DNA, 25 bp, Mus musculus
cgaccaggccgggcagtgagataca

SEQ ID NO: 392189 - DNA, 25 bp, Mus musculus
gcagtgagatacaggaagcggcagg

SEQ ID NO: 392190 - DNA, 25 bp, Mus musculus
acaccaagccttgcggcggcaggga

SEQ ID NO: 392191 - DNA, 25 bp, Mus musculus
gcctccaggtcggccatcttggcgg

SEQ ID NO: 392192 - DNA, 25 bp, Mus musculus
aaagggtgcccgctccttgcgtgct

SEQ ID NO: 392193 - DNA, 25 bp, Mus musculus
cctcctctgccaggcgggctgttag

SEQ ID NO: 392194 - DNA, 25 bp, Mus musculus
tagggtgtcctaaagcgtcccttga

SEQ ID NO: 392195 - DNA, 25 bp, Mus musculus
cgctcacttgagctgtcctcggtgg

SEQ ID NO: 392196 - DNA, 25 bp, Mus musculus
ctgcattattttccgcccgcagggt

SEQ ID NO: 392197 - DNA, 25 bp, Mus musculus
tcttcctctccgaagggctggtaac

SEQ ID NO: 392198 - DNA, 25 bp, Mus musculus
ctggtaacttgttgtgcggagcgaa

SEQ ID NO: 392199 - DNA, 25 bp, Mus musculus
tcggcccgaaacaagccgaggcgtc

SEQ ID NO: 392200 - DNA, 25 bp, Mus musculus
ctgagctgtcagagccgaggttact

SEQ ID NO: 392201 - DNA, 25 bp, Mus musculus
tgaacaatggttctgcctcctctgc

SEQ ID NO: 392202 - DNA, 25 bp, Mus musculus
gggctttggagccactgaacaatgg

SEQ ID NO: 392203 - DNA, 25 bp, Mus musculus
ttcccagaacctctgttttacatgg

SEQ ID NO: 392204 - DNA, 25 bp, Mus musculus
gcgtcccttgaacttgttgtcattc

SEQ ID NO: 392205 - DNA, 25 bp, Mus musculus
ccttctctgcaacgcctgcattatt

SEQ ID NO: 392206 - DNA, 25 bp, Mus musculus
agctggattgcgtttagcttggtca

SEQ ID NO: 392207 - DNA, 25 bp, Mus musculus
ccgggtagcttagaaggcccgcctg

SEQ ID NO: 392208 - DNA, 25 bp, Mus musculus
agaaggcccgcctgcgtgcggtcac

SEQ ID NO: 392209 - DNA, 25 bp, Mus musculus
cctgcgtgcggtcacgtgtgtcctg

SEQ ID NO: 392210 - DNA, 25 bp, Mus musculus
gtcctggagtgagagcgaactttca

SEQ ID NO: 392211 - DNA, 25 bp, Mus musculus
cgaactttcaagtgtgtggtcaagc

SEQ ID NO: 392212 - DNA, 25 bp, Mus musculus
ttcaagtgtgtggtcaagctgtctg

SEQ ID NO: 392213 - DNA, 25 bp, Mus musculus
tcaagctgtctgtcgagctatgctg

SEQ ID NO: 392214 - DNA, 25 bp, Mus musculus
agctatgctggggtgtttaagtctc

SEQ ID NO: 392215 - DNA, 25 bp, Mus musculus
tggggtgtttaagtctcccagcgcc

SEQ ID NO: 392216 - DNA, 25 bp, Mus musculus
tgggcctttggttccgctgtccgga

SEQ ID NO: 392217 - DNA, 25 bp, Mus musculus
attggctggtagctggattgcgttt

SEQ ID NO: 392218 - DNA, 25 bp, Mus musculus
tttagcttggtcacgtgtctacgcg

SEQ ID NO: 392219 - DNA, 25 bp, Mus musculus
tccgctgtccggagcgtgagaagct

SEQ ID NO: 392220 - DNA, 25 bp, Mus musculus
gctactggggagtgaggctcaaata

SEQ ID NO: 392221 - DNA, 25 bp, Mus musculus
tacacatccggggtgttgctggtgc

SEQ ID NO: 392222 - DNA, 25 bp, Mus musculus
agctctttcgggacatgcgcttcta

SEQ ID NO: 392223 - DNA, 25 bp, Mus musculus
gacgagctgtgtccacgcagctttc

SEQ ID NO: 392224 - DNA, 25 bp, Mus musculus
actgaagatccaaagggagctgcgc

SEQ ID NO: 392225 - DNA, 25 bp, Mus musculus
tgaactgagcgagcaactgaagatc

SEQ ID NO: 392226 - DNA, 25 bp, Mus musculus
gctgctgtcgcatctgcttcgagga

SEQ ID NO: 392227 - DNA, 25 bp, Mus musculus
agctttctcgaggagctgggctact

SEQ ID NO: 392228 - DNA, 25 bp, Mus musculus
tgcgcttctatggaccacaacgtca

SEQ ID NO: 392229 - DNA, 25 bp, Mus musculus
atctacaacttctacacatccgggg

SEQ ID NO: 392230 - DNA, 25 bp, Mus musculus
ctttgaccgtgacccagcggtcttc

SEQ ID NO: 392231 - DNA, 25 bp, Mus musculus
cgaggcacagacagacgagtacttc

SEQ ID NO: 392232 - DNA, 25 bp, Mus musculus
gcctgtgtgatgactacgaggcaca

SEQ ID NO: 392233 - DNA, 25 bp, Mus musculus
ggctcaaatacacgccacgctgctg

SEQ ID NO: 392234 - DNA, 25 bp, Mus musculus
ggctgcatgagttttggccctcgaa

SEQ ID NO: 392235 - DNA, 25 bp, Mus musculus
tcaccgcacacgtggggcagaaact

SEQ ID NO: 392236 - DNA, 25 bp, Mus musculus
cccggatccgctgattgtagcgtta

SEQ ID NO: 392237 - DNA, 25 bp, Mus musculus
ggtggagcttaggaaacacgaaatc

SEQ ID NO: 392238 - DNA, 25 bp, Mus musculus
gaaatccgtagttcctgttggtcca

SEQ ID NO: 392239 - DNA, 25 bp, Mus musculus
ttttcgccacacctctcgtctgaga

SEQ ID NO: 392240 - DNA, 25 bp, Mus musculus
tcgctcgttagtgtctgtttgcgtc

SEQ ID NO: 392241 - DNA, 25 bp, Mus musculus
tagcgttgggacagctcgctcgtta

SEQ ID NO: 392242 - DNA, 25 bp, Mus musculus
agcgaagtctgcaagctgggttagc

SEQ ID NO: 392243 - DNA, 25 bp, Mus musculus
ggccacccaggtcctgaaggagtta

SEQ ID NO: 392244 - DNA, 25 bp, Mus musculus
cagatttctgggaacgacgcgggtt

SEQ ID NO: 392245 - DNA, 25 bp, Mus musculus
tgacgcttgagcctgcagatttctg

SEQ ID NO: 392246 - DNA, 25 bp, Mus musculus
atccgtcccgtggaagacgagtccg

SEQ ID NO: 392247 - DNA, 25 bp, Mus musculus
ccgtcccggagatggagctgaagac

SEQ ID NO: 392248 - DNA, 25 bp, Mus musculus
ccaacactgtgtgagacgcgcgcta

SEQ ID NO: 392249 - DNA, 25 bp, Mus musculus
tgcgctttaagacttggcgggcccg

SEQ ID NO: 392250 - DNA, 25 bp, Mus musculus
aggcgagggctactttccgtcaaag

SEQ ID NO: 392251 - DNA, 25 bp, Mus musculus
ccgcgagaggaaaagcgcgaagcca

SEQ ID NO: 392252 - DNA, 25 bp, Mus musculus
gtgtgagcggtgctcccgccgccat

SEQ ID NO: 392253 - DNA, 25 bp, Mus musculus
ggagtgacgacggagccaacactgt

SEQ ID NO: 392254 - DNA, 25 bp, Mus musculus
cccgaggtgcgctttaagacttggc

SEQ ID NO: 392255 - DNA, 25 bp, Mus musculus
taatatcccggatgtgctgcgctcc

SEQ ID NO: 392256 - DNA, 25 bp, Mus musculus
aagaagcggcttcggcgccgtgact

SEQ ID NO: 392257 - DNA, 25 bp, Mus musculus
tccctctccgtggtcgccagtgtgg

SEQ ID NO: 392258 - DNA, 25 bp, Mus musculus
gtcgccagtgtggtgtttcccggtc

SEQ ID NO: 392259 - DNA, 25 bp, Mus musculus
tcccggtcggtcgtttatgcctcgc

SEQ ID NO: 392260 - DNA, 25 bp, Mus musculus
tatgcctcgcgggtgatccctttcc

SEQ ID NO: 392261 - DNA, 25 bp, Mus musculus
gaacggtgacccatctcgctcggcg

SEQ ID NO: 392262 - DNA, 25 bp, Mus musculus
cccacgagtgtcgttttgctattgc

SEQ ID NO: 392263 - DNA, 25 bp, Mus musculus
ttgctattgcctcccaaacacacta

SEQ ID NO: 392264 - DNA, 25 bp, Mus musculus
ctaccagatctaagggcgcgacctc

SEQ ID NO: 392265 - DNA, 25 bp, Mus musculus
actgtgaccctgtccggaccacggg

SEQ ID NO: 392266 - DNA, 25 bp, Mus musculus
tacatagggccctgcactgtgaccc

SEQ ID NO: 392267 - DNA, 25 bp, Mus musculus
tcttgggtcctagcctcagggatct

SEQ ID NO: 392268 - DNA, 25 bp, Mus musculus
tagcctcagggatctccggaggtga

SEQ ID NO: 392269 - DNA, 25 bp, Mus musculus
cgcgagcgagagaacgcaacaaaac

SEQ ID NO: 392270 - DNA, 25 bp, Mus musculus
aaacaaactcgtgccggcttcctgt

SEQ ID NO: 392271 - DNA, 25 bp, Mus musculus
acccggagccgcactggggtacata

SEQ ID NO: 392272 - DNA, 25 bp, Mus musculus
gtgccggcttcctgttgtgcaacca

SEQ ID NO: 392273 - DNA, 25 bp, Mus musculus
ctgttgtgcaaccactttctgagta

SEQ ID NO: 392274 - DNA, 25 bp, Mus musculus
ctttctgagtaagtaaggggctgaa

SEQ ID NO: 392275 - DNA, 25 bp, Mus musculus
ctgaaaggccgccagttaggaagcc

SEQ ID NO: 392276 - DNA, 25 bp, Mus musculus
ctccagtcatgtctttacaaagttg

SEQ ID NO: 392277 - DNA, 25 bp, Mus musculus
tggtcaccaggccagccagtgtctc

SEQ ID NO: 392278 - DNA, 25 bp, Mus musculus
cagtgtctccctcttgacgttcgcg

SEQ ID NO: 392279 - DNA, 25 bp, Mus musculus
ctttacaaagttgagaggcgacttc

SEQ ID NO: 392280 - DNA, 25 bp, Mus musculus
gacgttcgcgcacacacgctccttc

SEQ ID NO: 392281 - DNA, 25 bp, Mus musculus
tacgcacaggcacactccagtcatg

SEQ ID NO: 392282 - DNA, 25 bp, Mus musculus
atcagctccctgtccgcgctacgca

SEQ ID NO: 392283 - DNA, 25 bp, Mus musculus
ggaaaactcgcatccaagcccgtgg

SEQ ID NO: 392284 - DNA, 25 bp, Mus musculus
tccttcggaaaggaaaactcgcatc

SEQ ID NO: 392285 - DNA, 25 bp, Mus musculus
acaacactagcgatgcgtgggtgga

SEQ ID NO: 392286 - DNA, 25 bp, Mus musculus
agcccgctcgtgacaacactagcga

SEQ ID NO: 392287 - DNA, 25 bp, Mus musculus
agaggcgacttcatgcctggcccgg

SEQ ID NO: 392288 - DNA, 25 bp, Mus musculus
tccttcccataaaactccagagcgg

SEQ ID NO: 392289 - DNA, 25 bp, Mus musculus
cataaaactccagagcgggtaaccg

SEQ ID NO: 392290 - DNA, 25 bp, Mus musculus
gttgtacttctccaacgcctgggta

SEQ ID NO: 392291 - DNA, 25 bp, Mus musculus
ctcttccgacatgtctgcatttttg

SEQ ID NO: 392292 - DNA, 25 bp, Mus musculus
agccggtcgctaccgaagccgtggc

SEQ ID NO: 392293 - DNA, 25 bp, Mus musculus
gacagccggtcgctaccgaagccgt

SEQ ID NO: 392294 - DNA, 25 bp, Mus musculus
gctgctgcgagctcctagggaaggt

SEQ ID NO: 392295 - DNA, 25 bp, Mus musculus
gagcagaggccagccggctgctgcg

SEQ ID NO: 392296 - DNA, 25 bp, Mus musculus
ccgacatgtctgcatttttgatcac

SEQ ID NO: 392297 - DNA, 25 bp, Mus musculus
gcatctcttccgacatgtctgcatt

SEQ ID NO: 392298 - DNA, 25 bp, Mus musculus
tgttgcatctcttccgacatgtctg

SEQ ID NO: 392299 - DNA, 25 bp, Mus musculus
gcctgggtagcgcactccaccgagt

SEQ ID NO: 392300 - DNA, 25 bp, Mus musculus
ttctccaacgcctgggtagcgcact

SEQ ID NO: 392301 - DNA, 25 bp, Mus musculus
tgtacttctccaacgcctgggtagc

SEQ ID NO: 392302 - DNA, 25 bp, Mus musculus
cgatgttgtacttctccaacgcctg

SEQ ID NO: 392303 - DNA, 25 bp, Mus musculus
ttctcgatgttgtacttctccaacg

SEQ ID NO: 392304 - DNA, 25 bp, Mus musculus
atggacaacatcagccgaaacatcg

SEQ ID NO: 392305 - DNA, 25 bp, Mus musculus
ggtcgcaatcaagatggacaacatc

SEQ ID NO: 392306 - DNA, 25 bp, Mus musculus
cgctcttccaacaggtcgcaatcaa

SEQ ID NO: 392307 - DNA, 25 bp, Mus musculus
accgcctgtatggtgcgcagcgctc

SEQ ID NO: 392308 - DNA, 25 bp, Mus musculus
ttcgccaatagcagcgccgagctga

SEQ ID NO: 392309 - DNA, 25 bp, Mus musculus
gagctgctgatggacttcgccaata

SEQ ID NO: 392310 - DNA, 25 bp, Mus musculus
tacctccggacctgccggatctgga

SEQ ID NO: 392311 - DNA, 25 bp, Mus musculus
accagcagtcggcacccaggctttg

SEQ ID NO: 392312 - DNA, 25 bp, Mus musculus
gaccctgtctttgctgcagggcgga

SEQ ID NO: 392313 - DNA, 25 bp, Mus musculus
ggtgcaggacttgaccctgtctttg

SEQ ID NO: 392314 - DNA, 25 bp, Mus musculus
gggccgtgacgcactcacctcgtga

SEQ ID NO: 392315 - DNA, 25 bp, Mus musculus
agcaccgggcgagctatctgttaca

SEQ ID NO: 392316 - DNA, 25 bp, Mus musculus
ctatctgttacagtccggcccgggg

SEQ ID NO: 392317 - DNA, 25 bp, Mus musculus
tctagggccgctgtcactgctacct

SEQ ID NO: 392318 - DNA, 25 bp, Mus musculus
aggtttcggctcctgtctagactcc

SEQ ID NO: 392319 - DNA, 25 bp, Mus musculus
ttcagcttcttgaggtagacgggcc

SEQ ID NO: 392320 - DNA, 25 bp, Mus musculus
gctcttcctcgcgaagcttcttcag

SEQ ID NO: 392321 - DNA, 25 bp, Mus musculus
gttattactgttccgcgtcttgttg

SEQ ID NO: 392322 - DNA, 25 bp, Mus musculus
cgccgtcgccgtgttattgttatta

SEQ ID NO: 392323 - DNA, 25 bp, Mus musculus
cgagctgaagcccagcagcactttg

SEQ ID NO: 392324 - DNA, 25 bp, Mus musculus
tttaatacctgtctggccggggcca

SEQ ID NO: 392325 - DNA, 25 bp, Mus musculus
cgagggagtcgtcctttaatacctg

SEQ ID NO: 392326 - DNA, 25 bp, Mus musculus
cttactatggctccgtctgggtcga

SEQ ID NO: 392327 - DNA, 25 bp, Mus musculus
tcagcgccgagaacggcttactatg

SEQ ID NO: 392328 - DNA, 25 bp, Mus musculus
cggctgccgccagatttagcagtca

SEQ ID NO: 392329 - DNA, 25 bp, Mus musculus
tgaaccgaagtctcctgccggctgc

SEQ ID NO: 392330 - DNA, 25 bp, Mus musculus
gccctgtcattcatcgcgagtgctc

SEQ ID NO: 392331 - DNA, 25 bp, Mus musculus
tcacgggacccggagataagccgta

SEQ ID NO: 392332 - DNA, 25 bp, Mus musculus
tcaccatggggaagcccacgagctc

SEQ ID NO: 392333 - DNA, 25 bp, Mus musculus
tccgtctcgctggttggcccggtcg

SEQ ID NO: 392334 - DNA, 25 bp, Mus musculus
tgactggcgccgcttcctacggaat

SEQ ID NO: 392335 - DNA, 25 bp, Mus musculus
gctgctgctctccaccgtggccgcc

SEQ ID NO: 392336 - DNA, 25 bp, Mus musculus
ttcctacggaatcactggctgctgc

SEQ ID NO: 392337 - DNA, 25 bp, Mus musculus
ggcgccgcttcctacggaatcactg

SEQ ID NO: 392338 - DNA, 25 bp, Mus musculus
aagcccacgagctcgggatgtgact

SEQ ID NO: 392339 - DNA, 25 bp, Mus musculus
cgtcagtgctcaccatggggaagcc

SEQ ID NO: 392340 - DNA, 25 bp, Mus musculus
tcgcaaacgtcagtgctcaccatgg

SEQ ID NO: 392341 - DNA, 25 bp, Mus musculus
cgactcatcgcaaacgtcagtgctc

SEQ ID NO: 392342 - DNA, 25 bp, Mus musculus
aggctacccgactcatcgcaaacgt

SEQ ID NO: 392343 - DNA, 25 bp, Mus musculus
ccgcatctcgcatcggccaggctac

SEQ ID NO: 392344 - DNA, 25 bp, Mus musculus
gcgcccgccacgcaaaaccaccgtg

SEQ ID NO: 392345 - DNA, 25 bp, Mus musculus
cggtgcgcgttgtctccactgtgcc

SEQ ID NO: 392346 - DNA, 25 bp, Mus musculus
ggcaccctctactgcctgcttagga

SEQ ID NO: 392347 - DNA, 25 bp, Mus musculus
cctctcggtggacaggtactccttt

SEQ ID NO: 392348 - DNA, 25 bp, Mus musculus
ggacatgtttttcaccctctcggtg

SEQ ID NO: 392349 - DNA, 25 bp, Mus musculus
gccgacccgcgcacaatcaaaagga

SEQ ID NO: 392350 - DNA, 25 bp, Mus musculus
cctgctgctggtagctgtgattaaa

SEQ ID NO: 392351 - DNA, 25 bp, Mus musculus
gcgcgaagtgctgatgaacctgctc

SEQ ID NO: 392352 - DNA, 25 bp, Mus musculus
ctggagatctcagggcatggcatcc

SEQ ID NO: 392353 - DNA, 25 bp, Mus musculus
ttgaacccgtccttcctgggcatcg

SEQ ID NO: 392354 - DNA, 25 bp, Mus musculus
acgtctccgccaggtgtcacaatcg

SEQ ID NO: 392355 - DNA, 25 bp, Mus musculus
tgaacctgctcttcgccctgctgtt

SEQ ID NO: 392356 - DNA, 25 bp, Mus musculus
gaggacgcccgcatgaacttgaacc

SEQ ID NO: 392357 - DNA, 25 bp, Mus musculus
atcgacctgtggctgtccaagaagc

SEQ ID NO: 392358 - DNA, 25 bp, Mus musculus
ccctgatgaagctgctggagatctc

SEQ ID NO: 392359 - DNA, 25 bp, Mus musculus
tgtcacaatcgtgctctgcggctcg

SEQ ID NO: 392360 - DNA, 25 bp, Mus musculus
tggtcagacgggtcacacaaacgtg

SEQ ID NO: 392361 - DNA, 25 bp, Mus musculus
gccacctctgctgggtggtcagacg

SEQ ID NO: 392362 - DNA, 25 bp, Mus musculus
gccgccattttgaacccgtcagatt

SEQ ID NO: 392363 - DNA, 25 bp, Mus musculus
agtgcacggaaagaagcgccctccc

SEQ ID NO: 392364 - DNA, 25 bp, Mus musculus
ttgtcagacccagggagtgcacgga

SEQ ID NO: 392365 - DNA, 25 bp, Mus musculus
tgctgtgctcgggtcttgtcagacc

SEQ ID NO: 392366 - DNA, 25 bp, Mus musculus
tcacacaaacgtgggccagacggcc

SEQ ID NO: 392367 - DNA, 25 bp, Mus musculus
ccttcgagccacctctgctgggtgg

SEQ ID NO: 392368 - DNA, 25 bp, Mus musculus
cgtcagattctcacatacacacagc

SEQ ID NO: 392369 - DNA, 25 bp, Mus musculus
tccgggacacacgtgaacgcgcacg

SEQ ID NO: 392370 - DNA, 25 bp, Mus musculus
acacaggaggatccgctgaagcagc

SEQ ID NO: 392371 - DNA, 25 bp, Mus musculus
cgcgccgattgcgtcggcctcgaat

SEQ ID NO: 392372 - DNA, 25 bp, Mus musculus
cccactactctagggagggttgtga

SEQ ID NO: 392373 - DNA, 25 bp, Mus musculus
cagggcagccgttggccgcttcaac

SEQ ID NO: 392374 - DNA, 25 bp, Mus musculus
ctccaagcgcatcttgagggttttc

SEQ ID NO: 392375 - DNA, 25 bp, Mus musculus
tgacacaacccggacttccagaagc

SEQ ID NO: 392376 - DNA, 25 bp, Mus musculus
gttgatctccgccatcagcatgtcc

SEQ ID NO: 392377 - DNA, 25 bp, Mus musculus
cgtgtcagctgctccttatcctgca

SEQ ID NO: 392378 - DNA, 25 bp, Mus musculus
cggaaggttccctcttgcatctggc

SEQ ID NO: 392379 - DNA, 25 bp, Mus musculus
gagggttttcaagttgttgatctcc

SEQ ID NO: 392380 - DNA, 25 bp, Mus musculus
cggacttccagaagcggatgtcgga

SEQ ID NO: 392381 - DNA, 25 bp, Mus musculus
atgtcggagagcctctggcccaggt

SEQ ID NO: 392382 - DNA, 25 bp, Mus musculus
cgcgttgggtataacgattgaagtg

SEQ ID NO: 392383 - DNA, 25 bp, Mus musculus
cctcttgcatctggcgtgtcagctg

SEQ ID NO: 392384 - DNA, 25 bp, Mus musculus
gagccgcgatgcctctgcaatactg

SEQ ID NO: 392385 - DNA, 25 bp, Mus musculus
ctgcaatactgatcagcagatcatt

SEQ ID NO: 392386 - DNA, 25 bp, Mus musculus
agcagatcattagagcggtcccatt

SEQ ID NO: 392387 - DNA, 25 bp, Mus musculus
agcggtcccattcgcgttgggtata

SEQ ID NO: 392388 - DNA, 25 bp, Mus musculus
cagagggattctgggtaacgaccgt

SEQ ID NO: 392389 - DNA, 25 bp, Mus musculus
gcctgatgccaagccacagctctgg

SEQ ID NO: 392390 - DNA, 25 bp, Mus musculus
aaaggaggcgatcacgcgcgcattc

SEQ ID NO: 392391 - DNA, 25 bp, Mus musculus
tggcagcatcttccgcgagaaaagg

SEQ ID NO: 392392 - DNA, 25 bp, Mus musculus
acagctctggcagcatcttccgcga

SEQ ID NO: 392393 - DNA, 25 bp, Mus musculus
aaccgaggaggagagtgacttagac

SEQ ID NO: 392394 - DNA, 25 bp, Mus musculus
aggttccactcacgccagggccgtt

SEQ ID NO: 392395 - DNA, 25 bp, Mus musculus
cagactttgcttcttcgtccagacg

SEQ ID NO: 392396 - DNA, 25 bp, Mus musculus
ggccggctacttcttcttccgcagt

SEQ ID NO: 392397 - DNA, 25 bp, Mus musculus
gaggagagtgacttagacgtgtccc

SEQ ID NO: 392398 - DNA, 25 bp, Mus musculus
ccggacttaaactccagactttgct

SEQ ID NO: 392399 - DNA, 25 bp, Mus musculus
cctgcagaaaccctagttagctttc

SEQ ID NO: 392400 - DNA, 25 bp, Mus musculus
cggatccgaacctgcagaaacccta

SEQ ID NO: 392401 - DNA, 25 bp, Mus musculus
tttgcttcttcgtccagacgtggcc

SEQ ID NO: 392402 - DNA, 25 bp, Mus musculus
tgacgacacggtgcccttgccggag

SEQ ID NO: 392403 - DNA, 25 bp, Mus musculus
gattcggggcgcaacggctctttcc

SEQ ID NO: 392404 - DNA, 25 bp, Mus musculus
gcacccgcgtcgcaggaccctcgac

SEQ ID NO: 392405 - DNA, 25 bp, Mus musculus
gccctcggtctcagctcccacctgt

SEQ ID NO: 392406 - DNA, 25 bp, Mus musculus
ctgtgccctgcagcatgttctggcg

SEQ ID NO: 392407 - DNA, 25 bp, Mus musculus
ccctgcagcatgttctggcggagca

SEQ ID NO: 392408 - DNA, 25 bp, Mus musculus
ggtgcttcagctcgaagtgtttggt

SEQ ID NO: 392409 - DNA, 25 bp, Mus musculus
tgatgcgtgacgacacggtgccctt

SEQ ID NO: 392410 - DNA, 25 bp, Mus musculus
gtccgagctgcgcagacgctggtct

SEQ ID NO: 392411 - DNA, 25 bp, Mus musculus
cagacgctggtctgtggcctggcct

SEQ ID NO: 392412 - DNA, 25 bp, Mus musculus
tctcccggaagtgagcgacggccac

SEQ ID NO: 392413 - DNA, 25 bp, Mus musculus
agctgcccacggaggccagaggatt

SEQ ID NO: 392414 - DNA, 25 bp, Mus musculus
ccactcccttgagctccacccggcg

SEQ ID NO: 392415 - DNA, 25 bp, Mus musculus
ctcgaagtgtttggtgatgcgtgac

SEQ ID NO: 392416 - DNA, 25 bp, Mus musculus
cgaccggtcaagatccgcaggattc

SEQ ID NO: 392417 - DNA, 25 bp, Mus musculus
ggctagcttgttgctacgaatcgta

SEQ ID NO: 392418 - DNA, 25 bp, Mus musculus
gctgcacgttttcctggctagcttg

SEQ ID NO: 392419 - DNA, 25 bp, Mus musculus
aggctagctagcatccttgcccggg

SEQ ID NO: 392420 - DNA, 25 bp, Mus musculus
cgttgctaagtaccaccagctgtgg

SEQ ID NO: 392421 - DNA, 25 bp, Mus musculus
ccaggcggagccattgcctccttta

SEQ ID NO: 392422 - DNA, 25 bp, Mus musculus
ctcctttatcgcataggccgtgaaa

SEQ ID NO: 392423 - DNA, 25 bp, Mus musculus
ccagatccctcgtgggccaatggta

SEQ ID NO: 392424 - DNA, 25 bp, Mus musculus
ctctgacccggtgtctagtcgctct

SEQ ID NO: 392425 - DNA, 25 bp, Mus musculus
agtcgctctgtcttcctgttctaaa

SEQ ID NO: 392426 - DNA, 25 bp, Mus musculus
tgttctaaaccacgtggacgcgtcg

SEQ ID NO: 392427 - DNA, 25 bp, Mus musculus
aggcgcactcactcagctacgcggg

SEQ ID NO: 392428 - DNA, 25 bp, Mus musculus
tacgcggggtgtaacttcttgcgcc

SEQ ID NO: 392429 - DNA, 25 bp, Mus musculus
tcctgggcacgggtagtaaacagct

SEQ ID NO: 392430 - DNA, 25 bp, Mus musculus
ccgcctgtggaaacgaaagcaggaa

SEQ ID NO: 392431 - DNA, 25 bp, Mus musculus
agtcaggtacttgggtctcagcgcc

SEQ ID NO: 392432 - DNA, 25 bp, Mus musculus
gctccctagacctcggcccgcccga

SEQ ID NO: 392433 - DNA, 25 bp, Mus musculus
cagggagccgcctgtggaaacgaaa

SEQ ID NO: 392434 - DNA, 25 bp, Mus musculus
agtggtggttaactgaagtcaggta

SEQ ID NO: 392435 - DNA, 25 bp, Mus musculus
gccaatcctatcagctcggacgcag

SEQ ID NO: 392436 - DNA, 25 bp, Mus musculus
tatcagctcggacgcagcggggcct

SEQ ID NO: 392437 - DNA, 25 bp, Mus musculus
ccggccgggctgactcattcccagc

SEQ ID NO: 392438 - DNA, 25 bp, Mus musculus
attcccagccgtctcctccgcgagc

SEQ ID NO: 392439 - DNA, 25 bp, Mus musculus
ctccgcgagccgaggccgcaagcac

SEQ ID NO: 392440 - DNA, 25 bp, Mus musculus
cgcaagcacgctgcgccaacccgca

SEQ ID NO: 392441 - DNA, 25 bp, Mus musculus
cgggaatctccacgcgcgcctccgc

SEQ ID NO: 392442 - DNA, 25 bp, Mus musculus
cgctttcccgaagctgcaccgcgcc

SEQ ID NO: 392443 - DNA, 25 bp, Mus musculus
tacttgggtctcagcgcccggtcca

SEQ ID NO: 392444 - DNA, 25 bp, Mus musculus
cccaggattggttggctatgacagt

SEQ ID NO: 392445 - DNA, 25 bp, Mus musculus
tgttcttccggtgcaggcgcctgga

SEQ ID NO: 392446 - DNA, 25 bp, Mus musculus
tggctcccttaagcgctcgggtgcc

SEQ ID NO: 392447 - DNA, 25 bp, Mus musculus
gcctttggctcccttaagcgctcgg

SEQ ID NO: 392448 - DNA, 25 bp, Mus musculus
gatcacgagcttcaaccaatcagcg

SEQ ID NO: 392449 - DNA, 25 bp, Mus musculus
gctatgacagtggatcacgagcttc

SEQ ID NO: 392450 - DNA, 25 bp, Mus musculus
acagtaccttgcttcggcagagccc

SEQ ID NO: 392451 - DNA, 25 bp, Mus musculus
gcgatcagcgcagggacagtacctt

SEQ ID NO: 392452 - DNA, 25 bp, Mus musculus
cagcagaggcctctagccagagctc

SEQ ID NO: 392453 - DNA, 25 bp, Mus musculus
acactcacgcgacacggtgcgggga

SEQ ID NO: 392454 - DNA, 25 bp, Mus musculus
tgtgacccgaaacactcacgcgaca

SEQ ID NO: 392455 - DNA, 25 bp, Mus musculus
acggtgaccgcagcagaggcctcta

SEQ ID NO: 392456 - DNA, 25 bp, Mus musculus
caggtgtctgtgacccgaaacactc

SEQ ID NO: 392457 - DNA, 25 bp, Mus musculus
ccagagctccagagcgatcagcgca

SEQ ID NO: 392458 - DNA, 25 bp, Mus musculus
agaggcccggatctagtcccgattc

SEQ ID NO: 392459 - DNA, 25 bp, Mus musculus
ggtcagcgtcccagactgcgtcgcg

SEQ ID NO: 392460 - DNA, 25 bp, Mus musculus
gccaggtcgccagccagcaaggcgt

SEQ ID NO: 392461 - DNA, 25 bp, Mus musculus
cgcgcgcggaccatgtatttcctga

SEQ ID NO: 392462 - DNA, 25 bp, Mus musculus
tgtatttcctgagcggctggcccaa

SEQ ID NO: 392463 - DNA, 25 bp, Mus musculus
tccagtctgaccctcggagagcgtt

SEQ ID NO: 392464 - DNA, 25 bp, Mus musculus
gagagcgttcttcgccgtgctggcc

SEQ ID NO: 392465 - DNA, 25 bp, Mus musculus
tacagccgagtaagtaggcgccggc

SEQ ID NO: 392466 - DNA, 25 bp, Mus musculus
gagcgaccctcgctctcgagttgga

SEQ ID NO: 392467 - DNA, 25 bp, Mus musculus
gggcgaacccagaaccatcctgatc

SEQ ID NO: 392468 - DNA, 25 bp, Mus musculus
atcctgatcaccctccctatagtga

SEQ ID NO: 392469 - DNA, 25 bp, Mus musculus
ctatagtgaccctggaactggcgcg

SEQ ID NO: 392470 - DNA, 25 bp, Mus musculus
aactggcgcgactgccgccgagcga

SEQ ID NO: 392471 - DNA, 25 bp, Mus musculus
cctcagcatctggtacagccgagta

SEQ ID NO: 392472 - DNA, 25 bp, Mus musculus
ttgccagcatcgtgtctctgcgtcc

SEQ ID NO: 392473 - DNA, 25 bp, Mus musculus
cgttttcattcacctggcgcaggcg

SEQ ID NO: 392474 - DNA, 25 bp, Mus musculus
agtggcgaccgcctgcacaccaccg

SEQ ID NO: 392475 - DNA, 25 bp, Mus musculus
ggccgctctcagtgctcgccttttg

SEQ ID NO: 392476 - DNA, 25 bp, Mus musculus
agtgctcgccttttgccagcagttc

SEQ ID NO: 392477 - DNA, 25 bp, Mus musculus
gccttttgccagcagttcccgcggt

SEQ ID NO: 392478 - DNA, 25 bp, Mus musculus
tttgccagcagttcccgcggttcct

SEQ ID NO: 392479 - DNA, 25 bp, Mus musculus
gcggttcctccctctcgagtgtgct

SEQ ID NO: 392480 - DNA, 25 bp, Mus musculus
tctcgagtgtgctcctctagctgct

SEQ ID NO: 392481 - DNA, 25 bp, Mus musculus
tcctctagctgctggcgctgtggga

SEQ ID NO: 392482 - DNA, 25 bp, Mus musculus
gggacgtgctggcattgccagcttt

SEQ ID NO: 392483 - DNA, 25 bp, Mus musculus
tggcattgccagctttgccagcatc

SEQ ID NO: 392484 - DNA, 25 bp, Mus musculus
tttcattcacctggcgcaggcgagc

SEQ ID NO: 392485 - DNA, 25 bp, Mus musculus
gccagctttgccagcatcgtgtctc

SEQ ID NO: 392486 - DNA, 25 bp, Mus musculus
tgcctcggagaacactgcctaacac

SEQ ID NO: 392487 - DNA, 25 bp, Mus musculus
gggatgcctcggagaacactgccta

SEQ ID NO: 392488 - DNA, 25 bp, Mus musculus
gcctcggagaacactgcctaacacg

SEQ ID NO: 392489 - DNA, 25 bp, Mus musculus
tgcctcggagaacactgatgcctcg

SEQ ID NO: 392490 - DNA, 25 bp, Mus musculus
atgcctcggagaacactgatgcctc

SEQ ID NO: 392491 - DNA, 25 bp, Mus musculus
tgcctaacacgggatgcctcggaga

SEQ ID NO: 392492 - DNA, 25 bp, Mus musculus
gatgcctcggagaacactgcctaac

SEQ ID NO: 392493 - DNA, 25 bp, Mus musculus
gatgcctcggagagcactgcctaac

SEQ ID NO: 392494 - DNA, 25 bp, Mus musculus
cactgcctaacacggggatgcctcg

SEQ ID NO: 392495 - DNA, 25 bp, Mus musculus
ggatgcctcggagagcactgcctaa

SEQ ID NO: 392496 - DNA, 25 bp, Mus musculus
gaacactgcctaacacgggatgcct

SEQ ID NO: 392497 - DNA, 25 bp, Mus musculus
ctaacacgggatgcctcggagaaca

SEQ ID NO: 392498 - DNA, 25 bp, Mus musculus
cctcggagaacactgcctaacacgg

SEQ ID NO: 392499 - DNA, 25 bp, Mus musculus
gcctaacacgggatgcctcggagaa

SEQ ID NO: 392500 - DNA, 25 bp, Mus musculus
tccgcagcgcctcctagtgagcgga

SEQ ID NO: 392501 - DNA, 25 bp, Mus musculus
gctgactccgagctccactccatgg

SEQ ID NO: 392502 - DNA, 25 bp, Mus musculus
tgaggcctctctctgccggtgcgac

SEQ ID NO: 392503 - DNA, 25 bp, Mus musculus
tgcgctgaggcctctctctgccggt

SEQ ID NO: 392504 - DNA, 25 bp, Mus musculus
acatcctcccgacgcccttcgcatc

SEQ ID NO: 392505 - DNA, 25 bp, Mus musculus
ggacagcgcggtcttcgcaacccgg

SEQ ID NO: 392506 - DNA, 25 bp, Mus musculus
tgcgcgcctcggacagcgcggtctt

SEQ ID NO: 392507 - DNA, 25 bp, Mus musculus
agcgagagctgcacgagcgcccgca

SEQ ID NO: 392508 - DNA, 25 bp, Mus musculus
ctgcagcgagagctgcacgagcgcc

SEQ ID NO: 392509 - DNA, 25 bp, Mus musculus
tggcgcgcgtcgaactcgccctgga

SEQ ID NO: 392510 - DNA, 25 bp, Mus musculus
cgtacctggcttggcgcgcgtcgaa

SEQ ID NO: 392511 - DNA, 25 bp, Mus musculus
ggactctgcatacagcagcgccggc

SEQ ID NO: 392512 - DNA, 25 bp, Mus musculus
ttcccaccgaggtgcgcccaaggac

SEQ ID NO: 392513 - DNA, 25 bp, Mus musculus
aggacgcgcaggatcatcccacttc

SEQ ID NO: 392514 - DNA, 25 bp, Mus musculus
aagtccgccacaaactccgtgatgc

SEQ ID NO: 392515 - DNA, 25 bp, Mus musculus
gaggagagctaggtgccctcctctc

SEQ ID NO: 392516 - DNA, 25 bp, Mus musculus
cgcatcgggccttgctctcctccgt

SEQ ID NO: 392517 - DNA, 25 bp, Mus musculus
aggaggcactcctccggcggaccag

SEQ ID NO: 392518 - DNA, 25 bp, Mus musculus
caccgcctgcgaccaccgtcgtctc

SEQ ID NO: 392519 - DNA, 25 bp, Mus musculus
gctcgtaggtcagctcctgctcctt

SEQ ID NO: 392520 - DNA, 25 bp, Mus musculus
tagccctgctgcagctcgtaggtca

SEQ ID NO: 392521 - DNA, 25 bp, Mus musculus
cccaggatgcggtagccctgctgca

SEQ ID NO: 392522 - DNA, 25 bp, Mus musculus
cctgcaggaactcgcccaggatgcg

SEQ ID NO: 392523 - DNA, 25 bp, Mus musculus
gcggtgcttctcctgcaggaactcg

SEQ ID NO: 392524 - DNA, 25 bp, Mus musculus
caacagacacatgccctggctgggc

SEQ ID NO: 392525 - DNA, 25 bp, Mus musculus
catcttcaacagacacatgccctgg

SEQ ID NO: 392526 - DNA, 25 bp, Mus musculus
ctgtactggccgctggagaacttct

SEQ ID NO: 392527 - DNA, 25 bp, Mus musculus
cgctggagaacttctcctccatctt

SEQ ID NO: 392528 - DNA, 25 bp, Mus musculus
tacgccacccctgcagtgtagcggg

SEQ ID NO: 392529 - DNA, 25 bp, Mus musculus
agctcaggggaggtgtgtaaacagc

SEQ ID NO: 392530 - DNA, 25 bp, Mus musculus
tttcgggcttaagaagagggactga

SEQ ID NO: 392531 - DNA, 25 bp, Mus musculus
cttaagaagagggactgagtgcgtc

SEQ ID NO: 392532 - DNA, 25 bp, Mus musculus
ggactgagtgcgtccgcccgtccat

SEQ ID NO: 392533 - DNA, 25 bp, Mus musculus
gcgcttgtgcctgccgcgctctgtg

SEQ ID NO: 392534 - DNA, 25 bp, Mus musculus
acgcgggtccgactcctggttctat

SEQ ID NO: 392535 - DNA, 25 bp, Mus musculus
ggtccgactcctggttctatctctg

SEQ ID NO: 392536 - DNA, 25 bp, Mus musculus
ggttctatctctgctcccacgctgg

SEQ ID NO: 392537 - DNA, 25 bp, Mus musculus
gccgaatggagcagcgccgcagtcc

SEQ ID NO: 392538 - DNA, 25 bp, Mus musculus
gttggctctcacaggcgctcggccg

SEQ ID NO: 392539 - DNA, 25 bp, Mus musculus
gggcgctcgtctcctgctggagcct

SEQ ID NO: 392540 - DNA, 25 bp, Mus musculus
taaacagccgggtgaaccgcgtgtg

SEQ ID NO: 392541 - DNA, 25 bp, Mus musculus
cgcagttggctctcacaggcgctcg

SEQ ID NO: 392542 - DNA, 25 bp, Mus musculus
ctgtcaaagctaccgcgaccgggaa

SEQ ID NO: 392543 - DNA, 25 bp, Mus musculus
ttaggggtatcgtcctgttctccga

SEQ ID NO: 392544 - DNA, 25 bp, Mus musculus
tgagtgcgttttaggggtatcgtcc

SEQ ID NO: 392545 - DNA, 25 bp, Mus musculus
ctgagtgcgttttaggggtatcgtc

SEQ ID NO: 392546 - DNA, 25 bp, Mus musculus
acagggtggacggagctgagtgcgt

SEQ ID NO: 392547 - DNA, 25 bp, Mus musculus
ttttacagggtggacggagctgagt

SEQ ID NO: 392548 - DNA, 25 bp, Mus musculus
ccactctccgctgcggcggggtgaa

SEQ ID NO: 392549 - DNA, 25 bp, Mus musculus
gtgacgtcagtgaggcgacgccggg

SEQ ID NO: 392550 - DNA, 25 bp, Mus musculus
caaagctaccgcgaccgggaaggag

SEQ ID NO: 392551 - DNA, 25 bp, Mus musculus
cctgtcaaagctaccgcgaccggga

SEQ ID NO: 392552 - DNA, 25 bp, Mus musculus
tcctgtcaaagctaccgcgaccggg

SEQ ID NO: 392553 - DNA, 25 bp, Mus musculus
ccgccatcgcgtcctgtcaaagcta

SEQ ID NO: 392554 - DNA, 25 bp, Mus musculus
taggggtatcgtcctgttctccgac

SEQ ID NO: 392555 - DNA, 25 bp, Mus musculus
agcggtgacgtcagtgaggcgacgc

SEQ ID NO: 392556 - DNA, 25 bp, Mus musculus
gagccatggctccttcctatttgtg

SEQ ID NO: 392557 - DNA, 25 bp, Mus musculus
cacaccctggtgtgaagtctcggga

SEQ ID NO: 392558 - DNA, 25 bp, Mus musculus
gtctcgggaacgtaggctgcatccc

SEQ ID NO: 392559 - DNA, 25 bp, Mus musculus
cgcgcagcacggctagctattgttc

SEQ ID NO: 392560 - DNA, 25 bp, Mus musculus
cgtgcgtttttgagaccatggagtc

SEQ ID NO: 392561 - DNA, 25 bp, Mus musculus
accatggagtctaggcctcaggaga

SEQ ID NO: 392562 - DNA, 25 bp, Mus musculus
cgaggtgaccaacgacaacgagggc

SEQ ID NO: 392563 - DNA, 25 bp, Mus musculus
tctataagtaaacagtgcgcgccgc

SEQ ID NO: 392564 - DNA, 25 bp, Mus musculus
tcgcgcggtctaagagcgtcagtcc

SEQ ID NO: 392565 - DNA, 25 bp, Mus musculus
agacgcgcaccatcgaggacgtttc

SEQ ID NO: 392566 - DNA, 25 bp, Mus musculus
agcgcctgttctaccggggcaagca

SEQ ID NO: 392567 - DNA, 25 bp, Mus musculus
cgctcttcgatgtaaggcccgagtg

SEQ ID NO: 392568 - DNA, 25 bp, Mus musculus
ggacgtttctcgcaaagccaccatc

SEQ ID NO: 392569 - DNA, 25 bp, Mus musculus
acctccatgtgggagctgcatctct

SEQ ID NO: 392570 - DNA, 25 bp, Mus musculus
ccactgcgggcaatgaatgggtaca

SEQ ID NO: 392571 - DNA, 25 bp, Mus musculus
cttcccgaccactgcgggcaatgaa

SEQ ID NO: 392572 - DNA, 25 bp, Mus musculus
gcgaactgcactaactcttgcaaag

SEQ ID NO: 392573 - DNA, 25 bp, Mus musculus
tctccgggagaagtcatcgtgtctg

SEQ ID NO: 392574 - DNA, 25 bp, Mus musculus
agcccacgagggtcagcagcgcttt

SEQ ID NO: 392575 - DNA, 25 bp, Mus musculus
gccgatgtgtctccgggagaagtca

SEQ ID NO: 392576 - DNA, 25 bp, Mus musculus
cggtctttgtctccggggccgatgt

SEQ ID NO: 392577 - DNA, 25 bp, Mus musculus
tgggtacagcgaactgcactaactc

SEQ ID NO: 392578 - DNA, 25 bp, Mus musculus
cgattaagagcgagctcgctttcaa

SEQ ID NO: 392579 - DNA, 25 bp, Mus musculus
tgcaaagttcctccgcctcagcagg

SEQ ID NO: 392580 - DNA, 25 bp, Mus musculus
cgcacactttaagcggcgcccgaag

SEQ ID NO: 392581 - DNA, 25 bp, Mus musculus
cgagctcgctttcaagctggggccc

SEQ ID NO: 392582 - DNA, 25 bp, Mus musculus
tgcagcatctccctccggtctttgt

SEQ ID NO: 392583 - DNA, 25 bp, Mus musculus
gcacacagctgcatggacgccgtca

SEQ ID NO: 392584 - DNA, 25 bp, Mus musculus
cggtgcgaggctgccatggccggtt

SEQ ID NO: 392585 - DNA, 25 bp, Mus musculus
ccggtgcgaggctgccatggccggt

SEQ ID NO: 392586 - DNA, 25 bp, Mus musculus
gtgcgaggctgccatggccggttgc

SEQ ID NO: 392587 - DNA, 25 bp, Mus musculus
tgcgaggctgccatggccggttgct

SEQ ID NO: 392588 - DNA, 25 bp, Mus musculus
gcgaggctgccatggccggttgctc

SEQ ID NO: 392589 - DNA, 25 bp, Mus musculus
ccggcctagtgtgtggggcaattta

SEQ ID NO: 392590 - DNA, 25 bp, Mus musculus
cggcctagtgtgtggggcaatttaa

SEQ ID NO: 392591 - DNA, 25 bp, Mus musculus
ggcctagtgtgtggggcaatttaag

SEQ ID NO: 392592 - DNA, 25 bp, Mus musculus
gcctagtgtgtggggcaatttaaga

SEQ ID NO: 392593 - DNA, 25 bp, Mus musculus
cctagtgtgtggggcaatttaagaa

SEQ ID NO: 392594 - DNA, 25 bp, Mus musculus
ctagtgtgtggggcaatttaagaag

SEQ ID NO: 392595 - DNA, 25 bp, Mus musculus
tagtgtgtggggcaatttaagaagg

SEQ ID NO: 392596 - DNA, 25 bp, Mus musculus
tgtgtggggcaatttaagaaggaaa

SEQ ID NO: 392597 - DNA, 25 bp, Mus musculus
gggccggtgcgaggctgccatggcc

SEQ ID NO: 392598 - DNA, 25 bp, Mus musculus
cagttcctcttccacgatcgggcgg

SEQ ID NO: 392599 - DNA, 25 bp, Mus musculus
agttcctcttccacgatcgggcggg

SEQ ID NO: 392600 - DNA, 25 bp, Mus musculus
agccgcagaggtcttgttcttcagg

SEQ ID NO: 392601 - DNA, 25 bp, Mus musculus
gccgcagaggtcttgttcttcagga

SEQ ID NO: 392602 - DNA, 25 bp, Mus musculus
ccgcagaggtcttgttcttcaggat

SEQ ID NO: 392603 - DNA, 25 bp, Mus musculus
cgcagaggtcttgttcttcaggatt

SEQ ID NO: 392604 - DNA, 25 bp, Mus musculus
cagaggtcttgttcttcaggattcc

SEQ ID NO: 392605 - DNA, 25 bp, Mus musculus
cggaggagaagggatgggcgctgca

SEQ ID NO: 392606 - DNA, 25 bp, Mus musculus
aggagaagggatgggcgctgcagag

SEQ ID NO: 392607 - DNA, 25 bp, Mus musculus
gcgctgcagagaccctccaggcagc

SEQ ID NO: 392608 - DNA, 25 bp, Mus musculus
cgctgcagagaccctccaggcagcc

SEQ ID NO: 392609 - DNA, 25 bp, Mus musculus
gagcccaggccaggctaaagcagcc

SEQ ID NO: 392610 - DNA, 25 bp, Mus musculus
gcagaggtcttgttcttcaggattc

SEQ ID NO: 392611 - DNA, 25 bp, Mus musculus
tcagttcctcttccacgatcgggcg

SEQ ID NO: 392612 - DNA, 25 bp, Mus musculus
ccgccggtggaacgcaatgaaaaca

SEQ ID NO: 392613 - DNA, 25 bp, Mus musculus
aatcatgtcgagtttggcggtcaga

SEQ ID NO: 392614 - DNA, 25 bp, Mus musculus
tgtcctctcggcagcaatcatgtcg

SEQ ID NO: 392615 - DNA, 25 bp, Mus musculus
ggacgacccttagacgaattcaatc

SEQ ID NO: 392616 - DNA, 25 bp, Mus musculus
gagcttgctatctgcttccgttaca

SEQ ID NO: 392617 - DNA, 25 bp, Mus musculus
aaaggtttctgtccggagcttgcta

SEQ ID NO: 392618 - DNA, 25 bp, Mus musculus
tgcggcctaacggaactacagattc

SEQ ID NO: 392619 - DNA, 25 bp, Mus musculus
tccggtctcaggaagcagtgtctgc

SEQ ID NO: 392620 - DNA, 25 bp, Mus musculus
tgtcagtaagtaggcgcggacaacc

SEQ ID NO: 392621 - DNA, 25 bp, Mus musculus
accatggaacggaatcctgttgtca

SEQ ID NO: 392622 - DNA, 25 bp, Mus musculus
ggaaaactcgaccaataggaccatg

SEQ ID NO: 392623 - DNA, 25 bp, Mus musculus
agcccgatcggccatttttaatgag

SEQ ID NO: 392624 - DNA, 25 bp, Mus musculus
agccatggatcgatcgctgcgttcg

SEQ ID NO: 392625 - DNA, 25 bp, Mus musculus
aggtcagtcgtagtgcatcctgtgc

SEQ ID NO: 392626 - DNA, 25 bp, Mus musculus
tgtccagttcgttctgcagcttctg

SEQ ID NO: 392627 - DNA, 25 bp, Mus musculus
tgagcaaaacaggtccagcccagga

SEQ ID NO: 392628 - DNA, 25 bp, Mus musculus
tctccgggtttagggatgagcaaaa

SEQ ID NO: 392629 - DNA, 25 bp, Mus musculus
gccgctccagccacagagagtttca

SEQ ID NO: 392630 - DNA, 25 bp, Mus musculus
agcttccctcgacttgagaccaaag

SEQ ID NO: 392631 - DNA, 25 bp, Mus musculus
ctgcctcgcgagtgcaaaagcttcc

SEQ ID NO: 392632 - DNA, 25 bp, Mus musculus
tctcctggagcgcatactgtaaatc

SEQ ID NO: 392633 - DNA, 25 bp, Mus musculus
taaccctgcttactgtgggctcttg

SEQ ID NO: 392634 - DNA, 25 bp, Mus musculus
cagcttctggatcagttcgtccttc

SEQ ID NO: 392635 - DNA, 25 bp, Mus musculus
gccggatcaccgagcgatacttgtc

SEQ ID NO: 392636 - DNA, 25 bp, Mus musculus
gtgccaaaggaagccagcgatgtgt

SEQ ID NO: 392637 - DNA, 25 bp, Mus musculus
ctgtaaatcccgcagggtgcccatg

SEQ ID NO: 392638 - DNA, 25 bp, Mus musculus
atcgatgagagcatcccgctgcctc

SEQ ID NO: 392639 - DNA, 25 bp, Mus musculus
tcagctcctcgatcttctcctggag

SEQ ID NO: 392640 - DNA, 25 bp, Mus musculus
ttctgccgccgaggtcgcctggcgg

SEQ ID NO: 392641 - DNA, 25 bp, Mus musculus
tggtggtgatccatcctgcccgcct

SEQ ID NO: 392642 - DNA, 25 bp, Mus musculus
tcaccacctggtagcgaccagtccc

SEQ ID NO: 392643 - DNA, 25 bp, Mus musculus
gtgatccatcctgcccgcctcgggg

SEQ ID NO: 392644 - DNA, 25 bp, Mus musculus
ccgcctcgggttctgccgccgaggt

SEQ ID NO: 392645 - DNA, 25 bp, Mus musculus
catgctctctggctccgccggcgtc

SEQ ID NO: 392646 - DNA, 25 bp, Mus musculus
ggccgcttcacttcctgtcgctccc

SEQ ID NO: 392647 - DNA, 25 bp, Mus musculus
tcggctccagcggagagctccgcgt

SEQ ID NO: 392648 - DNA, 25 bp, Mus musculus
cagcggagagctccgcgtcgctcgc

SEQ ID NO: 392649 - DNA, 25 bp, Mus musculus
tcgctcgccgatcggcgccggagct

SEQ ID NO: 392650 - DNA, 25 bp, Mus musculus
atgctcggcgcggacgcgcatgctc

SEQ ID NO: 392651 - DNA, 25 bp, Mus musculus
gcgcggacgcgcatgctctctggct

SEQ ID NO: 392652 - DNA, 25 bp, Mus musculus
ccggcgtcccatccgccgcccggct

SEQ ID NO: 392653 - DNA, 25 bp, Mus musculus
tccggcttccgagcgggcgtgtccc

SEQ ID NO: 392654 - DNA, 25 bp, Mus musculus
agggctagagccctcttggcaaagc

SEQ ID NO: 392655 - DNA, 25 bp, Mus musculus
ttggcaaagcttactctccagacca

SEQ ID NO: 392656 - DNA, 25 bp, Mus musculus
aactctgtccctaaactgaactcga

SEQ ID NO: 392657 - DNA, 25 bp, Mus musculus
gtcgcctctgcgaagctgtccaggc

SEQ ID NO: 392658 - DNA, 25 bp, Mus musculus
caggcccgcggacggtcagagttct

SEQ ID NO: 392659 - DNA, 25 bp, Mus musculus
gagtgcggggtagcaaactttccgc

SEQ ID NO: 392660 - DNA, 25 bp, Mus musculus
acgccacaggggtgcgtctctgcga

SEQ ID NO: 392661 - DNA, 25 bp, Mus musculus
ccgccagagacaactacagcacgtg

SEQ ID NO: 392662 - DNA, 25 bp, Mus musculus
ctacagcacgtgatgcacagaaaca

SEQ ID NO: 392663 - DNA, 25 bp, Mus musculus
gccctgagcctacctctcggattta

SEQ ID NO: 392664 - DNA, 25 bp, Mus musculus
ctacctctcggatttagtgaacttc

SEQ ID NO: 392665 - DNA, 25 bp, Mus musculus
agtgaacttccggaacgcctggcgc

SEQ ID NO: 392666 - DNA, 25 bp, Mus musculus
tctgcgaagtgctcgcctttcccag

SEQ ID NO: 392667 - DNA, 25 bp, Mus musculus
acctgtaggtctgcggctccgcgga

SEQ ID NO: 392668 - DNA, 25 bp, Mus musculus
ggcagccgccggaattctttccacg

SEQ ID NO: 392669 - DNA, 25 bp, Mus musculus
cccaaatcaggggtctgcaggcttc

SEQ ID NO: 392670 - DNA, 25 bp, Mus musculus
cgggacatttttccgaagctctaat

SEQ ID NO: 392671 - DNA, 25 bp, Mus musculus
tggatgaacctcaaactcttcggga

SEQ ID NO: 392672 - DNA, 25 bp, Mus musculus
tgcgacacttgtgactcccttatga

SEQ ID NO: 392673 - DNA, 25 bp, Mus musculus
ctgttggcgaactacactggcattt

SEQ ID NO: 392674 - DNA, 25 bp, Mus musculus
gttggggacacaaactcagccttgg

SEQ ID NO: 392675 - DNA, 25 bp, Mus musculus
agccctattaggagccagcccgaga

SEQ ID NO: 392676 - DNA, 25 bp, Mus musculus
tcctccgggatcagaagccctatta

SEQ ID NO: 392677 - DNA, 25 bp, Mus musculus
gcgagaaggcttctgacttggaacc

SEQ ID NO: 392678 - DNA, 25 bp, Mus musculus
agactcgggtcagatccagccgctc

SEQ ID NO: 392679 - DNA, 25 bp, Mus musculus
ccagcccgagagttgtgcggcaaaa

SEQ ID NO: 392680 - DNA, 25 bp, Mus musculus
actggagatgcggttccctttcgcc

SEQ ID NO: 392681 - DNA, 25 bp, Mus musculus
tcagccttggtgaaactacctacgg

SEQ ID NO: 392682 - DNA, 25 bp, Mus musculus
ggaggtttccgcctctccacttgtc

SEQ ID NO: 392683 - DNA, 25 bp, Mus musculus
gacagtcgcccacgctccgggtcaa

SEQ ID NO: 392684 - DNA, 25 bp, Mus musculus
tgtcacacgctcgtcggaggtttcc

SEQ ID NO: 392685 - DNA, 25 bp, Mus musculus
ttgtccacaccgaagctccgagacg

SEQ ID NO: 392686 - DNA, 25 bp, Mus musculus
cgaagctccgagacgatcggccaca

SEQ ID NO: 392687 - DNA, 25 bp, Mus musculus
atcggccacactcgctcggtgacag

SEQ ID NO: 392688 - DNA, 25 bp, Mus musculus
acactcgctcggtgacagcaccgga

SEQ ID NO: 392689 - DNA, 25 bp, Mus musculus
tgacagcaccggagaccacgcttgc

SEQ ID NO: 392690 - DNA, 25 bp, Mus musculus
ccggagaccacgcttgccttctgag

SEQ ID NO: 392691 - DNA, 25 bp, Mus musculus
cacgcttgccttctgaggttcccgg

SEQ ID NO: 392692 - DNA, 25 bp, Mus musculus
gctgcggcgctgctctcgtcgttcg

SEQ ID NO: 392693 - DNA, 25 bp, Mus musculus
gacgtctcaggtgacagcgcgctcc

SEQ ID NO: 392694 - DNA, 25 bp, Mus musculus
cttccctagactgcggactccctca

SEQ ID NO: 392695 - DNA, 25 bp, Mus musculus
tccgggtcaactgacgccggctcca

SEQ ID NO: 392696 - DNA, 25 bp, Mus musculus
agacacgggtgtcccgggacctgca

SEQ ID NO: 392697 - DNA, 25 bp, Mus musculus
agagcctctcgctgtacggtgccac

SEQ ID NO: 392698 - DNA, 25 bp, Mus musculus
tgcgaaggacccgataggaaagtcc

SEQ ID NO: 392699 - DNA, 25 bp, Mus musculus
ataggaaagtcccttctccctccag

SEQ ID NO: 392700 - DNA, 25 bp, Mus musculus
cgggctctgtcacaaccgcagcatg

SEQ ID NO: 392701 - DNA, 25 bp, Mus musculus
cttctcgagtttgcgaaggacccga

SEQ ID NO: 392702 - DNA, 25 bp, Mus musculus
atccttaggggtcctgcccgcctga

SEQ ID NO: 392703 - DNA, 25 bp, Mus musculus
gacgtgtctgaggagcctttttata

SEQ ID NO: 392704 - DNA, 25 bp, Mus musculus
cagaagacggtaggctgccagccac

SEQ ID NO: 392705 - DNA, 25 bp, Mus musculus
ctgtcacaaccgcagcatgtcgggg

SEQ ID NO: 392706 - DNA, 25 bp, Mus musculus
ccgagggcagaacgtgtgtcagtca

SEQ ID NO: 392707 - DNA, 25 bp, Mus musculus
gtgtgtcagtcaggctcgtcctgga

SEQ ID NO: 392708 - DNA, 25 bp, Mus musculus
ctcgtcctggacctgagctggcgga

SEQ ID NO: 392709 - DNA, 25 bp, Mus musculus
tgccactgggaacctccgatcctta

SEQ ID NO: 392710 - DNA, 25 bp, Mus musculus
accgcagctgttccctgtcagtgga

SEQ ID NO: 392711 - DNA, 25 bp, Mus musculus
gatagggccagtcatccaatctttg

SEQ ID NO: 392712 - DNA, 25 bp, Mus musculus
cccacgtgaggctttcaagaaaaga

SEQ ID NO: 392713 - DNA, 25 bp, Mus musculus
caatcaggatgagcttccagccgga

SEQ ID NO: 392714 - DNA, 25 bp, Mus musculus
gagacacgtgctacccgagtgaatg

SEQ ID NO: 392715 - DNA, 25 bp, Mus musculus
gcgacctcttctgtatctgctaaag

SEQ ID NO: 392716 - DNA, 25 bp, Mus musculus
tcctcgtgtccttagctaacgcttc

SEQ ID NO: 392717 - DNA, 25 bp, Mus musculus
tactcttcctggtgcaagtcgctgc

SEQ ID NO: 392718 - DNA, 25 bp, Mus musculus
cggagcatccttcaggcgcaggcaa

SEQ ID NO: 392719 - DNA, 25 bp, Mus musculus
ctctggcggcccacattggccttaa

SEQ ID NO: 392720 - DNA, 25 bp, Mus musculus
cttgcgggcccattttcgagataga

SEQ ID NO: 392721 - DNA, 25 bp, Mus musculus
ttcgagatagagaaactgacgcttc

SEQ ID NO: 392722 - DNA, 25 bp, Mus musculus
gccctaaagtgcttcgcgccagctt

SEQ ID NO: 392723 - DNA, 25 bp, Mus musculus
gttgggctgtctccaccaatggaaa

SEQ ID NO: 392724 - DNA, 25 bp, Mus musculus
cttacaagcctagccctgaggtcgc

SEQ ID NO: 392725 - DNA, 25 bp, Mus musculus
ccagccaaggcatggcgacgcagtg

SEQ ID NO: 392726 - DNA, 25 bp, Mus musculus
gccttcttacaagcctagccctgag

SEQ ID NO: 392727 - DNA, 25 bp, Mus musculus
gaccaggccgcctacaagagatgtc

SEQ ID NO: 392728 - DNA, 25 bp, Mus musculus
gacgcccttggaggttaatccgctg

SEQ ID NO: 392729 - DNA, 25 bp, Mus musculus
ccttggaggttaatccgctggatcc

SEQ ID NO: 392730 - DNA, 25 bp, Mus musculus
ctcaagtgtgaccgacgcggaggca

SEQ ID NO: 392731 - DNA, 25 bp, Mus musculus
cgggaacccgctactcacccagagg

SEQ ID NO: 392732 - DNA, 25 bp, Mus musculus
cccagaggcaggaccagagacgatg

SEQ ID NO: 392733 - DNA, 25 bp, Mus musculus
agcccggcctcgcacaggaaagaaa

SEQ ID NO: 392734 - DNA, 25 bp, Mus musculus
ctcgcacaggaaagaaacgcggccg

SEQ ID NO: 392735 - DNA, 25 bp, Mus musculus
cggagcatgcgcgatccctgccgag

SEQ ID NO: 392736 - DNA, 25 bp, Mus musculus
acaagagatgtccttgcgggcagcc

SEQ ID NO: 392737 - DNA, 25 bp, Mus musculus
atgcgcgatccctgccgagccggtg

SEQ ID NO: 392738 - DNA, 25 bp, Mus musculus
tgcaatctgaccacagcgcagggca

SEQ ID NO: 392739 - DNA, 25 bp, Mus musculus
cttggctgtgatccggtagacccac

SEQ ID NO: 392740 - DNA, 25 bp, Mus musculus
actctattcacggagacccactttg

SEQ ID NO: 392741 - DNA, 25 bp, Mus musculus
cactttgtccaaccaggggtgtcct

SEQ ID NO: 392742 - DNA, 25 bp, Mus musculus
gcacaatcatcatgcttggctggga

SEQ ID NO: 392743 - DNA, 25 bp, Mus musculus
ggagcgttcatctttcgggcaaatg

SEQ ID NO: 392744 - DNA, 25 bp, Mus musculus
ctttgtgcaaagactgacaccttga

SEQ ID NO: 392745 - DNA, 25 bp, Mus musculus
tgttatctaggtaaagactgtcgcc

SEQ ID NO: 392746 - DNA, 25 bp, Mus musculus
agcgattgtgctcagcgcaccctca

SEQ ID NO: 392747 - DNA, 25 bp, Mus musculus
cagcctgttgtacctttgccgggtc

SEQ ID NO: 392748 - DNA, 25 bp, Mus musculus
actctttgtgcactgcggcaggata

SEQ ID NO: 392749 - DNA, 25 bp, Mus musculus
tagtgcgatccacctgtgagcggtc

SEQ ID NO: 392750 - DNA, 25 bp, Mus musculus
gtctctctgcgctgaggccaaagcc

SEQ ID NO: 392751 - DNA, 25 bp, Mus musculus
gccgacaaatcctagcgaagcactg

SEQ ID NO: 392752 - DNA, 25 bp, Mus musculus
gcctgttacgctctggctgtcctaa

SEQ ID NO: 392753 - DNA, 25 bp, Mus musculus
tcacgtgacagctctcacacggaga

SEQ ID NO: 392754 - DNA, 25 bp, Mus musculus
gactgggattttctctcagagcgac

SEQ ID NO: 392755 - DNA, 25 bp, Mus musculus
ttttctctcagagcgactgggtggc

SEQ ID NO: 392756 - DNA, 25 bp, Mus musculus
tggcccgcctacttcaccgaggaga

SEQ ID NO: 392757 - DNA, 25 bp, Mus musculus
cttcaccgaggagaggcctgttacg

SEQ ID NO: 392758 - DNA, 25 bp, Mus musculus
gctgtcctaacaactcacctatatc

SEQ ID NO: 392759 - DNA, 25 bp, Mus musculus
ggcggttatttccttcctcagcagc

SEQ ID NO: 392760 - DNA, 25 bp, Mus musculus
ggtgccctgcgcgagacgtctgctc

SEQ ID NO: 392761 - DNA, 25 bp, Mus musculus
tgcccttcggctaggccgctgacag

SEQ ID NO: 392762 - DNA, 25 bp, Mus musculus
gcagcagcctccagtcacgtgacag

SEQ ID NO: 392763 - DNA, 25 bp, Mus musculus
gccgctgacagagacgcggagcctc

SEQ ID NO: 392764 - DNA, 25 bp, Mus musculus
agcgcggcacacagacttccggtta

SEQ ID NO: 392765 - DNA, 25 bp, Mus musculus
gaacccacaggggtgactgaggccc

SEQ ID NO: 392766 - DNA, 25 bp, Mus musculus
ttcctggtctcttggccctggggcg

SEQ ID NO: 392767 - DNA, 25 bp, Mus musculus
cagggacagtcgtcgcagtcgtcat

SEQ ID NO: 392768 - DNA, 25 bp, Mus musculus
agaggccacacggatgcccgagcca

SEQ ID NO: 392769 - DNA, 25 bp, Mus musculus
ctgcagaggccacacggatgcccga

SEQ ID NO: 392770 - DNA, 25 bp, Mus musculus
caccaagcgccggtgccttgcggag

SEQ ID NO: 392771 - DNA, 25 bp, Mus musculus
gtcgtcatcccacacaagctccgga

SEQ ID NO: 392772 - DNA, 25 bp, Mus musculus
acgactgctggtgagtggccccaca

SEQ ID NO: 392773 - DNA, 25 bp, Mus musculus
tggtgatgacgagtggcttcctgtc

SEQ ID NO: 392774 - DNA, 25 bp, Mus musculus
gatgacgagtggcttcctgtcgccc

SEQ ID NO: 392775 - DNA, 25 bp, Mus musculus
cctatcccgctctagggttagcttc

SEQ ID NO: 392776 - DNA, 25 bp, Mus musculus
gacagtcgtcgcagtcgtcatccca

SEQ ID NO: 392777 - DNA, 25 bp, Mus musculus
gggttagcttcttctcgcccaggaa

SEQ ID NO: 392778 - DNA, 25 bp, Mus musculus
ttagcttcttctcgcccaggaaggc

SEQ ID NO: 392779 - DNA, 25 bp, Mus musculus
ctgtggttcctggtctcttggccct

SEQ ID NO: 392780 - DNA, 25 bp, Mus musculus
tcatgtattgggtcgccagcgcgaa

SEQ ID NO: 392781 - DNA, 25 bp, Mus musculus
cgcatcgctctctggagttcacgca

SEQ ID NO: 392782 - DNA, 25 bp, Mus musculus
gagtgcccagcattttgtcccagtg

SEQ ID NO: 392783 - DNA, 25 bp, Mus musculus
gtaccagccaaagggcacaagtctg

SEQ ID NO: 392784 - DNA, 25 bp, Mus musculus
aagtcatagcccgagtggtcctcca

SEQ ID NO: 392785 - DNA, 25 bp, Mus musculus
ccgggaacacgaacaccaggtgctg

SEQ ID NO: 392786 - DNA, 25 bp, Mus musculus
gcagaagcccacgtaagtgatgata

SEQ ID NO: 392787 - DNA, 25 bp, Mus musculus
aggacgtccagcaccacgaacggta

SEQ ID NO: 392788 - DNA, 25 bp, Mus musculus
ctgctttacggaaggcgagaagtcc

SEQ ID NO: 392789 - DNA, 25 bp, Mus musculus
cacgcgaagatctcggtgtcgaaga

SEQ ID NO: 392790 - DNA, 25 bp, Mus musculus
gcagctcccagaagctcatgtattg

SEQ ID NO: 392791 - DNA, 25 bp, Mus musculus
acgttcagcacgtcgaagaaggtca

SEQ ID NO: 392792 - DNA, 25 bp, Mus musculus
gtgacaccgaagcaccgcgacgttc

SEQ ID NO: 392793 - DNA, 25 bp, Mus musculus
ggtcctccaccgacagccagatgtt

SEQ ID NO: 392794 - DNA, 25 bp, Mus musculus
accatgcacggaggctaagcgcata

SEQ ID NO: 392795 - DNA, 25 bp, Mus musculus
agctccgggagtcaagaggatcaga

SEQ ID NO: 392796 - DNA, 25 bp, Mus musculus
gcacgggcactctctcgggaaaaca

SEQ ID NO: 392797 - DNA, 25 bp, Mus musculus
ctcgggaaaacacgctctggatcgc

SEQ ID NO: 392798 - DNA, 25 bp, Mus musculus
tgcccttccctcagacctgtagggt

SEQ ID NO: 392799 - DNA, 25 bp, Mus musculus
cctgtagggtcaaggctgcgcttca

SEQ ID NO: 392800 - DNA, 25 bp, Mus musculus
aggtctggcttccagcgaacctgga

SEQ ID NO: 392801 - DNA, 25 bp, Mus musculus
ctggagcacaataggtgacgcggcc

SEQ ID NO: 392802 - DNA, 25 bp, Mus musculus
tcacccggctccaaggtgcagagca

SEQ ID NO: 392803 - DNA, 25 bp, Mus musculus
tgcagctgcgcttcttgagcacatt

SEQ ID NO: 392804 - DNA, 25 bp, Mus musculus
acattgctcaggatggtgcccacgc

SEQ ID NO: 392805 - DNA, 25 bp, Mus musculus
ggtcagtttgtcttgccgcatccga

SEQ ID NO: 392806 - DNA, 25 bp, Mus musculus
aatgactcctcacgcagggctcggc

SEQ ID NO: 392807 - DNA, 25 bp, Mus musculus
agcggtgctcggcagacacctgcac

SEQ ID NO: 392808 - DNA, 25 bp, Mus musculus
gcccgccggacactgtcactaggga

SEQ ID NO: 392809 - DNA, 25 bp, Mus musculus
atgtaatgcttaggcccgcgagtcg

SEQ ID NO: 392810 - DNA, 25 bp, Mus musculus
gcgcctccaggttatgtaatgctta

SEQ ID NO: 392811 - DNA, 25 bp, Mus musculus
aagcaaagctctcagtcaccgcagc

SEQ ID NO: 392812 - DNA, 25 bp, Mus musculus
cgggacccacgggtgctcacctcgc

SEQ ID NO: 392813 - DNA, 25 bp, Mus musculus
cttcccacggctctggagtccggtc

SEQ ID NO: 392814 - DNA, 25 bp, Mus musculus
cgggacagcgccgattccggcgtgc

SEQ ID NO: 392815 - DNA, 25 bp, Mus musculus
gccggacactgtcactagggagatc

SEQ ID NO: 392816 - DNA, 25 bp, Mus musculus
gacactgtcactagggagatcccac

SEQ ID NO: 392817 - DNA, 25 bp, Mus musculus
ctccaggttatgtaatgcttaggcc

SEQ ID NO: 392818 - DNA, 25 bp, Mus musculus
ggttatgtaatgcttaggcccgcga

SEQ ID NO: 392819 - DNA, 25 bp, Mus musculus
actgtcactagggagatcccaccgc

SEQ ID NO: 392820 - DNA, 25 bp, Mus musculus
agaagcaaagctctcagtcaccgca

SEQ ID NO: 392821 - DNA, 25 bp, Mus musculus
acctcgcggggacagctgcaacgct

SEQ ID NO: 392822 - DNA, 25 bp, Mus musculus
ccggagaatcatgctgggcgaacag

SEQ ID NO: 392823 - DNA, 25 bp, Mus musculus
tcccaaggccgagccacttcaaatg

SEQ ID NO: 392824 - DNA, 25 bp, Mus musculus
atcttccgatccaccctggggcttg

SEQ ID NO: 392825 - DNA, 25 bp, Mus musculus
aagccgttgtgcagcagcccgttca

SEQ ID NO: 392826 - DNA, 25 bp, Mus musculus
accgccaccgacgagtttcaacgtg

SEQ ID NO: 392827 - DNA, 25 bp, Mus musculus
gccggcatttcttggccggagaatc

SEQ ID NO: 392828 - DNA, 25 bp, Mus musculus
aggacgcagtccagagcggcactct

SEQ ID NO: 392829 - DNA, 25 bp, Mus musculus
acccagtaggcggatcggactagac

SEQ ID NO: 392830 - DNA, 25 bp, Mus musculus
cagctagtgtctgaccgacccagta

SEQ ID NO: 392831 - DNA, 25 bp, Mus musculus
aataacagcgggcagtgcgttctcc

SEQ ID NO: 392832 - DNA, 25 bp, Mus musculus
cggcaggacttacgcggcctgttct

SEQ ID NO: 392833 - DNA, 25 bp, Mus musculus
tgcgttctcccagccgctacggtga

SEQ ID NO: 392834 - DNA, 25 bp, Mus musculus
atcggactagacaggcgccaccgcg

SEQ ID NO: 392835 - DNA, 25 bp, Mus musculus
tttcaacgtgcggaatgaagttctc

SEQ ID NO: 392836 - DNA, 25 bp, Mus musculus
tcgttagggtcaaacctaatatggc

SEQ ID NO: 392837 - DNA, 25 bp, Mus musculus
ctcgtgatgcccgtagtctaggtgc

SEQ ID NO: 392838 - DNA, 25 bp, Mus musculus
acgcctcggccgtgtcagcgttgtc

SEQ ID NO: 392839 - DNA, 25 bp, Mus musculus
agagggcacgaagctgcgacgcctc

SEQ ID NO: 392840 - DNA, 25 bp, Mus musculus
tggctgcttgcacagagggcacgaa

SEQ ID NO: 392841 - DNA, 25 bp, Mus musculus
cagtaagtgaggagctgacgatttt

SEQ ID NO: 392842 - DNA, 25 bp, Mus musculus
cagggaccagcgattgcagtaagtg

SEQ ID NO: 392843 - DNA, 25 bp, Mus musculus
cgccgagccgccattgtttgaattt

SEQ ID NO: 392844 - DNA, 25 bp, Mus musculus
acagcggcctcagcaaggctcgtca

SEQ ID NO: 392845 - DNA, 25 bp, Mus musculus
catcatgcgggtctaggacggaacc

SEQ ID NO: 392846 - DNA, 25 bp, Mus musculus
cctgagtaccgaacaggtatcgtta

SEQ ID NO: 392847 - DNA, 25 bp, Mus musculus
ggacggaacctgagacctgagtacc

SEQ ID NO: 392848 - DNA, 25 bp, Mus musculus
gctaggtagcccacgagcgttgcta

SEQ ID NO: 392849 - DNA, 25 bp, Mus musculus
caaggctcgtcatcatgcgggtcta

SEQ ID NO: 392850 - DNA, 25 bp, Mus musculus
agggctggattcaccttgcccgctc

SEQ ID NO: 392851 - DNA, 25 bp, Mus musculus
gccgctgctgttaacgtccatcatc

SEQ ID NO: 392852 - DNA, 25 bp, Mus musculus
ggccgtgcagcacatgacgtccatg

SEQ ID NO: 392853 - DNA, 25 bp, Mus musculus
tcacgcacagggtcatgatcgaggc

SEQ ID NO: 392854 - DNA, 25 bp, Mus musculus
cctgtcccttacctgtcgatgctga

SEQ ID NO: 392855 - DNA, 25 bp, Mus musculus
atccaggagctcaccaccgagtggg

SEQ ID NO: 392856 - DNA, 25 bp, Mus musculus
caggatggagccgatcacaactttc

SEQ ID NO: 392857 - DNA, 25 bp, Mus musculus
atcgtcagcagcgtgatgagcgtca

SEQ ID NO: 392858 - DNA, 25 bp, Mus musculus
gctggcggagcttcttgacaaagca

SEQ ID NO: 392859 - DNA, 25 bp, Mus musculus
taacgaaaggcatgaccgccacggc

SEQ ID NO: 392860 - DNA, 25 bp, Mus musculus
ccgatgaggtccgtgacactaacga

SEQ ID NO: 392861 - DNA, 25 bp, Mus musculus
ttgcagaagaagtggccgaagatcc

SEQ ID NO: 392862 - DNA, 25 bp, Mus musculus
cgactctgccatagttgatctgctc

SEQ ID NO: 392863 - DNA, 25 bp, Mus musculus
tccatggcgatgaagacgttgcaga

SEQ ID NO: 392864 - DNA, 25 bp, Mus musculus
ggtcgcgtcggagccaaccttgctc

SEQ ID NO: 392865 - DNA, 25 bp, Mus musculus
tccgatgattcacgcgggctccaca

SEQ ID NO: 392866 - DNA, 25 bp, Mus musculus
gctccggagcggtgaatgaatcatc

SEQ ID NO: 392867 - DNA, 25 bp, Mus musculus
gccgtcatagtacgccgggaacgtg

SEQ ID NO: 392868 - DNA, 25 bp, Mus musculus
cgctgcaggcgtctgtactttgaaa

SEQ ID NO: 392869 - DNA, 25 bp, Mus musculus
ccggaacgtggcctcccgagagcta

SEQ ID NO: 392870 - DNA, 25 bp, Mus musculus
gctattatataagatgccacggaga

SEQ ID NO: 392871 - DNA, 25 bp, Mus musculus
ccctctcctggaagctgcgtgggga

SEQ ID NO: 392872 - DNA, 25 bp, Mus musculus
accggccaggatcgagcgcctttgc

SEQ ID NO: 392873 - DNA, 25 bp, Mus musculus
aagctgacgcagttggtgacgctcg

SEQ ID NO: 392874 - DNA, 25 bp, Mus musculus
cacggtgtttgaagaagctgacgca

SEQ ID NO: 392875 - DNA, 25 bp, Mus musculus
taaagcgtggccgatcttccgctgg

SEQ ID NO: 392876 - DNA, 25 bp, Mus musculus
cccgagagctaggtaagagcgatgc

SEQ ID NO: 392877 - DNA, 25 bp, Mus musculus
tattaaggaagctgcgtgtgcggcc

SEQ ID NO: 392878 - DNA, 25 bp, Mus musculus
agttgccggttctggccgacgccta

SEQ ID NO: 392879 - DNA, 25 bp, Mus musculus
ccgcctacagcgtgcacgtgttatc

SEQ ID NO: 392880 - DNA, 25 bp, Mus musculus
aacggtcgtccagcctctcagaagc

SEQ ID NO: 392881 - DNA, 25 bp, Mus musculus
cctctcagaagcaaggcgagctgga

SEQ ID NO: 392882 - DNA, 25 bp, Mus musculus
acggccgcgtcgtgtcgctgttctc

SEQ ID NO: 392883 - DNA, 25 bp, Mus musculus
gctgttctcgggtcccagtggccat

SEQ ID NO: 392884 - DNA, 25 bp, Mus musculus
ggacgcgctgctcggcgccatgact

SEQ ID NO: 392885 - DNA, 25 bp, Mus musculus
taacggtcaacggtcgtccagcctc

SEQ ID NO: 392886 - DNA, 25 bp, Mus musculus
cagcgtgcacgtgttatcgtcgtta

SEQ ID NO: 392887 - DNA, 25 bp, Mus musculus
cgtgatcccagtaagcgccagcagg

SEQ ID NO: 392888 - DNA, 25 bp, Mus musculus
aagcgcaggagtgcgcgtgatccca

SEQ ID NO: 392889 - DNA, 25 bp, Mus musculus
tcccagtggccatggaggacgcgct

SEQ ID NO: 392890 - DNA, 25 bp, Mus musculus
cgctgttgccgctaagcgcaggagt

SEQ ID NO: 392891 - DNA, 25 bp, Mus musculus
tgttatcgtcgttacttcccggtgc

SEQ ID NO: 392892 - DNA, 25 bp, Mus musculus
aggcctctttaccatctcccagaga

SEQ ID NO: 392893 - DNA, 25 bp, Mus musculus
tttctccgcgccgttcgcggtggcg

SEQ ID NO: 392894 - DNA, 25 bp, Mus musculus
agcatcctgcaaccgctcaggcggg

SEQ ID NO: 392895 - DNA, 25 bp, Mus musculus
cgcggctctgcagacaaccagacaa

SEQ ID NO: 392896 - DNA, 25 bp, Mus musculus
aaagcgccagctctaggcctcttta

SEQ ID NO: 392897 - DNA, 25 bp, Mus musculus
ctgaaggtcacaaccgttctgcatc

SEQ ID NO: 392898 - DNA, 25 bp, Mus musculus
cgttcgcagacacacactgaaggtc

SEQ ID NO: 392899 - DNA, 25 bp, Mus musculus
gcaaacccgcactgttactgggacc

SEQ ID NO: 392900 - DNA, 25 bp, Mus musculus
ggccgggtgcaaacccgcactgtta

SEQ ID NO: 392901 - DNA, 25 bp, Mus musculus
cccagagacgggtctttgtcacatg

SEQ ID NO: 392902 - DNA, 25 bp, Mus musculus
gctcacctggtgtccgtcgctcagg

SEQ ID NO: 392903 - DNA, 25 bp, Mus musculus
caaatccctggcgtggactgtggct

SEQ ID NO: 392904 - DNA, 25 bp, Mus musculus
ttgtcacatgtctctgggcaccctc

SEQ ID NO: 392905 - DNA, 25 bp, Mus musculus
cgaacacgcacgtggaaggtggacc

SEQ ID NO: 392906 - DNA, 25 bp, Mus musculus
gcttcctttccgtgtcggggtgaca

SEQ ID NO: 392907 - DNA, 25 bp, Mus musculus
taagtcctgggagcaagggaaagtc

SEQ ID NO: 392908 - DNA, 25 bp, Mus musculus
agcgctcacgtaagtcctgggagca

SEQ ID NO: 392909 - DNA, 25 bp, Mus musculus
tttgcctcgagcgagcgctcacgta

SEQ ID NO: 392910 - DNA, 25 bp, Mus musculus
tgggattgggactgcgtttcccacc

SEQ ID NO: 392911 - DNA, 25 bp, Mus musculus
gcaagcgctcgcttcctttccgtgt

SEQ ID NO: 392912 - DNA, 25 bp, Mus musculus
tgacgcggaaaagttgccgccggcc

SEQ ID NO: 392913 - DNA, 25 bp, Mus musculus
gacccgcgccggctgacgcggaaaa

SEQ ID NO: 392914 - DNA, 25 bp, Mus musculus
agccgagcacctgcccggcggtgaa

SEQ ID NO: 392915 - DNA, 25 bp, Mus musculus
cgcggagactcgtcctgtcccgtgg

SEQ ID NO: 392916 - DNA, 25 bp, Mus musculus
tctctttcgctttcccgggctcgga

SEQ ID NO: 392917 - DNA, 25 bp, Mus musculus
gcgggcgctgtttctctttcgcttt

SEQ ID NO: 392918 - DNA, 25 bp, Mus musculus
gccctatcgcgccagagccgagtgg

SEQ ID NO: 392919 - DNA, 25 bp, Mus musculus
tgcgtttcccaccggtttgcctcga

SEQ ID NO: 392920 - DNA, 25 bp, Mus musculus
gcgcgagtttaaaggtcaaaggcca

SEQ ID NO: 392921 - DNA, 25 bp, Mus musculus
acggtgtcgcattgtcctctcccga

SEQ ID NO: 392922 - DNA, 25 bp, Mus musculus
gaccctaagcgcttctcccgtagga

SEQ ID NO: 392923 - DNA, 25 bp, Mus musculus
cttctcccgtaggatgaggccagga

SEQ ID NO: 392924 - DNA, 25 bp, Mus musculus
ggacacggggaaagagttagtcata

SEQ ID NO: 392925 - DNA, 25 bp, Mus musculus
tagtcataaggatgctcaggtgagc

SEQ ID NO: 392926 - DNA, 25 bp, Mus musculus
agtccgcttcctgagcgcgagttta

SEQ ID NO: 392927 - DNA, 25 bp, Mus musculus
aaggccaccagctgggtcaaaggtc

SEQ ID NO: 392928 - DNA, 25 bp, Mus musculus
tgccactccaggtgaagggaaagcc

SEQ ID NO: 392929 - DNA, 25 bp, Mus musculus
agccagggttagaatccgtgtcaca

SEQ ID NO: 392930 - DNA, 25 bp, Mus musculus
cgtgtcacagcctttacaaggcctg

SEQ ID NO: 392931 - DNA, 25 bp, Mus musculus
ggacaacagggaagttgcgcctcga

SEQ ID NO: 392932 - DNA, 25 bp, Mus musculus
agggaccgcggctcagaaatggaaa

SEQ ID NO: 392933 - DNA, 25 bp, Mus musculus
ccgcccggccagacatgagtgaggc

SEQ ID NO: 392934 - DNA, 25 bp, Mus musculus
gagcaacttcgcactcagtacttaa

SEQ ID NO: 392935 - DNA, 25 bp, Mus musculus
agctggccttctgcagcttgtgcga

SEQ ID NO: 392936 - DNA, 25 bp, Mus musculus
tgcagcacgtagctcacggctcgca

SEQ ID NO: 392937 - DNA, 25 bp, Mus musculus
ggatccagccgtgttcccggagcct

SEQ ID NO: 392938 - DNA, 25 bp, Mus musculus
aaggcggccgtagagtccctgagcc

SEQ ID NO: 392939 - DNA, 25 bp, Mus musculus
ccctggaacgtgatcaccgcggggc

SEQ ID NO: 392940 - DNA, 25 bp, Mus musculus
caaccactgtgcagctggggcacga

SEQ ID NO: 392941 - DNA, 25 bp, Mus musculus
atcaaaggccgtgcgccctgaccaa

SEQ ID NO: 392942 - DNA, 25 bp, Mus musculus
agatcacgtgaaccggtccctccga

SEQ ID NO: 392943 - DNA, 25 bp, Mus musculus
gcttatcaaagccagatcacgtgaa

SEQ ID NO: 392944 - DNA, 25 bp, Mus musculus
caaccgggaggcagcttatcaaagc

SEQ ID NO: 392945 - DNA, 25 bp, Mus musculus
gccgactgaccgcaggcaaccggga

SEQ ID NO: 392946 - DNA, 25 bp, Mus musculus
agtacttaagaggatgcagcgccgc

SEQ ID NO: 392947 - DNA, 25 bp, Mus musculus
ctggcggggtcttctatggaaacgc

SEQ ID NO: 392948 - DNA, 25 bp, Mus musculus
tgtagagctcggtgagcaacccgct

SEQ ID NO: 392949 - DNA, 25 bp, Mus musculus
cggagttccggcttcacgtccgcgg

SEQ ID NO: 392950 - DNA, 25 bp, Mus musculus
gtcgaaatgccaaccaatgggcgga

SEQ ID NO: 392951 - DNA, 25 bp, Mus musculus
cccagcaggggtcgaaatgccaacc

SEQ ID NO: 392952 - DNA, 25 bp, Mus musculus
gaaggacctccatggctcgaaccgc

SEQ ID NO: 392953 - DNA, 25 bp, Mus musculus
ctgcccgctggaaggacctccatgg

SEQ ID NO: 392954 - DNA, 25 bp, Mus musculus
tgagcaacccgctcactagggacgc

SEQ ID NO: 392955 - DNA, 25 bp, Mus musculus
ctcctcggtgcagctgtagagctcg

SEQ ID NO: 392956 - DNA, 25 bp, Mus musculus
ggtggagctgtccaggctgtccctt

SEQ ID NO: 392957 - DNA, 25 bp, Mus musculus
aacccgaggtctcggtggagctgtc

SEQ ID NO: 392958 - DNA, 25 bp, Mus musculus
gcccaggaatgcgtcggaacccgag

SEQ ID NO: 392959 - DNA, 25 bp, Mus musculus
tcctgcagcactcgggagtcgccag

SEQ ID NO: 392960 - DNA, 25 bp, Mus musculus
tgcaggtactgcatctggagccgca

SEQ ID NO: 392961 - DNA, 25 bp, Mus musculus
tcctcggattgctgcgggtcccacg

SEQ ID NO: 392962 - DNA, 25 bp, Mus musculus
cggatcatgtctggccgccgctgcg

SEQ ID NO: 392963 - DNA, 25 bp, Mus musculus
cttgcccaaactggcccggccggag

SEQ ID NO: 392964 - DNA, 25 bp, Mus musculus
gcgctgccctgtctccgacctttcc

SEQ ID NO: 392965 - DNA, 25 bp, Mus musculus
tccacttcgccgcaggtaaacgcgg

SEQ ID NO: 392966 - DNA, 25 bp, Mus musculus
agaaggtgaacagccgcgacacggc

SEQ ID NO: 392967 - DNA, 25 bp, Mus musculus
tgacgcccgagaaggtgaacagccg

SEQ ID NO: 392968 - DNA, 25 bp, Mus musculus
cgagctgttcgaggcttgccgcaac

SEQ ID NO: 392969 - DNA, 25 bp, Mus musculus
tcaagaggctggtgacgcccgagaa

SEQ ID NO: 392970 - DNA, 25 bp, Mus musculus
cgggctcctgctgcctttgctggcg

SEQ ID NO: 392971 - DNA, 25 bp, Mus musculus
gaccgtgccgactctggtgacagcg

SEQ ID NO: 392972 - DNA, 25 bp, Mus musculus
acgcggccatgggaccgtgccgact

SEQ ID NO: 392973 - DNA, 25 bp, Mus musculus
caggagtggtctcggccgcttccgc

SEQ ID NO: 392974 - DNA, 25 bp, Mus musculus
gccctcctctctcggggctcgtgat

SEQ ID NO: 392975 - DNA, 25 bp, Mus musculus
cgagccgacgtcacgcgcgctccca

SEQ ID NO: 392976 - DNA, 25 bp, Mus musculus
acccgaccctttgagcgacggaatg

SEQ ID NO: 392977 - DNA, 25 bp, Mus musculus
cgagttacatttcggaagctgtcag

SEQ ID NO: 392978 - DNA, 25 bp, Mus musculus
tgtcagaatgcgagacgggacgacc

SEQ ID NO: 392979 - DNA, 25 bp, Mus musculus
acgggacgacctggcctgcagtacc

SEQ ID NO: 392980 - DNA, 25 bp, Mus musculus
ggcctgcagtaccacggtaactgtc

SEQ ID NO: 392981 - DNA, 25 bp, Mus musculus
gtttctaattgcagcgacgcccgta

SEQ ID NO: 392982 - DNA, 25 bp, Mus musculus
agcgacgcccgtagacttcttaatg

SEQ ID NO: 392983 - DNA, 25 bp, Mus musculus
gcccgtagacttcttaatgtccctg

SEQ ID NO: 392984 - DNA, 25 bp, Mus musculus
tgacccgccctgctgggacgagtcg

SEQ ID NO: 392985 - DNA, 25 bp, Mus musculus
taagcccacagggtcgcctgaatgg

SEQ ID NO: 392986 - DNA, 25 bp, Mus musculus
tggcccacgattaaccctgtgctcg

SEQ ID NO: 392987 - DNA, 25 bp, Mus musculus
cgattaaccctgtgctcgccggggc

SEQ ID NO: 392988 - DNA, 25 bp, Mus musculus
gggaaaaggcgctccagacacctga

SEQ ID NO: 392989 - DNA, 25 bp, Mus musculus
tgtccctgctttgtaagcccacagg

SEQ ID NO: 392990 - DNA, 25 bp, Mus musculus
cggtaggcgcaatgcagactcgccc

SEQ ID NO: 392991 - DNA, 25 bp, Mus musculus
aggctccggaactgggtctgagccc

SEQ ID NO: 392992 - DNA, 25 bp, Mus musculus
gcagccgagaggaggcagcctccca

SEQ ID NO: 392993 - DNA, 25 bp, Mus musculus
tgtccctcccggcagccgagaggag

SEQ ID NO: 392994 - DNA, 25 bp, Mus musculus
gactcacgaagcgaccggaggagcc

SEQ ID NO: 392995 - DNA, 25 bp, Mus musculus
acgcgtgctgctctggactcacgaa

SEQ ID NO: 392996 - DNA, 25 bp, Mus musculus
gcgggtaccaagagctgccagctgc

SEQ ID NO: 392997 - DNA, 25 bp, Mus musculus
agctgccagctgcacgcgtgctgct

SEQ ID NO: 392998 - DNA, 25 bp, Mus musculus
cagcagccgtctccagtagtgcgcg

SEQ ID NO: 392999 - DNA, 25 bp, Mus musculus
agccagccgtcttgcgggcgcacag

SEQ ID NO: 393000 - DNA, 25 bp, Mus musculus
ttggggaccgcaccgactgtcgcga

SEQ ID NO: 393001 - DNA, 25 bp, Mus musculus
ctagcaagggcttcttttccggctg

SEQ ID NO: 393002 - DNA, 25 bp, Mus musculus
cgagttggacttcactagcaagggc

SEQ ID NO: 393003 - DNA, 25 bp, Mus musculus
tcccgcccgagttggacttcactag

SEQ ID NO: 393004 - DNA, 25 bp, Mus musculus
tgtagctccctgagagttccgaacc

SEQ ID NO: 393005 - DNA, 25 bp, Mus musculus
tggttaaatgtgactcggcgcgttc

SEQ ID NO: 393006 - DNA, 25 bp, Mus musculus
gctacattccgctcgccggcaggga

SEQ ID NO: 393007 - DNA, 25 bp, Mus musculus
cttccggcgtgcagacgctaagtcc

SEQ ID NO: 393008 - DNA, 25 bp, Mus musculus
cagacgctaagtccggcgtgccggc

SEQ ID NO: 393009 - DNA, 25 bp, Mus musculus
ctccgcccgtgtgtgggaccctggt

SEQ ID NO: 393010 - DNA, 25 bp, Mus musculus
accctggtcgctgcggagacgagct

SEQ ID NO: 393011 - DNA, 25 bp, Mus musculus
ctctgctcgggaaacgaacgccgga

SEQ ID NO: 393012 - DNA, 25 bp, Mus musculus
gtcgccgcccgtcagctaacgggga

SEQ ID NO: 393013 - DNA, 25 bp, Mus musculus
tccgaggcttccctcggctggcagg

SEQ ID NO: 393014 - DNA, 25 bp, Mus musculus
gttacccggagaagtcggctcacga

SEQ ID NO: 393015 - DNA, 25 bp, Mus musculus
gtcggctcacgaagcgctttttctc

SEQ ID NO: 393016 - DNA, 25 bp, Mus musculus
cgtgagcgctgcttctcgttcgctc

SEQ ID NO: 393017 - DNA, 25 bp, Mus musculus
aagcgctttttctcctggttaaatg

SEQ ID NO: 393018 - DNA, 25 bp, Mus musculus
ctccacggctgcaagcggcccacag

SEQ ID NO: 393019 - DNA, 25 bp, Mus musculus
cccacgaccgtctaggacacgtaga

SEQ ID NO: 393020 - DNA, 25 bp, Mus musculus
gaatccaacccacgaccgtctagga

SEQ ID NO: 393021 - DNA, 25 bp, Mus musculus
tagcactcttacctgcagggctggg

SEQ ID NO: 393022 - DNA, 25 bp, Mus musculus
aggctagcactcttacctgcagggc

SEQ ID NO: 393023 - DNA, 25 bp, Mus musculus
ccactcaaggtaaggctagcactct

SEQ ID NO: 393024 - DNA, 25 bp, Mus musculus
tggttgtagccactcaaggtaaggc

SEQ ID NO: 393025 - DNA, 25 bp, Mus musculus
gccgtggttgtagccactcaaggta

SEQ ID NO: 393026 - DNA, 25 bp, Mus musculus
acttgagtggccgtggttgtagcca

SEQ ID NO: 393027 - DNA, 25 bp, Mus musculus
cattcgtggagaacttgagtggccg

SEQ ID NO: 393028 - DNA, 25 bp, Mus musculus
ctgccattcgtggagaacttgagtg

SEQ ID NO: 393029 - DNA, 25 bp, Mus musculus
gccactgccattcgtggagaacttg

SEQ ID NO: 393030 - DNA, 25 bp, Mus musculus
cacagccactgccattcgtggagaa

SEQ ID NO: 393031 - DNA, 25 bp, Mus musculus
accgtctaggacacgtagagggtga

SEQ ID NO: 393032 - DNA, 25 bp, Mus musculus
tcacattgctggagaagggcttttt

SEQ ID NO: 393033 - DNA, 25 bp, Mus musculus
gcactgcgctactgtcttcgggctt

SEQ ID NO: 393034 - DNA, 25 bp, Mus musculus
caggagcggcgactccatctgcatc

SEQ ID NO: 393035 - DNA, 25 bp, Mus musculus
tgatggaaactcaagcccggcagga

SEQ ID NO: 393036 - DNA, 25 bp, Mus musculus
caccgcgtttgtagtgcctgtggac

SEQ ID NO: 393037 - DNA, 25 bp, Mus musculus
aagaagctgtcctccaccgcgtttg

SEQ ID NO: 393038 - DNA, 25 bp, Mus musculus
tggaagagcatggtcccgttgactg

SEQ ID NO: 393039 - DNA, 25 bp, Mus musculus
tcctctgcgcatagggcgcctggct

SEQ ID NO: 393040 - DNA, 25 bp, Mus musculus
cgtgttccagctggacgaggccgaa

SEQ ID NO: 393041 - DNA, 25 bp, Mus musculus
acggagcactccaggcggcgttcac

SEQ ID NO: 393042 - DNA, 25 bp, Mus musculus
aacttgggtggagcgatcacattgc

SEQ ID NO: 393043 - DNA, 25 bp, Mus musculus
tccatccaggacttggaggtgagcg

SEQ ID NO: 393044 - DNA, 25 bp, Mus musculus
ggtccggaaagcgttatcctccatc

SEQ ID NO: 393045 - DNA, 25 bp, Mus musculus
cgttcacgctctggtgcgtgttcca

SEQ ID NO: 393046 - DNA, 25 bp, Mus musculus
tctcagtgctattgtcccggggcct

SEQ ID NO: 393047 - DNA, 25 bp, Mus musculus
ggggacggtccgaggactacatctc

SEQ ID NO: 393048 - DNA, 25 bp, Mus musculus
gcttcccggacagcggcccgaagga

SEQ ID NO: 393049 - DNA, 25 bp, Mus musculus
ctactgacagcggagcgccacatgc

SEQ ID NO: 393050 - DNA, 25 bp, Mus musculus
ggcgctgaccttgttgctactgaca

SEQ ID NO: 393051 - DNA, 25 bp, Mus musculus
ggctctgtcccacctgagcgcgaga

SEQ ID NO: 393052 - DNA, 25 bp, Mus musculus
cccgaagatgggctctgacgcggcc

SEQ ID NO: 393053 - DNA, 25 bp, Mus musculus
ggtgcgaacagtcgggttacccaca

SEQ ID NO: 393054 - DNA, 25 bp, Mus musculus
cagatgctggacaggtaggagcaac

SEQ ID NO: 393055 - DNA, 25 bp, Mus musculus
ggaactgccggccttcgtcctgggc

SEQ ID NO: 393056 - DNA, 25 bp, Mus musculus
tggcgtccgccgagagttccacggc

SEQ ID NO: 393057 - DNA, 25 bp, Mus musculus
cgagctcgccggctccgcggaagat

SEQ ID NO: 393058 - DNA, 25 bp, Mus musculus
tccatggaccggaaccctgggcgga

SEQ ID NO: 393059 - DNA, 25 bp, Mus musculus
acagaggtagctcctccgccggcag

SEQ ID NO: 393060 - DNA, 25 bp, Mus musculus
tccacacgtagaggctgcccacgta

SEQ ID NO: 393061 - DNA, 25 bp, Mus musculus
tgggtctgcgatcctctagcagtga

SEQ ID NO: 393062 - DNA, 25 bp, Mus musculus
tggatacctcctgtagccacaagtc

SEQ ID NO: 393063 - DNA, 25 bp, Mus musculus
gccactcggacagattggatacctc

SEQ ID NO: 393064 - DNA, 25 bp, Mus musculus
tgtgtcccggattcagccactcgga

SEQ ID NO: 393065 - DNA, 25 bp, Mus musculus
agagagaatgcttaggacctgtgtc

SEQ ID NO: 393066 - DNA, 25 bp, Mus musculus
atactttgtgcttggaacggcttta

SEQ ID NO: 393067 - DNA, 25 bp, Mus musculus
cccttgcacgatagttgatactttg

SEQ ID NO: 393068 - DNA, 25 bp, Mus musculus
ctggccgcgataccgacagtaaacg

SEQ ID NO: 393069 - DNA, 25 bp, Mus musculus
ctgaagcaggagaacacagacaccc

SEQ ID NO: 393070 - DNA, 25 bp, Mus musculus
ggcagctcgctcttccacacgtaga

SEQ ID NO: 393071 - DNA, 25 bp, Mus musculus
tagccacaagtcctgcgggagcaga

SEQ ID NO: 393072 - DNA, 25 bp, Mus musculus
cgcttgataacagcggggtggtccc

SEQ ID NO: 393073 - DNA, 25 bp, Mus musculus
ccggtctcttgctgagcccagaact

SEQ ID NO: 393074 - DNA, 25 bp, Mus musculus
gcagcccgcgagtgcaggagatcct

SEQ ID NO: 393075 - DNA, 25 bp, Mus musculus
ggtgcggccgagtgccttcatcacc

SEQ ID NO: 393076 - DNA, 25 bp, Mus musculus
cttcggcctgggctacgatagtagc

SEQ ID NO: 393077 - DNA, 25 bp, Mus musculus
tgctgctgcaggagtacttgacgaa

SEQ ID NO: 393078 - DNA, 25 bp, Mus musculus
cctggtgctgctccggagatgttgt

SEQ ID NO: 393079 - DNA, 25 bp, Mus musculus
ctccggagatgttgtgttgggacct

SEQ ID NO: 393080 - DNA, 25 bp, Mus musculus
gctgtacttcaagctcaatgcactg

SEQ ID NO: 393081 - DNA, 25 bp, Mus musculus
aatgcactgcgccactcgccggtgc

SEQ ID NO: 393082 - DNA, 25 bp, Mus musculus
cgactctcgggagggctgtaccgcc

SEQ ID NO: 393083 - DNA, 25 bp, Mus musculus
agccaccgcttggaacctggctgga

SEQ ID NO: 393084 - DNA, 25 bp, Mus musculus
ccgcttggaacctggctggacgtgc

SEQ ID NO: 393085 - DNA, 25 bp, Mus musculus
gccaagcgaaggagcacatgcaccg

SEQ ID NO: 393086 - DNA, 25 bp, Mus musculus
ggagcacatgcaccgcatctgcata

SEQ ID NO: 393087 - DNA, 25 bp, Mus musculus
ctcttcttcggcctgggctacgata

SEQ ID NO: 393088 - DNA, 25 bp, Mus musculus
cttgcacagtgaacttcggactaca

SEQ ID NO: 393089 - DNA, 25 bp, Mus musculus
tcgctaagttacatcggagaggcta

SEQ ID NO: 393090 - DNA, 25 bp, Mus musculus
tcccggttctcactgtgtctgagtc

SEQ ID NO: 393091 - DNA, 25 bp, Mus musculus
cggaatcgttgctgatttcggagca

SEQ ID NO: 393092 - DNA, 25 bp, Mus musculus
tttttcaaaattgaggcgcggaatc

SEQ ID NO: 393093 - DNA, 25 bp, Mus musculus
cggtcagtcgtctccatttttcaaa

SEQ ID NO: 393094 - DNA, 25 bp, Mus musculus
tgacgacacggcgtcccatgatgcc

SEQ ID NO: 393095 - DNA, 25 bp, Mus musculus
gctctgctattggtccggtcagtcg

SEQ ID NO: 393096 - DNA, 25 bp, Mus musculus
ccagcggcagcactgaaagcttgca

SEQ ID NO: 393097 - DNA, 25 bp, Mus musculus
aaggacccagcgaatgcggcgatgt

SEQ ID NO: 393098 - DNA, 25 bp, Mus musculus
tctctacggaaagcgagaagcctcg

SEQ ID NO: 393099 - DNA, 25 bp, Mus musculus
ggccgagttgttcgtcacctctcta

SEQ ID NO: 393100 - DNA, 25 bp, Mus musculus
cgcatttaagatcccgcgaaacaga

SEQ ID NO: 393101 - DNA, 25 bp, Mus musculus
cggagaggctaaaccgcatttaaga

SEQ ID NO: 393102 - DNA, 25 bp, Mus musculus
accgacgaccaggacgcggagctcg

SEQ ID NO: 393103 - DNA, 25 bp, Mus musculus
gtcagccctcttcacggaggacctg

SEQ ID NO: 393104 - DNA, 25 bp, Mus musculus
tgctcaccgacgaccaggacgcgga

SEQ ID NO: 393105 - DNA, 25 bp, Mus musculus
cggcggcatggtaactcgtgtccac

SEQ ID NO: 393106 - DNA, 25 bp, Mus musculus
tgatctcgcctagggagagaaagcc

SEQ ID NO: 393107 - DNA, 25 bp, Mus musculus
cgcctagggagagaaagcctgaccc

SEQ ID NO: 393108 - DNA, 25 bp, Mus musculus
ctcttcacggaggacctgggacgtc

SEQ ID NO: 393109 - DNA, 25 bp, Mus musculus
agggagatccgaggccacgtcagcc

SEQ ID NO: 393110 - DNA, 25 bp, Mus musculus
ggccagtgattgattagggagatcc

SEQ ID NO: 393111 - DNA, 25 bp, Mus musculus
tgctgcagtggacactcgccgctca

SEQ ID NO: 393112 - DNA, 25 bp, Mus musculus
agctcacccacaggctcgcaccgtg

SEQ ID NO: 393113 - DNA, 25 bp, Mus musculus
gcatggtaactcgtgtccacgccct

SEQ ID NO: 393114 - DNA, 25 bp, Mus musculus
ggctcgcaggcccaacgtgctgctg

SEQ ID NO: 393115 - DNA, 25 bp, Mus musculus
gacgagtcatgggacccggcttcct

SEQ ID NO: 393116 - DNA, 25 bp, Mus musculus
ttcccgcggacggtgaacgactaca

SEQ ID NO: 393117 - DNA, 25 bp, Mus musculus
ggcgcacgtcttgtgacctcctctt

SEQ ID NO: 393118 - DNA, 25 bp, Mus musculus
tcgacgacatcttgggtcgcgggcc

SEQ ID NO: 393119 - DNA, 25 bp, Mus musculus
tgggagtcccgctgtatgcgcccac

SEQ ID NO: 393120 - DNA, 25 bp, Mus musculus
agagtcccatcgcttctccaggttc

SEQ ID NO: 393121 - DNA, 25 bp, Mus musculus
agcgcagagcgcaaataaatgtagc

SEQ ID NO: 393122 - DNA, 25 bp, Mus musculus
gggaagctcggcgactcagattgct

SEQ ID NO: 393123 - DNA, 25 bp, Mus musculus
ggcgaatctgaagccagcgccattg

SEQ ID NO: 393124 - DNA, 25 bp, Mus musculus
gtcgctcgctaggtgcctggaacct

SEQ ID NO: 393125 - DNA, 25 bp, Mus musculus
tgacctcctcttcgacggtcgcagt

SEQ ID NO: 393126 - DNA, 25 bp, Mus musculus
agtggaaaagttgcggcgagctctc

SEQ ID NO: 393127 - DNA, 25 bp, Mus musculus
agtttcagcagtggcgccatcccgt

SEQ ID NO: 393128 - DNA, 25 bp, Mus musculus
ggttccagaggctgcccgagtttca

SEQ ID NO: 393129 - DNA, 25 bp, Mus musculus
ggtgaacgactacacgcacgcccta

SEQ ID NO: 393130 - DNA, 25 bp, Mus musculus
gcacgagcggatcttgcaggagatc

SEQ ID NO: 393131 - DNA, 25 bp, Mus musculus
aggagatcgaaagcaccgacaccgc

SEQ ID NO: 393132 - DNA, 25 bp, Mus musculus
aaagcaccgacaccgcctgcgtagg

SEQ ID NO: 393133 - DNA, 25 bp, Mus musculus
accctccggtaaagttctcacatgc

SEQ ID NO: 393134 - DNA, 25 bp, Mus musculus
cggctttcgggctgccctgaccagg

SEQ ID NO: 393135 - DNA, 25 bp, Mus musculus
tgaccagggactccttaggagccgg

SEQ ID NO: 393136 - DNA, 25 bp, Mus musculus
ccagggtgtctctgacccggagagc

SEQ ID NO: 393137 - DNA, 25 bp, Mus musculus
ctgtctgctctgtgctggggacgaa

SEQ ID NO: 393138 - DNA, 25 bp, Mus musculus
ccggcgtgactgatcccggtgccaa

SEQ ID NO: 393139 - DNA, 25 bp, Mus musculus
tcccggtgccaagttgcgcgctgat

SEQ ID NO: 393140 - DNA, 25 bp, Mus musculus
ccagcgcactgactgctctgggcgt

SEQ ID NO: 393141 - DNA, 25 bp, Mus musculus
ctctgggcgtgggagaattgaaatt

SEQ ID NO: 393142 - DNA, 25 bp, Mus musculus
ggctgacagctcgagttcacgcagg

SEQ ID NO: 393143 - DNA, 25 bp, Mus musculus
aaattgagcgggagacgccagcacc

SEQ ID NO: 393144 - DNA, 25 bp, Mus musculus
cgctgagaacgtgcgcaccatcctg

SEQ ID NO: 393145 - DNA, 25 bp, Mus musculus
gagcgctacgggacagtgtttaaga

SEQ ID NO: 393146 - DNA, 25 bp, Mus musculus
gagaacgtgcgcaccatcctgctgg

SEQ ID NO: 393147 - DNA, 25 bp, Mus musculus
ccgcgagcgctacgggacagtgttt

SEQ ID NO: 393148 - DNA, 25 bp, Mus musculus
cggcgctgagaacgtgcgcaccatc

SEQ ID NO: 393149 - DNA, 25 bp, Mus musculus
agcggcgctgagaacgtgcgcacca

SEQ ID NO: 393150 - DNA, 25 bp, Mus musculus
caggccagtgatccgggtgagcggc

SEQ ID NO: 393151 - DNA, 25 bp, Mus musculus
cagtgtttaagacgcaccttctggg

SEQ ID NO: 393152 - DNA, 25 bp, Mus musculus
gacagtgtttaagacgcaccttctg

SEQ ID NO: 393153 - DNA, 25 bp, Mus musculus
gggacagtgtttaagacgcaccttc

SEQ ID NO: 393154 - DNA, 25 bp, Mus musculus
tacgggacagtgtttaagacgcacc

SEQ ID NO: 393155 - DNA, 25 bp, Mus musculus
gctacgggacagtgtttaagacgca

SEQ ID NO: 393156 - DNA, 25 bp, Mus musculus
tgagaacgtgcgcaccatcctgctg

SEQ ID NO: 393157 - DNA, 25 bp, Mus musculus
agcgctacgggacagtgtttaagac

SEQ ID NO: 393158 - DNA, 25 bp, Mus musculus
ccacagagtgcgcatattctactag

SEQ ID NO: 393159 - DNA, 25 bp, Mus musculus
gtggccacagagtgcgcatattcta

SEQ ID NO: 393160 - DNA, 25 bp, Mus musculus
gcgcatattctactagggtcacaca

SEQ ID NO: 393161 - DNA, 25 bp, Mus musculus
ccagtggccacagagtgcgcatatt

SEQ ID NO: 393162 - DNA, 25 bp, Mus musculus
agggtcacacacactacttggcgcg

SEQ ID NO: 393163 - DNA, 25 bp, Mus musculus
agagtgcgcatattctactagggtc

SEQ ID NO: 393164 - DNA, 25 bp, Mus musculus
tcacacacactacttggcgcggttg

SEQ ID NO: 393165 - DNA, 25 bp, Mus musculus
cacacactacttggcgcggttggtg

SEQ ID NO: 393166 - DNA, 25 bp, Mus musculus
gttggtgagccccatcggcaacggc

SEQ ID NO: 393167 - DNA, 25 bp, Mus musculus
tactagggtcacacacactacttgg

SEQ ID NO: 393168 - DNA, 25 bp, Mus musculus
gtagccagtggccacagagtgcgca

SEQ ID NO: 393169 - DNA, 25 bp, Mus musculus
agcaccgcctggtgcgtagccagtg

SEQ ID NO: 393170 - DNA, 25 bp, Mus musculus
tattctactagggtcacacacacta

SEQ ID NO: 393171 - DNA, 25 bp, Mus musculus
gcgagcaccgcctggtgcgtagcca

SEQ ID NO: 393172 - DNA, 25 bp, Mus musculus
ccaacgaccggtggctgtttaccag

SEQ ID NO: 393173 - DNA, 25 bp, Mus musculus
aagcgaggccttttcggaatcatgg

SEQ ID NO: 393174 - DNA, 25 bp, Mus musculus
gcctgctggtttccggatcagaaaa

SEQ ID NO: 393175 - DNA, 25 bp, Mus musculus
ggcgccggctcttgtcttaagggat

SEQ ID NO: 393176 - DNA, 25 bp, Mus musculus
ttgtcgtttctcaaagtggtgcctc

SEQ ID NO: 393177 - DNA, 25 bp, Mus musculus
gccagtgtagccttcttgagtttga

SEQ ID NO: 393178 - DNA, 25 bp, Mus musculus
atgctcctgccttcgagccagtgta

SEQ ID NO: 393179 - DNA, 25 bp, Mus musculus
ggcaggccacacaccctctatggga

SEQ ID NO: 393180 - DNA, 25 bp, Mus musculus
gctgcatctcttcggactctctgtg

SEQ ID NO: 393181 - DNA, 25 bp, Mus musculus
cccaaggctccagagggtccagata

SEQ ID NO: 393182 - DNA, 25 bp, Mus musculus
tcactgcccttggacgtaccgttca

SEQ ID NO: 393183 - DNA, 25 bp, Mus musculus
ccgagctggcccatacctttgaaca

SEQ ID NO: 393184 - DNA, 25 bp, Mus musculus
tctggagcaattcgtgccacggttg

SEQ ID NO: 393185 - DNA, 25 bp, Mus musculus
ctttgaacagctggtggagaacctc

SEQ ID NO: 393186 - DNA, 25 bp, Mus musculus
cgtagtcaaggaggtgctgcgcctc

SEQ ID NO: 393187 - DNA, 25 bp, Mus musculus
cgggcctctagatgcttgcagccgc

SEQ ID NO: 393188 - DNA, 25 bp, Mus musculus
aagtgcgccgcactgcgggcctcta

SEQ ID NO: 393189 - DNA, 25 bp, Mus musculus
cctttgaactggacgtaagtgcgcc

SEQ ID NO: 393190 - DNA, 25 bp, Mus musculus
tcaaggaggtgctgcgcctcctacc

SEQ ID NO: 393191 - DNA, 25 bp, Mus musculus
tacgtcgactgcgtagtcaaggagg

SEQ ID NO: 393192 - DNA, 25 bp, Mus musculus
ccgtttgcgctacgtcgactgcgta

SEQ ID NO: 393193 - DNA, 25 bp, Mus musculus
ttagcctggccatgctgggccgttt

SEQ ID NO: 393194 - DNA, 25 bp, Mus musculus
gagccggaccttagcctggccatgc

SEQ ID NO: 393195 - DNA, 25 bp, Mus musculus
gactgcggttgtgagccggacctta

SEQ ID NO: 393196 - DNA, 25 bp, Mus musculus
atcgccaccggactgcggttgtgag

SEQ ID NO: 393197 - DNA, 25 bp, Mus musculus
agagcctcaggatcgccaccggact

SEQ ID NO: 393198 - DNA, 25 bp, Mus musculus
ttgcacacccagagcctcaggatcg

SEQ ID NO: 393199 - DNA, 25 bp, Mus musculus
gctgcgcacctttgaactggacgta

SEQ ID NO: 393200 - DNA, 25 bp, Mus musculus
cctcacttcgcagggttaccagatc

SEQ ID NO: 393201 - DNA, 25 bp, Mus musculus
cggccaatcttcagagccctaggtc

SEQ ID NO: 393202 - DNA, 25 bp, Mus musculus
gctgatgcgtacacaccggccaatc

SEQ ID NO: 393203 - DNA, 25 bp, Mus musculus
ttcgttgcttctctagccttggctc

SEQ ID NO: 393204 - DNA, 25 bp, Mus musculus
atgggttacccttctgattcgttgc

SEQ ID NO: 393205 - DNA, 25 bp, Mus musculus
taatgcagacggtgcccatcgtgca

SEQ ID NO: 393206 - DNA, 25 bp, Mus musculus
cggtgctgcaactgctcgcagtcga

SEQ ID NO: 393207 - DNA, 25 bp, Mus musculus
tcattacatcccgttcggcggcggc

SEQ ID NO: 393208 - DNA, 25 bp, Mus musculus
tccggtggccgctttcattacatcc

SEQ ID NO: 393209 - DNA, 25 bp, Mus musculus
acgcatgagacagccgcagtgtacc

SEQ ID NO: 393210 - DNA, 25 bp, Mus musculus
ctaggtcctcatcgcgcgtatattc

SEQ ID NO: 393211 - DNA, 25 bp, Mus musculus
cccaaaggctggagcgtgatgtata

SEQ ID NO: 393212 - DNA, 25 bp, Mus musculus
gccatttccctgtgcttaacgatca

SEQ ID NO: 393213 - DNA, 25 bp, Mus musculus
tgtatagcatccgagacacgcatga

SEQ ID NO: 393214 - DNA, 25 bp, Mus musculus
tttctgctagcacgtgggttagtcc

SEQ ID NO: 393215 - DNA, 25 bp, Mus musculus
aagacgcatctgtttgggcggccca

SEQ ID NO: 393216 - DNA, 25 bp, Mus musculus
gcatcttgctgggagagcaccggtt

SEQ ID NO: 393217 - DNA, 25 bp, Mus musculus
tgcacgattcctcgcacaagcagcg

SEQ ID NO: 393218 - DNA, 25 bp, Mus musculus
tgagctggcaactccttggctggca

SEQ ID NO: 393219 - DNA, 25 bp, Mus musculus
tggcagggagacctcatcctatggc

SEQ ID NO: 393220 - DNA, 25 bp, Mus musculus
tcctatggcttggttcaggcaaata

SEQ ID NO: 393221 - DNA, 25 bp, Mus musculus
ggaccaggaccctctctatctgaga

SEQ ID NO: 393222 - DNA, 25 bp, Mus musculus
agcgcaggaaatacggcttcatcta

SEQ ID NO: 393223 - DNA, 25 bp, Mus musculus
tccctctcagcggaggaagtttctg

SEQ ID NO: 393224 - DNA, 25 bp, Mus musculus
ccattctttggggaaacattgcaga

SEQ ID NO: 393225 - DNA, 25 bp, Mus musculus
ctgggacctgtactgtgtgagcagc

SEQ ID NO: 393226 - DNA, 25 bp, Mus musculus
agtgcgctctgcaccttcgtgctgc

SEQ ID NO: 393227 - DNA, 25 bp, Mus musculus
gggcccgatccgcaattaaagatga

SEQ ID NO: 393228 - DNA, 25 bp, Mus musculus
ctttcttaacagagaggttaccgcg

SEQ ID NO: 393229 - DNA, 25 bp, Mus musculus
ggctcctttgaacttggcggtatta

SEQ ID NO: 393230 - DNA, 25 bp, Mus musculus
aggccatcctttcggctcctttgaa

SEQ ID NO: 393231 - DNA, 25 bp, Mus musculus
tggaacacatgctggctccctgaga

SEQ ID NO: 393232 - DNA, 25 bp, Mus musculus
cctggctggaatcgctggaacacat

SEQ ID NO: 393233 - DNA, 25 bp, Mus musculus
ggcggtattatcactttcttaacag

SEQ ID NO: 393234 - DNA, 25 bp, Mus musculus
gtgagcagatcacgccgcaggactc

SEQ ID NO: 393235 - DNA, 25 bp, Mus musculus
ccggcacggattgtagctcccgtca

SEQ ID NO: 393236 - DNA, 25 bp, Mus musculus
gctcccgtcaggctctatgtcttgc

SEQ ID NO: 393237 - DNA, 25 bp, Mus musculus
tctgattccagagccggtcttcgcc

SEQ ID NO: 393238 - DNA, 25 bp, Mus musculus
ttccagccttcactcagattgcagg

SEQ ID NO: 393239 - DNA, 25 bp, Mus musculus
tcgccaagccggcagtgacgtgacc

SEQ ID NO: 393240 - DNA, 25 bp, Mus musculus
gcgctgtgtttgtctcaggtagtga

SEQ ID NO: 393241 - DNA, 25 bp, Mus musculus
tcctggttgataagtggtctgcggc

SEQ ID NO: 393242 - DNA, 25 bp, Mus musculus
catctgccaaggttggaggcgagcc

SEQ ID NO: 393243 - DNA, 25 bp, Mus musculus
gacaggtggcgcatctgccaaggtt

SEQ ID NO: 393244 - DNA, 25 bp, Mus musculus
aggcggcccgcatccgtaggcgggt

SEQ ID NO: 393245 - DNA, 25 bp, Mus musculus
cccttcccgcctgaccgcgcgtccg

SEQ ID NO: 393246 - DNA, 25 bp, Mus musculus
tgctcctgagactttcccacggtct

SEQ ID NO: 393247 - DNA, 25 bp, Mus musculus
gagactttcccacggtctcgccaag

SEQ ID NO: 393248 - DNA, 25 bp, Mus musculus
tctcgccaagacacggccctcggcc

SEQ ID NO: 393249 - DNA, 25 bp, Mus musculus
ctcggcccttttcaaagcgctctgt

SEQ ID NO: 393250 - DNA, 25 bp, Mus musculus
ggcccttttcaaagcgctctgtccg

SEQ ID NO: 393251 - DNA, 25 bp, Mus musculus
cttttcaaagcgctctgtccgccct

SEQ ID NO: 393252 - DNA, 25 bp, Mus musculus
ccctcggcgttttccagggctgctc

SEQ ID NO: 393253 - DNA, 25 bp, Mus musculus
ggctgctccctggaaagccgcggct

SEQ ID NO: 393254 - DNA, 25 bp, Mus musculus
tgctccctggaaagccgcggctgcg

SEQ ID NO: 393255 - DNA, 25 bp, Mus musculus
cgggcggcgactgctcctgagactt

SEQ ID NO: 393256 - DNA, 25 bp, Mus musculus
ttctgcgcggatttgctcttcacca

SEQ ID NO: 393257 - DNA, 25 bp, Mus musculus
atctttgtcgtctcactgctgggca

SEQ ID NO: 393258 - DNA, 25 bp, Mus musculus
atccctctagtgctcgtcgtgcgct

SEQ ID NO: 393259 - DNA, 25 bp, Mus musculus
caggcggcactgctggctttcatat

SEQ ID NO: 393260 - DNA, 25 bp, Mus musculus
tggtgctcaacctcttctgcgcgga

SEQ ID NO: 393261 - DNA, 25 bp, Mus musculus
ggcagcgtcacgatcctcacactgg

SEQ ID NO: 393262 - DNA, 25 bp, Mus musculus
tttcatatggggttactcggcgctc

SEQ ID NO: 393263 - DNA, 25 bp, Mus musculus
gcgtgcaacgcaacaagtatccagg

SEQ ID NO: 393264 - DNA, 25 bp, Mus musculus
ccctctgcatcttgttccgcgtggt

SEQ ID NO: 393265 - DNA, 25 bp, Mus musculus
gaccaccgttctggggctcatcttt

SEQ ID NO: 393266 - DNA, 25 bp, Mus musculus
cgccttggcattcagttacctcgca

SEQ ID NO: 393267 - DNA, 25 bp, Mus musculus
tgccacctgctcttctacgtgatga

SEQ ID NO: 393268 - DNA, 25 bp, Mus musculus
ttacctcgcagatgagcgctctctc

SEQ ID NO: 393269 - DNA, 25 bp, Mus musculus
tcttctcggatgtcaagggcgacca

SEQ ID NO: 393270 - DNA, 25 bp, Mus musculus
cccgtgcgcttctcgcagagttttc

SEQ ID NO: 393271 - DNA, 25 bp, Mus musculus
cccgcatctgttgctctctgggagc

SEQ ID NO: 393272 - DNA, 25 bp, Mus musculus
gcctcagggcatgcttcccactata

SEQ ID NO: 393273 - DNA, 25 bp, Mus musculus
tcctcgggtctgatggaaccgttca

SEQ ID NO: 393274 - DNA, 25 bp, Mus musculus
ggggcatcaagccaaacacctggtg

SEQ ID NO: 393275 - DNA, 25 bp, Mus musculus
ggcctttccctatatctgccatatg

SEQ ID NO: 393276 - DNA, 25 bp, Mus musculus
tgcagctactaaacaacccggcctt

SEQ ID NO: 393277 - DNA, 25 bp, Mus musculus
acctctctcgcctccataatgaatg

SEQ ID NO: 393278 - DNA, 25 bp, Mus musculus
cgcgtgcagtgtttgcaaaagcttc

SEQ ID NO: 393279 - DNA, 25 bp, Mus musculus
agtgcacgcatcatctcggccggtg

SEQ ID NO: 393280 - DNA, 25 bp, Mus musculus
ctgacagttccgagaggatccctct

SEQ ID NO: 393281 - DNA, 25 bp, Mus musculus
cttgagcgccagcaactgacagttc

SEQ ID NO: 393282 - DNA, 25 bp, Mus musculus
ggcgacctcagctgcttccacgtgt

SEQ ID NO: 393283 - DNA, 25 bp, Mus musculus
ccgagtgtcttctgccactggctga

SEQ ID NO: 393284 - DNA, 25 bp, Mus musculus
ttgccgtcccacgtcgcctatgctc

SEQ ID NO: 393285 - DNA, 25 bp, Mus musculus
ggaacccgggctgatacctacacga

SEQ ID NO: 393286 - DNA, 25 bp, Mus musculus
ctgatacctacacgagccttgtcga

SEQ ID NO: 393287 - DNA, 25 bp, Mus musculus
gttctccttgactcggaagctgctc

SEQ ID NO: 393288 - DNA, 25 bp, Mus musculus
ctcaccagcaggagccgcgtgcaag

SEQ ID NO: 393289 - DNA, 25 bp, Mus musculus
agccgagcggccgtcggtcctttat

SEQ ID NO: 393290 - DNA, 25 bp, Mus musculus
cggccgtcggtcctttatagctccg

SEQ ID NO: 393291 - DNA, 25 bp, Mus musculus
ggcggccgagcttgcataacgctcc

SEQ ID NO: 393292 - DNA, 25 bp, Mus musculus
tgactcactcctgaacgcacgcggg

SEQ ID NO: 393293 - DNA, 25 bp, Mus musculus
cgagccttgtcgaagttctccttga

SEQ ID NO: 393294 - DNA, 25 bp, Mus musculus
ctatgctccgagctccgctcagggt

SEQ ID NO: 393295 - DNA, 25 bp, Mus musculus
tccgagctccgctcagggtggtctc

SEQ ID NO: 393296 - DNA, 25 bp, Mus musculus
gagcttgcataacgctccctgactc

SEQ ID NO: 393297 - DNA, 25 bp, Mus musculus
tgactcggaagctgctcaccctgca

SEQ ID NO: 393298 - DNA, 25 bp, Mus musculus
ccgactctgtgctgcagccagaatg

SEQ ID NO: 393299 - DNA, 25 bp, Mus musculus
agccagaatggctcgggggtaaaca

SEQ ID NO: 393300 - DNA, 25 bp, Mus musculus
acgagccacggcctcagcgagccgc

SEQ ID NO: 393301 - DNA, 25 bp, Mus musculus
cgccgactctgtgctgcagccagaa

SEQ ID NO: 393302 - DNA, 25 bp, Mus musculus
gataagacaccgttctccggcgcgc

SEQ ID NO: 393303 - DNA, 25 bp, Mus musculus
catcgataagacaccgttctccggc

SEQ ID NO: 393304 - DNA, 25 bp, Mus musculus
gtcacatcgataagacaccgttctc

SEQ ID NO: 393305 - DNA, 25 bp, Mus musculus
cagaggcgtgtcacatcgataagac

SEQ ID NO: 393306 - DNA, 25 bp, Mus musculus
ggctcagaggcgtgtcacatcgata

SEQ ID NO: 393307 - DNA, 25 bp, Mus musculus
cttccggcccggctcagaggcgtgt

SEQ ID NO: 393308 - DNA, 25 bp, Mus musculus
cgctgcacgcctggccctacgggta

SEQ ID NO: 393309 - DNA, 25 bp, Mus musculus
actgtcaccgcacgctgcacgcctg

SEQ ID NO: 393310 - DNA, 25 bp, Mus musculus
gcccgcgccactgtcaccgcacgct

SEQ ID NO: 393311 - DNA, 25 bp, Mus musculus
ccggtcctccagagccacgcagcgc

SEQ ID NO: 393312 - DNA, 25 bp, Mus musculus
aggtacagtctttctaaagcagcag

SEQ ID NO: 393313 - DNA, 25 bp, Mus musculus
gacaggacctcgcagtccagtggca

SEQ ID NO: 393314 - DNA, 25 bp, Mus musculus
cgagacccagaaagtttccgagtgt

SEQ ID NO: 393315 - DNA, 25 bp, Mus musculus
gagccgagacccagaaagtttccga

SEQ ID NO: 393316 - DNA, 25 bp, Mus musculus
gtcggtctggtcctctgcgcaccgg

SEQ ID NO: 393317 - DNA, 25 bp, Mus musculus
caccgcgccagctgtagccaccgca

SEQ ID NO: 393318 - DNA, 25 bp, Mus musculus
ctgtctagcccgactgccctggggt

SEQ ID NO: 393319 - DNA, 25 bp, Mus musculus
tgtgcaaagacagaggaggaccagt

SEQ ID NO: 393320 - DNA, 25 bp, Mus musculus
agggctgagaaccaagcgtccctcc

SEQ ID NO: 393321 - DNA, 25 bp, Mus musculus
acagtctttctaaagcagcagaagg

SEQ ID NO: 393322 - DNA, 25 bp, Mus musculus
acctcgcagtccagtggcagtcaga

SEQ ID NO: 393323 - DNA, 25 bp, Mus musculus
aggaccagtgtgctgtctagcccga

SEQ ID NO: 393324 - DNA, 25 bp, Mus musculus
acccgaggcgccagggctgagaacc

SEQ ID NO: 393325 - DNA, 25 bp, Mus musculus
ccctccctgtctgtgcaaagacaga

SEQ ID NO: 393326 - DNA, 25 bp, Mus musculus
ccggggcagccatcccttgcggaat

SEQ ID NO: 393327 - DNA, 25 bp, Mus musculus
ggctcctgctcgctcctgggaatcg

SEQ ID NO: 393328 - DNA, 25 bp, Mus musculus
ctcccaggaagacagccggggcagc

SEQ ID NO: 393329 - DNA, 25 bp, Mus musculus
taactttgcggcgtacctggtggcc

SEQ ID NO: 393330 - DNA, 25 bp, Mus musculus
ttcccgggcagcagcctaactttgc

SEQ ID NO: 393331 - DNA, 25 bp, Mus musculus
tgctctccaggctgtagtcgttccc

SEQ ID NO: 393332 - DNA, 25 bp, Mus musculus
ccgaggaccgcagatccggagagct

SEQ ID NO: 393333 - DNA, 25 bp, Mus musculus
agcttgcgactctgtcgcttggtcc

SEQ ID NO: 393334 - DNA, 25 bp, Mus musculus
tctaaggtgagcttgcgactctgtc

SEQ ID NO: 393335 - DNA, 25 bp, Mus musculus
gcacgactggctggagatctaaggt

SEQ ID NO: 393336 - DNA, 25 bp, Mus musculus
gacgcacgcgagtggaccaggtccc

SEQ ID NO: 393337 - DNA, 25 bp, Mus musculus
ctgtgctgctgacactcggtggccc

SEQ ID NO: 393338 - DNA, 25 bp, Mus musculus
ccatcccttgcggaatgcgaggctg

SEQ ID NO: 393339 - DNA, 25 bp, Mus musculus
gctcctgggaatcggctgtgctgct

SEQ ID NO: 393340 - DNA, 25 bp, Mus musculus
caaaccggaagacgctttcagcctc

SEQ ID NO: 393341 - DNA, 25 bp, Mus musculus
tggctccgcctgttgcgggtacttc

SEQ ID NO: 393342 - DNA, 25 bp, Mus musculus
cagtcctggagaagacaaaagacga

SEQ ID NO: 393343 - DNA, 25 bp, Mus musculus
gcccggattccttttcagtcctgga

SEQ ID NO: 393344 - DNA, 25 bp, Mus musculus
actcaagcaggttcccgcccggatt

SEQ ID NO: 393345 - DNA, 25 bp, Mus musculus
tgggcgtcccagctgaaggactcaa

SEQ ID NO: 393346 - DNA, 25 bp, Mus musculus
ccgggctcagtctctcacggactga

SEQ ID NO: 393347 - DNA, 25 bp, Mus musculus
tgagcgcaacctttcccaaaccgga

SEQ ID NO: 393348 - DNA, 25 bp, Mus musculus
aagacacacgtgcactgagcgcaac

SEQ ID NO: 393349 - DNA, 25 bp, Mus musculus
caggagccgggtggaaaagacacac

SEQ ID NO: 393350 - DNA, 25 bp, Mus musculus
tcactcggacagaggaacacgcagg

SEQ ID NO: 393351 - DNA, 25 bp, Mus musculus
tgcgaggagtaccacagacaagatc

SEQ ID NO: 393352 - DNA, 25 bp, Mus musculus
gttcggacagcacttaccgccttca

SEQ ID NO: 393353 - DNA, 25 bp, Mus musculus
gactgacccttgtgagaatcgctga

SEQ ID NO: 393354 - DNA, 25 bp, Mus musculus
actcgggctttttgctgcgccagga

SEQ ID NO: 393355 - DNA, 25 bp, Mus musculus
gctgccgtctctatggttcggggac

SEQ ID NO: 393356 - DNA, 25 bp, Mus musculus
tcctccgccgcctcagatgatgggt

SEQ ID NO: 393357 - DNA, 25 bp, Mus musculus
ctcagatgatgggtcccgaggatgc

SEQ ID NO: 393358 - DNA, 25 bp, Mus musculus
ctcgggaaggaacgccgagctgctc

SEQ ID NO: 393359 - DNA, 25 bp, Mus musculus
caccagcggctttagcggaggcgct

SEQ ID NO: 393360 - DNA, 25 bp, Mus musculus
catgaccaacggagactcgggcttt

SEQ ID NO: 393361 - DNA, 25 bp, Mus musculus
cagaggaggcacgtcgccgccgaac

SEQ ID NO: 393362 - DNA, 25 bp, Mus musculus
ctcgaggacccgctgcggagctgct

SEQ ID NO: 393363 - DNA, 25 bp, Mus musculus
cttcggctctcggaacacgttcgag

SEQ ID NO: 393364 - DNA, 25 bp, Mus musculus
gaacacgttcgaggtgagccgccgt

SEQ ID NO: 393365 - DNA, 25 bp, Mus musculus
tcgcggatttcttcgccaggtatca

SEQ ID NO: 393366 - DNA, 25 bp, Mus musculus
ccaggtatcacactggccgcgcgag

SEQ ID NO: 393367 - DNA, 25 bp, Mus musculus
ggcgcgcggctcaggcatgaccaac

SEQ ID NO: 393368 - DNA, 25 bp, Mus musculus
gtgaccacgggcgacattcaaggct

SEQ ID NO: 393369 - DNA, 25 bp, Mus musculus
tgcggtgattactccagccatgctg

SEQ ID NO: 393370 - DNA, 25 bp, Mus musculus
cccttagggtccttggctccagaga

SEQ ID NO: 393371 - DNA, 25 bp, Mus musculus
tacaggtctcctcacgagctgggtc

SEQ ID NO: 393372 - DNA, 25 bp, Mus musculus
cgcgaaagagaagcgcgcgaatttc

SEQ ID NO: 393373 - DNA, 25 bp, Mus musculus
agccaagcgcgtccaaatctcgtga

SEQ ID NO: 393374 - DNA, 25 bp, Mus musculus
ttcaaggctggagctagctacaccc

SEQ ID NO: 393375 - DNA, 25 bp, Mus musculus
cgccgaacaactcgggaccatcatt

SEQ ID NO: 393376 - DNA, 25 bp, Mus musculus
aagaggtcttgcacccgccgaacaa

SEQ ID NO: 393377 - DNA, 25 bp, Mus musculus
ggggcgttcaaacaatccagtgtgt

SEQ ID NO: 393378 - DNA, 25 bp, Mus musculus
ggttgtaacttgaatcccgttctga

SEQ ID NO: 393379 - DNA, 25 bp, Mus musculus
gagcttggccgtttttgacacccta

SEQ ID NO: 393380 - DNA, 25 bp, Mus musculus
ccgcgaactacaactggtcagggtc

SEQ ID NO: 393381 - DNA, 25 bp, Mus musculus
aggcttaacgcatccctcctgggga

SEQ ID NO: 393382 - DNA, 25 bp, Mus musculus
tctaatccgggagttaggctcttca

SEQ ID NO: 393383 - DNA, 25 bp, Mus musculus
tcccggagcagctgtcggagaaaga

SEQ ID NO: 393384 - DNA, 25 bp, Mus musculus
tccggggcgcagaaagaaaactgtc

SEQ ID NO: 393385 - DNA, 25 bp, Mus musculus
gtctttggccttgactcagcgcgca

SEQ ID NO: 393386 - DNA, 25 bp, Mus musculus
cagatggcacagagcgctcggcgaa

SEQ ID NO: 393387 - DNA, 25 bp, Mus musculus
ccaagacgctcttacccgggaaatg

SEQ ID NO: 393388 - DNA, 25 bp, Mus musculus
aatggcgagaggttgttcgaagtcc

SEQ ID NO: 393389 - DNA, 25 bp, Mus musculus
gttcgaagtccttgccgcccacgag

SEQ ID NO: 393390 - DNA, 25 bp, Mus musculus
acaatctgctgggtggtcatcgcta

SEQ ID NO: 393391 - DNA, 25 bp, Mus musculus
gtcatcgctaggcacaatcggaagg

SEQ ID NO: 393392 - DNA, 25 bp, Mus musculus
caggcaaggcacagaactgcacggc

SEQ ID NO: 393393 - DNA, 25 bp, Mus musculus
aggacctcgccagactctaatccgg

SEQ ID NO: 393394 - DNA, 25 bp, Mus musculus
agttaggctcttcaactccgcccag

SEQ ID NO: 393395 - DNA, 25 bp, Mus musculus
acaatcggaagggacagacaggcaa

SEQ ID NO: 393396 - DNA, 25 bp, Mus musculus
gggaccgctgaatgagctgctcaaa

SEQ ID NO: 393397 - DNA, 25 bp, Mus musculus
catggaccgggaccgctgaatgagc

SEQ ID NO: 393398 - DNA, 25 bp, Mus musculus
cagccggccagagaagtccagggac

SEQ ID NO: 393399 - DNA, 25 bp, Mus musculus
gggacttgctcagccggccagagaa

SEQ ID NO: 393400 - DNA, 25 bp, Mus musculus
aggtcaggccgcttctagagagcac

SEQ ID NO: 393401 - DNA, 25 bp, Mus musculus
ttccgctgaacgagctgaggtcagg

SEQ ID NO: 393402 - DNA, 25 bp, Mus musculus
gactcgaggagggattccgctgaac

SEQ ID NO: 393403 - DNA, 25 bp, Mus musculus
cttggtagactcgaggagggattcc

SEQ ID NO: 393404 - DNA, 25 bp, Mus musculus
atctctctgggacggagcttggtag

SEQ ID NO: 393405 - DNA, 25 bp, Mus musculus
atcccgtccatctctctgggacgga

SEQ ID NO: 393406 - DNA, 25 bp, Mus musculus
ctacacgtgggcgacgcatagaccc

SEQ ID NO: 393407 - DNA, 25 bp, Mus musculus
tggtccgccatattgctacacgtgg

SEQ ID NO: 393408 - DNA, 25 bp, Mus musculus
gaagctcaaggcgtggtccgccata

SEQ ID NO: 393409 - DNA, 25 bp, Mus musculus
atgagctgctcaaaggccgtgatgc

SEQ ID NO: 393410 - DNA, 25 bp, Mus musculus
aggcttggggcacgcggacctctat

SEQ ID NO: 393411 - DNA, 25 bp, Mus musculus
aactggcgaaggagcgaacgtcctg

SEQ ID NO: 393412 - DNA, 25 bp, Mus musculus
aaggagcgaacgtcctgcgtttgcc

SEQ ID NO: 393413 - DNA, 25 bp, Mus musculus
ttctggcagcgcatgtttttagcgg

SEQ ID NO: 393414 - DNA, 25 bp, Mus musculus
cacgcggacctctatggagcgcaga

SEQ ID NO: 393415 - DNA, 25 bp, Mus musculus
aatcggggcatccacgcggaagaca

SEQ ID NO: 393416 - DNA, 25 bp, Mus musculus
cccaggtatcgctgtgaagattctg

SEQ ID NO: 393417 - DNA, 25 bp, Mus musculus
cgggacacccaggtatcgctgtgaa

SEQ ID NO: 393418 - DNA, 25 bp, Mus musculus
atgcgacgccgagttcccgggtcct

SEQ ID NO: 393419 - DNA, 25 bp, Mus musculus
tccgcacccaggtaggtgcagccgg

SEQ ID NO: 393420 - DNA, 25 bp, Mus musculus
gaggctattgtcctccttccgcggc

SEQ ID NO: 393421 - DNA, 25 bp, Mus musculus
tactgcaggaacctagaggggccgc

SEQ ID NO: 393422 - DNA, 25 bp, Mus musculus
ttttagcggtgcgtcggttcctgcg

SEQ ID NO: 393423 - DNA, 25 bp, Mus musculus
tctatggagcgcagagaagagtctg

SEQ ID NO: 393424 - DNA, 25 bp, Mus musculus
gcgcagacacgtggagccaagaccc

SEQ ID NO: 393425 - DNA, 25 bp, Mus musculus
tgaagaaaaagtcctcgtcctcctc

SEQ ID NO: 393426 - DNA, 25 bp, Mus musculus
tgcccggaggcgctctcctgaagaa

SEQ ID NO: 393427 - DNA, 25 bp, Mus musculus
aagggcaaaggccactctcagagcc

SEQ ID NO: 393428 - DNA, 25 bp, Mus musculus
tcctggcggtgaagaaaaagtcctc

SEQ ID NO: 393429 - DNA, 25 bp, Mus musculus
catcgagcaaactgcagctagaagc

SEQ ID NO: 393430 - DNA, 25 bp, Mus musculus
tcgtcctcctcgaggctgctgtagc

SEQ ID NO: 393431 - DNA, 25 bp, Mus musculus
tccgtcctagcaccggtggactgtt

SEQ ID NO: 393432 - DNA, 25 bp, Mus musculus
ctggaacagttctcccgagggcttc

SEQ ID NO: 393433 - DNA, 25 bp, Mus musculus
tctcctgaagaaggaggtcctggcg

SEQ ID NO: 393434 - DNA, 25 bp, Mus musculus
cagagaggcccaggccatctggctc

SEQ ID NO: 393435 - DNA, 25 bp, Mus musculus
agctagaagcaaactgcagccagga

SEQ ID NO: 393436 - DNA, 25 bp, Mus musculus
tctttggagctgctcccgcagccgg

SEQ ID NO: 393437 - DNA, 25 bp, Mus musculus
tttcaggcgccgaaagggcaaaggc

SEQ ID NO: 393438 - DNA, 25 bp, Mus musculus
agctggccctttaaaagcacctcct

SEQ ID NO: 393439 - DNA, 25 bp, Mus musculus
gcgctgaacaaaggcaccgctccgg

SEQ ID NO: 393440 - DNA, 25 bp, Mus musculus
tctaccctgggctgcccgcgagtga

SEQ ID NO: 393441 - DNA, 25 bp, Mus musculus
ggctcgcgctccacgctacagtcag

SEQ ID NO: 393442 - DNA, 25 bp, Mus musculus
ccgctctgtttttctgctactccga

SEQ ID NO: 393443 - DNA, 25 bp, Mus musculus
tgctactccgagctgacttcaccga

SEQ ID NO: 393444 - DNA, 25 bp, Mus musculus
tccgagctgacttcaccgacactgg

SEQ ID NO: 393445 - DNA, 25 bp, Mus musculus
gctgacttcaccgacactggggccg

SEQ ID NO: 393446 - DNA, 25 bp, Mus musculus
ccctcattagcatggcctggaaccg

SEQ ID NO: 393447 - DNA, 25 bp, Mus musculus
ctggaaccgtccactccggcagcgc

SEQ ID NO: 393448 - DNA, 25 bp, Mus musculus
ggctgcccgcgagtgactccagacg

SEQ ID NO: 393449 - DNA, 25 bp, Mus musculus
gcgcgcacccgctaaccctttctac

SEQ ID NO: 393450 - DNA, 25 bp, Mus musculus
ggtccttccaacagctggcccttta

SEQ ID NO: 393451 - DNA, 25 bp, Mus musculus
agagcccgccgccaagcctgcgtcc

SEQ ID NO: 393452 - DNA, 25 bp, Mus musculus
ttttcttccgtctacgtccagctct

SEQ ID NO: 393453 - DNA, 25 bp, Mus musculus
ggcgcttctgagaatcgcgcccacg

SEQ ID NO: 393454 - DNA, 25 bp, Mus musculus
gtctacgtccagctctccggagttg

SEQ ID NO: 393455 - DNA, 25 bp, Mus musculus
ttgcccggtgctgcccagccaccta

SEQ ID NO: 393456 - DNA, 25 bp, Mus musculus
tgacccacgctacgccacggcaacg

SEQ ID NO: 393457 - DNA, 25 bp, Mus musculus
ctccgcgcccgcagagtataggggc

SEQ ID NO: 393458 - DNA, 25 bp, Mus musculus
agccctggaccactcttcgcggcga

SEQ ID NO: 393459 - DNA, 25 bp, Mus musculus
gcgcaggcgcttctgagaatcgcgc

SEQ ID NO: 393460 - DNA, 25 bp, Mus musculus
ttgggagacgggtctgacccacgct

SEQ ID NO: 393461 - DNA, 25 bp, Mus musculus
gactgaagccccgtagcgccgctga

SEQ ID NO: 393462 - DNA, 25 bp, Mus musculus
cgtcagccgcgttagactgaagccc

SEQ ID NO: 393463 - DNA, 25 bp, Mus musculus
ggagttgcgtcagccgcgttagact

SEQ ID NO: 393464 - DNA, 25 bp, Mus musculus
tccagctctccggagttgcgtcagc

SEQ ID NO: 393465 - DNA, 25 bp, Mus musculus
ccctttcagtgagtgtaccccttgc

SEQ ID NO: 393466 - DNA, 25 bp, Mus musculus
ccctgggaagaagagtcgcgtactt

SEQ ID NO: 393467 - DNA, 25 bp, Mus musculus
gggcggtctcagaaagcatcaggac

SEQ ID NO: 393468 - DNA, 25 bp, Mus musculus
gttacctggcaaccgctgggagcct

SEQ ID NO: 393469 - DNA, 25 bp, Mus musculus
ttcatgctgctctcctccttagcgg

SEQ ID NO: 393470 - DNA, 25 bp, Mus musculus
acgaccctgagcgtccttcatgctg

SEQ ID NO: 393471 - DNA, 25 bp, Mus musculus
gaaggccgtgttgttacgaccctga

SEQ ID NO: 393472 - DNA, 25 bp, Mus musculus
ccgggtgctcttcagccaatggaag

SEQ ID NO: 393473 - DNA, 25 bp, Mus musculus
tctttgcctgatcccgccgctagat

SEQ ID NO: 393474 - DNA, 25 bp, Mus musculus
gtcgcgtacttcgtcatcagcttcc

SEQ ID NO: 393475 - DNA, 25 bp, Mus musculus
agggagtcggactctcagacgaatc

SEQ ID NO: 393476 - DNA, 25 bp, Mus musculus
cgttcacgggcatcgatagagtcca

SEQ ID NO: 393477 - DNA, 25 bp, Mus musculus
ccgccgcatcacctggaaaggggtc

SEQ ID NO: 393478 - DNA, 25 bp, Mus musculus
gggtctccagatacgtcccaggagc

SEQ ID NO: 393479 - DNA, 25 bp, Mus musculus
cagcttccgtctgcgcattggctca

SEQ ID NO: 393480 - DNA, 25 bp, Mus musculus
cgattgcagacgactgggtagatca

SEQ ID NO: 393481 - DNA, 25 bp, Mus musculus
agatcaggccttgctggcgttggaa

SEQ ID NO: 393482 - DNA, 25 bp, Mus musculus
tcttccagactgaagttgcggcgtc

SEQ ID NO: 393483 - DNA, 25 bp, Mus musculus
agctcgcacctttctgcagttcttg

SEQ ID NO: 393484 - DNA, 25 bp, Mus musculus
cacctccggcttccatggagctgga

SEQ ID NO: 393485 - DNA, 25 bp, Mus musculus
tctgacaatgtcagggctcccgcgc

SEQ ID NO: 393486 - DNA, 25 bp, Mus musculus
ggtgacctgagatcgcatccctgga

SEQ ID NO: 393487 - DNA, 25 bp, Mus musculus
ttccggcgacgttctgacaatgtca

SEQ ID NO: 393488 - DNA, 25 bp, Mus musculus
tggtcactctccattccggcgacgt

SEQ ID NO: 393489 - DNA, 25 bp, Mus musculus
ccgcctgccggtcctttaacaatgg

SEQ ID NO: 393490 - DNA, 25 bp, Mus musculus
aagattctctgcaggtgagcggccc

SEQ ID NO: 393491 - DNA, 25 bp, Mus musculus
cccgggacccatcaaagattctctg

SEQ ID NO: 393492 - DNA, 25 bp, Mus musculus
atctttctttgccagcacccgggac

SEQ ID NO: 393493 - DNA, 25 bp, Mus musculus
gctgaggtcgaacccagaactcgga

SEQ ID NO: 393494 - DNA, 25 bp, Mus musculus
ttaactccacgtccattgcgagcgc

SEQ ID NO: 393495 - DNA, 25 bp, Mus musculus
cggcccgccttttcctgtaggatgc

SEQ ID NO: 393496 - DNA, 25 bp, Mus musculus
gcgcctgggctgcaaaaggatcaaa

SEQ ID NO: 393497 - DNA, 25 bp, Mus musculus
atcaaagacttgagtgggccgcgcg

SEQ ID NO: 393498 - DNA, 25 bp, Mus musculus
gagcaacttgtctagagacgcctga

SEQ ID NO: 393499 - DNA, 25 bp, Mus musculus
actcccgtccgttgcctctagatgg

SEQ ID NO: 393500 - DNA, 25 bp, Mus musculus
cctctagatggcaggcttcgaaatc

SEQ ID NO: 393501 - DNA, 25 bp, Mus musculus
cctaattgtaaacgcctctcgggca

SEQ ID NO: 393502 - DNA, 25 bp, Mus musculus
gctcacaggcgtcggccatgacagt

SEQ ID NO: 393503 - DNA, 25 bp, Mus musculus
gccatgacagttacatccgggtatg

SEQ ID NO: 393504 - DNA, 25 bp, Mus musculus
tccgggtatgatgcctagccacggc

SEQ ID NO: 393505 - DNA, 25 bp, Mus musculus
ctagccacggcctgaggctccggaa

SEQ ID NO: 393506 - DNA, 25 bp, Mus musculus
cgcggaaggatacgcgctcgaccga

SEQ ID NO: 393507 - DNA, 25 bp, Mus musculus
gcaggcttcgaaatccctaattgta

SEQ ID NO: 393508 - DNA, 25 bp, Mus musculus
ctactatgggcccagtctatggcta

SEQ ID NO: 393509 - DNA, 25 bp, Mus musculus
gcctcgacggcatccctactatggg

SEQ ID NO: 393510 - DNA, 25 bp, Mus musculus
ccacggtctcagagcctaggacttg

SEQ ID NO: 393511 - DNA, 25 bp, Mus musculus
gctggttgtaagtttgtccctaaga

SEQ ID NO: 393512 - DNA, 25 bp, Mus musculus
ctcttagggctggtcattgtcgtct

SEQ ID NO: 393513 - DNA, 25 bp, Mus musculus
taacccggggctcttgctagctctt

SEQ ID NO: 393514 - DNA, 25 bp, Mus musculus
tgccgcaaagttttctagagaagtc

SEQ ID NO: 393515 - DNA, 25 bp, Mus musculus
agctcatgttaaatagtcccgtcca

SEQ ID NO: 393516 - DNA, 25 bp, Mus musculus
cgcctcttgcgctaggaagctcatg

SEQ ID NO: 393517 - DNA, 25 bp, Mus musculus
accagttaggatgtcgggacgcaca

SEQ ID NO: 393518 - DNA, 25 bp, Mus musculus
cggagccgccaagaccagttaggat

SEQ ID NO: 393519 - DNA, 25 bp, Mus musculus
ccgccatctgggactcgcaggcaat

SEQ ID NO: 393520 - DNA, 25 bp, Mus musculus
ccatggcctactctcgggaggctga

SEQ ID NO: 393521 - DNA, 25 bp, Mus musculus
ggggttcttccttgcagagactccc

SEQ ID NO: 393522 - DNA, 25 bp, Mus musculus
ctgtcgccaccacgggatccggctt

SEQ ID NO: 393523 - DNA, 25 bp, Mus musculus
atccggcttcttgctgccgcagaag

SEQ ID NO: 393524 - DNA, 25 bp, Mus musculus
aacctgaggaataggctgctgcctg

SEQ ID NO: 393525 - DNA, 25 bp, Mus musculus
ttttaaccgggatgtttgagcgtgc

SEQ ID NO: 393526 - DNA, 25 bp, Mus musculus
cttgcccttcctgagcctgcgaggt

SEQ ID NO: 393527 - DNA, 25 bp, Mus musculus
ctgcactgaggcgtccgagtaaaac

SEQ ID NO: 393528 - DNA, 25 bp, Mus musculus
ccttcctgagcctgcgaggtgctca

SEQ ID NO: 393529 - DNA, 25 bp, Mus musculus
ctggaagcctttccgctgcactgag

SEQ ID NO: 393530 - DNA, 25 bp, Mus musculus
tgcacagcctggaagcctttccgct

SEQ ID NO: 393531 - DNA, 25 bp, Mus musculus
tgaggaataggctgctgcctgtcgc

SEQ ID NO: 393532 - DNA, 25 bp, Mus musculus
gaggtgctcagcctgaagccaccag

SEQ ID NO: 393533 - DNA, 25 bp, Mus musculus
cggcggctgaagaacgctcctttta

SEQ ID NO: 393534 - DNA, 25 bp, Mus musculus
atgtttgagcgtgcggctcccttgc

SEQ ID NO: 393535 - DNA, 25 bp, Mus musculus
gcgtccgagtaaaacctgaggaata

SEQ ID NO: 393536 - DNA, 25 bp, Mus musculus
aggctcgactcctgcagtgtctgga

SEQ ID NO: 393537 - DNA, 25 bp, Mus musculus
ctcggatccagagagacaccacgta

SEQ ID NO: 393538 - DNA, 25 bp, Mus musculus
cctggacttggaggagtactaaagc

SEQ ID NO: 393539 - DNA, 25 bp, Mus musculus
ctaaagcagtttcccgcagacattg

SEQ ID NO: 393540 - DNA, 25 bp, Mus musculus
ttcagcccgacttgcccggagacta

SEQ ID NO: 393541 - DNA, 25 bp, Mus musculus
acctaccagctttgcaggggtcgtg

SEQ ID NO: 393542 - DNA, 25 bp, Mus musculus
ggctccgtagtccaaggcgacattc

SEQ ID NO: 393543 - DNA, 25 bp, Mus musculus
gcccgagggacttaacctgcacaga

SEQ ID NO: 393544 - DNA, 25 bp, Mus musculus
ccaggcaccggtagggtaccaagca

SEQ ID NO: 393545 - DNA, 25 bp, Mus musculus
tgctaaacacgacttgcccagaggc

SEQ ID NO: 393546 - DNA, 25 bp, Mus musculus
atcacttatgcgtcctaggcgaggc

SEQ ID NO: 393547 - DNA, 25 bp, Mus musculus
ccgtgcaccacacaggctttgcttt

SEQ ID NO: 393548 - DNA, 25 bp, Mus musculus
gcccacctggccgaatgcaatcttg

SEQ ID NO: 393549 - DNA, 25 bp, Mus musculus
tagcagcaacagtagcaccagggtg

SEQ ID NO: 393550 - DNA, 25 bp, Mus musculus
gattcacatccaccgggcgcggaca

SEQ ID NO: 393551 - DNA, 25 bp, Mus musculus
tcgcttcgcctcaccgtgtgttcgt

SEQ ID NO: 393552 - DNA, 25 bp, Mus musculus
tcaccgtgtgttcgtgctcgtcaga

SEQ ID NO: 393553 - DNA, 25 bp, Mus musculus
agcgtccagtttcccgggtccagag

SEQ ID NO: 393554 - DNA, 25 bp, Mus musculus
tggcaagcgcctggatcaccacgca

SEQ ID NO: 393555 - DNA, 25 bp, Mus musculus
ttcgtgctcgtcagaccgagcccgg

SEQ ID NO: 393556 - DNA, 25 bp, Mus musculus
gctgcttgctcagcctcggcctgga

SEQ ID NO: 393557 - DNA, 25 bp, Mus musculus
cgctgctgtgctgcttgctcagcct

SEQ ID NO: 393558 - DNA, 25 bp, Mus musculus
gggtatttcctggttggcaagcgcc

SEQ ID NO: 393559 - DNA, 25 bp, Mus musculus
tgctgtgtgcacagcgtccagtttc

SEQ ID NO: 393560 - DNA, 25 bp, Mus musculus
cctgcgcgaagcgatgggtatttcc

SEQ ID NO: 393561 - DNA, 25 bp, Mus musculus
cgtgtccgcgtgtaaaccgttcaca

SEQ ID NO: 393562 - DNA, 25 bp, Mus musculus
gtgaagacgtgtccgcgtgtaaacc

SEQ ID NO: 393563 - DNA, 25 bp, Mus musculus
aagggttccgagtcgccgctgctgt

SEQ ID NO: 393564 - DNA, 25 bp, Mus musculus
tcgcgcatccctgaagacccacagg

SEQ ID NO: 393565 - DNA, 25 bp, Mus musculus
gcaccacacgctgcggcggatggca

SEQ ID NO: 393566 - DNA, 25 bp, Mus musculus
atggcaggcacgctgcagcattggc

SEQ ID NO: 393567 - DNA, 25 bp, Mus musculus
tgcagcattggcagcagtcctggct

SEQ ID NO: 393568 - DNA, 25 bp, Mus musculus
cgtcgcctggctgcactccacacaa

SEQ ID NO: 393569 - DNA, 25 bp, Mus musculus
tggctggccgaagcatcctaccagc

SEQ ID NO: 393570 - DNA, 25 bp, Mus musculus
tcttctggctacgaacctgccggca

SEQ ID NO: 393571 - DNA, 25 bp, Mus musculus
tgtctgcgtcttctggctacgaacc

SEQ ID NO: 393572 - DNA, 25 bp, Mus musculus
agtagcaccagcacgcatcgcgcat

SEQ ID NO: 393573 - DNA, 25 bp, Mus musculus
tggctacgaacctgccggcaggaca

SEQ ID NO: 393574 - DNA, 25 bp, Mus musculus
cccacaggtcctgggcagagaaaga

SEQ ID NO: 393575 - DNA, 25 bp, Mus musculus
agaaagaggcatccgggaccagccg

SEQ ID NO: 393576 - DNA, 25 bp, Mus musculus
gaccagccggtatgtctgcgtcttc

SEQ ID NO: 393577 - DNA, 25 bp, Mus musculus
gacagtagcaccagcacgcatcgcg

SEQ ID NO: 393578 - DNA, 25 bp, Mus musculus
cctgacagaaaacaccaggggaatg

SEQ ID NO: 393579 - DNA, 25 bp, Mus musculus
ggtgagtcaaccctcgggaacgcca

SEQ ID NO: 393580 - DNA, 25 bp, Mus musculus
gaacgccagtccgtctaaaaactgc

SEQ ID NO: 393581 - DNA, 25 bp, Mus musculus
cagtccgtctaaaaactgccggcgg

SEQ ID NO: 393582 - DNA, 25 bp, Mus musculus
aaaacgtctggtgccggtatcctcg

SEQ ID NO: 393583 - DNA, 25 bp, Mus musculus
taaatccagcaggtcggggaggaac

SEQ ID NO: 393584 - DNA, 25 bp, Mus musculus
tgccggtatcctcgggtgagtcaac

SEQ ID NO: 393585 - DNA, 25 bp, Mus musculus
caccaggggaatggatccgggaaat

SEQ ID NO: 393586 - DNA, 25 bp, Mus musculus
cttgggacgcctgacagaaaacacc

SEQ ID NO: 393587 - DNA, 25 bp, Mus musculus
ggagaatccgtcttgggacgcctga

SEQ ID NO: 393588 - DNA, 25 bp, Mus musculus
tttgacagttctcgggggagaatcc

SEQ ID NO: 393589 - DNA, 25 bp, Mus musculus
gggtttgcatttcgctgtgtacatt

SEQ ID NO: 393590 - DNA, 25 bp, Mus musculus
tttcgctgtgtacattaaaaacgtc

SEQ ID NO: 393591 - DNA, 25 bp, Mus musculus
aatggatccgggaaataaatccagc

SEQ ID NO: 393592 - DNA, 25 bp, Mus musculus
tttggggccactcatcttctgagga

SEQ ID NO: 393593 - DNA, 25 bp, Mus musculus
gcgacccactcccaaggcggtgatt

SEQ ID NO: 393594 - DNA, 25 bp, Mus musculus
gcgggctgaccttcgctccgcagtg

SEQ ID NO: 393595 - DNA, 25 bp, Mus musculus
cgccattttgtagggttctctctga

SEQ ID NO: 393596 - DNA, 25 bp, Mus musculus
tagggttctctctgacgcgggaccc

SEQ ID NO: 393597 - DNA, 25 bp, Mus musculus
caccacccggaggtaggagaggatg

SEQ ID NO: 393598 - DNA, 25 bp, Mus musculus
ctggcgcgcgagaaagcgcccggtc

SEQ ID NO: 393599 - DNA, 25 bp, Mus musculus
aaggctcgggtttggggccactcat

SEQ ID NO: 393600 - DNA, 25 bp, Mus musculus
ctccgcagtgccgtcaccacatgac

SEQ ID NO: 393601 - DNA, 25 bp, Mus musculus
ggccactcatcttctgaggaaggtc

SEQ ID NO: 393602 - DNA, 25 bp, Mus musculus
ccgtcgccattttgtagggttctct

SEQ ID NO: 393603 - DNA, 25 bp, Mus musculus
ctcatcttctgaggaaggtcccggg

SEQ ID NO: 393604 - DNA, 25 bp, Mus musculus
tctgaggaaggtcccgggaagacaa

SEQ ID NO: 393605 - DNA, 25 bp, Mus musculus
ctcccaaggcggtgattggctagcc

SEQ ID NO: 393606 - DNA, 25 bp, Mus musculus
ctgtgctcaggacagtggcgactct

SEQ ID NO: 393607 - DNA, 25 bp, Mus musculus
ggaagtgagaagtccacacgaccag

SEQ ID NO: 393608 - DNA, 25 bp, Mus musculus
gctgcgcctgctacccacctgaggc

SEQ ID NO: 393609 - DNA, 25 bp, Mus musculus
cggctggcaccggagcacggtatcc

SEQ ID NO: 393610 - DNA, 25 bp, Mus musculus
accggagcacggtatccggtgccca

SEQ ID NO: 393611 - DNA, 25 bp, Mus musculus
ggagcacggtatccggtgcccacag

SEQ ID NO: 393612 - DNA, 25 bp, Mus musculus
cacagccgcggtaggcgacgtcgct

SEQ ID NO: 393613 - DNA, 25 bp, Mus musculus
ggttagaagcagagtccagctgtgc

SEQ ID NO: 393614 - DNA, 25 bp, Mus musculus
cagctgtgctcaggacagtggcgac

SEQ ID NO: 393615 - DNA, 25 bp, Mus musculus
tgctcaggacagtggcgactctggc

SEQ ID NO: 393616 - DNA, 25 bp, Mus musculus
acagtggcgactctggcgcttcctc

SEQ ID NO: 393617 - DNA, 25 bp, Mus musculus
aggggaagtgagaagtccacacgac

SEQ ID NO: 393618 - DNA, 25 bp, Mus musculus
ccctgctcgtgccacgtgtgtcccg

SEQ ID NO: 393619 - DNA, 25 bp, Mus musculus
gtgtccagagggtctgccccgcctg

SEQ ID NO: 393620 - DNA, 25 bp, Mus musculus
gtgcggaacttgcaacagttggtgc

SEQ ID NO: 393621 - DNA, 25 bp, Mus musculus
ggaagtgatagatgggactagttta

SEQ ID NO: 393622 - DNA, 25 bp, Mus musculus
tgatagatgggactagtttaaaacc

SEQ ID NO: 393623 - DNA, 25 bp, Mus musculus
ccgagcgccggcgtagaaagacgcc

SEQ ID NO: 393624 - DNA, 25 bp, Mus musculus
gcgccggcgtagaaagacgccgttc

SEQ ID NO: 393625 - DNA, 25 bp, Mus musculus
actggacgtgggacgcagagctggt

SEQ ID NO: 393626 - DNA, 25 bp, Mus musculus
ttgcaacagttggtgcgggccgata

SEQ ID NO: 393627 - DNA, 25 bp, Mus musculus
acttgcaacagttggtgcgggccga

SEQ ID NO: 393628 - DNA, 25 bp, Mus musculus
caatggtgcggaacttgcaacagtt

SEQ ID NO: 393629 - DNA, 25 bp, Mus musculus
tgcgagaagcaatggtgcggaactt

SEQ ID NO: 393630 - DNA, 25 bp, Mus musculus
ttcgaccgagaagttgcgagaagca

SEQ ID NO: 393631 - DNA, 25 bp, Mus musculus
ccgtttcgaccgagaagttgcgaga

SEQ ID NO: 393632 - DNA, 25 bp, Mus musculus
aggagccgtttcgaccgagaagttg

SEQ ID NO: 393633 - DNA, 25 bp, Mus musculus
gccgataggcaggtaggaagtgata

SEQ ID NO: 393634 - DNA, 25 bp, Mus musculus
gtgcggatttgtgtttggcgtgcgc

SEQ ID NO: 393635 - DNA, 25 bp, Mus musculus
ctgagcgagccaagtggggtgtcat

SEQ ID NO: 393636 - DNA, 25 bp, Mus musculus
ggctgcggagttagtcctcgacgca

SEQ ID NO: 393637 - DNA, 25 bp, Mus musculus
agttagtcctcgacgcacgggtcgg

SEQ ID NO: 393638 - DNA, 25 bp, Mus musculus
cgcacgggtcggtgtgtgcggattt

SEQ ID NO: 393639 - DNA, 25 bp, Mus musculus
tgcggagttagtcctcgacgcacgg

SEQ ID NO: 393640 - DNA, 25 bp, Mus musculus
gaggcgagctgcacctctcacactg

SEQ ID NO: 393641 - DNA, 25 bp, Mus musculus
cgagctgcacctctcacactgtgtg

SEQ ID NO: 393642 - DNA, 25 bp, Mus musculus
gctgcacctctcacactgtgtgttt

SEQ ID NO: 393643 - DNA, 25 bp, Mus musculus
cacctctcacactgtgtgttttgtc

SEQ ID NO: 393644 - DNA, 25 bp, Mus musculus
tcacactgtgtgttttgtctgtttt

SEQ ID NO: 393645 - DNA, 25 bp, Mus musculus
tgtctgtttttctctcccaaggtcc

SEQ ID NO: 393646 - DNA, 25 bp, Mus musculus
caaggtcccgtttccctctgtgcgg

SEQ ID NO: 393647 - DNA, 25 bp, Mus musculus
tagtcctcgacgcacgggtcggtgt

SEQ ID NO: 393648 - DNA, 25 bp, Mus musculus
cggggctagctccaggtgctatccc

SEQ ID NO: 393649 - DNA, 25 bp, Mus musculus
cgtcttaagcggagggcgctcagct

SEQ ID NO: 393650 - DNA, 25 bp, Mus musculus
attccggtccctctgatccgtcagg

SEQ ID NO: 393651 - DNA, 25 bp, Mus musculus
acgggcggatccgtactcacaggcg

SEQ ID NO: 393652 - DNA, 25 bp, Mus musculus
atgttcttggggatggcctgcaaac

SEQ ID NO: 393653 - DNA, 25 bp, Mus musculus
gcctgcaaacccgtgccgtggcagt

SEQ ID NO: 393654 - DNA, 25 bp, Mus musculus
ggcagtccaccgtagtgccggtgca

SEQ ID NO: 393655 - DNA, 25 bp, Mus musculus
cccttgcggatcgagtggtacctag

SEQ ID NO: 393656 - DNA, 25 bp, Mus musculus
tgcgtagacccaggaaaggcgtctt

SEQ ID NO: 393657 - DNA, 25 bp, Mus musculus
cccaactgactgctgtgaggaggaa

SEQ ID NO: 393658 - DNA, 25 bp, Mus musculus
ccggcagtcatccatcaatcgaaaa

SEQ ID NO: 393659 - DNA, 25 bp, Mus musculus
aaagcacacttccagggccagactc

SEQ ID NO: 393660 - DNA, 25 bp, Mus musculus
tggtacctagatgctcccagcgaca

SEQ ID NO: 393661 - DNA, 25 bp, Mus musculus
cccagcgacagcgtctgtgcgtaga

SEQ ID NO: 393662 - DNA, 25 bp, Mus musculus
agttgccactcaaaacgctcggcgc

SEQ ID NO: 393663 - DNA, 25 bp, Mus musculus
cgctctgggcttcagttgccactca

SEQ ID NO: 393664 - DNA, 25 bp, Mus musculus
aaaacttggctcacctccggccaga

SEQ ID NO: 393665 - DNA, 25 bp, Mus musculus
ccagggcagacaccatgaccgtggc

SEQ ID NO: 393666 - DNA, 25 bp, Mus musculus
gggctccacacacggccgtgggact

SEQ ID NO: 393667 - DNA, 25 bp, Mus musculus
cgcagcgggaagcacggaccgcaaa

SEQ ID NO: 393668 - DNA, 25 bp, Mus musculus
caccacgggagagaggaacaaagcc

SEQ ID NO: 393669 - DNA, 25 bp, Mus musculus
gggcctgtggaccacggtgactcaa

SEQ ID NO: 393670 - DNA, 25 bp, Mus musculus
agggcggcgacatcgctagcccaca

SEQ ID NO: 393671 - DNA, 25 bp, Mus musculus
acagtcccgtctcctaggcagcagg

SEQ ID NO: 393672 - DNA, 25 bp, Mus musculus
cagaggctgtcacgaaggacattta

SEQ ID NO: 393673 - DNA, 25 bp, Mus musculus
taggcagcaggacggaaaacttggc

SEQ ID NO: 393674 - DNA, 25 bp, Mus musculus
catcttccgcggcagcttggtctgc

SEQ ID NO: 393675 - DNA, 25 bp, Mus musculus
tgggattctctaaaccgctctgggc

SEQ ID NO: 393676 - DNA, 25 bp, Mus musculus
tactgcgtggcggagatctcccccg

SEQ ID NO: 393677 - DNA, 25 bp, Mus musculus
acagttacacgcaaagcttcccgca

SEQ ID NO: 393678 - DNA, 25 bp, Mus musculus
cagctacagttacacgcaaagcttc

SEQ ID NO: 393679 - DNA, 25 bp, Mus musculus
cgacagctacagttacacgcaaagc

SEQ ID NO: 393680 - DNA, 25 bp, Mus musculus
cgcgacagctacagttacacgcaaa

SEQ ID NO: 393681 - DNA, 25 bp, Mus musculus
gcagacttcattcgcgacagctaca

SEQ ID NO: 393682 - DNA, 25 bp, Mus musculus
gcgcagacttcattcgcgacagcta

SEQ ID NO: 393683 - DNA, 25 bp, Mus musculus
cggtgcgcagacttcattcgcgaca

SEQ ID NO: 393684 - DNA, 25 bp, Mus musculus
gcactggcgacgacgacgacccgca

SEQ ID NO: 393685 - DNA, 25 bp, Mus musculus
cggagacccgcactggcgacgacga

SEQ ID NO: 393686 - DNA, 25 bp, Mus musculus
gcacacccgttcctcgggcctctgt

SEQ ID NO: 393687 - DNA, 25 bp, Mus musculus
tggtccctgcctagcccggcttggg

SEQ ID NO: 393688 - DNA, 25 bp, Mus musculus
agttacacgcaaagcttcccgcaca

SEQ ID NO: 393689 - DNA, 25 bp, Mus musculus
gagacccgcactggcgacgacgacg

SEQ ID NO: 393690 - DNA, 25 bp, Mus musculus
cgttcgctagaagacttaggggcgc

SEQ ID NO: 393691 - DNA, 25 bp, Mus musculus
gctcgtggccgcaaccgcggcgacc

SEQ ID NO: 393692 - DNA, 25 bp, Mus musculus
aaccgcggcgaccgctcgctggagt

SEQ ID NO: 393693 - DNA, 25 bp, Mus musculus
gcgctccgcctgctgtccaccgccg

SEQ ID NO: 393694 - DNA, 25 bp, Mus musculus
gattcggtgagaagccacggagccg

SEQ ID NO: 393695 - DNA, 25 bp, Mus musculus
gggagacgttcgctagaagacttag

SEQ ID NO: 393696 - DNA, 25 bp, Mus musculus
ggacggcgcaaaccgtgcgagacca

SEQ ID NO: 393697 - DNA, 25 bp, Mus musculus
ggcgcaaaccgtgcgagaccactgc

SEQ ID NO: 393698 - DNA, 25 bp, Mus musculus
gtgcgagaccactgcccacactgtc

SEQ ID NO: 393699 - DNA, 25 bp, Mus musculus
tgtctgcccagagatagtttatatg

SEQ ID NO: 393700 - DNA, 25 bp, Mus musculus
tagtttatatggttgcgagcgattc

SEQ ID NO: 393701 - DNA, 25 bp, Mus musculus
ttatatggttgcgagcgattccggg

SEQ ID NO: 393702 - DNA, 25 bp, Mus musculus
tgcccacactgtctgcccagagata

SEQ ID NO: 393703 - DNA, 25 bp, Mus musculus
gcggctcctaccaccgcgcgcgacc

SEQ ID NO: 393704 - DNA, 25 bp, Mus musculus
tgaccaaacggtggctcgcactcgc

SEQ ID NO: 393705 - DNA, 25 bp, Mus musculus
aacccacgtgtgtgtcctcagccgg

SEQ ID NO: 393706 - DNA, 25 bp, Mus musculus
agccacggcagaacccacgtgtgtg

SEQ ID NO: 393707 - DNA, 25 bp, Mus musculus
gaaaagacagcagaagccacggcag

SEQ ID NO: 393708 - DNA, 25 bp, Mus musculus
ggctcgcactcgcccagagaacaag

SEQ ID NO: 393709 - DNA, 25 bp, Mus musculus
ccatgttgaccaaacggtggctcgc

SEQ ID NO: 393710 - DNA, 25 bp, Mus musculus
ccgagacaccagagggcaatttccc

SEQ ID NO: 393711 - DNA, 25 bp, Mus musculus
agcgcttcaacttggccgagacacc

SEQ ID NO: 393712 - DNA, 25 bp, Mus musculus
ggcctttcttccagcgcttcaactt

SEQ ID NO: 393713 - DNA, 25 bp, Mus musculus
tgctgtcgctgctgtggcctttctt

SEQ ID NO: 393714 - DNA, 25 bp, Mus musculus
cccggctacctgacgggcggctgaa

SEQ ID NO: 393715 - DNA, 25 bp, Mus musculus
agatgccgcccaaggagtcccacgg

SEQ ID NO: 393716 - DNA, 25 bp, Mus musculus
gaatgccacaagatgccgcccaagg

SEQ ID NO: 393717 - DNA, 25 bp, Mus musculus
agcgtccacacacgccgaaaagaca

SEQ ID NO: 393718 - DNA, 25 bp, Mus musculus
catcagtggctgtaccggagtatac

SEQ ID NO: 393719 - DNA, 25 bp, Mus musculus
ggagtatacttgaggcgcctgccca

SEQ ID NO: 393720 - DNA, 25 bp, Mus musculus
aaaatctgttcttccggtccgagca

SEQ ID NO: 393721 - DNA, 25 bp, Mus musculus
gccgccgctaggctaaaatctgttc

SEQ ID NO: 393722 - DNA, 25 bp, Mus musculus
cccgttaagtctgagagtctgtgcc

SEQ ID NO: 393723 - DNA, 25 bp, Mus musculus
tggggaacccgcttgtcaaggtcac

SEQ ID NO: 393724 - DNA, 25 bp, Mus musculus
tcggtcggcctctgcagttgaattt

SEQ ID NO: 393725 - DNA, 25 bp, Mus musculus
tctgtcgagcgagtggaaagatttc

SEQ ID NO: 393726 - DNA, 25 bp, Mus musculus
ttagcaggccgcagaacttgcctga

SEQ ID NO: 393727 - DNA, 25 bp, Mus musculus
cgctacgtacaacgcatgcgcactg

SEQ ID NO: 393728 - DNA, 25 bp, Mus musculus
tagcacgcgggtaccgctacgtaca

SEQ ID NO: 393729 - DNA, 25 bp, Mus musculus
ctccttgcttacgtgcgctccgtga

SEQ ID NO: 393730 - DNA, 25 bp, Mus musculus
tggagctcaagctcgcaaccagcac

SEQ ID NO: 393731 - DNA, 25 bp, Mus musculus
cccatcatggcgaagcggcaggtca

SEQ ID NO: 393732 - DNA, 25 bp, Mus musculus
ttcagcacagcgcagagatcacagc

SEQ ID NO: 393733 - DNA, 25 bp, Mus musculus
gacgacttctcattggtcagctaga

SEQ ID NO: 393734 - DNA, 25 bp, Mus musculus
agccagccagcgacgaaaagatgta

SEQ ID NO: 393735 - DNA, 25 bp, Mus musculus
accaaagcgttctgcggctgagcca

SEQ ID NO: 393736 - DNA, 25 bp, Mus musculus
ggctgagccaccaaagacgcgtccg

SEQ ID NO: 393737 - DNA, 25 bp, Mus musculus
tgtgcccaaggaccggaactcaacg

SEQ ID NO: 393738 - DNA, 25 bp, Mus musculus
gcgccattctcgctggtcttcatca

SEQ ID NO: 393739 - DNA, 25 bp, Mus musculus
gggctgccttcctccaagttacaca

SEQ ID NO: 393740 - DNA, 25 bp, Mus musculus
ctggttgccacacagcctggaactg

SEQ ID NO: 393741 - DNA, 25 bp, Mus musculus
cacttaccggggatgcagtacctca

SEQ ID NO: 393742 - DNA, 25 bp, Mus musculus
gagcgaggtctgactccatttccca

SEQ ID NO: 393743 - DNA, 25 bp, Mus musculus
gagcggcctcgcagttacacgagta

SEQ ID NO: 393744 - DNA, 25 bp, Mus musculus
tacctcaccggtggtgccatgcttg

SEQ ID NO: 393745 - DNA, 25 bp, Mus musculus
cacgagtaccaattggcgccttcga

SEQ ID NO: 393746 - DNA, 25 bp, Mus musculus
agcacggcagcgcttgtagtaggca

SEQ ID NO: 393747 - DNA, 25 bp, Mus musculus
aggcgtacgcactgctccatattgc

SEQ ID NO: 393748 - DNA, 25 bp, Mus musculus
gcttgtagtaggcatcgagcgctcc

SEQ ID NO: 393749 - DNA, 25 bp, Mus musculus
gcgctccgtacgtgttgttgtaata

SEQ ID NO: 393750 - DNA, 25 bp, Mus musculus
taactcatggtgtaaggcgtacgca

SEQ ID NO: 393751 - DNA, 25 bp, Mus musculus
gcactgctccatattgctcattata

SEQ ID NO: 393752 - DNA, 25 bp, Mus musculus
gctcattatattgctcggtcaagtc

SEQ ID NO: 393753 - DNA, 25 bp, Mus musculus
atattgctcggtcaagtctgccacg

SEQ ID NO: 393754 - DNA, 25 bp, Mus musculus
ggtcaagtctgccacgcggcccgaa

SEQ ID NO: 393755 - DNA, 25 bp, Mus musculus
cgcggcccgaacgatctattggaca

SEQ ID NO: 393756 - DNA, 25 bp, Mus musculus
cgatctattggacactctttggacc

SEQ ID NO: 393757 - DNA, 25 bp, Mus musculus
ttggacactctttggaccagtgccc

SEQ ID NO: 393758 - DNA, 25 bp, Mus musculus
tcctaagccggctggtggacaactg

SEQ ID NO: 393759 - DNA, 25 bp, Mus musculus
cgtgttgttgtaatacaatgaatcc

SEQ ID NO: 393760 - DNA, 25 bp, Mus musculus
agggcgcataattcccggccgctct

SEQ ID NO: 393761 - DNA, 25 bp, Mus musculus
gccaggcagtcccttcagggaccta

SEQ ID NO: 393762 - DNA, 25 bp, Mus musculus
gcttctcggagccagacggggccct

SEQ ID NO: 393763 - DNA, 25 bp, Mus musculus
ctcggagtgatcctggagtagctgc

SEQ ID NO: 393764 - DNA, 25 bp, Mus musculus
cttggggttcccgagcgacctcgct

SEQ ID NO: 393765 - DNA, 25 bp, Mus musculus
gcgctgccagttggcccttgccttg

SEQ ID NO: 393766 - DNA, 25 bp, Mus musculus
cgcaagcgagcaggtaacgccagga

SEQ ID NO: 393767 - DNA, 25 bp, Mus musculus
ccaggggagatccaggagctctcga

SEQ ID NO: 393768 - DNA, 25 bp, Mus musculus
ccgcaaagtttgtggcgaagccggc

SEQ ID NO: 393769 - DNA, 25 bp, Mus musculus
tccgctggcccgcaaagtttgtggc

SEQ ID NO: 393770 - DNA, 25 bp, Mus musculus
gcggtacgcatcctgggaaaagcca

SEQ ID NO: 393771 - DNA, 25 bp, Mus musculus
atgagaaaaccagacccggcccgag

SEQ ID NO: 393772 - DNA, 25 bp, Mus musculus
gtgccgtcggtcacatgcgcacctg

SEQ ID NO: 393773 - DNA, 25 bp, Mus musculus
ggggcacctccaggtcacgtgcctg

SEQ ID NO: 393774 - DNA, 25 bp, Mus musculus
ctccggagctcactttccgcaagta

SEQ ID NO: 393775 - DNA, 25 bp, Mus musculus
atgcgcggtctccacagaaggtgac

SEQ ID NO: 393776 - DNA, 25 bp, Mus musculus
ccacagaaggtgacgcgaaagctaa

SEQ ID NO: 393777 - DNA, 25 bp, Mus musculus
cgaaagctaaggaggccgcgattgc

SEQ ID NO: 393778 - DNA, 25 bp, Mus musculus
attggccactacacaagcgcgaggg

SEQ ID NO: 393779 - DNA, 25 bp, Mus musculus
ccgtgcctacgcgtcgccaagtaaa

SEQ ID NO: 393780 - DNA, 25 bp, Mus musculus
caagtaaacaggacaggctaggggc

SEQ ID NO: 393781 - DNA, 25 bp, Mus musculus
cgaggttgccatcgagtgcagcatc

SEQ ID NO: 393782 - DNA, 25 bp, Mus musculus
gtgcagcatctatcccgagcgcatc

SEQ ID NO: 393783 - DNA, 25 bp, Mus musculus
gagcgcatctaccagggctccagtg

SEQ ID NO: 393784 - DNA, 25 bp, Mus musculus
ggctccagtggaagctacttcgtca

SEQ ID NO: 393785 - DNA, 25 bp, Mus musculus
ctacttcgtcaaggactctcagggg

SEQ ID NO: 393786 - DNA, 25 bp, Mus musculus
ctaacccgggtttgtctcgagcatg

SEQ ID NO: 393787 - DNA, 25 bp, Mus musculus
agacccaccgcgagcggaacgactt

SEQ ID NO: 393788 - DNA, 25 bp, Mus musculus
ttcctcagagaaagtgctccgagcc

SEQ ID NO: 393789 - DNA, 25 bp, Mus musculus
ttttctctgggtcgagtccaacgca

SEQ ID NO: 393790 - DNA, 25 bp, Mus musculus
ccctgcagggtacacgtgacaagtg

SEQ ID NO: 393791 - DNA, 25 bp, Mus musculus
tcgcattcctgacacggggtgcggc

SEQ ID NO: 393792 - DNA, 25 bp, Mus musculus
cttgattgacgtcagtcccaggggc

SEQ ID NO: 393793 - DNA, 25 bp, Mus musculus
tccaatcatctagggagtatcggcg

SEQ ID NO: 393794 - DNA, 25 bp, Mus musculus
ccagtgcggagattccttgagtcca

SEQ ID NO: 393795 - DNA, 25 bp, Mus musculus
ttcgcggaccaatcagctgctgcag

SEQ ID NO: 393796 - DNA, 25 bp, Mus musculus
tcgccaaatcgaacgcggagccttc

SEQ ID NO: 393797 - DNA, 25 bp, Mus musculus
gaagccgagccaacttcgccaaatc

SEQ ID NO: 393798 - DNA, 25 bp, Mus musculus
gccaatcctcggtcacagccttaga

SEQ ID NO: 393799 - DNA, 25 bp, Mus musculus
gatcacggccacagttcctcagaga

SEQ ID NO: 393800 - DNA, 25 bp, Mus musculus
tacctacctggttgccttagctgcc

SEQ ID NO: 393801 - DNA, 25 bp, Mus musculus
cagccttagagcgagaagccgagcc

SEQ ID NO: 393802 - DNA, 25 bp, Mus musculus
tggggctctacttcatcacgctgtt

SEQ ID NO: 393803 - DNA, 25 bp, Mus musculus
gccacagctactgcaacctcaagaa

SEQ ID NO: 393804 - DNA, 25 bp, Mus musculus
tactctcggcactctacggctgctg

SEQ ID NO: 393805 - DNA, 25 bp, Mus musculus
cattccctgtcgagagctagacgtg

SEQ ID NO: 393806 - DNA, 25 bp, Mus musculus
tcaggcgaagcctggaagtcccttt

SEQ ID NO: 393807 - DNA, 25 bp, Mus musculus
acacacccagttgggccgcttcagg

SEQ ID NO: 393808 - DNA, 25 bp, Mus musculus
ccagatatcagcttccagggaccca

SEQ ID NO: 393809 - DNA, 25 bp, Mus musculus
tgtaccgcagctcagcccagatatc

SEQ ID NO: 393810 - DNA, 25 bp, Mus musculus
cgcggcccagatcggtttagggaat

SEQ ID NO: 393811 - DNA, 25 bp, Mus musculus
gcgacgggcatcatgatcgaccaga

SEQ ID NO: 393812 - DNA, 25 bp, Mus musculus
accagcaagtaccagggcccggtgc

SEQ ID NO: 393813 - DNA, 25 bp, Mus musculus
ggagccgccttctggatcaccattg

SEQ ID NO: 393814 - DNA, 25 bp, Mus musculus
gttctagtctgactgctgtaccgca

SEQ ID NO: 393815 - DNA, 25 bp, Mus musculus
tgcacttcgcgctcttcgtgtccgt

SEQ ID NO: 393816 - DNA, 25 bp, Mus musculus
ccagcctcactgtatttatttacgg

SEQ ID NO: 393817 - DNA, 25 bp, Mus musculus
gaccttaggcgtgtcctgccctgcg

SEQ ID NO: 393818 - DNA, 25 bp, Mus musculus
gcacagcgaccttaggcgtgtcctg

SEQ ID NO: 393819 - DNA, 25 bp, Mus musculus
cgcaggcgcagtatcaacgcgcttg

SEQ ID NO: 393820 - DNA, 25 bp, Mus musculus
accgcgtgtgggtcgccacctgcag

SEQ ID NO: 393821 - DNA, 25 bp, Mus musculus
ctttcctgggacagcgtccgggtag

SEQ ID NO: 393822 - DNA, 25 bp, Mus musculus
tctcttcctttcctgggacagcgtc

SEQ ID NO: 393823 - DNA, 25 bp, Mus musculus
ccctggccgttcctgtctcttcctt

SEQ ID NO: 393824 - DNA, 25 bp, Mus musculus
ctccggggcttggtggcccttctgt

SEQ ID NO: 393825 - DNA, 25 bp, Mus musculus
tcccgggtggacctgcgacttcgga

SEQ ID NO: 393826 - DNA, 25 bp, Mus musculus
gcgccaccgcagagtgagtcgcgtc

SEQ ID NO: 393827 - DNA, 25 bp, Mus musculus
cgcttgctcacctgcgcttgggtgg

SEQ ID NO: 393828 - DNA, 25 bp, Mus musculus
gtatcaacgcgcttgctcacctgcg

SEQ ID NO: 393829 - DNA, 25 bp, Mus musculus
cacctgcaggcacagcgaccttagg

SEQ ID NO: 393830 - DNA, 25 bp, Mus musculus
tcgtccaagtaggtggcagtctctg

SEQ ID NO: 393831 - DNA, 25 bp, Mus musculus
cggctgctactagggtcgtccaagt

SEQ ID NO: 393832 - DNA, 25 bp, Mus musculus
aggccacccacatggctggatgttg

SEQ ID NO: 393833 - DNA, 25 bp, Mus musculus
gtagtagtcgtactcctggccgcgt

SEQ ID NO: 393834 - DNA, 25 bp, Mus musculus
ctcggcctgccaaccgtagtagtcg

SEQ ID NO: 393835 - DNA, 25 bp, Mus musculus
ccaccgtgtgacagagcggcagatc

SEQ ID NO: 393836 - DNA, 25 bp, Mus musculus
cgcatgcgcttgtagcccaccgtgt

SEQ ID NO: 393837 - DNA, 25 bp, Mus musculus
cacggcttcgcacagcgagcggcag

SEQ ID NO: 393838 - DNA, 25 bp, Mus musculus
cgctctgggcgcaaaggcgctacct

SEQ ID NO: 393839 - DNA, 25 bp, Mus musculus
agggaaaccgtaggcctccatgagc

SEQ ID NO: 393840 - DNA, 25 bp, Mus musculus
gcatctcgggccaagggaaaccgta

SEQ ID NO: 393841 - DNA, 25 bp, Mus musculus
ggaacttgtggcagtgcagcatctc

SEQ ID NO: 393842 - DNA, 25 bp, Mus musculus
gatgttccctgaagccggctgctac

SEQ ID NO: 393843 - DNA, 25 bp, Mus musculus
ggtgcccgaactgcaccgcgatgca

SEQ ID NO: 393844 - DNA, 25 bp, Mus musculus
gtggacagcacggaccacctttcag

SEQ ID NO: 393845 - DNA, 25 bp, Mus musculus
gctgctgccactgtcaaagataaaa

SEQ ID NO: 393846 - DNA, 25 bp, Mus musculus
tgccactgtcaaagataaaaccggg

SEQ ID NO: 393847 - DNA, 25 bp, Mus musculus
ctgtcaaagataaaaccgggccatt

SEQ ID NO: 393848 - DNA, 25 bp, Mus musculus
tcaaagataaaaccgggccattgcc

SEQ ID NO: 393849 - DNA, 25 bp, Mus musculus
ctgcaggaaccctggcagcaggcga

SEQ ID NO: 393850 - DNA, 25 bp, Mus musculus
caggaaccctggcagcaggcgatcg

SEQ ID NO: 393851 - DNA, 25 bp, Mus musculus
accgtggacagcacggaccaccttt

SEQ ID NO: 393852 - DNA, 25 bp, Mus musculus
ctttcagggaccctccggtcggcag

SEQ ID NO: 393853 - DNA, 25 bp, Mus musculus
cgcgcttcaggtttcggcgatctca

SEQ ID NO: 393854 - DNA, 25 bp, Mus musculus
tcaggtttcggcgatctcatcagta

SEQ ID NO: 393855 - DNA, 25 bp, Mus musculus
ggcgatctcatcagtaccgcggaca

SEQ ID NO: 393856 - DNA, 25 bp, Mus musculus
agcccaccggctcttcctatcagca

SEQ ID NO: 393857 - DNA, 25 bp, Mus musculus
ggctcccgcgtcagcaccgtggaca

SEQ ID NO: 393858 - DNA, 25 bp, Mus musculus
agcggatactcacgcccgggtcagc

SEQ ID NO: 393859 - DNA, 25 bp, Mus musculus
ctgctgtctttctgcctcccagata

SEQ ID NO: 393860 - DNA, 25 bp, Mus musculus
ccagatagcgatctggcggctccca

SEQ ID NO: 393861 - DNA, 25 bp, Mus musculus
ccgcgctgatttaggagccgggatt

SEQ ID NO: 393862 - DNA, 25 bp, Mus musculus
cgcgcccgggcttatgtaaaggctg

SEQ ID NO: 393863 - DNA, 25 bp, Mus musculus
tttatacaactccactcgagcgcgc

SEQ ID NO: 393864 - DNA, 25 bp, Mus musculus
acagagcttcaccacggtcccagag

SEQ ID NO: 393865 - DNA, 25 bp, Mus musculus
gtcagcgctcggagccatcctctgg

SEQ ID NO: 393866 - DNA, 25 bp, Mus musculus
cgctaggctggcgaaactttctccg

SEQ ID NO: 393867 - DNA, 25 bp, Mus musculus
agccacgccgatggcgagatttctc

SEQ ID NO: 393868 - DNA, 25 bp, Mus musculus
agcgagctccgagtcgatctttatc

SEQ ID NO: 393869 - DNA, 25 bp, Mus musculus
tcagtatggggaacagagcttcacc

SEQ ID NO: 393870 - DNA, 25 bp, Mus musculus
ttatccagcctagggacgtgtccga

SEQ ID NO: 393871 - DNA, 25 bp, Mus musculus
gacgccgcgcgctcgctttatacaa

SEQ ID NO: 393872 - DNA, 25 bp, Mus musculus
gtagcggcgtccgagctacgccaca

SEQ ID NO: 393873 - DNA, 25 bp, Mus musculus
tgtgggcacaactccgcatccttcg

SEQ ID NO: 393874 - DNA, 25 bp, Mus musculus
aataagagcgtgtgggcacaactcc

SEQ ID NO: 393875 - DNA, 25 bp, Mus musculus
tccgatccgcattgttctggacgcc

SEQ ID NO: 393876 - DNA, 25 bp, Mus musculus
ctctggccgcgagaccagaacgcgg

SEQ ID NO: 393877 - DNA, 25 bp, Mus musculus
ccttcgtggggctcatcgtgatccc

SEQ ID NO: 393878 - DNA, 25 bp, Mus musculus
tcacctccttcgtggggctcatcgt

SEQ ID NO: 393879 - DNA, 25 bp, Mus musculus
gggaacaccttcttctacttcctca

SEQ ID NO: 393880 - DNA, 25 bp, Mus musculus
cgatgacagcgggaacaccttcttc

SEQ ID NO: 393881 - DNA, 25 bp, Mus musculus
acgtctccctcagtgagcgtgtgga

SEQ ID NO: 393882 - DNA, 25 bp, Mus musculus
ggccagcagttccagtacgatgaca

SEQ ID NO: 393883 - DNA, 25 bp, Mus musculus
tcctctcgcgagagttggcgacggc

SEQ ID NO: 393884 - DNA, 25 bp, Mus musculus
gcgggaactagctcctctcgcgaga

SEQ ID NO: 393885 - DNA, 25 bp, Mus musculus
ccagtacgatgacagcgggaacacc

SEQ ID NO: 393886 - DNA, 25 bp, Mus musculus
ttcgccacagcacgcatgtactgct

SEQ ID NO: 393887 - DNA, 25 bp, Mus musculus
gaccgagtgtgttccctgctcccac

SEQ ID NO: 393888 - DNA, 25 bp, Mus musculus
aaggctgtctcctcttcacattcgc

SEQ ID NO: 393889 - DNA, 25 bp, Mus musculus
ttcacattcgccacagcacgcatgt

SEQ ID NO: 393890 - DNA, 25 bp, Mus musculus
ggcctagggagacgacgctcgctca

SEQ ID NO: 393891 - DNA, 25 bp, Mus musculus
ctgctcccaccgtgggaaggctgtc

SEQ ID NO: 393892 - DNA, 25 bp, Mus musculus
tccgcaagcacacacgcagcaccga

SEQ ID NO: 393893 - DNA, 25 bp, Mus musculus
gctggcccgaccgagtgtgttccct

SEQ ID NO: 393894 - DNA, 25 bp, Mus musculus
gacgcgctgactgcaaacccgctgg

SEQ ID NO: 393895 - DNA, 25 bp, Mus musculus
tcagcacgtggacgcgctgactgca

SEQ ID NO: 393896 - DNA, 25 bp, Mus musculus
ctcagtctcagcacgtggacgcgct

SEQ ID NO: 393897 - DNA, 25 bp, Mus musculus
cgctcgctcagtctcagcacgtgga

SEQ ID NO: 393898 - DNA, 25 bp, Mus musculus
agacgacgctcgctcagtctcagca

SEQ ID NO: 393899 - DNA, 25 bp, Mus musculus
gtgggaaggctgtctcctcttcaca

SEQ ID NO: 393900 - DNA, 25 bp, Mus musculus
gctcgggagaggaccctctttcctc

SEQ ID NO: 393901 - DNA, 25 bp, Mus musculus
ctcgaagaaactcgcccgtggacga

SEQ ID NO: 393902 - DNA, 25 bp, Mus musculus
acgtgagaagatttgagcgctttca

SEQ ID NO: 393903 - DNA, 25 bp, Mus musculus
gcgctttcacagctgagggttgaga

SEQ ID NO: 393904 - DNA, 25 bp, Mus musculus
cgatacaggagatagaggagcgtca

SEQ ID NO: 393905 - DNA, 25 bp, Mus musculus
gaacccgattctttctctccctgag

SEQ ID NO: 393906 - DNA, 25 bp, Mus musculus
gctaagtgcagattacgctcgaaga

SEQ ID NO: 393907 - DNA, 25 bp, Mus musculus
ctcctgtgtgttaacgctggttttc

SEQ ID NO: 393908 - DNA, 25 bp, Mus musculus
attcccgggcagtggcacttctgct

SEQ ID NO: 393909 - DNA, 25 bp, Mus musculus
gaagcttccgcccttcgacctgttg

SEQ ID NO: 393910 - DNA, 25 bp, Mus musculus
agctgtggaccaccgaggtggcttc

SEQ ID NO: 393911 - DNA, 25 bp, Mus musculus
agaaatcgtctccagtcaccaggta

SEQ ID NO: 393912 - DNA, 25 bp, Mus musculus
gggcctctgccctaatgcttctttc

SEQ ID NO: 393913 - DNA, 25 bp, Mus musculus
acaggggctcgcgaagactacaact

SEQ ID NO: 393914 - DNA, 25 bp, Mus musculus
atctgtgaggagaagcgcagcaagc

SEQ ID NO: 393915 - DNA, 25 bp, Mus musculus
tacccgtagggccagtccatgtgat

SEQ ID NO: 393916 - DNA, 25 bp, Mus musculus
tccagccttgggacggaagtcggcc

SEQ ID NO: 393917 - DNA, 25 bp, Mus musculus
ggcccggccaaggttgtagatctgt

SEQ ID NO: 393918 - DNA, 25 bp, Mus musculus
agggccagtccatgtgatcagcgga

SEQ ID NO: 393919 - DNA, 25 bp, Mus musculus
cagcatgctgagtggacgatcctcc

SEQ ID NO: 393920 - DNA, 25 bp, Mus musculus
agcacagtacagcatgctgagtgga

SEQ ID NO: 393921 - DNA, 25 bp, Mus musculus
ggcagttttcctcgtgagcacagta

SEQ ID NO: 393922 - DNA, 25 bp, Mus musculus
cttggaaaggcagttttcctcgtga

SEQ ID NO: 393923 - DNA, 25 bp, Mus musculus
gtacgccgtctcttgtaccagctgg

SEQ ID NO: 393924 - DNA, 25 bp, Mus musculus
tggacgatcctccaagtacgccgtc

SEQ ID NO: 393925 - DNA, 25 bp, Mus musculus
gtctcttgtaccagctgggcgttca

SEQ ID NO: 393926 - DNA, 25 bp, Mus musculus
ccaaggttgtagatctgtgaggaga

SEQ ID NO: 393927 - DNA, 25 bp, Mus musculus
atgtgatcagcggacttggaaaggc

SEQ ID NO: 393928 - DNA, 25 bp, Mus musculus
tcctcttcctgattggttacccgga

SEQ ID NO: 393929 - DNA, 25 bp, Mus musculus
acagcagtgactctgggtagaaaga

SEQ ID NO: 393930 - DNA, 25 bp, Mus musculus
gcggccacagcagtgactctgggta

SEQ ID NO: 393931 - DNA, 25 bp, Mus musculus
tctgacaaaacgctaaaatggcggc

SEQ ID NO: 393932 - DNA, 25 bp, Mus musculus
cgcggacggttctgacaaaacgcta

SEQ ID NO: 393933 - DNA, 25 bp, Mus musculus
cggagatcctcttcctgattggtta

SEQ ID NO: 393934 - DNA, 25 bp, Mus musculus
tcgaggaccgatgtcggctctcagg

SEQ ID NO: 393935 - DNA, 25 bp, Mus musculus
tgacacccaccggagtcaggtaagt

SEQ ID NO: 393936 - DNA, 25 bp, Mus musculus
gcagcgcggacggttctgacaaaac

SEQ ID NO: 393937 - DNA, 25 bp, Mus musculus
caggtcctcctccttgcagcgcgga

SEQ ID NO: 393938 - DNA, 25 bp, Mus musculus
cgtggagtatctcaccgcatggata

SEQ ID NO: 393939 - DNA, 25 bp, Mus musculus
acacagtggaagaacgtggagtatc

SEQ ID NO: 393940 - DNA, 25 bp, Mus musculus
cgcactaagtcgaggaccgatgtcg

SEQ ID NO: 393941 - DNA, 25 bp, Mus musculus
ttcccggagatcctcttcctgattg

SEQ ID NO: 393942 - DNA, 25 bp, Mus musculus
gggtgacggagtcccggagacgcat

SEQ ID NO: 393943 - DNA, 25 bp, Mus musculus
caagttgggaagtcccaggcgctgc

SEQ ID NO: 393944 - DNA, 25 bp, Mus musculus
gactgggccaagttgggaagtccca

SEQ ID NO: 393945 - DNA, 25 bp, Mus musculus
tgggggctttttatccgccagcctc

SEQ ID NO: 393946 - DNA, 25 bp, Mus musculus
ttctcctctgtctaatgggcgatcg

SEQ ID NO: 393947 - DNA, 25 bp, Mus musculus
ccacggcagagcagcgctaacgggc

SEQ ID NO: 393948 - DNA, 25 bp, Mus musculus
gacagcgtcgggtggcaaggatccg

SEQ ID NO: 393949 - DNA, 25 bp, Mus musculus
gttttctcctctgtctaatgggcga

SEQ ID NO: 393950 - DNA, 25 bp, Mus musculus
tctgcaggcacggttttctcctctg

SEQ ID NO: 393951 - DNA, 25 bp, Mus musculus
gcctctgcaggcacggttttctcct

SEQ ID NO: 393952 - DNA, 25 bp, Mus musculus
cggtctgcgagtgcctctgcaggca

SEQ ID NO: 393953 - DNA, 25 bp, Mus musculus
atccggtctgcgagtgcctctgcag

SEQ ID NO: 393954 - DNA, 25 bp, Mus musculus
caaggatccggtctgcgagtgcctc

SEQ ID NO: 393955 - DNA, 25 bp, Mus musculus
agagcagcgctaacgggcctcccgg

SEQ ID NO: 393956 - DNA, 25 bp, Mus musculus
gtggctccgcccaatagctgcttag

SEQ ID NO: 393957 - DNA, 25 bp, Mus musculus
acgtgactcagccacatgaccgggg

SEQ ID NO: 393958 - DNA, 25 bp, Mus musculus
tcagccacatgaccggggcctgctt

SEQ ID NO: 393959 - DNA, 25 bp, Mus musculus
tcacccttcaggctactgtgcttgc

SEQ ID NO: 393960 - DNA, 25 bp, Mus musculus
aggctactgtgcttgctggtcaccc

SEQ ID NO: 393961 - DNA, 25 bp, Mus musculus
gcttgctggtcacccgccgctaggg

SEQ ID NO: 393962 - DNA, 25 bp, Mus musculus
ggcgacccaggactgcgcttggtca

SEQ ID NO: 393963 - DNA, 25 bp, Mus musculus
gcttccgggtaggacacgtgactca

SEQ ID NO: 393964 - DNA, 25 bp, Mus musculus
gctgcttagcactctttcaacgaca

SEQ ID NO: 393965 - DNA, 25 bp, Mus musculus
ctttcaacgacacccagaaattctg

SEQ ID NO: 393966 - DNA, 25 bp, Mus musculus
acgaaggcctggcttgtgacgcccg

SEQ ID NO: 393967 - DNA, 25 bp, Mus musculus
gtgacgcccgctccaaaaggcatga

SEQ ID NO: 393968 - DNA, 25 bp, Mus musculus
ggcatgagactgatgcgggtttccc

SEQ ID NO: 393969 - DNA, 25 bp, Mus musculus
gcccgggcctctccaaactgggaga

SEQ ID NO: 393970 - DNA, 25 bp, Mus musculus
cgttctgctgcacagaaaagctttc

SEQ ID NO: 393971 - DNA, 25 bp, Mus musculus
aaagcccgcacagccaatgcaaatg

SEQ ID NO: 393972 - DNA, 25 bp, Mus musculus
cgccgcatttccaatcttccggata

SEQ ID NO: 393973 - DNA, 25 bp, Mus musculus
ccgaaaagctgccttccagaatttt

SEQ ID NO: 393974 - DNA, 25 bp, Mus musculus
ctgcagcaggcaaatatttagcgcg

SEQ ID NO: 393975 - DNA, 25 bp, Mus musculus
gcgcgaacaagctgacattttttaa

SEQ ID NO: 393976 - DNA, 25 bp, Mus musculus
tttggatgaattcagagaagcgttc

SEQ ID NO: 393977 - DNA, 25 bp, Mus musculus
ccgcagacctgaggctgagcgctaa

SEQ ID NO: 393978 - DNA, 25 bp, Mus musculus
atgaaacccggtagtgcagcgctgt

SEQ ID NO: 393979 - DNA, 25 bp, Mus musculus
aaacggcctccgcattggtggcgac

SEQ ID NO: 393980 - DNA, 25 bp, Mus musculus
acctccgagtctttggctaagctac

SEQ ID NO: 393981 - DNA, 25 bp, Mus musculus
gctaagctaccctgacctggatgga

SEQ ID NO: 393982 - DNA, 25 bp, Mus musculus
tacagctacctgctgcgtccgcaga

SEQ ID NO: 393983 - DNA, 25 bp, Mus musculus
tcgcgcagctggagcaaagcaatgc

SEQ ID NO: 393984 - DNA, 25 bp, Mus musculus
catggcaggcggcatggaaccacac

SEQ ID NO: 393985 - DNA, 25 bp, Mus musculus
cgaagacccgtgaggagactcccaa

SEQ ID NO: 393986 - DNA, 25 bp, Mus musculus
gcccggccgctctagtcacaagaaa

SEQ ID NO: 393987 - DNA, 25 bp, Mus musculus
ataacgccctcacgtcatgacgagg

SEQ ID NO: 393988 - DNA, 25 bp, Mus musculus
ctcctcaggggcttcggtcacctga

SEQ ID NO: 393989 - DNA, 25 bp, Mus musculus
tcatgacgaggctgctctcctcagg

SEQ ID NO: 393990 - DNA, 25 bp, Mus musculus
atgccttgcggctccggaagcccaa

SEQ ID NO: 393991 - DNA, 25 bp, Mus musculus
ggagactcccaacatgccttgcggc

SEQ ID NO: 393992 - DNA, 25 bp, Mus musculus
tgcgcagaggacgacgaagacccgt

SEQ ID NO: 393993 - DNA, 25 bp, Mus musculus
ccggaagcccaacttcgggcatgtg

SEQ ID NO: 393994 - DNA, 25 bp, Mus musculus
aaagtcagggcaaggccgagcacgt

SEQ ID NO: 393995 - DNA, 25 bp, Mus musculus
tcacaagaaagtcagggcaaggccg

SEQ ID NO: 393996 - DNA, 25 bp, Mus musculus
tcagccatcagccacattgctgtcg

SEQ ID NO: 393997 - DNA, 25 bp, Mus musculus
tcagccacattgctgtcgagcccgg

SEQ ID NO: 393998 - DNA, 25 bp, Mus musculus
cccgcggctcgtgttcatcgaggag

SEQ ID NO: 393999 - DNA, 25 bp, Mus musculus
gctctcgctggacccggtggagtta

SEQ ID NO: 394000 - DNA, 25 bp, Mus musculus
cctgtccgccctgttcagcggcctg

SEQ ID NO: 394001 - DNA, 25 bp, Mus musculus
ccgccgctgcctggttactgggtct

SEQ ID NO: 394002 - DNA, 25 bp, Mus musculus
cgggaagctcttttcgctgtgcgcc

SEQ ID NO: 394003 - DNA, 25 bp, Mus musculus
tcctgcgggtctacttccagcctgg

SEQ ID NO: 394004 - DNA, 25 bp, Mus musculus
gacccgaagacactgccggaggccg

SEQ ID NO: 394005 - DNA, 25 bp, Mus musculus
tctgcgacccgaagacactgccgga

SEQ ID NO: 394006 - DNA, 25 bp, Mus musculus
tgcctggttactgggtctgcgaccc

SEQ ID NO: 394007 - DNA, 25 bp, Mus musculus
gatctgtccgtactcggtgtgctcg

SEQ ID NO: 394008 - DNA, 25 bp, Mus musculus
gcagggggacccatctgctctgcac

SEQ ID NO: 394009 - DNA, 25 bp, Mus musculus
ggggcgccgtactcctgctcttctt

SEQ ID NO: 394010 - DNA, 25 bp, Mus musculus
ttcctgggagccgagatctgtccgt

SEQ ID NO: 394011 - DNA, 25 bp, Mus musculus
agctcttttcgctgtgcgcctggga

SEQ ID NO: 394012 - DNA, 25 bp, Mus musculus
ggcttccaatggtcgagccgcgtcc

SEQ ID NO: 394013 - DNA, 25 bp, Mus musculus
caggtctttctgtacccgctgagca

SEQ ID NO: 394014 - DNA, 25 bp, Mus musculus
aggacaacctcctgaccttctgggg

SEQ ID NO: 394015 - DNA, 25 bp, Mus musculus
gcgtgttccaatcgctgaggctttt

SEQ ID NO: 394016 - DNA, 25 bp, Mus musculus
aggatgattggcgtagcgtgttcca

SEQ ID NO: 394017 - DNA, 25 bp, Mus musculus
aaccaatgcaatgtacaccggagga

SEQ ID NO: 394018 - DNA, 25 bp, Mus musculus
tatcggaggcttgtatgatgcaacc

SEQ ID NO: 394019 - DNA, 25 bp, Mus musculus
ctagccaattcgagaagaggatctt

SEQ ID NO: 394020 - DNA, 25 bp, Mus musculus
tccggtgactggaggagactctcac

SEQ ID NO: 394021 - DNA, 25 bp, Mus musculus
tcgcgacagaatgtgccgagacctc

SEQ ID NO: 394022 - DNA, 25 bp, Mus musculus
cccggaagtccgcagtgagcttaaa

SEQ ID NO: 394023 - DNA, 25 bp, Mus musculus
taaccttgcggggatctggatcatc

SEQ ID NO: 394024 - DNA, 25 bp, Mus musculus
cggagcttggcaacgcgcttaacca

SEQ ID NO: 394025 - DNA, 25 bp, Mus musculus
cggggcaagcctctactagccaatt

SEQ ID NO: 394026 - DNA, 25 bp, Mus musculus
cgggaaagggcgcatttttcattgc

SEQ ID NO: 394027 - DNA, 25 bp, Mus musculus
ggggcaccaggttctcttccaggcc

SEQ ID NO: 394028 - DNA, 25 bp, Mus musculus
cgagataaagcgctcagcttcctgg

SEQ ID NO: 394029 - DNA, 25 bp, Mus musculus
cagcgcagtgctcagggcgactctg

SEQ ID NO: 394030 - DNA, 25 bp, Mus musculus
gcctacgacggttcccacattaatc

SEQ ID NO: 394031 - DNA, 25 bp, Mus musculus
ccagagtctcgggaaagggcgcatt

SEQ ID NO: 394032 - DNA, 25 bp, Mus musculus
gtgcgtcctggcagcgcagtgctca

SEQ ID NO: 394033 - DNA, 25 bp, Mus musculus
ggcgcatttttcattgctgggtaca

SEQ ID NO: 394034 - DNA, 25 bp, Mus musculus
cattgctgggtacagggcaactcca

SEQ ID NO: 394035 - DNA, 25 bp, Mus musculus
cagggcaactccagacaaggaacga

SEQ ID NO: 394036 - DNA, 25 bp, Mus musculus
caaggaacgagaaacagaagttgtc

SEQ ID NO: 394037 - DNA, 25 bp, Mus musculus
cagaagttgtctttagataaacggt

SEQ ID NO: 394038 - DNA, 25 bp, Mus musculus
acggtttaccggagcgtgcgtcctg

SEQ ID NO: 394039 - DNA, 25 bp, Mus musculus
cacattaatcaccagcgccagagtc

SEQ ID NO: 394040 - DNA, 25 bp, Mus musculus
tcgcttttgacacgtcacctgagaa

SEQ ID NO: 394041 - DNA, 25 bp, Mus musculus
tcacgccgagctctaaccattacga

SEQ ID NO: 394042 - DNA, 25 bp, Mus musculus
ccctgtgagcttacagcacggcaca

SEQ ID NO: 394043 - DNA, 25 bp, Mus musculus
gcacggcacaaaggacaaatacgtt

SEQ ID NO: 394044 - DNA, 25 bp, Mus musculus
gtatacctaccgtccgcatcatgtc

SEQ ID NO: 394045 - DNA, 25 bp, Mus musculus
cgtccgcatcatgtcctgcaaagca

SEQ ID NO: 394046 - DNA, 25 bp, Mus musculus
tcatgtcctgcaaagcactcgcttt

SEQ ID NO: 394047 - DNA, 25 bp, Mus musculus
cgctgtaaaaatcacgccgagctct

SEQ ID NO: 394048 - DNA, 25 bp, Mus musculus
gcacggctacttcaacctccatgaa

SEQ ID NO: 394049 - DNA, 25 bp, Mus musculus
cgtcacctgagaagtgagcgccgtg

SEQ ID NO: 394050 - DNA, 25 bp, Mus musculus
acaccgggagagcttccgccagcat

SEQ ID NO: 394051 - DNA, 25 bp, Mus musculus
gagagcttccgccagcatgtacagc

SEQ ID NO: 394052 - DNA, 25 bp, Mus musculus
gcatgtacagcaaccgcacggctac

SEQ ID NO: 394053 - DNA, 25 bp, Mus musculus
aagcactcgcttttgacacgtcacc

SEQ ID NO: 394054 - DNA, 25 bp, Mus musculus
ggtcgccacaaaagaggcgcccatc

SEQ ID NO: 394055 - DNA, 25 bp, Mus musculus
cggagctccgctctaatccggattc

SEQ ID NO: 394056 - DNA, 25 bp, Mus musculus
gaactccctaaactggtcgccacaa

SEQ ID NO: 394057 - DNA, 25 bp, Mus musculus
taatccggattcagaaaccgaactc

SEQ ID NO: 394058 - DNA, 25 bp, Mus musculus
aaagaggcgcccatcaaagtggccg

SEQ ID NO: 394059 - DNA, 25 bp, Mus musculus
agctccgctctaatccggattcaga

SEQ ID NO: 394060 - DNA, 25 bp, Mus musculus
cactctttgaagacagcgttaaccc

SEQ ID NO: 394061 - DNA, 25 bp, Mus musculus
tctacagccactctttgaagacagc

SEQ ID NO: 394062 - DNA, 25 bp, Mus musculus
gagctcactctacagccactctttg

SEQ ID NO: 394063 - DNA, 25 bp, Mus musculus
cttggggagcttcgagctcactcta

SEQ ID NO: 394064 - DNA, 25 bp, Mus musculus
gcgggtgtagtatctttgatcttcc

SEQ ID NO: 394065 - DNA, 25 bp, Mus musculus
tcggcgggtgtagtatctttgatct

SEQ ID NO: 394066 - DNA, 25 bp, Mus musculus
gccattcggcgggtgtagtatcttt

SEQ ID NO: 394067 - DNA, 25 bp, Mus musculus
tttgatcttccaaacttggggagct

SEQ ID NO: 394068 - DNA, 25 bp, Mus musculus
aagagtttcttgtcgcaggcgaaat

SEQ ID NO: 394069 - DNA, 25 bp, Mus musculus
ttgtcgcaggcgaaatctaaatcca

SEQ ID NO: 394070 - DNA, 25 bp, Mus musculus
cgaaatctaaatccaacgcaggtga

SEQ ID NO: 394071 - DNA, 25 bp, Mus musculus
taaatccaacgcaggtgaggttccc

SEQ ID NO: 394072 - DNA, 25 bp, Mus musculus
ggtgaggttccccacaagcgcgtca

SEQ ID NO: 394073 - DNA, 25 bp, Mus musculus
caagcgcgtcaccacggcctagcct

SEQ ID NO: 394074 - DNA, 25 bp, Mus musculus
tcctgacgcgcacaggacgctgcat

SEQ ID NO: 394075 - DNA, 25 bp, Mus musculus
caggacgctgcatgcaaaaggcgtg

SEQ ID NO: 394076 - DNA, 25 bp, Mus musculus
ctgcatgcaaaaggcgtgggaccta

SEQ ID NO: 394077 - DNA, 25 bp, Mus musculus
aaggcgtgggacctacgcactcacc

SEQ ID NO: 394078 - DNA, 25 bp, Mus musculus
gtgggacctacgcactcaccgaggc

SEQ ID NO: 394079 - DNA, 25 bp, Mus musculus
gaggcctccgcttgcgctaatgtaa

SEQ ID NO: 394080 - DNA, 25 bp, Mus musculus
cgcttgcgctaatgtaaccacggga

SEQ ID NO: 394081 - DNA, 25 bp, Mus musculus
ctaatgtaaccacgggagctggccc

SEQ ID NO: 394082 - DNA, 25 bp, Mus musculus
agcccggtttccagcagtgcctgct

SEQ ID NO: 394083 - DNA, 25 bp, Mus musculus
tgcatccgttaggtgaaaaagagtt

SEQ ID NO: 394084 - DNA, 25 bp, Mus musculus
ctgcgtggacaccatgcatccgtta

SEQ ID NO: 394085 - DNA, 25 bp, Mus musculus
ggcttttgtgtacactgcgtggaca

SEQ ID NO: 394086 - DNA, 25 bp, Mus musculus
cctcacccggcttttgtgtacactg

SEQ ID NO: 394087 - DNA, 25 bp, Mus musculus
ttcgatgagccacaggccgagcacc

SEQ ID NO: 394088 - DNA, 25 bp, Mus musculus
caaatcgttcgatgagccacaggcc

SEQ ID NO: 394089 - DNA, 25 bp, Mus musculus
taaccattaatagcgcaaatcgttc

SEQ ID NO: 394090 - DNA, 25 bp, Mus musculus
ccgaggggacaattctaacgatata

SEQ ID NO: 394091 - DNA, 25 bp, Mus musculus
cagacccgaggggacaattctaacg

SEQ ID NO: 394092 - DNA, 25 bp, Mus musculus
ccgaccagacgttggtgtaaacaga

SEQ ID NO: 394093 - DNA, 25 bp, Mus musculus
aacactgcggcagggccgaccagac

SEQ ID NO: 394094 - DNA, 25 bp, Mus musculus
tctcagctcgccatccattagtgta

SEQ ID NO: 394095 - DNA, 25 bp, Mus musculus
gctcgccatccattagtgtaatccc

SEQ ID NO: 394096 - DNA, 25 bp, Mus musculus
actttgcagggcatcagggcttggt

SEQ ID NO: 394097 - DNA, 25 bp, Mus musculus
ctcttctcgcaagctcaggtctttg

SEQ ID NO: 394098 - DNA, 25 bp, Mus musculus
cgcaggttcaagcagcagcggtacc

SEQ ID NO: 394099 - DNA, 25 bp, Mus musculus
tggttccagaatcgcaggtacaagt

SEQ ID NO: 394100 - DNA, 25 bp, Mus musculus
cgcaggtacaagtgcaagagacagc

SEQ ID NO: 394101 - DNA, 25 bp, Mus musculus
gacagcggcaggataagtccctgga

SEQ ID NO: 394102 - DNA, 25 bp, Mus musculus
agcggcggcttacagcggcagctac

SEQ ID NO: 394103 - DNA, 25 bp, Mus musculus
ggcagctacggctgcgcctatccga

SEQ ID NO: 394104 - DNA, 25 bp, Mus musculus
aacgtgagcaacctgggaggcttcg

SEQ ID NO: 394105 - DNA, 25 bp, Mus musculus
ggcggcgcgcaacccttgcatcaag

SEQ ID NO: 394106 - DNA, 25 bp, Mus musculus
ttgcatcaaggtgctgcagccgggt

SEQ ID NO: 394107 - DNA, 25 bp, Mus musculus
ccgcgtgcacgcaggggactttgca

SEQ ID NO: 394108 - DNA, 25 bp, Mus musculus
gggcgtcctactgcacgctgggcac

SEQ ID NO: 394109 - DNA, 25 bp, Mus musculus
agctggagcgcaggttcaagcagca

SEQ ID NO: 394110 - DNA, 25 bp, Mus musculus
ggcgcagctcatgaccgtgccatag

SEQ ID NO: 394111 - DNA, 25 bp, Mus musculus
gcgcgcggatagcagccaatcaaac

SEQ ID NO: 394112 - DNA, 25 bp, Mus musculus
ctaaccaattggaggcggcatcgcg

SEQ ID NO: 394113 - DNA, 25 bp, Mus musculus
cgcaggcgctctaacctaaccaatt

SEQ ID NO: 394114 - DNA, 25 bp, Mus musculus
tcctccacaggaatggctggcgacc

SEQ ID NO: 394115 - DNA, 25 bp, Mus musculus
tcctacagcgacaggcaaaacgtcc

SEQ ID NO: 394116 - DNA, 25 bp, Mus musculus
gctgccaactcctccggtgtcgtat

SEQ ID NO: 394117 - DNA, 25 bp, Mus musculus
cagatgtcctttgacgcagccaatc

SEQ ID NO: 394118 - DNA, 25 bp, Mus musculus
gcaaactgtttcatgacggcgcagc

SEQ ID NO: 394119 - DNA, 25 bp, Mus musculus
cgcgcatgtgcacgaaggcaaactg

SEQ ID NO: 394120 - DNA, 25 bp, Mus musculus
atcttccaagtgttcaggggcctcg

SEQ ID NO: 394121 - DNA, 25 bp, Mus musculus
tgcagccgatacattgcccacgaaa

SEQ ID NO: 394122 - DNA, 25 bp, Mus musculus
gaggctgcgcaattcctgacttgta

SEQ ID NO: 394123 - DNA, 25 bp, Mus musculus
ccgcagaggcctagtcagaagagct

SEQ ID NO: 394124 - DNA, 25 bp, Mus musculus
cacggccgattgtgagtgtgccaag

SEQ ID NO: 394125 - DNA, 25 bp, Mus musculus
ggctccttgtcactcctggagaatg

SEQ ID NO: 394126 - DNA, 25 bp, Mus musculus
tcactcctggagaatgcctgtgcga

SEQ ID NO: 394127 - DNA, 25 bp, Mus musculus
aatgcctgtgcgaggccagtgctgc

SEQ ID NO: 394128 - DNA, 25 bp, Mus musculus
agtgctgccacacggccgattgtga

SEQ ID NO: 394129 - DNA, 25 bp, Mus musculus
aggtgcggaaagaatggctttttat

SEQ ID NO: 394130 - DNA, 25 bp, Mus musculus
tggctttttattggagtcccgaaca

SEQ ID NO: 394131 - DNA, 25 bp, Mus musculus
ggctttatgcggctccttgtcactc

SEQ ID NO: 394132 - DNA, 25 bp, Mus musculus
ccagagcgtcggattgacgtccctc

SEQ ID NO: 394133 - DNA, 25 bp, Mus musculus
tcaacagagggacggagaaatgcgc

SEQ ID NO: 394134 - DNA, 25 bp, Mus musculus
cattgcttctcagagcgggggcttt

SEQ ID NO: 394135 - DNA, 25 bp, Mus musculus
ggggctttgtgcagcagtctgctca

SEQ ID NO: 394136 - DNA, 25 bp, Mus musculus
tgcagcagtctgctcaacagaggga

SEQ ID NO: 394137 - DNA, 25 bp, Mus musculus
attggagtcccgaacaaaaggtgtg

SEQ ID NO: 394138 - DNA, 25 bp, Mus musculus
tcgagtagcacggtgcgactgttcc

SEQ ID NO: 394139 - DNA, 25 bp, Mus musculus
tcccaatcgcggcagagcaactgct

SEQ ID NO: 394140 - DNA, 25 bp, Mus musculus
agggtcttggagcaccatcccaatc

SEQ ID NO: 394141 - DNA, 25 bp, Mus musculus
aaagccgcctagtgaaccctccagt

SEQ ID NO: 394142 - DNA, 25 bp, Mus musculus
agcttgtcattagtcccgtaggtcc

SEQ ID NO: 394143 - DNA, 25 bp, Mus musculus
gaccttcaaggtcaaaccgctgtcg

SEQ ID NO: 394144 - DNA, 25 bp, Mus musculus
aaccacttcgttcttccattggatg

SEQ ID NO: 394145 - DNA, 25 bp, Mus musculus
ggctcaaccgctctagctactttgg

SEQ ID NO: 394146 - DNA, 25 bp, Mus musculus
agctgaactttgataggctcaaccg

SEQ ID NO: 394147 - DNA, 25 bp, Mus musculus
attggctcttgattggcggacttgc

SEQ ID NO: 394148 - DNA, 25 bp, Mus musculus
ccctttgatcttggaagcgtcttgt

SEQ ID NO: 394149 - DNA, 25 bp, Mus musculus
gacagccattggtgtaggccctaac

SEQ ID NO: 394150 - DNA, 25 bp, Mus musculus
acggagccaaaatgtatctgtgtta

SEQ ID NO: 394151 - DNA, 25 bp, Mus musculus
tgagctctcattgggtggactctgc

SEQ ID NO: 394152 - DNA, 25 bp, Mus musculus
ctcagtttgtgaccgccgcggcttc

SEQ ID NO: 394153 - DNA, 25 bp, Mus musculus
cgttcgggatgcacggtaggatcct

SEQ ID NO: 394154 - DNA, 25 bp, Mus musculus
tggcgtgctccgtgaacactgagcc

SEQ ID NO: 394155 - DNA, 25 bp, Mus musculus
tgtccctaccacctggggtggcgtg

SEQ ID NO: 394156 - DNA, 25 bp, Mus musculus
agccactgggaaccgctgaggacca

SEQ ID NO: 394157 - DNA, 25 bp, Mus musculus
gcctgggtgcgacgacttttccatt

SEQ ID NO: 394158 - DNA, 25 bp, Mus musculus
tccttccggctgtgttgggagccac

SEQ ID NO: 394159 - DNA, 25 bp, Mus musculus
cagtcattggctcggtgcggtttcc

SEQ ID NO: 394160 - DNA, 25 bp, Mus musculus
gcgggcattcgtggccaggcacctt

SEQ ID NO: 394161 - DNA, 25 bp, Mus musculus
aacagacgctcagtttgtgaccgcc

SEQ ID NO: 394162 - DNA, 25 bp, Mus musculus
ttggtgtcgttgtgaacagacgctc

SEQ ID NO: 394163 - DNA, 25 bp, Mus musculus
ccaggcacctttggggattggtgtc

SEQ ID NO: 394164 - DNA, 25 bp, Mus musculus
acactgagcctgtccacaggaaagc

SEQ ID NO: 394165 - DNA, 25 bp, Mus musculus
cttttccattggtcacggccgggag

SEQ ID NO: 394166 - DNA, 25 bp, Mus musculus
cgaaagaacaagcacttccgggtca

SEQ ID NO: 394167 - DNA, 25 bp, Mus musculus
tcccgcggtcgagtttctcagtgct

SEQ ID NO: 394168 - DNA, 25 bp, Mus musculus
gagcaaccgttgcatgctgacagta

SEQ ID NO: 394169 - DNA, 25 bp, Mus musculus
ggcttccgtgatccgagccagcagg

SEQ ID NO: 394170 - DNA, 25 bp, Mus musculus
agtttctcagtgctccggagtcccg

SEQ ID NO: 394171 - DNA, 25 bp, Mus musculus
aaggggcttcttgcgagcggaaaca

SEQ ID NO: 394172 - DNA, 25 bp, Mus musculus
actcagtggaaaccgaaggcgagcg

SEQ ID NO: 394173 - DNA, 25 bp, Mus musculus
tgcacgcacgactccctgggaggct

SEQ ID NO: 394174 - DNA, 25 bp, Mus musculus
gctgacagtacagcgccactgccgg

SEQ ID NO: 394175 - DNA, 25 bp, Mus musculus
cctcagggacggaaggagcaaccgt

SEQ ID NO: 394176 - DNA, 25 bp, Mus musculus
gaccaggagcccgacattgcggctc

SEQ ID NO: 394177 - DNA, 25 bp, Mus musculus
tggacgccaccctagggaccaggag

SEQ ID NO: 394178 - DNA, 25 bp, Mus musculus
tgggtacctgtgttctggacgccac

SEQ ID NO: 394179 - DNA, 25 bp, Mus musculus
gggcagtcacgcagtccctcagctg

SEQ ID NO: 394180 - DNA, 25 bp, Mus musculus
acgtgcgaggatcaacagaggagcc

SEQ ID NO: 394181 - DNA, 25 bp, Mus musculus
gcgcctgcgcgcaaccctttccttg

SEQ ID NO: 394182 - DNA, 25 bp, Mus musculus
ggagccggactccatcccggctgga

SEQ ID NO: 394183 - DNA, 25 bp, Mus musculus
tggtaaaggatggagccggactcca

SEQ ID NO: 394184 - DNA, 25 bp, Mus musculus
aggcacgcaggcactgccgcggggc

SEQ ID NO: 394185 - DNA, 25 bp, Mus musculus
gaatttccctctgaatcgccccagg

SEQ ID NO: 394186 - DNA, 25 bp, Mus musculus
cgccaaggcccaccaaacagggtcg

SEQ ID NO: 394187 - DNA, 25 bp, Mus musculus
gcgcgccaacgtgcgaggatcaaca

SEQ ID NO: 394188 - DNA, 25 bp, Mus musculus
cgaggatcaacagaggagccgaact

SEQ ID NO: 394189 - DNA, 25 bp, Mus musculus
cgccaacgtgcgaggatcaacagag

SEQ ID NO: 394190 - DNA, 25 bp, Mus musculus
cgcaaccctttccttgccggtcgct

SEQ ID NO: 394191 - DNA, 25 bp, Mus musculus
gcccaccaaacagggtcggcccatc

SEQ ID NO: 394192 - DNA, 25 bp, Mus musculus
atcaacagaggagccgaactttccc

SEQ ID NO: 394193 - DNA, 25 bp, Mus musculus
ccagcacccagaaagcgccttagcc

SEQ ID NO: 394194 - DNA, 25 bp, Mus musculus
tgaagacagcgagggcctcgcgtct

SEQ ID NO: 394195 - DNA, 25 bp, Mus musculus
tcgcgtctcgcggagcgcagctcag

SEQ ID NO: 394196 - DNA, 25 bp, Mus musculus
agctcagcgcgaccgagagctgcgc

SEQ ID NO: 394197 - DNA, 25 bp, Mus musculus
tgctctctgccgctcggcgttccct

SEQ ID NO: 394198 - DNA, 25 bp, Mus musculus
ccgcctcccttagcgccgcttccgt

SEQ ID NO: 394199 - DNA, 25 bp, Mus musculus
ctagcccgtcgctccgccacgtcag

SEQ ID NO: 394200 - DNA, 25 bp, Mus musculus
ccagggcctttcagggaaactgagg

SEQ ID NO: 394201 - DNA, 25 bp, Mus musculus
cgtgggggcgtttagcgacacacct

SEQ ID NO: 394202 - DNA, 25 bp, Mus musculus
gacacacctcgctcaggctaggatc

SEQ ID NO: 394203 - DNA, 25 bp, Mus musculus
tcgctcaggctaggatccagatccc

SEQ ID NO: 394204 - DNA, 25 bp, Mus musculus
gctaccgccaacctagagaactcaa

SEQ ID NO: 394205 - DNA, 25 bp, Mus musculus
gagaactcaaattctccgctgcgcg

SEQ ID NO: 394206 - DNA, 25 bp, Mus musculus
ctcccagggcctttcagggaaactg

SEQ ID NO: 394207 - DNA, 25 bp, Mus musculus
cctcggccgtgagtgaagacagcga

SEQ ID NO: 394208 - DNA, 25 bp, Mus musculus
ctcctagctacaggttactgaggtc

SEQ ID NO: 394209 - DNA, 25 bp, Mus musculus
cctcgtggccactcgggtgatgaaa

SEQ ID NO: 394210 - DNA, 25 bp, Mus musculus
ggccacgttgcgctctgctttgagc

SEQ ID NO: 394211 - DNA, 25 bp, Mus musculus
tactgaggtcctctaagcttttaga

SEQ ID NO: 394212 - DNA, 25 bp, Mus musculus
gggagagtgcacaccgccctcctag

SEQ ID NO: 394213 - DNA, 25 bp, Mus musculus
gcacgtgctccctggagctcgcagg

SEQ ID NO: 394214 - DNA, 25 bp, Mus musculus
caaagcgcatgggacgcttccgaga

SEQ ID NO: 394215 - DNA, 25 bp, Mus musculus
aactcccagcgtgcaaagcgcatgg

SEQ ID NO: 394216 - DNA, 25 bp, Mus musculus
gcagcctcatggaagtagagtgcag

SEQ ID NO: 394217 - DNA, 25 bp, Mus musculus
gtagtcctccaatacagccgcagcg

SEQ ID NO: 394218 - DNA, 25 bp, Mus musculus
agcggcccacgtccttgtcgctgta

SEQ ID NO: 394219 - DNA, 25 bp, Mus musculus
gcaaccggcagccacgcactaggga

SEQ ID NO: 394220 - DNA, 25 bp, Mus musculus
ggtgatgaaacacccggcaaccggc

SEQ ID NO: 394221 - DNA, 25 bp, Mus musculus
agcttttagaagaccggccacgttg

SEQ ID NO: 394222 - DNA, 25 bp, Mus musculus
cggccttgatcgcaggcactcggag

SEQ ID NO: 394223 - DNA, 25 bp, Mus musculus
tgcgcgggcgggacaaaattggccc

SEQ ID NO: 394224 - DNA, 25 bp, Mus musculus
ccgcccgcgactcgcgagacggtgc

SEQ ID NO: 394225 - DNA, 25 bp, Mus musculus
gctgcgcggggacgcaggcgacgca

SEQ ID NO: 394226 - DNA, 25 bp, Mus musculus
cggctcggcgtacgtcgtgacacct

SEQ ID NO: 394227 - DNA, 25 bp, Mus musculus
cccgccaactgctgccaacagccgg

SEQ ID NO: 394228 - DNA, 25 bp, Mus musculus
ctcaccggtcagtgacgcatcgccc

SEQ ID NO: 394229 - DNA, 25 bp, Mus musculus
agcctcgcctcaccggtcagtgacg

SEQ ID NO: 394230 - DNA, 25 bp, Mus musculus
cttgatcgcaggcactcggaggacc

SEQ ID NO: 394231 - DNA, 25 bp, Mus musculus
agggcggccttgatcgcaggcactc

SEQ ID NO: 394232 - DNA, 25 bp, Mus musculus
caagcgttaggtcccgactgagggc

SEQ ID NO: 394233 - DNA, 25 bp, Mus musculus
cccaagcgttaggtcccgactgagg

SEQ ID NO: 394234 - DNA, 25 bp, Mus musculus
tcggcgtacgtcgtgacacctcttc

SEQ ID NO: 394235 - DNA, 25 bp, Mus musculus
atcgcaggcactcggaggaccgcga

SEQ ID NO: 394236 - DNA, 25 bp, Mus musculus
ctcacccggtgctggtacagactga

SEQ ID NO: 394237 - DNA, 25 bp, Mus musculus
cacccaggctcacaagcgcaggatg

SEQ ID NO: 394238 - DNA, 25 bp, Mus musculus
caacctgcgaggaccatcgtgcgtg

SEQ ID NO: 394239 - DNA, 25 bp, Mus musculus
tacagactgacgttcccgaaaccgc

SEQ ID NO: 394240 - DNA, 25 bp, Mus musculus
ccgaggcttgcggagtcctccgtct

SEQ ID NO: 394241 - DNA, 25 bp, Mus musculus
gcggagtcctccgtctcgcgagact

SEQ ID NO: 394242 - DNA, 25 bp, Mus musculus
tcgcgagactgcgtcacttccgcta

SEQ ID NO: 394243 - DNA, 25 bp, Mus musculus
gctagcttccgcatgcagagtcccg

SEQ ID NO: 394244 - DNA, 25 bp, Mus musculus
accttgactgacagctcgggtccca

SEQ ID NO: 394245 - DNA, 25 bp, Mus musculus
ccgagctcctggaatcaccctggga

SEQ ID NO: 394246 - DNA, 25 bp, Mus musculus
atcaccctgggattggtgctgccgg

SEQ ID NO: 394247 - DNA, 25 bp, Mus musculus
ctgggcaacttccaacctgcgagga

SEQ ID NO: 394248 - DNA, 25 bp, Mus musculus
acttccgctagcttccgcatgcaga

SEQ ID NO: 394249 - DNA, 25 bp, Mus musculus
aagcgcaggatgctccatcgctcgc

SEQ ID NO: 394250 - DNA, 25 bp, Mus musculus
ctcctgcatccggacctagcctccc

SEQ ID NO: 394251 - DNA, 25 bp, Mus musculus
gccgccttcgttctcctcctgccac

SEQ ID NO: 394252 - DNA, 25 bp, Mus musculus
cgcccacctgaaacgccaactccgt

SEQ ID NO: 394253 - DNA, 25 bp, Mus musculus
actccgttcccatgctcaggagcta

SEQ ID NO: 394254 - DNA, 25 bp, Mus musculus
catgctcaggagctaggctttcgtc

SEQ ID NO: 394255 - DNA, 25 bp, Mus musculus
gtagtacctcgaggtggctgctcct

SEQ ID NO: 394256 - DNA, 25 bp, Mus musculus
ctaggctttcgtctcagtgccctga

SEQ ID NO: 394257 - DNA, 25 bp, Mus musculus
ctcagtgccctgactgcggtagaca

SEQ ID NO: 394258 - DNA, 25 bp, Mus musculus
gtagacaggtccaccggctcctgca

SEQ ID NO: 394259 - DNA, 25 bp, Mus musculus
gcatctccatccacacagggtagta

SEQ ID NO: 394260 - DNA, 25 bp, Mus musculus
tccacacagggtagtacctcgaggt

SEQ ID NO: 394261 - DNA, 25 bp, Mus musculus
cttccggttctaagggcatctgcgc

SEQ ID NO: 394262 - DNA, 25 bp, Mus musculus
aggctgcttccggttctaagggcat

SEQ ID NO: 394263 - DNA, 25 bp, Mus musculus
cctgactgcggtagacaggtccacc

SEQ ID NO: 394264 - DNA, 25 bp, Mus musculus
gagacaaagggaaaggcgtggcgtc

SEQ ID NO: 394265 - DNA, 25 bp, Mus musculus
cgatccaatcagaaggcgccgcccg

SEQ ID NO: 394266 - DNA, 25 bp, Mus musculus
gatgctcgctcgttgcactcagccc

SEQ ID NO: 394267 - DNA, 25 bp, Mus musculus
cacgccctgtctctgcttaggcaag

SEQ ID NO: 394268 - DNA, 25 bp, Mus musculus
ccctgtctctgcttaggcaagcctg

SEQ ID NO: 394269 - DNA, 25 bp, Mus musculus
ctgtctctgcttaggcaagcctggc

SEQ ID NO: 394270 - DNA, 25 bp, Mus musculus
tctctgcttaggcaagcctggcggg

SEQ ID NO: 394271 - DNA, 25 bp, Mus musculus
ggagcctagagtcggaggagacaaa

SEQ ID NO: 394272 - DNA, 25 bp, Mus musculus
tcagcacccgcccacagggtcactc

SEQ ID NO: 394273 - DNA, 25 bp, Mus musculus
ctgcaggagcccgatccaatcagaa

SEQ ID NO: 394274 - DNA, 25 bp, Mus musculus
gcaggagcccgatccaatcagaagg

SEQ ID NO: 394275 - DNA, 25 bp, Mus musculus
aggagcccgatccaatcagaaggcg

SEQ ID NO: 394276 - DNA, 25 bp, Mus musculus
cacagggtcactcccgttcactcgg

SEQ ID NO: 394277 - DNA, 25 bp, Mus musculus
agcccgatccaatcagaaggcgccg

SEQ ID NO: 394278 - DNA, 25 bp, Mus musculus
cgagtaactgccaaggaccgacttc

SEQ ID NO: 394279 - DNA, 25 bp, Mus musculus
tgttgtcactgcctaggccgcaccg

SEQ ID NO: 394280 - DNA, 25 bp, Mus musculus
gggtccagagaccaacacaactcta

SEQ ID NO: 394281 - DNA, 25 bp, Mus musculus
aactctactttgtgggatgggcgga

SEQ ID NO: 394282 - DNA, 25 bp, Mus musculus
tccctaggctgaggcctctgagctg

SEQ ID NO: 394283 - DNA, 25 bp, Mus musculus
gcgcattgatgcagtttccttagta

SEQ ID NO: 394284 - DNA, 25 bp, Mus musculus
tccttagtaaccatttggcgtcctc

SEQ ID NO: 394285 - DNA, 25 bp, Mus musculus
cgctcagccggaaccacctggtaaa

SEQ ID NO: 394286 - DNA, 25 bp, Mus musculus
tggaaccacacagtcaggaacctga

SEQ ID NO: 394287 - DNA, 25 bp, Mus musculus
aggaacctgacctcaagccgattta

SEQ ID NO: 394288 - DNA, 25 bp, Mus musculus
ttaccaccggttgctgagtccgctg

SEQ ID NO: 394289 - DNA, 25 bp, Mus musculus
caatccatcccgctggcgaagctga

SEQ ID NO: 394290 - DNA, 25 bp, Mus musculus
ccaagtgtccaagcggctagcaagc

SEQ ID NO: 394291 - DNA, 25 bp, Mus musculus
gacttcgaagccatcctagctgttg

SEQ ID NO: 394292 - DNA, 25 bp, Mus musculus
gactgcgcgataggccgcatcgctg

SEQ ID NO: 394293 - DNA, 25 bp, Mus musculus
gaggtgcccctgcatcttgcggtcg

SEQ ID NO: 394294 - DNA, 25 bp, Mus musculus
cagcgactgcgcgataggccgcatc

SEQ ID NO: 394295 - DNA, 25 bp, Mus musculus
aggccgcatcgctgccctaccgcag

SEQ ID NO: 394296 - DNA, 25 bp, Mus musculus
gcggtgctcacactcctaccctggc

SEQ ID NO: 394297 - DNA, 25 bp, Mus musculus
ggccctcagccagcccacacccagg

SEQ ID NO: 394298 - DNA, 25 bp, Mus musculus
gcccacacccaggtcaacactggga

SEQ ID NO: 394299 - DNA, 25 bp, Mus musculus
gagtcgcggcccatcactcagagcc

SEQ ID NO: 394300 - DNA, 25 bp, Mus musculus
cccagggtcacacccgtccactcgg

SEQ ID NO: 394301 - DNA, 25 bp, Mus musculus
cagccgcgctgcgactctgcccgag

SEQ ID NO: 394302 - DNA, 25 bp, Mus musculus
gcgactctgcccgagtccgcgccca

SEQ ID NO: 394303 - DNA, 25 bp, Mus musculus
agtccgcgcccatcaggaggcgccg

SEQ ID NO: 394304 - DNA, 25 bp, Mus musculus
tgccctaccgcaggcggtgctcaca

SEQ ID NO: 394305 - DNA, 25 bp, Mus musculus
gccgcctctggttcgggaggtgccc

SEQ ID NO: 394306 - DNA, 25 bp, Mus musculus
ttactcgcgttcactcggtccacag

SEQ ID NO: 394307 - DNA, 25 bp, Mus musculus
gggttactcgcgttcactcggtcca

SEQ ID NO: 394308 - DNA, 25 bp, Mus musculus
gtcagcacacactcccggggttact

SEQ ID NO: 394309 - DNA, 25 bp, Mus musculus
tcggtcagcacacactcccggggtt

SEQ ID NO: 394310 - DNA, 25 bp, Mus musculus
gggcccagacgcctagagagacctg

SEQ ID NO: 394311 - DNA, 25 bp, Mus musculus
cctgcagtctagctgcgggagacag

SEQ ID NO: 394312 - DNA, 25 bp, Mus musculus
ctgcctccctgcagtgggcgggcct

SEQ ID NO: 394313 - DNA, 25 bp, Mus musculus
ccctgcagtctagctgcgggagaca

SEQ ID NO: 394314 - DNA, 25 bp, Mus musculus
gccggcacccgctccaatcaggagg

SEQ ID NO: 394315 - DNA, 25 bp, Mus musculus
gtggtggtgcctcttctgtccccca

SEQ ID NO: 394316 - DNA, 25 bp, Mus musculus
ccctccgggctctactggagcgggg

SEQ ID NO: 394317 - DNA, 25 bp, Mus musculus
gcacgtccctaacgtccgcctcctc

SEQ ID NO: 394318 - DNA, 25 bp, Mus musculus
gaggagcgcacgtccctaacgtccg

SEQ ID NO: 394319 - DNA, 25 bp, Mus musculus
ctcccgctctgcctccctgcagtgg

SEQ ID NO: 394320 - DNA, 25 bp, Mus musculus
ggagaagtatcatgcggcgctcaag

SEQ ID NO: 394321 - DNA, 25 bp, Mus musculus
ccgagacagtgtccagctgcaactg

SEQ ID NO: 394322 - DNA, 25 bp, Mus musculus
gcacgtgtaagtgccacggtgtgtc

SEQ ID NO: 394323 - DNA, 25 bp, Mus musculus
cccaggcggtcaagggcaccatgaa

SEQ ID NO: 394324 - DNA, 25 bp, Mus musculus
ccacccgcgagctggtgcatctgga

SEQ ID NO: 394325 - DNA, 25 bp, Mus musculus
tactgcctggagaacaagaccctgg

SEQ ID NO: 394326 - DNA, 25 bp, Mus musculus
caagtttcactggtgctgcgcggtc

SEQ ID NO: 394327 - DNA, 25 bp, Mus musculus
cggcgggtcaccaagtacttctgca

SEQ ID NO: 394328 - DNA, 25 bp, Mus musculus
ggtggcttacgtgctgctctctccc

SEQ ID NO: 394329 - DNA, 25 bp, Mus musculus
agggcaccatgaaacgcacgtgtaa

SEQ ID NO: 394330 - DNA, 25 bp, Mus musculus
gctgcaccacgcagacctgctggtt

SEQ ID NO: 394331 - DNA, 25 bp, Mus musculus
tgctggttgcaactgccagagttcc

SEQ ID NO: 394332 - DNA, 25 bp, Mus musculus
ggcgcgcacttgaaggagaagtatc

SEQ ID NO: 394333 - DNA, 25 bp, Mus musculus
ggcgctcaaggtggacctgctgcaa

SEQ ID NO: 394334 - DNA, 25 bp, Mus musculus
gctgactgccatacaaggcgcttga

SEQ ID NO: 394335 - DNA, 25 bp, Mus musculus
acaaggcgcttgacggtcagttacc

SEQ ID NO: 394336 - DNA, 25 bp, Mus musculus
gaaacccacctgttccgagcgccca

SEQ ID NO: 394337 - DNA, 25 bp, Mus musculus
aaccaagggcgcaccgcgctgcgga

SEQ ID NO: 394338 - DNA, 25 bp, Mus musculus
gcgcttgacggtcagttaccactgg

SEQ ID NO: 394339 - DNA, 25 bp, Mus musculus
ccgagcgcccaggtcaggggtcaca

SEQ ID NO: 394340 - DNA, 25 bp, Mus musculus
tctcgcctgctgactgccatacaag

SEQ ID NO: 394341 - DNA, 25 bp, Mus musculus
ttcgtactggtgctccagaggcgtg

SEQ ID NO: 394342 - DNA, 25 bp, Mus musculus
cactggccagggcaccgcgacagtg

SEQ ID NO: 394343 - DNA, 25 bp, Mus musculus
ggattcgtactggtgctccagaggc

SEQ ID NO: 394344 - DNA, 25 bp, Mus musculus
tgagggcccggtcaagtcaaggctt

SEQ ID NO: 394345 - DNA, 25 bp, Mus musculus
caccgcgacagtgtgcaggctgagg

SEQ ID NO: 394346 - DNA, 25 bp, Mus musculus
ggcttctcgcctgctgactgccata

SEQ ID NO: 394347 - DNA, 25 bp, Mus musculus
ctgggccggtcctgtcccaaccaag

SEQ ID NO: 394348 - DNA, 25 bp, Mus musculus
tgtcgtttcgcaccttgccggacta

SEQ ID NO: 394349 - DNA, 25 bp, Mus musculus
gagaaaacgcctgggtcgcaccacc

SEQ ID NO: 394350 - DNA, 25 bp, Mus musculus
tggctcgtagtcttccactcgcatg

SEQ ID NO: 394351 - DNA, 25 bp, Mus musculus
cagcgcagaagtcccggcatcaagc

SEQ ID NO: 394352 - DNA, 25 bp, Mus musculus
tcctctggggtcctaggatatgacc

SEQ ID NO: 394353 - DNA, 25 bp, Mus musculus
ccggcaacatgtccttggtcatatg

SEQ ID NO: 394354 - DNA, 25 bp, Mus musculus
caggtcagatggacacggtgcttta

SEQ ID NO: 394355 - DNA, 25 bp, Mus musculus
ggcgcccacccagaaaggactaagc

SEQ ID NO: 394356 - DNA, 25 bp, Mus musculus
ctttgggcacacgaatccaccgcga

SEQ ID NO: 394357 - DNA, 25 bp, Mus musculus
ggatgcctccatcccgaagcagtaa

SEQ ID NO: 394358 - DNA, 25 bp, Mus musculus
gcagtaaacttcaggcacccgcttc

SEQ ID NO: 394359 - DNA, 25 bp, Mus musculus
ttctccgcggttcactctgcacatg

SEQ ID NO: 394360 - DNA, 25 bp, Mus musculus
ggcgatctccgaagccagcgcagaa

SEQ ID NO: 394361 - DNA, 25 bp, Mus musculus
agcaaccctgtatcccttctttggg

SEQ ID NO: 394362 - DNA, 25 bp, Mus musculus
tgtacgacgcggtccgcgcctacga

SEQ ID NO: 394363 - DNA, 25 bp, Mus musculus
gaccggctcatctacctgaccgaga

SEQ ID NO: 394364 - DNA, 25 bp, Mus musculus
aacagccgtctggacgcgttcttgc

SEQ ID NO: 394365 - DNA, 25 bp, Mus musculus
cccatcgctgtgtaggtgaggacga

SEQ ID NO: 394366 - DNA, 25 bp, Mus musculus
cgcccaagtccatccggcgggtagt

SEQ ID NO: 394367 - DNA, 25 bp, Mus musculus
acgtggtgctcagcgaccggctcat

SEQ ID NO: 394368 - DNA, 25 bp, Mus musculus
tcggacgccgagaagcacacgttca

SEQ ID NO: 394369 - DNA, 25 bp, Mus musculus
gcctacgagccgtgcatcgtggtgt

SEQ ID NO: 394370 - DNA, 25 bp, Mus musculus
acctgcctccggaggtgtacgacgc

SEQ ID NO: 394371 - DNA, 25 bp, Mus musculus
ggagtcgcagccacccaggatactc

SEQ ID NO: 394372 - DNA, 25 bp, Mus musculus
ttccactgggtgtcgtggagtcgca

SEQ ID NO: 394373 - DNA, 25 bp, Mus musculus
tggttcctgaagcaaggtccggctc

SEQ ID NO: 394374 - DNA, 25 bp, Mus musculus
gggaacacgactccggagctggttc

SEQ ID NO: 394375 - DNA, 25 bp, Mus musculus
cgtggccattgacctggtgaggatt

SEQ ID NO: 394376 - DNA, 25 bp, Mus musculus
ttgcagtccatctctatggtgttcg

SEQ ID NO: 394377 - DNA, 25 bp, Mus musculus
gggagcgctccttcaacctaggcgc

SEQ ID NO: 394378 - DNA, 25 bp, Mus musculus
cacctacttaaaaggtctcgatcgg

SEQ ID NO: 394379 - DNA, 25 bp, Mus musculus
cggtttctcttgcagtccatctcta

SEQ ID NO: 394380 - DNA, 25 bp, Mus musculus
ctatggtgttcgttgttgttgcttc

SEQ ID NO: 394381 - DNA, 25 bp, Mus musculus
aagggcggagctttcacttccggcg

SEQ ID NO: 394382 - DNA, 25 bp, Mus musculus
tccctagagtagagatggcggcgac

SEQ ID NO: 394383 - DNA, 25 bp, Mus musculus
tcccgcctgggatgagtcccagcta

SEQ ID NO: 394384 - DNA, 25 bp, Mus musculus
tgagtcccagctacgaagttacagc

SEQ ID NO: 394385 - DNA, 25 bp, Mus musculus
agttacagctttccgaccaggccca

SEQ ID NO: 394386 - DNA, 25 bp, Mus musculus
ccatcccacgtctgagccagagtga

SEQ ID NO: 394387 - DNA, 25 bp, Mus musculus
acgtctgagccagagtgaccctcgg

SEQ ID NO: 394388 - DNA, 25 bp, Mus musculus
gaccctcgggcggaagagctcatcg

SEQ ID NO: 394389 - DNA, 25 bp, Mus musculus
aggtctcgatcggtttctcttgcag

SEQ ID NO: 394390 - DNA, 25 bp, Mus musculus
gcatggtggggacgtagcgcgaccc

SEQ ID NO: 394391 - DNA, 25 bp, Mus musculus
ataaatgccggcgacgcggggaagg

SEQ ID NO: 394392 - DNA, 25 bp, Mus musculus
ccgagtgggtgataaatgccggcga

SEQ ID NO: 394393 - DNA, 25 bp, Mus musculus
acagccgagtgggtgataaatgccg

SEQ ID NO: 394394 - DNA, 25 bp, Mus musculus
tgacagccgagtgggtgataaatgc

SEQ ID NO: 394395 - DNA, 25 bp, Mus musculus
ctgacagccgagtgggtgataaatg

SEQ ID NO: 394396 - DNA, 25 bp, Mus musculus
cgctgacagccgagtgggtgataaa

SEQ ID NO: 394397 - DNA, 25 bp, Mus musculus
aatctcggcgctgacagccgagtgg

SEQ ID NO: 394398 - DNA, 25 bp, Mus musculus
acaatctcggcgctgacagccgagt

SEQ ID NO: 394399 - DNA, 25 bp, Mus musculus
cccgcacaatctcggcgctgacagc

SEQ ID NO: 394400 - DNA, 25 bp, Mus musculus
gtggcggcccgtaggctgcgcctgc

SEQ ID NO: 394401 - DNA, 25 bp, Mus musculus
tatttgtctgtgttagtgtagggtg

SEQ ID NO: 394402 - DNA, 25 bp, Mus musculus
aagtttatttgtctgtgttagtgta

SEQ ID NO: 394403 - DNA, 25 bp, Mus musculus
cgcgacccctaagtttatttgtctg

SEQ ID NO: 394404 - DNA, 25 bp, Mus musculus
aaattctgtgccgagcctgatgcgc

SEQ ID NO: 394405 - DNA, 25 bp, Mus musculus
ggaaggtcacctccttcatcacgga

SEQ ID NO: 394406 - DNA, 25 bp, Mus musculus
cctccttcatcacggattctatttg

SEQ ID NO: 394407 - DNA, 25 bp, Mus musculus
acggattctatttgcatccggaatc

SEQ ID NO: 394408 - DNA, 25 bp, Mus musculus
tgcatccggaatcgcatgtacatga

SEQ ID NO: 394409 - DNA, 25 bp, Mus musculus
cggaatcgcatgtacatgaaaaatg

SEQ ID NO: 394410 - DNA, 25 bp, Mus musculus
catgaaaaatgtgtccgcgtgcggc

SEQ ID NO: 394411 - DNA, 25 bp, Mus musculus
tgaaaaatgtgtccgcgtgcggccc

SEQ ID NO: 394412 - DNA, 25 bp, Mus musculus
cgagcccgcgcgtgactttagcgcg

SEQ ID NO: 394413 - DNA, 25 bp, Mus musculus
agatgaaattctgtgccgagcctga

SEQ ID NO: 394414 - DNA, 25 bp, Mus musculus
cctgatgcgcggtaacctttgcaga

SEQ ID NO: 394415 - DNA, 25 bp, Mus musculus
cgcggtaacctttgcagatggcgcc

SEQ ID NO: 394416 - DNA, 25 bp, Mus musculus
cgcgtgactttagcgcgcgcgcgca

SEQ ID NO: 394417 - DNA, 25 bp, Mus musculus
cccgactgcagacgcagatgaaatt

SEQ ID NO: 394418 - DNA, 25 bp, Mus musculus
cgccctgcggtaagggcagtccctg

SEQ ID NO: 394419 - DNA, 25 bp, Mus musculus
atttctaaaggctccgcggccatta

SEQ ID NO: 394420 - DNA, 25 bp, Mus musculus
ggcacggctgcgagataaccattag

SEQ ID NO: 394421 - DNA, 25 bp, Mus musculus
cgagataaccattagcgcggccgcc

SEQ ID NO: 394422 - DNA, 25 bp, Mus musculus
ccgataaagcgggaggctgcatttc

SEQ ID NO: 394423 - DNA, 25 bp, Mus musculus
agcgggaggctgcatttctaaaggc

SEQ ID NO: 394424 - DNA, 25 bp, Mus musculus
tgcatttctaaaggctccgcggcca

SEQ ID NO: 394425 - DNA, 25 bp, Mus musculus
aggctccgcggccattacgggaaag

SEQ ID NO: 394426 - DNA, 25 bp, Mus musculus
cggccattacgggaaagttagtgtg

SEQ ID NO: 394427 - DNA, 25 bp, Mus musculus
tacgggaaagttagtgtgaaacatg

SEQ ID NO: 394428 - DNA, 25 bp, Mus musculus
agttagtgtgaaacatgttaaatta

SEQ ID NO: 394429 - DNA, 25 bp, Mus musculus
gcgagcctcagtctgccggctcgga

SEQ ID NO: 394430 - DNA, 25 bp, Mus musculus
taagggcagtccctgcgtcttcccg

SEQ ID NO: 394431 - DNA, 25 bp, Mus musculus
aggctgcatttctaaaggctccgcg

SEQ ID NO: 394432 - DNA, 25 bp, Mus musculus
cgaagacggatttctccaccaaacg

SEQ ID NO: 394433 - DNA, 25 bp, Mus musculus
ctggaggggccttcaatcgcattaa

SEQ ID NO: 394434 - DNA, 25 bp, Mus musculus
gaggggccttcaatcgcattaatcc

SEQ ID NO: 394435 - DNA, 25 bp, Mus musculus
atatcatgaaaaaggcgttagccgg

SEQ ID NO: 394436 - DNA, 25 bp, Mus musculus
gtagccgtggcgcagcaaaataata

SEQ ID NO: 394437 - DNA, 25 bp, Mus musculus
ggcggtgacgaagacggatttctcc

SEQ ID NO: 394438 - DNA, 25 bp, Mus musculus
atttctccaccaaacgatccatttg

SEQ ID NO: 394439 - DNA, 25 bp, Mus musculus
ccacttggttttttctgtgtggatg

SEQ ID NO: 394440 - DNA, 25 bp, Mus musculus
aataatagagtgatccggcaatgcg

SEQ ID NO: 394441 - DNA, 25 bp, Mus musculus
tcaatcgcattaatcccagcctggc

SEQ ID NO: 394442 - DNA, 25 bp, Mus musculus
acgatccatttgtatctctcgagca

SEQ ID NO: 394443 - DNA, 25 bp, Mus musculus
ctgtgtggatgttcaaaatatcatg

SEQ ID NO: 394444 - DNA, 25 bp, Mus musculus
gccgtggcgcagcaaaataatagag

SEQ ID NO: 394445 - DNA, 25 bp, Mus musculus
atctctcgagcactccacttggttt

SEQ ID NO: 394446 - DNA, 25 bp, Mus musculus
cttctgtggctgctgacactgctct

SEQ ID NO: 394447 - DNA, 25 bp, Mus musculus
gggaaactctctgtggcctctgaca

SEQ ID NO: 394448 - DNA, 25 bp, Mus musculus
gcctcgggtctcttgatccgtgtgt

SEQ ID NO: 394449 - DNA, 25 bp, Mus musculus
gagcagcttcgacctcgctatggcg

SEQ ID NO: 394450 - DNA, 25 bp, Mus musculus
tctccaacgttgtagggaaactctc

SEQ ID NO: 394451 - DNA, 25 bp, Mus musculus
cagatgacgagcaggcctggaactt

SEQ ID NO: 394452 - DNA, 25 bp, Mus musculus
atccgtgtgtttgtgggtcagtgaa

SEQ ID NO: 394453 - DNA, 25 bp, Mus musculus
cgcgcaagcgccaggaatcggtgcc

SEQ ID NO: 394454 - DNA, 25 bp, Mus musculus
cctcgcgtaaataagcgagcgcgca

SEQ ID NO: 394455 - DNA, 25 bp, Mus musculus
tggaacttgtcgtcccaggagctgc

SEQ ID NO: 394456 - DNA, 25 bp, Mus musculus
catgtacaattacggccgtgctgcg

SEQ ID NO: 394457 - DNA, 25 bp, Mus musculus
ccaagccctgggcagatgacgagca

SEQ ID NO: 394458 - DNA, 25 bp, Mus musculus
acactgctctcgactgtggccctga

SEQ ID NO: 394459 - DNA, 25 bp, Mus musculus
cttcgcgctggacatgtacaattac

SEQ ID NO: 394460 - DNA, 25 bp, Mus musculus
gcgctggtcactcttggccgctccc

SEQ ID NO: 394461 - DNA, 25 bp, Mus musculus
cgctcctcgaggctccgggcaagag

SEQ ID NO: 394462 - DNA, 25 bp, Mus musculus
ctgacacagaaacgccgcagggcct

SEQ ID NO: 394463 - DNA, 25 bp, Mus musculus
agccggcaaaactccctgacacaga

SEQ ID NO: 394464 - DNA, 25 bp, Mus musculus
catgggtcacggagccggcaaaact

SEQ ID NO: 394465 - DNA, 25 bp, Mus musculus
tgccgtgggatttgtacagaagagc

SEQ ID NO: 394466 - DNA, 25 bp, Mus musculus
gcctgcgcgtgtcgggaacaatcct

SEQ ID NO: 394467 - DNA, 25 bp, Mus musculus
gtcgggaacaatcctccagctgatg

SEQ ID NO: 394468 - DNA, 25 bp, Mus musculus
atcctccagctgatgggaaaagaca

SEQ ID NO: 394469 - DNA, 25 bp, Mus musculus
ctgatgggaaaagacagctccgccc

SEQ ID NO: 394470 - DNA, 25 bp, Mus musculus
ccaaattcctctgcgtgccgtggga

SEQ ID NO: 394471 - DNA, 25 bp, Mus musculus
gagcaaagcagtgacccggccaggt

SEQ ID NO: 394472 - DNA, 25 bp, Mus musculus
acagaaacgccgcagggcctgcgcg

SEQ ID NO: 394473 - DNA, 25 bp, Mus musculus
ctccgggcaagagagcaaagcagtg

SEQ ID NO: 394474 - DNA, 25 bp, Mus musculus
cgcagggaacagagcagaatgaaat

SEQ ID NO: 394475 - DNA, 25 bp, Mus musculus
cttccgtgctctgcacaggcgcgga

SEQ ID NO: 394476 - DNA, 25 bp, Mus musculus
tgaaatgcagatgcaaaacgtgctc

SEQ ID NO: 394477 - DNA, 25 bp, Mus musculus
tgcaaaacgtgctcgtaagagtttc

SEQ ID NO: 394478 - DNA, 25 bp, Mus musculus
cgtgctcgtaagagtttcctctctc

SEQ ID NO: 394479 - DNA, 25 bp, Mus musculus
gcgggcgttcgcagcttccgtgctc

SEQ ID NO: 394480 - DNA, 25 bp, Mus musculus
aatcagcgagcagcggcgaatggca

SEQ ID NO: 394481 - DNA, 25 bp, Mus musculus
agatgttttactgtcgcgggcgttc

SEQ ID NO: 394482 - DNA, 25 bp, Mus musculus
tttaatccatgagcaatcagcgagc

SEQ ID NO: 394483 - DNA, 25 bp, Mus musculus
ggcgaatggcacattacagatgttt

SEQ ID NO: 394484 - DNA, 25 bp, Mus musculus
tctccatctgccaaagccgagattt

SEQ ID NO: 394485 - DNA, 25 bp, Mus musculus
ctgccaaagccgagattttaatctt

SEQ ID NO: 394486 - DNA, 25 bp, Mus musculus
agccgagattttaatctttaatcca

SEQ ID NO: 394487 - DNA, 25 bp, Mus musculus
gcagcggcgaatggcacattacaga

SEQ ID NO: 394488 - DNA, 25 bp, Mus musculus
tctcgtatctgcctcctgccagggg

SEQ ID NO: 394489 - DNA, 25 bp, Mus musculus
gctgccgcagagaggcccacgcaga

SEQ ID NO: 394490 - DNA, 25 bp, Mus musculus
cccacgcagaggggcatcggcagat

SEQ ID NO: 394491 - DNA, 25 bp, Mus musculus
catcggcagatagaggatgccggga

SEQ ID NO: 394492 - DNA, 25 bp, Mus musculus
gcggggtccacaggcggccctgaga

SEQ ID NO: 394493 - DNA, 25 bp, Mus musculus
gcagcgtagccgcgtgtgtgttttt

SEQ ID NO: 394494 - DNA, 25 bp, Mus musculus
aagaggaattcatctcgtatctgcc

SEQ ID NO: 394495 - DNA, 25 bp, Mus musculus
agaggaattcatctcgtatctgcct

SEQ ID NO: 394496 - DNA, 25 bp, Mus musculus
aggaattcatctcgtatctgcctcc

SEQ ID NO: 394497 - DNA, 25 bp, Mus musculus
aattcatctcgtatctgcctcctgc

SEQ ID NO: 394498 - DNA, 25 bp, Mus musculus
gtatctgcctcctgccaggggccga

SEQ ID NO: 394499 - DNA, 25 bp, Mus musculus
cgaggcgccgccattggggttaacg

SEQ ID NO: 394500 - DNA, 25 bp, Mus musculus
tattatttctgattaaagaggaatt

SEQ ID NO: 394501 - DNA, 25 bp, Mus musculus
gaattcatctcgtatctgcctcctg

SEQ ID NO: 394502 - DNA, 25 bp, Mus musculus
ccgcagacactttgcggagatgtta

SEQ ID NO: 394503 - DNA, 25 bp, Mus musculus
ccggagttggagacgatgataaata

SEQ ID NO: 394504 - DNA, 25 bp, Mus musculus
gtcttgttttcagggagaatgcctc

SEQ ID NO: 394505 - DNA, 25 bp, Mus musculus
ccggctcccagatagatggctgata

SEQ ID NO: 394506 - DNA, 25 bp, Mus musculus
cattcggtacctgcagatgctgcgc

SEQ ID NO: 394507 - DNA, 25 bp, Mus musculus
ccggaggctcccgaaatgactctaa

SEQ ID NO: 394508 - DNA, 25 bp, Mus musculus
cgactcagagcagcaggttccaggt

SEQ ID NO: 394509 - DNA, 25 bp, Mus musculus
tgattattaatcgagcaccggcgct

SEQ ID NO: 394510 - DNA, 25 bp, Mus musculus
ggcttcaagtgctcagtccgctcga

SEQ ID NO: 394511 - DNA, 25 bp, Mus musculus
gcggccaggcctcctgctaatacgg

SEQ ID NO: 394512 - DNA, 25 bp, Mus musculus
gctaatacgggctgcagctctcaga

SEQ ID NO: 394513 - DNA, 25 bp, Mus musculus
agctctcagagtcctccagtgatca

SEQ ID NO: 394514 - DNA, 25 bp, Mus musculus
ctccagtgatcacgtgcacctgtca

SEQ ID NO: 394515 - DNA, 25 bp, Mus musculus
cccgtgcctgtagagacgactcaga

SEQ ID NO: 394516 - DNA, 25 bp, Mus musculus
ttctcttacgacaaggccaaggaca

SEQ ID NO: 394517 - DNA, 25 bp, Mus musculus
ctcaggttcctaggcttggtagcca

SEQ ID NO: 394518 - DNA, 25 bp, Mus musculus
ttggtagccacctccacctttcacc

SEQ ID NO: 394519 - DNA, 25 bp, Mus musculus
catgggggagtctatcccgctagcc

SEQ ID NO: 394520 - DNA, 25 bp, Mus musculus
ctggctctggaagctcaggttccta

SEQ ID NO: 394521 - DNA, 25 bp, Mus musculus
gagaaggaacgagaggccaacaaga

SEQ ID NO: 394522 - DNA, 25 bp, Mus musculus
caaggccaaggacaatgtggagaag

SEQ ID NO: 394523 - DNA, 25 bp, Mus musculus
cacctgggtatcttctcttacgaca

SEQ ID NO: 394524 - DNA, 25 bp, Mus musculus
aggtctctggctctggaagctcagg

SEQ ID NO: 394525 - DNA, 25 bp, Mus musculus
gagacgttcttctctcacctgggta

SEQ ID NO: 394526 - DNA, 25 bp, Mus musculus
acgtcatccgcgctaaggcgctggc

SEQ ID NO: 394527 - DNA, 25 bp, Mus musculus
gtcaagcccgtgtgacgtcatccgc

SEQ ID NO: 394528 - DNA, 25 bp, Mus musculus
cgcaagagctgacgtcaagcccgtg

SEQ ID NO: 394529 - DNA, 25 bp, Mus musculus
aacaggcggtgctggagacgttctt

SEQ ID NO: 394530 - DNA, 25 bp, Mus musculus
cctgggaactttcctgtctgagtta

SEQ ID NO: 394531 - DNA, 25 bp, Mus musculus
cgccggacagcggaaaactacagcc

SEQ ID NO: 394532 - DNA, 25 bp, Mus musculus
tcgctgtccctggacgaagctcgca

SEQ ID NO: 394533 - DNA, 25 bp, Mus musculus
aagctcgcacggtttcctgacagtc

SEQ ID NO: 394534 - DNA, 25 bp, Mus musculus
gccgccacggtgatttattcgcctc

SEQ ID NO: 394535 - DNA, 25 bp, Mus musculus
tcgcctcactcgacggaatcaggtg

SEQ ID NO: 394536 - DNA, 25 bp, Mus musculus
ggaacgagggaacagatttctccca

SEQ ID NO: 394537 - DNA, 25 bp, Mus musculus
cttaacgatgctaattacggggtgc

SEQ ID NO: 394538 - DNA, 25 bp, Mus musculus
ccgttggcgagaggcaattttcttc

SEQ ID NO: 394539 - DNA, 25 bp, Mus musculus
cttcggaatttcagcgatttccttt

SEQ ID NO: 394540 - DNA, 25 bp, Mus musculus
ttcgccgcggaagcagattaacatg

SEQ ID NO: 394541 - DNA, 25 bp, Mus musculus
ttaacatgcaaacggggaggcgatc

SEQ ID NO: 394542 - DNA, 25 bp, Mus musculus
ggctcgagtctgtctctccaaactg

SEQ ID NO: 394543 - DNA, 25 bp, Mus musculus
gggttttgtgaacttaacgatgcta

SEQ ID NO: 394544 - DNA, 25 bp, Mus musculus
cggccaaggcgagactgactgtggg

SEQ ID NO: 394545 - DNA, 25 bp, Mus musculus
cgcgaatagagcgaagcgcacagcc

SEQ ID NO: 394546 - DNA, 25 bp, Mus musculus
gaatagagcgaagcgcacagcccgc

SEQ ID NO: 394547 - DNA, 25 bp, Mus musculus
tggcggcccgcagccgcgattatct

SEQ ID NO: 394548 - DNA, 25 bp, Mus musculus
cgcagccgcgattatctgagccgct

SEQ ID NO: 394549 - DNA, 25 bp, Mus musculus
cgcgattatctgagccgctctgttg

SEQ ID NO: 394550 - DNA, 25 bp, Mus musculus
tatctgagccgctctgttgcgggtg

SEQ ID NO: 394551 - DNA, 25 bp, Mus musculus
ctgtgcgagcgagtgcgcgaataga

SEQ ID NO: 394552 - DNA, 25 bp, Mus musculus
ggcagcatggaacagcgtgcaagtc

SEQ ID NO: 394553 - DNA, 25 bp, Mus musculus
agccaagactcaggctcgggcagca

SEQ ID NO: 394554 - DNA, 25 bp, Mus musculus
aagactcaggctcgggcagcatgga

SEQ ID NO: 394555 - DNA, 25 bp, Mus musculus
tcaggctcgggcagcatggaacagc

SEQ ID NO: 394556 - DNA, 25 bp, Mus musculus
tcgggcagcatggaacagcgtgcaa

SEQ ID NO: 394557 - DNA, 25 bp, Mus musculus
ttgcgggtggctgctcctggatctc

SEQ ID NO: 394558 - DNA, 25 bp, Mus musculus
tccggggaaactctgccctggtgct

SEQ ID NO: 394559 - DNA, 25 bp, Mus musculus
caaggcctcccttgcctcgctggcg

SEQ ID NO: 394560 - DNA, 25 bp, Mus musculus
ctcgctggcgggtttcgctctgcct

SEQ ID NO: 394561 - DNA, 25 bp, Mus musculus
tggccgtgcccacaaggcctccctt

SEQ ID NO: 394562 - DNA, 25 bp, Mus musculus
gggtttcgctctgccttaccggctc

SEQ ID NO: 394563 - DNA, 25 bp, Mus musculus
ctccgcctgctcctcacatccacac

SEQ ID NO: 394564 - DNA, 25 bp, Mus musculus
tcacatccacacagctgcggcgaga

SEQ ID NO: 394565 - DNA, 25 bp, Mus musculus
cggttggatccgagacagtagattt

SEQ ID NO: 394566 - DNA, 25 bp, Mus musculus
tggatccgagacagtagatttggtg

SEQ ID NO: 394567 - DNA, 25 bp, Mus musculus
cagtagatttggtgtctgttcgcaa

SEQ ID NO: 394568 - DNA, 25 bp, Mus musculus
atttggtgtctgttcgcaactccgg

SEQ ID NO: 394569 - DNA, 25 bp, Mus musculus
gtgtctgttcgcaactccggggaaa

SEQ ID NO: 394570 - DNA, 25 bp, Mus musculus
tctgttcgcaactccggggaaactc

SEQ ID NO: 394571 - DNA, 25 bp, Mus musculus
gcaactccggggaaactctgccctg

SEQ ID NO: 394572 - DNA, 25 bp, Mus musculus
tgaatattcattaggctggccgctc

SEQ ID NO: 394573 - DNA, 25 bp, Mus musculus
cagagcctctcggacaaccgggttc

SEQ ID NO: 394574 - DNA, 25 bp, Mus musculus
ccgccctgagctctcttggttcaga

SEQ ID NO: 394575 - DNA, 25 bp, Mus musculus
atcccggggattgctacttctctgc

SEQ ID NO: 394576 - DNA, 25 bp, Mus musculus
agtctccggccgagtcttcttgcag

SEQ ID NO: 394577 - DNA, 25 bp, Mus musculus
tttagagagacacacaccgggagcc

SEQ ID NO: 394578 - DNA, 25 bp, Mus musculus
gggctttgcagcttttagagagaca

SEQ ID NO: 394579 - DNA, 25 bp, Mus musculus
ctcagcgcaagggtagccgagttag

SEQ ID NO: 394580 - DNA, 25 bp, Mus musculus
gctggccgctctttatccttatcta

SEQ ID NO: 394581 - DNA, 25 bp, Mus musculus
tcggcgagtttcgtttctcagtgta

SEQ ID NO: 394582 - DNA, 25 bp, Mus musculus
tcagtgtagttttaatccggggctc
